United States Patent 10,706,955 (BIOINFORMATIC PROCESSES FOR DETERMINATION OF PEPTIDE BINDING) - sequence listing, part 47

SEQ ID NO: 1793485 - protein, 17 aa, Staphylococcus epidermidis
DTIRLSIIGRPNVGKSS

SEQ ID NO: 1793486 - protein, 22 aa, Staphylococcus epidermidis
DTMSQIRWLSVLNLKDKSEDQL

SEQ ID NO: 1793487 - protein, 28 aa, Staphylococcus epidermidis
DTTYGKLGVKVWIYRGEVLPTKNTSEGG

SEQ ID NO: 1793488 - protein, 17 aa, Staphylococcus epidermidis
DVDVFVMGHDWEGEFDF

SEQ ID NO: 1793489 - protein, 26 aa, Staphylococcus epidermidis
DVEFYPVLCGTAFKNKGVQLMLNAVI

SEQ ID NO: 1793490 - protein, 25 aa, Staphylococcus epidermidis
DVKRMPFIGLQWIFARKGAAASNHF

SEQ ID NO: 1793491 - protein, 18 aa, Staphylococcus epidermidis
DVQTICIGMAASMGSFLL

SEQ ID NO: 1793492 - protein, 24 aa, Staphylococcus epidermidis
DWGKRRLAYEINDFKEGFYNIVRI

SEQ ID NO: 1793493 - protein, 24 aa, Staphylococcus epidermidis
DYIGMPAVCFTEPELAQVGYTEAQ

SEQ ID NO: 1793494 - protein, 24 aa, Staphylococcus epidermidis
DYSEYGGSVLLGLDGTVVKAHGSS

SEQ ID NO: 1793495 - protein, 24 aa, Staphylococcus epidermidis
DYVSCSPFRVPGAILATAQSQAEE

SEQ ID NO: 1793496 - protein, 18 aa, Staphylococcus epidermidis
DYVSYAIKGNLMYENAYP

SEQ ID NO: 1793497 - protein, 24 aa, Staphylococcus epidermidis
EAIREAGAIPFEFNTIGVDDGIAM

SEQ ID NO: 1793498 - protein, 18 aa, Staphylococcus epidermidis
EAKTIFLEQNYRSTKNIL

SEQ ID NO: 1793499 - protein, 20 aa, Staphylococcus epidermidis
EAPLKALIFDSEYDPYRGVI

SEQ ID NO: 1793500 - protein, 22 aa, Staphylococcus epidermidis
ECMACGYQSPKWMGKCPNCGAW

SEQ ID NO: 1793501 - protein, 20 aa, Staphylococcus epidermidis
EDARQAMLRGVDKLANAVKV

SEQ ID NO: 1793502 - protein, 17 aa, Staphylococcus epidermidis
EDMKLPKSYIFEIASNW

SEQ ID NO: 1793503 - protein, 21 aa, Staphylococcus epidermidis
EEAKCPNIHECWGARRTATFM

SEQ ID NO: 1793504 - protein, 21 aa, Staphylococcus epidermidis
EEFKVAIEGVIFDINLKELKS

SEQ ID NO: 1793505 - protein, 19 aa, Staphylococcus epidermidis
EERVMRPLHFAIIDEVDSI

SEQ ID NO: 1793506 - protein, 25 aa, Staphylococcus epidermidis
EEVENFPGFEMITGPDLSTKMFEHA

SEQ ID NO: 1793507 - protein, 24 aa, Staphylococcus epidermidis
EEVLYPAMEDFFLDIIIGKGDEAR

SEQ ID NO: 1793508 - protein, 26 aa, Staphylococcus epidermidis
EFACGIPGSIGGAVFMNAGAYGGEVK

SEQ ID NO: 1793509 - protein, 18 aa, Staphylococcus epidermidis
EFMFNGKHVLIVYDDLTK

SEQ ID NO: 1793510 - protein, 20 aa, Staphylococcus epidermidis
EFRPRVKAQIGGRRNGALIS

SEQ ID NO: 1793511 - protein, 23 aa, Staphylococcus epidermidis
EGHISTSLIQRHFQIGYNRAARI

SEQ ID NO: 1793512 - protein, 21 aa, Staphylococcus epidermidis
EGKDFKGIYPSSANYTTDLHS

SEQ ID NO: 1793513 - protein, 17 aa, Staphylococcus epidermidis
EGPKGGPGMPEMLAPTS

SEQ ID NO: 1793514 - protein, 25 aa, Staphylococcus epidermidis
EGTMPQTRFVLKKALEQNLKPVVVV

SEQ ID NO: 1793515 - protein, 21 aa, Staphylococcus epidermidis
EHDACGIGFYANMDNKRSHDI

SEQ ID NO: 1793516 - protein, 20 aa, Staphylococcus epidermidis
EHMLFIGAGAFHVSKPSDLI

SEQ ID NO: 1793517 - protein, 24 aa, Staphylococcus epidermidis
EINTIKGNVNWMRARQNKLVETLF

SEQ ID NO: 1793518 - protein, 21 aa, Staphylococcus epidermidis
EIYRIDHYLGKDMVQNIEVLR

SEQ ID NO: 1793519 - protein, 29 aa, Staphylococcus epidermidis
EKAGYKPGEDVFLGFDCASSEFYENGVYD

SEQ ID NO: 1793520 - protein, 22 aa, Staphylococcus epidermidis
EKAMKVLKARLYDMKLQEEQQK

SEQ ID NO: 1793521 - protein, 25 aa, Staphylococcus epidermidis
EKYLGKRYKVIASMGHVRDLPRSQM

SEQ ID NO: 1793522 - protein, 30 aa, Staphylococcus epidermidis; identical to SEQ ID NO: 1648232

SEQ ID NO: 1793523 - protein, 22 aa, Staphylococcus epidermidis
ELENHFFGRVGLFRNQVGDELL

SEQ ID NO: 1793524 - protein, 18 aa, Staphylococcus epidermidis
ELGLGCMSLGTDYKKAQP

SEQ ID NO: 1793525 - protein, 17 aa, Staphylococcus epidermidis
ELLRILYNYDRLSQYDL

SEQ ID NO: 1793526 - protein, 23 aa, Staphylococcus epidermidis
ELPYGAVPIDFAYAIHSEVGNKM

SEQ ID NO: 1793527 - protein, 26 aa, Staphylococcus epidermidis
ELTPELAFKLGRYGGYVLAHNKGEKH

SEQ ID NO: 1793528 - protein, 22 aa, Staphylococcus epidermidis
EMALGRNVVVGFMTWDGYNYED

SEQ ID NO: 1793529 - protein, 17 aa, Staphylococcus epidermidis
EMEEIGASTGLPLVLHG

SEQ ID NO: 1793530 - protein, 17 aa, Staphylococcus epidermidis
EMKCFKYTNDLGTEIDE

SEQ ID NO: 1793531 - protein, 17 aa, Staphylococcus epidermidis
EMKRNLKRFKEVRKEIE

SEQ ID NO: 1793532 - protein, 19 aa, Staphylococcus epidermidis
EMRELSYAGFGVFHDEALQ

SEQ ID NO: 1793533 - protein, 21 aa, Staphylococcus epidermidis
EMRLDGPTIVAGFLHDVIEDT

SEQ ID NO: 1793534 - protein, 17 aa, Staphylococcus epidermidis
ENAGAVIESLGARKGEM

SEQ ID NO: 1793535 - protein, 17 aa, Staphylococcus epidermidis
EPRGCPRGASFSWYEYS

SEQ ID NO: 1793536 - protein, 20 aa, Staphylococcus epidermidis
EPYIRRRAIRHLEKKRVVIF

SEQ ID NO: 1793537 - protein, 17 aa, Staphylococcus epidermidis
EREAVGIQDLPSTLYTA

SEQ ID NO: 1793538 - protein, 20 aa, Staphylococcus epidermidis
ERGLHHLVWEIVDNSIDEAL

SEQ ID NO: 1793539 - protein, 25 aa, Staphylococcus epidermidis
ESFLDYAMSVIVSRALPDVRDGLKP

SEQ ID NO: 1793540 - protein, 24 aa, Staphylococcus epidermidis
ESKRPSVQIGDPFVGKKLMEATLE

SEQ ID NO: 1793541 - protein, 26 aa, Staphylococcus epidermidis
ESLQFSVALSTVWKFISRTNKYIDET

SEQ ID NO: 1793542 - protein, 23 aa, Staphylococcus epidermidis
ESMEFPEPVIHLSVEPKSKADQD

SEQ ID NO: 1793543 - protein, 23 aa, Staphylococcus epidermidis
ETFLRGFLGRMLFSGEEVKKKAS

SEQ ID NO: 1793544 - protein, 19 aa, Staphylococcus epidermidis
ETKRIGITRLHMEEDAGKS

SEQ ID NO: 1793545 - protein, 17 aa, Staphylococcus epidermidis
ETTSEKNAMGWYLDGRV

SEQ ID NO: 1793546 - protein, 20 aa, Staphylococcus epidermidis
ETYESFKLFESTFFDHQLLR

SEQ ID NO: 1793547 - protein, 18 aa, Staphylococcus epidermidis
EVEKRFMHHYNFPNFSVG

SEQ ID NO: 1793548 - protein, 23 aa, Staphylococcus epidermidis
EVESMMFYTCILDMIKVEESSEL

SEQ ID NO: 1793549 - protein, 25 aa, Staphylococcus epidermidis
EVGKQTEMFARFSTVSGERGAADLE

SEQ ID NO: 1793550 - protein, 24 aa, Staphylococcus epidermidis
EVIERLRPFLLRDGGDCTLVDVED

SEQ ID NO: 1793551 - protein, 33 aa, Staphylococcus epidermidis; identical to SEQ ID NO: 1646178

SEQ ID NO: 1793552 - protein, 31 aa, Staphylococcus epidermidis; identical to SEQ ID NO: 1649699

SEQ ID NO: 1793553 - protein, 24 aa, Staphylococcus epidermidis
FFELACAMSGYQLGVNPFNQPGVE

SEQ ID NO: 1793554 - protein, 27 aa, Staphylococcus epidermidis
FFFEEGKRAVLLLHGFTGNSADVRQLG

SEQ ID NO: 1793555 - protein, 23 aa, Staphylococcus epidermidis
FGCGSSREHAAWALKDYGFNIII

SEQ ID NO: 1793556 - protein, 30 aa, Staphylococcus epidermidis
FGFATAPLVVLGCIMMRVCHNDTCPVGVAT

SEQ ID NO: 1793557 - protein, 19 aa, Staphylococcus epidermidis
FGHSAHSYFSRQNQPSNLS

SEQ ID NO: 1793558 - protein, 23 aa, Staphylococcus epidermidis
FGVINILLQFVMLKEDMKLPKSY

SEQ ID NO: 1793559 - protein, 21 aa, Staphylococcus epidermidis
FHPERMASRILGMGDVLSLIE

SEQ ID NO: 1793560 - protein, 25 aa, Staphylococcus epidermidis
FHSEYWFNVICMFREDGIYYYCNLS

SEQ ID NO: 1793561 - protein, 18 aa, Staphylococcus epidermidis
FIVHRDFAYERGKALVEK

SEQ ID NO: 1793562 - protein, 18 aa, Staphylococcus epidermidis
FKIYENDYVYAFLDISQV

SEQ ID NO: 1793563 - protein, 17 aa, Staphylococcus epidermidis
FLFYSGFYYPLYLAGQG

SEQ ID NO: 1793564 - protein, 20 aa, Staphylococcus epidermidis
FLSPETMWYYKSAFNTDQMK

SEQ ID NO: 1793565 - protein, 25 aa, Staphylococcus epidermidis
FNCPEFTSLCPITGQPDFATIYISY

SEQ ID NO: 1793566 - protein, 26 aa, Staphylococcus epidermidis
FNKYWPADIHLMAKEIVRFHSIIWPI

SEQ ID NO: 1793567 - protein, 29 aa, Staphylococcus epidermidis
FNLDRAAIEFGKMDFNTHLDLKAYSDNIK

SEQ ID NO: 1793568 - protein, 17 aa, Staphylococcus epidermidis
FNLMFKTFQGVTEDSTN

SEQ ID NO: 1793569 - protein, 18 aa, Staphylococcus epidermidis
FNTNYHYIVPEWDNVEPK

SEQ ID NO: 1793570 - protein, 20 aa, Staphylococcus epidermidis
FPGIGKKTARQIVLDLKGKV

SEQ ID NO: 1793571 - protein, 17 aa, Staphylococcus epidermidis
FPPGIKYDFEKVFQSHH

SEQ ID NO: 1793572 - protein, 17 aa, Staphylococcus epidermidis
FQAILPLRGKVINTEKA

SEQ ID NO: 1793573 - protein, 18 aa, Staphylococcus epidermidis
FQEHGHRPIVLIGGGTGM

SEQ ID NO: 1793574 - protein, 19 aa, Staphylococcus epidermidis
FQFDETFMMYLPRLCEHCL

SEQ ID NO: 1793575 - protein, 20 aa, Staphylococcus epidermidis
FRATLFRQTMFAEFEHKIHQ

SEQ ID NO: 1793576 - protein, 22 aa, Staphylococcus epidermidis
FRLENELKVFPSHFSKGMKQKV

SEQ ID NO: 1793577 - protein, 17 aa, Staphylococcus epidermidis
FSALDPISREKLQDDLI

SEQ ID NO: 1793578 - protein, 23 aa, Staphylococcus epidermidis
FSLEAFNLYGALSMANAGPNTNG

SEQ ID NO: 1793579 - protein, 17 aa, Staphylococcus epidermidis
FTARHHTFFEMLGNFSI

SEQ ID NO: 1793580 - protein, 17 aa, Staphylococcus epidermidis
FTPIPAMSMISYASGAR

SEQ ID NO: 1793581 - protein, 20 aa, Staphylococcus epidermidis
FVGEHSRYDLMLVQTDRHYG

SEQ ID NO: 1793582 - protein, 27 aa, Staphylococcus epidermidis
GAESFKESLRWGAEIFHNLKSILSERG

SEQ ID NO: 1793583 - protein, 31 aa, Staphylococcus epidermidis; identical to SEQ ID NO: 1650701

SEQ ID NO: 1793584 - protein, 26 aa, Staphylococcus epidermidis
GAKGKRFALPNAEVMIHQPLGGAQGQ

SEQ ID NO: 1793585 - protein, 18 aa, Staphylococcus epidermidis
GAKLMVDMAHIAGLVAAG

SEQ ID NO: 1793586 - protein, 24 aa, Staphylococcus epidermidis
GATSFKMKFGHRGANHPVKDLRTG

SEQ ID NO: 1793587 - protein, 25 aa, Staphylococcus epidermidis
GCHRTSPHLQDWAREGVLLLNTVLT

SEQ ID NO: 1793588 - protein, 28 aa, Staphylococcus epidermidis
GDEAAIFAGDLMRMYSKYAEANGFKTEI

SEQ ID NO: 1793589 - protein, 18 aa, Staphylococcus epidermidis
GDIQRVGTDIFLCTPDNV

SEQ ID NO: 1793590 - protein, 19 aa, Staphylococcus epidermidis
GDNIGALLRGVAREDVQRG

SEQ ID NO: 1793591 - protein, 18 aa, Staphylococcus epidermidis
GDSFTFDKVLFVGGDSVK

SEQ ID NO: 1793592 - protein, 25 aa, Staphylococcus epidermidis
GDTFFPPYTFENWEVESSVEGQLDE

SEQ ID NO: 1793593 - protein, 18 aa, Staphylococcus epidermidis
GEEFFWSMMDEINEEEDF

SEQ ID NO: 1793594 - protein, 25 aa, Staphylococcus epidermidis
GELDRYPLAKFKRSNSGTCYNQRPI

SEQ ID NO: 1793595 - protein, 31 aa, Staphylococcus epidermidis; identical to SEQ ID NO: 1646225

SEQ ID NO: 1793596 - protein, 24 aa, Staphylococcus epidermidis
GERMYEFLDKLIAVSLPRVRDFQG

SEQ ID NO: 1793597 - protein, 24 aa, Staphylococcus epidermidis
GEVIKAAPGFNVIAAINEGYVGTL

SEQ ID NO: 1793598 - protein, 22 aa, Staphylococcus epidermidis
GEYDAVITLGCVIRGATSHYDY

SEQ ID NO: 1793599 - protein, 27 aa, Staphylococcus epidermidis
GFQTHLKWGAQKEVIRLIPGLENVDIV

SEQ ID NO: 1793600 - protein, 21 aa, Staphylococcus epidermidis
GGLRYLKQLQVGVVAETGKER

SEQ ID NO: 1793601 - protein, 26 aa, Staphylococcus epidermidis
GGNMGVSGSVAYMFDHTATFGVEGKS

SEQ ID NO: 1793602 - protein, 17 aa, Staphylococcus epidermidis
GGPKGIMPGIAGLETIQ

SEQ ID NO: 1793603 - protein, 25 aa, Staphylococcus epidermidis
GGSGLHLRLDQVPTREPGISPYEMM

SEQ ID NO: 1793604 - protein, 21 aa, Staphylococcus epidermidis
GHGPFSHSFEKIFNTDHEAFT

SEQ ID NO: 1793605 - protein, 26 aa, Staphylococcus epidermidis
GHQLRFDLTKGFPLLTTKKVSFKLVA

SEQ ID NO: 1793606 - protein, 20 aa, Staphylococcus epidermidis
GKDFYMFAPHTVKQEYGVTL

SEQ ID NO: 1793607 - protein, 20 aa, Staphylococcus epidermidis
GKEGIAVTFVNPIEMDYIRQ

SEQ ID NO: 1793608 - protein, 25 aa, Staphylococcus epidermidis
GKEGLRLSQFYKELMVSTGSLEIEH

SEQ ID NO: 1793609 - protein, 19 aa, Staphylococcus epidermidis
GKFIMKHNIGYDLHTPNVD

SEQ ID NO: 1793610 - protein, 21 aa, Staphylococcus epidermidis
GKGKAMGFLVGQIMKASKGQA

SEQ ID NO: 1793611 - protein, 17 aa, Staphylococcus epidermidis
GKIPGGFKKREGRPGDE

SEQ ID NO: 1793612 - protein, 24 aa, Staphylococcus epidermidis
GKKFGKSESGAVWLDPEKTSPYEF

SEQ ID NO: 1793613 - protein, 19 aa, Staphylococcus epidermidis
GKLDLLVSLDFRMTATPLY

SEQ ID NO: 1793614 - protein, 25 aa, Staphylococcus epidermidis
GKSLSRLGGGIGTRGPGETKLEMDR

SEQ ID NO: 1793615 - protein, 19 aa, Staphylococcus epidermidis
GKTPILGLDVWEHAYYLKY

SEQ ID NO: 1793616 - protein, 25 aa, Staphylococcus epidermidis
GKVKMYVCGPTVYNYIHIGNARPAI

SEQ ID NO: 1793617 - protein, 23 aa, Staphylococcus epidermidis
GLGRFGGSIVRELNALDMDVMAI

SEQ ID NO: 1793618 - protein, 22 aa, Staphylococcus epidermidis
GLPKADIVLLGISRTSKTPLSQ

SEQ ID NO: 1793619 - protein, 18 aa, Staphylococcus epidermidis
GMLMAYEVTRDLELQDVE

SEQ ID NO: 1793620 - protein, 27 aa, Staphylococcus epidermidis
GMQTLGVALPWAISAALVRPNTQVVSV

SEQ ID NO: 1793621 - protein, 28 aa, Staphylococcus epidermidis
GNALSWSSAGALGFKGSKKSTPFAAQMA

SEQ ID NO: 1793622 - protein, 19 aa, Staphylococcus epidermidis
GNNTPVFFFRDPKLFISLN

SEQ ID NO: 1793623 - protein, 22 aa, Staphylococcus epidermidis
GPSLERPGDLAAILSGLQPGDV

SEQ ID NO: 1793624 - protein, 17 aa, Staphylococcus epidermidis
GPTKDWECSCGKYKRVR

SEQ ID NO: 1793625 - protein, 24 aa, Staphylococcus epidermidis
GQFYVNQRWLGGILTNYKTISKRI

SEQ ID NO: 1793626 - protein, 18 aa, Staphylococcus epidermidis
GQTIKFKGFMTLYVEAKD

SEQ ID NO: 1793627 - protein, 18 aa, Staphylococcus epidermidis
GQVFYLYNKVQSIYEKRE

SEQ ID NO: 1793628 - protein, 26 aa, Staphylococcus epidermidis
GRAPIGRPSPMSPWGKPTLGKKTRRG

SEQ ID NO: 1793629 - protein, 25 aa, Staphylococcus epidermidis
GRDGLKSECILLFSERDKGLHEYFI

SEQ ID NO: 1793630 - protein, 22 aa, Staphylococcus epidermidis
GSEAAYQLAQRGIKVNLIEMRP

SEQ ID NO: 1793631 - protein, 34 aa, Staphylococcus epidermidis
GSEISDWNKTGWGRIPMSLGFTYSSNTLMMHLQD

SEQ ID NO: 1793632 - protein, 26 aa, Staphylococcus epidermidis
GSGKSNITDAIKWVLGEQSAKSLRGA

SEQ ID NO: 1793633 - protein, 19 aa, Staphylococcus epidermidis
GSGTGWLLEIVISNEHYET

SEQ ID NO: 1793634 - protein, 32 aa, Staphylococcus epidermidis
GSKRVFNMIPYKVQVMGGIAIHKGDIAEMRTG

SEQ ID NO: 1793635 - protein, 19 aa, Staphylococcus epidermidis
GSVTAGFAIYDTIQHIKPD

SEQ ID NO: 1793636 - protein, 25 aa, Staphylococcus epidermidis
GTDQFKRIRIGVGRPTNGMSVPDYV

SEQ ID NO: 1793637 - protein, 24 aa, Staphylococcus epidermidis
GTEFLMDHRHLWLRSKKQHAVMKI

SEQ ID NO: 1793638 - protein, 27 aa, Staphylococcus epidermidis
GTIIAYRSSGGFGVRLDAGDGFQGAEI

SEQ ID NO: 1793639 - protein, 18 aa, Staphylococcus epidermidis
GVDAIHPGYGFLSENEQF

SEQ ID NO: 1793640 - protein, 17 aa, Staphylococcus epidermidis
GVGKTTISSFIALNLAE

SEQ ID NO: 1793641 - protein, 21 aa, Staphylococcus epidermidis
GVGSPDALIECSIRGMDMFDC

SEQ ID NO: 1793642 - protein, 32 aa, Staphylococcus epidermidis
GVKLVDFWATWCGPCKMIAPVLEELAGDYDGK

SEQ ID NO: 1793643 - protein, 23 aa, Staphylococcus epidermidis
GVLKETYPSVFIVELDQDKHNFE

SEQ ID NO: 1793644 - protein, 20 aa, Staphylococcus epidermidis
GVPIKAPVAGIAMGLVTRDD

SEQ ID NO: 1793645 - protein, 18 aa, Staphylococcus epidermidis
GVTTIFNVKHIYRGYTNI

SEQ ID NO: 1793646 - protein, 29 aa, Staphylococcus epidermidis
GVVSINAFKGVSFGEGFKAAEKPGSEIQD

SEQ ID NO: 1793647 - protein, 19 aa, Staphylococcus epidermidis
GYIHKKGHVGVVSRSGTLT

SEQ ID NO: 1793648 - protein, 39 aa, Staphylococcus epidermidis; identical to SEQ ID NO: 1646257

SEQ ID NO: 1793649 - protein, 24 aa, Staphylococcus epidermidis
HADFGGEVERIMKMVDGVVLVVDA

SEQ ID NO: 1793650 - protein, 25 aa, Staphylococcus epidermidis
HAKVKRIEKYGAFVELFPGKDALLH

SEQ ID NO: 1793651 - protein, 26 aa, Staphylococcus epidermidis
HDIVCAGASAVLFGSVNAIMGLTSEK

SEQ ID NO: 1793652 - protein, 18 aa, Staphylococcus epidermidis
HEALLCLDATTGQNALSQ

SEQ ID NO: 1793653 - protein, 17 aa, Staphylococcus epidermidis
HFIRATLESLCYQTRDV

SEQ ID NO: 1793654 - protein, 19 aa, Staphylococcus epidermidis
HGAGCTFAAATTAYLANGK

SEQ ID NO: 1793655 - protein, 28 aa, Staphylococcus epidermidis
HGPYKGEPKLGFKEMEEIGASTGLPLVL

SEQ ID NO: 1793656 - protein, 29 aa, Staphylococcus epidermidis
HIQVLLLTFFFKYMKPLVQAGRVFIALPP

SEQ ID NO: 1793657 - protein, 20 aa, Staphylococcus epidermidis
HKIPPTIISRAQRFDFKAIS

SEQ ID NO: 1793658 - protein, 25 aa, Staphylococcus epidermidis
HLDRKLSERRIFPAIDIGRSSTRKE

SEQ ID NO: 1793659 - protein, 19 aa, Staphylococcus epidermidis
HPFGGFKMSGTDAKTGSPD

SEQ ID NO: 1793660 - protein, 23 aa, Staphylococcus epidermidis
HPVYRKPMKQWVLKITEYADRLL

SEQ ID NO: 1793661 - protein, 23 aa, Staphylococcus epidermidis
HRDRIAFMRVVSGAFERGMDVTL

SEQ ID NO: 1793662 - protein, 22 aa, Staphylococcus epidermidis
HSGFGLGLERTVAWISGVEHVR

SEQ ID NO: 1793663 - protein, 18 aa, Staphylococcus epidermidis
HSKPFLKQFPTTGEHVLM

SEQ ID NO: 1793664 - protein, 26 aa, Staphylococcus epidermidis
HSYRELPIRIAELGTMHRYEASGAVS

SEQ ID NO: 1793665 - protein, 25 aa, Staphylococcus epidermidis
HTTDLRKKAVYSFMAMMEQIHAKSY

SEQ ID NO: 1793666 - protein, 20 aa, Staphylococcus epidermidis
HVTCRDRNLIGLQSHLLGLS

SEQ ID NO: 1793667 - protein, 19 aa, Staphylococcus epidermidis
IADEVGAKLMVDMAHIAGL

SEQ ID NO: 1793668 - protein, 21 aa, Staphylococcus epidermidis
IAGSYAERVPVIAITGAPTRA

SEQ ID NO: 1793669 - protein, 24 aa, Staphylococcus epidermidis
IDAKGNLIAPGFVDVHVHLREPGG

SEQ ID NO: 1793670 - protein, 19 aa, Staphylococcus epidermidis
IDEGCLIEDGHCIRTIHAE

SEQ ID NO: 1793671 - protein, 18 aa, Staphylococcus epidermidis
IDHLMGVPILAQHFENDP

SEQ ID NO: 1793672 - protein, 24 aa, Staphylococcus epidermidis
IDQSKFPLGQAVYFDTEKDGRMIF

SEQ ID NO: 1793673 - protein, 19 aa, Staphylococcus epidermidis
IDSGLDIDALKVVSKGINQ

SEQ ID NO: 1793674 - protein, 17 aa, Staphylococcus epidermidis
IEDGRLNVILMVGVNGV

SEQ ID NO: 1793675 - protein, 23 aa, Staphylococcus epidermidis
IEIGPGKVLSGLIKKINRDVKIT

SEQ ID NO: 1793676 - protein, 31 aa, Staphylococcus epidermidis; identical to SEQ ID NO: 1649464

SEQ ID NO: 1793677 - protein, 25 aa, Staphylococcus epidermidis
IEQKKGPFAPDFIKVWKERYKKIRD

SEQ ID NO: 1793678 - protein, 22 aa, Staphylococcus epidermidis
IESGSIFGVIGFSGAGKSTLIR

SEQ ID NO: 1793679 - protein, 25 aa, Staphylococcus epidermidis
IFDEKRLSKSPAMFDRQKLAWVNNQ

SEQ ID NO: 1793680 - protein, 19 aa, Staphylococcus epidermidis
IGPDIWKAASRVIDAAVEK

SEQ ID NO: 1793681 - protein, 21 aa, Staphylococcus epidermidis
IGQLIGMRASSDYVRHGEKKA

SEQ ID NO: 1793682 - protein, 22 aa, Staphylococcus epidermidis
IHGGARSNSAFQYKEMSHQEKH

SEQ ID NO: 1793683 - protein, 19 aa, Staphylococcus epidermidis
IIRGLRAVSDFEYELRLTS

SEQ ID NO: 1793684 - protein, 25 aa, Staphylococcus epidermidis
IKDPNRPIGSFLFLGPTGVGKTELA

SEQ ID NO: 1793685 - protein, 19 aa, Staphylococcus epidermidis
IKEMSVLELNDLVKAIEEE

SEQ ID NO: 1793686 - protein, 20 aa, Staphylococcus epidermidis
IKGTGPRYCPSIEDKFVRFN

SEQ ID NO: 1793687 - protein, 19 aa, Staphylococcus epidermidis
IKGVARPALVVTLPTTDGK

SEQ ID NO: 1793688 - protein, 19 aa, Staphylococcus epidermidis
IKRAKEFIVSPDPNINIEI

SEQ ID NO: 1793689 - protein, 19 aa, Staphylococcus epidermidis
IKVVKAVKEATGLGLKDAK

SEQ ID NO: 1793690 - protein, 27 aa, Staphylococcus epidermidis
IMKFTEGSFKQWGYDLAHNEFGDKVFT

SEQ ID NO: 1793691 - protein, 17 aa, Staphylococcus epidermidis
INAGRLSYEAGRIPVKY

SEQ ID NO: 1793692 - protein, 24 aa, Staphylococcus epidermidis
INFASAYKAPAIFVIQNNNYAIST

SEQ ID NO: 1793693 - protein, 18 aa, Staphylococcus epidermidis
INNEPLLMDIAKTPHALI

SEQ ID NO: 1793694 - protein, 33 aa, Staphylococcus epidermidis
INVPGFRKGKVPRPIFEQRFGVEALYQDAVDIL

SEQ ID NO: 1793695 - protein, 25 aa, Staphylococcus epidermidis
IPAISWLEDFLINFENTVIVVSHDR

SEQ ID NO: 1793696 - protein, 19 aa, Staphylococcus epidermidis
IPLGHEFNSLVLAILQVSG

SEQ ID NO: 1793697 - protein, 22 aa, Staphylococcus epidermidis
IPPEIRPMVQLDGGRFATSDLN

SEQ ID NO: 1793698 - protein, 23 aa, Staphylococcus epidermidis
IPREKRIVISLTYVYGIGTSTAN

SEQ ID NO: 1793699 - protein, 20 aa, Staphylococcus epidermidis
IQAIHELPFDKGLDRVCTNI

SEQ ID NO: 1793700 - protein, 18 aa, Staphylococcus epidermidis
IQKAIPYGTAKINVNTEN

SEQ ID NO: 1793701 - protein, 21 aa, Staphylococcus epidermidis
IQPKYFLPIHGEYRMLKAHGE

SEQ ID NO: 1793702 - protein, 21 aa, Staphylococcus epidermidis
IQRIEHMIRNALIIEDNGDNN

SEQ ID NO: 1793703 - protein, 26 aa, Staphylococcus epidermidis
IQSEVPAHVQAGWMLTTIASIGELER

SEQ ID NO: 1793704 - protein, 18 aa, Staphylococcus epidermidis
IQSSILTSIPLWKNQMAI

SEQ ID NO: 1793705 - protein, 18 aa, Staphylococcus epidermidis
IQVPGAFPKFGTTDGTIT

SEQ ID NO: 1793706 - protein, 23 aa, Staphylococcus epidermidis
IRIEAPIPGTSLVGIEVPNQNPT

SEQ ID NO: 1793707 - protein, 24 aa, Staphylococcus epidermidis
IRLKSKKGTLLWLMDETKTPMGAR

SEQ ID NO: 1793708 - protein, 18 aa, Staphylococcus epidermidis
IRLKYRYLDLRRQELAQT

SEQ ID NO: 1793709 - protein, 17 aa, Staphylococcus epidermidis
IRNELHIPVKYVGLGEK

SEQ ID NO: 1793710 - protein, 17 aa, Staphylococcus epidermidis
ISELGLAIESGMNAEDI

SEQ ID NO: 1793711 - protein, 17 aa, Staphylococcus epidermidis
ISKFKVIINNYIEESHG

SEQ ID NO: 1793712 - protein, 19 aa, Staphylococcus epidermidis
ISKKLGLSLNIINKAKTMI

SEQ ID NO: 1793713 - protein, 23 aa, Staphylococcus epidermidis
ISPVLWKKVKKGLSAGRVQSVAL

SEQ ID NO: 1793714 - protein, 23 aa, Staphylococcus epidermidis
ISRQRVWGVPLPVFYAENGDIIM

SEQ ID NO: 1793715 - protein, 25 aa, Staphylococcus epidermidis
ISTGASWRKLNIPGEDRLINKGVAF

SEQ ID NO: 1793716 - protein, 20 aa, Staphylococcus epidermidis
ITAFGTGIGGEFDISKARYH

SEQ ID NO: 1793717 - protein, 18 aa, Staphylococcus epidermidis
ITEHIPVVDMVKVKRYLQ

SEQ ID NO: 1793718 - protein, 23 aa, Staphylococcus epidermidis
ITLDEAFVIHDLRVIEGNSGLFV

SEQ ID NO: 1793719 - protein, 18 aa, Staphylococcus epidermidis
ITPGNFIFRTREFEQMEL

SEQ ID NO: 1793720 - protein, 26 aa, Staphylococcus epidermidis
IVKKFPIPHISTGDMFRKAIKDETDL

SEQ ID NO: 1793721 - protein, 18 aa, Staphylococcus epidermidis
IVSAWNPTEIDSMALPPC

SEQ ID NO: 1793722 - protein, 18 aa, Staphylococcus epidermidis
IWKAASRVIDAAVEKAYN

SEQ ID NO: 1793723 - protein, 18 aa, Staphylococcus epidermidis
IYDGTVIVKSVAREAGDR

SEQ ID NO: 1793724 - protein, 19 aa, Staphylococcus epidermidis
IYRNFGMAHPEGYRKALRL

SEQ ID NO: 1793725 - protein, 19 aa, Staphylococcus epidermidis
IYSLIKRIFNVEVEILVRK

SEQ ID NO: 1793726 - protein, 25 aa, Staphylococcus epidermidis
KAFINGKAGERFCIRNSGADVVVEG

SEQ ID NO: 1793727 - protein, 26 aa, Staphylococcus epidermidis
KAVAEMKLAVGLLVDKKLSHMRIHSI

SEQ ID NO: 1793728 - protein, 34 aa, Staphylococcus epidermidis
KAVEKFDFSKGFKFSTYATWWIRQAITRAIADQA

SEQ ID NO: 1793729 - protein, 22 aa, Staphylococcus epidermidis
KAVESYGIVGMASRQQVRDGIA

SEQ ID NO: 1793730 - protein, 25 aa, Staphylococcus epidermidis
KCRPIEGWNTIAFAKDWQGPPRLQN

SEQ ID NO: 1793731 - protein, 21 aa, Staphylococcus epidermidis
KDAGKIAGLEVERIINEPTAA

SEQ ID NO: 1793732 - protein, 17 aa, Staphylococcus epidermidis
KDDEFDRVLGLELGADD

SEQ ID NO: 1793733 - protein, 18 aa, Staphylococcus epidermidis
KDFGRVGAQAAKQAVMQR

SEQ ID NO: 1793734 - protein, 24 aa, Staphylococcus epidermidis
KDGDPRAKYLREMSRKITEETGQS

SEQ ID NO: 1793735 - protein, 19 aa, Staphylococcus epidermidis
KDLFEVIQAIHELPFDKGL

SEQ ID NO: 1793736 - protein, 21 aa, Staphylococcus epidermidis
KDSEIDKVLGLELGADDYVTK

SEQ ID NO: 1793737 - protein, 21 aa, Staphylococcus epidermidis
KEIFRSMGVAVPEGRVAFTAE

SEQ ID NO: 1793738 - protein, 19 aa, Staphylococcus epidermidis
KEKLRTNVGMVFQQPNPFP

SEQ ID NO: 1793739 - protein, 37 aa, Staphylococcus epidermidis
KEKYFEGCMPFEVMAERGRKTLLFGPMKPVGLEDPKT

SEQ ID NO: 1793740 - protein, 21 aa, Staphylococcus epidermidis
KELQQKLGKTFIFVTHDMDEA

SEQ ID NO: 1793741 - protein, 20 aa, Staphylococcus epidermidis
KERYEVYHGVRIQDRALVAA

SEQ ID NO: 1793742 - protein, 24 aa, Staphylococcus epidermidis
KEYDRLIKFLGGIRDMKSMPQALF

SEQ ID NO: 1793743 - protein, 26 aa, Staphylococcus epidermidis
KFYDRKEIKDLLSYLRVIANSNDDIS

SEQ ID NO: 1793744 - protein, 20 aa, Staphylococcus epidermidis
KGAVMKLGDNKGRRVSSTSS

SEQ ID NO: 1793745 - protein, 25 aa, Staphylococcus epidermidis
KGDKCKVSIRFRGRAITHKEIGQRV

SEQ ID NO: 1793746 - protein, 23 aa, Staphylococcus epidermidis
KGDKRRARAAAENIIPNSTGAAK

SEQ ID NO: 1793747 - protein, 22 aa, Staphylococcus epidermidis
KGKQLFMPIRVAVTGQMHGPEL

SEQ ID NO: 1793748 - protein, 20 aa, Staphylococcus epidermidis
KGTMEFSDRLYGVTMQESGV

SEQ ID NO: 1793749 - protein, 22 aa, Staphylococcus epidermidis
KHALKRKLIQTADSIANDGYND

SEQ ID NO: 1793750 - protein, 19 aa, Staphylococcus epidermidis
KIDTYRSSGAGGQHVNTTD

SEQ ID NO: 1793751 - protein, 18 aa, Staphylococcus epidermidis
KIEGRMKSIHYIATVVSV

SEQ ID NO: 1793752 - protein, 18 aa, Staphylococcus epidermidis
KIQQGWFDFDVVVATPDM

SEQ ID NO: 1793753 - protein, 26 aa, Staphylococcus epidermidis
KIQTDGRMKALVSITLDEAFVIHDLR

SEQ ID NO: 1793754 - protein, 23 aa, Staphylococcus epidermidis
KIYKQLLREGVDFMTMGNHTYGQ

SEQ ID NO: 1793755 - protein, 20 aa, Staphylococcus epidermidis
KKAREIWYLCRQYNAQEALD

SEQ ID NO: 1793756 - protein, 21 aa, Staphylococcus epidermidis
KKDIRTVIHFHLSSSPSNYLQ

SEQ ID NO: 1793757 - protein, 22 aa, Staphylococcus epidermidis
KKFYALDMFPYPSGAGLHVGHP

SEQ ID NO: 1793758 - protein, 18 aa, Staphylococcus epidermidis
KKGSIAYLKEAEKISDFL

SEQ ID NO: 1793759 - protein, 21 aa, Staphylococcus epidermidis
KKSGIGREVYKDAIKNYQQVK

SEQ ID NO: 1793760 - protein, 18 aa, Staphylococcus epidermidis
KKVIDKMAAVFILQGYLD

SEQ ID NO: 1793761 - protein, 26 aa, Staphylococcus epidermidis
KLEDRLRSRFEWGLIVDITPPDYETR

SEQ ID NO: 1793762 - protein, 17 aa, Staphylococcus epidermidis
KLFLKRNSNPFIAALSA

SEQ ID NO: 1793763 - protein, 17 aa, Staphylococcus epidermidis
KLHLVPSGIFYKDKLAV

SEQ ID NO: 1793764 - protein, 23 aa, Staphylococcus epidermidis
KLKHWLPVDLYIGGVEHAVLHLL

SEQ ID NO: 1793765 - protein, 20 aa, Staphylococcus epidermidis
KLNDEYFKRIEAIEYSVKYD

SEQ ID NO: 1793766 - protein, 19 aa, Staphylococcus epidermidis
KLYLFSFRNHGDFHEDCMN

SEQ ID NO: 1793767 - protein, 18 aa, Staphylococcus epidermidis
KMSNLCTEIFQLQETSVI

SEQ ID NO: 1793768 - protein, 20 aa, Staphylococcus epidermidis
KMSRRKKTAAKKLLEVSNQT

SEQ ID NO: 1793769 - protein, 24 aa, Staphylococcus epidermidis
KNGDYSSNIAMVLTKIAKRNPREI

SEQ ID NO: 1793770 - protein, 20 aa, Staphylococcus epidermidis
KNTMVRRAAEQAGIEGLDEF

SEQ ID NO: 1793771 - protein, 19 aa, Staphylococcus epidermidis
KPFMMPVEDVFSITGRGTV

SEQ ID NO: 1793772 - protein, 22 aa, Staphylococcus epidermidis
KPMPGRFKDYIAMPKQNMYQSL

SEQ ID NO: 1793773 - protein, 17 aa, Staphylococcus epidermidis
KPVKGMLTGPVTILNWS

SEQ ID NO: 1793774 - protein, 19 aa, Staphylococcus epidermidis
KQGVIRLFLKYGQNNERVI

SEQ ID NO: 1793775 - protein, 18 aa, Staphylococcus epidermidis
KQQHGFIDSVGFDLYSQM

SEQ ID NO: 1793776 - protein, 26 aa, Staphylococcus epidermidis
KRMQGYNVLHPMGWDAFGLPAEQYAL

SEQ ID NO: 1793777 - protein, 18 aa, Staphylococcus epidermidis
KRPGMYIGSTDKRGLHHL

SEQ ID NO: 1793778 - protein, 20 aa, Staphylococcus epidermidis
KRRLGEKVIGFASNEADKYD

SEQ ID NO: 1793779 - protein, 24 aa, Staphylococcus epidermidis
KSALEIVDGLLLNPLVGETKSDDI

SEQ ID NO: 1793780 - protein, 29 aa, Staphylococcus epidermidis
KSIAYPRQIAMYLSRELTDFSLPKIGEEF

SEQ ID NO: 1793781 - protein, 19 aa, Staphylococcus epidermidis
KSILSERGLETAVGDEGGF

SEQ ID NO: 1793782 - protein, 18 aa, Staphylococcus epidermidis
KSQAFDFIIEGDTLIPPF

SEQ ID NO: 1793783 - protein, 21 aa, Staphylococcus epidermidis
KTIPVRPGRNVAVIIEVAAMN

SEQ ID NO: 1793784 - protein, 18 aa, Staphylococcus epidermidis
KTKKCLEATIVHYFEPNE

SEQ ID NO: 1793785 - protein, 18 aa, Staphylococcus epidermidis
KTTALRMINRMIEATDGQ

SEQ ID NO: 1793786 - protein, 25 aa, Staphylococcus epidermidis
KTVGIAISDLMGWTAQGLDTLRINE

SEQ ID NO: 1793787 - protein, 19 aa, Staphylococcus epidermidis
KVAELLLERAKRLVEIGED

SEQ ID NO: 1793788 - protein, 18 aa, Staphylococcus epidermidis
KVARLICDVFKTDGTPFE

SEQ ID NO: 1793789 - protein, 21 aa, Staphylococcus epidermidis
KVDALSFIVHRDFAYERGKAL

SEQ ID NO: 1793790 - protein, 18 aa, Staphylococcus epidermidis
KVGNALPLQNIPVGTVIH

SEQ ID NO: 1793791 - protein, 20 aa, Staphylococcus epidermidis
KVIEIPEGFEVIADSPSTNY

SEQ ID NO: 1793792 - protein, 25 aa, Staphylococcus epidermidis
KVRRKPYSVILFDEIEKAHPDVFNI

SEQ ID NO: 1793793 - protein, 19 aa, Staphylococcus epidermidis
LAACSGFMYSMITAKQYIQ

SEQ ID NO: 1793794 - protein, 26 aa, Staphylococcus epidermidis
LAFYLTRPSLDVVIPGAKRAEQVVEN

SEQ ID NO: 1793795 - protein, 19 aa, Staphylococcus epidermidis
LAMTDCLNYGSPEKKEIYQ

SEQ ID NO: 1793796 - protein, 18 aa, Staphylococcus epidermidis
LANILIAAGYNVTREYYI

SEQ ID NO: 1793797 - protein, 21 aa, Staphylococcus epidermidis
LAPSKFEAWFLTTEHTEEDID

SEQ ID NO: 1793798 - protein, 26 aa, Staphylococcus epidermidis
LCNMRCSHCAVGYTLQTKDPDPLPMD

SEQ ID NO: 1793799 - protein, 19 aa, Staphylococcus epidermidis
LDFKDEFFEQYGLNVENPK

SEQ ID NO: 1793800 - protein, 17 aa, Staphylococcus epidermidis
LDFPVVYASAVNGTASL

SEQ ID NO: 1793801 - protein, 20 aa, Staphylococcus epidermidis
LDIAELVMELEDEFGTEIPD

SEQ ID NO: 1793802 - protein, 23 aa, Staphylococcus epidermidis
LDMAKRLLDFGVHPPTIYFPLNV

SEQ ID NO: 1793803 - protein, 18 aa, Staphylococcus epidermidis
LEAVRKRPGMYIGSTDKR

SEQ ID NO: 1793804 - protein, 18 aa, Staphylococcus epidermidis
LEAVRKRPGMYIGSTSER

SEQ ID NO: 1793805 - protein, 18 aa, Staphylococcus epidermidis
LECPSIISQVKFYHVPEG

SEQ ID NO: 1793806 - protein, 26 aa, Staphylococcus epidermidis
LEEVCGACSMVINGRARQSCSAIVDQ

SEQ ID NO: 1793807 - protein, 21 aa, Staphylococcus epidermidis
LEGALTRLLAYSKLQGKPITT

SEQ ID NO: 1793808 - protein, 17 aa, Staphylococcus epidermidis
LEIVQTISRNHCAYPNH

SEQ ID NO: 1793809 - protein, 23 aa, Staphylococcus epidermidis
LEKKVASGMSYFITQPVYSKEKI

SEQ ID NO: 1793810 - protein, 24 aa, Staphylococcus epidermidis
LEKNWPGLHIEPLQAPENMEVLIG

SEQ ID NO: 1793811 - protein, 25 aa, Staphylococcus epidermidis
LEMLRRLDHRGGVGADGITGDGAGI

SEQ ID NO: 1793812 - protein, 23 aa, Staphylococcus epidermidis
LEPNDPIIHFALAELLYYDGQYL

SEQ ID NO: 1793813 - protein, 22 aa, Staphylococcus epidermidis
LERKLTEMGIYPAVDPLASTSR

SEQ ID NO: 1793814 - protein, 19 aa, Staphylococcus epidermidis
LERTVAWISGVEHVRETSP

SEQ ID NO: 1793815 - protein, 18 aa, Staphylococcus epidermidis
LESVLRQEDDFVITDDHI

SEQ ID NO: 1793816 - protein, 17 aa, Staphylococcus epidermidis
LETFLFYSGFYYPLYLA

SEQ ID NO: 1793817 - protein, 19 aa, Staphylococcus epidermidis
LFANTVIEEYSYKVIDEKE

SEQ ID NO: 1793818 - protein, 17 aa, Staphylococcus epidermidis
LFEAGGINPDYYFVSEA

SEQ ID NO: 1793819 - protein, 20 aa, Staphylococcus epidermidis
LFHDLGWKTVVGFQTRNPVH

SEQ ID NO: 1793820 - protein, 18 aa, Staphylococcus epidermidis
LFIDHGMGVVIGETCTIG

SEQ ID NO: 1793821 - protein, 23 aa, Staphylococcus epidermidis
LFSGELDKAVAAMIIANGAKAAG

SEQ ID NO: 1793822 - protein, 26 aa, Staphylococcus epidermidis
LFTGYEVLNTFTFRITRNADLTIHED

SEQ ID NO: 1793823 - protein, 17 aa, Staphylococcus epidermidis
LGAKVVGISDAYGALHD

SEQ ID NO: 1793824 - protein, 24 aa, Staphylococcus epidermidis
LGFRGEALASISSVAKVTLKTCTD

SEQ ID NO: 1793825 - protein, 18 aa, Staphylococcus epidermidis
LGKYWASLGDVFVNDAFG

SEQ ID NO: 1793826 - protein, 19 aa, Staphylococcus epidermidis
LGNSLRRILLSSLPGAAVK

SEQ ID NO: 1793827 - protein, 22 aa, Staphylococcus epidermidis
LGQRPGAGAVYLNIFHYDVEEF

SEQ ID NO: 1793828 - protein, 21 aa, Staphylococcus epidermidis
LHATFMPKPLFGVNGSGMHFN

SEQ ID NO: 1793829 - protein, 19 aa, Staphylococcus epidermidis
LHAYFKPEILNRMDDIVLF

SEQ ID NO: 1793830 - protein, 17 aa, Staphylococcus epidermidis
LHLGMAAKNLGIHVASP

SEQ ID NO: 1793831 - protein, 21 aa, Staphylococcus epidermidis
LIARHSLKVDAGVIAIQKSIL

SEQ ID NO: 1793832 - protein, 17 aa, Staphylococcus epidermidis
LIDEARTPLIISGEAEK

SEQ ID NO: 1793833 - protein, 26 aa, Staphylococcus epidermidis
LIKANIPTRIAFMVSSSVDSRTILDS

SEQ ID NO: 1793834 - protein, 24 aa, Staphylococcus epidermidis
LIKEKPDLILLTFPTPVMSVLTEQ

SEQ ID NO: 1793835 - protein, 28 aa, Staphylococcus epidermidis
LINKGVAFCPHCDGPLFENKDVAVIGGG

SEQ ID NO: 1793836 - protein, 20 aa, Staphylococcus epidermidis
LITRRIREMGVYSELHDHEI

SEQ ID NO: 1793837 - protein, 19 aa, Staphylococcus epidermidis
LKAYSYNREGVMNASVEFD

SEQ ID NO: 1793838 - protein, 25 aa, Staphylococcus epidermidis
LKPALARGELQCIGATTLDEYRKNI

SEQ ID NO: 1793839 - protein, 22 aa, Staphylococcus epidermidis
LKPQIPTCRVIFTPHQKEWERL

SEQ ID NO: 1793840 - protein, 20 aa, Staphylococcus epidermidis
LKPTQLVGGYAQISYHFNYY

SEQ ID NO: 1793841 - protein, 20 aa, Staphylococcus epidermidis
LKRGLSATIEEFIYAAEYIA

SEQ ID NO: 1793842 - protein, 19 aa, Staphylococcus epidermidis
LKSRIDSLATQEEDYTYFF

SEQ ID NO: 1793843 - protein, 19 aa, Staphylococcus epidermidis
LKTLIPRQQFEVPVQAAIG

SEQ ID NO: 1793844 - protein, 17 aa, Staphylococcus epidermidis
LLEAGVHFGHQTRRWNP

SEQ ID NO: 1793845 - protein, 20 aa, Staphylococcus epidermidis
LLHEEIKEAYDLGIRAIMFF

SEQ ID NO: 1793846 - protein, 20 aa, Staphylococcus epidermidis
LLHRENEEVMAYAAENNITF

SEQ ID NO: 1793847 - protein, 17 aa, Staphylococcus epidermidis
LLRGVAREDVQRGQVLA

SEQ ID NO: 1793848 - protein, 22 aa, Staphylococcus epidermidis
LMNLKHVVITAVARDDLRDQGS

SEQ ID NO: 1793849 - protein, 17 aa, Staphylococcus epidermidis
LNDLRSRVKLETDGKLL

SEQ ID NO: 1793850 - protein, 20 aa, Staphylococcus epidermidis
LNERFIITRGLDKCLFGYTL

SEQ ID NO: 1793851 - protein, 18 aa, Staphylococcus epidermidis
LNGSFLPLAHERLDDDGQ

SEQ ID NO: 1793852 - protein, 21 aa, Staphylococcus epidermidis
LNQRYSEIMQAIIYDVIGYEV

SEQ ID NO: 1793853 - protein, 26 aa, Staphylococcus epidermidis
LPDAVTRFRQGLGRLIRHEDDKGLIV

SEQ ID NO: 1793854 - protein, 27 aa, Staphylococcus epidermidis
LPKEMALELFKPFVMKELVQREIATNI

SEQ ID NO: 1793855 - protein, 18 aa, Staphylococcus epidermidis
LPKKEVVELKKEYDRLIK

SEQ ID NO: 1793856 - protein, 24 aa, Staphylococcus epidermidis
LPLPKKVFAHGWILMKDGKMSKSK

SEQ ID NO: 1793857 - protein, 18 aa, Staphylococcus epidermidis
LPLTVLLRALGFSTDQEI

SEQ ID NO: 1793858 - protein, 17 aa, Staphylococcus epidermidis
LPNRRNVVLTNQASFHH

SEQ ID NO: 1793859 - protein, 20 aa, Staphylococcus epidermidis
LPYSIRVLLESVLRQEDDFV

SEQ ID NO: 1793860 - protein, 25 aa, Staphylococcus epidermidis
LQPLYKDRIPVVIKNTNRPNDKGTY

SEQ ID NO: 1793861 - protein, 27 aa, Staphylococcus epidermidis
LRDKTWSVHVPRRIKEIGPRIKKVSDE

SEQ ID NO: 1793862 - protein, 19 aa, Staphylococcus epidermidis
LREGMPIGAKVTLRGERMY

SEQ ID NO: 1793863 - protein, 21 aa, Staphylococcus epidermidis
LREKTGAGMMDCKKALTETDG

SEQ ID NO: 1793864 - protein, 23 aa, Staphylococcus epidermidis
LRKRGIEGLVVIGGDGSYRGAQR

SEQ ID NO: 1793865 - protein, 20 aa, Staphylococcus epidermidis
LRRILLSSLPGAAVKYIEIE

SEQ ID NO: 1793866 - protein, 19 aa, Staphylococcus epidermidis
LRSGEVRMILSTCRATIGQ

SEQ ID NO: 1793867 - protein, 22 aa, Staphylococcus epidermidis
LRVIEGNSGLFVAMPSKRTPDG

SEQ ID NO: 1793868 - protein, 19 aa, Staphylococcus epidermidis
LSEQFPYIRQLLDAYHIKR

SEQ ID NO: 1793869 - protein, 19 aa, Staphylococcus epidermidis
LSSVIGCRDDIMVYLMYAG

SEQ ID NO: 1793870 - protein, 19 aa, Staphylococcus epidermidis
LSYEAGRIPVKYTAQASSP

SEQ ID NO: 1793871 - protein, 17 aa, Staphylococcus epidermidis
LTMKISREQSIVSRWIK

SEQ ID NO: 1793872 - protein, 18 aa, Staphylococcus epidermidis
LTNKRSSGKIAFLQLRDG

SEQ ID NO: 1793873 - protein, 18 aa, Staphylococcus epidermidis
LVDEVGMLMAYEVTRDLE

SEQ ID NO: 1793874 - protein, 18 aa, Staphylococcus epidermidis
LVGYNISPVLWKKVKKGL

SEQ ID NO: 1793875 - protein, 23 aa, Staphylococcus epidermidis
LVKDRYDNYVFLFENEFATRWFE

SEQ ID NO: 1793876 - protein, 26 aa, Staphylococcus epidermidis
LVMKQLFEHRGLPQLPYISFLRSEYE

SEQ ID NO: 1793877 - protein, 19 aa, Staphylococcus epidermidis
LVQAGRVFIALPPLYKLEK

SEQ ID NO: 1793878 - protein, 23 aa, Staphylococcus epidermidis
LVQELKENYSIIMVTHNMQQAAR

SEQ ID NO: 1793879 - protein, 19 aa, Staphylococcus epidermidis
LVYYREVVKHHQLNIHPFE

SEQ ID NO: 1793880 - protein, 19 aa, Staphylococcus epidermidis
LYEKFGFKSTEPYSKGMYI

SEQ ID NO: 1793881 - protein, 20 aa, Staphylococcus epidermidis
LYFNYLISVLRLQRWIPPLQ

SEQ ID NO: 1793882 - protein, 17 aa, Staphylococcus epidermidis
LYHAYRLAIAPTQSISY

SEQ ID NO: 1793883 - protein, 29 aa, Staphylococcus epidermidis
LYKNHPEELRLLLIDPKMVELAPYNDLPH

SEQ ID NO: 1793884 - protein, 20 aa, Staphylococcus epidermidis
LYNMVRVLVAFLIEVGKGKR

SEQ ID NO: 1793885 - protein, 25 aa, Staphylococcus epidermidis
MAEPGEYTKRAFLNGRIDLSQAEAV

SEQ ID NO: 1793886 - protein, 18 aa, Staphylococcus epidermidis
MAIYPCLTSGGTLNLVDK

SEQ ID NO: 1793887 - protein, 20 aa, Staphylococcus epidermidis
MAKEIVRFHSIIWPILLMAL

SEQ ID NO: 1793888 - protein, 23 aa, Staphylococcus epidermidis
MDSGFDGFFLIAANPVDILTRYV

SEQ ID NO: 1793889 - protein, 25 aa, Staphylococcus epidermidis
MDTCIACGACGAAAPDIYDYDDEGI

SEQ ID NO: 1793890 - protein, 24 aa, Staphylococcus epidermidis
MENNIKIGMELGYIKAPPETFIEP

SEQ ID NO: 1793891 - protein, 38 aa, Staphylococcus epidermidis; identical to SEQ ID NO: 1645887

SEQ ID NO: 1793892 - protein, 17 aa, Staphylococcus epidermidis
MGIQIRHYTVQALKLLK

SEQ ID NO: 1793893 - protein, 23 aa, Staphylococcus epidermidis
MIRTDLEIPPFIQALTSIEEEML

SEQ ID NO: 1793894 - protein, 18 aa, Staphylococcus epidermidis
MKEACYAATPAIQLAKDY

SEQ ID NO: 1793895 - protein, 20 aa, Staphylococcus epidermidis
MKLEFERNYERYQFLNWATK

SEQ ID NO: 1793896 - protein, 19 aa, Staphylococcus epidermidis
MKSKTIQVVVEFKEVPMNL

SEQ ID NO: 1793897 - protein, 17 aa, Staphylococcus epidermidis
MLESIRYVDLVIPEEGW

SEQ ID NO: 1793898 - protein, 19 aa, Staphylococcus epidermidis
MPGLPKKPAALNMDVTDDG

SEQ ID NO: 1793899 - protein, 21 aa, Staphylococcus epidermidis
MPKTDFPMRGGLPNKEPQIQE

SEQ ID NO: 1793900 - protein, 17 aa, Staphylococcus epidermidis
MQAIIYDVIGYEVKPHF

SEQ ID NO: 1793901 - protein, 18 aa, Staphylococcus epidermidis
MQDSFYITEEILMRTHTS

SEQ ID NO: 1793902 - protein, 17 aa, Staphylococcus epidermidis
MSTKNGRKVLARRRRKG

SEQ ID NO: 1793903 - protein, 24 aa, Staphylococcus epidermidis
MSYGIKYASSFFGPFRDAADSAPS

SEQ ID NO: 1793904 - protein, 19 aa, Staphylococcus epidermidis
MTERVLRSETDMLKKQELI

SEQ ID NO: 1793905 - protein, 25 aa, Staphylococcus epidermidis
MTNMFWRQNISQMWVETEFKVSKDI

SEQ ID NO: 1793906 - protein, 18 aa, Staphylococcus epidermidis
MTPYFPKPDVLIYLECDY

SEQ ID NO: 1793907 - protein, 21 aa, Staphylococcus epidermidis
MTTIRVARAYTKRNKIIKFAG

SEQ ID NO: 1793908 - protein, 18 aa, Staphylococcus epidermidis
MVIDCAKGIEPQTLKLFK

SEQ ID NO: 1793909 - protein, 18 aa, Staphylococcus epidermidis
MVRIEAGYTQDTMAQTIG

SEQ ID NO: 1793910 - protein, 19 aa, Staphylococcus epidermidis
MWYYKSAFNTDQMKLIDLV

SEQ ID NO: 1793911 - protein, 18 aa, Staphylococcus epidermidis
MYALKTAGYQSALMVPTE

SEQ ID NO: 1793912 - protein, 24 aa, Staphylococcus epidermidis
NALIADEIVCVFDAYEQSGIEREY

SEQ ID NO: 1793913 - protein, 19 aa, Staphylococcus epidermidis
NCDGILRQSMKHIFNSETD

SEQ ID NO: 1793914 - protein, 17 aa, Staphylococcus epidermidis
NDLAALVYYPEEKLKLV

SEQ ID NO: 1793915 - protein, 24 aa, Staphylococcus epidermidis
NEDEIRRFLPRKVRTFQLQEAQRL

SEQ ID NO: 1793916 - protein, 24 aa, Staphylococcus epidermidis
NELDKCFYKYYGLNKLINLLIKEK

SEQ ID NO: 1793917 - protein, 28 aa, Staphylococcus epidermidis
NEREPSVLPARFPNLLVNGAAGIAVGMA

SEQ ID NO: 1793918 - protein, 26 aa, Staphylococcus epidermidis
NESKYCPNCGRLLQYDYIHYNQIGHY

SEQ ID NO: 1793919 - protein, 22 aa, Staphylococcus epidermidis
NEWVNMLGVVPVIRALREKAMN

SEQ ID NO: 1793920 - protein, 19 aa, Staphylococcus epidermidis
NFIMSRYQMYWQIYFHPVS

SEQ ID NO: 1793921 - protein, 23 aa, Staphylococcus epidermidis
NFMIRDGRMQRLIAPEKEPITPF

SEQ ID NO: 1793922 - protein, 18 aa, Staphylococcus epidermidis
NFYLDYGKDILYIEKKDS

SEQ ID NO: 1793923 - protein, 18 aa, Staphylococcus epidermidis
NHFTEWLNNNHAYYVPYK

SEQ ID NO: 1793924 - protein, 20 aa, Staphylococcus epidermidis
NIGQVLELHLGMAAKNLGIH

SEQ ID NO: 1793925 - protein, 25 aa, Staphylococcus epidermidis
NKDEFELIRLFGKRGRGLYNKARGI

SEQ ID NO: 1793926 - protein, 19 aa, Staphylococcus epidermidis
NKGRVYKLKGYEVPELSRQ

SEQ ID NO: 1793927 - protein, 17 aa, Staphylococcus epidermidis
NKSFVFGPCSVESQEQV

SEQ ID NO: 1793928 - protein, 17 aa, Staphylococcus epidermidis
NKYGITMVMTGMRHFKH

SEQ ID NO: 1793929 - protein, 18 aa, Staphylococcus epidermidis
NLKRFKEVRKEIEVGKMS

SEQ ID NO: 1793930 - protein, 24 aa, Staphylococcus epidermidis
NLNIKRLMEISSYRGIRHRRGLPV

SEQ ID NO: 1793931 - protein, 29 aa, Staphylococcus epidermidis
NPTEIDSMALPPCHTMFQFYVQEGKLNCQ

SEQ ID NO: 1793932 - protein, 20 aa, Staphylococcus epidermidis
NPTGSFKDRGMVMAVTKAKE

SEQ ID NO: 1793933 - protein, 24 aa, Staphylococcus epidermidis
NQTSLKLAAAFAAGSPVVLKPSEE

SEQ ID NO: 1793934 - protein, 18 aa, Staphylococcus epidermidis
NRISVGVMYMLKLAHMVD

SEQ ID NO: 1793935 - protein, 18 aa, Staphylococcus epidermidis
NRRNVVLTNQASFHHEGV

SEQ ID NO: 1793936 - protein, 28 aa, Staphylococcus epidermidis
NTGIGLAFVCAAKGYKAVFTMPETMSQE

SEQ ID NO: 1793937 - protein, 24 aa, Staphylococcus epidermidis
NTPARLKYIKSLYTELGKITDIVN

SEQ ID NO: 1793938 - protein, 25 aa, Staphylococcus epidermidis
NVEMTVELIAPIAIEDGTRFSIREG

SEQ ID NO: 1793939 - protein, 17 aa, Staphylococcus epidermidis
NVLNLPVVVIRKDNKVT

SEQ ID NO: 1793940 - protein, 17 aa, Staphylococcus epidermidis
NVQYYTDIVFKHALKRK

SEQ ID NO: 1793941 - protein, 23 aa, Staphylococcus epidermidis
NYACILLDLMLPEMDGIEVASKL

SEQ ID NO: 1793942 - protein, 25 aa, Staphylococcus epidermidis
NYEPSMQYFNEWWKQLYGESEGKDF

SEQ ID NO: 1793943 - protein, 32 aa, Staphylococcus epidermidis
PANEGRGYVLRRLLRRAVRFSQSLGINEPFMY

SEQ ID NO: 1793944 - protein, 23 aa, Staphylococcus epidermidis
PAVEAGESLGFLPGDLKEKVDPY

SEQ ID NO: 1793945 - protein, 19 aa, Staphylococcus epidermidis
PCLITIFGATGDLSHRKLF

SEQ ID NO: 1793946 - protein, 18 aa, Staphylococcus epidermidis
PDCSPEMAAMIGSSMALS

SEQ ID NO: 1793947 - protein, 19 aa, Staphylococcus epidermidis
PDYETRMAILQKKIEEENL

SEQ ID NO: 1793948 - protein, 21 aa, Staphylococcus epidermidis
PEEIKRTFDKLGIPEAEQKYL

SEQ ID NO: 1793949 - protein, 21 aa, Staphylococcus epidermidis
PEILEEAYLSKAMVVEVWSKE

SEQ ID NO: 1793950 - protein, 17 aa, Staphylococcus epidermidis
PETAQGIFVNYKNVQRS

SEQ ID NO: 1793951 - protein, 24 aa, Staphylococcus epidermidis
PGAAVKYIEIEGVLHEFSAVDNVV

SEQ ID NO: 1793952 - protein, 21 aa, Staphylococcus epidermidis
PHGGIALGLDRLVMLLTNRTN

SEQ ID NO: 1793953 - protein, 20 aa, Staphylococcus epidermidis
PHKLRHTFATHLLNQGADLR

SEQ ID NO: 1793954 - protein, 21 aa, Staphylococcus epidermidis
PLLQASWKIAPALATGCSLVM

SEQ ID NO: 1793955 - protein, 26 aa, Staphylococcus epidermidis
PLVENGRLEGLITIKDIEKVLEFPYA

SEQ ID NO: 1793956 - protein, 26 aa, Staphylococcus epidermidis
PNEPIIPFIIGDGIGPDIWKAASRVI

SEQ ID NO: 1793957 - protein, 24 aa, Staphylococcus epidermidis
PNVTGKLHLGHAWDTTLQDIITRM

SEQ ID NO: 1793958 - protein, 19 aa, Staphylococcus epidermidis
PRGTRIFGPVARELREGNF

SEQ ID NO: 1793959 - protein, 25 aa, Staphylococcus epidermidis
PSQMGIRKPEFSSAISTISSSIAFD

SEQ ID NO: 1793960 - protein, 18 aa, Staphylococcus epidermidis
PSVPESFRVLMKELQSLG

SEQ ID NO: 1793961 - protein, 19 aa, Staphylococcus epidermidis
PYEGGKMVVAEAYRNLIAV

SEQ ID NO: 1793962 - protein, 19 aa, Staphylococcus epidermidis
PYKGKGIRYQGEYVRRKEG

SEQ ID NO: 1793963 - protein, 25 aa, Staphylococcus epidermidis
PYNDLPHLVSPVITDVKAATQSLKW

SEQ ID NO: 1793964 - protein, 18 aa, Staphylococcus epidermidis
PYTLLDYFGDDWLVMIDE

SEQ ID NO: 1793965 - protein, 17 aa, Staphylococcus epidermidis
QACFDRGDVKNTYGTGG

SEQ ID NO: 1793966 - protein, 29 aa, Staphylococcus epidermidis
QAFEFKEQVGYPLIVRPAFTMGGTGGGIC

SEQ ID NO: 1793967 - protein, 18 aa, Staphylococcus epidermidis
QALLKFEDVRIVRDMRNS

SEQ ID NO: 1793968 - protein, 22 aa, Staphylococcus epidermidis
QDIPFETFLGFKGDKVPDIDLN

SEQ ID NO: 1793969 - protein, 20 aa, Staphylococcus epidermidis
QDRKARSREPITAKLVANLI

SEQ ID NO: 1793970 - protein, 18 aa, Staphylococcus epidermidis
QDTICIYVAIGQKDSTVR

SEQ ID NO: 1793971 - protein, 17 aa, Staphylococcus epidermidis
QDVLLFIDNIFRFTQAG

SEQ ID NO: 1793972 - protein, 17 aa, Staphylococcus epidermidis
QEHGLDMIVIDYLQLIQ

SEQ ID NO: 1793973 - protein, 24 aa, Staphylococcus epidermidis
QEKMGRPAVEVILTVLHAGGKFGG

SEQ ID NO: 1793974 - protein, 30 aa, Staphylococcus epidermidis; identical to SEQ ID NO: 1645941

SEQ ID NO: 1793975 - protein, 25 aa, Staphylococcus epidermidis
QFGGQRFGEMEVWALEAYGAAYTLQ

SEQ ID NO: 1793976 - protein, 21 aa, Staphylococcus epidermidis
QFRLHSLGIMHVINYLTTSET

SEQ ID NO: 1793977 - protein, 29 aa, Staphylococcus epidermidis
QGDRGDSRFYLSLQDELMVRFGSERLQKM

SEQ ID NO: 1793978 - protein, 27 aa, Staphylococcus epidermidis
QGFGNAGSFLAKFLYDLGAKVVGISDA

SEQ ID NO: 1793979 - protein, 18 aa, Staphylococcus epidermidis
QGICDLSSVIGCRDDIMV

SEQ ID NO: 1793980 - protein, 24 aa, Staphylococcus epidermidis
QGLEIAEAFVRSGAVDIVVVDSVA

SEQ ID NO: 1793981 - protein, 19 aa, Staphylococcus epidermidis
QGYDVIGIFMKNWDDTDEN

SEQ ID NO: 1793982 - protein, 22 aa, Staphylococcus epidermidis
QHIKVRVTGIQPYGAFVETPDH

SEQ ID NO: 1793983 - protein, 18 aa, Staphylococcus epidermidis
QIGGRRNGALISMDQGQA

SEQ ID NO: 1793984 - protein, 17 aa, Staphylococcus epidermidis
QIHAGGRGKAGGVKIAK

SEQ ID NO: 1793985 - protein, 26 aa, Staphylococcus epidermidis
QKKELFKKLAHVEGFEKYLHKNFVGA

SEQ ID NO: 1793986 - protein, 26 aa, Staphylococcus epidermidis
QKYRELQDIIAILGMDELSDEDKQTV

SEQ ID NO: 1793987 - protein, 20 aa, Staphylococcus epidermidis
QLIKGGRISKTKGLIGNIMK

SEQ ID NO: 1793988 - protein, 25 aa, Staphylococcus epidermidis
QLREAGVEYKVYKNTMVRRAAEQAG

SEQ ID NO: 1793989 - protein, 24 aa, Staphylococcus epidermidis
QNHMLQMVALLAMEAPISLNSEDI

SEQ ID NO: 1793990 - protein, 24 aa, Staphylococcus epidermidis
QPIRLEPMSTFPVIRDLQVDRSRM

SEQ ID NO: 1793991 - protein, 18 aa, Staphylococcus epidermidis
QPPMKGKQILGVDPAFRT

SEQ ID NO: 1793992 - protein, 25 aa, Staphylococcus epidermidis
QRNGPTGTVKLHFMKQYNKFTDIDY

SEQ ID NO: 1793993 - protein, 24 aa, Staphylococcus epidermidis
QRSMRKKLPFGIGQIGKSFRNEIT

SEQ ID NO: 1793994 - protein, 29 aa, Staphylococcus epidermidis
QRTNYDLEMMREMGFCSGIENYSVHLTLR

SEQ ID NO: 1793995 - protein, 31 aa, Staphylococcus epidermidis; identical to SEQ ID NO: 1647752

SEQ ID NO: 1793996 - protein, 18 aa, Staphylococcus epidermidis
QRVLLALINKGMVREEAY

SEQ ID NO: 1793997 - protein, 17 aa, Staphylococcus epidermidis
QSAERLGFPEARIPLSQ

SEQ ID NO: 1793998 - protein, 20 aa, Staphylococcus epidermidis
QTKFKMVRIEAGYTQDTMAQ

SEQ ID NO: 1793999 - protein, 23 aa, Staphylococcus epidermidis
QTRRWNPKMKKYIFTERNGIYII

SEQ ID NO: 1794000 - protein, 19 aa, Staphylococcus epidermidis
QTYEFFCQTGKDFDNRLAE

SEQ ID NO: 1794001 - protein, 18 aa, Staphylococcus epidermidis
RAAAGGDEAAIFAGDLMR

SEQ ID NO: 1794002 - protein, 20 aa, Staphylococcus epidermidis
RANIGHNWWVVNQSLVTLNQ

SEQ ID NO: 1794003 - protein, 21 aa, Staphylococcus epidermidis
RANLKTVMIERGMPGGQMANT

SEQ ID NO: 1794004 - protein, 23 aa, Staphylococcus epidermidis
RDSRTQAILPLRGKILNVEKARL

SEQ ID NO: 1794005 - protein, 22 aa, Staphylococcus epidermidis
RDVSLKVIRALGIEGGCNVQLA

SEQ ID NO: 1794006 - protein, 24 aa, Staphylococcus epidermidis
READFINCVVFRRQAENVNNYLSK

SEQ ID NO: 1794007 - protein, 18 aa, Staphylococcus epidermidis
REEVDAFLDDIITDYQKM

SEQ ID NO: 1794008 - protein, 19 aa, Staphylococcus epidermidis
REIFSSGKSICRINNQTVT

SEQ ID NO: 1794009 - protein, 22 aa, Staphylococcus epidermidis
RELEAKTGAGFIVALTGAIMTM

SEQ ID NO: 1794010 - protein, 19 aa, Staphylococcus epidermidis
RELTYCSVCGHITENDPCY

SEQ ID NO: 1794011 - protein, 20 aa, Staphylococcus epidermidis
RERGCSNGDIVRILGGEFEF

SEQ ID NO: 1794012 - protein, 21 aa, Staphylococcus epidermidis
RGGRGNSRFATPRNPAPDFSE

SEQ ID NO: 1794013 - protein, 20 aa, Staphylococcus epidermidis
RGGTFLFSARCPQFKEEDVR

SEQ ID NO: 1794014 - protein, 20 aa, Staphylococcus epidermidis
RHGTMPLTMFITKKGKQVKV

SEQ ID NO: 1794015 - protein, 19 aa, Staphylococcus epidermidis
RIIVEKGIMASRARVAAKK

SEQ ID NO: 1794016 - protein, 23 aa, Staphylococcus epidermidis
RISEVLELPNLIEIQTKSYDWFL

SEQ ID NO: 1794017 - protein, 21 aa, Staphylococcus epidermidis
RKIDMRLAAYIVGIKRTAEAA

SEQ ID NO: 1794018 - protein, 17 aa, Staphylococcus epidermidis
RKITALINQCYTSPINH

SEQ ID NO: 1794019 - protein, 23 aa, Staphylococcus epidermidis
RKNHPKTLFVWRSNLISSSAKGQ

SEQ ID NO: 1794020 - protein, 17 aa, Staphylococcus epidermidis
RKREFYEKPSVKRKKKS

SEQ ID NO: 1794021 - protein, 18 aa, Staphylococcus epidermidis
RLALLEADVNFKVVKEFV

SEQ ID NO: 1794022 - protein, 24 aa, Staphylococcus epidermidis
RLERLRKAIPNVLFQMLLRASNAV

SEQ ID NO: 1794023 - protein, 31 aa, Staphylococcus epidermidis
RLGFPEARIPLSQAVIELCLSPKSNSGITAI

SEQ ID NO: 1794024 - protein, 18 aa, Staphylococcus epidermidis
RLNVILMVGVNGVGKTTT

SEQ ID NO: 1794025 - protein, 17 aa, Staphylococcus epidermidis
RMFEYGGGFVQDRSIYE

SEQ ID NO: 1794026 - protein, 18 aa, Staphylococcus epidermidis
RMICSSGNVDSNRLRTGT

SEQ ID NO: 1794027 - protein, 17 aa, Staphylococcus epidermidis
RNMKLEFERNYERYQFL

SEQ ID NO: 1794028 - protein, 18 aa, Staphylococcus epidermidis
RNPYSVILLDEVEKAHSD

SEQ ID NO: 1794029 - protein, 17 aa, Staphylococcus epidermidis
RPDEKRVTERAYENPRF

SEQ ID NO: 1794030 - protein, 21 aa, Staphylococcus epidermidis
RPEDLQSYGLIPEFIGRVPIV

SEQ ID NO: 1794031 - protein, 18 aa, Staphylococcus epidermidis
RPGKELENLVPDYLDGLL

SEQ ID NO: 1794032 - protein, 20 aa, Staphylococcus epidermidis
RPIAEIQFADFILPATNQII

SEQ ID NO: 1794033 - protein, 17 aa, Staphylococcus epidermidis
RPPEPYKGKGIRYQGEY

SEQ ID NO: 1794034 - protein, 22 aa, Staphylococcus epidermidis
RQCYCGCVFAAMKQGIDFKQIN

SEQ ID NO: 1794035 - protein, 20 aa, Staphylococcus epidermidis
RRFEIKRGDKVTGKVRKPKD

SEQ ID NO: 1794036 - protein, 18 aa, Staphylococcus epidermidis
RRNQALVYYREVVKHHQL

SEQ ID NO: 1794037 - protein, 25 aa, Staphylococcus epidermidis
RRQAKAVNFGIVYGISDYGLSQSLG

SEQ ID NO: 1794038 - protein, 20 aa, Staphylococcus epidermidis
RRVSPFFVPMLIPDMATGQV

SEQ ID NO: 1794039 - protein, 21 aa, Staphylococcus epidermidis
RRYPDLTVHRLIRKYLIENSM

SEQ ID NO: 1794040 - protein, 20 aa, Staphylococcus epidermidis
RSDAYIGVLIDDLVTKGTNE

SEQ ID NO: 1794041 - protein, 23 aa, Staphylococcus epidermidis
RSFKEVTNVSGIVLTKLDGTAKG

SEQ ID NO: 1794042 - protein, 28 aa, Staphylococcus epidermidis
RTNVPAIFCSGGPMKAGLSAQGKALTLS

SEQ ID NO: 1794043 - protein, 19 aa, Staphylococcus epidermidis
RTTGHLMSMLVTLKGLPLA

SEQ ID NO: 1794044 - protein, 23 aa, Staphylococcus epidermidis
RTTVENGVPCLTSLDTASALTNV

SEQ ID NO: 1794045 - protein, 20 aa, Staphylococcus epidermidis
RVGRSSRIGYAYFLHPANKV

SEQ ID NO: 1794046 - protein, 21 aa, Staphylococcus epidermidis
RVGSAKIAIERAIEINDNVAL

SEQ ID NO: 1794047 - protein, 25 aa, Staphylococcus epidermidis
RVLPNWTTCVSICALFRDSDVLNST

SEQ ID NO: 1794048 - protein, 18 aa, Staphylococcus epidermidis
RVTERAYENPRFVEDLIR

SEQ ID NO: 1794049 - protein, 20 aa, Staphylococcus epidermidis
RWYAVHTYSGYENKVKKNLE

SEQ ID NO: 1794050 - protein, 19 aa, Staphylococcus epidermidis
SALIKWFNTNYHYIVPEWD

SEQ ID NO: 1794051 - protein, 17 aa, Staphylococcus epidermidis
SCAGMFTANSMNCLMEV

SEQ ID NO: 1794052 - protein, 20 aa, Staphylococcus epidermidis
SEGVIKVMAKMGISTVQSYQ

SEQ ID NO: 1794053 - protein, 22 aa, Staphylococcus epidermidis
SEITPLTTIRVFELMEEVGFPK

SEQ ID NO: 1794054 - protein, 21 aa, Staphylococcus epidermidis
SELHDLAFLLLVYPLSEYEGA

SEQ ID NO: 1794055 - protein, 22 aa, Staphylococcus epidermidis
SELKRDEDVLVFGEDVGVNGGV

SEQ ID NO: 1794056 - protein, 24 aa, Staphylococcus epidermidis
SEMAFKIAASLALKEAAKKCDPVI

SEQ ID NO: 1794057 - protein, 18 aa, Staphylococcus epidermidis
SESGTGAGVRRIEALTGK

SEQ ID NO: 1794058 - protein, 20 aa, Staphylococcus epidermidis
SESKYKVYIIDEVHMLTTGA

SEQ ID NO: 1794059 - protein, 18 aa, Staphylococcus epidermidis
SETCPISANAYDQFNKFL

SEQ ID NO: 1794060 - protein, 24 aa, Staphylococcus epidermidis
SFSPDKILGAILFEQTMDREVEGK

SEQ ID NO: 1794061 - protein, 24 aa, Staphylococcus epidermidis
SGEQRISNFLIWQASYSEFIFNEK

SEQ ID NO: 1794062 - protein, 18 aa, Staphylococcus epidermidis
SGMIKGTGPRYCPSIEDK

SEQ ID NO: 1794063 - protein, 21 aa, Staphylococcus epidermidis
SGSAIQWLRDGLRMINSAPQT

SEQ ID NO: 1794064 - protein, 19 aa, Staphylococcus epidermidis
SGSTQFKFRQLNAVTNTKK

SEQ ID NO: 1794065 - protein, 24 aa, Staphylococcus epidermidis
SHKKEHMIRAALEGVLYNLYTVYL

SEQ ID NO: 1794066 - protein, 24 aa, Staphylococcus epidermidis
SIFVKSRGQTAILFDEVDSGVSGQ

SEQ ID NO: 1794067 - protein, 30 aa, Staphylococcus epidermidis
SILTSIPLWKNQMAIALTLMRQRNAVSAQR

SEQ ID NO: 1794068 - protein, 17 aa, Staphylococcus epidermidis
SKIKEFKLLSTAGAYWR

SEQ ID NO: 1794069 - protein, 21 aa, Staphylococcus epidermidis
SKIQIGEKLTRGLGAGANPEI

SEQ ID NO: 1794070 - protein, 21 aa, Staphylococcus epidermidis
SKYMTELPCETCHGKRLSKEA

SEQ ID NO: 1794071 - protein, 18 aa, Staphylococcus epidermidis
SLFNYFKQLFAQVTNPPI

SEQ ID NO: 1794072 - protein, 25 aa, Staphylococcus epidermidis
SLLFEEMKHYFILNFPQRPGALREF

SEQ ID NO: 1794073 - protein, 20 aa, Staphylococcus epidermidis
SNAFDISKKLGLSLNIINKA

SEQ ID NO: 1794074 - protein, 19 aa, Staphylococcus epidermidis
SNIPYTMVGGQKFYDRKEI

SEQ ID NO: 1794075 - protein, 20 aa, Staphylococcus epidermidis
SNMYREMAKEGVFLPPSQFE

SEQ ID NO: 1794076 - protein, 17 aa, Staphylococcus epidermidis
SPIRRYPDLTVHRLIRK

SEQ ID NO: 1794077 - protein, 25 aa, Staphylococcus epidermidis
SPQLFKQLLMISGFDKYYQIVKCFR

SEQ ID NO: 1794078 - protein, 17 aa, Staphylococcus epidermidis
SQIDGKNGFLFVLSGVS

SEQ ID NO: 1794079 - protein, 18 aa, Staphylococcus epidermidis
SRIGYAYFLHPANKVLNE

SEQ ID NO: 1794080 - protein, 38 aa, Staphylococcus epidermidis
SRLAEANLRLVVSIAKRYVGRGMLFLDLIQEGNMGLIK

SEQ ID NO: 1794081 - protein, 22 aa, Staphylococcus epidermidis
SRNVGVPALVVFLNKVDMVDDE

SEQ ID NO: 1794082 - protein, 21 aa, Staphylococcus epidermidis
STEKVESVWNFINKIWNAARF

SEQ ID NO: 1794083 - protein, 20 aa, Staphylococcus epidermidis
STLHSFCLKLIQQHYDVLDI

SEQ ID NO: 1794084 - protein, 23 aa, Staphylococcus epidermidis
STLNRITSAFVRLQCNIDELHVK

SEQ ID NO: 1794085 - protein, 17 aa, Staphylococcus epidermidis
STYYRWKNKTYKNDTVT

SEQ ID NO: 1794086 - protein, 20 aa, Staphylococcus epidermidis
SVATFRLREGMPIGAKVTLR

SEQ ID NO: 1794087 - protein, 26 aa, Staphylococcus epidermidis
SVGKDLSCNVVRTWIHQHTVILGIHD

SEQ ID NO: 1794088 - protein, 17 aa, Staphylococcus epidermidis
SVGRIIVEKGIMASRAR

SEQ ID NO: 1794089 - protein, 23 aa, Staphylococcus epidermidis
SVIKSKHFEISFYLTTHSIPEAY

SEQ ID NO: 1794090 - protein, 27 aa, Staphylococcus epidermidis
SVRSYNCLKRAGINSVQELADKSEADM

SEQ ID NO: 1794091 - protein, 35 aa, Staphylococcus epidermidis
TAEVFKDSFSLEMWGGATFDVAYNFLKENPWERLE

SEQ ID NO: 1794092 - protein, 18 aa, Staphylococcus epidermidis
TAQRLAFHTLDMKEDDVV

SEQ ID NO: 1794093 - protein, 34 aa, Staphylococcus epidermidis; identical to SEQ ID NO: 1649292

SEQ ID NO: 1794094 - protein, 24 aa, Staphylococcus epidermidis
TCGDRIRLTFDIEDGIINDAKFEG

SEQ ID NO: 1794095 - protein, 25 aa, Staphylococcus epidermidis
TDVKAATQSLKWAVEEMEKRYKLFA

SEQ ID NO: 1794096 - protein, 18 aa, Staphylococcus epidermidis
TELIVAYQRVKNRVELNT

SEQ ID NO: 1794097 - protein, 21 aa, Staphylococcus epidermidis
TERILYYTGRIHKIGETHEGA

SEQ ID NO: 1794098 - protein, 22 aa, Staphylococcus epidermidis
TESEMLEAIFFGHEEIKRLVAF

SEQ ID NO: 1794099 - protein, 21 aa, Staphylococcus epidermidis
TESKMAIAMARQGGLGVIHKN

SEQ ID NO: 1794100 - protein, 25 aa, Staphylococcus epidermidis
TETVWRQATTYGVPRIVFVNKMDKL

SEQ ID NO: 1794101 - protein, 17 aa, Staphylococcus epidermidis
TEVNPLPPHYICSHCKT

SEQ ID NO: 1794102 - protein, 18 aa, Staphylococcus epidermidis
TFDKLGIPEAEQKYLAGV

SEQ ID NO: 1794103 - protein, 19 aa, Staphylococcus epidermidis
TFVPARNLLFLSFAGALAY

SEQ ID NO: 1794104 - protein, 20 aa, Staphylococcus epidermidis
TFYPMPFLSPETMWYYKSAF

SEQ ID NO: 1794105 - protein, 17 aa, Staphylococcus epidermidis
TGIGGEFDISKARYHKI

SEQ ID NO: 1794106 - protein, 17 aa, Staphylococcus epidermidis
TGLTISVDNGIWKVIDF

SEQ ID NO: 1794107 - protein, 26 aa, Staphylococcus epidermidis
THAQMKMFLTRLGFGSKMVVTGDQTQ

SEQ ID NO: 1794108 - protein, 33 aa, Staphylococcus epidermidis
TKFGGLDLLSPMKCLRIIAMFRLINPTKEIRIA

SEQ ID NO: 1794109 - protein, 21 aa, Staphylococcus epidermidis
TKLKNGRKFLSKGDKCKVSIR

SEQ ID NO: 1794110 - protein, 19 aa, Staphylococcus epidermidis
TKTEYDLLYVLAENRNHVM

SEQ ID NO: 1794111 - protein, 19 aa, Staphylococcus epidermidis
TLHYTPRAKKVIELSMDEA

SEQ ID NO: 1794112 - protein, 19 aa, Staphylococcus epidermidis
TLNVPFAIADATSLTEAGY

SEQ ID NO: 1794113 - protein, 29 aa, Staphylococcus epidermidis
TLYMRIAIELHLKRLIVGGLEKVYEIGRV

SEQ ID NO: 1794114 - protein, 20 aa, Staphylococcus epidermidis
TMARGYRREEVDAFLDDIIT

SEQ ID NO: 1794115 - protein, 17 aa, Staphylococcus epidermidis
TMASITFQNYFRMYNKL

SEQ ID NO: 1794116 - protein, 25 aa, Staphylococcus epidermidis
TNKAEKCTFCFPRIEAGMPTVCSET

SEQ ID NO: 1794117 - protein, 22 aa, Staphylococcus epidermidis
TPDLTCLGKVIGGGLPVGAFGG

SEQ ID NO: 1794118 - protein, 22 aa, Staphylococcus epidermidis
TPHTKFKAEVYVLSKDEGGRHT

SEQ ID NO: 1794119 - protein, 20 aa, Staphylococcus epidermidis
TPLSLGIEIMGGRMNTLIER

SEQ ID NO: 1794120 - protein, 22 aa, Staphylococcus epidermidis
TPVFFGSALANFGVQNFLNAYV

SEQ ID NO: 1794121 - protein, 17 aa, Staphylococcus epidermidis
TQFPGIGKKTARQIVLD

SEQ ID NO: 1794122 - protein, 23 aa, Staphylococcus epidermidis
TRAIKRLEVVESFRNSGNNPSWM

SEQ ID NO: 1794123 - protein, 25 aa, Staphylococcus epidermidis
TRESDGFKDIRDVLGQVYETAEELD

SEQ ID NO: 1794124 - protein, 19 aa, Staphylococcus epidermidis
TRLEHGISYTEFTYTILQA

SEQ ID NO: 1794125 - protein, 24 aa, Staphylococcus epidermidis
TRLLAGLLSGLGIESVLSGDVSIG

SEQ ID NO: 1794126 - protein, 20 aa, Staphylococcus epidermidis
TRPLSATKRFRLVEIVEESV

SEQ ID NO: 1794127 - protein, 29 aa, Staphylococcus epidermidis
TSEKNAMGWYLDGRVSAVVGTHTHIQTSD

SEQ ID NO: 1794128 - protein, 25 aa, Staphylococcus epidermidis
TSETRPVLTGVNWLIQDNELICTAT

SEQ ID NO: 1794129 - protein, 17 aa, Staphylococcus epidermidis
TSLLFNIIPERFQGREV

SEQ ID NO: 1794130 - protein, 18 aa, Staphylococcus epidermidis
TVTLKTLGLIIVMAQSGL

SEQ ID NO: 1794131 - protein, 18 aa, Staphylococcus epidermidis
TYGTGGFMLMNTGEEAVK

SEQ ID NO: 1794132 - protein, 17 aa, Staphylococcus epidermidis
TYLNALAGRGVHVITVN

SEQ ID NO: 1794133 - protein, 19 aa, Staphylococcus epidermidis
VAIEPPTFVVFVNDVELMH

SEQ ID NO: 1794134 - protein, 21 aa, Staphylococcus epidermidis
VALQLGDDVVRTIAMDSTDGV

SEQ ID NO: 1794135 - protein, 17 aa, Staphylococcus epidermidis
VALRLVIDRENEIRNFK

SEQ ID NO: 1794136 - protein, 20 aa, Staphylococcus epidermidis
VAVNWCPALGTVLSNEEVVD

SEQ ID NO: 1794137 - protein, 17 aa, Staphylococcus epidermidis
VDFKGNNAITFLLQNIQ

SEQ ID NO: 1794138 - protein, 17 aa, Staphylococcus epidermidis
VDGLDCFVGEVGLTGEV

SEQ ID NO: 1794139 - protein, 22 aa, Staphylococcus epidermidis
VDKKLSHMRIHSINIKEFETNC

SEQ ID NO: 1794140 - protein, 20 aa, Staphylococcus epidermidis
VDRYLLNRLREFTASTINNY

SEQ ID NO: 1794141 - protein, 19 aa, Staphylococcus epidermidis
VDWGKTRIYNMIRDRGEWV

SEQ ID NO: 1794142 - protein, 19 aa, Staphylococcus epidermidis
VDYFFKTKEEFEALIKDDQ

SEQ ID NO: 1794143 - protein, 17 aa, Staphylococcus epidermidis
VEDVFSITGRGTVATGR

SEQ ID NO: 1794144 - protein, 19 aa, Staphylococcus epidermidis
VEGDLRREQNLNIKRLMEI

SEQ ID NO: 1794145 - protein, 18 aa, Staphylococcus epidermidis
VEGLYPYHIYTYIINELM

SEQ ID NO: 1794146 - protein, 26 aa, Staphylococcus epidermidis
VERARRIQFFLSQNFHVAEQFTGQKG

SEQ ID NO: 1794147 - protein, 18 aa, Staphylococcus epidermidis
VESVICAPTIQLDALVTA

SEQ ID NO: 1794148 - protein, 19 aa, Staphylococcus epidermidis
VGAEVKDGDILVGKVTPKG

SEQ ID NO: 1794149 - protein, 24 aa, Staphylococcus epidermidis
VGAGLPLWLPNGATIRREIERYIV

SEQ ID NO: 1794150 - protein, 27 aa, Staphylococcus epidermidis
VGCRIGCTFCASTLGGLKRNLEAGEIV

SEQ ID NO: 1794151 - protein, 22 aa, Staphylococcus epidermidis
VGEKGDVALFFGLSGTGKTTLS

SEQ ID NO: 1794152 - protein, 18 aa, Staphylococcus epidermidis
VGGMYEFGLSRYFTAMLA

SEQ ID NO: 1794153 - protein, 18 aa, Staphylococcus epidermidis
VGHKKAREIWYLCRQYNA

SEQ ID NO: 1794154 - protein, 25 aa, Staphylococcus epidermidis
VGMSEKLDGLELFHPERMASRILGM

SEQ ID NO: 1794155 - protein, 20 aa, Staphylococcus epidermidis
VGPNCPGVITADECKIGIMP

SEQ ID NO: 1794156 - protein, 17 aa, Staphylococcus epidermidis
VGYYLRYALSYRDISEI

SEQ ID NO: 1794157 - protein, 22 aa, Staphylococcus epidermidis
VHNRRDLGGLIFVDLRDREGIV

SEQ ID NO: 1794158 - protein, 33 aa, Staphylococcus epidermidis
VHSRFSTNTFPSWKRAHPNRMLMHNGEINTIKG

SEQ ID NO: 1794159 - protein, 24 aa, Staphylococcus epidermidis
VIGPGNRFPHAASLAVAEAPAEAY

SEQ ID NO: 1794160 - protein, 20 aa, Staphylococcus epidermidis
VIYGDVKWTAPLTVKETVYA

SEQ ID NO: 1794161 - protein, 18 aa, Staphylococcus epidermidis
VKDALTVLVNAVKKKRQE

SEQ ID NO: 1794162 - protein, 19 aa, Staphylococcus epidermidis
VKMALWYTEMKRNLKRFKE

SEQ ID NO: 1794163 - protein, 30 aa, Staphylococcus epidermidis
VKNKVAPPFRVAEVDIMYGQGISKEGELID

SEQ ID NO: 1794164 - protein, 25 aa, Staphylococcus epidermidis
VLDKIMKMLHPFMPFVTETIWQSLP

SEQ ID NO: 1794165 - protein, 18 aa, Staphylococcus epidermidis
VLGICYGMQLTTKLLGGK

SEQ ID NO: 1794166 - protein, 28 aa, Staphylococcus epidermidis
VLHLLYARFWHKVLYDLGVVPTKEPFQK

SEQ ID NO: 1794167 - protein, 20 aa, Staphylococcus epidermidis
VLRLRFGLDDGRTRTLEEVG

SEQ ID NO: 1794168 - protein, 24 aa, Staphylococcus epidermidis
VLTEFKEWVGDAIFVAHNASFDMG

SEQ ID NO: 1794169 - protein, 28 aa, Staphylococcus epidermidis
VNAKGRLPDCLVEWSAKRLKEQGANAVK

SEQ ID NO: 1794170 - protein, 18 aa, Staphylococcus epidermidis
VPAARVGHIGLYRDPETL

SEQ ID NO: 1794171 - protein, 17 aa, Staphylococcus epidermidis
VPAGGALAVDRHDFAGY

SEQ ID NO: 1794172 - protein, 18 aa, Staphylococcus epidermidis
VPKGKVTIIGGGQAGTNA

SEQ ID NO: 1794173 - protein, 24 aa, Staphylococcus epidermidis
VQKRKIHVGDKMCGRHGNKGVISK

SEQ ID NO: 1794174 - protein, 26 aa, Staphylococcus epidermidis
VQNIEVLRFANAMFEPLWNNKYISNI

SEQ ID NO: 1794175 - protein, 23 aa, Staphylococcus epidermidis
VQNLLIPLTFHFSKDEQMIIDQY

SEQ ID NO: 1794176 - protein, 24 aa, Staphylococcus epidermidis
VRAKEGITDGLIRLSIGIEDTEDL

SEQ ID NO: 1794177 - protein, 19 aa, Staphylococcus epidermidis
VRDGLKPVQRRILFAMYSS

SEQ ID NO: 1794178 - protein, 24 aa, Staphylococcus epidermidis
VRGVPLRLVDTAGIRDTEDIVEKI

SEQ ID NO: 1794179 - protein, 17 aa, Staphylococcus epidermidis
VRLEVRRAEQLKQGQDI

SEQ ID NO: 1794180 - protein, 21 aa, Staphylococcus epidermidis
VRQHPGEVCPAKWEEGSESLQ

SEQ ID NO: 1794181 - protein, 18 aa, Staphylococcus epidermidis
VRRGNWSLQQLVDYFTIK

SEQ ID NO: 1794182 - protein, 23 aa, Staphylococcus epidermidis
VRSGAKISMPGMMDTILNLGLND

SEQ ID NO: 1794183 - protein, 22 aa, Staphylococcus epidermidis
VSALSRPLIAKKLVEIAEKTNS

SEQ ID NO: 1794184 - protein, 17 aa, Staphylococcus epidermidis
VSDGLMVARGDMGVEIP

SEQ ID NO: 1794185 - protein, 22 aa, Staphylococcus epidermidis
VSEVPANVAGVFTTNKVIAAPL

SEQ ID NO: 1794186 - protein, 26 aa, Staphylococcus epidermidis
VTIPPWNFPFAIMAGTTLAPVVAGNT

SEQ ID NO: 1794187 - protein, 22 aa, Staphylococcus epidermidis
VTLDCHPEVNILIGENAQGKTN

SEQ ID NO: 1794188 - protein, 19 aa, Staphylococcus epidermidis
VTMGEEFMFNGKHVLIVYD

SEQ ID NO: 1794189 - protein, 21 aa, Staphylococcus epidermidis
VTQLLQLRQKYFISVTTMKDN

SEQ ID NO: 1794190 - protein, 18 aa, Staphylococcus epidermidis
VTSPQAFEGLRIQNRKLR

SEQ ID NO: 1794191 - protein, 18 aa, Staphylococcus epidermidis
VVDISNYVLLEYGQPLHM

SEQ ID NO: 1794192 - protein, 17 aa, Staphylococcus epidermidis
VVKHHQLNIHPFEEVLT

SEQ ID NO: 1794193 - protein, 17 aa, Staphylococcus epidermidis
VVLRHSRRVSGITDLSI

SEQ ID NO: 1794194 - protein, 17 aa, Staphylococcus epidermidis
VVMLTSFIEDKEVYRAL

SEQ ID NO: 1794195 - protein, 17 aa, Staphylococcus epidermidis
WALEAYGAAYTLQEILT

SEQ ID NO: 1794196 - protein, 30 aa, Staphylococcus epidermidis
WAVEEMEKRYKLFAQYHVRNITAFNKKAPY

SEQ ID NO: 1794197 - protein, 17 aa, Staphylococcus epidermidis
WKKSRRLGISLSGTGKE

SEQ ID NO: 1794198 - protein, 27 aa, Staphylococcus epidermidis
WLGTMGCGLPGAMAAKIAYPNRQAVAI

SEQ ID NO: 1794199 - protein, 25 aa, Staphylococcus epidermidis
WQGPPRLQNGTSWFYFATDQWKYEE

SEQ ID NO: 1794200 - protein, 21 aa, Staphylococcus epidermidis
WSRIPHFYMNYYVYQYATGYS

SEQ ID NO: 1794201 - protein, 34 aa, Staphylococcus epidermidis
WYLDSCRKIKYMFPKAHAAAYVLMAVRIAYFKVH

SEQ ID NO: 1794202 - protein, 20 aa, Staphylococcus epidermidis
YAIGMGHTIHALRRNMNMTY

SEQ ID NO: 1794203 - protein, 19 aa, Staphylococcus epidermidis
YDLLYVLAENRNHVMQREQ

SEQ ID NO: 1794204 - protein, 20 aa, Staphylococcus epidermidis
YEYSPLRVKYPYIRGKLLDL

SEQ ID NO: 1794205 - protein, 23 aa, Staphylococcus epidermidis
YGCDKFCTYCIVPFTRGKERSRR

SEQ ID NO: 1794206 - protein, 17 aa, Staphylococcus epidermidis
YGLTLMISLAKREGQGC

SEQ ID NO: 1794207 - protein, 18 aa, Staphylococcus epidermidis
YHGLCEEILEIGNRRDDR

SEQ ID NO: 1794208 - protein, 17 aa, Staphylococcus epidermidis
YHLEGFVAKPEHSRSNK

SEQ ID NO: 1794209 - protein, 30 aa, Staphylococcus epidermidis
YHMPTHCPSCGHELVRIEGEVALRCINPKC

SEQ ID NO: 1794210 - protein, 19 aa, Staphylococcus epidermidis
YIDSVQYFRIVNLMKKKRS

SEQ ID NO: 1794211 - protein, 20 aa, Staphylococcus epidermidis
YKKSARIVGDVMGKYHPHGD

SEQ ID NO: 1794212 - protein, 22 aa, Staphylococcus epidermidis
YKLMFNTLRAMYSKHPIRVDIA

SEQ ID NO: 1794213 - protein, 26 aa, Staphylococcus epidermidis
YKRVRYKGMVCDRCGVEVTKSKVRRE

SEQ ID NO: 1794214 - protein, 19 aa, Staphylococcus epidermidis
YLKEIGRVNLLSAQEEIEL

SEQ ID NO: 1794215 - protein, 17 aa, Staphylococcus epidermidis
YLNRGCTAAVVGYHPFG

SEQ ID NO: 1794216 - protein, 25 aa, Staphylococcus epidermidis
YLPEALFNFITLLGWSPEGEEEIFS

SEQ ID NO: 1794217 - protein, 30 aa, Staphylococcus epidermidis
YNQYMGPYAMHWHMINYCFDNGYDRYNFYG

SEQ ID NO: 1794218 - protein, 25 aa, Staphylococcus epidermidis
YPVYEMRWDIGYVLQQIALFPHMTI

SEQ ID NO: 1794219 - protein, 25 aa, Staphylococcus epidermidis
YQRSADIFLGVPFNIASYALLTHLV

SEQ ID NO: 1794220 - protein, 22 aa, Staphylococcus epidermidis
YSTQNLDLWYGENHALQNINLD

SEQ ID NO: 1794221 - protein, 25 aa, Staphylococcus epidermidis
YVFISWTGKMAETFVLAHELGHAGH

SEQ ID NO: 1794222 - protein, 24 aa, Staphylococcus epidermidis
YVKEVTGLPAERVIGSGTVLDSAR

SEQ ID NO: 1794223 - protein, 27 aa, Staphylococcus epidermidis
YVLMAVRIAYFKVHHPLYYYAAYFTIR

SEQ ID NO: 1794224 - protein, 19 aa, Staphylococcus epidermidis
YYSVRIEDFSAKKRTKSIA

SEQ ID NO: 1794225 - protein, 17 aa, Staphylococcus epidermidis
AAFHKFYNAEKVLTDDT

SEQ ID NO: 1794226 - protein, 27 aa, Staphylococcus epidermidis
AAGAHGEWTALMIFKAYHEKNGQSHRD

SEQ ID NO: 1794227 - protein, 24 aa, Staphylococcus epidermidis
AAGDTFRAGAIQQLNVWGERVGVE

SEQ ID NO: 1794228 - protein, 22 aa, Staphylococcus epidermidis
AALHSRCPEAMVIDINDTKMLT

SEQ ID NO: 1794229 - protein, 27 aa, Staphylococcus epidermidis
AATGLRPIAELMFNDFIGFGLDPILNQ

SEQ ID NO: 1794230 - protein, 27 aa, Staphylococcus epidermidis
ACLIANDLAKHCDFFSFGTNDLTQLTF

SEQ ID NO: 1794231 - protein, 21 aa, Staphylococcus epidermidis
ACLTGDIFHSQRCDCGAQLEA

SEQ ID NO: 1794232 - protein, 26 aa, Staphylococcus epidermidis
ACVSESIHLLPFNVFFVPARGGLGEN

SEQ ID NO: 1794233 - protein, 23 aa, Staphylococcus epidermidis
ADDFKRYYPTNALVTGYDIIFFW

SEQ ID NO: 1794234 - protein, 18 aa, Staphylococcus epidermidis
ADGVFIYIGMKPLTAPFK

SEQ ID NO: 1794235 - protein, 17 aa, Staphylococcus epidermidis
ADIRGLKIWMFGVDEGD

SEQ ID NO: 1794236 - protein, 26 aa, Staphylococcus epidermidis
ADKILIGGGMAYTFIKAQGKEIGLSL

SEQ ID NO: 1794237 - protein, 24 aa, Staphylococcus epidermidis
ADLIKRIDTHLSIDFMDVSSYHGG

SEQ ID NO: 1794238 - protein, 20 aa, Staphylococcus epidermidis
ADLLLWFLRPEMKELNQIEN

SEQ ID NO: 1794239 - protein, 20 aa, Staphylococcus epidermidis
ADLMIDLGLIEDVDHIAARL

SEQ ID NO: 1794240 - protein, 26 aa, Staphylococcus epidermidis
ADNGIKFFGSDGFKLSDDQENEIEQL

SEQ ID NO: 1794241 - protein, 21 aa, Staphylococcus epidermidis
ADPAIDIGMLLYNYVPQNKWS

SEQ ID NO: 1794242 - protein, 23 aa, Staphylococcus epidermidis
ADQAICIGEANPLDSYLNIDRII

SEQ ID NO: 1794243 - protein, 24 aa, Staphylococcus epidermidis
ADTKKLTGWYSRRIAVGENGQIKG

SEQ ID NO: 1794244 - protein, 24 aa, Staphylococcus epidermidis
ADVNFKVVKEFVKTVSERALGSDV

SEQ ID NO: 1794245 - protein, 25 aa, Staphylococcus epidermidis
AEADVWLRENPLEFEWGGTSMIEDK

SEQ ID NO: 1794246 - protein, 20 aa, Staphylococcus epidermidis
AEDAFYLTMEAFNLAEEYQC

SEQ ID NO: 1794247 - protein, 22 aa, Staphylococcus epidermidis
AEELVHLSIKFKKRTTSYEIEH

SEQ ID NO: 1794248 - protein, 20 aa, Staphylococcus epidermidis
AEGDMNWRKVIGDFYNSFKQ

SEQ ID NO: 1794249 - protein, 21 aa, Staphylococcus epidermidis
AEGIVPKLVWTKRIETGEVVT

SEQ ID NO: 1794250 - protein, 30 aa, Staphylococcus epidermidis
AEGPGSYTGLRIGVTVAKTLAYALNTNLYG

SEQ ID NO: 1794251 - protein, 26 aa, Staphylococcus epidermidis
AEHFNKLEVPFIYRVHEQPKSDRLRQ

SEQ ID NO: 1794252 - protein, 17 aa, Staphylococcus epidermidis
AEIGHPVIGDPLYGTST

SEQ ID NO: 1794253 - protein, 21 aa, Staphylococcus epidermidis
AEILDWFDAIGRRRGLLQKGN

SEQ ID NO: 1794254 - protein, 19 aa, Staphylococcus epidermidis
AEIQIRTLAMNFWATIEHT

SEQ ID NO: 1794255 - protein, 19 aa, Staphylococcus epidermidis
AEISKRFSSIQDYILEYCN

SEQ ID NO: 1794256 - protein, 22 aa, Staphylococcus epidermidis
AEKEASHFIIGYRFSPEEIEEP

SEQ ID NO: 1794257 - protein, 25 aa, Staphylococcus epidermidis
AEKLSDRALGYGMHGIQVDGNDPIA

SEQ ID NO: 1794258 - protein, 24 aa, Staphylococcus epidermidis
AEKYLKDHKQMLLVTNNLYQADKI

SEQ ID NO: 1794259 - protein, 27 aa, Staphylococcus epidermidis
AEQSYRLTIPNIKFKSNLKEIYGMISQ

SEQ ID NO: 1794260 - protein, 25 aa, Staphylococcus epidermidis
AERKRAIIAPLYFKPQPEDFELTLF

SEQ ID NO: 1794261 - protein, 19 aa, Staphylococcus epidermidis
AETDYKLKSSYMDKQLILE

SEQ ID NO: 1794262 - protein, 17 aa, Staphylococcus epidermidis
AEYRVCKTNEGLLNIKR

SEQ ID NO: 1794263 - protein, 25 aa, Staphylococcus epidermidis
AFAQFFKLMLNQGINLAPSKFEAWF

SEQ ID NO: 1794264 - protein, 25 aa, Staphylococcus epidermidis
AFDKYPIEAVFGFHVNPFEKEGKIV

SEQ ID NO: 1794265 - protein, 19 aa, Staphylococcus epidermidis
AFVHRNHRNERWFEVSKKL

SEQ ID NO: 1794266 - protein, 25 aa, Staphylococcus epidermidis
AFYRPKAVIYDLDFLETLPYSEILS

SEQ ID NO: 1794267 - protein, 21 aa, Staphylococcus epidermidis
AGALQRPTSGNIYINNKNISI

SEQ ID NO: 1794268 - protein, 17 aa, Staphylococcus epidermidis
AGALSVSALEQYKKQIE

SEQ ID NO: 1794269 - protein, 18 aa, Staphylococcus epidermidis
AGASKIFVFDLSEERLAK

SEQ ID NO: 1794270 - protein, 17 aa, Staphylococcus epidermidis
AGDRFYMRLNDNYSSYF

SEQ ID NO: 1794271 - protein, 21 aa, Staphylococcus epidermidis
AGGCFWCMTKPFDTFDGIEKV

SEQ ID NO: 1794272 - protein, 19 aa, Staphylococcus epidermidis
AGIKFPDDNLLGIDYVIPD

SEQ ID NO: 1794273 - protein, 17 aa, Staphylococcus epidermidis
AGINHWFNSDTIYRSIL

SEQ ID NO: 1794274 - protein, 26 aa, Staphylococcus epidermidis
AGIVPWNAPILVLMRKVIPAIVTGCS

SEQ ID NO: 1794275 - protein, 19 aa, Staphylococcus epidermidis
AGLFLLKFLASLNLNKSAK

SEQ ID NO: 1794276 - protein, 19 aa, Staphylococcus epidermidis
AGLLKPKAAYELIGELREA

SEQ ID NO: 1794277 - protein, 30 aa, Staphylococcus epidermidis
AGLSLGGAFALKLSLNRDVKGIITMCAPME

SEQ ID NO: 1794278 - protein, 19 aa, Staphylococcus epidermidis
AGNMLKPMLARGELHCIGA

SEQ ID NO: 1794279 - protein, 23 aa, Staphylococcus epidermidis
AGNVLRFQPPLVITYKQLDKALD

SEQ ID NO: 1794280 - protein, 26 aa, Staphylococcus epidermidis
AGRARRGELVSCFLLEVDDSLNSINF

SEQ ID NO: 1794281 - protein, 17 aa, Staphylococcus epidermidis
AHCISKWGHDFRPSYQS

SEQ ID NO: 1794282 - protein, 26 aa, Staphylococcus epidermidis
AHGRERSGVCSVQFAERIQEGDTIPI

SEQ ID NO: 1794283 - protein, 24 aa, Staphylococcus epidermidis
AIAAKAQDGASCVTYIGPNGAGHY

SEQ ID NO: 1794284 - protein, 19 aa, Staphylococcus epidermidis
AIECVKVGGRISVITFHSL

SEQ ID NO: 1794285 - protein, 32 aa, Staphylococcus epidermidis
AIERASEVVGSWRLEECTLYVTLEPCVMCAGT

SEQ ID NO: 1794286 - protein, 24 aa, Staphylococcus epidermidis
AILKSEGNMNIFIIEYDDKAEDIK

SEQ ID NO: 1794287 - protein, 18 aa, Staphylococcus epidermidis
AINKILIQDGIKKQQIND

SEQ ID NO: 1794288 - protein, 17 aa, Staphylococcus epidermidis
AINPELDAQGLAEIAVE

SEQ ID NO: 1794289 - protein, 17 aa, Staphylococcus epidermidis
AIRIFRAAAELNISTVA

SEQ ID NO: 1794290 - protein, 24 aa, Staphylococcus epidermidis
AISEGRPKLMGLREIIESYLNHQI

SEQ ID NO: 1794291 - protein, 28 aa, Staphylococcus epidermidis
AKAGVDVFRIFDSLNWVDQMKVANEAVQ

SEQ ID NO: 1794292 - protein, 18 aa, Staphylococcus epidermidis
AKDFVEFNERYLFESHFG

SEQ ID NO: 1794293 - protein, 26 aa, Staphylococcus epidermidis
AKDGLKGAHIHLDFPSVGATQNIIMA

SEQ ID NO: 1794294 - protein, 20 aa, Staphylococcus epidermidis
AKDLKVSLITTKRAYEDLEK

SEQ ID NO: 1794295 - protein, 17 aa, Staphylococcus epidermidis
AKEGSLFVASKGYTVDS

SEQ ID NO: 1794296 - protein, 25 aa, Staphylococcus epidermidis
AKELEREGFHILAIKDMAGLLKPKA

SEQ ID NO: 1794297 - protein, 19 aa, Staphylococcus epidermidis
AKELLPEGFSHPGSPNGEF

SEQ ID NO: 1794298 - protein, 19 aa, Staphylococcus epidermidis
AKGVESFAIQANVAKGDEV

SEQ ID NO: 1794299 - protein, 23 aa, Staphylococcus epidermidis
AKIEEVFKTLVLENSNHEHYVFV

SEQ ID NO: 1794300 - protein, 24 aa, Staphylococcus epidermidis
AKKADTAPKRFIREFRNVNVDEYE

SEQ ID NO: 1794301 - protein, 19 aa, Staphylococcus epidermidis
AKKVMAFEIDQRLIPVLKD

SEQ ID NO: 1794302 - protein, 26 aa, Staphylococcus epidermidis
AKLAAQRGLPFVIARMGQSETDLHEA

SEQ ID NO: 1794303 - protein, 26 aa, Staphylococcus epidermidis
AKLYFEGVSVFDMLDIVENITLESVN

SEQ ID NO: 1794304 - protein, 24 aa, Staphylococcus epidermidis
AKMLNTLTIFRVFIIDSQALTRSI

SEQ ID NO: 1794305 - protein, 26 aa, Staphylococcus epidermidis
AKQRALEILNLVGLPRAEKRFKAYPH

SEQ ID NO: 1794306 - protein, 17 aa, Staphylococcus epidermidis
AKRWIRYIHEVEEPDFL

SEQ ID NO: 1794307 - protein, 21 aa, Staphylococcus epidermidis
AKSEIWRQMMADIFDTDLIVP

SEQ ID NO: 1794308 - protein, 26 aa, Staphylococcus epidermidis
AKVDLSLNVRRVFFSTFDRSELNESY

SEQ ID NO: 1794309 - protein, 17 aa, Staphylococcus epidermidis
AKVEFSFIDVTARHIIK

SEQ ID NO: 1794310 - protein, 24 aa, Staphylococcus epidermidis
AKVLDRLGAKLVFTYRKERSRKEL

SEQ ID NO: 1794311 - protein, 20 aa, Staphylococcus epidermidis
AKVRFECKLHQIVQLGNKDN

SEQ ID NO: 1794312 - protein, 22 aa, Staphylococcus epidermidis
AKVTTLCPCSKEISEYSAHNQR

SEQ ID NO: 1794313 - protein, 17 aa, Staphylococcus epidermidis
ALDSFQFEEQRGDDLVV

SEQ ID NO: 1794314 - protein, 20 aa, Staphylococcus epidermidis
ALELIVLLIIKKEDQYGYSL

SEQ ID NO: 1794315 - protein, 17 aa, Staphylococcus epidermidis
ALENAGFETEVIGDTAN

SEQ ID NO: 1794316 - protein, 20 aa, Staphylococcus epidermidis
ALESEDFILPGYRDVPQIIW

SEQ ID NO: 1794317 - protein, 27 aa, Staphylococcus epidermidis
ALETLRRYCFDRAFIGMNGIDVKYGLT

SEQ ID NO: 1794318 - protein, 20 aa, Staphylococcus epidermidis
ALFPDFTHLYLVVDAENQSA

SEQ ID NO: 1794319 - protein, 22 aa, Staphylococcus epidermidis
ALGERALRYIIPDTQDFPYTIR

SEQ ID NO: 1794320 - protein, 17 aa, Staphylococcus epidermidis
ALKKYPALNTSFNEEAG

SEQ ID NO: 1794321 - protein, 25 aa, Staphylococcus epidermidis
ALLAKGRLTGVQFLELFTDDLYFDI

SEQ ID NO: 1794322 - protein, 18 aa, Staphylococcus epidermidis
ALLERALMNYMLTKHTTQ

SEQ ID NO: 1794323 - protein, 19 aa, Staphylococcus epidermidis
ALMGKYRISGVPIVDNQED

SEQ ID NO: 1794324 - protein, 18 aa, Staphylococcus epidermidis
ALMGLELIENKPLLDEII

SEQ ID NO: 1794325 - protein, 18 aa, Staphylococcus epidermidis
ALNATSYCVEVKDPLNRN

SEQ ID NO: 1794326 - protein, 23 aa, Staphylococcus epidermidis
ALVKALQTWNIDHLYGIPGDSVD

SEQ ID NO: 1794327 - protein, 18 aa, Staphylococcus epidermidis
AMIADPAIDIGMLLYNYV

SEQ ID NO: 1794328 - protein, 33 aa, Staphylococcus epidermidis
AMIQFKLEMPIIKRRPSFEMEERLVLEKIDYDN

SEQ ID NO: 1794329 - protein, 28 aa, Staphylococcus epidermidis
AMKILKEKNIRFVVGGMYEFGLSRYFTA

SEQ ID NO: 1794330 - protein, 24 aa, Staphylococcus epidermidis
AMNLDYELGLLISKKKYWHKLPNF

SEQ ID NO: 1794331 - protein, 19 aa, Staphylococcus epidermidis
AMSPKDLKLIESIPQMMEL

SEQ ID NO: 1794332 - protein, 19 aa, Staphylococcus epidermidis
AMTNAICHRCEGYSNEYDV

SEQ ID NO: 1794333 - protein, 18 aa, Staphylococcus epidermidis
ANDLLQMMVKTMEDRLNE

SEQ ID NO: 1794334 - protein, 22 aa, Staphylococcus epidermidis
ANEVKLPVILYNVPSRTNMTIE

SEQ ID NO: 1794335 - protein, 22 aa, Staphylococcus epidermidis
ANGKADISFEEFLDKAALSSSE

SEQ ID NO: 1794336 - protein, 20 aa, Staphylococcus epidermidis
ANKRGIPFDCLHEEMYDIAG

SEQ ID NO: 1794337 - protein, 20 aa, Staphylococcus epidermidis
ANLLSGLGIEPDLHDKNMSE

SEQ ID NO: 1794338 - protein, 23 aa, Staphylococcus epidermidis
APAKGDVKTIVFNTNHDTLDGSE

SEQ ID NO: 1794339 - protein, 21 aa, Staphylococcus epidermidis
APCSGLGVLRHKPEIKYSQSQ

SEQ ID NO: 1794340 - protein, 24 aa, Staphylococcus epidermidis
APINVPRLLQNVSHTQWQGIPDET

SEQ ID NO: 1794341 - protein, 19 aa, Staphylococcus epidermidis
APLRVKVRLIIKETGEVKE

SEQ ID NO: 1794342 - protein, 18 aa, Staphylococcus epidermidis
APVIWRGPMLGKMLTNFF

SEQ ID NO: 1794343 - protein, 24 aa, Staphylococcus epidermidis
AQAILDMRLRRLTGLERDKIESEY

SEQ ID NO: 1794344 - protein, 19 aa, Staphylococcus epidermidis
AQERIKYEYFREKIGEVTN

SEQ ID NO: 1794345 - protein, 18 aa, Staphylococcus epidermidis
AQHALDLLGLSTLSLLDT

SEQ ID NO: 1794346 - protein, 25 aa, Staphylococcus epidermidis
AQNDFLYDRVEVVIATNAFGMGIDK

SEQ ID NO: 1794347 - protein, 34 aa, Staphylococcus epidermidis
AQPEIFRPQLRALLRASVYGKLNIMFPMVATIKE

SEQ ID NO: 1794348 - protein, 27 aa, Staphylococcus epidermidis
AQTMKRVAIHFTKLILCNNSNQCELKV

SEQ ID NO: 1794349 - protein, 20 aa, Staphylococcus epidermidis
AQYSFLQLMNYMFKQEPYRY

SEQ ID NO: 1794350 - protein, 19 aa, Staphylococcus epidermidis
ARDRAHILEGLRIALDHID

SEQ ID NO: 1794351 - protein, 24 aa, Staphylococcus epidermidis
ARDTLRLEAGLPLHGQDLSESITP

SEQ ID NO: 1794352 - protein, 25 aa, Staphylococcus epidermidis
ARHHTFFEMLGNFSIGDYFKHEAIE

SEQ ID NO: 1794353 - protein, 24 aa, Staphylococcus epidermidis
ARKKWGEDQVHQWRRSYDVRPPRE

SEQ ID NO: 1794354 - protein, 19 aa, Staphylococcus epidermidis
ARKLSDMKQPVWIRHVLVP

SEQ ID NO: 1794355 - protein, 18 aa, Staphylococcus epidermidis
ARLGHAIVALPGGCAIGT

SEQ ID NO: 1794356 - protein, 27 aa, Staphylococcus epidermidis
ARNLLFLSFAGALAYQIHAKHIITGVC

SEQ ID NO: 1794357 - protein, 18 aa, Staphylococcus epidermidis
ARTPLIISGEAEKSTSLY

SEQ ID NO: 1794358 - protein, 19 aa, Staphylococcus epidermidis
ASDGVGLGHQFLRHVERTK

SEQ ID NO: 1794359 - protein, 18 aa, Staphylococcus epidermidis
ASESAGWIKELTAGGHAT

SEQ ID NO: 1794360 - protein, 26 aa, Staphylococcus epidermidis
ASEVPACNEVQCGWAASHSLEGAKTI

SEQ ID NO: 1794361 - protein, 24 aa, Staphylococcus epidermidis
ASGIPDFRSMGGLYDEISKDGQSP

SEQ ID NO: 1794362 - protein, 18 aa, Staphylococcus epidermidis
ASIAHIRLRVKINDNYVF

SEQ ID NO: 1794363 - protein, 21 aa, Staphylococcus epidermidis
ASKAFTCIQMVKLIDEENLQL

SEQ ID NO: 1794364 - protein, 20 aa, Staphylococcus epidermidis
ASNIINCSRINLANHAYDKE

SEQ ID NO: 1794365 - protein, 24 aa, Staphylococcus epidermidis
ASNRHKVKCIIFAPEGFAEEKISI

SEQ ID NO: 1794366 - protein, 20 aa, Staphylococcus epidermidis
ASQQKISMVTAYDYPSAKQA

SEQ ID NO: 1794367 - protein, 24 aa, Staphylococcus epidermidis
ATAIRIGNPASWQKAVNALDESNG

SEQ ID NO: 1794368 - protein, 17 aa, Staphylococcus epidermidis
ATAKCFTNDLSMSSDYY

SEQ ID NO: 1794369 - protein, 18 aa, Staphylococcus epidermidis
ATEARIQEELDYFEKLVD

SEQ ID NO: 1794370 - protein, 24 aa, Staphylococcus epidermidis
ATEHSVAMLLAMARNIPQAHQSLR

SEQ ID NO: 1794371 - protein, 18 aa, Staphylococcus epidermidis
ATGCHYHVCHVSTKESVR

SEQ ID NO: 1794372 - protein, 22 aa, Staphylococcus epidermidis
ATGGRLDHFMGVLQILQKPQYL

SEQ ID NO: 1794373 - protein, 25 aa, Staphylococcus epidermidis
ATGIDHNRLSLLMAVLEKKENYLLQ

SEQ ID NO: 1794374 - protein, 18 aa, Staphylococcus epidermidis
ATGIRIGFLLGPEYLIEK

SEQ ID NO: 1794375 - protein, 18 aa, Staphylococcus epidermidis
ATHKEGVMHPVEIIETMQ

SEQ ID NO: 1794376 - protein, 35 aa, Staphylococcus epidermidis
ATIEAIEIAMEFRKEFHKDVVIDLVGYRRYGHNEM

SEQ ID NO: 1794377 - protein, 34 aa, Staphylococcus epidermidis
ATILYKMYKERGFEIKPEIAGLMISAIISDSLLF

SEQ ID NO: 1794378 - protein, 18 aa, Staphylococcus epidermidis
ATISMGYIGLYEAATLFY

SEQ ID NO: 1794379 - protein, 26 aa, Staphylococcus epidermidis
ATPIKLGQEISGWRYMLEKCEQLLSE

SEQ ID NO: 1794380 - protein, 17 aa, Staphylococcus epidermidis
ATSPIHLEHKLKMTQDE

SEQ ID NO: 1794381 - protein, 17 aa, Staphylococcus epidermidis
AVDLKVILEYGESAPKI

SEQ ID NO: 1794382 - protein, 20 aa, Staphylococcus epidermidis
AVDNGDGVLLVIKNYAGDVM

SEQ ID NO: 1794383 - protein, 24 aa, Staphylococcus epidermidis
AVDRELPYHLAIKQLKQLDENFGV

SEQ ID NO: 1794384 - protein, 18 aa, Staphylococcus epidermidis
AVEKGLKVPEFVKTSLAP

SEQ ID NO: 1794385 - protein, 25 aa, Staphylococcus epidermidis
AVETALKAARRWAYDVKGIEPNKAE

SEQ ID NO: 1794386 - protein, 24 aa, Staphylococcus epidermidis
AVIEGFTVRLVKKFQTDDMLTQIK

SEQ ID NO: 1794387 - protein, 23 aa, Staphylococcus epidermidis
AVIIPKRRSVALTQTVAKASTGA

SEQ ID NO: 1794388 - protein, 24 aa, Staphylococcus epidermidis
AVPLDLPALFKGYFKDEARTKAAS

SEQ ID NO: 1794389 - protein, 18 aa, Staphylococcus epidermidis
AVQYNLPMTIFVLNNKQL

SEQ ID NO: 1794390 - protein, 26 aa, Staphylococcus epidermidis
AVTGFRPVMEIQFLGFVYEVFDEVAG

SEQ ID NO: 1794391 - protein, 20 aa, Staphylococcus epidermidis
AVTHSHGWGYAHLQMAPKHW

SEQ ID NO: 1794392 - protein, 17 aa, Staphylococcus epidermidis
AVVGFEYGYNVENKGNF

SEQ ID NO: 1794393 - protein, 29 aa, Staphylococcus epidermidis
AYAQMAEELYRFPIMYVEYSGTYGDVDKV

SEQ ID NO: 1794394 - protein, 31 aa, Staphylococcus epidermidis
AYDAIVRMERRYKGPIAFEYTHINNNKERVW

SEQ ID NO: 1794395 - protein, 24 aa, Staphylococcus epidermidis
AYEKKGVSVIICPNDLLTQKIKDT

SEQ ID NO: 1794396 - protein, 36 aa, Staphylococcus epidermidis
AYENPRFVEDLIRLIAADLVEFDWIEGFDIECRNEE

SEQ ID NO: 1794397 - protein, 17 aa, Staphylococcus epidermidis
AYERMLTQVKQNWPYAE

SEQ ID NO: 1794398 - protein, 22 aa, Staphylococcus epidermidis
AYGIMKGVRGVRVHNVLLNTRL

SEQ ID NO: 1794399 - protein, 18 aa, Staphylococcus epidermidis
AYHAPIRLLIVIQAPDAY

SEQ ID NO: 1794400 - protein, 17 aa, Staphylococcus epidermidis
AYLRLKNIVKETPLQFD

SEQ ID NO: 1794401 - protein, 23 aa, Staphylococcus epidermidis
AYQFTAGVLKNARGFTAVCNPIV

SEQ ID NO: 1794402 - protein, 23 aa, Staphylococcus epidermidis
AYTRRLPFHAKRFHQWLEQMPEN

SEQ ID NO: 1794403 - protein, 19 aa, Staphylococcus epidermidis
CAAGSRSAKVVSYLEEQGV

SEQ ID NO: 1794404 - protein, 24 aa, Staphylococcus epidermidis
CAEDCGYCGQSVKMKEKQRYALVE

SEQ ID NO: 1794405 - protein, 17 aa, Staphylococcus epidermidis
CDGVHPGYGFLAENGDF

SEQ ID NO: 1794406 - protein, 18 aa, Staphylococcus epidermidis
CDLNGMMAEIMGKRDGLG

SEQ ID NO: 1794407 - protein, 24 aa, Staphylococcus epidermidis
CEEDLQIFYSFIILKNNEVYFNLP

SEQ ID NO: 1794408 - protein, 18 aa, Staphylococcus epidermidis
CEIGPKGDLALVLDTSEN

SEQ ID NO: 1794409 - protein, 23 aa, Staphylococcus epidermidis
CELIEARCQCLSSDEIASLNQLL

SEQ ID NO: 1794410 - protein, 21 aa, Staphylococcus epidermidis
CENGGGWILGHLVNGTQAEYV

SEQ ID NO: 1794411 - protein, 26 aa, Staphylococcus epidermidis
CEVAKCPKNYLAHVLSRYGFNVKKEK

SEQ ID NO: 1794412 - protein, 19 aa, Staphylococcus epidermidis
CFELLAMVTYADRLKGIIK

SEQ ID NO: 1794413 - protein, 20 aa, Staphylococcus epidermidis
CGGVSKLIQSGFETLVEAGY

SEQ ID NO: 1794414 - protein, 32 aa, Staphylococcus epidermidis
CGNAYLFRFPPKAFKHAAHFPGNMVKSTSFAK

SEQ ID NO: 1794415 - protein, 21 aa, Staphylococcus epidermidis
CGVGIPGELCIAGESLTSGYL

SEQ ID NO: 1794416 - protein, 19 aa, Staphylococcus epidermidis
CHLAIGSAYSFNIKGGTEM

SEQ ID NO: 1794417 - protein, 21 aa, Staphylococcus epidermidis
CKEHHLKGRILVSTEGINGTL

SEQ ID NO: 1794418 - protein, 19 aa, Staphylococcus epidermidis
CKKSIKANHYLKNNEMADL

SEQ ID NO: 1794419 - protein, 20 aa, Staphylococcus epidermidis
CKKVAPRLEIHLSTQQSLSN

SEQ ID NO: 1794420 - protein, 19 aa, Staphylococcus epidermidis
CKNHEEIFVKLFSLLSETQ

SEQ ID NO: 1794421 - protein, 24 aa, Staphylococcus epidermidis
CLNLPQTRLRKLLKKMDYYIKFED

SEQ ID NO: 1794422 - protein, 21 aa, Staphylococcus epidermidis
CNIKFKTALLDQGIINENWLS

SEQ ID NO: 1794423 - protein, 31 aa, Staphylococcus epidermidis; identical to SEQ ID NO: 1646838

SEQ ID NO: 1794424 - protein, 24 aa, Staphylococcus epidermidis
CNTRHGVCEKCYGKNLATGEKVEV

SEQ ID NO: 1794425 - protein, 19 aa, Staphylococcus epidermidis
CNYWGKKGANRAVLARELS

SEQ ID NO: 1794426 - protein, 17 aa, Staphylococcus epidermidis
CPLTIRAPFGGGVHGGL

SEQ ID NO: 1794427 - protein, 24 aa, Staphylococcus epidermidis
CPNGCARPALAEIAFIGKAPGKYN

SEQ ID NO: 1794428 - protein, 24 aa, Staphylococcus epidermidis
CQSGIRSSIAIGILEHKGYHNIIN

SEQ ID NO: 1794429 - protein, 18 aa, Staphylococcus epidermidis
CREVRKKYEMPIIMLTAK

SEQ ID NO: 1794430 - protein, 21 aa, Staphylococcus epidermidis
CTGRMRYLGVLLYDADRVQEA

SEQ ID NO: 1794431 - protein, 18 aa, Staphylococcus epidermidis
CTIQRRMQKLVEEAPSPV

SEQ ID NO: 1794432 - protein, 23 aa, Staphylococcus epidermidis
CTNSSAFSLKAFKNVIKKTLAQN

SEQ ID NO: 1794433 - protein, 18 aa, Staphylococcus epidermidis
CYEDIGWFKKASVVEKTK

SEQ ID NO: 1794434 - protein, 18 aa, Staphylococcus epidermidis
CYRNYKMYLQEAIVHDTY

SEQ ID NO: 1794435 - protein, 21 aa, Staphylococcus epidermidis
DAALEFIAKASEGGMRDALSI

SEQ ID NO: 1794436 - protein, 22 aa, Staphylococcus epidermidis
DADLDMVICITEHIPVVDMVKV

SEQ ID NO: 1794437 - protein, 22 aa, Staphylococcus epidermidis
DADLRILRRLTRDTKERGRTME

SEQ ID NO: 1794438 - protein, 23 aa, Staphylococcus epidermidis
DADRLDAIGAIGIARTFQFSGHF

SEQ ID NO: 1794439 - protein, 24 aa, Staphylococcus epidermidis
DAEGRMVLGDAVFYATQFKPQLIL

SEQ ID NO: 1794440 - protein, 24 aa, Staphylococcus epidermidis
DAFIGCNTNLIAPVTVGNHTLIAA

SEQ ID NO: 1794441 - protein, 24 aa, Staphylococcus epidermidis
DAKPENYDALLIPGGFSPDHLRGD

SEQ ID NO: 1794442 - protein, 25 aa, Staphylococcus epidermidis
DAMLDYPKDFHVLKKLNKVLEKRRE

SEQ ID NO: 1794443 - protein, 28 aa, Staphylococcus epidermidis
DAMVRLSQDWKLRHVLIEMHGNNGSIDN

SEQ ID NO: 1794444 - protein, 24 aa, Staphylococcus epidermidis
DAPEVYYLKQFIAHKLKHLLDEGL

SEQ ID NO: 1794445 - protein, 18 aa, Staphylococcus epidermidis
DAQLRGVDSSGMICSMKE

SEQ ID NO: 1794446 - protein, 19 aa, Staphylococcus epidermidis
DAQQPVGMISKVYKNFIQK

SEQ ID NO: 1794447 - protein, 31 aa, Staphylococcus epidermidis
DARFAYDCYRRLLQMFGEVVYGIPMTAFDTY

SEQ ID NO: 1794448 - protein, 21 aa, Staphylococcus epidermidis
DASINWALGLMNEGSQIIDNT

SEQ ID NO: 1794449 - protein, 33 aa, Staphylococcus epidermidis
DATIIRLAVDGLWLSEIFGISAIDEEMREKVIE

SEQ ID NO: 1794450 - protein, 24 aa, Staphylococcus epidermidis
DAVPMIEKHLHRKIGEEESHIYSG

SEQ ID NO: 1794451 - protein, 18 aa, Staphylococcus epidermidis
DCFLELVQIDSETGHEET

SEQ ID NO: 1794452 - protein, 20 aa, Staphylococcus epidermidis
DCPDATIRFLVGGTQTNQVV

SEQ ID NO: 1794453 - protein, 24 aa, Staphylococcus epidermidis
DDEMKRSYLRGAFLAGGSVNNPET

SEQ ID NO: 1794454 - protein, 19 aa, Staphylococcus epidermidis
DDEVWDVLEDVITEHPVLL

SEQ ID NO: 1794455 - protein, 17 aa, Staphylococcus epidermidis
DDFDYIIAMDQSNVDNI

SEQ ID NO: 1794456 - protein, 27 aa, Staphylococcus epidermidis
DDIKIGDPLIRFDLEYINNNAKSIISP

SEQ ID NO: 1794457 - protein, 19 aa, Staphylococcus epidermidis
DDIRVNIVYEIPLSEVVFD

SEQ ID NO: 1794458 - protein, 24 aa, Staphylococcus epidermidis
DDLKAQFKRLWSIRNDQYSDKRTM

SEQ ID NO: 1794459 - protein, 22 aa, Staphylococcus epidermidis
DDSLKPFVLLVVEQKGEGLKAA

SEQ ID NO: 1794460 - protein, 21 aa, Staphylococcus epidermidis
DDYECFFCIVDQHAITVPQDR

SEQ ID NO: 1794461 - protein, 22 aa, Staphylococcus epidermidis
DEANVIRYAQYLNELSTETQFI

SEQ ID NO: 1794462 - protein, 23 aa, Staphylococcus epidermidis
DEAYPSIKARGGGYQRIEIDTFP

SEQ ID NO: 1794463 - protein, 22 aa, Staphylococcus epidermidis
DEAYRKSLMVKVFQHTNEYDHA

SEQ ID NO: 1794464 - protein, 28 aa, Staphylococcus epidermidis
DEDRIRRLLKLYLERESFEIHEARDGKE

SEQ ID NO: 1794465 - protein, 26 aa, Staphylococcus epidermidis
DEEGRYGTFAKYFTKNDVPTFAICHG

SEQ ID NO: 1794466 - protein, 23 aa, Staphylococcus epidermidis
DEGEGIPIILIHGLDGNLAGFKD

SEQ ID NO: 1794467 - protein, 23 aa, Staphylococcus epidermidis
DEKAKELIRLVDLPEEYLDRYPS

SEQ ID NO: 1794468 - protein, 22 aa, Staphylococcus epidermidis
DELLRKSDLVITIGYDPIEYEA

SEQ ID NO: 1794469 - protein, 18 aa, Staphylococcus epidermidis
DELTSALLSKGYKAEGLH

SEQ ID NO: 1794470 - protein, 20 aa, Staphylococcus epidermidis
DENTWMLFGTLPIYPCLNDE

SEQ ID NO: 1794471 - protein, 21 aa, Staphylococcus epidermidis
DEQRGISAFTLQNVAPQIERQ

SEQ ID NO: 1794472 - protein, 23 aa, Staphylococcus epidermidis
DERFTDRFELFIVGREHANAFTE

SEQ ID NO: 1794473 - protein, 23 aa, Staphylococcus epidermidis
DETFKLGIVLSYLKQYRASQNLL

SEQ ID NO: 1794474 - protein, 23 aa, Staphylococcus epidermidis
DETIKGVVLFHETLKSLNIKHEI

SEQ ID NO: 1794475 - protein, 21 aa, Staphylococcus epidermidis
DEVAVGFGRTGEMFACNHEDV

SEQ ID NO: 1794476 - protein, 21 aa, Staphylococcus epidermidis
DEVIWLYQYFTDVKIAPTTYT

SEQ ID NO: 1794477 - protein, 23 aa, Staphylococcus epidermidis
DEWLFRLDHHIRLPKNNIYFHSL

SEQ ID NO: 1794478 - protein, 23 aa, Staphylococcus epidermidis
DFAFEFNGIPTIVPRHYHYQFDL

SEQ ID NO: 1794479 - protein, 17 aa, Staphylococcus epidermidis
DFFTFFRNFFTKKWERE

SEQ ID NO: 1794480 - protein, 26 aa, Staphylococcus epidermidis
DFTNSYLKRIFSYLYDYYSKNDYYTI

SEQ ID NO: 1794481 - protein, 18 aa, Staphylococcus epidermidis
DFYCSLLNGYPLVIATSV

SEQ ID NO: 1794482 - protein, 19 aa, Staphylococcus epidermidis
DFYFMKLNQFYDDIVEYHS

SEQ ID NO: 1794483 - protein, 17 aa, Staphylococcus epidermidis
DGDAFAQFFKLMLNQGI

SEQ ID NO: 1794484 - protein, 20 aa, Staphylococcus epidermidis
DGDDIYYNLDISFSQAALGD

SEQ ID NO: 1794485 - protein, 22 aa, Staphylococcus epidermidis
DGFDGVLIPGGFSFGDYLRSGA

SEQ ID NO: 1794486 - protein, 24 aa, Staphylococcus epidermidis
DGGKAANIIPDFTHARFYTRATSR

SEQ ID NO: 1794487 - protein, 26 aa, Staphylococcus epidermidis
DGKVARLTNFGAFIDIGGVDGLVHVS

SEQ ID NO: 1794488 - protein, 26 aa, Staphylococcus epidermidis
DGMLVKRPLAISGNHLTLGFKENEYQ

SEQ ID NO: 1794489 - protein, 18 aa, Staphylococcus epidermidis
DGPKVIEFNARFGDPEAQ

SEQ ID NO: 1794490 - protein, 22 aa, Staphylococcus epidermidis
DGTKLGFMSFFTKAAVAALKKY

SEQ ID NO: 1794491 - protein, 18 aa, Staphylococcus epidermidis
DGTMSFAVADVIGSGIPA

SEQ ID NO: 1794492 - protein, 20 aa, Staphylococcus epidermidis
DHAMLKLAYIDLQDYLDTLQ

SEQ ID NO: 1794493 - protein, 21 aa, Staphylococcus epidermidis
DHFIMKLRIVKFARTPEYNEL

SEQ ID NO: 1794494 - protein, 23 aa, Staphylococcus epidermidis
DHLAAFSKRTGKAFSSDDNLLLV

SEQ ID NO: 1794495 - protein, 23 aa, Staphylococcus epidermidis
DHPNVHIQYCEFGPVIASHLGSG

SEQ ID NO: 1794496 - protein, 25 aa, Staphylococcus epidermidis
DHPSPEFRRKSFRAFSDALRQYQHT

SEQ ID NO: 1794497 - protein, 27 aa, Staphylococcus epidermidis
DHRIIDGKEAVGFLKTIKELIENPEDL

SEQ ID NO: 1794498 - protein, 24 aa, Staphylococcus epidermidis
DHSDLDFDFIYWLVTGVKDHQIVL

SEQ ID NO: 1794499 - protein, 24 aa, Staphylococcus epidermidis
DIDIILRRNVDILQQWIEQKKGPF

SEQ ID NO: 1794500 - protein, 23 aa, Staphylococcus epidermidis
DIEARGFSREDLWSNRKRGEEFF

SEQ ID NO: 1794501 - protein, 22 aa, Staphylococcus epidermidis
DIEGRTAIIIDDIIDTAGTITL

SEQ ID NO: 1794502 - protein, 25 aa, Staphylococcus epidermidis
DIEKWSFQTEMFFLCNRYKQIRDIE

SEQ ID NO: 1794503 - protein, 17 aa, Staphylococcus epidermidis
DIIEDVNKIYGLDHDQV

SEQ ID NO: 1794504 - protein, 22 aa, Staphylococcus epidermidis
DIKATQIMSHWPKHPTNPYKGY

SEQ ID NO: 1794505 - protein, 18 aa, Staphylococcus epidermidis
DIQKLLKAYFEKLGVKND

SEQ ID NO: 1794506 - protein, 23 aa, Staphylococcus epidermidis
DIQMAAQCLIQAIGGEGHVYIKG

SEQ ID NO: 1794507 - protein, 18 aa, Staphylococcus epidermidis
DIRIAFSCVEKEDIPYVF

SEQ ID NO: 1794508 - protein, 25 aa, Staphylococcus epidermidis
DISRPGLEMAGYFSHYASDRIQLLG

SEQ ID NO: 1794509 - protein, 18 aa, Staphylococcus epidermidis
DIVMSPELISWINQRGLH

SEQ ID NO: 1794510 - protein, 23 aa, Staphylococcus epidermidis
DIYCLDEPFVGIDIYSEQLIMKK

SEQ ID NO: 1794511 - protein, 24 aa, Staphylococcus epidermidis
DKAQRIGIRMADLLEKETFERRLK

SEQ ID NO: 1794512 - protein, 25 aa, Staphylococcus epidermidis
DKINDLRIGEALLRGIDTTTNHSIN

SEQ ID NO: 1794513 - protein, 23 aa, Staphylococcus epidermidis
DKKYGEVLGAFIVGPHATDIIGE

SEQ ID NO: 1794514 - protein, 17 aa, Staphylococcus epidermidis
DKLKFPYFLGKSKYILV

SEQ ID NO: 1794515 - protein, 18 aa, Staphylococcus epidermidis
DKNLVPILMLTAKDDEFD

SEQ ID NO: 1794516 - protein, 23 aa, Staphylococcus epidermidis
DKPDTRFGMELINVSQLGKEMNF

SEQ ID NO: 1794517 - protein, 20 aa, Staphylococcus epidermidis
DKPILLKRGLSATIEEFIYA

SEQ ID NO: 1794518 - protein, 29 aa, Staphylococcus epidermidis
DKQICHCFGCKKGGNVFQFTQEIKDVSFV

SEQ ID NO: 1794519 - protein, 26 aa, Staphylococcus epidermidis
DKRGIDEYLIRLSVGIEDYNDIEADI

SEQ ID NO: 1794520 - protein, 19 aa, Staphylococcus epidermidis
DKRRGRLTISKKWDQSTAI

SEQ ID NO: 1794521 - protein, 20 aa, Staphylococcus epidermidis
DKRSASIYVAFDVKDSKGKV

SEQ ID NO: 1794522 - protein, 20 aa, Staphylococcus epidermidis
DKSNVRYVIHYNMPGDLESY

SEQ ID NO: 1794523 - protein, 26 aa, Staphylococcus epidermidis
DKYLKDLPFISGFIGTCSFDLVRHEF

SEQ ID NO: 1794524 - protein, 20 aa, Staphylococcus epidermidis
DLCATYEVMLMGIDTTSGRP

SEQ ID NO: 1794525 - protein, 19 aa, Staphylococcus epidermidis
DLEGYRTGSMNEIIDTKST

SEQ ID NO: 1794526 - protein, 26 aa, Staphylococcus epidermidis
DLEKLIRLPGKFKYFEHNVAAHSFKV

SEQ ID NO: 1794527 - protein, 20 aa, Staphylococcus epidermidis
DLKAPIRMHRLLQGDVGSGK

SEQ ID NO: 1794528 - protein, 20 aa, Staphylococcus epidermidis
DLLIMAGTNYPYVNYLPKKN

SEQ ID NO: 1794529 - protein, 24 aa, Staphylococcus epidermidis
DLNITIPVAIHLDHGSSFEKCKEA

SEQ ID NO: 1794530 - protein, 20 aa, Staphylococcus epidermidis
DLRALFRGKAQHVVNFMYFI

SEQ ID NO: 1794531 - protein, 22 aa, Staphylococcus epidermidis
DLRLMLESFAFSKLSGTDTQHI

SEQ ID NO: 1794532 - protein, 20 aa, Staphylococcus epidermidis
DLRLTDMGYELGLISEERYA

SEQ ID NO: 1794533 - protein, 25 aa, Staphylococcus epidermidis
DLSRLARRGSGSASRSIFGGFAEWE

SEQ ID NO: 1794534 - protein, 19 aa, Staphylococcus epidermidis
DLVEELKMADFERAAKVSG

SEQ ID NO: 1794535 - protein, 18 aa, Staphylococcus epidermidis
DLVTLRKSIIRWCQLILS

SEQ ID NO: 1794536 - protein, 20 aa, Staphylococcus epidermidis
DMEEELKILLIPKDPNDDKD

SEQ ID NO: 1794537 - protein, 20 aa, Staphylococcus epidermidis
DMFVHQGAESFKIWTNLEPD

SEQ ID NO: 1794538 - protein, 23 aa, Staphylococcus epidermidis
DMIKEMKDGSVIVDIAIDQGGIF

SEQ ID NO: 1794539 - protein, 21 aa, Staphylococcus epidermidis
DMTGWTKEDVLAFEDLTKIKV

SEQ ID NO: 1794540 - protein, 25 aa, Staphylococcus epidermidis
DNEEKYLRLYAEFENYKRRIQKENQ

SEQ ID NO: 1794541 - protein, 25 aa, Staphylococcus epidermidis
DNELCIELDPGMAFGTGDHPTTSMC

SEQ ID NO: 1794542 - protein, 25 aa, Staphylococcus epidermidis
DNKHLKLTLGHSGLTALFWNHGHLA

SEQ ID NO: 1794543 - protein, 18 aa, Staphylococcus epidermidis
DNKYYYSIHFDDSVSQEM

SEQ ID NO: 1794544 - protein, 27 aa, Staphylococcus epidermidis
DNLGLDYLDLFLIHWPCENDQLYIESY

SEQ ID NO: 1794545 - protein, 24 aa, Staphylococcus epidermidis
DNLRKLGFDIVRFKTGTPPRVNAR

SEQ ID NO: 1794546 - protein, 18 aa, Staphylococcus epidermidis
DNPFDLTKVWYKKDYPLI

SEQ ID NO: 1794547 - protein, 21 aa, Staphylococcus epidermidis
DNQITKVGVFGTFSAGKSSLI

SEQ ID NO: 1794548 - protein, 18 aa, Staphylococcus epidermidis
DNQLLIKLIENFENLPIL

SEQ ID NO: 1794549 - protein, 20 aa, Staphylococcus epidermidis
DNQVRIALTEVWEKGGEGGI

SEQ ID NO: 1794550 - protein, 24 aa, Staphylococcus epidermidis
DNTDRPLALCAALLHDLGHGPFSH

SEQ ID NO: 1794551 - protein, 18 aa, Staphylococcus epidermidis
DNTFKALHKATGFIKSEL

SEQ ID NO: 1794552 - protein, 32 aa, Staphylococcus epidermidis
DNVLESVYWLKDKGVHFDRSFVDMPVGALWRR

SEQ ID NO: 1794553 - protein, 33 aa, Staphylococcus epidermidis
DPDVLRFFMISVHYRSPINYNLELVGAARSGLE

SEQ ID NO: 1794554 - protein, 17 aa, Staphylococcus epidermidis
DPLSTFKKVVAIEIPTS

SEQ ID NO: 1794555 - protein, 25 aa, Staphylococcus epidermidis
DPVLSRVSVHLANFLEIPFDVYPQD

SEQ ID NO: 1794556 - protein, 17 aa, Staphylococcus epidermidis
DPYLRPLYDGLNTVLGR

SEQ ID NO: 1794557 - protein, 23 aa, Staphylococcus epidermidis
DPYRGVISSIRIIDGVVKAGDRI

SEQ ID NO: 1794558 - protein, 21 aa, Staphylococcus epidermidis
DQEACRGWRYCMTGCPYKKVY

SEQ ID NO: 1794559 - protein, 27 aa, Staphylococcus epidermidis
DQGPAFPFAECGAMSQAYIGYQLQESL

SEQ ID NO: 1794560 - protein, 21 aa, Staphylococcus epidermidis
DQLMLRKAMVQLIEMHEEMNV

SEQ ID NO: 1794561 - protein, 22 aa, Staphylococcus epidermidis
DQLPTRGAIIYAISPKPKDAPG

SEQ ID NO: 1794562 - protein, 25 aa, Staphylococcus epidermidis
DQRREMIRQAAFRLVENIKNDIKPR

SEQ ID NO: 1794563 - protein, 23 aa, Staphylococcus epidermidis
DQSVFHIHFHLIPRYENDIDGFG

SEQ ID NO: 1794564 - protein, 19 aa, Staphylococcus epidermidis
DRAEFVVNGMLIRKDFYSY

SEQ ID NO: 1794565 - protein, 38 aa, Staphylococcus epidermidis
DRAELLLRVAAIIRRRKEEISAIMVYEAGKPWDEAVGD

SEQ ID NO: 1794566 - protein, 26 aa, Staphylococcus epidermidis
DRGVEFKIATPIVACNEKGFVVEVNG

SEQ ID NO: 1794567 - protein, 19 aa, Staphylococcus epidermidis
DRKLIGILTNRDLRFIEDF

SEQ ID NO: 1794568 - protein, 18 aa, Staphylococcus epidermidis
DRLTLSCRMEINERGEVV

SEQ ID NO: 1794569 - protein, 17 aa, Staphylococcus epidermidis
DRMTYSHFTQMEGNYEL

SEQ ID NO: 1794570 - protein, 20 aa, Staphylococcus epidermidis
DRTMLELLYATGMRVTEIIQ

SEQ ID NO: 1794571 - protein, 22 aa, Staphylococcus epidermidis
DRTRASLKIQEGCNNFCTFCII

SEQ ID NO: 1794572 - protein, 26 aa, Staphylococcus epidermidis
DSAIKCARAGATVAHIHVRDPETGGV

SEQ ID NO: 1794573 - protein, 26 aa, Staphylococcus epidermidis
DSCGDCTICVDRCPTGALVGNGQLNS

SEQ ID NO: 1794574 - protein, 23 aa, Staphylococcus epidermidis
DSEIIPRVNLTEVYRQQDGSSII

SEQ ID NO: 1794575 - protein, 34 aa, Staphylococcus epidermidis
DSEVKCITPADIVASMSYFFNLLNGIGYTDDIDH

SEQ ID NO: 1794576 - protein, 24 aa, Staphylococcus epidermidis
DSKSISFGLGYQIKQIVELISQGT

SEQ ID NO: 1794577 - protein, 17 aa, Staphylococcus epidermidis
DSLGVCIHTSYGSIVYT

SEQ ID NO: 1794578 - protein, 19 aa, Staphylococcus epidermidis
DSTKLLVPIFDARREAVYA

SEQ ID NO: 1794579 - protein, 20 aa, Staphylococcus epidermidis
DSYTDFKMGIQIRHYTVQAL

SEQ ID NO: 1794580 - protein, 19 aa, Staphylococcus epidermidis
DSYTRRIFRKLGYQHTESY

SEQ ID NO: 1794581 - protein, 24 aa, Staphylococcus epidermidis
DTDNGFKLGADIKVTLENMSQQDA

SEQ ID NO: 1794582 - protein, 21 aa, Staphylococcus epidermidis
DTFKPIRLDRYFPEWHETYSK

SEQ ID NO: 1794583 - protein, 17 aa, Staphylococcus epidermidis
DTGELNGALGVEKIFNS

SEQ ID NO: 1794584 - protein, 19 aa, Staphylococcus epidermidis
DTLEMRPLIVMSPKSLLRN

SEQ ID NO: 1794585 - protein, 23 aa, Staphylococcus epidermidis
DTLVELSKFLHVHLVKNQKLINK

SEQ ID NO: 1794586 - protein, 18 aa, Staphylococcus epidermidis
DTSMGFTPLAGVTMGTRS

SEQ ID NO: 1794587 - protein, 21 aa, Staphylococcus epidermidis
DTSRFYQYWLDHVDEDLNEAK

SEQ ID NO: 1794588 - protein, 18 aa, Staphylococcus epidermidis
DTVIRFAPPLVITKEELD

SEQ ID NO: 1794589 - protein, 24 aa, Staphylococcus epidermidis
DTWFSSALWPFSTLGWPDTNADDF

SEQ ID NO: 1794590 - protein, 23 aa, Staphylococcus epidermidis
DTYCGIGTIGLYMAPLAKHVYGV

SEQ ID NO: 1794591 - protein, 19 aa, Staphylococcus epidermidis
DTYPVVPMNFDERYHYMVA

SEQ ID NO: 1794592 - protein, 24 aa, Staphylococcus epidermidis
DVAKRAGASIILLIVNILSDDQLK

SEQ ID NO: 1794593 - protein, 28 aa, Staphylococcus epidermidis
DVIKEGIPAKARRKGGHPAKRVFQAIRI

SEQ ID NO: 1794594 - protein, 24 aa, Staphylococcus epidermidis
DVKLRLKGYPAIVFQHEIDHLNGI

SEQ ID NO: 1794595 - protein, 19 aa, Staphylococcus epidermidis
DVLAEMKEQLSGSCTVEVA

SEQ ID NO: 1794596 - protein, 23 aa, Staphylococcus epidermidis
DVLDFKINASLIKSKNDYISLGL

SEQ ID NO: 1794597 - protein, 24 aa, Staphylococcus epidermidis
DVNHFKINFPKILERKDAIVKQLH

SEQ ID NO: 1794598 - protein, 21 aa, Staphylococcus epidermidis
DVPTFAICHGPLVLVDTDDLK

SEQ ID NO: 1794599 - protein, 18 aa, Staphylococcus epidermidis
DVRIALETMAGKGTEVGR

SEQ ID NO: 1794600 - protein, 19 aa, Staphylococcus epidermidis
DVSIPKERGFLPGNGAITS

SEQ ID NO: 1794601 - protein, 17 aa, Staphylococcus epidermidis
DVVACCLDVGEGKDLDV

SEQ ID NO: 1794602 - protein, 24 aa, Staphylococcus epidermidis
DVVKRTCGYLGNPVQRPVIEGRQK

SEQ ID NO: 1794603 - protein, 26 aa, Staphylococcus epidermidis
DVYDPRKYLGPAREAIKETVKGKIRE

SEQ ID NO: 1794604 - protein, 25 aa, Staphylococcus epidermidis
DWKIMKESCSMLEEFEIPYEKKVVS

SEQ ID NO: 1794605 - protein, 19 aa, Staphylococcus epidermidis
DYDAIILAAAGLKRMGWSD

SEQ ID NO: 1794606 - protein, 23 aa, Staphylococcus epidermidis
DYDEIIQIGITFVRQNQVIDTYH

SEQ ID NO: 1794607 - protein, 25 aa, Staphylococcus epidermidis
DYKDRPLVCVGILKGSVMFMADLIK

SEQ ID NO: 1794608 - protein, 24 aa, Staphylococcus epidermidis
DYLSHGRVGWNLVTSMTDIEAQNH

SEQ ID NO: 1794609 - protein, 19 aa, Staphylococcus epidermidis
DYPLIEVGEFELNRNPENY

SEQ ID NO: 1794610 - protein, 18 aa, Staphylococcus epidermidis
DYVNRGAANLALIAEDPE

SEQ ID NO: 1794611 - protein, 26 aa, Staphylococcus epidermidis
DYVSGGKRPLVCFFSNDLNIHRTKTE

SEQ ID NO: 1794612 - protein, 19 aa, Staphylococcus epidermidis
DYYKFKQMLLYIMTDLAKS

SEQ ID NO: 1794613 - protein, 23 aa, Staphylococcus epidermidis
EAAEEMPINVGFTGKGQAVNHTA

SEQ ID NO: 1794614 - protein, 20 aa, Staphylococcus epidermidis
EAARRIGEGAAMLRTKGEPG

SEQ ID NO: 1794615 - protein, 28 aa, Staphylococcus epidermidis
EAEDPFTCPHGRPIIINFSNYELEKLFK

SEQ ID NO: 1794616 - protein, 23 aa, Staphylococcus epidermidis
EAEGAELPKVFHYFKEAHPYFNQ

SEQ ID NO: 1794617 - protein, 38 aa, Staphylococcus epidermidis
EAGRSDYFWDLFIQMPAALMFPSGNRFYDWEYQTDEEP

SEQ ID NO: 1794618 - protein, 24 aa, Staphylococcus epidermidis
EALSGTVTPQGFFAIIKKPTYDKT

SEQ ID NO: 1794619 - protein, 19 aa, Staphylococcus epidermidis
EARGFIIGCPVAYSMGIGF

SEQ ID NO: 1794620 - protein, 19 aa, Staphylococcus epidermidis
ECHDCQFLSKTFYLMEQLF

SEQ ID NO: 1794621 - protein, 19 aa, Staphylococcus epidermidis
EDAGRGYRRVVPSPQPISI

SEQ ID NO: 1794622 - protein, 24 aa, Staphylococcus epidermidis
EDDAKKGFLLDGFPRTIDQAESLS

SEQ ID NO: 1794623 - protein, 23 aa, Staphylococcus epidermidis
EDFTGNLSLEFVDYRLGEPKYDL

SEQ ID NO: 1794624 - protein, 18 aa, Staphylococcus epidermidis
EDGNLFYHHYEDVTEKNV

SEQ ID NO: 1794625 - protein, 23 aa, Staphylococcus epidermidis
EDHKLYYPKEMILKIKDYQIKGS

SEQ ID NO: 1794626 - protein, 19 aa, Staphylococcus epidermidis
EDIAFADSRIRKETIAAED

SEQ ID NO: 1794627 - protein, 18 aa, Staphylococcus epidermidis
EDIDEWIGLLDQLEEKVK

SEQ ID NO: 1794628 - protein, 25 aa, Staphylococcus epidermidis
EDIPGELIMKVLAFDADLSKIDQVG

SEQ ID NO: 1794629 - protein, 22 aa, Staphylococcus epidermidis
EDKGEIFPSFTVPTHHPGFKQL

SEQ ID NO: 1794630 - protein, 25 aa, Staphylococcus epidermidis
EDLDPIFMWHLAYAYGQEERDKEAQ

SEQ ID NO: 1794631 - protein, 20 aa, Staphylococcus epidermidis
EDLKGLLSIESIRDDSKATA

SEQ ID NO: 1794632 - protein, 25 aa, Staphylococcus epidermidis
EDLNQRLYHYWALGHIHQREQLSDM

SEQ ID NO: 1794633 - protein, 24 aa, Staphylococcus epidermidis
EDVYEIFKSTMLKRANENEEAWNN

SEQ ID NO: 1794634 - protein, 23 aa, Staphylococcus epidermidis
EEAKSIGAMALFGEKYGDIVRVV

SEQ ID NO: 1794635 - protein, 27 aa, Staphylococcus epidermidis
EEAQVIWMSTFHSMCVRILRRDADRIG

SEQ ID NO: 1794636 - protein, 26 aa, Staphylococcus epidermidis
EEDLELLESVAFQIGSAIKRIQLTNK

SEQ ID NO: 1794637 - protein, 20 aa, Staphylococcus epidermidis
EEFKRVVNMIQDVYKDFGFE

SEQ ID NO: 1794638 - protein, 24 aa, Staphylococcus epidermidis
EEGISLDVSEDFDLFVVTMGEDAD

SEQ ID NO: 1794639 - protein, 19 aa, Staphylococcus epidermidis
EEKAEITIFPKIENQEGID

SEQ ID NO: 1794640 - protein, 17 aa, Staphylococcus epidermidis
EEKEVMDKLLLSFQQSE

SEQ ID NO: 1794641 - protein, 25 aa, Staphylococcus epidermidis
EEKMKELQDFIARFSANASKSKQAT

SEQ ID NO: 1794642 - protein, 36 aa, Staphylococcus epidermidis
EEKVKFPIILSESLTAVVAVPLWLENSMYGVLLLGQ

SEQ ID NO: 1794643 - protein, 18 aa, Staphylococcus epidermidis
EELDLKELVLPLIVLDYS

SEQ ID NO: 1794644 - protein, 27 aa, Staphylococcus epidermidis
EENGKEISRIGSTFGKTNRVLIDTDQH

SEQ ID NO: 1794645 - protein, 18 aa, Staphylococcus epidermidis
EEPHLKYKSDKIVENYHK

SEQ ID NO: 1794646 - protein, 18 aa, Staphylococcus epidermidis
EESLFPHIRAIKSEDDHE

SEQ ID NO: 1794647 - protein, 17 aa, Staphylococcus epidermidis
EETPVIISSRIRLARNL

SEQ ID NO: 1794648 - protein, 22 aa, Staphylococcus epidermidis
EEYEWLQQSTFNFPDKQTLKGL

SEQ ID NO: 1794649 - protein, 27 aa, Staphylococcus epidermidis
EEYPQLTIRVSGYAVNFIKLTREQQLD

SEQ ID NO: 1794650 - protein, 19 aa, Staphylococcus epidermidis
EFCGFKVSNQLIYQTLKTM

SEQ ID NO: 1794651 - protein, 18 aa, Staphylococcus epidermidis
EFGALMITHYQRLLNYIT

SEQ ID NO: 1794652 - protein, 22 aa, Staphylococcus epidermidis
EFKSNKTILDYVWDQYPHMNEK

SEQ ID NO: 1794653 - protein, 19 aa, Staphylococcus epidermidis
EFMSRFPAINSKIKEANEG

SEQ ID NO: 1794654 - protein, 19 aa, Staphylococcus epidermidis
EFNLTKYLVSQLMLSNEER

SEQ ID NO: 1794655 - protein, 18 aa, Staphylococcus epidermidis
EFSPELLDDASLFDSAMT

SEQ ID NO: 1794656 - protein, 26 aa, Staphylococcus epidermidis
EFSVFKKPMLFYAFDLEDYIYTRDFY

SEQ ID NO: 1794657 - protein, 29 aa, Staphylococcus epidermidis
EGAALAMSILDYVRRLGSLVMATTHYPEL

SEQ ID NO: 1794658 - protein, 21 aa, Staphylococcus epidermidis
EGELVARLILDKVGNKKPIKR

SEQ ID NO: 1794659 - protein, 19 aa, Staphylococcus epidermidis
EGFDVKALIRNGATDDDLK

SEQ ID NO: 1794660 - protein, 24 aa, Staphylococcus epidermidis
EGFSLALLECESHGVPSISYDIQY

SEQ ID NO: 1794661 - protein, 22 aa, Staphylococcus epidermidis
EGHAGQSLAAYAPRGLTIHHTG

SEQ ID NO: 1794662 - protein, 23 aa, Staphylococcus epidermidis
EGKLPREVIRYEYNLEYGTNVLT

SEQ ID NO: 1794663 - protein, 18 aa, Staphylococcus epidermidis
EGLGVLDFYTESKKERLT

SEQ ID NO: 1794664 - protein, 17 aa, Staphylococcus epidermidis
EGLMLLKVVHYDEKHQP

SEQ ID NO: 1794665 - protein, 19 aa, Staphylococcus epidermidis
EGLVRAGINKLTIVDRDYI

SEQ ID NO: 1794666 - protein, 24 aa, Staphylococcus epidermidis
EGMLDAAVCGEIFTSPTPDKILDA

SEQ ID NO: 1794667 - protein, 17 aa, Staphylococcus epidermidis
EGMNFAAVHKLPFVCVI

SEQ ID NO: 1794668 - protein, 23 aa, Staphylococcus epidermidis
EGQYKVYIIEDFEKLTVQGENSI

SEQ ID NO: 1794669 - protein, 21 aa, Staphylococcus epidermidis
EGRKPSIRFRVPKDQTYTFND

SEQ ID NO: 1794670 - protein, 19 aa, Staphylococcus epidermidis
EGRLPDALVACVGGGSNSI

SEQ ID NO: 1794671 - protein, 19 aa, Staphylococcus epidermidis
EGSLRCDANISLRPYGQKE

SEQ ID NO: 1794672 - protein, 19 aa, Staphylococcus epidermidis
EGTIAEWLKNVGDNVDKGE

SEQ ID NO: 1794673 - protein, 25 aa, Staphylococcus epidermidis
EGTVVRLANFGAFVEIAPSVQGLVH

SEQ ID NO: 1794674 - protein, 20 aa, Staphylococcus epidermidis
EHMLFYFAYKTFITTADEII

SEQ ID NO: 1794675 - protein, 18 aa, Staphylococcus epidermidis
EHQSYCVLIASPKTETGI

SEQ ID NO: 1794676 - protein, 27 aa, Staphylococcus epidermidis
EIDAALWGARAAFIGGFDSTSNVRAGK

SEQ ID NO: 1794677 - protein, 18 aa, Staphylococcus epidermidis
EIDNLIWYFSELFKNELK

SEQ ID NO: 1794678 - protein, 17 aa, Staphylococcus epidermidis
EIEIPRNKIAKARHAVM

SEQ ID NO: 1794679 - protein, 19 aa, Staphylococcus epidermidis
EIERTQALGAKDIVLHPGA

SEQ ID NO: 1794680 - protein, 19 aa, Staphylococcus epidermidis
EIGGAVAKRARAFDMDVLY

SEQ ID NO: 1794681 - protein, 18 aa, Staphylococcus epidermidis
EIIQPGVLPELFTAQTAC

SEQ ID NO: 1794682 - protein, 19 aa, Staphylococcus epidermidis
EILVRRLVEENGTEHEGEL

SEQ ID NO: 1794683 - protein, 26 aa, Staphylococcus epidermidis
EINFPSNKFNLGFTFQDTPGVDSNVA

SEQ ID NO: 1794684 - protein, 24 aa, Staphylococcus epidermidis
EIYKNECDLDYDVTSLYTFKDPVS

SEQ ID NO: 1794685 - protein, 20 aa, Staphylococcus epidermidis
EKANDLWKSQLGALLSPPQD

SEQ ID NO: 1794686 - protein, 23 aa, Staphylococcus epidermidis
EKDPKLLPFQGYILQNFDLNDKG

SEQ ID NO: 1794687 - protein, 21 aa, Staphylococcus epidermidis
EKELRECLKIYQSRQRRFGGL

SEQ ID NO: 1794688 - protein, 18 aa, Staphylococcus epidermidis
EKERDIGAKYVDLDTLLK

SEQ ID NO: 1794689 - protein, 18 aa, Staphylococcus epidermidis
EKERGVCLYGPHRDDLSF

SEQ ID NO: 1794690 - protein, 24 aa, Staphylococcus epidermidis
EKGNIYLGGPIKLLNRPKHDAFSN

SEQ ID NO: 1794691 - protein, 19 aa, Staphylococcus epidermidis
EKHGFKFREEPYFVEMQKT

SEQ ID NO: 1794692 - protein, 24 aa, Staphylococcus epidermidis
EKHGIKMIYGMEGMLVDDGVPIAY

SEQ ID NO: 1794693 - protein, 21 aa, Staphylococcus epidermidis
EKKLKQFGITYSQYLVLLTLW

SEQ ID NO: 1794694 - protein, 23 aa, Staphylococcus epidermidis
EKLPYRAKRHYSIIDGDENHLVF

SEQ ID NO: 1794695 - protein, 20 aa, Staphylococcus epidermidis
EKNIDVVIGLGGGKALDTGK

SEQ ID NO: 1794696 - protein, 37 aa, Staphylococcus epidermidis
EKQSRLKRLFKRTKASINEVFSRMQSVSSQIDRITIQ

SEQ ID NO: 1794697 - protein, 25 aa, Staphylococcus epidermidis
EKRMILERILPILSERERQIIQCTF

SEQ ID NO: 1794698 - protein, 19 aa, Staphylococcus epidermidis
EKRRGVAGTVFVHKYAGYL

SEQ ID NO: 1794699 - protein, 17 aa, Staphylococcus epidermidis
EKVAEAFEFDTLKNNSF

SEQ ID NO: 1794700 - protein, 18 aa, Staphylococcus epidermidis
EKYIKAFYEDVGALNVKK

SEQ ID NO: 1794701 - protein, 25 aa, Staphylococcus epidermidis
EKYIPYCIEPSLGADRVTLAFLCDA

SEQ ID NO: 1794702 - protein, 24 aa, Staphylococcus epidermidis
ELASSMADLGVRVTIIEVADDILL

SEQ ID NO: 1794703 - protein, 33 aa, Staphylococcus epidermidis
ELCRYEMLKILRFCSGLNLIPTFKIITDRHDTF

SEQ ID NO: 1794704 - protein, 17 aa, Staphylococcus epidermidis
ELDEMGADYIAVHTGYD

SEQ ID NO: 1794705 - protein, 27 aa, Staphylococcus epidermidis
ELDLFTCLRPVRWFKGVPSPVKRPEDV

SEQ ID NO: 1794706 - protein, 19 aa, Staphylococcus epidermidis
ELDPKRVIVELNKELIKQD

SEQ ID NO: 1794707 - protein, 19 aa, Staphylococcus epidermidis
ELEDLFDGRVRTIMSNPLN

SEQ ID NO: 1794708 - protein, 27 aa, Staphylococcus epidermidis
ELFMFELRMQWLNRLEKTSDEAIEINY

SEQ ID NO: 1794709 - protein, 21 aa, Staphylococcus epidermidis
ELGPKGIRVNCVAPGPFWSPL

SEQ ID NO: 1794710 - protein, 26 aa, Staphylococcus epidermidis
ELGTRFSPFYFKKLWLDAWEETHERR

SEQ ID NO: 1794711 - protein, 17 aa, Staphylococcus epidermidis
ELIKDYYHYALMKTVEG

SEQ ID NO: 1794712 - protein, 19 aa, Staphylococcus epidermidis
ELKMMLNIMKPEYFVPVQG

SEQ ID NO: 1794713 - protein, 17 aa, Staphylococcus epidermidis
ELKNRKSKIIFANGDSL

SEQ ID NO: 1794714 - protein, 20 aa, Staphylococcus epidermidis
ELMERMVWTRILDQRSISLN

SEQ ID NO: 1794715 - protein, 29 aa, Staphylococcus epidermidis
ELMNRLTGRRICEKCGTTYHLVFNPPKVD

SEQ ID NO: 1794716 - protein, 25 aa, Staphylococcus epidermidis
ELNEIKKKFKVDRLSTIEAEISEIK

SEQ ID NO: 1794717 - protein, 22 aa, Staphylococcus epidermidis
ELNHGLPMLVIDGNMNKAKINH

SEQ ID NO: 1794718 - protein, 23 aa, Staphylococcus epidermidis
ELSEHRMLVDLGRNDIHRISKTG

SEQ ID NO: 1794719 - protein, 18 aa, Staphylococcus epidermidis
ELTTNIQKVIDWLNNEEI

SEQ ID NO: 1794720 - protein, 18 aa, Staphylococcus epidermidis
ELYLKYQPDIIFIECSGV

SEQ ID NO: 1794721 - protein, 20 aa, Staphylococcus epidermidis
EMGVIPGAKTIPMDEIPDNL

SEQ ID NO: 1794722 - protein, 17 aa, Staphylococcus epidermidis
EMSECLILIQKLNDRMV

SEQ ID NO: 1794723 - protein, 22 aa, Staphylococcus epidermidis
EMSVIQKICHRVAVMENGEVIE

SEQ ID NO: 1794724 - protein, 23 aa, Staphylococcus epidermidis
ENEMGRLLLYRSQDVVDWHFEGE

SEQ ID NO: 1794725 - protein, 19 aa, Staphylococcus epidermidis
ENERGIVDIETLKTTQNDI

SEQ ID NO: 1794726 - protein, 25 aa, Staphylococcus epidermidis
ENERYLEVWNLVFSEFNHNKDNTYT

SEQ ID NO: 1794727 - protein, 18 aa, Staphylococcus epidermidis
ENFGYLKGINLTYVGNGR

SEQ ID NO: 1794728 - protein, 29 aa, Staphylococcus epidermidis
ENGDLLFGTIDSWLVWKLSGRTAHITDYT

SEQ ID NO: 1794729 - protein, 21 aa, Staphylococcus epidermidis
ENIAEVIAGWTGIPLTKINET

SEQ ID NO: 1794730 - protein, 22 aa, Staphylococcus epidermidis
ENIVLVPKLLKWSKEKKDEKAK

SEQ ID NO: 1794731 - protein, 22 aa, Staphylococcus epidermidis
ENIVLVPKLLKWSQEKKDEKAK

SEQ ID NO: 1794732 - protein, 24 aa, Staphylococcus epidermidis
ENIVRTKGIVWLAQYNDVACLLSQ

SEQ ID NO: 1794733 - protein, 25 aa, Staphylococcus epidermidis
ENKERLKGIFLTHGHEHAIGAVSYV

SEQ ID NO: 1794734 - protein, 24 aa, Staphylococcus epidermidis
ENKGKIALFAGIDKCRFKKQVVPG

SEQ ID NO: 1794735 - protein, 18 aa, Staphylococcus epidermidis
ENLKCSFCGKDQDQVKKL

SEQ ID NO: 1794736 - protein, 19 aa, Staphylococcus epidermidis
ENLMNPYLYEVLTIHAQLK

SEQ ID NO: 1794737 - protein, 19 aa, Staphylococcus epidermidis
ENLNVIACLMEIRRNPVNS

SEQ ID NO: 1794738 - protein, 25 aa, Staphylococcus epidermidis
ENLVPDYLDGLLFDDIPFLKVAQQE

SEQ ID NO: 1794739 - protein, 22 aa, Staphylococcus epidermidis
ENRVKYNSALEKLRNQDDTTMM

SEQ ID NO: 1794740 - protein, 26 aa, Staphylococcus epidermidis
ENSRFNVDLFLRNAHRIPDYASNRIK

SEQ ID NO: 1794741 - protein, 25 aa, Staphylococcus epidermidis
ENSSFRGLFQFIRFIDELIDRKKDF

SEQ ID NO: 1794742 - protein, 20 aa, Staphylococcus epidermidis
EPAVAFRLFKQLVEEKYGKD

SEQ ID NO: 1794743 - protein, 30 aa, Staphylococcus epidermidis
EPEGGLRCTACFEMRLEIVAKAALEHGYDY

SEQ ID NO: 1794744 - protein, 24 aa, Staphylococcus epidermidis
EPEILKPRLVPLLQMSNKKFKSTY

SEQ ID NO: 1794745 - protein, 20 aa, Staphylococcus epidermidis
EPKAHWDLVEELKMADFERA

SEQ ID NO: 1794746 - protein, 17 aa, Staphylococcus epidermidis
EPLKSLNKIASGGELSR

SEQ ID NO: 1794747 - protein, 18 aa, Staphylococcus epidermidis
EPLVKRDGLKGGGYYVEY

SEQ ID NO: 1794748 - protein, 25 aa, Staphylococcus epidermidis
EPMVLPARFPNLLINGSTGISSGYA

SEQ ID NO: 1794749 - protein, 18 aa, Staphylococcus epidermidis
EPSMAFKTMEFVRKGRGL

SEQ ID NO: 1794750 - protein, 30 aa, Staphylococcus epidermidis
EPYKVFTSFYRKWRPYLMIRDEYDYHLEDI

SEQ ID NO: 1794751 - protein, 19 aa, Staphylococcus epidermidis
EQDPNEWFEATKKGIKELI

SEQ ID NO: 1794752 - protein, 20 aa, Staphylococcus epidermidis
EQEGLLQLINPVVKSQSQET

SEQ ID NO: 1794753 - protein, 25 aa, Staphylococcus epidermidis
EQFELRKKRMMEIRDDINVHYNHFP

SEQ ID NO: 1794754 - protein, 20 aa, Staphylococcus epidermidis
EQFSQLDWLSNQHIALVGVG

SEQ ID NO: 1794755 - protein, 25 aa, Staphylococcus epidermidis
EQNYKEVAEALGIYNLGNKYPSEIS

SEQ ID NO: 1794756 - protein, 24 aa, Staphylococcus epidermidis
EQQYKQSVGFYFDLFEVGDFLKAS

SEQ ID NO: 1794757 - protein, 25 aa, Staphylococcus epidermidis
EQRLSKAALEMMIFHIVQQHESDLK

SEQ ID NO: 1794758 - protein, 22 aa, Staphylococcus epidermidis
ERAAKVSGARFVYLTKDGALLE

SEQ ID NO: 1794759 - protein, 19 aa, Staphylococcus epidermidis
ERADYLLEISRRIHEKTEH

SEQ ID NO: 1794760 - protein, 25 aa, Staphylococcus epidermidis
ERAFKNDKVDFIWSHTLKTINEKDG

SEQ ID NO: 1794761 - protein, 23 aa, Staphylococcus epidermidis
ERAGLGFTGRNGFVISPELGTWS

SEQ ID NO: 1794762 - protein, 26 aa, Staphylococcus epidermidis
ERARKFGIEVFNVFLSQEPITEDIEQ

SEQ ID NO: 1794763 - protein, 23 aa, Staphylococcus epidermidis
ERENGGDVFVHFSAIVEDGYKSL

SEQ ID NO: 1794764 - protein, 23 aa, Staphylococcus epidermidis
ERFWPADLVLLSIGFVGTETTVP

SEQ ID NO: 1794765 - protein, 20 aa, Staphylococcus epidermidis
ERIEREFGIELIATAPSVIY

SEQ ID NO: 1794766 - protein, 22 aa, Staphylococcus epidermidis
ERISELCGVHISIFSVGPDREQ

SEQ ID NO: 1794767 - protein, 17 aa, Staphylococcus epidermidis
ERLEFLGDAVLELTVSR

SEQ ID NO: 1794768 - protein, 17 aa, Staphylococcus epidermidis
ERLRSLPNVDIKTSAKT

SEQ ID NO: 1794769 - protein, 25 aa, Staphylococcus epidermidis
ERSGLTLFLPHAFEGQGPEHSSARL

SEQ ID NO: 1794770 - protein, 19 aa, Staphylococcus epidermidis
ERVHLKFLSSLPVGGLGLD

SEQ ID NO: 1794771 - protein, 24 aa, Staphylococcus epidermidis
ERVLHPNQILDWILIEDENLNNEA

SEQ ID NO: 1794772 - protein, 24 aa, Staphylococcus epidermidis
ERVWLKRRIETPYKASLNDNQKKE

SEQ ID NO: 1794773 - protein, 19 aa, Staphylococcus epidermidis
ERVYKRLIDDGGHAKVKLN

SEQ ID NO: 1794774 - protein, 19 aa, Staphylococcus epidermidis
ESAPKIFRKVTDLVKEQVK

SEQ ID NO: 1794775 - protein, 20 aa, Staphylococcus epidermidis
ESDLKEGCDMMIVKPSLSYL

SEQ ID NO: 1794776 - protein, 23 aa, Staphylococcus epidermidis
ESEEFKSHLLKLFKETDVAVMSG

SEQ ID NO: 1794777 - protein, 23 aa, Staphylococcus epidermidis
ESKQPLEFPSCGSVFQRPPGHFA

SEQ ID NO: 1794778 - protein, 24 aa, Staphylococcus epidermidis
ESLAEKIGKLEVVQDYHNVEKQIH

SEQ ID NO: 1794779 - protein, 25 aa, Staphylococcus epidermidis
ESLGARKGEMLDMMTTDNGLTRLIF

SEQ ID NO: 1794780 - protein, 23 aa, Staphylococcus epidermidis
ESLKGFEGIEVWQIDKDDYSEDM

SEQ ID NO: 1794781 - protein, 26 aa, Staphylococcus epidermidis
ESLLRALKDNGLEEILAEGKEFDPNL

SEQ ID NO: 1794782 - protein, 27 aa, Staphylococcus epidermidis
ESLTIAKKCIKDINETLGYQLNNKTSE

SEQ ID NO: 1794783 - protein, 18 aa, Staphylococcus epidermidis
ESSAARMIAKSVVGSSLV

SEQ ID NO: 1794784 - protein, 26 aa, Staphylococcus epidermidis
ESTRAEWLFLDVFGWSKTDYLIHKDE

SEQ ID NO: 1794785 - protein, 19 aa, Staphylococcus epidermidis
ESVFARFISSIKEERVTAS

SEQ ID NO: 1794786 - protein, 19 aa, Staphylococcus epidermidis
ETADVLIVYIFKGKEFIPD

SEQ ID NO: 1794787 - protein, 23 aa, Staphylococcus epidermidis
ETFKSRVEKSIKDWDIKLQDTYY

SEQ ID NO: 1794788 - protein, 25 aa, Staphylococcus epidermidis
ETFVPLKPLRELEVIEGDYEDIIQE

SEQ ID NO: 1794789 - protein, 23 aa, Staphylococcus epidermidis
ETGIGFALSIERLLMALDEEGIS

SEQ ID NO: 1794790 - protein, 25 aa, Staphylococcus epidermidis
ETIGCPIGNYIPEWNDLVYHQDFKA

SEQ ID NO: 1794791 - protein, 19 aa, Staphylococcus epidermidis
ETILLRRLNRLAAKNTTKE

SEQ ID NO: 1794792 - protein, 25 aa, Staphylococcus epidermidis
ETLFPQRVDLGLGRAPGTDMMTASA

SEQ ID NO: 1794793 - protein, 25 aa, Staphylococcus epidermidis
ETLKSLKLNGYMVVIDTGVKGSTKQ

SEQ ID NO: 1794794 - protein, 26 aa, Staphylococcus epidermidis
ETLYDEGIQCLIDFDHSYHISQQNVY

SEQ ID NO: 1794795 - protein, 29 aa, Staphylococcus epidermidis
ETNTMPQWAGSCWYYLRYIDPHNEKMIAD

SEQ ID NO: 1794796 - protein, 17 aa, Staphylococcus epidermidis
ETNVYHLPDNVSAREGA

SEQ ID NO: 1794797 - protein, 18 aa, Staphylococcus epidermidis
ETPFAAIILAEIFDKVGV

SEQ ID NO: 1794798 - protein, 18 aa, Staphylococcus epidermidis
ETPVGRNGIKATFKGSDS

SEQ ID NO: 1794799 - protein, 25 aa, Staphylococcus epidermidis
ETRDLKGGQTIGLFSYGSGSVGEFF

SEQ ID NO: 1794800 - protein, 19 aa, Staphylococcus epidermidis
ETSRWDYLISPNRYSTEIF

SEQ ID NO: 1794801 - protein, 25 aa, Staphylococcus epidermidis
ETTIKEAAMLAGYFSKAGSSAQIPV

SEQ ID NO: 1794802 - protein, 23 aa, Staphylococcus epidermidis
EVACLNKHLHFHGSTEAFKSLDE

SEQ ID NO: 1794803 - protein, 25 aa, Staphylococcus epidermidis
EVAEACLKLGVSMINDQWAGLFDSN

SEQ ID NO: 1794804 - protein, 35 aa, Staphylococcus epidermidis
EVDVSCFKCKGQGCNVCKHTGWIEILGAGMVHPNV

SEQ ID NO: 1794805 - protein, 29 aa, Staphylococcus epidermidis
EVIAACLLTAVPVMKIFKYFYSNRGPVID

SEQ ID NO: 1794806 - protein, 26 aa, Staphylococcus epidermidis
EVIFPRETMIGSMAYYISHAKNEKNF

SEQ ID NO: 1794807 - protein, 24 aa, Staphylococcus epidermidis
EVNRMCKPDFLLNVALNKSKEITA

SEQ ID NO: 1794808 - protein, 18 aa, Staphylococcus epidermidis
EVVTSHMIDLLNKYDKQN

SEQ ID NO: 1794809 - protein, 26 aa, Staphylococcus epidermidis
EVVYEAWTKTDILKKWFMTTQRTNKS

SEQ ID NO: 1794810 - protein, 23 aa, Staphylococcus epidermidis
EYGSRIIGLRAGELVYDGPASEA

SEQ ID NO: 1794811 - protein, 18 aa, Staphylococcus epidermidis
EYIVLKLQSKPHRLHQVS

SEQ ID NO: 1794812 - protein, 28 aa, Staphylococcus epidermidis
EYKNLVVSVRVGMEMERSELLRKLVDVQ

SEQ ID NO: 1794813 - protein, 19 aa, Staphylococcus epidermidis
EYLEGPIFISTDQPDPLLG

SEQ ID NO: 1794814 - protein, 26 aa, Staphylococcus epidermidis
EYQEFLQNEIARWIKIQEDIGLDVLV

SEQ ID NO: 1794815 - protein, 19 aa, Staphylococcus epidermidis
FADDIKFLLDAIYIDEAAF

SEQ ID NO: 1794816 - protein, 19 aa, Staphylococcus epidermidis
FAEACILALSHTKKNKIVV

SEQ ID NO: 1794817 - protein, 19 aa, Staphylococcus epidermidis
FAEGIEVGQVFKLGTKYSE

SEQ ID NO: 1794818 - protein, 19 aa, Staphylococcus epidermidis
FAKSLGHSITELFPTEVPI

SEQ ID NO: 1794819 - protein, 18 aa, Staphylococcus epidermidis
FARIDWEVLQKISSRIVN

SEQ ID NO: 1794820 - protein, 18 aa, Staphylococcus epidermidis
FATKFNLPIIEVIEGGEV

SEQ ID NO: 1794821 - protein, 25 aa, Staphylococcus epidermidis
FDASVEVAFRLGIDTRKNDQQIRGA

SEQ ID NO: 1794822 - protein, 19 aa, Staphylococcus epidermidis
FDDRIKIVISDQGESFDYE

SEQ ID NO: 1794823 - protein, 17 aa, Staphylococcus epidermidis
FDEWRYLPDGSDNPDFN

SEQ ID NO: 1794824 - protein, 19 aa, Staphylococcus epidermidis
FDHTLEVIQQLKLNHSLYI

SEQ ID NO: 1794825 - protein, 26 aa, Staphylococcus epidermidis
FDIEELLARIRAVLRRQPDKDVLDIN

SEQ ID NO: 1794826 - protein, 17 aa, Staphylococcus epidermidis
FDIPHPSGHELLVKVQS

SEQ ID NO: 1794827 - protein, 18 aa, Staphylococcus epidermidis
FDLILKFADYGFPRAHAV

SEQ ID NO: 1794828 - protein, 23 aa, Staphylococcus epidermidis
FDLTKVWYKKDYPLIEVGEFELN

SEQ ID NO: 1794829 - protein, 17 aa, Staphylococcus epidermidis
FDLVKRYDIHMTLPSLN

SEQ ID NO: 1794830 - protein, 19 aa, Staphylococcus epidermidis
FDNAFLLRTFSKAYGLAGL

SEQ ID NO: 1794831 - protein, 25 aa, Staphylococcus epidermidis
FDVDVPRTDWDWMIYPQGLYDQIMR

SEQ ID NO: 1794832 - protein, 20 aa, Staphylococcus epidermidis
FDVGNLYLNRGCTAAVVGYH

SEQ ID NO: 1794833 - protein, 17 aa, Staphylococcus epidermidis
FDYRPEVLETFDNKHQG

SEQ ID NO: 1794834 - protein, 22 aa, Staphylococcus epidermidis
FEDYFLIVSDLIHFAKTHEVMV

SEQ ID NO: 1794835 - protein, 25 aa, Staphylococcus epidermidis
FEHAFYCEACGNMATAKTCPHDASQ

SEQ ID NO: 1794836 - protein, 26 aa, Staphylococcus epidermidis
FEITTGLKTNGIFIYDGDEPLLKPHV

SEQ ID NO: 1794837 - protein, 19 aa, Staphylococcus epidermidis
FEKEGPRIMTLEPQDDNRD

SEQ ID NO: 1794838 - protein, 17 aa, Staphylococcus epidermidis
FEKTMARGYRREEVDAF

SEQ ID NO: 1794839 - protein, 17 aa, Staphylococcus epidermidis
FELKASVIDFASTASMD

SEQ ID NO: 1794840 - protein, 18 aa, Staphylococcus epidermidis
FELLDEIEETLNIDTYPM

SEQ ID NO: 1794841 - protein, 28 aa, Staphylococcus epidermidis
FELNKDFNFSAAHYIPFEEAGKCIRTHG

SEQ ID NO: 1794842 - protein, 18 aa, Staphylococcus epidermidis
FEMLRQMLNHHFISNEII

SEQ ID NO: 1794843 - protein, 17 aa, Staphylococcus epidermidis
FEMYSWAQIGIHQKPIG

SEQ ID NO: 1794844 - protein, 17 aa, Staphylococcus epidermidis
FENIKVGDPFDEDTKMS

SEQ ID NO: 1794845 - protein, 17 aa, Staphylococcus epidermidis
FEQLLLKEKSILVAPGK

SEQ ID NO: 1794846 - protein, 24 aa, Staphylococcus epidermidis
FEQTEVRLVLSFLRTIDNPLQDIY

SEQ ID NO: 1794847 - protein, 25 aa, Staphylococcus epidermidis
FESNTSWPLAMPVFKMDYAHKEYEA

SEQ ID NO: 1794848 - protein, 21 aa, Staphylococcus epidermidis
FGACPTCDGLGQKLKVDLDLV

SEQ ID NO: 1794849 - protein, 20 aa, Staphylococcus epidermidis
FGARPLKRFVQRQIETPIAR

SEQ ID NO: 1794850 - protein, 25 aa, Staphylococcus epidermidis
FGAYYRGYCSDITRTFAIGEPDPKL

SEQ ID NO: 1794851 - protein, 17 aa, Staphylococcus epidermidis
FGDPEAQVLLTRLESDL

SEQ ID NO: 1794852 - protein, 31 aa, Staphylococcus epidermidis
FGEVGRALYNFIWDEFCDWYIEMSKIPMNGE

SEQ ID NO: 1794853 - protein, 17 aa, Staphylococcus epidermidis
FGGVVPEVASRHHVEGI

SEQ ID NO: 1794854 - protein, 23 aa, Staphylococcus epidermidis
FGHEEIKRLVAFQQEIIDHIQPI

SEQ ID NO: 1794855 - protein, 25 aa, Staphylococcus epidermidis
FGISGPAALRCSQFVYKEQKNQKKK

SEQ ID NO: 1794856 - protein, 23 aa, Staphylococcus epidermidis
FGKMRKIAMEKGFKHCQAGPLVR

SEQ ID NO: 1794857 - protein, 19 aa, Staphylococcus epidermidis
FGTASGRVILADTSNGHII

SEQ ID NO: 1794858 - protein, 17 aa, Staphylococcus epidermidis
FGTGGWQLSALNLCNKA

SEQ ID NO: 1794859 - protein, 19 aa, Staphylococcus epidermidis
FGVDLKLMRDIIEDVNKIY

SEQ ID NO: 1794860 - protein, 25 aa, Staphylococcus epidermidis
FGVGNLMMRYVMKKKNVDDLPSLIN

SEQ ID NO: 1794861 - protein, 25 aa, Staphylococcus epidermidis
FHLRLLNNHIFRSGEFNTKFLEKYN

SEQ ID NO: 1794862 - protein, 21 aa, Staphylococcus epidermidis
FHWYVKGPNFFSLHTKFEELY

SEQ ID NO: 1794863 - protein, 18 aa, Staphylococcus epidermidis
FIAHSEMKEMLKSPLNKG

SEQ ID NO: 1794864 - protein, 17 aa, Staphylococcus epidermidis
FIDEGFGTLDQETLETA

SEQ ID NO: 1794865 - protein, 18 aa, Staphylococcus epidermidis
FIDVETMLTLLDLAHVYV

SEQ ID NO: 1794866 - protein, 19 aa, Staphylococcus epidermidis
FIEEKRFIAKNAVDLIEDG

SEQ ID NO: 1794867 - protein, 18 aa, Staphylococcus epidermidis
FIEMNARIQVEHTVTEMR

SEQ ID NO: 1794868 - protein, 32 aa, Staphylococcus epidermidis
FIKSELGSRMRLRIIPELTFEYDESIEYGNKI

SEQ ID NO: 1794869 - protein, 19 aa, Staphylococcus epidermidis
FIKSNRLKGLSLKDVNLSV

SEQ ID NO: 1794870 - protein, 18 aa, Staphylococcus epidermidis
FILPGYRDVPQIIWHGLP

SEQ ID NO: 1794871 - protein, 18 aa, Staphylococcus epidermidis
FILSLGINHVRVRYHHNI

SEQ ID NO: 1794872 - protein, 23 aa, Staphylococcus epidermidis
FINRDLFKYIPFDGSIITISELQ

SEQ ID NO: 1794873 - protein, 21 aa, Staphylococcus epidermidis
FIRTLKGGFKDGSFEKKLQRV

SEQ ID NO: 1794874 - protein, 23 aa, Staphylococcus epidermidis
FKAILRCDPDVILIGEIRDSTVA

SEQ ID NO: 1794875 - protein, 19 aa, Staphylococcus epidermidis
FKDSIIIGAVDIRHQLNDK

SEQ ID NO: 1794876 - protein, 20 aa, Staphylococcus epidermidis
FKEDDIELFTDIANKVKQTN

SEQ ID NO: 1794877 - protein, 24 aa, Staphylococcus epidermidis
FKELKANGVHTCIDTSAGCVNDTP

SEQ ID NO: 1794878 - protein, 17 aa, Staphylococcus epidermidis
FKKQIALAKRVQLPIII

SEQ ID NO: 1794879 - protein, 23 aa, Staphylococcus epidermidis
FKLNHSNHILPIFEKSKEILDYH

SEQ ID NO: 1794880 - protein, 19 aa, Staphylococcus epidermidis
FKNEAFYIMATKNGMIKKS

SEQ ID NO: 1794881 - protein, 28 aa, Staphylococcus epidermidis
FKNTESKLTVAMGYRINNEPLLMDIAKT

SEQ ID NO: 1794882 - protein, 17 aa, Staphylococcus epidermidis
FKQMLLYIMTDLAKSIA

SEQ ID NO: 1794883 - protein, 18 aa, Staphylococcus epidermidis
FKRIEAIEYSVKYDDGKH

SEQ ID NO: 1794884 - protein, 24 aa, Staphylococcus epidermidis
FKSIKVCPLIYWTEEEVWSYIRDK

SEQ ID NO: 1794885 - protein, 20 aa, Staphylococcus epidermidis
FKSTYGHLAGAWRGKKPIQR

SEQ ID NO: 1794886 - protein, 21 aa, Staphylococcus epidermidis
FKTGRWNKNIDVREFIQLNYS

SEQ ID NO: 1794887 - protein, 19 aa, Staphylococcus epidermidis
FKTKEEFEALIKDDQFIEY

SEQ ID NO: 1794888 - protein, 23 aa, Staphylococcus epidermidis
FKVQRIIERSCKFYGNNYISKKA

SEQ ID NO: 1794889 - protein, 17 aa, Staphylococcus epidermidis
FKYLCGAGVAYKLAQGL

SEQ ID NO: 1794890 - protein, 20 aa, Staphylococcus epidermidis
FLIAKARYARTIKGTKPTFK

SEQ ID NO: 1794891 - protein, 17 aa, Staphylococcus epidermidis
FLIEERGVKSIGHETFD

SEQ ID NO: 1794892 - protein, 18 aa, Staphylococcus epidermidis
FLLVKREIFSSGKSICRI

SEQ ID NO: 1794893 - protein, 17 aa, Staphylococcus epidermidis
FLMNPVYDFDLVKRYDI

SEQ ID NO: 1794894 - protein, 21 aa, Staphylococcus epidermidis
FLNSRTTIFPILGGGERLGTL

SEQ ID NO: 1794895 - protein, 17 aa, Staphylococcus epidermidis
FLSSLPVGGLGLDLVHD

SEQ ID NO: 1794896 - protein, 17 aa, Staphylococcus epidermidis
FMLDAGLMFPEDEMLGV

SEQ ID NO: 1794897 - protein, 18 aa, Staphylococcus epidermidis
FNAEKGFGFIERENGGDV

SEQ ID NO: 1794898 - protein, 23 aa, Staphylococcus epidermidis
FNDYPIEVERLLDIVEIKVHALH

SEQ ID NO: 1794899 - protein, 17 aa, Staphylococcus epidermidis
FNGLYIITPFQKVDYSL

SEQ ID NO: 1794900 - protein, 28 aa, Staphylococcus epidermidis
FNGVLCGRATWSGAVKVYIEEGEQAARE

SEQ ID NO: 1794901 - protein, 17 aa, Staphylococcus epidermidis
FNIRGIKQIIFDEQGHL

SEQ ID NO: 1794902 - protein, 22 aa, Staphylococcus epidermidis
FNKGDLNAPVILNQQYGLGMDY

SEQ ID NO: 1794903 - protein, 18 aa, Staphylococcus epidermidis
FNKKRYAKHLKNVVNNKI

SEQ ID NO: 1794904 - protein, 27 aa, Staphylococcus epidermidis
FNLAEEYQCPVILLSDLQLSLGKQTVK

SEQ ID NO: 1794905 - protein, 18 aa, Staphylococcus epidermidis
FNLESIASIMFTSGTTGP

SEQ ID NO: 1794906 - protein, 17 aa, Staphylococcus epidermidis
FNLLNGIGYTDDIDHLG

SEQ ID NO: 1794907 - protein, 20 aa, Staphylococcus epidermidis
FNPRTIFLLQHACRENDYEL

SEQ ID NO: 1794908 - protein, 17 aa, Staphylococcus epidermidis
FNSGLPLTMIGLDLARE

SEQ ID NO: 1794909 - protein, 19 aa, Staphylococcus epidermidis
FPDHGKFAEIFKMADTPQG

SEQ ID NO: 1794910 - protein, 21 aa, Staphylococcus epidermidis
FPEMFEGVLNHSILKRAQDKG

SEQ ID NO: 1794911 - protein, 20 aa, Staphylococcus epidermidis
FPEVKYWTTFNEIGPIGDGQ

SEQ ID NO: 1794912 - protein, 20 aa, Staphylococcus epidermidis
FPIVELDASYYAIQPERNII

SEQ ID NO: 1794913 - protein, 19 aa, Staphylococcus epidermidis
FPTMVRDFQSVIGNEIKSQ

SEQ ID NO: 1794914 - protein, 19 aa, Staphylococcus epidermidis
FPYPSGAGLHVGHPEGYTA

SEQ ID NO: 1794915 - protein, 23 aa, Staphylococcus epidermidis
FPYSPRIGTPAARMDNQIDEETK

SEQ ID NO: 1794916 - protein, 18 aa, Staphylococcus epidermidis
FQALTPLYPEERILLETQ

SEQ ID NO: 1794917 - protein, 27 aa, Staphylococcus epidermidis
FQANGLKCVMIAKLPFMNKHNIKYWLM

SEQ ID NO: 1794918 - protein, 17 aa, Staphylococcus epidermidis
FQFCDSQFPTGAFSHSF

SEQ ID NO: 1794919 - protein, 17 aa, Staphylococcus epidermidis
FQIGSAIKRIQLTNKEK

SEQ ID NO: 1794920 - protein, 17 aa, Staphylococcus epidermidis
FQILVKYKSEPQLHQAL

SEQ ID NO: 1794921 - protein, 18 aa, Staphylococcus epidermidis
FQLYERFVIDYSLGSATG

SEQ ID NO: 1794922 - protein, 25 aa, Staphylococcus epidermidis
FRDDALRLAHEDLYETKAILENVIL

SEQ ID NO: 1794923 - protein, 17 aa, Staphylococcus epidermidis
FRDIAILYRDESYAYLF

SEQ ID NO: 1794924 - protein, 22 aa, Staphylococcus epidermidis
FRDLIKILVELEQSGLIERTRT

SEQ ID NO: 1794925 - protein, 21 aa, Staphylococcus epidermidis
FRLESLNVHAAIVGKAAHLDE

SEQ ID NO: 1794926 - protein, 18 aa, Staphylococcus epidermidis
FSETSREGFLLAQEISSY

SEQ ID NO: 1794927 - protein, 18 aa, Staphylococcus epidermidis
FSGLKSAVINKLHNLRQK

SEQ ID NO: 1794928 - protein, 25 aa, Staphylococcus epidermidis
FSHYLKVRPGAFFLTGCGNKDKGIT

SEQ ID NO: 1794929 - protein, 25 aa, Staphylococcus epidermidis
FSKDCFKLSAILSKLRIEYNKYIKV

SEQ ID NO: 1794930 - protein, 19 aa, Staphylococcus epidermidis
FSRQRYWGEPIPIIHWEDG

SEQ ID NO: 1794931 - protein, 17 aa, Staphylococcus epidermidis
FSSIDIANELLKQQSTI

SEQ ID NO: 1794932 - protein, 18 aa, Staphylococcus epidermidis
FSSIGVTIADNFNVELPK

SEQ ID NO: 1794933 - protein, 28 aa, Staphylococcus epidermidis
FSTGMKMKLSLAIAFSHHAELFILDEPT

SEQ ID NO: 1794934 - protein, 28 aa, Staphylococcus epidermidis
FTAYSMYPNLWKNMGLSYPDLIAKLIDL

SEQ ID NO: 1794935 - protein, 31 aa, Staphylococcus epidermidis
FTEVGIFSVMWSEHCSYKHSKPFLKQFPTTG

SEQ ID NO: 1794936 - protein, 26 aa, Staphylococcus epidermidis
FTGRVCPAPCEQSCVMKINRESVAIK

SEQ ID NO: 1794937 - protein, 24 aa, Staphylococcus epidermidis
FTHWEELKSTWKFVDAIQDQWTMV

SEQ ID NO: 1794938 - protein, 30 aa, Staphylococcus epidermidis
FTLDILREMKRYQVEWTKQYDIWFSIYSTP

SEQ ID NO: 1794939 - protein, 18 aa, Staphylococcus epidermidis
FTTFEHIEVSPLIVVKKD

SEQ ID NO: 1794940 - protein, 32 aa, Staphylococcus epidermidis
FVDMPVGALWRRGHKPMKAQGLEYIENLGDYV

SEQ ID NO: 1794941 - protein, 17 aa, Staphylococcus epidermidis
FVEDEFCGFKVSNQLIY

SEQ ID NO: 1794942 - protein, 18 aa, Staphylococcus epidermidis
FVHESAKAGVDVFRIFDS

SEQ ID NO: 1794943 - protein, 21 aa, Staphylococcus epidermidis
FVRYHGRNHYGWTKKDMTDQE

SEQ ID NO: 1794944 - protein, 18 aa, Staphylococcus epidermidis
FVVNGMLIRKDFYSYVRT

SEQ ID NO: 1794945 - protein, 26 aa, Staphylococcus epidermidis
FVYGLFIYNKWRGMGTLNSVDVINQH

SEQ ID NO: 1794946 - protein, 20 aa, Staphylococcus epidermidis
FYDMSVGICHNGNLINAKSL

SEQ ID NO: 1794947 - protein, 23 aa, Staphylococcus epidermidis
FYDNSLEFLALFEKLSLEMNDIV

SEQ ID NO: 1794948 - protein, 17 aa, Staphylococcus epidermidis
FYEFYSYLMEPWDGPTM

SEQ ID NO: 1794949 - protein, 18 aa, Staphylococcus epidermidis
FYESFILQSHEKLASSLP

SEQ ID NO: 1794950 - protein, 18 aa, Staphylococcus epidermidis
FYHFKYPYADGNGYIEIA

SEQ ID NO: 1794951 - protein, 21 aa, Staphylococcus epidermidis
FYLAMAPQFFGVISDYLKSSG

SEQ ID NO: 1794952 - protein, 17 aa, Staphylococcus epidermidis
FYLDENFETFTINVTSF

SEQ ID NO: 1794953 - protein, 19 aa, Staphylococcus epidermidis
FYLKLGYSPFGKVFLEENI

SEQ ID NO: 1794954 - protein, 25 aa, Staphylococcus epidermidis
FYMNCTKNAMLPICLNQKEREHLAQ

SEQ ID NO: 1794955 - protein, 19 aa, Staphylococcus epidermidis
FYNKAMCVCGTGGDQSNSF

SEQ ID NO: 1794956 - protein, 25 aa, Staphylococcus epidermidis
GAADMKSGLAALAIALIEIKESGKL

SEQ ID NO: 1794957 - protein, 19 aa, Staphylococcus epidermidis
GADTLRLYEMFMGPLDAAI

SEQ ID NO: 1794958 - protein, 17 aa, Staphylococcus epidermidis
GALGDYQLIDGLGPEVE

SEQ ID NO: 1794959 - protein, 25 aa, Staphylococcus epidermidis
GAPLKRGAATIAMLGKAPILPAAYV

SEQ ID NO: 1794960 - protein, 23 aa, Staphylococcus epidermidis
GAQNKIRVEFKFKETLKPLTTDY

SEQ ID NO: 1794961 - protein, 23 aa, Staphylococcus epidermidis
GARCMDCGTPFCQTGQSYGRETI

SEQ ID NO: 1794962 - protein, 23 aa, Staphylococcus epidermidis
GASGPLYGFGFIKMASAVNDEID

SEQ ID NO: 1794963 - protein, 17 aa, Staphylococcus epidermidis
GATIGIIGGGQLGKMMA

SEQ ID NO: 1794964 - protein, 33 aa, Staphylococcus epidermidis
GAVVAWNFPILLASWKLGPALAAGNTVVIQPSS

SEQ ID NO: 1794965 - protein, 26 aa, Staphylococcus epidermidis
GCAGGIARPAAAHALHYDKLPQRLVT

SEQ ID NO: 1794966 - protein, 24 aa, Staphylococcus epidermidis
GCDYRCSWCDSAFTWDGSAKEDIK

SEQ ID NO: 1794967 - protein, 23 aa, Staphylococcus epidermidis
GCFWCMVKPFTSYPGIKSVVSGY

SEQ ID NO: 1794968 - protein, 17 aa, Staphylococcus epidermidis
GCGAPLQSENKDAPGYV

SEQ ID NO: 1794969 - protein, 27 aa, Staphylococcus epidermidis
GCLQNCGLCASSLYALVDGDIVEGNTP

SEQ ID NO: 1794970 - protein, 17 aa, Staphylococcus epidermidis
GCLWGTQAFFNTIPGVI

SEQ ID NO: 1794971 - protein, 17 aa, Staphylococcus epidermidis
GCQTGFYVSFINHDDYD

SEQ ID NO: 1794972 - protein, 22 aa, Staphylococcus epidermidis
GCSRYPECDFISWDKPVGRDCP

SEQ ID NO: 1794973 - protein, 20 aa, Staphylococcus epidermidis
GCTHYPLLYQPIYEYFSGTK

SEQ ID NO: 1794974 - protein, 17 aa, Staphylococcus epidermidis
GDDYVILLRMHYLISNA

SEQ ID NO: 1794975 - protein, 18 aa, Staphylococcus epidermidis
GDGLIITGSLYFISEVKA

SEQ ID NO: 1794976 - protein, 18 aa, Staphylococcus epidermidis
GDGSYRGAQRISEECKEI

SEQ ID NO: 1794977 - protein, 27 aa, Staphylococcus epidermidis
GDHRLSPDVYLKWYKKSPCTVDIQKRF

SEQ ID NO: 1794978 - protein, 18 aa, Staphylococcus epidermidis
GDILLQVLLHSSIGKKEG

SEQ ID NO: 1794979 - protein, 26 aa, Staphylococcus epidermidis
GDPMFQFCLGIPWGAENDPETIEYLK

SEQ ID NO: 1794980 - protein, 21 aa, Staphylococcus epidermidis
GDQIRCRLRSKGHIIINDVAN

SEQ ID NO: 1794981 - protein, 19 aa, Staphylococcus epidermidis
GDTVRPALQIIKTKPGVSR

SEQ ID NO: 1794982 - protein, 18 aa, Staphylococcus epidermidis
GDVQGSVEALAASLMKID

SEQ ID NO: 1794983 - protein, 26 aa, Staphylococcus epidermidis
GDYFKHEAIEFAWEFLTSDKWMGMEP

SEQ ID NO: 1794984 - protein, 24 aa, Staphylococcus epidermidis
GDYFPHRLGHGLGLEEHEYQDISS

SEQ ID NO: 1794985 - protein, 17 aa, Staphylococcus epidermidis
GDYKHILVVGADKLSKI

SEQ ID NO: 1794986 - protein, 23 aa, Staphylococcus epidermidis
GDYRRVALYGVDFLMEQKLKDFN

SEQ ID NO: 1794987 - protein, 21 aa, Staphylococcus epidermidis
GEFSLRGGIIDIYPLIGTPVR

SEQ ID NO: 1794988 - protein, 26 aa, Staphylococcus epidermidis
GEIAVRIIRACRELNIETVAIYAKGD

SEQ ID NO: 1794989 - protein, 17 aa, Staphylococcus epidermidis
GEIMPIYDAAMKYKEDG

SEQ ID NO: 1794990 - protein, 23 aa, Staphylococcus epidermidis
GEITGNAGHDWIFDELESLGYKH

SEQ ID NO: 1794991 - protein, 20 aa, Staphylococcus epidermidis
GEIVKWFIKAGDTIEEDDVL

SEQ ID NO: 1794992 - protein, 26 aa, Staphylococcus epidermidis
GEKAHSIRVANDWGITTKDLKIDFTQ

SEQ ID NO: 1794993 - protein, 18 aa, Staphylococcus epidermidis
GEKQGKKLFVYGGAEHPH

SEQ ID NO: 1794994 - protein, 18 aa, Staphylococcus epidermidis
GELLFGDTVAVFGAGPIG

SEQ ID NO: 1794995 - protein, 20 aa, Staphylococcus epidermidis
GELNGALGVEKIFNSYLNGS

SEQ ID NO: 1794996 - protein, 21 aa, Staphylococcus epidermidis
GEMGIMYGHIPTVAALKTGHV

SEQ ID NO: 1794997 - protein, 18 aa, Staphylococcus epidermidis
GEPIPIIHWEDGSMTTVP

SEQ ID NO: 1794998 - protein, 20 aa, Staphylococcus epidermidis
GEPTSNIAYYAHKGSMSCVV

SEQ ID NO: 1794999 - protein, 19 aa, Staphylococcus epidermidis
GESISKAKVEFSFIDVTAR

SEQ ID NO: 1795000 - protein, 24 aa, Staphylococcus epidermidis
GESSRFGKAKAFAKIDNQYFYQKI

SEQ ID NO: 1795001 - protein, 24 aa, Staphylococcus epidermidis
GEVAEGRGIISYEMGSDGSGGKYL

SEQ ID NO: 1795002 - protein, 17 aa, Staphylococcus epidermidis
GEVNGTISIGCSSLIGQ

SEQ ID NO: 1795003 - protein, 17 aa, Staphylococcus epidermidis
GEYILRQQISHYLFNSR

SEQ ID NO: 1795004 - protein, 25 aa, Staphylococcus epidermidis
GEYYLPDVLSLILKDGGKAEVYCTE

SEQ ID NO: 1795005 - protein, 22 aa, Staphylococcus epidermidis
GFEDYRFRLSYRDPEDKHKYFD

SEQ ID NO: 1795006 - protein, 19 aa, Staphylococcus epidermidis
GFELPYMQLVVITERELFK

SEQ ID NO: 1795007 - protein, 27 aa, Staphylococcus epidermidis
GFIYSKPRSGYFVSDIESLPVIHRQTN

SEQ ID NO: 1795008 - protein, 24 aa, Staphylococcus epidermidis
GFNKSEAMIILFSKLFKEKDKAMK

SEQ ID NO: 1795009 - protein, 19 aa, Staphylococcus epidermidis
GFTCYVPSYPGHGLPLKEF

SEQ ID NO: 1795010 - protein, 24 aa, Staphylococcus epidermidis
GGKKEIMDYIAPVGTIYQAGTLSG

SEQ ID NO: 1795011 - protein, 25 aa, Staphylococcus epidermidis
GGKLGSGRQWYSWIHIDDLIRGILF

SEQ ID NO: 1795012 - protein, 17 aa, Staphylococcus epidermidis
GGKVVVLGCPAEEGGEN

SEQ ID NO: 1795013 - protein, 21 aa, Staphylococcus epidermidis
GGLALGLAVTGFRPVMEIQFL

SEQ ID NO: 1795014 - protein, 19 aa, Staphylococcus epidermidis
GGNIVPHIHLPVQSGNNQV

SEQ ID NO: 1795015 - protein, 18 aa, Staphylococcus epidermidis
GGNRLFYLAMAPQFFGVI

SEQ ID NO: 1795016 - protein, 23 aa, Staphylococcus epidermidis
GGPVRAVLELAGITDILSKSLGS

SEQ ID NO: 1795017 - protein, 19 aa, Staphylococcus epidermidis
GGQGTRLGYKGPKGSFEIE

SEQ ID NO: 1795018 - protein, 18 aa, Staphylococcus epidermidis
GGSREKRTRFPIEVLTKV

SEQ ID NO: 1795019 - protein, 23 aa, Staphylococcus epidermidis
GGSRLKDGILAIDLLRRPEMNYE

SEQ ID NO: 1795020 - protein, 18 aa, Staphylococcus epidermidis
GGTTCKLGIFDKDLEQLH

SEQ ID NO: 1795021 - protein, 18 aa, Staphylococcus epidermidis
GGVGEIAKNMYIVEVDDE

SEQ ID NO: 1795022 - protein, 27 aa, Staphylococcus epidermidis
GGYGAIKFALTQSYRFSKAAMLSAPYD

SEQ ID NO: 1795023 - protein, 22 aa, Staphylococcus epidermidis
GHAPDLIKSAAYSNILPSSTNP

SEQ ID NO: 1795024 - protein, 17 aa, Staphylococcus epidermidis
GHELFDIMMQNIEEDTC

SEQ ID NO: 1795025 - protein, 20 aa, Staphylococcus epidermidis
GHPGLPMGAAPMAYTLWTRH

SEQ ID NO: 1795026 - protein, 22 aa, Staphylococcus epidermidis
GHPVEFNPLLQMNKGVKLTTTI

SEQ ID NO: 1795027 - protein, 26 aa, Staphylococcus epidermidis
GHRYDDCPNFVKGHVPELYIENERIK

SEQ ID NO: 1795028 - protein, 18 aa, Staphylococcus epidermidis
GHTRFPIVNEEFKLVGIV

SEQ ID NO: 1795029 - protein, 19 aa, Staphylococcus epidermidis
GHVKFPLREVDVEDVTLPL

SEQ ID NO: 1795030 - protein, 17 aa, Staphylococcus epidermidis
GHYVMIATGRPYRASQM

SEQ ID NO: 1795031 - protein, 23 aa, Staphylococcus epidermidis
GIALSTDEKVLWVTETTTNRLHR

SEQ ID NO: 1795032 - protein, 26 aa, Staphylococcus epidermidis
GIELGIPEHLVWRQPFPGPGLGIRVL

SEQ ID NO: 1795033 - protein, 17 aa, Staphylococcus epidermidis
GIGRPGLIRFKLQVIPK

SEQ ID NO: 1795034 - protein, 18 aa, Staphylococcus epidermidis
GIGTCWKSPQYIFDPKIR

SEQ ID NO: 1795035 - protein, 20 aa, Staphylococcus epidermidis
GIGYEIQTPNSYRFQKYLEK

SEQ ID NO: 1795036 - protein, 19 aa, Staphylococcus epidermidis
GIHAFKLGFITSAVDRELP

SEQ ID NO: 1795037 - protein, 18 aa, Staphylococcus epidermidis
GIHARPATMLVQTASKFD

SEQ ID NO: 1795038 - protein, 24 aa, Staphylococcus epidermidis
GINELRESIQYFAKVESRTILEQQ

SEQ ID NO: 1795039 - protein, 25 aa, Staphylococcus epidermidis
GINGEIRPGIVHRIDKDTSGLLMVA

SEQ ID NO: 1795040 - protein, 21 aa, Staphylococcus epidermidis
GIPEGVLIRAIEPDEGIGAMN

SEQ ID NO: 1795041 - protein, 19 aa, Staphylococcus epidermidis
GISDDTWGQVPILYYVTNQ

SEQ ID NO: 1795042 - protein, 26 aa, Staphylococcus epidermidis
GISDLELIGIGGFSPLTGFMNKEDYT

SEQ ID NO: 1795043 - protein, 21 aa, Staphylococcus epidermidis
GISLREGDTVVGLDVADSESE

SEQ ID NO: 1795044 - protein, 20 aa, Staphylococcus epidermidis
GISSPDVFKALDLTEEHIVH

SEQ ID NO: 1795045 - protein, 18 aa, Staphylococcus epidermidis
GIVKRSSLSNFSRINKNG

SEQ ID NO: 1795046 - protein, 21 aa, Staphylococcus epidermidis
GIYGKRWLDEDIFSIDQFSRM

SEQ ID NO: 1795047 - protein, 21 aa, Staphylococcus epidermidis
GIYLRAYTYIRSMGANGLKEV

SEQ ID NO: 1795048 - protein, 19 aa, Staphylococcus epidermidis
GIYSYELYHFFDVDTIIRV

SEQ ID NO: 1795049 - protein, 19 aa, Staphylococcus epidermidis
GKAKFDFGTVKFVQAFHSS

SEQ ID NO: 1795050 - protein, 22 aa, Staphylococcus epidermidis
GKALFAAAFISHFSGDIPHIHF

SEQ ID NO: 1795051 - protein, 19 aa, Staphylococcus epidermidis
GKALLVDMIAVQNLEQRAK

SEQ ID NO: 1795052 - protein, 18 aa, Staphylococcus epidermidis
GKDAEQFIQYILSNDTNL

SEQ ID NO: 1795053 - protein, 20 aa, Staphylococcus epidermidis
GKDAFKQAIVNFYQRHYDVE

SEQ ID NO: 1795054 - protein, 24 aa, Staphylococcus epidermidis
GKDLKIAIVVSRFNDFITTRLLEG

SEQ ID NO: 1795055 - protein, 17 aa, Staphylococcus epidermidis
GKGKAGFAHIQDLKGQI

SEQ ID NO: 1795056 - protein, 26 aa, Staphylococcus epidermidis
GKIEPLKSLRVMGKFGDSVTTDHISP

SEQ ID NO: 1795057 - protein, 21 aa, Staphylococcus epidermidis
GKILDVGKCPFHPSSSHNTID

SEQ ID NO: 1795058 - protein, 24 aa, Staphylococcus epidermidis
GKITRNAGVRVIRDGIVLFEGELD

SEQ ID NO: 1795059 - protein, 26 aa, Staphylococcus epidermidis
GKKIPDEFVVGYGLDYRELYRNLPYI

SEQ ID NO: 1795060 - protein, 19 aa, Staphylococcus epidermidis
GKKSIAIRLSYLDTENTLT

SEQ ID NO: 1795061 - protein, 22 aa, Staphylococcus epidermidis
GKLKSKHAVVIGAGEMGELSLL

SEQ ID NO: 1795062 - protein, 17 aa, Staphylococcus epidermidis
GKLVLNRDGHIMETPNG

SEQ ID NO: 1795063 - protein, 19 aa, Staphylococcus epidermidis
GKQLMLRLEKELSKLHEAF

SEQ ID NO: 1795064 - protein, 26 aa, Staphylococcus epidermidis
GKSSLAHRLSKTFGFYEEKEIVDENP

SEQ ID NO: 1795065 - protein, 23 aa, Staphylococcus epidermidis
GKSTLLLQICAALSQNKNVLYIT

SEQ ID NO: 1795066 - protein, 21 aa, Staphylococcus epidermidis
GKSTLLSAISRLFSYENGSIL

SEQ ID NO: 1795067 - protein, 20 aa, Staphylococcus epidermidis
GKTGAFGIPLIEKVVGQQGV

SEQ ID NO: 1795068 - protein, 22 aa, Staphylococcus epidermidis
GKTKRDIMISGLGFITIDAGAK

SEQ ID NO: 1795069 - protein, 24 aa, Staphylococcus epidermidis
GKTPAQVVIRWNIQHDVVVIPKSV

SEQ ID NO: 1795070 - protein, 18 aa, Staphylococcus epidermidis
GKWSYLYRAIDAEGHTLD

SEQ ID NO: 1795071 - protein, 19 aa, Staphylococcus epidermidis
GKYLIEKAIDEGRLKEGDT

SEQ ID NO: 1795072 - protein, 27 aa, Staphylococcus epidermidis
GLDLPFPLKMNRLLGFDSTYVTYEGLI

SEQ ID NO: 1795073 - protein, 25 aa, Staphylococcus epidermidis
GLHVKQDWVDMGFGIADTVAKIVDQ

SEQ ID NO: 1795074 - protein, 22 aa, Staphylococcus epidermidis
GLKPQDGFEVITHFEFTSQHLD

SEQ ID NO: 1795075 - protein, 23 aa, Staphylococcus epidermidis
GLKRNIIHMGHFEAGEAINTVPS

SEQ ID NO: 1795076 - protein, 17 aa, Staphylococcus epidermidis
GLNVTRVLSEFGEDVIA

SEQ ID NO: 1795077 - protein, 21 aa, Staphylococcus epidermidis
GLRHKELPAFSVQYHPEARPG

SEQ ID NO: 1795078 - protein, 17 aa, Staphylococcus epidermidis
GLRVGVIRDWEAKWYAE

SEQ ID NO: 1795079 - protein, 23 aa, Staphylococcus epidermidis
GLSRDRVDIILPAISVFKTLFKK

SEQ ID NO: 1795080 - protein, 23 aa, Staphylococcus epidermidis
GLYEEMNHLLYCSSAGHEPGYIY

SEQ ID NO: 1795081 - protein, 25 aa, Staphylococcus epidermidis
GMAHPEGYRKALRLMKQAEKFNRPI

SEQ ID NO: 1795082 - protein, 20 aa, Staphylococcus epidermidis
GMGKCCVTGCSNVEIDTVNK

SEQ ID NO: 1795083 - protein, 24 aa, Staphylococcus epidermidis
GMGRIGRMVLRIALNNKNLNVKAI

SEQ ID NO: 1795084 - protein, 23 aa, Staphylococcus epidermidis
GMKLSANCDSTLKEAEKKVNELM

SEQ ID NO: 1795085 - protein, 18 aa, Staphylococcus epidermidis
GMRFYGYHGVLAAENDIG

SEQ ID NO: 1795086 - protein, 19 aa, Staphylococcus epidermidis
GNAGLSLYSSTKFAVRGLT

SEQ ID NO: 1795087 - protein, 20 aa, Staphylococcus epidermidis
GNDAKTTWDNALKGVNGIDK

SEQ ID NO: 1795088 - protein, 21 aa, Staphylococcus epidermidis
GNGFSVIYLISQRLVKKSLDD

SEQ ID NO: 1795089 - protein, 18 aa, Staphylococcus epidermidis
GNGKFLYSPFSVFDNLSI

SEQ ID NO: 1795090 - protein, 18 aa, Staphylococcus epidermidis
GNINFISRLLEGHYPDTT

SEQ ID NO: 1795091 - protein, 17 aa, Staphylococcus epidermidis
GNLGYITAVLLKKLYPT

SEQ ID NO: 1795092 - protein, 18 aa, Staphylococcus epidermidis
GNMVKSTSFAKLIQYQTY

SEQ ID NO: 1795093 - protein, 20 aa, Staphylococcus epidermidis
GNPLSMRAGIALLEVLEQEG

SEQ ID NO: 1795094 - protein, 17 aa, Staphylococcus epidermidis
GNRFYDWEYQTDEEPHM

SEQ ID NO: 1795095 - protein, 26 aa, Staphylococcus epidermidis
GNSLSFRAFYALPLLSNHAGIHTNAV

SEQ ID NO: 1795096 - protein, 27 aa, Staphylococcus epidermidis
GNTYLPRKFKIGIAVPPSNDIDVYSQD

SEQ ID NO: 1795097 - protein, 21 aa, Staphylococcus epidermidis
GPLDAAIAWSEKGLDGSRRFL

SEQ ID NO: 1795098 - protein, 26 aa, Staphylococcus epidermidis
GPLLHYRMVHELPTFFSSNFNYSELE

SEQ ID NO: 1795099 - protein, 21 aa, Staphylococcus epidermidis
GPYTQAAVMSIAFNHPLATVD

SEQ ID NO: 1795100 - protein, 19 aa, Staphylococcus epidermidis
GQAKWFLQDFEVLINGQRE

SEQ ID NO: 1795101 - protein, 17 aa, Staphylococcus epidermidis
GQIAVIGPTAMHYQNVI

SEQ ID NO: 1795102 - protein, 24 aa, Staphylococcus epidermidis
GQLENNGRCNLGVVTLNVPRIAIE

SEQ ID NO: 1795103 - protein, 18 aa, Staphylococcus epidermidis
GQLYRSGDLARLMPDGQI

SEQ ID NO: 1795104 - protein, 17 aa, Staphylococcus epidermidis
GQLYSEFKEFFPENRVE

SEQ ID NO: 1795105 - protein, 35 aa, Staphylococcus epidermidis
GQPEFINRLFEIEGVKSIFYVLDFISIDKEDNANW

SEQ ID NO: 1795106 - protein, 21 aa, Staphylococcus epidermidis
GQQGVDFFKHRGYEIESSLVE

SEQ ID NO: 1795107 - protein, 19 aa, Staphylococcus epidermidis
GRDGFVMGEGAGIVVLESL

SEQ ID NO: 1795108 - protein, 17 aa, Staphylococcus epidermidis
GRDLIDLLNDFATTELQ

SEQ ID NO: 1795109 - protein, 18 aa, Staphylococcus epidermidis
GRFENTFNRWMEEIRDWT

SEQ ID NO: 1795110 - protein, 17 aa, Staphylococcus epidermidis
GRGQLFINLAIDQAIKF

SEQ ID NO: 1795111 - protein, 17 aa, Staphylococcus epidermidis
GRIGIPNKGEWTNKPLR

SEQ ID NO: 1795112 - protein, 19 aa, Staphylococcus epidermidis
GRIRMDIAPINVPRLLQNV

SEQ ID NO: 1795113 - protein, 20 aa, Staphylococcus epidermidis
GRKPIKTSWAKHEQYDQVLA

SEQ ID NO: 1795114 - protein, 19 aa, Staphylococcus epidermidis
GRKRAILIHGANGMDEATL

SEQ ID NO: 1795115 - protein, 19 aa, Staphylococcus epidermidis
GRLIVSCYASNFVRIQQVL

SEQ ID NO: 1795116 - protein, 17 aa, Staphylococcus epidermidis
GRTITGVINVRKDLSNA

SEQ ID NO: 1795117 - protein, 19 aa, Staphylococcus epidermidis
GRTYHPYGTLGRVTYGYGN

SEQ ID NO: 1795118 - protein, 19 aa, Staphylococcus epidermidis
GRVVKGIQFQSLRDIGNPV

SEQ ID NO: 1795119 - protein, 21 aa, Staphylococcus epidermidis
GSCSWKVFVKNGVITWENQQI

SEQ ID NO: 1795120 - protein, 24 aa, Staphylococcus epidermidis
GSEFPIVIMPIVRQYYRMLQRPIL

SEQ ID NO: 1795121 - protein, 24 aa, Staphylococcus epidermidis
GSGKTVVAAICMYALKTAGYQSAL

SEQ ID NO: 1795122 - protein, 25 aa, Staphylococcus epidermidis
GSGLEAVIQACRMVQSGAGTIYIAG

SEQ ID NO: 1795123 - protein, 19 aa, Staphylococcus epidermidis
GSHFHRAPGSVGMASDASK

SEQ ID NO: 1795124 - protein, 18 aa, Staphylococcus epidermidis
GSIEFLEVVGLQGSTYLL

SEQ ID NO: 1795125 - protein, 18 aa, Staphylococcus epidermidis
GSIVGFFTPELFHGIGSA

SEQ ID NO: 1795126 - protein, 24 aa, Staphylococcus epidermidis
GSMLPKIESAISFIENNPNGSVLI

SEQ ID NO: 1795127 - protein, 22 aa, Staphylococcus epidermidis
GTDIPFCIYNQTAVCTGRGEQV

SEQ ID NO: 1795128 - protein, 33 aa, Staphylococcus epidermidis
GTDKRVSPDLFIKRTHFYDYLLLNSDGLTDYVR

SEQ ID NO: 1795129 - protein, 19 aa, Staphylococcus epidermidis
GTEIYFCNDDVYKLPIGTP

SEQ ID NO: 1795130 - protein, 23 aa, Staphylococcus epidermidis
GTERLVRAAIQYALDNNRKSVTL

SEQ ID NO: 1795131 - protein, 27 aa, Staphylococcus epidermidis
GTGAGVRRIEALTGKGAFLHLEEIETQ

SEQ ID NO: 1795132 - protein, 23 aa, Staphylococcus epidermidis
GTICGDDTCLLICRDEEASEEIK

SEQ ID NO: 1795133 - protein, 19 aa, Staphylococcus epidermidis
GTIRGDYGLNLGRNIIHGS

SEQ ID NO: 1795134 - protein, 20 aa, Staphylococcus epidermidis
GTKLTFLPYVVKALVSALKK

SEQ ID NO: 1795135 - protein, 17 aa, Staphylococcus epidermidis
GTKYSESMNATFLDNQG

SEQ ID NO: 1795136 - protein, 26 aa, Staphylococcus epidermidis
GTLTHLHLIKPLGFSTEDKMLKRAGL

SEQ ID NO: 1795137 - protein, 25 aa, Staphylococcus epidermidis
GTNIPIDHCYRCGYDGDFETTANGY

SEQ ID NO: 1795138 - protein, 22 aa, Staphylococcus epidermidis
GTRGFKAGNIVDVILTESNSFE

SEQ ID NO: 1795139 - protein, 20 aa, Staphylococcus epidermidis
GTSIFPTPVVGMVGLIEDVS

SEQ ID NO: 1795140 - protein, 21 aa, Staphylococcus epidermidis
GTTIKRIVKMLKDSGANRIHV

SEQ ID NO: 1795141 - protein, 18 aa, Staphylococcus epidermidis
GTTTGRPRRVGWFDSVVL

SEQ ID NO: 1795142 - protein, 28 aa, Staphylococcus epidermidis
GTVKNFRVTKIFGYFGLKREEIEEAQAG

SEQ ID NO: 1795143 - protein, 18 aa, Staphylococcus epidermidis
GTVYPLLRRLVKSGELST

SEQ ID NO: 1795144 - protein, 27 aa, Staphylococcus epidermidis
GTYTMPCARTLVPVDVPLDVSTSEVFD

SEQ ID NO: 1795145 - protein, 18 aa, Staphylococcus epidermidis
GVAKSYRGKGYATILLEK

SEQ ID NO: 1795146 - protein, 24 aa, Staphylococcus epidermidis
GVDFRLIEPAAFYHTLQHFTGSKD

SEQ ID NO: 1795147 - protein, 24 aa, Staphylococcus epidermidis
GVDHREIIEELSLLQYSEEEDKWT

SEQ ID NO: 1795148 - protein, 27 aa, Staphylococcus epidermidis
GVDIKDVFLKLPIIGTEVYDESNEIEF

SEQ ID NO: 1795149 - protein, 24 aa, Staphylococcus epidermidis
GVENLCPFSRDGQMRFLDNNQGGG

SEQ ID NO: 1795150 - protein, 18 aa, Staphylococcus epidermidis
GVKGILNFTPRRIKTPQD

SEQ ID NO: 1795151 - protein, 21 aa, Staphylococcus epidermidis
GVLKYKKRKAESIQKLDHTED

SEQ ID NO: 1795152 - protein, 23 aa, Staphylococcus epidermidis
GVRVISMPNWYAFEQQSSEYKES

SEQ ID NO: 1795153 - protein, 20 aa, Staphylococcus epidermidis
GVVLRWLRDEILASEVETAK

SEQ ID NO: 1795154 - protein, 21 aa, Staphylococcus epidermidis
GYDQLRLKGFYKDSNKKAEIS

SEQ ID NO: 1795155 - protein, 27 aa, Staphylococcus epidermidis
GYFNLAPEEFIVWVLGFNKSISELKQK

SEQ ID NO: 1795156 - protein, 25 aa, Staphylococcus epidermidis
GYHPDYDFLKTIGIDIHTNEYGTAP

SEQ ID NO: 1795157 - protein, 21 aa, Staphylococcus epidermidis
GYQQCPFKHYASHGLRLNERT

SEQ ID NO: 1795158 - protein, 18 aa, Staphylococcus epidermidis
GYSFIGLGSDGAFAEFTN

SEQ ID NO: 1795159 - protein, 17 aa, Staphylococcus epidermidis
GYTATDIISRYKRMQGY

SEQ ID NO: 1795160 - protein, 24 aa, Staphylococcus epidermidis
GYVPQCPHCDISLTYHKTTDQLKC

SEQ ID NO: 1795161 - protein, 25 aa, Staphylococcus epidermidis
HAGAIGLKVHEDWGATPSALSHALD

SEQ ID NO: 1795162 - protein, 26 aa, Staphylococcus epidermidis
HAGFKKKKLDFGWIVSEVPANVAGVF

SEQ ID NO: 1795163 - protein, 25 aa, Staphylococcus epidermidis
HAGQVCSAGSRILVHNDIKDKFEKA

SEQ ID NO: 1795164 - protein, 20 aa, Staphylococcus epidermidis
HAIAKGCDLNGMMAEIMGKR

SEQ ID NO: 1795165 - protein, 20 aa, Staphylococcus epidermidis
HARDIIEFSHLVIDNDAHRV

SEQ ID NO: 1795166 - protein, 25 aa, Staphylococcus epidermidis
HASLIRFSESTLRPLGRTAAGVKGI

SEQ ID NO: 1795167 - protein, 26 aa, Staphylococcus epidermidis
HASLLPKYRGGAPIHQAIIDGEEETG

SEQ ID NO: 1795168 - protein, 18 aa, Staphylococcus epidermidis
HAWQRLVKHDPLFTKKQR

SEQ ID NO: 1795169 - protein, 18 aa, Staphylococcus epidermidis
HDDLGMAVANSLAAIEGG

SEQ ID NO: 1795170 - protein, 20 aa, Staphylococcus epidermidis
HDFLPYTITTVWGLGYKFER

SEQ ID NO: 1795171 - protein, 20 aa, Staphylococcus epidermidis
HEAPEILRRARYIMEAGDYI

SEQ ID NO: 1795172 - protein, 23 aa, Staphylococcus epidermidis
HFPCLNCTKSIIQAGIKTIYYAQ

SEQ ID NO: 1795173 - protein, 19 aa, Staphylococcus epidermidis
HFTTDFLYQTEWQEWLEDG

SEQ ID NO: 1795174 - protein, 18 aa, Staphylococcus epidermidis
HGFLKAVEQLCRKYDVLL

SEQ ID NO: 1795175 - protein, 24 aa, Staphylococcus epidermidis
HGLTIQRYGSTYVLTTKKETSTYI

SEQ ID NO: 1795176 - protein, 29 aa, Staphylococcus epidermidis
HGMKEPYNDIRMWDYKSLPSVFGGDNVLV

SEQ ID NO: 1795177 - protein, 20 aa, Staphylococcus epidermidis
HGMREPWRLVHISKDKLGDF

SEQ ID NO: 1795178 - protein, 26 aa, Staphylococcus epidermidis
HGNELPISAGFFIINPFEVVYYAGGT

SEQ ID NO: 1795179 - protein, 17 aa, Staphylococcus epidermidis
HGYHVIMDIPLLYENEL

SEQ ID NO: 1795180 - protein, 31 aa, Staphylococcus epidermidis
HHISLTMVHLSRFAEEIIFWSTDEAKFITLS

SEQ ID NO: 1795181 - protein, 18 aa, Staphylococcus epidermidis
HHMQRSFSHIELPKHAYL

SEQ ID NO: 1795182 - protein, 22 aa, Staphylococcus epidermidis
HHTHARVGIALYGSRPYSLINE

SEQ ID NO: 1795183 - protein, 17 aa, Staphylococcus epidermidis
HIGEVNGTISIGCSSLI

SEQ ID NO: 1795184 - protein, 23 aa, Staphylococcus epidermidis
HIKKHLPNSFVIAGNVGTPEGVR

SEQ ID NO: 1795185 - protein, 22 aa, Staphylococcus epidermidis
HILEGLRIALDHIDEIITTIRE

SEQ ID NO: 1795186 - protein, 21 aa, Staphylococcus epidermidis
HIPEDAFRLVGSMEDVIEKAK

SEQ ID NO: 1795187 - protein, 26 aa, Staphylococcus epidermidis
HIPFCYRICTYCDFNKYFIDKQPVDE

SEQ ID NO: 1795188 - protein, 26 aa, Staphylococcus epidermidis
HISECKEADVAIDFSNPELLFPLLEE

SEQ ID NO: 1795189 - protein, 21 aa, Staphylococcus epidermidis
HIVPYPPGIPVMFKGEVVTSH

SEQ ID NO: 1795190 - protein, 19 aa, Staphylococcus epidermidis
HKARIDTIRKVAKRLNKTI

SEQ ID NO: 1795191 - protein, 20 aa, Staphylococcus epidermidis
HKEGKWTGMCGEMAGDQTAV

SEQ ID NO: 1795192 - protein, 19 aa, Staphylococcus epidermidis
HKSAVIWFTGLSGSGKSTV

SEQ ID NO: 1795193 - protein, 17 aa, Staphylococcus epidermidis
HLDRGYVNLHGKLKSLG

SEQ ID NO: 1795194 - protein, 26 aa, Staphylococcus epidermidis
HLEQSRLTQYIGHLNVVLFAPEDLNI

SEQ ID NO: 1795195 - protein, 24 aa, Staphylococcus epidermidis
HLKKERPDCLIGVCGCMSQEESVV

SEQ ID NO: 1795196 - protein, 23 aa, Staphylococcus epidermidis
HLKKRLNEQLFLVAEEDSEIVGF

SEQ ID NO: 1795197 - protein, 19 aa, Staphylococcus epidermidis
HLKTLPVRFKQSVHNAERL

SEQ ID NO: 1795198 - protein, 24 aa, Staphylococcus epidermidis
HLKYCEKCGNVIRPDIVLYGEMLN

SEQ ID NO: 1795199 - protein, 26 aa, Staphylococcus epidermidis
HLNERLKLQLLDEVKSVFNSQMTQNN

SEQ ID NO: 1795200 - protein, 23 aa, Staphylococcus epidermidis
HLSELVKVYPLLNGCVCCDMKSD

SEQ ID NO: 1795201 - protein, 25 aa, Staphylococcus epidermidis
HMALNVKKGIIAWGDDEYLRKLDVD

SEQ ID NO: 1795202 - protein, 24 aa, Staphylococcus epidermidis
HMEKEQPDLIVIAGDLYDTSYPSK

SEQ ID NO: 1795203 - protein, 25 aa, Staphylococcus epidermidis
HMNEKDVRAVLGRFLFVQEDVKKII

SEQ ID NO: 1795204 - protein, 26 aa, Staphylococcus epidermidis
HNFERWSFHLQIYFLAERFKEQKRMF

SEQ ID NO: 1795205 - protein, 19 aa, Staphylococcus epidermidis
HNIKYWLMDSEFTSTFKDY

SEQ ID NO: 1795206 - protein, 23 aa, Staphylococcus epidermidis
HNKPHIMPVWSIKSRARKVRDQD

SEQ ID NO: 1795207 - protein, 20 aa, Staphylococcus epidermidis
HNKTLADFASLCFHVPFTKM

SEQ ID NO: 1795208 - protein, 25 aa, Staphylococcus epidermidis
HNPANLMGIRAFRKLLPEIPHVAVF

SEQ ID NO: 1795209 - protein, 25 aa, Staphylococcus epidermidis
HNYYPRPDTGLSISFIEEKNQLIRK

SEQ ID NO: 1795210 - protein, 22 aa, Staphylococcus epidermidis
HPRMKERSFVLIPLNDIATKQI

SEQ ID NO: 1795211 - protein, 21 aa, Staphylococcus epidermidis
HPYRVKLALNQSRHYKLESLF

SEQ ID NO: 1795212 - protein, 25 aa, Staphylococcus epidermidis
HQFDVSRFNADFAYTMDGSQLGELQ

SEQ ID NO: 1795213 - protein, 17 aa, Staphylococcus epidermidis
HQIMLMVDWKDGREGVL

SEQ ID NO: 1795214 - protein, 27 aa, Staphylococcus epidermidis
HQLVIKYSSAWSFLVPEILQLDEATIQ

SEQ ID NO: 1795215 - protein, 17 aa, Staphylococcus epidermidis
HQYGHAFYDSASDQDVF

SEQ ID NO: 1795216 - protein, 24 aa, Staphylococcus epidermidis
HRAQRQGFPEVIFGQGKTKEQITK

SEQ ID NO: 1795217 - protein, 19 aa, Staphylococcus epidermidis
HRHLLKGNVVFIFQYGEEI

SEQ ID NO: 1795218 - protein, 17 aa, Staphylococcus epidermidis
HRLALVFEDRHLTYGEL

SEQ ID NO: 1795219 - protein, 21 aa, Staphylococcus epidermidis
HRYGRKLTIGVMPQGPLTIPY

SEQ ID NO: 1795220 - protein, 25 aa, Staphylococcus epidermidis
HSGSMPMELFLRLKKYVQSGRLVIH

SEQ ID NO: 1795221 - protein, 24 aa, Staphylococcus epidermidis
HSLKSEYSISDFYNWIKEMNQKMD

SEQ ID NO: 1795222 - protein, 23 aa, Staphylococcus epidermidis
HSVPYYAGLSFRTLVPKQPDLSP

SEQ ID NO: 1795223 - protein, 18 aa, Staphylococcus epidermidis
HTYGLAMIDFHYPKTTHK

SEQ ID NO: 1795224 - protein, 19 aa, Staphylococcus epidermidis
HVAKRPFLDKTLERKAVWD

SEQ ID NO: 1795225 - protein, 24 aa, Staphylococcus epidermidis
HVHEPRIKFKSWADIDEDQFQKDY

SEQ ID NO: 1795226 - protein, 18 aa, Staphylococcus epidermidis
HVLVKFDEEIHCEIVNKD

SEQ ID NO: 1795227 - protein, 24 aa, Staphylococcus epidermidis
HYDKLPQRLVTVFAGQDKEATQQA

SEQ ID NO: 1795228 - protein, 26 aa, Staphylococcus epidermidis
HYEKKLPSSLFIKIHRATIVNKEHIQ

SEQ ID NO: 1795229 - protein, 19 aa, Staphylococcus epidermidis
HYKHLFAILELAKKQGIDK

SEQ ID NO: 1795230 - protein, 30 aa, Staphylococcus epidermidis
HYVPTLMCAKLWPQFELFQSFSKKPIILKE

SEQ ID NO: 1795231 - protein, 26 aa, Staphylococcus epidermidis
IAAMAPCPYVYAVIGKRAMEDPKLNK

SEQ ID NO: 1795232 - protein, 19 aa, Staphylococcus epidermidis
IAEELKLDNLHLIDDYVDF

SEQ ID NO: 1795233 - protein, 25 aa, Staphylococcus epidermidis
IAEELREILASLGLETVEELVGRTD

SEQ ID NO: 1795234 - protein, 18 aa, Staphylococcus epidermidis
IAEELVIIEKPMRAYSEH

SEQ ID NO: 1795235 - protein, 17 aa, Staphylococcus epidermidis
IAHARLFEDENDKLNLN

SEQ ID NO: 1795236 - protein, 27 aa, Staphylococcus epidermidis
IAIATGRPRTETIIPFQSLGLKSYFKD

SEQ ID NO: 1795237 - protein, 22 aa, Staphylococcus epidermidis
IANEYKIPTFVLGVGLGGLIIL

SEQ ID NO: 1795238 - protein, 26 aa, Staphylococcus epidermidis
IANLEHGKHGFAFGSGMAAISAVIML

SEQ ID NO: 1795239 - protein, 24 aa, Staphylococcus epidermidis
IANPYRRNILLIGDGSLQLTVQSL

SEQ ID NO: 1795240 - protein, 22 aa, Staphylococcus epidermidis
IAQHLMRHGATFFAVATLDEAI

SEQ ID NO: 1795241 - protein, 26 aa, Staphylococcus epidermidis
IARDLRELHIYRLPVKANQYEYKLLT

SEQ ID NO: 1795242 - protein, 19 aa, Staphylococcus epidermidis
IATRLLKYNTLPVSHLIYL

SEQ ID NO: 1795243 - protein, 29 aa, Staphylococcus epidermidis
ICNCKFTTCGFNNCIFEDVHFYKNQFKDS

SEQ ID NO: 1795244 - protein, 19 aa, Staphylococcus epidermidis
ICRRCFRLKNYNEVQDVGM

SEQ ID NO: 1795245 - protein, 30 aa, Staphylococcus epidermidis
IDAEILAMVMHIYESFGLKHLKLVINSIGD

SEQ ID NO: 1795246 - protein, 17 aa, Staphylococcus epidermidis
IDALVNYISSLGYLSDD

SEQ ID NO: 1795247 - protein, 27 aa, Staphylococcus epidermidis
IDDTKKRIAIQYSLPKWIVDHWVTHFG

SEQ ID NO: 1795248 - protein, 17 aa, Staphylococcus epidermidis
IDDVKRQLREVIERKVS

SEQ ID NO: 1795249 - protein, 18 aa, Staphylococcus epidermidis
IDEADLMIDLGLIEDVDH

SEQ ID NO: 1795250 - protein, 21 aa, Staphylococcus epidermidis
IDELTIYYSHYVSVLENKPAT

SEQ ID NO: 1795251 - protein, 21 aa, Staphylococcus epidermidis
IDGKNGFLFVLSGVSAEKYEQ

SEQ ID NO: 1795252 - protein, 25 aa, Staphylococcus epidermidis
IDGLEELSHYWSVVRPYYADFESDI

SEQ ID NO: 1795253 - protein, 19 aa, Staphylococcus epidermidis
IDHLHLKYGKGIVSKATSY

SEQ ID NO: 1795254 - protein, 20 aa, Staphylococcus epidermidis
IDHLNGIMFYDYIDANEPLK

SEQ ID NO: 1795255 - protein, 17 aa, Staphylococcus epidermidis
IDHLRLRYEHVGLPGQP

SEQ ID NO: 1795256 - protein, 17 aa, Staphylococcus epidermidis
IDIPSDVTVTFDGSHVT

SEQ ID NO: 1795257 - protein, 20 aa, Staphylococcus epidermidis
IDIRRGEIIQSDIERAEDDK

SEQ ID NO: 1795258 - protein, 22 aa, Staphylococcus epidermidis
IDKMYRRFYILSTISQNQPVGR

SEQ ID NO: 1795259 - protein, 18 aa, Staphylococcus epidermidis
IDLIPEYAHLNIFPVGRL

SEQ ID NO: 1795260 - protein, 20 aa, Staphylococcus epidermidis
IDLKSGVVGTVVSAQKLSNE

SEQ ID NO: 1795261 - protein, 22 aa, Staphylococcus epidermidis
IDLRGKELFKSLVKEIDIIKSR

SEQ ID NO: 1795262 - protein, 22 aa, Staphylococcus epidermidis
IDRVPSIEKVRMVSSGTEATLD

SEQ ID NO: 1795263 - protein, 24 aa, Staphylococcus epidermidis
IDSESFPMHIFRKYAKDVFEDHQL

SEQ ID NO: 1795264 - protein, 20 aa, Staphylococcus epidermidis
IDVPELFSIEKYDTVFQMTS

SEQ ID NO: 1795265 - protein, 18 aa, Staphylococcus epidermidis
IDVTARHIIKLARSNAIP

SEQ ID NO: 1795266 - protein, 23 aa, Staphylococcus epidermidis
IDYCTEHRLPFILFSASGGARMQ

SEQ ID NO: 1795267 - protein, 20 aa, Staphylococcus epidermidis
IDYFFLNKFQNIIDIEHELK

SEQ ID NO: 1795268 - protein, 20 aa, Staphylococcus epidermidis
IDYVLSWGPLILGHKNQQVI

SEQ ID NO: 1795269 - protein, 19 aa, Staphylococcus epidermidis
IEADINLQSRMKITTEEAF

SEQ ID NO: 1795270 - protein, 17 aa, Staphylococcus epidermidis
IEDASYAINEFIKPTIS

SEQ ID NO: 1795271 - protein, 19 aa, Staphylococcus epidermidis
IEEPGIRFEDTMFLLNTLA

SEQ ID NO: 1795272 - protein, 24 aa, Staphylococcus epidermidis
IEEYRECFDEEIFSARYSDILDKY

SEQ ID NO: 1795273 - protein, 23 aa, Staphylococcus epidermidis
IEFDSSWEKIGVRLVDQLLETFP

SEQ ID NO: 1795274 - protein, 18 aa, Staphylococcus epidermidis
IEGKEVKKVIAVPQKLVN

SEQ ID NO: 1795275 - protein, 17 aa, Staphylococcus epidermidis
IEGRTAYKGPLQDTIYQ

SEQ ID NO: 1795276 - protein, 19 aa, Staphylococcus epidermidis
IEGSFAIYAAQLVQKGYKP

SEQ ID NO: 1795277 - protein, 25 aa, Staphylococcus epidermidis
IEHAYQLLVDEGFIYSKPRSGYFVS

SEQ ID NO: 1795278 - protein, 23 aa, Staphylococcus epidermidis
IEKSQQAQLEWERVPQPTRAEHV

SEQ ID NO: 1795279 - protein, 25 aa, Staphylococcus epidermidis
IENRPMMYIALSYDHRIIDGKEAVG

SEQ ID NO: 1795280 - protein, 17 aa, Staphylococcus epidermidis
IEQAPSLVFFSENVHEE

SEQ ID NO: 1795281 - protein, 28 aa, Staphylococcus epidermidis
IEQLVKFGRFPYSKGRMKQEDYDKVEYA

SEQ ID NO: 1795282 - protein, 18 aa, Staphylococcus epidermidis
IERTVCRIFEEILHVDQV

SEQ ID NO: 1795283 - protein, 20 aa, Staphylococcus epidermidis
IETPCLYKSKYRNEAEMLNS

SEQ ID NO: 1795284 - protein, 19 aa, Staphylococcus epidermidis
IETPIARMMIKESLPEGTI

SEQ ID NO: 1795285 - protein, 19 aa, Staphylococcus epidermidis
IETPRACLIANDLAKHCDF

SEQ ID NO: 1795286 - protein, 21 aa, Staphylococcus epidermidis
IEVGQVFKLGTKYSESMNATF

SEQ ID NO: 1795287 - protein, 17 aa, Staphylococcus epidermidis
IEWKEVLAGQKAYDETG

SEQ ID NO: 1795288 - protein, 19 aa, Staphylococcus epidermidis
IFARKGAAASNHFEGGGFV

SEQ ID NO: 1795289 - protein, 24 aa, Staphylococcus epidermidis
IFAVSRTSGWIAHILEQYRDNRIM

SEQ ID NO: 1795290 - protein, 27 aa, Staphylococcus epidermidis
IFNDRKRLLPSIAYLEGEYGCSDICFG

SEQ ID NO: 1795291 - protein, 26 aa, Staphylococcus epidermidis
IFNGDIGIIVGIFWAKENALNKDVLV

SEQ ID NO: 1795292 - protein, 23 aa, Staphylococcus epidermidis
IFNHLFKQAITFAKKAHSETDIA

SEQ ID NO: 1795293 - protein, 23 aa, Staphylococcus epidermidis
IFQGEALLFLLGLTNSMAGFEKL

SEQ ID NO: 1795294 - protein, 26 aa, Staphylococcus epidermidis
IFYDPKHPYTWGLLSSMPDLTTSNDT

SEQ ID NO: 1795295 - protein, 23 aa, Staphylococcus epidermidis
IGARFKINVGILGDSKVAFHQLT

SEQ ID NO: 1795296 - protein, 20 aa, Staphylococcus epidermidis
IGCSGRLSGYINSYGVHSIH

SEQ ID NO: 1795297 - protein, 23 aa, Staphylococcus epidermidis
IGEHGDSELAVWSQANVGGISVY

SEQ ID NO: 1795298 - protein, 17 aa, Staphylococcus epidermidis
IGGEVLNAKWVHLLNSR

SEQ ID NO: 1795299 - protein, 17 aa, Staphylococcus epidermidis
IGIAGFFGLPIQKEVLD

SEQ ID NO: 1795300 - protein, 22 aa, Staphylococcus epidermidis
IGNMIIDGFILRDPGNYKDVID

SEQ ID NO: 1795301 - protein, 25 aa, Staphylococcus epidermidis
IGPSPVWMQFRLIKAGIRPINNVVD

SEQ ID NO: 1795302 - protein, 21 aa, Staphylococcus epidermidis
IGRQHKGLGWVLSYNQNEEIN

SEQ ID NO: 1795303 - protein, 23 aa, Staphylococcus epidermidis
IGSGIPAALAMSMIKFGMDAYGH

SEQ ID NO: 1795304 - protein, 21 aa, Staphylococcus epidermidis
IGVESIGLYHFMSQFIDESQQ

SEQ ID NO: 1795305 - protein, 17 aa, Staphylococcus epidermidis
IGVGSYVHYDRKLDGRI

SEQ ID NO: 1795306 - protein, 17 aa, Staphylococcus epidermidis
IGVRVVVPFGPRTIQGY

SEQ ID NO: 1795307 - protein, 24 aa, Staphylococcus epidermidis
IHERIAVFDLYFRKMPFNSGYAVF

SEQ ID NO: 1795308 - protein, 23 aa, Staphylococcus epidermidis
IHGEAALKDAIRISKALFSGDLK

SEQ ID NO: 1795309 - protein, 17 aa, Staphylococcus epidermidis
IHGEYRMLKAHGETGVQ

SEQ ID NO: 1795310 - protein, 17 aa, Staphylococcus epidermidis
IHRLIGWNQDTQPQDIL

SEQ ID NO: 1795311 - protein, 20 aa, Staphylococcus epidermidis
IIDEFDELAYLYIKKDVVHY

SEQ ID NO: 1795312 - protein, 23 aa, Staphylococcus epidermidis
IIEINCHGGILTINRILELTMTY

SEQ ID NO: 1795313 - protein, 24 aa, Staphylococcus epidermidis
IIELDIRAQYGINIIAIKRAKEFI

SEQ ID NO: 1795314 - protein, 18 aa, Staphylococcus epidermidis
IIETCKKVAPRLEIHLST

SEQ ID NO: 1795315 - protein, 26 aa, Staphylococcus epidermidis
IIFQANQRLSFMSGNRYQLIRREAIS

SEQ ID NO: 1795316 - protein, 23 aa, Staphylococcus epidermidis
IIGSIRIRPEFFEVYKEDELLEL

SEQ ID NO: 1795317 - protein, 17 aa, Staphylococcus epidermidis
IIKEIKQDIHIEIQIVP

SEQ ID NO: 1795318 - protein, 25 aa, Staphylococcus epidermidis
IIKRYPTRRLRVEDGCLKEMEGEHI

SEQ ID NO: 1795319 - protein, 18 aa, Staphylococcus epidermidis
IINYRGRKQMKIHQIRLA

SEQ ID NO: 1795320 - protein, 28 aa, Staphylococcus epidermidis
IIYPCKNCTRIIPFSSISYLELIDKQDQ

SEQ ID NO: 1795321 - protein, 17 aa, Staphylococcus epidermidis
IKAATIIDAENVKKSEK

SEQ ID NO: 1795322 - protein, 22 aa, Staphylococcus epidermidis
IKDIPFGRQMVFEYQNETEAEM

SEQ ID NO: 1795323 - protein, 31 aa, Staphylococcus epidermidis
IKESVKGSLKRLGLNHLDLYQLHGGTIDDPL

SEQ ID NO: 1795324 - protein, 34 aa, Staphylococcus epidermidis
IKGLEGPFHFETFVSLTCQKCPDVVQALNLMSVI

SEQ ID NO: 1795325 - protein, 25 aa, Staphylococcus epidermidis
IKGMGIPKGITLIVGGGYHGKSTLL

SEQ ID NO: 1795326 - protein, 19 aa, Staphylococcus epidermidis
IKHQLKTVVDHRERYRNKR

SEQ ID NO: 1795327 - protein, 18 aa, Staphylococcus epidermidis
IKKELSYAEEVFRKLNAT

SEQ ID NO: 1795328 - protein, 18 aa, Staphylococcus epidermidis
IKKLKLNNIKAFQHDATE

SEQ ID NO: 1795329 - protein, 21 aa, Staphylococcus epidermidis
IKKLMPEIIEFSELGEFIYQP

SEQ ID NO: 1795330 - protein, 26 aa, Staphylococcus epidermidis
IKKSYRFALNQSKNVYKYIVLTHQQK

SEQ ID NO: 1795331 - protein, 20 aa, Staphylococcus epidermidis
IKLFKGNAIVNGRQSPYTLY

SEQ ID NO: 1795332 - protein, 18 aa, Staphylococcus epidermidis
IKLIENFENLPILGVCLG

SEQ ID NO: 1795333 - protein, 20 aa, Staphylococcus epidermidis
IKMKTAKTFLNKLYGGDMKS

SEQ ID NO: 1795334 - protein, 20 aa, Staphylococcus epidermidis
IKQFPKILFMSGKEDQIIPY

SEQ ID NO: 1795335 - protein, 20 aa, Staphylococcus epidermidis
IKRKEAFYRATLVTYPNKDI

SEQ ID NO: 1795336 - protein, 25 aa, Staphylococcus epidermidis
IKSLKISFNKVFGYFIEITRANLNN

SEQ ID NO: 1795337 - protein, 17 aa, Staphylococcus epidermidis
IKTNLTQFGYMWECPDY

SEQ ID NO: 1795338 - protein, 20 aa, Staphylococcus epidermidis
IKVTRLAQGLSVGGDLEYAD

SEQ ID NO: 1795339 - protein, 17 aa, Staphylococcus epidermidis
ILEMSKSGIVNIKQTKQ

SEQ ID NO: 1795340 - protein, 26 aa, Staphylococcus epidermidis
ILESLAIDVDEDFLLVKREIFSSGKS

SEQ ID NO: 1795341 - protein, 25 aa, Staphylococcus epidermidis
ILGGKNANISTCWFNIRQKENHTSI

SEQ ID NO: 1795342 - protein, 20 aa, Staphylococcus epidermidis
ILHFAQHNAIDWVIIGPEQP

SEQ ID NO: 1795343 - protein, 19 aa, Staphylococcus epidermidis
ILKSEGFIKNVEYVEDDKQ

SEQ ID NO: 1795344 - protein, 20 aa, Staphylococcus epidermidis
ILLHSCCAPCSTYTLEFLTQ

SEQ ID NO: 1795345 - protein, 25 aa, Staphylococcus epidermidis
ILNFPQRPGALREFVNDVLGPQDDI

SEQ ID NO: 1795346 - protein, 28 aa, Staphylococcus epidermidis
ILNIHPSLLPKFKGLDAIGQALESGDTV

SEQ ID NO: 1795347 - protein, 20 aa, Staphylococcus epidermidis
ILNIYFPFIDVETMLTLLDL

SEQ ID NO: 1795348 - protein, 19 aa, Staphylococcus epidermidis
ILNLPDYTFPLFGMAVGEP

SEQ ID NO: 1795349 - protein, 18 aa, Staphylococcus epidermidis
ILRRARYIMEAGDYITSI

SEQ ID NO: 1795350 - protein, 18 aa, Staphylococcus epidermidis
ILSKVLVRATQQWPTDKT

SEQ ID NO: 1795351 - protein, 24 aa, Staphylococcus epidermidis
ILTAIKIARIFGEPVEDIFIMEEE

SEQ ID NO: 1795352 - protein, 19 aa, Staphylococcus epidermidis
ILVDAPCSGLGVLRHKPEI

SEQ ID NO: 1795353 - protein, 17 aa, Staphylococcus epidermidis
ILYRDQNIFDAKYSKEK

SEQ ID NO: 1795354 - protein, 27 aa, Staphylococcus epidermidis
IMASFHFDVPCLFAKKAKPSTLKDGFY

SEQ ID NO: 1795355 - protein, 18 aa, Staphylococcus epidermidis
IMEIPGVDIVVGTQDRHK

SEQ ID NO: 1795356 - protein, 18 aa, Staphylococcus epidermidis
IMEMLRSLLEVIRSNWHI

SEQ ID NO: 1795357 - protein, 23 aa, Staphylococcus epidermidis
IMKEEPIKLLALITSNYRLYYQC

SEQ ID NO: 1795358 - protein, 20 aa, Staphylococcus epidermidis
IMKPEYFVPVQGEFKMQIAH

SEQ ID NO: 1795359 - protein, 18 aa, Staphylococcus epidermidis
IMRTRRVDTIFVVNNQNK

SEQ ID NO: 1795360 - protein, 21 aa, Staphylococcus epidermidis
IMTSICKKWYINSFKYFRNTY

SEQ ID NO: 1795361 - protein, 24 aa, Staphylococcus epidermidis
INAMKRNDLVFGIGPAGTGKTFLA

SEQ ID NO: 1795362 - protein, 22 aa, Staphylococcus epidermidis
INDRTILVSIMFVNNEIGTVQN

SEQ ID NO: 1795363 - protein, 25 aa, Staphylococcus epidermidis
INEAYVKISLIGSGMRDMSGVASKA

SEQ ID NO: 1795364 - protein, 26 aa, Staphylococcus epidermidis
INEELGITILINLHFVDLAKEYGSRI

SEQ ID NO: 1795365 - protein, 21 aa, Staphylococcus epidermidis
INEPKRMIAVYLPDDGNGKSY

SEQ ID NO: 1795366 - protein, 17 aa, Staphylococcus epidermidis
INETLGYQLNNKTSECF

SEQ ID NO: 1795367 - protein, 21 aa, Staphylococcus epidermidis
INFSDGLTVMSGETGSGKSII

SEQ ID NO: 1795368 - protein, 17 aa, Staphylococcus epidermidis
INGEIIGIVGPNGAGKS

SEQ ID NO: 1795369 - protein, 23 aa, Staphylococcus epidermidis
INGGKFNGIIPISQLSTHHIENP

SEQ ID NO: 1795370 - protein, 17 aa, Staphylococcus epidermidis
INGRPKHIYSIYRKMIK

SEQ ID NO: 1795371 - protein, 17 aa, Staphylococcus epidermidis
INKKGYVQFEFVKDDLT

SEQ ID NO: 1795372 - protein, 25 aa, Staphylococcus epidermidis
INLSEPKALIGFAGRRVIEQTINEK

SEQ ID NO: 1795373 - protein, 27 aa, Staphylococcus epidermidis
INNHVKEVIAGFDFTFGKFGKGNMTVL

SEQ ID NO: 1795374 - protein, 17 aa, Staphylococcus epidermidis
INPFEVVYYAGGTSNRY

SEQ ID NO: 1795375 - protein, 24 aa, Staphylococcus epidermidis
INVKELRLSPTIEEHDFQTKLKNG

SEQ ID NO: 1795376 - protein, 21 aa, Staphylococcus epidermidis
INVLEILALEYAKNKGYELYN

SEQ ID NO: 1795377 - protein, 19 aa, Staphylococcus epidermidis
INYSLPYDVIASFRNGKDA

SEQ ID NO: 1795378 - protein, 20 aa, Staphylococcus epidermidis
IPEYAHLNIFPVGRLDKDTE

SEQ ID NO: 1795379 - protein, 18 aa, Staphylococcus epidermidis
IPIYLKRNPNFKFPQDES

SEQ ID NO: 1795380 - protein, 19 aa, Staphylococcus epidermidis
IPLSLTFDHQILDGAGAAD

SEQ ID NO: 1795381 - protein, 17 aa, Staphylococcus epidermidis
IPMIFDEAFYRKMATQK

SEQ ID NO: 1795382 - protein, 26 aa, Staphylococcus epidermidis
IPQHIKIDHAFECVGGKGSQQAIEQI

SEQ ID NO: 1795383 - protein, 25 aa, Staphylococcus epidermidis
IPQKAHIDLDFPIKVDQVILSGCYE

SEQ ID NO: 1795384 - protein, 22 aa, Staphylococcus epidermidis
IPRGLALDYIYGYTIINDITDR

SEQ ID NO: 1795385 - protein, 19 aa, Staphylococcus epidermidis
IPSKALLHASHRFVEAQNS

SEQ ID NO: 1795386 - protein, 26 aa, Staphylococcus epidermidis
IPTVELIIRRCKENGLMIRNLENVIT

SEQ ID NO: 1795387 - protein, 20 aa, Staphylococcus epidermidis
IQALEFKKINILIGGSLGGM

SEQ ID NO: 1795388 - protein, 17 aa, Staphylococcus epidermidis
IQETTALGAAYLAGLAV

SEQ ID NO: 1795389 - protein, 28 aa, Staphylococcus epidermidis
IQGPDFPTAGLVLGKSGIRRAYETGRGS

SEQ ID NO: 1795390 - protein, 23 aa, Staphylococcus epidermidis
IQIFKNQRIMKAFKNEKDLFKYY

SEQ ID NO: 1795391 - protein, 17 aa, Staphylococcus epidermidis
IQKLFLLIFQLPEHLAR

SEQ ID NO: 1795392 - protein, 18 aa, Staphylococcus epidermidis
IQKVIDWLNNEEIETLKL

SEQ ID NO: 1795393 - protein, 17 aa, Staphylococcus epidermidis
IQRRGGFCYELNHLFAT

SEQ ID NO: 1795394 - protein, 25 aa, Staphylococcus epidermidis
IQTFKRQIQELGFSYDWDREVNTTD

SEQ ID NO: 1795395 - protein, 23 aa, Staphylococcus epidermidis
IRAPQWRGGGVVFGPTPRSYAYK

SEQ ID NO: 1795396 - protein, 32 aa, Staphylococcus epidermidis
IRDGRARVSVGARSSIFAPFKNLGIIIIDEEH

SEQ ID NO: 1795397 - protein, 32 aa, Staphylococcus epidermidis
IRDVFGYSVSKGWMCVQVFFVRQGNMIKRDAT

SEQ ID NO: 1795398 - protein, 22 aa, Staphylococcus epidermidis
IRDVSKRVLAHILGVDLPNPSL

SEQ ID NO: 1795399 - protein, 24 aa, Staphylococcus epidermidis
IRFGDANLSPGTRVHFVEVPEEDY

SEQ ID NO: 1795400 - protein, 22 aa, Staphylococcus epidermidis
IRGAKILALMGLELIENKPLLD

SEQ ID NO: 1795401 - protein, 23 aa, Staphylococcus epidermidis
IRGICCLKPGIPGISENIEVVSI

SEQ ID NO: 1795402 - protein, 22 aa, Staphylococcus epidermidis
IRHLGVKASQVLAERYETMDQL

SEQ ID NO: 1795403 - protein, 23 aa, Staphylococcus epidermidis
IRHVHKPSGAKPGFVTYDNQKTL

SEQ ID NO: 1795404 - protein, 17 aa, Staphylococcus epidermidis
IRIAGGREVNLRSLQPL

SEQ ID NO: 1795405 - protein, 24 aa, Staphylococcus epidermidis
IRIQAKIASLVTAFARVRDGKEPV

SEQ ID NO: 1795406 - protein, 24 aa, Staphylococcus epidermidis
IRKQDEIILLEGFMDVIKSDYAGL

SEQ ID NO: 1795407 - protein, 20 aa, Staphylococcus epidermidis
IRMFNQLRGTIVYKDDAIIM

SEQ ID NO: 1795408 - protein, 28 aa, Staphylococcus epidermidis
IRNFKPEEYWSIEGEFRYKKSKFTAKFL

SEQ ID NO: 1795409 - protein, 20 aa, Staphylococcus epidermidis
IRNLLAMCYLYLGEYDSAKA

SEQ ID NO: 1795410 - protein, 19 aa, Staphylococcus epidermidis
IRQNLDRIVKNQGNQKKLS

SEQ ID NO: 1795411 - protein, 19 aa, Staphylococcus epidermidis
IRVDIAGSVESIYEITKDD

SEQ ID NO: 1795412 - protein, 21 aa, Staphylococcus epidermidis
ISAGRLEYEKGYDLLLESIRL

SEQ ID NO: 1795413 - protein, 36 aa, Staphylococcus epidermidis
ISARAYRLLRVGSFLLSNEGYKIFVHESERKHEPRL

SEQ ID NO: 1795414 - protein, 18 aa, Staphylococcus epidermidis
ISDRIAVMHFGKIVEIGP

SEQ ID NO: 1795415 - protein, 24 aa, Staphylococcus epidermidis
ISETRKLDSLVLIDIAVPRDIEPG

SEQ ID NO: 1795416 - protein, 20 aa, Staphylococcus epidermidis
ISFSGQMHGLVIVDDNGIPL

SEQ ID NO: 1795417 - protein, 24 aa, Staphylococcus epidermidis
ISGHYRNGILLSPIIGRDIANWLL

SEQ ID NO: 1795418 - protein, 17 aa, Staphylococcus epidermidis
ISKEERADYLLEISRRI

SEQ ID NO: 1795419 - protein, 23 aa, Staphylococcus epidermidis
ISKIPRFPFDKFEKGERELGTQM

SEQ ID NO: 1795420 - protein, 20 aa, Staphylococcus epidermidis
ISKKNAMRTAVKRAKTAIST

SEQ ID NO: 1795421 - protein, 22 aa, Staphylococcus epidermidis
ISKSFDGEDIFTDVNFEVKTGE

SEQ ID NO: 1795422 - protein, 17 aa, Staphylococcus epidermidis
ISKTKGLIGNIMKIKPI

SEQ ID NO: 1795423 - protein, 24 aa, Staphylococcus epidermidis
ISMKRAGADLIITYFAKDICRYLD

SEQ ID NO: 1795424 - protein, 19 aa, Staphylococcus epidermidis
ISMVTAYDYPSAKQAQQAE

SEQ ID NO: 1795425 - protein, 21 aa, Staphylococcus epidermidis
ISPLDTMLSAFGKRDDINSGG

SEQ ID NO: 1795426 - protein, 18 aa, Staphylococcus epidermidis
ISQWNVIENLVINQLGIS

SEQ ID NO: 1795427 - protein, 28 aa, Staphylococcus epidermidis
ISRPATNFKEAVQWLYLAYLAAIKEQNG

SEQ ID NO: 1795428 - protein, 29 aa, Staphylococcus epidermidis
ISSCGKCYYCKKGIYAHCENGGGWILGHL

SEQ ID NO: 1795429 - protein, 19 aa, Staphylococcus epidermidis
ISSGKLRRYLSFENAKDVF

SEQ ID NO: 1795430 - protein, 20 aa, Staphylococcus epidermidis
ISSLKKRGAKSIRFMCLIAA

SEQ ID NO: 1795431 - protein, 19 aa, Staphylococcus epidermidis
ISSYYKFKQPSLLYDQQIQ

SEQ ID NO: 1795432 - protein, 18 aa, Staphylococcus epidermidis
ISVPLQYLIAAALEVTDV

SEQ ID NO: 1795433 - protein, 23 aa, Staphylococcus epidermidis
ITENVAMAFGFFDGMHRGHDKVF

SEQ ID NO: 1795434 - protein, 22 aa, Staphylococcus epidermidis
ITERHARAVLVLPDETQEELIE

SEQ ID NO: 1795435 - protein, 32 aa, Staphylococcus epidermidis
ITETGSVVLPGRFFVDIIKKLPGKEVKLSTNE

SEQ ID NO: 1795436 - protein, 20 aa, Staphylococcus epidermidis
ITGAQAWVGTLLKMKPVLRF

SEQ ID NO: 1795437 - protein, 17 aa, Staphylococcus epidermidis
ITIVSGFLGSGKTTFLT

SEQ ID NO: 1795438 - protein, 29 aa, Staphylococcus epidermidis
ITLPKANVIKIYFNEGFIALRPSGTEPKI

SEQ ID NO: 1795439 - protein, 23 aa, Staphylococcus epidermidis
ITMYPHLDGVLSLDLTTVLILNQ

SEQ ID NO: 1795440 - protein, 20 aa, Staphylococcus epidermidis
ITRGDIFVRGAIKEHMASLI

SEQ ID NO: 1795441 - protein, 17 aa, Staphylococcus epidermidis
ITSQWPNNVSVFSNQVE

SEQ ID NO: 1795442 - protein, 30 aa, Staphylococcus epidermidis
ITTERHGKNGFGYDPIFFVPELNKTMAEIT

SEQ ID NO: 1795443 - protein, 23 aa, Staphylococcus epidermidis
ITVCGMGGPLIAKILNDGKDKLV

SEQ ID NO: 1795444 - protein, 17 aa, Staphylococcus epidermidis
ITVNAFAPGIVETPMMK

SEQ ID NO: 1795445 - protein, 19 aa, Staphylococcus epidermidis
IVAAPVLALSLSFDHRQID

SEQ ID NO: 1795446 - protein, 20 aa, Staphylococcus epidermidis
IVASGYRGALPHGVASDKRI

SEQ ID NO: 1795447 - protein, 18 aa, Staphylococcus epidermidis
IVDIMMSGMDGFELCQTL

SEQ ID NO: 1795448 - protein, 25 aa, Staphylococcus epidermidis
IVGYEIKTGAPLVYELTDDLVVKDK

SEQ ID NO: 1795449 - protein, 18 aa, Staphylococcus epidermidis
IVIHKDINISIAVADDDK

SEQ ID NO: 1795450 - protein, 19 aa, Staphylococcus epidermidis
IVQHIKYYFNLTNDRPNHF

SEQ ID NO: 1795451 - protein, 38 aa, Staphylococcus epidermidis
IVRQYYRMLQRPILYTGLTRAKQSLVLLGEQEAFDIGL

SEQ ID NO: 1795452 - protein, 17 aa, Staphylococcus epidermidis
IVTILGVAEDASIKAAV

SEQ ID NO: 1795453 - protein, 25 aa, Staphylococcus epidermidis
IVVGNTYGRIRAMVNDLGKRIKSAG

SEQ ID NO: 1795454 - protein, 21 aa, Staphylococcus epidermidis
IYDVIGYEVKPHFISEDELAS

SEQ ID NO: 1795455 - protein, 25 aa, Staphylococcus epidermidis
IYEFKAAKKTIFFVSHNIRQVREFC

SEQ ID NO: 1795456 - protein, 20 aa, Staphylococcus epidermidis
IYGAKGLAWVKVVDDGLSGP

SEQ ID NO: 1795457 - protein, 22 aa, Staphylococcus epidermidis
IYGMKVAKDLVHISGDTSDYHL

SEQ ID NO: 1795458 - protein, 22 aa, Staphylococcus epidermidis
IYIDVFCSLKHGVNISKTANQI

SEQ ID NO: 1795459 - protein, 17 aa, Staphylococcus epidermidis
IYLNFSDPWPKKRHAKR

SEQ ID NO: 1795460 - protein, 17 aa, Staphylococcus epidermidis
IYNQTAVCTGRGEQVTF

SEQ ID NO: 1795461 - protein, 18 aa, Staphylococcus epidermidis
IYNYRARKYNKWTQQDYL

SEQ ID NO: 1795462 - protein, 19 aa, Staphylococcus epidermidis
IYPHTVFELAKRVIPSEKV

SEQ ID NO: 1795463 - protein, 18 aa, Staphylococcus epidermidis
IYQALSPKFPNISVATIY

SEQ ID NO: 1795464 - protein, 24 aa, Staphylococcus epidermidis
IYYYCNLSSPFACDEEALKYIDYD

SEQ ID NO: 1795465 - protein, 22 aa, Staphylococcus epidermidis
KAAIIKPHIPIVYAVKNDDALK

SEQ ID NO: 1795466 - protein, 23 aa, Staphylococcus epidermidis
KAEDIKLGYVFLGSCTNARLSDL

SEQ ID NO: 1795467 - protein, 21 aa, Staphylococcus epidermidis
KAELSALIRMNGALSLSNQQF

SEQ ID NO: 1795468 - protein, 28 aa, Staphylococcus epidermidis
KAFVASAIKNGWKMNDFVGPVDHGAYNR

SEQ ID NO: 1795469 - protein, 19 aa, Staphylococcus epidermidis
KAGDIVLHKGMRINSGVIA

SEQ ID NO: 1795470 - protein, 24 aa, Staphylococcus epidermidis
KAHLRLNDIGFIFQASHLVPYLKV

SEQ ID NO: 1795471 - protein, 19 aa, Staphylococcus epidermidis
KAHVKGVSVLVESKEVKQR

SEQ ID NO: 1795472 - protein, 21 aa, Staphylococcus epidermidis
KAIEAAFGVEIFIRTKKQLIT

SEQ ID NO: 1795473 - protein, 23 aa, Staphylococcus epidermidis
KAIMLPPGLAFVAYSDRAKKRFA

SEQ ID NO: 1795474 - protein, 23 aa, Staphylococcus epidermidis
KAKSKRGKIGIEHANIKDIQEAL

SEQ ID NO: 1795475 - protein, 20 aa, Staphylococcus epidermidis
KALEAVWDYAYDKVGYLGTN

SEQ ID NO: 1795476 - protein, 18 aa, Staphylococcus epidermidis
KALSEADLILFVLNNNEP

SEQ ID NO: 1795477 - protein, 20 aa, Staphylococcus epidermidis
KAQHVVNFMYFIAEELREIL

SEQ ID NO: 1795478 - protein, 19 aa, Staphylococcus epidermidis
KASEGGMRDALSIMDQAIA

SEQ ID NO: 1795479 - protein, 18 aa, Staphylococcus epidermidis
KASVIDFASTASMDAPTA

SEQ ID NO: 1795480 - protein, 20 aa, Staphylococcus epidermidis
KAVGHADVTYGLAIENHTVT

SEQ ID NO: 1795481 - protein, 17 aa, Staphylococcus epidermidis
KAWGEGMVSNVNEKNGS

SEQ ID NO: 1795482 - protein, 22 aa, Staphylococcus epidermidis
KAYQFKSVCVNPTHVQYASEQL

SEQ ID NO: 1795483 - protein, 22 aa, Staphylococcus epidermidis
KCIEIGKSFLKEGVEEREVVNH

SEQ ID NO: 1795484 - protein, 17 aa, Staphylococcus epidermidis
KDAPGYVPEHNMFREDV

SEQ ID NO: 1795485 - protein, 18 aa, Staphylococcus epidermidis
KDDKGVFAEQIFEDLAFP

SEQ ID NO: 1795486 - protein, 19 aa, Staphylococcus epidermidis
KDEIVIIDAGIKFPDDNLL

SEQ ID NO: 1795487 - protein, 20 aa, Staphylococcus epidermidis
KDELREFIEAAKIPVIHTLP

SEQ ID NO: 1795488 - protein, 22 aa, Staphylococcus epidermidis
KDFFNRDRFILSAGHGSALLYS

SEQ ID NO: 1795489 - protein, 18 aa, Staphylococcus epidermidis
KDFKAFEVEGLDQRMEAL

SEQ ID NO: 1795490 - protein, 25 aa, Staphylococcus epidermidis
KDGCPKCRPAINYYLNMVYPFEHRD

SEQ ID NO: 1795491 - protein, 17 aa, Staphylococcus epidermidis
KDIGPRIQQTLIKNQAM

SEQ ID NO: 1795492 - protein, 17 aa, Staphylococcus epidermidis
KDKAAIIKPHIPIVYAV

SEQ ID NO: 1795493 - protein, 19 aa, Staphylococcus epidermidis
KDKSLSRYDIMTVGEANGV

SEQ ID NO: 1795494 - protein, 17 aa, Staphylococcus epidermidis
KDLGRKRAILIHGANGM

SEQ ID NO: 1795495 - protein, 17 aa, Staphylococcus epidermidis
KDMLDGITVSNNDVEVV

SEQ ID NO: 1795496 - protein, 19 aa, Staphylococcus epidermidis
KDPRVGFLTITDVELTNDL

SEQ ID NO: 1795497 - protein, 21 aa, Staphylococcus epidermidis
KDSRIPMDQKFIFNPYETKSL

SEQ ID NO: 1795498 - protein, 20 aa, Staphylococcus epidermidis
KDTNAIIVYTLIKPEIKKYM

SEQ ID NO: 1795499 - protein, 20 aa, Staphylococcus epidermidis
KDVDKSLCYYKDVFNAQTEI

SEQ ID NO: 1795500 - protein, 18 aa, Staphylococcus epidermidis
KEARRMLDEAGFTEAKII

SEQ ID NO: 1795501 - protein, 18 aa, Staphylococcus epidermidis
KEDVKSVLQNVHRTLEER

SEQ ID NO: 1795502 - protein, 18 aa, Staphylococcus epidermidis
KEDVLAFEDLTKIKVSTK

SEQ ID NO: 1795503 - protein, 25 aa, Staphylococcus epidermidis
KEELPQVWKDLGMRSASAYGKKTRS

SEQ ID NO: 1795504 - protein, 19 aa, Staphylococcus epidermidis
KEEYATFIRQQWAKLGLGL

SEQ ID NO: 1795505 - protein, 25 aa, Staphylococcus epidermidis
KEFFPENRVEYFVSYYDYYQPEAYV

SEQ ID NO: 1795506 - protein, 17 aa, Staphylococcus epidermidis
KEFKEYLPVNQSTPALT

SEQ ID NO: 1795507 - protein, 23 aa, Staphylococcus epidermidis
KEFNRKEKVLSMGADELSVKRVV

SEQ ID NO: 1795508 - protein, 27 aa, Staphylococcus epidermidis
KEHYHLPILGTHNMKNAAIAIAIGHEL

SEQ ID NO: 1795509 - protein, 22 aa, Staphylococcus epidermidis
KEIEARAPLKRNVDQEEVGKTA

SEQ ID NO: 1795510 - protein, 17 aa, Staphylococcus epidermidis
KEIEKKPLIVMVNGMGG

SEQ ID NO: 1795511 - protein, 31 aa, Staphylococcus epidermidis
KEIKFKAFLEHALKLGADYVATGHYARIRRH

SEQ ID NO: 1795512 - protein, 21 aa, Staphylococcus epidermidis
KEIKGTRILFVAATAPFTPFY

SEQ ID NO: 1795513 - protein, 21 aa, Staphylococcus epidermidis
KEISSGIFAFNNRVLFEKLEQ

SEQ ID NO: 1795514 - protein, 24 aa, Staphylococcus epidermidis
KEKGKRKFLNLGHTFGHAIEYEHK

SEQ ID NO: 1795515 - protein, 24 aa, Staphylococcus epidermidis
KELEELRLRVATSRPQDNKNFSSN

SEQ ID NO: 1795516 - protein, 23 aa, Staphylococcus epidermidis
KELFELDCDILVPAAISNQITED

SEQ ID NO: 1795517 - protein, 18 aa, Staphylococcus epidermidis
KELKGYTHLSSWADAQYK

SEQ ID NO: 1795518 - protein, 25 aa, Staphylococcus epidermidis
KELNLRLSNYKNKLLSFLAEYKNVF

SEQ ID NO: 1795519 - protein, 28 aa, Staphylococcus epidermidis
KELQGAHTVVWNGPMGVFEFSNFAKGTI

SEQ ID NO: 1795520 - protein, 20 aa, Staphylococcus epidermidis
KENNTVPFIARYRKEATGGL

SEQ ID NO: 1795521 - protein, 17 aa, Staphylococcus epidermidis
KESRAKEILAHRIFSFE

SEQ ID NO: 1795522 - protein, 26 aa, Staphylococcus epidermidis
KESRLKLKVINELAWHNLFARNMFIR

SEQ ID NO: 1795523 - protein, 20 aa, Staphylococcus epidermidis
KESYDGFANFYIEQAKEERF

SEQ ID NO: 1795524 - protein, 20 aa, Staphylococcus epidermidis
KEVMDKLLLSFQQSEKLRRH

SEQ ID NO: 1795525 - protein, 18 aa, Staphylococcus epidermidis
KEVNRLINDMIYFVRDTI

SEQ ID NO: 1795526 - protein, 19 aa, Staphylococcus epidermidis
KEVPDMVLVHGDTVTTFSG

SEQ ID NO: 1795527 - protein, 24 aa, Staphylococcus epidermidis
KEVSFSVSGTGAYSKLKFENGAHR

SEQ ID NO: 1795528 - protein, 33 aa, Staphylococcus epidermidis
KEYANHIIEAFGMKPYIKKKVNKYSMGMKQKLS

SEQ ID NO: 1795529 - protein, 19 aa, Staphylococcus epidermidis
KEYGLTYTGYIVLMAIEDD

SEQ ID NO: 1795530 - protein, 25 aa, Staphylococcus epidermidis
KFESNCGWPSFSKALNDDEIVELVD

SEQ ID NO: 1795531 - protein, 21 aa, Staphylococcus epidermidis
KFINCNGGIRFLGVKDGKNAA

SEQ ID NO: 1795532 - protein, 17 aa, Staphylococcus epidermidis
KFLVRCIEESMAIKDED

SEQ ID NO: 1795533 - protein, 25 aa, Staphylococcus epidermidis
KFNGLKGQGLLLLKNIQNIEPIVHG

SEQ ID NO: 1795534 - protein, 18 aa, Staphylococcus epidermidis
KFVPEGIEGRTAYKGPLQ

SEQ ID NO: 1795535 - protein, 17 aa, Staphylococcus epidermidis
KGARVGIVGAGLSGIEL

SEQ ID NO: 1795536 - protein, 21 aa, Staphylococcus epidermidis
KGDMTFKLFPDIAPKTVENFV

SEQ ID NO: 1795537 - protein, 21 aa, Staphylococcus epidermidis
KGDYCGYSFAFEVKNDHTQLA

SEQ ID NO: 1795538 - protein, 22 aa, Staphylococcus epidermidis
KGHIKIGLSPMMNVQMFTNALN

SEQ ID NO: 1795539 - protein, 18 aa, Staphylococcus epidermidis
KGKDFIFEATVTVEPEVK

SEQ ID NO: 1795540 - protein, 21 aa, Staphylococcus epidermidis
KGMGKGRTFLIKTYGCQMNAH

SEQ ID NO: 1795541 - protein, 20 aa, Staphylococcus epidermidis
KGPTGYMIPTVVEWLQQKYK

SEQ ID NO: 1795542 - protein, 19 aa, Staphylococcus epidermidis
KGQWLNAFIEATRAHRTDN

SEQ ID NO: 1795543 - protein, 25 aa, Staphylococcus epidermidis
KGTDLPGQIARRVDHNILRKLAKQV

SEQ ID NO: 1795544 - protein, 18 aa, Staphylococcus epidermidis
KGTFSYLAAKQFESHEQY

SEQ ID NO: 1795545 - protein, 20 aa, Staphylococcus epidermidis
KGVVPFLKVDKGLAEEKNGV

SEQ ID NO: 1795546 - protein, 24 aa, Staphylococcus epidermidis
KGYFARPTIFINVDNHMTIAQEEI

SEQ ID NO: 1795547 - protein, 23 aa, Staphylococcus epidermidis
KHAGGLHKFMNWDGPILTDSGGF

SEQ ID NO: 1795548 - protein, 19 aa, Staphylococcus epidermidis
KHLDAIIVLSDYNRRYLSD

SEQ ID NO: 1795549 - protein, 24 aa, Staphylococcus epidermidis
KHLDIPAGAAVRFEPGDEKKVQLV

SEQ ID NO: 1795550 - protein, 23 aa, Staphylococcus epidermidis
KHLLDEGLEWVLIQGQMGIELWS

SEQ ID NO: 1795551 - protein, 17 aa, Staphylococcus epidermidis
KIAKFYDFIEVQPPALY

SEQ ID NO: 1795552 - protein, 28 aa, Staphylococcus epidermidis
KIAKQLLNICEGFSPLIANEIVNRRQFM

SEQ ID NO: 1795553 - protein, 23 aa, Staphylococcus epidermidis
KIDEIKSFIEFHDIDVVVTNDEL

SEQ ID NO: 1795554 - protein, 31 aa, Staphylococcus epidermidis
KIDIPRVRFTTSHPWDFTDRMIEVIAKGGNI

SEQ ID NO: 1795555 - protein, 25 aa, Staphylococcus epidermidis
KIEKMKLPGIALYPETERFYPNGNF

SEQ ID NO: 1795556 - protein, 23 aa, Staphylococcus epidermidis
KIFSDGRIPGFVHLYVGEEAVAT

SEQ ID NO: 1795557 - protein, 24 aa, Staphylococcus epidermidis
KIHKDGRCPKCLNNKISTDGECHD

SEQ ID NO: 1795558 - protein, 19 aa, Staphylococcus epidermidis
KIHTRHGVVLATGGFGANT

SEQ ID NO: 1795559 - protein, 24 aa, Staphylococcus epidermidis
KIIQGELIAIVGPSGSGKSTFLTM

SEQ ID NO: 1795560 - protein, 25 aa, Staphylococcus epidermidis
KIKHLRHMGKLILIVHHDLSKADQY

SEQ ID NO: 1795561 - protein, 20 aa, Staphylococcus epidermidis
KILDQREFTLILYVNDIVGM

SEQ ID NO: 1795562 - protein, 25 aa, Staphylococcus epidermidis
KIMKEEIFGPILPIITYDNFDEVLE

SEQ ID NO: 1795563 - protein, 24 aa, Staphylococcus epidermidis
KINELKKLVTFIVVNRETDNQNVS

SEQ ID NO: 1795564 - protein, 19 aa, Staphylococcus epidermidis
KINKHELAEAVNLSNQALT

SEQ ID NO: 1795565 - protein, 23 aa, Staphylococcus epidermidis
KIPAEQRQTMLFSATMPKAIQEL

SEQ ID NO: 1795566 - protein, 24 aa, Staphylococcus epidermidis
KIPHGHAVMIGILYQFIVANHLFE

SEQ ID NO: 1795567 - protein, 26 aa, Staphylococcus epidermidis
KIPKLPYTLCYVSRGFVADYNNKEVL

SEQ ID NO: 1795568 - protein, 19 aa, Staphylococcus epidermidis
KIRVKNVIGTLDIQVDDIT

SEQ ID NO: 1795569 - protein, 20 aa, Staphylococcus epidermidis
KIYGTHLWSGYPSGTIYSRP

SEQ ID NO: 1795570 - protein, 37 aa, Staphylococcus epidermidis
KKAFEKCNIQFKPKRVMDTLELFKIAFPTDKSYQLSA

SEQ ID NO: 1795571 - protein, 19 aa, Staphylococcus epidermidis
KKALFIVYANPLSLGLLTP

SEQ ID NO: 1795572 - protein, 23 aa, Staphylococcus epidermidis
KKDFKRLGVRGDFNNPYITLTPE

SEQ ID NO: 1795573 - protein, 21 aa, Staphylococcus epidermidis
KKDVTCHTCNGDGAKPGTSKK

SEQ ID NO: 1795574 - protein, 23 aa, Staphylococcus epidermidis
KKEIDWALSVTGTSEFRHRTIND

SEQ ID NO: 1795575 - protein, 19 aa, Staphylococcus epidermidis
KKGIIVNVVDVFDFEGSFI

SEQ ID NO: 1795576 - protein, 19 aa, Staphylococcus epidermidis
KKINIPYVLNRALENEKNS

SEQ ID NO: 1795577 - protein, 23 aa, Staphylococcus epidermidis
KKKYHITNKLAVYVPTYREGQVA

SEQ ID NO: 1795578 - protein, 17 aa, Staphylococcus epidermidis
KKLARTIHFSFGYAEGG

SEQ ID NO: 1795579 - protein, 25 aa, Staphylococcus epidermidis
KKLLEMRRSIGMIFQHFNLVKRSTV

SEQ ID NO: 1795580 - protein, 23 aa, Staphylococcus epidermidis
KKLNLKAVIFMPVTTPRQKINQV

SEQ ID NO: 1795581 - protein, 46 aa, Staphylococcus epidermidis
KKLQHLSLLSGGERALSAIALLFAILKVRSAPFVILDEVEAALDEA

SEQ ID NO: 1795582 - protein, 18 aa, Staphylococcus epidermidis
KKPVMLIGLGTQHAKDEL

SEQ ID NO: 1795583 - protein, 27 aa, Staphylococcus epidermidis
KKQLALKLKQLCHSYHVPMIVNDDVQL

SEQ ID NO: 1795584 - protein, 21 aa, Staphylococcus epidermidis
KKRHILPGFIDIHIHGGYGED

SEQ ID NO: 1795585 - protein, 18 aa, Staphylococcus epidermidis
KKVLLVMGGSLGSKKLNN

SEQ ID NO: 1795586 - protein, 19 aa, Staphylococcus epidermidis
KKYKVLHEVAGKPMVEHVL

SEQ ID NO: 1795587 - protein, 30 aa, Staphylococcus epidermidis
KLAIEYKMAFPLHPEFRTMPMVWYCPPLSP

SEQ ID NO: 1795588 - protein, 25 aa, Staphylococcus epidermidis
KLAMVLVQFPPWFDCNVQNINYILY

SEQ ID NO: 1795589 - protein, 21 aa, Staphylococcus epidermidis
KLAQLRPAFKKDGSVTAGNAS

SEQ ID NO: 1795590 - protein, 20 aa, Staphylococcus epidermidis
KLIKEGNQVVGIEARKANGA

SEQ ID NO: 1795591 - protein, 22 aa, Staphylococcus epidermidis
KLIPKYPKKIAVLTASTGAAIR

SEQ ID NO: 1795592 - protein, 21 aa, Staphylococcus epidermidis
KLKDDGVYCFSEESTEGLEEV

SEQ ID NO: 1795593 - protein, 29 aa, Staphylococcus epidermidis
KLKMNGREVFKFAVRIMGDASTRVVEKAG

SEQ ID NO: 1795594 - protein, 17 aa, Staphylococcus epidermidis
KLLMGVPGRSNAFDISK

SEQ ID NO: 1795595 - protein, 17 aa, Staphylococcus epidermidis
KLLSTAGAYWRGNSDNK

SEQ ID NO: 1795596 - protein, 18 aa, Staphylococcus epidermidis
KLPDLSERERKVISKHTK

SEQ ID NO: 1795597 - protein, 18 aa, Staphylococcus epidermidis
KLPHLKEAEILYFIDNID

SEQ ID NO: 1795598 - protein, 25 aa, Staphylococcus epidermidis
KLQAIYRRVYEFGVEEKRTLSWQDA

SEQ ID NO: 1795599 - protein, 18 aa, Staphylococcus epidermidis
KLREKLGIFDGDVDENEN

SEQ ID NO: 1795600 - protein, 21 aa, Staphylococcus epidermidis
KLSEFVPSFFGGSADLAGSNK

SEQ ID NO: 1795601 - protein, 18 aa, Staphylococcus epidermidis
KLSGRTAHITDYTNASRT

SEQ ID NO: 1795602 - protein, 25 aa, Staphylococcus epidermidis
KLYLKHGQCKVLLGVARGKKKYDKR

SEQ ID NO: 1795603 - protein, 19 aa, Staphylococcus epidermidis
KLYYNGPMFRYERKQKGRY

SEQ ID NO: 1795604 - protein, 20 aa, Staphylococcus epidermidis
KMICAYSGVNRSTFYDHFQD

SEQ ID NO: 1795605 - protein, 22 aa, Staphylococcus epidermidis
KMPEIKVQGFLGSLGDKQGFAY

SEQ ID NO: 1795606 - protein, 18 aa, Staphylococcus epidermidis
KNDRPRIDTARKVADVIL

SEQ ID NO: 1795607 - protein, 24 aa, Staphylococcus epidermidis
KNEKKIAQFILNYPHKVVNMTSQE

SEQ ID NO: 1795608 - protein, 17 aa, Staphylococcus epidermidis
KNELKKQYRVITYDVRG

SEQ ID NO: 1795609 - protein, 22 aa, Staphylococcus epidermidis
KNETDRLISVEWVKSKDSTQQY

SEQ ID NO: 1795610 - protein, 19 aa, Staphylococcus epidermidis
KNGRVGFGTGKAQEVPEAI

SEQ ID NO: 1795611 - protein, 24 aa, Staphylococcus epidermidis
KNKDCPVCEKHEYTLLESQQERTI

SEQ ID NO: 1795612 - protein, 29 aa, Staphylococcus epidermidis
KNKFEEHGFEVLKAQSFNEFVVKFNQPIK

SEQ ID NO: 1795613 - protein, 17 aa, Staphylococcus epidermidis
KNKKAFDEQEFRNDMSE

SEQ ID NO: 1795614 - protein, 19 aa, Staphylococcus epidermidis
KNKNFILLTAHRRENIGKP

SEQ ID NO: 1795615 - protein, 23 aa, Staphylococcus epidermidis
KNLKYDLYHILFEMVRNYQTKPP

SEQ ID NO: 1795616 - protein, 21 aa, Staphylococcus epidermidis
KNNGVEYVFGIPGAKIDYLFN

SEQ ID NO: 1795617 - protein, 22 aa, Staphylococcus epidermidis
KNQGAWLFVYPYLKALVANKYD

SEQ ID NO: 1795618 - protein, 21 aa, Staphylococcus epidermidis
KNSKFPVLLAGMRSSSQAETE

SEQ ID NO: 1795619 - protein, 22 aa, Staphylococcus epidermidis
KNTQLPQMFGFQAEGASPIVQN

SEQ ID NO: 1795620 - protein, 19 aa, Staphylococcus epidermidis
KPEEIRTRVSYLMQQSELI

SEQ ID NO: 1795621 - protein, 24 aa, Staphylococcus epidermidis
KPENVDLYDGYSFIGLGSDGAFAE

SEQ ID NO: 1795622 - protein, 18 aa, Staphylococcus epidermidis
KPFSPRELVLRTNNLLAR

SEQ ID NO: 1795623 - protein, 20 aa, Staphylococcus epidermidis
KPFSPREVVARVKAILRRSQ

SEQ ID NO: 1795624 - protein, 20 aa, Staphylococcus epidermidis
KPKEIAMVLNLESKVVYNAI

SEQ ID NO: 1795625 - protein, 19 aa, Staphylococcus epidermidis
KPLRFTVKGNPYVSRMRKS

SEQ ID NO: 1795626 - protein, 18 aa, Staphylococcus epidermidis
KPLYLQWKKALSEVGIGR

SEQ ID NO: 1795627 - protein, 19 aa, Staphylococcus epidermidis
KPPMTVPHLDTRYINGKQT

SEQ ID NO: 1795628 - protein, 25 aa, Staphylococcus epidermidis
KQGHLFLLLAKEGWHEGVLGIVASK

SEQ ID NO: 1795629 - protein, 18 aa, Staphylococcus epidermidis
KQIRLNINLENWNKNKLY

SEQ ID NO: 1795630 - protein, 18 aa, Staphylococcus epidermidis
KQKVKFAVWEKYDNQHRV

SEQ ID NO: 1795631 - protein, 17 aa, Staphylococcus epidermidis
KQKYSFQELPQFTPEIF

SEQ ID NO: 1795632 - protein, 25 aa, Staphylococcus epidermidis
KQLNTRIIIVTTFKRPGYFEKAVAN

SEQ ID NO: 1795633 - protein, 21 aa, Staphylococcus epidermidis
KQNFIEYILFNYRFKSRITVW

SEQ ID NO: 1795634 - protein, 22 aa, Staphylococcus epidermidis
KQPTVRELLGYLSAGGGHLTLI

SEQ ID NO: 1795635 - protein, 23 aa, Staphylococcus epidermidis
KQTLKGLFFEAGFNDIIVRSFTG

SEQ ID NO: 1795636 - protein, 22 aa, Staphylococcus epidermidis
KQVIKTWSRRSTIFPNFIGHTF

SEQ ID NO: 1795637 - protein, 27 aa, Staphylococcus epidermidis
KQVLEKFKSLTFISGTLTFNHSFKAFQ

SEQ ID NO: 1795638 - protein, 18 aa, Staphylococcus epidermidis
KQYGLKFKYVDFLNYEEV

SEQ ID NO: 1795639 - protein, 21 aa, Staphylococcus epidermidis
KQYIVTWALGHLVTNATPEQY

SEQ ID NO: 1795640 - protein, 22 aa, Staphylococcus epidermidis
KRATNPKVREFIVTKMGNKIAN

SEQ ID NO: 1795641 - protein, 18 aa, Staphylococcus epidermidis
KRDRFKAKGLNVVTYGKE

SEQ ID NO: 1795642 - protein, 18 aa, Staphylococcus epidermidis
KREGQGCVSLKTIAEENK

SEQ ID NO: 1795643 - protein, 29 aa, Staphylococcus epidermidis
KRFAKEGKPVLGVCNGFQILTEIGLLPGA

SEQ ID NO: 1795644 - protein, 18 aa, Staphylococcus epidermidis
KRFNVPEDVYEIFKSTML

SEQ ID NO: 1795645 - protein, 19 aa, Staphylococcus epidermidis
KRFTENDFEFCVDVLEKAH

SEQ ID NO: 1795646 - protein, 25 aa, Staphylococcus epidermidis
KRIEKGDMITLDFGAYYRGYCSDIT

SEQ ID NO: 1795647 - protein, 20 aa, Staphylococcus epidermidis
KRKLNDMNEINIAHVKFYVG

SEQ ID NO: 1795648 - protein, 18 aa, Staphylococcus epidermidis
KRLFSMNDLERLLEIKSL

SEQ ID NO: 1795649 - protein, 20 aa, Staphylococcus epidermidis
KRLGYMRMMGYTNLDQCRRK

SEQ ID NO: 1795650 - protein, 20 aa, Staphylococcus epidermidis
KRMRRKYTMAHFSERLTKLH

SEQ ID NO: 1795651 - protein, 40 aa, Staphylococcus epidermidis
KRQSKVFRSRFRMLVEAQLDLLKSEDWDYLLNYDLDAEQV

SEQ ID NO: 1795652 - protein, 17 aa, Staphylococcus epidermidis
KRRGGGISETFTVRKIS

SEQ ID NO: 1795653 - protein, 20 aa, Staphylococcus epidermidis
KRSNSGTCYNQRPIVSIGDV

SEQ ID NO: 1795654 - protein, 17 aa, Staphylococcus epidermidis
KRTTDWGIDGYALSFNY

SEQ ID NO: 1795655 - protein, 21 aa, Staphylococcus epidermidis
KRVDVPVIIKEVGFGMSKETL

SEQ ID NO: 1795656 - protein, 26 aa, Staphylococcus epidermidis
KRVSKSGFGPFAFDEWRYLPDGSDNP

SEQ ID NO: 1795657 - protein, 29 aa, Staphylococcus epidermidis
KSADIFRNAGIDFCCGGQESIASAVNHKP

SEQ ID NO: 1795658 - protein, 24 aa, Staphylococcus epidermidis
KSDHNIKIAIVMHLCSTTQQDARL

SEQ ID NO: 1795659 - protein, 21 aa, Staphylococcus epidermidis
KSDRIILRMATFEILHSDTPK

SEQ ID NO: 1795660 - protein, 17 aa, Staphylococcus epidermidis
KSGRITGAQAWVGTLLK

SEQ ID NO: 1795661 - protein, 18 aa, Staphylococcus epidermidis
KSIIKMLGTDQFKRIRIG

SEQ ID NO: 1795662 - protein, 20 aa, Staphylococcus epidermidis
KSKLTVHLMINHIAVKCVFF

SEQ ID NO: 1795663 - protein, 22 aa, Staphylococcus epidermidis
KSKNYDVALAIGQAGGRSEITP

SEQ ID NO: 1795664 - protein, 23 aa, Staphylococcus epidermidis
KSKREALEMAERVDLDLVVVAPN

SEQ ID NO: 1795665 - protein, 17 aa, Staphylococcus epidermidis
KSLAGFDIESFNVSHDA

SEQ ID NO: 1795666 - protein, 17 aa, Staphylococcus epidermidis
KSLAYLLAATMYNIETG

SEQ ID NO: 1795667 - protein, 18 aa, Staphylococcus epidermidis
KSLGNFILVHDIIKEVDP

SEQ ID NO: 1795668 - protein, 17 aa, Staphylococcus epidermidis
KSLLFGPFAGFSPKFLK

SEQ ID NO: 1795669 - protein, 26 aa, Staphylococcus epidermidis
KSLLGGTCLHKGCIPTKALLKSAEVN

SEQ ID NO: 1795670 - protein, 24 aa, Staphylococcus epidermidis
KSLYEQHLLKLLSSEEVQWIVLAG

SEQ ID NO: 1795671 - protein, 22 aa, Staphylococcus epidermidis
KSLYPSCRIAYIVLPQNLMHKY

SEQ ID NO: 1795672 - protein, 23 aa, Staphylococcus epidermidis
KSPHPSPLSAFRGFFGSKPYSTT

SEQ ID NO: 1795673 - protein, 21 aa, Staphylococcus epidermidis
KSPLCLFCPIQEHCEAFHMGT

SEQ ID NO: 1795674 - protein, 17 aa, Staphylococcus epidermidis
KSSPFVWFKDVLDGYDY

SEQ ID NO: 1795675 - protein, 20 aa, Staphylococcus epidermidis
KSSYDFCGLVLDYDHETQLA

SEQ ID NO: 1795676 - protein, 20 aa, Staphylococcus epidermidis
KSTEKMAGQTIIELDIRAQY

SEQ ID NO: 1795677 - protein, 20 aa, Staphylococcus epidermidis
KSTLDLLKRLKYMNEEFNTT

SEQ ID NO: 1795678 - protein, 22 aa, Staphylococcus epidermidis
KSYTPQELSAMILQNLKSTAEN

SEQ ID NO: 1795679 - protein, 22 aa, Staphylococcus epidermidis
KTAEMELRILTQIKEALEDGKP

SEQ ID NO: 1795680 - protein, 23 aa, Staphylococcus epidermidis
KTDYKACVVLDMHIGHLKSIMEL

SEQ ID NO: 1795681 - protein, 19 aa, Staphylococcus epidermidis
KTFASEWLTDLNISEDNMR

SEQ ID NO: 1795682 - protein, 17 aa, Staphylococcus epidermidis
KTFTLDILREMKRYQVE

SEQ ID NO: 1795683 - protein, 20 aa, Staphylococcus epidermidis
KTIPTTFEFTDIAGIVKGAS

SEQ ID NO: 1795684 - protein, 20 aa, Staphylococcus epidermidis
KTITSRSILSKVLVRATQQW

SEQ ID NO: 1795685 - protein, 25 aa, Staphylococcus epidermidis
KTKELSLRLSKELIDTVHEYFNGLY

SEQ ID NO: 1795686 - protein, 31 aa, Staphylococcus epidermidis
KTKIKESKHIGGFPVSGLFLRCKNPDVIHRH

SEQ ID NO: 1795687 - protein, 20 aa, Staphylococcus epidermidis
KTKSRLDIINTLPTSNQVSH

SEQ ID NO: 1795688 - protein, 21 aa, Staphylococcus epidermidis
KTLIKEANWAEQIAHGKPSGI

SEQ ID NO: 1795689 - protein, 17 aa, Staphylococcus epidermidis
KTLLSEAEFREYYDKYP

SEQ ID NO: 1795690 - protein, 19 aa, Staphylococcus epidermidis
KTNSIGIAHGCTGKGNDQV

SEQ ID NO: 1795691 - protein, 19 aa, Staphylococcus epidermidis
KTRIEDGEELIVVVSAMGK

SEQ ID NO: 1795692 - protein, 17 aa, Staphylococcus epidermidis
KTTICGTDLHIIKGDTP

SEQ ID NO: 1795693 - protein, 19 aa, Staphylococcus epidermidis
KTTLLRMINALEIPTEGTV

SEQ ID NO: 1795694 - protein, 21 aa, Staphylococcus epidermidis
KTTTITFKFMAPLNYKTITSR

SEQ ID NO: 1795695 - protein, 23 aa, Staphylococcus epidermidis
KTVSELYAPISGKIVEVNEELED

SEQ ID NO: 1795696 - protein, 21 aa, Staphylococcus epidermidis
KVDEVEFIKVIREVGRNGVID

SEQ ID NO: 1795697 - protein, 17 aa, Staphylococcus epidermidis
KVESLRASYYMMGAMLG

SEQ ID NO: 1795698 - protein, 21 aa, Staphylococcus epidermidis
KVIARKIAHARLFEDENDKLN

SEQ ID NO: 1795699 - protein, 23 aa, Staphylococcus epidermidis
KVIDEMADRFVVVVDESKLVNYL

SEQ ID NO: 1795700 - protein, 21 aa, Staphylococcus epidermidis
KVIEFNARFGDPEAQVLLTRL

SEQ ID NO: 1795701 - protein, 22 aa, Staphylococcus epidermidis
KVKAQLGQDIPLVINGEKLTKT

SEQ ID NO: 1795702 - protein, 18 aa, Staphylococcus epidermidis
KVLPDLFYPEYISVGKNT

SEQ ID NO: 1795703 - protein, 17 aa, Staphylococcus epidermidis
KVLQKRRFKKALQQKRQ

SEQ ID NO: 1795704 - protein, 17 aa, Staphylococcus epidermidis
KVNGGFVVTGGSANLLG

SEQ ID NO: 1795705 - protein, 22 aa, Staphylococcus epidermidis
KVNLKSIMGVMSLGVGKDAEIT

SEQ ID NO: 1795706 - protein, 23 aa, Staphylococcus epidermidis
KVPGEGYYAVGLFFSKEKVRDSI

SEQ ID NO: 1795707 - protein, 23 aa, Staphylococcus epidermidis
KVRRAKLYYLRSLRGKAARIQEI

SEQ ID NO: 1795708 - protein, 23 aa, Staphylococcus epidermidis
KVSEALLKVVIKDVAKRAAAKQT

SEQ ID NO: 1795709 - protein, 24 aa, Staphylococcus epidermidis
KVSKIPVVAGFGIKNPEHVKDIAS

SEQ ID NO: 1795710 - protein, 17 aa, Staphylococcus epidermidis
KVVINYRSDRHHDEIEE

SEQ ID NO: 1795711 - protein, 26 aa, Staphylococcus epidermidis
KVVKGGRRFRFTALVVVGDKNGRVGF

SEQ ID NO: 1795712 - protein, 21 aa, Staphylococcus epidermidis
KVWGSDNLRQFGYQLPNNHIG

SEQ ID NO: 1795713 - protein, 24 aa, Staphylococcus epidermidis
KWNIIRPPFNVTRISEYAAIAALE

SEQ ID NO: 1795714 - protein, 18 aa, Staphylococcus epidermidis
KWVHYGLTSTDVVDTALS

SEQ ID NO: 1795715 - protein, 24 aa, Staphylococcus epidermidis
KYDDVRTAMKMILPKKWTLNQLVD

SEQ ID NO: 1795716 - protein, 17 aa, Staphylococcus epidermidis
KYDRLNNIISFEQHKVW

SEQ ID NO: 1795717 - protein, 23 aa, Staphylococcus epidermidis
KYEVMSIPTLIVFKDGEPVDKVV

SEQ ID NO: 1795718 - protein, 18 aa, Staphylococcus epidermidis
KYGADIVTILGVAEDASI

SEQ ID NO: 1795719 - protein, 18 aa, Staphylococcus epidermidis
KYLTVATGYYGQHNTLEA

SEQ ID NO: 1795720 - protein, 21 aa, Staphylococcus epidermidis
KYNNNIWNEWAFENYVQSDDY

SEQ ID NO: 1795721 - protein, 20 aa, Staphylococcus epidermidis
KYPEYTWDLTTIFKSDEAFE

SEQ ID NO: 1795722 - protein, 19 aa, Staphylococcus epidermidis
KYPLADYALTPDIAIVDPQ

SEQ ID NO: 1795723 - protein, 36 aa, Staphylococcus epidermidis
KYRDEKRPRFGLLRGREFLMKDAYSFHSDEASLDAT

SEQ ID NO: 1795724 - protein, 20 aa, Staphylococcus epidermidis
KYVSRRAAQIVGRPIEDLRI

SEQ ID NO: 1795725 - protein, 25 aa, Staphylococcus epidermidis
LADTYRTTPDLSFAVRYLQADAGVM

SEQ ID NO: 1795726 - protein, 17 aa, Staphylococcus epidermidis
LAGQLYSEFKEFFPENR

SEQ ID NO: 1795727 - protein, 18 aa, Staphylococcus epidermidis
LAIVFGRTKRRVDELTSA

SEQ ID NO: 1795728 - protein, 19 aa, Staphylococcus epidermidis
LAKDLKPQQLHDIKHVISF

SEQ ID NO: 1795729 - protein, 22 aa, Staphylococcus epidermidis
LALKEEGYRVILVNSNPATIMT

SEQ ID NO: 1795730 - protein, 23 aa, Staphylococcus epidermidis
LANKFKNLCVVGDSDQSIYGWRG

SEQ ID NO: 1795731 - protein, 22 aa, Staphylococcus epidermidis
LARNELQYLLNLNDAIDEIEEA

SEQ ID NO: 1795732 - protein, 18 aa, Staphylococcus epidermidis
LASTTFLLREQFYTDKVS

SEQ ID NO: 1795733 - protein, 17 aa, Staphylococcus epidermidis
LATMLAFITCDANISSQ

SEQ ID NO: 1795734 - protein, 18 aa, Staphylococcus epidermidis
LAVSGPFHSSMMKVIEED

SEQ ID NO: 1795735 - protein, 19 aa, Staphylococcus epidermidis
LCNHYEIQTPLKSYHEHNK

SEQ ID NO: 1795736 - protein, 24 aa, Staphylococcus epidermidis
LDACSAPGGKACHMAEILSPEGHV

SEQ ID NO: 1795737 - protein, 19 aa, Staphylococcus epidermidis
LDAGLMFPEDEMLGVDIVI

SEQ ID NO: 1795738 - protein, 22 aa, Staphylococcus epidermidis
LDEIDGLILPGGESTTLRRLMD

SEQ ID NO: 1795739 - protein, 23 aa, Staphylococcus epidermidis
LDEKIYYSYRMDNLIVSYLIQAH

SEQ ID NO: 1795740 - protein, 23 aa, Staphylococcus epidermidis
LDERFFRCHNSFVINRHNIESID

SEQ ID NO: 1795741 - protein, 18 aa, Staphylococcus epidermidis
LDEYIKMTIGMPGLSEEE

SEQ ID NO: 1795742 - protein, 18 aa, Staphylococcus epidermidis
LDFITHSYPHDWRTKKPV

SEQ ID NO: 1795743 - protein, 23 aa, Staphylococcus epidermidis
LDFKDRLATELKQADQDVKLTVT

SEQ ID NO: 1795744 - protein, 24 aa, Staphylococcus epidermidis
LDGDTRGGAALSIRSVTQKPIKFV

SEQ ID NO: 1795745 - protein, 18 aa, Staphylococcus epidermidis
LDGLNYLAGKSIDEVNTK

SEQ ID NO: 1795746 - protein, 24 aa, Staphylococcus epidermidis
LDGPLDLTFLFGLVDHLSHKLKYL

SEQ ID NO: 1795747 - protein, 26 aa, Staphylococcus epidermidis
LDGSRRFLDRVWRLIITDENSINKKI

SEQ ID NO: 1795748 - protein, 28 aa, Staphylococcus epidermidis
LDHSKIYYKWLAQLSEALESGEIFNYFP

SEQ ID NO: 1795749 - protein, 19 aa, Staphylococcus epidermidis
LDHSYDWLIFSSKNAVKYF

SEQ ID NO: 1795750 - protein, 22 aa, Staphylococcus epidermidis
LDIQSGEFIAFIGTSGSGKTTA

SEQ ID NO: 1795751 - protein, 34 aa, Staphylococcus epidermidis
LDKLFKDAGFEWREPGCSMCLGMNPDQVPEGVHC

SEQ ID NO: 1795752 - protein, 21 aa, Staphylococcus epidermidis
LDLKGKVVLERADFNVPIKDG

SEQ ID NO: 1795753 - protein, 17 aa, Staphylococcus epidermidis
LDNLHLIDDYVDFIENY

SEQ ID NO: 1795754 - protein, 24 aa, Staphylococcus epidermidis
LDPEVNGVLPICLGDATKVSDYIM

SEQ ID NO: 1795755 - protein, 17 aa, Staphylococcus epidermidis
LDSDMRLEYGFVGTNLK

SEQ ID NO: 1795756 - protein, 19 aa, Staphylococcus epidermidis
LDSIIGNGFSVIYLISQRL

SEQ ID NO: 1795757 - protein, 19 aa, Staphylococcus epidermidis
LDSPIKYTQHIGGTCHFNY

SEQ ID NO: 1795758 - protein, 18 aa, Staphylococcus epidermidis
LDTEAEIAYIKESMQPPK

SEQ ID NO: 1795759 - protein, 19 aa, Staphylococcus epidermidis
LDYRELYRNLPYIGTLKAE

SEQ ID NO: 1795760 - protein, 28 aa, Staphylococcus epidermidis
LEDMPRSIYCGTIGLLLPNQRMIFNIPI

SEQ ID NO: 1795761 - protein, 18 aa, Staphylococcus epidermidis
LEEIKKWSAEDEYATFVK

SEQ ID NO: 1795762 - protein, 21 aa, Staphylococcus epidermidis
LEELQMCGASFVVQPKAVQTD

SEQ ID NO: 1795763 - protein, 18 aa, Staphylococcus epidermidis
LEFYKQYKALSGYIDKKY

SEQ ID NO: 1795764 - protein, 23 aa, Staphylococcus epidermidis
LEGHPGICILGNILDDINRTLLN

SEQ ID NO: 1795765 - protein, 25 aa, Staphylococcus epidermidis
LEHTGRYAYVITMLRRNGYHVIMGD

SEQ ID NO: 1795766 - protein, 22 aa, Staphylococcus epidermidis
LEKGEIVGLIGLNGAGKSTTIK

SEQ ID NO: 1795767 - protein, 23 aa, Staphylococcus epidermidis
LEKRGRNYIGLCPFHDEKTPSFT

SEQ ID NO: 1795768 - protein, 17 aa, Staphylococcus epidermidis
LELSNLYIYKLAVIANM

SEQ ID NO: 1795769 - protein, 21 aa, Staphylococcus epidermidis
LENLFGGAIPNFGQNQDEEEE

SEQ ID NO: 1795770 - protein, 27 aa, Staphylococcus epidermidis
LENVELSWHLGVIWRKDAYLNHVTRKW

SEQ ID NO: 1795771 - protein, 22 aa, Staphylococcus epidermidis
LENVSIPLIYNGLSNKARKSKV

SEQ ID NO: 1795772 - protein, 17 aa, Staphylococcus epidermidis
LEQYKGDVMLIVNTASE

SEQ ID NO: 1795773 - protein, 26 aa, Staphylococcus epidermidis
LERKKAIDIGNAMLKDGYKESDVIPI

SEQ ID NO: 1795774 - protein, 19 aa, Staphylococcus epidermidis
LESAYDYRWIDFAQNKGKD

SEQ ID NO: 1795775 - protein, 20 aa, Staphylococcus epidermidis
LESDVLFKYVENIMNQNQSQ

SEQ ID NO: 1795776 - protein, 21 aa, Staphylococcus epidermidis
LESLRPLLLRYSKERLDGEHF

SEQ ID NO: 1795777 - protein, 19 aa, Staphylococcus epidermidis
LESNLTALSFKYLTSHDAM

SEQ ID NO: 1795778 - protein, 24 aa, Staphylococcus epidermidis
LESSWKRLHIVDAVKEVTGVDFYN

SEQ ID NO: 1795779 - protein, 17 aa, Staphylococcus epidermidis
LETLPYSEILSGYAEVY

SEQ ID NO: 1795780 - protein, 21 aa, Staphylococcus epidermidis
LEVYNRNGVVTARAVTSHRMP

SEQ ID NO: 1795781 - protein, 19 aa, Staphylococcus epidermidis
LFGTLPIYPCLNDEYDQHL

SEQ ID NO: 1795782 - protein, 20 aa, Staphylococcus epidermidis
LFKAYRYKKPIDFISENYQL

SEQ ID NO: 1795783 - protein, 17 aa, Staphylococcus epidermidis
LFKEIFKASTDLQKSEN

SEQ ID NO: 1795784 - protein, 23 aa, Staphylococcus epidermidis
LFKIVSASLVKYYYRTPRIPRSL

SEQ ID NO: 1795785 - protein, 27 aa, Staphylococcus epidermidis
LFNYRFKSRITVWVLNYLKANQDKLNN

SEQ ID NO: 1795786 - protein, 19 aa, Staphylococcus epidermidis
LFPTHVVVETCGIGYEIQT

SEQ ID NO: 1795787 - protein, 25 aa, Staphylococcus epidermidis
LFRNEEFELALKLGQSLGVEVLETE

SEQ ID NO: 1795788 - protein, 23 aa, Staphylococcus epidermidis
LFRNQLFIMFGIMHEGRNKEEKV

SEQ ID NO: 1795789 - protein, 23 aa, Staphylococcus epidermidis
LGERFKYHRHFFVPDNVGHDGFL

SEQ ID NO: 1795790 - protein, 18 aa, Staphylococcus epidermidis
LGFITSAVDRELPYHLAI

SEQ ID NO: 1795791 - protein, 18 aa, Staphylococcus epidermidis
LGFPRLGRKREWKKAIEN

SEQ ID NO: 1795792 - protein, 25 aa, Staphylococcus epidermidis
LGGHSLRATLVVNRIEERLKKRLKV

SEQ ID NO: 1795793 - protein, 18 aa, Staphylococcus epidermidis
LGGSFKGERLNKIYKENI

SEQ ID NO: 1795794 - protein, 20 aa, Staphylococcus epidermidis
LGHACGHNIIGTASVLAAVA

SEQ ID NO: 1795795 - protein, 21 aa, Staphylococcus epidermidis
LGHEGVLCLLSDSTNALVPDF

SEQ ID NO: 1795796 - protein, 24 aa, Staphylococcus epidermidis
LGKEAFSIISQGRVDEILNAKPIN

SEQ ID NO: 1795797 - protein, 26 aa, Staphylococcus epidermidis
LGLPYRRVILCTGDIGFSASKTYDLE

SEQ ID NO: 1795798 - protein, 19 aa, Staphylococcus epidermidis
LGPNYKMKFIVRDLGGSRI

SEQ ID NO: 1795799 - protein, 18 aa, Staphylococcus epidermidis
LGVGQFASVSGRYYAMDR

SEQ ID NO: 1795800 - protein, 24 aa, Staphylococcus epidermidis
LGVSSTARASFYVYNTKEDVDQLV

SEQ ID NO: 1795801 - protein, 18 aa, Staphylococcus epidermidis
LGYKGPKGSFEIEGTSLF

SEQ ID NO: 1795802 - protein, 26 aa, Staphylococcus epidermidis
LHDLGFGPKLSMAIYQFYMGDTLNVL

SEQ ID NO: 1795803 - protein, 18 aa, Staphylococcus epidermidis
LHESTGLEAMTIHRLIGW

SEQ ID NO: 1795804 - protein, 18 aa, Staphylococcus epidermidis
LHKFCNPSQLTIDTEIEI

SEQ ID NO: 1795805 - protein, 19 aa, Staphylococcus epidermidis
LHMGGRIGVLTVVEGTTDE

SEQ ID NO: 1795806 - protein, 26 aa, Staphylococcus epidermidis
LHPDYCIPGPFDKRVAPSVAKNVAKA

SEQ ID NO: 1795807 - protein, 23 aa, Staphylococcus epidermidis
LIAIYRYHFNVSKDNALKKIKKA

SEQ ID NO: 1795808 - protein, 17 aa, Staphylococcus epidermidis
LIDAVSYNVARKNTNVK

SEQ ID NO: 1795809 - protein, 18 aa, Staphylococcus epidermidis
LIDDLSLEYNRARQAAIT

SEQ ID NO: 1795810 - protein, 23 aa, Staphylococcus epidermidis
LIDESKLNFLWVTDWPLLEYDED

SEQ ID NO: 1795811 - protein, 25 aa, Staphylococcus epidermidis
LIDILNPYLCIIFCNSRENADELAD

SEQ ID NO: 1795812 - protein, 23 aa, Staphylococcus epidermidis
LIDKYDFIYGIIGWHPVDAIDCT

SEQ ID NO: 1795813 - protein, 18 aa, Staphylococcus epidermidis
LIEKLDYLENLGIDVIWL

SEQ ID NO: 1795814 - protein, 25 aa, Staphylococcus epidermidis
LIEKLTFMHAYNCICANVPAQIACT

SEQ ID NO: 1795815 - protein, 18 aa, Staphylococcus epidermidis
LIGGKGRRANLYGLFNKA

SEQ ID NO: 1795816 - protein, 18 aa, Staphylococcus epidermidis
LIGKRLQYPGAPGPGGIA

SEQ ID NO: 1795817 - protein, 19 aa, Staphylococcus epidermidis
LIHRHHLDVSPATIRNEMK

SEQ ID NO: 1795818 - protein, 20 aa, Staphylococcus epidermidis
LIKDRCFDHTYVAQEKSLLS

SEQ ID NO: 1795819 - protein, 25 aa, Staphylococcus epidermidis
LIMMPRAIVTYELYIAALKLGIAIV

SEQ ID NO: 1795820 - protein, 24 aa, Staphylococcus epidermidis
LITGGFRPSAEIIRYADEHELPII

SEQ ID NO: 1795821 - protein, 24 aa, Staphylococcus epidermidis
LITHEMHVIRRICDEVAVMENGKV

SEQ ID NO: 1795822 - protein, 19 aa, Staphylococcus epidermidis
LKADSVLQERLRSLPNVDI

SEQ ID NO: 1795823 - protein, 23 aa, Staphylococcus epidermidis
LKAENGLELLVHIGLDTVQLDGK

SEQ ID NO: 1795824 - protein, 21 aa, Staphylococcus epidermidis
LKAHGETGVQCGVDEDNVFIF

SEQ ID NO: 1795825 - protein, 22 aa, Staphylococcus epidermidis
LKDRLIRHAYLDVFEKEPLSKD

SEQ ID NO: 1795826 - protein, 21 aa, Staphylococcus epidermidis
LKDSHILKKWSGVRPYTEKEM

SEQ ID NO: 1795827 - protein, 24 aa, Staphylococcus epidermidis
LKEKISRITIGYTRHHKPITVSDL

SEQ ID NO: 1795828 - protein, 17 aa, Staphylococcus epidermidis
LKFLSSLPVGGLGLDLV

SEQ ID NO: 1795829 - protein, 18 aa, Staphylococcus epidermidis
LKGAFNVTQSVIPQFIEQ

SEQ ID NO: 1795830 - protein, 19 aa, Staphylococcus epidermidis
LKGGDPAIFGRITEEVQTL

SEQ ID NO: 1795831 - protein, 17 aa, Staphylococcus epidermidis
LKGPDGIYFRFNRIKEV

SEQ ID NO: 1795832 - protein, 19 aa, Staphylococcus epidermidis
LKHEYKIITDMGFEDYFLI

SEQ ID NO: 1795833 - protein, 17 aa, Staphylococcus epidermidis
LKIPTIIHESDLTPGLA

SEQ ID NO: 1795834 - protein, 17 aa, Staphylococcus epidermidis
LKITIVSGFLGSGKTTF

SEQ ID NO: 1795835 - protein, 20 aa, Staphylococcus epidermidis
LKKANAFGMLNAMEQQTGHI

SEQ ID NO: 1795836 - protein, 23 aa, Staphylococcus epidermidis
LKKDLSDFNVHFDNWFSETSLYE

SEQ ID NO: 1795837 - protein, 21 aa, Staphylococcus epidermidis
LKKEGQCFVNSGGRVILAIGE

SEQ ID NO: 1795838 - protein, 23 aa, Staphylococcus epidermidis
LKKKLELNSIVTIKGKWNRNKQE

SEQ ID NO: 1795839 - protein, 20 aa, Staphylococcus epidermidis
LKLNNIKAFQHDATEVYDKM

SEQ ID NO: 1795840 - protein, 26 aa, Staphylococcus epidermidis
LKNHVVFLGFDFGYRGNSKYLFNYFV

SEQ ID NO: 1795841 - protein, 20 aa, Staphylococcus epidermidis
LKNREGRRIAVIVNDMSEVN

SEQ ID NO: 1795842 - protein, 21 aa, Staphylococcus epidermidis
LKPDLILMDLLMDDMDGVEAT

SEQ ID NO: 1795843 - protein, 29 aa, Staphylococcus epidermidis
LKPFIKTKIKSWVRQLLWMSLYQYLYLDK

SEQ ID NO: 1795844 - protein, 25 aa, Staphylococcus epidermidis
LKQHESFNFFSLFTFHEPVEQVVTH

SEQ ID NO: 1795845 - protein, 20 aa, Staphylococcus epidermidis
LKQLEIDTGVTFAFQGCEHI

SEQ ID NO: 1795846 - protein, 17 aa, Staphylococcus epidermidis
LKQYRASQNLLYPLYKK

SEQ ID NO: 1795847 - protein, 19 aa, Staphylococcus epidermidis
LKRLLDLGAPGIIVQNEKR

SEQ ID NO: 1795848 - protein, 21 aa, Staphylococcus epidermidis
LKSFHACGVYGMATITSIVAQ

SEQ ID NO: 1795849 - protein, 20 aa, Staphylococcus epidermidis
LKTFRQLGVDYEMEKLKKDL

SEQ ID NO: 1795850 - protein, 22 aa, Staphylococcus epidermidis
LKTMKNDIIFSIGHTVATFDQA

SEQ ID NO: 1795851 - protein, 19 aa, Staphylococcus epidermidis
LKTYVLFQLYERFVIDYSL

SEQ ID NO: 1795852 - protein, 25 aa, Staphylococcus epidermidis
LKVGRYRFGDGINEKGLAISNHYFT

SEQ ID NO: 1795853 - protein, 18 aa, Staphylococcus epidermidis
LKYPLSIIKQLHFEDTYH

SEQ ID NO: 1795854 - protein, 17 aa, Staphylococcus epidermidis
LLDDASLFDSAMTDLYL

SEQ ID NO: 1795855 - protein, 18 aa, Staphylococcus epidermidis
LLDTPGILWPKFEDEEVG

SEQ ID NO: 1795856 - protein, 18 aa, Staphylococcus epidermidis
LLDTPTFLFGMRNGETVE

SEQ ID NO: 1795857 - protein, 25 aa, Staphylococcus epidermidis
LLENFKFNELMVAIQSPFLIDDDDN

SEQ ID NO: 1795858 - protein, 26 aa, Staphylococcus epidermidis
LLGDFKAPMGCRSFLPSWKNDEGQLE

SEQ ID NO: 1795859 - protein, 28 aa, Staphylococcus epidermidis
LLHDAIRLAYNYDISCVHIPKNGEEGLK

SEQ ID NO: 1795860 - protein, 19 aa, Staphylococcus epidermidis
LLKELGIPYSHEDRKVNQA

SEQ ID NO: 1795861 - protein, 24 aa, Staphylococcus epidermidis
LLKHLKLKLEDFVKLHTQEKYFVS

SEQ ID NO: 1795862 - protein, 18 aa, Staphylococcus epidermidis
LLNSLRFGELTVKQNQRL

SEQ ID NO: 1795863 - protein, 19 aa, Staphylococcus epidermidis
LLREGYEVSDDIELGIMVE

SEQ ID NO: 1795864 - protein, 27 aa, Staphylococcus epidermidis
LLRTFSKAYGLAGLRVGYVIASEDAIE

SEQ ID NO: 1795865 - protein, 19 aa, Staphylococcus epidermidis
LLSGLGFENGGLAGAHAIH

SEQ ID NO: 1795866 - protein, 17 aa, Staphylococcus epidermidis
LLTGISINNESDMKETA

SEQ ID NO: 1795867 - protein, 25 aa, Staphylococcus epidermidis
LLTKELEGFGELFRYLSYTEDVGTR

SEQ ID NO: 1795868 - protein, 26 aa, Staphylococcus epidermidis
LMDEFWPGPISFILPLKQGYLCSKVT

SEQ ID NO: 1795869 - protein, 20 aa, Staphylococcus epidermidis
LMEKEIKFIGGVVNDPQKPV

SEQ ID NO: 1795870 - protein, 24 aa, Staphylococcus epidermidis
LMSRVRRYPLPLVLEVSNVESVMP

SEQ ID NO: 1795871 - protein, 25 aa, Staphylococcus epidermidis
LNANYIKSRLKNHFEIPFNQYCKHE

SEQ ID NO: 1795872 - protein, 18 aa, Staphylococcus epidermidis
LNAPKLGAINVHASLLPK

SEQ ID NO: 1795873 - protein, 17 aa, Staphylococcus epidermidis
LNDFLGINYYMSDWMRG

SEQ ID NO: 1795874 - protein, 19 aa, Staphylococcus epidermidis
LNDIGCYFLDIQLEADMNG

SEQ ID NO: 1795875 - protein, 23 aa, Staphylococcus epidermidis
LNDKSMFEVAGYSVAMGNASDEL

SEQ ID NO: 1795876 - protein, 18 aa, Staphylococcus epidermidis
LNEAIKILHDYQGIQVTQ

SEQ ID NO: 1795877 - protein, 24 aa, Staphylococcus epidermidis
LNFPKTCPHGGVIPRGDQYKEIFT

SEQ ID NO: 1795878 - protein, 18 aa, Staphylococcus epidermidis
LNGYPLVIATSVERTNTD

SEQ ID NO: 1795879 - protein, 17 aa, Staphylococcus epidermidis
LNIKGLINIQFVIAHDG

SEQ ID NO: 1795880 - protein, 25 aa, Staphylococcus epidermidis
LNIPELRKRIKLVAEQNYGRIKSIE

SEQ ID NO: 1795881 - protein, 25 aa, Staphylococcus epidermidis
LNKDWSRSQLQDWIKEGLVKVNGKV

SEQ ID NO: 1795882 - protein, 23 aa, Staphylococcus epidermidis
LNKRMKWYTVIQAIGLIQWYEEQ

SEQ ID NO: 1795883 - protein, 23 aa, Staphylococcus epidermidis
LNKSVSKFAIGAMQFDDILKYIG

SEQ ID NO: 1795884 - protein, 23 aa, Staphylococcus epidermidis
LNKTMKPSVLFHLTEKDAGDRFY

SEQ ID NO: 1795885 - protein, 17 aa, Staphylococcus epidermidis
LNLKGGQKMYVDQKIET

SEQ ID NO: 1795886 - protein, 26 aa, Staphylococcus epidermidis
LNPKLKAFAPVREWAWSREEEIDYAI

SEQ ID NO: 1795887 - protein, 24 aa, Staphylococcus epidermidis
LNPVELRRSIGYVIQQIGLMPHMT

SEQ ID NO: 1795888 - protein, 18 aa, Staphylococcus epidermidis
LNPVQLRRVLAYLTEHNY

SEQ ID NO: 1795889 - protein, 33 aa, Staphylococcus epidermidis
LNQGAKMRYMFGGKAKIPLVVRTVHGAGASAAA

SEQ ID NO: 1795890 - protein, 24 aa, Staphylococcus epidermidis
LNQKRIGLYISNDIDSVVLIHACW

SEQ ID NO: 1795891 - protein, 32 aa, Staphylococcus epidermidis
LNQLKSLGLNSNWDMLFIVFSIHLIDKAKQLK

SEQ ID NO: 1795892 - protein, 18 aa, Staphylococcus epidermidis
LNTPFFIGIMPIASYNNA

SEQ ID NO: 1795893 - protein, 18 aa, Staphylococcus epidermidis
LNTYKAFFGDTVEMTDGV

SEQ ID NO: 1795894 - protein, 24 aa, Staphylococcus epidermidis
LNVAKAMRTGRIWINTYNQIPAGA

SEQ ID NO: 1795895 - protein, 29 aa, Staphylococcus epidermidis
LNVESAGIIKKLFLLGIMANINQSLDEET

SEQ ID NO: 1795896 - protein, 18 aa, Staphylococcus epidermidis
LNVGCIPSKTLLEHGEKA

SEQ ID NO: 1795897 - protein, 20 aa, Staphylococcus epidermidis
LPGRSLELGEYFKSELKKIE

SEQ ID NO: 1795898 - protein, 21 aa, Staphylococcus epidermidis
LPKYDGFYWCRKMRQQSNVPI

SEQ ID NO: 1795899 - protein, 19 aa, Staphylococcus epidermidis
LPLEIYVELVYSIQQEMVY

SEQ ID NO: 1795900 - protein, 22 aa, Staphylococcus epidermidis
LPLSDARISPLYGTLKGLPPIY

SEQ ID NO: 1795901 - protein, 18 aa, Staphylococcus epidermidis
LPMNNAIEFKSPKQYEIV

SEQ ID NO: 1795902 - protein, 19 aa, Staphylococcus epidermidis
LPNHAPLVVAEQFGTLETL

SEQ ID NO: 1795903 - protein, 21 aa, Staphylococcus epidermidis
LPNKLHALGFEFKYNNLRNAL

SEQ ID NO: 1795904 - protein, 20 aa, Staphylococcus epidermidis
LPQFTPEIFMKVSAKNVMKQ

SEQ ID NO: 1795905 - protein, 32 aa, Staphylococcus epidermidis
LPSDVTKRIAIEMASPLGWHKYVGIEGKVIGI

SEQ ID NO: 1795906 - protein, 26 aa, Staphylococcus epidermidis
LPSEESYFLFYINRPSIIVGKNQNTI

SEQ ID NO: 1795907 - protein, 22 aa, Staphylococcus epidermidis
LPTEINSLYGLETGHITISMSA

SEQ ID NO: 1795908 - protein, 23 aa, Staphylococcus epidermidis
LPVDCKIAKEFSNDAKITEVSIN

SEQ ID NO: 1795909 - protein, 19 aa, Staphylococcus epidermidis
LPVVIYFYGGSFLQGHGTA

SEQ ID NO: 1795910 - protein, 21 aa, Staphylococcus epidermidis
LQADMSLGIVIGSEGQGMSRL

SEQ ID NO: 1795911 - protein, 19 aa, Staphylococcus epidermidis
LQAGKIVLCDRYIDSSLAY

SEQ ID NO: 1795912 - protein, 19 aa, Staphylococcus epidermidis
LQANLSHPERLVVAHPFHP

SEQ ID NO: 1795913 - protein, 19 aa, Staphylococcus epidermidis
LQIYRELFEPSEVLDKPYV

SEQ ID NO: 1795914 - protein, 17 aa, Staphylococcus epidermidis
LQKEVDFAVQLGLVDKE

SEQ ID NO: 1795915 - protein, 17 aa, Staphylococcus epidermidis
LQKTVDVYRSYKTKKEE

SEQ ID NO: 1795916 - protein, 18 aa, Staphylococcus epidermidis
LQTEYGISAEQSHVLNML

SEQ ID NO: 1795917 - protein, 20 aa, Staphylococcus epidermidis
LQVRIPVRMDDGTVKTFTGY

SEQ ID NO: 1795918 - protein, 24 aa, Staphylococcus epidermidis
LQYVETCDLPIVIKKDGLAAGKGV

SEQ ID NO: 1795919 - protein, 20 aa, Staphylococcus epidermidis
LRDWLFSRQRYWGEPIPIIH

SEQ ID NO: 1795920 - protein, 19 aa, Staphylococcus epidermidis
LREATHLPIHLHTHDTSGN

SEQ ID NO: 1795921 - protein, 20 aa, Staphylococcus epidermidis
LRKPDWLKIKLNTNDNYTGL

SEQ ID NO: 1795922 - protein, 21 aa, Staphylococcus epidermidis
LRLNTLPQRLAIIGGGVIGLE

SEQ ID NO: 1795923 - protein, 20 aa, Staphylococcus epidermidis
LRLYQRFEKRRELYNLMKQS

SEQ ID NO: 1795924 - protein, 22 aa, Staphylococcus epidermidis
LRQEPLDHVLLFGPPGLGKTTL

SEQ ID NO: 1795925 - protein, 19 aa, Staphylococcus epidermidis
LRQKMGMVFQNFNLFPHKK

SEQ ID NO: 1795926 - protein, 18 aa, Staphylococcus epidermidis
LRSKCRRLKQEHGLDMIV

SEQ ID NO: 1795927 - protein, 21 aa, Staphylococcus epidermidis
LRYLTPHGKWNIHSTYQDNER

SEQ ID NO: 1795928 - protein, 18 aa, Staphylococcus epidermidis
LSAKELKEGFKDVPQVTL

SEQ ID NO: 1795929 - protein, 23 aa, Staphylococcus epidermidis
LSEELKRQINMITETITVREDIS

SEQ ID NO: 1795930 - protein, 26 aa, Staphylococcus epidermidis
LSEMKRLGLPVPDGFTITTEACITYL

SEQ ID NO: 1795931 - protein, 19 aa, Staphylococcus epidermidis
LSGAVAWISGLRRAQSPTR

SEQ ID NO: 1795932 - protein, 24 aa, Staphylococcus epidermidis
LSGPKRPQDLIFLSDMKKEFEKSV

SEQ ID NO: 1795933 - protein, 18 aa, Staphylococcus epidermidis
LSHLRVIVRSLLGIAVPT

SEQ ID NO: 1795934 - protein, 29 aa, Staphylococcus epidermidis
LSKGYNMSGFRVGFAVGNKKMIQALKKYQ

SEQ ID NO: 1795935 - protein, 22 aa, Staphylococcus epidermidis
LSKKLPMSLIHESVGEIVYDSE

SEQ ID NO: 1795936 - protein, 28 aa, Staphylococcus epidermidis
LSKTEYRGREATDFKEDDIELFTDIANK

SEQ ID NO: 1795937 - protein, 23 aa, Staphylococcus epidermidis
LSMKSQYATLVVRPNHKQDVIND

SEQ ID NO: 1795938 - protein, 25 aa, Staphylococcus epidermidis
LSNELEWLNQLFVAGGLADLELGPF

SEQ ID NO: 1795939 - protein, 23 aa, Staphylococcus epidermidis
LSNYKAVEFWKQEGLDRVVLARE

SEQ ID NO: 1795940 - protein, 18 aa, Staphylococcus epidermidis
LSPHIKLSTNVHITGEIR

SEQ ID NO: 1795941 - protein, 17 aa, Staphylococcus epidermidis
LSPYEIETLNQWIDVDH

SEQ ID NO: 1795942 - protein, 22 aa, Staphylococcus epidermidis
LSQLRFSKMFFSSNGVKDGLAM

SEQ ID NO: 1795943 - protein, 22 aa, Staphylococcus epidermidis
LSRDIIPIITSLGVNEQGEYLN

SEQ ID NO: 1795944 - protein, 25 aa, Staphylococcus epidermidis
LSSGGKRVRPAFVILSGQFGSNNKP

SEQ ID NO: 1795945 - protein, 24 aa, Staphylococcus epidermidis
LSTQFHLLLGMGFKKYIDTLKISK

SEQ ID NO: 1795946 - protein, 17 aa, Staphylococcus epidermidis
LTAYLKKHNCLYVLVDP

SEQ ID NO: 1795947 - protein, 17 aa, Staphylococcus epidermidis
LTDFVRYEVGEGMEKRE

SEQ ID NO: 1795948 - protein, 18 aa, Staphylococcus epidermidis
LTENITWADNRANDYADL

SEQ ID NO: 1795949 - protein, 22 aa, Staphylococcus epidermidis
LTESGAFGRALVPSGASTGEHE

SEQ ID NO: 1795950 - protein, 25 aa, Staphylococcus epidermidis
LTGMKKRYATLMGIDEQTPVIVGAS

SEQ ID NO: 1795951 - protein, 17 aa, Staphylococcus epidermidis
LTIGVMPQGPLTIPYVE

SEQ ID NO: 1795952 - protein, 17 aa, Staphylococcus epidermidis
LTINALKCVQKCSPILP

SEQ ID NO: 1795953 - protein, 17 aa, Staphylococcus epidermidis
LTKASNIINCSRINLAN

SEQ ID NO: 1795954 - protein, 17 aa, Staphylococcus epidermidis
LTMEAFNLAEEYQCPVI

SEQ ID NO: 1795955 - protein, 18 aa, Staphylococcus epidermidis
LTNKDEWLYGRGVSDMKG

SEQ ID NO: 1795956 - protein, 22 aa, Staphylococcus epidermidis
LTRAKEQLILVGRVKDEKSLIK

SEQ ID NO: 1795957 - protein, 19 aa, Staphylococcus epidermidis
LTSQLSIYLAYGMIDIIQV

SEQ ID NO: 1795958 - protein, 26 aa, Staphylococcus epidermidis
LVAKELRGAHIFLDMVSVGATINIML

SEQ ID NO: 1795959 - protein, 17 aa, Staphylococcus epidermidis
LVDQKLIYVPKKGENSM

SEQ ID NO: 1795960 - protein, 20 aa, Staphylococcus epidermidis
LVHKGGIDQIVIESTGISEP

SEQ ID NO: 1795961 - protein, 19 aa, Staphylococcus epidermidis
LVIVPLFLFDGRLVNKVKR

SEQ ID NO: 1795962 - protein, 22 aa, Staphylococcus epidermidis
LVKKTFPGYVLVELIMTDESWY

SEQ ID NO: 1795963 - protein, 23 aa, Staphylococcus epidermidis
LVKTEYCGVCHTDLHVKNADFGD

SEQ ID NO: 1795964 - protein, 24 aa, Staphylococcus epidermidis
LVLLGIKTRGAFLAHRIQDKINSI

SEQ ID NO: 1795965 - protein, 29 aa, Staphylococcus epidermidis
LVPGYEAPCYIAWSGKNRSPLVRVPTSRG

SEQ ID NO: 1795966 - protein, 24 aa, Staphylococcus epidermidis
LVTHPKILLCDEATSALDPATTSS

SEQ ID NO: 1795967 - protein, 25 aa, Staphylococcus epidermidis
LVVAHPFHPVYILPLVEIVPGKQTS

SEQ ID NO: 1795968 - protein, 19 aa, Staphylococcus epidermidis
LVWMGGTFLDKGNVEEPEH

SEQ ID NO: 1795969 - protein, 37 aa, Staphylococcus epidermidis
LWMSLVLRPDVPFSMIPKFNLFIALGIRDAIQQFSNE

SEQ ID NO: 1795970 - protein, 20 aa, Staphylococcus epidermidis
LWTGKYSSLFGKRAMTTFER

SEQ ID NO: 1795971 - protein, 24 aa, Staphylococcus epidermidis
LYERKIPLVLVFEGMDAAGKGGNI

SEQ ID NO: 1795972 - protein, 20 aa, Staphylococcus epidermidis
LYIAALKLGIAIVPSSEMLR

SEQ ID NO: 1795973 - protein, 19 aa, Staphylococcus epidermidis
LYKLSRFSFVDEIIQIDNI

SEQ ID NO: 1795974 - protein, 17 aa, Staphylococcus epidermidis
LYLYDWRVIESESNESD

SEQ ID NO: 1795975 - protein, 23 aa, Staphylococcus epidermidis
LYPELPHSEYICFYPMDKRRNET

SEQ ID NO: 1795976 - protein, 20 aa, Staphylococcus epidermidis
MAAYCDKESYDGFANFYIEQ

SEQ ID NO: 1795977 - protein, 18 aa, Staphylococcus epidermidis
MAEMKEMCLGAYEHQEYP

SEQ ID NO: 1795978 - protein, 29 aa, Staphylococcus epidermidis
MAINEIFDILSIEGIIILVIYHGHEEGKV

SEQ ID NO: 1795979 - protein, 21 aa, Staphylococcus epidermidis
MALAAKDIRIEAPIPGTSLVG

SEQ ID NO: 1795980 - protein, 21 aa, Staphylococcus epidermidis
MARRVAREEGILAGISSGAAI

SEQ ID NO: 1795981 - protein, 19 aa, Staphylococcus epidermidis
MDEAIKLADKICIMSKGKV

SEQ ID NO: 1795982 - protein, 19 aa, Staphylococcus epidermidis
MDEAIKLADKICIMTNGQV

SEQ ID NO: 1795983 - protein, 26 aa, Staphylococcus epidermidis
MDHFKMKPVGLICNSGGIVSSEPLSH

SEQ ID NO: 1795984 - protein, 18 aa, Staphylococcus epidermidis
MEALESQASLLLIDEDTS

SEQ ID NO: 1795985 - protein, 21 aa, Staphylococcus epidermidis
MEEEMFLGLRMNQGVSKSRFK

SEQ ID NO: 1795986 - protein, 19 aa, Staphylococcus epidermidis
MEGKAALFKSFAGINGVPI

SEQ ID NO: 1795987 - protein, 24 aa, Staphylococcus epidermidis
MEIKRYGFTPVRFGSEKYIKTFRK

SEQ ID NO: 1795988 - protein, 32 aa, Staphylococcus epidermidis
METTKWLEDYLKYFKGAIVIISHDRYFLDKIV

SEQ ID NO: 1795989 - protein, 30 aa, Staphylococcus epidermidis
MFARVFRKHLEGGFIKAIRQVGNDRRIEID

SEQ ID NO: 1795990 - protein, 23 aa, Staphylococcus epidermidis
MFDCVLPTRIARNGTCMTSNGRL

SEQ ID NO: 1795991 - protein, 22 aa, Staphylococcus epidermidis
MFEGIRIARQMGHNIAIVSPRV

SEQ ID NO: 1795992 - protein, 17 aa, Staphylococcus epidermidis
MFPLKNGQGRIVGYSGR

SEQ ID NO: 1795993 - protein, 25 aa, Staphylococcus epidermidis
MGARRLKQWIDRPLINKQQINDRLN

SEQ ID NO: 1795994 - protein, 22 aa, Staphylococcus epidermidis
MGKCPNCGAWNQMEEIVEKVAH

SEQ ID NO: 1795995 - protein, 20 aa, Staphylococcus epidermidis
MGRVACRADYVIFTPDNPAN

SEQ ID NO: 1795996 - protein, 21 aa, Staphylococcus epidermidis
MGVSKAFKPIMENTLKYLNVG

SEQ ID NO: 1795997 - protein, 19 aa, Staphylococcus epidermidis
MGVSVKRFYDVGVSGIHRL

SEQ ID NO: 1795998 - protein, 24 aa, Staphylococcus epidermidis
MHGDHIFGLPGLLTSRSFQGGENK

SEQ ID NO: 1795999 - protein, 32 aa, Staphylococcus epidermidis
MHGKSLSRQGIWKIIKQYGLKANINKTLTPHT

SEQ ID NO: 1796000 - protein, 18 aa, Staphylococcus epidermidis
MIHPNLATMLAFITCDAN

SEQ ID NO: 1796001 - protein, 17 aa, Staphylococcus epidermidis
MIHRAYIEATAFGTKLI

SEQ ID NO: 1796002 - protein, 19 aa, Staphylococcus epidermidis
MKGKQILGVDPAFRTGCKL

SEQ ID NO: 1796003 - protein, 18 aa, Staphylococcus epidermidis
MKIFSLKGNEPLAQEVAD

SEQ ID NO: 1796004 - protein, 21 aa, Staphylococcus epidermidis
MKNAAIAIAIGHELGLNETII

SEQ ID NO: 1796005 - protein, 19 aa, Staphylococcus epidermidis
MKRIRNLDFQFVIASDLAS

SEQ ID NO: 1796006 - protein, 27 aa, Staphylococcus epidermidis
MKYIKGPDFPTGGIIQGIEGIKKAYET

SEQ ID NO: 1796007 - protein, 25 aa, Staphylococcus epidermidis
MLAKLKVLYEMFGLKMVDNELSDFL

SEQ ID NO: 1796008 - protein, 28 aa, Staphylococcus epidermidis
MLDFRLKALKLFYKMPMPQWGGDLSELD

SEQ ID NO: 1796009 - protein, 19 aa, Staphylococcus epidermidis
MLPSTRLGEKQGKKLFVYG

SEQ ID NO: 1796010 - protein, 26 aa, Staphylococcus epidermidis
MLRLFKTNVLTSQFKRSSYLIDLLEN

SEQ ID NO: 1796011 - protein, 32 aa, Staphylococcus epidermidis
MMGAMLGRFKKCVIGLPGGCPLGPRPIDQHIK

SEQ ID NO: 1796012 - protein, 20 aa, Staphylococcus epidermidis
MNGHITLPVLLEMRKNKTFK

SEQ ID NO: 1796013 - protein, 23 aa, Staphylococcus epidermidis
MNHPNKLIPLTYFVKKFKQAKSS

SEQ ID NO: 1796014 - protein, 24 aa, Staphylococcus epidermidis
MNPVELRRSIGYVIQQIGLMPHMT

SEQ ID NO: 1796015 - protein, 17 aa, Staphylococcus epidermidis
MNYKIKYLKPINIDEEV

SEQ ID NO: 1796016 - protein, 17 aa, Staphylococcus epidermidis
MPNAYVKSIFEIDIEKL

SEQ ID NO: 1796017 - protein, 25 aa, Staphylococcus epidermidis
MPPGFKGICAISYFNNASLEEIKQL

SEQ ID NO: 1796018 - protein, 20 aa, Staphylococcus epidermidis
MPSVRKYARENGVNIKAVNG

SEQ ID NO: 1796019 - protein, 26 aa, Staphylococcus epidermidis
MQKYYPNYRYIWSFKNPDKNVVPGSA

SEQ ID NO: 1796020 - protein, 23 aa, Staphylococcus epidermidis
MRKIYRDKLDYILKRLKPYNTQI

SEQ ID NO: 1796021 - protein, 18 aa, Staphylococcus epidermidis
MSEDVDAFLFLDADDEFL

SEQ ID NO: 1796022 - protein, 21 aa, Staphylococcus epidermidis
MSEKELKHWIKNTLNNNYKDI

SEQ ID NO: 1796023 - protein, 19 aa, Staphylococcus epidermidis
MSGNVLKVLVSNDIERNHF

SEQ ID NO: 1796024 - protein, 23 aa, Staphylococcus epidermidis
MSLGRTSTFLDIYAERDLQNGDI

SEQ ID NO: 1796025 - protein, 26 aa, Staphylococcus epidermidis
MSPRALEEVIYFASYVVVDPGPTGLE

SEQ ID NO: 1796026 - protein, 17 aa, Staphylococcus epidermidis
MSRLVSDKCDFHIKIPM

SEQ ID NO: 1796027 - protein, 25 aa, Staphylococcus epidermidis
MSVELRPSSLDDLGIEAAFKSYFKQ

SEQ ID NO: 1796028 - protein, 23 aa, Staphylococcus epidermidis
MTRNMIKRVEILFPVEDKSIGQR

SEQ ID NO: 1796029 - protein, 23 aa, Staphylococcus epidermidis
MTVMENIEFFKSLCENPISDETL

SEQ ID NO: 1796030 - protein, 19 aa, Staphylococcus epidermidis
MTYSHFTQMEGNYELKVAE

SEQ ID NO: 1796031 - protein, 19 aa, Staphylococcus epidermidis
MVDWKDGREGVLTYDVVRY

SEQ ID NO: 1796032 - protein, 25 aa, Staphylococcus epidermidis
MVFDSKGGFYFTDFRGYSTQPLGGV

SEQ ID NO: 1796033 - protein, 27 aa, Staphylococcus epidermidis
MVLNKTIPEDLFFIISLSGETHQLKEV

SEQ ID NO: 1796034 - protein, 22 aa, Staphylococcus epidermidis
MVSEGTICYTGDILNAERSNIY

SEQ ID NO: 1796035 - protein, 18 aa, Staphylococcus epidermidis
MVWYCPPLSPIMSYFEGE

SEQ ID NO: 1796036 - protein, 18 aa, Staphylococcus epidermidis
MVYGHSYYDYILEIYEYV

SEQ ID NO: 1796037 - protein, 20 aa, Staphylococcus epidermidis
MYDIAGLRIMCQFVDDIDIV

SEQ ID NO: 1796038 - protein, 20 aa, Staphylococcus epidermidis
NAITKAGALAANYPFATIDP

SEQ ID NO: 1796039 - protein, 23 aa, Staphylococcus epidermidis
NALKKIKKALTWVNLNDESIINK

SEQ ID NO: 1796040 - protein, 28 aa, Staphylococcus epidermidis
NDAKRKVAIALRNRYRRSLLKEEEKQEI

SEQ ID NO: 1796041 - protein, 24 aa, Staphylococcus epidermidis
NDDFTHWRKIMGVAPISDEERENM

SEQ ID NO: 1796042 - protein, 24 aa, Staphylococcus epidermidis
NDEVIPRNVIHIGFTSGTTGLPKA

SEQ ID NO: 1796043 - protein, 21 aa, Staphylococcus epidermidis
NDIYDFYSLGFGDPYPISGSH

SEQ ID NO: 1796044 - protein, 20 aa, Staphylococcus epidermidis
NDLKRTYVFELNYDAMMEVS

SEQ ID NO: 1796045 - protein, 18 aa, Staphylococcus epidermidis
NDLLRNFVRRVCNCTGEW

SEQ ID NO: 1796046 - protein, 25 aa, Staphylococcus epidermidis
NDRARLKDIIDLFLDSGLGKEAFSI

SEQ ID NO: 1796047 - protein, 21 aa, Staphylococcus epidermidis
NDTKYGLAGYVIGKDKDTLRH

SEQ ID NO: 1796048 - protein, 18 aa, Staphylococcus epidermidis
NDYAKIIMSHNVTSQVRK

SEQ ID NO: 1796049 - protein, 24 aa, Staphylococcus epidermidis
NDYGMGSSRDWAAKGTNLLGVKTV

SEQ ID NO: 1796050 - protein, 27 aa, Staphylococcus epidermidis
NDYTLREIFQYLKLPKKDLHQLNMSKE

SEQ ID NO: 1796051 - protein, 18 aa, Staphylococcus epidermidis
NEAHKAKALGEVPIGAVI

SEQ ID NO: 1796052 - protein, 22 aa, Staphylococcus epidermidis
NEDYPIAIVFNASCYNEKIVIG

SEQ ID NO: 1796053 - protein, 17 aa, Staphylococcus epidermidis
NEGLAAQIIRLGNLTSA

SEQ ID NO: 1796054 - protein, 17 aa, Staphylococcus epidermidis
NEHKEFIELTGDEMTPY

SEQ ID NO: 1796055 - protein, 17 aa, Staphylococcus epidermidis
NEIGYKILATRGTAQKL

SEQ ID NO: 1796056 - protein, 23 aa, Staphylococcus epidermidis
NEKDGRQAIQYLKQRGLGRATFL

SEQ ID NO: 1796057 - protein, 19 aa, Staphylococcus epidermidis
NEKGCPWDKVQTHDSLKRY

SEQ ID NO: 1796058 - protein, 25 aa, Staphylococcus epidermidis
NELARAIRYRTRIVTLEGDVVNPGG

SEQ ID NO: 1796059 - protein, 17 aa, Staphylococcus epidermidis
NELKRPPVSNIDELVIV

SEQ ID NO: 1796060 - protein, 21 aa, Staphylococcus epidermidis
NELSDFLPLMLQFLQVADFKN

SEQ ID NO: 1796061 - protein, 20 aa, Staphylococcus epidermidis
NEPFMYKLVDIVADIMEPYY

SEQ ID NO: 1796062 - protein, 21 aa, Staphylococcus epidermidis
NETNAMPGFTAYSMYPNLWKN

SEQ ID NO: 1796063 - protein, 23 aa, Staphylococcus epidermidis
NEVKPDHKVTVFAGQDKEATQTM

SEQ ID NO: 1796064 - protein, 36 aa, Staphylococcus epidermidis
NEWNLKLGELAMIWREGCIIRAQFLQKIKDAYDNNE

SEQ ID NO: 1796065 - protein, 26 aa, Staphylococcus epidermidis
NFAAVHKLPFVCVIINNKYAISVPDS

SEQ ID NO: 1796066 - protein, 20 aa, Staphylococcus epidermidis
NFDERYHYMVARKHHFMGYR

SEQ ID NO: 1796067 - protein, 22 aa, Staphylococcus epidermidis
NFEHLRESLDLIDLSDINVEGQ

SEQ ID NO: 1796068 - protein, 20 aa, Staphylococcus epidermidis
NFEYPFKYLCGAGVAYKLAQ

SEQ ID NO: 1796069 - protein, 17 aa, Staphylococcus epidermidis
NFLQSTIHERHFFNMAY

SEQ ID NO: 1796070 - protein, 24 aa, Staphylococcus epidermidis
NFTPEHFEALLAQVSIKPVINQVE

SEQ ID NO: 1796071 - protein, 19 aa, Staphylococcus epidermidis
NFVRRVCNCTGEWTMENFI

SEQ ID NO: 1796072 - protein, 17 aa, Staphylococcus epidermidis
NGAVLVRYGDTVVLSTA

SEQ ID NO: 1796073 - protein, 24 aa, Staphylococcus epidermidis
NGGLYLEKFIENFRHIEIQIIGDT

SEQ ID NO: 1796074 - protein, 24 aa, Staphylococcus epidermidis
NGIPLRKAILWNDTRNSIQCRQIE

SEQ ID NO: 1796075 - protein, 22 aa, Staphylococcus epidermidis
NGKKRVSHQMDMIFTHFGISGP

SEQ ID NO: 1796076 - protein, 17 aa, Staphylococcus epidermidis
NGKVLAEDVERYKLVAV

SEQ ID NO: 1796077 - protein, 21 aa, Staphylococcus epidermidis
NGPLDLLLHLIQKYEIDIYDI

SEQ ID NO: 1796078 - protein, 25 aa, Staphylococcus epidermidis
NGRHELLDSVFLWQSGNKYRVSAHD

SEQ ID NO: 1796079 - protein, 24 aa, Staphylococcus epidermidis
NGTVRNVVDFGAFVDIGVKQDGLV

SEQ ID NO: 1796080 - protein, 18 aa, Staphylococcus epidermidis
NGVESLKEYGVRYNEVEL

SEQ ID NO: 1796081 - protein, 28 aa, Staphylococcus epidermidis
NGYAKKAFKMAIDYAFLVLNMNKVYLYV

SEQ ID NO: 1796082 - protein, 23 aa, Staphylococcus epidermidis
NGYEKRYGLFYVDFETQERFPKK

SEQ ID NO: 1796083 - protein, 23 aa, Staphylococcus epidermidis
NGYYADTGISFVVGKSDQPLKQK

SEQ ID NO: 1796084 - protein, 20 aa, Staphylococcus epidermidis
NGYYDGVTFHRVINDFMVQG

SEQ ID NO: 1796085 - protein, 20 aa, Staphylococcus epidermidis
NHAYQSWKKWSHKDRAELLL

SEQ ID NO: 1796086 - protein, 17 aa, Staphylococcus epidermidis
NHGEYGHDIVCAGASAV

SEQ ID NO: 1796087 - protein, 24 aa, Staphylococcus epidermidis
NHSFPTPPVKPVIMAFTKSYDRPY

SEQ ID NO: 1796088 - protein, 21 aa, Staphylococcus epidermidis
NHYRLYGIFLLHQLNGKEILM

SEQ ID NO: 1796089 - protein, 19 aa, Staphylococcus epidermidis
NIEFYDFADDIKFLLDAIY

SEQ ID NO: 1796090 - protein, 25 aa, Staphylococcus epidermidis
NIEHRRWGAPFPVIEIVKRGINKAR

SEQ ID NO: 1796091 - protein, 23 aa, Staphylococcus epidermidis
NIEYKNAYFKGMFNETCPTFDEI

SEQ ID NO: 1796092 - protein, 24 aa, Staphylococcus epidermidis
NIMREKRVDTIFVVGNDEHLLGYL

SEQ ID NO: 1796093 - protein, 17 aa, Staphylococcus epidermidis
NINLSWIESRPLKTQLG

SEQ ID NO: 1796094 - protein, 17 aa, Staphylococcus epidermidis
NISKRLYDELIHSRDSL

SEQ ID NO: 1796095 - protein, 21 aa, Staphylococcus epidermidis
NIVDLALKQEVDFIIIAGDLF

SEQ ID NO: 1796096 - protein, 19 aa, Staphylococcus epidermidis
NKALEFDREKAYGKHLDIP

SEQ ID NO: 1796097 - protein, 22 aa, Staphylococcus epidermidis
NKDELLRFAIKQVDKASQSNLI

SEQ ID NO: 1796098 - protein, 25 aa, Staphylococcus epidermidis
NKDMAFPSLASVAYRAINEKELISE

SEQ ID NO: 1796099 - protein, 24 aa, Staphylococcus epidermidis
NKEGIKIGMIHGGLTPRERKQQMK

SEQ ID NO: 1796100 - protein, 27 aa, Staphylococcus epidermidis
NKFVRIFNFPFYFRGEVYDPFETLTLS

SEQ ID NO: 1796101 - protein, 22 aa, Staphylococcus epidermidis
NKGNMLKPWFVSSIDNPITKKN

SEQ ID NO: 1796102 - protein, 20 aa, Staphylococcus epidermidis
NKIANFLTEHFSFNRKVLTQ

SEQ ID NO: 1796103 - protein, 17 aa, Staphylococcus epidermidis
NKIATFCVATERNYKDD

SEQ ID NO: 1796104 - protein, 17 aa, Staphylococcus epidermidis
NKIPFKGQMWLNRLGFV

SEQ ID NO: 1796105 - protein, 17 aa, Staphylococcus epidermidis
NKLGFNYVLDGMIMDDL

SEQ ID NO: 1796106 - protein, 19 aa, Staphylococcus epidermidis
NKLVARMALLDKGEVEETY

SEQ ID NO: 1796107 - protein, 18 aa, Staphylococcus epidermidis
NKNGFKEFYQLREDQHGH

SEQ ID NO: 1796108 - protein, 23 aa, Staphylococcus epidermidis
NKNVKRLIFVAAPGIYDELPEPF

SEQ ID NO: 1796109 - protein, 18 aa, Staphylococcus epidermidis
NKTLLGLVTRANLVDIVY

SEQ ID NO: 1796110 - protein, 21 aa, Staphylococcus epidermidis
NKVKVIAWYDNEWGYSNRVVE

SEQ ID NO: 1796111 - protein, 18 aa, Staphylococcus epidermidis
NLAYSRLGKQVYELKNLS

SEQ ID NO: 1796112 - protein, 24 aa, Staphylococcus epidermidis
NLDEFSHHLGMMFQIKDDLLDVYG

SEQ ID NO: 1796113 - protein, 21 aa, Staphylococcus epidermidis
NLEGHSVALLAQDYYYKDQSH

SEQ ID NO: 1796114 - protein, 29 aa, Staphylococcus epidermidis
NLERAMSGSGRFGGHFVLGHVDELGTISK

SEQ ID NO: 1796115 - protein, 17 aa, Staphylococcus epidermidis
NLIIQLATLYGITEDGM

SEQ ID NO: 1796116 - protein, 19 aa, Staphylococcus epidermidis
NLLTYLGVFDSVRSYFSKE

SEQ ID NO: 1796117 - protein, 26 aa, Staphylococcus epidermidis
NLPNKEFQLLFLLASNPKHIFTRDDI

SEQ ID NO: 1796118 - protein, 31 aa, Staphylococcus epidermidis
NLTKGRLQKDLINWFIDDQFKLFYKKQDLSK

SEQ ID NO: 1796119 - protein, 18 aa, Staphylococcus epidermidis
NMAVFSMSVVSKLTDLSP

SEQ ID NO: 1796120 - protein, 19 aa, Staphylococcus epidermidis
NMAYGHSYYDYILEVYDYV

SEQ ID NO: 1796121 - protein, 24 aa, Staphylococcus epidermidis
NMTFPHQMMRVILIEQIYRAFKIM

SEQ ID NO: 1796122 - protein, 18 aa, Staphylococcus epidermidis
NNELTSFVHLGTGNYNDK

SEQ ID NO: 1796123 - protein, 18 aa, Staphylococcus epidermidis
NNERPDIVLLDLVMPEMN

SEQ ID NO: 1796124 - protein, 18 aa, Staphylococcus epidermidis
NNEYRFQILVKYKSEPQL

SEQ ID NO: 1796125 - protein, 24 aa, Staphylococcus epidermidis
NNKTLLIKKCEAFTNEVIKKDVLP

SEQ ID NO: 1796126 - protein, 17 aa, Staphylococcus epidermidis
NNLKIIANYGAGFNNID

SEQ ID NO: 1796127 - protein, 22 aa, Staphylococcus epidermidis
NNLRVFKDIGIVKELTYGDSSS

SEQ ID NO: 1796128 - protein, 21 aa, Staphylococcus epidermidis
NNMKDLARMSVGQVLNEHDID

SEQ ID NO: 1796129 - protein, 20 aa, Staphylococcus epidermidis
NNMQWFKLPPKVYFEENSVM

SEQ ID NO: 1796130 - protein, 24 aa, Staphylococcus epidermidis
NNNRFKGIIGLVTMKKVREPLEVT

SEQ ID NO: 1796131 - protein, 18 aa, Staphylococcus epidermidis
NNSIGFRGEASIKYKEKL

SEQ ID NO: 1796132 - protein, 27 aa, Staphylococcus epidermidis
NNVKPNWCPGCGDFSVQAAIQKATANI

SEQ ID NO: 1796133 - protein, 27 aa, Staphylococcus epidermidis
NPDEIFDAVLMTVKYIVRESGIAKEDI

SEQ ID NO: 1796134 - protein, 24 aa, Staphylococcus epidermidis
NPDLPRPVGEDIVHYSDYFEGAQK

SEQ ID NO: 1796135 - protein, 24 aa, Staphylococcus epidermidis
NPLSGDKLPIWIADYVLSTYGTGA

SEQ ID NO: 1796136 - protein, 23 aa, Staphylococcus epidermidis
NPPIRAGKDIVHRIFEQAFDRLK

SEQ ID NO: 1796137 - protein, 20 aa, Staphylococcus epidermidis
NQFRIGLSRMERVVRERMSI

SEQ ID NO: 1796138 - protein, 17 aa, Staphylococcus epidermidis
NQINWRYVDHSSGLEPM

SEQ ID NO: 1796139 - protein, 18 aa, Staphylococcus epidermidis
NREFASWMSNIESIVKRV

SEQ ID NO: 1796140 - protein, 20 aa, Staphylococcus epidermidis
NRFMHVAEFRRMNANISVEG

SEQ ID NO: 1796141 - protein, 21 aa, Staphylococcus epidermidis
NRIAQTINRFGFTIRGIYGEG

SEQ ID NO: 1796142 - protein, 20 aa, Staphylococcus epidermidis
NRIKRLVQVQNQFKTFYNQM

SEQ ID NO: 1796143 - protein, 24 aa, Staphylococcus epidermidis
NRLIPLSEGYIYFKDKPISDYPVY

SEQ ID NO: 1796144 - protein, 17 aa, Staphylococcus epidermidis
NRLKRLLDLGAPGIIVQ

SEQ ID NO: 1796145 - protein, 22 aa, Staphylococcus epidermidis
NRPEVRNAFTPKTVAEMIDAFS

SEQ ID NO: 1796146 - protein, 17 aa, Staphylococcus epidermidis
NSGKVPAVVYGYGTKNT

SEQ ID NO: 1796147 - protein, 18 aa, Staphylococcus epidermidis
NSLQEMYQGFFLAPHVVS

SEQ ID NO: 1796148 - protein, 23 aa, Staphylococcus epidermidis
NSMNCLMEVLGLALPYNGTALAV

SEQ ID NO: 1796149 - protein, 17 aa, Staphylococcus epidermidis
NSPGGSVTAGFAIYDTI

SEQ ID NO: 1796150 - protein, 20 aa, Staphylococcus epidermidis
NSVIELTKGTGIFVTILRSF

SEQ ID NO: 1796151 - protein, 19 aa, Staphylococcus epidermidis
NTEDIYAGIEFKQGTSEVK

SEQ ID NO: 1796152 - protein, 25 aa, Staphylococcus epidermidis
NTELEVVEGMQFDRGYQSPYMVTDS

SEQ ID NO: 1796153 - protein, 20 aa, Staphylococcus epidermidis
NTGTPWLGPDVQDLTRDLYK

SEQ ID NO: 1796154 - protein, 19 aa, Staphylococcus epidermidis
NTILKDMLDGITVSNNDVE

SEQ ID NO: 1796155 - protein, 25 aa, Staphylococcus epidermidis
NTKDRIDFFPGRFENTFNRWMEEIR

SEQ ID NO: 1796156 - protein, 18 aa, Staphylococcus epidermidis
NTYDWFKEHLTSIDDIEG

SEQ ID NO: 1796157 - protein, 25 aa, Staphylococcus epidermidis
NVARDHVLTGLEFACGIPGSIGGAV

SEQ ID NO: 1796158 - protein, 22 aa, Staphylococcus epidermidis
NVGCITRLFPNGVRITIGLPEQ

SEQ ID NO: 1796159 - protein, 18 aa, Staphylococcus epidermidis
NVIYEINSTLELIDKFEV

SEQ ID NO: 1796160 - protein, 18 aa, Staphylococcus epidermidis
NVKVHLRPSAQLVSETVQ

SEQ ID NO: 1796161 - protein, 18 aa, Staphylococcus epidermidis
NVLTFAVRRMNLYDRNLP

SEQ ID NO: 1796162 - protein, 25 aa, Staphylococcus epidermidis
NVNFKEVLTGFKYIAAEIRHLSPEQ

SEQ ID NO: 1796163 - protein, 19 aa, Staphylococcus epidermidis
NVTRFLVVKNHTHFIEHPN

SEQ ID NO: 1796164 - protein, 18 aa, Staphylococcus epidermidis
NYEIIKFFIEINEEKRNE

SEQ ID NO: 1796165 - protein, 23 aa, Staphylococcus epidermidis
NYHLKNKFGQKIFKVALDGGFDC

SEQ ID NO: 1796166 - protein, 20 aa, Staphylococcus epidermidis
NYKAQAYDLIQRFNNNFKKF

SEQ ID NO: 1796167 - protein, 20 aa, Staphylococcus epidermidis
NYLREKRLQLKKLIDTLTLS

SEQ ID NO: 1796168 - protein, 18 aa, Staphylococcus epidermidis
NYVKPVVVKSELFRNEEF

SEQ ID NO: 1796169 - protein, 18 aa, Staphylococcus epidermidis
NYVMKWKETQIFFDKLTD

SEQ ID NO: 1796170 - protein, 17 aa, Staphylococcus epidermidis
PADQLYEKFGFKSTEPY

SEQ ID NO: 1796171 - protein, 25 aa, Staphylococcus epidermidis
PAFIADECRLWITVHYLPNESYESV

SEQ ID NO: 1796172 - protein, 18 aa, Staphylococcus epidermidis
PAIGDWIENFERLREQGY

SEQ ID NO: 1796173 - protein, 26 aa, Staphylococcus epidermidis
PARIKCATLAWKALEKGTVEKEGKSE

SEQ ID NO: 1796174 - protein, 18 aa, Staphylococcus epidermidis
PATIFNLNYGKLHKDSYA

SEQ ID NO: 1796175 - protein, 19 aa, Staphylococcus epidermidis
PATQCLIEKSIAGYKEIEY

SEQ ID NO: 1796176 - protein, 20 aa, Staphylococcus epidermidis
PCTELSMGMSNDYQMAVEEG

SEQ ID NO: 1796177 - protein, 24 aa, Staphylococcus epidermidis
PDAELKVYMIASVAERAERRQKEN

SEQ ID NO: 1796178 - protein, 21 aa, Staphylococcus epidermidis
PDKDVLDINGIIIDKDAFKVT

SEQ ID NO: 1796179 - protein, 20 aa, Staphylococcus epidermidis
PDKKCPTCGNELIKEGQDIP

SEQ ID NO: 1796180 - protein, 19 aa, Staphylococcus epidermidis
PDLAIAVDVGVAYDVPGMT

SEQ ID NO: 1796181 - protein, 24 aa, Staphylococcus epidermidis
PDNILRYPANDFVRDFIGQNRLIQ

SEQ ID NO: 1796182 - protein, 24 aa, Staphylococcus epidermidis
PDNSIKAAGGFIIQVMPGATDETV

SEQ ID NO: 1796183 - protein, 21 aa, Staphylococcus epidermidis
PDNVIKKFVHESAKAGVDVFR

SEQ ID NO: 1796184 - protein, 23 aa, Staphylococcus epidermidis
PDQWYSGIVKPILDELGLFNHLE

SEQ ID NO: 1796185 - protein, 24 aa, Staphylococcus epidermidis
PDRKIKIFPGLVTYVGETHEKALS

SEQ ID NO: 1796186 - protein, 24 aa, Staphylococcus epidermidis
PDVFPELNKVVGHTLMVTDGTSLL

SEQ ID NO: 1796187 - protein, 19 aa, Staphylococcus epidermidis
PDVPRGLPVIPEAYTPKLK

SEQ ID NO: 1796188 - protein, 19 aa, Staphylococcus epidermidis
PEANLFILLVGERPEEVTD

SEQ ID NO: 1796189 - protein, 26 aa, Staphylococcus epidermidis
PEDRARLVIYPAAMRYAGPREAILHA

SEQ ID NO: 1796190 - protein, 19 aa, Staphylococcus epidermidis
PEHINVIKCDLMQRKDIES

SEQ ID NO: 1796191 - protein, 19 aa, Staphylococcus epidermidis
PEIKVLVLTSYVDDEHVIS

SEQ ID NO: 1796192 - protein, 18 aa, Staphylococcus epidermidis
PEILTFMLKVFKELEFIY

SEQ ID NO: 1796193 - protein, 21 aa, Staphylococcus epidermidis
PEIYLKAVQELNYNPTTCLAI

SEQ ID NO: 1796194 - protein, 23 aa, Staphylococcus epidermidis
PEKLSKYISNWFSKHNVTVVPNS

SEQ ID NO: 1796195 - protein, 20 aa, Staphylococcus epidermidis
PELITLKGLKAIKEADVILY

SEQ ID NO: 1796196 - protein, 17 aa, Staphylococcus epidermidis
PELLDDASLFDSAMTDL

SEQ ID NO: 1796197 - protein, 17 aa, Staphylococcus epidermidis
PELPNTIEVLGKDKVLS

SEQ ID NO: 1796198 - protein, 30 aa, Staphylococcus epidermidis
PEQLFAAGYSACFNSALSLILSQNKISDAN

SEQ ID NO: 1796199 - protein, 22 aa, Staphylococcus epidermidis
PEQLYYLMSRGISRAEAERLVI

SEQ ID NO: 1796200 - protein, 23 aa, Staphylococcus epidermidis
PERLIEMRRFILASNHDERVQAL

SEQ ID NO: 1796201 - protein, 29 aa, Staphylococcus epidermidis
PESEVNYIMNLPVNFLKTFLPELIEKNVK

SEQ ID NO: 1796202 - protein, 17 aa, Staphylococcus epidermidis
PESIKEDYLTAVKEAFS

SEQ ID NO: 1796203 - protein, 21 aa, Staphylococcus epidermidis
PETLPILNGVLDYRRQLTNPY

SEQ ID NO: 1796204 - protein, 20 aa, Staphylococcus epidermidis
PEWLYCAKANLVLEPAYTGE

SEQ ID NO: 1796205 - protein, 20 aa, Staphylococcus epidermidis
PEYFNEGSLLKAMENPQNHI

SEQ ID NO: 1796206 - protein, 19 aa, Staphylococcus epidermidis
PFAPPSKMSVVIDRQQAKF

SEQ ID NO: 1796207 - protein, 18 aa, Staphylococcus epidermidis
PFAQLRPGSNLGSEVKVG

SEQ ID NO: 1796208 - protein, 17 aa, Staphylococcus epidermidis
PFDKGLDRVCTNIRIDD

SEQ ID NO: 1796209 - protein, 21 aa, Staphylococcus epidermidis
PFEAIEQAFKIARKQNITTVL

SEQ ID NO: 1796210 - protein, 26 aa, Staphylococcus epidermidis
PFEVKELLFRIKAVLRRYQINADNEL

SEQ ID NO: 1796211 - protein, 24 aa, Staphylococcus epidermidis
PFFTNYRPQFYFRTTDVTGVVNLP

SEQ ID NO: 1796212 - protein, 19 aa, Staphylococcus epidermidis
PFQEGRDGFVMGEGAGIVV

SEQ ID NO: 1796213 - protein, 26 aa, Staphylococcus epidermidis
PFQGHPACVHIAIGKGVCGTAVSSGE

SEQ ID NO: 1796214 - protein, 21 aa, Staphylococcus epidermidis
PFQPLTNCCLIDAKDMLENGF

SEQ ID NO: 1796215 - protein, 24 aa, Staphylococcus epidermidis
PFSPREVVLRVKALLRRTQTANTE

SEQ ID NO: 1796216 - protein, 19 aa, Staphylococcus epidermidis
PFTPPMFARVFRKHLEGGF

SEQ ID NO: 1796217 - protein, 20 aa, Staphylococcus epidermidis
PFVCGCRNLGEAARRIGEGA

SEQ ID NO: 1796218 - protein, 23 aa, Staphylococcus epidermidis
PFVKQKLIFLVGMAGERDLTKTP

SEQ ID NO: 1796219 - protein, 20 aa, Staphylococcus epidermidis
PFYATPRKPAIHHTMGGLKI

SEQ ID NO: 1796220 - protein, 24 aa, Staphylococcus epidermidis
PGGKASYPSTVLMTATLAQVAGVN

SEQ ID NO: 1796221 - protein, 27 aa, Staphylococcus epidermidis
PGIEIPDARYKNWFPNFTLSDLISDNT

SEQ ID NO: 1796222 - protein, 24 aa, Staphylococcus epidermidis
PGNPKPRMYRLLEDDALINRMGFN

SEQ ID NO: 1796223 - protein, 18 aa, Staphylococcus epidermidis
PGNRPLKSLSHMLKGKQG

SEQ ID NO: 1796224 - protein, 22 aa, Staphylococcus epidermidis
PGREAYPGDVFYLHSRLLERAA

SEQ ID NO: 1796225 - protein, 19 aa, Staphylococcus epidermidis
PGVFGAAWLNQGLHTEMIV

SEQ ID NO: 1796226 - protein, 18 aa, Staphylococcus epidermidis
PHGKSVIENGIFAGQTLD

SEQ ID NO: 1796227 - protein, 26 aa, Staphylococcus epidermidis
PHKFKMGVSGCPRSCVESGVKDFGVI

SEQ ID NO: 1796228 - protein, 26 aa, Staphylococcus epidermidis
PHSPERLKAALLFTLEEECIKQGHTY

SEQ ID NO: 1796229 - protein, 24 aa, Staphylococcus epidermidis
PHVTELINEISLLQFMNGSSLELG

SEQ ID NO: 1796230 - protein, 23 aa, Staphylococcus epidermidis
PIEYGLKGLKSFQVKDSNFKKKI

SEQ ID NO: 1796231 - protein, 21 aa, Staphylococcus epidermidis
PIGASGARTLVSLLHQLSDAK

SEQ ID NO: 1796232 - protein, 22 aa, Staphylococcus epidermidis
PILEGFTLPKMLWVQQHEPEIW

SEQ ID NO: 1796233 - protein, 26 aa, Staphylococcus epidermidis
PIPGSNLPSVIGWRTIDDTNKMIEIA

SEQ ID NO: 1796234 - protein, 18 aa, Staphylococcus epidermidis
PIRFLQVRIPVRMDDGTV

SEQ ID NO: 1796235 - protein, 18 aa, Staphylococcus epidermidis
PISLEKSQAFDFIIEGDT

SEQ ID NO: 1796236 - protein, 33 aa, Staphylococcus epidermidis
PIYCDNRITLGYPEVRNAIRDGLIQLIKEHFSN

SEQ ID NO: 1796237 - protein, 18 aa, Staphylococcus epidermidis
PIYLDDLIIIFTDGVTEA

SEQ ID NO: 1796238 - protein, 21 aa, Staphylococcus epidermidis
PKDYLRYCLTQTIHMEYSDAC

SEQ ID NO: 1796239 - protein, 19 aa, Staphylococcus epidermidis
PKGTLVPHRGIDRLVHNPN

SEQ ID NO: 1796240 - protein, 17 aa, Staphylococcus epidermidis
PKGVGVENLCPFSRDGQ

SEQ ID NO: 1796241 - protein, 19 aa, Staphylococcus epidermidis
PKHHTCLITPVNHDTIRTT

SEQ ID NO: 1796242 - protein, 20 aa, Staphylococcus epidermidis
PKIYFTSHMDTVVPGKNIQP

SEQ ID NO: 1796243 - protein, 18 aa, Staphylococcus epidermidis
PKKKRMGRYQGYTNKRRK

SEQ ID NO: 1796244 - protein, 20 aa, Staphylococcus epidermidis
PKLTFKSSILQLIKDNQVTA

SEQ ID NO: 1796245 - protein, 18 aa, Staphylococcus epidermidis
PKNLKKVEDLFIITSTHG

SEQ ID NO: 1796246 - protein, 28 aa, Staphylococcus epidermidis
PKQCKHEFLRYPYIESFENVDEVIQVAK

SEQ ID NO: 1796247 - protein, 17 aa, Staphylococcus epidermidis
PKRLLTVGLGNLKILSY

SEQ ID NO: 1796248 - protein, 24 aa, Staphylococcus epidermidis
PKRSKAVINEAYFRTPSTTDYNGV

SEQ ID NO: 1796249 - protein, 20 aa, Staphylococcus epidermidis
PKYFKAMLVEFMEKTNYTCD

SEQ ID NO: 1796250 - protein, 26 aa, Staphylococcus epidermidis
PLAGPVVACAVILEKNHHYIGLDDSK

SEQ ID NO: 1796251 - protein, 20 aa, Staphylococcus epidermidis
PLEKLGRYLMDSFVNIEGTG

SEQ ID NO: 1796252 - protein, 20 aa, Staphylococcus epidermidis
PLKIKEPLNFEVRGEAYMPR

SEQ ID NO: 1796253 - protein, 18 aa, Staphylococcus epidermidis
PLLQMPFLEQLFKELKAN

SEQ ID NO: 1796254 - protein, 26 aa, Staphylococcus epidermidis
PLLVAGDIYRPAAIDQLQTVGKQIDI

SEQ ID NO: 1796255 - protein, 18 aa, Staphylococcus epidermidis
PLMKKILDRMLEYNEITR

SEQ ID NO: 1796256 - protein, 25 aa, Staphylococcus epidermidis
PLQVYNVMHHFYIPKVITGGATSTP

SEQ ID NO: 1796257 - protein, 24 aa, Staphylococcus epidermidis
PLRDRFGVHLRLEYYNENDLKEII

SEQ ID NO: 1796258 - protein, 17 aa, Staphylococcus epidermidis
PMAYTLWTRHLNFNPQS

SEQ ID NO: 1796259 - protein, 23 aa, Staphylococcus epidermidis
PMPGHSHINCIGHVCDKDVPLLS

SEQ ID NO: 1796260 - protein, 24 aa, Staphylococcus epidermidis
PNKRGYKMLPHFQIGLFRNQLFIM

SEQ ID NO: 1796261 - protein, 27 aa, Staphylococcus epidermidis
PNPLLPEEVRFILKQMGLKEKTIDVEL

SEQ ID NO: 1796262 - protein, 24 aa, Staphylococcus epidermidis
PPAPRGVPQIEVTFDIDKNGIVNV

SEQ ID NO: 1796263 - protein, 18 aa, Staphylococcus epidermidis
PPGESGLIATSKISESFP

SEQ ID NO: 1796264 - protein, 22 aa, Staphylococcus epidermidis
PPGKRMGHAGAIISGGKGTASE

SEQ ID NO: 1796265 - protein, 19 aa, Staphylococcus epidermidis
PPIDTWVAFAPNKRGYKML

SEQ ID NO: 1796266 - protein, 34 aa, Staphylococcus epidermidis
PPKEWRKSAKYVGLIPRFSRIFLGDKEFNKKRYA

SEQ ID NO: 1796267 - protein, 25 aa, Staphylococcus epidermidis
PPSVREIGEAVGLASSSTVHGHLSR

SEQ ID NO: 1796268 - protein, 17 aa, Staphylococcus epidermidis
PPVARIMDYGKYKFEQQ

SEQ ID NO: 1796269 - protein, 28 aa, Staphylococcus epidermidis
PQDSYLLIRGIKTLGLRMEQINRNVEGI

SEQ ID NO: 1796270 - protein, 25 aa, Staphylococcus epidermidis
PQFENKLTFSDEVVEKIAGIAAREV

SEQ ID NO: 1796271 - protein, 24 aa, Staphylococcus epidermidis
PQQLHDIKHVISFDEIPKAIDQVI

SEQ ID NO: 1796272 - protein, 27 aa, Staphylococcus epidermidis
PQYWWPAETPIEMMLGAILVQNTNWNN

SEQ ID NO: 1796273 - protein, 18 aa, Staphylococcus epidermidis
PRANLKRVLRRMEDMGFT

SEQ ID NO: 1796274 - protein, 17 aa, Staphylococcus epidermidis
PRILRAETAPLYALSAV

SEQ ID NO: 1796275 - protein, 18 aa, Staphylococcus epidermidis
PRPIPGVKGGIHHVTGVE

SEQ ID NO: 1796276 - protein, 26 aa, Staphylococcus epidermidis
PRSLLNEYREGILIGTACDEGELFTA

SEQ ID NO: 1796277 - protein, 18 aa, Staphylococcus epidermidis
PRVGYFYSGKSKNKIINE

SEQ ID NO: 1796278 - protein, 20 aa, Staphylococcus epidermidis
PRVSGTSGLQLFDYKFGQTG

SEQ ID NO: 1796279 - protein, 28 aa, Staphylococcus epidermidis
PSEKTARQCAIVWGVNPVVKEGRKTTDA

SEQ ID NO: 1796280 - protein, 25 aa, Staphylococcus epidermidis
PSERFSEDALRIIRGLRFQSQLNFQ

SEQ ID NO: 1796281 - protein, 19 aa, Staphylococcus epidermidis
PSFDTIVASGYRGALPHGV

SEQ ID NO: 1796282 - protein, 20 aa, Staphylococcus epidermidis
PSFKQLISYCLLENEKGEIL

SEQ ID NO: 1796283 - protein, 17 aa, Staphylococcus epidermidis
PSFSLENQDGNFISNET

SEQ ID NO: 1796284 - protein, 22 aa, Staphylococcus epidermidis
PSIGCIPCTSPVFDSNDSRAGR

SEQ ID NO: 1796285 - protein, 21 aa, Staphylococcus epidermidis
PSKELRASFNSRKDSNFTDYK

SEQ ID NO: 1796286 - protein, 35 aa, Staphylococcus epidermidis
PSKLKSIVGPFAYYIKGFEMLPQMKAVDVRIEYDD

SEQ ID NO: 1796287 - protein, 19 aa, Staphylococcus epidermidis
PTAAFVAARAGAMAKHTEH

SEQ ID NO: 1796288 - protein, 24 aa, Staphylococcus epidermidis
PTEKFMKYKTFFDNINMPTTLEGL

SEQ ID NO: 1796289 - protein, 18 aa, Staphylococcus epidermidis
PTGICPCTDLTRDQIVTQ

SEQ ID NO: 1796290 - protein, 24 aa, Staphylococcus epidermidis
PTIEGIEFVEFLISPNRGEPLKSL

SEQ ID NO: 1796291 - protein, 19 aa, Staphylococcus epidermidis
PTISVPIHYNTFPLIEQDP

SEQ ID NO: 1796292 - protein, 19 aa, Staphylococcus epidermidis
PTSKDSVILSADYSQIELR

SEQ ID NO: 1796293 - protein, 22 aa, Staphylococcus epidermidis
PVALSELGVKYVVIGHSERRDY

SEQ ID NO: 1796294 - protein, 24 aa, Staphylococcus epidermidis
PVGNAGNITAYWQGFVEYHNKKNT

SEQ ID NO: 1796295 - protein, 24 aa, Staphylococcus epidermidis
PVGRDCPKCHHYLVNKKKGKSSQV

SEQ ID NO: 1796296 - protein, 26 aa, Staphylococcus epidermidis
PVHTYKMKFIKSFKAVNLHQSIFENG

SEQ ID NO: 1796297 - protein, 17 aa, Staphylococcus epidermidis
PVNNGGVVLRWLRDEIL

SEQ ID NO: 1796298 - protein, 18 aa, Staphylococcus epidermidis
PYASLNPRLKVMDIVAEG

SEQ ID NO: 1796299 - protein, 17 aa, Staphylococcus epidermidis
PYEGHLWIMDPIDGTSN

SEQ ID NO: 1796300 - protein, 26 aa, Staphylococcus epidermidis
PYEQRMPKIVIVIDELADLMMMAPQD

SEQ ID NO: 1796301 - protein, 22 aa, Staphylococcus epidermidis
PYFAGTKVKWILDHVEGAREKA

SEQ ID NO: 1796302 - protein, 29 aa, Staphylococcus epidermidis
PYLIYMLGFMPGFPYLGGLDAKLHTPRRS

SEQ ID NO: 1796303 - protein, 18 aa, Staphylococcus epidermidis
PYPNHSFNMARYISDSAH

SEQ ID NO: 1796304 - protein, 18 aa, Staphylococcus epidermidis
PYQARRIAFNINIPKESV

SEQ ID NO: 1796305 - protein, 20 aa, Staphylococcus epidermidis
PYQYQPRLNYLKAVDKLILD

SEQ ID NO: 1796306 - protein, 20 aa, Staphylococcus epidermidis
PYVGKLTFFRVYSGTLSSGS

SEQ ID NO: 1796307 - protein, 22 aa, Staphylococcus epidermidis
PYYASGGFIHYCEYPKLNHNLK

SEQ ID NO: 1796308 - protein, 20 aa, Staphylococcus epidermidis
QAEVRQTFKVSKVGTIAGSY

SEQ ID NO: 1796309 - protein, 27 aa, Staphylococcus epidermidis
QAIKEFTELGSGFKIAMRDLNIRGAGN

SEQ ID NO: 1796310 - protein, 25 aa, Staphylococcus epidermidis
QALELAEQMGIIFIDEIDKVATNNQ

SEQ ID NO: 1796311 - protein, 24 aa, Staphylococcus epidermidis
QALKDFEGTIIFVSHDRYFINQLA

SEQ ID NO: 1796312 - protein, 18 aa, Staphylococcus epidermidis
QALLRRTYDLSIARDEIA

SEQ ID NO: 1796313 - protein, 17 aa, Staphylococcus epidermidis
QALSDVTIHEWLTDDLR

SEQ ID NO: 1796314 - protein, 22 aa, Staphylococcus epidermidis
QASIRAGVHLDKLTEKRSKGLE

SEQ ID NO: 1796315 - protein, 18 aa, Staphylococcus epidermidis
QASSLAMAIFFQDMNDEE

SEQ ID NO: 1796316 - protein, 17 aa, Staphylococcus epidermidis
QAVELLDAQALQIHVNS

SEQ ID NO: 1796317 - protein, 18 aa, Staphylococcus epidermidis
QAVKEGELLFGDTVAVFG

SEQ ID NO: 1796318 - protein, 18 aa, Staphylococcus epidermidis
QAWDWKEEYATFIRQQWA

SEQ ID NO: 1796319 - protein, 25 aa, Staphylococcus epidermidis
QCLYVKLDPYWLYQVYDKDINPLTE

SEQ ID NO: 1796320 - protein, 24 aa, Staphylococcus epidermidis
QDDCPPCAFIKNYLVNKNIKFTEK

SEQ ID NO: 1796321 - protein, 23 aa, Staphylococcus epidermidis
QDDLFDDVCEFMVEEGHISTSLI

SEQ ID NO: 1796322 - protein, 24 aa, Staphylococcus epidermidis
QDIIKRAGDVFVESGADYFVVDPV

SEQ ID NO: 1796323 - protein, 26 aa, Staphylococcus epidermidis
QDLKDRYEFIGGLSPLAGTTDRQAEA

SEQ ID NO: 1796324 - protein, 25 aa, Staphylococcus epidermidis
QEGEICFGNEPLLRVEAPLIQAQLI

SEQ ID NO: 1796325 - protein, 18 aa, Staphylococcus epidermidis
QEGNGYKLLNITIKQIEE

SEQ ID NO: 1796326 - protein, 23 aa, Staphylococcus epidermidis
QEGRRFLFETVVKVNHPKHDIKI

SEQ ID NO: 1796327 - protein, 22 aa, Staphylococcus epidermidis
QEKKGKVVLVTAMSPTPAGEGK

SEQ ID NO: 1796328 - protein, 17 aa, Staphylococcus epidermidis
QELAWMRAGAKARTTKQ

SEQ ID NO: 1796329 - protein, 25 aa, Staphylococcus epidermidis
QELSEAKHIVFICGHYEGYDERIRK

SEQ ID NO: 1796330 - protein, 20 aa, Staphylococcus epidermidis
QEMYQGFFLAPHVVSQSLKG

SEQ ID NO: 1796331 - protein, 22 aa, Staphylococcus epidermidis
QESSKMCLFEPRVFSDTQDIAD

SEQ ID NO: 1796332 - protein, 18 aa, Staphylococcus epidermidis
QEVRAWTFKQGMTAPQCA

SEQ ID NO: 1796333 - protein, 25 aa, Staphylococcus epidermidis
QFAKREVYQHYALSALPFPDKTKFE

SEQ ID NO: 1796334 - protein, 26 aa, Staphylococcus epidermidis
QFSERRHVLNLFSYTGAFSVIAAENA

SEQ ID NO: 1796335 - protein, 23 aa, Staphylococcus epidermidis
QFTFSRKGIREGFIMNHISKRYP

SEQ ID NO: 1796336 - protein, 23 aa, Staphylococcus epidermidis
QGASEISMMFGIHEADAEKAVLS

SEQ ID NO: 1796337 - protein, 17 aa, Staphylococcus epidermidis
QGHLKGQILRIGHMGKI

SEQ ID NO: 1796338 - protein, 18 aa, Staphylococcus epidermidis
QGMTLIAHFAHKTRFNHH

SEQ ID NO: 1796339 - protein, 17 aa, Staphylococcus epidermidis
QGVLTDILPSIDNIERA

SEQ ID NO: 1796340 - protein, 18 aa, Staphylococcus epidermidis
QHAGLSWLTILKKKESYE

SEQ ID NO: 1796341 - protein, 24 aa, Staphylococcus epidermidis
QHLEERGYHLSKTEYRGREATDFK

SEQ ID NO: 1796342 - protein, 17 aa, Staphylococcus epidermidis
QHNAIDWVIIGPEQPLI

SEQ ID NO: 1796343 - protein, 18 aa, Staphylococcus epidermidis
QHRRYLLNREDVFTYLSL

SEQ ID NO: 1796344 - protein, 17 aa, Staphylococcus epidermidis
QHTRSKETIAFDPKDVI

SEQ ID NO: 1796345 - protein, 18 aa, Staphylococcus epidermidis
QHVYFKPIDKRQFIERLV

SEQ ID NO: 1796346 - protein, 27 aa, Staphylococcus epidermidis
QIELLKDLELPLARILSEMEEIGIYTD

SEQ ID NO: 1796347 - protein, 24 aa, Staphylococcus epidermidis
QIHQRLFLEQSLITERIKKYFNSQ

SEQ ID NO: 1796348 - protein, 25 aa, Staphylococcus epidermidis
QIIENCKRLGYYPKTVANISQISFI

SEQ ID NO: 1796349 - protein, 29 aa, Staphylococcus epidermidis
QIKDLYEFNLFKLRIDHIQADPFAPPSKM

SEQ ID NO: 1796350 - protein, 19 aa, Staphylococcus epidermidis
QIMPHITIKPQFEIDDHDF

SEQ ID NO: 1796351 - protein, 19 aa, Staphylococcus epidermidis
QISRLPLVVLTSDRPHELR

SEQ ID NO: 1796352 - protein, 25 aa, Staphylococcus epidermidis
QIYSLYFKFVMPIFGKMFAKSKEEY

SEQ ID NO: 1796353 - protein, 18 aa, Staphylococcus epidermidis
QKFKEGFNAKIYEYIGDF

SEQ ID NO: 1796354 - protein, 19 aa, Staphylococcus epidermidis
QKGTGKWTSINALELGVPL

SEQ ID NO: 1796355 - protein, 17 aa, Staphylococcus epidermidis
QKTRLSLAQMLLKEPDL

SEQ ID NO: 1796356 - protein, 18 aa, Staphylococcus epidermidis
QKVQEFKTSVVNKLTGGV

SEQ ID NO: 1796357 - protein, 18 aa, Staphylococcus epidermidis
QLAGLRAIPNMNVIRPAD

SEQ ID NO: 1796358 - protein, 18 aa, Staphylococcus epidermidis
QLEHPSLYIDIGDHVDLS

SEQ ID NO: 1796359 - protein, 20 aa, Staphylococcus epidermidis
QLHYPVLCANIIENTQPFTG

SEQ ID NO: 1796360 - protein, 23 aa, Staphylococcus epidermidis
QLMMLEPKFAILDEIDSGLDIDA

SEQ ID NO: 1796361 - protein, 26 aa, Staphylococcus epidermidis
QLNSEVKPRVSIVIDHYEDVSTEEVV

SEQ ID NO: 1796362 - protein, 19 aa, Staphylococcus epidermidis
QLRRYLHQYPELSFEEKRT

SEQ ID NO: 1796363 - protein, 28 aa, Staphylococcus epidermidis
QLYFFSIANPQPFEWLNQLAQPYKEENK

SEQ ID NO: 1796364 - protein, 19 aa, Staphylococcus epidermidis
QMGIIKMKLPIEDLEKTKK

SEQ ID NO: 1796365 - protein, 24 aa, Staphylococcus epidermidis
QMSEFERMILLRSIDTHWTDHIDT

SEQ ID NO: 1796366 - protein, 19 aa, Staphylococcus epidermidis
QNDYCLFLNIWKPSSNQNH

SEQ ID NO: 1796367 - protein, 23 aa, Staphylococcus epidermidis
QNITRIAPNYVHEDIVVSALIGT

SEQ ID NO: 1796368 - protein, 23 aa, Staphylococcus epidermidis
QNKREVRKHIGIVFQNPDNQFVG

SEQ ID NO: 1796369 - protein, 19 aa, Staphylococcus epidermidis
QNLFARWRKEETLYSEDEK

SEQ ID NO: 1796370 - protein, 24 aa, Staphylococcus epidermidis
QNLLRARRTYAFTELFMFELRMQW

SEQ ID NO: 1796371 - protein, 18 aa, Staphylococcus epidermidis
QNMFALLGKPGFEDKKKE

SEQ ID NO: 1796372 - protein, 23 aa, Staphylococcus epidermidis
QNRKLRRPDLTFATLDHNVPTID

SEQ ID NO: 1796373 - protein, 21 aa, Staphylococcus epidermidis
QPEGAFYIFPSIKRFTENDFE

SEQ ID NO: 1796374 - protein, 30 aa, Staphylococcus epidermidis; identical to SEQ ID NO: 1647747

SEQ ID NO: 1796375 - protein, 20 aa, Staphylococcus epidermidis
QPLREDMSFLTRFINKHAVN

SEQ ID NO: 1796376 - protein, 24 aa, Staphylococcus epidermidis
QQEIKSPMVGTFFLQDSKELTEPK

SEQ ID NO: 1796377 - protein, 17 aa, Staphylococcus epidermidis
QQIRGAVVLPHGTGKSQ

SEQ ID NO: 1796378 - protein, 25 aa, Staphylococcus epidermidis
QQKFGLKMKACRVLVNTPSAVGGIG

SEQ ID NO: 1796379 - protein, 18 aa, Staphylococcus epidermidis
QQLAKRKNATLKFIPMTK

SEQ ID NO: 1796380 - protein, 18 aa, Staphylococcus epidermidis
QQVLYIIKHMSYRAGKNN

SEQ ID NO: 1796381 - protein, 25 aa, Staphylococcus epidermidis
QRDRKKRVYDLLETVGLGKEHANRY

SEQ ID NO: 1796382 - protein, 17 aa, Staphylococcus epidermidis
QRLDVSELREMIGDMPL

SEQ ID NO: 1796383 - protein, 17 aa, Staphylococcus epidermidis
QRLLPNHIFEKEKDSNW

SEQ ID NO: 1796384 - protein, 26 aa, Staphylococcus epidermidis
QRSHEQRFLIVFSDGEPSAFNYSQDG

SEQ ID NO: 1796385 - protein, 20 aa, Staphylococcus epidermidis
QSAFDIIGPVMMGPSSSHTA

SEQ ID NO: 1796386 - protein, 17 aa, Staphylococcus epidermidis
QSAWNVYERAGFMHTAT

SEQ ID NO: 1796387 - protein, 20 aa, Staphylococcus epidermidis
QSLLPHLIDAVSYNVARKNT

SEQ ID NO: 1796388 - protein, 19 aa, Staphylococcus epidermidis
QSNTFYLKSGIAVIHKKPT

SEQ ID NO: 1796389 - protein, 18 aa, Staphylococcus epidermidis
QSVVPLKILQDAYGLKRV

SEQ ID NO: 1796390 - protein, 21 aa, Staphylococcus epidermidis
QTKKRAVVIGGGLLGLECARG

SEQ ID NO: 1796391 - protein, 18 aa, Staphylococcus epidermidis
QTPYEMIHRAYIEATAFG

SEQ ID NO: 1796392 - protein, 19 aa, Staphylococcus epidermidis
QTSKRCVEQGATMLVTGSY

SEQ ID NO: 1796393 - protein, 21 aa, Staphylococcus epidermidis
QVATCKEMLLSGVGVTILPKI

SEQ ID NO: 1796394 - protein, 24 aa, Staphylococcus epidermidis
QWIKKAEVFIDGFHNFSTLEYRII

SEQ ID NO: 1796395 - protein, 17 aa, Staphylococcus epidermidis
QYELTYLVEYFIQTNYP

SEQ ID NO: 1796396 - protein, 27 aa, Staphylococcus epidermidis
QYFKVERLKGVFAWGFRINSSEPEEGL

SEQ ID NO: 1796397 - protein, 25 aa, Staphylococcus epidermidis
QYKNDCPRIRTIPVGSIESLQYPEK

SEQ ID NO: 1796398 - protein, 24 aa, Staphylococcus epidermidis
QYPKAIKPWILPNFESLVNHEKIT

SEQ ID NO: 1796399 - protein, 25 aa, Staphylococcus epidermidis
QYTTRLGIRLEKTFEYIDTPHKFKM

SEQ ID NO: 1796400 - protein, 18 aa, Staphylococcus epidermidis
RAAYPIDYIENIVTPSKA

SEQ ID NO: 1796401 - protein, 17 aa, Staphylococcus epidermidis
RADIDRFVTYEMDEIFD

SEQ ID NO: 1796402 - protein, 17 aa, Staphylococcus epidermidis
RAFKSVDTPAIFMDHGE

SEQ ID NO: 1796403 - protein, 18 aa, Staphylococcus epidermidis
RAGNTTFLCGVKDDRVDE

SEQ ID NO: 1796404 - protein, 18 aa, Staphylococcus epidermidis
RAHGSGLFTRGQTQALSV

SEQ ID NO: 1796405 - protein, 21 aa, Staphylococcus epidermidis
RAKPLLKVFRLENELKVFPSH

SEQ ID NO: 1796406 - protein, 19 aa, Staphylococcus epidermidis
RAQSFGMKILAFDPYLTED

SEQ ID NO: 1796407 - protein, 24 aa, Staphylococcus epidermidis
RARKQVLIDHGFRLPSALDNRPLK

SEQ ID NO: 1796408 - protein, 18 aa, Staphylococcus epidermidis
RATYEFFNENGFTKIDPP

SEQ ID NO: 1796409 - protein, 23 aa, Staphylococcus epidermidis
RCNFRCDYCMPKEIFGDDYTFLP

SEQ ID NO: 1796410 - protein, 20 aa, Staphylococcus epidermidis
RCPYGPRPGEEVKKFTTELA

SEQ ID NO: 1796411 - protein, 19 aa, Staphylococcus epidermidis
RCVEQGATMLVTGSYFFKQ

SEQ ID NO: 1796412 - protein, 28 aa, Staphylococcus epidermidis
RDETDRTGLRIAIELKKDANSESIKNYL

SEQ ID NO: 1796413 - protein, 23 aa, Staphylococcus epidermidis
RDETSLRTGVRVVIDVRKDANAS

SEQ ID NO: 1796414 - protein, 36 aa, Staphylococcus epidermidis
RDHPQFVATSGWTDIFIYPGFEFKAIDGLITNFHLP

SEQ ID NO: 1796415 - protein, 19 aa, Staphylococcus epidermidis
RDIANWLLSGIKPSRYSSF

SEQ ID NO: 1796416 - protein, 19 aa, Staphylococcus epidermidis
RDISCNLGSLNIVNVMESG

SEQ ID NO: 1796417 - protein, 17 aa, Staphylococcus epidermidis
RDKGIKELYSFTSENNL

SEQ ID NO: 1796418 - protein, 30 aa, Staphylococcus epidermidis
RDKLKQPRSSVCFDAPSWYELVVEGRKIAG

SEQ ID NO: 1796419 - protein, 23 aa, Staphylococcus epidermidis
RDLEVQFQYGLVLCQLEMFDEAI

SEQ ID NO: 1796420 - protein, 23 aa, Staphylococcus epidermidis
RDYDEKLIIPGFFGVSKQNYIVT

SEQ ID NO: 1796421 - protein, 21 aa, Staphylococcus epidermidis
READYKFRDIAILYRDESYAY

SEQ ID NO: 1796422 - protein, 27 aa, Staphylococcus epidermidis
REDAVWDLPMVFAEFGDKDFNPKTLIA

SEQ ID NO: 1796423 - protein, 17 aa, Staphylococcus epidermidis
REEEIDYAIKHNIPVSI

SEQ ID NO: 1796424 - protein, 22 aa, Staphylococcus epidermidis
REFKQHFPHPGWVEHDANEIWT

SEQ ID NO: 1796425 - protein, 26 aa, Staphylococcus epidermidis
REIEFGEAVFRKGDKVLQLVNRPNDN

SEQ ID NO: 1796426 - protein, 18 aa, Staphylococcus epidermidis
REKNILKQQALEEHYLSM

SEQ ID NO: 1796427 - protein, 22 aa, Staphylococcus epidermidis
REKRTRFPIEVLTKVQHVVAEK

SEQ ID NO: 1796428 - protein, 23 aa, Staphylococcus epidermidis
RELRASAFRNVYKAYGAHNNTLG

SEQ ID NO: 1796429 - protein, 20 aa, Staphylococcus epidermidis
RENLKLVIQLVDLRHQPTED

SEQ ID NO: 1796430 - protein, 20 aa, Staphylococcus epidermidis
RENYEALLIYYKDSLDNPVV

SEQ ID NO: 1796431 - protein, 17 aa, Staphylococcus epidermidis
REVKGILDMKGGFTDSF

SEQ ID NO: 1796432 - protein, 17 aa, Staphylococcus epidermidis
REVKLWFTSSEIADYKE

SEQ ID NO: 1796433 - protein, 17 aa, Staphylococcus epidermidis
RFETYVIAGERGSGKMC

SEQ ID NO: 1796434 - protein, 22 aa, Staphylococcus epidermidis
RFNKSPYDGFAIRSEDSQGASG

SEQ ID NO: 1796435 - protein, 19 aa, Staphylococcus epidermidis
RFTNGLSVNDFMTRHSVIH

SEQ ID NO: 1796436 - protein, 21 aa, Staphylococcus epidermidis
RGAKSIRFMCLIAAPEGVEKM

SEQ ID NO: 1796437 - protein, 20 aa, Staphylococcus epidermidis
RGAMKRIDFNVLQEAKRAQR

SEQ ID NO: 1796438 - protein, 25 aa, Staphylococcus epidermidis
RGEYRDCYVMGLLKRNWVNKNDDDL

SEQ ID NO: 1796439 - protein, 22 aa, Staphylococcus epidermidis
RGGFTTVCPMPNTRPVPDTVEH

SEQ ID NO: 1796440 - protein, 24 aa, Staphylococcus epidermidis
RGMPKGFRNMHGFGSHTYSMYNDK

SEQ ID NO: 1796441 - protein, 24 aa, Staphylococcus epidermidis
RGQNARLAAKLTSWKIDIKSESDA

SEQ ID NO: 1796442 - protein, 18 aa, Staphylococcus epidermidis
RGTPRIANRLLKRVRDFQ

SEQ ID NO: 1796443 - protein, 27 aa, Staphylococcus epidermidis
RGTTDMKGGLMAMVIAMIELKQSNALK

SEQ ID NO: 1796444 - protein, 17 aa, Staphylococcus epidermidis
RGVCTRVGTMTPKKPNS

SEQ ID NO: 1796445 - protein, 21 aa, Staphylococcus epidermidis
RGVRYVLNDVVKRTAGVNDIH

SEQ ID NO: 1796446 - protein, 29 aa, Staphylococcus epidermidis
RHFKSLRRFFKIYVRGIRGASELRHQLMN

SEQ ID NO: 1796447 - protein, 23 aa, Staphylococcus epidermidis
RHLEKKRVVIFAAGIGNPYFSTD

SEQ ID NO: 1796448 - protein, 22 aa, Staphylococcus epidermidis
RHMALEIVDLLAKRLKQEYGLK

SEQ ID NO: 1796449 - protein, 26 aa, Staphylococcus epidermidis
RIASPEFMFPSFYGIDVSTTAELISA

SEQ ID NO: 1796450 - protein, 29 aa, Staphylococcus epidermidis
RIEERLKKRLKVGDLMKSPTVEQLGQQIE

SEQ ID NO: 1796451 - protein, 18 aa, Staphylococcus epidermidis
RIHLKPTQLVGGYAQISY

SEQ ID NO: 1796452 - protein, 17 aa, Staphylococcus epidermidis
RIIFATFASNIYRVQQA

SEQ ID NO: 1796453 - protein, 20 aa, Staphylococcus epidermidis
RIIRGLRFQSQLNFQIDSDT

SEQ ID NO: 1796454 - protein, 21 aa, Staphylococcus epidermidis
RIKIRYLPCPCKIKHDEERFD

SEQ ID NO: 1796455 - protein, 28 aa, Staphylococcus epidermidis
RISGDSCFIFKAHFKKMSEVETLINEIQ

SEQ ID NO: 1796456 - protein, 17 aa, Staphylococcus epidermidis
RKCIISNEMRPKKDMIR

SEQ ID NO: 1796457 - protein, 20 aa, Staphylococcus epidermidis
RKIIEGFKHLTPNTNQYRTV

SEQ ID NO: 1796458 - protein, 24 aa, Staphylococcus epidermidis
RKIKRELYDTRGFLSCVRVLSTDQ

SEQ ID NO: 1796459 - protein, 20 aa, Staphylococcus epidermidis
RKKYEMPIIMLTAKDSEIDK

SEQ ID NO: 1796460 - protein, 19 aa, Staphylococcus epidermidis
RKLESAGVIESRSLGMKGT

SEQ ID NO: 1796461 - protein, 17 aa, Staphylococcus epidermidis
RKLNATVINTEYKSIEE

SEQ ID NO: 1796462 - protein, 19 aa, Staphylococcus epidermidis
RKNYGCTHFIVGRDHAGVG

SEQ ID NO: 1796463 - protein, 23 aa, Staphylococcus epidermidis
RKQIPFDELVLFSSARSAGKKVE

SEQ ID NO: 1796464 - protein, 25 aa, Staphylococcus epidermidis
RKQKLEPAYSFMIRVRVPGGKATPE

SEQ ID NO: 1796465 - protein, 18 aa, Staphylococcus epidermidis
RKRIDPWIERYQYVGDVR

SEQ ID NO: 1796466 - protein, 20 aa, Staphylococcus epidermidis
RKRKIIGNEFVYVFDDEAAK

SEQ ID NO: 1796467 - protein, 25 aa, Staphylococcus epidermidis
RKVAKRLNKTIGLLLDTKGPEIRTH

SEQ ID NO: 1796468 - protein, 19 aa, Staphylococcus epidermidis
RLAAMIEGSFAIYAAQLVQ

SEQ ID NO: 1796469 - protein, 21 aa, Staphylococcus epidermidis
RLDSEFALGGNRLFYLAMAPQ

SEQ ID NO: 1796470 - protein, 20 aa, Staphylococcus epidermidis
RLDSRLVEAFNQLKDIQQNI

SEQ ID NO: 1796471 - protein, 25 aa, Staphylococcus epidermidis
RLGKSRPYIANMLRLLQLPKNVAQM

SEQ ID NO: 1796472 - protein, 19 aa, Staphylococcus epidermidis
RLLPGGYLFLSDLVGNPSL

SEQ ID NO: 1796473 - protein, 19 aa, Staphylococcus epidermidis
RLLYARVGKPYCPYHGIEI

SEQ ID NO: 1796474 - protein, 21 aa, Staphylococcus epidermidis
RLMKQAEKFNRPIFTFIDTKG

SEQ ID NO: 1796475 - protein, 21 aa, Staphylococcus epidermidis
RLMPDGQIEFLGRIDKQVKVH

SEQ ID NO: 1796476 - protein, 20 aa, Staphylococcus epidermidis
RLNNIISFEQHKVWRKHVMS

SEQ ID NO: 1796477 - protein, 20 aa, Staphylococcus epidermidis
RLNYAGFYRLHHSYKKKVVM

SEQ ID NO: 1796478 - protein, 22 aa, Staphylococcus epidermidis
RLSEICELLIQYGRSSETPVAL

SEQ ID NO: 1796479 - protein, 19 aa, Staphylococcus epidermidis
RLSKSRFIYLSPEYILQPH

SEQ ID NO: 1796480 - protein, 19 aa, Staphylococcus epidermidis
RLVEVGDVIIIMTYAQLNE

SEQ ID NO: 1796481 - protein, 21 aa, Staphylococcus epidermidis
RMHAKGSGAFGTFTVTNDITQ

SEQ ID NO: 1796482 - protein, 19 aa, Staphylococcus epidermidis
RMNEIKHQLKTVVDHRERY

SEQ ID NO: 1796483 - protein, 25 aa, Staphylococcus epidermidis
RMPDNVLRLKGYVQFKDEPNVTYEF

SEQ ID NO: 1796484 - protein, 19 aa, Staphylococcus epidermidis
RMQDFPVEIQLVSRFRTAK

SEQ ID NO: 1796485 - protein, 26 aa, Staphylococcus epidermidis
RMSASRAYLRPALRRRNLDVETRAFV

SEQ ID NO: 1796486 - protein, 28 aa, Staphylococcus epidermidis
RNEENFTYFDRFRNRIMFPLKNGQGRIV

SEQ ID NO: 1796487 - protein, 24 aa, Staphylococcus epidermidis
RNELKPLCLNSNFVAIEETEDYTR

SEQ ID NO: 1796488 - protein, 18 aa, Staphylococcus epidermidis
RNERWFEVSKKLEGLPRH

SEQ ID NO: 1796489 - protein, 17 aa, Staphylococcus epidermidis
RNHSCSIPVGLNVGVNK

SEQ ID NO: 1796490 - protein, 21 aa, Staphylococcus epidermidis
RNPENLPWNEMDIDVVIEATG

SEQ ID NO: 1796491 - protein, 31 aa, Staphylococcus epidermidis
RNPYVRHIAHPTGRIIGRRKGYKANIEKLMN

SEQ ID NO: 1796492 - protein, 20 aa, Staphylococcus epidermidis
RNVHKSVFHGLDITQQQATI

SEQ ID NO: 1796493 - protein, 28 aa, Staphylococcus epidermidis
RNYGLVMDELRLLARSVFVLNENNKVVY

SEQ ID NO: 1796494 - protein, 24 aa, Staphylococcus epidermidis
RNYLKEKLESLGFELTAQPEGAFY

SEQ ID NO: 1796495 - protein, 19 aa, Staphylococcus epidermidis
RPATMLVQTASKFDSDIQL

SEQ ID NO: 1796496 - protein, 20 aa, Staphylococcus epidermidis
RPDTIYGTSFLVLSPEHPLV

SEQ ID NO: 1796497 - protein, 26 aa, Staphylococcus epidermidis
RPFLDKTLERKAVWDKWMKQDLNNDN

SEQ ID NO: 1796498 - protein, 19 aa, Staphylococcus epidermidis
RPGLIRFKLQVIPKKISFS

SEQ ID NO: 1796499 - protein, 22 aa, Staphylococcus epidermidis
RPIEDLRIISCHIGNGASIAAI

SEQ ID NO: 1796500 - protein, 19 aa, Staphylococcus epidermidis
RPIQVGSHFHFFEANKALE

SEQ ID NO: 1796501 - protein, 20 aa, Staphylococcus epidermidis
RPKHIYSIYRKMIKQKKQFD

SEQ ID NO: 1796502 - protein, 19 aa, Staphylococcus epidermidis
RPRRVGWFDSVVLRHSRRV

SEQ ID NO: 1796503 - protein, 20 aa, Staphylococcus epidermidis
RPTPNHILVPLLIEELNHVP

SEQ ID NO: 1796504 - protein, 18 aa, Staphylococcus epidermidis
RQMLNHHFISNEIIDKEA

SEQ ID NO: 1796505 - protein, 24 aa, Staphylococcus epidermidis
RQMTEMYRLLGIAKYEDRFVVPSS

SEQ ID NO: 1796506 - protein, 24 aa, Staphylococcus epidermidis
RQPASYCGVVGMKPTYGRVSRFGL

SEQ ID NO: 1796507 - protein, 18 aa, Staphylococcus epidermidis
RQQAVLLLHSFTGTVRDV

SEQ ID NO: 1796508 - protein, 26 aa, Staphylococcus epidermidis
RQQLNVFRMELLGAKVVSVSDGQGTL

SEQ ID NO: 1796509 - protein, 18 aa, Staphylococcus epidermidis
RQRLSKLKSSVSIQTVRG

SEQ ID NO: 1796510 - protein, 24 aa, Staphylococcus epidermidis
RQVREFCTKIAWIEGGKLKEFGEL

SEQ ID NO: 1796511 - protein, 20 aa, Staphylococcus epidermidis
RRAHKPSNVRNIIVKFDDLE

SEQ ID NO: 1796512 - protein, 22 aa, Staphylococcus epidermidis
RRDIYEVTRLTASAGVSYNKFL

SEQ ID NO: 1796513 - protein, 18 aa, Staphylococcus epidermidis
RRKGYKANIEKLMNLAEE

SEQ ID NO: 1796514 - protein, 20 aa, Staphylococcus epidermidis
RRKIYGFRGLVDGDIDEERV

SEQ ID NO: 1796515 - protein, 20 aa, Staphylococcus epidermidis
RRLYEGKVLAGFAGSVADAF

SEQ ID NO: 1796516 - protein, 23 aa, Staphylococcus epidermidis
RRPSEVYFVRDLYQDVQRRDFTM

SEQ ID NO: 1796517 - protein, 21 aa, Staphylococcus epidermidis
RRVNEEIWRAIDVRIQEMSIE

SEQ ID NO: 1796518 - protein, 25 aa, Staphylococcus epidermidis
RRYLENQIRNAFGFEGTPIHIIPRK

SEQ ID NO: 1796519 - protein, 23 aa, Staphylococcus epidermidis
RSAFYKYRETIFPVDEKILDQRE

SEQ ID NO: 1796520 - protein, 18 aa, Staphylococcus epidermidis
RSIIKQLYFFSIANPQPF

SEQ ID NO: 1796521 - protein, 21 aa, Staphylococcus epidermidis
RSRLMPINRAYNVDKLMEAIR

SEQ ID NO: 1796522 - protein, 19 aa, Staphylococcus epidermidis
RSRWKGVRPTVRGSVMNPN

SEQ ID NO: 1796523 - protein, 24 aa, Staphylococcus epidermidis
RSSVEALELTHLIVEEAYKAGAED

SEQ ID NO: 1796524 - protein, 23 aa, Staphylococcus epidermidis
RSVGNLYGIMVFEGSMTLDEMRQ

SEQ ID NO: 1796525 - protein, 18 aa, Staphylococcus epidermidis
RSVLSYVLDKIMKMLHPF

SEQ ID NO: 1796526 - protein, 21 aa, Staphylococcus epidermidis
RTALIEKCWESENFIDDNTLA

SEQ ID NO: 1796527 - protein, 25 aa, Staphylococcus epidermidis
RTHELGIPIMVLFEGIPASGKTRLS

SEQ ID NO: 1796528 - protein, 18 aa, Staphylococcus epidermidis
RTIDLCLDVLVLPNGEYE

SEQ ID NO: 1796529 - protein, 20 aa, Staphylococcus epidermidis
RTNTEYPEIVFVGNHLSSSY

SEQ ID NO: 1796530 - protein, 24 aa, Staphylococcus epidermidis
RTQLILEIFALRARSREGKLQVEL

SEQ ID NO: 1796531 - protein, 19 aa, Staphylococcus epidermidis
RTRALLDQYGFNFKKSLGQ

SEQ ID NO: 1796532 - protein, 24 aa, Staphylococcus epidermidis
RTRTYNNLVNLEWIYKERPQDDER

SEQ ID NO: 1796533 - protein, 24 aa, Staphylococcus epidermidis
RTTENRGAIPYTVFIDPPLSRVGL

SEQ ID NO: 1796534 - protein, 20 aa, Staphylococcus epidermidis
RVAVALELIHMATLVHDDVI

SEQ ID NO: 1796535 - protein, 23 aa, Staphylococcus epidermidis
RVGKPYCPYHGIEIESQTVQQMV

SEQ ID NO: 1796536 - protein, 18 aa, Staphylococcus epidermidis
RVSVYERRGNYQIYVNKM

SEQ ID NO: 1796537 - protein, 18 aa, Staphylococcus epidermidis
RVTRKLCNHYEIQTPLKS

SEQ ID NO: 1796538 - protein, 26 aa, Staphylococcus epidermidis
RYDKTPAQIVLRWHLAHNRIIIPKSQ

SEQ ID NO: 1796539 - protein, 21 aa, Staphylococcus epidermidis
RYEKMMDWLAGVYINSLNIIH

SEQ ID NO: 1796540 - protein, 21 aa, Staphylococcus epidermidis
RYPIRALMMSHMFIEVDDEVH

SEQ ID NO: 1796541 - protein, 19 aa, Staphylococcus epidermidis
RYPNIPFYLQVGNPYLDDN

SEQ ID NO: 1796542 - protein, 21 aa, Staphylococcus epidermidis
RYQMYWQIYFHPVSRGGEVLL

SEQ ID NO: 1796543 - protein, 25 aa, Staphylococcus epidermidis
RYSTEIFRSAFWMDEERILEIGYPR

SEQ ID NO: 1796544 - protein, 19 aa, Staphylococcus epidermidis
RYYIQRFLARSFGFEVDDI

SEQ ID NO: 1796545 - protein, 25 aa, Staphylococcus epidermidis
SAASSCYIISLAATLEKSGFTNVKI

SEQ ID NO: 1796546 - protein, 19 aa, Staphylococcus epidermidis
SAGLFIVGRIKGVARPALV

SEQ ID NO: 1796547 - protein, 23 aa, Staphylococcus epidermidis
SAIIAENCLFDLDAPIMRLAAPD

SEQ ID NO: 1796548 - protein, 23 aa, Staphylococcus epidermidis
SAKTGEGGKLFGSISTKQIAEAL

SEQ ID NO: 1796549 - protein, 24 aa, Staphylococcus epidermidis
SALALEMIHTYSLIHDDLPAMDND

SEQ ID NO: 1796550 - protein, 24 aa, Staphylococcus epidermidis
SALQHAASVAAMFLTTEAVVASIP

SEQ ID NO: 1796551 - protein, 25 aa, Staphylococcus epidermidis
SCGDIAVSVYSGWLAYSTFDHDWVK

SEQ ID NO: 1796552 - protein, 20 aa, Staphylococcus epidermidis
SCVNAPTSIDTYQWLQALLL

SEQ ID NO: 1796553 - protein, 24 aa, Staphylococcus epidermidis
SDDSKYQEICWFHTLEGIWHPVEV

SEQ ID NO: 1796554 - protein, 21 aa, Staphylococcus epidermidis
SDGAHVIECPLYEIDRYDDYF

SEQ ID NO: 1796555 - protein, 19 aa, Staphylococcus epidermidis
SDIPILMECFDDLIDQNNT

SEQ ID NO: 1796556 - protein, 25 aa, Staphylococcus epidermidis
SDIQFKIKHLMVSQVKGTFKQFDVQ

SEQ ID NO: 1796557 - protein, 22 aa, Staphylococcus epidermidis
SDIRKKDIGFIFQDYNILNTLT

SEQ ID NO: 1796558 - protein, 18 aa, Staphylococcus epidermidis
SDKPRNIEFYDFADDIKF

SEQ ID NO: 1796559 - protein, 28 aa, Staphylococcus epidermidis
SDLIPELQGRFPIRVELESLSVEDFVRI

SEQ ID NO: 1796560 - protein, 22 aa, Staphylococcus epidermidis
SDLRAGACLITAGLIAEGVTTI

SEQ ID NO: 1796561 - protein, 26 aa, Staphylococcus epidermidis
SDMKQPVWIRHVLVPGISDDKEDLIK

SEQ ID NO: 1796562 - protein, 25 aa, Staphylococcus epidermidis
SDQPLKQKVCDVATMAFENAMKKVK

SEQ ID NO: 1796563 - protein, 17 aa, Staphylococcus epidermidis
SDYLDVFQIGARNMQNF

SEQ ID NO: 1796564 - protein, 25 aa, Staphylococcus epidermidis
SEAALKICNYCFENGVIIIAVAGNV

SEQ ID NO: 1796565 - protein, 17 aa, Staphylococcus epidermidis
SEEELPIFRSFMEDTSE

SEQ ID NO: 1796566 - protein, 17 aa, Staphylococcus epidermidis
SEEIARLQVRMNAETPQ

SEQ ID NO: 1796567 - protein, 25 aa, Staphylococcus epidermidis
SEEMAELYNYLGLTVGLNLNSKSTE

SEQ ID NO: 1796568 - protein, 20 aa, Staphylococcus epidermidis
SEFTLPMSVFDDLYDDYTEW

SEQ ID NO: 1796569 - protein, 24 aa, Staphylococcus epidermidis
SEGLSRCIPMIFLNPAPGQELENA

SEQ ID NO: 1796570 - protein, 18 aa, Staphylococcus epidermidis
SEIAWRLERYGHRMNEIL

SEQ ID NO: 1796571 - protein, 20 aa, Staphylococcus epidermidis
SEIQKMREERQMLGQMINQV

SEQ ID NO: 1796572 - protein, 21 aa, Staphylococcus epidermidis
SEIYDLITIACQFKSGERPLP

SEQ ID NO: 1796573 - protein, 25 aa, Staphylococcus epidermidis
SELFKNELKIAMGPIERGGAGGGIA

SEQ ID NO: 1796574 - protein, 20 aa, Staphylococcus epidermidis
SELKLSDKVKIFKYTNQPLQ

SEQ ID NO: 1796575 - protein, 19 aa, Staphylococcus epidermidis
SELNLPFELDISSVDIKLH

SEQ ID NO: 1796576 - protein, 17 aa, Staphylococcus epidermidis
SELREMIGDMPLIQTSM

SEQ ID NO: 1796577 - protein, 19 aa, Staphylococcus epidermidis
SELTYLTFVYKVAAMDFIF

SEQ ID NO: 1796578 - protein, 28 aa, Staphylococcus epidermidis
SENHACPICGFSIGELEPRMFSFNSPFG

SEQ ID NO: 1796579 - protein, 31 aa, Staphylococcus epidermidis
SERFGVNGIRISIAWSRIFPKGYGEVNQKGV

SEQ ID NO: 1796580 - protein, 23 aa, Staphylococcus epidermidis
SEWNAKNLFTGWADVKLSKQGIE

SEQ ID NO: 1796581 - protein, 30 aa, Staphylococcus epidermidis
SEYDDCLLFFRLGDFYEMFFDDAKEASRVL

SEQ ID NO: 1796582 - protein, 25 aa, Staphylococcus epidermidis
SFDFDCVKKLSAMNLDYELGLLISK

SEQ ID NO: 1796583 - protein, 18 aa, Staphylococcus epidermidis
SFYYDFNGQLSLCDIGAG

SEQ ID NO: 1796584 - protein, 21 aa, Staphylococcus epidermidis
SGACGRLMCCLKYENDYYEEA

SEQ ID NO: 1796585 - protein, 20 aa, Staphylococcus epidermidis
SGCLYCKSKGKPNKKFTDEK

SEQ ID NO: 1796586 - protein, 17 aa, Staphylococcus epidermidis
SGDRLNLKWGPNWEDDL

SEQ ID NO: 1796587 - protein, 19 aa, Staphylococcus epidermidis
SGEVTQELQKGYKLKDRVL

SEQ ID NO: 1796588 - protein, 20 aa, Staphylococcus epidermidis
SGGIMLPNHAPLVVAEQFGT

SEQ ID NO: 1796589 - protein, 22 aa, Staphylococcus epidermidis
SGGQRQRVWIAMALAQRTDIIF

SEQ ID NO: 1796590 - protein, 26 aa, Staphylococcus epidermidis
SGIEPGQWLGVFGVGGLGNLALQYAK

SEQ ID NO: 1796591 - protein, 20 aa, Staphylococcus epidermidis
SGIKPSRYSSFTVTRRNNHE

SEQ ID NO: 1796592 - protein, 20 aa, Staphylococcus epidermidis
SGKTGFYFRVIKEGYVHQSD

SEQ ID NO: 1796593 - protein, 37 aa, Staphylococcus epidermidis
SGMAAIQLICNIFKPGDEILVAFDLYGGTFRLFDFYE

SEQ ID NO: 1796594 - protein, 22 aa, Staphylococcus epidermidis
SGNVRRFISRAGIKDTFEITQD

SEQ ID NO: 1796595 - protein, 23 aa, Staphylococcus epidermidis
SGQKCSACSRAIVHQDVHDEILE

SEQ ID NO: 1796596 - protein, 20 aa, Staphylococcus epidermidis
SHAFLLPLIQLIESDIQEPQ

SEQ ID NO: 1796597 - protein, 28 aa, Staphylococcus epidermidis
SHLESRFLPGRHYALFNLQGEIDYATNE

SEQ ID NO: 1796598 - protein, 22 aa, Staphylococcus epidermidis
SHLLSLPGWAGIMYHRSQTQSN

SEQ ID NO: 1796599 - protein, 21 aa, Staphylococcus epidermidis
SHRKLFPSIFHLYQQDNLDEH

SEQ ID NO: 1796600 - protein, 26 aa, Staphylococcus epidermidis
SHVSELKQRIPLILEVTSNQYESHTQ

SEQ ID NO: 1796601 - protein, 17 aa, Staphylococcus epidermidis
SIDRKLPDLSERERKVI

SEQ ID NO: 1796602 - protein, 20 aa, Staphylococcus epidermidis
SIDTYQWLQALLLRKFPQHH

SEQ ID NO: 1796603 - protein, 25 aa, Staphylococcus epidermidis
SIEVTRPRGTAVIVSIFGHPVEFNP

SEQ ID NO: 1796604 - protein, 20 aa, Staphylococcus epidermidis
SIKDVENFISLLSQIYDESE

SEQ ID NO: 1796605 - protein, 18 aa, Staphylococcus epidermidis
SIKIPRIDISSTMIRNRV

SEQ ID NO: 1796606 - protein, 19 aa, Staphylococcus epidermidis
SILNLVLLCGCQGVNGGGW

SEQ ID NO: 1796607 - protein, 18 aa, Staphylococcus epidermidis
SIVKRVDVPVIIKEVGFG

SEQ ID NO: 1796608 - protein, 25 aa, Staphylococcus epidermidis
SKDGHYRGIATWEYDRSRNKLVGTI

SEQ ID NO: 1796609 - protein, 28 aa, Staphylococcus epidermidis
SKDLKAYGFKFLGPVTVFSFLEAAGLYD

SEQ ID NO: 1796610 - protein, 18 aa, Staphylococcus epidermidis
SKETIAFDPKDVIIVEGI

SEQ ID NO: 1796611 - protein, 34 aa, Staphylococcus epidermidis
SKETLEIYAPLAHRLGINTIKWELEDTALRYIDS

SEQ ID NO: 1796612 - protein, 25 aa, Staphylococcus epidermidis
SKFGLSIKHGLALNAVNKVKATKHL

SEQ ID NO: 1796613 - protein, 19 aa, Staphylococcus epidermidis
SKFYSEIKVLEAVNEGLAA

SEQ ID NO: 1796614 - protein, 18 aa, Staphylococcus epidermidis
SKGGAYLEMELHEGENSE

SEQ ID NO: 1796615 - protein, 22 aa, Staphylococcus epidermidis
SKGKYLFELKIDLDNLYKELGD

SEQ ID NO: 1796616 - protein, 21 aa, Staphylococcus epidermidis
SKHLNELILYIAPKLIGGSGK

SEQ ID NO: 1796617 - protein, 17 aa, Staphylococcus epidermidis
SKHPIRVDIAGSVESIY

SEQ ID NO: 1796618 - protein, 24 aa, Staphylococcus epidermidis
SKIGKDDFSSFCELRELNAVLTDN

SEQ ID NO: 1796619 - protein, 21 aa, Staphylococcus epidermidis
SKIIFSAHCHDDLGMAVANSL

SEQ ID NO: 1796620 - protein, 17 aa, Staphylococcus epidermidis
SKIPLSLTFDHQILDGA

SEQ ID NO: 1796621 - protein, 21 aa, Staphylococcus epidermidis
SKKFGEEAFEVVIGAIKHNRE

SEQ ID NO: 1796622 - protein, 27 aa, Staphylococcus epidermidis
SKLAAKRKLSVFLYSVNDLTEFNATTQ

SEQ ID NO: 1796623 - protein, 17 aa, Staphylococcus epidermidis
SKMTGIKERHWADEDQD

SEQ ID NO: 1796624 - protein, 19 aa, Staphylococcus epidermidis
SKPFFLEFMAKNVSKGNAI

SEQ ID NO: 1796625 - protein, 21 aa, Staphylococcus epidermidis
SKQLCFLFYVSSKEIIKKYTD

SEQ ID NO: 1796626 - protein, 26 aa, Staphylococcus epidermidis
SKSVTFTHEFMFSRPLHHTDDVIKHH

SEQ ID NO: 1796627 - protein, 21 aa, Staphylococcus epidermidis
SKTKELFNHIIGLQHSTKNEH

SEQ ID NO: 1796628 - protein, 22 aa, Staphylococcus epidermidis
SKTSKNLMCLFRKINQKHQTIL

SEQ ID NO: 1796629 - protein, 26 aa, Staphylococcus epidermidis
SKYPHLKIKWIRGNIDTRLKKLETED

SEQ ID NO: 1796630 - protein, 30 aa, Staphylococcus epidermidis
SKYVKKYNCLYLRVDPYLPYQYLNHEGEIT

SEQ ID NO: 1796631 - protein, 17 aa, Staphylococcus epidermidis
SLESSFNIARKMGYFDI

SEQ ID NO: 1796632 - protein, 23 aa, Staphylococcus epidermidis
SLKRYLLEETFELFEAIDNEDDW

SEQ ID NO: 1796633 - protein, 25 aa, Staphylococcus epidermidis
SLKVGDRVSIAWMYAACGNCEYCTT

SEQ ID NO: 1796634 - protein, 19 aa, Staphylococcus epidermidis
SLQAIKLTFDYLKSSVQEN

SEQ ID NO: 1796635 - protein, 25 aa, Staphylococcus epidermidis
SLRTEPKLSLPSARSIIAIAVGYPN

SEQ ID NO: 1796636 - protein, 24 aa, Staphylococcus epidermidis
SLSRVCRRHQIPLFMDGARLGYGL

SEQ ID NO: 1796637 - protein, 24 aa, Staphylococcus epidermidis
SLTAKHTTCRIVGISMSSLGKVSR

SEQ ID NO: 1796638 - protein, 18 aa, Staphylococcus epidermidis
SLTAPLLNEIMLNTYKAF

SEQ ID NO: 1796639 - protein, 17 aa, Staphylococcus epidermidis
SMLKEASDELGLTYEEA

SEQ ID NO: 1796640 - protein, 28 aa, Staphylococcus epidermidis
SMYNDKGERVWVKYHFRTQQGIENYTDE

SEQ ID NO: 1796641 - protein, 18 aa, Staphylococcus epidermidis
SNESVHFESLIHFDLDML

SEQ ID NO: 1796642 - protein, 34 aa, Staphylococcus epidermidis
SNHDVDMLRMCRYPWKTKQRILSDMGHVSNEDAG

SEQ ID NO: 1796643 - protein, 17 aa, Staphylococcus epidermidis
SNKEIDTIQALGGIIKF

SEQ ID NO: 1796644 - protein, 24 aa, Staphylococcus epidermidis
SNNGRIIVISSIWGETGASLETIY

SEQ ID NO: 1796645 - protein, 24 aa, Staphylococcus epidermidis
SNQTLRLVLERAKTYSVPNHIIDR

SEQ ID NO: 1796646 - protein, 20 aa, Staphylococcus epidermidis
SNYLPSYRYAQIYYEDDDLA

SEQ ID NO: 1796647 - protein, 17 aa, Staphylococcus epidermidis
SPMAEAIMRQRLQERGI

SEQ ID NO: 1796648 - protein, 26 aa, Staphylococcus epidermidis
SPMLLKNSRFGFKMGNQTLEDSMIAD

SEQ ID NO: 1796649 - protein, 28 aa, Staphylococcus epidermidis
SPSYALFKGQHLVHFIPREHIEGRDIND

SEQ ID NO: 1796650 - protein, 19 aa, Staphylococcus epidermidis
SPYEKAWMVKIEISDDSQL

SEQ ID NO: 1796651 - protein, 24 aa, Staphylococcus epidermidis
SQFDNLKWLGLDWDESVDKDKGFG

SEQ ID NO: 1796652 - protein, 25 aa, Staphylococcus epidermidis
SQGLLEGFKNLGFETYFAIPRSKEE

SEQ ID NO: 1796653 - protein, 17 aa, Staphylococcus epidermidis
SQIVGLIGKNGVGKTTL

SEQ ID NO: 1796654 - protein, 18 aa, Staphylococcus epidermidis
SQMAEGWGKKILGDEWQV

SEQ ID NO: 1796655 - protein, 24 aa, Staphylococcus epidermidis
SQQIETFLGRKTRLDMLDELKKAG

SEQ ID NO: 1796656 - protein, 21 aa, Staphylococcus epidermidis
SQVQFVGFVGEHSRYDLMLVQ

SEQ ID NO: 1796657 - protein, 21 aa, Staphylococcus epidermidis
SRANMSGNFKFIYEEMLKQQL

SEQ ID NO: 1796658 - protein, 21 aa, Staphylococcus epidermidis
SRAQQAGVFDAEIVPVEVPQR

SEQ ID NO: 1796659 - protein, 18 aa, Staphylococcus epidermidis
SRDIKRSGYLVITSDKGL

SEQ ID NO: 1796660 - protein, 24 aa, Staphylococcus epidermidis
SRDRIKYWILKILELHCLSYNDVS

SEQ ID NO: 1796661 - protein, 18 aa, Staphylococcus epidermidis
SREGFLLAQEISSYSLTL

SEQ ID NO: 1796662 - protein, 21 aa, Staphylococcus epidermidis
SRFGHSLGVYEIVRRMIDETF

SEQ ID NO: 1796663 - protein, 25 aa, Staphylococcus epidermidis
SRGALKYIHDIWGYIAPNTKKEQQP

SEQ ID NO: 1796664 - protein, 19 aa, Staphylococcus epidermidis
SRGSLKIKSKDPFEKPSIV

SEQ ID NO: 1796665 - protein, 21 aa, Staphylococcus epidermidis
SRILFGAGLDEVILMISRAVL

SEQ ID NO: 1796666 - protein, 18 aa, Staphylococcus epidermidis
SRKTFAIISHPDAGKTTL

SEQ ID NO: 1796667 - protein, 19 aa, Staphylococcus epidermidis
SRLVKPIGIKVTRLAQGLS

SEQ ID NO: 1796668 - protein, 31 aa, Staphylococcus epidermidis
SRTTGFDGWAPLFFRGREVSGKTIGIIGLGE

SEQ ID NO: 1796669 - protein, 20 aa, Staphylococcus epidermidis
SSDVDVLFILGGDGTLNELV

SEQ ID NO: 1796670 - protein, 22 aa, Staphylococcus epidermidis
SSFIEYYAKVMSKFVTNDHLIF

SEQ ID NO: 1796671 - protein, 30 aa, Staphylococcus epidermidis
SSFNIARKMGYFDIPKDLLIPINEVENYPK

SEQ ID NO: 1796672 - protein, 21 aa, Staphylococcus epidermidis
SSKELKLYSGEWLTITGKNGA

SEQ ID NO: 1796673 - protein, 24 aa, Staphylococcus epidermidis
SSKGLEFPFVIYSGLSKKFNKGDL

SEQ ID NO: 1796674 - protein, 20 aa, Staphylococcus epidermidis
SSKSLARFISTIRSFHQFAL

SEQ ID NO: 1796675 - protein, 19 aa, Staphylococcus epidermidis
SSMCKHLSLQLSENKGDII

SEQ ID NO: 1796676 - protein, 17 aa, Staphylococcus epidermidis
SSQGRKATSTGFGSSVN

SEQ ID NO: 1796677 - protein, 24 aa, Staphylococcus epidermidis
STIFPNFIGHTFAVYDGRKHVPVY

SEQ ID NO: 1796678 - protein, 22 aa, Staphylococcus epidermidis
STLEYRIIEALVQHAKQVTVLL

SEQ ID NO: 1796679 - protein, 23 aa, Staphylococcus epidermidis
STMAGMAFANAFLGISHSIAHKI

SEQ ID NO: 1796680 - protein, 23 aa, Staphylococcus epidermidis
STTLRRLMDLYGFKEKLQQLDLP

SEQ ID NO: 1796681 - protein, 20 aa, Staphylococcus epidermidis
SVALAKRLAEYLNEIFEYNV

SEQ ID NO: 1796682 - protein, 24 aa, Staphylococcus epidermidis
SVEAGKLADLVMWEPEFFGAKPDL

SEQ ID NO: 1796683 - protein, 24 aa, Staphylococcus epidermidis
SVLKGFKDGATFLSYLKNNERPDI

SEQ ID NO: 1796684 - protein, 24 aa, Staphylococcus epidermidis
SYCGPGRRKTFAFVNNRPLAALTE

SEQ ID NO: 1796685 - protein, 17 aa, Staphylococcus epidermidis
SYEDFETWSALILQDIS

SEQ ID NO: 1796686 - protein, 26 aa, Staphylococcus epidermidis
SYGLIPEFIGRVPIVANLETLDVAAL

SEQ ID NO: 1796687 - protein, 17 aa, Staphylococcus epidermidis
SYHVPMIVNDDVQLAQE

SEQ ID NO: 1796688 - protein, 17 aa, Staphylococcus epidermidis
SYILIKTTPGFAQSINY

SEQ ID NO: 1796689 - protein, 24 aa, Staphylococcus epidermidis
SYLKEFKPKAGDKIYLVGETRDDF

SEQ ID NO: 1796690 - protein, 19 aa, Staphylococcus epidermidis
SYMCMAAAMGEEVILHNIV

SEQ ID NO: 1796691 - protein, 25 aa, Staphylococcus epidermidis
SYRLSEVKLGIDLNYILLENFKFNE

SEQ ID NO: 1796692 - protein, 18 aa, Staphylococcus epidermidis
SYYDYILEIYEYVHQILP

SEQ ID NO: 1796693 - protein, 19 aa, Staphylococcus epidermidis
SYYEGYRLGSDDLSIGEIV

SEQ ID NO: 1796694 - protein, 20 aa, Staphylococcus epidermidis
TAFDGRGNYTLGVKEQLIFP

SEQ ID NO: 1796695 - protein, 24 aa, Staphylococcus epidermidis
TAFPLLYTHFVRRGNWSLQQLVDY

SEQ ID NO: 1796696 - protein, 18 aa, Staphylococcus epidermidis
TAKLMIKAFEKFEQLHLD

SEQ ID NO: 1796697 - protein, 18 aa, Staphylococcus epidermidis
TALLDQGIINENWLSQLE

SEQ ID NO: 1796698 - protein, 20 aa, Staphylococcus epidermidis
TAMYISRLVKPIGIKVTRLA

SEQ ID NO: 1796699 - protein, 24 aa, Staphylococcus epidermidis
TANHKPVVYCLDKIAKTYLTCTDY

SEQ ID NO: 1796700 - protein, 23 aa, Staphylococcus epidermidis
TAPWLERMGFENVKNVLLNQEKQ

SEQ ID NO: 1796701 - protein, 23 aa, Staphylococcus epidermidis
TAQRADTFLPYMSDALKVRQRVM

SEQ ID NO: 1796702 - protein, 24 aa, Staphylococcus epidermidis
TATERLKFGEVYANCEAEEVVNGY

SEQ ID NO: 1796703 - protein, 25 aa, Staphylococcus epidermidis
TCGCAAGLARPAAVAVAEQNEVKPD

SEQ ID NO: 1796704 - protein, 19 aa, Staphylococcus epidermidis
TCSEFKPYYLTKALQKLKD

SEQ ID NO: 1796705 - protein, 24 aa, Staphylococcus epidermidis
TDFNLGPEPEFFLFKLDEKGEPTL

SEQ ID NO: 1796706 - protein, 25 aa, Staphylococcus epidermidis
TDIGLKLGFPAHMSRLTRIASGGFQ

SEQ ID NO: 1796707 - protein, 19 aa, Staphylococcus epidermidis
TDLTIQEAIEFIKDDHSDL

SEQ ID NO: 1796708 - protein, 35 aa, Staphylococcus epidermidis
TDMGELRGKIFYKEHYKTRVVSHVEWLDSKQRLRS

SEQ ID NO: 1796709 - protein, 18 aa, Staphylococcus epidermidis
TDPMKFLPEDGSLELTSG

SEQ ID NO: 1796710 - protein, 18 aa, Staphylococcus epidermidis
TDQLFLISGKTGSGKTMI

SEQ ID NO: 1796711 - protein, 21 aa, Staphylococcus epidermidis
TDVSPKFVVGYVETKEKHPNA

SEQ ID NO: 1796712 - protein, 17 aa, Staphylococcus epidermidis
TDYADIAKFLGLKGNTT

SEQ ID NO: 1796713 - protein, 21 aa, Staphylococcus epidermidis
TEAFEPGKNYTIFTHTFNGIK

SEQ ID NO: 1796714 - protein, 21 aa, Staphylococcus epidermidis
TEDVYDFWRPTGHQYPLVAGA

SEQ ID NO: 1796715 - protein, 24 aa, Staphylococcus epidermidis
TEETIGFIIGPRLNAVGRLEDASL

SEQ ID NO: 1796716 - protein, 19 aa, Staphylococcus epidermidis
TEEVDGYNAIQVGFEDKQA

SEQ ID NO: 1796717 - protein, 17 aa, Staphylococcus epidermidis
TEGKAKEESKFKKLMKS

SEQ ID NO: 1796718 - protein, 21 aa, Staphylococcus epidermidis
TEGYEGFYHLMNFTGNVEKAT

SEQ ID NO: 1796719 - protein, 20 aa, Staphylococcus epidermidis
TEIYDYIRLLYARVGKPYCP

SEQ ID NO: 1796720 - protein, 18 aa, Staphylococcus epidermidis
TEKGQFTERIFGLENRQF

SEQ ID NO: 1796721 - protein, 25 aa, Staphylococcus epidermidis
TEKSLKRTPSFSVNRPGEETGITFA

SEQ ID NO: 1796722 - protein, 23 aa, Staphylococcus epidermidis
TEKYSVLRALKAIERSEVVLVVI

SEQ ID NO: 1796723 - protein, 23 aa, Staphylococcus epidermidis
TELNPQSLLKCCLTTEQQLHRKR

SEQ ID NO: 1796724 - protein, 24 aa, Staphylococcus epidermidis
TFEYKDARNYLAFLYSNQLKRTTV

SEQ ID NO: 1796725 - protein, 20 aa, Staphylococcus epidermidis
TFHSLNLKVVIFDDADYDFA

SEQ ID NO: 1796726 - protein, 18 aa, Staphylococcus epidermidis
TFNHSFKAFQNWFNEDID

SEQ ID NO: 1796727 - protein, 18 aa, Staphylococcus epidermidis
TFRLTEQILNRFNIEFTT

SEQ ID NO: 1796728 - protein, 23 aa, Staphylococcus epidermidis
TFVTEGKNEWAFETKDKSYVAQI

SEQ ID NO: 1796729 - protein, 22 aa, Staphylococcus epidermidis
TFYHPSNMVLFVVGDVSPQSII

SEQ ID NO: 1796730 - protein, 18 aa, Staphylococcus epidermidis
TGDRPIQVGSHFHFFEAN

SEQ ID NO: 1796731 - protein, 25 aa, Staphylococcus epidermidis
TGKEWLNQAPFSFDLSVMAIYPCLT

SEQ ID NO: 1796732 - protein, 17 aa, Staphylococcus epidermidis
TGLPEALHQVTILMSDR

SEQ ID NO: 1796733 - protein, 24 aa, Staphylococcus epidermidis
TGSDLSVVLLDFGKKQNIVRELNL

SEQ ID NO: 1796734 - protein, 27 aa, Staphylococcus epidermidis
TGTMTEEDWSRFTIAVGKLSRTKIFID

SEQ ID NO: 1796735 - protein, 25 aa, Staphylococcus epidermidis
THAAGLRYAQYGPFMTFHLAGGEGG

SEQ ID NO: 1796736 - protein, 22 aa, Staphylococcus epidermidis
THARIPVCGAISSYNHPEKDIG

SEQ ID NO: 1796737 - protein, 26 aa, Staphylococcus epidermidis
THKTLRGPRGGMILCKEEYKKDIDKT

SEQ ID NO: 1796738 - protein, 25 aa, Staphylococcus epidermidis
TIAEYSVSIALQLVRKFPTIEKRVQ

SEQ ID NO: 1796739 - protein, 18 aa, Staphylococcus epidermidis
TIEGLERIRISSIEASQL

SEQ ID NO: 1796740 - protein, 20 aa, Staphylococcus epidermidis
TIFFLNGFQMKGVVENYDKY

SEQ ID NO: 1796741 - protein, 22 aa, Staphylococcus epidermidis
TIFPDAFAPFLKQYDSRIVDGT

SEQ ID NO: 1796742 - protein, 19 aa, Staphylococcus epidermidis
TIHPHIKIGSRNLVGHTHR

SEQ ID NO: 1796743 - protein, 22 aa, Staphylococcus epidermidis
TKEIKNDMLVTLDASQGKVFEG

SEQ ID NO: 1796744 - protein, 17 aa, Staphylococcus epidermidis
TKEPITIIERLRTANHK

SEQ ID NO: 1796745 - protein, 19 aa, Staphylococcus epidermidis
TKIGALCGEAIVFTKQNEP

SEQ ID NO: 1796746 - protein, 26 aa, Staphylococcus epidermidis
TKKPVIFRATPQWFASINKVRQDILD

SEQ ID NO: 1796747 - protein, 21 aa, Staphylococcus epidermidis
TKLQAVCSVCGSPSSRTQRLI

SEQ ID NO: 1796748 - protein, 24 aa, Staphylococcus epidermidis
TKMIDLRIETRLSFTESQINFYKT

SEQ ID NO: 1796749 - protein, 22 aa, Staphylococcus epidermidis
TKRQAGTELVDFEKLALEGVFA

SEQ ID NO: 1796750 - protein, 20 aa, Staphylococcus epidermidis
TLCGGGRYNGLLQLLDGPDE

SEQ ID NO: 1796751 - protein, 22 aa, Staphylococcus epidermidis
TLEEPPAHAIFILATTEPHKIP

SEQ ID NO: 1796752 - protein, 19 aa, Staphylococcus epidermidis
TLELLKLISEKYHFEYHLE

SEQ ID NO: 1796753 - protein, 22 aa, Staphylococcus epidermidis
TLLERFKYAQSINVNAHPVIVG

SEQ ID NO: 1796754 - protein, 17 aa, Staphylococcus epidermidis
TLLVPKKPSANIFETDE

SEQ ID NO: 1796755 - protein, 17 aa, Staphylococcus epidermidis
TLNQLVDYFSRWLDETK

SEQ ID NO: 1796756 - protein, 24 aa, Staphylococcus epidermidis
TLPNGVEVRNRFVLAPLTHTSSND

SEQ ID NO: 1796757 - protein, 24 aa, Staphylococcus epidermidis
TLQDRRKAFQFAYLSLLQEENIQA

SEQ ID NO: 1796758 - protein, 21 aa, Staphylococcus epidermidis
TLQKVGHDWYAMMEELANYRE

SEQ ID NO: 1796759 - protein, 18 aa, Staphylococcus epidermidis
TLQPAAGAHGEWTALMIF

SEQ ID NO: 1796760 - protein, 21 aa, Staphylococcus epidermidis
TLRMNYLFDFYQSLLTNKQKN

SEQ ID NO: 1796761 - protein, 25 aa, Staphylococcus epidermidis
TLWKKAKPGEISWNSPFGKGRPGWH

SEQ ID NO: 1796762 - protein, 17 aa, Staphylococcus epidermidis
TMRARGAQVTDITILVV

SEQ ID NO: 1796763 - protein, 27 aa, Staphylococcus epidermidis
TNDRYKLIILRKGRGLAGMVMKTGKRM

SEQ ID NO: 1796764 - protein, 28 aa, Staphylococcus epidermidis
TNELKLYAPEFEKVIPLNIMLIEKNHVV

SEQ ID NO: 1796765 - protein, 32 aa, Staphylococcus epidermidis
TNKGRYLFIPVHKLADIRWKELGQHISQIVPI

SEQ ID NO: 1796766 - protein, 24 aa, Staphylococcus epidermidis
TNMGASGIEYFTPILNLGETGILG

SEQ ID NO: 1796767 - protein, 18 aa, Staphylococcus epidermidis
TNPERLLETSIKGMLPST

SEQ ID NO: 1796768 - protein, 18 aa, Staphylococcus epidermidis
TNTNARIEPGAFIREQAI

SEQ ID NO: 1796769 - protein, 18 aa, Staphylococcus epidermidis
TPESWYYSKRLMYSQLEN

SEQ ID NO: 1796770 - protein, 19 aa, Staphylococcus epidermidis
TPIFPRLDTEAEIAYIKES

SEQ ID NO: 1796771 - protein, 26 aa, Staphylococcus epidermidis
TPIKLRKRVWRRLAKDLKPQQLHDIK

SEQ ID NO: 1796772 - protein, 30 aa, Staphylococcus epidermidis
TPKQLMIYEAFGWEAPRFGHMSLIVNEERK

SEQ ID NO: 1796773 - protein, 18 aa, Staphylococcus epidermidis
TPSNPLLRVTDIKASAKI

SEQ ID NO: 1796774 - protein, 24 aa, Staphylococcus epidermidis
TPSSIKAILNQAGFNDEITEETIG

SEQ ID NO: 1796775 - protein, 17 aa, Staphylococcus epidermidis
TPTFLFGMRNGETVEIE

SEQ ID NO: 1796776 - protein, 22 aa, Staphylococcus epidermidis
TPVIISSRIRLARNLENHVHPL

SEQ ID NO: 1796777 - protein, 17 aa, Staphylococcus epidermidis
TPYDLKVANSIITGAVD

SEQ ID NO: 1796778 - protein, 23 aa, Staphylococcus epidermidis
TQFGGPHCGYFATTKKLMRKVPG

SEQ ID NO: 1796779 - protein, 25 aa, Staphylococcus epidermidis
TQKSPRWAIAYKFPAEEVITKLLDI

SEQ ID NO: 1796780 - protein, 18 aa, Staphylococcus epidermidis
TQLAGMRGLMAAPSGKII

SEQ ID NO: 1796781 - protein, 17 aa, Staphylococcus epidermidis
TQLEVGDNIIIYNKYQN

SEQ ID NO: 1796782 - protein, 24 aa, Staphylococcus epidermidis
TRELSRLYVYAHHKGLKSLYYTRN

SEQ ID NO: 1796783 - protein, 21 aa, Staphylococcus epidermidis
TREYIPLLMFSPKIKDYHELS

SEQ ID NO: 1796784 - protein, 19 aa, Staphylococcus epidermidis
TRHNIGFEVVDDILERHQF

SEQ ID NO: 1796785 - protein, 25 aa, Staphylococcus epidermidis
TRPIKIGLAALVDRGHRELPIRADF

SEQ ID NO: 1796786 - protein, 17 aa, Staphylococcus epidermidis
TRSKETIAFDPKDVIIV

SEQ ID NO: 1796787 - protein, 23 aa, Staphylococcus epidermidis
TRSKLRKALPEQYVYIIEELLYK

SEQ ID NO: 1796788 - protein, 28 aa, Staphylococcus epidermidis
TRSVALSRFPWLSANIEYTVTREPYFST

SEQ ID NO: 1796789 - protein, 22 aa, Staphylococcus epidermidis
TRTSYLLAESVYEFSRADCAIV

SEQ ID NO: 1796790 - protein, 17 aa, Staphylococcus epidermidis
TSFGFKHGIQMDADLVF

SEQ ID NO: 1796791 - protein, 23 aa, Staphylococcus epidermidis
TSGWTSDVKYHLGGVKTTNSYGI

SEQ ID NO: 1796792 - protein, 17 aa, Staphylococcus epidermidis
TSIATMIHLIYRKLNKN

SEQ ID NO: 1796793 - protein, 24 aa, Staphylococcus epidermidis
TSQIKRLYPFVFNTLYDSIRQLSQ

SEQ ID NO: 1796794 - protein, 18 aa, Staphylococcus epidermidis
TSSHKQAMMLSRIQSTQT

SEQ ID NO: 1796795 - protein, 25 aa, Staphylococcus epidermidis
TSSHLFKFHGEVAMHLFLNDDFILP

SEQ ID NO: 1796796 - protein, 24 aa, Staphylococcus epidermidis
TTAVCGLARCKKSDIDAVYEATKE

SEQ ID NO: 1796797 - protein, 19 aa, Staphylococcus epidermidis
TTLVLAPLVAAVGVPVAKM

SEQ ID NO: 1796798 - protein, 33 aa, Staphylococcus epidermidis
TTPLNIFYFTGYRSEPHERLFALLIPSNEEPVL

SEQ ID NO: 1796799 - protein, 24 aa, Staphylococcus epidermidis
TTRKFTEVFNVPKKVNVSDQINLK

SEQ ID NO: 1796800 - protein, 20 aa, Staphylococcus epidermidis
TVFCYGLMVNYCLQAADILA

SEQ ID NO: 1796801 - protein, 26 aa, Staphylococcus epidermidis
TVIDCTQFPFRIARPGSITQDMIETK

SEQ ID NO: 1796802 - protein, 25 aa, Staphylococcus epidermidis
TVVRRRTEYNLKKARDRAHILEGLR

SEQ ID NO: 1796803 - protein, 17 aa, Staphylococcus epidermidis
TVVTPNLFEAGQLSGLG

SEQ ID NO: 1796804 - protein, 28 aa, Staphylococcus epidermidis
TVYNIPFLWRLSSELNVMQLQRALSKLI

SEQ ID NO: 1796805 - protein, 23 aa, Staphylococcus epidermidis
TWTNRPGAEYMWFNNVETKPGVG

SEQ ID NO: 1796806 - protein, 20 aa, Staphylococcus epidermidis
TYEGESVFEPEVLVKMRNRM

SEQ ID NO: 1796807 - protein, 18 aa, Staphylococcus epidermidis
TYHQKGIVFLMIRFKSLD

SEQ ID NO: 1796808 - protein, 34 aa, Staphylococcus epidermidis
TYNFKHAIIATGSRPIEIPNFEFGKRVIDSTGAL

SEQ ID NO: 1796809 - protein, 19 aa, Staphylococcus epidermidis
TYVDWSFVLEYMKYVNKFV

SEQ ID NO: 1796810 - protein, 23 aa, Staphylococcus epidermidis
TYYDRKAVKHWANSVVSNKNNGL

SEQ ID NO: 1796811 - protein, 20 aa, Staphylococcus epidermidis
VAAKAAGASKIFVFDLSEER

SEQ ID NO: 1796812 - protein, 23 aa, Staphylococcus epidermidis
VAKIPYDCCKDGISNTFSIVPKS

SEQ ID NO: 1796813 - protein, 26 aa, Staphylococcus epidermidis
VAKKDCNYMIGMSFNQLGAFKEALPF

SEQ ID NO: 1796814 - protein, 18 aa, Staphylococcus epidermidis
VAKRAAAKQTKWFPFVGQ

SEQ ID NO: 1796815 - protein, 19 aa, Staphylococcus epidermidis
VALDGGFDCPNRDGTVAHG

SEQ ID NO: 1796816 - protein, 17 aa, Staphylococcus epidermidis
VALDLFASKIHKYIGSY

SEQ ID NO: 1796817 - protein, 19 aa, Staphylococcus epidermidis
VARVKAILRRSQFVNEIEK

SEQ ID NO: 1796818 - protein, 26 aa, Staphylococcus epidermidis
VASCAHLLIWEGIELLPVTDNNKKAV

SEQ ID NO: 1796819 - protein, 22 aa, Staphylococcus epidermidis
VASEIMAILCLSRNIKDLKEKI

SEQ ID NO: 1796820 - protein, 24 aa, Staphylococcus epidermidis
VDDYPFGGGQGMVLKPEPVFNAME

SEQ ID NO: 1796821 - protein, 23 aa, Staphylococcus epidermidis
VDEIAVDLVERFMTKLRSHKTYR

SEQ ID NO: 1796822 - protein, 24 aa, Staphylococcus epidermidis
VDERAKAGLFLAMQYPSEITGVTN

SEQ ID NO: 1796823 - protein, 17 aa, Staphylococcus epidermidis
VDEVIGAMDRVGRNLPA

SEQ ID NO: 1796824 - protein, 17 aa, Staphylococcus epidermidis
VDFKFDYIVPKNLERVI

SEQ ID NO: 1796825 - protein, 18 aa, Staphylococcus epidermidis
VDGACYILALPEIFNKVD

SEQ ID NO: 1796826 - protein, 25 aa, Staphylococcus epidermidis
VDNVFPTKHAVGLKAENGLELLVHI

SEQ ID NO: 1796827 - protein, 25 aa, Staphylococcus epidermidis
VDQAKLNLGYRFPSYYGKSNYYAFI

SEQ ID NO: 1796828 - protein, 19 aa, Staphylococcus epidermidis
VDRHAKFVKQFADFSSGID

SEQ ID NO: 1796829 - protein, 17 aa, Staphylococcus epidermidis
VDSSGMICSMKELNLPN

SEQ ID NO: 1796830 - protein, 17 aa, Staphylococcus epidermidis
VDTPAIFMDHGEGSKIY

SEQ ID NO: 1796831 - protein, 17 aa, Staphylococcus epidermidis
VDVFDFEGSFINAIQRI

SEQ ID NO: 1796832 - protein, 25 aa, Staphylococcus epidermidis
VDVGQRGFVPASLISTDFIEDFSVF

SEQ ID NO: 1796833 - protein, 24 aa, Staphylococcus epidermidis
VEDSIRFYSQFKCVKRIHIVDLIG

SEQ ID NO: 1796834 - protein, 23 aa, Staphylococcus epidermidis
VEIKAEEGITFAVEKNTTVKVSG

SEQ ID NO: 1796835 - protein, 18 aa, Staphylococcus epidermidis
VEKGEFVAVMGPSGSGKT

SEQ ID NO: 1796836 - protein, 24 aa, Staphylococcus epidermidis
VEKYSRLRSTYCYEVYNENGELAT

SEQ ID NO: 1796837 - protein, 24 aa, Staphylococcus epidermidis
VELDKEDEVCILYGTKNGLVALPT

SEQ ID NO: 1796838 - protein, 17 aa, Staphylococcus epidermidis
VELKKLIMGNNVKQSFE

SEQ ID NO: 1796839 - protein, 22 aa, Staphylococcus epidermidis
VENIEFKMLCMGFKRKEIKKLM

SEQ ID NO: 1796840 - protein, 24 aa, Staphylococcus epidermidis
VEPERLRFDFSHFGPMTQEEINLV

SEQ ID NO: 1796841 - protein, 18 aa, Staphylococcus epidermidis
VEQLCRKYDVLLICDEVA

SEQ ID NO: 1796842 - protein, 20 aa, Staphylococcus epidermidis
VERVEGFASQNEWQRASDEI

SEQ ID NO: 1796843 - protein, 21 aa, Staphylococcus epidermidis
VETKPGVGYPKRWEDQGQYKG

SEQ ID NO: 1796844 - protein, 20 aa, Staphylococcus epidermidis
VETVLPYRPLFIKPNKDELE

SEQ ID NO: 1796845 - protein, 23 aa, Staphylococcus epidermidis
VFEHLQRYKAIIVSTQQQKADVI

SEQ ID NO: 1796846 - protein, 20 aa, Staphylococcus epidermidis
VFGIPGAKIDYLFNALEDDD

SEQ ID NO: 1796847 - protein, 19 aa, Staphylococcus epidermidis
VFGVPGDFNLAFLDDIIAH

SEQ ID NO: 1796848 - protein, 18 aa, Staphylococcus epidermidis
VFMLPKDYLRYCLTQTIH

SEQ ID NO: 1796849 - protein, 23 aa, Staphylococcus epidermidis
VFYIPNCDKITPGMLLAAVRTNV

SEQ ID NO: 1796850 - protein, 19 aa, Staphylococcus epidermidis
VGDKVMHKAWGEGMVSNVN

SEQ ID NO: 1796851 - protein, 23 aa, Staphylococcus epidermidis
VGDRQLVKVAAWYDNEMSYTAQL

SEQ ID NO: 1796852 - protein, 17 aa, Staphylococcus epidermidis
VGIGVPGPVDFDTGVVY

SEQ ID NO: 1796853 - protein, 17 aa, Staphylococcus epidermidis
VGITRSVIVNALRKLES

SEQ ID NO: 1796854 - protein, 23 aa, Staphylococcus epidermidis
VGKATKFLLALYNVFIEKDCSIV

SEQ ID NO: 1796855 - protein, 27 aa, Staphylococcus epidermidis
VGKIVLNCIHKGIYLLDVPLSEYQEHH

SEQ ID NO: 1796856 - protein, 18 aa, Staphylococcus epidermidis
VGLLPRAHGSGLFTRGQT

SEQ ID NO: 1796857 - protein, 18 aa, Staphylococcus epidermidis
VGNKMIGAKVNGKIVPID

SEQ ID NO: 1796858 - protein, 19 aa, Staphylococcus epidermidis
VGPIKLHLVPFTEIQKQIN

SEQ ID NO: 1796859 - protein, 21 aa, Staphylococcus epidermidis
VGSIVKFDVAFGLENQLVPYK

SEQ ID NO: 1796860 - protein, 24 aa, Staphylococcus epidermidis
VGTKLKLAIDYGKHDTIGIDAVAM

SEQ ID NO: 1796861 - protein, 17 aa, Staphylococcus epidermidis
VGVIRDWEAKWYAEKDF

SEQ ID NO: 1796862 - protein, 25 aa, Staphylococcus epidermidis
VGVPADQWLRVRAEYLQNRNTNETH

SEQ ID NO: 1796863 - protein, 19 aa, Staphylococcus epidermidis
VHAGGSLSTYAYQQMEDPI

SEQ ID NO: 1796864 - protein, 25 aa, Staphylococcus epidermidis
VHDTIPWPNYVHYAASKGGLKLMME

SEQ ID NO: 1796865 - protein, 18 aa, Staphylococcus epidermidis
VHQPELAIVFGRTKRRVD

SEQ ID NO: 1796866 - protein, 25 aa, Staphylococcus epidermidis
VIAGERGSGKMCLNGAASRLVEVGD

SEQ ID NO: 1796867 - protein, 20 aa, Staphylococcus epidermidis
VIAICGSLGKDYEAIYHHGI

SEQ ID NO: 1796868 - protein, 23 aa, Staphylococcus epidermidis
VIDGEFQFDAAIVPSVAEKKAPG

SEQ ID NO: 1796869 - protein, 24 aa, Staphylococcus epidermidis
VIEIPGSELVRGRGGPRCMSQPLI

SEQ ID NO: 1796870 - protein, 20 aa, Staphylococcus epidermidis
VILEYGESAPKIFRKVTDLV

SEQ ID NO: 1796871 - protein, 18 aa, Staphylococcus epidermidis
VINQCTFHSLNLKVVIFD

SEQ ID NO: 1796872 - protein, 23 aa, Staphylococcus epidermidis
VIPEMLTENFIPRTELRETTMSI

SEQ ID NO: 1796873 - protein, 25 aa, Staphylococcus epidermidis
VIREREHFTIFPASHFVTREEKMKV

SEQ ID NO: 1796874 - protein, 29 aa, Staphylococcus epidermidis
VIRKLKMIGHYIGMSFQIIDDVLDFTSSE

SEQ ID NO: 1796875 - protein, 22 aa, Staphylococcus epidermidis
VIRRELFDHYSELGLDEQDLVI

SEQ ID NO: 1796876 - protein, 24 aa, Staphylococcus epidermidis
VISKSELLEKVWGYDYYEDANTVN

SEQ ID NO: 1796877 - protein, 18 aa, Staphylococcus epidermidis
VISTHAHEKWGLNCDYDN

SEQ ID NO: 1796878 - protein, 33 aa, Staphylococcus epidermidis
VITTYDLLYRAGLNLEVDYVIRVGKPVISKKLN

SEQ ID NO: 1796879 - protein, 21 aa, Staphylococcus epidermidis
VKAGDLIKNMTPIIGGKGGGR

SEQ ID NO: 1796880 - protein, 19 aa, Staphylococcus epidermidis
VKALSMWMTLKCGIVNLPY

SEQ ID NO: 1796881 - protein, 19 aa, Staphylococcus epidermidis
VKASGGVRNLEDFNNMIEA

SEQ ID NO: 1796882 - protein, 25 aa, Staphylococcus epidermidis
VKATDLRAAAALILAGLVAEGTTQV

SEQ ID NO: 1796883 - protein, 17 aa, Staphylococcus epidermidis
VKDHKIKSIGIAHANVK

SEQ ID NO: 1796884 - protein, 25 aa, Staphylococcus epidermidis
VKDKAFQLLLELGFSRNVMSSSPFQ

SEQ ID NO: 1796885 - protein, 25 aa, Staphylococcus epidermidis
VKEGKDHFLRISIDKEGGVDLNDCT

SEQ ID NO: 1796886 - protein, 21 aa, Staphylococcus epidermidis
VKELNRLLGKVIDAFIETKEK

SEQ ID NO: 1796887 - protein, 18 aa, Staphylococcus epidermidis
VKEMLKKVDFDYEDLKIV

SEQ ID NO: 1796888 - protein, 26 aa, Staphylococcus epidermidis
VKESEGRIILFIDEIHMLVGAGKTDG

SEQ ID NO: 1796889 - protein, 23 aa, Staphylococcus epidermidis
VKFKKGINVKLFIGGTDLEKDKQ

SEQ ID NO: 1796890 - protein, 19 aa, Staphylococcus epidermidis
VKFSKARLIDNIIIGDDYI

SEQ ID NO: 1796891 - protein, 19 aa, Staphylococcus epidermidis
VKHMNPCGVGIGQSIDEAF

SEQ ID NO: 1796892 - protein, 23 aa, Staphylococcus epidermidis
VKILARGPVFKGLLTSKSVDVID

SEQ ID NO: 1796893 - protein, 36 aa, Staphylococcus epidermidis
VKISGTFKKMHVRMMPGQEPPYTRLIDSARRQPEET

SEQ ID NO: 1796894 - protein, 21 aa, Staphylococcus epidermidis
VKNLRKLESYNYELEVIAKNE

SEQ ID NO: 1796895 - protein, 21 aa, Staphylococcus epidermidis
VKPGKGSAFVRSKLRNLRTGA

SEQ ID NO: 1796896 - protein, 24 aa, Staphylococcus epidermidis
VKQREHLGGFPISGQFLRCTNPDI

SEQ ID NO: 1796897 - protein, 25 aa, Staphylococcus epidermidis
VKQRNILNLVCAWTKRLNLSDDEVY

SEQ ID NO: 1796898 - protein, 24 aa, Staphylococcus epidermidis
VKRGMAEMQKGGVIMDVVNAEQAK

SEQ ID NO: 1796899 - protein, 29 aa, Staphylococcus epidermidis
VKTVHLKLPLDWLKGKIIIDSLGLHSNNQ

SEQ ID NO: 1796900 - protein, 23 aa, Staphylococcus epidermidis
VKVSWAGICGTDLHEYLEGPIFI

SEQ ID NO: 1796901 - protein, 17 aa, Staphylococcus epidermidis
VKWRLVNSSTFMYGTKL

SEQ ID NO: 1796902 - protein, 25 aa, Staphylococcus epidermidis
VKYAESFGAKGLRVTNQEELEAALK

SEQ ID NO: 1796903 - protein, 21 aa, Staphylococcus epidermidis
VLAGFAGSVADAFTLFEKFET

SEQ ID NO: 1796904 - protein, 24 aa, Staphylococcus epidermidis
VLDPSLPIDLIIDYAHTADGMNKL

SEQ ID NO: 1796905 - protein, 23 aa, Staphylococcus epidermidis
VLEENKYVFVLKHSETCPISANA

SEQ ID NO: 1796906 - protein, 19 aa, Staphylococcus epidermidis
VLIEARVSVYERRGNYQIY

SEQ ID NO: 1796907 - protein, 23 aa, Staphylococcus epidermidis
VLPEVEGKLHGMALRVPTKNVSL

SEQ ID NO: 1796908 - protein, 17 aa, Staphylococcus epidermidis
VLQRSNYALSFSNMTFP

SEQ ID NO: 1796909 - protein, 20 aa, Staphylococcus epidermidis
VLVDEWRVGKVIIGDYTLIG

SEQ ID NO: 1796910 - protein, 26 aa, Staphylococcus epidermidis
VLWSTRLPENFKIYCAKMSIKTSSIQ

SEQ ID NO: 1796911 - protein, 18 aa, Staphylococcus epidermidis
VMAKMGISTVQSYQGAQI

SEQ ID NO: 1796912 - protein, 25 aa, Staphylococcus epidermidis
VMGRDCGDLALWAGLSVGAETIVLP

SEQ ID NO: 1796913 - protein, 18 aa, Staphylococcus epidermidis
VMIVWSPPWNKDMMSRYA

SEQ ID NO: 1796914 - protein, 19 aa, Staphylococcus epidermidis
VMPGFDFYFIPTVMNSKDT

SEQ ID NO: 1796915 - protein, 20 aa, Staphylococcus epidermidis
VMSKIAFAVSEHVKIETGNP

SEQ ID NO: 1796916 - protein, 18 aa, Staphylococcus epidermidis
VNAALHYLARLIEAGDLP

SEQ ID NO: 1796917 - protein, 24 aa, Staphylococcus epidermidis
VNCVAPGPFWSPLQIVGGQPQSAI

SEQ ID NO: 1796918 - protein, 21 aa, Staphylococcus epidermidis
VNEEFKLVGIVTSREIINMNE

SEQ ID NO: 1796919 - protein, 19 aa, Staphylococcus epidermidis
VNGLYHFMVSNLIESRLDI

SEQ ID NO: 1796920 - protein, 18 aa, Staphylococcus epidermidis
VNHPRLILQSNIQTQALR

SEQ ID NO: 1796921 - protein, 24 aa, Staphylococcus epidermidis
VNKLHLPQGFNIRVDSLLYTGYQV

SEQ ID NO: 1796922 - protein, 24 aa, Staphylococcus epidermidis
VNMFSNYVNFQFDLPIADGSEHTI

SEQ ID NO: 1796923 - protein, 25 aa, Staphylococcus epidermidis
VNPDEVVAMGAAIQAGVITGDVKDV

SEQ ID NO: 1796924 - protein, 19 aa, Staphylococcus epidermidis
VNVGGVFWGIQAAIEQFDK

SEQ ID NO: 1796925 - protein, 18 aa, Staphylococcus epidermidis
VPAGDGWDSNPFQPVVTD

SEQ ID NO: 1796926 - protein, 33 aa, Staphylococcus epidermidis
VPDTLRVASLLAHELYEFPSHQLTTYGVTGTNG

SEQ ID NO: 1796927 - protein, 25 aa, Staphylococcus epidermidis
VPEKLWPIQPLRDFWGINKRTEKKL

SEQ ID NO: 1796928 - protein, 26 aa, Staphylococcus epidermidis
VPETEVINVFPIRFVVDKDNEVSDPK

SEQ ID NO: 1796929 - protein, 18 aa, Staphylococcus epidermidis
VPNKLVVVGGGYIGSELG

SEQ ID NO: 1796930 - protein, 17 aa, Staphylococcus epidermidis
VPSKAWLKETIKQIPDD

SEQ ID NO: 1796931 - protein, 21 aa, Staphylococcus epidermidis
VPVYLGMPMGIIVEAEGKTIY

SEQ ID NO: 1796932 - protein, 18 aa, Staphylococcus epidermidis
VQFYLVEDVFVFDHYKDE

SEQ ID NO: 1796933 - protein, 21 aa, Staphylococcus epidermidis
VQIYLCIEGSGSERALMMQQF

SEQ ID NO: 1796934 - protein, 20 aa, Staphylococcus epidermidis
VQSCKDCFLETTQLQHSNFQ

SEQ ID NO: 1796935 - protein, 17 aa, Staphylococcus epidermidis
VRAGKLFNIPVSGTHAH

SEQ ID NO: 1796936 - protein, 23 aa, Staphylococcus epidermidis
VRDGHIKAWVNIMYGCDKFCTYC

SEQ ID NO: 1796937 - protein, 18 aa, Staphylococcus epidermidis
VRGRGLFIGIELHESARP

SEQ ID NO: 1796938 - protein, 22 aa, Staphylococcus epidermidis
VRRYFEYKGYEVIYVSNFTDVD

SEQ ID NO: 1796939 - protein, 20 aa, Staphylococcus epidermidis
VRSSHQYKLLIILSPSGAYY

SEQ ID NO: 1796940 - protein, 20 aa, Staphylococcus epidermidis
VRTILKRNVRNVPVVDNDEH

SEQ ID NO: 1796941 - protein, 20 aa, Staphylococcus epidermidis
VRTILKRNVRNVPVVDSDNK

SEQ ID NO: 1796942 - protein, 27 aa, Staphylococcus epidermidis
VSAKEGLRLKTLFPYINQASENHKKRV

SEQ ID NO: 1796943 - protein, 22 aa, Staphylococcus epidermidis
VSCPLEQGLEIFVGVPSERYPS

SEQ ID NO: 1796944 - protein, 25 aa, Staphylococcus epidermidis
VSDDFKNHMLVAVTELRSKDEIDDF

SEQ ID NO: 1796945 - protein, 19 aa, Staphylococcus epidermidis
VSDMLVFKGKFKMYYTSED

SEQ ID NO: 1796946 - protein, 23 aa, Staphylococcus epidermidis
VSEDAKFGKFVVEPLERGYGTTL

SEQ ID NO: 1796947 - protein, 25 aa, Staphylococcus epidermidis
VSERIGRLFDITGLKDLMHVNEGTE

SEQ ID NO: 1796948 - protein, 24 aa, Staphylococcus epidermidis
VSEVKRLKSDPSFYGDFLDQSHAC

SEQ ID NO: 1796949 - protein, 17 aa, Staphylococcus epidermidis
VSGRGGTNFVDIENERR

SEQ ID NO: 1796950 - protein, 17 aa, Staphylococcus epidermidis
VSGVKHAYVDREKAKSK

SEQ ID NO: 1796951 - protein, 25 aa, Staphylococcus epidermidis
VSIRFSVNQSVHFEVLLVKLAEMIK

SEQ ID NO: 1796952 - protein, 17 aa, Staphylococcus epidermidis
VSKKLGNAVTRNRIKRA

SEQ ID NO: 1796953 - protein, 26 aa, Staphylococcus epidermidis
VSLIRLTLSGVFSRAGASYDDIEDSK

SEQ ID NO: 1796954 - protein, 17 aa, Staphylococcus epidermidis
VSLNYQKVQEFKTSVVN

SEQ ID NO: 1796955 - protein, 17 aa, Staphylococcus epidermidis
VSPRPIPGVKGGIHHVT

SEQ ID NO: 1796956 - protein, 20 aa, Staphylococcus epidermidis
VSSSDWKVGDKVMHKAWGEG

SEQ ID NO: 1796957 - protein, 22 aa, Staphylococcus epidermidis
VSVATFTLAVNRTFTNAQGERE

SEQ ID NO: 1796958 - protein, 20 aa, Staphylococcus epidermidis
VSVLRAPKTFTREDIIEINC

SEQ ID NO: 1796959 - protein, 22 aa, Staphylococcus epidermidis
VTAARMGWLPSYPQFNKNSLLF

SEQ ID NO: 1796960 - protein, 18 aa, Staphylococcus epidermidis
VTCHKDKPGIVGQTGNLL

SEQ ID NO: 1796961 - protein, 25 aa, Staphylococcus epidermidis
VTEELNRRLGWEIKAPRDFEFEHNG

SEQ ID NO: 1796962 - protein, 24 aa, Staphylococcus epidermidis
VTEPSYKDNINWGDINQPMDEETF

SEQ ID NO: 1796963 - protein, 19 aa, Staphylococcus epidermidis
VTFIFGKRRRLKWVNQLLN

SEQ ID NO: 1796964 - protein, 25 aa, Staphylococcus epidermidis
VTFLKRPPSAWVVLAKPNIGISSPD

SEQ ID NO: 1796965 - protein, 18 aa, Staphylococcus epidermidis
VTGIGPKSALAILASSTP

SEQ ID NO: 1796966 - protein, 18 aa, Staphylococcus epidermidis
VTGVSLGGLFTLRLAEHF

SEQ ID NO: 1796967 - protein, 31 aa, Staphylococcus epidermidis
VTGYDIIFFWVARMIFQGLEFTDRRPFNDVL

SEQ ID NO: 1796968 - protein, 18 aa, Staphylococcus epidermidis
VTIADNFNVELPKYGKSY

SEQ ID NO: 1796969 - protein, 19 aa, Staphylococcus epidermidis
VTILKRKLNDMNEINIAHV

SEQ ID NO: 1796970 - protein, 21 aa, Staphylococcus epidermidis
VTQSKCLVLFTSYKMMHMVQD

SEQ ID NO: 1796971 - protein, 18 aa, Staphylococcus epidermidis
VTTPEVFDLIAQTTPLRK

SEQ ID NO: 1796972 - protein, 22 aa, Staphylococcus epidermidis
VTVYWHHFLRPEVKFDGIDPLV

SEQ ID NO: 1796973 - protein, 17 aa, Staphylococcus epidermidis
VTYEFQYSFGMPDYEVI

SEQ ID NO: 1796974 - protein, 17 aa, Staphylococcus epidermidis
VVARGMGKCCVTGCSNV

SEQ ID NO: 1796975 - protein, 32 aa, Staphylococcus epidermidis
VVGDSDQSIYGWRGADIQNILSFEEDYPEAKT

SEQ ID NO: 1796976 - protein, 22 aa, Staphylococcus epidermidis
VVKPLLKYAKHRGIYVQMNSNL

SEQ ID NO: 1796977 - protein, 23 aa, Staphylococcus epidermidis
VVMKEGHGAYLYDVDGNKYIDYL

SEQ ID NO: 1796978 - protein, 20 aa, Staphylococcus epidermidis
VVNMIQDVYKDFGFEDYRFR

SEQ ID NO: 1796979 - protein, 26 aa, Staphylococcus epidermidis
VVPSRNEGFGMIILEAMVQDNIVISF

SEQ ID NO: 1796980 - protein, 24 aa, Staphylococcus epidermidis
VVSSGLHYQALQILHTYAKTRDEF

SEQ ID NO: 1796981 - protein, 20 aa, Staphylococcus epidermidis
VVVETCGIGYEIQTPNSYRF

SEQ ID NO: 1796982 - protein, 21 aa, Staphylococcus epidermidis
VWIAMALAQRTDIIFLDEPTT

SEQ ID NO: 1796983 - protein, 18 aa, Staphylococcus epidermidis
VYECKYLTVATGYYGQHN

SEQ ID NO: 1796984 - protein, 25 aa, Staphylococcus epidermidis
VYHAIKPDIFFFLPSYMAPLKHHNT

SEQ ID NO: 1796985 - protein, 19 aa, Staphylococcus epidermidis
VYKDFGFEDYRFRLSYRDP

SEQ ID NO: 1796986 - protein, 26 aa, Staphylococcus epidermidis
VYLKREDLQWVRSFKLRGAYNAISVL

SEQ ID NO: 1796987 - protein, 17 aa, Staphylococcus epidermidis
VYRGMGSLGAMEKGSND

SEQ ID NO: 1796988 - protein, 24 aa, Staphylococcus epidermidis
VYRKIRNTLRFMLGNINDFNPETD

SEQ ID NO: 1796989 - protein, 24 aa, Staphylococcus epidermidis
VYSVACPGFVPLVEQMRYKDPTIT

SEQ ID NO: 1796990 - protein, 20 aa, Staphylococcus epidermidis
VYTDLLFLYLEHAFLSQNFF

SEQ ID NO: 1796991 - protein, 32 aa, Staphylococcus epidermidis
WAEPEGMDTWDFAHCLPYFKKLETTYGAAPYD

SEQ ID NO: 1796992 - protein, 21 aa, Staphylococcus epidermidis
WAGKFLKSLNAFPVDRENPGP

SEQ ID NO: 1796993 - protein, 19 aa, Staphylococcus epidermidis
WDREERAYNAIRNFEGPTF

SEQ ID NO: 1796994 - protein, 32 aa, Staphylococcus epidermidis
WENEWKNYFHPFRASKQFTIVPSWESYVKEND

SEQ ID NO: 1796995 - protein, 20 aa, Staphylococcus epidermidis
WFEKEAKELLPEGFSHPGSP

SEQ ID NO: 1796996 - protein, 17 aa, Staphylococcus epidermidis
WFIQGRIDFQIKLNGYR

SEQ ID NO: 1796997 - protein, 17 aa, Staphylococcus epidermidis
WFKDVLDGYDYLVDQGY

SEQ ID NO: 1796998 - protein, 20 aa, Staphylococcus epidermidis
WGELDYLLLDLPPGTGDVAL

SEQ ID NO: 1796999 - protein, 19 aa, Staphylococcus epidermidis
WGLDALKFLIEERGVKSIG

SEQ ID NO: 1797000 - protein, 30 aa, Staphylococcus epidermidis
WGYAHLQMAPKHWLCIQENDLVWATAAPGW

SEQ ID NO: 1797001 - protein, 18 aa, Staphylococcus epidermidis
WHAVGAFKTVGFSRTGKK

SEQ ID NO: 1797002 - protein, 18 aa, Staphylococcus epidermidis
WHDMKIVPYAPFEISPAA

SEQ ID NO: 1797003 - protein, 36 aa, Staphylococcus epidermidis
WHGLPLTDAFLFSRGHFKGNQFPEGVNALSPQIIIG

SEQ ID NO: 1797004 - protein, 26 aa, Staphylococcus epidermidis
WIHPDERSAAFFALGLIKGSEKPVAI

SEQ ID NO: 1797005 - protein, 27 aa, Staphylococcus epidermidis
WKIAPALATGCSLVMKPSEITPLTTIR

SEQ ID NO: 1797006 - protein, 19 aa, Staphylococcus epidermidis
WLASGPRAGLAEISIPENE

SEQ ID NO: 1797007 - protein, 17 aa, Staphylococcus epidermidis
WLESAGIDPKRRGETLT

SEQ ID NO: 1797008 - protein, 18 aa, Staphylococcus epidermidis
WLMDAGLTQPFSLEKILL

SEQ ID NO: 1797009 - protein, 23 aa, Staphylococcus epidermidis
WLRCDIKSLNLLGNVLAKEYAVK

SEQ ID NO: 1797010 - protein, 27 aa, Staphylococcus epidermidis
WNSPFGKGRPGWHIECSVMAYHELGST

SEQ ID NO: 1797011 - protein, 18 aa, Staphylococcus epidermidis
WRQPFPGPGLGIRVLGEI

SEQ ID NO: 1797012 - protein, 26 aa, Staphylococcus epidermidis
WTISRQLWWGHQIPAWYHKDTGEVFV

SEQ ID NO: 1797013 - protein, 19 aa, Staphylococcus epidermidis
WVEAIRVARNILKQKAMDP

SEQ ID NO: 1797014 - protein, 19 aa, Staphylococcus epidermidis
WVQEYAPILYQIWKKKHKK

SEQ ID NO: 1797015 - protein, 22 aa, Staphylococcus epidermidis
WVTESIGGVGIDGRPMVTKNSF

SEQ ID NO: 1797016 - protein, 26 aa, Staphylococcus epidermidis
WVVAGRGELHLSILIENMRREGFELQ

SEQ ID NO: 1797017 - protein, 18 aa, Staphylococcus epidermidis
YADKEIFNDLNLSISEHE

SEQ ID NO: 1797018 - protein, 23 aa, Staphylococcus epidermidis
YADRLKGIIKKEFSISFEEFAVL

SEQ ID NO: 1797019 - protein, 19 aa, Staphylococcus epidermidis
YAHARICSILKQAKEQGIE

SEQ ID NO: 1797020 - protein, 19 aa, Staphylococcus epidermidis
YAKAEIVTIAMEHMNFDAH

SEQ ID NO: 1797021 - protein, 18 aa, Staphylococcus epidermidis
YAKCGGCQLQHMTYRAQL

SEQ ID NO: 1797022 - protein, 19 aa, Staphylococcus epidermidis
YAKELNLKSKEIIDELKSM

SEQ ID NO: 1797023 - protein, 22 aa, Staphylococcus epidermidis
YASLNEFAEWMVSLNKTGTGKE

SEQ ID NO: 1797024 - protein, 17 aa, Staphylococcus epidermidis
YATLGLVHTLWKPMPGR

SEQ ID NO: 1797025 - protein, 17 aa, Staphylococcus epidermidis
YAVSIGFEVKVNVVIQK

SEQ ID NO: 1797026 - protein, 18 aa, Staphylococcus epidermidis
YCKHEFVLSGTLQKQYGV

SEQ ID NO: 1797027 - protein, 19 aa, Staphylococcus epidermidis
YDANHRWSVQYEAKSTKKT

SEQ ID NO: 1797028 - protein, 18 aa, Staphylococcus epidermidis
YDDLKFYESFILQSHEKL

SEQ ID NO: 1797029 - protein, 19 aa, Staphylococcus epidermidis
YDETGEWLPQETLETIKEY

SEQ ID NO: 1797030 - protein, 18 aa, Staphylococcus epidermidis
YDFDILVVALGFVSETFG

SEQ ID NO: 1797031 - protein, 21 aa, Staphylococcus epidermidis
YDFRPHYALVGKIIHHFNSAT

SEQ ID NO: 1797032 - protein, 25 aa, Staphylococcus epidermidis
YDIIDEFKSLGGYEYEDIENRIVQF

SEQ ID NO: 1797033 - protein, 17 aa, Staphylococcus epidermidis
YDLASVGRYKANKKLHL

SEQ ID NO: 1797034 - protein, 23 aa, Staphylococcus epidermidis
YDLGHFRGAIRPDITRFRDLPEW

SEQ ID NO: 1797035 - protein, 18 aa, Staphylococcus epidermidis
YDRSRNKLVGTIEVPMTL

SEQ ID NO: 1797036 - protein, 25 aa, Staphylococcus epidermidis
YDVVIGLRPGRSFNKAKEDGFDVYT

SEQ ID NO: 1797037 - protein, 17 aa, Staphylococcus epidermidis
YDYTKFEGEHGAKRSAA

SEQ ID NO: 1797038 - protein, 27 aa, Staphylococcus epidermidis
YEAAARKLIPVTLELGGKSPVIVDDTA

SEQ ID NO: 1797039 - protein, 22 aa, Staphylococcus epidermidis
YEAAKLLLKLGANVKVNDGKDL

SEQ ID NO: 1797040 - protein, 23 aa, Staphylococcus epidermidis
YEFKMYPKDFIPFFEGTMTIEQY

SEQ ID NO: 1797041 - protein, 18 aa, Staphylococcus epidermidis
YEKLSIATLAVRNGAKFI

SEQ ID NO: 1797042 - protein, 25 aa, Staphylococcus epidermidis
YELSKCMTCGVCLEVCPNVTKNNKF

SEQ ID NO: 1797043 - protein, 18 aa, Staphylococcus epidermidis
YENIPLWHERDISHSSAE

SEQ ID NO: 1797044 - protein, 19 aa, Staphylococcus epidermidis
YEVNKSSLVKRIDELRADK

SEQ ID NO: 1797045 - protein, 18 aa, Staphylococcus epidermidis
YFDLNCYLTLLDVLDSHH

SEQ ID NO: 1797046 - protein, 26 aa, Staphylococcus epidermidis
YFESEGFKVIGYRDVPVDTRAIAQHV

SEQ ID NO: 1797047 - protein, 25 aa, Staphylococcus epidermidis
YFGGIKLGAGGLIRAYSGAVRDVIY

SEQ ID NO: 1797048 - protein, 20 aa, Staphylococcus epidermidis
YFTSLSHRTIVYKGWLRSDQ

SEQ ID NO: 1797049 - protein, 22 aa, Staphylococcus epidermidis
YGGEFQLKQGFSPAFTVENKDA

SEQ ID NO: 1797050 - protein, 20 aa, Staphylococcus epidermidis
YGHMSPYMIVGMIGAIKSGC

SEQ ID NO: 1797051 - protein, 23 aa, Staphylococcus epidermidis
YGINLRPLLTLAEKYYDAENPAF

SEQ ID NO: 1797052 - protein, 25 aa, Staphylococcus epidermidis
YGIPHGRTNAILLPHVIRYNAKDPQ

SEQ ID NO: 1797053 - protein, 18 aa, Staphylococcus epidermidis
YGKEILKKGAQSVIISLG

SEQ ID NO: 1797054 - protein, 17 aa, Staphylococcus epidermidis
YGKFKGDLSEIVKDFLI

SEQ ID NO: 1797055 - protein, 18 aa, Staphylococcus epidermidis
YGLDPEKRFNVPEDVYEI

SEQ ID NO: 1797056 - protein, 17 aa, Staphylococcus epidermidis
YGTLGRVTYGYGNNDND

SEQ ID NO: 1797057 - protein, 17 aa, Staphylococcus epidermidis
YGYETTLSSNFKMNILI

SEQ ID NO: 1797058 - protein, 17 aa, Staphylococcus epidermidis
YHPDYAIMTNIDFDHPD

SEQ ID NO: 1797059 - protein, 19 aa, Staphylococcus epidermidis
YHPEARPGPSDSNYLFDEF

SEQ ID NO: 1797060 - protein, 17 aa, Staphylococcus epidermidis
YHQQFGLTQARYDKLKE

SEQ ID NO: 1797061 - protein, 17 aa, Staphylococcus epidermidis
YHTDEMMVIFVTNGATF

SEQ ID NO: 1797062 - protein, 29 aa, Staphylococcus epidermidis
YHTLLTIGRFPICYINIQMDPILVDVNVH

SEQ ID NO: 1797063 - protein, 25 aa, Staphylococcus epidermidis
YHVMKRISVLEAMLPSAIKAKYKKA

SEQ ID NO: 1797064 - protein, 20 aa, Staphylococcus epidermidis
YIKDGFIVFNGIRIINTKDL

SEQ ID NO: 1797065 - protein, 23 aa, Staphylococcus epidermidis
YIKKEPYGTVLIIGPFNYPVQLV

SEQ ID NO: 1797066 - protein, 21 aa, Staphylococcus epidermidis
YIKRLPVSTYRSQNRGGRGIQ

SEQ ID NO: 1797067 - protein, 19 aa, Staphylococcus epidermidis
YILALPEIFNKVDVFESDL

SEQ ID NO: 1797068 - protein, 26 aa, Staphylococcus epidermidis
YILFTQGCLLRCLYCHNPDTWKINEP

SEQ ID NO: 1797069 - protein, 21 aa, Staphylococcus epidermidis
YINYCRKRHSVLEPTLSAMYQ

SEQ ID NO: 1797070 - protein, 22 aa, Staphylococcus epidermidis
YIYFTPIGGWWNQVMLSQKVTI

SEQ ID NO: 1797071 - protein, 23 aa, Staphylococcus epidermidis
YKFFKEELILFTYLHLANEQKLT

SEQ ID NO: 1797072 - protein, 23 aa, Staphylococcus epidermidis
YKKARSGEIPEFTGISAPYQAPE

SEQ ID NO: 1797073 - protein, 22 aa, Staphylococcus epidermidis
YKLDFPESVVSFFKGDIGQPVN

SEQ ID NO: 1797074 - protein, 20 aa, Staphylococcus epidermidis
YKLESLFNIINACAETDYKL

SEQ ID NO: 1797075 - protein, 29 aa, Staphylococcus epidermidis
YKMPKKMRRLALRSALSFKVQENSFTIVD

SEQ ID NO: 1797076 - protein, 24 aa, Staphylococcus epidermidis
YKNERHLAALSFLTFVALDSDGKP

SEQ ID NO: 1797077 - protein, 20 aa, Staphylococcus epidermidis
YKRHPMIKLMNAMQYDASGI

SEQ ID NO: 1797078 - protein, 19 aa, Staphylococcus epidermidis
YKTMQGFYAPYVPGWDTHG

SEQ ID NO: 1797079 - protein, 20 aa, Staphylococcus epidermidis
YLDGYASLWVNVHGHQHKKL

SEQ ID NO: 1797080 - protein, 17 aa, Staphylococcus epidermidis
YLEDAVHSFKLATSSVH

SEQ ID NO: 1797081 - protein, 32 aa, Staphylococcus epidermidis
YLEGEYGCSDICFGVPTIIGYQGIEKIIEVDM

SEQ ID NO: 1797082 - protein, 17 aa, Staphylococcus epidermidis
YLEHAFLSQNFFNIPSI

SEQ ID NO: 1797083 - protein, 18 aa, Staphylococcus epidermidis
YLEHGYHVIMDIPLLYEN

SEQ ID NO: 1797084 - protein, 18 aa, Staphylococcus epidermidis
YLENLGIDVIWLSPMYPS

SEQ ID NO: 1797085 - protein, 17 aa, Staphylococcus epidermidis
YLFNYFVKHNPMIESYF

SEQ ID NO: 1797086 - protein, 20 aa, Staphylococcus epidermidis
YLKKHNCLYVLVDPYVLENL

SEQ ID NO: 1797087 - protein, 25 aa, Staphylococcus epidermidis
YLKPALRLSSIMGLNSTFIFTHDSI

SEQ ID NO: 1797088 - protein, 17 aa, Staphylococcus epidermidis
YLLPTRSDLADFLYHAN

SEQ ID NO: 1797089 - protein, 18 aa, Staphylococcus epidermidis
YLNPRASKFLDDYNEFDK

SEQ ID NO: 1797090 - protein, 18 aa, Staphylococcus epidermidis
YLRSLAHNIDPTFQIGKG

SEQ ID NO: 1797091 - protein, 20 aa, Staphylococcus epidermidis
YLSICAADLRYYCGNRDSKI

SEQ ID NO: 1797092 - protein, 25 aa, Staphylococcus epidermidis
YLVDRVIPMIPHRLSNGICSLNPEE

SEQ ID NO: 1797093 - protein, 24 aa, Staphylococcus epidermidis
YLVQESYDAMAIVEQCRKANLPCY

SEQ ID NO: 1797094 - protein, 17 aa, Staphylococcus epidermidis
YLYIKKDVVHYINVDHI

SEQ ID NO: 1797095 - protein, 22 aa, Staphylococcus epidermidis
YMFKQEPYRYIATGQLEQIPQV

SEQ ID NO: 1797096 - protein, 17 aa, Staphylococcus epidermidis
YMKKLKYPLSIIKQLHF

SEQ ID NO: 1797097 - protein, 19 aa, Staphylococcus epidermidis
YMSKICSYAQGFAQMRKAS

SEQ ID NO: 1797098 - protein, 21 aa, Staphylococcus epidermidis
YNLTYPQFLVLTILWDESPVN

SEQ ID NO: 1797099 - protein, 24 aa, Staphylococcus epidermidis
YNNKEIKSYVIVPAISQEINEFIF

SEQ ID NO: 1797100 - protein, 24 aa, Staphylococcus epidermidis
YNPYSNTLIASWFWSHRPKHIEQA

SEQ ID NO: 1797101 - protein, 28 aa, Staphylococcus epidermidis
YNRFKHYKDRVLVPLAYINFDEYIEELN

SEQ ID NO: 1797102 - protein, 17 aa, Staphylococcus epidermidis
YPEIVFVGNHLSSSYTK

SEQ ID NO: 1797103 - protein, 26 aa, Staphylococcus epidermidis
YPEKGVRLKAYFNEFTYNENLKSNIN

SEQ ID NO: 1797104 - protein, 26 aa, Staphylococcus epidermidis
YPFKELPFYEIGWRLIPEVWGNGLAT

SEQ ID NO: 1797105 - protein, 17 aa, Staphylococcus epidermidis
YPHRLALVFEDRHLTYG

SEQ ID NO: 1797106 - protein, 25 aa, Staphylococcus epidermidis
YPMNWPVGMGQNFFGIIDRHSKTIE

SEQ ID NO: 1797107 - protein, 17 aa, Staphylococcus epidermidis
YPNYNRIMLSNILQKKM

SEQ ID NO: 1797108 - protein, 20 aa, Staphylococcus epidermidis
YPSKEAIGLLEETIEYLNIE

SEQ ID NO: 1797109 - protein, 25 aa, Staphylococcus epidermidis
YPSLCKEMYDYPYVIFYKGNPQFFN

SEQ ID NO: 1797110 - protein, 28 aa, Staphylococcus epidermidis
YPTDKEGWAHCLTIPRVLTIENGKLKQR

SEQ ID NO: 1797111 - protein, 22 aa, Staphylococcus epidermidis
YPTLLKRVCEVYKINMDKPYKK

SEQ ID NO: 1797112 - protein, 19 aa, Staphylococcus epidermidis
YPVQLVFEPLIGAIAAGNT

SEQ ID NO: 1797113 - protein, 25 aa, Staphylococcus epidermidis
YPYHYLKRDFGVLGIDMHLHANGID

SEQ ID NO: 1797114 - protein, 24 aa, Staphylococcus epidermidis
YQFVLEPSYSFSIITSATQQPDLF

SEQ ID NO: 1797115 - protein, 17 aa, Staphylococcus epidermidis
YQGNQFLGFQIQQQGRT

SEQ ID NO: 1797116 - protein, 24 aa, Staphylococcus epidermidis
YQNKRPDYINAFWNVVNWEKVNEL

SEQ ID NO: 1797117 - protein, 18 aa, Staphylococcus epidermidis
YQPWPTFDESLLVDDEVE

SEQ ID NO: 1797118 - protein, 20 aa, Staphylococcus epidermidis
YRAQLDMKREQVVNLFHRKG

SEQ ID NO: 1797119 - protein, 26 aa, Staphylococcus epidermidis
YREGFHICKGELFGKHRHGEDCLLCL

SEQ ID NO: 1797120 - protein, 21 aa, Staphylococcus epidermidis
YRGNSKYLFNYFVKHNPMIES

SEQ ID NO: 1797121 - protein, 18 aa, Staphylococcus epidermidis
YRIFPSYTGVGLAFESME

SEQ ID NO: 1797122 - protein, 29 aa, Staphylococcus epidermidis
YRKMLEFYHPEFKKEYVVLAEEGAQSDDE

SEQ ID NO: 1797123 - protein, 25 aa, Staphylococcus epidermidis
YRKYPEVLNQLALLKGKEFEINTIE

SEQ ID NO: 1797124 - protein, 18 aa, Staphylococcus epidermidis
YRTLELLAEIKVLDKINF

SEQ ID NO: 1797125 - protein, 20 aa, Staphylococcus epidermidis
YSGEAMFRIVRAVEQSATHW

SEQ ID NO: 1797126 - protein, 18 aa, Staphylococcus epidermidis
YSKATRGNIDVNLNVEVV

SEQ ID NO: 1797127 - protein, 25 aa, Staphylococcus epidermidis
YSKVYPKFILGFGGIKKEELEDHVN

SEQ ID NO: 1797128 - protein, 20 aa, Staphylococcus epidermidis
YSLGFGDPYPISGSHGLGLG

SEQ ID NO: 1797129 - protein, 21 aa, Staphylococcus epidermidis
YSSFISYHIFFETLLRKYNEY

SEQ ID NO: 1797130 - protein, 23 aa, Staphylococcus epidermidis
YSSGMRAKLGFSINITVNPDILV

SEQ ID NO: 1797131 - protein, 24 aa, Staphylococcus epidermidis
YSSSLPSYHLYFIQVSLQHVIEDT

SEQ ID NO: 1797132 - protein, 20 aa, Staphylococcus epidermidis
YSSYFGYHAIHRFKNDFENK

SEQ ID NO: 1797133 - protein, 18 aa, Staphylococcus epidermidis
YTDYLKEYGLTYTGYIVL

SEQ ID NO: 1797134 - protein, 25 aa, Staphylococcus epidermidis
YTEDPKRDLAIYIDIAERAGQKADV

SEQ ID NO: 1797135 - protein, 18 aa, Staphylococcus epidermidis
YTKSKFYSEIKVLEAVNE

SEQ ID NO: 1797136 - protein, 26 aa, Staphylococcus epidermidis
YTLLKCKQPGLFGSQIKWNFTKFVVD

SEQ ID NO: 1797137 - protein, 18 aa, Staphylococcus epidermidis
YVELGVLYPLSYYDGDWY

SEQ ID NO: 1797138 - protein, 20 aa, Staphylococcus epidermidis
YVGLKTGRDGIHGATFASEE

SEQ ID NO: 1797139 - protein, 29 aa, Staphylococcus epidermidis
YVGRIGVGRVFRGKMRVGDNVSLIKLDGT

SEQ ID NO: 1797140 - protein, 20 aa, Staphylococcus epidermidis
YVIRVGKPVISKKLNQWLKK

SEQ ID NO: 1797141 - protein, 18 aa, Staphylococcus epidermidis
YVKEAYELGKYMAEQGYE

SEQ ID NO: 1797142 - protein, 18 aa, Staphylococcus epidermidis
YVPSLKLSNYEANQSELI

SEQ ID NO: 1797143 - protein, 23 aa, Staphylococcus epidermidis
YVRGGCSPIGMKHSFKTTIDASA

SEQ ID NO: 1797144 - protein, 34 aa, Staphylococcus epidermidis
YVSRSHPGLLKRLFEQEVPEIYDGTVIVKSVARE

SEQ ID NO: 1797145 - protein, 20 aa, Staphylococcus epidermidis
YVSVLCAGTSDLPIAEEAAL

SEQ ID NO: 1797146 - protein, 24 aa, Staphylococcus epidermidis
YWDSEARGAIFGLSRGTEKEHFIR

SEQ ID NO: 1797147 - protein, 26 aa, Staphylococcus epidermidis
YYLNDCKYFGLDFVDFEDWVKNINLY

SEQ ID NO: 1797148 - protein, 20 aa, Staphylococcus epidermidis
YYLTNGSCWCVQAYQNHKLT

SEQ ID NO: 1797149 - protein, 20 aa, Staphylococcus epidermidis
YYQFRAGDASAIIVESCFVE

SEQ ID NO: 1797150 - protein, 18 aa, Staphylococcus epidermidis
AATELFQFAIDLANEHDI

SEQ ID NO: 1797151 - protein, 17 aa, Staphylococcus epidermidis
AAYKHFEAGHGKKGAQH

SEQ ID NO: 1797152 - protein, 19 aa, Staphylococcus epidermidis
ADAATLIFENFEILEARNQ

SEQ ID NO: 1797153 - protein, 19 aa, Staphylococcus epidermidis
ADCYLEPSLSASLKIINRF

SEQ ID NO: 1797154 - protein, 22 aa, Staphylococcus epidermidis
ADGKSPMSVIYQFKVNNQTFKI

SEQ ID NO: 1797155 - protein, 17 aa, Staphylococcus epidermidis
ADGKYLFGLSGNPSACY

SEQ ID NO: 1797156 - protein, 21 aa, Staphylococcus epidermidis
ADLTIGLILSVARRIVEGDHL

SEQ ID NO: 1797157 - protein, 24 aa, Staphylococcus epidermidis
ADPTLKYFKNYRHMMIQPQQLAKQ

SEQ ID NO: 1797158 - protein, 20 aa, Staphylococcus epidermidis
ADQYYLYLYDWRVIESESNE

SEQ ID NO: 1797159 - protein, 25 aa, Staphylococcus epidermidis
ADVKRPGEDITVFCYGLMVNYCLQA

SEQ ID NO: 1797160 - protein, 18 aa, Staphylococcus epidermidis
AEAAEYFSAELFKRDIPN

SEQ ID NO: 1797161 - protein, 17 aa, Staphylococcus epidermidis
AEAHSSIIVNEKIYSQI

SEQ ID NO: 1797162 - protein, 17 aa, Staphylococcus epidermidis
AEALGLDGKEEISVDIN

SEQ ID NO: 1797163 - protein, 20 aa, Staphylococcus epidermidis
AEGYSLVGCMCQPGFEYEHF

SEQ ID NO: 1797164 - protein, 21 aa, Staphylococcus epidermidis
AEIAYHQSLLPQFVTPNGETS

SEQ ID NO: 1797165 - protein, 21 aa, Staphylococcus epidermidis
AEILKGIPIAHFDVQSELTTP

SEQ ID NO: 1797166 - protein, 25 aa, Staphylococcus epidermidis
AEKGHPVTIISVFRGADSPYFELHS

SEQ ID NO: 1797167 - protein, 17 aa, Staphylococcus epidermidis
AEQAGIEGLDEFLTGPT

SEQ ID NO: 1797168 - protein, 17 aa, Staphylococcus epidermidis
AERLVIHGFLDPVVREL

SEQ ID NO: 1797169 - protein, 21 aa, Staphylococcus epidermidis
AEYALKVTLRREHFIKELETL

SEQ ID NO: 1797170 - protein, 17 aa, Staphylococcus epidermidis
AFADGKYLFGLSGNPSA

SEQ ID NO: 1797171 - protein, 24 aa, Staphylococcus epidermidis
AFEIDQRLIPVLKDTLSPYDNVTI

SEQ ID NO: 1797172 - protein, 30 aa, Staphylococcus epidermidis
AFLTRDQHRLYKLIWERFVASQMAPAILDT

SEQ ID NO: 1797173 - protein, 19 aa, Staphylococcus epidermidis
AGDASAIIVESCFVENHGR

SEQ ID NO: 1797174 - protein, 28 aa, Staphylococcus epidermidis
AGKLPWGDLDIDVVLECTGFYTDKEKAQ

SEQ ID NO: 1797175 - protein, 24 aa, Staphylococcus epidermidis
AGRLCKDYQQIWGLSQDVQVSPFI

SEQ ID NO: 1797176 - protein, 20 aa, Staphylococcus epidermidis
AGSIPREDVATVLKEVVTSD

SEQ ID NO: 1797177 - protein, 17 aa, Staphylococcus epidermidis
AHEKWGLNCDYDNNKAR

SEQ ID NO: 1797178 - protein, 20 aa, Staphylococcus epidermidis
AHGGLHPYAATFFVFSDYLK

SEQ ID NO: 1797179 - protein, 19 aa, Staphylococcus epidermidis
AIARAICMQPDYILFDEAI

SEQ ID NO: 1797180 - protein, 29 aa, Staphylococcus epidermidis
AIDAYGAGSFIVATKIKGMIAAEVSDERS

SEQ ID NO: 1797181 - protein, 18 aa, Staphylococcus epidermidis
AIDHGFHHYSRFIQLFKN

SEQ ID NO: 1797182 - protein, 24 aa, Staphylococcus epidermidis
AIETLKKVDVIACEDTRVTRKLCN

SEQ ID NO: 1797183 - protein, 26 aa, Staphylococcus epidermidis
AIHKRWSRLELGQFILGGKRYSDENK

SEQ ID NO: 1797184 - protein, 17 aa, Staphylococcus epidermidis
AISIGPDAIKTGMLGTQ

SEQ ID NO: 1797185 - protein, 25 aa, Staphylococcus epidermidis
AITLREIMDEVGIDAARYFLTMRSP

SEQ ID NO: 1797186 - protein, 17 aa, Staphylococcus epidermidis
AKAGDQVIFYQVQTDSG

SEQ ID NO: 1797187 - protein, 17 aa, Staphylococcus epidermidis
AKAKFEITTGLKTNGIF

SEQ ID NO: 1797188 - protein, 20 aa, Staphylococcus epidermidis
AKIACLTIDTSMRHLDAIGD

SEQ ID NO: 1797189 - protein, 21 aa, Staphylococcus epidermidis
AKKDRYPIELMRGLNQEIVKF

SEQ ID NO: 1797190 - protein, 19 aa, Staphylococcus epidermidis
AKKIGYPVIIKATAGGGGK

SEQ ID NO: 1797191 - protein, 17 aa, Staphylococcus epidermidis
AKLTCLNPVQLRRVLAY

SEQ ID NO: 1797192 - protein, 19 aa, Staphylococcus epidermidis
AKPLKTMLLLHGLSSDTSS

SEQ ID NO: 1797193 - protein, 27 aa, Staphylococcus epidermidis
AKQKALELIELVGLKGRESAYPSELSG

SEQ ID NO: 1797194 - protein, 19 aa, Staphylococcus epidermidis
AKQLKDHLSKMIGINSVDI

SEQ ID NO: 1797195 - protein, 18 aa, Staphylococcus epidermidis
AKYQVEFKAKKDGYITEI

SEQ ID NO: 1797196 - protein, 25 aa, Staphylococcus epidermidis
ALDILESGPIWGFDTSVHGSVNIED

SEQ ID NO: 1797197 - protein, 18 aa, Staphylococcus epidermidis
ALENIGFGAIELGGITPK

SEQ ID NO: 1797198 - protein, 25 aa, Staphylococcus epidermidis
ALIAERSLEMIIGMLGILKAGAGYI

SEQ ID NO: 1797199 - protein, 18 aa, Staphylococcus epidermidis
ALIARPKLLLADEPTGAL

SEQ ID NO: 1797200 - protein, 25 aa, Staphylococcus epidermidis
ALKEMHRVLKPGGMVVCLETSQPTL

SEQ ID NO: 1797201 - protein, 21 aa, Staphylococcus epidermidis
ALRKYARVRLSNNIEVNAYIP

SEQ ID NO: 1797202 - protein, 26 aa, Staphylococcus epidermidis
AMAQEGHDFFGLLYIGAILTKDGPKV

SEQ ID NO: 1797203 - protein, 19 aa, Staphylococcus epidermidis
AMSHPEIRISLVSDGKKLL

SEQ ID NO: 1797204 - protein, 24 aa, Staphylococcus epidermidis
ANAVYDLGCSVGIDMNLKSQGVTE

SEQ ID NO: 1797205 - protein, 24 aa, Staphylococcus epidermidis
ANDDKWSKVAFVFPESQRSLIPEN

SEQ ID NO: 1797206 - protein, 17 aa, Staphylococcus epidermidis
ANDIRWLASGPRAGLAE

SEQ ID NO: 1797207 - protein, 24 aa, Staphylococcus epidermidis
ANELKDSELRSHFDSMSNSASISQ

SEQ ID NO: 1797208 - protein, 18 aa, Staphylococcus epidermidis
ANKFKQFGTRVVLGRFGL

SEQ ID NO: 1797209 - protein, 27 aa, Staphylococcus epidermidis
ANKGYREAFKVNHPLSLGLNTFNGHVT

SEQ ID NO: 1797210 - protein, 17 aa, Staphylococcus epidermidis
ANKLLKDNDELIASFSR

SEQ ID NO: 1797211 - protein, 17 aa, Staphylococcus epidermidis
ANLPCYFTMDAGPNVKV

SEQ ID NO: 1797212 - protein, 19 aa, Staphylococcus epidermidis
ANNHLIILVMVFSSGHVEN

SEQ ID NO: 1797213 - protein, 25 aa, Staphylococcus epidermidis
ANNNGRFSPVVFKLASEHDIDLTQV

SEQ ID NO: 1797214 - protein, 29 aa, Staphylococcus epidermidis
APLKYKQVLPCQFCNYKSVCHVDGLIDSK

SEQ ID NO: 1797215 - protein, 39 aa, Staphylococcus epidermidis
APQIFRKLNIEWVYRVLIDWKRIGRMISIPKFMLKVAIQ

SEQ ID NO: 1797216 - protein, 19 aa, Staphylococcus epidermidis
AQALTCYYGGDVIQGSCVK

SEQ ID NO: 1797217 - protein, 18 aa, Staphylococcus epidermidis
AQENLQLVIMIIEDGTYE

SEQ ID NO: 1797218 - protein, 19 aa, Staphylococcus epidermidis
AQRLLNGRASTSGYFENIE

SEQ ID NO: 1797219 - protein, 20 aa, Staphylococcus epidermidis
ARAEVEKGVKWITDKSQVEG

SEQ ID NO: 1797220 - protein, 19 aa, Staphylococcus epidermidis
ARHPQRIDMAIGRSPSFKN

SEQ ID NO: 1797221 - protein, 19 aa, Staphylococcus epidermidis
ARSEADWIVGINATRALTT

SEQ ID NO: 1797222 - protein, 20 aa, Staphylococcus epidermidis
ARSNAIPIIYHVYAPCSITM

SEQ ID NO: 1797223 - protein, 19 aa, Staphylococcus epidermidis
ARTDYIRKLGFSYASMEEQ

SEQ ID NO: 1797224 - protein, 18 aa, Staphylococcus epidermidis
ARTILKFNTSVKVANKQT

SEQ ID NO: 1797225 - protein, 19 aa, Staphylococcus epidermidis
ARTPMQWNNSINAGFTTGK

SEQ ID NO: 1797226 - protein, 21 aa, Staphylococcus epidermidis
ARYGEFGSFYIGHILNIEDFK

SEQ ID NO: 1797227 - protein, 18 aa, Staphylococcus epidermidis
ASAKGCKQSLGFEQNTVW

SEQ ID NO: 1797228 - protein, 20 aa, Staphylococcus epidermidis
ASGFPKERIIGQSGILDAAR

SEQ ID NO: 1797229 - protein, 29 aa, Staphylococcus epidermidis
ASGKTRLSNELLLHLDAKYSRFIATKSPE

SEQ ID NO: 1797230 - protein, 23 aa, Staphylococcus epidermidis
ASIISRYAFVKHMDHISKKLHME

SEQ ID NO: 1797231 - protein, 25 aa, Staphylococcus epidermidis
ASKGKMAFRVYPTWEKDLNRVAHKT

SEQ ID NO: 1797232 - protein, 40 aa, Staphylococcus epidermidis
ASQKNQFPWVVAAFPTRDWARRVYPELDVESAYIKFIDEV

SEQ ID NO: 1797233 - protein, 25 aa, Staphylococcus epidermidis
ASYLKEFTNIYAMLIPKMSSMEDVK

SEQ ID NO: 1797234 - protein, 17 aa, Staphylococcus epidermidis
ATAEILKGIPIAHFDVQ

SEQ ID NO: 1797235 - protein, 20 aa, Staphylococcus epidermidis
ATDIFKKNLEHFLNNYDVIE

SEQ ID NO: 1797236 - protein, 19 aa, Staphylococcus epidermidis
ATLAKEHKILLAVDNTFMT

SEQ ID NO: 1797237 - protein, 25 aa, Staphylococcus epidermidis
AVPYHHPLFLGMGGMHGSYASNMAL

SEQ ID NO: 1797238 - protein, 23 aa, Staphylococcus epidermidis
AVSDIKISGDFTIENNPEDSIVT

SEQ ID NO: 1797239 - protein, 25 aa, Staphylococcus epidermidis
AVTSLYRPGPMEEIPTYITRRHNPN

SEQ ID NO: 1797240 - protein, 18 aa, Staphylococcus epidermidis
AYIAMTIAQDTDYILLDE

SEQ ID NO: 1797241 - protein, 30 aa, Staphylococcus epidermidis
AYVESDFKIVTGFIEPHFFAGFSGGPKGIM

SEQ ID NO: 1797242 - protein, 18 aa, Staphylococcus epidermidis
AYVKSHSFIQTLVLGISG

SEQ ID NO: 1797243 - protein, 35 aa, Staphylococcus epidermidis
AYYAVKILNEMKVDWKKRIHIIIGTDEESDWKCTD

SEQ ID NO: 1797244 - protein, 19 aa, Staphylococcus epidermidis
CDCGAQLEASMKYIDEHGG

SEQ ID NO: 1797245 - protein, 21 aa, Staphylococcus epidermidis
CGDYNYFSFKGMRSKGNNELH

SEQ ID NO: 1797246 - protein, 17 aa, Staphylococcus epidermidis
CGVKSAYILKETSEAFK

SEQ ID NO: 1797247 - protein, 17 aa, Staphylococcus epidermidis
CHIAIGITKDGDREIIG

SEQ ID NO: 1797248 - protein, 20 aa, Staphylococcus epidermidis
CIPKRCKASEDEAYIDIIRK

SEQ ID NO: 1797249 - protein, 17 aa, Staphylococcus epidermidis
CKCNGEISERVKDARAL

SEQ ID NO: 1797250 - protein, 20 aa, Staphylococcus epidermidis
CKQSLGFEQNTVWLSVLPIY

SEQ ID NO: 1797251 - protein, 18 aa, Staphylococcus epidermidis
CNDDVYKLPIGTPAMATG

SEQ ID NO: 1797252 - protein, 17 aa, Staphylococcus epidermidis
CNHHLDFALAIRTMIID

SEQ ID NO: 1797253 - protein, 22 aa, Staphylococcus epidermidis
CPDCKAMDMWIDPIVEKYNNYQ

SEQ ID NO: 1797254 - protein, 20 aa, Staphylococcus epidermidis
CPTCQMTLKDIAHVGKLGCA

SEQ ID NO: 1797255 - protein, 26 aa, Staphylococcus epidermidis
CTDFQARRANIRFKRDAASKPELVHT

SEQ ID NO: 1797256 - protein, 19 aa, Staphylococcus epidermidis
CTPSSLTPRDVYFNIAKDQ

SEQ ID NO: 1797257 - protein, 23 aa, Staphylococcus epidermidis
CTPTEYRMMAKLSHLEQYNLEYL

SEQ ID NO: 1797258 - protein, 17 aa, Staphylococcus epidermidis
DAANLLSGLGIEPDLHD

SEQ ID NO: 1797259 - protein, 18 aa, Staphylococcus epidermidis
DADFKVICTNVIDEEGHL

SEQ ID NO: 1797260 - protein, 24 aa, Staphylococcus epidermidis
DADKNCPILPPSVKKEHWGFDDPA

SEQ ID NO: 1797261 - protein, 24 aa, Staphylococcus epidermidis
DAEALAHAMVRIGNNVGRNTMAII

SEQ ID NO: 1797262 - protein, 22 aa, Staphylococcus epidermidis
DAFAKVKGRLIVSCYASNFVRI

SEQ ID NO: 1797263 - protein, 24 aa, Staphylococcus epidermidis
DAGKIFFKKCQEIIALYDNLPTEI

SEQ ID NO: 1797264 - protein, 25 aa, Staphylococcus epidermidis
DAHQCFSGKFTVRHFFKDVKDITQY

SEQ ID NO: 1797265 - protein, 23 aa, Staphylococcus epidermidis
DAICGDEPLSVYHEMTFFVSQQN

SEQ ID NO: 1797266 - protein, 24 aa, Staphylococcus epidermidis
DAKACAMITYRLLKHYDDLQSMLS

SEQ ID NO: 1797267 - protein, 23 aa, Staphylococcus epidermidis
DALKSFKNVVLTPHIGNATFEAR

SEQ ID NO: 1797268 - protein, 23 aa, Staphylococcus epidermidis
DASILRKAFHLNFDDVGENIEAF

SEQ ID NO: 1797269 - protein, 18 aa, Staphylococcus epidermidis
DATDIIAAQILYTIKKDG

SEQ ID NO: 1797270 - protein, 20 aa, Staphylococcus epidermidis
DAYLLLDFHATIFNESQLTP

SEQ ID NO: 1797271 - protein, 17 aa, Staphylococcus epidermidis
DCLGAAVNRSMELSHKE

SEQ ID NO: 1797272 - protein, 23 aa, Staphylococcus epidermidis
DDAYEIIETLYLEELNVPYIIIG

SEQ ID NO: 1797273 - protein, 20 aa, Staphylococcus epidermidis
DDIKGSIKIGKDADIVIIDD

SEQ ID NO: 1797274 - protein, 21 aa, Staphylococcus epidermidis
DDIRMREFIKDVAKYDEVYGL

SEQ ID NO: 1797275 - protein, 18 aa, Staphylococcus epidermidis
DDLIGLKAAYQKFGGGPL

SEQ ID NO: 1797276 - protein, 18 aa, Staphylococcus epidermidis
DDPYKLELIDAIPEDESV

SEQ ID NO: 1797277 - protein, 30 aa, Staphylococcus epidermidis
DEFYFEEPFNFGATIGRYAGRIENASFKLD

SEQ ID NO: 1797278 - protein, 22 aa, Staphylococcus epidermidis
DEIKELSGHVFIFGGQTLFEAM

SEQ ID NO: 1797279 - protein, 17 aa, Staphylococcus epidermidis
DELLELLNIPKQMLPEV

SEQ ID NO: 1797280 - protein, 18 aa, Staphylococcus epidermidis
DEPAFINVLEILALEYAK

SEQ ID NO: 1797281 - protein, 20 aa, Staphylococcus epidermidis
DESHVSIAGRLMTKRGKGKA

SEQ ID NO: 1797282 - protein, 23 aa, Staphylococcus epidermidis
DESRTIKAIEELGERMGIQTPIR

SEQ ID NO: 1797283 - protein, 23 aa, Staphylococcus epidermidis
DETVLRFITFKLIPLLNQTHGKK

SEQ ID NO: 1797284 - protein, 19 aa, Staphylococcus epidermidis
DEVLQKSGYRDMLDREQSI

SEQ ID NO: 1797285 - protein, 25 aa, Staphylococcus epidermidis
DFMKMAEAYGIKGFLIDSPDKLESS

SEQ ID NO: 1797286 - protein, 20 aa, Staphylococcus epidermidis
DFQDALGLNSADSFRDLIKI

SEQ ID NO: 1797287 - protein, 20 aa, Staphylococcus epidermidis
DFRPGLKARDDFGVRSVLQE

SEQ ID NO: 1797288 - protein, 30 aa, Staphylococcus epidermidis
DGANVKGYFLWSLMDVFSWSNGYEKRYGLF

SEQ ID NO: 1797289 - protein, 20 aa, Staphylococcus epidermidis
DGCGECPACHLRARGLKHYL

SEQ ID NO: 1797290 - protein, 20 aa, Staphylococcus epidermidis
DGEMKFRIACTNHHHHHFIC

SEQ ID NO: 1797291 - protein, 19 aa, Staphylococcus epidermidis
DGFTLTFKDGVIIDVKAEK

SEQ ID NO: 1797292 - protein, 29 aa, Staphylococcus epidermidis
DGRFLNVGENLWGLRDWYSVDDIEEKIAP

SEQ ID NO: 1797293 - protein, 17 aa, Staphylococcus epidermidis
DGTEINAALKYVVECGA

SEQ ID NO: 1797294 - protein, 18 aa, Staphylococcus epidermidis
DGWYSLHLFYAVDWTTFR

SEQ ID NO: 1797295 - protein, 25 aa, Staphylococcus epidermidis
DHDILKASCKAYIDAHAKYISEYEL

SEQ ID NO: 1797296 - protein, 24 aa, Staphylococcus epidermidis
DHFKALSVGKWVRAQGRIEEDTFV

SEQ ID NO: 1797297 - protein, 17 aa, Staphylococcus epidermidis
DHIVIIVSGAFGNRFKQ

SEQ ID NO: 1797298 - protein, 18 aa, Staphylococcus epidermidis
DHQMTLKVGQDIDVDAFL

SEQ ID NO: 1797299 - protein, 17 aa, Staphylococcus epidermidis
DIEGVLNYIEKWTSKRG

SEQ ID NO: 1797300 - protein, 18 aa, Staphylococcus epidermidis
DIGIKYLTLYAFSTENWS

SEQ ID NO: 1797301 - protein, 26 aa, Staphylococcus epidermidis
DIGRVELREAIPVTVTLDYDQTGKFE

SEQ ID NO: 1797302 - protein, 25 aa, Staphylococcus epidermidis
DILKKRDSMNWNEITQGIDHISGKH

SEQ ID NO: 1797303 - protein, 25 aa, Staphylococcus epidermidis
DINKEMFKRQGGYGRGRRMKIEKDT

SEQ ID NO: 1797304 - protein, 28 aa, Staphylococcus epidermidis
DIYSRPRGKFRFPIQVSENEYTQKNENY

SEQ ID NO: 1797305 - protein, 18 aa, Staphylococcus epidermidis
DKAIAEWFASKKNEIVQH

SEQ ID NO: 1797306 - protein, 24 aa, Staphylococcus epidermidis
DKAKKEGYRALAITDTNVLYGYPK

SEQ ID NO: 1797307 - protein, 26 aa, Staphylococcus epidermidis
DKDEVIFSELLRFAGIGESKLETLLI

SEQ ID NO: 1797308 - protein, 23 aa, Staphylococcus epidermidis
DKDYATISFLNWFLDEQVEEEST

SEQ ID NO: 1797309 - protein, 17 aa, Staphylococcus epidermidis
DKFEVENIFDLALLTIL

SEQ ID NO: 1797310 - protein, 21 aa, Staphylococcus epidermidis
DKFPFKLLIEKIREINVPKKC

SEQ ID NO: 1797311 - protein, 29 aa, Staphylococcus epidermidis
DKIKIGATVFAGFGPRIVRINDYSLDFKP

SEQ ID NO: 1797312 - protein, 28 aa, Staphylococcus epidermidis
DKLFELEGDMPLFPGHGPYTTVDDEQLN

SEQ ID NO: 1797313 - protein, 17 aa, Staphylococcus epidermidis
DKLLAQFYFQNRFKNQD

SEQ ID NO: 1797314 - protein, 19 aa, Staphylococcus epidermidis
DKRIYDLQLSRQIAIQTAP

SEQ ID NO: 1797315 - protein, 17 aa, Staphylococcus epidermidis
DKSNFIKRVIKSEEERF

SEQ ID NO: 1797316 - protein, 17 aa, Staphylococcus epidermidis
DKVLVKGSRGMKLEEVV

SEQ ID NO: 1797317 - protein, 21 aa, Staphylococcus epidermidis
DLEIGSGSFIPGFEEQIEGMK

SEQ ID NO: 1797318 - protein, 25 aa, Staphylococcus epidermidis
DLIEEVARIYGYDDIPSTLPVFKDV

SEQ ID NO: 1797319 - protein, 24 aa, Staphylococcus epidermidis
DLLKRLRHSHQLSYIFITHDIQAA

SEQ ID NO: 1797320 - protein, 19 aa, Staphylococcus epidermidis
DLLNASWKKGSYVRKRIDP

SEQ ID NO: 1797321 - protein, 17 aa, Staphylococcus epidermidis
DLPGVRYHIVRGALDTS

SEQ ID NO: 1797322 - protein, 22 aa, Staphylococcus epidermidis
DLPVDSYMIWGGVSDIHLMYEE

SEQ ID NO: 1797323 - protein, 23 aa, Staphylococcus epidermidis
DLSWPEGTEFIFTPFQIQAITGD

SEQ ID NO: 1797324 - protein, 19 aa, Staphylococcus epidermidis
DMHSFRLFDYVMLGHLHHP

SEQ ID NO: 1797325 - protein, 18 aa, Staphylococcus epidermidis
DMLPGCMRQSLIDQGKVI

SEQ ID NO: 1797326 - protein, 17 aa, Staphylococcus epidermidis
DMVKVKRYLQGRKTRLV

SEQ ID NO: 1797327 - protein, 27 aa, Staphylococcus epidermidis
DMYLHPDLDTWVIFPWTAGQGKVARLI

SEQ ID NO: 1797328 - protein, 17 aa, Staphylococcus epidermidis
DNARTPMQWNNSINAGF

SEQ ID NO: 1797329 - protein, 17 aa, Staphylococcus epidermidis
DNGHLEPIFILGKNNKQ

SEQ ID NO: 1797330 - protein, 18 aa, Staphylococcus epidermidis
DNLGIAIDAYGAGSFIVA

SEQ ID NO: 1797331 - protein, 18 aa, Staphylococcus epidermidis
DNLQLFVVIGQLNQLIKG

SEQ ID NO: 1797332 - protein, 24 aa, Staphylococcus epidermidis
DNQEVPRKLFLLSPLLDATLTNPN

SEQ ID NO: 1797333 - protein, 24 aa, Staphylococcus epidermidis
DNQKYIFDYSACNYPVGVVEDQIY

SEQ ID NO: 1797334 - protein, 22 aa, Staphylococcus epidermidis
DNRYGCALAVEVLQQLKDENID

SEQ ID NO: 1797335 - protein, 19 aa, Staphylococcus epidermidis
DNVKRALIPLSGYHVKGKR

SEQ ID NO: 1797336 - protein, 20 aa, Staphylococcus epidermidis
DPCSFPESLLITGQTYDSIQ

SEQ ID NO: 1797337 - protein, 24 aa, Staphylococcus epidermidis
DPFTKIQLWLPIKQEIYDLDEGYQ

SEQ ID NO: 1797338 - protein, 24 aa, Staphylococcus epidermidis
DPLWSRLSKFVIFPSIIPNSKQII

SEQ ID NO: 1797339 - protein, 25 aa, Staphylococcus epidermidis
DPSELKMRIIDCLETAHTRLKLLSK

SEQ ID NO: 1797340 - protein, 17 aa, Staphylococcus epidermidis
DQFNIWKMADLGDIIGV

SEQ ID NO: 1797341 - protein, 22 aa, Staphylococcus epidermidis
DQLTCIFVDHGLLRKGEGDMVM

SEQ ID NO: 1797342 - protein, 19 aa, Staphylococcus epidermidis
DRLNLKWGPNWEDDLAGGH

SEQ ID NO: 1797343 - protein, 23 aa, Staphylococcus epidermidis
DRVSPKLPILKKGRQYQFQFNFE

SEQ ID NO: 1797344 - protein, 18 aa, Staphylococcus epidermidis
DRYFPEWHETYSKVNQLN

SEQ ID NO: 1797345 - protein, 21 aa, Staphylococcus epidermidis
DSDLIKVPAIKEAKVRFECKL

SEQ ID NO: 1797346 - protein, 24 aa, Staphylococcus epidermidis
DSETKAVVMIGEIGGTAEEEAAQW

SEQ ID NO: 1797347 - protein, 19 aa, Staphylococcus epidermidis
DSIASRGLFAVEGQAISKE

SEQ ID NO: 1797348 - protein, 23 aa, Staphylococcus epidermidis
DSIINRYTFLTALLTQIIHRFDQ

SEQ ID NO: 1797349 - protein, 17 aa, Staphylococcus epidermidis
DSLSYYQFYILKLVVGE

SEQ ID NO: 1797350 - protein, 25 aa, Staphylococcus epidermidis
DSNRGGCCQSCRWDYDLLEVDSDGE

SEQ ID NO: 1797351 - protein, 26 aa, Staphylococcus epidermidis
DSTALGFSGGFPGDFIAQTLEDSNIQ

SEQ ID NO: 1797352 - protein, 19 aa, Staphylococcus epidermidis
DTEAFRIWHEDIGLEESRI

SEQ ID NO: 1797353 - protein, 19 aa, Staphylococcus epidermidis
DTFIGAFLSELNKDLSNLE

SEQ ID NO: 1797354 - protein, 24 aa, Staphylococcus epidermidis
DTHFKKEFNYYLSEYVGRETPLTF

SEQ ID NO: 1797355 - protein, 24 aa, Staphylococcus epidermidis
DTLKEIIWNPLIKDRCFDHTYVAQ

SEQ ID NO: 1797356 - protein, 18 aa, Staphylococcus epidermidis
DVCFVPIGDNFTMGIEDA

SEQ ID NO: 1797357 - protein, 21 aa, Staphylococcus epidermidis
DVDGFHPINIGKLYIDEQTFV

SEQ ID NO: 1797358 - protein, 21 aa, Staphylococcus epidermidis
DVFLGIPYAKSFNKISRFQHS

SEQ ID NO: 1797359 - protein, 21 aa, Staphylococcus epidermidis
DVHYSHYGRMCPIETPEGPNI

SEQ ID NO: 1797360 - protein, 19 aa, Staphylococcus epidermidis
DVIDLGVGIVLNKKVGEHV

SEQ ID NO: 1797361 - protein, 24 aa, Staphylococcus epidermidis
DVSEIQRLIQFLLIELSYLKKPKL

SEQ ID NO: 1797362 - protein, 20 aa, Staphylococcus epidermidis
DVTGKWSWLAPPLSPTLTSN

SEQ ID NO: 1797363 - protein, 24 aa, Staphylococcus epidermidis
DVTYPNKRIEFIIEDAEVAAVLTY

SEQ ID NO: 1797364 - protein, 17 aa, Staphylococcus epidermidis
DVYDFPRVWLEKDSYDF

SEQ ID NO: 1797365 - protein, 19 aa, Staphylococcus epidermidis
DVYRVKGFVRFSDQQHVYL

SEQ ID NO: 1797366 - protein, 21 aa, Staphylococcus epidermidis
DYESFPGKLIVHVMDDSQVGQ

SEQ ID NO: 1797367 - protein, 20 aa, Staphylococcus epidermidis
DYLKLMKELVINSRKEDGNL

SEQ ID NO: 1797368 - protein, 17 aa, Staphylococcus epidermidis
DYRSKRKNIQFKESESN

SEQ ID NO: 1797369 - protein, 32 aa, Staphylococcus epidermidis
DYVTRIQTWAIKFDIYLSIKKKQGIMIDASTT

SEQ ID NO: 1797370 - protein, 21 aa, Staphylococcus epidermidis
EAEAYKKLLEIGGTTQNELAK

SEQ ID NO: 1797371 - protein, 23 aa, Staphylococcus epidermidis
EAFKVQLDDGMAFLSGVVSRKKQ

SEQ ID NO: 1797372 - protein, 19 aa, Staphylococcus epidermidis
EAIDHFLLLIDTCHENVLL

SEQ ID NO: 1797373 - protein, 18 aa, Staphylococcus epidermidis
EALIDFIPNVTHSKLKDV

SEQ ID NO: 1797374 - protein, 26 aa, Staphylococcus epidermidis
EAMIKTAKIVLNWLASERIEVSLLNI

SEQ ID NO: 1797375 - protein, 20 aa, Staphylococcus epidermidis
EASKQLAQWVQENKIKTQVS

SEQ ID NO: 1797376 - protein, 22 aa, Staphylococcus epidermidis
EDAEVKAVLGIIGEEGEAIDKD

SEQ ID NO: 1797377 - protein, 17 aa, Staphylococcus epidermidis
EDEIKRDISCNLGSLNI

SEQ ID NO: 1797378 - protein, 25 aa, Staphylococcus epidermidis
EDFKGSWNVVCFYPADFSFVCPTEL

SEQ ID NO: 1797379 - protein, 24 aa, Staphylococcus epidermidis
EDHGAEAVCHFCGNKYQYSESELE

SEQ ID NO: 1797380 - protein, 24 aa, Staphylococcus epidermidis
EDNVPEFDHYFAIGKQTARTILKF

SEQ ID NO: 1797381 - protein, 21 aa, Staphylococcus epidermidis
EDVYEPFLIQRGFLERTPRGR

SEQ ID NO: 1797382 - protein, 25 aa, Staphylococcus epidermidis
EDYGVYRFKRGFNVRIEELIGDFYK

SEQ ID NO: 1797383 - protein, 23 aa, Staphylococcus epidermidis
EEFKLLFTDIDFLPPVTPPNNVI

SEQ ID NO: 1797384 - protein, 19 aa, Staphylococcus epidermidis
EEKKCPTCQMTLKDIAHVG

SEQ ID NO: 1797385 - protein, 17 aa, Staphylococcus epidermidis
EELEVTLELKLLADVGL

SEQ ID NO: 1797386 - protein, 25 aa, Staphylococcus epidermidis
EELQTRPKQIFDIALYRKVASKVGV

SEQ ID NO: 1797387 - protein, 19 aa, Staphylococcus epidermidis
EELYLLGLLIISDNKTTFK

SEQ ID NO: 1797388 - protein, 17 aa, Staphylococcus epidermidis
EEMRLIYVALTRAKEQL

SEQ ID NO: 1797389 - protein, 25 aa, Staphylococcus epidermidis
EENVKFLKSRVASLQKNVLFEKMKI

SEQ ID NO: 1797390 - protein, 18 aa, Staphylococcus epidermidis
EEPVLFCPKMEVEEVKQS

SEQ ID NO: 1797391 - protein, 22 aa, Staphylococcus epidermidis
EFLPSRIDLMVNAFNKNKETDV

SEQ ID NO: 1797392 - protein, 20 aa, Staphylococcus epidermidis
EFLSMQSLPDSITFIGAGII

SEQ ID NO: 1797393 - protein, 18 aa, Staphylococcus epidermidis
EGALPKSGESWFESYTVK

SEQ ID NO: 1797394 - protein, 23 aa, Staphylococcus epidermidis
EGAQRPGHFEGVVTVVNKLFNIV

SEQ ID NO: 1797395 - protein, 20 aa, Staphylococcus epidermidis
EGHTPLIYCENLSQKLDIEL

SEQ ID NO: 1797396 - protein, 26 aa, Staphylococcus epidermidis
EGITCLPEIMIPLVSTVEEFTTLKER

SEQ ID NO: 1797397 - protein, 18 aa, Staphylococcus epidermidis
EGKNVWFGVREFAMGAAI

SEQ ID NO: 1797398 - protein, 29 aa, Staphylococcus epidermidis
EGLKELLEKWLFKYENQFPIYASEINTDP

SEQ ID NO: 1797399 - protein, 18 aa, Staphylococcus epidermidis
EGLQKMAMMRSYMRSQIT

SEQ ID NO: 1797400 - protein, 19 aa, Staphylococcus epidermidis
EGNRSMFSIALRQAIQERL

SEQ ID NO: 1797401 - protein, 20 aa, Staphylococcus epidermidis
EHFGDFVIRDGVIAKVHDGR

SEQ ID NO: 1797402 - protein, 27 aa, Staphylococcus epidermidis
EHNPKALSFYKNRGFRVTGSHQFYTGS

SEQ ID NO: 1797403 - protein, 30 aa, Staphylococcus epidermidis
EHYPKLSKLGLKWYAVPIISNMDLKIGGIT

SEQ ID NO: 1797404 - protein, 33 aa, Staphylococcus epidermidis
EIFATAMNRKGYFLYGYRHFSSRIKGGHTNNKI

SEQ ID NO: 1797405 - protein, 18 aa, Staphylococcus epidermidis
EIGFPVVLKAASGGGGKG

SEQ ID NO: 1797406 - protein, 18 aa, Staphylococcus epidermidis
EIILGNLKYSSGPNHQLP

SEQ ID NO: 1797407 - protein, 21 aa, Staphylococcus epidermidis
EIKQFIKAYVKSHSFIQTLVL

SEQ ID NO: 1797408 - protein, 18 aa, Staphylococcus epidermidis
EILNRMDDIVLFKPLSVN

SEQ ID NO: 1797409 - protein, 27 aa, Staphylococcus epidermidis
EIMEIGVSKGFFGVAGFDLLVDDNNDV

SEQ ID NO: 1797410 - protein, 18 aa, Staphylococcus epidermidis
EINELPIVEEFRSAQYEA

SEQ ID NO: 1797411 - protein, 20 aa, Staphylococcus epidermidis
EINVPKKCTRDIKPLNFMTG

SEQ ID NO: 1797412 - protein, 18 aa, Staphylococcus epidermidis
EIRLRPSYFPFTEPSVEV

SEQ ID NO: 1797413 - protein, 19 aa, Staphylococcus epidermidis
EISKRTVLFLIEKDITVYG

SEQ ID NO: 1797414 - protein, 17 aa, Staphylococcus epidermidis
EITSLKMGNIEEQVELI

SEQ ID NO: 1797415 - protein, 28 aa, Staphylococcus epidermidis
EIVEKSLRGAAIWDELKDRLHTNAYGLS

SEQ ID NO: 1797416 - protein, 25 aa, Staphylococcus epidermidis
EIVPIWKKEIWEDGAEWQGHQKGTY

SEQ ID NO: 1797417 - protein, 18 aa, Staphylococcus epidermidis
EKAPFYATPRKPAIHHTM

SEQ ID NO: 1797418 - protein, 18 aa, Staphylococcus epidermidis
EKEKDFLQVIVKDEDSQL

SEQ ID NO: 1797419 - protein, 23 aa, Staphylococcus epidermidis
EKELKRLGINATIRREQGSDIDA

SEQ ID NO: 1797420 - protein, 23 aa, Staphylococcus epidermidis
EKESFGLTLLEAMKTGVLPIGSH

SEQ ID NO: 1797421 - protein, 20 aa, Staphylococcus epidermidis
EKFGPFLLRECNNIFQKKWQ

SEQ ID NO: 1797422 - protein, 27 aa, Staphylococcus epidermidis
EKITRAIHFVGTFTVEFFIDKENNLYV

SEQ ID NO: 1797423 - protein, 21 aa, Staphylococcus epidermidis
EKKGPSVLGMIEYNVQGQTKF

SEQ ID NO: 1797424 - protein, 23 aa, Staphylococcus epidermidis
EKKKFIPCGSVIMEGKKCGIVTT

SEQ ID NO: 1797425 - protein, 25 aa, Staphylococcus epidermidis
EKLGYLRYWVAEHHQVYSVVSSAPE

SEQ ID NO: 1797426 - protein, 25 aa, Staphylococcus epidermidis
EKLNIKKLGERVFLDSGTLTPLLKK

SEQ ID NO: 1797427 - protein, 34 aa, Staphylococcus epidermidis
EKLRRHMSFLMRKGKLYLPYNGNLLIHGCIPVDE

SEQ ID NO: 1797428 - protein, 17 aa, Staphylococcus epidermidis
EKMALKLTFQMLFIMLR

SEQ ID NO: 1797429 - protein, 24 aa, Staphylococcus epidermidis
EKMRFKGTSYTGGFVEGNAPEFPI

SEQ ID NO: 1797430 - protein, 21 aa, Staphylococcus epidermidis
ELACHNIHFEIIPGITSGIAA

SEQ ID NO: 1797431 - protein, 25 aa, Staphylococcus epidermidis
ELEYKIGLDISCMFNDTAQFKSLAS

SEQ ID NO: 1797432 - protein, 17 aa, Staphylococcus epidermidis
ELFDIAPTLDRGTKTLE

SEQ ID NO: 1797433 - protein, 20 aa, Staphylococcus epidermidis
ELFNAMVMTPYFPKPDVLIY

SEQ ID NO: 1797434 - protein, 21 aa, Staphylococcus epidermidis
ELGIDWPSVHADLEMVKDNLR

SEQ ID NO: 1797435 - protein, 29 aa, Staphylococcus epidermidis
ELKKLPLDQFKLHFQKRVKQGIHAMTLNI

SEQ ID NO: 1797436 - protein, 24 aa, Staphylococcus epidermidis
ELKNRRATLVNLQRIDQVSAKRII

SEQ ID NO: 1797437 - protein, 24 aa, Staphylococcus epidermidis
ELNGFKVNRAIDWSKVETDHEITD

SEQ ID NO: 1797438 - protein, 19 aa, Staphylococcus epidermidis
ELQLRLKLAEVEVPIKVEK

SEQ ID NO: 1797439 - protein, 23 aa, Staphylococcus epidermidis
ELVLRTNNLLARMSKSNHSNKIE

SEQ ID NO: 1797440 - protein, 20 aa, Staphylococcus epidermidis
EMKDQLRGNVVIIHQPAEEM

SEQ ID NO: 1797441 - protein, 20 aa, Staphylococcus epidermidis
EMRSDIPLARGLGSSASALV

SEQ ID NO: 1797442 - protein, 24 aa, Staphylococcus epidermidis
EMSLRLVDFKVEFGKTNGGKILLA

SEQ ID NO: 1797443 - protein, 25 aa, Staphylococcus epidermidis
ENDFKYKEHLGVVFDDLRVPDKLTL

SEQ ID NO: 1797444 - protein, 18 aa, Staphylococcus epidermidis
ENEKPIAPGMKYKHYSPE

SEQ ID NO: 1797445 - protein, 23 aa, Staphylococcus epidermidis
ENGFKTTFGLIFNHLSWMTNQNQ

SEQ ID NO: 1797446 - protein, 17 aa, Staphylococcus epidermidis
ENIYDWLSDFKLLSIPK

SEQ ID NO: 1797447 - protein, 19 aa, Staphylococcus epidermidis
ENLEICIFAESLGGTETFI

SEQ ID NO: 1797448 - protein, 17 aa, Staphylococcus epidermidis
ENLNTYVDWSFVLEYMK

SEQ ID NO: 1797449 - protein, 19 aa, Staphylococcus epidermidis
EPDFLIVIYHGGLNKISSA

SEQ ID NO: 1797450 - protein, 21 aa, Staphylococcus epidermidis
EPEDPLKLVVSFEGVEGYDVQ

SEQ ID NO: 1797451 - protein, 24 aa, Staphylococcus epidermidis
EPITFELWIAILIVQQPKDIQLST

SEQ ID NO: 1797452 - protein, 22 aa, Staphylococcus epidermidis
EPKKDRVVVEGVNVIKKHQKPT

SEQ ID NO: 1797453 - protein, 21 aa, Staphylococcus epidermidis
EPLDFSKAGPFIISNPGCYDD

SEQ ID NO: 1797454 - protein, 24 aa, Staphylococcus epidermidis
EPPISIKDGGLFKNGFNAQLDEYL

SEQ ID NO: 1797455 - protein, 26 aa, Staphylococcus epidermidis
EPPWFKISPTHFVKSWLLDARAPKVT

SEQ ID NO: 1797456 - protein, 24 aa, Staphylococcus epidermidis
EPSDLKAHRMVNVILDKEAAAGLP

SEQ ID NO: 1797457 - protein, 18 aa, Staphylococcus epidermidis
EQIKRGAIQFLYVAPERF

SEQ ID NO: 1797458 - protein, 25 aa, Staphylococcus epidermidis
EQKFGLRLPGEFNRDAMQEAVALAH

SEQ ID NO: 1797459 - protein, 17 aa, Staphylococcus epidermidis
EQNRYLVMPALSDELNI

SEQ ID NO: 1797460 - protein, 26 aa, Staphylococcus epidermidis
EQSLEHLLFGLGIRHLGVKASQVLAE

SEQ ID NO: 1797461 - protein, 25 aa, Staphylococcus epidermidis
ERARPMDRLLCGDVGYGKTEVAVRA

SEQ ID NO: 1797462 - protein, 18 aa, Staphylococcus epidermidis
ERIAVMSAPHKKRESEIA

SEQ ID NO: 1797463 - protein, 19 aa, Staphylococcus epidermidis
ERLDGEHFGDFVIRDGVIA

SEQ ID NO: 1797464 - protein, 20 aa, Staphylococcus epidermidis
ERNFKEFLSHYLPAQSGEML

SEQ ID NO: 1797465 - protein, 19 aa, Staphylococcus epidermidis
ERRTRICGDAVKVAQASRY

SEQ ID NO: 1797466 - protein, 18 aa, Staphylococcus epidermidis
ERYHPIERVGIYVPGGKA

SEQ ID NO: 1797467 - protein, 20 aa, Staphylococcus epidermidis
ESGRWSAYGPELMRLKDRNG

SEQ ID NO: 1797468 - protein, 23 aa, Staphylococcus epidermidis
ESITPYEGGIAFAAKPLIENHFI

SEQ ID NO: 1797469 - protein, 24 aa, Staphylococcus epidermidis
ESKIKTVLHGLNFTESDFNKPIND

SEQ ID NO: 1797470 - protein, 18 aa, Staphylococcus epidermidis
ESLDYFLAHLKNWNYSYA

SEQ ID NO: 1797471 - protein, 26 aa, Staphylococcus epidermidis
ESLPVYKPTLPPMVFGARDKKVKGGQ

SEQ ID NO: 1797472 - protein, 30 aa, Staphylococcus epidermidis
ESLQGVEFEFCTPFGSFPVKSPYVGRFNIS

SEQ ID NO: 1797473 - protein, 19 aa, Staphylococcus epidermidis
ESNRISLKEDEDWMKEMIS

SEQ ID NO: 1797474 - protein, 25 aa, Staphylococcus epidermidis
ESPGREIYPTYSLEEFVESLEKPRK

SEQ ID NO: 1797475 - protein, 17 aa, Staphylococcus epidermidis
ESRMNLLNNLKRKYGKD

SEQ ID NO: 1797476 - protein, 24 aa, Staphylococcus epidermidis
ETAKRYGLRSGVGLAAPQINEPKR

SEQ ID NO: 1797477 - protein, 18 aa, Staphylococcus epidermidis
ETEAELLTGISINNESDM

SEQ ID NO: 1797478 - protein, 20 aa, Staphylococcus epidermidis
ETGETLSILDGGFLTKVRTG

SEQ ID NO: 1797479 - protein, 21 aa, Staphylococcus epidermidis
ETGRGSIQMRSRAEIEERGGG

SEQ ID NO: 1797480 - protein, 24 aa, Staphylococcus epidermidis
ETIKGRKTILYFYPRDNTPTCTTE

SEQ ID NO: 1797481 - protein, 24 aa, Staphylococcus epidermidis
ETILKRPVKGYLYFFKFGTLEIDD

SEQ ID NO: 1797482 - protein, 22 aa, Staphylococcus epidermidis
ETKGAFPTWLAPMQVEIIPVNI

SEQ ID NO: 1797483 - protein, 20 aa, Staphylococcus epidermidis
ETLFAHFNIPISIQGKTIQT

SEQ ID NO: 1797484 - protein, 21 aa, Staphylococcus epidermidis
ETPNRFQFVVKIHQALTLHAD

SEQ ID NO: 1797485 - protein, 25 aa, Staphylococcus epidermidis
ETPQDIKAGYNFGSKGIGLVRTEHM

SEQ ID NO: 1797486 - protein, 18 aa, Staphylococcus epidermidis
ETTEFILDQLPCWLTYTN

SEQ ID NO: 1797487 - protein, 24 aa, Staphylococcus epidermidis
ETYDIFQIYSPQIWEEIIGMQDVL

SEQ ID NO: 1797488 - protein, 20 aa, Staphylococcus epidermidis
EVAHACAYLCSTMSKSITGT

SEQ ID NO: 1797489 - protein, 28 aa, Staphylococcus epidermidis
EVGLKSDCLYCYPHMLSGGEAQRVAIAR

SEQ ID NO: 1797490 - protein, 20 aa, Staphylococcus epidermidis
EVIQLCGALMQYYRETGVYA

SEQ ID NO: 1797491 - protein, 21 aa, Staphylococcus epidermidis
EVKQRIATHVSPDFEEVTTSL

SEQ ID NO: 1797492 - protein, 25 aa, Staphylococcus epidermidis
EVLTYKAIHACKTYNVNRLIVAGGV

SEQ ID NO: 1797493 - protein, 17 aa, Staphylococcus epidermidis
EVRKFRADWKNNRITDA

SEQ ID NO: 1797494 - protein, 21 aa, Staphylococcus epidermidis
EVSDPKELIARHSLKVDAGVI

SEQ ID NO: 1797495 - protein, 21 aa, Staphylococcus epidermidis
EVSEAAVLNANYIKSRLKNHF

SEQ ID NO: 1797496 - protein, 23 aa, Staphylococcus epidermidis
EVSILKMQLLIWITETNTGDIQE

SEQ ID NO: 1797497 - protein, 17 aa, Staphylococcus epidermidis
EYYTHFTSPIRRYPDLT

SEQ ID NO: 1797498 - protein, 25 aa, Staphylococcus epidermidis
FAAGDARRGQSLVVWAIKEGREVAH

SEQ ID NO: 1797499 - protein, 25 aa, Staphylococcus epidermidis
FAEFPEIRDQLLLIGGLSKSHSATG

SEQ ID NO: 1797500 - protein, 17 aa, Staphylococcus epidermidis
FAKSEIARGHVLFAQAN

SEQ ID NO: 1797501 - protein, 19 aa, Staphylococcus epidermidis
FAMGAAINGMAAHGGLHPY

SEQ ID NO: 1797502 - protein, 18 aa, Staphylococcus epidermidis
FANIFFMIMNYYSIERSM

SEQ ID NO: 1797503 - protein, 19 aa, Staphylococcus epidermidis
FAQKRWCASSGLDNVITLS

SEQ ID NO: 1797504 - protein, 22 aa, Staphylococcus epidermidis
FAVVGDTLFKNGIGRTDLYKGD

SEQ ID NO: 1797505 - protein, 18 aa, Staphylococcus epidermidis
FDEAFYRKMATQKWRQQD

SEQ ID NO: 1797506 - protein, 17 aa, Staphylococcus epidermidis
FDEQPLFNLNQLRHTSN

SEQ ID NO: 1797507 - protein, 29 aa, Staphylococcus epidermidis
FDEVKEMYRRVNFLFGDLVKVTPSSKVVG

SEQ ID NO: 1797508 - protein, 17 aa, Staphylococcus epidermidis
FDKETKEGHAFVLTEHT

SEQ ID NO: 1797509 - protein, 17 aa, Staphylococcus epidermidis
FDKVRFVHHSIPSIDVS

SEQ ID NO: 1797510 - protein, 23 aa, Staphylococcus epidermidis
FDLTGRLALYTSLPVIASGGIRH

SEQ ID NO: 1797511 - protein, 17 aa, Staphylococcus epidermidis
FDSIIGVDRIKVVHVND

SEQ ID NO: 1797512 - protein, 17 aa, Staphylococcus epidermidis
FDSSMAWWKELYSDDDA

SEQ ID NO: 1797513 - protein, 18 aa, Staphylococcus epidermidis
FEEEFNHWAESNATELLN

SEQ ID NO: 1797514 - protein, 17 aa, Staphylococcus epidermidis
FEEFNFDIPHPSGHELL

SEQ ID NO: 1797515 - protein, 22 aa, Staphylococcus epidermidis
FEIITTMMFLYFGEINPVDFVI

SEQ ID NO: 1797516 - protein, 29 aa, Staphylococcus epidermidis
FEMPYEEAKSWMLKALEPMGEEYLNVVKE

SEQ ID NO: 1797517 - protein, 23 aa, Staphylococcus epidermidis
FENMYEWLSNFKLFKVPKTLITR

SEQ ID NO: 1797518 - protein, 27 aa, Staphylococcus epidermidis
FENVTFPESFKVFGSEHSKVIFCEADE

SEQ ID NO: 1797519 - protein, 17 aa, Staphylococcus epidermidis
FEPRMFIGAISNLKNEL

SEQ ID NO: 1797520 - protein, 29 aa, Staphylococcus epidermidis
FERELGFLALHGFLHLLGYDHMNDNDEKE

SEQ ID NO: 1797521 - protein, 20 aa, Staphylococcus epidermidis
FEVENIFDLALLTILKGHIA

SEQ ID NO: 1797522 - protein, 17 aa, Staphylococcus epidermidis
FFDFSRRIPKRVKNRKL

SEQ ID NO: 1797523 - protein, 27 aa, Staphylococcus epidermidis
FFEVFDVLQELGLTKVNGGFVVTGGSA

SEQ ID NO: 1797524 - protein, 27 aa, Staphylococcus epidermidis
FFRALVINARLTVHIDLLRGGNTHHEI

SEQ ID NO: 1797525 - protein, 18 aa, Staphylococcus epidermidis
FGAGPIGLLTIVAAKAAG

SEQ ID NO: 1797526 - protein, 21 aa, Staphylococcus epidermidis
FGEDTDIANTVAFLASDKAKY

SEQ ID NO: 1797527 - protein, 25 aa, Staphylococcus epidermidis
FGHTKTIWVWTGFLFEYLKQQDDAR

SEQ ID NO: 1797528 - protein, 21 aa, Staphylococcus epidermidis
FGRDHLEQIYAHTFKADDALV

SEQ ID NO: 1797529 - protein, 19 aa, Staphylococcus epidermidis
FGSTITVKALLSMRMENKV

SEQ ID NO: 1797530 - protein, 18 aa, Staphylococcus epidermidis
FGVREFAMGAAINGMAAH

SEQ ID NO: 1797531 - protein, 22 aa, Staphylococcus epidermidis
FGYKSFRPGQEEIITKILNHQH

SEQ ID NO: 1797532 - protein, 17 aa, Staphylococcus epidermidis
FHIQKLFLLIFQLPEHL

SEQ ID NO: 1797533 - protein, 18 aa, Staphylococcus epidermidis
FHQLFKLLEDVRIFEHIR

SEQ ID NO: 1797534 - protein, 26 aa, Staphylococcus epidermidis
FIEHCINLKWIGWFATGVNNLPLNYI

SEQ ID NO: 1797535 - protein, 23 aa, Staphylococcus epidermidis
FILDQLPCWLTYTNGDTHQVIDD

SEQ ID NO: 1797536 - protein, 17 aa, Staphylococcus epidermidis
FINLAIDQAIKFGKSKI

SEQ ID NO: 1797537 - protein, 17 aa, Staphylococcus epidermidis
FIPCEEHTIIKLRIKDE

SEQ ID NO: 1797538 - protein, 19 aa, Staphylococcus epidermidis
FIRLTRYFIDILRQSNNGR

SEQ ID NO: 1797539 - protein, 18 aa, Staphylococcus epidermidis
FKALASHELSFYQIEKLI

SEQ ID NO: 1797540 - protein, 18 aa, Staphylococcus epidermidis
FKDILINEYIYFASKNKK

SEQ ID NO: 1797541 - protein, 19 aa, Staphylococcus epidermidis
FKDKHVITISLEVVNEKFL

SEQ ID NO: 1797542 - protein, 21 aa, Staphylococcus epidermidis
FKEGEICIPTIGFYTLSTFPF

SEQ ID NO: 1797543 - protein, 21 aa, Staphylococcus epidermidis
FKEGQLFKVHRIEIHEHETKA

SEQ ID NO: 1797544 - protein, 28 aa, Staphylococcus epidermidis
FKERHHLKMITIKSLVAFRKAVELNVNL

SEQ ID NO: 1797545 - protein, 17 aa, Staphylococcus epidermidis
FKGFLDIDGDRSFSEAV

SEQ ID NO: 1797546 - protein, 25 aa, Staphylococcus epidermidis
FKGKAKPGPIISIFGDTKPCENEYE

SEQ ID NO: 1797547 - protein, 20 aa, Staphylococcus epidermidis
FKIDGEFIMFLVRGHHELNE

SEQ ID NO: 1797548 - protein, 20 aa, Staphylococcus epidermidis
FKKGFIYDEVILKPIEEIQL

SEQ ID NO: 1797549 - protein, 19 aa, Staphylococcus epidermidis
FKVEGDAKIQYTLRLTPVY

SEQ ID NO: 1797550 - protein, 17 aa, Staphylococcus epidermidis
FKYNTSLFTDWINQAEM

SEQ ID NO: 1797551 - protein, 17 aa, Staphylococcus epidermidis
FLAHFVLDHVTIEYLKY

SEQ ID NO: 1797552 - protein, 27 aa, Staphylococcus epidermidis
FLEETHHHIEGFFSIAGFKEDAQDIDE

SEQ ID NO: 1797553 - protein, 20 aa, Staphylococcus epidermidis
FLEKIRKALYMSKICSYAQG

SEQ ID NO: 1797554 - protein, 18 aa, Staphylococcus epidermidis
FLIDREGNVIKRFSPQKK

SEQ ID NO: 1797555 - protein, 17 aa, Staphylococcus epidermidis
FLLGYSMGGRVALYYAI

SEQ ID NO: 1797556 - protein, 18 aa, Staphylococcus epidermidis
FLMERMKNSPFHQYEISN

SEQ ID NO: 1797557 - protein, 25 aa, Staphylococcus epidermidis
FLNAELRPGIDVVLEETQFKQRIKD

SEQ ID NO: 1797558 - protein, 18 aa, Staphylococcus epidermidis
FLQLRDGTGFMQGVVVKS

SEQ ID NO: 1797559 - protein, 21 aa, Staphylococcus epidermidis
FLSKDEFDLFLDLYRETEART

SEQ ID NO: 1797560 - protein, 26 aa, Staphylococcus epidermidis
FMHRKKPANGFVCYMVGRLILENCKN

SEQ ID NO: 1797561 - protein, 23 aa, Staphylococcus epidermidis
FMNELKINLLDFREQMDNLEAIG

SEQ ID NO: 1797562 - protein, 19 aa, Staphylococcus epidermidis
FNAEKGFGFIEVEGENDVF

SEQ ID NO: 1797563 - protein, 17 aa, Staphylococcus epidermidis
FNCLMPQLPSINLTCDT

SEQ ID NO: 1797564 - protein, 20 aa, Staphylococcus epidermidis
FNEVHGLSWSERDRLQYTVF

SEQ ID NO: 1797565 - protein, 24 aa, Staphylococcus epidermidis
FNGLKRVVNFIENFGFTNEDITYL

SEQ ID NO: 1797566 - protein, 17 aa, Staphylococcus epidermidis
FNIPDFLEDLLVDGYIK

SEQ ID NO: 1797567 - protein, 23 aa, Staphylococcus epidermidis
FNIYKAHSGFSIETQYMPNDINM

SEQ ID NO: 1797568 - protein, 25 aa, Staphylococcus epidermidis
FNNTRLVEMVRPQLSSVIQPLYDIG

SEQ ID NO: 1797569 - protein, 26 aa, Staphylococcus epidermidis
FNQLGAFKEALPFLMTAAEMDDDRDL

SEQ ID NO: 1797570 - protein, 21 aa, Staphylococcus epidermidis
FNQLPLFNFKIYQFLDDAYLL

SEQ ID NO: 1797571 - protein, 29 aa, Staphylococcus epidermidis
FNSKEDPELCVLKVIPRSIKLMNDDELDT

SEQ ID NO: 1797572 - protein, 22 aa, Staphylococcus epidermidis
FNVRKLECRYSTDEVKGNIFYF

SEQ ID NO: 1797573 - protein, 23 aa, Staphylococcus epidermidis
FPFILRGASIIGIDSVFTPIKLR

SEQ ID NO: 1797574 - protein, 18 aa, Staphylococcus epidermidis
FPLLTKILDAHDCLSVQV

SEQ ID NO: 1797575 - protein, 17 aa, Staphylococcus epidermidis
FPNSNDYILLWKLEVLD

SEQ ID NO: 1797576 - protein, 25 aa, Staphylococcus epidermidis
FPPEKIIKLPARFHRSPLPIPKFKY

SEQ ID NO: 1797577 - protein, 21 aa, Staphylococcus epidermidis
FQFSGHFGEPMWTETKLSNEE

SEQ ID NO: 1797578 - protein, 24 aa, Staphylococcus epidermidis
FQKYYKLLVEWNKKMNLTSITDEH

SEQ ID NO: 1797579 - protein, 19 aa, Staphylococcus epidermidis
FQYSFGMPDYEVINGDYPL

SEQ ID NO: 1797580 - protein, 18 aa, Staphylococcus epidermidis
FSDKIIGYVGLWLVVDQA

SEQ ID NO: 1797581 - protein, 17 aa, Staphylococcus epidermidis
FSFKGMRSKGNNELHVT

SEQ ID NO: 1797582 - protein, 24 aa, Staphylococcus epidermidis
FSGAEHRKAQNFAEVKLKLDNHSQ

SEQ ID NO: 1797583 - protein, 19 aa, Staphylococcus epidermidis
FSMLCDALNSFKAKNNINV

SEQ ID NO: 1797584 - protein, 18 aa, Staphylococcus epidermidis
FSRTGKKGGPFIDSIGHR

SEQ ID NO: 1797585 - protein, 18 aa, Staphylococcus epidermidis
FSYPTEYGEIFKQLTQAV

SEQ ID NO: 1797586 - protein, 24 aa, Staphylococcus epidermidis
FTLKELKALDFGFYKGEKFKGESI

SEQ ID NO: 1797587 - protein, 19 aa, Staphylococcus epidermidis
FTPVLAPFITLRSMVGIID

SEQ ID NO: 1797588 - protein, 25 aa, Staphylococcus epidermidis
FTRTFSAPINKVFDAYTKRELFEQW

SEQ ID NO: 1797589 - protein, 22 aa, Staphylococcus epidermidis
FVDYAEFCFKEFPEVKYWTTFN

SEQ ID NO: 1797590 - protein, 17 aa, Staphylococcus epidermidis
FVIFPSIIPNSKQIIKI

SEQ ID NO: 1797591 - protein, 17 aa, Staphylococcus epidermidis
FVNRQGKIIAMNDAAKD

SEQ ID NO: 1797592 - protein, 22 aa, Staphylococcus epidermidis
FVQTGRAYFRLVVKGQGGHGSS

SEQ ID NO: 1797593 - protein, 28 aa, Staphylococcus epidermidis
FVSEKMKLQSPRLMLGFKNEPLDESATK

SEQ ID NO: 1797594 - protein, 24 aa, Staphylococcus epidermidis
FWDNEAGFNYDFFHSVDPDLPKIV

SEQ ID NO: 1797595 - protein, 19 aa, Staphylococcus epidermidis
FYQLCPRTLEKLCPNLFKN

SEQ ID NO: 1797596 - protein, 19 aa, Staphylococcus epidermidis
GAAYFKMKFYRKNKEILSH

SEQ ID NO: 1797597 - protein, 17 aa, Staphylococcus epidermidis
GAFEIINTGVLKGAKAV

SEQ ID NO: 1797598 - protein, 20 aa, Staphylococcus epidermidis
GANFEKLKSFGLEHKVKEIH

SEQ ID NO: 1797599 - protein, 20 aa, Staphylococcus epidermidis
GCHKIDRLILPTVFHDSADM

SEQ ID NO: 1797600 - protein, 24 aa, Staphylococcus epidermidis
GCNTLDELLMLNAIHVPLHTGKIE

SEQ ID NO: 1797601 - protein, 18 aa, Staphylococcus epidermidis
GDHGVNMVRGFEHLKEKI

SEQ ID NO: 1797602 - protein, 17 aa, Staphylococcus epidermidis
GDITFRAIETLKKVDVI

SEQ ID NO: 1797603 - protein, 18 aa, Staphylococcus epidermidis
GDLSEIVKDFLINFQEKY

SEQ ID NO: 1797604 - protein, 20 aa, Staphylococcus epidermidis
GEFFSGTLVDGFKEQLDVER

SEQ ID NO: 1797605 - protein, 19 aa, Staphylococcus epidermidis
GEIGPFIEAYLRKEMDSRD

SEQ ID NO: 1797606 - protein, 22 aa, Staphylococcus epidermidis
GEKEFFDLYSKVVIEIPTHSPI

SEQ ID NO: 1797607 - protein, 22 aa, Staphylococcus epidermidis
GELDNHFPLVIWQTGSGTQSNM

SEQ ID NO: 1797608 - protein, 26 aa, Staphylococcus epidermidis
GEPMFSKKSIKNVVKPLLKYAKHRGI

SEQ ID NO: 1797609 - protein, 18 aa, Staphylococcus epidermidis
GEVKDCIDYALCVNEKGD

SEQ ID NO: 1797610 - protein, 19 aa, Staphylococcus epidermidis
GFAQLKRGAALANHELGKL

SEQ ID NO: 1797611 - protein, 18 aa, Staphylococcus epidermidis
GGGLPIGGYGGRQDIMEH

SEQ ID NO: 1797612 - protein, 17 aa, Staphylococcus epidermidis
GGIAIENLNDAFIQQIN

SEQ ID NO: 1797613 - protein, 25 aa, Staphylococcus epidermidis
GGQQQRVCIARCLAIEPDVILMDEP

SEQ ID NO: 1797614 - protein, 21 aa, Staphylococcus epidermidis
GGSDITGAIIARGVRASLYEN

SEQ ID NO: 1797615 - protein, 28 aa, Staphylococcus epidermidis
GGTYRALTKVFTRFGIDVDFVDTTKIEN

SEQ ID NO: 1797616 - protein, 24 aa, Staphylococcus epidermidis
GGYARHGGGCFSGKDPTKVDRSAA

SEQ ID NO: 1797617 - protein, 25 aa, Staphylococcus epidermidis
GHALDACGINGLHISECEFKGFLDI

SEQ ID NO: 1797618 - protein, 23 aa, Staphylococcus epidermidis
GIEKYKHVLFMRGRDWANQIKER

SEQ ID NO: 1797619 - protein, 24 aa, Staphylococcus epidermidis
GIIKEALHKLGFDDGMYDLIKEPI

SEQ ID NO: 1797620 - protein, 21 aa, Staphylococcus epidermidis
GIIWPKSVTPFDIHLITINPK

SEQ ID NO: 1797621 - protein, 25 aa, Staphylococcus epidermidis
GIVADCKLVLENLCHEQVLTSSHEE

SEQ ID NO: 1797622 - protein, 18 aa, Staphylococcus epidermidis
GKEFIPDSYTRRIFRKLG

SEQ ID NO: 1797623 - protein, 17 aa, Staphylococcus epidermidis
GKHPIRVILSKKGQLDF

SEQ ID NO: 1797624 - protein, 25 aa, Staphylococcus epidermidis
GKNPFPKEWRMHAFFMDALPVLNES

SEQ ID NO: 1797625 - protein, 32 aa, Staphylococcus epidermidis
GKPPKLIEHLLEIRGLGIINVMTLFGAGSILT

SEQ ID NO: 1797626 - protein, 17 aa, Staphylococcus epidermidis
GKSQSFIANKLRLLKLA

SEQ ID NO: 1797627 - protein, 19 aa, Staphylococcus epidermidis
GKSTLLKALSRLLSIKEGK

SEQ ID NO: 1797628 - protein, 18 aa, Staphylococcus epidermidis
GKYLFGLSGNPSACYTGF

SEQ ID NO: 1797629 - protein, 21 aa, Staphylococcus epidermidis
GLEAMTIHRLIGWNQDTQPQD

SEQ ID NO: 1797630 - protein, 27 aa, Staphylococcus epidermidis
GLEEMFGVICDFEFKKDYPALYNDPEF

SEQ ID NO: 1797631 - protein, 19 aa, Staphylococcus epidermidis
GLEIDVFDFHSNKSRHISS

SEQ ID NO: 1797632 - protein, 17 aa, Staphylococcus epidermidis
GLFSTIQDIGRLGYQDL

SEQ ID NO: 1797633 - protein, 23 aa, Staphylococcus epidermidis
GLIDRLHPTPALGGYPKEEALDF

SEQ ID NO: 1797634 - protein, 23 aa, Staphylococcus epidermidis
GLIPEDWGGDTIFVPLSALSGDG

SEQ ID NO: 1797635 - protein, 18 aa, Staphylococcus epidermidis
GLISIGAEVMRLGVISTP

SEQ ID NO: 1797636 - protein, 19 aa, Staphylococcus epidermidis
GLTELALRFNKGINTDGDA

SEQ ID NO: 1797637 - protein, 23 aa, Staphylococcus epidermidis
GMNEYGLVMAYNFMHRKKPANGF

SEQ ID NO: 1797638 - protein, 20 aa, Staphylococcus epidermidis
GNLDEIVEALTLSEQTEKLK

SEQ ID NO: 1797639 - protein, 23 aa, Staphylococcus epidermidis
GNYPEIKVPLAPKGTDFQQKVWN

SEQ ID NO: 1797640 - protein, 18 aa, Staphylococcus epidermidis
GPEIYRQKLYQLGIEVTI

SEQ ID NO: 1797641 - protein, 19 aa, Staphylococcus epidermidis
GPWHIHRMLEAAEEMPINV

SEQ ID NO: 1797642 - protein, 27 aa, Staphylococcus epidermidis
GQALSRLLKEWQMPASHLMAFGDANND

SEQ ID NO: 1797643 - protein, 22 aa, Staphylococcus epidermidis
GQGYPVVLVHTAFDNYAVFNDL

SEQ ID NO: 1797644 - protein, 17 aa, Staphylococcus epidermidis
GQHKIVFTTTILERGFT

SEQ ID NO: 1797645 - protein, 20 aa, Staphylococcus epidermidis
GRASKRLHESTGLEAMTIHR

SEQ ID NO: 1797646 - protein, 18 aa, Staphylococcus epidermidis
GREGVLTYDVVRYVQEVL

SEQ ID NO: 1797647 - protein, 18 aa, Staphylococcus epidermidis
GRHYIIITLWNSRQAFYD

SEQ ID NO: 1797648 - protein, 30 aa, Staphylococcus epidermidis
GRIGAATGKIYAGFGARVVGYDAYPNHSLS

SEQ ID NO: 1797649 - protein, 19 aa, Staphylococcus epidermidis
GRLLKSFIEYLQQVNQIDI

SEQ ID NO: 1797650 - protein, 28 aa, Staphylococcus epidermidis
GRMRKLCRPETPAIIVTRGLEPPEELIQ

SEQ ID NO: 1797651 - protein, 21 aa, Staphylococcus epidermidis
GRTMPKIGLGTYRVKDGDECR

SEQ ID NO: 1797652 - protein, 18 aa, Staphylococcus epidermidis
GRVLVFNKRGYPIGQILM

SEQ ID NO: 1797653 - protein, 24 aa, Staphylococcus epidermidis
GRYSYKMKHLYYLRISTLPLSLGN

SEQ ID NO: 1797654 - protein, 24 aa, Staphylococcus epidermidis
GSGKSITCKALIGLNAQRLSVSGD

SEQ ID NO: 1797655 - protein, 18 aa, Staphylococcus epidermidis
GSLVKAFRQCGFEIDKVV

SEQ ID NO: 1797656 - protein, 20 aa, Staphylococcus epidermidis
GSMYCKRYFKTKPNSKINGV

SEQ ID NO: 1797657 - protein, 25 aa, Staphylococcus epidermidis
GSPKPRLPFKHIFHKDQYDANQHQQ

SEQ ID NO: 1797658 - protein, 23 aa, Staphylococcus epidermidis
GSTYKIYFGFANRTAYEDFKASD

SEQ ID NO: 1797659 - protein, 17 aa, Staphylococcus epidermidis
GTCHFNYQTEPILDILV

SEQ ID NO: 1797660 - protein, 32 aa, Staphylococcus epidermidis
GTESQDWVSMLLRMYQRYCEQNGFKVETVDYL

SEQ ID NO: 1797661 - protein, 30 aa, Staphylococcus epidermidis
GTGHMPNLWPHLSLIRIPTLILVGEKDKKF

SEQ ID NO: 1797662 - protein, 25 aa, Staphylococcus epidermidis
GTGIKEMIDHYGIKQEETLVIGDSD

SEQ ID NO: 1797663 - protein, 23 aa, Staphylococcus epidermidis
GTIILKFFLCLDKDEQLKRFKDR

SEQ ID NO: 1797664 - protein, 17 aa, Staphylococcus epidermidis
GTVDAILFQNTDNFYTV

SEQ ID NO: 1797665 - protein, 23 aa, Staphylococcus epidermidis
GVDPAFRTGCKLAVVNPFGTFIA

SEQ ID NO: 1797666 - protein, 25 aa, Staphylococcus epidermidis
GVFKDIPAYELGATVIRQILEHSQI

SEQ ID NO: 1797667 - protein, 20 aa, Staphylococcus epidermidis
GVNELKRTSLSMIDSDLIKV

SEQ ID NO: 1797668 - protein, 23 aa, Staphylococcus epidermidis
GVQFPRDHFEDITPQQVKETFMT

SEQ ID NO: 1797669 - protein, 19 aa, Staphylococcus epidermidis
GVSDLPMNNAIEFKSPKQY

SEQ ID NO: 1797670 - protein, 30 aa, Staphylococcus epidermidis
GVTEPQPSFSTCFGAPFLPLSPTKYADLLG

SEQ ID NO: 1797671 - protein, 24 aa, Staphylococcus epidermidis
GVVTRPFGFEGRKRQTQAAAGVES

SEQ ID NO: 1797672 - protein, 19 aa, Staphylococcus epidermidis
GYGTKMMMFLPEYVQALFP

SEQ ID NO: 1797673 - protein, 20 aa, Staphylococcus epidermidis
GYLFVFVLDYYRHHLVDEVA

SEQ ID NO: 1797674 - protein, 22 aa, Staphylococcus epidermidis
GYPMPAVGLGVYKIADEQMEEV

SEQ ID NO: 1797675 - protein, 34 aa, Staphylococcus epidermidis
GYRTAEGFEGYFMMKRMNAPFILIADPRIEGGAF

SEQ ID NO: 1797676 - protein, 25 aa, Staphylococcus epidermidis
GYTEEYPGVFAFIGSDSKYDLHHPK

SEQ ID NO: 1797677 - protein, 26 aa, Staphylococcus epidermidis
GYYYISHQWFPLGAVHGLKYWFNYKS

SEQ ID NO: 1797678 - protein, 19 aa, Staphylococcus epidermidis
HAFAEKLKALGYEIKLEDQ

SEQ ID NO: 1797679 - protein, 17 aa, Staphylococcus epidermidis
HAFNYKTNKSIYNILTG

SEQ ID NO: 1797680 - protein, 29 aa, Staphylococcus epidermidis
HAQGLGFRGDIFGGYILYNLGFIESEDRY

SEQ ID NO: 1797681 - protein, 28 aa, Staphylococcus epidermidis
HASDWSEVRPEWGLARNAEFIIGKRQIT

SEQ ID NO: 1797682 - protein, 20 aa, Staphylococcus epidermidis
HEKWVCSVCAQGENPWLHSN

SEQ ID NO: 1797683 - protein, 25 aa, Staphylococcus epidermidis
HFDLDMLYRMIDIINDTLVSIRFSV

SEQ ID NO: 1797684 - protein, 20 aa, Staphylococcus epidermidis
HFLPSQANFVFVKTSRSQAL

SEQ ID NO: 1797685 - protein, 20 aa, Staphylococcus epidermidis
HFSSRIKGGHTNNKIRVSKS

SEQ ID NO: 1797686 - protein, 19 aa, Staphylococcus epidermidis
HGAGGIVLDVKVFNREEGD

SEQ ID NO: 1797687 - protein, 20 aa, Staphylococcus epidermidis
HGQTVFNLKGKIQGASDSPL

SEQ ID NO: 1797688 - protein, 18 aa, Staphylococcus epidermidis
HHHIDIYNGIGRIMGTSI

SEQ ID NO: 1797689 - protein, 21 aa, Staphylococcus epidermidis
HIEIFDRSWYGRVLVERVEGF

SEQ ID NO: 1797690 - protein, 17 aa, Staphylococcus epidermidis
HILNFTDIIALSVNNGI

SEQ ID NO: 1797691 - protein, 18 aa, Staphylococcus epidermidis
HKQDVINDIHLIRANNHL

SEQ ID NO: 1797692 - protein, 24 aa, Staphylococcus epidermidis
HKQKYRALNNISFSVEKGEFVAVM

SEQ ID NO: 1797693 - protein, 19 aa, Staphylococcus epidermidis
HLENKKIIIVHGGGQVISN

SEQ ID NO: 1797694 - protein, 26 aa, Staphylococcus epidermidis
HLLARAVARDVGRIMGFDETSLNEIS

SEQ ID NO: 1797695 - protein, 30 aa, Staphylococcus epidermidis
HLLSLKVARKSALKRYVFTGDIVLKNKKLS

SEQ ID NO: 1797696 - protein, 24 aa, Staphylococcus epidermidis
HLMNLKELFLVQLQERAIPFELNG

SEQ ID NO: 1797697 - protein, 18 aa, Staphylococcus epidermidis
HLPGLSIMKRMNRIAQTI

SEQ ID NO: 1797698 - protein, 27 aa, Staphylococcus epidermidis
HLQDVPGFKALRFLRPVVKGRHYIIIT

SEQ ID NO: 1797699 - protein, 18 aa, Staphylococcus epidermidis
HLYELKQPLEAKIETIVK

SEQ ID NO: 1797700 - protein, 20 aa, Staphylococcus epidermidis
HMAMFEFKQNVQIFGKSIIL

SEQ ID NO: 1797701 - protein, 24 aa, Staphylococcus epidermidis
HMIIFKPSQPITWKQHEVKLVFFL

SEQ ID NO: 1797702 - protein, 23 aa, Staphylococcus epidermidis
HMMPKLYDMIKIKSLIQQKLSLI

SEQ ID NO: 1797703 - protein, 18 aa, Staphylococcus epidermidis
HNDIKWIGNTNELNASYA

SEQ ID NO: 1797704 - protein, 19 aa, Staphylococcus epidermidis
HNLEYLKGVIWVIDPIDGT

SEQ ID NO: 1797705 - protein, 27 aa, Staphylococcus epidermidis
HPCVHGQALHCCSVEFIHPIYRSHYLI

SEQ ID NO: 1797706 - protein, 18 aa, Staphylococcus epidermidis
HPFTQLLHDAIRLAYNYD

SEQ ID NO: 1797707 - protein, 24 aa, Staphylococcus epidermidis
HPGDLKPPLNVYFSGYRTAEGFEG

SEQ ID NO: 1797708 - protein, 25 aa, Staphylococcus epidermidis
HPREIKNKIGFVYSEIYFNQKWTVK

SEQ ID NO: 1797709 - protein, 22 aa, Staphylococcus epidermidis
HQGPCLKCLLQTIPDTGESCAI

SEQ ID NO: 1797710 - protein, 23 aa, Staphylococcus epidermidis
HQLESFKFPGEILELQNGGRHHH

SEQ ID NO: 1797711 - protein, 23 aa, Staphylococcus epidermidis
HQLNQPYVFVGFHIEKIKHLLDS

SEQ ID NO: 1797712 - protein, 19 aa, Staphylococcus epidermidis
HQVQGLGPVIIKVNELSVT

SEQ ID NO: 1797713 - protein, 18 aa, Staphylococcus epidermidis
HRIHTRFNQTLAQTGRLS

SEQ ID NO: 1797714 - protein, 17 aa, Staphylococcus epidermidis
HRNAFDLTIAVLLSAQC

SEQ ID NO: 1797715 - protein, 21 aa, Staphylococcus epidermidis
HSGLTALFWNHGHLASELEPG

SEQ ID NO: 1797716 - protein, 22 aa, Staphylococcus epidermidis
HSKSNHLLTEFVTRHQIPTVTT

SEQ ID NO: 1797717 - protein, 21 aa, Staphylococcus epidermidis
HSRILNRHQFAGYGVNVIAIL

SEQ ID NO: 1797718 - protein, 18 aa, Staphylococcus epidermidis
HSVTYWVKLSRDIELHRL

SEQ ID NO: 1797719 - protein, 21 aa, Staphylococcus epidermidis
HSYHLKPRILITKHDLASEQE

SEQ ID NO: 1797720 - protein, 17 aa, Staphylococcus epidermidis
HTNIALIKYWGKADETY

SEQ ID NO: 1797721 - protein, 25 aa, Staphylococcus epidermidis
HTPGHSPGSLSFVFNDFAVVGDTLF

SEQ ID NO: 1797722 - protein, 22 aa, Staphylococcus epidermidis
HVERVSKRLGINRWKDSVRQVE

SEQ ID NO: 1797723 - protein, 18 aa, Staphylococcus epidermidis
HVRANWKDATDIIAAQIL

SEQ ID NO: 1797724 - protein, 28 aa, Staphylococcus epidermidis
HVRSGMGGFKGRALKKYDVIATQVNHNY

SEQ ID NO: 1797725 - protein, 21 aa, Staphylococcus epidermidis
HYRRGVNLAIQYLSYKKRTER

SEQ ID NO: 1797726 - protein, 18 aa, Staphylococcus epidermidis
HYVMVSTYDSRREAFDAS

SEQ ID NO: 1797727 - protein, 18 aa, Staphylococcus epidermidis
IAEKVGFSEYKMFCYHFK

SEQ ID NO: 1797728 - protein, 18 aa, Staphylococcus epidermidis
IAGKHPGKTIAIRADFDA

SEQ ID NO: 1797729 - protein, 24 aa, Staphylococcus epidermidis
IAKSIRFGATMVMIGSLFAAHEES

SEQ ID NO: 1797730 - protein, 19 aa, Staphylococcus epidermidis
IAMDLNYRLYDYFNGQQDI

SEQ ID NO: 1797731 - protein, 22 aa, Staphylococcus epidermidis
IASEAFKGLKPVFGSKNEVLIL

SEQ ID NO: 1797732 - protein, 21 aa, Staphylococcus epidermidis
IATGRPYRASQMYYHELNMST

SEQ ID NO: 1797733 - protein, 23 aa, Staphylococcus epidermidis
ICIGMAASMGSFLLAAGAKGKRF

SEQ ID NO: 1797734 - protein, 20 aa, Staphylococcus epidermidis
IDEVILVGGSTRIPAVQEAV

SEQ ID NO: 1797735 - protein, 24 aa, Staphylococcus epidermidis
IDGEVWSTICSFGQSQKNIELLNL

SEQ ID NO: 1797736 - protein, 18 aa, Staphylococcus epidermidis
IDIESLYTIDNWIDAYDV

SEQ ID NO: 1797737 - protein, 20 aa, Staphylococcus epidermidis
IDIKDLYNKIVIQRRGGFCY

SEQ ID NO: 1797738 - protein, 18 aa, Staphylococcus epidermidis
IDKSISFIDYMTSLSMSD

SEQ ID NO: 1797739 - protein, 23 aa, Staphylococcus epidermidis
IDPLKYNLLFERFLNPERVTMPD

SEQ ID NO: 1797740 - protein, 17 aa, Staphylococcus epidermidis
IDQINWVGFYLIENNEL

SEQ ID NO: 1797741 - protein, 22 aa, Staphylococcus epidermidis
IDRKEARRMDRFTQYAVVAARE

SEQ ID NO: 1797742 - protein, 22 aa, Staphylococcus epidermidis
IDRLAAKGKDVYDFPRVWLEKD

SEQ ID NO: 1797743 - protein, 17 aa, Staphylococcus epidermidis
IDYAIKHNIPVSINYDS

SEQ ID NO: 1797744 - protein, 20 aa, Staphylococcus epidermidis
IDYDELIIGLGCEDKYHNVP

SEQ ID NO: 1797745 - protein, 25 aa, Staphylococcus epidermidis
IEAARHLLKEGGRFIMVHRAERLMD

SEQ ID NO: 1797746 - protein, 18 aa, Staphylococcus epidermidis
IEAMGGKVPQSMKKHHTS

SEQ ID NO: 1797747 - protein, 17 aa, Staphylococcus epidermidis
IEATKIFLENSRFNVDL

SEQ ID NO: 1797748 - protein, 23 aa, Staphylococcus epidermidis
IECDTYRKYGHFEGDEQKVKSPD

SEQ ID NO: 1797749 - protein, 20 aa, Staphylococcus epidermidis
IEEFKKIILKTIFGENEVEE

SEQ ID NO: 1797750 - protein, 22 aa, Staphylococcus epidermidis
IEHPPQHFIALAAIGTIADLVS

SEQ ID NO: 1797751 - protein, 29 aa, Staphylococcus epidermidis
IEINRAESWLRSNIKEINFQLYNYAQENE

SEQ ID NO: 1797752 - protein, 22 aa, Staphylococcus epidermidis
IENSKWASVTFYIRTEKRMKKI

SEQ ID NO: 1797753 - protein, 24 aa, Staphylococcus epidermidis
IESGNGFIGQGFMKYESFDALLEQ

SEQ ID NO: 1797754 - protein, 22 aa, Staphylococcus epidermidis
IESKRGGGGYIRITKIENKDAT

SEQ ID NO: 1797755 - protein, 24 aa, Staphylococcus epidermidis
IEYDAIVPTQLWPTLETKAIKNLY

SEQ ID NO: 1797756 - protein, 20 aa, Staphylococcus epidermidis
IFAAAYSFKSVNSIKNIKKV

SEQ ID NO: 1797757 - protein, 18 aa, Staphylococcus epidermidis
IFNMIRYGYETTLSSNFK

SEQ ID NO: 1797758 - protein, 22 aa, Staphylococcus epidermidis
IFPKHVLFHKGILRNHASKGKM

SEQ ID NO: 1797759 - protein, 20 aa, Staphylococcus epidermidis
IGIKEVKLLNEFAINGLYPD

SEQ ID NO: 1797760 - protein, 17 aa, Staphylococcus epidermidis
IGNVTINGFPNVEKRPK

SEQ ID NO: 1797761 - protein, 20 aa, Staphylococcus epidermidis
IGSCGLDSIRVIKGQFGAHI

SEQ ID NO: 1797762 - protein, 25 aa, Staphylococcus epidermidis
IHCDGSDIIFEFNIGTVPMREIKTE

SEQ ID NO: 1797763 - protein, 24 aa, Staphylococcus epidermidis
IHEDGMRQLLNFDGTYFKLNKTEK

SEQ ID NO: 1797764 - protein, 18 aa, Staphylococcus epidermidis
IHEDSRKVYEYTIKGNTV

SEQ ID NO: 1797765 - protein, 24 aa, Staphylococcus epidermidis
IHPQLKICACLGLTKEEQAKKLKA

SEQ ID NO: 1797766 - protein, 17 aa, Staphylococcus epidermidis
IHPSEFRSNATVDSQTD

SEQ ID NO: 1797767 - protein, 27 aa, Staphylococcus epidermidis
IHQVAPISLEFYKQFIGGEATELHTYL

SEQ ID NO: 1797768 - protein, 19 aa, Staphylococcus epidermidis
IHRHPHIFGNAHVTSQEDL

SEQ ID NO: 1797769 - protein, 23 aa, Staphylococcus epidermidis
IIAFKKSFHGRTYGAMSATGQKK

SEQ ID NO: 1797770 - protein, 23 aa, Staphylococcus epidermidis
IIDRDAFEMGKKVIVQIRKRQVE

SEQ ID NO: 1797771 - protein, 19 aa, Staphylococcus epidermidis
IIEATSYIQEGKWKSWGPY

SEQ ID NO: 1797772 - protein, 23 aa, Staphylococcus epidermidis
IIGHSMGSIIARSFVEKYPDIAQ

SEQ ID NO: 1797773 - protein, 19 aa, Staphylococcus epidermidis
IIRDLRMGTYDAIVGINLL

SEQ ID NO: 1797774 - protein, 19 aa, Staphylococcus epidermidis
IIYHVYAPCSITMKQVIDN

SEQ ID NO: 1797775 - protein, 31 aa, Staphylococcus epidermidis
IKAELGDNLFVLLCIANSLNIDMTESFNDTM

SEQ ID NO: 1797776 - protein, 20 aa, Staphylococcus epidermidis
IKAQLLDWILPYYKNLSREG

SEQ ID NO: 1797777 - protein, 23 aa, Staphylococcus epidermidis
IKDFDLRLPELMNHLREDDLVII

SEQ ID NO: 1797778 - protein, 18 aa, Staphylococcus epidermidis
IKDKVIDIMNMFANHHNV

SEQ ID NO: 1797779 - protein, 26 aa, Staphylococcus epidermidis
IKEAYDLGIRAIMFFGVPNDKDDIGS

SEQ ID NO: 1797780 - protein, 20 aa, Staphylococcus epidermidis
IKGIGYQSVKLIIDERQQNG

SEQ ID NO: 1797781 - protein, 21 aa, Staphylococcus epidermidis
IKKAELAGILHDYCKYEDLST

SEQ ID NO: 1797782 - protein, 24 aa, Staphylococcus epidermidis
IKKYLMNRLVGFTRKILGVLEEFN

SEQ ID NO: 1797783 - protein, 17 aa, Staphylococcus epidermidis
IKNSLSPYEEIVDSADA

SEQ ID NO: 1797784 - protein, 17 aa, Staphylococcus epidermidis
IKPFTAMYQNIDEQRGI

SEQ ID NO: 1797785 - protein, 17 aa, Staphylococcus epidermidis
IKPTISVPIHYNTFPLI

SEQ ID NO: 1797786 - protein, 32 aa, Staphylococcus epidermidis
IKPYLEKGNALAFAHGFNIHFSVIEPPSDVDV

SEQ ID NO: 1797787 - protein, 18 aa, Staphylococcus epidermidis
IKRDFYLAEVLARKLVLP

SEQ ID NO: 1797788 - protein, 22 aa, Staphylococcus epidermidis
IKSEIKSLPGIYQISLNLLHEE

SEQ ID NO: 1797789 - protein, 18 aa, Staphylococcus epidermidis
IKSIKPGVTIKDIDKIAR

SEQ ID NO: 1797790 - protein, 25 aa, Staphylococcus epidermidis
IKTFRKCKYVFINGNSWDKVYKSSD

SEQ ID NO: 1797791 - protein, 20 aa, Staphylococcus epidermidis
IKYKKRSVLDETFVINMTPF

SEQ ID NO: 1797792 - protein, 17 aa, Staphylococcus epidermidis
ILERTAVVIKNRQIEAR

SEQ ID NO: 1797793 - protein, 27 aa, Staphylococcus epidermidis
ILHGPVCAALMKHEFDVNDEEVLLAIK

SEQ ID NO: 1797794 - protein, 19 aa, Staphylococcus epidermidis
ILIDLANVVVHVFHKDERS

SEQ ID NO: 1797795 - protein, 17 aa, Staphylococcus epidermidis
ILINEYIYFASKNKKLI

SEQ ID NO: 1797796 - protein, 24 aa, Staphylococcus epidermidis
ILLFWPIEGSMHFQQFMKERILSD

SEQ ID NO: 1797797 - protein, 28 aa, Staphylococcus epidermidis
ILMEHLRLAKYQDLMLISGKQFEVGNAV

SEQ ID NO: 1797798 - protein, 24 aa, Staphylococcus epidermidis
ILQHLAAKHGINFHEMAFKEEKKC

SEQ ID NO: 1797799 - protein, 24 aa, Staphylococcus epidermidis
INDFAYKHQIPWIYGGVVQSTYVQ

SEQ ID NO: 1797800 - protein, 23 aa, Staphylococcus epidermidis
INGDYPLTIVLIGEQLDVNRLKN

SEQ ID NO: 1797801 - protein, 28 aa, Staphylococcus epidermidis
INIGFPGVKGEVLVNAFSKQNVMVSTTS

SEQ ID NO: 1797802 - protein, 17 aa, Staphylococcus epidermidis
INIKYNFLPEKTTIKSI

SEQ ID NO: 1797803 - protein, 17 aa, Staphylococcus epidermidis
INIPVGVLLPFKSQCFV

SEQ ID NO: 1797804 - protein, 23 aa, Staphylococcus epidermidis
INLEIFKGDHIAIIGPNGVGKTT

SEQ ID NO: 1797805 - protein, 24 aa, Staphylococcus epidermidis
INLKSSGRMVGIISHVSELKQRIP

SEQ ID NO: 1797806 - protein, 23 aa, Staphylococcus epidermidis
INQLPRYIEMTIKGKKILFIHYE

SEQ ID NO: 1797807 - protein, 25 aa, Staphylococcus epidermidis
INVPEARLLVISPYDKSSVADIEKA

SEQ ID NO: 1797808 - protein, 20 aa, Staphylococcus epidermidis
IPEVIGVRLTHSLPQGSTAT

SEQ ID NO: 1797809 - protein, 18 aa, Staphylococcus epidermidis
IPFIKKMHHAGLFASISV

SEQ ID NO: 1797810 - protein, 24 aa, Staphylococcus epidermidis
IPFKGQMWLNRLGFVDDEQAYHNH

SEQ ID NO: 1797811 - protein, 18 aa, Staphylococcus epidermidis
IPHIKALLNELGAQTTTQ

SEQ ID NO: 1797812 - protein, 17 aa, Staphylococcus epidermidis
IPLKRFGEDTDIANTVA

SEQ ID NO: 1797813 - protein, 18 aa, Staphylococcus epidermidis
IPMCGVPYHSADNYIETL

SEQ ID NO: 1797814 - protein, 25 aa, Staphylococcus epidermidis
IPSKSLFKKCYKALINKKETDLIKE

SEQ ID NO: 1797815 - protein, 20 aa, Staphylococcus epidermidis
IPSLTLGCGSYGRNSISHNV

SEQ ID NO: 1797816 - protein, 25 aa, Staphylococcus epidermidis
IPVGVLLPFKSQCFVRHYNKGQIVY

SEQ ID NO: 1797817 - protein, 18 aa, Staphylococcus epidermidis
IQEAMKLGDRICLLNEGR

SEQ ID NO: 1797818 - protein, 17 aa, Staphylococcus epidermidis
IQEKTFRAGEKVEQAMI

SEQ ID NO: 1797819 - protein, 18 aa, Staphylococcus epidermidis
IQILKFEHAFYCEACGNM

SEQ ID NO: 1797820 - protein, 17 aa, Staphylococcus epidermidis
IQKGEIIVDGKPFKGNK

SEQ ID NO: 1797821 - protein, 21 aa, Staphylococcus epidermidis
IQKRFTYGLSEVMNISHRNRF

SEQ ID NO: 1797822 - protein, 19 aa, Staphylococcus epidermidis
IQLSHDFEKGSTFKVDVKR

SEQ ID NO: 1797823 - protein, 25 aa, Staphylococcus epidermidis
IQPGDDIGRAFSFETTEFILDQLPC

SEQ ID NO: 1797824 - protein, 23 aa, Staphylococcus epidermidis
IQQGLGRTGKWSSVDHYHFTPDL

SEQ ID NO: 1797825 - protein, 24 aa, Staphylococcus epidermidis
IQSRFPYENIEWLIKEGYTKLTLP

SEQ ID NO: 1797826 - protein, 25 aa, Staphylococcus epidermidis
IQYRTNLYMTMFRFREHRIVAFSGG

SEQ ID NO: 1797827 - protein, 21 aa, Staphylococcus epidermidis
IRAKFLPKLNFAIIDEVDSII

SEQ ID NO: 1797828 - protein, 19 aa, Staphylococcus epidermidis
IREAFKDKILIPQNDLNHA

SEQ ID NO: 1797829 - protein, 17 aa, Staphylococcus epidermidis
IRIGFLLGPEYLIEKLT

SEQ ID NO: 1797830 - protein, 19 aa, Staphylococcus epidermidis
IRKAFKPTSKDSVILSADY

SEQ ID NO: 1797831 - protein, 23 aa, Staphylococcus epidermidis
IRNRFNIKVSVFRSADEAIDSAD

SEQ ID NO: 1797832 - protein, 18 aa, Staphylococcus epidermidis
IRNRVRMNQSIKVLVPKR

SEQ ID NO: 1797833 - protein, 18 aa, Staphylococcus epidermidis
IRQKYLDFFVEKGHMIEP

SEQ ID NO: 1797834 - protein, 23 aa, Staphylococcus epidermidis
IRYHTRIAPGIEIPDARYKNWFP

SEQ ID NO: 1797835 - protein, 17 aa, Staphylococcus epidermidis
ISCDKGFTVINIKKYLM

SEQ ID NO: 1797836 - protein, 26 aa, Staphylococcus epidermidis
ISGKELRDTLHFEMLWDTSKIDVIIR

SEQ ID NO: 1797837 - protein, 34 aa, Staphylococcus epidermidis
ISGLNRAKATYKFAGGKGINVSRVLKTLDVDSTA

SEQ ID NO: 1797838 - protein, 20 aa, Staphylococcus epidermidis
ISKKIAHTMSHYYSQEHQII

SEQ ID NO: 1797839 - protein, 22 aa, Staphylococcus epidermidis
ISLKEDEDWMKEMISTIEPPDA

SEQ ID NO: 1797840 - protein, 23 aa, Staphylococcus epidermidis
ISNDYRISYDFIQSIQELSGIPT

SEQ ID NO: 1797841 - protein, 19 aa, Staphylococcus epidermidis
ISNTGQRAITHIINSKMIK

SEQ ID NO: 1797842 - protein, 25 aa, Staphylococcus epidermidis
ISPNEFKFGLSFLTRSVALSRFPWL

SEQ ID NO: 1797843 - protein, 20 aa, Staphylococcus epidermidis
ISQEILLSFLERNHIQYRTN

SEQ ID NO: 1797844 - protein, 35 aa, Staphylococcus epidermidis
ISQNLRHKYVWSTPFLMRVEENFRPYMHIMEHDFK

SEQ ID NO: 1797845 - protein, 19 aa, Staphylococcus epidermidis
ISQYFKRKYNFLYSEEEII

SEQ ID NO: 1797846 - protein, 25 aa, Staphylococcus epidermidis
ISYEEWLKEINLSLNGAFSVAQTVG

SEQ ID NO: 1797847 - protein, 21 aa, Staphylococcus epidermidis
ITKRLGFKKGHTFEEPLVEFF

SEQ ID NO: 1797848 - protein, 18 aa, Staphylococcus epidermidis
ITLWNSRQAFYDWQNSQA

SEQ ID NO: 1797849 - protein, 24 aa, Staphylococcus epidermidis
ITLYKLKSLFDYLNIELTTMDTPL

SEQ ID NO: 1797850 - protein, 25 aa, Staphylococcus epidermidis
ITPDSIGLILGFLVQRFLEHKKEMH

SEQ ID NO: 1797851 - protein, 19 aa, Staphylococcus epidermidis
ITTQIAHMIIRYFEDGPIR

SEQ ID NO: 1797852 - protein, 22 aa, Staphylococcus epidermidis
IVACNSCGDDGHTNYAGNSIVI

SEQ ID NO: 1797853 - protein, 17 aa, Staphylococcus epidermidis
IVEALTLSEQTEKLKEL

SEQ ID NO: 1797854 - protein, 17 aa, Staphylococcus epidermidis
IVEEFRSAQYEANDLLQ

SEQ ID NO: 1797855 - protein, 21 aa, Staphylococcus epidermidis
IVFDRGGYLYHGRVKALADAA

SEQ ID NO: 1797856 - protein, 17 aa, Staphylococcus epidermidis
IVNEARSARAYGSAALE

SEQ ID NO: 1797857 - protein, 18 aa, Staphylococcus epidermidis
IVTFGHLLARAVARDVGR

SEQ ID NO: 1797858 - protein, 25 aa, Staphylococcus epidermidis
IVTRLKGGDPFVFGRGGEEAEELAC

SEQ ID NO: 1797859 - protein, 20 aa, Staphylococcus epidermidis
IVVGMLPWRKINTVNSEYVN

SEQ ID NO: 1797860 - protein, 26 aa, Staphylococcus epidermidis
IYAEQLSNMWLYRHFILHLDQLDSSF

SEQ ID NO: 1797861 - protein, 18 aa, Staphylococcus epidermidis
IYKATALTMKYSSFTVAI

SEQ ID NO: 1797862 - protein, 25 aa, Staphylococcus epidermidis
IYRNYPIRFSIMGHVHFRKKLVENN

SEQ ID NO: 1797863 - protein, 25 aa, Staphylococcus epidermidis
IYRVYKYKFGITFPIHAKINVNGEH

SEQ ID NO: 1797864 - protein, 24 aa, Staphylococcus epidermidis
IYSNELNTGIGLGMPTFDSPVNPL

SEQ ID NO: 1797865 - protein, 19 aa, Staphylococcus epidermidis
KADGVSIVDHLTAAKQFEM

SEQ ID NO: 1797866 - protein, 34 aa, Staphylococcus epidermidis
KAIEKLGFPFIVKTRFGGYDGKGQILVRNDSELD

SEQ ID NO: 1797867 - protein, 18 aa, Staphylococcus epidermidis
KAIIPKKLARDVGADLIM

SEQ ID NO: 1797868 - protein, 18 aa, Staphylococcus epidermidis
KALFGNDSRKDFPLLTKI

SEQ ID NO: 1797869 - protein, 17 aa, Staphylococcus epidermidis
KALVSALKKYPALNTSF

SEQ ID NO: 1797870 - protein, 20 aa, Staphylococcus epidermidis
KAMALIGVIELLKQAKNRKL

SEQ ID NO: 1797871 - protein, 36 aa, Staphylococcus epidermidis
KAMINRLNLFKAYHYQAKILLLAWNRYLTQTASQYI

SEQ ID NO: 1797872 - protein, 22 aa, Staphylococcus epidermidis
KANGKMLVIDGGFSKAYQSTTG

SEQ ID NO: 1797873 - protein, 22 aa, Staphylococcus epidermidis
KAYKSRDAMQFIKKDSPPILII

SEQ ID NO: 1797874 - protein, 20 aa, Staphylococcus epidermidis
KAYYKWRIDETYIKIKGKWS

SEQ ID NO: 1797875 - protein, 26 aa, Staphylococcus epidermidis
KCTRDIKPLNFMTGFSEYKTVHFQNT

SEQ ID NO: 1797876 - protein, 23 aa, Staphylococcus epidermidis
KDEKAKELIKLVDLPEEYLDRYP

SEQ ID NO: 1797877 - protein, 25 aa, Staphylococcus epidermidis
KDENIPLWVDRDCPFNIEGGDELVL

SEQ ID NO: 1797878 - protein, 26 aa, Staphylococcus epidermidis
KDGRLFICYLGDFKTTGGIFATTEKG

SEQ ID NO: 1797879 - protein, 25 aa, Staphylococcus epidermidis
KDIARFRREMMGFVFQDFNVLNTMS

SEQ ID NO: 1797880 - protein, 18 aa, Staphylococcus epidermidis
KDILEFINYYQKHRGERL

SEQ ID NO: 1797881 - protein, 19 aa, Staphylococcus epidermidis
KDKQLKEAHSFPFGVVSLK

SEQ ID NO: 1797882 - protein, 19 aa, Staphylococcus epidermidis
KDLDITFTLLRPTVEADLE

SEQ ID NO: 1797883 - protein, 17 aa, Staphylococcus epidermidis
KDLLGGKGANLSEMKRL

SEQ ID NO: 1797884 - protein, 28 aa, Staphylococcus epidermidis
KDLRDIKKDIGMIFQHFNLLNSKSVYKN

SEQ ID NO: 1797885 - protein, 19 aa, Staphylococcus epidermidis
KDLTELVLTLGSQMVVLAE

SEQ ID NO: 1797886 - protein, 21 aa, Staphylococcus epidermidis
KDVYKNKPFIRIKDGLPQLNE

SEQ ID NO: 1797887 - protein, 24 aa, Staphylococcus epidermidis
KDYGFNIIIAGSFSDIFYMNCTKN

SEQ ID NO: 1797888 - protein, 21 aa, Staphylococcus epidermidis
KDYIQPRMTMITPIDKTDDEL

SEQ ID NO: 1797889 - protein, 20 aa, Staphylococcus epidermidis
KEADLILFGHNHRLHMFDDK

SEQ ID NO: 1797890 - protein, 19 aa, Staphylococcus epidermidis
KEAGIKHYVMVSTYDSRRE

SEQ ID NO: 1797891 - protein, 21 aa, Staphylococcus epidermidis
KEARGKGGHVRANWKDATDII

SEQ ID NO: 1797892 - protein, 19 aa, Staphylococcus epidermidis
KEEFEKVMLEMSANEKYDL

SEQ ID NO: 1797893 - protein, 26 aa, Staphylococcus epidermidis
KEEGRNCKFIAVKLPYGVQQDAHEVE

SEQ ID NO: 1797894 - protein, 19 aa, Staphylococcus epidermidis
KEEVPETYYTVPLGKADVK

SEQ ID NO: 1797895 - protein, 20 aa, Staphylococcus epidermidis
KEFESFLSTYYVNKGKYDIT

SEQ ID NO: 1797896 - protein, 24 aa, Staphylococcus epidermidis
KEGLNHVISRHFKIRNALRAALKA

SEQ ID NO: 1797897 - protein, 22 aa, Staphylococcus epidermidis
KEGTCKVEIFLNNHLLSLKVAR

SEQ ID NO: 1797898 - protein, 17 aa, Staphylococcus epidermidis
KEHKILLAVDNTFMTPL

SEQ ID NO: 1797899 - protein, 25 aa, Staphylococcus epidermidis
KEHMPIQVIYGFAQLKRGAALANHE

SEQ ID NO: 1797900 - protein, 20 aa, Staphylococcus epidermidis
KEIFNDLNLSISEHERIGLV

SEQ ID NO: 1797901 - protein, 20 aa, Staphylococcus epidermidis
KEIKELVAQLTLNFLDNDVD

SEQ ID NO: 1797902 - protein, 20 aa, Staphylococcus epidermidis
KEKELRFLKFFHQQKYNVVD

SEQ ID NO: 1797903 - protein, 19 aa, Staphylococcus epidermidis
KEKHPRLLVTRTVKKNSGK

SEQ ID NO: 1797904 - protein, 18 aa, Staphylococcus epidermidis
KEKLSRIETLEELHKHEA

SEQ ID NO: 1797905 - protein, 18 aa, Staphylococcus epidermidis
KEKVLSIKIDFDTTRIQR

SEQ ID NO: 1797906 - protein, 23 aa, Staphylococcus epidermidis
KELFKRVLPDALIKLEKAGYETS

SEQ ID NO: 1797907 - protein, 25 aa, Staphylococcus epidermidis
KELTEPKIKVGDTVTEGDIIGYIEA

SEQ ID NO: 1797908 - protein, 20 aa, Staphylococcus epidermidis
KESINHCYFIIPTEEFEEEA

SEQ ID NO: 1797909 - protein, 18 aa, Staphylococcus epidermidis
KESIRYYNNHLVLVKYNE

SEQ ID NO: 1797910 - protein, 21 aa, Staphylococcus epidermidis
KETKEGHAFVLTEHTAETNIY

SEQ ID NO: 1797911 - protein, 17 aa, Staphylococcus epidermidis
KETLDYFIDAMIQIADE

SEQ ID NO: 1797912 - protein, 22 aa, Staphylococcus epidermidis
KEVEGRFKTTFHAVQDHFTTVF

SEQ ID NO: 1797913 - protein, 21 aa, Staphylococcus epidermidis
KEVEKRLFLARKQIEKYSETQ

SEQ ID NO: 1797914 - protein, 22 aa, Staphylococcus epidermidis
KEVPHRSSFSYILMDRHSNYAI

SEQ ID NO: 1797915 - protein, 21 aa, Staphylococcus epidermidis
KFEADWCPDCKAMDMWIDPIV

SEQ ID NO: 1797916 - protein, 20 aa, Staphylococcus epidermidis
KFPERNRLISGLSRGVLITE

SEQ ID NO: 1797917 - protein, 29 aa, Staphylococcus epidermidis
KGIDVSGPFPRMTYAEAMDRFGSDKPDTR

SEQ ID NO: 1797918 - protein, 19 aa, Staphylococcus epidermidis
KGILDMKGGFTDSFTNAFS

SEQ ID NO: 1797919 - protein, 24 aa, Staphylococcus epidermidis
KGINKDVSIEWNIPDITPQNVIDY

SEQ ID NO: 1797920 - protein, 17 aa, Staphylococcus epidermidis
KGLPPIYMYGGGREILS

SEQ ID NO: 1797921 - protein, 27 aa, Staphylococcus epidermidis
KHLRHIRKEVGIVFQFPESQLFEDSVE

SEQ ID NO: 1797922 - protein, 21 aa, Staphylococcus epidermidis
KHLSAKDLILLNGDLGAGKTT

SEQ ID NO: 1797923 - protein, 17 aa, Staphylococcus epidermidis
KIKNLPVAMTINQKRFN

SEQ ID NO: 1797924 - protein, 26 aa, Staphylococcus epidermidis
KILSKRELEILPLIAKGYGNKDIAEK

SEQ ID NO: 1797925 - protein, 19 aa, Staphylococcus epidermidis
KIQLIIRGICCLKPGIPGI

SEQ ID NO: 1797926 - protein, 17 aa, Staphylococcus epidermidis
KIQQRLYIKLSTTENAP

SEQ ID NO: 1797927 - protein, 20 aa, Staphylococcus epidermidis
KIQYTLRLTPVYSTDQPVEK

SEQ ID NO: 1797928 - protein, 19 aa, Staphylococcus epidermidis
KIYYREGFVQTGRAYFRLV

SEQ ID NO: 1797929 - protein, 17 aa, Staphylococcus epidermidis
KKFQIAVNEEFVRQDDI

SEQ ID NO: 1797930 - protein, 19 aa, Staphylococcus epidermidis
KKGSYVRKRIDPWIERYQY

SEQ ID NO: 1797931 - protein, 22 aa, Staphylococcus epidermidis
KKKAAEKIGMISEIIHLDESTS

SEQ ID NO: 1797932 - protein, 19 aa, Staphylococcus epidermidis
KKLGKEVIFVPETRGEKLE

SEQ ID NO: 1797933 - protein, 19 aa, Staphylococcus epidermidis
KKMCSLHAELPSLDIDVWI

SEQ ID NO: 1797934 - protein, 19 aa, Staphylococcus epidermidis
KKMHVRPRREIVALDLEED

SEQ ID NO: 1797935 - protein, 20 aa, Staphylococcus epidermidis
KKNAIVYACDRILNGELDNH

SEQ ID NO: 1797936 - protein, 19 aa, Staphylococcus epidermidis
KKNLEHFLNNYDVIENKVD

SEQ ID NO: 1797937 - protein, 19 aa, Staphylococcus epidermidis
KKSKASLLTSEYEGFGLTV

SEQ ID NO: 1797938 - protein, 20 aa, Staphylococcus epidermidis
KKSTPLKVYVNGHFENVTFP

SEQ ID NO: 1797939 - protein, 17 aa, Staphylococcus epidermidis
KKVLIKECNLMNVNNNT

SEQ ID NO: 1797940 - protein, 24 aa, Staphylococcus epidermidis
KKVTRLAEHLGWKGKGSNFDILPL

SEQ ID NO: 1797941 - protein, 20 aa, Staphylococcus epidermidis
KLCQEIPEIDVIFGSHTHHH

SEQ ID NO: 1797942 - protein, 23 aa, Staphylococcus epidermidis
KLFPEGPITMTLIHEMRLMWQEM

SEQ ID NO: 1797943 - protein, 18 aa, Staphylococcus epidermidis
KLHIHLRVNNSDSVINDI

SEQ ID NO: 1797944 - protein, 18 aa, Staphylococcus epidermidis
KLLKDLQTEYGISAEQSH

SEQ ID NO: 1797945 - protein, 18 aa, Staphylococcus epidermidis
KLLSFLAEYKNVFINSPQ

SEQ ID NO: 1797946 - protein, 17 aa, Staphylococcus epidermidis
KLNLSLKDNDYFKNYER

SEQ ID NO: 1797947 - protein, 19 aa, Staphylococcus epidermidis
KLPSAKYQVEFKAKKDGYI

SEQ ID NO: 1797948 - protein, 22 aa, Staphylococcus epidermidis
KLPYQHVFQAVVYISGQKVNNN

SEQ ID NO: 1797949 - protein, 18 aa, Staphylococcus epidermidis
KLQYKDYSEWMVHRDLSK

SEQ ID NO: 1797950 - protein, 21 aa, Staphylococcus epidermidis
KLTGKVAMVIGGATGIGKAMA

SEQ ID NO: 1797951 - protein, 23 aa, Staphylococcus epidermidis
KLTTQFYPTQFIKFEEATIETDH

SEQ ID NO: 1797952 - protein, 25 aa, Staphylococcus epidermidis
KMLAKEILNDLGILKKGVFTHDIDP

SEQ ID NO: 1797953 - protein, 22 aa, Staphylococcus epidermidis
KMMMFLPEYVQALFPDFTHLYL

SEQ ID NO: 1797954 - protein, 20 aa, Staphylococcus epidermidis
KMNPMVFCGLFPIDNKDYND

SEQ ID NO: 1797955 - protein, 18 aa, Staphylococcus epidermidis
KMSDAKCIKTRQVYPQDT

SEQ ID NO: 1797956 - protein, 28 aa, Staphylococcus epidermidis
KNDEAIILVSLPFNASWLNQRYSEIMQA

SEQ ID NO: 1797957 - protein, 21 aa, Staphylococcus epidermidis
KNFKYSMSVVLECHIYTLRQE

SEQ ID NO: 1797958 - protein, 18 aa, Staphylococcus epidermidis
KNLGHAFGYGSHGTTFGG

SEQ ID NO: 1797959 - protein, 26 aa, Staphylococcus epidermidis
KNMLYRLGALGLNIGSEISIKQKCLL

SEQ ID NO: 1797960 - protein, 19 aa, Staphylococcus epidermidis
KNNFDSIGTLNIWYITTIQ

SEQ ID NO: 1797961 - protein, 26 aa, Staphylococcus epidermidis
KNNFKGKEIFSALSKYEVKRRGDMED

SEQ ID NO: 1797962 - protein, 18 aa, Staphylococcus epidermidis
KNSEIGMINLCFEIFDDR

SEQ ID NO: 1797963 - protein, 19 aa, Staphylococcus epidermidis
KNSGPWLKDTLREIEIAVI

SEQ ID NO: 1797964 - protein, 17 aa, Staphylococcus epidermidis
KNSHSFLIMPLDAMGLK

SEQ ID NO: 1797965 - protein, 25 aa, Staphylococcus epidermidis
KNVTEAIKFLKEVPHRSSFSYILMD

SEQ ID NO: 1797966 - protein, 19 aa, Staphylococcus epidermidis
KPAIHHTMGGLKINTHAQV

SEQ ID NO: 1797967 - protein, 17 aa, Staphylococcus epidermidis
KPHLSPMSVIASLLPTG

SEQ ID NO: 1797968 - protein, 24 aa, Staphylococcus epidermidis
KPIGTLRDGKLELVHNSRTQNSSV

SEQ ID NO: 1797969 - protein, 17 aa, Staphylococcus epidermidis
KPILELKKHIDIKAMSH

SEQ ID NO: 1797970 - protein, 25 aa, Staphylococcus epidermidis
KPKEVDIQRALLCMNPENLVLNSKT

SEQ ID NO: 1797971 - protein, 19 aa, Staphylococcus epidermidis
KPMLARGELHCIGATTLNE

SEQ ID NO: 1797972 - protein, 18 aa, Staphylococcus epidermidis
KPNFTIVSAPHFKANPKL

SEQ ID NO: 1797973 - protein, 18 aa, Staphylococcus epidermidis
KPNHFLVAFDAGKTTFRH

SEQ ID NO: 1797974 - protein, 21 aa, Staphylococcus epidermidis
KPVMESLILISMRQRMANDPK

SEQ ID NO: 1797975 - protein, 19 aa, Staphylococcus epidermidis
KQEVRLHIIQMETSLFKQY

SEQ ID NO: 1797976 - protein, 19 aa, Staphylococcus epidermidis
KQFDEFSGMTGTGKLGEKE

SEQ ID NO: 1797977 - protein, 26 aa, Staphylococcus epidermidis
KQFGTRVVLGRFGLILSDDGGALEMM

SEQ ID NO: 1797978 - protein, 26 aa, Staphylococcus epidermidis
KQGITKFRIVPLLIFSAMHYISDIPQ

SEQ ID NO: 1797979 - protein, 22 aa, Staphylococcus epidermidis
KQHNIHVIPLSLTIDGKSYTDQ

SEQ ID NO: 1797980 - protein, 17 aa, Staphylococcus epidermidis
KQIKANQMIGIMITHDE

SEQ ID NO: 1797981 - protein, 22 aa, Staphylococcus epidermidis
KQLEIFEGKSIMFTASHNVNEH

SEQ ID NO: 1797982 - protein, 17 aa, Staphylococcus epidermidis
KQLEKWGVDVLEAGFPA

SEQ ID NO: 1797983 - protein, 20 aa, Staphylococcus epidermidis
KQLRKGSVKRIVLTRPAVEA

SEQ ID NO: 1797984 - protein, 23 aa, Staphylococcus epidermidis
KQPIYRQTAAYGHFGRTDVLLPW

SEQ ID NO: 1797985 - protein, 19 aa, Staphylococcus epidermidis
KQRCSHQPQLIIGTPTRIN

SEQ ID NO: 1797986 - protein, 20 aa, Staphylococcus epidermidis
KQRQSILEILAQVEVNIDYP

SEQ ID NO: 1797987 - protein, 19 aa, Staphylococcus epidermidis
KQSHIFAAAYSFKSVNSIK

SEQ ID NO: 1797988 - protein, 20 aa, Staphylococcus epidermidis
KQTLIIEIARFVPSMKLKNK

SEQ ID NO: 1797989 - protein, 19 aa, Staphylococcus epidermidis
KQVEVIRAQRLLNGRASTS

SEQ ID NO: 1797990 - protein, 22 aa, Staphylococcus epidermidis
KQYAELLVRVGMNVQPQQPVFI

SEQ ID NO: 1797991 - protein, 17 aa, Staphylococcus epidermidis
KQYKEKNIDVVIGLGGG

SEQ ID NO: 1797992 - protein, 20 aa, Staphylococcus epidermidis
KRAQRGITLLKELKKKPHRI

SEQ ID NO: 1797993 - protein, 20 aa, Staphylococcus epidermidis
KRGYPIGQILMPGRDDGKML

SEQ ID NO: 1797994 - protein, 19 aa, Staphylococcus epidermidis
KRIKQIILVSPTLGSHMLV

SEQ ID NO: 1797995 - protein, 20 aa, Staphylococcus epidermidis
KRLGPYTKIELIEVPDEKAP

SEQ ID NO: 1797996 - protein, 24 aa, Staphylococcus epidermidis
KRLKQPLKRRVPGIELLEECLKIA

SEQ ID NO: 1797997 - protein, 17 aa, Staphylococcus epidermidis
KRMKVTDYLSGVQESLV

SEQ ID NO: 1797998 - protein, 20 aa, Staphylococcus epidermidis
KRQALPEVVLPDHLPQLQSL

SEQ ID NO: 1797999 - protein, 18 aa, Staphylococcus epidermidis
KRRRLKWVNQLLNKTFNK

SEQ ID NO: 1798000 - protein, 19 aa, Staphylococcus epidermidis
KRSLQWGNDAYTMILDRLN

SEQ ID NO: 1798001 - protein, 23 aa, Staphylococcus epidermidis
KRSSGKIAFLQLRDGTGFMQGVV

SEQ ID NO: 1798002 - protein, 25 aa, Staphylococcus epidermidis
KRSSYLIDLLENFVLERGIYGKRWL

SEQ ID NO: 1798003 - protein, 19 aa, Staphylococcus epidermidis
KRTSLSMIDSDLIKVPAIK

SEQ ID NO: 1798004 - protein, 22 aa, Staphylococcus epidermidis
KSAARERIFISPLARNMAEDKG

SEQ ID NO: 1798005 - protein, 17 aa, Staphylococcus epidermidis
KSFILGAIANQLKSQKI

SEQ ID NO: 1798006 - protein, 17 aa, Staphylococcus epidermidis
KSIFGDREMFFISENGA

SEQ ID NO: 1798007 - protein, 25 aa, Staphylococcus epidermidis
KSIKRHKQTFLLGGGHDIAYAQYLA

SEQ ID NO: 1798008 - protein, 22 aa, Staphylococcus epidermidis
KSIKVHALKGIIAMGPIIKTLQ

SEQ ID NO: 1798009 - protein, 18 aa, Staphylococcus epidermidis
KSLLATPMVTSFPQLYIL

SEQ ID NO: 1798010 - protein, 25 aa, Staphylococcus epidermidis
KSLTGACPMGPYIVTKDELPAPENV

SEQ ID NO: 1798011 - protein, 23 aa, Staphylococcus epidermidis
KSRFKNCNFNEGIFKNIEAICNC

SEQ ID NO: 1798012 - protein, 18 aa, Staphylococcus epidermidis
KSSHIHVVIACYYGLGIS

SEQ ID NO: 1798013 - protein, 19 aa, Staphylococcus epidermidis
KSSYKIALENSDKVAQYLL

SEQ ID NO: 1798014 - protein, 25 aa, Staphylococcus epidermidis
KSVPFRTAHEIVGKIVLNCIHKGIY

SEQ ID NO: 1798015 - protein, 25 aa, Staphylococcus epidermidis
KTELPIEGILLFSPMLELKRDYKGR

SEQ ID NO: 1798016 - protein, 21 aa, Staphylococcus epidermidis
KTFKHWIQTNHYWKYVEKYGV

SEQ ID NO: 1798017 - protein, 24 aa, Staphylococcus epidermidis
KTITPLRYVLPFNEQNRYLVMPAL

SEQ ID NO: 1798018 - protein, 18 aa, Staphylococcus epidermidis
KTKGDVHLVGVKDDQEDV

SEQ ID NO: 1798019 - protein, 19 aa, Staphylococcus epidermidis
KTKTVYTDLLFLYLEHAFL

SEQ ID NO: 1798020 - protein, 23 aa, Staphylococcus epidermidis
KTLLNPVKFDFSLTVDGETKEGN

SEQ ID NO: 1798021 - protein, 23 aa, Staphylococcus epidermidis
KTTYRISIEEFVVLYKVYADTKI

SEQ ID NO: 1798022 - protein, 17 aa, Staphylococcus epidermidis
KVAAMDFIFKDDPSELK

SEQ ID NO: 1798023 - protein, 20 aa, Staphylococcus epidermidis
KVEKDIYKATALTMKYSSFT

SEQ ID NO: 1798024 - protein, 21 aa, Staphylococcus epidermidis
KVKPIHCRVSIHFDGSYQFNG

SEQ ID NO: 1798025 - protein, 20 aa, Staphylococcus epidermidis
KVKRYLQGRKTRLVGPNCPG

SEQ ID NO: 1798026 - protein, 18 aa, Staphylococcus epidermidis
KVKYWLFNTLDRIRNKLK

SEQ ID NO: 1798027 - protein, 18 aa, Staphylococcus epidermidis
KVLIHVSNFRKVKRIDTV

SEQ ID NO: 1798028 - protein, 24 aa, Staphylococcus epidermidis
KVQKEIFLLSEILAGKNDYKLTLE

SEQ ID NO: 1798029 - protein, 17 aa, Staphylococcus epidermidis
KVRMMSFTGSGPTGSKI

SEQ ID NO: 1798030 - protein, 17 aa, Staphylococcus epidermidis
KVRTEGKSFYRLNVRIN

SEQ ID NO: 1798031 - protein, 27 aa, Staphylococcus epidermidis
KVYLELWVKVQRDWRNKVNFIRQIGYV

SEQ ID NO: 1798032 - protein, 18 aa, Staphylococcus epidermidis
KYGVEPIVALNAFIHDTP

SEQ ID NO: 1798033 - protein, 27 aa, Staphylococcus epidermidis
KYHHLRLCGGFQFSSHKSDDEWREYGL

SEQ ID NO: 1798034 - protein, 24 aa, Staphylococcus epidermidis
KYIKTPRKIKGLIDKQGKKSGLIH

SEQ ID NO: 1798035 - protein, 17 aa, Staphylococcus epidermidis
KYNTLPVSHLIYLHSAA

SEQ ID NO: 1798036 - protein, 19 aa, Staphylococcus epidermidis
KYPYIRGKLLDLWTEALEE

SEQ ID NO: 1798037 - protein, 22 aa, Staphylococcus epidermidis
KYQLIFCFDGLDFFRFGRIQRI

SEQ ID NO: 1798038 - protein, 20 aa, Staphylococcus epidermidis
KYTQHIGGTCHFNYQTEPIL

SEQ ID NO: 1798039 - protein, 19 aa, Staphylococcus epidermidis
KYWLNELNISIYNEKTKTG

SEQ ID NO: 1798040 - protein, 28 aa, Staphylococcus epidermidis
LAEKAKELGCLFAFYGHTHVAKYEQIGG

SEQ ID NO: 1798041 - protein, 18 aa, Staphylococcus epidermidis
LAEKYANIATNCYDTAEI

SEQ ID NO: 1798042 - protein, 19 aa, Staphylococcus epidermidis
LAERVGPIKLHLVPFTEIQ

SEQ ID NO: 1798043 - protein, 17 aa, Staphylococcus epidermidis
LAFKTCKCNGEISERVK

SEQ ID NO: 1798044 - protein, 19 aa, Staphylococcus epidermidis
LAGAVLKKDLETFAKKMDY

SEQ ID NO: 1798045 - protein, 26 aa, Staphylococcus epidermidis
LAQMKPGDIIQFKWITVEEASKKLKE

SEQ ID NO: 1798046 - protein, 18 aa, Staphylococcus epidermidis
LASKYGLIISNVPSYSPR

SEQ ID NO: 1798047 - protein, 17 aa, Staphylococcus epidermidis
LATLKVIGVGGGGNNAV

SEQ ID NO: 1798048 - protein, 19 aa, Staphylococcus epidermidis
LAYTIAHCGDYNYFSFKGM

SEQ ID NO: 1798049 - protein, 18 aa, Staphylococcus epidermidis
LCPNGYYVTSRFDTYREV

SEQ ID NO: 1798050 - protein, 18 aa, Staphylococcus epidermidis
LCQYKNLFSQEEMNDIIK

SEQ ID NO: 1798051 - protein, 17 aa, Staphylococcus epidermidis
LDEKLALKFKDDIKLVS

SEQ ID NO: 1798052 - protein, 21 aa, Staphylococcus epidermidis
LDHHMKGCIMEKINDGAQEEA

SEQ ID NO: 1798053 - protein, 25 aa, Staphylococcus epidermidis
LDHHPKGSGLGLYGMRERAELVNGH

SEQ ID NO: 1798054 - protein, 17 aa, Staphylococcus epidermidis
LDKDSVILLEQIRTLDK

SEQ ID NO: 1798055 - protein, 25 aa, Staphylococcus epidermidis
LDKDVIRRRVSLMKDAGVLFKTGVE

SEQ ID NO: 1798056 - protein, 22 aa, Staphylococcus epidermidis
LDKGFIPRLDYHYQRISTSSEH

SEQ ID NO: 1798057 - protein, 25 aa, Staphylococcus epidermidis
LDKKRLKEKLTFLSESKMIEVDNAL

SEQ ID NO: 1798058 - protein, 24 aa, Staphylococcus epidermidis
LDQDDIRLALDRAINDKERGLSTY

SEQ ID NO: 1798059 - protein, 22 aa, Staphylococcus epidermidis
LDQMLKCLKNVHVAANEYQGEL

SEQ ID NO: 1798060 - protein, 20 aa, Staphylococcus epidermidis
LDSARFRYLISKELGVTSSS

SEQ ID NO: 1798061 - protein, 24 aa, Staphylococcus epidermidis
LDSHKRLVGAEIYGNDAGDLVNLL

SEQ ID NO: 1798062 - protein, 18 aa, Staphylococcus epidermidis
LDVEFKFDREEETLRIVR

SEQ ID NO: 1798063 - protein, 17 aa, Staphylococcus epidermidis
LDYLDLYLMHWPGTNEA

SEQ ID NO: 1798064 - protein, 19 aa, Staphylococcus epidermidis
LEALYLNDQVMEFDLTPNR

SEQ ID NO: 1798065 - protein, 18 aa, Staphylococcus epidermidis
LEASMKYIDEHGGMIIYL

SEQ ID NO: 1798066 - protein, 33 aa, Staphylococcus epidermidis
LEFLGDAVLELTVSRYLFDRHPHLPEGNLTKMR

SEQ ID NO: 1798067 - protein, 21 aa, Staphylococcus epidermidis
LEGKTPASLRKEFDSQRKRNI

SEQ ID NO: 1798068 - protein, 19 aa, Staphylococcus epidermidis
LEGSISLPHIYGEVKRSKM

SEQ ID NO: 1798069 - protein, 20 aa, Staphylococcus epidermidis
LEKLLYNTFDLIFLDINLMD

SEQ ID NO: 1798070 - protein, 22 aa, Staphylococcus epidermidis
LEKRELIKIHILQNNFDDKKDL

SEQ ID NO: 1798071 - protein, 20 aa, Staphylococcus epidermidis
LELDILRFSLGKPVKIYAAQ

SEQ ID NO: 1798072 - protein, 23 aa, Staphylococcus epidermidis
LEMYIKGYLIDYTLFINKKDILE

SEQ ID NO: 1798073 - protein, 22 aa, Staphylococcus epidermidis
LENDALCFYDIGSAGMNLDTAL

SEQ ID NO: 1798074 - protein, 19 aa, Staphylococcus epidermidis
LENNLNCYFDTAHVDKLMK

SEQ ID NO: 1798075 - protein, 29 aa, Staphylococcus epidermidis
LEQEIYNHMLWKGFKPFKITNITQETSDI

SEQ ID NO: 1798076 - protein, 25 aa, Staphylococcus epidermidis
LEQSFDLMFVRWIPRKQNKEANQLA

SEQ ID NO: 1798077 - protein, 20 aa, Staphylococcus epidermidis
LERDKGRFMDSLKRIDISPL

SEQ ID NO: 1798078 - protein, 27 aa, Staphylococcus epidermidis
LESSALFKKRVKSIVNKAQRVSEETAM

SEQ ID NO: 1798079 - protein, 24 aa, Staphylococcus epidermidis
LESTEFQDRLNIFASGGLRTPLDA

SEQ ID NO: 1798080 - protein, 33 aa, Staphylococcus epidermidis
LETRPELSFPADLYFEGSDQYRGWFNSSITTAV

SEQ ID NO: 1798081 - protein, 18 aa, Staphylococcus epidermidis
LEVLPPEMIVHRITGDGP

SEQ ID NO: 1798082 - protein, 19 aa, Staphylococcus epidermidis
LEVTLELKLLADVGLVGFP

SEQ ID NO: 1798083 - protein, 20 aa, Staphylococcus epidermidis
LEVVIAPQFTEEALKILTQK

SEQ ID NO: 1798084 - protein, 18 aa, Staphylococcus epidermidis
LFEPSEVLDKPYVIVCLN

SEQ ID NO: 1798085 - protein, 23 aa, Staphylococcus epidermidis
LFKHVPVKPGDFFYVPAGTVHAI

SEQ ID NO: 1798086 - protein, 19 aa, Staphylococcus epidermidis
LFKSTGMTLMSNVGGASGP

SEQ ID NO: 1798087 - protein, 19 aa, Staphylococcus epidermidis
LFMDGARLGYGLMSNQTNV

SEQ ID NO: 1798088 - protein, 22 aa, Staphylococcus epidermidis
LFPIPDKPFFTARLVQQKKNID

SEQ ID NO: 1798089 - protein, 17 aa, Staphylococcus epidermidis
LFQFLVKIKDIYKTKLG

SEQ ID NO: 1798090 - protein, 17 aa, Staphylococcus epidermidis
LGDGVEELGGLAVIGTE

SEQ ID NO: 1798091 - protein, 17 aa, Staphylococcus epidermidis
LGFTLMLTVARRIIEAT

SEQ ID NO: 1798092 - protein, 20 aa, Staphylococcus epidermidis
LGMFANTLVYRGRPHDQKTW

SEQ ID NO: 1798093 - protein, 23 aa, Staphylococcus epidermidis
LGQAGVNIMGFCKEFNARTQEQA

SEQ ID NO: 1798094 - protein, 25 aa, Staphylococcus epidermidis
LGQLLLKYAMNYARFSCDVMSLEVR

SEQ ID NO: 1798095 - protein, 22 aa, Staphylococcus epidermidis
LGREILLDYDFVAKIKEGREDE

SEQ ID NO: 1798096 - protein, 17 aa, Staphylococcus epidermidis
LGYLPEALFNFITLLGW

SEQ ID NO: 1798097 - protein, 23 aa, Staphylococcus epidermidis
LIADPRIEGGAFYLGSENYEQAI

SEQ ID NO: 1798098 - protein, 20 aa, Staphylococcus epidermidis
LIAYSFKFDGAISESALYQD

SEQ ID NO: 1798099 - protein, 18 aa, Staphylococcus epidermidis
LIEKIREINVPKKCTRDI

SEQ ID NO: 1798100 - protein, 25 aa, Staphylococcus epidermidis
LIKNSETIFIYGYGASFVVATDLYQ

SEQ ID NO: 1798101 - protein, 22 aa, Staphylococcus epidermidis
LIKYIRRIDLSGVHPQLTKVNI

SEQ ID NO: 1798102 - protein, 20 aa, Staphylococcus epidermidis
LIPKPLRDLGYRLFANNRDK

SEQ ID NO: 1798103 - protein, 25 aa, Staphylococcus epidermidis
LKAISPRTTLPILTGIKIDAKENEV

SEQ ID NO: 1798104 - protein, 17 aa, Staphylococcus epidermidis
LKARDDFGVRSVLQEAK

SEQ ID NO: 1798105 - protein, 30 aa, Staphylococcus epidermidis
LKDNMNVHFSRTYLRLMSHVYLNNPLTSQI

SEQ ID NO: 1798106 - protein, 17 aa, Staphylococcus epidermidis
LKFGLPRLTQYFRSNLK

SEQ ID NO: 1798107 - protein, 21 aa, Staphylococcus epidermidis
LKGETHVACVHSGMDEVEKRD

SEQ ID NO: 1798108 - protein, 17 aa, Staphylococcus epidermidis
LKGGQKMYVDQKIETYV

SEQ ID NO: 1798109 - protein, 19 aa, Staphylococcus epidermidis
LKGIFDKEIQVFDSEFIMT

SEQ ID NO: 1798110 - protein, 22 aa, Staphylococcus epidermidis
LKGKITGIKKFGAFVELPEGKS

SEQ ID NO: 1798111 - protein, 21 aa, Staphylococcus epidermidis
LKGQILRIGHMGKISPFDILA

SEQ ID NO: 1798112 - protein, 17 aa, Staphylococcus epidermidis
LKGQIQIYVRKDQVGDD

SEQ ID NO: 1798113 - protein, 27 aa, Staphylococcus epidermidis
LKGTDVLVCTVIGFPLGATTTAVKSYE

SEQ ID NO: 1798114 - protein, 25 aa, Staphylococcus epidermidis
LKHHYLWRFAKKMPKSGHIEIFDRS

SEQ ID NO: 1798115 - protein, 20 aa, Staphylococcus epidermidis
LKILGNLLMILKMYGNKNSH

SEQ ID NO: 1798116 - protein, 23 aa, Staphylococcus epidermidis
LKINLRDFFPFIEIKEVNEMSQS

SEQ ID NO: 1798117 - protein, 25 aa, Staphylococcus epidermidis
LKINNCVTIEPGIYIEGLGGVRIED

SEQ ID NO: 1798118 - protein, 17 aa, Staphylococcus epidermidis
LKKAYEYTRPKIEKSVR

SEQ ID NO: 1798119 - protein, 20 aa, Staphylococcus epidermidis
LKKQEIHNVCVVVTRYFGGI

SEQ ID NO: 1798120 - protein, 18 aa, Staphylococcus epidermidis
LKLLKSTHLVKSKRQGQS

SEQ ID NO: 1798121 - protein, 20 aa, Staphylococcus epidermidis
LKLNPKRIVYISCNPSTQQR

SEQ ID NO: 1798122 - protein, 20 aa, Staphylococcus epidermidis
LKLRKQIRQLAAIYLATGID

SEQ ID NO: 1798123 - protein, 20 aa, Staphylococcus epidermidis
LKNMSKFGFTASFDHCAITG

SEQ ID NO: 1798124 - protein, 25 aa, Staphylococcus epidermidis
LKNNIKKAWWQKFITQSPYNVGIDA

SEQ ID NO: 1798125 - protein, 19 aa, Staphylococcus epidermidis
LKNRVLMAPMTIQAGYFDG

SEQ ID NO: 1798126 - protein, 17 aa, Staphylococcus epidermidis
LKQEVDFIIIAGDLFDS

SEQ ID NO: 1798127 - protein, 18 aa, Staphylococcus epidermidis
LKSELIKMNASYLIRKQR

SEQ ID NO: 1798128 - protein, 34 aa, Staphylococcus epidermidis
LKSPHIESLCRRILVDGLKVARAEQIDFEDHIVD

SEQ ID NO: 1798129 - protein, 20 aa, Staphylococcus epidermidis
LKSSLPLTSIYNRLGFDFGI

SEQ ID NO: 1798130 - protein, 18 aa, Staphylococcus epidermidis
LKTDVLLATYGYLNMDLS

SEQ ID NO: 1798131 - protein, 17 aa, Staphylococcus epidermidis
LKTILSNHTDYWNIFGA

SEQ ID NO: 1798132 - protein, 26 aa, Staphylococcus epidermidis
LLDLPFGKCHFALAAKPETSCYKKVA

SEQ ID NO: 1798133 - protein, 17 aa, Staphylococcus epidermidis
LLEKIAIYMELKGENTF

SEQ ID NO: 1798134 - protein, 17 aa, Staphylococcus epidermidis
LLERRHIHFTPVIKCVA

SEQ ID NO: 1798135 - protein, 24 aa, Staphylococcus epidermidis
LLEYIKELEEILADEEVLLQLVRD

SEQ ID NO: 1798136 - protein, 17 aa, Staphylococcus epidermidis
LLKTYGFIIYFKNPDDM

SEQ ID NO: 1798137 - protein, 18 aa, Staphylococcus epidermidis
LLMIKSKLLLPQTSIEED

SEQ ID NO: 1798138 - protein, 17 aa, Staphylococcus epidermidis
LLNGPSVVEVNGQHLSL

SEQ ID NO: 1798139 - protein, 22 aa, Staphylococcus epidermidis
LLNKVGKLIASIYMNEELDAVV

SEQ ID NO: 1798140 - protein, 25 aa, Staphylococcus epidermidis
LLRELQSRLGITFIFVTHDQEEALA

SEQ ID NO: 1798141 - protein, 19 aa, Staphylococcus epidermidis
LLSPACASWDQYHTFEERG

SEQ ID NO: 1798142 - protein, 17 aa, Staphylococcus epidermidis
LLTMLKRMEMEPITPDI

SEQ ID NO: 1798143 - protein, 24 aa, Staphylococcus epidermidis
LMESIEMGCPVLSYNVRYGPSEII

SEQ ID NO: 1798144 - protein, 26 aa, Staphylococcus epidermidis
LMGEDCRRTMDIFKLLGVTIEEQDNS

SEQ ID NO: 1798145 - protein, 27 aa, Staphylococcus epidermidis
LMQYLKKRHIPMAITTSSYKKNIYPIF

SEQ ID NO: 1798146 - protein, 17 aa, Staphylococcus epidermidis
LMRGFEIDCRIKHYQGR

SEQ ID NO: 1798147 - protein, 17 aa, Staphylococcus epidermidis
LNFTDIIALSVNNGITT

SEQ ID NO: 1798148 - protein, 19 aa, Staphylococcus epidermidis
LNGAFSVAQTVGRQMIEKG

SEQ ID NO: 1798149 - protein, 19 aa, Staphylococcus epidermidis
LNIDVELRLLKYKHRDKVL

SEQ ID NO: 1798150 - protein, 23 aa, Staphylococcus epidermidis
LNIELKIPIIMISGNHDGRERLN

SEQ ID NO: 1798151 - protein, 17 aa, Staphylococcus epidermidis
LNIKKFIPIYINEETIL

SEQ ID NO: 1798152 - protein, 21 aa, Staphylococcus epidermidis
LNIMFPMVATIKEFRDAKSML

SEQ ID NO: 1798153 - protein, 19 aa, Staphylococcus epidermidis
LNLASGVYFANAYEVNYFS

SEQ ID NO: 1798154 - protein, 19 aa, Staphylococcus epidermidis
LNLPIGVIPGGTFNDFTKT

SEQ ID NO: 1798155 - protein, 25 aa, Staphylococcus epidermidis
LNNLKRKYGKDITELIAYQSKLANE

SEQ ID NO: 1798156 - protein, 18 aa, Staphylococcus epidermidis
LNPMRQRIAQNMRQSLNS

SEQ ID NO: 1798157 - protein, 21 aa, Staphylococcus epidermidis
LNQKEELYIFSGYAGSDKESR

SEQ ID NO: 1798158 - protein, 17 aa, Staphylococcus epidermidis
LNQLFHGIEHRMQLEML

SEQ ID NO: 1798159 - protein, 18 aa, Staphylococcus epidermidis
LNREDVFTYLSLNKEEAT

SEQ ID NO: 1798160 - protein, 18 aa, Staphylococcus epidermidis
LPARGRTILGRIARHTLI

SEQ ID NO: 1798161 - protein, 20 aa, Staphylococcus epidermidis
LPDAVLCISDEQAIGILHSA

SEQ ID NO: 1798162 - protein, 21 aa, Staphylococcus epidermidis
LPHGDFYIRIDNQLNIDLIKD

SEQ ID NO: 1798163 - protein, 17 aa, Staphylococcus epidermidis
LPIGFTLEEQIQFSKKA

SEQ ID NO: 1798164 - protein, 26 aa, Staphylococcus epidermidis
LPKSYIFEIASNWKKIGISNAKQAYE

SEQ ID NO: 1798165 - protein, 17 aa, Staphylococcus epidermidis
LPLGGVIYTDISKDGKL

SEQ ID NO: 1798166 - protein, 18 aa, Staphylococcus epidermidis
LPLLTPMSEVAGRMSTQV

SEQ ID NO: 1798167 - protein, 24 aa, Staphylococcus epidermidis
LPMDIIYRRLDEIPNLRTLSITGG

SEQ ID NO: 1798168 - protein, 18 aa, Staphylococcus epidermidis
LPNAPKEKGIMVLNDDYD

SEQ ID NO: 1798169 - protein, 20 aa, Staphylococcus epidermidis
LPQIKVVMLTSFIEDKEVYR

SEQ ID NO: 1798170 - protein, 20 aa, Staphylococcus epidermidis
LPSERFIHLMSQYGTHVEKN

SEQ ID NO: 1798171 - protein, 19 aa, Staphylococcus epidermidis
LPTAGGYGVMICYNDTDLD

SEQ ID NO: 1798172 - protein, 24 aa, Staphylococcus epidermidis
LQDKGTEITSIFYPKMFEANPELL

SEQ ID NO: 1798173 - protein, 17 aa, Staphylococcus epidermidis
LQEMGVKAKAYAHDLKD

SEQ ID NO: 1798174 - protein, 23 aa, Staphylococcus epidermidis
LQKLTQNVTLMFDGDYAGKEATL

SEQ ID NO: 1798175 - protein, 23 aa, Staphylococcus epidermidis
LQKYQHVEVALKIDNETVQVKSL

SEQ ID NO: 1798176 - protein, 17 aa, Staphylococcus epidermidis
LQLIKYEGDMFYRDQLL

SEQ ID NO: 1798177 - protein, 25 aa, Staphylococcus epidermidis
LQNRIPAYELHEFLIHLTGVLETGY

SEQ ID NO: 1798178 - protein, 18 aa, Staphylococcus epidermidis
LQPLALKAANSIFVGDYL

SEQ ID NO: 1798179 - protein, 18 aa, Staphylococcus epidermidis
LQQNEFVLFDLGVVYHHY

SEQ ID NO: 1798180 - protein, 18 aa, Staphylococcus epidermidis
LQSRLLLGTGKFENEEVQ

SEQ ID NO: 1798181 - protein, 18 aa, Staphylococcus epidermidis
LQVYPEHYPIVGENLLAA

SEQ ID NO: 1798182 - protein, 25 aa, Staphylococcus epidermidis
LRARRTNLIGAIIPRMNSYAVDETI

SEQ ID NO: 1798183 - protein, 17 aa, Staphylococcus epidermidis
LRGFYMNYMEDLPGPIY

SEQ ID NO: 1798184 - protein, 21 aa, Staphylococcus epidermidis
LRKEQIFVYICHGNHDPLTSK

SEQ ID NO: 1798185 - protein, 22 aa, Staphylococcus epidermidis
LRKILKSYGIRILEVPLKTGLV

SEQ ID NO: 1798186 - protein, 17 aa, Staphylococcus epidermidis
LRMHYLISNALDLSGYE

SEQ ID NO: 1798187 - protein, 22 aa, Staphylococcus epidermidis
LRNARKAKLKLLIDEALINKNE

SEQ ID NO: 1798188 - protein, 24 aa, Staphylococcus epidermidis
LRNGSFKILAEFNALNTDYIQVYD

SEQ ID NO: 1798189 - protein, 23 aa, Staphylococcus epidermidis
LRPPHRKEVLKAREDDIKDRVQN

SEQ ID NO: 1798190 - protein, 18 aa, Staphylococcus epidermidis
LRQILKDHFAMTTLTTVV

SEQ ID NO: 1798191 - protein, 19 aa, Staphylococcus epidermidis
LRRINRKTALLIQLSTQVG

SEQ ID NO: 1798192 - protein, 17 aa, Staphylococcus epidermidis
LRTTGGRYILSSHNIEI

SEQ ID NO: 1798193 - protein, 19 aa, Staphylococcus epidermidis
LRVPHGAGGIVLDVKVFNR

SEQ ID NO: 1798194 - protein, 17 aa, Staphylococcus epidermidis
LSDVHGFIFPTDFSSRE

SEQ ID NO: 1798195 - protein, 17 aa, Staphylococcus epidermidis
LSEYGHEQLNLFLTEVG

SEQ ID NO: 1798196 - protein, 19 aa, Staphylococcus epidermidis
LSGGETFQASLALALGLSE

SEQ ID NO: 1798197 - protein, 23 aa, Staphylococcus epidermidis
LSGGQRQRAYIAMTIAQDTDYIL

SEQ ID NO: 1798198 - protein, 17 aa, Staphylococcus epidermidis
LSGRPLFQRNLQLVKYA

SEQ ID NO: 1798199 - protein, 29 aa, Staphylococcus epidermidis
LSGRVGYHPTWKMILGLFPKEDKVKALDA

SEQ ID NO: 1798200 - protein, 24 aa, Staphylococcus epidermidis
LSHALDVADEFDVQVALHADTLNE

SEQ ID NO: 1798201 - protein, 26 aa, Staphylococcus epidermidis
LSILGGEPFCNLFITLQLVEAFRQRF

SEQ ID NO: 1798202 - protein, 23 aa, Staphylococcus epidermidis
LSKIGGGVAINLSKLRARGEAIK

SEQ ID NO: 1798203 - protein, 25 aa, Staphylococcus epidermidis
LSNDSFCVLNHLFVNGGNEEVFESR

SEQ ID NO: 1798204 - protein, 27 aa, Staphylococcus epidermidis
LSNKLRERICDAAIQLMENIKYVNAGT

SEQ ID NO: 1798205 - protein, 18 aa, Staphylococcus epidermidis
LSPSFSINEIDLLIKDIS

SEQ ID NO: 1798206 - protein, 23 aa, Staphylococcus epidermidis
LSQLKMKAPVLVSGTDGVGTKLK

SEQ ID NO: 1798207 - protein, 17 aa, Staphylococcus epidermidis
LSVILPQYVESLIYGTI

SEQ ID NO: 1798208 - protein, 23 aa, Staphylococcus epidermidis
LSYYLKCHSQFRVIEQSCTSQHL

SEQ ID NO: 1798209 - protein, 29 aa, Staphylococcus epidermidis
LTEARSLKFFKYFYTHRGPVMDFNNLVLV

SEQ ID NO: 1798210 - protein, 21 aa, Staphylococcus epidermidis
LTEREMEILLLIAKGYSNQEI

SEQ ID NO: 1798211 - protein, 17 aa, Staphylococcus epidermidis
LTFQMLFIMLREFNQLE

SEQ ID NO: 1798212 - protein, 29 aa, Staphylococcus epidermidis
LTKDLFIDWIWGESFFKQKLIDYDAASNV

SEQ ID NO: 1798213 - protein, 24 aa, Staphylococcus epidermidis
LTLTHEFKYQVSRSYMKTFKQQLG

SEQ ID NO: 1798214 - protein, 20 aa, Staphylococcus epidermidis
LTPVDLWKDHQMTLKVGQDI

SEQ ID NO: 1798215 - protein, 24 aa, Staphylococcus epidermidis
LTQIKELFYDLEITNLQDLHKAQP

SEQ ID NO: 1798216 - protein, 27 aa, Staphylococcus epidermidis
LTSIYNRLGFDFGIVGNHEFNYDLPYL

SEQ ID NO: 1798217 - protein, 23 aa, Staphylococcus epidermidis
LVGGEKMAQCFIQSFDASPSQML

SEQ ID NO: 1798218 - protein, 20 aa, Staphylococcus epidermidis
LVIQEIKNSLSPYEEIVDSA

SEQ ID NO: 1798219 - protein, 18 aa, Staphylococcus epidermidis
LVSMFKKAASLNVPTQMI

SEQ ID NO: 1798220 - protein, 19 aa, Staphylococcus epidermidis
LYAGCGIVKNSDPDSEVAE

SEQ ID NO: 1798221 - protein, 19 aa, Staphylococcus epidermidis
LYDSEWIQWYYNQMKNNKI

SEQ ID NO: 1798222 - protein, 19 aa, Staphylococcus epidermidis
LYDTYGFPIELTEELATQE

SEQ ID NO: 1798223 - protein, 23 aa, Staphylococcus epidermidis
LYERLRESLSLSDVEHVKVFKND

SEQ ID NO: 1798224 - protein, 26 aa, Staphylococcus epidermidis
LYFDISRHAIKMAEKVKKGFIDKGYQ

SEQ ID NO: 1798225 - protein, 21 aa, Staphylococcus epidermidis
LYNKIVIQRRGGFCYELNHLF

SEQ ID NO: 1798226 - protein, 17 aa, Staphylococcus epidermidis
LYPDLTIYLDVDAEIGR

SEQ ID NO: 1798227 - protein, 19 aa, Staphylococcus epidermidis
LYYSELKSVQNLYRIKTNT

SEQ ID NO: 1798228 - protein, 18 aa, Staphylococcus epidermidis
LYYTRNKLLSVEECTSCA

SEQ ID NO: 1798229 - protein, 21 aa, Staphylococcus epidermidis
MASDASKVFKGQKMPGRMGGN

SEQ ID NO: 1798230 - protein, 20 aa, Staphylococcus epidermidis
MDLPHGIHALGYTNVPVKLD

SEQ ID NO: 1798231 - protein, 23 aa, Staphylococcus epidermidis
MDYLFEMINPYSLNQQGQDKGQK

SEQ ID NO: 1798232 - protein, 18 aa, Staphylococcus epidermidis
MEGIKYLIDHPDIKHGTI

SEQ ID NO: 1798233 - protein, 17 aa, Staphylococcus epidermidis
MEHIERAGVHSGDSIAV

SEQ ID NO: 1798234 - protein, 17 aa, Staphylococcus epidermidis
MEKLGMTFLDNFEYPNL

SEQ ID NO: 1798235 - protein, 22 aa, Staphylococcus epidermidis
MELPYRLYVGGKLGSGRQWYSW

SEQ ID NO: 1798236 - protein, 23 aa, Staphylococcus epidermidis
MFRDKRIPVVKGVSFDCPTGASV

SEQ ID NO: 1798237 - protein, 17 aa, Staphylococcus epidermidis
MGAKACYPQIIKATLME

SEQ ID NO: 1798238 - protein, 17 aa, Staphylococcus epidermidis
MGIPSILIFQNGKKLAH

SEQ ID NO: 1798239 - protein, 18 aa, Staphylococcus epidermidis
MGYELGLISEERYARFNE

SEQ ID NO: 1798240 - protein, 17 aa, Staphylococcus epidermidis
MHHAGLFASISVGVKEN

SEQ ID NO: 1798241 - protein, 20 aa, Staphylococcus epidermidis
MHNRMRMVVSQFLTKDLFID

SEQ ID NO: 1798242 - protein, 26 aa, Staphylococcus epidermidis
MHSAKGLEFPIVFIMGMEESLFPHIR

SEQ ID NO: 1798243 - protein, 17 aa, Staphylococcus epidermidis
MHYLISNALDLSGYENF

SEQ ID NO: 1798244 - protein, 19 aa, Staphylococcus epidermidis
MICNDAIELNEYFKDKEIS

SEQ ID NO: 1798245 - protein, 17 aa, Staphylococcus epidermidis
MIEAGILDGDKVIVRSQ

SEQ ID NO: 1798246 - protein, 19 aa, Staphylococcus epidermidis
MIQESKVLITYFTRLQSLK

SEQ ID NO: 1798247 - protein, 21 aa, Staphylococcus epidermidis
MKEKVKESFGFNSRQLTTSSA

SEQ ID NO: 1798248 - protein, 19 aa, Staphylococcus epidermidis
MKEMCLGAYEHQEYPFESL

SEQ ID NO: 1798249 - protein, 17 aa, Staphylococcus epidermidis
MKFYRKNKEILSHQILK

SEQ ID NO: 1798250 - protein, 20 aa, Staphylococcus epidermidis
MKLSSGKVIKGMGIPKGITL

SEQ ID NO: 1798251 - protein, 22 aa, Staphylococcus epidermidis
MKRAMKMSYILGQKEAIDHFLL

SEQ ID NO: 1798252 - protein, 17 aa, Staphylococcus epidermidis
MKVIHFFNKIENYYEAS

SEQ ID NO: 1798253 - protein, 22 aa, Staphylococcus epidermidis
MLDDCFEIRKCVFVEEQGVPLE

SEQ ID NO: 1798254 - protein, 24 aa, Staphylococcus epidermidis
MLGILKAGAGYIPIDPDYPEERMN

SEQ ID NO: 1798255 - protein, 17 aa, Staphylococcus epidermidis
MLGPTGIGVLYGKRELL

SEQ ID NO: 1798256 - protein, 30 aa, Staphylococcus epidermidis
MNDIIKIIIEYRLHVAFSIDKIEQIYELNQ

SEQ ID NO: 1798257 - protein, 17 aa, Staphylococcus epidermidis
MPIGVGSYVHYDRKLDG

SEQ ID NO: 1798258 - protein, 21 aa, Staphylococcus epidermidis
MQELTEYGLIPEDWGGDTIFV

SEQ ID NO: 1798259 - protein, 26 aa, Staphylococcus epidermidis
MQNMKAFNYIPFFKSFEMSHLHIDEP

SEQ ID NO: 1798260 - protein, 18 aa, Staphylococcus epidermidis
MRAGAKARTTKQQARINR

SEQ ID NO: 1798261 - protein, 19 aa, Staphylococcus epidermidis
MRHWDEYQFGYFILIMRDN

SEQ ID NO: 1798262 - protein, 23 aa, Staphylococcus epidermidis
MRIKEFELLWYLASREGEVISKS

SEQ ID NO: 1798263 - protein, 19 aa, Staphylococcus epidermidis
MRKGAYLIKYIRRIDLSGV

SEQ ID NO: 1798264 - protein, 24 aa, Staphylococcus epidermidis
MRLMWQEMMMILKKLKVPSVNLLK

SEQ ID NO: 1798265 - protein, 18 aa, Staphylococcus epidermidis
MRLTDDFSSINIIHQINQ

SEQ ID NO: 1798266 - protein, 21 aa, Staphylococcus epidermidis
MRYGDDMKALFNYPSQATDET

SEQ ID NO: 1798267 - protein, 24 aa, Staphylococcus epidermidis
MSANEKYDLFVLVVTDIINSDSKI

SEQ ID NO: 1798268 - protein, 17 aa, Staphylococcus epidermidis
MSCEHCRNAVESALAKL

SEQ ID NO: 1798269 - protein, 19 aa, Staphylococcus epidermidis
MSKGSFKRAIGHLYKKKII

SEQ ID NO: 1798270 - protein, 20 aa, Staphylococcus epidermidis
MSRFNNWSLNINKINLSHAE

SEQ ID NO: 1798271 - protein, 21 aa, Staphylococcus epidermidis
MVATIKEFRDAKSMLLEEKEN

SEQ ID NO: 1798272 - protein, 19 aa, Staphylococcus epidermidis
MYNALSFNFYYLGNKDESI

SEQ ID NO: 1798273 - protein, 24 aa, Staphylococcus epidermidis
MYNIFNMGIGYTIIVDKKDVQTTL

SEQ ID NO: 1798274 - protein, 20 aa, Staphylococcus epidermidis
NADEIILTFKQGIPVQVDGK

SEQ ID NO: 1798275 - protein, 17 aa, Staphylococcus epidermidis
NAFDLTIAVLLSAQCTD

SEQ ID NO: 1798276 - protein, 23 aa, Staphylococcus epidermidis
NAIASCGCGSSFKTAKVAGNPEQ

SEQ ID NO: 1798277 - protein, 28 aa, Staphylococcus epidermidis
NAIKALCKRLQISLEEVIVFGDSLNDKS

SEQ ID NO: 1798278 - protein, 19 aa, Staphylococcus epidermidis
NALDLVQFIAPIKTIITDM

SEQ ID NO: 1798279 - protein, 19 aa, Staphylococcus epidermidis
NDALKHSIKLAQHAEKLGY

SEQ ID NO: 1798280 - protein, 24 aa, Staphylococcus epidermidis
NDDEGKIEWLLPFLSNSGPTIIYV

SEQ ID NO: 1798281 - protein, 23 aa, Staphylococcus epidermidis
NDELRSLQGLSHVIGKIETNHPR

SEQ ID NO: 1798282 - protein, 21 aa, Staphylococcus epidermidis
NDIDSVVLIHACWLAHIEIAM

SEQ ID NO: 1798283 - protein, 27 aa, Staphylococcus epidermidis
NDIKELKAAVSQPIFNDIEWIIVSLGS

SEQ ID NO: 1798284 - protein, 20 aa, Staphylococcus epidermidis
NDIRVGKVLYMTVNEPTDEA

SEQ ID NO: 1798285 - protein, 21 aa, Staphylococcus epidermidis
NDLQLWLKEVNDIKDTINPTL

SEQ ID NO: 1798286 - protein, 27 aa, Staphylococcus epidermidis
NEARSARAYGSAALEIISVAKGQLAAY

SEQ ID NO: 1798287 - protein, 17 aa, Staphylococcus epidermidis
NEASSFADLEFYPHVQD

SEQ ID NO: 1798288 - protein, 18 aa, Staphylococcus epidermidis
NEDKLLCETIQNLIQKHH

SEQ ID NO: 1798289 - protein, 23 aa, Staphylococcus epidermidis
NEGEVPFKPSRVILQDFTGVPAV

SEQ ID NO: 1798290 - protein, 32 aa, Staphylococcus epidermidis
NEGIKLILKIFEAWQIPIIFVTHSNYEAQQMA

SEQ ID NO: 1798291 - protein, 22 aa, Staphylococcus epidermidis
NEIGIRLKQPIDLQYGDILYQD

SEQ ID NO: 1798292 - protein, 24 aa, Staphylococcus epidermidis
NEIIQRLSKVYGIKSISPVIKIDK

SEQ ID NO: 1798293 - protein, 17 aa, Staphylococcus epidermidis
NEKDVRMINKFIHNVEN

SEQ ID NO: 1798294 - protein, 23 aa, Staphylococcus epidermidis
NEKLPIHCRKELAINGKDILNHT

SEQ ID NO: 1798295 - protein, 23 aa, Staphylococcus epidermidis
NEKNLKLFSAFIVKGKKGNPGTI

SEQ ID NO: 1798296 - protein, 21 aa, Staphylococcus epidermidis
NEMSFDTMVLFGDHAASPHGT

SEQ ID NO: 1798297 - protein, 22 aa, Staphylococcus epidermidis
NEPNKAFLFGINYVILSEDKDF

SEQ ID NO: 1798298 - protein, 17 aa, Staphylococcus epidermidis
NESCIPKRCKASEDEAY

SEQ ID NO: 1798299 - protein, 25 aa, Staphylococcus epidermidis
NESPMAKALIGKGLNDQVRVPLPNG

SEQ ID NO: 1798300 - protein, 25 aa, Staphylococcus epidermidis
NESTVCILEAMKLFNEIQAETTGEI

SEQ ID NO: 1798301 - protein, 19 aa, Staphylococcus epidermidis
NEYDAFIDFLNRITSGNYD

SEQ ID NO: 1798302 - protein, 24 aa, Staphylococcus epidermidis
NFINKIWNAARFSLMNIGEDFKVE

SEQ ID NO: 1798303 - protein, 24 aa, Staphylococcus epidermidis
NFMAKEGRGLICAPIDKSIAERLK

SEQ ID NO: 1798304 - protein, 18 aa, Staphylococcus epidermidis
NFRKVKRIDTVIETFAKV

SEQ ID NO: 1798305 - protein, 22 aa, Staphylococcus epidermidis
NGDRLGWIEGINNWNFTLFIQN

SEQ ID NO: 1798306 - protein, 29 aa, Staphylococcus epidermidis
NGGHHWKSWKPLLGDILLQFLGDPINGKY

SEQ ID NO: 1798307 - protein, 17 aa, Staphylococcus epidermidis
NGQGRIVGYSGRTYTDQ

SEQ ID NO: 1798308 - protein, 17 aa, Staphylococcus epidermidis
NGREFALGPTHEEVVTS

SEQ ID NO: 1798309 - protein, 19 aa, Staphylococcus epidermidis
NGYRCPHCGNTDPKTVDVV

SEQ ID NO: 1798310 - protein, 20 aa, Staphylococcus epidermidis
NHIAVKCVFFNQPYLKKKLE

SEQ ID NO: 1798311 - protein, 19 aa, Staphylococcus epidermidis
NHLGELVITIAKYSNSKVL

SEQ ID NO: 1798312 - protein, 26 aa, Staphylococcus epidermidis
NHSFKSSEVPSAIFGTKKRRPIENGV

SEQ ID NO: 1798313 - protein, 25 aa, Staphylococcus epidermidis
NHTELKRMLCVVMRKDNKKNDINIA

SEQ ID NO: 1798314 - protein, 18 aa, Staphylococcus epidermidis
NHTFLHYYLQGYEESMYT

SEQ ID NO: 1798315 - protein, 18 aa, Staphylococcus epidermidis
NHTLRLDIQIHFANCHIR

SEQ ID NO: 1798316 - protein, 27 aa, Staphylococcus epidermidis
NIEKSIWYKLLVNLGINTITAIGQQPA

SEQ ID NO: 1798317 - protein, 21 aa, Staphylococcus epidermidis
NIKEGEFFVLIGPSGCGKTTT

SEQ ID NO: 1798318 - protein, 17 aa, Staphylococcus epidermidis
NINKLFNTHGIKYRELN

SEQ ID NO: 1798319 - protein, 25 aa, Staphylococcus epidermidis
NINLKLAEYGYIGGFDLGEVSDDFK

SEQ ID NO: 1798320 - protein, 22 aa, Staphylococcus epidermidis
NISAKVFFSSIGFENLAFEKNA

SEQ ID NO: 1798321 - protein, 22 aa, Staphylococcus epidermidis
NISPCSGVICGMGESNEDIIDM

SEQ ID NO: 1798322 - protein, 20 aa, Staphylococcus epidermidis
NIVTKQAWVYKGTLNSSIIH

SEQ ID NO: 1798323 - protein, 17 aa, Staphylococcus epidermidis
NKEILSHQILKNKKENI

SEQ ID NO: 1798324 - protein, 27 aa, Staphylococcus epidermidis
NKEWNRKAFRGVELYGKTLGVIGAGRI

SEQ ID NO: 1798325 - protein, 27 aa, Staphylococcus epidermidis
NKFNEPLCVKIGMELFYQTGPALIKSI

SEQ ID NO: 1798326 - protein, 23 aa, Staphylococcus epidermidis
NKIKRLESKKVKIRDEIIKIETR

SEQ ID NO: 1798327 - protein, 18 aa, Staphylococcus epidermidis
NKNCRKYDSDKSVIKTIE

SEQ ID NO: 1798328 - protein, 17 aa, Staphylococcus epidermidis
NKRQGKQLLAYLGAPKH

SEQ ID NO: 1798329 - protein, 20 aa, Staphylococcus epidermidis
NKVCGSGLKAIQLAYQSIVA

SEQ ID NO: 1798330 - protein, 18 aa, Staphylococcus epidermidis
NLGGVCLNVGCIPSKALL

SEQ ID NO: 1798331 - protein, 18 aa, Staphylococcus epidermidis
NLGRKLGFELSTAKESRI

SEQ ID NO: 1798332 - protein, 17 aa, Staphylococcus epidermidis
NLIESRLDIVAFKEGEI

SEQ ID NO: 1798333 - protein, 24 aa, Staphylococcus epidermidis
NLLAYRLRLNHQIEPNDMVALIAE

SEQ ID NO: 1798334 - protein, 20 aa, Staphylococcus epidermidis
NLPVHVIGIDIVREKDGLAK

SEQ ID NO: 1798335 - protein, 24 aa, Staphylococcus epidermidis
NLTDFKYAELSKMGSHMYEVITNR

SEQ ID NO: 1798336 - protein, 18 aa, Staphylococcus epidermidis
NLVSLMLEYLRFAEYSHT

SEQ ID NO: 1798337 - protein, 20 aa, Staphylococcus epidermidis
NLYNNFKALASHELSFYQIE

SEQ ID NO: 1798338 - protein, 18 aa, Staphylococcus epidermidis
NMALEAFKATDCSGLVRA

SEQ ID NO: 1798339 - protein, 27 aa, Staphylococcus epidermidis
NMPDKLCLYYHIGQCMGPCVYDVDLEK

SEQ ID NO: 1798340 - protein, 20 aa, Staphylococcus epidermidis
NNHIGECWGISAHPHGKSVI

SEQ ID NO: 1798341 - protein, 22 aa, Staphylococcus epidermidis
NPISILIPCHRVVGKDGNLTGY

SEQ ID NO: 1798342 - protein, 25 aa, Staphylococcus epidermidis
NPLFKITDIHAVATLAKEHKILLAV

SEQ ID NO: 1798343 - protein, 26 aa, Staphylococcus epidermidis
NQEGRRIFVTEVVCDSVQFLEPKNAQ

SEQ ID NO: 1798344 - protein, 17 aa, Staphylococcus epidermidis
NQGEFLAIVGPNGAGKS

SEQ ID NO: 1798345 - protein, 23 aa, Staphylococcus epidermidis
NQLRLKFCLIDILTTHKPIEEIA

SEQ ID NO: 1798346 - protein, 27 aa, Staphylococcus epidermidis
NRDLKHFRLGISVSKKLGNAVTRNRIK

SEQ ID NO: 1798347 - protein, 17 aa, Staphylococcus epidermidis
NRDNARTPMQWNNSINA

SEQ ID NO: 1798348 - protein, 18 aa, Staphylococcus epidermidis
NRDQEVLDALDIRLEPKY

SEQ ID NO: 1798349 - protein, 20 aa, Staphylococcus epidermidis
NRGAANLALIAEDPELLNGI

SEQ ID NO: 1798350 - protein, 24 aa, Staphylococcus epidermidis
NRIKENYFKPEHINVIKCDLMQRK

SEQ ID NO: 1798351 - protein, 23 aa, Staphylococcus epidermidis
NRPVFQEALNFVRMGDRFVVESI

SEQ ID NO: 1798352 - protein, 18 aa, Staphylococcus epidermidis
NSAPLLFKTISKLKKHFK

SEQ ID NO: 1798353 - protein, 20 aa, Staphylococcus epidermidis
NSCGKCKGQIGELLQYTLGD

SEQ ID NO: 1798354 - protein, 18 aa, Staphylococcus epidermidis
NSIDDLMKIKGFGKKTFE

SEQ ID NO: 1798355 - protein, 23 aa, Staphylococcus epidermidis
NSNDYILLWKLEVLDTYQRRGYA

SEQ ID NO: 1798356 - protein, 28 aa, Staphylococcus epidermidis
NSNIRSNCGIGFKGFWDNEAGFNYDFFH

SEQ ID NO: 1798357 - protein, 18 aa, Staphylococcus epidermidis
NSTGECWAISAHKNGPNT

SEQ ID NO: 1798358 - protein, 17 aa, Staphylococcus epidermidis
NTIDTRNGFILQSNKVS

SEQ ID NO: 1798359 - protein, 19 aa, Staphylococcus epidermidis
NTLFFKRLFEAALEERQYY

SEQ ID NO: 1798360 - protein, 22 aa, Staphylococcus epidermidis
NTLHWQYGHVLTIFEQALSLGN

SEQ ID NO: 1798361 - protein, 39 aa, Staphylococcus epidermidis
NTSLFKLKSALWTLAKDIYQEWYLGKALFNQVEYKKDIQ

SEQ ID NO: 1798362 - protein, 34 aa, Staphylococcus epidermidis
NTSTIIPMCHPLPLTGIDISFKWDSNNDDSYRLN

SEQ ID NO: 1798363 - protein, 24 aa, Staphylococcus epidermidis
NVEWDYFDVGLFDFESGYQDVVVH

SEQ ID NO: 1798364 - protein, 19 aa, Staphylococcus epidermidis
NVGKSTLFNAITKAGALAA

SEQ ID NO: 1798365 - protein, 17 aa, Staphylococcus epidermidis
NYEWDRYYLENVSIDRL

SEQ ID NO: 1798366 - protein, 24 aa, Staphylococcus epidermidis
NYFKPEKYYTLSINVDGYDLNLKQ

SEQ ID NO: 1798367 - protein, 28 aa, Staphylococcus epidermidis
NYKLLSGSIIPRPIAFVTTQNLKGDINA

SEQ ID NO: 1798368 - protein, 19 aa, Staphylococcus epidermidis
NYMLNLQKRKEEVIHNIDQ

SEQ ID NO: 1798369 - protein, 19 aa, Staphylococcus epidermidis
NYYVRRFMITVPFENINVQ

SEQ ID NO: 1798370 - protein, 18 aa, Staphylococcus epidermidis
PAARSMVVMAVYQMYNDL

SEQ ID NO: 1798371 - protein, 23 aa, Staphylococcus epidermidis
PAEIEGFKFKVLHTPGHSPGSLS

SEQ ID NO: 1798372 - protein, 19 aa, Staphylococcus epidermidis
PAIDSLIWENSCGSGAASI

SEQ ID NO: 1798373 - protein, 18 aa, Staphylococcus epidermidis
PAIEEMRLPIQYLANLLT

SEQ ID NO: 1798374 - protein, 18 aa, Staphylococcus epidermidis
PAIMPVAHKHCALQVYPE

SEQ ID NO: 1798375 - protein, 17 aa, Staphylococcus epidermidis
PALCSLASRIPYGEELS

SEQ ID NO: 1798376 - protein, 21 aa, Staphylococcus epidermidis
PCGRSLCCSTFLGDFEPVSIK

SEQ ID NO: 1798377 - protein, 17 aa, Staphylococcus epidermidis
PDDDFDYIIAMDQSNVD

SEQ ID NO: 1798378 - protein, 26 aa, Staphylococcus epidermidis
PDFDKVIKYESVFNFDEMIENAVENI

SEQ ID NO: 1798379 - protein, 21 aa, Staphylococcus epidermidis
PDILSSLNFNQFELVASQCEP

SEQ ID NO: 1798380 - protein, 23 aa, Staphylococcus epidermidis
PDPKLKEIFNIVLTSQKKAIEQI

SEQ ID NO: 1798381 - protein, 18 aa, Staphylococcus epidermidis
PDVLEIDEVIALLETPDL

SEQ ID NO: 1798382 - protein, 31 aa, Staphylococcus epidermidis
PDVRQAVFEMMNWWFEKGIDGFRVDAITHIK

SEQ ID NO: 1798383 - protein, 19 aa, Staphylococcus epidermidis
PDYDRPWHYLNVLAQQALG

SEQ ID NO: 1798384 - protein, 24 aa, Staphylococcus epidermidis
PEEACGTWKLVYQRLQNIERQTHQ

SEQ ID NO: 1798385 - protein, 18 aa, Staphylococcus epidermidis
PEELAGITVYLASDASSF

SEQ ID NO: 1798386 - protein, 18 aa, Staphylococcus epidermidis
PEHVKIVYVDDGPDAVDY

SEQ ID NO: 1798387 - protein, 18 aa, Staphylococcus epidermidis
PEILESVPSLPKKKQKQI

SEQ ID NO: 1798388 - protein, 21 aa, Staphylococcus epidermidis
PEMGVSFSNPFPEIKNANDQR

SEQ ID NO: 1798389 - protein, 20 aa, Staphylococcus epidermidis
PESFKKLKGVGPYTQAAVMS

SEQ ID NO: 1798390 - protein, 20 aa, Staphylococcus epidermidis
PETLMPAIIELKKAYEDAKS

SEQ ID NO: 1798391 - protein, 21 aa, Staphylococcus epidermidis
PEVHPGPTLLNVGRIDYSEEF

SEQ ID NO: 1798392 - protein, 20 aa, Staphylococcus epidermidis
PEVYPKLESYGIKQIAQRTA

SEQ ID NO: 1798393 - protein, 22 aa, Staphylococcus epidermidis
PFHQAESWDNVGLLIGNDKLDI

SEQ ID NO: 1798394 - protein, 25 aa, Staphylococcus epidermidis
PFTVESKATLSFRTMDLIHTPYHVK

SEQ ID NO: 1798395 - protein, 19 aa, Staphylococcus epidermidis
PGGMVVCLETSQPTLPLFK

SEQ ID NO: 1798396 - protein, 22 aa, Staphylococcus epidermidis
PGLPDLKGFGRRKMDLTPNEIY

SEQ ID NO: 1798397 - protein, 20 aa, Staphylococcus epidermidis
PGRRYYGGCEHVDVTESIAI

SEQ ID NO: 1798398 - protein, 20 aa, Staphylococcus epidermidis
PGVLPELFTAQTACFRSEAG

SEQ ID NO: 1798399 - protein, 20 aa, Staphylococcus epidermidis
PGYDSEAFEQLLLKEKSILV

SEQ ID NO: 1798400 - protein, 23 aa, Staphylococcus epidermidis
PHQKEWERLSGIPIEEQTYERNL

SEQ ID NO: 1798401 - protein, 18 aa, Staphylococcus epidermidis
PILSSVLEIFHRHVPILG

SEQ ID NO: 1798402 - protein, 18 aa, Staphylococcus epidermidis
PIPHLGWNELKSTHPLLQ

SEQ ID NO: 1798403 - protein, 20 aa, Staphylococcus epidermidis
PIQYIVGFQSFYGYQYKVNQ

SEQ ID NO: 1798404 - protein, 25 aa, Staphylococcus epidermidis
PITVNRAGSMIGYFLNEGPVTNFEE

SEQ ID NO: 1798405 - protein, 19 aa, Staphylococcus epidermidis
PKDVIIVEGIFALENNTLR

SEQ ID NO: 1798406 - protein, 19 aa, Staphylococcus epidermidis
PKLVFSIKKGVNFSPEDPN

SEQ ID NO: 1798407 - protein, 23 aa, Staphylococcus epidermidis
PKRIKENFDIFDFNLELTDVAEI

SEQ ID NO: 1798408 - protein, 17 aa, Staphylococcus epidermidis
PKVFNAVHLFDENGFKT

SEQ ID NO: 1798409 - protein, 29 aa, Staphylococcus epidermidis
PKYNAYMGAYRLQWDMIQFAKEHNIDRYN

SEQ ID NO: 1798410 - protein, 18 aa, Staphylococcus epidermidis
PLFQRNLQLVKYAYQQTR

SEQ ID NO: 1798411 - protein, 24 aa, Staphylococcus epidermidis
PLGIYRFLEKESKVYARTLNHPVI

SEQ ID NO: 1798412 - protein, 25 aa, Staphylococcus epidermidis
PLKIRMKYNAVYLVEIYKKDKINKR

SEQ ID NO: 1798413 - protein, 19 aa, Staphylococcus epidermidis
PLRESEGIVDVSIKDNINH

SEQ ID NO: 1798414 - protein, 18 aa, Staphylococcus epidermidis
PLSKIFWMRHEEPKIFKQ

SEQ ID NO: 1798415 - protein, 18 aa, Staphylococcus epidermidis
PMMKLKQIYPNILALSNV

SEQ ID NO: 1798416 - protein, 21 aa, Staphylococcus epidermidis
PNATVYMIGGHGLKTALTDAG

SEQ ID NO: 1798417 - protein, 17 aa, Staphylococcus epidermidis
PNIFTGCGNFHGPFEYA

SEQ ID NO: 1798418 - protein, 20 aa, Staphylococcus epidermidis
PNLQSRFAVIVPNQNEYKLI

SEQ ID NO: 1798419 - protein, 29 aa, Staphylococcus epidermidis
PPIGDAFARRSRYALDIDFKEEPPWFKIS

SEQ ID NO: 1798420 - protein, 25 aa, Staphylococcus epidermidis
PRLQPWDFAGGLLILNEVGGIGTNL

SEQ ID NO: 1798421 - protein, 18 aa, Staphylococcus epidermidis
PSAFPNDILNNIEHYYNI

SEQ ID NO: 1798422 - protein, 20 aa, Staphylococcus epidermidis
PSARRHARKNGVDLSEVSGK

SEQ ID NO: 1798423 - protein, 19 aa, Staphylococcus epidermidis
PSFLSCGIQSYLEDISSSL

SEQ ID NO: 1798424 - protein, 21 aa, Staphylococcus epidermidis
PSGIFYKDKLAVIGNGVVVDP

SEQ ID NO: 1798425 - protein, 22 aa, Staphylococcus epidermidis
PSHPYLLKLQDLYREFRDSMLD

SEQ ID NO: 1798426 - protein, 18 aa, Staphylococcus epidermidis
PSILRLVKQVIEASHKEG

SEQ ID NO: 1798427 - protein, 21 aa, Staphylococcus epidermidis
PSLHKPVLVLRDSTERPEGVD

SEQ ID NO: 1798428 - protein, 18 aa, Staphylococcus epidermidis
PSLVYAHKGSMDFRIKSK

SEQ ID NO: 1798429 - protein, 17 aa, Staphylococcus epidermidis
PSYQSVIQKVFTLPQNF

SEQ ID NO: 1798430 - protein, 21 aa, Staphylococcus epidermidis
PSYSLKPGQVITVREKSQNLD

SEQ ID NO: 1798431 - protein, 17 aa, Staphylococcus epidermidis
PSYYGKSNYYAFIVLNM

SEQ ID NO: 1798432 - protein, 20 aa, Staphylococcus epidermidis
PTKQMILNFGHYRFTDLKDS

SEQ ID NO: 1798433 - protein, 21 aa, Staphylococcus epidermidis
PTYDKNGVYRAVWINDNQYAL

SEQ ID NO: 1798434 - protein, 20 aa, Staphylococcus epidermidis
PVAHKHCALQVYPEHYPIVG

SEQ ID NO: 1798435 - protein, 19 aa, Staphylococcus epidermidis
PVDIKNMYIDIGVRNKEEA

SEQ ID NO: 1798436 - protein, 25 aa, Staphylococcus epidermidis
PVFKLKHQFTHLTWEIKVYNVTAPL

SEQ ID NO: 1798437 - protein, 20 aa, Staphylococcus epidermidis
PVNIDLHYDYARLLQDELKS

SEQ ID NO: 1798438 - protein, 24 aa, Staphylococcus epidermidis
PVPFAANLEAAYMPNADKVLDIAS

SEQ ID NO: 1798439 - protein, 20 aa, Staphylococcus epidermidis
PVRSFAVKIQKELAAKKGIV

SEQ ID NO: 1798440 - protein, 18 aa, Staphylococcus epidermidis
PVSPHLAFKIERHQQLNH

SEQ ID NO: 1798441 - protein, 25 aa, Staphylococcus epidermidis
PVTQKRAPIKYFINARNIIGIHSSI

SEQ ID NO: 1798442 - protein, 18 aa, Staphylococcus epidermidis
PVVPDILSSLNFNQFELV

SEQ ID NO: 1798443 - protein, 17 aa, Staphylococcus epidermidis
PVVRELPIDDVKRQLRE

SEQ ID NO: 1798444 - protein, 18 aa, Staphylococcus epidermidis
PYAKSFNKISRFQHSKLM

SEQ ID NO: 1798445 - protein, 23 aa, Staphylococcus epidermidis
PYHSWFNIVEHFLPSDSHDLLDI

SEQ ID NO: 1798446 - protein, 20 aa, Staphylococcus epidermidis
PYLDMAYTFLYAYHLEYTQP

SEQ ID NO: 1798447 - protein, 17 aa, Staphylococcus epidermidis
PYSGVTMGEEFMFNGKH

SEQ ID NO: 1798448 - protein, 37 aa, Staphylococcus epidermidis
QAENVIFIGLICKNAVWHAVVFEIGRGYTRELSILDI

SEQ ID NO: 1798449 - protein, 18 aa, Staphylococcus epidermidis
QAIKDTIKKASIASGVDI

SEQ ID NO: 1798450 - protein, 29 aa, Staphylococcus epidermidis
QAIKFGKSKIWLGVWEHNPKALSFYKNRG

SEQ ID NO: 1798451 - protein, 25 aa, Staphylococcus epidermidis
QALTYRLPVYNSFGMTETCSQFLTA

SEQ ID NO: 1798452 - protein, 24 aa, Staphylococcus epidermidis
QASRYRSAGTIEFLVTEDAHYFIE

SEQ ID NO: 1798453 - protein, 18 aa, Staphylococcus epidermidis
QCGLPKEMALELFKPFVM

SEQ ID NO: 1798454 - protein, 19 aa, Staphylococcus epidermidis
QDIFIPKGQNLGAVDGHKV

SEQ ID NO: 1798455 - protein, 17 aa, Staphylococcus epidermidis
QDLYPEKEVEIFKDING

SEQ ID NO: 1798456 - protein, 25 aa, Staphylococcus epidermidis
QDSLKRLILPSIEREIRGDLTQNAE

SEQ ID NO: 1798457 - protein, 22 aa, Staphylococcus epidermidis
QEKGDEVLPITFIEGNIAKTGA

SEQ ID NO: 1798458 - protein, 17 aa, Staphylococcus epidermidis
QELCHAHNILIAVDDIQ

SEQ ID NO: 1798459 - protein, 25 aa, Staphylococcus epidermidis
QELDNGFDFYAPQTFVDADGQRILI

SEQ ID NO: 1798460 - protein, 27 aa, Staphylococcus epidermidis
QELNPSPKWSIARYKGLGEMNADQLWE

SEQ ID NO: 1798461 - protein, 17 aa, Staphylococcus epidermidis
QEVEFLLTLSEDLKRAK

SEQ ID NO: 1798462 - protein, 23 aa, Staphylococcus epidermidis
QFDQIFDLLAIRIIVNSINDCYA

SEQ ID NO: 1798463 - protein, 27 aa, Staphylococcus epidermidis
QFGHIPSRIPLRASFNQKGKRDRFKAK

SEQ ID NO: 1798464 - protein, 23 aa, Staphylococcus epidermidis
QGIKEGLESTGLSREDLFITSKL

SEQ ID NO: 1798465 - protein, 22 aa, Staphylococcus epidermidis
QGIKIHLLHLLKGTPMVKQYEK

SEQ ID NO: 1798466 - protein, 23 aa, Staphylococcus epidermidis
QGLMEAREIFLVITGANKRDMVE

SEQ ID NO: 1798467 - protein, 23 aa, Staphylococcus epidermidis
QIGHYHCECGFKREEPTYEVSSF

SEQ ID NO: 1798468 - protein, 23 aa, Staphylococcus epidermidis
QINKGYCLLVGVGQNSTEEDVKV

SEQ ID NO: 1798469 - protein, 27 aa, Staphylococcus epidermidis
QIYLITHPIEWQLKYLLLRRTLNDNEL

SEQ ID NO: 1798470 - protein, 21 aa, Staphylococcus epidermidis
QKFDAKCIVIPSGETSKSFEH

SEQ ID NO: 1798471 - protein, 24 aa, Staphylococcus epidermidis
QKHALFPKYDFFRADTDYADIAKF

SEQ ID NO: 1798472 - protein, 18 aa, Staphylococcus epidermidis
QKHHLMIGKTVYIGDTAQ

SEQ ID NO: 1798473 - protein, 17 aa, Staphylococcus epidermidis
QKLIEEAPCAALTEERR

SEQ ID NO: 1798474 - protein, 17 aa, Staphylococcus epidermidis
QKLYEDIYADSFEDLKR

SEQ ID NO: 1798475 - protein, 20 aa, Staphylococcus epidermidis
QKRLMEISEQLGIEDLLEKY

SEQ ID NO: 1798476 - protein, 18 aa, Staphylococcus epidermidis
QLAYAIGVAEPVSISINT

SEQ ID NO: 1798477 - protein, 18 aa, Staphylococcus epidermidis
QLDYLLPRLHGHGKSLSR

SEQ ID NO: 1798478 - protein, 24 aa, Staphylococcus epidermidis
QLERVNIASVLMLDPELIIADEPV

SEQ ID NO: 1798479 - protein, 19 aa, Staphylococcus epidermidis
QLGALSGFCKINHVKMMHV

SEQ ID NO: 1798480 - protein, 19 aa, Staphylococcus epidermidis
QLKVARLSRRTHELGIPIM

SEQ ID NO: 1798481 - protein, 18 aa, Staphylococcus epidermidis
QLLKRFDEQPLFNLNQLR

SEQ ID NO: 1798482 - protein, 31 aa, Staphylococcus epidermidis
QLNNKTSECFSFFISYHFNKFDLGIQQLFIQ

SEQ ID NO: 1798483 - protein, 19 aa, Staphylococcus epidermidis
QLQSGYPYLMFKDNANKVH

SEQ ID NO: 1798484 - protein, 22 aa, Staphylococcus epidermidis
QLSKQFPEYGFDKNAGYGTKQH

SEQ ID NO: 1798485 - protein, 17 aa, Staphylococcus epidermidis
QLTDIPMSIEFRHQSWF

SEQ ID NO: 1798486 - protein, 17 aa, Staphylococcus epidermidis
QNAIKFGIEQSDIVTSV

SEQ ID NO: 1798487 - protein, 26 aa, Staphylococcus epidermidis
QNKGFKAYFVGGSVRDYIMQRPIHDV

SEQ ID NO: 1798488 - protein, 25 aa, Staphylococcus epidermidis
QNKLSFKYIDRILLNWKKNNVKTVD

SEQ ID NO: 1798489 - protein, 22 aa, Staphylococcus epidermidis
QNRLVELGFDIAKSHFSNERDL

SEQ ID NO: 1798490 - protein, 25 aa, Staphylococcus epidermidis
QPSPFHWRLLDKLTLNTLHEVVLPI

SEQ ID NO: 1798491 - protein, 17 aa, Staphylococcus epidermidis
QPSWMQIMLKFYQLCPR

SEQ ID NO: 1798492 - protein, 18 aa, Staphylococcus epidermidis
QQALKMVLENKVVSKNGK

SEQ ID NO: 1798493 - protein, 23 aa, Staphylococcus epidermidis
QQEDYCIIIGYFIDGEPKLSYIY

SEQ ID NO: 1798494 - protein, 26 aa, Staphylococcus epidermidis
QQHYAQCLVKLNIGKKAERLFYENIV

SEQ ID NO: 1798495 - protein, 25 aa, Staphylococcus epidermidis
QQKLKGRYSIVVFDHYGKITLDNSQ

SEQ ID NO: 1798496 - protein, 23 aa, Staphylococcus epidermidis
QRFYNCSIYGFGGDPMTQIVSPV

SEQ ID NO: 1798497 - protein, 25 aa, Staphylococcus epidermidis
QRGGIPCIFNHQWSNERIHQLVKSY

SEQ ID NO: 1798498 - protein, 21 aa, Staphylococcus epidermidis
QRLEYVIKQCLSRFDTIVLTG

SEQ ID NO: 1798499 - protein, 26 aa, Staphylococcus epidermidis
QRLIERGVIEIAPLAYMRGRTLDDAF

SEQ ID NO: 1798500 - protein, 19 aa, Staphylococcus epidermidis
QRLYRAIAGIGAYENNQLM

SEQ ID NO: 1798501 - protein, 21 aa, Staphylococcus epidermidis
QRRPVHIHLPIDVALTEIEIS

SEQ ID NO: 1798502 - protein, 21 aa, Staphylococcus epidermidis
QRSGKKYSEMAILYRTNAQSR

SEQ ID NO: 1798503 - protein, 17 aa, Staphylococcus epidermidis
QRSNYALSFSNMTFPHQ

SEQ ID NO: 1798504 - protein, 26 aa, Staphylococcus epidermidis
QSEAYRKANTIGFVLSMPHEVNTYPI

SEQ ID NO: 1798505 - protein, 27 aa, Staphylococcus epidermidis
QSHFKQRIIHIPVLYGGDFGPDLSEVA

SEQ ID NO: 1798506 - protein, 17 aa, Staphylococcus epidermidis
QSLYNMFAAIPGVKVVV

SEQ ID NO: 1798507 - protein, 20 aa, Staphylococcus epidermidis
QSNMPSRFLKEIPEDLLDSH

SEQ ID NO: 1798508 - protein, 17 aa, Staphylococcus epidermidis
QSSHPIPHLGWNELKST

SEQ ID NO: 1798509 - protein, 24 aa, Staphylococcus epidermidis
QSTKGVSIADNWDMVGMRATESHD

SEQ ID NO: 1798510 - protein, 24 aa, Staphylococcus epidermidis
QSTKMYGGTCINIGCIPTKTLIHD

SEQ ID NO: 1798511 - protein, 19 aa, Staphylococcus epidermidis
QSYSYLIFVQETWSMLHEN

SEQ ID NO: 1798512 - protein, 23 aa, Staphylococcus epidermidis
QTKERNKTCVIVTHDERLTHFCD

SEQ ID NO: 1798513 - protein, 18 aa, Staphylococcus epidermidis
QTYDVFLLGYSMGGRVAL

SEQ ID NO: 1798514 - protein, 20 aa, Staphylococcus epidermidis
QVCTCPERIFVHEDVHDDFL

SEQ ID NO: 1798515 - protein, 32 aa, Staphylococcus epidermidis
QYIATTYYNNWLFYYIFAHSFLNQHEKKNSVD

SEQ ID NO: 1798516 - protein, 23 aa, Staphylococcus epidermidis
QYLPKYMIPKTLTAISEIPLTGN

SEQ ID NO: 1798517 - protein, 30 aa, Staphylococcus epidermidis
QYLSEQPEIYICGGTKFLHSIINSLKELNY

SEQ ID NO: 1798518 - protein, 22 aa, Staphylococcus epidermidis
QYRTVMPGFKYEAPPNQNKINP

SEQ ID NO: 1798519 - protein, 23 aa, Staphylococcus epidermidis
QYYKLAICTYPNYYGETFDISQY

SEQ ID NO: 1798520 - protein, 18 aa, Staphylococcus epidermidis
RAALKALELELLVKDDAH

SEQ ID NO: 1798521 - protein, 22 aa, Staphylococcus epidermidis
RAEHVKLLIPLLEKNRDEIAQL

SEQ ID NO: 1798522 - protein, 19 aa, Staphylococcus epidermidis
RAFINLPSIIFADEPTGAL

SEQ ID NO: 1798523 - protein, 22 aa, Staphylococcus epidermidis
RAGISKGGLFYHFKSKDELIKE

SEQ ID NO: 1798524 - protein, 25 aa, Staphylococcus epidermidis
RAIDELPVIALLCTQASNSCIIKNA

SEQ ID NO: 1798525 - protein, 19 aa, Staphylococcus epidermidis
RAKHSVRFSFNEQTTTQEI

SEQ ID NO: 1798526 - protein, 23 aa, Staphylococcus epidermidis
RALHLPSDIMGAIDVIIDGHTTK

SEQ ID NO: 1798527 - protein, 20 aa, Staphylococcus epidermidis
RAVKPPVIYGDVKWTAPLTV

SEQ ID NO: 1798528 - protein, 22 aa, Staphylococcus epidermidis
RAVLKDEIKAVKNLPQYILDKT

SEQ ID NO: 1798529 - protein, 32 aa, Staphylococcus epidermidis
RDFLEMKPLYEWLGLSVSLGFVDIPEYEYAEN

SEQ ID NO: 1798530 - protein, 17 aa, Staphylococcus epidermidis
RDFTGGIYAVFKVSHTK

SEQ ID NO: 1798531 - protein, 19 aa, Staphylococcus epidermidis
RDNHEVVGIAGFEYRTIHQ

SEQ ID NO: 1798532 - protein, 19 aa, Staphylococcus epidermidis
RDNPKLKGKPVIVGGKASH

SEQ ID NO: 1798533 - protein, 25 aa, Staphylococcus epidermidis
RDTLPDAHFSKIYLFSPNLDKITDF

SEQ ID NO: 1798534 - protein, 17 aa, Staphylococcus epidermidis
RDYLAFFCNSGTEANEA

SEQ ID NO: 1798535 - protein, 24 aa, Staphylococcus epidermidis
REDTIKWSVNMGADVVLNHKKDLS

SEQ ID NO: 1798536 - protein, 29 aa, Staphylococcus epidermidis
REVVENYTVLRGFKPYYIENGAFSGALGA

SEQ ID NO: 1798537 - protein, 19 aa, Staphylococcus epidermidis
RFDCVPSQLNYVIKTRFTN

SEQ ID NO: 1798538 - protein, 21 aa, Staphylococcus epidermidis
RFISIMAGLSIDYIRQQLNTN

SEQ ID NO: 1798539 - protein, 18 aa, Staphylococcus epidermidis
RFLKERKSGSAVRLELDC

SEQ ID NO: 1798540 - protein, 19 aa, Staphylococcus epidermidis
RFSIEGVDTLVPMLQHTIT

SEQ ID NO: 1798541 - protein, 18 aa, Staphylococcus epidermidis
RGISRAEAERLVIHGFLD

SEQ ID NO: 1798542 - protein, 21 aa, Staphylococcus epidermidis
RHFKIRNALRAALKALELELL

SEQ ID NO: 1798543 - protein, 17 aa, Staphylococcus epidermidis
RHQFMIQYLKQFMSEWN

SEQ ID NO: 1798544 - protein, 30 aa, Staphylococcus epidermidis
RIDQVSAKRIIDFLSGTVYAIGGDIQRVGT

SEQ ID NO: 1798545 - protein, 18 aa, Staphylococcus epidermidis
RIPENAHWSAFGIGKMQL

SEQ ID NO: 1798546 - protein, 18 aa, Staphylococcus epidermidis
RIQHENLPYIAMWTDENV

SEQ ID NO: 1798547 - protein, 24 aa, Staphylococcus epidermidis
RITHGEIDAVISFDSLTKEFENVK

SEQ ID NO: 1798548 - protein, 17 aa, Staphylococcus epidermidis
RIVRIAFNLANRRRKKL

SEQ ID NO: 1798549 - protein, 18 aa, Staphylococcus epidermidis
RKASQFLTQRGYNVVNLD

SEQ ID NO: 1798550 - protein, 20 aa, Staphylococcus epidermidis
RKIKFVKVLKQTLIIEIARF

SEQ ID NO: 1798551 - protein, 23 aa, Staphylococcus epidermidis
RKLGKYPPYYFLINFTISHTDIK

SEQ ID NO: 1798552 - protein, 18 aa, Staphylococcus epidermidis
RKQAKAFIDDYLASFPGV

SEQ ID NO: 1798553 - protein, 17 aa, Staphylococcus epidermidis
RKYNFLYSEEEIIVTNG

SEQ ID NO: 1798554 - protein, 19 aa, Staphylococcus epidermidis
RLDIQIHFANCHIRESRLD

SEQ ID NO: 1798555 - protein, 32 aa, Staphylococcus epidermidis
RLELKYNVKIFEFKSPYLKLTRDGEKLLQYAL

SEQ ID NO: 1798556 - protein, 18 aa, Staphylococcus epidermidis
RLIDSPKVATYDLKPEMS

SEQ ID NO: 1798557 - protein, 23 aa, Staphylococcus epidermidis
RLKAEVFCPISHLYYQLTMSQNG

SEQ ID NO: 1798558 - protein, 26 aa, Staphylococcus epidermidis
RLLINGSDFSTGWIFYIDEEGHHDLV

SEQ ID NO: 1798559 - protein, 19 aa, Staphylococcus epidermidis
RLQPEHFEDIVAVTSLYRP

SEQ ID NO: 1798560 - protein, 17 aa, Staphylococcus epidermidis
RLQRISSELLKEYDSTE

SEQ ID NO: 1798561 - protein, 18 aa, Staphylococcus epidermidis
RLRTGTMTEEDWSRFTIA

SEQ ID NO: 1798562 - protein, 21 aa, Staphylococcus epidermidis
RLYSDNAVDSFIYIPEEGYSH

SEQ ID NO: 1798563 - protein, 31 aa, Staphylococcus epidermidis
RMIHLSLRAKYLFKYNLDYFIFDGEIVLIDR

SEQ ID NO: 1798564 - protein, 25 aa, Staphylococcus epidermidis
RNIFFEKALKVLRPIYLEQSPVPTF

SEQ ID NO: 1798565 - protein, 18 aa, Staphylococcus epidermidis
RNLLKDVGYHSVKTFTDF

SEQ ID NO: 1798566 - protein, 23 aa, Staphylococcus epidermidis
RNWESSKGKGLWMSLVLRPDVPF

SEQ ID NO: 1798567 - protein, 17 aa, Staphylococcus epidermidis
RQRELTKAFNIEHYQDV

SEQ ID NO: 1798568 - protein, 23 aa, Staphylococcus epidermidis
RQYLEEFRKGFKQQIENTKVIDP

SEQ ID NO: 1798569 - protein, 27 aa, Staphylococcus epidermidis
RRCAEEGIKFIGPHLEHLDMFGDKVKA

SEQ ID NO: 1798570 - protein, 17 aa, Staphylococcus epidermidis
RRDELRAQNILQERAFK

SEQ ID NO: 1798571 - protein, 25 aa, Staphylococcus epidermidis
RRGGFCYELNHLFATYLEHKGFHVT

SEQ ID NO: 1798572 - protein, 21 aa, Staphylococcus epidermidis
RRGNLKGALKSFEKALLTINH

SEQ ID NO: 1798573 - protein, 25 aa, Staphylococcus epidermidis
RRKMLIDLLVNMGFTVIEPEDPLKL

SEQ ID NO: 1798574 - protein, 23 aa, Staphylococcus epidermidis
RRNRSKVRLALKRGTKVERSNRE

SEQ ID NO: 1798575 - protein, 20 aa, Staphylococcus epidermidis
RSAAYAARYVAKNIVAAGLA

SEQ ID NO: 1798576 - protein, 20 aa, Staphylococcus epidermidis
RSYYKGIFIKCHLKNTTHSV

SEQ ID NO: 1798577 - protein, 20 aa, Staphylococcus epidermidis
RTEIPFLIECVQTAINAGAT

SEQ ID NO: 1798578 - protein, 24 aa, Staphylococcus epidermidis
RTGMLSLRLNQAYSVAKFLENLEI

SEQ ID NO: 1798579 - protein, 17 aa, Staphylococcus epidermidis
RTKSLLTRIRFLDKEMG

SEQ ID NO: 1798580 - protein, 24 aa, Staphylococcus epidermidis
RTLRKEVLGGLGGFGATFDLSQLK

SEQ ID NO: 1798581 - protein, 23 aa, Staphylococcus epidermidis
RTPRGRKATALAYEHFNTTNEKR

SEQ ID NO: 1798582 - protein, 28 aa, Staphylococcus epidermidis
RTQRRAAPFPKHYLNAIQDYAHKQEKIE

SEQ ID NO: 1798583 - protein, 17 aa, Staphylococcus epidermidis
RTTRWAARCLKAHQRPG

SEQ ID NO: 1798584 - protein, 20 aa, Staphylococcus epidermidis
RVKESPVHFECEYVQTVRIP

SEQ ID NO: 1798585 - protein, 25 aa, Staphylococcus epidermidis
RVPSESGIRYYVNRLLEQTSHQSQN

SEQ ID NO: 1798586 - protein, 21 aa, Staphylococcus epidermidis
RVTDHRIGLTLQKLNQIMEGN

SEQ ID NO: 1798587 - protein, 23 aa, Staphylococcus epidermidis
RVYLAVGGGFKLEKWLHSASTDF

SEQ ID NO: 1798588 - protein, 19 aa, Staphylococcus epidermidis
RYGKEIIGVVANIPKHFRT

SEQ ID NO: 1798589 - protein, 18 aa, Staphylococcus epidermidis
RYIENRLHTLMELYNYKE

SEQ ID NO: 1798590 - protein, 17 aa, Staphylococcus epidermidis
RYNMVEFQEEMKYKRSS

SEQ ID NO: 1798591 - protein, 25 aa, Staphylococcus epidermidis
RYRHFAGSYAVQWKMINYAIEHGIN

SEQ ID NO: 1798592 - protein, 35 aa, Staphylococcus epidermidis
RYYDSVLLSTKFKAPRWLVTPIKNYSVKKHKEISY

SEQ ID NO: 1798593 - protein, 17 aa, Staphylococcus epidermidis
SAFNAGFPASVKEVVLS

SEQ ID NO: 1798594 - protein, 20 aa, Staphylococcus epidermidis
SAKCVKQVEVIRAQRLLNGR

SEQ ID NO: 1798595 - protein, 23 aa, Staphylococcus epidermidis
SANRLIGAVLMDLHDEWIYSSRK

SEQ ID NO: 1798596 - protein, 19 aa, Staphylococcus epidermidis
SAYNVSRLFAQFYEKKLKQ

SEQ ID NO: 1798597 - protein, 25 aa, Staphylococcus epidermidis
SDAKPTGVASLCIGGGQGIATVVSK

SEQ ID NO: 1798598 - protein, 21 aa, Staphylococcus epidermidis
SDAPIAFQEFMILPVGAESFK

SEQ ID NO: 1798599 - protein, 28 aa, Staphylococcus epidermidis
SDDGEPCNECAICKGITQGTNNDVIEID

SEQ ID NO: 1798600 - protein, 17 aa, Staphylococcus epidermidis
SDDKELLDLLSKVHNHD

SEQ ID NO: 1798601 - protein, 28 aa, Staphylococcus epidermidis
SDFFTMVKWDISGTLNYMKPREFCLVSV

SEQ ID NO: 1798602 - protein, 52 aa, Staphylococcus epidermidis
SDIYASVRLLWSRIGEPFVGYSDAYSFNSPKGMCKTCEGLGYIEDINLDELL

SEQ ID NO: 1798603 - protein, 17 aa, Staphylococcus epidermidis
SDLILYVTYFNHSFTDN

SEQ ID NO: 1798604 - protein, 24 aa, Staphylococcus epidermidis
SDQDEMRFQELFKEMKNNLDDDIQ

SEQ ID NO: 1798605 - protein, 19 aa, Staphylococcus epidermidis
SDSLMKLLSLVSTPYNTVI

SEQ ID NO: 1798606 - protein, 21 aa, Staphylococcus epidermidis
SDYFAFEACEYRRHFLSYHPD

SEQ ID NO: 1798607 - protein, 27 aa, Staphylococcus epidermidis
SEDFEIGFKLYDVFTILYLLDPEAFNV

SEQ ID NO: 1798608 - protein, 25 aa, Staphylococcus epidermidis
SEDIKRKMVRNLCLSILAFDKDGDM

SEQ ID NO: 1798609 - protein, 18 aa, Staphylococcus epidermidis
SEETWTTFFEYLKERGLQ

SEQ ID NO: 1798610 - protein, 18 aa, Staphylococcus epidermidis
SEFPQFFERAPFAREGED

SEQ ID NO: 1798611 - protein, 28 aa, Staphylococcus epidermidis
SEHLGFQFDHLFWKQFIHNIKTLHSKGV

SEQ ID NO: 1798612 - protein, 23 aa, Staphylococcus epidermidis
SEIDLEKGFECTAKFRYRQKDTK

SEQ ID NO: 1798613 - protein, 21 aa, Staphylococcus epidermidis
SEIDYKCVTTMRLEDQAHEYT

SEQ ID NO: 1798614 - protein, 17 aa, Staphylococcus epidermidis
SEIESAYDLFRNATDHK

SEQ ID NO: 1798615 - protein, 23 aa, Staphylococcus epidermidis
SEKFGRQCICIAIDSFYDKDRKD

SEQ ID NO: 1798616 - protein, 19 aa, Staphylococcus epidermidis
SEKQIKAVLKLLKENNTVP

SEQ ID NO: 1798617 - protein, 25 aa, Staphylococcus epidermidis
SELFEREMNELIDILNQLKDSTKYP

SEQ ID NO: 1798618 - protein, 20 aa, Staphylococcus epidermidis
SELYGAYVNSFVSKFKDKHV

SEQ ID NO: 1798619 - protein, 17 aa, Staphylococcus epidermidis
SEYLRRAKVQEQFVNDF

SEQ ID NO: 1798620 - protein, 28 aa, Staphylococcus epidermidis
SFDQPIIWLCGGLDRGNEFDELIPYMEN

SEQ ID NO: 1798621 - protein, 20 aa, Staphylococcus epidermidis
SFEGVKRGRIINKQDLTIEG

SEQ ID NO: 1798622 - protein, 27 aa, Staphylococcus epidermidis
SFLRKQSACNIIFRTAIVRAHHIRFNE

SEQ ID NO: 1798623 - protein, 24 aa, Staphylococcus epidermidis
SGAKIVEFGGWAMPVQFSSIKEEH

SEQ ID NO: 1798624 - protein, 26 aa, Staphylococcus epidermidis
SGGEKARLQLALLMLQRDNVLILDEP

SEQ ID NO: 1798625 - protein, 26 aa, Staphylococcus epidermidis
SGGKVRPGFEGGQLPLFRRLPKRGFT

SEQ ID NO: 1798626 - protein, 19 aa, Staphylococcus epidermidis
SGIGRAIAILYAKEGANVA

SEQ ID NO: 1798627 - protein, 24 aa, Staphylococcus epidermidis
SGKRHRRRRQAYSKHDQSKITQQK

SEQ ID NO: 1798628 - protein, 21 aa, Staphylococcus epidermidis
SGPVAIQLARLCNLHGEHMVD

SEQ ID NO: 1798629 - protein, 23 aa, Staphylococcus epidermidis
SGSFSDRMSRLLTGEDGEETVLS

SEQ ID NO: 1798630 - protein, 24 aa, Staphylococcus epidermidis
SGTINLPMAISMVRAIKNAVDQTK

SEQ ID NO: 1798631 - protein, 26 aa, Staphylococcus epidermidis
SGVAEPLAVVDACFTPVLAPFITLRS

SEQ ID NO: 1798632 - protein, 19 aa, Staphylococcus epidermidis
SHAKTLFSTHYHELTSLDQ

SEQ ID NO: 1798633 - protein, 17 aa, Staphylococcus epidermidis
SHKRFGGVVPEVASRHH

SEQ ID NO: 1798634 - protein, 17 aa, Staphylococcus epidermidis
SHLIYLHSAAKITPDAS

SEQ ID NO: 1798635 - protein, 17 aa, Staphylococcus epidermidis
SHLKEVFLEEPFGVNQS

SEQ ID NO: 1798636 - protein, 17 aa, Staphylococcus epidermidis
SHLPIDVHLMIEQPENY

SEQ ID NO: 1798637 - protein, 25 aa, Staphylococcus epidermidis
SHSSIPFLGQNAIKPLLEFIQNINQ

SEQ ID NO: 1798638 - protein, 17 aa, Staphylococcus epidermidis
SIASGVDIKDVFLKLPI

SEQ ID NO: 1798639 - protein, 20 aa, Staphylococcus epidermidis
SIATQIAKFYGLKVITTASR

SEQ ID NO: 1798640 - protein, 25 aa, Staphylococcus epidermidis
SIDEIKMLFLQGIHKKIGYEGSNII

SEQ ID NO: 1798641 - protein, 17 aa, Staphylococcus epidermidis
SIFISLCENKGDFKSAG

SEQ ID NO: 1798642 - protein, 25 aa, Staphylococcus epidermidis
SIGRGMTVNRMFWRARRRESIFISY

SEQ ID NO: 1798643 - protein, 24 aa, Staphylococcus epidermidis
SIVGRLLEHSRIYYFHNNSEAHIY

SEQ ID NO: 1798644 - protein, 19 aa, Staphylococcus epidermidis
SKDAINILESLAIDVDEDF

SEQ ID NO: 1798645 - protein, 23 aa, Staphylococcus epidermidis
SKDQLKEKALYLLEKVGLKDKAD

SEQ ID NO: 1798646 - protein, 20 aa, Staphylococcus epidermidis
SKELLGLLRLHLSLFEKYDK

SEQ ID NO: 1798647 - protein, 36 aa, Staphylococcus epidermidis
SKGIYKFRFPILEAIKEVYEYTSIFEKMRFKGTSYT

SEQ ID NO: 1798648 - protein, 25 aa, Staphylococcus epidermidis
SKIHFSQEGYLMWVEDYKYSTIQRR

SEQ ID NO: 1798649 - protein, 26 aa, Staphylococcus epidermidis
SKIHGRIFISLAVKFSKARLIDNIII

SEQ ID NO: 1798650 - protein, 20 aa, Staphylococcus epidermidis
SKKDMQSFIVTLFDSNIETN

SEQ ID NO: 1798651 - protein, 22 aa, Staphylococcus epidermidis
SKLPDSINFIAWLQHLQDSGIT

SEQ ID NO: 1798652 - protein, 23 aa, Staphylococcus epidermidis
SKNKGCMHACGHDGHTAILLGVA

SEQ ID NO: 1798653 - protein, 18 aa, Staphylococcus epidermidis
SKRSLVLTDAGKIFFKKC

SEQ ID NO: 1798654 - protein, 19 aa, Staphylococcus epidermidis
SKRTSICSVGMVKVIDNQI

SEQ ID NO: 1798655 - protein, 24 aa, Staphylococcus epidermidis
SKSKRPGLDKAIEFARSGDTIVVW

SEQ ID NO: 1798656 - protein, 19 aa, Staphylococcus epidermidis
SKVALGFAHYLTSSIAHPV

SEQ ID NO: 1798657 - protein, 26 aa, Staphylococcus epidermidis
SKVCLANLLRICARYDNLDIIEDAYG

SEQ ID NO: 1798658 - protein, 19 aa, Staphylococcus epidermidis
SLDEARQMLIDAIKTGKAL

SEQ ID NO: 1798659 - protein, 28 aa, Staphylococcus epidermidis
SLGGLFTLRLAEHFDLERIAVMSAPHKK

SEQ ID NO: 1798660 - protein, 19 aa, Staphylococcus epidermidis
SLISTDFIEDFSVFDGQTI

SEQ ID NO: 1798661 - protein, 35 aa, Staphylococcus epidermidis
SNFKMNILIGPLVKLWKIGFKDALKPKEVDIQRAL

SEQ ID NO: 1798662 - protein, 17 aa, Staphylococcus epidermidis
SNIKFIFDELIKNKNTI

SEQ ID NO: 1798663 - protein, 21 aa, Staphylococcus epidermidis
SNLIRSVKWTDIIFKNVSFKN

SEQ ID NO: 1798664 - protein, 18 aa, Staphylococcus epidermidis
SNQIFKIKLTEDLLSKNE

SEQ ID NO: 1798665 - protein, 23 aa, Staphylococcus epidermidis
SNSFNISTTVAFVVASAGVPVIK

SEQ ID NO: 1798666 - protein, 20 aa, Staphylococcus epidermidis
SNTAEFGDYVSGPRVITPNV

SEQ ID NO: 1798667 - protein, 17 aa, Staphylococcus epidermidis
SNTFIPIVQNTYIQQRV

SEQ ID NO: 1798668 - protein, 17 aa, Staphylococcus epidermidis
SNYALSFSNMTFPHQMM

SEQ ID NO: 1798669 - protein, 17 aa, Staphylococcus epidermidis
SPHAFVNLLNYILLEKS

SEQ ID NO: 1798670 - protein, 17 aa, Staphylococcus epidermidis
SPVKADAISLCQKPHLG

SEQ ID NO: 1798671 - protein, 23 aa, Staphylococcus epidermidis
SQELEKLILFIGERPIINKEDID

SEQ ID NO: 1798672 - protein, 18 aa, Staphylococcus epidermidis
SQFSSYVEKKMIKAIRHT

SEQ ID NO: 1798673 - protein, 20 aa, Staphylococcus epidermidis
SRAREAGVDRMFVVGFDTPT

SEQ ID NO: 1798674 - protein, 17 aa, Staphylococcus epidermidis
SRFLKEIPEDLLDSHTG

SEQ ID NO: 1798675 - protein, 21 aa, Staphylococcus epidermidis
SRGCSTEDVYNLSIITAAQAL

SEQ ID NO: 1798676 - protein, 17 aa, Staphylococcus epidermidis
SRKDFPLLTKILDAHDC

SEQ ID NO: 1798677 - protein, 18 aa, Staphylococcus epidermidis
SRLDIVAFKEGEICIPTI

SEQ ID NO: 1798678 - protein, 31 aa, Staphylococcus epidermidis
SRLPEYMIPRKFEWMEQLPLTSNGKLDRKKI

SEQ ID NO: 1798679 - protein, 30 aa, Staphylococcus epidermidis
SSFKSYLFIRLKFYLIDLFRQKDNTLNICS

SEQ ID NO: 1798680 - protein, 21 aa, Staphylococcus epidermidis
SSGEWLTHEFNIIDTGGIEIG

SEQ ID NO: 1798681 - protein, 26 aa, Staphylococcus epidermidis
SSKTNAKRDWYIWADPKPDGSEPNNW

SEQ ID NO: 1798682 - protein, 22 aa, Staphylococcus epidermidis
SSLGLEPWHFVVVQNKELREKL

SEQ ID NO: 1798683 - protein, 26 aa, Staphylococcus epidermidis
SSRREAIKGKIDWRDTLPDAHFSKIY

SEQ ID NO: 1798684 - protein, 17 aa, Staphylococcus epidermidis
STFVKDLFEKVIRHVGE

SEQ ID NO: 1798685 - protein, 25 aa, Staphylococcus epidermidis
STHLVKSKRQGQSMIYSIDDIHVST

SEQ ID NO: 1798686 - protein, 26 aa, Staphylococcus epidermidis
STIAKRVASRLSMIYVDTGAMYRAIT

SEQ ID NO: 1798687 - protein, 19 aa, Staphylococcus epidermidis
STSEIDEVILVGGSTRIPA

SEQ ID NO: 1798688 - protein, 24 aa, Staphylococcus epidermidis
STVSELLTAYGFKIVDADIASREA

SEQ ID NO: 1798689 - protein, 27 aa, Staphylococcus epidermidis
SVPLVNRITSEIAFVRYHGRNHYGWTK

SEQ ID NO: 1798690 - protein, 17 aa, Staphylococcus epidermidis
SVTGISFSNNFDPKSKN

SEQ ID NO: 1798691 - protein, 20 aa, Staphylococcus epidermidis
SWMQIMLKFYQLCPRTLEKL

SEQ ID NO: 1798692 - protein, 17 aa, Staphylococcus epidermidis
SYAMPILLALSHVHQLL

SEQ ID NO: 1798693 - protein, 19 aa, Staphylococcus epidermidis
SYIEGLSILGGEPFCNLFI

SEQ ID NO: 1798694 - protein, 21 aa, Staphylococcus epidermidis
SYKKKHIFDSLDMQFQNHKIT

SEQ ID NO: 1798695 - protein, 23 aa, Staphylococcus epidermidis
SYMDFTDIIPISALEGLNVDHFI

SEQ ID NO: 1798696 - protein, 33 aa, Staphylococcus epidermidis
SYTELYRTLPFDFLSEIVYQWERFANKFKQFGT

SEQ ID NO: 1798697 - protein, 26 aa, Staphylococcus epidermidis
SYTEWIKFYLSEMGIEIKEVIFNTLS

SEQ ID NO: 1798698 - protein, 19 aa, Staphylococcus epidermidis
TAEKVKHQYGHAFYDSASD

SEQ ID NO: 1798699 - protein, 18 aa, Staphylococcus epidermidis
TAGFDMYDLELAKKHEII

SEQ ID NO: 1798700 - protein, 25 aa, Staphylococcus epidermidis
TANALKLKRFFNSSVPVHRGASQPL

SEQ ID NO: 1798701 - protein, 25 aa, Staphylococcus epidermidis
TATPIPRTLAISVFGEMDVSSIKQL

SEQ ID NO: 1798702 - protein, 20 aa, Staphylococcus epidermidis
TATPVLRPLLTLDKEDIIKK

SEQ ID NO: 1798703 - protein, 23 aa, Staphylococcus epidermidis
TDDARLTIEVMKKAAENGAEILN

SEQ ID NO: 1798704 - protein, 21 aa, Staphylococcus epidermidis
TDEKYFGGSFERLNQLSKITS

SEQ ID NO: 1798705 - protein, 18 aa, Staphylococcus epidermidis
TDFIEDFSVFDGQTIRIK

SEQ ID NO: 1798706 - protein, 31 aa, Staphylococcus epidermidis
TDIEYKFPFGWGELWGIASRTDYDLRQHSEH

SEQ ID NO: 1798707 - protein, 24 aa, Staphylococcus epidermidis
TDLKSEVVEYPWLQHIHTLIKMCG

SEQ ID NO: 1798708 - protein, 24 aa, Staphylococcus epidermidis
TDMPHFVMFTFNDPQVWNNDFNIY

SEQ ID NO: 1798709 - protein, 22 aa, Staphylococcus epidermidis
TDQEWRDVRYLYDYSDDELADL

SEQ ID NO: 1798710 - protein, 22 aa, Staphylococcus epidermidis
TDTYMPLPIFLSHQLAKRLADV

SEQ ID NO: 1798711 - protein, 25 aa, Staphylococcus epidermidis
TEAKRKGLEDLADWFSQSKLDTKIE

SEQ ID NO: 1798712 - protein, 21 aa, Staphylococcus epidermidis
TEGARGYIVFGHPLKINKVAQ

SEQ ID NO: 1798713 - protein, 22 aa, Staphylococcus epidermidis
TEINAALKYVVECGANVVGLNC

SEQ ID NO: 1798714 - protein, 31 aa, Staphylococcus epidermidis
TEKALSVKVFYCLKGKCEVTINVQKHILEKD

SEQ ID NO: 1798715 - protein, 25 aa, Staphylococcus epidermidis
TEQFGISVMVGFGYRAQEPKHGKVR

SEQ ID NO: 1798716 - protein, 17 aa, Staphylococcus epidermidis
TEVTIFFLNGFQMKGVV

SEQ ID NO: 1798717 - protein, 24 aa, Staphylococcus epidermidis
TEYGVWHPRAWHSAPRPIPLPNQT

SEQ ID NO: 1798718 - protein, 18 aa, Staphylococcus epidermidis
TFIYCLNGEVSLQLGNQV

SEQ ID NO: 1798719 - protein, 20 aa, Staphylococcus epidermidis
TFLRGEIILGNLKYSSGPNH

SEQ ID NO: 1798720 - protein, 24 aa, Staphylococcus epidermidis
TFNDSWKKMGILGIEMESAGLYLN

SEQ ID NO: 1798721 - protein, 18 aa, Staphylococcus epidermidis
TFPLEIAGVPSGLAKQKA

SEQ ID NO: 1798722 - protein, 24 aa, Staphylococcus epidermidis
TGAGNDFLGWLDLPVDYDKEEFSR

SEQ ID NO: 1798723 - protein, 19 aa, Staphylococcus epidermidis
TGDIKTPVKYASKELKHLF

SEQ ID NO: 1798724 - protein, 24 aa, Staphylococcus epidermidis
TGLIRHLVVRTGYHTDEMMVIFVT

SEQ ID NO: 1798725 - protein, 31 aa, Staphylococcus epidermidis
TGMFPKWKGVPIRLAMKLVTFIFGKRRRLKW

SEQ ID NO: 1798726 - protein, 17 aa, Staphylococcus epidermidis
TGVKVTSISPGMVDTPM

SEQ ID NO: 1798727 - protein, 24 aa, Staphylococcus epidermidis
TGVLKGAKAVLGFHNYPTLKVGEF

SEQ ID NO: 1798728 - protein, 25 aa, Staphylococcus epidermidis
TGVTFAFQGCEHINRAVTIERANFN

SEQ ID NO: 1798729 - protein, 17 aa, Staphylococcus epidermidis
THILKFARKLSDMKQPV

SEQ ID NO: 1798730 - protein, 24 aa, Staphylococcus epidermidis
TIEQLKLLIFILHFTENHKEDLSL

SEQ ID NO: 1798731 - protein, 18 aa, Staphylococcus epidermidis
TIKRVMRLIDNIRQYGHL

SEQ ID NO: 1798732 - protein, 25 aa, Staphylococcus epidermidis
TIRIAPRKVRLVLDLIRGKNAGEAI

SEQ ID NO: 1798733 - protein, 18 aa, Staphylococcus epidermidis
TKEIRIAGGREVNLRSLQ

SEQ ID NO: 1798734 - protein, 22 aa, Staphylococcus epidermidis
TKEVKIGITLSKRLHFIRDKRL

SEQ ID NO: 1798735 - protein, 24 aa, Staphylococcus epidermidis
TKGMVRREVVRIITPGTVMDQNGM

SEQ ID NO: 1798736 - protein, 19 aa, Staphylococcus epidermidis
TKMGIPVVSHLGLTPQSVG

SEQ ID NO: 1798737 - protein, 25 aa, Staphylococcus epidermidis
TKNILEIGTAIGYSSMQFANISKDI

SEQ ID NO: 1798738 - protein, 19 aa, Staphylococcus epidermidis
TKQGKRVVVVPKKQYDKIE

SEQ ID NO: 1798739 - protein, 29 aa, Staphylococcus epidermidis
TKYLYKALRTRGYRVCIFKPFQTEEIGGG

SEQ ID NO: 1798740 - protein, 18 aa, Staphylococcus epidermidis
TLFYFKDSIIIGAVDIRH

SEQ ID NO: 1798741 - protein, 24 aa, Staphylococcus epidermidis
TLHFRVYLLGGEMRDLTEAFVGEM

SEQ ID NO: 1798742 - protein, 17 aa, Staphylococcus epidermidis
TLIARGLVEAKDVDHSR

SEQ ID NO: 1798743 - protein, 23 aa, Staphylococcus epidermidis
TLKEYKKDKVIIILNYPNNPTGY

SEQ ID NO: 1798744 - protein, 26 aa, Staphylococcus epidermidis
TLPLIKRLSSKQVRLNVTAVYTIEQV

SEQ ID NO: 1798745 - protein, 17 aa, Staphylococcus epidermidis
TLRHVKNIVLRRKNKER

SEQ ID NO: 1798746 - protein, 23 aa, Staphylococcus epidermidis
TLSAIKLNGALLLNGSPVTVRHV

SEQ ID NO: 1798747 - protein, 43 aa, Staphylococcus epidermidis
TLVTQIICYDLRFPEILRYPARKGAKIAFYVAQWPSSRLDHWL

SEQ ID NO: 1798748 - protein, 34 aa, Staphylococcus epidermidis
TMLTKSLAREWSRYGIKVNAIAPGYMRTIETEKI

SEQ ID NO: 1798749 - protein, 22 aa, Staphylococcus epidermidis
TMPKRIGLREAIISFKPQVLKE

SEQ ID NO: 1798750 - protein, 20 aa, Staphylococcus epidermidis
TNDEMMKVIHFFNKIENYYE

SEQ ID NO: 1798751 - protein, 31 aa, Staphylococcus epidermidis
TNHLDFESIRWLINYVKQYPHTVLFVTHDRY

SEQ ID NO: 1798752 - protein, 26 aa, Staphylococcus epidermidis
TNKLLKFKKSNCCYISESGIHTKEDV

SEQ ID NO: 1798753 - protein, 18 aa, Staphylococcus epidermidis
TNLFKYQLIFCFDGLDFF

SEQ ID NO: 1798754 - protein, 32 aa, Staphylococcus epidermidis
TNLTQFGYMWECPDYFRLGNKDVILMCPQGVE

SEQ ID NO: 1798755 - protein, 24 aa, Staphylococcus epidermidis
TNQKLIHRSIRIIQDVCDLNHQEA

SEQ ID NO: 1798756 - protein, 26 aa, Staphylococcus epidermidis
TNRDLRFIEDFSIKISDVMTKDNLIT

SEQ ID NO: 1798757 - protein, 22 aa, Staphylococcus epidermidis
TNRRVTFEYGLFGGVNDQLEHA

SEQ ID NO: 1798758 - protein, 21 aa, Staphylococcus epidermidis
TNSAFLIYLIAKESPNHDERM

SEQ ID NO: 1798759 - protein, 19 aa, Staphylococcus epidermidis
TNVTIAIMSGNFVMRGEPA

SEQ ID NO: 1798760 - protein, 36 aa, Staphylococcus epidermidis
TPFPRISYDDAIEFLKKEGFDDIEWGEDFGAPHETA

SEQ ID NO: 1798761 - protein, 22 aa, Staphylococcus epidermidis
TPIKNIVCDSLASAQAQYDMLF

SEQ ID NO: 1798762 - protein, 23 aa, Staphylococcus epidermidis
TPKTRGIVGSSFFNKAKQNLQII

SEQ ID NO: 1798763 - protein, 19 aa, Staphylococcus epidermidis
TPLDAVKCLALGAKAIGMS

SEQ ID NO: 1798764 - protein, 28 aa, Staphylococcus epidermidis
TPQMVLRFKRRFGDDVAVLHSGLSKGER

SEQ ID NO: 1798765 - protein, 18 aa, Staphylococcus epidermidis
TQLKAKRALVGNKDTFLI

SEQ ID NO: 1798766 - protein, 22 aa, Staphylococcus epidermidis
TQLLERFLFPSATHGKKVYKLS

SEQ ID NO: 1798767 - protein, 19 aa, Staphylococcus epidermidis
TQLLFQFLFSQGRLEEART

SEQ ID NO: 1798768 - protein, 18 aa, Staphylococcus epidermidis
TQPFTGQGIHYFKVNDLT

SEQ ID NO: 1798769 - protein, 24 aa, Staphylococcus epidermidis
TQSFPTLEVFNWLQKQGNISTNEM

SEQ ID NO: 1798770 - protein, 20 aa, Staphylococcus epidermidis
TQTFSCIQLLIQTLSHTRKE

SEQ ID NO: 1798771 - protein, 18 aa, Staphylococcus epidermidis
TRDGEKLLQYALQRESIE

SEQ ID NO: 1798772 - protein, 20 aa, Staphylococcus epidermidis
TRISKIYAQLGVKKIRITGG

SEQ ID NO: 1798773 - protein, 20 aa, Staphylococcus epidermidis
TRLAQSMDFLKENEYERHHL

SEQ ID NO: 1798774 - protein, 22 aa, Staphylococcus epidermidis
TRPEAIKMAPLIKTLEKDSDLE

SEQ ID NO: 1798775 - protein, 21 aa, Staphylococcus epidermidis
TRSEVKQLLKKGSVKVNQNIV

SEQ ID NO: 1798776 - protein, 25 aa, Staphylococcus epidermidis
TSEEIPHAIGVNVDRMIKEDEDRVR

SEQ ID NO: 1798777 - protein, 23 aa, Staphylococcus epidermidis
TSEVKLKKFLKVIQKAIHYINHH

SEQ ID NO: 1798778 - protein, 18 aa, Staphylococcus epidermidis
TTELAYTIAHCGDYNYFS

SEQ ID NO: 1798779 - protein, 24 aa, Staphylococcus epidermidis
TTTECPTCGKFMIKVKTKNGQMLV

SEQ ID NO: 1798780 - protein, 24 aa, Staphylococcus epidermidis
TTYRLKECGDILGINLLDHIIIGD

SEQ ID NO: 1798781 - protein, 23 aa, Staphylococcus epidermidis
TVGLELLGKGIARTGYDVLDENS

SEQ ID NO: 1798782 - protein, 17 aa, Staphylococcus epidermidis
TVKTLLNPVKFDFSLTV

SEQ ID NO: 1798783 - protein, 25 aa, Staphylococcus epidermidis
VAAVKKLQVDYVFHPSVDEMYPEEL

SEQ ID NO: 1798784 - protein, 28 aa, Staphylococcus epidermidis
VAFDKLGYRIGYGGGYYDRFLSQHKCNT

SEQ ID NO: 1798785 - protein, 28 aa, Staphylococcus epidermidis
VAQWPSSRLDHWLSLLKARAIENDIFIV

SEQ ID NO: 1798786 - protein, 23 aa, Staphylococcus epidermidis
VAYSDRAKKRFADVKTPRFYLDL

SEQ ID NO: 1798787 - protein, 22 aa, Staphylococcus epidermidis
VCEHVVAFELAKAVLEEFQSNH

SEQ ID NO: 1798788 - protein, 24 aa, Staphylococcus epidermidis
VDADGQRILIGWMGLPDTEYPTDK

SEQ ID NO: 1798789 - protein, 25 aa, Staphylococcus epidermidis
VDAMISRSEFYTAYTPYQPEISQGE

SEQ ID NO: 1798790 - protein, 24 aa, Staphylococcus epidermidis
VDDGLSGPIARFFEDVNVETLKQL

SEQ ID NO: 1798791 - protein, 17 aa, Staphylococcus epidermidis
VDEEALLEGLKQLIDVE

SEQ ID NO: 1798792 - protein, 18 aa, Staphylococcus epidermidis
VDESRLPVPNVHKNKFVA

SEQ ID NO: 1798793 - protein, 17 aa, Staphylococcus epidermidis
VDKFNWYQVAKKIERTY

SEQ ID NO: 1798794 - protein, 26 aa, Staphylococcus epidermidis
VDLLAKRLKQEYGLKFESCATKNLKI

SEQ ID NO: 1798795 - protein, 19 aa, Staphylococcus epidermidis
VDQNFKAVKVIKANLNQLD

SEQ ID NO: 1798796 - protein, 22 aa, Staphylococcus epidermidis
VDYLKVKALMMIPKNKKDIKRI

SEQ ID NO: 1798797 - protein, 23 aa, Staphylococcus epidermidis
VDYLNRYRILKSLHLLDQHYKHY

SEQ ID NO: 1798798 - protein, 22 aa, Staphylococcus epidermidis
VEAVKDLGERVNIQVDIGQNQT

SEQ ID NO: 1798799 - protein, 21 aa, Staphylococcus epidermidis
VEEAKRILAELDIEPLTPAEA

SEQ ID NO: 1798800 - protein, 22 aa, Staphylococcus epidermidis
VEIAPSVQGLVHISEIDHKHIG

SEQ ID NO: 1798801 - protein, 21 aa, Staphylococcus epidermidis
VEIPCVMRNAIGSGNALISAD

SEQ ID NO: 1798802 - protein, 21 aa, Staphylococcus epidermidis
VFDDARLYSKQALVAYFIRQL

SEQ ID NO: 1798803 - protein, 24 aa, Staphylococcus epidermidis
VFEHEFDNGLKLFIIPKPGFQKTY

SEQ ID NO: 1798804 - protein, 25 aa, Staphylococcus epidermidis
VFHYFKEAHPYFNQNVVIIGGKNSA

SEQ ID NO: 1798805 - protein, 17 aa, Staphylococcus epidermidis
VFLEEPFGVNQSAYSIT

SEQ ID NO: 1798806 - protein, 18 aa, Staphylococcus epidermidis
VGMTPLVSMFKKAASLNV

SEQ ID NO: 1798807 - protein, 26 aa, Staphylococcus epidermidis
VGQIAKLKGCRVVGIAGGDKKVNYLK

SEQ ID NO: 1798808 - protein, 21 aa, Staphylococcus epidermidis
VGVQISDIFPHLKGIFDKEIQ

SEQ ID NO: 1798809 - protein, 26 aa, Staphylococcus epidermidis
VIAAELRLGIVSGEIESHIQLSENQV

SEQ ID NO: 1798810 - protein, 26 aa, Staphylococcus epidermidis
VIEQSQCKRAIILPNNKNIMMASEQA

SEQ ID NO: 1798811 - protein, 26 aa, Staphylococcus epidermidis
VIGAGRIGLGVAKRAQSFGMKILAFD

SEQ ID NO: 1798812 - protein, 17 aa, Staphylococcus epidermidis
VIGELKPHLSPMSVIAS

SEQ ID NO: 1798813 - protein, 20 aa, Staphylococcus epidermidis
VIGMSIARHLSATHLDVAVI

SEQ ID NO: 1798814 - protein, 19 aa, Staphylococcus epidermidis
VIIYDRRKDLIISGGENIY

SEQ ID NO: 1798815 - protein, 19 aa, Staphylococcus epidermidis
VINFSSRFANVTSDDFIKN

SEQ ID NO: 1798816 - protein, 18 aa, Staphylococcus epidermidis
VIQQLKLNHSLYIVTNGV

SEQ ID NO: 1798817 - protein, 36 aa, Staphylococcus epidermidis
VISKLRVVVDLSLEPKLFLQICCIGAGIPQINKKRT

SEQ ID NO: 1798818 - protein, 22 aa, Staphylococcus epidermidis
VKADAISLCQKPHLGVPSEQEI

SEQ ID NO: 1798819 - protein, 20 aa, Staphylococcus epidermidis
VKDNEILAGFLYLTDLEEVP

SEQ ID NO: 1798820 - protein, 22 aa, Staphylococcus epidermidis
VKDNIKPGGTIVYSTCTIEQME

SEQ ID NO: 1798821 - protein, 24 aa, Staphylococcus epidermidis
VKENKLLITIAYRLFMEKHTFTIK

SEQ ID NO: 1798822 - protein, 27 aa, Staphylococcus epidermidis
VKKDFEGISFLNLVDFDALYGHRRDKE

SEQ ID NO: 1798823 - protein, 19 aa, Staphylococcus epidermidis
VKKQMKSENMFSAVKISGT

SEQ ID NO: 1798824 - protein, 19 aa, Staphylococcus epidermidis
VKPKKAIKFVATDRHMKTG

SEQ ID NO: 1798825 - protein, 23 aa, Staphylococcus epidermidis
VKPSELTPHVAIVIKDIIEDTFD

SEQ ID NO: 1798826 - protein, 23 aa, Staphylococcus epidermidis
VKQKGADIARLWVSSTDYLSDVR

SEQ ID NO: 1798827 - protein, 25 aa, Staphylococcus epidermidis
VKRDGLKGGGYYVEYRTDDARLTIE

SEQ ID NO: 1798828 - protein, 27 aa, Staphylococcus epidermidis
VKRPEVVEKIKVARSFGDLSENSEYDA

SEQ ID NO: 1798829 - protein, 21 aa, Staphylococcus epidermidis
VKTNIPFLINVMRNDKFRSGD

SEQ ID NO: 1798830 - protein, 22 aa, Staphylococcus epidermidis
VKTPRFYLDLNKYIKSQEQNST

SEQ ID NO: 1798831 - protein, 24 aa, Staphylococcus epidermidis
VKVKPPFYYPLNKIISIGTMIKEA

SEQ ID NO: 1798832 - protein, 18 aa, Staphylococcus epidermidis
VKVPEDLQIISFNNTRLV

SEQ ID NO: 1798833 - protein, 18 aa, Staphylococcus epidermidis
VLDALDIRLEPKYNSDIV

SEQ ID NO: 1798834 - protein, 26 aa, Staphylococcus epidermidis
VLDEAHCLSEWGYDFRPHYALVGKII

SEQ ID NO: 1798835 - protein, 31 aa, Staphylococcus epidermidis
VLEAIPSDLAREISQQLTIPVIGIGAGKDTD

SEQ ID NO: 1798836 - protein, 25 aa, Staphylococcus epidermidis
VLELKRIKIAQLELDHNLDLGSYRL

SEQ ID NO: 1798837 - protein, 28 aa, Staphylococcus epidermidis
VLGMYPKDVQILGAIAMHQGNIAEMQTG

SEQ ID NO: 1798838 - protein, 28 aa, Staphylococcus epidermidis
VLHIPSPLWKVMDFMILDKEEEHRKYEK

SEQ ID NO: 1798839 - protein, 25 aa, Staphylococcus epidermidis
VLIHACWLAHIEIAMINTRLTRHEM

SEQ ID NO: 1798840 - protein, 26 aa, Staphylococcus epidermidis
VLLCGCQGVNGGGWAHYVGQEKCRPI

SEQ ID NO: 1798841 - protein, 17 aa, Staphylococcus epidermidis
VNDIFKMIDDSTLPERV

SEQ ID NO: 1798842 - protein, 18 aa, Staphylococcus epidermidis
VNEKFLKDKTPLFEKGLD

SEQ ID NO: 1798843 - protein, 23 aa, Staphylococcus epidermidis
VNEVIKRLNYRPNAVARGLASKR

SEQ ID NO: 1798844 - protein, 20 aa, Staphylococcus epidermidis
VNMQPWRIAVVESDEMKEKV

SEQ ID NO: 1798845 - protein, 21 aa, Staphylococcus epidermidis
VPDGKKFAPAFDVDMNQPGIQ

SEQ ID NO: 1798846 - protein, 21 aa, Staphylococcus epidermidis
VPEFGTGFVRQMLEDTKPTTF

SEQ ID NO: 1798847 - protein, 18 aa, Staphylococcus epidermidis
VPGFKFAIFNDFNSFKSL

SEQ ID NO: 1798848 - protein, 20 aa, Staphylococcus epidermidis
VPLFDRSKRSLVLTDAGKIF

SEQ ID NO: 1798849 - protein, 24 aa, Staphylococcus epidermidis
VPSDIRAAGGVARMANPKIVEEVM

SEQ ID NO: 1798850 - protein, 18 aa, Staphylococcus epidermidis
VPVDLIFLKGKEMHRQAR

SEQ ID NO: 1798851 - protein, 29 aa, Staphylococcus epidermidis
VQDAPGFKHVYPYMLKFIDQLPVVAHNAA

SEQ ID NO: 1798852 - protein, 30 aa, Staphylococcus epidermidis
VQEVLRLSHIQLVGLAFNFMCFKSEAPNEK

SEQ ID NO: 1798853 - protein, 27 aa, Staphylococcus epidermidis
VRKHFDLRPAGIIKMLDLKQPIYRQTA

SEQ ID NO: 1798854 - protein, 18 aa, Staphylococcus epidermidis
VRLVKDEKKSLVKDEATK

SEQ ID NO: 1798855 - protein, 17 aa, Staphylococcus epidermidis
VRMINKFIHNVENETHF

SEQ ID NO: 1798856 - protein, 21 aa, Staphylococcus epidermidis
VRPDLPASTIANYIRRDIYEV

SEQ ID NO: 1798857 - protein, 18 aa, Staphylococcus epidermidis
VSAPHFKANPKLDGTHSE

SEQ ID NO: 1798858 - protein, 23 aa, Staphylococcus epidermidis
VSDMKGGMSSLFYVLEQLHQAGQ

SEQ ID NO: 1798859 - protein, 28 aa, Staphylococcus epidermidis
VSFGGKVAGELFIFDIVDAFIEAEYKPT

SEQ ID NO: 1798860 - protein, 23 aa, Staphylococcus epidermidis
VSGCPFQCKGCYNVKAQNFKYGE

SEQ ID NO: 1798861 - protein, 18 aa, Staphylococcus epidermidis
VSHVPIMFISSRTDNMDQ

SEQ ID NO: 1798862 - protein, 24 aa, Staphylococcus epidermidis
VSQSLKGALFTSLLLEKINMKTSP

SEQ ID NO: 1798863 - protein, 25 aa, Staphylococcus epidermidis
VSSHGLALGRLRGVEFDVAIFSNLT

SEQ ID NO: 1798864 - protein, 19 aa, Staphylococcus epidermidis
VSSVFLETFLFYSGFYYPL

SEQ ID NO: 1798865 - protein, 21 aa, Staphylococcus epidermidis
VSTLRLLGAQVGWYIPNRFTE

SEQ ID NO: 1798866 - protein, 19 aa, Staphylococcus epidermidis
VTCGKGTYIRTLATDIGLK

SEQ ID NO: 1798867 - protein, 25 aa, Staphylococcus epidermidis
VTLEPCVMCAGTIIMSRIPKVVYGA

SEQ ID NO: 1798868 - protein, 21 aa, Staphylococcus epidermidis
VVANLPYYITTPILLNLMQQD

SEQ ID NO: 1798869 - protein, 19 aa, Staphylococcus epidermidis
VVCPSKHFNVLNADGDNYA

SEQ ID NO: 1798870 - protein, 19 aa, Staphylococcus epidermidis
VVDISGRPYFSFNSKLSAQ

SEQ ID NO: 1798871 - protein, 18 aa, Staphylococcus epidermidis
VVQEGVFNALKYAEVNEI

SEQ ID NO: 1798872 - protein, 22 aa, Staphylococcus epidermidis
VVVLKPFRLGGIDRMLNAMKIL

SEQ ID NO: 1798873 - protein, 18 aa, Staphylococcus epidermidis
VWGNGLATEGAEAVMKYA

SEQ ID NO: 1798874 - protein, 20 aa, Staphylococcus epidermidis
VWLDCDIEIIFKRVKNDSHR

SEQ ID NO: 1798875 - protein, 22 aa, Staphylococcus epidermidis
VWQERLKLLKPYQVNQALLEKT

SEQ ID NO: 1798876 - protein, 19 aa, Staphylococcus epidermidis
VYKNVAMPLILSKTNKKEI

SEQ ID NO: 1798877 - protein, 25 aa, Staphylococcus epidermidis
VYLEHMKLYRSFREEVPEEEYKIDI

SEQ ID NO: 1798878 - protein, 18 aa, Staphylococcus epidermidis
WENSCGSGAASIGVLVNY

SEQ ID NO: 1798879 - protein, 17 aa, Staphylococcus epidermidis
WHLAHNRIIIPKSQTPK

SEQ ID NO: 1798880 - protein, 29 aa, Staphylococcus epidermidis
WIHERSKFGIKPGVKRMEWMLEQLNNPQH

SEQ ID NO: 1798881 - protein, 24 aa, Staphylococcus epidermidis
WINGRMPLIGIGSVFTAEDALNAV

SEQ ID NO: 1798882 - protein, 17 aa, Staphylococcus epidermidis
WIVSIYLAHHFISQSSD

SEQ ID NO: 1798883 - protein, 18 aa, Staphylococcus epidermidis
WLAKKLYQSEAYRKANTI

SEQ ID NO: 1798884 - protein, 17 aa, Staphylococcus epidermidis
WLNCGYNRWNHNEPLVG

SEQ ID NO: 1798885 - protein, 30 aa, Staphylococcus epidermidis
WLQHIHTLIKMCGLVRGVLIQPSFDYATTY

SEQ ID NO: 1798886 - protein, 17 aa, Staphylococcus epidermidis
WMVKIEISDDSQLEELL

SEQ ID NO: 1798887 - protein, 17 aa, Staphylococcus epidermidis
WNFTKFLIDREGNVIKR

SEQ ID NO: 1798888 - protein, 18 aa, Staphylococcus epidermidis
WNSDTFFSLIKAFELPTN

SEQ ID NO: 1798889 - protein, 17 aa, Staphylococcus epidermidis
WNYEVHVVDNFEKIMED

SEQ ID NO: 1798890 - protein, 18 aa, Staphylococcus epidermidis
WPDSVNVREIFKQYVNCP

SEQ ID NO: 1798891 - protein, 21 aa, Staphylococcus epidermidis
WPVNRNGAYVIHRLAGSKQYK

SEQ ID NO: 1798892 - protein, 19 aa, Staphylococcus epidermidis
WRGPMLGKMLTNFFTEVQW

SEQ ID NO: 1798893 - protein, 21 aa, Staphylococcus epidermidis
WRLIPEVWGNGLATEGAEAVM

SEQ ID NO: 1798894 - protein, 19 aa, Staphylococcus epidermidis
WRTTIKQADKMGVNKAIQG

SEQ ID NO: 1798895 - protein, 17 aa, Staphylococcus epidermidis
WYSKGIYKFRFPILEAI

SEQ ID NO: 1798896 - protein, 19 aa, Staphylococcus epidermidis
WYYIESSLQLTLPYERNSL

SEQ ID NO: 1798897 - protein, 19 aa, Staphylococcus epidermidis
YADGYLRSMQGAFVNVNGS

SEQ ID NO: 1798898 - protein, 23 aa, Staphylococcus epidermidis
YAENVKFADHWLAPHPGTDAAVA

SEQ ID NO: 1798899 - protein, 29 aa, Staphylococcus epidermidis
YASNTWIYKTMPTMNQWLKDIEVQKKMHL

SEQ ID NO: 1798900 - protein, 17 aa, Staphylococcus epidermidis
YATDFDSSMAWWKELYS

SEQ ID NO: 1798901 - protein, 17 aa, Staphylococcus epidermidis
YCEQNGFKVETVDYLPG

SEQ ID NO: 1798902 - protein, 25 aa, Staphylococcus epidermidis
YDELLPKLKEAFENIKVGDPFDEDT

SEQ ID NO: 1798903 - protein, 19 aa, Staphylococcus epidermidis
YDIELAFEAGLLSRNEENF

SEQ ID NO: 1798904 - protein, 19 aa, Staphylococcus epidermidis
YDIGAVGMRLLTKYMNDEE

SEQ ID NO: 1798905 - protein, 17 aa, Staphylococcus epidermidis
YDMSDIQVLAPMYKGNA

SEQ ID NO: 1798906 - protein, 25 aa, Staphylococcus epidermidis
YDNKHGYLYFCGQLDVPLTERGIKS

SEQ ID NO: 1798907 - protein, 23 aa, Staphylococcus epidermidis
YDSKELFKLMALESQHAGLSWLT

SEQ ID NO: 1798908 - protein, 17 aa, Staphylococcus epidermidis
YDVYFKQLIGIDINGCN

SEQ ID NO: 1798909 - protein, 25 aa, Staphylococcus epidermidis
YDYIPRLFWPIYYFIQAPIQGLLMR

SEQ ID NO: 1798910 - protein, 18 aa, Staphylococcus epidermidis
YDYPHQRLYRAIAGIGAY

SEQ ID NO: 1798911 - protein, 24 aa, Staphylococcus epidermidis
YEELQKSYDLFSMMESVDKQLEVI

SEQ ID NO: 1798912 - protein, 18 aa, Staphylococcus epidermidis
YEFFEGIAKVTINRPEVR

SEQ ID NO: 1798913 - protein, 17 aa, Staphylococcus epidermidis
YEKRLGPYTKIELIEVP

SEQ ID NO: 1798914 - protein, 19 aa, Staphylococcus epidermidis
YENLSFVFDEDVSNINMQN

SEQ ID NO: 1798915 - protein, 19 aa, Staphylococcus epidermidis
YFLCHDILEDAWKSQNTFS

SEQ ID NO: 1798916 - protein, 17 aa, Staphylococcus epidermidis
YGARPLIRAIQKTVEDN

SEQ ID NO: 1798917 - protein, 20 aa, Staphylococcus epidermidis
YGAVNLHWPDSVNVREIFKQ

SEQ ID NO: 1798918 - protein, 19 aa, Staphylococcus epidermidis
YGFTPKLSVILVGNDGASQ

SEQ ID NO: 1798919 - protein, 25 aa, Staphylococcus epidermidis
YGHFGRTDVLLPWEKLDKVNVLKDA

SEQ ID NO: 1798920 - protein, 23 aa, Staphylococcus epidermidis
YGKTECWYILDAQPGAEIIYGVN

SEQ ID NO: 1798921 - protein, 22 aa, Staphylococcus epidermidis
YGMPPTGGLGIGIDRLVMLLTD

SEQ ID NO: 1798922 - protein, 21 aa, Staphylococcus epidermidis
YGSSVNSEWMIPKILEVKHEA

SEQ ID NO: 1798923 - protein, 23 aa, Staphylococcus epidermidis
YGVDFGTGYALEFTGETIKNLSM

SEQ ID NO: 1798924 - protein, 20 aa, Staphylococcus epidermidis
YHHFGVDWIAPAMREDGSEF

SEQ ID NO: 1798925 - protein, 21 aa, Staphylococcus epidermidis
YHHSVKIISLIAMTASDARIM

SEQ ID NO: 1798926 - protein, 24 aa, Staphylococcus epidermidis
YHLPTLKKGILFWQEQSQGYVPGN

SEQ ID NO: 1798927 - protein, 19 aa, Staphylococcus epidermidis
YHLSFSFPANEKIDEVLLE

SEQ ID NO: 1798928 - protein, 19 aa, Staphylococcus epidermidis
YIDEHGGMIIYLPQEGRGI

SEQ ID NO: 1798929 - protein, 23 aa, Staphylococcus epidermidis
YIGSELGTAFANFGSEVTILEGA

SEQ ID NO: 1798930 - protein, 21 aa, Staphylococcus epidermidis
YINAYRLAEKYANIATNCYDT

SEQ ID NO: 1798931 - protein, 23 aa, Staphylococcus epidermidis
YITPDKVHVMYGGKVVKSGGPEL

SEQ ID NO: 1798932 - protein, 17 aa, Staphylococcus epidermidis
YKAADLMFERFNINEGV

SEQ ID NO: 1798933 - protein, 17 aa, Staphylococcus epidermidis
YKFGEDGLKQYAVSQFK

SEQ ID NO: 1798934 - protein, 19 aa, Staphylococcus epidermidis
YKGSTTFTSLKVSGCDLYS

SEQ ID NO: 1798935 - protein, 20 aa, Staphylococcus epidermidis
YKQKKCKVCGHSIETKVIAG

SEQ ID NO: 1798936 - protein, 34 aa, Staphylococcus epidermidis
YLDLPKEMNPFLGYRAIRLCLAQPEIFRPQLRAL

SEQ ID NO: 1798937 - protein, 23 aa, Staphylococcus epidermidis
YLKNELRFDAGIDYKKDNFPEAL

SEQ ID NO: 1798938 - protein, 19 aa, Staphylococcus epidermidis
YLLEKACERKGILFEPKKI

SEQ ID NO: 1798939 - protein, 20 aa, Staphylococcus epidermidis
YLLKRYKGKVLIIVNTATNC

SEQ ID NO: 1798940 - protein, 21 aa, Staphylococcus epidermidis
YLRPLYDGLNTVLGREQTQRL

SEQ ID NO: 1798941 - protein, 23 aa, Staphylococcus epidermidis
YNGHLLIQWYSKGIYKFRFPILE

SEQ ID NO: 1798942 - protein, 18 aa, Staphylococcus epidermidis
YNLVIYQLGALSGFCKIN

SEQ ID NO: 1798943 - protein, 24 aa, Staphylococcus epidermidis
YNRNIKRPLAIFKMVNTTEDIITL

SEQ ID NO: 1798944 - protein, 28 aa, Staphylococcus epidermidis
YNSKGACPNCGGKGYIKTELAFMGDFSQ

SEQ ID NO: 1798945 - protein, 22 aa, Staphylococcus epidermidis
YNVPDFCQLIFITTPEVLNTSE

SEQ ID NO: 1798946 - protein, 26 aa, Staphylococcus epidermidis
YPDARYSIENGHSFTGNYVVNNEQRD

SEQ ID NO: 1798947 - protein, 23 aa, Staphylococcus epidermidis
YPEELGIHLKVGHLAQVLEGAQR

SEQ ID NO: 1798948 - protein, 20 aa, Staphylococcus epidermidis
YPLLNGCVCCDMKSDLVQQI

SEQ ID NO: 1798949 - protein, 27 aa, Staphylococcus epidermidis
YPMDSPGGWQIIGRTPIKVFDLNRTPM

SEQ ID NO: 1798950 - protein, 20 aa, Staphylococcus epidermidis
YPTIFSRVALLSPMYNENIK

SEQ ID NO: 1798951 - protein, 32 aa, Staphylococcus epidermidis; identical to SEQ ID NO: 1745848

SEQ ID NO: 1798952 - protein, 21 aa, Staphylococcus epidermidis
YQKLKSGLNLKEIAQLQNVKL

SEQ ID NO: 1798953 - protein, 18 aa, Staphylococcus epidermidis
YQMRRARMEVEERLLYDD

SEQ ID NO: 1798954 - protein, 24 aa, Staphylococcus epidermidis
YQNEIRAIIKQCLNLPQTRLRKLL

SEQ ID NO: 1798955 - protein, 17 aa, Staphylococcus epidermidis
YREGFITHLMPKKDKSY

SEQ ID NO: 1798956 - protein, 18 aa, Staphylococcus epidermidis
YSMIKGTVDAILFQNTDN

SEQ ID NO: 1798957 - protein, 19 aa, Staphylococcus epidermidis
YSRNRWWESTSRPFYLKKQ

SEQ ID NO: 1798958 - protein, 21 aa, Staphylococcus epidermidis
YTGLELLRLALNHPHVTVSSI

SEQ ID NO: 1798959 - protein, 22 aa, Staphylococcus epidermidis
YTKEGFKFAETVYDLLGNAILK

SEQ ID NO: 1798960 - protein, 25 aa, Staphylococcus epidermidis
YTKKSGKGIYRFKLNDETGVIEALE

SEQ ID NO: 1798961 - protein, 17 aa, Staphylococcus epidermidis
YTTAKAGLIGFTRNIAA

SEQ ID NO: 1798962 - protein, 22 aa, Staphylococcus epidermidis
YTTNGRLGFDYLIDNLADDIRA

SEQ ID NO: 1798963 - protein, 24 aa, Staphylococcus epidermidis
YVMLGHLHHPFSINNSFIKYSGSI

SEQ ID NO: 1798964 - protein, 19 aa, Staphylococcus epidermidis
YVVECGANVVGLNCHHGPH

SEQ ID NO: 1798965 - protein, 20 aa, Staphylococcus epidermidis
YYNKRLRTTGGRYILSSHNI

SEQ ID NO: 1798966 - protein, 18 aa, Staphylococcus epidermidis
YYQFYILKLVVGEQRIKK

SEQ ID NO: 1798967 - protein, 20 aa, Staphylococcus epidermidis
YYVEELRPFTGLDEPVYNYV

SEQ ID NO: 1798968 - protein, 23 aa, Staphylococcus epidermidis
AAGDVKGGLQFTYISLDDYRIIK

SEQ ID NO: 1798969 - protein, 19 aa, Staphylococcus epidermidis
AANLIKPDLAIAVDVGVAY

SEQ ID NO: 1798970 - protein, 25 aa, Staphylococcus epidermidis
AASEVEGINWLELDVAITKDEQLII

SEQ ID NO: 1798971 - protein, 25 aa, Staphylococcus epidermidis
AATKAGAPKDCIQWIEVPSIEATKQ

SEQ ID NO: 1798972 - protein, 22 aa, Staphylococcus epidermidis
ADFASLCFHVPFTKMGQKALDS

SEQ ID NO: 1798973 - protein, 24 aa, Staphylococcus epidermidis
ADHFYPDLLLGFIHVPLIPEQTIN

SEQ ID NO: 1798974 - protein, 23 aa, Staphylococcus epidermidis
ADKLEIGDDIALYGEDGQLYGTL

SEQ ID NO: 1798975 - protein, 20 aa, Staphylococcus epidermidis
ADLDVLKSRIAQRNRSFESQ

SEQ ID NO: 1798976 - protein, 17 aa, Staphylococcus epidermidis
ADSLRYFLATGSSPGHD

SEQ ID NO: 1798977 - protein, 23 aa, Staphylococcus epidermidis
AEHGIDYCIVINFSSRFANVTSD

SEQ ID NO: 1798978 - protein, 23 aa, Staphylococcus epidermidis
AEKGVHRLVRISPFDSSGRRHTS

SEQ ID NO: 1798979 - protein, 21 aa, Staphylococcus epidermidis
AELFKSMGATHIISGGQTMNP

SEQ ID NO: 1798980 - protein, 22 aa, Staphylococcus epidermidis
AENGHRVIVAGLDMDFRGEPFK

SEQ ID NO: 1798981 - protein, 21 aa, Staphylococcus epidermidis
AEVPSTISGTITELVVEEGQT

SEQ ID NO: 1798982 - protein, 18 aa, Staphylococcus epidermidis
AFDEAHCISKWGHDFRPS

SEQ ID NO: 1798983 - protein, 19 aa, Staphylococcus epidermidis
AFEQELHPYVLKDAGTFNQ

SEQ ID NO: 1798984 - protein, 18 aa, Staphylococcus epidermidis
AFLSYLDHAMIMSNSQDE

SEQ ID NO: 1798985 - protein, 17 aa, Staphylococcus epidermidis
AFPSWVKIDIVTEEEVT

SEQ ID NO: 1798986 - protein, 23 aa, Staphylococcus epidermidis
AGAGFPSIPLKIVYPELKVTIVD

SEQ ID NO: 1798987 - protein, 20 aa, Staphylococcus epidermidis
AGGHAVMLGSLLAGTEESPG

SEQ ID NO: 1798988 - protein, 17 aa, Staphylococcus epidermidis
AGLKRMGWSDNIVTTYL

SEQ ID NO: 1798989 - protein, 20 aa, Staphylococcus epidermidis
AGTCTNYGCNAKILLEGPYE

SEQ ID NO: 1798990 - protein, 17 aa, Staphylococcus epidermidis
AGYFSPLANLARMTEEV

SEQ ID NO: 1798991 - protein, 18 aa, Staphylococcus epidermidis
AHASYRIDGFSEIDYMIS

SEQ ID NO: 1798992 - protein, 25 aa, Staphylococcus epidermidis
AHKLYKNRRYVAARMISQLSRFFTG

SEQ ID NO: 1798993 - protein, 22 aa, Staphylococcus epidermidis
AHQLGIDLTDVIAIGDNLNDIS

SEQ ID NO: 1798994 - protein, 17 aa, Staphylococcus epidermidis
AIDYWKDDIAAVLVEPI

SEQ ID NO: 1798995 - protein, 21 aa, Staphylococcus epidermidis
AIKEHMASLIYKLEEMGVDLE

SEQ ID NO: 1798996 - protein, 19 aa, Staphylococcus epidermidis
AIMGETLAEIGFKQGIQPY

SEQ ID NO: 1798997 - protein, 18 aa, Staphylococcus epidermidis
AIMGMNFHLVCPKELNPT

SEQ ID NO: 1798998 - protein, 21 aa, Staphylococcus epidermidis
AKAKVQLAFCIDVRSEPFRRH

SEQ ID NO: 1798999 - protein, 29 aa, Staphylococcus epidermidis
AKLLRQLPYPTKFIFLDFIQSENIQTLTS

SEQ ID NO: 1799000 - protein, 25 aa, Staphylococcus epidermidis
AKNYDIPLYLGRTLSNVKGTWIMSK

SEQ ID NO: 1799001 - protein, 20 aa, Staphylococcus epidermidis
AKSRFWLQLQADIFNVQIKR

SEQ ID NO: 1799002 - protein, 28 aa, Staphylococcus epidermidis
AKVDSMLFRGVHYEICCKDRKGYEWVIQ

SEQ ID NO: 1799003 - protein, 27 aa, Staphylococcus epidermidis
AKVGGRLPGGIKIKRAKLRGERSEGMI

SEQ ID NO: 1799004 - protein, 18 aa, Staphylococcus epidermidis
ALELILPKVQFNLLNSSA

SEQ ID NO: 1799005 - protein, 18 aa, Staphylococcus epidermidis
ALESLTYLLIGGEVLNAK

SEQ ID NO: 1799006 - protein, 21 aa, Staphylococcus epidermidis
ALIQHKYKLAGKMMEQDGFHE

SEQ ID NO: 1799007 - protein, 18 aa, Staphylococcus epidermidis
ALKANPLLNSTWQGDEIV

SEQ ID NO: 1799008 - protein, 20 aa, Staphylococcus epidermidis
ALPYYKQFIQEVGQFLENEN

SEQ ID NO: 1799009 - protein, 20 aa, Staphylococcus epidermidis
ANQLANWGVDGIFTDNADKM

SEQ ID NO: 1799010 - protein, 23 aa, Staphylococcus epidermidis
APFGATIPYYFTGHEGPDSCCID

SEQ ID NO: 1799011 - protein, 17 aa, Staphylococcus epidermidis
AQLFLNDEVTTIEDAIE

SEQ ID NO: 1799012 - protein, 28 aa, Staphylococcus epidermidis
AQTCYQFKVPFIVTRAVSDLANGKADIS

SEQ ID NO: 1799013 - protein, 18 aa, Staphylococcus epidermidis
AREALFTHHFVKDFKDTN

SEQ ID NO: 1799014 - protein, 19 aa, Staphylococcus epidermidis
AREAYKVGIRHFGENRLDG

SEQ ID NO: 1799015 - protein, 18 aa, Staphylococcus epidermidis
ARFKHVEELQRMGANIKS

SEQ ID NO: 1799016 - protein, 19 aa, Staphylococcus epidermidis
ARLEGGKYAFAYASGIAAI

SEQ ID NO: 1799017 - protein, 18 aa, Staphylococcus epidermidis
ARLKHLDVEFKFDREEET

SEQ ID NO: 1799018 - protein, 18 aa, Staphylococcus epidermidis
ASEDEAYIDIIRKVKSCD

SEQ ID NO: 1799019 - protein, 18 aa, Staphylococcus epidermidis
ASLETFGVDSDRLEIQIM

SEQ ID NO: 1799020 - protein, 20 aa, Staphylococcus epidermidis
ASPFLKMIINQSEFNMKIAG

SEQ ID NO: 1799021 - protein, 25 aa, Staphylococcus epidermidis
ASQIKRLKFDYLYIDNARLKSPYLL

SEQ ID NO: 1799022 - protein, 25 aa, Staphylococcus epidermidis
ASVEIAIKMAYQYWKNIDAERYAKK

SEQ ID NO: 1799023 - protein, 21 aa, Staphylococcus epidermidis
ATKVGIGPGRVCITKIKTGFG

SEQ ID NO: 1799024 - protein, 25 aa, Staphylococcus epidermidis
ATNRQLVYFKYNIKEDIYTEDEKVH

SEQ ID NO: 1799025 - protein, 17 aa, Staphylococcus epidermidis
ATPQKWINYMLDLLNNY

SEQ ID NO: 1799026 - protein, 17 aa, Staphylococcus epidermidis
ATQFKPQLILDFATLTG

SEQ ID NO: 1799027 - protein, 26 aa, Staphylococcus epidermidis
AVLIHGFKGYVALLFQKGAILEEKYH

SEQ ID NO: 1799028 - protein, 17 aa, Staphylococcus epidermidis
AVMSIAFNHPLATVDGN

SEQ ID NO: 1799029 - protein, 22 aa, Staphylococcus epidermidis
AVSRLVGAPPGYVGHDDGGQLT

SEQ ID NO: 1799030 - protein, 22 aa, Staphylococcus epidermidis
AYATEIGMLLKSIKLMRKELKN

SEQ ID NO: 1799031 - protein, 26 aa, Staphylococcus epidermidis
AYGEKGGTPWLDQKHTVFGQLIEGES

SEQ ID NO: 1799032 - protein, 20 aa, Staphylococcus epidermidis
AYRRDLKKYKDYLEDNKISH

SEQ ID NO: 1799033 - protein, 23 aa, Staphylococcus epidermidis
CASPYITHSYVFISWTGKMAETF

SEQ ID NO: 1799034 - protein, 21 aa, Staphylococcus epidermidis
CDFHIKIPMVGHVNSLNASVA

SEQ ID NO: 1799035 - protein, 17 aa, Staphylococcus epidermidis
CDFYPEFLEEAITEENG

SEQ ID NO: 1799036 - protein, 19 aa, Staphylococcus epidermidis
CKEDVLYFKAKDKHRLYNE

SEQ ID NO: 1799037 - protein, 18 aa, Staphylococcus epidermidis
CLQKGAFVSDKDGDMHYD

SEQ ID NO: 1799038 - protein, 20 aa, Staphylococcus epidermidis
CNHIKEPQCHVKALVEKGEI

SEQ ID NO: 1799039 - protein, 17 aa, Staphylococcus epidermidis
CQTLGLQSAQSIFEFDH

SEQ ID NO: 1799040 - protein, 17 aa, Staphylococcus epidermidis
CSSIKSILSSGAKLTLQ

SEQ ID NO: 1799041 - protein, 20 aa, Staphylococcus epidermidis
CTTEACEFRDHIEDFNQLDV

SEQ ID NO: 1799042 - protein, 26 aa, Staphylococcus epidermidis
DACIAAHIHPIFGMTIYLTDGLYTIE

SEQ ID NO: 1799043 - protein, 21 aa, Staphylococcus epidermidis
DAIQIVPLMIKYAAELKNKGR

SEQ ID NO: 1799044 - protein, 22 aa, Staphylococcus epidermidis
DDMLKAVIDHFGHIDIVVNSAG

SEQ ID NO: 1799045 - protein, 22 aa, Staphylococcus epidermidis
DDYRIIKSHLFGDGSRTTENRG

SEQ ID NO: 1799046 - protein, 19 aa, Staphylococcus epidermidis
DEGMDWLLRHAYHRVPQLK

SEQ ID NO: 1799047 - protein, 21 aa, Staphylococcus epidermidis
DEIFGPVLAITTYRDFEQVIE

SEQ ID NO: 1799048 - protein, 20 aa, Staphylococcus epidermidis
DEILEYYGLKVLVDRNDAPV

SEQ ID NO: 1799049 - protein, 22 aa, Staphylococcus epidermidis
DELRAQNILQERAFKNDKVDFI

SEQ ID NO: 1799050 - protein, 28 aa, Staphylococcus epidermidis
DETKLGSLHIKSIRISDVKSYYLNYFGL

SEQ ID NO: 1799051 - protein, 26 aa, Staphylococcus epidermidis
DEVVEKIAGIAAREVKGILDMKGGFT

SEQ ID NO: 1799052 - protein, 27 aa, Staphylococcus epidermidis
DFDIPRVLGDIIICTDVAKEQSESYGH

SEQ ID NO: 1799053 - protein, 25 aa, Staphylococcus epidermidis
DFHRPGHLFPLIAKENGVLTRNGHT

SEQ ID NO: 1799054 - protein, 24 aa, Staphylococcus epidermidis
DFVNEIKSAMSIGDTCPICGNEIH

SEQ ID NO: 1799055 - protein, 18 aa, Staphylococcus epidermidis
DGFGYKWETHEDVIDDET

SEQ ID NO: 1799056 - protein, 22 aa, Staphylococcus epidermidis
DGGFLTKVRTGAISGVATKYLA

SEQ ID NO: 1799057 - protein, 22 aa, Staphylococcus epidermidis
DGHTTALMLFVKRCKALYDKSE

SEQ ID NO: 1799058 - protein, 20 aa, Staphylococcus epidermidis
DGILKSRAKHEAIINGKRYP

SEQ ID NO: 1799059 - protein, 24 aa, Staphylococcus epidermidis
DGLFKEHQLLYILIMHAFANTYVS

SEQ ID NO: 1799060 - protein, 17 aa, Staphylococcus epidermidis
DGLLVPFVRDCDKKNFA

SEQ ID NO: 1799061 - protein, 18 aa, Staphylococcus epidermidis
DHEIFIKYLKFFQLPYKN

SEQ ID NO: 1799062 - protein, 20 aa, Staphylococcus epidermidis
DIDDLFDMFKFKNERLKAKM

SEQ ID NO: 1799063 - protein, 25 aa, Staphylococcus epidermidis
DIDLRVDELLTMVGLNPEQFKNRKP

SEQ ID NO: 1799064 - protein, 17 aa, Staphylococcus epidermidis
DIGEDLTQVAFYERGEL

SEQ ID NO: 1799065 - protein, 24 aa, Staphylococcus epidermidis
DIIELRIDQWPSFNKALLNEVIKQ

SEQ ID NO: 1799066 - protein, 27 aa, Staphylococcus epidermidis
DIIKRHRLLELFLIEILQYNWEEVHQE

SEQ ID NO: 1799067 - protein, 19 aa, Staphylococcus epidermidis
DIKPISALIMYGTNDKILE

SEQ ID NO: 1799068 - protein, 27 aa, Staphylococcus epidermidis
DILCCYRLNRLHRNLKNALKLIKLCQT

SEQ ID NO: 1799069 - protein, 21 aa, Staphylococcus epidermidis
DINTSLSILDFTFFKKTIGKT

SEQ ID NO: 1799070 - protein, 26 aa, Staphylococcus epidermidis
DIREPCWKIQAKYAIPNLVQKMSQSG

SEQ ID NO: 1799071 - protein, 19 aa, Staphylococcus epidermidis
DISKARYHKIVIMTDADVD

SEQ ID NO: 1799072 - protein, 17 aa, Staphylococcus epidermidis
DIVLFKPLSVNDMSMIV

SEQ ID NO: 1799073 - protein, 26 aa, Staphylococcus epidermidis
DKDPYRVGLKLKDGGWVYVQGLTHYE

SEQ ID NO: 1799074 - protein, 26 aa, Staphylococcus epidermidis
DKDSEHYGLWAFKRVWGTYLSEKIGE

SEQ ID NO: 1799075 - protein, 24 aa, Staphylococcus epidermidis
DKINFGDGVARFDLRKEGAKHFHH

SEQ ID NO: 1799076 - protein, 18 aa, Staphylococcus epidermidis
DKKRYSMTVMFDNKGNPL

SEQ ID NO: 1799077 - protein, 18 aa, Staphylococcus epidermidis
DKKYILYCPTWRGNQRKE

SEQ ID NO: 1799078 - protein, 17 aa, Staphylococcus epidermidis
DKNLDEMEFLKANSDFL

SEQ ID NO: 1799079 - protein, 18 aa, Staphylococcus epidermidis
DKQVKIRGFRIELSEIEK

SEQ ID NO: 1799080 - protein, 23 aa, Staphylococcus epidermidis
DKSELPHNVVFIFQPAEETGGGA

SEQ ID NO: 1799081 - protein, 23 aa, Staphylococcus epidermidis
DKVKYVGALFLGHFSPEVIGDYM

SEQ ID NO: 1799082 - protein, 26 aa, Staphylococcus epidermidis
DLPKLKELWPKAGDYLLVTLRIDSTN

SEQ ID NO: 1799083 - protein, 18 aa, Staphylococcus epidermidis
DLQYLATQMIDYEKHPDF

SEQ ID NO: 1799084 - protein, 19 aa, Staphylococcus epidermidis
DMLPFCLHISGMPVVNSNA

SEQ ID NO: 1799085 - protein, 17 aa, Staphylococcus epidermidis
DNFDGFNSIEIDTGSIL

SEQ ID NO: 1799086 - protein, 19 aa, Staphylococcus epidermidis
DNVFKDEIFGPVLAITTYR

SEQ ID NO: 1799087 - protein, 20 aa, Staphylococcus epidermidis
DQLIILTAIDYVYINYHTDQ

SEQ ID NO: 1799088 - protein, 24 aa, Staphylococcus epidermidis
DQNFKRINNSLARLEMPEVDEEAL

SEQ ID NO: 1799089 - protein, 23 aa, Staphylococcus epidermidis
DQTLFRLQKQFAYTKEDINKYMT

SEQ ID NO: 1799090 - protein, 21 aa, Staphylococcus epidermidis
DRGEWVISRQRVWGVPLPVFY

SEQ ID NO: 1799091 - protein, 24 aa, Staphylococcus epidermidis
DRITGRMLPGTKLQSGLHQAIEAL

SEQ ID NO: 1799092 - protein, 22 aa, Staphylococcus epidermidis
DSSHKGNFVPRLLVNNKEENVL

SEQ ID NO: 1799093 - protein, 19 aa, Staphylococcus epidermidis
DSTYPYISFIPLNDKTILT

SEQ ID NO: 1799094 - protein, 17 aa, Staphylococcus epidermidis
DTCKTLESIGVDLLVIR

SEQ ID NO: 1799095 - protein, 25 aa, Staphylococcus epidermidis
DTEVFRGNHPFAFTNLKTDEGLEKV

SEQ ID NO: 1799096 - protein, 22 aa, Staphylococcus epidermidis
DTKQRFEAYGWNYILVENGNDL

SEQ ID NO: 1799097 - protein, 17 aa, Staphylococcus epidermidis
DTLKIKWIEQGDIQSYE

SEQ ID NO: 1799098 - protein, 17 aa, Staphylococcus epidermidis
DVITYFINYLFTGYEVL

SEQ ID NO: 1799099 - protein, 23 aa, Staphylococcus epidermidis
DVNFKLYLGLKHISPYIEEAVEQ

SEQ ID NO: 1799100 - protein, 17 aa, Staphylococcus epidermidis
DVPAGIMTKCPKCKKIM

SEQ ID NO: 1799101 - protein, 18 aa, Staphylococcus epidermidis
DVTLGRVFNVLGETIDLD

SEQ ID NO: 1799102 - protein, 21 aa, Staphylococcus epidermidis
DYIVNSYPVWFPKEEAEEIIK

SEQ ID NO: 1799103 - protein, 21 aa, Staphylococcus epidermidis
DYPLSREKLSPVLAMVTAKST

SEQ ID NO: 1799104 - protein, 17 aa, Staphylococcus epidermidis
EAFVCYIAMTRSQQSVT

SEQ ID NO: 1799105 - protein, 27 aa, Staphylococcus epidermidis
EALESNILCPFHYFGVTDYIQNEMSQE

SEQ ID NO: 1799106 - protein, 31 aa, Staphylococcus epidermidis
EAMVRMAQDFSYRYPLVDGQGNFGSMDGDGA

SEQ ID NO: 1799107 - protein, 30 aa, Staphylococcus epidermidis
EDGMPGLTICGGYQFLGHKYITPDGTELEG

SEQ ID NO: 1799108 - protein, 17 aa, Staphylococcus epidermidis
EDIAVGIQRKLGVIQAL

SEQ ID NO: 1799109 - protein, 17 aa, Staphylococcus epidermidis
EDIRHFYTNDVRFLDQF

SEQ ID NO: 1799110 - protein, 19 aa, Staphylococcus epidermidis
EDLTQVAFYERGELVDAES

SEQ ID NO: 1799111 - protein, 19 aa, Staphylococcus epidermidis
EDVLGILCHVDVVPAGDGW

SEQ ID NO: 1799112 - protein, 20 aa, Staphylococcus epidermidis
EEACKAIGITDLRKMGLRDK

SEQ ID NO: 1799113 - protein, 20 aa, Staphylococcus epidermidis
EEIEDLFLGLGYEIVDGYEV

SEQ ID NO: 1799114 - protein, 18 aa, Staphylococcus epidermidis
EEIIDIFEQLGFDTENKN

SEQ ID NO: 1799115 - protein, 17 aa, Staphylococcus epidermidis
EELERKKAIDIGNAMLK

SEQ ID NO: 1799116 - protein, 34 aa, Staphylococcus epidermidis
EELSYGAKMAWRNSNRCIGRLFWGSLNVKDARDV

SEQ ID NO: 1799117 - protein, 22 aa, Staphylococcus epidermidis
EESHIYSGFVMLNSVFNGGKQV

SEQ ID NO: 1799118 - protein, 22 aa, Staphylococcus epidermidis
EGELKIGQTVKVAYFKQTEKTL

SEQ ID NO: 1799119 - protein, 20 aa, Staphylococcus epidermidis
EGKVPRVKFEKVFADHFLKL

SEQ ID NO: 1799120 - protein, 17 aa, Staphylococcus epidermidis
EGLPLPDLIIVDGGKGH

SEQ ID NO: 1799121 - protein, 20 aa, Staphylococcus epidermidis
EGYSKFKTLLQHFNLQHQKP

SEQ ID NO: 1799122 - protein, 24 aa, Staphylococcus epidermidis
EHARELKVSNALLYTDSKLIEDSM

SEQ ID NO: 1799123 - protein, 17 aa, Staphylococcus epidermidis
EHINELIHTLKIEHLLE

SEQ ID NO: 1799124 - protein, 24 aa, Staphylococcus epidermidis
EICCKDRKGYEWVIQSTKKANVGS

SEQ ID NO: 1799125 - protein, 21 aa, Staphylococcus epidermidis
EIEHLKGDYIYQERDHQDIEL

SEQ ID NO: 1799126 - protein, 22 aa, Staphylococcus epidermidis
EIGETLPDAFAIVHPMHPNFEY

SEQ ID NO: 1799127 - protein, 17 aa, Staphylococcus epidermidis
EKANYLEFVEYYIEFIT

SEQ ID NO: 1799128 - protein, 17 aa, Staphylococcus epidermidis
EKDLWYFQDEKLTVDAI

SEQ ID NO: 1799129 - protein, 25 aa, Staphylococcus epidermidis
EKDVPRQAVSMGVKSILKAKRIILL

SEQ ID NO: 1799130 - protein, 19 aa, Staphylococcus epidermidis
EKEMFGRQDAILNEFGLTR

SEQ ID NO: 1799131 - protein, 18 aa, Staphylococcus epidermidis
EKPWNSIEMTIKDLDNHL

SEQ ID NO: 1799132 - protein, 21 aa, Staphylococcus epidermidis
EKVDEMLEFVGLADKKDQFPD

SEQ ID NO: 1799133 - protein, 18 aa, Staphylococcus epidermidis
EKVKPFLNKNFKYKDGKS

SEQ ID NO: 1799134 - protein, 19 aa, Staphylococcus epidermidis
ELFPYDIPTIYTKTLRERS

SEQ ID NO: 1799135 - protein, 29 aa, Staphylococcus epidermidis
ELHEYIHGRKAPKLDGVRFSVLALGDQTY

SEQ ID NO: 1799136 - protein, 17 aa, Staphylococcus epidermidis
ENDIDGFGYKWETHEDV

SEQ ID NO: 1799137 - protein, 23 aa, Staphylococcus epidermidis
ENFKLKQHHAALRIRVKDYMFEM

SEQ ID NO: 1799138 - protein, 27 aa, Staphylococcus epidermidis
ENIDLALDCIDCVRVSTARIKNEFIAK

SEQ ID NO: 1799139 - protein, 24 aa, Staphylococcus epidermidis
ENMSLPLKWEFPGGKIENGETEKD

SEQ ID NO: 1799140 - protein, 18 aa, Staphylococcus epidermidis
EPIPRFPGVTRDIALEVN

SEQ ID NO: 1799141 - protein, 21 aa, Staphylococcus epidermidis
EPLKYRKMYGQFGGNITHTAM

SEQ ID NO: 1799142 - protein, 19 aa, Staphylococcus epidermidis
EQGTYCAYQEQYKMIPACN

SEQ ID NO: 1799143 - protein, 19 aa, Staphylococcus epidermidis
EQHMWSLSMLDSFAKEVVH

SEQ ID NO: 1799144 - protein, 25 aa, Staphylococcus epidermidis
EQPDYIKTLTFNSAVHILKSELPTL

SEQ ID NO: 1799145 - protein, 17 aa, Staphylococcus epidermidis
EQWKVSRTTIYRYLNKL

SEQ ID NO: 1799146 - protein, 21 aa, Staphylococcus epidermidis
ERHPAMVAIQSWAQWFTDHGI

SEQ ID NO: 1799147 - protein, 22 aa, Staphylococcus epidermidis
ERLSGRELLDVFEYHVRRAFDH

SEQ ID NO: 1799148 - protein, 22 aa, Staphylococcus epidermidis
ESGCGKSTTGKAIIKLNDITDG

SEQ ID NO: 1799149 - protein, 19 aa, Staphylococcus epidermidis
ESITEGTIAEWLKNVGDNV

SEQ ID NO: 1799150 - protein, 19 aa, Staphylococcus epidermidis
ESKVGYSTRKICKDLLDLI

SEQ ID NO: 1799151 - protein, 25 aa, Staphylococcus epidermidis
ESLRLIKGGFTFAILTKDALYGAVD

SEQ ID NO: 1799152 - protein, 23 aa, Staphylococcus epidermidis
ETKGAYEILKWAYQTYENDIVYS

SEQ ID NO: 1799153 - protein, 19 aa, Staphylococcus epidermidis
ETLAQYSGVPVWNGLTDED

SEQ ID NO: 1799154 - protein, 32 aa, Staphylococcus epidermidis
ETLHPMGGLQERVWNPLQIMNDFGIDVFSPST

SEQ ID NO: 1799155 - protein, 26 aa, Staphylococcus epidermidis
ETRKRKRAYEMLPVVMEYKAKEVALQ

SEQ ID NO: 1799156 - protein, 27 aa, Staphylococcus epidermidis
ETRPKRIKLKWSTSLIKDLETIRLLNF

SEQ ID NO: 1799157 - protein, 30 aa, Staphylococcus epidermidis
ETTLLTLRLAELFRASTIPAGLIQIVPGTG

SEQ ID NO: 1799158 - protein, 24 aa, Staphylococcus epidermidis
ETVCYLWLRFEHDESFNDFKLTDY

SEQ ID NO: 1799159 - protein, 21 aa, Staphylococcus epidermidis
ETYPQLGRLIGFIPKEKVVDV

SEQ ID NO: 1799160 - protein, 22 aa, Staphylococcus epidermidis
EVANFRKQHLGFIFQDYSVLPT

SEQ ID NO: 1799161 - protein, 35 aa, Staphylococcus epidermidis
EVCGSPMVIKMGRYGKFMACSNFPDCRNTKAIVKT

SEQ ID NO: 1799162 - protein, 17 aa, Staphylococcus epidermidis
EVIKFKTKGFILDEQKI

SEQ ID NO: 1799163 - protein, 23 aa, Staphylococcus epidermidis
EVLCNLSRRLPRIYYYDNNEEVT

SEQ ID NO: 1799164 - protein, 26 aa, Staphylococcus epidermidis
EVYKPYIEGFVKMLSPIAPHIGEELW

SEQ ID NO: 1799165 - protein, 19 aa, Staphylococcus epidermidis
EVYPNIIIFVDNCYGEFVE

SEQ ID NO: 1799166 - protein, 18 aa, Staphylococcus epidermidis
EYIMTFILHDYKKMKTSY

SEQ ID NO: 1799167 - protein, 23 aa, Staphylococcus epidermidis
EYKDQRFIILGFPCNQFGGQEPG

SEQ ID NO: 1799168 - protein, 26 aa, Staphylococcus epidermidis
FDKYQCPHCKSEVILKQGMTLIAHFA

SEQ ID NO: 1799169 - protein, 20 aa, Staphylococcus epidermidis
FDLSFDRKFEAFLVPTVIGE

SEQ ID NO: 1799170 - protein, 17 aa, Staphylococcus epidermidis
FDMDVLYTGPHRKEEKE

SEQ ID NO: 1799171 - protein, 19 aa, Staphylococcus epidermidis
FDMEPLILTLRPNASYKNF

SEQ ID NO: 1799172 - protein, 17 aa, Staphylococcus epidermidis
FDMFKFKNERLKAKMKE

SEQ ID NO: 1799173 - protein, 24 aa, Staphylococcus epidermidis
FDRIDVEGPFYFKNLSKEDDFERV

SEQ ID NO: 1799174 - protein, 18 aa, Staphylococcus epidermidis
FDRNRFETIFKELIDKNI

SEQ ID NO: 1799175 - protein, 28 aa, Staphylococcus epidermidis
FDYGILKRPQFFFAYDIDKYDKGLRGFY

SEQ ID NO: 1799176 - protein, 25 aa, Staphylococcus epidermidis
FECGKAEDVILTWKSQGIKPGVVMV

SEQ ID NO: 1799177 - protein, 18 aa, Staphylococcus epidermidis
FEDVRIVRDMRNSVNRLV

SEQ ID NO: 1799178 - protein, 17 aa, Staphylococcus epidermidis
FEERLKAVLKEVKESEG

SEQ ID NO: 1799179 - protein, 17 aa, Staphylococcus epidermidis
FEEVAFEHYLECLTMKK

SEQ ID NO: 1799180 - protein, 23 aa, Staphylococcus epidermidis
FESRIQAWSYPFVIKPGDDLPTA

SEQ ID NO: 1799181 - protein, 24 aa, Staphylococcus epidermidis
FFDHQLLRRLVSFMYEKPSTLIDY

SEQ ID NO: 1799182 - protein, 17 aa, Staphylococcus epidermidis
FGGFKSYRLLKPTEGST

SEQ ID NO: 1799183 - protein, 18 aa, Staphylococcus epidermidis
FHTKDIPGSHVVILNESP

SEQ ID NO: 1799184 - protein, 20 aa, Staphylococcus epidermidis
FIEAAKIPVIHTLPAKTILP

SEQ ID NO: 1799185 - protein, 23 aa, Staphylococcus epidermidis
FKAIFKNQHVIGISELIEDFDVE

SEQ ID NO: 1799186 - protein, 19 aa, Staphylococcus epidermidis
FKDEHLPTFDDVVKIANEY

SEQ ID NO: 1799187 - protein, 17 aa, Staphylococcus epidermidis
FKEASKQLAQWVQENKI

SEQ ID NO: 1799188 - protein, 17 aa, Staphylococcus epidermidis
FKGNNAITFLLQNIQPH

SEQ ID NO: 1799189 - protein, 19 aa, Staphylococcus epidermidis
FKHTVMMGVGGSFEVFSGS

SEQ ID NO: 1799190 - protein, 17 aa, Staphylococcus epidermidis
FKLKPDCHCTSKYLNNL

SEQ ID NO: 1799191 - protein, 21 aa, Staphylococcus epidermidis
FKLVATELLWFIKGDTNIQYL

SEQ ID NO: 1799192 - protein, 19 aa, Staphylococcus epidermidis
FKNHDILVVAGFQGINEDF

SEQ ID NO: 1799193 - protein, 21 aa, Staphylococcus epidermidis
FKSNLKEIYGMISQYDYVLIA

SEQ ID NO: 1799194 - protein, 22 aa, Staphylococcus epidermidis
FLFSQGRLEEARTYILNQSYEI

SEQ ID NO: 1799195 - protein, 24 aa, Staphylococcus epidermidis
FLHRYDLYESHYWSVFDEIQGVGH

SEQ ID NO: 1799196 - protein, 18 aa, Staphylococcus epidermidis
FLNLLRKIEIPLIAFDEA

SEQ ID NO: 1799197 - protein, 24 aa, Staphylococcus epidermidis
FMNKYPGIILFTSHDTRFVKHVSD

SEQ ID NO: 1799198 - protein, 17 aa, Staphylococcus epidermidis
FMRDGRIILKESKEVLL

SEQ ID NO: 1799199 - protein, 22 aa, Staphylococcus epidermidis
FNAGTFLRNIVVTFEHAQLKGG

SEQ ID NO: 1799200 - protein, 25 aa, Staphylococcus epidermidis
FNELKTRLSKFLPKEVTQYNVELVD

SEQ ID NO: 1799201 - protein, 17 aa, Staphylococcus epidermidis
FNLDEYVGLKASHQQSY

SEQ ID NO: 1799202 - protein, 30 aa, Staphylococcus epidermidis
FNQGEVCSAGSRLLVQSSIYDELLPKLKEA

SEQ ID NO: 1799203 - protein, 22 aa, Staphylococcus epidermidis
FNQRLNSELQRRLKQKEDEKAE

SEQ ID NO: 1799204 - protein, 20 aa, Staphylococcus epidermidis
FNSIEIDTGSILYDITENKI

SEQ ID NO: 1799205 - protein, 27 aa, Staphylococcus epidermidis
FPNQINNVLAFPGIFRGALDVEATHIN

SEQ ID NO: 1799206 - protein, 18 aa, Staphylococcus epidermidis
FPVVYASAVNGTASLDSE

SEQ ID NO: 1799207 - protein, 18 aa, Staphylococcus epidermidis
FPYTIRIVSEVLESNGSS

SEQ ID NO: 1799208 - protein, 21 aa, Staphylococcus epidermidis
FQERLWGGTNLTQFGYDIPNN

SEQ ID NO: 1799209 - protein, 20 aa, Staphylococcus epidermidis
FQLSNNEAWECEALEEAAEN

SEQ ID NO: 1799210 - protein, 19 aa, Staphylococcus epidermidis
FREDWRTLLDYCNAKIVNT

SEQ ID NO: 1799211 - protein, 17 aa, Staphylococcus epidermidis
FSKFLWSYVNHQPINMG

SEQ ID NO: 1799212 - protein, 21 aa, Staphylococcus epidermidis
FTAGWCPDCKVIEPDLPKLEK

SEQ ID NO: 1799213 - protein, 17 aa, Staphylococcus epidermidis
FTESFDFSQFDINVTTP

SEQ ID NO: 1799214 - protein, 17 aa, Staphylococcus epidermidis
FTGHIIRRGSADADASI

SEQ ID NO: 1799215 - protein, 22 aa, Staphylococcus epidermidis
FVHSKGGIYIWLHTPPGYDSEA

SEQ ID NO: 1799216 - protein, 20 aa, Staphylococcus epidermidis
FVKDLFEKVIRHVGEDYLTV

SEQ ID NO: 1799217 - protein, 18 aa, Staphylococcus epidermidis
FVYKVAAMDFIFKDDPSE

SEQ ID NO: 1799218 - protein, 18 aa, Staphylococcus epidermidis
FYKEGKMAYYFIKDDEIR

SEQ ID NO: 1799219 - protein, 20 aa, Staphylococcus epidermidis
FYMKHQFRTIATMGIGGGIG

SEQ ID NO: 1799220 - protein, 21 aa, Staphylococcus epidermidis
FYRRLKTPNNGREFHLSRVIK

SEQ ID NO: 1799221 - protein, 17 aa, Staphylococcus epidermidis
FYSSGVIEVLRRWVEND

SEQ ID NO: 1799222 - protein, 17 aa, Staphylococcus epidermidis
FYVDRETESWIDEKEGR

SEQ ID NO: 1799223 - protein, 17 aa, Staphylococcus epidermidis
GAIKLAIEKLIKPELSH

SEQ ID NO: 1799224 - protein, 24 aa, Staphylococcus epidermidis
GDAKSIRKFNQWEIDYVSCSPFRV

SEQ ID NO: 1799225 - protein, 18 aa, Staphylococcus epidermidis
GDFIFVGDIGRPDLLEKA

SEQ ID NO: 1799226 - protein, 18 aa, Staphylococcus epidermidis
GDKVHLESDVLFKYVENI

SEQ ID NO: 1799227 - protein, 22 aa, Staphylococcus epidermidis
GDNLFRHSLTLERVQKIVELAK

SEQ ID NO: 1799228 - protein, 21 aa, Staphylococcus epidermidis
GDYNPFGIGDYDFIRPEHVNW

SEQ ID NO: 1799229 - protein, 22 aa, Staphylococcus epidermidis
GDYPKWKMYIQVMTEEQAKNHP

SEQ ID NO: 1799230 - protein, 17 aa, Staphylococcus epidermidis
GEEESHIYSGFVMLNSV

SEQ ID NO: 1799231 - protein, 21 aa, Staphylococcus epidermidis
GEFEMGIDIDTLVKFNLKKDQ

SEQ ID NO: 1799232 - protein, 18 aa, Staphylococcus epidermidis
GEILNLASGVYFANAYEV

SEQ ID NO: 1799233 - protein, 24 aa, Staphylococcus epidermidis
GEKAKYKLANVISNYSPILLLDEP

SEQ ID NO: 1799234 - protein, 17 aa, Staphylococcus epidermidis
GEKFKDEHLPTFDDVVK

SEQ ID NO: 1799235 - protein, 22 aa, Staphylococcus epidermidis
GELKPIKAYNMRKSRQRKDDHL

SEQ ID NO: 1799236 - protein, 22 aa, Staphylococcus epidermidis
GEQKRLYLLRLLVHKPNVLLLD

SEQ ID NO: 1799237 - protein, 17 aa, Staphylococcus epidermidis
GETFKTKSLHITEEEII

SEQ ID NO: 1799238 - protein, 27 aa, Staphylococcus epidermidis
GFGEEVKRRIFLGTFALSSGYYDAYYK

SEQ ID NO: 1799239 - protein, 24 aa, Staphylococcus epidermidis
GFGRIGRLAFRRIQDVEGLEVVAV

SEQ ID NO: 1799240 - protein, 18 aa, Staphylococcus epidermidis
GFGRRKMDLTPNEIYNLV

SEQ ID NO: 1799241 - protein, 19 aa, Staphylococcus epidermidis
GFVSEFKGDNLVIINRDAT

SEQ ID NO: 1799242 - protein, 24 aa, Staphylococcus epidermidis
GGERTKLSLAVLFSTKANMLILDE

SEQ ID NO: 1799243 - protein, 25 aa, Staphylococcus epidermidis
GGKGLLCVYEGFLKGLKGEKIEAQA

SEQ ID NO: 1799244 - protein, 36 aa, Staphylococcus epidermidis; identical to SEQ ID NO: 1646230

SEQ ID NO: 1799245 - protein, 20 aa, Staphylococcus epidermidis
GHDMGGIIASEFTEKYQYKV

SEQ ID NO: 1799246 - protein, 36 aa, Staphylococcus epidermidis
GHMTNELLQRFKFDKAFISCGSFDTSDCYEFDLEEA

SEQ ID NO: 1799247 - protein, 19 aa, Staphylococcus epidermidis
GHRELPIRADFVGKNIPTA

SEQ ID NO: 1799248 - protein, 17 aa, Staphylococcus epidermidis
GIAELFKSMGATHIISG

SEQ ID NO: 1799249 - protein, 21 aa, Staphylococcus epidermidis
GIEAAEAFAKAGIDTTIVDVA

SEQ ID NO: 1799250 - protein, 26 aa, Staphylococcus epidermidis
GIEGSSFKEAITRKKEVVQALNNKNY

SEQ ID NO: 1799251 - protein, 23 aa, Staphylococcus epidermidis
GINLRYPEGFKFEDAIDRFRSEI

SEQ ID NO: 1799252 - protein, 22 aa, Staphylococcus epidermidis
GIRHFGENRLDGFKEKKESLPS

SEQ ID NO: 1799253 - protein, 17 aa, Staphylococcus epidermidis
GKEVIMLEKFAAIGGNT

SEQ ID NO: 1799254 - protein, 22 aa, Staphylococcus epidermidis
GKPYAGFVYDVMKDVLYHAKVG

SEQ ID NO: 1799255 - protein, 18 aa, Staphylococcus epidermidis
GKQLLAYLGAPKHLYEKV

SEQ ID NO: 1799256 - protein, 18 aa, Staphylococcus epidermidis
GKTFSKGLLMGARGNSGV

SEQ ID NO: 1799257 - protein, 26 aa, Staphylococcus epidermidis
GKVATRRAKTLLAYTKHIHVVSPTIT

SEQ ID NO: 1799258 - protein, 19 aa, Staphylococcus epidermidis
GKWFFDRYSPVTNIKAVGH

SEQ ID NO: 1799259 - protein, 18 aa, Staphylococcus epidermidis
GLAQNFSACRALVSEGIQ

SEQ ID NO: 1799260 - protein, 19 aa, Staphylococcus epidermidis
GLGVEGLKILKNVKDKYNL

SEQ ID NO: 1799261 - protein, 24 aa, Staphylococcus epidermidis
GLLGLECARGLLDQGMEVTVLHLA

SEQ ID NO: 1799262 - protein, 20 aa, Staphylococcus epidermidis
GLMVNYCLQAADILANDGID

SEQ ID NO: 1799263 - protein, 18 aa, Staphylococcus epidermidis
GLTPKEWEYHITTMGKVE

SEQ ID NO: 1799264 - protein, 19 aa, Staphylococcus epidermidis
GMHTLSISFKLWVEEGKYG

SEQ ID NO: 1799265 - protein, 18 aa, Staphylococcus epidermidis
GNIVEICQTLGLQSAQSI

SEQ ID NO: 1799266 - protein, 21 aa, Staphylococcus epidermidis
GNLDPALIPFIMEKTGKTADE

SEQ ID NO: 1799267 - protein, 20 aa, Staphylococcus epidermidis
GNLDPSVLLAPWDVIESRLK

SEQ ID NO: 1799268 - protein, 25 aa, Staphylococcus epidermidis
GNLEKLKIAVHYGADAVFLGGQEYG

SEQ ID NO: 1799269 - protein, 18 aa, Staphylococcus epidermidis
GNNAITFLLQNIQPHQNL

SEQ ID NO: 1799270 - protein, 19 aa, Staphylococcus epidermidis
GNQFLGFQIQQQGRTVQQQ

SEQ ID NO: 1799271 - protein, 29 aa, Staphylococcus epidermidis
GNRICGVGVPGELCIGGAGLAKGYLNQPK

SEQ ID NO: 1799272 - protein, 27 aa, Staphylococcus epidermidis
GNSGVILSQLFRGFCKNIEEEKEISVQ

SEQ ID NO: 1799273 - protein, 19 aa, Staphylococcus epidermidis
GNYEYCFFESEGKGQFKPV

SEQ ID NO: 1799274 - protein, 21 aa, Staphylococcus epidermidis
GNYTLGVKEQLIFPEIDYDKV

SEQ ID NO: 1799275 - protein, 17 aa, Staphylococcus epidermidis
GPGQVFKDLIDSEIIPR

SEQ ID NO: 1799276 - protein, 26 aa, Staphylococcus epidermidis
GPPKDRRAGVITFNLADIHPHDVATA

SEQ ID NO: 1799277 - protein, 17 aa, Staphylococcus epidermidis
GPSDSNYLFDEFIAMMK

SEQ ID NO: 1799278 - protein, 20 aa, Staphylococcus epidermidis
GQKRRLSVATALSSKAEIIL

SEQ ID NO: 1799279 - protein, 23 aa, Staphylococcus epidermidis
GQPVECAGTYVLLASDDASYITG

SEQ ID NO: 1799280 - protein, 25 aa, Staphylococcus epidermidis
GQSFDWKLLKKIKGVDFLIAGGLDF

SEQ ID NO: 1799281 - protein, 17 aa, Staphylococcus epidermidis
GRDIGTVVLPDAELKVY

SEQ ID NO: 1799282 - protein, 17 aa, Staphylococcus epidermidis
GRPYFSFNSKLSAQKVG

SEQ ID NO: 1799283 - protein, 25 aa, Staphylococcus epidermidis
GRQPEFREAGLFHVAYLLPTRSDLA

SEQ ID NO: 1799284 - protein, 29 aa, Staphylococcus epidermidis
GSGKSVCINSILMSLLYKNHPEELRLLLI

SEQ ID NO: 1799285 - protein, 28 aa, Staphylococcus epidermidis
GTAGIRGKFGLGEGRLNKFTVSKVALGF

SEQ ID NO: 1799286 - protein, 26 aa, Staphylococcus epidermidis
GTDAQPGWWREIIDGGYIPVHDYQFL

SEQ ID NO: 1799287 - protein, 26 aa, Staphylococcus epidermidis
GTEPKIKLYVSLSCDHFDVVAQKMND

SEQ ID NO: 1799288 - protein, 18 aa, Staphylococcus epidermidis
GTGCTFSAVITAELAKGR

SEQ ID NO: 1799289 - protein, 17 aa, Staphylococcus epidermidis
GTICFDGCSIDSSIKQR

SEQ ID NO: 1799290 - protein, 25 aa, Staphylococcus epidermidis
GTKKRIRYYSCSNFRNKGSKVCSAN

SEQ ID NO: 1799291 - protein, 17 aa, Staphylococcus epidermidis
GTLNIWYITTIQRLIDL

SEQ ID NO: 1799292 - protein, 17 aa, Staphylococcus epidermidis
GTYDAIVGINLLREGID

SEQ ID NO: 1799293 - protein, 27 aa, Staphylococcus epidermidis
GVGFRFYTQRIAHQFNIKGTVQNVEDY

SEQ ID NO: 1799294 - protein, 24 aa, Staphylococcus epidermidis
GVIDRVDHRYVYVNLGRIEAVLSE

SEQ ID NO: 1799295 - protein, 23 aa, Staphylococcus epidermidis
GVNWSTRLWQDMAVVQKEVERTT

SEQ ID NO: 1799296 - protein, 23 aa, Staphylococcus epidermidis
GVQKRSRNILDFSDYEHFALRIL

SEQ ID NO: 1799297 - protein, 26 aa, Staphylococcus epidermidis
GVQTFKPELLKILGRTHKTEDIYDAV

SEQ ID NO: 1799298 - protein, 20 aa, Staphylococcus epidermidis
GWDEYPICMAKTQYSFSDDQ

SEQ ID NO: 1799299 - protein, 21 aa, Staphylococcus epidermidis
GWRYMLEKCEQLLSESKKHIL

SEQ ID NO: 1799300 - protein, 17 aa, Staphylococcus epidermidis
GYLKIKVNGGGCTGLTY

SEQ ID NO: 1799301 - protein, 18 aa, Staphylococcus epidermidis
GYVGHPLLVKFGHHQTIF

SEQ ID NO: 1799302 - protein, 20 aa, Staphylococcus epidermidis
HDPVAASFSNRVVMLKDGQI

SEQ ID NO: 1799303 - protein, 24 aa, Staphylococcus epidermidis
HEQRRLEFLAGRFTVKEAFSKALG

SEQ ID NO: 1799304 - protein, 20 aa, Staphylococcus epidermidis
HFDKEINFYNILRHASSTYA

SEQ ID NO: 1799305 - protein, 23 aa, Staphylococcus epidermidis
HFKQGVKGICFRTKDINQVKSTL

SEQ ID NO: 1799306 - protein, 19 aa, Staphylococcus epidermidis
HFRALGGEVEAFFPSKVPL

SEQ ID NO: 1799307 - protein, 20 aa, Staphylococcus epidermidis
HGAGSPCGKSLGAIPTSTLG

SEQ ID NO: 1799308 - protein, 20 aa, Staphylococcus epidermidis
HGFHHYSRFIQLFKNTYGYT

SEQ ID NO: 1799309 - protein, 19 aa, Staphylococcus epidermidis
HGGCTFCSAAGSGDFAGNR

SEQ ID NO: 1799310 - protein, 32 aa, Staphylococcus epidermidis
HGNSKNHWYEWLRHNLTLEGYDVSLFNLEAND

SEQ ID NO: 1799311 - protein, 18 aa, Staphylococcus epidermidis
HKQRIPFTRVPFNDHDSI

SEQ ID NO: 1799312 - protein, 18 aa, Staphylococcus epidermidis
HLHQYPELSLHEFETTSY

SEQ ID NO: 1799313 - protein, 26 aa, Staphylococcus epidermidis
HLIPETRRSTILSSKKVGDKVHLESD

SEQ ID NO: 1799314 - protein, 20 aa, Staphylococcus epidermidis
HLQLKGIHFHIGSQIEGTEA

SEQ ID NO: 1799315 - protein, 20 aa, Staphylococcus epidermidis
HNFASGLSYHVLTMLRIAKS

SEQ ID NO: 1799316 - protein, 17 aa, Staphylococcus epidermidis
HPGKTIAIRADFDALPI

SEQ ID NO: 1799317 - protein, 25 aa, Staphylococcus epidermidis
HQGEYDLLMVMSHVGIFFDEKLCQE

SEQ ID NO: 1799318 - protein, 21 aa, Staphylococcus epidermidis
HQHLPGWGLDALKFLIEERGV

SEQ ID NO: 1799319 - protein, 18 aa, Staphylococcus epidermidis
HTIIKLRIKDELTIYDRL

SEQ ID NO: 1799320 - protein, 24 aa, Staphylococcus epidermidis
HTLRMLELPSAWTDYLNTTSNDAS

SEQ ID NO: 1799321 - protein, 26 aa, Staphylococcus epidermidis
HWLGYCTNELVQLCPQDKYFEFGIKN

SEQ ID NO: 1799322 - protein, 18 aa, Staphylococcus epidermidis
IALDQYWNLSFLPEEINT

SEQ ID NO: 1799323 - protein, 29 aa, Staphylococcus epidermidis
IAMYFKNPKRILGSFFIKHHGYRVRIDDI

SEQ ID NO: 1799324 - protein, 17 aa, Staphylococcus epidermidis
IAPEVLSVIASIATSEV

SEQ ID NO: 1799325 - protein, 17 aa, Staphylococcus epidermidis
IASHSIVYYGMKKFAHD

SEQ ID NO: 1799326 - protein, 23 aa, Staphylococcus epidermidis
IDLTRTWEILGEIIGESASDELI

SEQ ID NO: 1799327 - protein, 23 aa, Staphylococcus epidermidis
IDNFRWAGVPFYIRTGKRMKSKT

SEQ ID NO: 1799328 - protein, 24 aa, Staphylococcus epidermidis
IDTFPNHRLLSLKVFVDTKDAMGA

SEQ ID NO: 1799329 - protein, 18 aa, Staphylococcus epidermidis
IDTGSILYDITENKIKSI

SEQ ID NO: 1799330 - protein, 24 aa, Staphylococcus epidermidis
IEHNLSIMCEADWIIDVGPGPGLD

SEQ ID NO: 1799331 - protein, 18 aa, Staphylococcus epidermidis
IEISELGLGCMSLGTDYK

SEQ ID NO: 1799332 - protein, 19 aa, Staphylococcus epidermidis
IEKARRLAFQTEDMKRQSK

SEQ ID NO: 1799333 - protein, 17 aa, Staphylococcus epidermidis
IEPLKHIIDIPKRVFEA

SEQ ID NO: 1799334 - protein, 18 aa, Staphylococcus epidermidis
IEQCAGLTPKEWEYHITT

SEQ ID NO: 1799335 - protein, 18 aa, Staphylococcus epidermidis
IERREYNHFGQLHRKIYF

SEQ ID NO: 1799336 - protein, 17 aa, Staphylococcus epidermidis
IFAESLGGTETFITFPY

SEQ ID NO: 1799337 - protein, 30 aa, Staphylococcus epidermidis
IFHRHVPILGVCLGFQLIIEYFGGNIIHND

SEQ ID NO: 1799338 - protein, 24 aa, Staphylococcus epidermidis
IFNYFKPNFLLGMTATPERTDELN

SEQ ID NO: 1799339 - protein, 20 aa, Staphylococcus epidermidis
IFRNCKGRIIFATFASNIYR

SEQ ID NO: 1799340 - protein, 19 aa, Staphylococcus epidermidis
IGALKDGRFDKVQNDIEAV

SEQ ID NO: 1799341 - protein, 21 aa, Staphylococcus epidermidis
IGANYAGVRGFTASAGPGLSL

SEQ ID NO: 1799342 - protein, 24 aa, Staphylococcus epidermidis
IGDTCPICGNEIHSLGEHIDFESI

SEQ ID NO: 1799343 - protein, 29 aa, Staphylococcus epidermidis
IGLYKAVILQAAFELGERINSTSTFDKVQ

SEQ ID NO: 1799344 - protein, 22 aa, Staphylococcus epidermidis
IGNARPAINYDVVRRYFEYKGY

SEQ ID NO: 1799345 - protein, 17 aa, Staphylococcus epidermidis
IGSEIVKRIEIDSRKEF

SEQ ID NO: 1799346 - protein, 19 aa, Staphylococcus epidermidis
IHDIRKGKVSIVIAGMEGA

SEQ ID NO: 1799347 - protein, 26 aa, Staphylococcus epidermidis
IHDKPVIGICLGMQLLFQHSAEGDVS

SEQ ID NO: 1799348 - protein, 22 aa, Staphylococcus epidermidis
IHHSPEIFVEFDASSKGLEILL

SEQ ID NO: 1799349 - protein, 19 aa, Staphylococcus epidermidis
IIAEVKDYVFINSYDSRLY

SEQ ID NO: 1799350 - protein, 25 aa, Staphylococcus epidermidis
IIDIPKRVFEALDIVPNTEPIRGGT

SEQ ID NO: 1799351 - protein, 23 aa, Staphylococcus epidermidis
IIGKDARYRRNILGRKLHIGHSN

SEQ ID NO: 1799352 - protein, 22 aa, Staphylococcus epidermidis
IIHCPQCGAPMAASNTTNTLKD

SEQ ID NO: 1799353 - protein, 21 aa, Staphylococcus epidermidis
IIHPREVFNIAIRESSNSIIV

SEQ ID NO: 1799354 - protein, 30 aa, Staphylococcus epidermidis
IIHTVEKFLMYKDFDEIIIATPQKWINYML

SEQ ID NO: 1799355 - protein, 24 aa, Staphylococcus epidermidis
IIRQGLKQMIPWKEYHFTTIYTAT

SEQ ID NO: 1799356 - protein, 19 aa, Staphylococcus epidermidis
IITDMGFEDYFLIVSDLIH

SEQ ID NO: 1799357 - protein, 21 aa, Staphylococcus epidermidis
IKDASAGSWFGEKFKDEHLPT

SEQ ID NO: 1799358 - protein, 23 aa, Staphylococcus epidermidis
IKDLRRLGLRVYFNINNALVSLG

SEQ ID NO: 1799359 - protein, 18 aa, Staphylococcus epidermidis
IKDYSKALLGLVIPLYSK

SEQ ID NO: 1799360 - protein, 20 aa, Staphylococcus epidermidis
IKFAQANGITVVIATGRAFY

SEQ ID NO: 1799361 - protein, 19 aa, Staphylococcus epidermidis
IKGGGGALFREKVIDEMAD

SEQ ID NO: 1799362 - protein, 28 aa, Staphylococcus epidermidis
IKGLGKDRVTAIFPKLVFSIKKGVNFSP

SEQ ID NO: 1799363 - protein, 23 aa, Staphylococcus epidermidis
IKHLARLYKRVGIKHITVQLYKH

SEQ ID NO: 1799364 - protein, 17 aa, Staphylococcus epidermidis
IKLGQNAAFIFAVCEYL

SEQ ID NO: 1799365 - protein, 17 aa, Staphylococcus epidermidis
IKLNASIYVSGESDDTL

SEQ ID NO: 1799366 - protein, 21 aa, Staphylococcus epidermidis
IKRALDIVKDVPLFDRTKQDI

SEQ ID NO: 1799367 - protein, 21 aa, Staphylococcus epidermidis
IKSIRPIARLGYYDYTVVDEI

SEQ ID NO: 1799368 - protein, 17 aa, Staphylococcus epidermidis
IKSKLLLPQTSIEEDIE

SEQ ID NO: 1799369 - protein, 26 aa, Staphylococcus epidermidis
IKTLHSKGVFRLKVTLNKEGELNYEL

SEQ ID NO: 1799370 - protein, 17 aa, Staphylococcus epidermidis
IKVASISPELFFQKGDY

SEQ ID NO: 1799371 - protein, 26 aa, Staphylococcus epidermidis
ILDIEIPGLTGLEILSYVRKKQLNTR

SEQ ID NO: 1799372 - protein, 19 aa, Staphylococcus epidermidis
ILEEREAEQLFKLVDSNRD

SEQ ID NO: 1799373 - protein, 22 aa, Staphylococcus epidermidis
ILIDMTKLLAPILVHTAEEVWS

SEQ ID NO: 1799374 - protein, 17 aa, Staphylococcus epidermidis
ILKDVFNQGLIVSSKKK

SEQ ID NO: 1799375 - protein, 19 aa, Staphylococcus epidermidis
ILTEPKLSLVKQYEALLQT

SEQ ID NO: 1799376 - protein, 17 aa, Staphylococcus epidermidis
IMESLEAPAHLFTTGAN

SEQ ID NO: 1799377 - protein, 25 aa, Staphylococcus epidermidis
IMGIANKRSIAFGVAKVLDRLGAKL

SEQ ID NO: 1799378 - protein, 17 aa, Staphylococcus epidermidis
IMQPFKVYPNGFPEELV

SEQ ID NO: 1799379 - protein, 23 aa, Staphylococcus epidermidis
INAHPEFGHKVAKYISQNTGYAF

SEQ ID NO: 1799380 - protein, 19 aa, Staphylococcus epidermidis
INARLIIIDEMSMVDTWLF

SEQ ID NO: 1799381 - protein, 18 aa, Staphylococcus epidermidis
INETSFDITCDYFSKDII

SEQ ID NO: 1799382 - protein, 17 aa, Staphylococcus epidermidis
INFKAIVRFDSLVELDY

SEQ ID NO: 1799383 - protein, 21 aa, Staphylococcus epidermidis
INKGYKVAICEQMEDPKQTKG

SEQ ID NO: 1799384 - protein, 25 aa, Staphylococcus epidermidis
INKRANHVIKCFLQVNVSGEESKHG

SEQ ID NO: 1799385 - protein, 17 aa, Staphylococcus epidermidis
INLASVSGFEPTKTNAV

SEQ ID NO: 1799386 - protein, 22 aa, Staphylococcus epidermidis
INRILELTMTYGARMAEPGEYT

SEQ ID NO: 1799387 - protein, 27 aa, Staphylococcus epidermidis
INRLVHLKQRYNAILIIDASHSLGLNL

SEQ ID NO: 1799388 - protein, 27 aa, Staphylococcus epidermidis
INTGVGFLDHMLTLFTFHSGLTLSIEA

SEQ ID NO: 1799389 - protein, 19 aa, Staphylococcus epidermidis
IPAIYSKYFLDISNYREVN

SEQ ID NO: 1799390 - protein, 22 aa, Staphylococcus epidermidis
IPGTQKRGPLFKGLPTVEKHRF

SEQ ID NO: 1799391 - protein, 25 aa, Staphylococcus epidermidis
IPHNKIWLDPGIGFAKTREEENEVM

SEQ ID NO: 1799392 - protein, 21 aa, Staphylococcus epidermidis
IPPKLGVSSFVGYLKGKSSLM

SEQ ID NO: 1799393 - protein, 28 aa, Staphylococcus epidermidis
IPQEMPSRIPIGLPISGTTVYVMQGNRI

SEQ ID NO: 1799394 - protein, 24 aa, Staphylococcus epidermidis
IQVISLRANHYFNPRKTHNKQGEP

SEQ ID NO: 1799395 - protein, 19 aa, Staphylococcus epidermidis
IQVNTRMVLEKGLTIIGSS

SEQ ID NO: 1799396 - protein, 20 aa, Staphylococcus epidermidis
IREVNYLTGEVIREREHFTI

SEQ ID NO: 1799397 - protein, 27 aa, Staphylococcus epidermidis
IRHLLEFKTRQSIDISRVEPASEIVKR

SEQ ID NO: 1799398 - protein, 29 aa, Staphylococcus epidermidis
ISAHKFGGPKGVGLLLVKEHTPIAYNQLG

SEQ ID NO: 1799399 - protein, 17 aa, Staphylococcus epidermidis
ITGCRSLDELPENARNY

SEQ ID NO: 1799400 - protein, 24 aa, Staphylococcus epidermidis
ITKKEFINFPVLFDDEGKFRNKQI

SEQ ID NO: 1799401 - protein, 24 aa, Staphylococcus epidermidis
ITLDHIKHFIAIYTQTLVTPLIAY

SEQ ID NO: 1799402 - protein, 17 aa, Staphylococcus epidermidis
IVADFYSSGVIEVLRRW

SEQ ID NO: 1799403 - protein, 25 aa, Staphylococcus epidermidis
IVKADIGIKNGYIFKIGKAGNPDIM

SEQ ID NO: 1799404 - protein, 19 aa, Staphylococcus epidermidis
IVLARRRLVKFDKKINIPY

SEQ ID NO: 1799405 - protein, 32 aa, Staphylococcus epidermidis
IVLFLNRRGYASFMLCRDCGYVPQCPHCDISL

SEQ ID NO: 1799406 - protein, 25 aa, Staphylococcus epidermidis
IWSNKELIGVIGLHYLDLVNKTTSI

SEQ ID NO: 1799407 - protein, 23 aa, Staphylococcus epidermidis
IYGEVKRSKMITVQSYDINGNAV

SEQ ID NO: 1799408 - protein, 17 aa, Staphylococcus epidermidis
IYLPVHMMNDIKEYLKW

SEQ ID NO: 1799409 - protein, 18 aa, Staphylococcus epidermidis
IYTRLEAASVGLSEAQAK

SEQ ID NO: 1799410 - protein, 17 aa, Staphylococcus epidermidis
KALGEVPIGAVIVKEDQ

SEQ ID NO: 1799411 - protein, 21 aa, Staphylococcus epidermidis
KAYFKRYALTASGVSPRPIPG

SEQ ID NO: 1799412 - protein, 22 aa, Staphylococcus epidermidis
KCTTCKKAAKFLDEHDVNYESI

SEQ ID NO: 1799413 - protein, 19 aa, Staphylococcus epidermidis
KDDVKVGFIALEQNDNKMN

SEQ ID NO: 1799414 - protein, 24 aa, Staphylococcus epidermidis
KDIISHGFKCCLNASTLTDSMLAH

SEQ ID NO: 1799415 - protein, 17 aa, Staphylococcus epidermidis
KDLYITAIEFIRENHFN

SEQ ID NO: 1799416 - protein, 18 aa, Staphylococcus epidermidis
KDNSEFFDGVDMNLVEWL

SEQ ID NO: 1799417 - protein, 22 aa, Staphylococcus epidermidis
KDPEIPIRLIGVTVGSLEQSDF

SEQ ID NO: 1799418 - protein, 20 aa, Staphylococcus epidermidis
KDTFPNIELHMYGFGKEEQH

SEQ ID NO: 1799419 - protein, 20 aa, Staphylococcus epidermidis
KDTLERVVPFWTDHISQHLL

SEQ ID NO: 1799420 - protein, 20 aa, Staphylococcus epidermidis
KDVDILICDTAGRLQNKSNL

SEQ ID NO: 1799421 - protein, 25 aa, Staphylococcus epidermidis
KDYLWTILIHRLREWELNDKTYFNR

SEQ ID NO: 1799422 - protein, 21 aa, Staphylococcus epidermidis
KEDRTIYLPNAFHPLLDKDTV

SEQ ID NO: 1799423 - protein, 21 aa, Staphylococcus epidermidis
KEIISTITVCYAWSSVKPISG

SEQ ID NO: 1799424 - protein, 19 aa, Staphylococcus epidermidis
KEITAAFAGEIFDTHKEGC

SEQ ID NO: 1799425 - protein, 21 aa, Staphylococcus epidermidis
KEKAQELIQGLVMTNSIVQGG

SEQ ID NO: 1799426 - protein, 17 aa, Staphylococcus epidermidis
KENGYRSLHIVVSIPVF

SEQ ID NO: 1799427 - protein, 24 aa, Staphylococcus epidermidis
KESLPSDVKLHFIGSLQSRKVKDI

SEQ ID NO: 1799428 - protein, 19 aa, Staphylococcus epidermidis
KESVISAMMFKGNASKLGF

SEQ ID NO: 1799429 - protein, 23 aa, Staphylococcus epidermidis
KETFMTNIFGMMFLSQAAVPYLS

SEQ ID NO: 1799430 - protein, 17 aa, Staphylococcus epidermidis
KETLRYGENPQQSAYFV

SEQ ID NO: 1799431 - protein, 19 aa, Staphylococcus epidermidis
KGDDLQYTMTITFEEAVFG

SEQ ID NO: 1799432 - protein, 19 aa, Staphylococcus epidermidis
KGDEILREAGIEVEFQYNE

SEQ ID NO: 1799433 - protein, 25 aa, Staphylococcus epidermidis
KGLIHEVFKDYGILLIDAQYPELRQ

SEQ ID NO: 1799434 - protein, 21 aa, Staphylococcus epidermidis
KGPIGRYETVLAIIKDKQPTV

SEQ ID NO: 1799435 - protein, 17 aa, Staphylococcus epidermidis
KGQLDFNQQIFKDTASE

SEQ ID NO: 1799436 - protein, 18 aa, Staphylococcus epidermidis
KGSFEIEGTSLFELQARQ

SEQ ID NO: 1799437 - protein, 23 aa, Staphylococcus epidermidis
KGYIRISYAYDMETLKKGMHRLE

SEQ ID NO: 1799438 - protein, 17 aa, Staphylococcus epidermidis
KGYKGSTTFTSLKVSGC

SEQ ID NO: 1799439 - protein, 17 aa, Staphylococcus epidermidis
KHPNVITTYDLLYRAGL

SEQ ID NO: 1799440 - protein, 17 aa, Staphylococcus epidermidis
KIEIPLIAFDEAHCISK

SEQ ID NO: 1799441 - protein, 26 aa, Staphylococcus epidermidis
KIKGVDFLIAGGLDFEKIKRLEIYSF

SEQ ID NO: 1799442 - protein, 21 aa, Staphylococcus epidermidis
KIKIVGEIHGPLEYINENIDL

SEQ ID NO: 1799443 - protein, 19 aa, Staphylococcus epidermidis
KIKSKDPFEKPSIVFNYLS

SEQ ID NO: 1799444 - protein, 20 aa, Staphylococcus epidermidis
KINNVIPIYVIPAGYIDTNE

SEQ ID NO: 1799445 - protein, 25 aa, Staphylococcus epidermidis
KISIDSGKVLPIFQHATESFDRQFT

SEQ ID NO: 1799446 - protein, 18 aa, Staphylococcus epidermidis
KITAHDLLDLGIIDEVIN

SEQ ID NO: 1799447 - protein, 21 aa, Staphylococcus epidermidis
KKESVDFYLTKGVVERIAEKL

SEQ ID NO: 1799448 - protein, 22 aa, Staphylococcus epidermidis
KKFPDALFIFLAPPSLDDLKER

SEQ ID NO: 1799449 - protein, 24 aa, Staphylococcus epidermidis
KKGHQIRWRLLYIANPDYTVKPPF

SEQ ID NO: 1799450 - protein, 21 aa, Staphylococcus epidermidis
KKKYVAKLKGYLMREEIKQLE

SEQ ID NO: 1799451 - protein, 18 aa, Staphylococcus epidermidis
KKLTPFLRELEKRDIQYK

SEQ ID NO: 1799452 - protein, 20 aa, Staphylococcus epidermidis
KKNIYPIFKQLGLDTYIDVV

SEQ ID NO: 1799453 - protein, 23 aa, Staphylococcus epidermidis
KKNRRSLQIYGFSPCHEISIMLA

SEQ ID NO: 1799454 - protein, 18 aa, Staphylococcus epidermidis
KLIMSGNVLKVLVSNDIE

SEQ ID NO: 1799455 - protein, 17 aa, Staphylococcus epidermidis
KLISVIPSIDTGVCDSQ

SEQ ID NO: 1799456 - protein, 24 aa, Staphylococcus epidermidis
KMVKEAGYELNVWTVNKPARANQL

SEQ ID NO: 1799457 - protein, 21 aa, Staphylococcus epidermidis
KNARFKYTVDRLGETWVTEEL

SEQ ID NO: 1799458 - protein, 21 aa, Staphylococcus epidermidis
KNIQIGMAHRGRLNVLTHVLE

SEQ ID NO: 1799459 - protein, 22 aa, Staphylococcus epidermidis
KNLASFYVACELFKQIQQHPHA

SEQ ID NO: 1799460 - protein, 18 aa, Staphylococcus epidermidis
KNQLAFISAIEKHYEMYT

SEQ ID NO: 1799461 - protein, 20 aa, Staphylococcus epidermidis
KPMILYGHMSPYMIVGMIGA

SEQ ID NO: 1799462 - protein, 18 aa, Staphylococcus epidermidis
KPQHIFSDLSSKMFTWNN

SEQ ID NO: 1799463 - protein, 27 aa, Staphylococcus epidermidis
KPRGLFRKKKFSPVVGDIVDFEVQNTK

SEQ ID NO: 1799464 - protein, 19 aa, Staphylococcus epidermidis
KQARSYKKKLSDAISKTQH

SEQ ID NO: 1799465 - protein, 20 aa, Staphylococcus epidermidis
KQYDCRIGISQLPTHGLAVR

SEQ ID NO: 1799466 - protein, 17 aa, Staphylococcus epidermidis
KQYLCVAQKVARGILSM

SEQ ID NO: 1799467 - protein, 17 aa, Staphylococcus epidermidis
KRKMVFEGVVPNIDRRY

SEQ ID NO: 1799468 - protein, 21 aa, Staphylococcus epidermidis
KRNLYAFERIGQMLIESSVDI

SEQ ID NO: 1799469 - protein, 24 aa, Staphylococcus epidermidis
KSIQPRMDICFVREKGSGTRFYQE

SEQ ID NO: 1799470 - protein, 18 aa, Staphylococcus epidermidis
KSISRPIVTNALTHGLSL

SEQ ID NO: 1799471 - protein, 24 aa, Staphylococcus epidermidis
KSLLEAGLDFKIPGITIDRQCGSG

SEQ ID NO: 1799472 - protein, 17 aa, Staphylococcus epidermidis
KSLQKGVQMVHESLLRA

SEQ ID NO: 1799473 - protein, 19 aa, Staphylococcus epidermidis
KSMTHRAIMLASLAKGIST

SEQ ID NO: 1799474 - protein, 28 aa, Staphylococcus epidermidis
KSNYILKYVFANGISREIIYPLLKEMNL

SEQ ID NO: 1799475 - protein, 18 aa, Staphylococcus epidermidis
KSPYLLDNEEGLLLKNIL

SEQ ID NO: 1799476 - protein, 20 aa, Staphylococcus epidermidis
KSSNLLPVRLDGATKEFFSW

SEQ ID NO: 1799477 - protein, 24 aa, Staphylococcus epidermidis
KSSTVPRPIGWISTVSKEGKDNLA

SEQ ID NO: 1799478 - protein, 19 aa, Staphylococcus epidermidis
KTAIIACINRLLKTIHYLV

SEQ ID NO: 1799479 - protein, 18 aa, Staphylococcus epidermidis
KTGALLNFSVMAAVDIAQ

SEQ ID NO: 1799480 - protein, 17 aa, Staphylococcus epidermidis
KTMIFKIDGEFIMFLVR

SEQ ID NO: 1799481 - protein, 17 aa, Staphylococcus epidermidis
KTNHVVYIGSSFNNNQL

SEQ ID NO: 1799482 - protein, 18 aa, Staphylococcus epidermidis
KTNLEKISRKNLNRDLKI

SEQ ID NO: 1799483 - protein, 17 aa, Staphylococcus epidermidis
KVLDPLFNAFDVKPEKV

SEQ ID NO: 1799484 - protein, 26 aa, Staphylococcus epidermidis
KVLNRFKEVYSIFSDVLGVPLKSKET

SEQ ID NO: 1799485 - protein, 23 aa, Staphylococcus epidermidis
KVNEFKFATIICSRNYLEELTLG

SEQ ID NO: 1799486 - protein, 24 aa, Staphylococcus epidermidis
KVVKRLAKKMSIGVITNDIYTKED

SEQ ID NO: 1799487 - protein, 19 aa, Staphylococcus epidermidis
KWIVDHWVTHFGVEKTENI

SEQ ID NO: 1799488 - protein, 18 aa, Staphylococcus epidermidis
KYFEFGIKNVNTYLEYIE

SEQ ID NO: 1799489 - protein, 26 aa, Staphylococcus epidermidis
KYGIGRRISLHYTREMVDQAISGKLK

SEQ ID NO: 1799490 - protein, 18 aa, Staphylococcus epidermidis
KYKKAFSIIDPKNLSSKT

SEQ ID NO: 1799491 - protein, 19 aa, Staphylococcus epidermidis
KYPNCVLLGEGAKGSTLSI

SEQ ID NO: 1799492 - protein, 17 aa, Staphylococcus epidermidis
LACEAWSELGYIPKEDV

SEQ ID NO: 1799493 - protein, 18 aa, Staphylococcus epidermidis
LAEIGFKQGIQPYSEGVY

SEQ ID NO: 1799494 - protein, 22 aa, Staphylococcus epidermidis
LAEPEKTVVCFVGDGGFQMTNQ

SEQ ID NO: 1799495 - protein, 28 aa, Staphylococcus epidermidis
LAHLKNWNYSYAYSMRLTDDFSSINIIH

SEQ ID NO: 1799496 - protein, 17 aa, Staphylococcus epidermidis
LALDLYDSEWIQWYYNQ

SEQ ID NO: 1799497 - protein, 17 aa, Staphylococcus epidermidis
LALGLKGDTCIAGGGSD

SEQ ID NO: 1799498 - protein, 21 aa, Staphylococcus epidermidis
LDDAKDCLQKGAFVSDKDGDM

SEQ ID NO: 1799499 - protein, 24 aa, Staphylococcus epidermidis
LDEYICQWIRGLDNIIPRLVEKME

SEQ ID NO: 1799500 - protein, 17 aa, Staphylococcus epidermidis
LDGEFEMGIDIDTLVKF

SEQ ID NO: 1799501 - protein, 20 aa, Staphylococcus epidermidis
LDIKTLEALEMFMNKYPGII

SEQ ID NO: 1799502 - protein, 18 aa, Staphylococcus epidermidis
LDNLSRYSGIIVSTEQQK

SEQ ID NO: 1799503 - protein, 17 aa, Staphylococcus epidermidis
LDQSFKMIVGQSPEEYA

SEQ ID NO: 1799504 - protein, 23 aa, Staphylococcus epidermidis
LDSVWTFAEKVIFPYVEDDELVG

SEQ ID NO: 1799505 - protein, 24 aa, Staphylococcus epidermidis
LENAHTTWELGVVWKKDKRLSHAT

SEQ ID NO: 1799506 - protein, 18 aa, Staphylococcus epidermidis
LESLLSLESDLIVTAAFG

SEQ ID NO: 1799507 - protein, 17 aa, Staphylococcus epidermidis
LEVDAVGFIHYPDSKRH

SEQ ID NO: 1799508 - protein, 18 aa, Staphylococcus epidermidis
LEYLKYAKDYGFSDKVIA

SEQ ID NO: 1799509 - protein, 25 aa, Staphylococcus epidermidis
LFILGETLYNFGLTPQGLEVFRTLY

SEQ ID NO: 1799510 - protein, 18 aa, Staphylococcus epidermidis
LGEISAETQFALDYFNVE

SEQ ID NO: 1799511 - protein, 17 aa, Staphylococcus epidermidis
LGFLASEGIFLKRNDLQ

SEQ ID NO: 1799512 - protein, 18 aa, Staphylococcus epidermidis
LGLEKHVILRGFLKDLTD

SEQ ID NO: 1799513 - protein, 25 aa, Staphylococcus epidermidis
LGNIIAEVFNRFSITDTSMMLDRMK

SEQ ID NO: 1799514 - protein, 21 aa, Staphylococcus epidermidis
LGQNAAFIFAVCEYLKHNPNK

SEQ ID NO: 1799515 - protein, 19 aa, Staphylococcus epidermidis
LGVCICGTGVGISNAANKV

SEQ ID NO: 1799516 - protein, 22 aa, Staphylococcus epidermidis
LGYGDMLYLGSGMNKPIRVQGT

SEQ ID NO: 1799517 - protein, 26 aa, Staphylococcus epidermidis
LHNCQSFCISVAFITESGLASLKSHF

SEQ ID NO: 1799518 - protein, 17 aa, Staphylococcus epidermidis
LIGCQKTGEAMIIDPIR

SEQ ID NO: 1799519 - protein, 24 aa, Staphylococcus epidermidis
LIRSADVILFDRLVNPFILQYASS

SEQ ID NO: 1799520 - protein, 21 aa, Staphylococcus epidermidis
LIWNDGRYNMVEFQEEMKYKR

SEQ ID NO: 1799521 - protein, 21 aa, Staphylococcus epidermidis
LKAKRIILLAFGPKKKEAISK

SEQ ID NO: 1799522 - protein, 18 aa, Staphylococcus epidermidis
LKFNKKIQMIFQDPYASL

SEQ ID NO: 1799523 - protein, 19 aa, Staphylococcus epidermidis
LKGDTCIAGGGSDGNIMNQ

SEQ ID NO: 1799524 - protein, 23 aa, Staphylococcus epidermidis
LKGIECIYALYKKNRRSLQIYGF

SEQ ID NO: 1799525 - protein, 20 aa, Staphylococcus epidermidis
LKILTEVELSYLISEAPIIA

SEQ ID NO: 1799526 - protein, 17 aa, Staphylococcus epidermidis
LKKEFPNITSIKQNINN

SEQ ID NO: 1799527 - protein, 20 aa, Staphylococcus epidermidis
LKKHFKGYGLNVFSNPKVFN

SEQ ID NO: 1799528 - protein, 20 aa, Staphylococcus epidermidis
LKLKLQFFAEEPGDNAQTSE

SEQ ID NO: 1799529 - protein, 22 aa, Staphylococcus epidermidis
LKRETSILITGGFRPSAEIIRY

SEQ ID NO: 1799530 - protein, 23 aa, Staphylococcus epidermidis
LKRIGLNVIWIIKDVPLKYKYVK

SEQ ID NO: 1799531 - protein, 18 aa, Staphylococcus epidermidis
LLAFGPKKKEAISKLLNE

SEQ ID NO: 1799532 - protein, 22 aa, Staphylococcus epidermidis
LLAVRSEMVFSGYVGQSNQEGA

SEQ ID NO: 1799533 - protein, 21 aa, Staphylococcus epidermidis
LLDSYFDLIINYFKQINNIDE

SEQ ID NO: 1799534 - protein, 18 aa, Staphylococcus epidermidis
LLEMIGLVAEVQELKANP

SEQ ID NO: 1799535 - protein, 20 aa, Staphylococcus epidermidis
LLESIYTLALAKSHRTSNDK

SEQ ID NO: 1799536 - protein, 26 aa, Staphylococcus epidermidis
LLGIEEYKPHIAIITNIYSAHLDYHE

SEQ ID NO: 1799537 - protein, 17 aa, Staphylococcus epidermidis
LLKKYGKSFQRYNNKEI

SEQ ID NO: 1799538 - protein, 18 aa, Staphylococcus epidermidis
LLNSTWQGDEIVIHKDIN

SEQ ID NO: 1799539 - protein, 18 aa, Staphylococcus epidermidis
LMKHHHIDIYNGIGRIMG

SEQ ID NO: 1799540 - protein, 20 aa, Staphylococcus epidermidis
LNDKTILTLQGFKYNLNQEH

SEQ ID NO: 1799541 - protein, 20 aa, Staphylococcus epidermidis
LNDYRVMLIHPWQYDHTIGE

SEQ ID NO: 1799542 - protein, 17 aa, Staphylococcus epidermidis
LNEKLILISNHSVPYYA

SEQ ID NO: 1799543 - protein, 23 aa, Staphylococcus epidermidis
LNGEVSLQLGNQVYKACKEDVLY

SEQ ID NO: 1799544 - protein, 25 aa, Staphylococcus epidermidis
LNIDSKDIFSLYDFLQDSINFEKKH

SEQ ID NO: 1799545 - protein, 18 aa, Staphylococcus epidermidis
LNIIQLIWNDGRYNMVEF

SEQ ID NO: 1799546 - protein, 17 aa, Staphylococcus epidermidis
LNLTGKVDTIFLHCLPA

SEQ ID NO: 1799547 - protein, 21 aa, Staphylococcus epidermidis
LNSKVFKVKDMIFGVNAPPMH

SEQ ID NO: 1799548 - protein, 22 aa, Staphylococcus epidermidis
LPEIYKSIQAQILFNKVAQRPG

SEQ ID NO: 1799549 - protein, 18 aa, Staphylococcus epidermidis
LPLPDLIIVDGGKGHMNG

SEQ ID NO: 1799550 - protein, 20 aa, Staphylococcus epidermidis
LPNHSKFLGIGLRLIPKPLR

SEQ ID NO: 1799551 - protein, 23 aa, Staphylococcus epidermidis
LPSQSAIKHVLKYHEQFDKEIDQ

SEQ ID NO: 1799552 - protein, 19 aa, Staphylococcus epidermidis
LPVIPEFADDTLIGGNGSI

SEQ ID NO: 1799553 - protein, 27 aa, Staphylococcus epidermidis
LPVVNRRAVDWAMRASMALNMDIATNS

SEQ ID NO: 1799554 - protein, 17 aa, Staphylococcus epidermidis
LQIEMRSDIPLARGLGS

SEQ ID NO: 1799555 - protein, 18 aa, Staphylococcus epidermidis
LQILKLLFQNENKYVSRT

SEQ ID NO: 1799556 - protein, 19 aa, Staphylococcus epidermidis
LQNDLEKRESLHQDIDPLF

SEQ ID NO: 1799557 - protein, 17 aa, Staphylococcus epidermidis
LRIKDELTIYDRLSFPI

SEQ ID NO: 1799558 - protein, 18 aa, Staphylococcus epidermidis
LRIPNKVKDVAVGDTKIS

SEQ ID NO: 1799559 - protein, 31 aa, Staphylococcus epidermidis
LRKGKDALLKNGRRLKLYHGYNGNSHIYIKG

SEQ ID NO: 1799560 - protein, 21 aa, Staphylococcus epidermidis
LRKQFPNEEFKFYDKAINIPI

SEQ ID NO: 1799561 - protein, 18 aa, Staphylococcus epidermidis
LRMSQNIKPVYKMVDTCA

SEQ ID NO: 1799562 - protein, 21 aa, Staphylococcus epidermidis
LRQLPTYIRKQFEDIEVLSIT

SEQ ID NO: 1799563 - protein, 18 aa, Staphylococcus epidermidis
LRSGAMASVAPIIKEVKR

SEQ ID NO: 1799564 - protein, 19 aa, Staphylococcus epidermidis
LSAGEKVGLIGSNGSGKST

SEQ ID NO: 1799565 - protein, 18 aa, Staphylococcus epidermidis
LSAYEVVNQWSYEALVRI

SEQ ID NO: 1799566 - protein, 21 aa, Staphylococcus epidermidis
LSEPKINSTRAFYDANNPLEY

SEQ ID NO: 1799567 - protein, 20 aa, Staphylococcus epidermidis
LSIYLAYGMIDIIQVFNDLL

SEQ ID NO: 1799568 - protein, 17 aa, Staphylococcus epidermidis
LSSALTFVVETAVNQVG

SEQ ID NO: 1799569 - protein, 19 aa, Staphylococcus epidermidis
LSSHYQFGHIPSRIPLRAS

SEQ ID NO: 1799570 - protein, 17 aa, Staphylococcus epidermidis
LSTKCWENKHKRIFEVA

SEQ ID NO: 1799571 - protein, 25 aa, Staphylococcus epidermidis
LTANAESKERCQLLINPIRDEILNR

SEQ ID NO: 1799572 - protein, 25 aa, Staphylococcus epidermidis
LTDIEIVELLAFVSFTHCQQEFGAM

SEQ ID NO: 1799573 - protein, 23 aa, Staphylococcus epidermidis
LTGNFLLAMGLKHLSEISDTRVH

SEQ ID NO: 1799574 - protein, 22 aa, Staphylococcus epidermidis
LTKDPKYLIGRIIARPYVGEPG

SEQ ID NO: 1799575 - protein, 23 aa, Staphylococcus epidermidis
LTLPMKTSFFIPANDISRHANDI

SEQ ID NO: 1799576 - protein, 17 aa, Staphylococcus epidermidis
LTLQGFKYNLNQEHLNL

SEQ ID NO: 1799577 - protein, 24 aa, Staphylococcus epidermidis
LTMCYADCVPVYFYSEPHGYIGLA

SEQ ID NO: 1799578 - protein, 23 aa, Staphylococcus epidermidis
LTNEPKLDWHLSNLRNYAFLTPQ

SEQ ID NO: 1799579 - protein, 24 aa, Staphylococcus epidermidis
LTNKKARKNHLWFHTKDIPGSHVV

SEQ ID NO: 1799580 - protein, 18 aa, Staphylococcus epidermidis
LTNRIIVIKDGQIVDDFK

SEQ ID NO: 1799581 - protein, 18 aa, Staphylococcus epidermidis
LTTSSAMLIIFGDLQNYE

SEQ ID NO: 1799582 - protein, 20 aa, Staphylococcus epidermidis
LVSDKCDFHIKIPMVGHVNS

SEQ ID NO: 1799583 - protein, 17 aa, Staphylococcus epidermidis
LYERDIDGYYLIVQQER

SEQ ID NO: 1799584 - protein, 21 aa, Staphylococcus epidermidis
LYHKYCELHDLLGRQYPELSY

SEQ ID NO: 1799585 - protein, 19 aa, Staphylococcus epidermidis
LYIHDFPIVAIGGINETNV

SEQ ID NO: 1799586 - protein, 18 aa, Staphylococcus epidermidis
LYKFFLLIAKYIKRKEAF

SEQ ID NO: 1799587 - protein, 17 aa, Staphylococcus epidermidis
MDSLKRIDISPLGAAAL

SEQ ID NO: 1799588 - protein, 21 aa, Staphylococcus epidermidis
MEALWRESLHIVNDGIATTEE

SEQ ID NO: 1799589 - protein, 17 aa, Staphylococcus epidermidis
MEMERLFNGLKNEGAIL

SEQ ID NO: 1799590 - protein, 24 aa, Staphylococcus epidermidis
MESIEVGCPVIAYDVRYGPGEIIE

SEQ ID NO: 1799591 - protein, 23 aa, Staphylococcus epidermidis
MEVTVLHLADWLMEMQLDRKAGE

SEQ ID NO: 1799592 - protein, 17 aa, Staphylococcus epidermidis
MFKGEVVTSHMIDLLNK

SEQ ID NO: 1799593 - protein, 21 aa, Staphylococcus epidermidis
MFRFREHRIVAFSGGRFLIHG

SEQ ID NO: 1799594 - protein, 18 aa, Staphylococcus epidermidis
MGATAFVYNGRFHPETYL

SEQ ID NO: 1799595 - protein, 24 aa, Staphylococcus epidermidis
MHQLGDALIQYAIEQCAGLTPKEW

SEQ ID NO: 1799596 - protein, 20 aa, Staphylococcus epidermidis
MISQLSRFFTGIEIHPGAKI

SEQ ID NO: 1799597 - protein, 25 aa, Staphylococcus epidermidis
MKDAKKAVVVGGGYIGIEAAEAFAK

SEQ ID NO: 1799598 - protein, 21 aa, Staphylococcus epidermidis
MKLFSEDRFNVDVLKVEVPVN

SEQ ID NO: 1799599 - protein, 20 aa, Staphylococcus epidermidis
MLLKEPDLLLLDEPTNHLDM

SEQ ID NO: 1799600 - protein, 19 aa, Staphylococcus epidermidis
MLNRYLLIYSMKSVDLLSI

SEQ ID NO: 1799601 - protein, 24 aa, Staphylococcus epidermidis
MNHVLKYADYFNVMRNGMMIESGE

SEQ ID NO: 1799602 - protein, 23 aa, Staphylococcus epidermidis
MPISDPKTGALFTGLIVTPSNFV

SEQ ID NO: 1799603 - protein, 22 aa, Staphylococcus epidermidis
MPLDQLKQVTGYVRGGCSPIGM

SEQ ID NO: 1799604 - protein, 24 aa, Staphylococcus epidermidis
MQQLAPRVAYLAQIVQDVIQSFGV

SEQ ID NO: 1799605 - protein, 25 aa, Staphylococcus epidermidis
MQVPLQHIIKFSCKPVQQFYGQYDI

SEQ ID NO: 1799606 - protein, 24 aa, Staphylococcus epidermidis
MSKEEILILLTLLEKGSMTLKEMD

SEQ ID NO: 1799607 - protein, 25 aa, Staphylococcus epidermidis
MSKTVKRKYTALVHGNIPHDYGTID

SEQ ID NO: 1799608 - protein, 20 aa, Staphylococcus epidermidis
MSRSEGFGEEVKRRIFLGTF

SEQ ID NO: 1799609 - protein, 18 aa, Staphylococcus epidermidis
MTDYCYRNYKMYLQEAIV

SEQ ID NO: 1799610 - protein, 18 aa, Staphylococcus epidermidis
NADLSGVLDVEEAPLVSV

SEQ ID NO: 1799611 - protein, 20 aa, Staphylococcus epidermidis
NAGGTCLNVGCIPSKTLLEH

SEQ ID NO: 1799612 - protein, 19 aa, Staphylococcus epidermidis
NALVGFKFDPNQQKSFKDL

SEQ ID NO: 1799613 - protein, 32 aa, Staphylococcus epidermidis
NATIHRFTRKLGFDGYSDFKSFLKFEDSKNHQ

SEQ ID NO: 1799614 - protein, 17 aa, Staphylococcus epidermidis
NAYHYGLEFAVKTFLKA

SEQ ID NO: 1799615 - protein, 20 aa, Staphylococcus epidermidis
NCVYCYNYAIWLIQNGLSHK

SEQ ID NO: 1799616 - protein, 22 aa, Staphylococcus epidermidis
NDTCIEAFSLPNILNGLNKYIH

SEQ ID NO: 1799617 - protein, 23 aa, Staphylococcus epidermidis
NEDSLKFIGLMDEIDDDMYKKAT

SEQ ID NO: 1799618 - protein, 17 aa, Staphylococcus epidermidis
NEEFKFYDKAINIPIND

SEQ ID NO: 1799619 - protein, 17 aa, Staphylococcus epidermidis
NEETLLFLGTGAIAQRA

SEQ ID NO: 1799620 - protein, 19 aa, Staphylococcus epidermidis
NESGLRIDLSQNFRSRQEV

SEQ ID NO: 1799621 - protein, 29 aa, Staphylococcus epidermidis
NFQRIRKGPNIKLPSYQLLEAPEPHEKDQ

SEQ ID NO: 1799622 - protein, 23 aa, Staphylococcus epidermidis
NGITRRVIKWIAEDEQIPFKEET

SEQ ID NO: 1799623 - protein, 28 aa, Staphylococcus epidermidis
NGYRSLHIVVSIPVFLADSVEVTPVEIQ

SEQ ID NO: 1799624 - protein, 24 aa, Staphylococcus epidermidis
NHRRVKEWLRKSARKYGLEAEDVV

SEQ ID NO: 1799625 - protein, 27 aa, Staphylococcus epidermidis
NIIVVTFNYRLGALGYLDWSYFNQHLN

SEQ ID NO: 1799626 - protein, 17 aa, Staphylococcus epidermidis
NKDYCLDKFNSKDTFIG

SEQ ID NO: 1799627 - protein, 21 aa, Staphylococcus epidermidis
NKHYISIFINGRYIKNFVLNK

SEQ ID NO: 1799628 - protein, 26 aa, Staphylococcus epidermidis
NLMIPCKPDHPFVYWATFSNAADLLD

SEQ ID NO: 1799629 - protein, 17 aa, Staphylococcus epidermidis
NLQFDFRAGQIDGLHPG

SEQ ID NO: 1799630 - protein, 24 aa, Staphylococcus epidermidis
NMAPEYGATCGFFPVDEESLKYMK

SEQ ID NO: 1799631 - protein, 24 aa, Staphylococcus epidermidis
NNLYKDFKAFISVQNNVDFCYRIS

SEQ ID NO: 1799632 - protein, 18 aa, Staphylococcus epidermidis
NNSKEFFLKQGFKDVETK

SEQ ID NO: 1799633 - protein, 17 aa, Staphylococcus epidermidis
NQGLDIRNPLYIYNEDG

SEQ ID NO: 1799634 - protein, 17 aa, Staphylococcus epidermidis
NQKVIDWLWETQDKTFF

SEQ ID NO: 1799635 - protein, 25 aa, Staphylococcus epidermidis
NTELPQNITICSGLIKADKYEWMIQ

SEQ ID NO: 1799636 - protein, 17 aa, Staphylococcus epidermidis
NTRNIGIMAHIDAGKTT

SEQ ID NO: 1799637 - protein, 25 aa, Staphylococcus epidermidis
NTTMPAFWFDPIINLSAIAQVTSHI

SEQ ID NO: 1799638 - protein, 30 aa, Staphylococcus epidermidis
NVEMPIVMPRLRITYLYARTKKLLKQYNLS

SEQ ID NO: 1799639 - protein, 25 aa, Staphylococcus epidermidis
NVVTRPVVEEWLFNTVAFIGGPSEI

SEQ ID NO: 1799640 - protein, 25 aa, Staphylococcus epidermidis
NWIHYWRNECGYTIKPVSETNDVRI

SEQ ID NO: 1799641 - protein, 19 aa, Staphylococcus epidermidis
NYIDFGIALDQYWNLSFLP

SEQ ID NO: 1799642 - protein, 21 aa, Staphylococcus epidermidis
NYKYRCIYCEQEFIRIKRVNL

SEQ ID NO: 1799643 - protein, 24 aa, Staphylococcus epidermidis
NYLKDTILKFGFYTNHQHVVINAE

SEQ ID NO: 1799644 - protein, 18 aa, Staphylococcus epidermidis
NYPELRLSVDTSNEEAQK

SEQ ID NO: 1799645 - protein, 24 aa, Staphylococcus epidermidis
NYWQNICNYTLKFVENTNDIKIYD

SEQ ID NO: 1799646 - protein, 19 aa, Staphylococcus epidermidis
PAGKPWSEFQRVRDEIKTA

SEQ ID NO: 1799647 - protein, 21 aa, Staphylococcus epidermidis
PEERLFRKYAHKIRNWEDDKQ

SEQ ID NO: 1799648 - protein, 32 aa, Staphylococcus epidermidis
PEQLFAAGYASCFNGAFDLILKQNKVRDAEPE

SEQ ID NO: 1799649 - protein, 22 aa, Staphylococcus epidermidis
PEQMVISTMMLRSMQQAHYDDV

SEQ ID NO: 1799650 - protein, 24 aa, Staphylococcus epidermidis
PFDTDFSGFIFKIQANMDPKHRDR

SEQ ID NO: 1799651 - protein, 19 aa, Staphylococcus epidermidis
PGAEGLIFHPYLAGERAPL

SEQ ID NO: 1799652 - protein, 24 aa, Staphylococcus epidermidis
PGHTPESISFLLTDEGAGAQVPMG

SEQ ID NO: 1799653 - protein, 26 aa, Staphylococcus epidermidis
PHGYIGLAHAGWRGTYGQIVKEMLKK

SEQ ID NO: 1799654 - protein, 19 aa, Staphylococcus epidermidis
PIEETNTFFELFKMAEEKH

SEQ ID NO: 1799655 - protein, 17 aa, Staphylococcus epidermidis
PIPINYDLIPKCVYTNP

SEQ ID NO: 1799656 - protein, 17 aa, Staphylococcus epidermidis
PKEKGIMVLNDDYDIGQ

SEQ ID NO: 1799657 - protein, 17 aa, Staphylococcus epidermidis
PKGRKPIKTSWAKHEQY

SEQ ID NO: 1799658 - protein, 21 aa, Staphylococcus epidermidis
PKKKPKVIVYAGMSLAQKNDQ

SEQ ID NO: 1799659 - protein, 19 aa, Staphylococcus epidermidis
PKMVHDFPIYPIRQSHKVL

SEQ ID NO: 1799660 - protein, 18 aa, Staphylococcus epidermidis
PLACAVSIAAIDVIIDED

SEQ ID NO: 1799661 - protein, 22 aa, Staphylococcus epidermidis
PLGSLFEQASLIFLDSVVLPLM

SEQ ID NO: 1799662 - protein, 18 aa, Staphylococcus epidermidis
PMSILKNGFSKLVKNGNA

SEQ ID NO: 1799663 - protein, 20 aa, Staphylococcus epidermidis
PPLSRVGLIASEAKLQGYDI

SEQ ID NO: 1799664 - protein, 17 aa, Staphylococcus epidermidis
PRASKFLDDYNEFDKVE

SEQ ID NO: 1799665 - protein, 17 aa, Staphylococcus epidermidis
PRSSRTVPFLSKITDIQ

SEQ ID NO: 1799666 - protein, 18 aa, Staphylococcus epidermidis
PSGCGKSTTLRMIAGLED

SEQ ID NO: 1799667 - protein, 19 aa, Staphylococcus epidermidis
PTTSQPAIGDWIENFERLR

SEQ ID NO: 1799668 - protein, 19 aa, Staphylococcus epidermidis
PVGVARPGTKLFATEEGEL

SEQ ID NO: 1799669 - protein, 22 aa, Staphylococcus epidermidis
PVPGGVGPLTITMVLNNTLLAE

SEQ ID NO: 1799670 - protein, 24 aa, Staphylococcus epidermidis
PYDKNFINQIGWYLNYDQEINLIG

SEQ ID NO: 1799671 - protein, 23 aa, Staphylococcus epidermidis
QAAREWLRTVGFKNIDDLNTVLK

SEQ ID NO: 1799672 - protein, 18 aa, Staphylococcus epidermidis
QALHAGIIGFEHPVTHEY

SEQ ID NO: 1799673 - protein, 22 aa, Staphylococcus epidermidis
QALKEIGYICAKVRDTMKEATK

SEQ ID NO: 1799674 - protein, 17 aa, Staphylococcus epidermidis
QDIFKKYGLTEMEVTDE

SEQ ID NO: 1799675 - protein, 17 aa, Staphylococcus epidermidis
QDLKGIHVHLEYENLLH

SEQ ID NO: 1799676 - protein, 21 aa, Staphylococcus epidermidis
QEIDMVINIGALKDGRFDKVQ

SEQ ID NO: 1799677 - protein, 19 aa, Staphylococcus epidermidis
QGALPVGLLPRIIVDDKEY

SEQ ID NO: 1799678 - protein, 17 aa, Staphylococcus epidermidis
QGGKLVLFSHLGKVKEE

SEQ ID NO: 1799679 - protein, 22 aa, Staphylococcus epidermidis
QGNCEGQAWGCDLSYDYVKINA

SEQ ID NO: 1799680 - protein, 18 aa, Staphylococcus epidermidis
QIIPHRQPFLLIDKIVEY

SEQ ID NO: 1799681 - protein, 24 aa, Staphylococcus epidermidis
QILKEIISRLSFLNNVGLEYLTLD

SEQ ID NO: 1799682 - protein, 22 aa, Staphylococcus epidermidis
QISEVDVGYAPWVIEESKTVFE

SEQ ID NO: 1799683 - protein, 27 aa, Staphylococcus epidermidis
QKFRAKQIFEWLYQKRVNTIDEMTNLS

SEQ ID NO: 1799684 - protein, 21 aa, Staphylococcus epidermidis
QKKLEQIRYLLFNIQMNVEQW

SEQ ID NO: 1799685 - protein, 18 aa, Staphylococcus epidermidis
QKPENCVAQLIELPFTST

SEQ ID NO: 1799686 - protein, 21 aa, Staphylococcus epidermidis
QLDFLLPERFDLTYIGQDGEQ

SEQ ID NO: 1799687 - protein, 20 aa, Staphylococcus epidermidis
QLLEEVNHVLEFYEISFNTL

SEQ ID NO: 1799688 - protein, 20 aa, Staphylococcus epidermidis
QMKAEARLMLNKEGIDVTEE

SEQ ID NO: 1799689 - protein, 24 aa, Staphylococcus epidermidis
QNEIDKLSNFLVFMDQHRESTEDY

SEQ ID NO: 1799690 - protein, 23 aa, Staphylococcus epidermidis
QPFIKEIVLMGGSTGRGNVTPLA

SEQ ID NO: 1799691 - protein, 18 aa, Staphylococcus epidermidis
QPLTFPLMSLIVSGGHTE

SEQ ID NO: 1799692 - protein, 20 aa, Staphylococcus epidermidis
QQEFPHARIIRMDVDTTSRK

SEQ ID NO: 1799693 - protein, 18 aa, Staphylococcus epidermidis
QRERDITLLFIAHDLSMV

SEQ ID NO: 1799694 - protein, 24 aa, Staphylococcus epidermidis
QRISMPYLRSPFVHHIHPKPFHLK

SEQ ID NO: 1799695 - protein, 21 aa, Staphylococcus epidermidis
QRVALGRAIVREAQIFLMDEP

SEQ ID NO: 1799696 - protein, 19 aa, Staphylococcus epidermidis
QRVGFFYPEIAMYFKNPKR

SEQ ID NO: 1799697 - protein, 19 aa, Staphylococcus epidermidis
QSIDLEAFFTRNLNSYHFN

SEQ ID NO: 1799698 - protein, 27 aa, Staphylococcus epidermidis
QTNHYWKYVEKYGVLGIALDNPLHVQS

SEQ ID NO: 1799699 - protein, 19 aa, Staphylococcus epidermidis
QVKSAILLASLFSKEATTL

SEQ ID NO: 1799700 - protein, 21 aa, Staphylococcus epidermidis
RAAYLAKAFGMKVIGVSKSGK

SEQ ID NO: 1799701 - protein, 26 aa, Staphylococcus epidermidis
RAIKQPRYLYGDAVVPFGGESRSEVE

SEQ ID NO: 1799702 - protein, 32 aa, Staphylococcus epidermidis
RAIQRIYESYPYKRGIYSGGVGYINCNHHLDF

SEQ ID NO: 1799703 - protein, 22 aa, Staphylococcus epidermidis
RAKELLTKIGLEEQLNSYPHML

SEQ ID NO: 1799704 - protein, 19 aa, Staphylococcus epidermidis
RAKLRGERSEGMICSLQEI

SEQ ID NO: 1799705 - protein, 20 aa, Staphylococcus epidermidis
RAPWKIKRPQSVYESEFPQF

SEQ ID NO: 1799706 - protein, 17 aa, Staphylococcus epidermidis
RDADRIGIERNFTIIDP

SEQ ID NO: 1799707 - protein, 19 aa, Staphylococcus epidermidis
RDVPQIIWHGLPLTDAFLF

SEQ ID NO: 1799708 - protein, 20 aa, Staphylococcus epidermidis
REGLKIFANLMKITGERDGF

SEQ ID NO: 1799709 - protein, 17 aa, Staphylococcus epidermidis
REQRLTKDELFQYIDRL

SEQ ID NO: 1799710 - protein, 22 aa, Staphylococcus epidermidis
RFDEIRHLLVENVKQEKVQIEN

SEQ ID NO: 1799711 - protein, 23 aa, Staphylococcus epidermidis
RFKSNKQLNAFVGIDIKRYQSGH

SEQ ID NO: 1799712 - protein, 19 aa, Staphylococcus epidermidis
RGLFKAVINKDTKEILGAS

SEQ ID NO: 1799713 - protein, 17 aa, Staphylococcus epidermidis
RGSGHLIDYSATKGAIV

SEQ ID NO: 1799714 - protein, 18 aa, Staphylococcus epidermidis
RGVIPVYAIPVGYSSFEM

SEQ ID NO: 1799715 - protein, 19 aa, Staphylococcus epidermidis
RHFLWSTARGYQSYTEDAQ

SEQ ID NO: 1799716 - protein, 21 aa, Staphylococcus epidermidis
RHNEELKDCYGISPEEKVLIH

SEQ ID NO: 1799717 - protein, 24 aa, Staphylococcus epidermidis
RKLIESLAYRYSKGQSHHEDLVQV

SEQ ID NO: 1799718 - protein, 19 aa, Staphylococcus epidermidis
RNKGIKILPFDANNITKEM

SEQ ID NO: 1799719 - protein, 24 aa, Staphylococcus epidermidis
RNKIIKFEGCYHGHSDSLLIKAGS

SEQ ID NO: 1799720 - protein, 18 aa, Staphylococcus epidermidis
RNTSGLVVFAKFGHVHHL

SEQ ID NO: 1799721 - protein, 19 aa, Staphylococcus epidermidis
RPGHADLIGGMKYNHRDLR

SEQ ID NO: 1799722 - protein, 20 aa, Staphylococcus epidermidis
RQKELLKEFAEINGENINEQ

SEQ ID NO: 1799723 - protein, 20 aa, Staphylococcus epidermidis
RQVRRMFEYFGHQVNKLTRI

SEQ ID NO: 1799724 - protein, 21 aa, Staphylococcus epidermidis
RREAISLGLSGLEIDVFDFHS

SEQ ID NO: 1799725 - protein, 17 aa, Staphylococcus epidermidis
RRKDLIISGGENIYPYQ

SEQ ID NO: 1799726 - protein, 19 aa, Staphylococcus epidermidis
RRRLVKFDKKINIPYVLNR

SEQ ID NO: 1799727 - protein, 17 aa, Staphylococcus epidermidis
RRSKYIIFYIADHDDDR

SEQ ID NO: 1799728 - protein, 19 aa, Staphylococcus epidermidis
RSIAEFTVTQAINIVRHFN

SEQ ID NO: 1799729 - protein, 19 aa, Staphylococcus epidermidis
RSQTKYPHFIKQLQDRKPY

SEQ ID NO: 1799730 - protein, 18 aa, Staphylococcus epidermidis
RSVRFPGLISHVKEPGGG

SEQ ID NO: 1799731 - protein, 18 aa, Staphylococcus epidermidis
RTDRGVHAYQQFFHFDTE

SEQ ID NO: 1799732 - protein, 17 aa, Staphylococcus epidermidis
RTTPSVVAFKNGETQVG

SEQ ID NO: 1799733 - protein, 17 aa, Staphylococcus epidermidis
RVIEEGRTNMVLQQPRH

SEQ ID NO: 1799734 - protein, 23 aa, Staphylococcus epidermidis
RVLASRLGGYAVELLKQGETAKG

SEQ ID NO: 1799735 - protein, 26 aa, Staphylococcus epidermidis
RWNKSHHQLIFFGRYHCLARKPKCEI

SEQ ID NO: 1799736 - protein, 18 aa, Staphylococcus epidermidis
RYIEVIGISIGGGTIKLK

SEQ ID NO: 1799737 - protein, 18 aa, Staphylococcus epidermidis
SAIGRAAAIAYAKEGADV

SEQ ID NO: 1799738 - protein, 18 aa, Staphylococcus epidermidis
SALEAVIGFLYLDHQSER

SEQ ID NO: 1799739 - protein, 19 aa, Staphylococcus epidermidis
SDIKRVIAHLPNFESDTDT

SEQ ID NO: 1799740 - protein, 20 aa, Staphylococcus epidermidis
SDITKLIIYEGLSTKHLHIH

SEQ ID NO: 1799741 - protein, 23 aa, Staphylococcus epidermidis
SEEYKVPLMMKFEVQGTNKDIIE

SEQ ID NO: 1799742 - protein, 17 aa, Staphylococcus epidermidis
SEIKYKKRSVLDETFVI

SEQ ID NO: 1799743 - protein, 24 aa, Staphylococcus epidermidis
SEYKMFCYHFKKYLHMSPSDYNKL

SEQ ID NO: 1799744 - protein, 29 aa, Staphylococcus epidermidis
SFCSTCTRARLSSDGKFYGCLFASSEGFD

SEQ ID NO: 1799745 - protein, 22 aa, Staphylococcus epidermidis
SGGQRGMQIIIHVNDLIDMTKA

SEQ ID NO: 1799746 - protein, 19 aa, Staphylococcus epidermidis
SGHIINLASVSGFEPTKTN

SEQ ID NO: 1799747 - protein, 18 aa, Staphylococcus epidermidis
SGTIPGVIFKLEKTHNIT

SEQ ID NO: 1799748 - protein, 25 aa, Staphylococcus epidermidis
SHNMIKDFSFMIGQIYYPELNARQN

SEQ ID NO: 1799749 - protein, 20 aa, Staphylococcus epidermidis
SIAKAISGSTQFKFRQLNAV

SEQ ID NO: 1799750 - protein, 22 aa, Staphylococcus epidermidis
SIQYNRFHCIGSDEAGSGDYFG

SEQ ID NO: 1799751 - protein, 18 aa, Staphylococcus epidermidis
SIVCSFIKRGTLADIGSD

SEQ ID NO: 1799752 - protein, 19 aa, Staphylococcus epidermidis
SKEIATCSEFKPYYLTKAL

SEQ ID NO: 1799753 - protein, 18 aa, Staphylococcus epidermidis
SKHGIALEEVNQFINQIK

SEQ ID NO: 1799754 - protein, 21 aa, Staphylococcus epidermidis
SKMIKEGVCQLDIKLDTGRTH

SEQ ID NO: 1799755 - protein, 18 aa, Staphylococcus epidermidis
SKPLRRVFHFDNQPTKLV

SEQ ID NO: 1799756 - protein, 18 aa, Staphylococcus epidermidis
SKPMKGTMPRGKNVKEDE

SEQ ID NO: 1799757 - protein, 21 aa, Staphylococcus epidermidis
SKYAGLRFDEDVVFCEEHTFI

SEQ ID NO: 1799758 - protein, 22 aa, Staphylococcus epidermidis
SLLNIGGGFGIKYVEGDESFPI

SEQ ID NO: 1799759 - protein, 25 aa, Staphylococcus epidermidis
SLPKLQLPYLISFLSFHNYAIYQIL

SEQ ID NO: 1799760 - protein, 23 aa, Staphylococcus epidermidis
SLSKADQVFLCEIFGSIRENTGD

SEQ ID NO: 1799761 - protein, 28 aa, Staphylococcus epidermidis
SNNPRFKRWVIGSILSRTYYHNMVTHLL

SEQ ID NO: 1799762 - protein, 20 aa, Staphylococcus epidermidis
SPCGACRQVMMELCDKDMPV

SEQ ID NO: 1799763 - protein, 18 aa, Staphylococcus epidermidis
SPDKSRLDGIGYMENYTH

SEQ ID NO: 1799764 - protein, 19 aa, Staphylococcus epidermidis
SPFVHHIHPKPFHLKQYAR

SEQ ID NO: 1799765 - protein, 23 aa, Staphylococcus epidermidis
SQREFKIYMLIAERFLENLMNPY

SEQ ID NO: 1799766 - protein, 17 aa, Staphylococcus epidermidis
SQVRWMGVLDLEGKTPA

SEQ ID NO: 1799767 - protein, 18 aa, Staphylococcus epidermidis
SRIYPVGRLDYDTSGVLL

SEQ ID NO: 1799768 - protein, 20 aa, Staphylococcus epidermidis
SRLDDLILMQLIHSPSYSSY

SEQ ID NO: 1799769 - protein, 19 aa, Staphylococcus epidermidis
SRLPVPNVHKNKFVAPRNN

SEQ ID NO: 1799770 - protein, 20 aa, Staphylococcus epidermidis
SRLYEGFSMGNPKIQTGNLL

SEQ ID NO: 1799771 - protein, 28 aa, Staphylococcus epidermidis
SSVKPISGYPFVWWFATRPTYDGQGYGS

SEQ ID NO: 1799772 - protein, 20 aa, Staphylococcus epidermidis
STNLVPFLTIEQQFKLLGKY

SEQ ID NO: 1799773 - protein, 23 aa, Staphylococcus epidermidis
STRKGKYLISRNVHKSVFHGLDI

SEQ ID NO: 1799774 - protein, 22 aa, Staphylococcus epidermidis
SVKDRIALAMIEKAEREGKIKP

SEQ ID NO: 1799775 - protein, 20 aa, Staphylococcus epidermidis
SVLIDLGLIIGKDARYRRNI

SEQ ID NO: 1799776 - protein, 21 aa, Staphylococcus epidermidis
SVRIPEELLQFEGQTKSKLGT

SEQ ID NO: 1799777 - protein, 23 aa, Staphylococcus epidermidis
SVSEIPHGWMMVEADATNLVQTR

SEQ ID NO: 1799778 - protein, 20 aa, Staphylococcus epidermidis
SVVTSGIYERYFIQENQLFH

SEQ ID NO: 1799779 - protein, 21 aa, Staphylococcus epidermidis
SYEALVRIFFRYGEEKFSKQI

SEQ ID NO: 1799780 - protein, 30 aa, Staphylococcus epidermidis
SYFKSAYHILDLVFWFGHLSILTKNHYSVT

SEQ ID NO: 1799781 - protein, 25 aa, Staphylococcus epidermidis
SYIQEGKWKSWGPYLLSGKDVYGAT

SEQ ID NO: 1799782 - protein, 22 aa, Staphylococcus epidermidis
SYLKVHYPHYFYANILSNVIGS

SEQ ID NO: 1799783 - protein, 26 aa, Staphylococcus epidermidis
SYLMEPWDGPTMISFCNGDKIGALTD

SEQ ID NO: 1799784 - protein, 24 aa, Staphylococcus epidermidis
TAINAHLGLAIGVLTGVAKKEELY

SEQ ID NO: 1799785 - protein, 18 aa, Staphylococcus epidermidis
TALSIGWHLSVIGQLYEQ

SEQ ID NO: 1799786 - protein, 23 aa, Staphylococcus epidermidis
TDLKVPYICLNGAEVRDESFNIM

SEQ ID NO: 1799787 - protein, 23 aa, Staphylococcus epidermidis
TDPEYWKKLFKRYENWINNFNAC

SEQ ID NO: 1799788 - protein, 23 aa, Staphylococcus epidermidis
TDRMSSSIIDYAKEVYQINLKVA

SEQ ID NO: 1799789 - protein, 22 aa, Staphylococcus epidermidis
TDYSSVMFDYGILKRPQFFFAY

SEQ ID NO: 1799790 - protein, 22 aa, Staphylococcus epidermidis
TEAKAYRLGEISAETQFALDYF

SEQ ID NO: 1799791 - protein, 23 aa, Staphylococcus epidermidis
TEDSRRVLPDTFSHKGAVQNSAI

SEQ ID NO: 1799792 - protein, 19 aa, Staphylococcus epidermidis
TEEAIKHLIFDALDATMEV

SEQ ID NO: 1799793 - protein, 24 aa, Staphylococcus epidermidis
TFNKYEIYQLLSLLENDVDNMPTS

SEQ ID NO: 1799794 - protein, 20 aa, Staphylococcus epidermidis
TFSPELVDFSIYIIDVAQGE

SEQ ID NO: 1799795 - protein, 24 aa, Staphylococcus epidermidis
TGHALQICEDILKFGGLGHTAVIH

SEQ ID NO: 1799796 - protein, 20 aa, Staphylococcus epidermidis
TGKALNKFKTFLSNQGGDDS

SEQ ID NO: 1799797 - protein, 17 aa, Staphylococcus epidermidis
TGKLYAHEHYQLSPDII

SEQ ID NO: 1799798 - protein, 23 aa, Staphylococcus epidermidis
TGTALSAYDSWALAKHLKTLPVR

SEQ ID NO: 1799799 - protein, 17 aa, Staphylococcus epidermidis
TGVCGPEPDETLIKTNQ

SEQ ID NO: 1799800 - protein, 18 aa, Staphylococcus epidermidis
THGARKGLADTALKTADS

SEQ ID NO: 1799801 - protein, 26 aa, Staphylococcus epidermidis
TIADVGCGYGPIGLAIGKVSPHHQIT

SEQ ID NO: 1799802 - protein, 17 aa, Staphylococcus epidermidis
TIIKPGLQASVVRVEGT

SEQ ID NO: 1799803 - protein, 22 aa, Staphylococcus epidermidis
TKKEIIPIYNFVRENEFPTRHN

SEQ ID NO: 1799804 - protein, 21 aa, Staphylococcus epidermidis
TKLGFKRAIIPQTNIGGWTFP

SEQ ID NO: 1799805 - protein, 21 aa, Staphylococcus epidermidis
TKNKRETAVLIGVHAQTDRQF

SEQ ID NO: 1799806 - protein, 19 aa, Staphylococcus epidermidis
TKSSGFDWFKRKSNKKEND

SEQ ID NO: 1799807 - protein, 24 aa, Staphylococcus epidermidis
TKVNELEKQIEIFETRAKNDEKYI

SEQ ID NO: 1799808 - protein, 17 aa, Staphylococcus epidermidis
TLAREYKTNHVVYIGSS

SEQ ID NO: 1799809 - protein, 24 aa, Staphylococcus epidermidis
TLLIKGHNAYGYLKAEKGVHRLVR

SEQ ID NO: 1799810 - protein, 28 aa, Staphylococcus epidermidis
TLMNHAISFLKERGYSVVTIKHHGHIGE

SEQ ID NO: 1799811 - protein, 25 aa, Staphylococcus epidermidis
TLVRLHKDYQFHIGAKTEMSSKLLS

SEQ ID NO: 1799812 - protein, 21 aa, Staphylococcus epidermidis
TMAGKGTEVGRSFEEIAQIID

SEQ ID NO: 1799813 - protein, 17 aa, Staphylococcus epidermidis
TMEPTRQALKDAGLSTS

SEQ ID NO: 1799814 - protein, 18 aa, Staphylococcus epidermidis
TMTFNRCNPLAGDPENAY

SEQ ID NO: 1799815 - protein, 18 aa, Staphylococcus epidermidis
TNIEGFHAKGYIFEHHNH

SEQ ID NO: 1799816 - protein, 24 aa, Staphylococcus epidermidis
TNMIPSYRAILIYFDNSGINGTEL

SEQ ID NO: 1799817 - protein, 19 aa, Staphylococcus epidermidis
TPKYHKLSEAERNWLNQQE

SEQ ID NO: 1799818 - protein, 17 aa, Staphylococcus epidermidis
TPLGKLATCINQDEDLP

SEQ ID NO: 1799819 - protein, 17 aa, Staphylococcus epidermidis
TQAFLNEFAESLSKADQ

SEQ ID NO: 1799820 - protein, 29 aa, Staphylococcus epidermidis
TQVGAEFLQRFNGGMGILLGGIPGVPKGK

SEQ ID NO: 1799821 - protein, 22 aa, Staphylococcus epidermidis
TREAKMIISCIARMKQQENYSV

SEQ ID NO: 1799822 - protein, 17 aa, Staphylococcus epidermidis
TREVRKFRADWKNNRIT

SEQ ID NO: 1799823 - protein, 23 aa, Staphylococcus epidermidis
TRIQFGPIDLKGLNAGEGRVLTP

SEQ ID NO: 1799824 - protein, 17 aa, Staphylococcus epidermidis
TRLKSGTAQKLVLNMIS

SEQ ID NO: 1799825 - protein, 24 aa, Staphylococcus epidermidis
TSGMAKSRRKTLEKMERIDKPMID

SEQ ID NO: 1799826 - protein, 18 aa, Staphylococcus epidermidis
TSPEFTYLNHSFKSSEVP

SEQ ID NO: 1799827 - protein, 22 aa, Staphylococcus epidermidis
TSRPSYVSNPWLKPDEHQSNFL

SEQ ID NO: 1799828 - protein, 18 aa, Staphylococcus epidermidis
TSYAPWYIVPADHKKTSR

SEQ ID NO: 1799829 - protein, 17 aa, Staphylococcus epidermidis
TTAYLTIGHTWIALNQE

SEQ ID NO: 1799830 - protein, 29 aa, Staphylococcus epidermidis
TVASYRIHKGFHMLRFEGINNINEIEHLK

SEQ ID NO: 1799831 - protein, 26 aa, Staphylococcus epidermidis
TVKESFRIIYYDGEAALALLRLYHQD

SEQ ID NO: 1799832 - protein, 22 aa, Staphylococcus epidermidis
TVLSNKGYRVLLATTDPTKEIN

SEQ ID NO: 1799833 - protein, 24 aa, Staphylococcus epidermidis
TVSALRLDVVLKEMIHKSRNIAQQ

SEQ ID NO: 1799834 - protein, 24 aa, Staphylococcus epidermidis
TVSLWKEWYNLKIVNETATSTDLK

SEQ ID NO: 1799835 - protein, 23 aa, Staphylococcus epidermidis
TVYKGLEMFINFQPNTIIALGGG

SEQ ID NO: 1799836 - protein, 18 aa, Staphylococcus epidermidis
TYKGPKGPTGYMIPTVVE

SEQ ID NO: 1799837 - protein, 18 aa, Staphylococcus epidermidis
TYTILQAIDFGYLNRELN

SEQ ID NO: 1799838 - protein, 18 aa, Staphylococcus epidermidis
VADLKEYINHSVPKVMGV

SEQ ID NO: 1799839 - protein, 23 aa, Staphylococcus epidermidis
VAGSGVYICNECIELCSEIVEEE

SEQ ID NO: 1799840 - protein, 20 aa, Staphylococcus epidermidis
VAGTKYRGEFEERLKKVMEE

SEQ ID NO: 1799841 - protein, 19 aa, Staphylococcus epidermidis
VAIKEAIELNPFITDYELC

SEQ ID NO: 1799842 - protein, 19 aa, Staphylococcus epidermidis
VAKHVPMDRLLCETDAPYL

SEQ ID NO: 1799843 - protein, 24 aa, Staphylococcus epidermidis
VAPARAMGMVSVWYKQEDAELEPL

SEQ ID NO: 1799844 - protein, 18 aa, Staphylococcus epidermidis
VASISPELFFQKGDYKGK

SEQ ID NO: 1799845 - protein, 22 aa, Staphylococcus epidermidis
VDEYEPLCEVITDKVTAEVPST

SEQ ID NO: 1799846 - protein, 17 aa, Staphylococcus epidermidis
VDLDTESLLGFKTIQTN

SEQ ID NO: 1799847 - protein, 24 aa, Staphylococcus epidermidis
VDNLPPVLLPKFVELMAQGNPSLQ

SEQ ID NO: 1799848 - protein, 20 aa, Staphylococcus epidermidis
VDSALNLIKGGGGALFREKV

SEQ ID NO: 1799849 - protein, 25 aa, Staphylococcus epidermidis
VDYNHVQSALNFKFMKRINEAGIPI

SEQ ID NO: 1799850 - protein, 27 aa, Staphylococcus epidermidis
VEAINKSRGKWCIKLSTGDKMITDCVV

SEQ ID NO: 1799851 - protein, 22 aa, Staphylococcus epidermidis
VEERSAVSIGRRVQDPLSELVK

SEQ ID NO: 1799852 - protein, 17 aa, Staphylococcus epidermidis
VEICQTLGLQSAQSIFE

SEQ ID NO: 1799853 - protein, 20 aa, Staphylococcus epidermidis
VFKSVGLAIVDIIVAQYFYK

SEQ ID NO: 1799854 - protein, 19 aa, Staphylococcus epidermidis
VGNSVIYVGLKTGRDGIHG

SEQ ID NO: 1799855 - protein, 17 aa, Staphylococcus epidermidis
VGRGGGSIEDLWNFNEE

SEQ ID NO: 1799856 - protein, 17 aa, Staphylococcus epidermidis
VIARAGVGVDNINIEAA

SEQ ID NO: 1799857 - protein, 17 aa, Staphylococcus epidermidis
VIGDYMAGPSHVLPTNQ

SEQ ID NO: 1799858 - protein, 23 aa, Staphylococcus epidermidis
VIKHRDLIRMLLMKQDAFLTENN

SEQ ID NO: 1799859 - protein, 19 aa, Staphylococcus epidermidis
VITTMAITLAREYKTNHVV

SEQ ID NO: 1799860 - protein, 20 aa, Staphylococcus epidermidis
VKDKFGVYVIFDEKKPVFVG

SEQ ID NO: 1799861 - protein, 19 aa, Staphylococcus epidermidis
VKEQLIFPEIDYDKVTKVR

SEQ ID NO: 1799862 - protein, 19 aa, Staphylococcus epidermidis
VKGEKEYLIPYIEDVVKDI

SEQ ID NO: 1799863 - protein, 22 aa, Staphylococcus epidermidis
VKIDLYRPVPNFKNISQVKSLV

SEQ ID NO: 1799864 - protein, 17 aa, Staphylococcus epidermidis
VKTKNGQMLVCQDPKCK

SEQ ID NO: 1799865 - protein, 19 aa, Staphylococcus epidermidis
VLHSLELDPKRVIVELNKE

SEQ ID NO: 1799866 - protein, 23 aa, Staphylococcus epidermidis
VLTGRLSGNIGYVASKVAQEVKS

SEQ ID NO: 1799867 - protein, 18 aa, Staphylococcus epidermidis
VNAYIPGIGHNLQEHSVV

SEQ ID NO: 1799868 - protein, 19 aa, Staphylococcus epidermidis
VNEAMKLFSEDRFNVDVLK

SEQ ID NO: 1799869 - protein, 26 aa, Staphylococcus epidermidis
VNGILRTVMRTELPSFEDIDDTKKRI

SEQ ID NO: 1799870 - protein, 18 aa, Staphylococcus epidermidis
VNGTISIGCSSLIGQTLL

SEQ ID NO: 1799871 - protein, 17 aa, Staphylococcus epidermidis
VNPRSSRTVPFLSKITD

SEQ ID NO: 1799872 - protein, 19 aa, Staphylococcus epidermidis
VNQEMKWAMSHQLLLNSND

SEQ ID NO: 1799873 - protein, 17 aa, Staphylococcus epidermidis
VNQWSYEALVRIFFRYG

SEQ ID NO: 1799874 - protein, 21 aa, Staphylococcus epidermidis
VPLAGDRFVVFGDEKQARRIG

SEQ ID NO: 1799875 - protein, 21 aa, Staphylococcus epidermidis
VPLEPGCYLMKDRNDQVIYVG

SEQ ID NO: 1799876 - protein, 23 aa, Staphylococcus epidermidis
VPLNGFKKWLTPVDLWKDHQMTL

SEQ ID NO: 1799877 - protein, 26 aa, Staphylococcus epidermidis
VPNKLIFTSWSPRLYMHAHSLNIDSK

SEQ ID NO: 1799878 - protein, 19 aa, Staphylococcus epidermidis
VPRNKAIVGQNAFSHESGI

SEQ ID NO: 1799879 - protein, 24 aa, Staphylococcus epidermidis
VPTSDVPLHLYLSVLGMPGQTAYH

SEQ ID NO: 1799880 - protein, 21 aa, Staphylococcus epidermidis
VPVKETWDLKDLFTSDQAFYQ

SEQ ID NO: 1799881 - protein, 18 aa, Staphylococcus epidermidis
VREAVVVPVYKNGKVIHL

SEQ ID NO: 1799882 - protein, 29 aa, Staphylococcus epidermidis
VRLDGATKEFFSWGFRVGFMTFGIDHETL

SEQ ID NO: 1799883 - protein, 18 aa, Staphylococcus epidermidis
VRSLLGIAVPTQIATHDS

SEQ ID NO: 1799884 - protein, 17 aa, Staphylococcus epidermidis
VSGKWFFDRYSPVTNIK

SEQ ID NO: 1799885 - protein, 24 aa, Staphylococcus epidermidis
VSQCIKKEGQPAVDRWLKTLQAGG

SEQ ID NO: 1799886 - protein, 17 aa, Staphylococcus epidermidis
VSRLVKRRTLAKEISDQ

SEQ ID NO: 1799887 - protein, 43 aa, Staphylococcus epidermidis
VSSEFLRKRIVDLNEVNPMLGHRGCRLAVTYPELYEMQVEAII

SEQ ID NO: 1799888 - protein, 20 aa, Staphylococcus epidermidis
VSSFDASPFLKMIINQSEFN

SEQ ID NO: 1799889 - protein, 21 aa, Staphylococcus epidermidis
VSSKHKVEFIPQRIFRENETL

SEQ ID NO: 1799890 - protein, 19 aa, Staphylococcus epidermidis
VTAYRGSGHLIDYSATKGA

SEQ ID NO: 1799891 - protein, 25 aa, Staphylococcus epidermidis
VTEELRKKGVVGKFVEFFGPGVQHL

SEQ ID NO: 1799892 - protein, 19 aa, Staphylococcus epidermidis
VTPSMMVFTNFFRDQMDRF

SEQ ID NO: 1799893 - protein, 17 aa, Staphylococcus epidermidis
VVNSNFKGVNWSTRLWQ

SEQ ID NO: 1799894 - protein, 26 aa, Staphylococcus epidermidis
VVVPDYQLSLAIGKRGQNARLAAKLT

SEQ ID NO: 1799895 - protein, 26 aa, Staphylococcus epidermidis
VWATAAPGWQKWVWSPFLSVLGMGAT

SEQ ID NO: 1799896 - protein, 19 aa, Staphylococcus epidermidis
WCRSTTVPHVGNWRDRFFT

SEQ ID NO: 1799897 - protein, 17 aa, Staphylococcus epidermidis
WDIKQARSYKKKLSDAI

SEQ ID NO: 1799898 - protein, 17 aa, Staphylococcus epidermidis
WDNVGLLIGNDKLDITG

SEQ ID NO: 1799899 - protein, 17 aa, Staphylococcus epidermidis
WESTSRPFYLKKQYTDF

SEQ ID NO: 1799900 - protein, 26 aa, Staphylococcus epidermidis
WFLNPDHMLLILGIEKGWFKEESLEI

SEQ ID NO: 1799901 - protein, 17 aa, Staphylococcus epidermidis
WIENGATIYVCGDESKM

SEQ ID NO: 1799902 - protein, 19 aa, Staphylococcus epidermidis
WKLEVLDTYQRRGYAKQLL

SEQ ID NO: 1799903 - protein, 25 aa, Staphylococcus epidermidis
WKQHEVKLVFFLAMSKKDLNINRKI

SEQ ID NO: 1799904 - protein, 19 aa, Staphylococcus epidermidis
WKSQGIKPGVVMVDPPRKG

SEQ ID NO: 1799905 - protein, 19 aa, Staphylococcus epidermidis
WSLSMLDSFAKEVVHGALI

SEQ ID NO: 1799906 - protein, 21 aa, Staphylococcus epidermidis
WTSKRGSLSYDIDGIVIKVND

SEQ ID NO: 1799907 - protein, 20 aa, Staphylococcus epidermidis
WVGTLLKMKPVLRFEEDGKI

SEQ ID NO: 1799908 - protein, 17 aa, Staphylococcus epidermidis
WYINSFKYFRNTYKRFY

SEQ ID NO: 1799909 - protein, 25 aa, Staphylococcus epidermidis
YAACGNCEYCTTGRETLCRDVLNAG

SEQ ID NO: 1799910 - protein, 23 aa, Staphylococcus epidermidis
YAEIAKELLAFYAKYATDTGLTI

SEQ ID NO: 1799911 - protein, 21 aa, Staphylococcus epidermidis
YAKQFFEVVQFSPEDATRTEI

SEQ ID NO: 1799912 - protein, 19 aa, Staphylococcus epidermidis
YDDVMRFGKYHPDYKDIML

SEQ ID NO: 1799913 - protein, 24 aa, Staphylococcus epidermidis
YDSDRYLPVLAIAIGKKAQDAHDS

SEQ ID NO: 1799914 - protein, 19 aa, Staphylococcus epidermidis
YDTPIVPVFWIAGEDHDFE

SEQ ID NO: 1799915 - protein, 19 aa, Staphylococcus epidermidis
YDVAYRMLHQLDLTAQDIG

SEQ ID NO: 1799916 - protein, 17 aa, Staphylococcus epidermidis
YDVSMIGQYQWYDFTPE

SEQ ID NO: 1799917 - protein, 30 aa, Staphylococcus epidermidis
YEAGYKIGVLIGEKGCRNVHFFGVSEEDIA

SEQ ID NO: 1799918 - protein, 20 aa, Staphylococcus epidermidis
YENIQIIGLMTMAPLTDDLS

SEQ ID NO: 1799919 - protein, 21 aa, Staphylococcus epidermidis
YEPNSLIAWMALGQNSHPTSI

SEQ ID NO: 1799920 - protein, 18 aa, Staphylococcus epidermidis
YFYSEPHGYIGLAHAGWR

SEQ ID NO: 1799921 - protein, 19 aa, Staphylococcus epidermidis
YILNWLVANSNEFDMEPLI

SEQ ID NO: 1799922 - protein, 26 aa, Staphylococcus epidermidis
YKEPIKRIANHRVLAMNRGEKEKVLS

SEQ ID NO: 1799923 - protein, 17 aa, Staphylococcus epidermidis
YLFDEFIAMMKDFKEKE

SEQ ID NO: 1799924 - protein, 23 aa, Staphylococcus epidermidis
YLGDLCQLLSAYQITYIIDVTPS

SEQ ID NO: 1799925 - protein, 20 aa, Staphylococcus epidermidis
YNMIRDRGEWVISRQRVWGV

SEQ ID NO: 1799926 - protein, 17 aa, Staphylococcus epidermidis
YPELKVTIVDSLNKRIQ

SEQ ID NO: 1799927 - protein, 17 aa, Staphylococcus epidermidis
YQFGYFILIMRDNHEVV

SEQ ID NO: 1799928 - protein, 17 aa, Staphylococcus epidermidis
YQLSYIIDDKFNYASNL

SEQ ID NO: 1799929 - protein, 17 aa, Staphylococcus epidermidis
YRAKLLRQLPYPTKFIF

SEQ ID NO: 1799930 - protein, 17 aa, Staphylococcus epidermidis
YRASQMYYHELNMSTPV

SEQ ID NO: 1799931 - protein, 20 aa, Staphylococcus epidermidis
YREGEIEGTIDLNQYYYKNR

SEQ ID NO: 1799932 - protein, 23 aa, Staphylococcus epidermidis
YRFINAHALAVVHIMRDNCTVCH

SEQ ID NO: 1799933 - protein, 21 aa, Staphylococcus epidermidis
YRNLHLFKDLGIIESTELDGE

SEQ ID NO: 1799934 - protein, 24 aa, Staphylococcus epidermidis
YSDIKLKAFEAHASQTGPFLKQLA

SEQ ID NO: 1799935 - protein, 25 aa, Staphylococcus epidermidis
YSHFVYELIQPPTAYQFFNDPMLSV

SEQ ID NO: 1799936 - protein, 23 aa, Staphylococcus epidermidis
YVKGENPYFVSFIGDAPKKKPKV

SEQ ID NO: 1799937 - protein, 17 aa, Staphylococcus epidermidis
YYITTPILLNLMQQDVP

SEQ ID NO: 1799938 - protein, 17 aa, Staphylococcus epidermidis
YYSARVVHDVTIGPSPV

SEQ ID NO: 1799939 - protein, 17 aa, Staphylococcus epidermidis
YYYGTLIIVSHDRALID

SEQ ID NO: 1799940 - protein, 20 aa, Staphylococcus epidermidis
AAALYRDFFTAKRNEVPEVT

SEQ ID NO: 1799941 - protein, 25 aa, Staphylococcus epidermidis
AADGYARINGIGAMVTTFGVGELSA

SEQ ID NO: 1799942 - protein, 21 aa, Staphylococcus epidermidis
AAGGHAVMLGSLLAGTEESPG

SEQ ID NO: 1799943 - protein, 25 aa, Staphylococcus epidermidis
ACQLSEAAGAHFVKTSTGFAGGGAT

SEQ ID NO: 1799944 - protein, 17 aa, Staphylococcus epidermidis
ADIVTILGVAEDASIKA

SEQ ID NO: 1799945 - protein, 19 aa, Staphylococcus epidermidis
ADVFIGVSVADILTQDMVK

SEQ ID NO: 1799946 - protein, 26 aa, Staphylococcus epidermidis
AEAVLETESDFGLAFDGDGDRIIAVD

SEQ ID NO: 1799947 - protein, 23 aa, Staphylococcus epidermidis
AEKVKKGFIDKGYQVYFDSPTNQ

SEQ ID NO: 1799948 - protein, 21 aa, Staphylococcus epidermidis
AEQKLGLKLINFETSTSSVKK

SEQ ID NO: 1799949 - protein, 23 aa, Staphylococcus epidermidis
AFSVQPHAKFPPSLRNMYQELEN

SEQ ID NO: 1799950 - protein, 24 aa, Staphylococcus epidermidis
AFSVQPHAKFPPSLRNMYQELEND

SEQ ID NO: 1799951 - protein, 19 aa, Staphylococcus epidermidis
AFTVMYLLISKMFEDEDVS

SEQ ID NO: 1799952 - protein, 25 aa, Staphylococcus epidermidis
AGIMTKCPKCKKIMYTKELNENLNV

SEQ ID NO: 1799953 - protein, 18 aa, Staphylococcus epidermidis
AGLFHIGILLPTLTTLAD

SEQ ID NO: 1799954 - protein, 19 aa, Staphylococcus epidermidis
AGLKRFKDQYETVYLEVDN

SEQ ID NO: 1799955 - protein, 30 aa, Staphylococcus epidermidis
AGSNAIYEFLSLRIPMLLIPLGLDQSRGDQ

SEQ ID NO: 1799956 - protein, 19 aa, Staphylococcus epidermidis
AGYSLNWLKQTFFENESFE

SEQ ID NO: 1799957 - protein, 20 aa, Staphylococcus epidermidis
AGYSLNWLKQTFFENESFEE

SEQ ID NO: 1799958 - protein, 17 aa, Staphylococcus epidermidis
AHAKICAFIPGTQKRGP

SEQ ID NO: 1799959 - protein, 26 aa, Staphylococcus epidermidis
AIEFARSGDTIVVWRLDRLGRNMEDL

SEQ ID NO: 1799960 - protein, 27 aa, Staphylococcus epidermidis
AIISYLSSDLFKGIGKKTAQNIVNTLG

SEQ ID NO: 1799961 - protein, 17 aa, Staphylococcus epidermidis
AIPTGHGKINIAHGIYP

SEQ ID NO: 1799962 - protein, 21 aa, Staphylococcus epidermidis
AIQGYIYKCAKKHHLETPYLD

SEQ ID NO: 1799963 - protein, 17 aa, Staphylococcus epidermidis
AISKAFRGYGLGQLLLK

SEQ ID NO: 1799964 - protein, 27 aa, Staphylococcus epidermidis
AKDLRMMMAALKISTDFERMGDNAASI

SEQ ID NO: 1799965 - protein, 22 aa, Staphylococcus epidermidis
AKGLKPRAIRAMIVGIPNVGKS

SEQ ID NO: 1799966 - protein, 20 aa, Staphylococcus epidermidis
AKWYAEKDFASLLHEDLKIR

SEQ ID NO: 1799967 - protein, 17 aa, Staphylococcus epidermidis
AKYSYLIVEKGFAKRLQ

SEQ ID NO: 1799968 - protein, 26 aa, Staphylococcus epidermidis
ALFILGETLYNFGLTPQGLEVFRTLY

SEQ ID NO: 1799969 - protein, 17 aa, Staphylococcus epidermidis
ALSELSPSFSINEIDLL

SEQ ID NO: 1799970 - protein, 17 aa, Staphylococcus epidermidis
ANGYRYYNVQDISKLQY

SEQ ID NO: 1799971 - protein, 23 aa, Staphylococcus epidermidis
ANSERYGAVYLVNLFSNIRTPEN

SEQ ID NO: 1799972 - protein, 18 aa, Staphylococcus epidermidis
AQANFALILGNEGEGVNS

SEQ ID NO: 1799973 - protein, 17 aa, Staphylococcus epidermidis
ARCFEMKEACYAATPAI

SEQ ID NO: 1799974 - protein, 17 aa, Staphylococcus epidermidis
ASLETFGVDSDRLEIQI

SEQ ID NO: 1799975 - protein, 17 aa, Staphylococcus epidermidis
ASLLQIYSSLVIEGPGL

SEQ ID NO: 1799976 - protein, 22 aa, Staphylococcus epidermidis
ASPKLGYRRIFNIKEKGTRHGG

SEQ ID NO: 1799977 - protein, 26 aa, Staphylococcus epidermidis
ATIYRRWKDKSSIIMSAFIEQSQYIA

SEQ ID NO: 1799978 - protein, 26 aa, Staphylococcus epidermidis
ATIYRRWKDKSSIIMSAFIEQSQYIV

SEQ ID NO: 1799979 - protein, 20 aa, Staphylococcus epidermidis
ATKVGIGPGRVCITKIKTGF

SEQ ID NO: 1799980 - protein, 24 aa, Staphylococcus epidermidis
AVRIVRKRGQLMARAFPNGVGGMA

SEQ ID NO: 1799981 - protein, 21 aa, Staphylococcus epidermidis
AVSRLVGAPPGYVGHDDGGQL

SEQ ID NO: 1799982 - protein, 19 aa, Staphylococcus epidermidis
AWHSAPRPIPLPNQTKNLL

SEQ ID NO: 1799983 - protein, 27 aa, Staphylococcus epidermidis
CDIYPLLNRSLLYSAIILHDLGKVREL

SEQ ID NO: 1799984 - protein, 18 aa, Staphylococcus epidermidis
CKTLESIGVDLLVIRHSQ

SEQ ID NO: 1799985 - protein, 17 aa, Staphylococcus epidermidis
CLQKGAFVSDKDGDMHY

SEQ ID NO: 1799986 - protein, 19 aa, Staphylococcus epidermidis
CRESVKYAIERGYRSIDTA

SEQ ID NO: 1799987 - protein, 17 aa, Staphylococcus epidermidis
CRFGTQYTTRLGIRLEK

SEQ ID NO: 1799988 - protein, 19 aa, Staphylococcus epidermidis
DCTHFCTSKQFLPQHEEQL

SEQ ID NO: 1799989 - protein, 20 aa, Staphylococcus epidermidis
DDIKDLDCQVIILSSYDDFE

SEQ ID NO: 1799990 - protein, 19 aa, Staphylococcus epidermidis
DDYFFKNDEWHITAFNKFK

SEQ ID NO: 1799991 - protein, 20 aa, Staphylococcus epidermidis
DEILNRIGTYYFGSDEVSIE

SEQ ID NO: 1799992 - protein, 21 aa, Staphylococcus epidermidis
DEKILKVDGFLNHQIDAKLMN

SEQ ID NO: 1799993 - protein, 21 aa, Staphylococcus epidermidis
DEMKAKYILQHYPKLEYHQTA

SEQ ID NO: 1799994 - protein, 24 aa, Staphylococcus epidermidis
DFDFPNILRVIQFESEFEQQDSVQ

SEQ ID NO: 1799995 - protein, 17 aa, Staphylococcus epidermidis
DFNSGYFMSLKLNQVDP

SEQ ID NO: 1799996 - protein, 18 aa, Staphylococcus epidermidis
DFNSGYFMSLKLNQVDPE

SEQ ID NO: 1799997 - protein, 17 aa, Staphylococcus epidermidis
DFTLDYDIDLERQDIAL

SEQ ID NO: 1799998 - protein, 18 aa, Staphylococcus epidermidis
DGYLKIKVNGGGCTGLTY

SEQ ID NO: 1799999 - protein, 22 aa, Staphylococcus epidermidis
DIKMKTAKTFLNKLYGGDMKSL

SEQ ID NO: 1800000 - protein, 17 aa, Staphylococcus epidermidis
DINAAPFSFFNVVNHTP

SEQ ID NO: 1800001 - protein, 17 aa, Staphylococcus epidermidis
DISYIIKLFNYIIKNQI

SEQ ID NO: 1800002 - protein, 24 aa, Staphylococcus epidermidis
DKFAKAAPLSAVFEAQRFIDLDWT

SEQ ID NO: 1800003 - protein, 23 aa, Staphylococcus epidermidis
DKLIGRTETHFELKQENSTAYHR

SEQ ID NO: 1800004 - protein, 19 aa, Staphylococcus epidermidis
DKLIGRTKTHFELKQENST

SEQ ID NO: 1800005 - protein, 21 aa, Staphylococcus epidermidis
DKVLEVCRDFYQNQRIYTKIK

SEQ ID NO: 1800006 - protein, 27 aa, Staphylococcus epidermidis
DLIPVVWIAFKTGLRISDVLTLQNNCL

SEQ ID NO: 1800007 - protein, 24 aa, Staphylococcus epidermidis
DLVARLKTMQGFYVERKAGWDTHG

SEQ ID NO: 1800008 - protein, 19 aa, Staphylococcus epidermidis
DNHIEGVDYIFCTFDTDMY

SEQ ID NO: 1800009 - protein, 18 aa, Staphylococcus epidermidis
DNLKTFGVEKIFTEKQSG

SEQ ID NO: 1800010 - protein, 27 aa, Staphylococcus epidermidis
DNRQIAELCYLIWRDMELDITKEITKD

SEQ ID NO: 1800011 - protein, 22 aa, Staphylococcus epidermidis
DRIGKLPLLMDFINNDSIDPSV

SEQ ID NO: 1800012 - protein, 22 aa, Staphylococcus epidermidis
DRLKWRDLFNDFEMHFYRYVFP

SEQ ID NO: 1800013 - protein, 20 aa, Staphylococcus epidermidis
DTASHFVLIFARKNVTAHTD

SEQ ID NO: 1800014 - protein, 22 aa, Staphylococcus epidermidis
DTCKYILKSVVQFEDDVEREKS

SEQ ID NO: 1800015 - protein, 22 aa, Staphylococcus epidermidis
DTETFIKWLHLFINEQLTYSDG

SEQ ID NO: 1800016 - protein, 24 aa, Staphylococcus epidermidis
DVAAEWAIPLLPKEHVTLLDIARK

SEQ ID NO: 1800017 - protein, 17 aa, Staphylococcus epidermidis
DVEDVNLIMGFVRVFGK

SEQ ID NO: 1800018 - protein, 25 aa, Staphylococcus epidermidis
DVFKSEGIADVFKHVQVPTLIVAGE

SEQ ID NO: 1800019 - protein, 27 aa, Staphylococcus epidermidis
DVKLAEALHSIFLEVVIAPQFTEEALK

SEQ ID NO: 1800020 - protein, 20 aa, Staphylococcus epidermidis
DVNLIMGFVRVFGKGNKERI

SEQ ID NO: 1800021 - protein, 17 aa, Staphylococcus epidermidis
DYEYKSGLASFLKNMYI

SEQ ID NO: 1800022 - protein, 18 aa, Staphylococcus epidermidis
DYRWLDAYLAIRDDDQLN

SEQ ID NO: 1800023 - protein, 17 aa, Staphylococcus epidermidis
DYVKRVIGTPGDSVEYK

SEQ ID NO: 1800024 - protein, 18 aa, Staphylococcus epidermidis
DYVYEIIDELSICSDYLF

SEQ ID NO: 1800025 - protein, 19 aa, Staphylococcus epidermidis
EAGLFHIGILLPTLTTLAD

SEQ ID NO: 1800026 - protein, 21 aa, Staphylococcus epidermidis
EAKFKTSALRSWKTDQADAHK

SEQ ID NO: 1800027 - protein, 30 aa, Staphylococcus epidermidis; identical to SEQ ID NO: 1646911

SEQ ID NO: 1800028 - protein, 30 aa, Staphylococcus epidermidis; identical to SEQ ID NO: 1646913

SEQ ID NO: 1800029 - protein, 23 aa, Staphylococcus epidermidis
EAQWEAMLLGWKVVSAVKSNAVI

SEQ ID NO: 1800030 - protein, 19 aa, Staphylococcus epidermidis
ECKKSVFNYEKEWRDFSKD

SEQ ID NO: 1800031 - protein, 28 aa, Staphylococcus epidermidis
EDNAIIVIEWSKFIKDFLPPNHLTINIS

SEQ ID NO: 1800032 - protein, 23 aa, Staphylococcus epidermidis
EDTCKYILKSVVQFEDDVEREKS

SEQ ID NO: 1800033 - protein, 17 aa, Staphylococcus epidermidis
EDVERYKLVAVVDKKAS

SEQ ID NO: 1800034 - protein, 17 aa, Staphylococcus epidermidis
EDYGIEIVDRIELIVPE

SEQ ID NO: 1800035 - protein, 26 aa, Staphylococcus epidermidis
EEAEEIIKDMIELVLKHKSVDVKKIR

SEQ ID NO: 1800036 - protein, 19 aa, Staphylococcus epidermidis
EEAKMSGQVILLLDEIHRL

SEQ ID NO: 1800037 - protein, 21 aa, Staphylococcus epidermidis
EEAKMSGQVILLLDEIHRLDK

SEQ ID NO: 1800038 - protein, 20 aa, Staphylococcus epidermidis
EEALISVGLDLPFPLKMNRL

SEQ ID NO: 1800039 - protein, 25 aa, Staphylococcus epidermidis
EEEKAHSITAIWNFEKQNYYLKDLK

SEQ ID NO: 1800040 - protein, 19 aa, Staphylococcus epidermidis
EEIEDLFLGLGYEIVDGYE

SEQ ID NO: 1800041 - protein, 18 aa, Staphylococcus epidermidis
EELRKHLINNYSIGIIAL

SEQ ID NO: 1800042 - protein, 17 aa, Staphylococcus epidermidis
EEMMEMSALGAGVLETR

SEQ ID NO: 1800043 - protein, 18 aa, Staphylococcus epidermidis
EEMMEMSALGAGVLETRS

SEQ ID NO: 1800044 - protein, 21 aa, Staphylococcus epidermidis
EEYKEIDIYSGTEMDILPDGT

SEQ ID NO: 1800045 - protein, 24 aa, Staphylococcus epidermidis
EGEEAKAYWLCWVTTERSEEGPYY

SEQ ID NO: 1800046 - protein, 24 aa, Staphylococcus epidermidis
EGEEAKAYWLCWVTTERSEQGPYY

SEQ ID NO: 1800047 - protein, 17 aa, Staphylococcus epidermidis
EGIILESMENFRKHKNY

SEQ ID NO: 1800048 - protein, 25 aa, Staphylococcus epidermidis
EGILNRAIEEFKKVFPYEDESNFGL

SEQ ID NO: 1800049 - protein, 25 aa, Staphylococcus epidermidis
EGIYLSGALLMFAGNKSYYLYGASS

SEQ ID NO: 1800050 - protein, 20 aa, Staphylococcus epidermidis
EGLEVKLLYDDVGSKKVRLS

SEQ ID NO: 1800051 - protein, 20 aa, Staphylococcus epidermidis
EGLPLPDLIIVDGGKGHMNG

SEQ ID NO: 1800052 - protein, 24 aa, Staphylococcus epidermidis
EHARDMLKRERLFFDKIQAHIGEV

SEQ ID NO: 1800053 - protein, 19 aa, Staphylococcus epidermidis
EHMDMPGLHSLEHLMAENI

SEQ ID NO: 1800054 - protein, 22 aa, Staphylococcus epidermidis
EIDRLVKGCTGVKRTTGQHPGG

SEQ ID NO: 1800055 - protein, 19 aa, Staphylococcus epidermidis
EIFTNKAFDGFKVEQVDNL

SEQ ID NO: 1800056 - protein, 20 aa, Staphylococcus epidermidis
EINARLIIIDEMSMVDTWLF

SEQ ID NO: 1800057 - protein, 17 aa, Staphylococcus epidermidis
EINFIHRTCEVLIIIDP

SEQ ID NO: 1800058 - protein, 18 aa, Staphylococcus epidermidis
EINFIHRTCEVLIIIDPQ

SEQ ID NO: 1800059 - protein, 25 aa, Staphylococcus epidermidis
EKDLFKYYFEHRFKQNDIVFNDARL

SEQ ID NO: 1800060 - protein, 20 aa, Staphylococcus epidermidis
EKHWFNWLTENNIPIKRRSS

SEQ ID NO: 1800061 - protein, 20 aa, Staphylococcus epidermidis
EKISIVPHFIKSYGQQDTHD

SEQ ID NO: 1800062 - protein, 26 aa, Staphylococcus epidermidis
EKKPRIRIPLSNEILEEFEKIRRGNQ

SEQ ID NO: 1800063 - protein, 18 aa, Staphylococcus epidermidis
EKLCQVIKQRSIELLIIA

SEQ ID NO: 1800064 - protein, 24 aa, Staphylococcus epidermidis
ELDNNSFLLLEFIENGHAYPESYR

SEQ ID NO: 1800065 - protein, 17 aa, Staphylococcus epidermidis
ELEFVLMALNIRKVTVQ

SEQ ID NO: 1800066 - protein, 18 aa, Staphylococcus epidermidis
ELGFKHKGFKEGLSKDYI

SEQ ID NO: 1800067 - protein, 18 aa, Staphylococcus epidermidis
ELMFQSQINYFFEHNHSL

SEQ ID NO: 1800068 - protein, 25 aa, Staphylococcus epidermidis
EMLNHGIPSFGYRIEAPIMPGTINV

SEQ ID NO: 1800069 - protein, 23 aa, Staphylococcus epidermidis
EMSAEAFIGADFVVAQLEVPFEA

SEQ ID NO: 1800070 - protein, 23 aa, Staphylococcus epidermidis
ENMFQMFKKGAVFVNCARGSLVD

SEQ ID NO: 1800071 - protein, 17 aa, Staphylococcus epidermidis
ENVEIALKLLKILLKEL

SEQ ID NO: 1800072 - protein, 22 aa, Staphylococcus epidermidis
EPEGIAAKVLESFNITEDKVIE

SEQ ID NO: 1800073 - protein, 20 aa, Staphylococcus epidermidis
EPFFMSLNEMFAMKEYKQKY

SEQ ID NO: 1800074 - protein, 21 aa, Staphylococcus epidermidis
EPTTYLDICHQLEILNLVKKL

SEQ ID NO: 1800075 - protein, 22 aa, Staphylococcus epidermidis
EPTTYLDICHQLEILNLVKKLN

SEQ ID NO: 1800076 - protein, 20 aa, Staphylococcus epidermidis
EQKLGLKLINFETSTSSVKK

SEQ ID NO: 1800077 - protein, 20 aa, Staphylococcus epidermidis
EQQERITLYLKYNTKKPNTI

SEQ ID NO: 1800078 - protein, 18 aa, Staphylococcus epidermidis
EQQWLKLPLEEDILQLGT

SEQ ID NO: 1800079 - protein, 17 aa, Staphylococcus epidermidis
EQSYCPGKFDLSINDKK

SEQ ID NO: 1800080 - protein, 30 aa, Staphylococcus epidermidis
ERLKFYKEHFTDWTYFQIKLVIVGIERGDL

SEQ ID NO: 1800081 - protein, 18 aa, Staphylococcus epidermidis
ERLLHAIFGEKAREVRDT

SEQ ID NO: 1800082 - protein, 17 aa, Staphylococcus epidermidis
ERQKIEVNEKIKLFNSD

SEQ ID NO: 1800083 - protein, 28 aa, Staphylococcus epidermidis
ERVKNLWLRTELKYFYFYHLNNGIWNAK

SEQ ID NO: 1800084 - protein, 17 aa, Staphylococcus epidermidis
ESLRITENSGISFIYTL

SEQ ID NO: 1800085 - protein, 21 aa, Staphylococcus epidermidis
ETEETIYLLKRKDFIQMDNNA

SEQ ID NO: 1800086 - protein, 19 aa, Staphylococcus epidermidis
ETHFKFRIISGGNSSMLPQ

SEQ ID NO: 1800087 - protein, 25 aa, Staphylococcus epidermidis
ETQTLLSLPFDYMFFTGSEKVGKIV

SEQ ID NO: 1800088 - protein, 17 aa, Staphylococcus epidermidis
ETVKRCYENGLDSVFFG

SEQ ID NO: 1800089 - protein, 25 aa, Staphylococcus epidermidis
EVAADSYLKLRFIQKSILKAIDSEW

SEQ ID NO: 1800090 - protein, 18 aa, Staphylococcus epidermidis
EVKLSRMERRIIRLLLND

SEQ ID NO: 1800091 - protein, 19 aa, Staphylococcus epidermidis
EVKLSRMERRIIRLLLNDY

SEQ ID NO: 1800092 - protein, 23 aa, Staphylococcus epidermidis
EVLDKPYVIVCLNTIVSDSDEQA

SEQ ID NO: 1800093 - protein, 18 aa, Staphylococcus epidermidis
EVLNAKWVHLLNSRECHP

SEQ ID NO: 1800094 - protein, 18 aa, Staphylococcus epidermidis
EVSELFKKDNEALKSNNQ

SEQ ID NO: 1800095 - protein, 23 aa, Staphylococcus epidermidis
EVVDLRTVYPLDKATIIERSQRT

SEQ ID NO: 1800096 - protein, 26 aa, Staphylococcus epidermidis
FAMKEYKQKYLILRIFNVSGKEPQFY

SEQ ID NO: 1800097 - protein, 21 aa, Staphylococcus epidermidis
FATARFYIRVLTRFFQNISKN

SEQ ID NO: 1800098 - protein, 21 aa, Staphylococcus epidermidis
FATYFVIEFSDKIIGYVGLWL

SEQ ID NO: 1800099 - protein, 18 aa, Staphylococcus epidermidis
FDMDVLYTGPHRKEEKER

SEQ ID NO: 1800100 - protein, 18 aa, Staphylococcus epidermidis
FEERLKAVLKEVKESEGR

SEQ ID NO: 1800101 - protein, 18 aa, Staphylococcus epidermidis
FESQAKYSYLIVEKGFAK

SEQ ID NO: 1800102 - protein, 17 aa, Staphylococcus epidermidis
FFVLIGPSGCGKTTTLK

SEQ ID NO: 1800103 - protein, 17 aa, Staphylococcus epidermidis
FGAESMVLIDLISQIKP

SEQ ID NO: 1800104 - protein, 17 aa, Staphylococcus epidermidis
FGEDGLKQYAVSQFKNS

SEQ ID NO: 1800105 - protein, 17 aa, Staphylococcus epidermidis
FGLQNGKIMKMKPEYED

SEQ ID NO: 1800106 - protein, 19 aa, Staphylococcus epidermidis
FGNVIHLRAVFIHKSISRI

SEQ ID NO: 1800107 - protein, 19 aa, Staphylococcus epidermidis
FGSQIKWNFTKFVVDQQGN

SEQ ID NO: 1800108 - protein, 18 aa, Staphylococcus epidermidis
FIALELIRPNPYQPRKTF

SEQ ID NO: 1800109 - protein, 19 aa, Staphylococcus epidermidis
FIALELIRPNPYQPRKTFE

SEQ ID NO: 1800110 - protein, 21 aa, Staphylococcus epidermidis
FIGTCSFDLVRHEFKKLQDIK

SEQ ID NO: 1800111 - protein, 19 aa, Staphylococcus epidermidis
FKAKIEVVSTLFSTKSDFT

SEQ ID NO: 1800112 - protein, 17 aa, Staphylococcus epidermidis
FKENVEIALKLLKILLK

SEQ ID NO: 1800113 - protein, 20 aa, Staphylococcus epidermidis
FKGNNAITFLLQNIQPHQNL

SEQ ID NO: 1800114 - protein, 20 aa, Staphylococcus epidermidis
FKKVFPYEDESNFGLLTGKR

SEQ ID NO: 1800115 - protein, 20 aa, Staphylococcus epidermidis
FKNDEWHITAFNKFKQFQDS

SEQ ID NO: 1800116 - protein, 31 aa, Staphylococcus epidermidis
FKTDNRGLFAFSIESMSQFGMYFTKMNLNLH

SEQ ID NO: 1800117 - protein, 21 aa, Staphylococcus epidermidis
FKVAKTESLEQLFNQFNTEDF

SEQ ID NO: 1800118 - protein, 18 aa, Staphylococcus epidermidis
FLYERDIDGYYLIVQQER

SEQ ID NO: 1800119 - protein, 25 aa, Staphylococcus epidermidis
FNMIFQFEHLGLWSTGDTKFDVKSY

SEQ ID NO: 1800120 - protein, 22 aa, Staphylococcus epidermidis
FPTSNIYLYAPITGMHAFDRID

SEQ ID NO: 1800121 - protein, 24 aa, Staphylococcus epidermidis
FQISKQFWAYLIREGHIESPDKFI

SEQ ID NO: 1800122 - protein, 24 aa, Staphylococcus epidermidis
FQLSKQFWAYLIREGHIESPDKFI

SEQ ID NO: 1800123 - protein, 19 aa, Staphylococcus epidermidis
FSISDLLLYEDIRKIMLKS

SEQ ID NO: 1800124 - protein, 21 aa, Staphylococcus epidermidis
FTITNGGIFGSMMSTPIINGN

SEQ ID NO: 1800125 - protein, 17 aa, Staphylococcus epidermidis
FTYPLIGNYGINRDDFE

SEQ ID NO: 1800126 - protein, 20 aa, Staphylococcus epidermidis
GAAASNHFEGGGFVRSNDDV

SEQ ID NO: 1800127 - protein, 17 aa, Staphylococcus epidermidis
GAEPLYFLDYIATNKVV

SEQ ID NO: 1800128 - protein, 21 aa, Staphylococcus epidermidis
GAIAKFIYYFAQYSIKMGHDE

SEQ ID NO: 1800129 - protein, 30 aa, Staphylococcus epidermidis; identical to SEQ ID NO: 1652499

SEQ ID NO: 1800130 - protein, 26 aa, Staphylococcus epidermidis
GAKLRKGMNAEENFMYSSEFGNVIHL

SEQ ID NO: 1800131 - protein, 23 aa, Staphylococcus epidermidis
GDIGKAFARRLQGFDARIIYHNR

SEQ ID NO: 1800132 - protein, 17 aa, Staphylococcus epidermidis
GENRLELIHQWINGRMP

SEQ ID NO: 1800133 - protein, 21 aa, Staphylococcus epidermidis
GEQKRLYLLRLLVHKPNVLLL

SEQ ID NO: 1800134 - protein, 20 aa, Staphylococcus epidermidis
GEVKRPIFLKIKRNRYKDIN

SEQ ID NO: 1800135 - protein, 25 aa, Staphylococcus epidermidis
GFGRIGRLAFRRIQDVEGLEVVAVN

SEQ ID NO: 1800136 - protein, 24 aa, Staphylococcus epidermidis
GGKKLTDVRVYDWVQEVELLGAGE

SEQ ID NO: 1800137 - protein, 19 aa, Staphylococcus epidermidis
GGKYAFAYASGIAAISAVL

SEQ ID NO: 1800138 - protein, 24 aa, Staphylococcus epidermidis
GGMKKRLGIAQAILHDPKVIIVDE

SEQ ID NO: 1800139 - protein, 17 aa, Staphylococcus epidermidis
GGQYRTSKIFKLLKEKY

SEQ ID NO: 1800140 - protein, 23 aa, Staphylococcus epidermidis
GHQLKRHGFFYAPTVLDNVRKDD

SEQ ID NO: 1800141 - protein, 25 aa, Staphylococcus epidermidis
GHTLRMLELPSAWTDYLNTTSNDAS

SEQ ID NO: 1800142 - protein, 24 aa, Staphylococcus epidermidis
GIMTKCPNCKKIMYTKELNENLNV

SEQ ID NO: 1800143 - protein, 18 aa, Staphylococcus epidermidis
GIQIGTDIPFCIYNQTAV

SEQ ID NO: 1800144 - protein, 17 aa, Staphylococcus epidermidis
GKAETLKSLKLNGYMVV

SEQ ID NO: 1800145 - protein, 19 aa, Staphylococcus epidermidis
GKDENFPFLMFGPGNGPHQ

SEQ ID NO: 1800146 - protein, 20 aa, Staphylococcus epidermidis
GKGTLFIGAIHKRWSRLELG

SEQ ID NO: 1800147 - protein, 22 aa, Staphylococcus epidermidis
GKPCKDLAIGFSDLDVEKYELH

SEQ ID NO: 1800148 - protein, 21 aa, Staphylococcus epidermidis
GKSSYKRALSLGHILDSNGKK

SEQ ID NO: 1800149 - protein, 20 aa, Staphylococcus epidermidis
GKVQLNYRQIKSFLMKHLSR

SEQ ID NO: 1800150 - protein, 17 aa, Staphylococcus epidermidis
GKWSYLYRAIDAEGHTL

SEQ ID NO: 1800151 - protein, 18 aa, Staphylococcus epidermidis
GLARIYKLNPITGAIEKL

SEQ ID NO: 1800152 - protein, 18 aa, Staphylococcus epidermidis
GLLSRPKILILDEPTEDI

SEQ ID NO: 1800153 - protein, 17 aa, Staphylococcus epidermidis
GLLSRPKILILDEPTEG

SEQ ID NO: 1800154 - protein, 19 aa, Staphylococcus epidermidis
GMVKWAPFIICTNLIKNLI

SEQ ID NO: 1800155 - protein, 22 aa, Staphylococcus epidermidis
GNETRVAWEVALESEHTPTSLV

SEQ ID NO: 1800156 - protein, 21 aa, Staphylococcus epidermidis
GNETRVAWEVALESEQTPTSL

SEQ ID NO: 1800157 - protein, 18 aa, Staphylococcus epidermidis
GNLGRALLTYNFSIHDEM

SEQ ID NO: 1800158 - protein, 19 aa, Staphylococcus epidermidis
GNLGRALLTYNFSIHDEMT

SEQ ID NO: 1800159 - protein, 17 aa, Staphylococcus epidermidis
GNQFLGFQIQQQGRTVQ

SEQ ID NO: 1800160 - protein, 21 aa, Staphylococcus epidermidis
GNTEAMIQYLLPKATVVTPNL

SEQ ID NO: 1800161 - protein, 17 aa, Staphylococcus epidermidis
GNYEKRVTFGLSGSDAN

SEQ ID NO: 1800162 - protein, 26 aa, Staphylococcus epidermidis
GQAPYKFLLSHGFVMDGEGKKMSKSL

SEQ ID NO: 1800163 - protein, 18 aa, Staphylococcus epidermidis
GQEIEFFGPEIDSFKQVV

SEQ ID NO: 1800164 - protein, 23 aa, Staphylococcus epidermidis
GQEVLKYIDFNAGKIAKQLLNIC

SEQ ID NO: 1800165 - protein, 25 aa, Staphylococcus epidermidis
GQGMSGGVSYIFPSDVEKFKKVNAL

SEQ ID NO: 1800166 - protein, 22 aa, Staphylococcus epidermidis
GRMGNFLENMVDWNIGRNRYWG

SEQ ID NO: 1800167 - protein, 21 aa, Staphylococcus epidermidis
GSGHAAWHAALTLKQSGKQVA

SEQ ID NO: 1800168 - protein, 28 aa, Staphylococcus epidermidis
GSGKSVCINSILMSLLYKNHPEELRLLL

SEQ ID NO: 1800169 - protein, 29 aa, Staphylococcus epidermidis
GSNAIYEFLTLRIPMLLIPLGLDQSRGDQ

SEQ ID NO: 1800170 - protein, 18 aa, Staphylococcus epidermidis
GSQIKWNFTKFVVDQQGN

SEQ ID NO: 1800171 - protein, 29 aa, Staphylococcus epidermidis
GTHSETFVIISFKHKVILIGGTEYAGEMK

SEQ ID NO: 1800172 - protein, 24 aa, Staphylococcus epidermidis
GTRQDLREAFQFAAENKVIPKIQL

SEQ ID NO: 1800173 - protein, 24 aa, Staphylococcus epidermidis
GTRQDLREAFQFAAENKVIPKVQL

SEQ ID NO: 1800174 - protein, 18 aa, Staphylococcus epidermidis
GVDILICDTAGRLQNKSN

SEQ ID NO: 1800175 - protein, 20 aa, Staphylococcus epidermidis
GVGNSVIYVGLKTGRDGIHG

SEQ ID NO: 1800176 - protein, 20 aa, Staphylococcus epidermidis
GVLDAAECVPTFNVSPNDII

SEQ ID NO: 1800177 - protein, 23 aa, Staphylococcus epidermidis
GVLDAAECVPTFNVSPNDIIGII

SEQ ID NO: 1800178 - protein, 17 aa, Staphylococcus epidermidis
GVLETRPELSFPADLYF

SEQ ID NO: 1800179 - protein, 18 aa, Staphylococcus epidermidis
GVTLAAGYSLNWLKQTFF

SEQ ID NO: 1800180 - protein, 19 aa, Staphylococcus epidermidis
GVYICNECIELCSEIVEEE

SEQ ID NO: 1800181 - protein, 17 aa, Staphylococcus epidermidis
GWSKISDMFPRDKNAAK

SEQ ID NO: 1800182 - protein, 17 aa, Staphylococcus epidermidis
GWTGGKYGIGRRISLHY

SEQ ID NO: 1800183 - protein, 18 aa, Staphylococcus epidermidis
GYLDHFDMDFLYLTDTQN

SEQ ID NO: 1800184 - protein, 24 aa, Staphylococcus epidermidis
HAKLPAGVGDYLFERLRLTANHMV

SEQ ID NO: 1800185 - protein, 23 aa, Staphylococcus epidermidis
HARDMLKRERLFFDKIQAHIGEV

SEQ ID NO: 1800186 - protein, 18 aa, Staphylococcus epidermidis
HARELIRLIQQLRKKKNL

SEQ ID NO: 1800187 - protein, 21 aa, Staphylococcus epidermidis
HCYKADPEYGKGVAKALGIDI

SEQ ID NO: 1800188 - protein, 17 aa, Staphylococcus epidermidis
HDSIAIFEVLEDGRSLR

SEQ ID NO: 1800189 - protein, 19 aa, Staphylococcus epidermidis
HELCHYFLHLAGEGYQHRD

SEQ ID NO: 1800190 - protein, 17 aa, Staphylococcus epidermidis
HGARKGLADTALKTADS

SEQ ID NO: 1800191 - protein, 17 aa, Staphylococcus epidermidis
HGLTINALKCVQKCSPI

SEQ ID NO: 1800192 - protein, 22 aa, Staphylococcus epidermidis
HGNETLSGLLLESTSAGIQNET

SEQ ID NO: 1800193 - protein, 19 aa, Staphylococcus epidermidis
HHILSYVIRMFNQLRGTIV

SEQ ID NO: 1800194 - protein, 19 aa, Staphylococcus epidermidis
HHLDFALAIRTMIIDEEKV

SEQ ID NO: 1800195 - protein, 17 aa, Staphylococcus epidermidis
HIGHAYSTVAGDVIARY

SEQ ID NO: 1800196 - protein, 22 aa, Staphylococcus epidermidis
HKCNTVSLLYDFQLAQFNIEPH

SEQ ID NO: 1800197 - protein, 19 aa, Staphylococcus epidermidis
HKGSMDFRIKSKGRASHSS

SEQ ID NO: 1800198 - protein, 19 aa, Staphylococcus epidermidis
HKKNIDVFLGIPYAKSFNK

SEQ ID NO: 1800199 - protein, 26 aa, Staphylococcus epidermidis
HKLTKDELKEIVTMMVNKLTHRLSEQ

SEQ ID NO: 1800200 - protein, 27 aa, Staphylococcus epidermidis
HKLTKDELKEIVTMMVNKLTHRLSEQN

SEQ ID NO: 1800201 - protein, 17 aa, Staphylococcus epidermidis
HKNCVFLVDTFHTLKSG

SEQ ID NO: 1800202 - protein, 31 aa, Staphylococcus epidermidis
HLSPEQNFIFGYEESYGFLARPFVRDKDAIQ

SEQ ID NO: 1800203 - protein, 32 aa, Staphylococcus epidermidis
HLSPEQNFIFGYEESYGFLARPFVRDKDAIQI

SEQ ID NO: 1800204 - protein, 18 aa, Staphylococcus epidermidis
HMDMPGLHSLEHLMAENI

SEQ ID NO: 1800205 - protein, 19 aa, Staphylococcus epidermidis
HNLESAYEFYVEKLGFEHI

SEQ ID NO: 1800206 - protein, 22 aa, Staphylococcus epidermidis
HPILKLPNAVVLPHIGSASQVT

SEQ ID NO: 1800207 - protein, 18 aa, Staphylococcus epidermidis
HPSAIELSKNPALRNRWV

SEQ ID NO: 1800208 - protein, 24 aa, Staphylococcus epidermidis
HQILRHSIKLGKIDHIFITHMHGD

SEQ ID NO: 1800209 - protein, 20 aa, Staphylococcus epidermidis
HRQFKTIGVMLFQQDKQFIY

SEQ ID NO: 1800210 - protein, 17 aa, Staphylococcus epidermidis
HRRQFLFENQFEKQDDI

SEQ ID NO: 1800211 - protein, 18 aa, Staphylococcus epidermidis
HSAIKVKVVVDYRLKLKN

SEQ ID NO: 1800212 - protein, 22 aa, Staphylococcus epidermidis
HSAYVFIKRLIKQFGKSQKVIT

SEQ ID NO: 1800213 - protein, 23 aa, Staphylococcus epidermidis
HSEGNQGPIIWVEDTLIALQQLA

SEQ ID NO: 1800214 - protein, 27 aa, Staphylococcus epidermidis
HSKEGVQLLWASCREVYNVIQADEIGA

SEQ ID NO: 1800215 - protein, 17 aa, Staphylococcus epidermidis
HTLPMETSVLIPTNDIS

SEQ ID NO: 1800216 - protein, 21 aa, Staphylococcus epidermidis
IALNIAEIFTHPDMVLDIDKE

SEQ ID NO: 1800217 - protein, 17 aa, Staphylococcus epidermidis
IANTVAFLASDKAKYIT

SEQ ID NO: 1800218 - protein, 18 aa, Staphylococcus epidermidis
IANTVAFLASDKAKYITG

SEQ ID NO: 1800219 - protein, 17 aa, Staphylococcus epidermidis
IAQRLKEFFNFLDMKFK

SEQ ID NO: 1800220 - protein, 22 aa, Staphylococcus epidermidis
ICPTCKGQRLNSKILSSKIMSK

SEQ ID NO: 1800221 - protein, 24 aa, Staphylococcus epidermidis
IDALQLRFILDWNSQSHRPQFKFD

SEQ ID NO: 1800222 - protein, 17 aa, Staphylococcus epidermidis
IDEIARMISGASVTELT

SEQ ID NO: 1800223 - protein, 18 aa, Staphylococcus epidermidis
IDEIARMISGASVTELTR

SEQ ID NO: 1800224 - protein, 22 aa, Staphylococcus epidermidis
IDEKILKVDGFLNHQIDAKLMN

SEQ ID NO: 1800225 - protein, 23 aa, Staphylococcus epidermidis
IDIEPGYFYTLLGPSGCGKTTIL

SEQ ID NO: 1800226 - protein, 17 aa, Staphylococcus epidermidis
IDLYKEREMSVGYQYGQ

SEQ ID NO: 1800227 - protein, 21 aa, Staphylococcus epidermidis
IDLYKEREMSVGYQYGQDTAE

SEQ ID NO: 1800228 - protein, 19 aa, Staphylococcus epidermidis
IDNFRWAGVPFYIRTGKRM

SEQ ID NO: 1800229 - protein, 21 aa, Staphylococcus epidermidis
IDRLVKGCTGVKRTTGQHPGG

SEQ ID NO: 1800230 - protein, 17 aa, Staphylococcus epidermidis
IDSCPIEGFDLDKVTEI

SEQ ID NO: 1800231 - protein, 19 aa, Staphylococcus epidermidis
IEAFAAYMDKIIKNPLKHV

SEQ ID NO: 1800232 - protein, 25 aa, Staphylococcus epidermidis
IEFARSGDTIVVWRLDRLGRNMEDL

SEQ ID NO: 1800233 - protein, 20 aa, Staphylococcus epidermidis
IEFYKLYVFMIHLFAIGTDF

SEQ ID NO: 1800234 - protein, 29 aa, Staphylococcus epidermidis
IEKFPQFNDYGCKILKSFEEAKNKITKEL

SEQ ID NO: 1800235 - protein, 17 aa, Staphylococcus epidermidis
IEKKPLIVMVNGMGGTP

SEQ ID NO: 1800236 - protein, 19 aa, Staphylococcus epidermidis
IEKKPLIVMVNGMGGTPLS

SEQ ID NO: 1800237 - protein, 18 aa, Staphylococcus epidermidis
IEQSYCPGKFDLSINDKK

SEQ ID NO: 1800238 - protein, 18 aa, Staphylococcus epidermidis
IEWLKRYDEHLIIIFKEA

SEQ ID NO: 1800239 - protein, 17 aa, Staphylococcus epidermidis
IFLSHQLAKRLADVRKD

SEQ ID NO: 1800240 - protein, 26 aa, Staphylococcus epidermidis
IFMKKSRPSTQLTLICKLHDKTYFEQ

SEQ ID NO: 1800241 - protein, 28 aa, Staphylococcus epidermidis
IFTAGKGRSGFVANSFAMRLNQLGKNAY

SEQ ID NO: 1800242 - protein, 25 aa, Staphylococcus epidermidis
IGEVLSLRLEDIVTWDNQIHLTPRD

SEQ ID NO: 1800243 - protein, 19 aa, Staphylococcus epidermidis
IGGHGLKTALTDAGLSIKN

SEQ ID NO: 1800244 - protein, 17 aa, Staphylococcus epidermidis
IGMAYAMQKGDISSPYY

SEQ ID NO: 1800245 - protein, 23 aa, Staphylococcus epidermidis
IGNARPAINYDVVRRYFEYKGYE

SEQ ID NO: 1800246 - protein, 20 aa, Staphylococcus epidermidis
IGTCSFDLVRHEFKKLQDIK

SEQ ID NO: 1800247 - protein, 17 aa, Staphylococcus epidermidis
IHRMLPHPINIVRVRLT

SEQ ID NO: 1800248 - protein, 18 aa, Staphylococcus epidermidis
IIDELSICSDYLFVKIKG

SEQ ID NO: 1800249 - protein, 17 aa, Staphylococcus epidermidis
IISSWLGTMGCGLPGAM

SEQ ID NO: 1800250 - protein, 25 aa, Staphylococcus epidermidis
IKAYCYHLKLLYEFMEQRGVILNDI

SEQ ID NO: 1800251 - protein, 20 aa, Staphylococcus epidermidis
IKEYCDFHHFEVKDIYADRG

SEQ ID NO: 1800252 - protein, 21 aa, Staphylococcus epidermidis
IKFDFRKGHQIVLKNRFNDNG

SEQ ID NO: 1800253 - protein, 24 aa, Staphylococcus epidermidis
IKILTELHGAPGFEDEVRSYMKSE

SEQ ID NO: 1800254 - protein, 17 aa, Staphylococcus epidermidis
IKKRVKVNHTVIDSTDF

SEQ ID NO: 1800255 - protein, 21 aa, Staphylococcus epidermidis
IKLYLQILVYFDMMNRNIKNN

SEQ ID NO: 1800256 - protein, 19 aa, Staphylococcus epidermidis
IKQCLSRFDTIVLTGGLGP

SEQ ID NO: 1800257 - protein, 17 aa, Staphylococcus epidermidis
IKRLETFVEKNITRAST

SEQ ID NO: 1800258 - protein, 24 aa, Staphylococcus epidermidis
IKSPLKFNPDLAKKNWREAQKELG

SEQ ID NO: 1800259 - protein, 17 aa, Staphylococcus epidermidis
IKWSKLYVDDFQSSWTM

SEQ ID NO: 1800260 - protein, 24 aa, Staphylococcus epidermidis
ILDIKMPYIDGFEVAQSLKESNIP

SEQ ID NO: 1800261 - protein, 17 aa, Staphylococcus epidermidis
ILSSVLMLEHLGWQEAA

SEQ ID NO: 1800262 - protein, 18 aa, Staphylococcus epidermidis
ILSSVLMLEHLGWQKAAD

SEQ ID NO: 1800263 - protein, 20 aa, Staphylococcus epidermidis
ILVDMTKLLAPILVHTAEEV

SEQ ID NO: 1800264 - protein, 24 aa, Staphylococcus epidermidis
IMSGNFVMRGEPAIYHKFKRTEMA

SEQ ID NO: 1800265 - protein, 23 aa, Staphylococcus epidermidis
INIKGEVLITEIYDDYFFKNDEW

SEQ ID NO: 1800266 - protein, 18 aa, Staphylococcus epidermidis
INKYGADSLRWALISDSA

SEQ ID NO: 1800267 - protein, 17 aa, Staphylococcus epidermidis
INQDLWDKVQMRKKQVS

SEQ ID NO: 1800268 - protein, 17 aa, Staphylococcus epidermidis
INRFDLSFDRKFEAFLV

SEQ ID NO: 1800269 - protein, 21 aa, Staphylococcus epidermidis
INRILELTMTYGARMAEPGEY

SEQ ID NO: 1800270 - protein, 24 aa, Staphylococcus epidermidis
INVLRWVHQYIEHFGGDPNNVTLM

SEQ ID NO: 1800271 - protein, 18 aa, Staphylococcus epidermidis
IPGKRVIHEGDLVNIDVS

SEQ ID NO: 1800272 - protein, 18 aa, Staphylococcus epidermidis
IPGKRVIREGDLVNIDVS

SEQ ID NO: 1800273 - protein, 24 aa, Staphylococcus epidermidis
IPGVIQYRNYIGIQFHPEKSGTYG

SEQ ID NO: 1800274 - protein, 20 aa, Staphylococcus epidermidis
IPPKLGVSSFVGYLKGKSSL

SEQ ID NO: 1800275 - protein, 19 aa, Staphylococcus epidermidis
IPTITIGVPLRYMHSNVSV

SEQ ID NO: 1800276 - protein, 18 aa, Staphylococcus epidermidis
IQAGLGRSGKLFATDWDH

SEQ ID NO: 1800277 - protein, 18 aa, Staphylococcus epidermidis
IQAGLGRSGKLFATDWDY

SEQ ID NO: 1800278 - protein, 17 aa, Staphylococcus epidermidis
IQIEGAQLLIDYLSHND

SEQ ID NO: 1800279 - protein, 18 aa, Staphylococcus epidermidis
IQIEGAQLLIDYLSHNDL

SEQ ID NO: 1800280 - protein, 17 aa, Staphylococcus epidermidis
IQIGTDIPFCIYNQTAV

SEQ ID NO: 1800281 - protein, 18 aa, Staphylococcus epidermidis
IQSTKWLINQGVDHFIEI

SEQ ID NO: 1800282 - protein, 18 aa, Staphylococcus epidermidis
IQSWAQWFTDHGITEIHL

SEQ ID NO: 1800283 - protein, 17 aa, Staphylococcus epidermidis
IQYLKDEINELPIVEEF

SEQ ID NO: 1800284 - protein, 18 aa, Staphylococcus epidermidis
IRKCPHPSAIELSKNPAL

SEQ ID NO: 1800285 - protein, 19 aa, Staphylococcus epidermidis
IRNPIKAILLNIDNKDFDM

SEQ ID NO: 1800286 - protein, 20 aa, Staphylococcus epidermidis
IRYLINEVCHKYQIPWVYGA

SEQ ID NO: 1800287 - protein, 26 aa, Staphylococcus epidermidis
ISAMMFKGNASKLGFEPKEGDEVLIE

SEQ ID NO: 1800288 - protein, 17 aa, Staphylococcus epidermidis
ISAQFLFVRELGLIMTQ

SEQ ID NO: 1800289 - protein, 30 aa, Staphylococcus epidermidis; identical to SEQ ID NO: 1652675

SEQ ID NO: 1800290 - protein, 19 aa, Staphylococcus epidermidis
ISKLQYILFLKELDLTLKQ

SEQ ID NO: 1800291 - protein, 17 aa, Staphylococcus epidermidis
ISTDFERMGDNAASIAH

SEQ ID NO: 1800292 - protein, 22 aa, Staphylococcus epidermidis
ISVRIPEELLQFEGQTKSKLGT

SEQ ID NO: 1800293 - protein, 24 aa, Staphylococcus epidermidis
ITELNGLKHFTFKDHNQQKFDIYS

SEQ ID NO: 1800294 - protein, 26 aa, Staphylococcus epidermidis
ITKKEFEIIKLLSLNPQYYFSKEQIY

SEQ ID NO: 1800295 - protein, 17 aa, Staphylococcus epidermidis
ITKNVVIEKCYFGCSDH

SEQ ID NO: 1800296 - protein, 25 aa, Staphylococcus epidermidis
IVEKKLPFLFGEDFSFYGQQLAPSY

SEQ ID NO: 1800297 - protein, 18 aa, Staphylococcus epidermidis
IVQTLQFFNKSLQNIQFS

SEQ ID NO: 1800298 - protein, 19 aa, Staphylococcus epidermidis
IVRSLLGIAVPTQIATHDS

SEQ ID NO: 1800299 - protein, 22 aa, Staphylococcus epidermidis
IVTMAGLINALKIVDKELTDIK

SEQ ID NO: 1800300 - protein, 18 aa, Staphylococcus epidermidis
IYHRVVEMLEEGKAISKI

SEQ ID NO: 1800301 - protein, 19 aa, Staphylococcus epidermidis
IYIEIGSGMGQFITTLAAQ

SEQ ID NO: 1800302 - protein, 20 aa, Staphylococcus epidermidis
IYIEIGSGMGQFITTLAAQY

SEQ ID NO: 1800303 - protein, 25 aa, Staphylococcus epidermidis
IYKGKRKGMPFTQHMVRAHLNHLSK

SEQ ID NO: 1800304 - protein, 26 aa, Staphylococcus epidermidis
KACQLSEAAGAHFVKTSTGFAGGGAT

SEQ ID NO: 1800305 - protein, 20 aa, Staphylococcus epidermidis
KAISKFSIEGKVINFNSIAK

SEQ ID NO: 1800306 - protein, 23 aa, Staphylococcus epidermidis
KARHLYHKLGFKEDATIRLYGHQ

SEQ ID NO: 1800307 - protein, 19 aa, Staphylococcus epidermidis
KASHRGVVSTASYEARAYG

SEQ ID NO: 1800308 - protein, 19 aa, Staphylococcus epidermidis
KCGAELKNRVLMAPMTIQA

SEQ ID NO: 1800309 - protein, 22 aa, Staphylococcus epidermidis
KDELYIIASNLFSYRTKERLKE

SEQ ID NO: 1800310 - protein, 25 aa, Staphylococcus epidermidis
KDFPDIKLGIITPFIGHTQRWNDKN

SEQ ID NO: 1800311 - protein, 25 aa, Staphylococcus epidermidis
KDFPDIKLGIITPFLGHTQRWNDKN

SEQ ID NO: 1800312 - protein, 17 aa, Staphylococcus epidermidis
KDIKDLIINKGRSLIYS

SEQ ID NO: 1800313 - protein, 21 aa, Staphylococcus epidermidis
KDMALRWGKKNNIDVTTSTEL

SEQ ID NO: 1800314 - protein, 21 aa, Staphylococcus epidermidis
KDNFYIFSIEIVFFTYLEPFC

SEQ ID NO: 1800315 - protein, 20 aa, Staphylococcus epidermidis
KDPKYLIGRIIARPYVGEPG

SEQ ID NO: 1800316 - protein, 26 aa, Staphylococcus epidermidis
KDVFKSEGIADVFKHVQVPTLIVAGE

SEQ ID NO: 1800317 - protein, 20 aa, Staphylococcus epidermidis
KEIQSLMAQTTFETTKLPQG

SEQ ID NO: 1800318 - protein, 24 aa, Staphylococcus epidermidis
KELPMEYAVEMNRLIKFEMEGSIG

SEQ ID NO: 1800319 - protein, 30 aa, Staphylococcus epidermidis
KENGYRSLHIVVSIPVFLADSVEVTPVEIQ

SEQ ID NO: 1800320 - protein, 25 aa, Staphylococcus epidermidis
KENRLFYLAMSPKFFGVATNHLKES

SEQ ID NO: 1800321 - protein, 25 aa, Staphylococcus epidermidis
KEWRDFSKDLGYWVDMDSPYITLEN

SEQ ID NO: 1800322 - protein, 21 aa, Staphylococcus epidermidis
KGAAASNHFEGGGFVRSNDDV

SEQ ID NO: 1800323 - protein, 17 aa, Staphylococcus epidermidis
KGGLKLMMETMSMEYAQ

SEQ ID NO: 1800324 - protein, 22 aa, Staphylococcus epidermidis
KGHDAFKLYDTYGFPIELTEEL

SEQ ID NO: 1800325 - protein, 19 aa, Staphylococcus epidermidis
KGRIFCYILDKDQYVIGGP

SEQ ID NO: 1800326 - protein, 19 aa, Staphylococcus epidermidis
KGRQAYVICPLIESSEHLE

SEQ ID NO: 1800327 - protein, 18 aa, Staphylococcus epidermidis
KGSMDFRIKSKGRASHSS

SEQ ID NO: 1800328 - protein, 21 aa, Staphylococcus epidermidis
KGTELDTYYLLDQAIDANVDI

SEQ ID NO: 1800329 - protein, 18 aa, Staphylococcus epidermidis
KHFMKKKQGLLLFSGPTG

SEQ ID NO: 1800330 - protein, 19 aa, Staphylococcus epidermidis
KHHFDCAMIFISHDLTVIN

SEQ ID NO: 1800331 - protein, 22 aa, Staphylococcus epidermidis
KHHYSQRHLKLFENLSDKRTTD

SEQ ID NO: 1800332 - protein, 20 aa, Staphylococcus epidermidis
KINEGALFIPFKGENVDGHR

SEQ ID NO: 1800333 - protein, 27 aa, Staphylococcus epidermidis
KIPFFGICLGHQLFALSQGATSFKMKF

SEQ ID NO: 1800334 - protein, 23 aa, Staphylococcus epidermidis
KKAFQWKNMYVDRDFIFTNHKGN

SEQ ID NO: 1800335 - protein, 17 aa, Staphylococcus epidermidis
KKDEISNTFSFSDTNNN

SEQ ID NO: 1800336 - protein, 26 aa, Staphylococcus epidermidis
KKEIIKRYKYNNIYFYSSIIKEDDIK

SEQ ID NO: 1800337 - protein, 27 aa, Staphylococcus epidermidis
KKGRALDIGCGSGLLVEKLASYYDEVV

SEQ ID NO: 1800338 - protein, 23 aa, Staphylococcus epidermidis
KKGRKIEYLEFIFDAEKRIHNKR

SEQ ID NO: 1800339 - protein, 20 aa, Staphylococcus epidermidis
KKGRQAYVICPLIESSEHLE

SEQ ID NO: 1800340 - protein, 22 aa, Staphylococcus epidermidis
KKITLKDGLLFKKMFIETEDFM

SEQ ID NO: 1800341 - protein, 19 aa, Staphylococcus epidermidis
KKLKAEKIKFDDLKKEQNY

SEQ ID NO: 1800342 - protein, 17 aa, Staphylococcus epidermidis
KKPLIVMVNGMGGTPLS

SEQ ID NO: 1800343 - protein, 24 aa, Staphylococcus epidermidis
KKPRIRIPLSNEILEEFEKIRRGN

SEQ ID NO: 1800344 - protein, 23 aa, Staphylococcus epidermidis
KLAIDQHIPYTVLRDNIYTHPTM

SEQ ID NO: 1800345 - protein, 17 aa, Staphylococcus epidermidis
KLCQVIKQRSIELLIIA

SEQ ID NO: 1800346 - protein, 18 aa, Staphylococcus epidermidis
KLLPGCQFHKMGWAMGVV

SEQ ID NO: 1800347 - protein, 26 aa, Staphylococcus epidermidis
KLNPEYLKLAVMPKCQEDVLHLLEAM

SEQ ID NO: 1800348 - protein, 22 aa, Staphylococcus epidermidis
KLTCVEAAPKMLPMFSDDLVSY

SEQ ID NO: 1800349 - protein, 20 aa, Staphylococcus epidermidis
KLTLENYVLIYYLEKIIFQA

SEQ ID NO: 1800350 - protein, 20 aa, Staphylococcus epidermidis
KLVATELLWFIKGDTNIQYL

SEQ ID NO: 1800351 - protein, 18 aa, Staphylococcus epidermidis
KMDIPDLICVHSEDDLRF

SEQ ID NO: 1800352 - protein, 20 aa, Staphylococcus epidermidis
KNADRIGVWIGSGIGGMETF

SEQ ID NO: 1800353 - protein, 21 aa, Staphylococcus epidermidis
KNADRIGVWIGSGIGGMETFE

SEQ ID NO: 1800354 - protein, 22 aa, Staphylococcus epidermidis
KNEGYNLTFFAFFVKAVAEALK

SEQ ID NO: 1800355 - protein, 22 aa, Staphylococcus epidermidis
KNELKASLNHFFKEMKETVHTQ

SEQ ID NO: 1800356 - protein, 18 aa, Staphylococcus epidermidis
KNGRIVGLGAHLKKGDKH

SEQ ID NO: 1800357 - protein, 19 aa, Staphylococcus epidermidis
KNGRIVGLGAHLKKGDKHA

SEQ ID NO: 1800358 - protein, 20 aa, Staphylococcus epidermidis
KNGSFGFLVIHIPHISEEHF

SEQ ID NO: 1800359 - protein, 27 aa, Staphylococcus epidermidis
KNIPTGRGMVKWAPFATLPEQFETIYQ

SEQ ID NO: 1800360 - protein, 25 aa, Staphylococcus epidermidis
KNKAKAIQALLLWLNEHHFDYSSIA

SEQ ID NO: 1800361 - protein, 24 aa, Staphylococcus epidermidis
KNKAKAIQALLLWLNQHHFDYSSI

SEQ ID NO: 1800362 - protein, 25 aa, Staphylococcus epidermidis
KNKALKCLGLCFNFVNKIEKIDSFL

SEQ ID NO: 1800363 - protein, 27 aa, Staphylococcus epidermidis
KNKKLIIDGTIHWRKEGNNLGFKDTTK

SEQ ID NO: 1800364 - protein, 32 aa, Staphylococcus epidermidis; identical to SEQ ID NO: 1663675

SEQ ID NO: 1800365 - protein, 17 aa, Staphylococcus epidermidis
KNNPIRTFMCDDCKSRL

SEQ ID NO: 1800366 - protein, 19 aa, Staphylococcus epidermidis
KPVGLTINIKYNFLPEKTT

SEQ ID NO: 1800367 - protein, 21 aa, Staphylococcus epidermidis
KRGFNCYDELMIYYIKSLNGL

SEQ ID NO: 1800368 - protein, 17 aa, Staphylococcus epidermidis
KRIIYHRVVEMLEEGKA

SEQ ID NO: 1800369 - protein, 25 aa, Staphylococcus epidermidis
KRINEAGIPIVFVINQIDKHNEEEI

SEQ ID NO: 1800370 - protein, 20 aa, Staphylococcus epidermidis
KRNMVKQLYSPVQFIQSTKW

SEQ ID NO: 1800371 - protein, 17 aa, Staphylococcus epidermidis
KRPIFLKIKRNRYKDIN

SEQ ID NO: 1800372 - protein, 19 aa, Staphylococcus epidermidis
KRYDEHLIIIFKEAELSHK

SEQ ID NO: 1800373 - protein, 21 aa, Staphylococcus epidermidis
KSCDEKVTLLFTGPLTDLAKA

SEQ ID NO: 1800374 - protein, 17 aa, Staphylococcus epidermidis
KSDLIYIYGKFNMVDAE

SEQ ID NO: 1800375 - protein, 23 aa, Staphylococcus epidermidis
KSHSIECYVHIDLIKGLSHDEFA

SEQ ID NO: 1800376 - protein, 30 aa, Staphylococcus epidermidis
KSLKLRPQLHCLKLKFPLDQHSIRKEITPP

SEQ ID NO: 1800377 - protein, 21 aa, Staphylococcus epidermidis
KSRAIPIFVFMNDSFEQLTVW

SEQ ID NO: 1800378 - protein, 17 aa, Staphylococcus epidermidis
KSVVGSSLVKTAIFGED

SEQ ID NO: 1800379 - protein, 17 aa, Staphylococcus epidermidis
KTILCALDVRAYSPDKF

SEQ ID NO: 1800380 - protein, 19 aa, Staphylococcus epidermidis
KTKRYTQTYIQRVLMNVLL

SEQ ID NO: 1800381 - protein, 17 aa, Staphylococcus epidermidis
KTLKRRVMELEKENKKL

SEQ ID NO: 1800382 - protein, 17 aa, Staphylococcus epidermidis
KTLTATMPLYLNALTGK

SEQ ID NO: 1800383 - protein, 18 aa, Staphylococcus epidermidis
KTLTATMPLYLNALTGKG

SEQ ID NO: 1800384 - protein, 24 aa, Staphylococcus epidermidis
KTQLLKWHIELPKVVKLQKDIEKK

SEQ ID NO: 1800385 - protein, 24 aa, Staphylococcus epidermidis
KTQQSFTRYGCSYVPMDETLARTV

SEQ ID NO: 1800386 - protein, 17 aa, Staphylococcus epidermidis
KVEFGDFNQLKAAINKN

SEQ ID NO: 1800387 - protein, 17 aa, Staphylococcus epidermidis
KVNIMIGLLSRPKILIL

SEQ ID NO: 1800388 - protein, 19 aa, Staphylococcus epidermidis
KWYAEKDFASLLHEDLKIR

SEQ ID NO: 1800389 - protein, 24 aa, Staphylococcus epidermidis
KYFEYKHILLATGFYNQLLTQPLI

SEQ ID NO: 1800390 - protein, 24 aa, Staphylococcus epidermidis
KYINRFNSKLSFFIFCENQIKLYL

SEQ ID NO: 1800391 - protein, 19 aa, Staphylococcus epidermidis
KYIPNERIKVYVNKVEQTT

SEQ ID NO: 1800392 - protein, 23 aa, Staphylococcus epidermidis
KYLEKEVQIYTSLIVREDAQLLY

SEQ ID NO: 1800393 - protein, 23 aa, Staphylococcus epidermidis
KYYEEGYINFIELIVHRIDSINY

SEQ ID NO: 1800394 - protein, 19 aa, Staphylococcus epidermidis
LAHGDLLIITRETFFNHAY

SEQ ID NO: 1800395 - protein, 22 aa, Staphylococcus epidermidis
LAIDQHIPYTVLRDNIYTHPTM

SEQ ID NO: 1800396 - protein, 17 aa, Staphylococcus epidermidis
LAQNFSACRALVSEGIQ

SEQ ID NO: 1800397 - protein, 17 aa, Staphylococcus epidermidis
LAVNRTFTNAQGEREAD

SEQ ID NO: 1800398 - protein, 19 aa, Staphylococcus epidermidis
LDDAKDCLQKGAFVSDKDG

SEQ ID NO: 1800399 - protein, 22 aa, Staphylococcus epidermidis
LDFELGQTVSFGIKTEDAHFFD

SEQ ID NO: 1800400 - protein, 18 aa, Staphylococcus epidermidis
LDGFRKVEFGDFNQLKAA

SEQ ID NO: 1800401 - protein, 21 aa, Staphylococcus epidermidis
LDKCDEAGVYGLIIPDLPYEL

SEQ ID NO: 1800402 - protein, 19 aa, Staphylococcus epidermidis
LDLQILLWHMVEKKDNQPH

SEQ ID NO: 1800403 - protein, 17 aa, Staphylococcus epidermidis
LDNIAPVFIDIENQKAF

SEQ ID NO: 1800404 - protein, 21 aa, Staphylococcus epidermidis
LDPERAHGLTINALKCVQKCS

SEQ ID NO: 1800405 - protein, 23 aa, Staphylococcus epidermidis
LDPERAHGLTINALKCVQKCSPI

SEQ ID NO: 1800406 - protein, 17 aa, Staphylococcus epidermidis
LDTESLLGFKTIQTNEE

SEQ ID NO: 1800407 - protein, 26 aa, Staphylococcus epidermidis
LEASGKIKKLLCILKEQVPNCDNQFL

SEQ ID NO: 1800408 - protein, 22 aa, Staphylococcus epidermidis
LEDLKKFLELFNELASKVTKTS

SEQ ID NO: 1800409 - protein, 18 aa, Staphylococcus epidermidis
LEIYEYVHQILPLSRKRE

SEQ ID NO: 1800410 - protein, 28 aa, Staphylococcus epidermidis
LEVAHYFKRLFSQYGIRSHIDTVTDGRA

SEQ ID NO: 1800411 - protein, 19 aa, Staphylococcus epidermidis
LFGGPLYTFHKIFSIITLS

SEQ ID NO: 1800412 - protein, 17 aa, Staphylococcus epidermidis
LFHLFAAFAEFERNLIL

SEQ ID NO: 1800413 - protein, 23 aa, Staphylococcus epidermidis
LFKNKEQLFYVAYEIKGEKVYYK

SEQ ID NO: 1800414 - protein, 22 aa, Staphylococcus epidermidis
LFKRLKHKTSINVHPHLFRHTH

SEQ ID NO: 1800415 - protein, 18 aa, Staphylococcus epidermidis
LGAINVHASLLPKYRGGA

SEQ ID NO: 1800416 - protein, 19 aa, Staphylococcus epidermidis
LGAINVHASLLPKYRGGAP

SEQ ID NO: 1800417 - protein, 20 aa, Staphylococcus epidermidis
LGEQFFKDNFSLNVKATNVV

SEQ ID NO: 1800418 - protein, 21 aa, Staphylococcus epidermidis
LGEQFFKDNFSLNVKATNVVG

SEQ ID NO: 1800419 - protein, 37 aa, Staphylococcus epidermidis
LGGRGVSYCAVCDGAFFKNKRLFVIGGGDSAVEEGTF

SEQ ID NO: 1800420 - protein, 24 aa, Staphylococcus epidermidis
LGIEKYKPHIAIITNIYSAHLDYH

SEQ ID NO: 1800421 - protein, 17 aa, Staphylococcus epidermidis
LGKIPFFGICLGHQLFA

SEQ ID NO: 1800422 - protein, 29 aa, Staphylococcus epidermidis
LGKIPFFGICLGHQLFALSQGATSFKMKF

SEQ ID NO: 1800423 - protein, 19 aa, Staphylococcus epidermidis
LGKTFSKGLLMGARGNSGV

SEQ ID NO: 1800424 - protein, 22 aa, Staphylococcus epidermidis
LGSGHAAWHAALTLKQSGKQVA

SEQ ID NO: 1800425 - protein, 20 aa, Staphylococcus epidermidis
LGVTLFKRSGRNIILTVEGR

SEQ ID NO: 1800426 - protein, 27 aa, Staphylococcus epidermidis
LGYSMGGRVALYYAIHGNETLSGLLLE

SEQ ID NO: 1800427 - protein, 28 aa, Staphylococcus epidermidis
LHEYIHGRKAPKLDGVRFSVLALGDQTY

SEQ ID NO: 1800428 - protein, 25 aa, Staphylococcus epidermidis
LHFYPRQQIHLILSAYSRMKSLKLQ

SEQ ID NO: 1800429 - protein, 25 aa, Staphylococcus epidermidis
LHFYPRQQIHLILSAYSRMKSLKLR

SEQ ID NO: 1800430 - protein, 23 aa, Staphylococcus epidermidis
LHSAIKVKVLVDYRLKLKNTRAI

SEQ ID NO: 1800431 - protein, 18 aa, Staphylococcus epidermidis
LIEYLCKNHEEIFVKLFS

SEQ ID NO: 1800432 - protein, 19 aa, Staphylococcus epidermidis
LIEYLCKNHEEIFVKLFSL

SEQ ID NO: 1800433 - protein, 23 aa, Staphylococcus epidermidis
LIKGENVMNGYLYPKYLKDTFDN

SEQ ID NO: 1800434 - protein, 24 aa, Staphylococcus epidermidis
LIQYKDNLICLANEFKEALNKPLF

SEQ ID NO: 1800435 - protein, 18 aa, Staphylococcus epidermidis
LIVYIFKGKEFIPDSYTR

SEQ ID NO: 1800436 - protein, 23 aa, Staphylococcus epidermidis
LKDKNIDVLYTFGKEASYIHDSG

SEQ ID NO: 1800437 - protein, 23 aa, Staphylococcus epidermidis
LKDKNIDVLYTFGKEASYIYDSG

SEQ ID NO: 1800438 - protein, 17 aa, Staphylococcus epidermidis
LKEYINHSVPKVMGVDY

SEQ ID NO: 1800439 - protein, 21 aa, Staphylococcus epidermidis
LKGENTFKVSAYRKAAQSLEV

SEQ ID NO: 1800440 - protein, 18 aa, Staphylococcus epidermidis
LKKKRERDKTGLALVEGI

SEQ ID NO: 1800441 - protein, 24 aa, Staphylococcus epidermidis
LKQFMEFYENFYFDGEEWDKDVWD

SEQ ID NO: 1800442 - protein, 24 aa, Staphylococcus epidermidis
LKSHSIECYVHIDLIKGLSHDEFA

SEQ ID NO: 1800443 - protein, 17 aa, Staphylococcus epidermidis
LKVIAIEDFETGKKTDL

SEQ ID NO: 1800444 - protein, 20 aa, Staphylococcus epidermidis
LKVPAEVGLTEYNHSVNIEP

SEQ ID NO: 1800445 - protein, 17 aa, Staphylococcus epidermidis
LKYGQYNVDGHKYIVAQ

SEQ ID NO: 1800446 - protein, 25 aa, Staphylococcus epidermidis
LKYIIPELQRRALFKNSYNQSTLRT

SEQ ID NO: 1800447 - protein, 23 aa, Staphylococcus epidermidis
LLGYGDMLYLGSGMNKPIRVQGT

SEQ ID NO: 1800448 - protein, 24 aa, Staphylococcus epidermidis
LLQRQFKASCPMEVLTTDITYLPF

SEQ ID NO: 1800449 - protein, 18 aa, Staphylococcus epidermidis
LMNHLVDISIDYVVAQVE

SEQ ID NO: 1800450 - protein, 19 aa, Staphylococcus epidermidis
LMPDANIAVAHGQMTERDL

SEQ ID NO: 1800451 - protein, 17 aa, Staphylococcus epidermidis
LNASIYVSGESDDTLGY

SEQ ID NO: 1800452 - protein, 17 aa, Staphylococcus epidermidis
LNAYVSFLETVPKEIIE

SEQ ID NO: 1800453 - protein, 20 aa, Staphylococcus epidermidis
LNKLNCWGGAIATGHPYGAS

SEQ ID NO: 1800454 - protein, 21 aa, Staphylococcus epidermidis
LNKLNCWGGAIATGHPYGASG

SEQ ID NO: 1800455 - protein, 18 aa, Staphylococcus epidermidis
LNSLDLVIPNGMFGILGR

SEQ ID NO: 1800456 - protein, 17 aa, Staphylococcus epidermidis
LNSSAYYKYLSKKIGSI

SEQ ID NO: 1800457 - protein, 20 aa, Staphylococcus epidermidis
LNVGCIPSKALLHASHRFVE

SEQ ID NO: 1800458 - protein, 19 aa, Staphylococcus epidermidis
LPMETSVLIPTNDISRHVN

SEQ ID NO: 1800459 - protein, 28 aa, Staphylococcus epidermidis
LPVVNRRAVDWAMRASMALNMDIATNSK

SEQ ID NO: 1800460 - protein, 28 aa, Staphylococcus epidermidis
LQLASHAQYRLGIRPEDLHLVNDNEISN

SEQ ID NO: 1800461 - protein, 17 aa, Staphylococcus epidermidis
LRDNVSPVYDRHEKTEK

SEQ ID NO: 1800462 - protein, 17 aa, Staphylococcus epidermidis
LRKFPQHHFEFTYIDIR

SEQ ID NO: 1800463 - protein, 19 aa, Staphylococcus epidermidis
LRSNMRSEIIKIHKQMKAT

SEQ ID NO: 1800464 - protein, 17 aa, Staphylococcus epidermidis
LSSFQLLGIEKYKPHIA

SEQ ID NO: 1800465 - protein, 17 aa, Staphylococcus epidermidis
LSVGATIVKDNRIIAGG

SEQ ID NO: 1800466 - protein, 20 aa, Staphylococcus epidermidis
LTDIKVVLNGAGAAGIAIVK

SEQ ID NO: 1800467 - protein, 17 aa, Staphylococcus epidermidis
LTLCPKEKSGKLVRTLR

SEQ ID NO: 1800468 - protein, 25 aa, Staphylococcus epidermidis
LTTLSRLVAPFVPFISEKIHYNLTG

SEQ ID NO: 1800469 - protein, 19 aa, Staphylococcus epidermidis
LVIPNGMFGILGRNGSGKS

SEQ ID NO: 1800470 - protein, 25 aa, Staphylococcus epidermidis
LVRRIVKRTGIEFTSHMLRHTHATQ

SEQ ID NO: 1800471 - protein, 26 aa, Staphylococcus epidermidis
LWEDKLECQRTINAFIPKAHIVKISD

SEQ ID NO: 1800472 - protein, 27 aa, Staphylococcus epidermidis
LWEDKLECQRTINAFIPKAHIVKISDE

SEQ ID NO: 1800473 - protein, 21 aa, Staphylococcus epidermidis
LYKEIIKQFHIDRLKWKDLFN

SEQ ID NO: 1800474 - protein, 23 aa, Staphylococcus epidermidis
LYKEIIKQFHIDRLKWRDLFNDF

SEQ ID NO: 1800475 - protein, 19 aa, Staphylococcus epidermidis
LYKEREMSVGYQYGQDTAE

SEQ ID NO: 1800476 - protein, 17 aa, Staphylococcus epidermidis
LYTELGKITDIVNRMAM

SEQ ID NO: 1800477 - protein, 24 aa, Staphylococcus epidermidis
MAEKVKKGFIDKGYQVYFDSPTNQ

SEQ ID NO: 1800478 - protein, 22 aa, Staphylococcus epidermidis
MAPFSIELCGGIHVNNTAEIGL

SEQ ID NO: 1800479 - protein, 17 aa, Staphylococcus epidermidis
MEKELFIEGSYIYYLGS

SEQ ID NO: 1800480 - protein, 20 aa, Staphylococcus epidermidis
MIGGHGLKTALTDAGLSIKN

SEQ ID NO: 1800481 - protein, 20 aa, Staphylococcus epidermidis
MIRQNLNPVIFVINNDGYTV

SEQ ID NO: 1800482 - protein, 17 aa, Staphylococcus epidermidis
MKARTRYQNTVINIYSS

SEQ ID NO: 1800483 - protein, 24 aa, Staphylococcus epidermidis
MPKIIEIIQSVGLPKEILKRKVYT

SEQ ID NO: 1800484 - protein, 22 aa, Staphylococcus epidermidis
MRDNCTVCHAVLPQIQDLLKDY

SEQ ID NO: 1800485 - protein, 23 aa, Staphylococcus epidermidis
MRDNCTVCHAVLPQIQDLLKDYP

SEQ ID NO: 1800486 - protein, 17 aa, Staphylococcus epidermidis
MTELRKKALKLTETLEM

SEQ ID NO: 1800487 - protein, 18 aa, Staphylococcus epidermidis
MVDWNIGRNRYWGTPLNV

SEQ ID NO: 1800488 - protein, 19 aa, Staphylococcus epidermidis
NAHMIKWSKLYVDDFQSSW

SEQ ID NO: 1800489 - protein, 19 aa, Staphylococcus epidermidis
NCVYCYNYAIWLIQNGLSH

SEQ ID NO: 1800490 - protein, 31 aa, Staphylococcus epidermidis
NDSIDPSVIFSRFKNYYEFLIKNKIIENELS

SEQ ID NO: 1800491 - protein, 18 aa, Staphylococcus epidermidis
NEATNFKAKIEVVSTLFS

SEQ ID NO: 1800492 - protein, 28 aa, Staphylococcus epidermidis
NEISTDYLLCKAFGKTATNIEKYTSQGT

SEQ ID NO: 1800493 - protein, 18 aa, Staphylococcus epidermidis
NESIPLDLQILLWHMVEK

SEQ ID NO: 1800494 - protein, 17 aa, Staphylococcus epidermidis
NFKKKICNGQKFHKKVL

SEQ ID NO: 1800495 - protein, 22 aa, Staphylococcus epidermidis
NFLDFIKTYSIHLSSSRLVSGN

SEQ ID NO: 1800496 - protein, 30 aa, Staphylococcus epidermidis
NFTWASPIMSRPVKNMTVAIIGTGRIGAAT

SEQ ID NO: 1800497 - protein, 23 aa, Staphylococcus epidermidis
NHTLRYYVCPKNMNASRFVCDFK

SEQ ID NO: 1800498 - protein, 17 aa, Staphylococcus epidermidis
NKEEVPIEWLKRYDEHL

SEQ ID NO: 1800499 - protein, 23 aa, Staphylococcus epidermidis
NKIIKFEGCYHGHSDSLLIKAGS

SEQ ID NO: 1800500 - protein, 25 aa, Staphylococcus epidermidis
NKIKLHPAVCFTMLGHFLGVDVESI

SEQ ID NO: 1800501 - protein, 24 aa, Staphylococcus epidermidis
NKKPIKRLWISSVTKKAIQEGFKQ

SEQ ID NO: 1800502 - protein, 25 aa, Staphylococcus epidermidis
NKKPIKRLWISSVTKKAIQEGFKQL

SEQ ID NO: 1800503 - protein, 27 aa, Staphylococcus epidermidis
NKWTSSWGDLFIKSRMDKLCSEIYKKR

SEQ ID NO: 1800504 - protein, 23 aa, Staphylococcus epidermidis
NLDKGVAFGAMFADSEDLMHQKN

SEQ ID NO: 1800505 - protein, 24 aa, Staphylococcus epidermidis
NLEKLKIAVHYGADAVFLGGQEYG

SEQ ID NO: 1800506 - protein, 21 aa, Staphylococcus epidermidis
NLIGYPRDEWVFPIQTHDSRI

SEQ ID NO: 1800507 - protein, 21 aa, Staphylococcus epidermidis
NLLESIYTLALAKSHRTSNDK

SEQ ID NO: 1800508 - protein, 25 aa, Staphylococcus epidermidis
NMAPEYGATCGFFPVDEESLKYMKL

SEQ ID NO: 1800509 - protein, 23 aa, Staphylococcus epidermidis
NMAPFSIELCGGIHVNNTAEIGL

SEQ ID NO: 1800510 - protein, 21 aa, Staphylococcus epidermidis
NNGYKVAICEQMEDPKQTKGM

SEQ ID NO: 1800511 - protein, 17 aa, Staphylococcus epidermidis
NNITFVPYFPLASGILA

SEQ ID NO: 1800512 - protein, 23 aa, Staphylococcus epidermidis
NNKYLPQREIVSIKDFESRIQAW

SEQ ID NO: 1800513 - protein, 20 aa, Staphylococcus epidermidis
NPNYCGRVNNQYGQFDNMFP

SEQ ID NO: 1800514 - protein, 25 aa, Staphylococcus epidermidis
NPSLIISFYPKFAVHPDHEATAEAV

SEQ ID NO: 1800515 - protein, 18 aa, Staphylococcus epidermidis
NQFLEYIAQIYIEDERFV

SEQ ID NO: 1800516 - protein, 23 aa, Staphylococcus epidermidis
NRIKRYIAKYTINPAITHGISDY

SEQ ID NO: 1800517 - protein, 17 aa, Staphylococcus epidermidis
NRLELIHQWINGRMPLI

SEQ ID NO: 1800518 - protein, 17 aa, Staphylococcus epidermidis
NSADSFRDLIKILVELE

SEQ ID NO: 1800519 - protein, 18 aa, Staphylococcus epidermidis
NSADSFRDLIKILVELEQ

SEQ ID NO: 1800520 - protein, 17 aa, Staphylococcus epidermidis
NSLHLLKQRVKSSKNST

SEQ ID NO: 1800521 - protein, 26 aa, Staphylococcus epidermidis
NVELTKYLFFTGKGGVGKTTISSFIA

SEQ ID NO: 1800522 - protein, 26 aa, Staphylococcus epidermidis
NVITEYCFVRPIYLFLNQMNSCDTWL

SEQ ID NO: 1800523 - protein, 28 aa, Staphylococcus epidermidis
NVNFLRKRYETLKTLPMFDTIEYTEDME

SEQ ID NO: 1800524 - protein, 25 aa, Staphylococcus epidermidis
NVNFLRKRYETLRTLPMFDTIEYTE

SEQ ID NO: 1800525 - protein, 24 aa, Staphylococcus epidermidis
NVSKSWLYKEHDIRQRIESLRERQ

SEQ ID NO: 1800526 - protein, 22 aa, Staphylococcus epidermidis
NYDEFYQQMLIKMWQLTLDFDE

SEQ ID NO: 1800527 - protein, 22 aa, Staphylococcus epidermidis
NYMKPREFCLVSVLDGQGKLIV

SEQ ID NO: 1800528 - protein, 19 aa, Staphylococcus epidermidis
PAGNKYIMRHMKVLSKAKV

SEQ ID NO: 1800529 - protein, 25 aa, Staphylococcus epidermidis
PDILRARPKPVVQWSDEVVEETADV

SEQ ID NO: 1800530 - protein, 25 aa, Staphylococcus epidermidis
PDILRARPKPVVQWSDEVVEETTDV

SEQ ID NO: 1800531 - protein, 18 aa, Staphylococcus epidermidis
PEGAAALLWKDSNLAQIA

SEQ ID NO: 1800532 - protein, 21 aa, Staphylococcus epidermidis
PEGLVPLLKIQGLGSKKIAKL

SEQ ID NO: 1800533 - protein, 17 aa, Staphylococcus epidermidis
PELKYGQYNVDGHKYIV

SEQ ID NO: 1800534 - protein, 19 aa, Staphylococcus epidermidis
PEVRMPKVGGRVMSLQDPT

SEQ ID NO: 1800535 - protein, 18 aa, Staphylococcus epidermidis
PFYDRWDHEIFIKYLKFF

SEQ ID NO: 1800536 - protein, 19 aa, Staphylococcus epidermidis
PGQEIEFFGPEIDSFKQVV

SEQ ID NO: 1800537 - protein, 19 aa, Staphylococcus epidermidis
PHRIFDFFNAFIGTHDFDT

SEQ ID NO: 1800538 - protein, 17 aa, Staphylococcus epidermidis
PHVAGVRIEDDILVTEN

SEQ ID NO: 1800539 - protein, 28 aa, Staphylococcus epidermidis
PKKAKRIVHRFSQKWLRKPTGKLTIQRE

SEQ ID NO: 1800540 - protein, 21 aa, Staphylococcus epidermidis
PLDQLKQVTGYVRGGCSPIGM

SEQ ID NO: 1800541 - protein, 26 aa, Staphylococcus epidermidis
PLSNERVVPVKGIRKAIAQNMVTSVS

SEQ ID NO: 1800542 - protein, 19 aa, Staphylococcus epidermidis
PMEWGWKQFTDQIALKRLS

SEQ ID NO: 1800543 - protein, 20 aa, Staphylococcus epidermidis
PNGYCRLPVVAGGCPHANAC

SEQ ID NO: 1800544 - protein, 18 aa, Staphylococcus epidermidis
PNVEDIALRNQLEDWLDT

SEQ ID NO: 1800545 - protein, 17 aa, Staphylococcus epidermidis
PQELVIIGGGYIALEFA

SEQ ID NO: 1800546 - protein, 23 aa, Staphylococcus epidermidis
PRAKPRFIDEFVLEQLNSHLDKL

SEQ ID NO: 1800547 - protein, 32 aa, Staphylococcus epidermidis; identical to SEQ ID NO: 1662126

SEQ ID NO: 1800548 - protein, 24 aa, Staphylococcus epidermidis
PSEIKYWAELKGVFDTLNVEMPIV

SEQ ID NO: 1800549 - protein, 21 aa, Staphylococcus epidermidis
PSHIKEGRMGNFLENMVDWNI

SEQ ID NO: 1800550 - protein, 22 aa, Staphylococcus epidermidis
PSMVQKRLRTMPSNYEQPHRVE

SEQ ID NO: 1800551 - protein, 25 aa, Staphylococcus epidermidis
PTEAQWEAMLLGWKVVSAVKSNAVI

SEQ ID NO: 1800552 - protein, 25 aa, Staphylococcus epidermidis
PVDKVPRVLGFDAVGVIEKIGDQVS

SEQ ID NO: 1800553 - protein, 19 aa, Staphylococcus epidermidis
PYKLEIDMLKSQKFDPELK

SEQ ID NO: 1800554 - protein, 18 aa, Staphylococcus epidermidis
QAASLPLTGLTAYETLFD

SEQ ID NO: 1800555 - protein, 25 aa, Staphylococcus epidermidis
QAFDRLKLNIFISLAELESDNIGEQ

SEQ ID NO: 1800556 - protein, 20 aa, Staphylococcus epidermidis
QEATQIGMAYAMQKGDISSP

SEQ ID NO: 1800557 - protein, 22 aa, Staphylococcus epidermidis
QEATQIGMAYAMQKGDISSPYY

SEQ ID NO: 1800558 - protein, 17 aa, Staphylococcus epidermidis
QELPPNVLIMNNYTDSA

SEQ ID NO: 1800559 - protein, 22 aa, Staphylococcus epidermidis
QGGGPIGYYRLDINKKPVGLTI

SEQ ID NO: 1800560 - protein, 17 aa, Staphylococcus epidermidis
QGRFRQNLLGKRVDYSG

SEQ ID NO: 1800561 - protein, 18 aa, Staphylococcus epidermidis
QGVKLIACTMSMDVMGIS

SEQ ID NO: 1800562 - protein, 24 aa, Staphylococcus epidermidis
QHEPEIWNRVDVFMLPKDYLRYCL

SEQ ID NO: 1800563 - protein, 24 aa, Staphylococcus epidermidis
QHEPEIWSRVDVFMLPKDYLRYCL

SEQ ID NO: 1800564 - protein, 20 aa, Staphylococcus epidermidis
QHIPEIVQTLQFFNKSLQNI

SEQ ID NO: 1800565 - protein, 23 aa, Staphylococcus epidermidis
QKIEVNEKIKLFNSDEMMGKDAF

SEQ ID NO: 1800566 - protein, 23 aa, Staphylococcus epidermidis
QLEHHLDMLNARHQAMNDMVRND

SEQ ID NO: 1800567 - protein, 22 aa, Staphylococcus epidermidis
QLIIKKRVKVNHTIIDSTDFQL

SEQ ID NO: 1800568 - protein, 18 aa, Staphylococcus epidermidis
QLIIKKRVKVNHTVIDST

SEQ ID NO: 1800569 - protein, 22 aa, Staphylococcus epidermidis
QLIWNDGRYNMVEFQEEMKYKR

SEQ ID NO: 1800570 - protein, 22 aa, Staphylococcus epidermidis
QNEGYNLTFFAFFVKAVAEALK

SEQ ID NO: 1800571 - protein, 19 aa, Staphylococcus epidermidis
QNIKNIILNYLIEFNLSTD

SEQ ID NO: 1800572 - protein, 23 aa, Staphylococcus epidermidis
QNLQRALGLLLMVEMDIKMLKKV

SEQ ID NO: 1800573 - protein, 20 aa, Staphylococcus epidermidis
QPMEWGWKQFTDQIALKRLS

SEQ ID NO: 1800574 - protein, 20 aa, Staphylococcus epidermidis
QREFSVYVYEAEIVYLTLHI

SEQ ID NO: 1800575 - protein, 23 aa, Staphylococcus epidermidis
QRLKEFFNFLDMKFKQVQRVHQL

SEQ ID NO: 1800576 - protein, 17 aa, Staphylococcus epidermidis
QRLRKSKNVTMRNDPDG

SEQ ID NO: 1800577 - protein, 22 aa, Staphylococcus epidermidis
QSLKVAHGLQVDRLLRQNEEIK

SEQ ID NO: 1800578 - protein, 17 aa, Staphylococcus epidermidis
QTFHIQPEMGLLNDPNG

SEQ ID NO: 1800579 - protein, 18 aa, Staphylococcus epidermidis
QTFHIQPEMGLLNDPNGL

SEQ ID NO: 1800580 - protein, 18 aa, Staphylococcus epidermidis
QVKMKAVLHNEAIKNVLQ

SEQ ID NO: 1800581 - protein, 23 aa, Staphylococcus epidermidis
QVVIRCFFVYFKMITKEEALTTE

SEQ ID NO: 1800582 - protein, 17 aa, Staphylococcus epidermidis
QYLNRQGVTIIMATHSQ

SEQ ID NO: 1800583 - protein, 25 aa, Staphylococcus epidermidis
QYLSRRRIRHIVGYVPQDIALFEHM

SEQ ID NO: 1800584 - protein, 20 aa, Staphylococcus epidermidis
RAKLAKSRAESHLEDDDDNT

SEQ ID NO: 1800585 - protein, 19 aa, Staphylococcus epidermidis
RAKLAKSRAESHLEEDDDN

SEQ ID NO: 1800586 - protein, 30 aa, Staphylococcus epidermidis
RATLKRLPLYYRFVSILKGKGIDRVNSKTI

SEQ ID NO: 1800587 - protein, 30 aa, Staphylococcus epidermidis
RATLKRLPLYYRLVSILKGKGIDRVNSKTI

SEQ ID NO: 1800588 - protein, 18 aa, Staphylococcus epidermidis
RAYYCLVDTQANQNMIEH

SEQ ID NO: 1800589 - protein, 23 aa, Staphylococcus epidermidis
RDIAEINGFWVYHNTKNKQFTVN

SEQ ID NO: 1800590 - protein, 21 aa, Staphylococcus epidermidis
RDKGTWIINSVMNIQKKGQAM

SEQ ID NO: 1800591 - protein, 21 aa, Staphylococcus epidermidis
RDRLKCYLEPLRLNLNDYRVM

SEQ ID NO: 1800592 - protein, 24 aa, Staphylococcus epidermidis
REDEDVIEFFVLFNHFKIHKTEKY

SEQ ID NO: 1800593 - protein, 17 aa, Staphylococcus epidermidis
REMGDYLIVALSTDEFN

SEQ ID NO: 1800594 - protein, 17 aa, Staphylococcus epidermidis
RFSCDVMSLEVRIDNDV

SEQ ID NO: 1800595 - protein, 21 aa, Staphylococcus epidermidis
RGGGSIEDLWNFNEEDVVKTI

SEQ ID NO: 1800596 - protein, 19 aa, Staphylococcus epidermidis
RIGEVLSLRIDDIKFDFRK

SEQ ID NO: 1800597 - protein, 19 aa, Staphylococcus epidermidis
RISSEILIKAAKIDVEIIL

SEQ ID NO: 1800598 - protein, 26 aa, Staphylococcus epidermidis
RKFTSVEIDLFFAMCNKLKEQDTNKL

SEQ ID NO: 1800599 - protein, 20 aa, Staphylococcus epidermidis
RKGYRGECDDKWEGLYSKVK

SEQ ID NO: 1800600 - protein, 17 aa, Staphylococcus epidermidis
RKIPRKYLNPKIPQGRG

SEQ ID NO: 1800601 - protein, 40 aa, Staphylococcus epidermidis
RKKRQKVSMIFQHFNLLWSRSVLKNVTFPLEIAGVPSGLA

SEQ ID NO: 1800602 - protein, 17 aa, Staphylococcus epidermidis
RLGEFKSIDVFKQAKGR

SEQ ID NO: 1800603 - protein, 19 aa, Staphylococcus epidermidis
RLHDFRWEASILSQSIKDL

SEQ ID NO: 1800604 - protein, 19 aa, Staphylococcus epidermidis
RLIKAGAFDKYPIEAVFGF

SEQ ID NO: 1800605 - protein, 25 aa, Staphylococcus epidermidis
RLKWKDLFNDFEMHFYRYVFPYYDT

SEQ ID NO: 1800606 - protein, 17 aa, Staphylococcus epidermidis
RLLHAIFGEKAREVRDT

SEQ ID NO: 1800607 - protein, 18 aa, Staphylococcus epidermidis
RLNNKKAFQIEFGQKGTN

SEQ ID NO: 1800608 - protein, 19 aa, Staphylococcus epidermidis
RLNNKKAFQIEFGQKGTNL

SEQ ID NO: 1800609 - protein, 19 aa, Staphylococcus epidermidis
RLQGFDARIIYHNRKRDLN

SEQ ID NO: 1800610 - protein, 19 aa, Staphylococcus epidermidis
RMGSMGKGIPGSFVTVIDD

SEQ ID NO: 1800611 - protein, 20 aa, Staphylococcus epidermidis
RMGSMGKGIPGSFVTVIDDD

SEQ ID NO: 1800612 - protein, 24 aa, Staphylococcus epidermidis
RNLDKGVAFGAMFADSEDLMHQKN

SEQ ID NO: 1800613 - protein, 24 aa, Staphylococcus epidermidis
RNPFKSGTETFVYETLDYDKMNKA

SEQ ID NO: 1800614 - protein, 17 aa, Staphylococcus epidermidis
RNVILTLARMWQTVTTG

SEQ ID NO: 1800615 - protein, 17 aa, Staphylococcus epidermidis
RNYLESMATDFKVNGLF

SEQ ID NO: 1800616 - protein, 27 aa, Staphylococcus epidermidis
RPNGWLLHIPSCYLGIAQAARDYAVDF

SEQ ID NO: 1800617 - protein, 17 aa, Staphylococcus epidermidis
RQGKQLLAYLGAPKHLY

SEQ ID NO: 1800618 - protein, 17 aa, Staphylococcus epidermidis
RQNLLGKRVDYSGRSVI

SEQ ID NO: 1800619 - protein, 22 aa, Staphylococcus epidermidis
RRERGITFGLFRLSVGLENPEE

SEQ ID NO: 1800620 - protein, 26 aa, Staphylococcus epidermidis
RSVKSCVGKEFCRFGTQYTTRLGIRL

SEQ ID NO: 1800621 - protein, 28 aa, Staphylococcus epidermidis
RSVKSCVGKEFCRFGTQYTTRLGIRLEK

SEQ ID NO: 1800622 - protein, 22 aa, Staphylococcus epidermidis
RTLGRLKPLLNEGTVTVGNSCK

SEQ ID NO: 1800623 - protein, 22 aa, Staphylococcus epidermidis
RVKFEKVFADHFLKLYDKTKNR

SEQ ID NO: 1800624 - protein, 19 aa, Staphylococcus epidermidis
RWAGVPFYIRTGKRMKSKT

SEQ ID NO: 1800625 - protein, 19 aa, Staphylococcus epidermidis
RYAKEQGYRTIVAGIDASN

SEQ ID NO: 1800626 - protein, 19 aa, Staphylococcus epidermidis
RYVFKDGKLIIISYKLFKN

SEQ ID NO: 1800627 - protein, 18 aa, Staphylococcus epidermidis
SAEEIGLDLNYTIEELIE

SEQ ID NO: 1800628 - protein, 34 aa, Staphylococcus epidermidis
SAKAWDNRYGCVLAIEILELLKDVQLDVDLYVGA

SEQ ID NO: 1800629 - protein, 19 aa, Staphylococcus epidermidis
SANGYRYYNVQDISKLQYI

SEQ ID NO: 1800630 - protein, 21 aa, Staphylococcus epidermidis
SATVTHWFINFYNLIMEERFG

SEQ ID NO: 1800631 - protein, 19 aa, Staphylococcus epidermidis
SCDILRKVMLENKKAFQWK

SEQ ID NO: 1800632 - protein, 19 aa, Staphylococcus epidermidis
SCDTWLARFDWHQPHTSYF

SEQ ID NO: 1800633 - protein, 28 aa, Staphylococcus epidermidis
SDDYRYFPEPDIVPLYVDEDWKARVRET

SEQ ID NO: 1800634 - protein, 22 aa, Staphylococcus epidermidis
SDGKLKPAILKKVDNYVSHVTI

SEQ ID NO: 1800635 - protein, 17 aa, Staphylococcus epidermidis
SDGLIVLSGQSGVGKST

SEQ ID NO: 1800636 - protein, 18 aa, Staphylococcus epidermidis
SDKTAFFLNGYVNEYDDT

SEQ ID NO: 1800637 - protein, 19 aa, Staphylococcus epidermidis
SDKTAFFLNGYVNEYDDTD

SEQ ID NO: 1800638 - protein, 25 aa, Staphylococcus epidermidis
SDQIFIQTWHGFPLKKMVNDLNEQH

SEQ ID NO: 1800639 - protein, 20 aa, Staphylococcus epidermidis
SEIFTNKAFDGFKVEQVDNL

SEQ ID NO: 1800640 - protein, 21 aa, Staphylococcus epidermidis
SELCTLKKGCLLEDKDGDFFL

SEQ ID NO: 1800641 - protein, 19 aa, Staphylococcus epidermidis
SELMFQSQINYFFEHNHSL

SEQ ID NO: 1800642 - protein, 17 aa, Staphylococcus epidermidis
SEPRIKINAGSVGIANN

SEQ ID NO: 1800643 - protein, 19 aa, Staphylococcus epidermidis
SEQTRLKILPIIDNPNEEI

SEQ ID NO: 1800644 - protein, 28 aa, Staphylococcus epidermidis
SEVVPWQYPPKREFIYGEWLRGEFENGQ

SEQ ID NO: 1800645 - protein, 18 aa, Staphylococcus epidermidis
SFGAESMVLIDLISQIKP

SEQ ID NO: 1800646 - protein, 25 aa, Staphylococcus epidermidis
SGDCPYMEAPPCLTCNSGKPCKDLA

SEQ ID NO: 1800647 - protein, 21 aa, Staphylococcus epidermidis
SGKTKKLQCILKEQVPNCDNQ

SEQ ID NO: 1800648 - protein, 23 aa, Staphylococcus epidermidis
SGMAKSRRKTLEKMERIDKPMID

SEQ ID NO: 1800649 - protein, 21 aa, Staphylococcus epidermidis
SHLVPYLKVLDQLTLIGKETG

SEQ ID NO: 1800650 - protein, 19 aa, Staphylococcus epidermidis
SIAKAISGSTQFKFRQLNA

SEQ ID NO: 1800651 - protein, 24 aa, Staphylococcus epidermidis
SIDNRKGQESFVFYDGPPTANGLP

SEQ ID NO: 1800652 - protein, 19 aa, Staphylococcus epidermidis
SKAWLKETIKQIPDDNQKN

SEQ ID NO: 1800653 - protein, 20 aa, Staphylococcus epidermidis
SKAWLKETIKQIPDDNQKNL

SEQ ID NO: 1800654 - protein, 18 aa, Staphylococcus epidermidis
SKEIATCSEFKPYYLTKA

SEQ ID NO: 1800655 - protein, 20 aa, Staphylococcus epidermidis
SKKYKSFMHHINKDYRTLKN

SEQ ID NO: 1800656 - protein, 17 aa, Staphylococcus epidermidis
SKLWRQIVNDVKKDYPE

SEQ ID NO: 1800657 - protein, 21 aa, Staphylococcus epidermidis
SLIRIPCKYQELINQLKHKYE

SEQ ID NO: 1800658 - protein, 21 aa, Staphylococcus epidermidis
SLKVAHGLQVDRLLRQNEEIK

SEQ ID NO: 1800659 - protein, 19 aa, Staphylococcus epidermidis
SLLLRRPPGREAYPGDVFY

SEQ ID NO: 1800660 - protein, 20 aa, Staphylococcus epidermidis
SLLLRRPPGREAYPGDVFYL

SEQ ID NO: 1800661 - protein, 21 aa, Staphylococcus epidermidis
SLSDPKLSLLAAQEVEKDINN

SEQ ID NO: 1800662 - protein, 21 aa, Staphylococcus epidermidis
SLYLEGFNTIVAYNGRDVLKQ

SEQ ID NO: 1800663 - protein, 19 aa, Staphylococcus epidermidis
SMAEWDVMNIIWDKKSVSA

SEQ ID NO: 1800664 - protein, 20 aa, Staphylococcus epidermidis
SMAEWDVMNIIWGKKSVSAN

SEQ ID NO: 1800665 - protein, 18 aa, Staphylococcus epidermidis
SMAEWDVMNIIWNKKSVS

SEQ ID NO: 1800666 - protein, 33 aa, Staphylococcus epidermidis
SMIKTMYPRSFNTAYKILKMIQREFSVYVYEAE

SEQ ID NO: 1800667 - protein, 17 aa, Staphylococcus epidermidis
SNIPIIFLTAKDNLDTR

SEQ ID NO: 1800668 - protein, 20 aa, Staphylococcus epidermidis
SNKHLCEYLGYAEQKIIKLK

SEQ ID NO: 1800669 - protein, 17 aa, Staphylococcus epidermidis
SNTFTIPSLNDLIFHIQ

SEQ ID NO: 1800670 - protein, 24 aa, Staphylococcus epidermidis
SQKHCLKLKFPLDQHSIRKEITPP

SEQ ID NO: 1800671 - protein, 24 aa, Staphylococcus epidermidis
SQKLLTQVRFQIPYGKNIALVGAN

SEQ ID NO: 1800672 - protein, 18 aa, Staphylococcus epidermidis
SQNYERISLELLNKHYHI

SEQ ID NO: 1800673 - protein, 17 aa, Staphylococcus epidermidis
SRMDKLCSEIYKKRLFS

SEQ ID NO: 1800674 - protein, 18 aa, Staphylococcus epidermidis
SSKTEVLKDINFEVKDGE

SEQ ID NO: 1800675 - protein, 20 aa, Staphylococcus epidermidis
SSPEMTLRYAKLLDDTKRKA

SEQ ID NO: 1800676 - protein, 21 aa, Staphylococcus epidermidis
SSRRYPYVKFTPEREIGNDLL

SEQ ID NO: 1800677 - protein, 24 aa, Staphylococcus epidermidis
STPSFIEMCLLLPNLNEQQYSSLK

SEQ ID NO: 1800678 - protein, 22 aa, Staphylococcus epidermidis
STYYGIALALLRISKALLNNEN

SEQ ID NO: 1800679 - protein, 23 aa, Staphylococcus epidermidis
SVKDRIALAMIEKAEREGKIKPG

SEQ ID NO: 1800680 - protein, 20 aa, Staphylococcus epidermidis
SYVFHPYSMIKDHRTNEETG

SEQ ID NO: 1800681 - protein, 18 aa, Staphylococcus epidermidis
SYYDYILEVYDYVHQIFP

SEQ ID NO: 1800682 - protein, 18 aa, Staphylococcus epidermidis
SYYDYILEVYDYVHQILP

SEQ ID NO: 1800683 - protein, 17 aa, Staphylococcus epidermidis
TAGEMGIMYGHIPTVAA

SEQ ID NO: 1800684 - protein, 21 aa, Staphylococcus epidermidis
TDLPFNRNDVIYVHCQSGIRS

SEQ ID NO: 1800685 - protein, 35 aa, Staphylococcus epidermidis
TDYSSVMFDYGILKRPQFFFAYDIDKYDKGLRGFY

SEQ ID NO: 1800686 - protein, 21 aa, Staphylococcus epidermidis
TELNGLKHFTFEDHNQQKFDI

SEQ ID NO: 1800687 - protein, 27 aa, Staphylococcus epidermidis
TENINAIELFKGMGFQIEGELKDKLFI

SEQ ID NO: 1800688 - protein, 18 aa, Staphylococcus epidermidis
TESLLGFKTIQTNEEGHQ

SEQ ID NO: 1800689 - protein, 17 aa, Staphylococcus epidermidis
TFALSFQHYTMRNERAP

SEQ ID NO: 1800690 - protein, 30 aa, Staphylococcus epidermidis
TFIGAGIISIEFASIMIKSGVEVNVVHHTN

SEQ ID NO: 1800691 - protein, 23 aa, Staphylococcus epidermidis
TFPNFLKRDKLTISVSTDGASPK

SEQ ID NO: 1800692 - protein, 19 aa, Staphylococcus epidermidis
TFSPELVDFSIYIIDVAQG

SEQ ID NO: 1800693 - protein, 21 aa, Staphylococcus epidermidis
TGNYSKVPWISIYDENITKET

SEQ ID NO: 1800694 - protein, 21 aa, Staphylococcus epidermidis
THDPVAASFSNRVVMLKDGQI

SEQ ID NO: 1800695 - protein, 29 aa, Staphylococcus epidermidis
THKEGCAYVKEHAMFKCDQHFDIVIASNS

SEQ ID NO: 1800696 - protein, 18 aa, Staphylococcus epidermidis
THVLPIEVDERIHILNFT

SEQ ID NO: 1800697 - protein, 23 aa, Staphylococcus epidermidis
TIDFKQSLMGGGFQINNPNAIAS

SEQ ID NO: 1800698 - protein, 26 aa, Staphylococcus epidermidis
TIQPYLKDTFEKMGLHVIEDEASKNN

SEQ ID NO: 1800699 - protein, 20 aa, Staphylococcus epidermidis
TITNGGIFGSMMSTPIINGN

SEQ ID NO: 1800700 - protein, 23 aa, Staphylococcus epidermidis
TITYCRRCIQLGRMDSITDICLV

SEQ ID NO: 1800701 - protein, 17 aa, Staphylococcus epidermidis
TKNGQMLVCQDPKCKTK

SEQ ID NO: 1800702 - protein, 20 aa, Staphylococcus epidermidis
TKWLINQGVDHFIEIGPGKV

SEQ ID NO: 1800703 - protein, 17 aa, Staphylococcus epidermidis
TLAVRNGAKFISTNPDV

SEQ ID NO: 1800704 - protein, 24 aa, Staphylococcus epidermidis
TMILKPLFRDYLLKLAEENQIAYQ

SEQ ID NO: 1800705 - protein, 24 aa, Staphylococcus epidermidis
TNTISNWYIRRSRGRFWEQGISND

SEQ ID NO: 1800706 - protein, 21 aa, Staphylococcus epidermidis
TPNYRKHWQVIFDLDNKQKLV

SEQ ID NO: 1800707 - protein, 23 aa, Staphylococcus epidermidis
TPVPGGVGPLTITMVLNNTLLAE

SEQ ID NO: 1800708 - protein, 22 aa, Staphylococcus epidermidis
TREAKMIISCIARMKQQESYSV

SEQ ID NO: 1800709 - protein, 24 aa, Staphylococcus epidermidis
TRKLIKVLLDNGWVMTKTGVDKRE

SEQ ID NO: 1800710 - protein, 27 aa, Staphylococcus epidermidis
TSDLISRYAGIRVPRNKAIVGQNAFSH

SEQ ID NO: 1800711 - protein, 23 aa, Staphylococcus epidermidis
TSENLDLFFSYRVEKGQTGRMLA

SEQ ID NO: 1800712 - protein, 17 aa, Staphylococcus epidermidis
TSKEIQSLMAQTTFETT

SEQ ID NO: 1800713 - protein, 22 aa, Staphylococcus epidermidis
TSKEIQSLMAQTTFETTKLPQG

SEQ ID NO: 1800714 - protein, 18 aa, Staphylococcus epidermidis
TSKTEVLKDINFEVKDGE

SEQ ID NO: 1800715 - protein, 19 aa, Staphylococcus epidermidis
TTGLPEWVKEKYAKTALRI

SEQ ID NO: 1800716 - protein, 17 aa, Staphylococcus epidermidis
TYFKQLVKRYCKLRLNV

SEQ ID NO: 1800717 - protein, 20 aa, Staphylococcus epidermidis
TYILANPFYIGKIQFAKYKD

SEQ ID NO: 1800718 - protein, 19 aa, Staphylococcus epidermidis
VAGSGVYICNECIELCSEI

SEQ ID NO: 1800719 - protein, 18 aa, Staphylococcus epidermidis
VAIVYKPKGMVVHPSPGH

SEQ ID NO: 1800720 - protein, 19 aa, Staphylococcus epidermidis
VAKELGDTINFIGIRLDSG

SEQ ID NO: 1800721 - protein, 23 aa, Staphylococcus epidermidis
VAPARAMGMVSVWYKQEDAELEP

SEQ ID NO: 1800722 - protein, 17 aa, Staphylococcus epidermidis
VARNILKQKAMDPFNGG

SEQ ID NO: 1800723 - protein, 28 aa, Staphylococcus epidermidis
VCDIYPLLNRSLLYSAIILHDLGKVREL

SEQ ID NO: 1800724 - protein, 25 aa, Staphylococcus epidermidis
VDCHFPRTSRKLFVEKLKSAQYDLK

SEQ ID NO: 1800725 - protein, 27 aa, Staphylococcus epidermidis
VDEAVDRACYLLERYASGTVLKDRVSH

SEQ ID NO: 1800726 - protein, 23 aa, Staphylococcus epidermidis
VDTKRLSSMIFYGPPGIGKTSIA

SEQ ID NO: 1800727 - protein, 20 aa, Staphylococcus epidermidis
VELTGSYKLLHCHHNEHKII

SEQ ID NO: 1800728 - protein, 24 aa, Staphylococcus epidermidis
VEVVDLRTVYPLDKATIIERSQRT

SEQ ID NO: 1800729 - protein, 18 aa, Staphylococcus epidermidis
VFNKRGYPIGQILMPGRD

SEQ ID NO: 1800730 - protein, 18 aa, Staphylococcus epidermidis
VKDLSAVVKFQLTNSKDT

SEQ ID NO: 1800731 - protein, 22 aa, Staphylococcus epidermidis
VKETLEGAGLDQAITYSLVSKN

SEQ ID NO: 1800732 - protein, 23 aa, Staphylococcus epidermidis
VKLTCVEAAPKMLPMFSDDLVSY

SEQ ID NO: 1800733 - protein, 18 aa, Staphylococcus epidermidis
VLEALLSYAKEVAKDEKS

SEQ ID NO: 1800734 - protein, 19 aa, Staphylococcus epidermidis
VLIVYIFKGKEFIPDSYTR

SEQ ID NO: 1800735 - protein, 18 aa, Staphylococcus epidermidis
VLSELCLPLVKKGGQFLA

SEQ ID NO: 1800736 - protein, 18 aa, Staphylococcus epidermidis
VLSELCLPLVNKGGQFLA

SEQ ID NO: 1800737 - protein, 26 aa, Staphylococcus epidermidis
VLVDYRLKLKNTRAITANRIKKYTPF

SEQ ID NO: 1800738 - protein, 26 aa, Staphylococcus epidermidis
VMDFNNLVLVRFFFKSLTAYLKKHNC

SEQ ID NO: 1800739 - protein, 27 aa, Staphylococcus epidermidis
VNAEQFRQLFILPQGEFKKFLQSNSKD

SEQ ID NO: 1800740 - protein, 26 aa, Staphylococcus epidermidis
VNGKEADECFRAELAKAPVKLFDHTL

SEQ ID NO: 1800741 - protein, 18 aa, Staphylococcus epidermidis
VPILDGLSIITSQKAMQS

SEQ ID NO: 1800742 - protein, 19 aa, Staphylococcus epidermidis
VPMDLLPYLFFQFSSNGKR

SEQ ID NO: 1800743 - protein, 17 aa, Staphylococcus epidermidis
VQGVGFRFYTQRIAHQF

SEQ ID NO: 1800744 - protein, 20 aa, Staphylococcus epidermidis
VSFDNFVDFIRWMKTPFEYE

SEQ ID NO: 1800745 - protein, 28 aa, Staphylococcus epidermidis
VSIIKRLSKASGHWGMVGGQALDMESEG

SEQ ID NO: 1800746 - protein, 17 aa, Staphylococcus epidermidis
VSVPELKPEKQANANHR

SEQ ID NO: 1800747 - protein, 24 aa, Staphylococcus epidermidis
VTEELRKKGVVGKFVEFFGPGVQH

SEQ ID NO: 1800748 - protein, 23 aa, Staphylococcus epidermidis
VTHNGGKLKIHYELYQDEQKMGS

SEQ ID NO: 1800749 - protein, 20 aa, Staphylococcus epidermidis
VTIFCTFWGLNALKKIQSQR

SEQ ID NO: 1800750 - protein, 17 aa, Staphylococcus epidermidis
VTLAAGYSLNWLKQTFF

SEQ ID NO: 1800751 - protein, 25 aa, Staphylococcus epidermidis
VVDYRLKLKNTRAITANRIKKYTPF

SEQ ID NO: 1800752 - protein, 31 aa, Staphylococcus epidermidis
VVERPTLKFELFYFDIFRYGTSFVTLQVPRE

SEQ ID NO: 1800753 - protein, 32 aa, Staphylococcus epidermidis
VVERPTLKFELFYFDIFRYGTSFVTLQVPREE

SEQ ID NO: 1800754 - protein, 18 aa, Staphylococcus epidermidis
VVLPEMWNNGYALEELEQ

SEQ ID NO: 1800755 - protein, 25 aa, Staphylococcus epidermidis
VVVPDYQLSLAIGKRGQNARLAAKL

SEQ ID NO: 1800756 - protein, 30 aa, Staphylococcus epidermidis
VYHDRPSEDWVWRDGFVKMDTLEVDVNDLM

SEQ ID NO: 1800757 - protein, 23 aa, Staphylococcus epidermidis
WADNYKFPVAVIDEVVKAKKAHA

SEQ ID NO: 1800758 - protein, 17 aa, Staphylococcus epidermidis
WDISAQFLFVRELGLIM

SEQ ID NO: 1800759 - protein, 20 aa, Staphylococcus epidermidis
WKNLMHYKEQVINPMSETLT

SEQ ID NO: 1800760 - protein, 18 aa, Staphylococcus epidermidis
WNAKTVWIRKGTVINKML

SEQ ID NO: 1800761 - protein, 26 aa, Staphylococcus epidermidis
YAADGYARINGIGAMVTTFGVGELSA

SEQ ID NO: 1800762 - protein, 18 aa, Staphylococcus epidermidis
YDSKRLHVLMEMFNADDD

SEQ ID NO: 1800763 - protein, 19 aa, Staphylococcus epidermidis
YDSKRLHVLMEMFNADDDL

SEQ ID NO: 1800764 - protein, 17 aa, Staphylococcus epidermidis
YDVVPSLISDLYQTQTS

SEQ ID NO: 1800765 - protein, 34 aa, Staphylococcus epidermidis; identical to SEQ ID NO: 1674113

SEQ ID NO: 1800766 - protein, 19 aa, Staphylococcus epidermidis
YEKRVTFGLSGSDANDGII

SEQ ID NO: 1800767 - protein, 17 aa, Staphylococcus epidermidis
YELKLNFSSVGPKLGNK

SEQ ID NO: 1800768 - protein, 23 aa, Staphylococcus epidermidis
YFEYKHILLATGFYNQLLTQPLI

SEQ ID NO: 1800769 - protein, 22 aa, Staphylococcus epidermidis
YFGEKFLALLNVNFNTFEYIKV

SEQ ID NO: 1800770 - protein, 19 aa, Staphylococcus epidermidis
YGADSLRWALISDSAPWNN

SEQ ID NO: 1800771 - protein, 22 aa, Staphylococcus epidermidis
YGIEIVDRIELIVPETQYNHSY

SEQ ID NO: 1800772 - protein, 19 aa, Staphylococcus epidermidis
YIALEFASMFANFGTHVTI

SEQ ID NO: 1800773 - protein, 18 aa, Staphylococcus epidermidis
YIEDFKDSLNELGLAKEG

SEQ ID NO: 1800774 - protein, 24 aa, Staphylococcus epidermidis
YIKLRKERTIHVSKELMSLYTDYL

SEQ ID NO: 1800775 - protein, 21 aa, Staphylococcus epidermidis
YKDELYIIASNLFSDRTKERL

SEQ ID NO: 1800776 - protein, 20 aa, Staphylococcus epidermidis
YKKRLFSISDLLLYEDIRKI

SEQ ID NO: 1800777 - protein, 19 aa, Staphylococcus epidermidis
YKNPHIDSVGLRTPSDSGL

SEQ ID NO: 1800778 - protein, 22 aa, Staphylococcus epidermidis
YLEKEVQIYTSLIVREDAQLLY

SEQ ID NO: 1800779 - protein, 18 aa, Staphylococcus epidermidis
YLEPLRLNLNDYRVMLIH

SEQ ID NO: 1800780 - protein, 23 aa, Staphylococcus epidermidis
YLESMATDFKVNGFFNKRKKKEE

SEQ ID NO: 1800781 - protein, 25 aa, Staphylococcus epidermidis
YLESMATDFKVNGLFNKKKKKEEEQ

SEQ ID NO: 1800782 - protein, 25 aa, Staphylococcus epidermidis
YLMEPWDGPTMISFCNGDKIGALTD

SEQ ID NO: 1800783 - protein, 19 aa, Staphylococcus epidermidis
YNISTDIVKRITFESQAKY

SEQ ID NO: 1800784 - protein, 26 aa, Staphylococcus epidermidis
YNMIRDRGEWVISRQRVWGVPLPVFY

SEQ ID NO: 1800785 - protein, 18 aa, Staphylococcus epidermidis
YPNCVLLGEGAKGSTLSI

SEQ ID NO: 1800786 - protein, 26 aa, Staphylococcus epidermidis
YPSGYSHGSIRFKYYDLNEGFTEEDM

SEQ ID NO: 1800787 - protein, 24 aa, Staphylococcus epidermidis
YQEQYKMIPACNVKAIDTTAAGDT

SEQ ID NO: 1800788 - protein, 23 aa, Staphylococcus epidermidis
YQLIKDCVFVAHNISFDLNFIKK

SEQ ID NO: 1800789 - protein, 24 aa, Staphylococcus epidermidis
YQNLTWDPPMVMFAANQSVLGDHE

SEQ ID NO: 1800790 - protein, 21 aa, Staphylococcus epidermidis
YRDEETWFALMNHLVDISIDY

SEQ ID NO: 1800791 - protein, 20 aa, Staphylococcus epidermidis
YRQIKSFLMKHLSRQEVPSK

SEQ ID NO: 1800792 - protein, 26 aa, Staphylococcus epidermidis
YSGDVLKGLIFVSSRGEAYQLANQLS

SEQ ID NO: 1800793 - protein, 18 aa, Staphylococcus epidermidis
YTFHKIFSIITLSRQLSE

SEQ ID NO: 1800794 - protein, 17 aa, Staphylococcus epidermidis
YTMTITFEEAVFGTKKE

SEQ ID NO: 1800795 - protein, 21 aa, Staphylococcus epidermidis
YTRKDMDALTEFVNIYGAKGL

SEQ ID NO: 1800796 - protein, 17 aa, Staphylococcus epidermidis
YVDEDWKARVRETIPEL

SEQ ID NO: 1800797 - protein, 18 aa, Staphylococcus epidermidis
YWPFSEFKSNFNPNNTKN

SEQ ID NO: 1800798 - protein, 23 aa, Staphylococcus epidermidis
YYQWKMKKEHIVPISKEVALLIK

SEQ ID NO: 1800799 - protein, 19 aa, Staphylococcus epidermidis
AAALYRDFFTAKRNEVPEV

SEQ ID NO: 1800800 - protein, 18 aa, Staphylococcus epidermidis
AAEQAGIEGLDEFLTGPT

SEQ ID NO: 1800801 - protein, 17 aa, Staphylococcus epidermidis
AASLPLTGLTAYETLFD

SEQ ID NO: 1800802 - protein, 20 aa, Staphylococcus epidermidis
AAYLAKAFGMKVIGVSKSGK

SEQ ID NO: 1800803 - protein, 21 aa, Staphylococcus epidermidis
ADFASLCFHVPFTKMGQKALD

SEQ ID NO: 1800804 - protein, 18 aa, Staphylococcus epidermidis
AECVPTFNVSPNDIIGII

SEQ ID NO: 1800805 - protein, 18 aa, Staphylococcus epidermidis
AEDLKKEFVISFRDLSNT

SEQ ID NO: 1800806 - protein, 19 aa, Staphylococcus epidermidis
AEEGVTFLISSHILSELVK

SEQ ID NO: 1800807 - protein, 17 aa, Staphylococcus epidermidis
AEKGFGFIEVEGENDVF

SEQ ID NO: 1800808 - protein, 24 aa, Staphylococcus epidermidis
AEKGVHRLVRISPFDSSGRRHTSF

SEQ ID NO: 1800809 - protein, 23 aa, Staphylococcus epidermidis
AETMKITALDLLDLGIIDEVINE

SEQ ID NO: 1800810 - protein, 18 aa, Staphylococcus epidermidis
AGLDFKIPGITIDRQCGS

SEQ ID NO: 1800811 - protein, 21 aa, Staphylococcus epidermidis
AGLKRFKDQYETVYLEVDNNN

SEQ ID NO: 1800812 - protein, 18 aa, Staphylococcus epidermidis
AGLKRMGWSDNIVTTYLD

SEQ ID NO: 1800813 - protein, 24 aa, Staphylococcus epidermidis
AGQPVECAGTYVLLASDDASYITG

SEQ ID NO: 1800814 - protein, 20 aa, Staphylococcus epidermidis
AGTCTNYGCNAKIFLEGPYE

SEQ ID NO: 1800815 - protein, 18 aa, Staphylococcus epidermidis
AHAKICAFIPGTQKRGPL

SEQ ID NO: 1800816 - protein, 26 aa, Staphylococcus epidermidis
AHKLYKNRRYVAARMISQLSRFFTGI

SEQ ID NO: 1800817 - protein, 19 aa, Staphylococcus epidermidis
AHKQRIPFTRVPFNDHDSI

SEQ ID NO: 1800818 - protein, 18 aa, Staphylococcus epidermidis
AIDYWKDDIAAVLVEPIV

SEQ ID NO: 1800819 - protein, 20 aa, Staphylococcus epidermidis
AIEKARRLAFQTEDMKRQSK

SEQ ID NO: 1800820 - protein, 25 aa, Staphylococcus epidermidis
AIISYLSSDLFKGIGKKTAQNIVNT

SEQ ID NO: 1800821 - protein, 22 aa, Staphylococcus epidermidis
AIQGYIYKCAKKHHLETPYLDM

SEQ ID NO: 1800822 - protein, 18 aa, Staphylococcus epidermidis
AISGAKYGYSNFKKLWIE

SEQ ID NO: 1800823 - protein, 19 aa, Staphylococcus epidermidis
AITLREIMDEVGIDAARYF

SEQ ID NO: 1800824 - protein, 18 aa, Staphylococcus epidermidis
AKATFLFDKTAKKFAKDE

SEQ ID NO: 1800825 - protein, 33 aa, Staphylococcus epidermidis
AKAWDNRYGCVLAIEILELLKDVQLDVDLYVGA

SEQ ID NO: 1800826 - protein, 22 aa, Staphylococcus epidermidis
AKDLRVGMDSSWMDRKGDGYPA

SEQ ID NO: 1800827 - protein, 21 aa, Staphylococcus epidermidis
AKHLKSMLLLHGLSSDETTYI

SEQ ID NO: 1800828 - protein, 25 aa, Staphylococcus epidermidis
AKLRKGMNAEENFMYSSEFGNVIYL

SEQ ID NO: 1800829 - protein, 25 aa, Staphylococcus epidermidis
AKNYDIPLYLGRTLSNMKGTWIMSK

SEQ ID NO: 1800830 - protein, 24 aa, Staphylococcus epidermidis
AKQVIEVILDWVFHNDIPLNYKTS

SEQ ID NO: 1800831 - protein, 20 aa, Staphylococcus epidermidis
AKSRFWLQLQADIFNLQIKR

SEQ ID NO: 1800832 - protein, 18 aa, Staphylococcus epidermidis
AKTLEYLLGIDWFTEEEL

SEQ ID NO: 1800833 - protein, 27 aa, Staphylococcus epidermidis
AKVGGRLPGGVKIKRAKLRGERSEGMI

SEQ ID NO: 1800834 - protein, 17 aa, Staphylococcus epidermidis
ALAQAGANIVIADLQSN

SEQ ID NO: 1800835 - protein, 21 aa, Staphylococcus epidermidis
ALARSEADWIVGINATRALTT

SEQ ID NO: 1800836 - protein, 19 aa, Staphylococcus epidermidis
ALELILPKVQFNLLNSSAY

SEQ ID NO: 1800837 - protein, 22 aa, Staphylococcus epidermidis
ALIQHKYKLAGKMMEQDGFHEP

SEQ ID NO: 1800838 - protein, 19 aa, Staphylococcus epidermidis
ALPYYKQFIQEVGQFLENE

SEQ ID NO: 1800839 - protein, 21 aa, Staphylococcus epidermidis
ALSTLYRWNKLYKEEGLTGLI

SEQ ID NO: 1800840 - protein, 17 aa, Staphylococcus epidermidis
AMLSAPYDVSMFGQYQW

SEQ ID NO: 1800841 - protein, 18 aa, Staphylococcus epidermidis
ANLIKPDLAIAVDVGVAY

SEQ ID NO: 1800842 - protein, 22 aa, Staphylococcus epidermidis
AQESWSVRYLEEYVNGLVSKDI

SEQ ID NO: 1800843 - protein, 19 aa, Staphylococcus epidermidis
AQLDYLLPRLQGHGKSLSR

SEQ ID NO: 1800844 - protein, 28 aa, Staphylococcus epidermidis
AQTCYQFKVPFIVIRAVSDLANGKADIS

SEQ ID NO: 1800845 - protein, 19 aa, Staphylococcus epidermidis
AREALFTHHFVKDFKDTNA

SEQ ID NO: 1800846 - protein, 19 aa, Staphylococcus epidermidis
ARIRPLNTHICKIERVAII

SEQ ID NO: 1800847 - protein, 18 aa, Staphylococcus epidermidis
ARLEGGKYGFAYASGIAA

SEQ ID NO: 1800848 - protein, 25 aa, Staphylococcus epidermidis
ARLQRRVGKQWVLYIENMNRGYTKS

SEQ ID NO: 1800849 - protein, 17 aa, Staphylococcus epidermidis
ARYSTVIILDGLEDPHN

SEQ ID NO: 1800850 - protein, 18 aa, Staphylococcus epidermidis
ASLLQIYSSLVIEGPGLT

SEQ ID NO: 1800851 - protein, 25 aa, Staphylococcus epidermidis
ASQIKRLKFDYLYIDNARLKSSYLL

SEQ ID NO: 1800852 - protein, 29 aa, Staphylococcus epidermidis
ATDLRMMMAALKISTDFERMGDNAASIAH

SEQ ID NO: 1800853 - protein, 19 aa, Staphylococcus epidermidis
ATQKYNIIKPFILGNQSLS

SEQ ID NO: 1800854 - protein, 20 aa, Staphylococcus epidermidis
ATVTHWFINFYHLIMEERFG

SEQ ID NO: 1800855 - protein, 17 aa, Staphylococcus epidermidis
ATYGSFRQWPAYLYTIE

SEQ ID NO: 1800856 - protein, 19 aa, Staphylococcus epidermidis
ATYKGPKGPTGYMIPTVVE

SEQ ID NO: 1800857 - protein, 24 aa, Staphylococcus epidermidis
AVRIVRKRGQLMAQAFPNGVGGMA

SEQ ID NO: 1800858 - protein, 22 aa, Staphylococcus epidermidis
AVVLPHGVLFRGAAEGTIRKYL

SEQ ID NO: 1800859 - protein, 27 aa, Staphylococcus epidermidis
AYGEKGGTPWLDQKHTVFGQLIEGEST

SEQ ID NO: 1800860 - protein, 18 aa, Staphylococcus epidermidis
AYGSRSGIINALNSETDK

SEQ ID NO: 1800861 - protein, 17 aa, Staphylococcus epidermidis
AYILSKRQLETEKSYEY

SEQ ID NO: 1800862 - protein, 25 aa, Staphylococcus epidermidis
CAFIPGTQKRGPLFKGLPTVEKHRF

SEQ ID NO: 1800863 - protein, 18 aa, Staphylococcus epidermidis
CDTWLARFDWHQPHTSYF

SEQ ID NO: 1800864 - protein, 18 aa, Staphylococcus epidermidis
CDTYDLLKNYSLKDKLHI

SEQ ID NO: 1800865 - protein, 17 aa, Staphylococcus epidermidis
CELLHLYQSFYQTFISF

SEQ ID NO: 1800866 - protein, 36 aa, Staphylococcus epidermidis
CEVCGSPMVIKMGRYGKFMACSNFPDCRNTKAIVKT

SEQ ID NO: 1800867 - protein, 23 aa, Staphylococcus epidermidis
CGELCACDLLIHFNFSQPTLSHH

SEQ ID NO: 1800868 - protein, 17 aa, Staphylococcus epidermidis
CGLPKEMALELFKPFVM

SEQ ID NO: 1800869 - protein, 18 aa, Staphylococcus epidermidis
CLHHYLIKDAIRDHNVLG

SEQ ID NO: 1800870 - protein, 21 aa, Staphylococcus epidermidis
CLNVGCIPSKALLHASHRFVE

SEQ ID NO: 1800871 - protein, 18 aa, Staphylococcus epidermidis
CPYCKKKMTLFGKGKEAV

SEQ ID NO: 1800872 - protein, 21 aa, Staphylococcus epidermidis
CSTCKGQRLNSKILSSKIMSK

SEQ ID NO: 1800873 - protein, 19 aa, Staphylococcus epidermidis
CTYCGVGCSFEVWTKDREI

SEQ ID NO: 1800874 - protein, 25 aa, Staphylococcus epidermidis
CVDNLPPVLLPKFVELMAQGNPSLQ

SEQ ID NO: 1800875 - protein, 17 aa, Staphylococcus epidermidis
CYTLLRPDGKTMFYLHS

SEQ ID NO: 1800876 - protein, 19 aa, Staphylococcus epidermidis
DAFIGAIIYCILESRYSEC

SEQ ID NO: 1800877 - protein, 20 aa, Staphylococcus epidermidis
DAIQIVPLMIKYAAELKNEG

SEQ ID NO: 1800878 - protein, 18 aa, Staphylococcus epidermidis
DALLHCIDVTYANDNYYY

SEQ ID NO: 1800879 - protein, 18 aa, Staphylococcus epidermidis
DDKGTWIINSKMIVEPKG

SEQ ID NO: 1800880 - protein, 18 aa, Staphylococcus epidermidis
DEAFVCYIAMTRSQQSVT

SEQ ID NO: 1800881 - protein, 20 aa, Staphylococcus epidermidis
DEAVDRACYLLETYASATVL

SEQ ID NO: 1800882 - protein, 17 aa, Staphylococcus epidermidis
DEGINLNAYVSFLETVP

SEQ ID NO: 1800883 - protein, 23 aa, Staphylococcus epidermidis
DEGNVSFEWRDVPVENPDYDDSI

SEQ ID NO: 1800884 - protein, 23 aa, Staphylococcus epidermidis
DEIKELSGHVFIFGGQTLYEAMI

SEQ ID NO: 1800885 - protein, 17 aa, Staphylococcus epidermidis
DEIKLEFMIKDNELEIT

SEQ ID NO: 1800886 - protein, 19 aa, Staphylococcus epidermidis
DEPVPPLPPVENFKGPIGR

SEQ ID NO: 1800887 - protein, 27 aa, Staphylococcus epidermidis
DETKLGSLHIKSIRISDVKSYYLHYFG

SEQ ID NO: 1800888 - protein, 18 aa, Staphylococcus epidermidis
DEVFKHSIEIFKRAKKNL

SEQ ID NO: 1800889 - protein, 27 aa, Staphylococcus epidermidis
DEVVEKIAGIAAREVKGILDMKGGFTD

SEQ ID NO: 1800890 - protein, 21 aa, Staphylococcus epidermidis
DEYEPLCEVITDKVTAEVPST

SEQ ID NO: 1800891 - protein, 26 aa, Staphylococcus epidermidis
DFDALERHVKFLLNNNIQAIIVNGTT

SEQ ID NO: 1800892 - protein, 24 aa, Staphylococcus epidermidis
DFHRPGHLFPLIAKENGVLTRNGH

SEQ ID NO: 1800893 - protein, 21 aa, Staphylococcus epidermidis
DFMHNLKYYKAISVAGESGSG

SEQ ID NO: 1800894 - protein, 25 aa, Staphylococcus epidermidis
DFNALERHVQFLLNNNIQAIIVNGT

SEQ ID NO: 1800895 - protein, 23 aa, Staphylococcus epidermidis
DFNFPNILRVIQFDSEFEQQDSV

SEQ ID NO: 1800896 - protein, 23 aa, Staphylococcus epidermidis
DGDLKGSSIGYKEIEFSFVDNKE

SEQ ID NO: 1800897 - protein, 19 aa, Staphylococcus epidermidis
DGEEGVSVLDDIDFQVELM

SEQ ID NO: 1800898 - protein, 23 aa, Staphylococcus epidermidis
DGFTRIDLAFDFEDDLSNYYAMT

SEQ ID NO: 1800899 - protein, 23 aa, Staphylococcus epidermidis
DGFTRLDLAFDFEDDLSDYYAMS

SEQ ID NO: 1800900 - protein, 23 aa, Staphylococcus epidermidis
DGFTRLDLAFDFEDDLSDYYAMT

SEQ ID NO: 1800901 - protein, 19 aa, Staphylococcus epidermidis
DGILKSRAKHEAIINGKRY

SEQ ID NO: 1800902 - protein, 17 aa, Staphylococcus epidermidis
DGLRRVFNVDIDLTYSR

SEQ ID NO: 1800903 - protein, 29 aa, Staphylococcus epidermidis
DGMPGLTICGGYQFLGHKYITPDGTELEG

SEQ ID NO: 1800904 - protein, 17 aa, Staphylococcus epidermidis
DGSELGIEFTVSGLNRV

SEQ ID NO: 1800905 - protein, 18 aa, Staphylococcus epidermidis
DHIVIIVSGAFGNRFKQI

SEQ ID NO: 1800906 - protein, 19 aa, Staphylococcus epidermidis
DHLSGLLFDDIPYLKVAQE

SEQ ID NO: 1800907 - protein, 18 aa, Staphylococcus epidermidis
DHQELPPNVVIMNNYTDS

SEQ ID NO: 1800908 - protein, 25 aa, Staphylococcus epidermidis
DIAKSIRFGASMVMIGSLFAAHEES

SEQ ID NO: 1800909 - protein, 17 aa, Staphylococcus epidermidis
DIGEDLTQVAFFERGEL

SEQ ID NO: 1800910 - protein, 18 aa, Staphylococcus epidermidis
DISKARYHKIVIMTDADV

SEQ ID NO: 1800911 - protein, 25 aa, Staphylococcus epidermidis
DKFAKAAPLSAVFEAQRFIDLDWTD

SEQ ID NO: 1800912 - protein, 25 aa, Staphylococcus epidermidis
DKHQCPHCKSEVILKQGMTLIAHFA

SEQ ID NO: 1800913 - protein, 23 aa, Staphylococcus epidermidis
DKINFGDGVARFDLRKEGAKHFH

SEQ ID NO: 1800914 - protein, 24 aa, Staphylococcus epidermidis
DLALDCIDCVRVSTARIKNEFIAK

SEQ ID NO: 1800915 - protein, 19 aa, Staphylococcus epidermidis
DLEYLKYAKDYGFSDKVIA

SEQ ID NO: 1800916 - protein, 18 aa, Staphylococcus epidermidis
DLHGLWLGDLILIKRNLS

SEQ ID NO: 1800917 - protein, 23 aa, Staphylococcus epidermidis
DLMRLRYWECPIGCSEWEDIADY

SEQ ID NO: 1800918 - protein, 19 aa, Staphylococcus epidermidis
DMLPFCLHISGLPVVNSNA

SEQ ID NO: 1800919 - protein, 18 aa, Staphylococcus epidermidis
DMVKVKRYLQGRKTRLVG

SEQ ID NO: 1800920 - protein, 19 aa, Staphylococcus epidermidis
DNHIEGVNYIFCTFDTDMY

SEQ ID NO: 1800921 - protein, 23 aa, Staphylococcus epidermidis
DNQSIEKACIWGNEVASKIVQER

SEQ ID NO: 1800922 - protein, 21 aa, Staphylococcus epidermidis
DPEIPIRLIGVTVGSLEQSDF

SEQ ID NO: 1800923 - protein, 22 aa, Staphylococcus epidermidis
DPEYWRKLFKRYENWINNFNAC

SEQ ID NO: 1800924 - protein, 22 aa, Staphylococcus epidermidis
DPFPSEHVKPYVTYKQSINEAI

SEQ ID NO: 1800925 - protein, 18 aa, Staphylococcus epidermidis
DPKYIALAIKRQYDHKKI

SEQ ID NO: 1800926 - protein, 23 aa, Staphylococcus epidermidis
DQKVAYAVANPVTFGVDNDKALK

SEQ ID NO: 1800927 - protein, 18 aa, Staphylococcus epidermidis
DQKVIDWLWETQDKTFFN

SEQ ID NO: 1800928 - protein, 19 aa, Staphylococcus epidermidis
DQLIILTAIDYVYINYHTD

SEQ ID NO: 1800929 - protein, 18 aa, Staphylococcus epidermidis
DQLKAKGTDTGWQTLPLV

SEQ ID NO: 1800930 - protein, 24 aa, Staphylococcus epidermidis
DQTLFRLQKQFAYTKEDINKYMTD

SEQ ID NO: 1800931 - protein, 23 aa, Staphylococcus epidermidis
DREIFKGQMFYWSNEQNERINYL

SEQ ID NO: 1800932 - protein, 21 aa, Staphylococcus epidermidis
DRLKVQHLEQLRAIYDEHNLA

SEQ ID NO: 1800933 - protein, 18 aa, Staphylococcus epidermidis
DSEIKYKKRSVLDETFVI

SEQ ID NO: 1800934 - protein, 23 aa, Staphylococcus epidermidis
DSKIDFMDALLVFYAKENHPEIL

SEQ ID NO: 1800935 - protein, 20 aa, Staphylococcus epidermidis
DSNYPYISFIPLNDKAILTL

SEQ ID NO: 1800936 - protein, 25 aa, Staphylococcus epidermidis
DSSNRIKENLYYFINHEITDQRDYE

SEQ ID NO: 1800937 - protein, 21 aa, Staphylococcus epidermidis
DTASHFVLIFARKNVTAHTDY

SEQ ID NO: 1800938 - protein, 20 aa, Staphylococcus epidermidis
DTCKTLESIGVDLLVIRHSQ

SEQ ID NO: 1800939 - protein, 21 aa, Staphylococcus epidermidis
DTETFIKWLHLFINEQLTYSD

SEQ ID NO: 1800940 - protein, 21 aa, Staphylococcus epidermidis
DTKQRFEAYGWNYILVENGND

SEQ ID NO: 1800941 - protein, 25 aa, Staphylococcus epidermidis
DVIERISGVIPVYAIPVGYSSIDMK

SEQ ID NO: 1800942 - protein, 18 aa, Staphylococcus epidermidis
DVITYFINYLFTGYEVLN

SEQ ID NO: 1800943 - protein, 26 aa, Staphylococcus epidermidis
DVKLAEALHSIFLEVVIAPQFTEEAL

SEQ ID NO: 1800944 - protein, 22 aa, Staphylococcus epidermidis
DVPLAGDRFVVFGDEKQARRIG

SEQ ID NO: 1800945 - protein, 18 aa, Staphylococcus epidermidis
DVPQIIWHGLPLTDAFLF

SEQ ID NO: 1800946 - protein, 18 aa, Staphylococcus epidermidis
DVTDIIAAQILYTIKKDG

SEQ ID NO: 1800947 - protein, 19 aa, Staphylococcus epidermidis
DVTLGRVFNVLGETIDLDE

SEQ ID NO: 1800948 - protein, 20 aa, Staphylococcus epidermidis
DYKNLHIDSVGLRTPSDSGL

SEQ ID NO: 1800949 - protein, 19 aa, Staphylococcus epidermidis
EACKAIGITDLRKMGLRDK

SEQ ID NO: 1800950 - protein, 25 aa, Staphylococcus epidermidis
EAEEIIKDMIELVLKHKSVDVKKIR

SEQ ID NO: 1800951 - protein, 19 aa, Staphylococcus epidermidis
EAFMKGGDFLGAGEFTVKV

SEQ ID NO: 1800952 - protein, 17 aa, Staphylococcus epidermidis
EAIYLNDQVMEFDLTPN

SEQ ID NO: 1800953 - protein, 21 aa, Staphylococcus epidermidis
EAKLYLARIYKALNFNVEIEP

SEQ ID NO: 1800954 - protein, 22 aa, Staphylococcus epidermidis
EAKLYLARIYKALNFNVEIEPY

SEQ ID NO: 1800955 - protein, 19 aa, Staphylococcus epidermidis
EALESLTYLLIGGEVLNAK

SEQ ID NO: 1800956 - protein, 17 aa, Staphylococcus epidermidis
EALKFQLLEELPQSIQN

SEQ ID NO: 1800957 - protein, 25 aa, Staphylococcus epidermidis
EALQQELINLIGFVIEPQDLFSHLI

SEQ ID NO: 1800958 - protein, 25 aa, Staphylococcus epidermidis
EAVLETESDFGLAFDGDGDRIIAVD

SEQ ID NO: 1800959 - protein, 17 aa, Staphylococcus epidermidis
EDEIGFIALHIASNSEK

SEQ ID NO: 1800960 - protein, 19 aa, Staphylococcus epidermidis
EDESNFGLLTGKRKDHDAK

SEQ ID NO: 1800961 - protein, 23 aa, Staphylococcus epidermidis
EDIGYKIEVDWMPSRMELKHEEY

SEQ ID NO: 1800962 - protein, 19 aa, Staphylococcus epidermidis
EDLCDRFLLLENHQIREID

SEQ ID NO: 1800963 - protein, 17 aa, Staphylococcus epidermidis
EDLKRAKYAGIEQQKMK

SEQ ID NO: 1800964 - protein, 26 aa, Staphylococcus epidermidis
EDLPKLKELWPQAGDYLLVTLRIDST

SEQ ID NO: 1800965 - protein, 19 aa, Staphylococcus epidermidis
EDLTQVAFFERGELVDAES

SEQ ID NO: 1800966 - protein, 22 aa, Staphylococcus epidermidis
EDSRRVLPDTFSHKGAVQNSAI

SEQ ID NO: 1800967 - protein, 17 aa, Staphylococcus epidermidis
EEFKRIFLANKFSTSKF

SEQ ID NO: 1800968 - protein, 18 aa, Staphylococcus epidermidis
EEIIDIFEQLGFKTENKN

SEQ ID NO: 1800969 - protein, 18 aa, Staphylococcus epidermidis
EESMKYSLNAGGKRIRPV

SEQ ID NO: 1800970 - protein, 18 aa, Staphylococcus epidermidis
EEVIDVWFDSGSMPFAQH

SEQ ID NO: 1800971 - protein, 20 aa, Staphylococcus epidermidis
EEYKEIDIYSGTEMDILPDG

SEQ ID NO: 1800972 - protein, 19 aa, Staphylococcus epidermidis
EEYSLWLYDVIGCGTSLTE

SEQ ID NO: 1800973 - protein, 28 aa, Staphylococcus epidermidis
EFCDACIKYQYIGICYGQPGVGKTLSSR

SEQ ID NO: 1800974 - protein, 24 aa, Staphylococcus epidermidis
EFICPNNKRLGFKRYAYRHDKYGY

SEQ ID NO: 1800975 - protein, 21 aa, Staphylococcus epidermidis
EFPKYIKVCELLHLYQSFYQT

SEQ ID NO: 1800976 - protein, 22 aa, Staphylococcus epidermidis
EGAQRPGHFEGVVTVVNKLFNI

SEQ ID NO: 1800977 - protein, 22 aa, Staphylococcus epidermidis
EGELKIGQTVKVAYFKQTEETL

SEQ ID NO: 1800978 - protein, 17 aa, Staphylococcus epidermidis
EGFMPIRRIEKPVYKEN

SEQ ID NO: 1800979 - protein, 26 aa, Staphylococcus epidermidis
EGGILTDSYYCFSYSLKGNSKKVLGT

SEQ ID NO: 1800980 - protein, 23 aa, Staphylococcus epidermidis
EGKKCLCHNDFSCNHLLLDGNNR

SEQ ID NO: 1800981 - protein, 27 aa, Staphylococcus epidermidis
EGKVPRVKFEKVFADHFLKLYDKTKNR

SEQ ID NO: 1800982 - protein, 20 aa, Staphylococcus epidermidis
EGNYEYCFFESEGKGQFKPV

SEQ ID NO: 1800983 - protein, 25 aa, Staphylococcus epidermidis
EHARELKVSNALLFTDSKLIEDSMM

SEQ ID NO: 1800984 - protein, 17 aa, Staphylococcus epidermidis
EHQFKHFIYTPVGFVCE

SEQ ID NO: 1800985 - protein, 18 aa, Staphylococcus epidermidis
EHRRQFLFENQFEKQDDI

SEQ ID NO: 1800986 - protein, 24 aa, Staphylococcus epidermidis
EIFSDEIIEFITLNNYVLIKTSPG

SEQ ID NO: 1800987 - protein, 18 aa, Staphylococcus epidermidis
EIMESLEAPAHLFTTGAN

SEQ ID NO: 1800988 - protein, 23 aa, Staphylococcus epidermidis
EIRPCLSNFKFYIGQTGQEEDHP

SEQ ID NO: 1800989 - protein, 27 aa, Staphylococcus epidermidis
EISTDYLLCKAFGKTATNIEKYTSQGT

SEQ ID NO: 1800990 - protein, 19 aa, Staphylococcus epidermidis
EIVDRIELIVPETPYNHSY

SEQ ID NO: 1800991 - protein, 27 aa, Staphylococcus epidermidis
EIVEKSLRGAAIWDELKDRLHTNAYGL

SEQ ID NO: 1800992 - protein, 26 aa, Staphylococcus epidermidis
EIVSVLKRFKAMLLQKNETVEAMQGY

SEQ ID NO: 1800993 - protein, 23 aa, Staphylococcus epidermidis
EIYFKNEGFYPVAVDAKHGKNLK

SEQ ID NO: 1800994 - protein, 24 aa, Staphylococcus epidermidis
EIYFPISNIYLYAPITGMHAFDRI

SEQ ID NO: 1800995 - protein, 24 aa, Staphylococcus epidermidis
EKDLFKYYFEHRFKQNDIVFNDAR

SEQ ID NO: 1800996 - protein, 22 aa, Staphylococcus epidermidis
EKDMALRWGKKNNIDVTTSTEL

SEQ ID NO: 1800997 - protein, 17 aa, Staphylococcus epidermidis
EKELFIEGAYIYYLGSF

SEQ ID NO: 1800998 - protein, 20 aa, Staphylococcus epidermidis
EKFYQLPKVFFTNPKYVNLS

SEQ ID NO: 1800999 - protein, 19 aa, Staphylococcus epidermidis
EKLADWIIDSLPIKNGVVL

SEQ ID NO: 1801000 - protein, 19 aa, Staphylococcus epidermidis
EKNQLAFISAIEKHYEMYT

SEQ ID NO: 1801001 - protein, 20 aa, Staphylococcus epidermidis
EKVDEMLEFVGLADKKDQFP

SEQ ID NO: 1801002 - protein, 18 aa, Staphylococcus epidermidis
ELFDIAPTLDRGTKTLEY

SEQ ID NO: 1801003 - protein, 22 aa, Staphylococcus epidermidis
ELGVTLFKRSGRNIILTVEGRQ

SEQ ID NO: 1801004 - protein, 22 aa, Staphylococcus epidermidis
ELKRSGVAITEAFNQIERYRRQ

SEQ ID NO: 1801005 - protein, 18 aa, Staphylococcus epidermidis
ELLQYIIDFYRLDVKVQD

SEQ ID NO: 1801006 - protein, 19 aa, Staphylococcus epidermidis
ELTKEDKFVEETKSDPDDN

SEQ ID NO: 1801007 - protein, 20 aa, Staphylococcus epidermidis
ELWDSSFSLTNEWINEYKQS

SEQ ID NO: 1801008 - protein, 26 aa, Staphylococcus epidermidis
EMLNHGIPSFGYRIEAPITPGTINVE

SEQ ID NO: 1801009 - protein, 22 aa, Staphylococcus epidermidis
ENDEILEYYGLKVLVDQNDAPV

SEQ ID NO: 1801010 - protein, 21 aa, Staphylococcus epidermidis
ENGHRVIVAGLDMDFRGEPFK

SEQ ID NO: 1801011 - protein, 26 aa, Staphylococcus epidermidis
ENINAIELFKGMGFQIEGELKDKLFI

SEQ ID NO: 1801012 - protein, 24 aa, Staphylococcus epidermidis
EPEGIAAKVLVSFNITEDKVIEEV

SEQ ID NO: 1801013 - protein, 21 aa, Staphylococcus epidermidis
EPKKGRVVVEGVNVIKKHQKP

SEQ ID NO: 1801014 - protein, 20 aa, Staphylococcus epidermidis
EPSYFYTLLGPSGCGKTTIL

SEQ ID NO: 1801015 - protein, 18 aa, Staphylococcus epidermidis
EQGTYCAYQEQYKIIPAC

SEQ ID NO: 1801016 - protein, 19 aa, Staphylococcus epidermidis
EQGVKLIACTMSMDVMGIT

SEQ ID NO: 1801017 - protein, 30 aa, Staphylococcus epidermidis
EQLFAAGYASCFNGAFDLILKQNKVRDAEP

SEQ ID NO: 1801018 - protein, 20 aa, Staphylococcus epidermidis
EQLTCIFVDHGLLRKGEGDM

SEQ ID NO: 1801019 - protein, 19 aa, Staphylococcus epidermidis
EQQLNLKGLAFISATDSYP

SEQ ID NO: 1801020 - protein, 23 aa, Staphylococcus epidermidis
ERPEWNVVGLLGQIYTNIEKDVI

SEQ ID NO: 1801021 - protein, 25 aa, Staphylococcus epidermidis
ERQKLEVNEKIKLFNSDEMMGEDAF

SEQ ID NO: 1801022 - protein, 17 aa, Staphylococcus epidermidis
ERREYNHFGQLHRKIYF

SEQ ID NO: 1801023 - protein, 21 aa, Staphylococcus epidermidis
ESGCGKSTTGKAIIKLNDITD

SEQ ID NO: 1801024 - protein, 20 aa, Staphylococcus epidermidis
ESGEIGKLFNHQHLHRYTEQ

SEQ ID NO: 1801025 - protein, 18 aa, Staphylococcus epidermidis
ESLRITENSGISFIYTLE

SEQ ID NO: 1801026 - protein, 25 aa, Staphylococcus epidermidis
ESLRLIKGGFTFAILTKDALYGVVD

SEQ ID NO: 1801027 - protein, 21 aa, Staphylococcus epidermidis
ETEETIYLLKRKDFIQMDNNV

SEQ ID NO: 1801028 - protein, 24 aa, Staphylococcus epidermidis
ETKGAYEILKWAYQTYENDIVYSC

SEQ ID NO: 1801029 - protein, 20 aa, Staphylococcus epidermidis
ETKSSGFDWFKRKSNKKEND

SEQ ID NO: 1801030 - protein, 23 aa, Staphylococcus epidermidis
ETPSEMCGLKVIAIEDFETGKKT

SEQ ID NO: 1801031 - protein, 25 aa, Staphylococcus epidermidis
ETPSEMCGLKVIAIEDFETGKKTDL

SEQ ID NO: 1801032 - protein, 17 aa, Staphylococcus epidermidis
ETSPIDMLASWSDSEPT

SEQ ID NO: 1801033 - protein, 18 aa, Staphylococcus epidermidis
ETVKRCYENGLDSVFFGH

SEQ ID NO: 1801034 - protein, 24 aa, Staphylococcus epidermidis
EVLCNLSRRLPRIYYYDNNEEVTN

SEQ ID NO: 1801035 - protein, 20 aa, Staphylococcus epidermidis
EVLHSLELDPKRVIVELNKE

SEQ ID NO: 1801036 - protein, 19 aa, Staphylococcus epidermidis
EVNAYIPGIGHNLQEHSVV

SEQ ID NO: 1801037 - protein, 17 aa, Staphylococcus epidermidis
EVNSMLGHRGCRLAVTY

SEQ ID NO: 1801038 - protein, 17 aa, Staphylococcus epidermidis
EVPKVLNGLGIALVSTS

SEQ ID NO: 1801039 - protein, 20 aa, Staphylococcus epidermidis
EVSDPKELIARHSLKVDAGV

SEQ ID NO: 1801040 - protein, 25 aa, Staphylococcus epidermidis
EVTPEQCNQLGLALAEKLAPNHQVA

SEQ ID NO: 1801041 - protein, 26 aa, Staphylococcus epidermidis
EVVEKKLPFLFGEDFSFYGQQLAPSY

SEQ ID NO: 1801042 - protein, 26 aa, Staphylococcus epidermidis
EWLNPSAAAPTVEWEDMGAYTDSYEN

SEQ ID NO: 1801043 - protein, 21 aa, Staphylococcus epidermidis
EYENIQIIGLMTMAPLTDDLS

SEQ ID NO: 1801044 - protein, 20 aa, Staphylococcus epidermidis
EYENSAIQLGEWIAKNNHTL

SEQ ID NO: 1801045 - protein, 23 aa, Staphylococcus epidermidis
FASPKLGYRRIFNIKEKGTRHGG

SEQ ID NO: 1801046 - protein, 24 aa, Staphylococcus epidermidis
FDALERHVQFLLDNNIQAIIVNGT

SEQ ID NO: 1801047 - protein, 17 aa, Staphylococcus epidermidis
FDDKKDLAAIVSQQTQS

SEQ ID NO: 1801048 - protein, 19 aa, Staphylococcus epidermidis
FDDVDMNLVEWLRQYAPED

SEQ ID NO: 1801049 - protein, 19 aa, Staphylococcus epidermidis
FDGSLLINGKISYAVDIFP

SEQ ID NO: 1801050 - protein, 17 aa, Staphylococcus epidermidis
FDLEGFKNVFSVEYDLQ

SEQ ID NO: 1801051 - protein, 21 aa, Staphylococcus epidermidis
FDLSFDRKFEAFLVPTVIGEI

SEQ ID NO: 1801052 - protein, 19 aa, Staphylococcus epidermidis
FDMIAHLLVSQSHGIELIR

SEQ ID NO: 1801053 - protein, 24 aa, Staphylococcus epidermidis
FECGKAEDVILTWKSQGIKPDVVM

SEQ ID NO: 1801054 - protein, 29 aa, Staphylococcus epidermidis
FEDNAIIVIEWSKFIKDFLPPNHLTINIS

SEQ ID NO: 1801055 - protein, 23 aa, Staphylococcus epidermidis
FEIREIRIIKSVLLKGKKSFNNA

SEQ ID NO: 1801056 - protein, 19 aa, Staphylococcus epidermidis
FEKVKPFLNKNFKYKDGKS

SEQ ID NO: 1801057 - protein, 27 aa, Staphylococcus epidermidis
FEMPYEEAKSWMLKALEPMGEEYLNVV

SEQ ID NO: 1801058 - protein, 18 aa, Staphylococcus epidermidis
FFVLIGPSGCGKTTTLKM

SEQ ID NO: 1801059 - protein, 23 aa, Staphylococcus epidermidis
FGNSPSGIALKFMYSNLDLKANK

SEQ ID NO: 1801060 - protein, 25 aa, Staphylococcus epidermidis
FGNVIYLKAVFIHKSISRIQSLNVD

SEQ ID NO: 1801061 - protein, 28 aa, Staphylococcus epidermidis
FGTAGIRGKFGLGKGRLNKFTVSKVALG

SEQ ID NO: 1801062 - protein, 19 aa, Staphylococcus epidermidis
FIEAAKIPVIHTLPAKTIL

SEQ ID NO: 1801063 - protein, 18 aa, Staphylococcus epidermidis
FIEGAYIYYLGSFIDSDS

SEQ ID NO: 1801064 - protein, 18 aa, Staphylococcus epidermidis
FIISSWLGTMGCGLPGAM

SEQ ID NO: 1801065 - protein, 21 aa, Staphylococcus epidermidis
FIRHIQFLIYRLTKGEYLEAQ

SEQ ID NO: 1801066 - protein, 20 aa, Staphylococcus epidermidis
FKCGAELKNRVLMAPMTIQA

SEQ ID NO: 1801067 - protein, 20 aa, Staphylococcus epidermidis
FKDEGFYPVAVDAKHGKNLK

SEQ ID NO: 1801068 - protein, 21 aa, Staphylococcus epidermidis
FKEAHPYFNQNVVIIGGKNSA

SEQ ID NO: 1801069 - protein, 17 aa, Staphylococcus epidermidis
FKGIGKKTAQNIVNTLG

SEQ ID NO: 1801070 - protein, 20 aa, Staphylococcus epidermidis
FKHTVMMGVGGSFEVFSGSK

SEQ ID NO: 1801071 - protein, 19 aa, Staphylococcus epidermidis
FKKAPGNHDYAFWDKAIED

SEQ ID NO: 1801072 - protein, 22 aa, Staphylococcus epidermidis
FKKEYGYSFGTVRPMQIGLVYD

SEQ ID NO: 1801073 - protein, 17 aa, Staphylococcus epidermidis
FKNKDYCLDKFNSKDTF

SEQ ID NO: 1801074 - protein, 21 aa, Staphylococcus epidermidis
FKRINNSLARLEMPEVDEEAL

SEQ ID NO: 1801075 - protein, 20 aa, Staphylococcus epidermidis
FKSNLKEIYGMISQYDYVLI

SEQ ID NO: 1801076 - protein, 27 aa, Staphylococcus epidermidis
FKTDNRGLFAFSIESMSQFGMYFTKMN

SEQ ID NO: 1801077 - protein, 17 aa, Staphylococcus epidermidis
FLIYRLTKGEYLEAQEN

SEQ ID NO: 1801078 - protein, 17 aa, Staphylococcus epidermidis
FNAEKGFGFIEVEGEND

SEQ ID NO: 1801079 - protein, 17 aa, Staphylococcus epidermidis
FNDFEMHFYRYVFPYYD

SEQ ID NO: 1801080 - protein, 18 aa, Staphylococcus epidermidis
FNKLCMKYELKINDKKTE

SEQ ID NO: 1801081 - protein, 19 aa, Staphylococcus epidermidis
FNTLDNFIKSDLEKLKSKL

SEQ ID NO: 1801082 - protein, 29 aa, Staphylococcus epidermidis
FPKKAKRIVHRFSQKWLRKPTGKLTIQRE

SEQ ID NO: 1801083 - protein, 17 aa, Staphylococcus epidermidis
FPNIELHMYGFGKEEQH

SEQ ID NO: 1801084 - protein, 27 aa, Staphylococcus epidermidis
FPNQINNVLAFPGLFRGALDVEATHIN

SEQ ID NO: 1801085 - protein, 17 aa, Staphylococcus epidermidis
FPYTIRIVSEVLESNGS

SEQ ID NO: 1801086 - protein, 20 aa, Staphylococcus epidermidis
FQEKCMYRFGKNHKRYIKIR

SEQ ID NO: 1801087 - protein, 17 aa, Staphylococcus epidermidis
FQIPYGKNIALVGANGV

SEQ ID NO: 1801088 - protein, 22 aa, Staphylococcus epidermidis
FQKKLEQIRYLLFNIQMNVEQW

SEQ ID NO: 1801089 - protein, 19 aa, Staphylococcus epidermidis
FRERLDIPKSYRMSEIDKY

SEQ ID NO: 1801090 - protein, 17 aa, Staphylococcus epidermidis
FRYIQLFVVSNKMETRY

SEQ ID NO: 1801091 - protein, 18 aa, Staphylococcus epidermidis
FSETSREGFLLAQDISSY

SEQ ID NO: 1801092 - protein, 18 aa, Staphylococcus epidermidis
FSIEGVDTLVPMLQHTIT

SEQ ID NO: 1801093 - protein, 23 aa, Staphylococcus epidermidis
FTDNLKKTLLFGGNHILNVDLSN

SEQ ID NO: 1801094 - protein, 19 aa, Staphylococcus epidermidis
FTYTILQAIDFGYLNRELN

SEQ ID NO: 1801095 - protein, 21 aa, Staphylococcus epidermidis
FVIEPQDLFSHLIQKIETQTF

SEQ ID NO: 1801096 - protein, 17 aa, Staphylococcus epidermidis
FVQAAFEKLDFMVVQDE

SEQ ID NO: 1801097 - protein, 19 aa, Staphylococcus epidermidis
FYEISFNTLDDFIESDLDK

SEQ ID NO: 1801098 - protein, 20 aa, Staphylococcus epidermidis
FYEISFNTLDNFIKSDLEKL

SEQ ID NO: 1801099 - protein, 18 aa, Staphylococcus epidermidis
FYKDGKMAYYFIKDDEIR

SEQ ID NO: 1801100 - protein, 18 aa, Staphylococcus epidermidis
FYQQMLIKMWQLTLDFDE

SEQ ID NO: 1801101 - protein, 18 aa, Staphylococcus epidermidis
GAEGLIFHPYLAGERAPL

SEQ ID NO: 1801102 - protein, 23 aa, Staphylococcus epidermidis
GAFGEALGAVIVRSKKLDEGEAI

SEQ ID NO: 1801103 - protein, 22 aa, Staphylococcus epidermidis
GAGFPSIPLKIVYPELKVTIVD

SEQ ID NO: 1801104 - protein, 21 aa, Staphylococcus epidermidis
GAIAKFIYYFAQYSIKMEHDE

SEQ ID NO: 1801105 - protein, 17 aa, Staphylococcus epidermidis
GATAFVYNGRFHPETYL

SEQ ID NO: 1801106 - protein, 21 aa, Staphylococcus epidermidis
GAYRRDLKKYKDYLEDNKISH

SEQ ID NO: 1801107 - protein, 20 aa, Staphylococcus epidermidis
GDAFIGAIIYCILESRHSEC

SEQ ID NO: 1801108 - protein, 17 aa, Staphylococcus epidermidis
GDGPLAILMDATSIAHD

SEQ ID NO: 1801109 - protein, 17 aa, Staphylococcus epidermidis
GDLPTIVRRLLVISYED

SEQ ID NO: 1801110 - protein, 20 aa, Staphylococcus epidermidis
GDNEFYPSLAFILIRGILQS

SEQ ID NO: 1801111 - protein, 20 aa, Staphylococcus epidermidis
GDPKYIALAIKRQYDHKKIY

SEQ ID NO: 1801112 - protein, 17 aa, Staphylococcus epidermidis
GDRFVVESIDRLGRNYD

SEQ ID NO: 1801113 - protein, 19 aa, Staphylococcus epidermidis
GDVLIQYAIEQCAGLTPKE

SEQ ID NO: 1801114 - protein, 22 aa, Staphylococcus epidermidis
GDYPKWKMYIQVMTEEQSKNHP

SEQ ID NO: 1801115 - protein, 17 aa, Staphylococcus epidermidis
GEAIAWHLSKILELEDS

SEQ ID NO: 1801116 - protein, 24 aa, Staphylococcus epidermidis
GEEESHIYSGFVMLNSVFNGGKQV

SEQ ID NO: 1801117 - protein, 17 aa, Staphylococcus epidermidis
GEGPTLIECDTYRKYGH

SEQ ID NO: 1801118 - protein, 21 aa, Staphylococcus epidermidis
GELDDGLFYKFFFSYNPPKRK

SEQ ID NO: 1801119 - protein, 17 aa, Staphylococcus epidermidis
GETLGLVGESGCGKSTT

SEQ ID NO: 1801120 - protein, 20 aa, Staphylococcus epidermidis
GEVLNAKWVHLLNSRECHPQ

SEQ ID NO: 1801121 - protein, 17 aa, Staphylococcus epidermidis
GFESTRAEWLFLDVFGW

SEQ ID NO: 1801122 - protein, 17 aa, Staphylococcus epidermidis
GFGYKWETHEDVIDDET

SEQ ID NO: 1801123 - protein, 26 aa, Staphylococcus epidermidis
GFNELKTRLSKFLPKEVTQYNVELVD

SEQ ID NO: 1801124 - protein, 18 aa, Staphylococcus epidermidis
GFVSEFKGDNLVIINRDA

SEQ ID NO: 1801125 - protein, 18 aa, Staphylococcus epidermidis
GGCTFCSAAGSGDFAGNR

SEQ ID NO: 1801126 - protein, 17 aa, Staphylococcus epidermidis
GGGLPIGGYGGRQDIME

SEQ ID NO: 1801127 - protein, 25 aa, Staphylococcus epidermidis
GGKGLLCVYEGFLKGLKGEKVEAQA

SEQ ID NO: 1801128 - protein, 26 aa, Staphylococcus epidermidis
GGQQQRVCIARCLAIEPDVILMDEPT

SEQ ID NO: 1801129 - protein, 17 aa, Staphylococcus epidermidis
GGWTFPEGIQVVGVSSV

SEQ ID NO: 1801130 - protein, 21 aa, Staphylococcus epidermidis
GHDAFKLYDTYGFPIELTEEL

SEQ ID NO: 1801131 - protein, 23 aa, Staphylococcus epidermidis
GHQLKRHGFFYAPTVLDSVRKDD

SEQ ID NO: 1801132 - protein, 20 aa, Staphylococcus epidermidis
GHRELPIRADFVGKNIPTAR

SEQ ID NO: 1801133 - protein, 23 aa, Staphylococcus epidermidis
GIAELFKSMGATHIISGGQTMNP

SEQ ID NO: 1801134 - protein, 17 aa, Staphylococcus epidermidis
GIHPEWLYCAKANLVLE

SEQ ID NO: 1801135 - protein, 18 aa, Staphylococcus epidermidis
GISCDKGFTVINIKKYLM

SEQ ID NO: 1801136 - protein, 20 aa, Staphylococcus epidermidis
GKASHRGVVSTASYEARAYG

SEQ ID NO: 1801137 - protein, 20 aa, Staphylococcus epidermidis
GKDENFPFLMFGPGNGPHQI

SEQ ID NO: 1801138 - protein, 17 aa, Staphylococcus epidermidis
GKDYLKNILKYYYGTLI

SEQ ID NO: 1801139 - protein, 24 aa, Staphylococcus epidermidis
GKKEPVDFYLTKGIVERVAEKLNL

SEQ ID NO: 1801140 - protein, 25 aa, Staphylococcus epidermidis
GKNDYKLTLENYVLIYYLEKIIFQA

SEQ ID NO: 1801141 - protein, 18 aa, Staphylococcus epidermidis
GKPFSISSITYILANPFY

SEQ ID NO: 1801142 - protein, 21 aa, Staphylococcus epidermidis
GKRIRPVILLLTLKMLNKDYQ

SEQ ID NO: 1801143 - protein, 22 aa, Staphylococcus epidermidis
GKRIRPVILLLTLKMLNKDYQQ

SEQ ID NO: 1801144 - protein, 19 aa, Staphylococcus epidermidis
GKRTSICSVGMVKVIDNQI

SEQ ID NO: 1801145 - protein, 17 aa, Staphylococcus epidermidis
GKVVGFATYGSFRQWPA

SEQ ID NO: 1801146 - protein, 17 aa, Staphylococcus epidermidis
GKWSYLYRAIDTEGHTL

SEQ ID NO: 1801147 - protein, 20 aa, Staphylococcus epidermidis
GKWYYDFGYEGKRYKKKGFK

SEQ ID NO: 1801148 - protein, 18 aa, Staphylococcus epidermidis
GKYGFAYASGIAAISAVL

SEQ ID NO: 1801149 - protein, 27 aa, Staphylococcus epidermidis
GLANKISLKFAKKIYTTFEDTLTYLPK

SEQ ID NO: 1801150 - protein, 17 aa, Staphylococcus epidermidis
GLEKHVILRGFLKDLTD

SEQ ID NO: 1801151 - protein, 17 aa, Staphylococcus epidermidis
GLFKAVINKDTKEILGA

SEQ ID NO: 1801152 - protein, 18 aa, Staphylococcus epidermidis
GLITQFDGSLLINGKISY

SEQ ID NO: 1801153 - protein, 25 aa, Staphylococcus epidermidis
GLLGLECARGLLDQGMEVTVLHLAD

SEQ ID NO: 1801154 - protein, 23 aa, Staphylococcus epidermidis
GMKQRLCLAICLITKPKVAVLDE

SEQ ID NO: 1801155 - protein, 24 aa, Staphylococcus epidermidis
GMKQRLCLAICLITKPKVAVLDEP

SEQ ID NO: 1801156 - protein, 21 aa, Staphylococcus epidermidis
GMPPTGGLGIGIDRLVMLLTD

SEQ ID NO: 1801157 - protein, 25 aa, Staphylococcus epidermidis
GMQTMKYDMCGAANVIGMIDVISKQ

SEQ ID NO: 1801158 - protein, 19 aa, Staphylococcus epidermidis
GMSCDHCKHSIEKALNGLD

SEQ ID NO: 1801159 - protein, 24 aa, Staphylococcus epidermidis
GNIIAEVFNRFSITDTSMMLDRMK

SEQ ID NO: 1801160 - protein, 20 aa, Staphylococcus epidermidis
GNINRPWLTIIMDDYSRAIA

SEQ ID NO: 1801161 - protein, 18 aa, Staphylococcus epidermidis
GNKVHLESDVLFKYVENI

SEQ ID NO: 1801162 - protein, 22 aa, Staphylococcus epidermidis
GNLDPALIPFIMEKTGKTADEV

SEQ ID NO: 1801163 - protein, 20 aa, Staphylococcus epidermidis
GNLNGEWCINDVNAVSKIAA

SEQ ID NO: 1801164 - protein, 20 aa, Staphylococcus epidermidis
GNRIKPTIIEQIKESSEVSE

SEQ ID NO: 1801165 - protein, 28 aa, Staphylococcus epidermidis
GNSGVILSQLFRGFCKNIEGEKEISVQQ

SEQ ID NO: 1801166 - protein, 19 aa, Staphylococcus epidermidis
GNTEAMIQYLLPKATVVTP

SEQ ID NO: 1801167 - protein, 19 aa, Staphylococcus epidermidis
GNVPLPKQFLLLQGKPIII

SEQ ID NO: 1801168 - protein, 21 aa, Staphylococcus epidermidis
GNYEKRVTFGLSGSDANDGII

SEQ ID NO: 1801169 - protein, 25 aa, Staphylococcus epidermidis
GNYTLGVKEQLIFPEIDYDKVTKVR

SEQ ID NO: 1801170 - protein, 17 aa, Staphylococcus epidermidis
GPSDSNYLFDEFITMMK

SEQ ID NO: 1801171 - protein, 20 aa, Staphylococcus epidermidis
GPVPKGYCLIHLNQNRSDCS

SEQ ID NO: 1801172 - protein, 19 aa, Staphylococcus epidermidis
GQALHAGIIGFEHPVTHKY

SEQ ID NO: 1801173 - protein, 25 aa, Staphylococcus epidermidis
GQAPYKFLLSHGFVMDGEGKKMSKS

SEQ ID NO: 1801174 - protein, 25 aa, Staphylococcus epidermidis
GQGMSGGVSYIFSSDVEKFKKVNAL

SEQ ID NO: 1801175 - protein, 23 aa, Staphylococcus epidermidis
GQKGFKLNNLWSVNLDDEDMKES

SEQ ID NO: 1801176 - protein, 18 aa, Staphylococcus epidermidis
GQKRRLSVATALSSKAEI

SEQ ID NO: 1801177 - protein, 18 aa, Staphylococcus epidermidis
GQTESKRQFMLNQIRALI

SEQ ID NO: 1801178 - protein, 18 aa, Staphylococcus epidermidis
GRPYFSFNSKLSAQKVGT

SEQ ID NO: 1801179 - protein, 24 aa, Staphylococcus epidermidis
GRQPEFREAGLFHVAYLLPTRSDL

SEQ ID NO: 1801180 - protein, 19 aa, Staphylococcus epidermidis
GRYIEVIGISIGGGTIKLK

SEQ ID NO: 1801181 - protein, 21 aa, Staphylococcus epidermidis
GSGPIGYYRLDINKKPVGLTI

SEQ ID NO: 1801182 - protein, 20 aa, Staphylococcus epidermidis
GSLVYKGDIPSLIQQSDDHI

SEQ ID NO: 1801183 - protein, 17 aa, Staphylococcus epidermidis
GSVADAFTLFEKFETKL

SEQ ID NO: 1801184 - protein, 26 aa, Staphylococcus epidermidis
GTEPKIKLYVSLSCDHFDVIAQKIND

SEQ ID NO: 1801185 - protein, 17 aa, Staphylococcus epidermidis
GTGCTFSAVITAELAKG

SEQ ID NO: 1801186 - protein, 24 aa, Staphylococcus epidermidis
GTGTALSAYDSWALAKHLKTLPVR

SEQ ID NO: 1801187 - protein, 17 aa, Staphylococcus epidermidis
GTICFDGCSIDPSIKQR

SEQ ID NO: 1801188 - protein, 24 aa, Staphylococcus epidermidis
GTNFGEDILRMYGNIDIEKAKEYQ

SEQ ID NO: 1801189 - protein, 17 aa, Staphylococcus epidermidis
GTVRPMQIGLVYDALSS

SEQ ID NO: 1801190 - protein, 22 aa, Staphylococcus epidermidis
GVPGELCIGGAGLAKGYLNQPK

SEQ ID NO: 1801191 - protein, 20 aa, Staphylococcus epidermidis
GWRYMLEKCEQLLSESKKHI

SEQ ID NO: 1801192 - protein, 28 aa, Staphylococcus epidermidis
GYGHYEVRLPLVPLEEAQCKQVERAFEQ

SEQ ID NO: 1801193 - protein, 29 aa, Staphylococcus epidermidis
GYGHYEVRLPLVPLEEAQCKQVERAFEQF

SEQ ID NO: 1801194 - protein, 17 aa, Staphylococcus epidermidis
HAIDRFKAKAIPQFESL

SEQ ID NO: 1801195 - protein, 21 aa, Staphylococcus epidermidis
HALTNYYLYFLVDSNIEIGIK

SEQ ID NO: 1801196 - protein, 20 aa, Staphylococcus epidermidis
HCYKADPEYGKGVAKALGID

SEQ ID NO: 1801197 - protein, 23 aa, Staphylococcus epidermidis
HEIGETLPDAFAIVHPMHPNFEY

SEQ ID NO: 1801198 - protein, 19 aa, Staphylococcus epidermidis
HELNQLINITTHILNIETG

SEQ ID NO: 1801199 - protein, 23 aa, Staphylococcus epidermidis
HGLHFKGGETVKSISGNQNGEVT

SEQ ID NO: 1801200 - protein, 21 aa, Staphylococcus epidermidis
HGLHFKGGETVQSISGNQNGE

SEQ ID NO: 1801201 - protein, 22 aa, Staphylococcus epidermidis
HGNETLSGLLLVSTSAGIQNET

SEQ ID NO: 1801202 - protein, 31 aa, Staphylococcus epidermidis
HGNSKNHWYEWLRHNLTLEGYDVSLFNLEAN

SEQ ID NO: 1801203 - protein, 22 aa, Staphylococcus epidermidis
HGVEWVLRLPRRPDVYKRTKPE

SEQ ID NO: 1801204 - protein, 20 aa, Staphylococcus epidermidis
HHLDFALAIRTMIIDEEKVS

SEQ ID NO: 1801205 - protein, 17 aa, Staphylococcus epidermidis
HIEDFKDSLNELGLAKE

SEQ ID NO: 1801206 - protein, 24 aa, Staphylococcus epidermidis
HIEEAIDGLLFRTSMNNEENKDMI

SEQ ID NO: 1801207 - protein, 18 aa, Staphylococcus epidermidis
HILSYVIRMFNQLRGTIV

SEQ ID NO: 1801208 - protein, 28 aa, Staphylococcus epidermidis
HINTGVGFLDHMLTLFTFHSGLTLSIEA

SEQ ID NO: 1801209 - protein, 21 aa, Staphylococcus epidermidis
HKCNTVSLLYDFQLAQFNIEP

SEQ ID NO: 1801210 - protein, 17 aa, Staphylococcus epidermidis
HKDRFLKNEYGVTITNR

SEQ ID NO: 1801211 - protein, 33 aa, Staphylococcus epidermidis
HKEGCAYVKDHAMFKCEQRFDIVIASNSGYPLD

SEQ ID NO: 1801212 - protein, 20 aa, Staphylococcus epidermidis
HKKNIDVFLGIPYAKSFNKI

SEQ ID NO: 1801213 - protein, 21 aa, Staphylococcus epidermidis
HKTAIIACINRLLKTIHYLVM

SEQ ID NO: 1801214 - protein, 18 aa, Staphylococcus epidermidis
HLHPQKKHEGLFIINQQL

SEQ ID NO: 1801215 - protein, 26 aa, Staphylococcus epidermidis
HLIPETRRSTILSSKKVGNKVHLESD

SEQ ID NO: 1801216 - protein, 19 aa, Staphylococcus epidermidis
HLQLKGIHFHIGSQIEGTE

SEQ ID NO: 1801217 - protein, 23 aa, Staphylococcus epidermidis
HLRLLYKNEVLDFYKEGKMAYYF

SEQ ID NO: 1801218 - protein, 18 aa, Staphylococcus epidermidis
HMRKRRGEIDFDINEAKV

SEQ ID NO: 1801219 - protein, 19 aa, Staphylococcus epidermidis
HMRKRRGEIDFDINEAKVL

SEQ ID NO: 1801220 - protein, 22 aa, Staphylococcus epidermidis
HNLESAYAFYVEKLGFEHISNF

SEQ ID NO: 1801221 - protein, 18 aa, Staphylococcus epidermidis
HNPKAPKLILNGHVDVAS

SEQ ID NO: 1801222 - protein, 19 aa, Staphylococcus epidermidis
HNPKAPKLILNGHVDVASV

SEQ ID NO: 1801223 - protein, 17 aa, Staphylococcus epidermidis
HNVVFIFQPAEETGGGA

SEQ ID NO: 1801224 - protein, 22 aa, Staphylococcus epidermidis
HNWGNYKLVFSTRHGAHIDTYS

SEQ ID NO: 1801225 - protein, 22 aa, Staphylococcus epidermidis
HNWGNYKLVFSTRHGAHINTYP

SEQ ID NO: 1801226 - protein, 22 aa, Staphylococcus epidermidis
HNWGNYKLVFSTRHGAHINTYS

SEQ ID NO: 1801227 - protein, 22 aa, Staphylococcus epidermidis
HPILKLPNAVVLPHIGSSSQVT

SEQ ID NO: 1801228 - protein, 24 aa, Staphylococcus epidermidis
HQGEYDFLMVMSHVGIFFDEKLCQ

SEQ ID NO: 1801229 - protein, 24 aa, Staphylococcus epidermidis
HSECKDLFKEKGKDILAFSNRVAA

SEQ ID NO: 1801230 - protein, 22 aa, Staphylococcus epidermidis
HSKEGVQLLWASCREVYNVIQA

SEQ ID NO: 1801231 - protein, 18 aa, Staphylococcus epidermidis
HSTNHCDFLHQSSTKNEH

SEQ ID NO: 1801232 - protein, 20 aa, Staphylococcus epidermidis
HTFSRTQAFLNEFAESLSKA

SEQ ID NO: 1801233 - protein, 17 aa, Staphylococcus epidermidis
HTIEFLNIIARVFHRDD

SEQ ID NO: 1801234 - protein, 17 aa, Staphylococcus epidermidis
HTKDIPGSHVVILNESP

SEQ ID NO: 1801235 - protein, 22 aa, Staphylococcus epidermidis
HVERVSKRLGINRWKDNVRQVE

SEQ ID NO: 1801236 - protein, 18 aa, Staphylococcus epidermidis
HVRANWKDVTDIIAAQIL

SEQ ID NO: 1801237 - protein, 17 aa, Staphylococcus epidermidis
HYSESYIDVTARGVDKY

SEQ ID NO: 1801238 - protein, 18 aa, Staphylococcus epidermidis
HYSESYIDVTARGVDKYT

SEQ ID NO: 1801239 - protein, 22 aa, Staphylococcus epidermidis
IAARARGRYGGRPEKLNKQDLK

SEQ ID NO: 1801240 - protein, 24 aa, Staphylococcus epidermidis
IAPFGATILYYFTGHEGPDSCCID

SEQ ID NO: 1801241 - protein, 22 aa, Staphylococcus epidermidis
ICIGMAASMGSFLLAAGAKGKR

SEQ ID NO: 1801242 - protein, 18 aa, Staphylococcus epidermidis
ICQTLGLQSAQSIFEFDH

SEQ ID NO: 1801243 - protein, 19 aa, Staphylococcus epidermidis
IDKQVKIRGFRIELSEIEK

SEQ ID NO: 1801244 - protein, 18 aa, Staphylococcus epidermidis
IDLAVTKSLPCFIDVLET

SEQ ID NO: 1801245 - protein, 23 aa, Staphylococcus epidermidis
IDLTRTWEILGEILGESASDELI

SEQ ID NO: 1801246 - protein, 18 aa, Staphylococcus epidermidis
IDPSIKQRLFKLRQANHN

SEQ ID NO: 1801247 - protein, 20 aa, Staphylococcus epidermidis
IDSLPIKNGVVLDGFSGGNS

SEQ ID NO: 1801248 - protein, 21 aa, Staphylococcus epidermidis
IDYDKFTVHAAIFKEENNMNI

SEQ ID NO: 1801249 - protein, 24 aa, Staphylococcus epidermidis
IEANANRYTFVWKKSIQNHESKMN

SEQ ID NO: 1801250 - protein, 17 aa, Staphylococcus epidermidis
IEILELINNVYDMKFNK

SEQ ID NO: 1801251 - protein, 26 aa, Staphylococcus epidermidis
IEILHVLKRFKAMLIQKNETVEAMQG

SEQ ID NO: 1801252 - protein, 19 aa, Staphylococcus epidermidis
IEISELGLGCMSLGTDYKK

SEQ ID NO: 1801253 - protein, 17 aa, Staphylococcus epidermidis
IEITGSELVRGRGGPRC

SEQ ID NO: 1801254 - protein, 28 aa, Staphylococcus epidermidis
IEKKLSRYPQLYSRIGFAHEFDNLSKDE

SEQ ID NO: 1801255 - protein, 26 aa, Staphylococcus epidermidis
IEKSRLKALYLSVIDRIDIKKDGNHK

SEQ ID NO: 1801256 - protein, 25 aa, Staphylococcus epidermidis
IELTKYLFFTGKGGVGKTTISSFIA

SEQ ID NO: 1801257 - protein, 24 aa, Staphylococcus epidermidis
IEPPEGIYTPCHFDGKQWIGNTKE

SEQ ID NO: 1801258 - protein, 17 aa, Staphylococcus epidermidis
IEQSLREPLLFYRQLIP

SEQ ID NO: 1801259 - protein, 22 aa, Staphylococcus epidermidis
IERGYRSIDTAMIYGNEETVGQ

SEQ ID NO: 1801260 - protein, 19 aa, Staphylococcus epidermidis
IESKPFWNKGYFLKTLGSV

SEQ ID NO: 1801261 - protein, 19 aa, Staphylococcus epidermidis
IESMSQFGMYFTKMNLNLH

SEQ ID NO: 1801262 - protein, 25 aa, Staphylococcus epidermidis
IEYDAIVPTQLWPTLETKAIKNLYT

SEQ ID NO: 1801263 - protein, 17 aa, Staphylococcus epidermidis
IFIPNALIDEEIKFKLI

SEQ ID NO: 1801264 - protein, 26 aa, Staphylococcus epidermidis
IFMKKSRPSTQLTLICKLHDKIYFEQ

SEQ ID NO: 1801265 - protein, 27 aa, Staphylococcus epidermidis
IFTAGKGRSGFVSNSFAMRLNQLGKNA

SEQ ID NO: 1801266 - protein, 17 aa, Staphylococcus epidermidis
IFVDHGLLRKGEGDMVM

SEQ ID NO: 1801267 - protein, 25 aa, Staphylococcus epidermidis
IGAGRIGLGVAKRAQSFGMKILAFD

SEQ ID NO: 1801268 - protein, 18 aa, Staphylococcus epidermidis
IGALKDGRFDEVQNDIEA

SEQ ID NO: 1801269 - protein, 19 aa, Staphylococcus epidermidis
IGANYAGVRGFTASAGPGL

SEQ ID NO: 1801270 - protein, 29 aa, Staphylococcus epidermidis
IGGPPCQGFSLAGKFGRTFIDDPRNQLFK

SEQ ID NO: 1801271 - protein, 22 aa, Staphylococcus epidermidis
IGTRYIKLIFEFLKKERNANAV

SEQ ID NO: 1801272 - protein, 24 aa, Staphylococcus epidermidis
IHDIRRGKVSIVIAGMEGALASVV

SEQ ID NO: 1801273 - protein, 18 aa, Staphylococcus epidermidis
IHELIFFELRERVRFHLE

SEQ ID NO: 1801274 - protein, 17 aa, Staphylococcus epidermidis
IHNCLKQSIDDAIQEGL

SEQ ID NO: 1801275 - protein, 18 aa, Staphylococcus epidermidis
IHRMLPHPINIVRVRLTG

SEQ ID NO: 1801276 - protein, 17 aa, Staphylococcus epidermidis
IHRTFKPLFDELVAEER

SEQ ID NO: 1801277 - protein, 21 aa, Staphylococcus epidermidis
IICKMDFTLALLFILVANDDM

SEQ ID NO: 1801278 - protein, 17 aa, Staphylococcus epidermidis
IIDGIKLSGLSKVIYQH

SEQ ID NO: 1801279 - protein, 31 aa, Staphylococcus epidermidis
IIIHTVEKFLMYKDFDEIIIATPQKWINYMH

SEQ ID NO: 1801280 - protein, 21 aa, Staphylococcus epidermidis
IIKKLLKKAFEDLGLHRIELG

SEQ ID NO: 1801281 - protein, 17 aa, Staphylococcus epidermidis
IINSSKVLPIFQHATES

SEQ ID NO: 1801282 - protein, 17 aa, Staphylococcus epidermidis
IIPHRQPFLLIDKIVEY

SEQ ID NO: 1801283 - protein, 18 aa, Staphylococcus epidermidis
IIRDLRMGTYDAIVGINL

SEQ ID NO: 1801284 - protein, 17 aa, Staphylococcus epidermidis
IIYRGERIINWDPKART

SEQ ID NO: 1801285 - protein, 19 aa, Staphylococcus epidermidis
IKFAQANGITVVIATGRAF

SEQ ID NO: 1801286 - protein, 19 aa, Staphylococcus epidermidis
IKHLARLYKRAGIKHITVQ

SEQ ID NO: 1801287 - protein, 25 aa, Staphylococcus epidermidis
IKILTELHGAPGFEDEVRRYMKSEM

SEQ ID NO: 1801288 - protein, 17 aa, Staphylococcus epidermidis
IKIRPAIDFIEQNLMVS

SEQ ID NO: 1801289 - protein, 23 aa, Staphylococcus epidermidis
IKKELQAVGLLEQIRTGFNKPNK

SEQ ID NO: 1801290 - protein, 25 aa, Staphylococcus epidermidis
IKKLIKRYQLSYIIDDKFNYASNLD

SEQ ID NO: 1801291 - protein, 19 aa, Staphylococcus epidermidis
IKNLENFYDKEGFRDEEFD

SEQ ID NO: 1801292 - protein, 21 aa, Staphylococcus epidermidis
IKRAKLRGERSEGMICSLQEI

SEQ ID NO: 1801293 - protein, 22 aa, Staphylococcus epidermidis
IKRALDIVKDVPLFDRTKQDIH

SEQ ID NO: 1801294 - protein, 20 aa, Staphylococcus epidermidis
IKVASISPELFFQKGDYKGK

SEQ ID NO: 1801295 - protein, 23 aa, Staphylococcus epidermidis
IKYIIEQGGKLVLFSHLGKVKEE

SEQ ID NO: 1801296 - protein, 17 aa, Staphylococcus epidermidis
ILCALDVRAYSPDKFLF

SEQ ID NO: 1801297 - protein, 18 aa, Staphylococcus epidermidis
ILCALDVRAYSPDKFLFI

SEQ ID NO: 1801298 - protein, 28 aa, Staphylococcus epidermidis
ILESRYSECKDLFKEKGKDILAFSNRVA

SEQ ID NO: 1801299 - protein, 23 aa, Staphylococcus epidermidis
ILNQEYDVVPSLISELYQTQTSI

SEQ ID NO: 1801300 - protein, 17 aa, Staphylococcus epidermidis
ILTEPKLSLVKQYEALL

SEQ ID NO: 1801301 - protein, 17 aa, Staphylococcus epidermidis
ILYGHMSPYMIVGMIGA

SEQ ID NO: 1801302 - protein, 17 aa, Staphylococcus epidermidis
IMGMTFHLVCPKELNPT

SEQ ID NO: 1801303 - protein, 28 aa, Staphylococcus epidermidis
IMKISGLELKAGDVIKFDGIHVYRNNLR

SEQ ID NO: 1801304 - protein, 29 aa, Staphylococcus epidermidis
IMPEHIQQMLFDFALERGYIEKLLEMKEE

SEQ ID NO: 1801305 - protein, 17 aa, Staphylococcus epidermidis
IMQPFKVYPNGFPAELV

SEQ ID NO: 1801306 - protein, 19 aa, Staphylococcus epidermidis
INEGALFIPFKGENVDGHR

SEQ ID NO: 1801307 - protein, 36 aa, Staphylococcus epidermidis; identical to SEQ ID NO: 1653793

SEQ ID NO: 1801308 - protein, 17 aa, Staphylococcus epidermidis
INKMNCESIRKLLEINT

SEQ ID NO: 1801309 - protein, 25 aa, Staphylococcus epidermidis
INKRANHVIKCFLQVNVSGEKSKHG

SEQ ID NO: 1801310 - protein, 19 aa, Staphylococcus epidermidis
INLIKLAIDQHIPYTVLRD

SEQ ID NO: 1801311 - protein, 17 aa, Staphylococcus epidermidis
INLKVAEALSGTVTPQG

SEQ ID NO: 1801312 - protein, 21 aa, Staphylococcus epidermidis
INLRKNAKWSNGDSVTAYDFV

SEQ ID NO: 1801313 - protein, 25 aa, Staphylococcus epidermidis
INQFIKLGFVKPFYNGYHKDAKKFL

SEQ ID NO: 1801314 - protein, 24 aa, Staphylococcus epidermidis
INVLRWVHQYIEHFGGDSNNVTLM

SEQ ID NO: 1801315 - protein, 23 aa, Staphylococcus epidermidis
IPIKVLTAYLGYGHYEVRLPLVP

SEQ ID NO: 1801316 - protein, 24 aa, Staphylococcus epidermidis
IPIKVLTAYLGYGHYEVRLPLVPL

SEQ ID NO: 1801317 - protein, 17 aa, Staphylococcus epidermidis
IPNERIKVYVNKVEQTT

SEQ ID NO: 1801318 - protein, 20 aa, Staphylococcus epidermidis
IPQKRQRVFIVGYKNIEFNY

SEQ ID NO: 1801319 - protein, 20 aa, Staphylococcus epidermidis
IPTITIGVPLRYMHSNVSVL

SEQ ID NO: 1801320 - protein, 17 aa, Staphylococcus epidermidis
IPTSILVFKKCREDSDN

SEQ ID NO: 1801321 - protein, 17 aa, Staphylococcus epidermidis
IQPVEIVRNLPIDMSTT

SEQ ID NO: 1801322 - protein, 25 aa, Staphylococcus epidermidis
IQPYLKDTFEKMGLHVIEDEASKNN

SEQ ID NO: 1801323 - protein, 24 aa, Staphylococcus epidermidis
IQRVIRNKKKYGFESTNISSEKVK

SEQ ID NO: 1801324 - protein, 18 aa, Staphylococcus epidermidis
IQYQRFIRHIQFLIYRLT

SEQ ID NO: 1801325 - protein, 17 aa, Staphylococcus epidermidis
IRLEELFNANTVYIQRI

SEQ ID NO: 1801326 - protein, 19 aa, Staphylococcus epidermidis
IRNPIKAILLNIDKKNFDM

SEQ ID NO: 1801327 - protein, 18 aa, Staphylococcus epidermidis
IRNYGVLRAGFTDNKDNI

SEQ ID NO: 1801328 - protein, 24 aa, Staphylococcus epidermidis
ISDKNVKGYAFFKATNGTEEKRPS

SEQ ID NO: 1801329 - protein, 18 aa, Staphylococcus epidermidis
ISEEIPWTKQVGVEAPTE

SEQ ID NO: 1801330 - protein, 24 aa, Staphylococcus epidermidis
ISEEYKVPLMMKFEVQGTNKDIIE

SEQ ID NO: 1801331 - protein, 19 aa, Staphylococcus epidermidis
ISEKRQFVELYKHDKNNCI

SEQ ID NO: 1801332 - protein, 25 aa, Staphylococcus epidermidis
ISGKELRDTLHFEMLWDTSKIDVII

SEQ ID NO: 1801333 - protein, 26 aa, Staphylococcus epidermidis
ISGMMFKGNASKLGFEPKEGDEVLIE

SEQ ID NO: 1801334 - protein, 17 aa, Staphylococcus epidermidis
ISKIKNLTMSYLTQQMT

SEQ ID NO: 1801335 - protein, 19 aa, Staphylococcus epidermidis
ISQLSRFFTGIEIHPGAKI

SEQ ID NO: 1801336 - protein, 20 aa, Staphylococcus epidermidis
ISSAIATLGHYELLTINDAG

SEQ ID NO: 1801337 - protein, 23 aa, Staphylococcus epidermidis
ISSRTMGTVSYTFVTDLPKETYG

SEQ ID NO: 1801338 - protein, 17 aa, Staphylococcus epidermidis
ISTMMLRSMQQAHYDDV

SEQ ID NO: 1801339 - protein, 19 aa, Staphylococcus epidermidis
ITDDGRLSAKEVVGNKKAL

SEQ ID NO: 1801340 - protein, 18 aa, Staphylococcus epidermidis
ITGARYSDVINMTYKDLN

SEQ ID NO: 1801341 - protein, 27 aa, Staphylococcus epidermidis
ITVNAYCPGVAKTEMWDRIDEEMVKLD

SEQ ID NO: 1801342 - protein, 24 aa, Staphylococcus epidermidis
IVKADIGIKNGYIFKIGKAGNPDI

SEQ ID NO: 1801343 - protein, 23 aa, Staphylococcus epidermidis
IVLARRRLVKFDKKINIPYVLNR

SEQ ID NO: 1801344 - protein, 17 aa, Staphylococcus epidermidis
IVQFYTDLNTDGRFLNV

SEQ ID NO: 1801345 - protein, 22 aa, Staphylococcus epidermidis
IVTMAGLINALKIVDKELTNIK

SEQ ID NO: 1801346 - protein, 23 aa, Staphylococcus epidermidis
IWMADERIEAVCRHLISNYHKKT

SEQ ID NO: 1801347 - protein, 17 aa, Staphylococcus epidermidis
IWRSMKDLINYDLIKNG

SEQ ID NO: 1801348 - protein, 22 aa, Staphylococcus epidermidis
KADGKMLVIDGGFSKAYQSTTG

SEQ ID NO: 1801349 - protein, 17 aa, Staphylococcus epidermidis
KADTFKPIRLDRYFPEW

SEQ ID NO: 1801350 - protein, 24 aa, Staphylococcus epidermidis
KAKGLKPRAIRAMIVGIPNVGKST

SEQ ID NO: 1801351 - protein, 17 aa, Staphylococcus epidermidis
KALGEVPIGAVIVKEGQ

SEQ ID NO: 1801352 - protein, 18 aa, Staphylococcus epidermidis
KALVSALKKYPALNTSFN

SEQ ID NO: 1801353 - protein, 18 aa, Staphylococcus epidermidis
KARYSTVIILDGLEDPHN

SEQ ID NO: 1801354 - protein, 22 aa, Staphylococcus epidermidis
KAYFKRYALTASGVSPRPIPGV

SEQ ID NO: 1801355 - protein, 20 aa, Staphylococcus epidermidis
KDDVKVGFIALEQNDNKMNI

SEQ ID NO: 1801356 - protein, 17 aa, Staphylococcus epidermidis
KDEQEFLNVLQLAKEQN

SEQ ID NO: 1801357 - protein, 20 aa, Staphylococcus epidermidis
KDKDVPVWLDRNSPFNIEGG

SEQ ID NO: 1801358 - protein, 20 aa, Staphylococcus epidermidis
KDLNKANGIIHLPGTKTKNS

SEQ ID NO: 1801359 - protein, 18 aa, Staphylococcus epidermidis
KDNSEFFDDVDMNLVEWL

SEQ ID NO: 1801360 - protein, 20 aa, Staphylococcus epidermidis
KDPNKCAIFCANIGGDTDTI

SEQ ID NO: 1801361 - protein, 25 aa, Staphylococcus epidermidis
KDPYRVGLKLKDGGWVYVQGLTHYE

SEQ ID NO: 1801362 - protein, 18 aa, Staphylococcus epidermidis
KDSQELDVLLSLESDLIV

SEQ ID NO: 1801363 - protein, 17 aa, Staphylococcus epidermidis
KDTHLILGGQVMSKEDI

SEQ ID NO: 1801364 - protein, 17 aa, Staphylococcus epidermidis
KDTKAWLREYFKGNYPE

SEQ ID NO: 1801365 - protein, 24 aa, Staphylococcus epidermidis
KDYGFKFDSARPMQIGLVYDALKN

SEQ ID NO: 1801366 - protein, 23 aa, Staphylococcus epidermidis
KDYGFNIIIAGSFSDIFYMNCTK

SEQ ID NO: 1801367 - protein, 22 aa, Staphylococcus epidermidis
KEERTIYLPNAFHPLLDKDTVV

SEQ ID NO: 1801368 - protein, 20 aa, Staphylococcus epidermidis
KEFKEKGYQAVAFKSDVSKK

SEQ ID NO: 1801369 - protein, 22 aa, Staphylococcus epidermidis
KEIISTITVCYSWSSVKPISGY

SEQ ID NO: 1801370 - protein, 18 aa, Staphylococcus epidermidis
KEITAAFAGEILDTHKEG

SEQ ID NO: 1801371 - protein, 17 aa, Staphylococcus epidermidis
KELKRLGINATIRREQG

SEQ ID NO: 1801372 - protein, 20 aa, Staphylococcus epidermidis
KENRLFYLAMSPKFLELQQT

SEQ ID NO: 1801373 - protein, 17 aa, Staphylococcus epidermidis
KEPDLLLLDEPTNHLDM

SEQ ID NO: 1801374 - protein, 25 aa, Staphylococcus epidermidis
KEPEGIAAKVLVSFNITEDKVIEEV

SEQ ID NO: 1801375 - protein, 21 aa, Staphylococcus epidermidis
KEQQERITLYLKYNTKKPNTI

SEQ ID NO: 1801376 - protein, 19 aa, Staphylococcus epidermidis
KESVISGMMFKGNASKLGF

SEQ ID NO: 1801377 - protein, 17 aa, Staphylococcus epidermidis
KEVLNFIDDNTIVTILT

SEQ ID NO: 1801378 - protein, 17 aa, Staphylococcus epidermidis
KEVSFDNFVDFIRWMKT

SEQ ID NO: 1801379 - protein, 20 aa, Staphylococcus epidermidis
KEYAEGHIIGGHKKDIRKQV

SEQ ID NO: 1801380 - protein, 20 aa, Staphylococcus epidermidis
KFAFEKAIIYAFNILNMHKI

SEQ ID NO: 1801381 - protein, 19 aa, Staphylococcus epidermidis
KFEDVRIVRDMRNSVNRLV

SEQ ID NO: 1801382 - protein, 22 aa, Staphylococcus epidermidis
KFHGGCATNIIADEVTLEAEAR

SEQ ID NO: 1801383 - protein, 26 aa, Staphylococcus epidermidis
KFNMIFQFEHLGLWSTGDTKFDVKSY

SEQ ID NO: 1801384 - protein, 19 aa, Staphylococcus epidermidis
KFVYFLVNGCILHESSNIT

SEQ ID NO: 1801385 - protein, 18 aa, Staphylococcus epidermidis
KFYVDRETESWIDEKEGR

SEQ ID NO: 1801386 - protein, 18 aa, Staphylococcus epidermidis
KGDDLQYTMTITFEEAVF

SEQ ID NO: 1801387 - protein, 18 aa, Staphylococcus epidermidis
KGDEILREAGIEVEFQYN

SEQ ID NO: 1801388 - protein, 17 aa, Staphylococcus epidermidis
KGDTCIAGGGSDGNIMN

SEQ ID NO: 1801389 - protein, 18 aa, Staphylococcus epidermidis
KGGGGALFREKVIDEMAD

SEQ ID NO: 1801390 - protein, 17 aa, Staphylococcus epidermidis
KGIDKSSPFFKGDGNTV

SEQ ID NO: 1801391 - protein, 19 aa, Staphylococcus epidermidis
KGKPFSISSITYILANPFY

SEQ ID NO: 1801392 - protein, 25 aa, Staphylococcus epidermidis
KGNIIKATHVQYLFKQNNNIPNDVL

SEQ ID NO: 1801393 - protein, 20 aa, Staphylococcus epidermidis
KGPIGRYETVLAIIKDKQPT

SEQ ID NO: 1801394 - protein, 19 aa, Staphylococcus epidermidis
KGSFEIEGTSLFELQARQL

SEQ ID NO: 1801395 - protein, 20 aa, Staphylococcus epidermidis
KGTELDTYYLLDQAIDANVD

SEQ ID NO: 1801396 - protein, 19 aa, Staphylococcus epidermidis
KGTLFIGAIHKRWSRLELG

SEQ ID NO: 1801397 - protein, 23 aa, Staphylococcus epidermidis
KGYIRISYAYNMETLKKGMHRLE

SEQ ID NO: 1801398 - protein, 26 aa, Staphylococcus epidermidis
KGYRYARYVDDISFPFNFEEEKDKFY

SEQ ID NO: 1801399 - protein, 19 aa, Staphylococcus epidermidis
KHFMKKKQGLLLFSGPTGS

SEQ ID NO: 1801400 - protein, 20 aa, Staphylococcus epidermidis
KHHFDCAMIFISHDLTVINK

SEQ ID NO: 1801401 - protein, 21 aa, Staphylococcus epidermidis
KHHYSQRHLKLFDNLSDKRTT

SEQ ID NO: 1801402 - protein, 20 aa, Staphylococcus epidermidis
KIIGFAYCYTLLRPDGKTMF

SEQ ID NO: 1801403 - protein, 19 aa, Staphylococcus epidermidis
KIRNHGVLRAGFTDNKDNI

SEQ ID NO: 1801404 - protein, 23 aa, Staphylococcus epidermidis
KIRYLINEVCHKYQIPWVYGAAV

SEQ ID NO: 1801405 - protein, 18 aa, Staphylococcus epidermidis
KISHRGNAILLLKEYLEG

SEQ ID NO: 1801406 - protein, 17 aa, Staphylococcus epidermidis
KKALKLTETLEMPKPDK

SEQ ID NO: 1801407 - protein, 17 aa, Staphylococcus epidermidis
KKAPGNHDYAFWDKAIE

SEQ ID NO: 1801408 - protein, 19 aa, Staphylococcus epidermidis
KKDPKVIVYAGMSLAQKND

SEQ ID NO: 1801409 - protein, 22 aa, Staphylococcus epidermidis
KKFPDALFIFLAPPSLDDLRER

SEQ ID NO: 1801410 - protein, 23 aa, Staphylococcus epidermidis
KKGRKIEWLEFSFEPEKRIHSKR

SEQ ID NO: 1801411 - protein, 23 aa, Staphylococcus epidermidis
KKGRKIEWLEFTFDAEKRIHNKR

SEQ ID NO: 1801412 - protein, 23 aa, Staphylococcus epidermidis
KKGRKIEWLEFTFDAEKRIHSKR

SEQ ID NO: 1801413 - protein, 20 aa, Staphylococcus epidermidis
KKIMKNYNWEYFKSQINKKL

SEQ ID NO: 1801414 - protein, 23 aa, Staphylococcus epidermidis
KKITWNWGGTFYPNAPKSGIRVR

SEQ ID NO: 1801415 - protein, 25 aa, Staphylococcus epidermidis
KKLDEGEAILAKRGAVKLITKRDFF

SEQ ID NO: 1801416 - protein, 24 aa, Staphylococcus epidermidis
KKLFKYAHKKALAFTPEDREKVKD

SEQ ID NO: 1801417 - protein, 18 aa, Staphylococcus epidermidis
KKNRRSLQIYGFSPCHEI

SEQ ID NO: 1801418 - protein, 18 aa, Staphylococcus epidermidis
KKPACTVITMYPHLDGVL

SEQ ID NO: 1801419 - protein, 19 aa, Staphylococcus epidermidis
KKTNLEKISRKNLNRDLKI

SEQ ID NO: 1801420 - protein, 29 aa, Staphylococcus epidermidis
KKYDEKFYHSLGFANTYAFMVTKETAKKY

SEQ ID NO: 1801421 - protein, 19 aa, Staphylococcus epidermidis
KKYNQTFFNSYGFENTYAL

SEQ ID NO: 1801422 - protein, 17 aa, Staphylococcus epidermidis
KKYPKKDVVAVFQPHTF

SEQ ID NO: 1801423 - protein, 20 aa, Staphylococcus epidermidis
KLAGAVLKKDLDTFAKKMDY

SEQ ID NO: 1801424 - protein, 24 aa, Staphylococcus epidermidis
KLAPKSKADFAFIQHMIHYLDDNG

SEQ ID NO: 1801425 - protein, 25 aa, Staphylococcus epidermidis
KLAPKSKADFAFIQHMIYHLDDEGT

SEQ ID NO: 1801426 - protein, 22 aa, Staphylococcus epidermidis
KLCRKCSRYLVISLNANVKPSV

SEQ ID NO: 1801427 - protein, 30 aa, Staphylococcus epidermidis
KLEFSIAVVSLRKDIGWSQMQFAQKLKVPQ

SEQ ID NO: 1801428 - protein, 19 aa, Staphylococcus epidermidis
KLINLWKDQTVLIVEHKVE

SEQ ID NO: 1801429 - protein, 19 aa, Staphylococcus epidermidis
KLLENQQVLALESNKKIQK

SEQ ID NO: 1801430 - protein, 24 aa, Staphylococcus epidermidis
KLNIKKLGERVFLDSGTLTPLLKK

SEQ ID NO: 1801431 - protein, 19 aa, Staphylococcus epidermidis
KLYKFFLLIAKYIKRKEAF

SEQ ID NO: 1801432 - protein, 22 aa, Staphylococcus epidermidis
KMSAEAKIMYALLKDRFELSLQ

SEQ ID NO: 1801433 - protein, 18 aa, Staphylococcus epidermidis
KMVHDFPIYPIRQSHKVL

SEQ ID NO: 1801434 - protein, 19 aa, Staphylococcus epidermidis
KNDVDVEKIIQRVIRNKKK

SEQ ID NO: 1801435 - protein, 19 aa, Staphylococcus epidermidis
KNDYKLTLENYVLIYYLEK

SEQ ID NO: 1801436 - protein, 19 aa, Staphylococcus epidermidis
KNEGQPAVDRWLKTLQAGG

SEQ ID NO: 1801437 - protein, 25 aa, Staphylococcus epidermidis
KNETVEAMQGYLMQSIKAELEEIHA

SEQ ID NO: 1801438 - protein, 20 aa, Staphylococcus epidermidis
KNGQLKPGYNLQIATNSQFV

SEQ ID NO: 1801439 - protein, 17 aa, Staphylococcus epidermidis
KNGTNFMILDGNNEPIV

SEQ ID NO: 1801440 - protein, 17 aa, Staphylococcus epidermidis
KNIALLFEKDSTRTRCA

SEQ ID NO: 1801441 - protein, 20 aa, Staphylococcus epidermidis
KNIQIGMAHRGRLNVLTHVL

SEQ ID NO: 1801442 - protein, 25 aa, Staphylococcus epidermidis
KNTVPRSYISPTIIVGPDYYMGIGS

SEQ ID NO: 1801443 - protein, 22 aa, Staphylococcus epidermidis
KPEIRMPKVGGRVMSLQDPTKK

SEQ ID NO: 1801444 - protein, 17 aa, Staphylococcus epidermidis
KPENCVAQLIELPFTST

SEQ ID NO: 1801445 - protein, 17 aa, Staphylococcus epidermidis
KPEPIIMSKSLDILGLE

SEQ ID NO: 1801446 - protein, 19 aa, Staphylococcus epidermidis
KPKCEICPLLYDCREGQKR

SEQ ID NO: 1801447 - protein, 38 aa, Staphylococcus epidermidis; identical to SEQ ID NO: 1657974

SEQ ID NO: 1801448 - protein, 18 aa, Staphylococcus epidermidis
KPMILYGHMSPYMIVGMI

SEQ ID NO: 1801449 - protein, 23 aa, Staphylococcus epidermidis
KPNRKAPKQISFRVSESEYLKLQ

SEQ ID NO: 1801450 - protein, 31 aa, Staphylococcus epidermidis
KPPKLIEHLLEIRGLGIINVMTLFGAGSILT

SEQ ID NO: 1801451 - protein, 28 aa, Staphylococcus epidermidis
KPRGLFRKKKFSPVVGDIVDFEVQNTKE

SEQ ID NO: 1801452 - protein, 18 aa, Staphylococcus epidermidis
KPTFNDWGECATRIVHMY

SEQ ID NO: 1801453 - protein, 20 aa, Staphylococcus epidermidis
KPVGLTINIKYNFLPEKTTI

SEQ ID NO: 1801454 - protein, 18 aa, Staphylococcus epidermidis
KQARSYKKKLSDAISKTH

SEQ ID NO: 1801455 - protein, 22 aa, Staphylococcus epidermidis
KQEKRHETTIEFYRKELQERSK

SEQ ID NO: 1801456 - protein, 17 aa, Staphylococcus epidermidis
KQLRQAFEKDIEQSKLL

SEQ ID NO: 1801457 - protein, 20 aa, Staphylococcus epidermidis
KQMVEAGNGFAIISKSALHP

SEQ ID NO: 1801458 - protein, 21 aa, Staphylococcus epidermidis
KQMVEAGNGFAIISKSALHPE

SEQ ID NO: 1801459 - protein, 18 aa, Staphylococcus epidermidis
KQRINANEFALYSGNDDN

SEQ ID NO: 1801460 - protein, 20 aa, Staphylococcus epidermidis
KQTIHYHLKSLPSNLKVNKV

SEQ ID NO: 1801461 - protein, 23 aa, Staphylococcus epidermidis
KRDEESYVLLYLLGITGARYSDV

SEQ ID NO: 1801462 - protein, 22 aa, Staphylococcus epidermidis
KRGFNCYDELMIYYIKSLNGLG

SEQ ID NO: 1801463 - protein, 20 aa, Staphylococcus epidermidis
KRIDLYFKHNLKNYQTMKIN

SEQ ID NO: 1801464 - protein, 24 aa, Staphylococcus epidermidis
KRINEVGIPIIFVINQIDKHNEEE

SEQ ID NO: 1801465 - protein, 23 aa, Staphylococcus epidermidis
KRKIRKDAVKHIDGMITSDNEFF

SEQ ID NO: 1801466 - protein, 24 aa, Staphylococcus epidermidis
KRLYKQGYRLEAIDEQQKPKVTEL

SEQ ID NO: 1801467 - protein, 24 aa, Staphylococcus epidermidis
KRPSTSGVLDVEFIDPMKGLIGVT

SEQ ID NO: 1801468 - protein, 26 aa, Staphylococcus epidermidis
KRSSGKIAFLQLRDGTGFMQGVVVKS

SEQ ID NO: 1801469 - protein, 17 aa, Staphylococcus epidermidis
KSAPTPVFHKNHETGKE

SEQ ID NO: 1801470 - protein, 23 aa, Staphylococcus epidermidis
KSKRPGLDKAIEFARAGDTIVVW

SEQ ID NO: 1801471 - protein, 19 aa, Staphylococcus epidermidis
KSLLEAGLDFKIPGITIDR

SEQ ID NO: 1801472 - protein, 25 aa, Staphylococcus epidermidis
KSLTGACPMGPYIVTKDELPTPENV

SEQ ID NO: 1801473 - protein, 17 aa, Staphylococcus epidermidis
KSMTHRAIMLASLAKGI

SEQ ID NO: 1801474 - protein, 32 aa, Staphylococcus epidermidis
KSNLCKNRFCPVCAWRKARKDALGLSLMMQYI

SEQ ID NO: 1801475 - protein, 22 aa, Staphylococcus epidermidis
KSPGNYHVVGGYGSKGGPSTSN

SEQ ID NO: 1801476 - protein, 17 aa, Staphylococcus epidermidis
KSRRLGISLSGTGKELE

SEQ ID NO: 1801477 - protein, 18 aa, Staphylococcus epidermidis
KSVVGSSLVKTAIFGEDP

SEQ ID NO: 1801478 - protein, 18 aa, Staphylococcus epidermidis
KTDELFADFREFGNKNLY

SEQ ID NO: 1801479 - protein, 24 aa, Staphylococcus epidermidis
KTEFPKYIKVCELLHLYQSFYQTF

SEQ ID NO: 1801480 - protein, 20 aa, Staphylococcus epidermidis
KTNIPFLINVMRNDKFRSGD

SEQ ID NO: 1801481 - protein, 25 aa, Staphylococcus epidermidis
KTSLMKVILGYSIYQEGNFEVIENK

SEQ ID NO: 1801482 - protein, 18 aa, Staphylococcus epidermidis
KVAKTESLDQLFNQFNTE

SEQ ID NO: 1801483 - protein, 18 aa, Staphylococcus epidermidis
KVIARAGVGVDNINIEAA

SEQ ID NO: 1801484 - protein, 17 aa, Staphylococcus epidermidis
KVLDPLFNAFDVEPGQV

SEQ ID NO: 1801485 - protein, 25 aa, Staphylococcus epidermidis
KVLNRFKEVYSIFSDVLGIPLKSKE

SEQ ID NO: 1801486 - protein, 18 aa, Staphylococcus epidermidis
KVVKRLAKEMSIGVITND

SEQ ID NO: 1801487 - protein, 21 aa, Staphylococcus epidermidis
KWIVDHWVTHFGIEKTENIAQ

SEQ ID NO: 1801488 - protein, 26 aa, Staphylococcus epidermidis
KYGVGRRISLHYTREMVDQAISGKLK

SEQ ID NO: 1801489 - protein, 24 aa, Staphylococcus epidermidis
KYIIPELQRRSLFKNSYNQPTLRT

SEQ ID NO: 1801490 - protein, 26 aa, Staphylococcus epidermidis
KYNQIRYVYTFLKYVDGVQVIGNKVG

SEQ ID NO: 1801491 - protein, 18 aa, Staphylococcus epidermidis
KYPYIRGKLLDLWTEALE

SEQ ID NO: 1801492 - protein, 22 aa, Staphylococcus epidermidis
LAEPEKTVVCFVGDGSFQMTNQ

SEQ ID NO: 1801493 - protein, 17 aa, Staphylococcus epidermidis
LAGGVAVIKVGAASETE

SEQ ID NO: 1801494 - protein, 19 aa, Staphylococcus epidermidis
LAKEMSIGVITNDIYTKED

SEQ ID NO: 1801495 - protein, 18 aa, Staphylococcus epidermidis
LASARARGRVGGRPPMPD

SEQ ID NO: 1801496 - protein, 23 aa, Staphylococcus epidermidis
LDGEFEMGIDIDTLVKFNLKKDQ

SEQ ID NO: 1801497 - protein, 19 aa, Staphylococcus epidermidis
LDIRYTIRTETKIKKFVLF

SEQ ID NO: 1801498 - protein, 20 aa, Staphylococcus epidermidis
LDKCDEAGVYGLIIPDLPYE

SEQ ID NO: 1801499 - protein, 18 aa, Staphylococcus epidermidis
LDKDSVILLEQIRTLDKK

SEQ ID NO: 1801500 - protein, 23 aa, Staphylococcus epidermidis
LDKKLRFAQFADIDSTLVGQPGD

SEQ ID NO: 1801501 - protein, 23 aa, Staphylococcus epidermidis
LDTVWTFAEKVIFPYVEDDELVG

SEQ ID NO: 1801502 - protein, 20 aa, Staphylococcus epidermidis
LEDLCDRFLLLENHQIREID

SEQ ID NO: 1801503 - protein, 18 aa, Staphylococcus epidermidis
LEIYEYVHQILPLSRNRE

SEQ ID NO: 1801504 - protein, 17 aa, Staphylococcus epidermidis
LEMIGLVAEVQELKANP

SEQ ID NO: 1801505 - protein, 22 aa, Staphylococcus epidermidis
LENDELWPRHATMIHGDLHPGH

SEQ ID NO: 1801506 - protein, 26 aa, Staphylococcus epidermidis
LEVAADSYLKLRFIQKSILKAIDSEW

SEQ ID NO: 1801507 - protein, 17 aa, Staphylococcus epidermidis
LFEHGIFVSYLRYPTVS

SEQ ID NO: 1801508 - protein, 18 aa, Staphylococcus epidermidis
LFEHGIFVSYLRYPTVSQ

SEQ ID NO: 1801509 - protein, 17 aa, Staphylococcus epidermidis
LFLIEILQYNWEEVHQE

SEQ ID NO: 1801510 - protein, 19 aa, Staphylococcus epidermidis
LFNAMVMTPYFPKPDVLIY

SEQ ID NO: 1801511 - protein, 22 aa, Staphylococcus epidermidis
LFYMKHQFRTVATMGIGGGIGN

SEQ ID NO: 1801512 - protein, 17 aa, Staphylococcus epidermidis
LGFKHKGFKEGLSKDYI

SEQ ID NO: 1801513 - protein, 17 aa, Staphylococcus epidermidis
LGGVCLNVGCIPSKALL

SEQ ID NO: 1801514 - protein, 21 aa, Staphylococcus epidermidis
LGHDMGGIIASEFTEKYQYKV

SEQ ID NO: 1801515 - protein, 17 aa, Staphylococcus epidermidis
LGIEFTVSGLNRVYKND

SEQ ID NO: 1801516 - protein, 18 aa, Staphylococcus epidermidis
LGKSQSFIANKLRLLKLA

SEQ ID NO: 1801517 - protein, 22 aa, Staphylococcus epidermidis
LGQAGVNIMGFCKEFNARTQEQ

SEQ ID NO: 1801518 - protein, 18 aa, Staphylococcus epidermidis
LGRLKPLLNEGTVTVGNS

SEQ ID NO: 1801519 - protein, 20 aa, Staphylococcus epidermidis
LGTFKFTVRDSLINQIESDI

SEQ ID NO: 1801520 - protein, 18 aa, Staphylococcus epidermidis
LGVCICGTGVGISNAANK

SEQ ID NO: 1801521 - protein, 18 aa, Staphylococcus epidermidis
LGVEGLKILKNVKDKYNL

SEQ ID NO: 1801522 - protein, 24 aa, Staphylococcus epidermidis
LGYKEIKGTFLTPEIYSTMSEEEQ

SEQ ID NO: 1801523 - protein, 27 aa, Staphylococcus epidermidis
LGYSMGGRVALYYAIHGNETLSGLLLV

SEQ ID NO: 1801524 - protein, 22 aa, Staphylococcus epidermidis
LHGDLWKGNILFQKNGDPILCD

SEQ ID NO: 1801525 - protein, 18 aa, Staphylococcus epidermidis
LIELAQWLENNNIELQII

SEQ ID NO: 1801526 - protein, 24 aa, Staphylococcus epidermidis
LIKDLRRLGLRVYFNINNALVSLG

SEQ ID NO: 1801527 - protein, 17 aa, Staphylococcus epidermidis
LIMSGNVLKVLVSNDIE

SEQ ID NO: 1801528 - protein, 17 aa, Staphylococcus epidermidis
LKALEPMGEEYLNVVKE

SEQ ID NO: 1801529 - protein, 19 aa, Staphylococcus epidermidis
LKFNKKIQMIFQDPYASLN

SEQ ID NO: 1801530 - protein, 26 aa, Staphylococcus epidermidis
LKGENTFKISAYRKAAQSLEVDERTL

SEQ ID NO: 1801531 - protein, 24 aa, Staphylococcus epidermidis
LKHLSFILHKALRKISFNVRDKIY

SEQ ID NO: 1801532 - protein, 26 aa, Staphylococcus epidermidis
LKIIAKETGCIIIALSQLSRGVESRS

SEQ ID NO: 1801533 - protein, 20 aa, Staphylococcus epidermidis
LKIKSKDPFEKPSIVFNYLS

SEQ ID NO: 1801534 - protein, 17 aa, Staphylococcus epidermidis
LKKEFVISFRDLSNTLI

SEQ ID NO: 1801535 - protein, 20 aa, Staphylococcus epidermidis
LKLRKQIRQLAAIYLASGID

SEQ ID NO: 1801536 - protein, 17 aa, Staphylococcus epidermidis
LKLRKSLNLFANIRPTF

SEQ ID NO: 1801537 - protein, 20 aa, Staphylococcus epidermidis
LKNILKYYYGTLIIVSHDRA

SEQ ID NO: 1801538 - protein, 24 aa, Staphylococcus epidermidis
LKNNIKKAWWQKFISQSPYNVGID

SEQ ID NO: 1801539 - protein, 20 aa, Staphylococcus epidermidis
LKPMLARGELHCIGATTLNE

SEQ ID NO: 1801540 - protein, 23 aa, Staphylococcus epidermidis
LKQHNIHVIPLSLTIDGKSYTDQ

SEQ ID NO: 1801541 - protein, 24 aa, Staphylococcus epidermidis
LKQKIKCPCCNATLTNMTIRKKNH

SEQ ID NO: 1801542 - protein, 21 aa, Staphylococcus epidermidis
LKRETSILITGGFRPSAEIIR

SEQ ID NO: 1801543 - protein, 22 aa, Staphylococcus epidermidis
LKRIGLNVIWIIKDVPLKDKYV

SEQ ID NO: 1801544 - protein, 26 aa, Staphylococcus epidermidis
LKSLKDSRFPFSIMWIEELAEFKTED

SEQ ID NO: 1801545 - protein, 19 aa, Staphylococcus epidermidis
LKSSYLLDNEEGLLLKNIL

SEQ ID NO: 1801546 - protein, 24 aa, Staphylococcus epidermidis
LKTTYRISIEEFVVLYKVYADTKI

SEQ ID NO: 1801547 - protein, 23 aa, Staphylococcus epidermidis
LLEYIKELEEILADEEVLLQLVR

SEQ ID NO: 1801548 - protein, 24 aa, Staphylococcus epidermidis
LLIKGENVMKGYLYPKYLKDTFDN

SEQ ID NO: 1801549 - protein, 22 aa, Staphylococcus epidermidis
LLNKHKMGILFQKTEFPKYIKV

SEQ ID NO: 1801550 - protein, 21 aa, Staphylococcus epidermidis
LLSKVKFRVFVTFQYDKRQIL

SEQ ID NO: 1801551 - protein, 20 aa, Staphylococcus epidermidis
LLWASCREVYNVIQADEIGA

SEQ ID NO: 1801552 - protein, 20 aa, Staphylococcus epidermidis
LNDKAILTLQGFKYNLNQEH

SEQ ID NO: 1801553 - protein, 23 aa, Staphylococcus epidermidis
LNEEVRKAIGMDSNFTSIQEKSE

SEQ ID NO: 1801554 - protein, 17 aa, Staphylococcus epidermidis
LNIAEIFTHPDMVLDID

SEQ ID NO: 1801555 - protein, 25 aa, Staphylococcus epidermidis
LNIDHLYAYQFEKIALIGGNGTGKT

SEQ ID NO: 1801556 - protein, 20 aa, Staphylococcus epidermidis
LNIGGGFGIKYVEGDESFPI

SEQ ID NO: 1801557 - protein, 24 aa, Staphylococcus epidermidis
LNKLLENQQILALESNKKIQKLES

SEQ ID NO: 1801558 - protein, 19 aa, Staphylococcus epidermidis
LNLGRKLGFELSTAKESRI

SEQ ID NO: 1801559 - protein, 25 aa, Staphylococcus epidermidis
LNNAPELKANFNFIKKIDGNSITII

SEQ ID NO: 1801560 - protein, 25 aa, Staphylococcus epidermidis
LNNAPELKANFNFIKKIDSNSITII

SEQ ID NO: 1801561 - protein, 20 aa, Staphylococcus epidermidis
LNNILKYYYGTLIIVSHDRA

SEQ ID NO: 1801562 - protein, 17 aa, Staphylococcus epidermidis
LNPESSWQDRARVKNLR

SEQ ID NO: 1801563 - protein, 25 aa, Staphylococcus epidermidis
LNPEYLKLAVMPKCQEDVLHLLEAM

SEQ ID NO: 1801564 - protein, 24 aa, Staphylococcus epidermidis
LNTTFYRKFIKWYGDDHATETVRK

SEQ ID NO: 1801565 - protein, 19 aa, Staphylococcus epidermidis
LNVGCIPSKALLHASHRFV

SEQ ID NO: 1801566 - protein, 22 aa, Staphylococcus epidermidis
LPEERLFRKYAHKIRNWEDDKQ

SEQ ID NO: 1801567 - protein, 17 aa, Staphylococcus epidermidis
LPGLSIMKRMNRIAQTI

SEQ ID NO: 1801568 - protein, 18 aa, Staphylococcus epidermidis
LPKGRKPIKTSWAKHEQY

SEQ ID NO: 1801569 - protein, 19 aa, Staphylococcus epidermidis
LPLVKKGGQFLALKSSKGE

SEQ ID NO: 1801570 - protein, 17 aa, Staphylococcus epidermidis
LPLVVFTGQVATPGIGK

SEQ ID NO: 1801571 - protein, 21 aa, Staphylococcus epidermidis
LPSDIKLHFIGSLQSRKVKDI

SEQ ID NO: 1801572 - protein, 20 aa, Staphylococcus epidermidis
LPVIPEFADDTLIGGNGSII

SEQ ID NO: 1801573 - protein, 19 aa, Staphylococcus epidermidis
LQDRYMKAVNTAANYVKAI

SEQ ID NO: 1801574 - protein, 17 aa, Staphylococcus epidermidis
LQILKLLFQNENKYVSR

SEQ ID NO: 1801575 - protein, 18 aa, Staphylococcus epidermidis
LQMKEILGTIGGNDTLMI

SEQ ID NO: 1801576 - protein, 19 aa, Staphylococcus epidermidis
LQNDLEKRESLHQDIDPLL

SEQ ID NO: 1801577 - protein, 23 aa, Staphylococcus epidermidis
LQPISNRGIGFYNLDKNTAKFQF

SEQ ID NO: 1801578 - protein, 22 aa, Staphylococcus epidermidis
LRCALKDMNIELSAEIKYQRMP

SEQ ID NO: 1801579 - protein, 18 aa, Staphylococcus epidermidis
LREPLLFYRQLIPQNIKN

SEQ ID NO: 1801580 - protein, 17 aa, Staphylococcus epidermidis
LRIPNKVKDVAVGDTKI

SEQ ID NO: 1801581 - protein, 23 aa, Staphylococcus epidermidis
LRKQFPNEEFKFYDKAINIPIND

SEQ ID NO: 1801582 - protein, 21 aa, Staphylococcus epidermidis
LRLLYKNDVLDFYKEGKMAYY

SEQ ID NO: 1801583 - protein, 22 aa, Staphylococcus epidermidis
LRLLYKNEVLDFYKDGKMAYYF

SEQ ID NO: 1801584 - protein, 19 aa, Staphylococcus epidermidis
LRMHYLISNALDLSGYENF

SEQ ID NO: 1801585 - protein, 17 aa, Staphylococcus epidermidis
LRMSQNIKPVYKMVDTC

SEQ ID NO: 1801586 - protein, 20 aa, Staphylococcus epidermidis
LRNSDEFIPDLSLVALHRDK

SEQ ID NO: 1801587 - protein, 17 aa, Staphylococcus epidermidis
LRSGAMASVAPIIKEVK

SEQ ID NO: 1801588 - protein, 23 aa, Staphylococcus epidermidis
LRVPHGAGGIVLDVKVFNREEGD

SEQ ID NO: 1801589 - protein, 18 aa, Staphylococcus epidermidis
LSAYEVVNQWSYEALVKI

SEQ ID NO: 1801590 - protein, 17 aa, Staphylococcus epidermidis
LSFGRIGGYNTYGDLQR

SEQ ID NO: 1801591 - protein, 26 aa, Staphylococcus epidermidis
LSGGQRQRAYIAMTIAQDTDYILLDE

SEQ ID NO: 1801592 - protein, 19 aa, Staphylococcus epidermidis
LSGMKGRKILILADVLELG

SEQ ID NO: 1801593 - protein, 19 aa, Staphylococcus epidermidis
LSKFKHFRALGGEVEAFFP

SEQ ID NO: 1801594 - protein, 20 aa, Staphylococcus epidermidis
LSKFKHFRALGGEVEAFFPS

SEQ ID NO: 1801595 - protein, 18 aa, Staphylococcus epidermidis
LSMYPIKNLENFYDKEGF

SEQ ID NO: 1801596 - protein, 25 aa, Staphylococcus epidermidis
LSNERVVPVKGIRKAIAQNMVTSVS

SEQ ID NO: 1801597 - protein, 17 aa, Staphylococcus epidermidis
LSRYSGIIVSTEQQKTD

SEQ ID NO: 1801598 - protein, 20 aa, Staphylococcus epidermidis
LTASHIWSFNDAMKIGDDEA

SEQ ID NO: 1801599 - protein, 18 aa, Staphylococcus epidermidis
LTDLRSLNIDHLYAYQFE

SEQ ID NO: 1801600 - protein, 31 aa, Staphylococcus epidermidis; identical to SEQ ID NO: 1660774

SEQ ID NO: 1801601 - protein, 20 aa, Staphylococcus epidermidis
LTEREMEILLLIAKGYSNQE

SEQ ID NO: 1801602 - protein, 17 aa, Staphylococcus epidermidis
LTETKLLNANRVNIQGS

SEQ ID NO: 1801603 - protein, 17 aa, Staphylococcus epidermidis
LTKDPKYLIGRIIARPY

SEQ ID NO: 1801604 - protein, 24 aa, Staphylococcus epidermidis
LTNKKAHKNHLWFHTKDIPGSHVV

SEQ ID NO: 1801605 - protein, 18 aa, Staphylococcus epidermidis
LTREFPLNRTEDFAKALS

SEQ ID NO: 1801606 - protein, 19 aa, Staphylococcus epidermidis
LTTSSAMLIIFGDLQNYEK

SEQ ID NO: 1801607 - protein, 19 aa, Staphylococcus epidermidis
LVEKLRLLIQQLKQSIHHL

SEQ ID NO: 1801608 - protein, 20 aa, Staphylococcus epidermidis
LVFKKCREDSDNVLFIDASQ

SEQ ID NO: 1801609 - protein, 19 aa, Staphylococcus epidermidis
LVFNKRGYPIGQILMPGRD

SEQ ID NO: 1801610 - protein, 26 aa, Staphylococcus epidermidis
LVSDKCDFHIKIPMVGHVNSLNASVA

SEQ ID NO: 1801611 - protein, 17 aa, Staphylococcus epidermidis
LYHDFLRESNAREELRA

SEQ ID NO: 1801612 - protein, 20 aa, Staphylococcus epidermidis
LYYSELKSVQNLYRIKTNTS

SEQ ID NO: 1801613 - protein, 21 aa, Staphylococcus epidermidis
MADHFYPDLLFGFIHVPLIPE

SEQ ID NO: 1801614 - protein, 20 aa, Staphylococcus epidermidis
MAGKGTEVGRSFEEIAQIID

SEQ ID NO: 1801615 - protein, 30 aa, Staphylococcus epidermidis
MDASEFRNYILGLIFYRFLSEKTEEEVAEL

SEQ ID NO: 1801616 - protein, 17 aa, Staphylococcus epidermidis
MDIPDLICVHSEDDLRF

SEQ ID NO: 1801617 - protein, 22 aa, Staphylococcus epidermidis
MEALWRESLHIVNDGIATTEEV

SEQ ID NO: 1801618 - protein, 18 aa, Staphylococcus epidermidis
MEARGMVLHINRNTRTTK

SEQ ID NO: 1801619 - protein, 17 aa, Staphylococcus epidermidis
MEGLARLDIDLVNVHAA

SEQ ID NO: 1801620 - protein, 18 aa, Staphylococcus epidermidis
MEHIERAGVHSGDSIAVY

SEQ ID NO: 1801621 - protein, 17 aa, Staphylococcus epidermidis
METSVLIPTNDISRHVN

SEQ ID NO: 1801622 - protein, 24 aa, Staphylococcus epidermidis
MGDIGKAFARRLQGFDARIIYHNR

SEQ ID NO: 1801623 - protein, 24 aa, Staphylococcus epidermidis
MGIANKRSIAFGVAKVLDRLGAKL

SEQ ID NO: 1801624 - protein, 24 aa, Staphylococcus epidermidis
MGIANKRSIGFGVAKVLDQLGAKL

SEQ ID NO: 1801625 - protein, 18 aa, Staphylococcus epidermidis
MGTYDAIVGINLLREGID

SEQ ID NO: 1801626 - protein, 18 aa, Staphylococcus epidermidis
MHNRMRMVVSQFLTKDLF

SEQ ID NO: 1801627 - protein, 27 aa, Staphylococcus epidermidis
MHSAKGLEFPIVFIMGMEESLFPHIRA

SEQ ID NO: 1801628 - protein, 23 aa, Staphylococcus epidermidis
MILKPLFRDYLLKLAEENQIAYQ

SEQ ID NO: 1801629 - protein, 18 aa, Staphylococcus epidermidis
MKARTRYQNTVINIYSSG

SEQ ID NO: 1801630 - protein, 29 aa, Staphylococcus epidermidis
MKGLIGVTVPQWFLKNVVDSEVLGEIYLS

SEQ ID NO: 1801631 - protein, 23 aa, Staphylococcus epidermidis
MKLLVDCKLVFANKVGNKQIYEL

SEQ ID NO: 1801632 - protein, 25 aa, Staphylococcus epidermidis
MLAIPELFWSIELSKELDANQLYEE

SEQ ID NO: 1801633 - protein, 18 aa, Staphylococcus epidermidis
MLLKEPDLLLLDEPTNHL

SEQ ID NO: 1801634 - protein, 23 aa, Staphylococcus epidermidis
MNHVLKYADYFNVMKNGMMIESG

SEQ ID NO: 1801635 - protein, 25 aa, Staphylococcus epidermidis
MPVDKAPRVLGFDAVGVIEKIGDQV

SEQ ID NO: 1801636 - protein, 23 aa, Staphylococcus epidermidis
MQTMKYDMCGAANVIGMIDVISK

SEQ ID NO: 1801637 - protein, 23 aa, Staphylococcus epidermidis
MQTMKYDMCGAANVIGMVDAISK

SEQ ID NO: 1801638 - protein, 17 aa, Staphylococcus epidermidis
MRKIAIVSILAMDPQVI

SEQ ID NO: 1801639 - protein, 19 aa, Staphylococcus epidermidis
MSFDTMVLFGDHAASPHGT

SEQ ID NO: 1801640 - protein, 23 aa, Staphylococcus epidermidis
MSKEEILILLTLLEKGSMTLKEM

SEQ ID NO: 1801641 - protein, 17 aa, Staphylococcus epidermidis
MTHRAIMLASLAKGIST

SEQ ID NO: 1801642 - protein, 26 aa, Staphylococcus epidermidis
MYAACGNCEYCTTGRETLCRDVLNAG

SEQ ID NO: 1801643 - protein, 17 aa, Staphylococcus epidermidis
MYLNYPLIKIITLPEKF

SEQ ID NO: 1801644 - protein, 26 aa, Staphylococcus epidermidis
NAEQFRQLFILPQGEFKKFLQSNSKD

SEQ ID NO: 1801645 - protein, 19 aa, Staphylococcus epidermidis
NAGGTCLNVGCIPSKTLLE

SEQ ID NO: 1801646 - protein, 17 aa, Staphylococcus epidermidis
NAGKSSWFNVLANEETY

SEQ ID NO: 1801647 - protein, 21 aa, Staphylococcus epidermidis
NAGTFLRNIVVTFEHAQLKGG

SEQ ID NO: 1801648 - protein, 21 aa, Staphylococcus epidermidis
NAHMIKWSKLYVDDFQSSWTM

SEQ ID NO: 1801649 - protein, 19 aa, Staphylococcus epidermidis
NALVGFKFDPNQQKSFEDL

SEQ ID NO: 1801650 - protein, 33 aa, Staphylococcus epidermidis
NATIHRFTRKLGFDGYSDFKSFLKFEDSKNHQL

SEQ ID NO: 1801651 - protein, 32 aa, Staphylococcus epidermidis
NATKFLINYLEWLKLSSTIILTSHELNQLINI

SEQ ID NO: 1801652 - protein, 20 aa, Staphylococcus epidermidis
NDALKFQVLEELPQQIKDYV

SEQ ID NO: 1801653 - protein, 19 aa, Staphylococcus epidermidis
NDINIAWNLIYTLLNKSTI

SEQ ID NO: 1801654 - protein, 24 aa, Staphylococcus epidermidis
NDQSYEAFLYLKSKMNYSDDSNTR

SEQ ID NO: 1801655 - protein, 23 aa, Staphylococcus epidermidis
NDTCIEAFSLPNILNGLNKYIHY

SEQ ID NO: 1801656 - protein, 17 aa, Staphylococcus epidermidis
NEEWCALSLAERQKQEK

SEQ ID NO: 1801657 - protein, 17 aa, Staphylococcus epidermidis
NEMSFDTMVLFGDHAAS

SEQ ID NO: 1801658 - protein, 24 aa, Staphylococcus epidermidis
NEQRRLEFLAGRFTVKEAFSKALG

SEQ ID NO: 1801659 - protein, 28 aa, Staphylococcus epidermidis
NESSCVSCGQCATVCPCNAMMEVNMEGN

SEQ ID NO: 1801660 - protein, 20 aa, Staphylococcus epidermidis
NETHFKFRIISGGNSSMLPQ

SEQ ID NO: 1801661 - protein, 21 aa, Staphylococcus epidermidis
NFLDFIKTYSIHLSSSRLVSG

SEQ ID NO: 1801662 - protein, 17 aa, Staphylococcus epidermidis
NFLIKARFEDEVKDISY

SEQ ID NO: 1801663 - protein, 25 aa, Staphylococcus epidermidis
NFNKFCNALGINIANFKSGKSYVFK

SEQ ID NO: 1801664 - protein, 18 aa, Staphylococcus epidermidis
NFYHAMGQFTFNMEKQAK

SEQ ID NO: 1801665 - protein, 23 aa, Staphylococcus epidermidis
NGADFNILVALHMLADISEEKAV

SEQ ID NO: 1801666 - protein, 27 aa, Staphylococcus epidermidis
NGDSVTAYDFVYAWRKVVNPKTASEFA

SEQ ID NO: 1801667 - protein, 23 aa, Staphylococcus epidermidis
NGITRRVIKWIAEDEQIPFKEEK

SEQ ID NO: 1801668 - protein, 22 aa, Staphylococcus epidermidis
NGKEADECFRDELAKAPVKLFD

SEQ ID NO: 1801669 - protein, 17 aa, Staphylococcus epidermidis
NGMICASEQVMVVDKEV

SEQ ID NO: 1801670 - protein, 22 aa, Staphylococcus epidermidis
NGTRLRILHTLLRTPNASVSEV

SEQ ID NO: 1801671 - protein, 19 aa, Staphylococcus epidermidis
NGYAIGLIKSGLSKEGKKA

SEQ ID NO: 1801672 - protein, 18 aa, Staphylococcus epidermidis
NHIKEPQCHVKTLVEKGE

SEQ ID NO: 1801673 - protein, 25 aa, Staphylococcus epidermidis
NHRRVKEWLRKSARKYGLEAEDVVL

SEQ ID NO: 1801674 - protein, 20 aa, Staphylococcus epidermidis
NIEAFSAYMDKIIKNPLKHV

SEQ ID NO: 1801675 - protein, 17 aa, Staphylococcus epidermidis
NIIQLIWNDGRYNMVEF

SEQ ID NO: 1801676 - protein, 24 aa, Staphylococcus epidermidis
NIKEGEFFVLIGPSGCGKTTTLKM

SEQ ID NO: 1801677 - protein, 24 aa, Staphylococcus epidermidis
NKARHLYHKLGFKEDATIRLYGHQ

SEQ ID NO: 1801678 - protein, 17 aa, Staphylococcus epidermidis
NKEFQEKCMYRFGKNHK

SEQ ID NO: 1801679 - protein, 18 aa, Staphylococcus epidermidis
NKGIKILPFDANNITKEM

SEQ ID NO: 1801680 - protein, 20 aa, Staphylococcus epidermidis
NKHYISIFINGRYIKNFVLN

SEQ ID NO: 1801681 - protein, 24 aa, Staphylococcus epidermidis
NKIKLHPAVCFTMLGHFLGVDVES

SEQ ID NO: 1801682 - protein, 22 aa, Staphylococcus epidermidis
NKILQKRVNQIFQKKDYGSTRK

SEQ ID NO: 1801683 - protein, 21 aa, Staphylococcus epidermidis
NLIGYPRDEWVFPIQTHDNRI

SEQ ID NO: 1801684 - protein, 26 aa, Staphylococcus epidermidis
NLITEYCFVRPIYLFLNKMNSCDTWL

SEQ ID NO: 1801685 - protein, 22 aa, Staphylococcus epidermidis
NLSETRKAEVLYEELTHHKLTY

SEQ ID NO: 1801686 - protein, 20 aa, Staphylococcus epidermidis
NMSKGSFKRAIGHLYKKKII

SEQ ID NO: 1801687 - protein, 25 aa, Staphylococcus epidermidis
NNLYKDFKAFISVQNNVDFCYRISG

SEQ ID NO: 1801688 - protein, 17 aa, Staphylococcus epidermidis
NNVSLCVTFENVEDTKR

SEQ ID NO: 1801689 - protein, 24 aa, Staphylococcus epidermidis
NPIPIKVLTTYLGYGHYEVRLPLV

SEQ ID NO: 1801690 - protein, 24 aa, Staphylococcus epidermidis
NPSLIISFYPKFAVHPDHEATAEA

SEQ ID NO: 1801691 - protein, 26 aa, Staphylococcus epidermidis
NQSYSVIRIPCKYQELINQLKHKYEI

SEQ ID NO: 1801692 - protein, 22 aa, Staphylococcus epidermidis
NRAGDGYPAFVKDYGFKFDSAR

SEQ ID NO: 1801693 - protein, 22 aa, Staphylococcus epidermidis
NRIKRYIAKYTINPAITHGISD

SEQ ID NO: 1801694 - protein, 20 aa, Staphylococcus epidermidis
NRLIKAGAFDKYPIEAVFGF

SEQ ID NO: 1801695 - protein, 20 aa, Staphylococcus epidermidis
NRLTGIIDFGDSGIIDEYCD

SEQ ID NO: 1801696 - protein, 22 aa, Staphylococcus epidermidis
NRNEEIKNLLVFYNKNDYHQET

SEQ ID NO: 1801697 - protein, 23 aa, Staphylococcus epidermidis
NRPVLQEALNFVRMGDRFIVESI

SEQ ID NO: 1801698 - protein, 17 aa, Staphylococcus epidermidis
NRQGKIIAMNDAAKDIL

SEQ ID NO: 1801699 - protein, 23 aa, Staphylococcus epidermidis
NSFDDIYNLIGIGTHISQKEQAK

SEQ ID NO: 1801700 - protein, 19 aa, Staphylococcus epidermidis
NSKAFFLTQGFKDVATKNP

SEQ ID NO: 1801701 - protein, 18 aa, Staphylococcus epidermidis
NSKKVLGTFNCGYHIAED

SEQ ID NO: 1801702 - protein, 27 aa, Staphylococcus epidermidis
NSMLGHRGCRLAVTYPELYEMQVEAII

SEQ ID NO: 1801703 - protein, 21 aa, Staphylococcus epidermidis
NSSKVLPIFQHATESFDRQFT

SEQ ID NO: 1801704 - protein, 19 aa, Staphylococcus epidermidis
NTFDSASTFGRKIQNDLLK

SEQ ID NO: 1801705 - protein, 18 aa, Staphylococcus epidermidis
NTLIKLKTFDEFQFTEDE

SEQ ID NO: 1801706 - protein, 23 aa, Staphylococcus epidermidis
NTTMPAFWFDPIINLSAIAQVTS

SEQ ID NO: 1801707 - protein, 18 aa, Staphylococcus epidermidis
NVAQDLDIIYAMSNSLGF

SEQ ID NO: 1801708 - protein, 19 aa, Staphylococcus epidermidis
NVIQCLIKNADIYILDEPF

SEQ ID NO: 1801709 - protein, 21 aa, Staphylococcus epidermidis
NWKNLMRYKEKVINPMSETLT

SEQ ID NO: 1801710 - protein, 19 aa, Staphylococcus epidermidis
NYDEFYQQMLIKMWQLTLD

SEQ ID NO: 1801711 - protein, 18 aa, Staphylococcus epidermidis
NYNIAYEIRLQEALESNI

SEQ ID NO: 1801712 - protein, 18 aa, Staphylococcus epidermidis
NYPELRLSVDTANEEAQK

SEQ ID NO: 1801713 - protein, 19 aa, Staphylococcus epidermidis
PAKNMTVAIIGTGRIGAAT

SEQ ID NO: 1801714 - protein, 20 aa, Staphylococcus epidermidis
PCGRSLCCSTFLGDFEPVSI

SEQ ID NO: 1801715 - protein, 20 aa, Staphylococcus epidermidis
PDRMSSSIVDYAKEVYQINL

SEQ ID NO: 1801716 - protein, 24 aa, Staphylococcus epidermidis
PEFSGKGYAKFAFEKAIIYAFNIL

SEQ ID NO: 1801717 - protein, 19 aa, Staphylococcus epidermidis
PEGAAALLWKDSNLAQIAA

SEQ ID NO: 1801718 - protein, 21 aa, Staphylococcus epidermidis
PEIKANVVYRDGNIEITLEDE

SEQ ID NO: 1801719 - protein, 19 aa, Staphylococcus epidermidis
PELLVKWAGTDFNYPLDEE

SEQ ID NO: 1801720 - protein, 20 aa, Staphylococcus epidermidis
PEQMVISTMMLRSMQQAHYD

SEQ ID NO: 1801721 - protein, 26 aa, Staphylococcus epidermidis
PESPDSTTFYAHFPKKGMYKIWAEFK

SEQ ID NO: 1801722 - protein, 25 aa, Staphylococcus epidermidis
PFDIDFSGFIFKIQANMDPKHRDRI

SEQ ID NO: 1801723 - protein, 20 aa, Staphylococcus epidermidis
PFPSEHVKPYVTYKQSINEA

SEQ ID NO: 1801724 - protein, 28 aa, Staphylococcus epidermidis
PGLANKISLKFAKKIYTTFEDTLTYLPK

SEQ ID NO: 1801725 - protein, 22 aa, Staphylococcus epidermidis
PGVIQYRNYIGIQFHPEKSGTY

SEQ ID NO: 1801726 - protein, 19 aa, Staphylococcus epidermidis
PHTIELGSREVVGEYPREQ

SEQ ID NO: 1801727 - protein, 17 aa, Staphylococcus epidermidis
PIHFNLPFREPLTPDLD

SEQ ID NO: 1801728 - protein, 17 aa, Staphylococcus epidermidis
PIIKEVEHVSGKKYLID

SEQ ID NO: 1801729 - protein, 22 aa, Staphylococcus epidermidis
PISDPKTGALFTGLIVTPSNFV

SEQ ID NO: 1801730 - protein, 17 aa, Staphylococcus epidermidis
PKFVELMAQGNPSLQKV

SEQ ID NO: 1801731 - protein, 18 aa, Staphylococcus epidermidis
PKNMLLSLILNSDLVSPK

SEQ ID NO: 1801732 - protein, 22 aa, Staphylococcus epidermidis
PKWKVHAKDLIAYPKLTGKPAA

SEQ ID NO: 1801733 - protein, 21 aa, Staphylococcus epidermidis
PLGSLFEQASLIFLDSIVLPL

SEQ ID NO: 1801734 - protein, 22 aa, Staphylococcus epidermidis
PLYHKYCELHDLLGRQYPELSY

SEQ ID NO: 1801735 - protein, 19 aa, Staphylococcus epidermidis
PNHSKFLGIGLRLIPKPLR

SEQ ID NO: 1801736 - protein, 26 aa, Staphylococcus epidermidis
PNMKVSEVLYYLGFLSKINQTDFDKY

SEQ ID NO: 1801737 - protein, 24 aa, Staphylococcus epidermidis
PNNLSLTINEYFEFLLKVHSNNQT

SEQ ID NO: 1801738 - protein, 17 aa, Staphylococcus epidermidis
PPVSNIDELVIVMSAVE

SEQ ID NO: 1801739 - protein, 24 aa, Staphylococcus epidermidis
PPYSAKWSADPSFLDDERFSGYGK

SEQ ID NO: 1801740 - protein, 20 aa, Staphylococcus epidermidis
PRSIAEFTVTQAINIVRHFN

SEQ ID NO: 1801741 - protein, 23 aa, Staphylococcus epidermidis
PSDIRAAGGVARMANPKIVEEVM

SEQ ID NO: 1801742 - protein, 20 aa, Staphylococcus epidermidis
PSGIFYKDKLAVIGNGVVVD

SEQ ID NO: 1801743 - protein, 17 aa, Staphylococcus epidermidis
PSILRLVKQVIEASHKE

SEQ ID NO: 1801744 - protein, 27 aa, Staphylococcus epidermidis
PSLGKTSLALTMMWNIAQRGYPTTFFS

SEQ ID NO: 1801745 - protein, 22 aa, Staphylococcus epidermidis
PSMVQKRLRTMPSNYEQPQRVE

SEQ ID NO: 1801746 - protein, 18 aa, Staphylococcus epidermidis
PSYKQVYSIIKAMPKSVI

SEQ ID NO: 1801747 - protein, 17 aa, Staphylococcus epidermidis
PTQRISEEIPWTKQVGV

SEQ ID NO: 1801748 - protein, 17 aa, Staphylococcus epidermidis
PTTSQPAIGDWIENFER

SEQ ID NO: 1801749 - protein, 27 aa, Staphylococcus epidermidis
PVMDFNNLVLVRFFFKSLTAYLKKHNC

SEQ ID NO: 1801750 - protein, 21 aa, Staphylococcus epidermidis
PYATHSYVFISWTGKMAETFV

SEQ ID NO: 1801751 - protein, 20 aa, Staphylococcus epidermidis
PYDVSMFGQYQWYDFTPEAI

SEQ ID NO: 1801752 - protein, 19 aa, Staphylococcus epidermidis
PYKLEIDMLKSQKFDPDLK

SEQ ID NO: 1801753 - protein, 20 aa, Staphylococcus epidermidis
QAAFEKLDFMVVQDEFLTFT

SEQ ID NO: 1801754 - protein, 23 aa, Staphylococcus epidermidis
QAAREWLRTVGFKNIDVLNTVLK

SEQ ID NO: 1801755 - protein, 18 aa, Staphylococcus epidermidis
QDKLPLFNPFKVINEGNQ

SEQ ID NO: 1801756 - protein, 18 aa, Staphylococcus epidermidis
QDKVIFIIDECHRTQFGD

SEQ ID NO: 1801757 - protein, 21 aa, Staphylococcus epidermidis
QEIDMVINIGALKDGRFDEVQ

SEQ ID NO: 1801758 - protein, 21 aa, Staphylococcus epidermidis
QERFKSEKTIQGFMDTPTSSE

SEQ ID NO: 1801759 - protein, 21 aa, Staphylococcus epidermidis
QFFEYAKEFLEQEYGKDNLLY

SEQ ID NO: 1801760 - protein, 17 aa, Staphylococcus epidermidis
QFYPFKNYGQWVTSGGL

SEQ ID NO: 1801761 - protein, 20 aa, Staphylococcus epidermidis
QGHNDFKMAYINKFNEMEKQ

SEQ ID NO: 1801762 - protein, 23 aa, Staphylococcus epidermidis
QHIPEIVQTLQFFNKSLQNIQFS

SEQ ID NO: 1801763 - protein, 23 aa, Staphylococcus epidermidis
QHTLPIETSVLIPTNNISRHVND

SEQ ID NO: 1801764 - protein, 23 aa, Staphylococcus epidermidis
QHTLPMETSVLIPTNDISRHVND

SEQ ID NO: 1801765 - protein, 23 aa, Staphylococcus epidermidis
QHTLPMETSVLIPTNNISRHVND

SEQ ID NO: 1801766 - protein, 23 aa, Staphylococcus epidermidis
QILRHSIKLGKIDHIFITHMHGD

SEQ ID NO: 1801767 - protein, 33 aa, Staphylococcus epidermidis
QIVLFLNRRGYASFMLCRDCGYVPQCPHCDISL

SEQ ID NO: 1801768 - protein, 17 aa, Staphylococcus epidermidis
QKFRAKQIFEWLYQKRV

SEQ ID NO: 1801769 - protein, 29 aa, Staphylococcus epidermidis
QKLSIDCHFPRTSRKLFVEKLKSAQYDLK

SEQ ID NO: 1801770 - protein, 21 aa, Staphylococcus epidermidis
QKQEKAFRCEVNKREYIRMPF

SEQ ID NO: 1801771 - protein, 21 aa, Staphylococcus epidermidis
QKQYDCRIGISQLPTHGLAVR

SEQ ID NO: 1801772 - protein, 19 aa, Staphylococcus epidermidis
QLESTFKCINYGQEFLNNV

SEQ ID NO: 1801773 - protein, 19 aa, Staphylococcus epidermidis
QLLEEVNHVLEFYEISFNT

SEQ ID NO: 1801774 - protein, 17 aa, Staphylococcus epidermidis
QLMNIYCHQCPLKKHNR

SEQ ID NO: 1801775 - protein, 17 aa, Staphylococcus epidermidis
QLQKCHQDILSIENHYQ

SEQ ID NO: 1801776 - protein, 19 aa, Staphylococcus epidermidis
QLTLPMETSVLIPTNDISR

SEQ ID NO: 1801777 - protein, 24 aa, Staphylococcus epidermidis
QNEIDKLSNFLVFMDQHRESTKDY

SEQ ID NO: 1801778 - protein, 17 aa, Staphylococcus epidermidis
QNFKRINNSLARLEMPE

SEQ ID NO: 1801779 - protein, 17 aa, Staphylococcus epidermidis
QNLKGIHVHLEYENLLH

SEQ ID NO: 1801780 - protein, 24 aa, Staphylococcus epidermidis
QNLLKRDIASFLRQMHGLDYTDIS

SEQ ID NO: 1801781 - protein, 23 aa, Staphylococcus epidermidis
QNRLKFQILELFHQTFPGLERLF

SEQ ID NO: 1801782 - protein, 24 aa, Staphylococcus epidermidis
QPFIKEIVLMGGSTGRGNVTPLAE

SEQ ID NO: 1801783 - protein, 22 aa, Staphylococcus epidermidis
QQEFPQARIIRMDVDTTSRKGA

SEQ ID NO: 1801784 - protein, 18 aa, Staphylococcus epidermidis
QQLNLKGLAFISATDSYP

SEQ ID NO: 1801785 - protein, 17 aa, Staphylococcus epidermidis
QQWLKLPLEEDILQLGT

SEQ ID NO: 1801786 - protein, 28 aa, Staphylococcus epidermidis
QRISMPYLRSPFVHHIHPKPFHLKQYAR

SEQ ID NO: 1801787 - protein, 21 aa, Staphylococcus epidermidis
QRIYGKKVCYFTKKSLQGLTA

SEQ ID NO: 1801788 - protein, 17 aa, Staphylococcus epidermidis
QRLYHDFLRESNAREEL

SEQ ID NO: 1801789 - protein, 23 aa, Staphylococcus epidermidis
QRSNEGWQGWPEEGKIGHLHLKT

SEQ ID NO: 1801790 - protein, 22 aa, Staphylococcus epidermidis
QRSNEGWQGWSEEGKIGHLHLK

SEQ ID NO: 1801791 - protein, 22 aa, Staphylococcus epidermidis
QRSNEGWQSWPEEGKIGHLHLK

SEQ ID NO: 1801792 - protein, 19 aa, Staphylococcus epidermidis
QSFEKFVLFTSYKVDIKKQ

SEQ ID NO: 1801793 - protein, 23 aa, Staphylococcus epidermidis
QSILRTLFNSERFDEIRHLLVEN

SEQ ID NO: 1801794 - protein, 23 aa, Staphylococcus epidermidis
QSLFRGRVNVVIYTQGAQGATIY

SEQ ID NO: 1801795 - protein, 24 aa, Staphylococcus epidermidis
QSMQSYLMRCIKSEFEEIHVLTKR

SEQ ID NO: 1801796 - protein, 18 aa, Staphylococcus epidermidis
QTFIPKNYIEDFKDSLNE

SEQ ID NO: 1801797 - protein, 30 aa, Staphylococcus epidermidis
QTFSASIAERLKLAVQFANHFESEEEYSLW

SEQ ID NO: 1801798 - protein, 17 aa, Staphylococcus epidermidis
QTTKRKTPNYSKVDNTI

SEQ ID NO: 1801799 - protein, 18 aa, Staphylococcus epidermidis
QVKMKAVLHNEAIKNVIQ

SEQ ID NO: 1801800 - protein, 19 aa, Staphylococcus epidermidis
QVNHRGWEDLASKTTDDIL

SEQ ID NO: 1801801 - protein, 18 aa, Staphylococcus epidermidis
QVNTRMVLEKGLTIIGSS

SEQ ID NO: 1801802 - protein, 24 aa, Staphylococcus epidermidis
QVPLQHIIKFSCKPVQQFYGQYDI

SEQ ID NO: 1801803 - protein, 17 aa, Staphylococcus epidermidis
QVRRLLKKYGYPPDLQK

SEQ ID NO: 1801804 - protein, 28 aa, Staphylococcus epidermidis
QVTKDYKPELAFAIGNAIKYISRANRKN

SEQ ID NO: 1801805 - protein, 23 aa, Staphylococcus epidermidis
QVVIRCFFVYFKMITKEEALATE

SEQ ID NO: 1801806 - protein, 18 aa, Staphylococcus epidermidis
QYGAVYLVNLFSNIKTPE

SEQ ID NO: 1801807 - protein, 24 aa, Staphylococcus epidermidis
QYLSRRRIRHIVGYVPQDIALFEH

SEQ ID NO: 1801808 - protein, 17 aa, Staphylococcus epidermidis
RAIEFVEHLPKTNSGKI

SEQ ID NO: 1801809 - protein, 26 aa, Staphylococcus epidermidis
RAIQRIYESYPYKRGIYSGGVGYINC

SEQ ID NO: 1801810 - protein, 19 aa, Staphylococcus epidermidis
RAPWKIKRPQSVYESEFPQ

SEQ ID NO: 1801811 - protein, 23 aa, Staphylococcus epidermidis
RAQQLKVIANMAVGFDNIDISLA

SEQ ID NO: 1801812 - protein, 24 aa, Staphylococcus epidermidis
RAQQLKVIANMAVGFDNIDITLAK

SEQ ID NO: 1801813 - protein, 20 aa, Staphylococcus epidermidis
RAVRDVRELIVKKAEEGVTF

SEQ ID NO: 1801814 - protein, 20 aa, Staphylococcus epidermidis
RAYEMLPVVMEYKAKEVALQ

SEQ ID NO: 1801815 - protein, 17 aa, Staphylococcus epidermidis
RAYYCLVDTQANQNMIE

SEQ ID NO: 1801816 - protein, 22 aa, Staphylococcus epidermidis
RDKGTWIINSVMNIQKKGQAME

SEQ ID NO: 1801817 - protein, 24 aa, Staphylococcus epidermidis
RDNHSAYAFIKRLIKQFGKPQKVV

SEQ ID NO: 1801818 - protein, 24 aa, Staphylococcus epidermidis
RDRLKCYLEPLRLNLNDYRVMLIH

SEQ ID NO: 1801819 - protein, 21 aa, Staphylococcus epidermidis
REIMDEVGIDAARYFLTMRSP

SEQ ID NO: 1801820 - protein, 18 aa, Staphylococcus epidermidis
RERGLNLYISDAIKTFIK

SEQ ID NO: 1801821 - protein, 21 aa, Staphylococcus epidermidis
RESRYKPTIAQIIDRKPPEMK

SEQ ID NO: 1801822 - protein, 18 aa, Staphylococcus epidermidis
RESVKYAIEQGYRSIDTA

SEQ ID NO: 1801823 - protein, 18 aa, Staphylococcus epidermidis
REVLVPWEDLPKLKELWP

SEQ ID NO: 1801824 - protein, 28 aa, Staphylococcus epidermidis
RFADFDFKEVRKHWELKLNQYSEREQSL

SEQ ID NO: 1801825 - protein, 20 aa, Staphylococcus epidermidis
RGAVKLITKRDFFLETDRDP

SEQ ID NO: 1801826 - protein, 22 aa, Staphylococcus epidermidis
RGLKILTEVELSYLISEAPIIA

SEQ ID NO: 1801827 - protein, 20 aa, Staphylococcus epidermidis
RHFLWSTARGYQSYTEDAQI

SEQ ID NO: 1801828 - protein, 25 aa, Staphylococcus epidermidis
RIASELIELIIAFMFHHQIPMRVET

SEQ ID NO: 1801829 - protein, 21 aa, Staphylococcus epidermidis
RIREVNYLTGEVIREREHFTI

SEQ ID NO: 1801830 - protein, 18 aa, Staphylococcus epidermidis
RIRPLNTHICKIERVAII

SEQ ID NO: 1801831 - protein, 24 aa, Staphylococcus epidermidis
RKDKLKELVEYGWLEDENYEILLN

SEQ ID NO: 1801832 - protein, 24 aa, Staphylococcus epidermidis
RKIRKKLSCYSRFEYIDTKWGVGY

SEQ ID NO: 1801833 - protein, 20 aa, Staphylococcus epidermidis
RKIRNHGVLRAGFTDNKDNI

SEQ ID NO: 1801834 - protein, 19 aa, Staphylococcus epidermidis
RKKAKAFIDDYLASFPGVK

SEQ ID NO: 1801835 - protein, 40 aa, Staphylococcus epidermidis
RKKRQKVSMIFQHFNLLWSRNVLKNVTFPLEIAGVPSGLA

SEQ ID NO: 1801836 - protein, 20 aa, Staphylococcus epidermidis
RKPPEMKSAVIPEEQTDKYR

SEQ ID NO: 1801837 - protein, 17 aa, Staphylococcus epidermidis
RKQRFGGSRPFNVLMTP

SEQ ID NO: 1801838 - protein, 29 aa, Staphylococcus epidermidis
RLKFYKEHFTDWTYFQIKLVIVGIERGDL

SEQ ID NO: 1801839 - protein, 17 aa, Staphylococcus epidermidis
RLNVLDLQRLIRVIPKP

SEQ ID NO: 1801840 - protein, 19 aa, Staphylococcus epidermidis
RLQGFDARIIYHNRKRDLI

SEQ ID NO: 1801841 - protein, 18 aa, Staphylococcus epidermidis
RLVASLRNSDEFIPDLSL

SEQ ID NO: 1801842 - protein, 18 aa, Staphylococcus epidermidis
RNGREFALGPTHEEVVTS

SEQ ID NO: 1801843 - protein, 18 aa, Staphylococcus epidermidis
RNKVKDFFGKITTFLDGP

SEQ ID NO: 1801844 - protein, 23 aa, Staphylococcus epidermidis
RNMVKQLYLPVQFIQSTEWLINQ

SEQ ID NO: 1801845 - protein, 37 aa, Staphylococcus epidermidis
RNPELLSKFRLKPEMFTDEKLRVFIEYALEQGKVDVN

SEQ ID NO: 1801846 - protein, 27 aa, Staphylococcus epidermidis
RNQLFKEYLRFVSILKPKIFIIENVAR

SEQ ID NO: 1801847 - protein, 18 aa, Staphylococcus epidermidis
RNRYWGTPLNVWICNDCN

SEQ ID NO: 1801848 - protein, 19 aa, Staphylococcus epidermidis
RPMMSDLREAGGIEQDANM

SEQ ID NO: 1801849 - protein, 20 aa, Staphylococcus epidermidis
RPTKSSIIFIQQLGRGLRKS

SEQ ID NO: 1801850 - protein, 19 aa, Staphylococcus epidermidis
RQAIKDTIKKASIASGVDI

SEQ ID NO: 1801851 - protein, 21 aa, Staphylococcus epidermidis
RQANHNVMFASARPIRDLLPV

SEQ ID NO: 1801852 - protein, 20 aa, Staphylococcus epidermidis
RQGKQLLAYLGAPKHLYEKV

SEQ ID NO: 1801853 - protein, 20 aa, Staphylococcus epidermidis
RQKELLKEFAEINGEDINEQ

SEQ ID NO: 1801854 - protein, 21 aa, Staphylococcus epidermidis
RQLKSTFKCINYGQEFLNNVE

SEQ ID NO: 1801855 - protein, 25 aa, Staphylococcus epidermidis
RQYIELLSRLGIQLNLPDLTFDTDR

SEQ ID NO: 1801856 - protein, 24 aa, Staphylococcus epidermidis
RRDELRAQNILQERAFKNDKVDFI

SEQ ID NO: 1801857 - protein, 22 aa, Staphylococcus epidermidis
RRERGITFGLFRLSVGLENSEE

SEQ ID NO: 1801858 - protein, 26 aa, Staphylococcus epidermidis
RRFTATEINLFFAMCNKLKEQDTNTL

SEQ ID NO: 1801859 - protein, 19 aa, Staphylococcus epidermidis
RRLIDSPKVATYDLKPEMS

SEQ ID NO: 1801860 - protein, 17 aa, Staphylococcus epidermidis
RRLSVATALSSKAEIIL

SEQ ID NO: 1801861 - protein, 20 aa, Staphylococcus epidermidis
RRVTFEYGLFGGVNDQLEHA

SEQ ID NO: 1801862 - protein, 20 aa, Staphylococcus epidermidis
RSKVDGIVLMATHITEAHIE

SEQ ID NO: 1801863 - protein, 19 aa, Staphylococcus epidermidis
RSVRFPGLISHVKEPGGGT

SEQ ID NO: 1801864 - protein, 21 aa, Staphylococcus epidermidis
RSYVFHPYSMVKDHRTNEETG

SEQ ID NO: 1801865 - protein, 18 aa, Staphylococcus epidermidis
RTFCYILDKDQYVIGGPV

SEQ ID NO: 1801866 - protein, 17 aa, Staphylococcus epidermidis
RTKYPHFIKQLQDRKPY

SEQ ID NO: 1801867 - protein, 19 aa, Staphylococcus epidermidis
RTTKQLIELAQWLENNNIE

SEQ ID NO: 1801868 - protein, 17 aa, Staphylococcus epidermidis
RTVKETLEGAGLNQAIT

SEQ ID NO: 1801869 - protein, 18 aa, Staphylococcus epidermidis
RVGRSEHQSYCVLIASPK

SEQ ID NO: 1801870 - protein, 19 aa, Staphylococcus epidermidis
RVPILDGLSIITSQKAMQS

SEQ ID NO: 1801871 - protein, 18 aa, Staphylococcus epidermidis
RVSTARIKNEFIAKYDYH

SEQ ID NO: 1801872 - protein, 25 aa, Staphylococcus epidermidis
RWNKSHHQLIFFGRYHCLARKPKCE

SEQ ID NO: 1801873 - protein, 17 aa, Staphylococcus epidermidis
RYIKIRPAIDFIEQNLM

SEQ ID NO: 1801874 - protein, 25 aa, Staphylococcus epidermidis
RYSIIALNIAEIFTHPDMVLDIDKE

SEQ ID NO: 1801875 - protein, 25 aa, Staphylococcus epidermidis
RYTALKKIGCQYVMCQVVEKDDYTI

SEQ ID NO: 1801876 - protein, 17 aa, Staphylococcus epidermidis
RYVDLVIPEEGWGQKEK

SEQ ID NO: 1801877 - protein, 19 aa, Staphylococcus epidermidis
SAIGRAAAIAYAKEGADVA

SEQ ID NO: 1801878 - protein, 24 aa, Staphylococcus epidermidis
SAIPTGHGKIHIAHGIYPIPAPAT

SEQ ID NO: 1801879 - protein, 17 aa, Staphylococcus epidermidis
SALEAVIGFLYLDHQSE

SEQ ID NO: 1801880 - protein, 22 aa, Staphylococcus epidermidis
SDAPIAFQEFMILPVGAESFKE

SEQ ID NO: 1801881 - protein, 28 aa, Staphylococcus epidermidis
SDDYRYFPEPDIVPLYVDEDWKARVRKT

SEQ ID NO: 1801882 - protein, 22 aa, Staphylococcus epidermidis
SDGKLKPAILKKVDDYVSHVTI

SEQ ID NO: 1801883 - protein, 20 aa, Staphylococcus epidermidis
SDHLWRVEIELKRDMVDYWN

SEQ ID NO: 1801884 - protein, 23 aa, Staphylococcus epidermidis
SDIKLKAFEAHASQTGPFLKQLA

SEQ ID NO: 1801885 - protein, 21 aa, Staphylococcus epidermidis
SDITKLIIYEGLSTKHLHIHQ

SEQ ID NO: 1801886 - protein, 17 aa, Staphylococcus epidermidis
SELGIEFTVSGLNRVYK

SEQ ID NO: 1801887 - protein, 19 aa, Staphylococcus epidermidis
SELRSRTKYPHFIKQLQDR

SEQ ID NO: 1801888 - protein, 18 aa, Staphylococcus epidermidis
SELVRGRGGPRCMSQPLF

SEQ ID NO: 1801889 - protein, 20 aa, Staphylococcus epidermidis
SELWNRNKVKDFFGKITTFL

SEQ ID NO: 1801890 - protein, 21 aa, Staphylococcus epidermidis
SENLDLFFSYRVEKGQTGRML

SEQ ID NO: 1801891 - protein, 22 aa, Staphylococcus epidermidis
SEPLKYRKMYGQFGGNITHTAM

SEQ ID NO: 1801892 - protein, 23 aa, Staphylococcus epidermidis
SEQRSSLGKLALELDKVSNQLNN

SEQ ID NO: 1801893 - protein, 29 aa, Staphylococcus epidermidis
SEYYPKFEFKKASNWGIKAPFEVPDEFLM

SEQ ID NO: 1801894 - protein, 18 aa, Staphylococcus epidermidis
SFCSTCTRARLSSDGKFY

SEQ ID NO: 1801895 - protein, 23 aa, Staphylococcus epidermidis
SFTGKSYFDLVFKDTGYKYELHA

SEQ ID NO: 1801896 - protein, 26 aa, Staphylococcus epidermidis
SGGEKARLQLVLLMLQRDNVLILDEP

SEQ ID NO: 1801897 - protein, 18 aa, Staphylococcus epidermidis
SGGETFQASLALALGLSE

SEQ ID NO: 1801898 - protein, 26 aa, Staphylococcus epidermidis
SGGKLRPGFEGGQLPLFRRLPKRGFT

SEQ ID NO: 1801899 - protein, 21 aa, Staphylococcus epidermidis
SGGQRGMQIIIHVNDLIDMTK

SEQ ID NO: 1801900 - protein, 17 aa, Staphylococcus epidermidis
SGLDFQVAFGKDKHGVE

SEQ ID NO: 1801901 - protein, 23 aa, Staphylococcus epidermidis
SGSFSDRMSRLLTGEDGEEAVLS

SEQ ID NO: 1801902 - protein, 17 aa, Staphylococcus epidermidis
SGTIPGVIFKLEKTHNI

SEQ ID NO: 1801903 - protein, 19 aa, Staphylococcus epidermidis
SGVKLIRKGDINMNLHFVE

SEQ ID NO: 1801904 - protein, 24 aa, Staphylococcus epidermidis
SHFVYELIQPPTAYQFFNDPMLSV

SEQ ID NO: 1801905 - protein, 26 aa, Staphylococcus epidermidis
SHGYIGLAHAGWRGTYGQIVKEMLKK

SEQ ID NO: 1801906 - protein, 21 aa, Staphylococcus epidermidis
SHLVPYLKVLDQLTLIGKEAG

SEQ ID NO: 1801907 - protein, 24 aa, Staphylococcus epidermidis
SIGRGMTINRMYWRARRRESIFMT

SEQ ID NO: 1801908 - protein, 22 aa, Staphylococcus epidermidis
SIKDLPNYIQIWPGHGAGSPCG

SEQ ID NO: 1801909 - protein, 18 aa, Staphylococcus epidermidis
SILFDRYQRDVGYSEAKE

SEQ ID NO: 1801910 - protein, 18 aa, Staphylococcus epidermidis
SITEGTIAEWLKNVGDNV

SEQ ID NO: 1801911 - protein, 17 aa, Staphylococcus epidermidis
SIVCSFIKRGTLADIGS

SEQ ID NO: 1801912 - protein, 19 aa, Staphylococcus epidermidis
SIYLAYGMIDIIQVFNDLL

SEQ ID NO: 1801913 - protein, 24 aa, Staphylococcus epidermidis
SKKIIADELIEWANATNAFKNNIL

SEQ ID NO: 1801914 - protein, 17 aa, Staphylococcus epidermidis
SKMFTWNNCEYIESDEY

SEQ ID NO: 1801915 - protein, 18 aa, Staphylococcus epidermidis
SKNAFSMQQIAKVLDKAN

SEQ ID NO: 1801916 - protein, 19 aa, Staphylococcus epidermidis
SKSISRPIVTNALTHGLSL

SEQ ID NO: 1801917 - protein, 24 aa, Staphylococcus epidermidis
SKTVKRKYTALVHGNIPHDYGTID

SEQ ID NO: 1801918 - protein, 27 aa, Staphylococcus epidermidis
SKVCLANLLRICARYDNLDIIEDAYGI

SEQ ID NO: 1801919 - protein, 18 aa, Staphylococcus epidermidis
SLHQRLYHDFLRESNARE

SEQ ID NO: 1801920 - protein, 17 aa, Staphylococcus epidermidis
SLIKLAIDQHIPYTVLR

SEQ ID NO: 1801921 - protein, 17 aa, Staphylococcus epidermidis
SLLNIGGGFGIKYVEGD

SEQ ID NO: 1801922 - protein, 20 aa, Staphylococcus epidermidis
SLREPLLFYRQLKPQNIKNI

SEQ ID NO: 1801923 - protein, 28 aa, Staphylococcus epidermidis
SNDPRFKRWVIGSILSRTYYHNMVTHLL

SEQ ID NO: 1801924 - protein, 17 aa, Staphylococcus epidermidis
SNEIIGQIAAYLNKNIS

SEQ ID NO: 1801925 - protein, 24 aa, Staphylococcus epidermidis
SNQKGYKSDLNWRYINSNDAVDEF

SEQ ID NO: 1801926 - protein, 20 aa, Staphylococcus epidermidis
SPKDFSINISDIVRYSILCM

SEQ ID NO: 1801927 - protein, 24 aa, Staphylococcus epidermidis
SQMAEGFGKLILGDKWNVYSAGIE

SEQ ID NO: 1801928 - protein, 17 aa, Staphylococcus epidermidis
SQPPIGRFIETYEQLAQ

SEQ ID NO: 1801929 - protein, 24 aa, Staphylococcus epidermidis
SQREFKIYMLIAERFLENLMNPYL

SEQ ID NO: 1801930 - protein, 21 aa, Staphylococcus epidermidis
SQRKIDVESVFGIMKPILSFT

SEQ ID NO: 1801931 - protein, 20 aa, Staphylococcus epidermidis
SQSIDLEAFFTRNLNSYHFN

SEQ ID NO: 1801932 - protein, 19 aa, Staphylococcus epidermidis
SRAIPIFVFMNDSFEQLTV

SEQ ID NO: 1801933 - protein, 21 aa, Staphylococcus epidermidis
SRAVKPPVIYGDVKWTAPLTV

SEQ ID NO: 1801934 - protein, 32 aa, Staphylococcus epidermidis
SRLPEYMIPRKFEWMERLPLTLNGKLDRKKIA

SEQ ID NO: 1801935 - protein, 28 aa, Staphylococcus epidermidis
SRPNGWLLHIPSCYLGIAQAARDYAVDF

SEQ ID NO: 1801936 - protein, 21 aa, Staphylococcus epidermidis
SRPSYVSNPWLKPDEHQSNFL

SEQ ID NO: 1801937 - protein, 20 aa, Staphylococcus epidermidis
SRRYPYVKFTPEREIGNDLL

SEQ ID NO: 1801938 - protein, 21 aa, Staphylococcus epidermidis
SRSKVDGIVLMATHITEAHIE

SEQ ID NO: 1801939 - protein, 23 aa, Staphylococcus epidermidis
SSGCVGPAPKLFVGVASAKENIN

SEQ ID NO: 1801940 - protein, 19 aa, Staphylococcus epidermidis
SSGEWLTHEFNIIDTGGIE

SEQ ID NO: 1801941 - protein, 18 aa, Staphylococcus epidermidis
SSISTFAARNPWEGLEDA

SEQ ID NO: 1801942 - protein, 19 aa, Staphylococcus epidermidis
SSKLWRQIVNDVKKDYPEV

SEQ ID NO: 1801943 - protein, 22 aa, Staphylococcus epidermidis
SSRRYPYVKFTPEREIGNDLLT

SEQ ID NO: 1801944 - protein, 24 aa, Staphylococcus epidermidis
SSSNPLGGGLMLQGLKLDEMLNNG

SEQ ID NO: 1801945 - protein, 23 aa, Staphylococcus epidermidis
SSTSEIIYEFILHFNDEHIIDEQ

SEQ ID NO: 1801946 - protein, 26 aa, Staphylococcus epidermidis
STCTRARLSSDGKFYGCLFASSEGFD

SEQ ID NO: 1801947 - protein, 19 aa, Staphylococcus epidermidis
STLGYEKQTNWAFSENNEA

SEQ ID NO: 1801948 - protein, 22 aa, Staphylococcus epidermidis
STLGYEKQTNWAFSENNEATFI

SEQ ID NO: 1801949 - protein, 23 aa, Staphylococcus epidermidis
STLNCYYNALNIFDEKFGNTAIK

SEQ ID NO: 1801950 - protein, 20 aa, Staphylococcus epidermidis
STNLVPFLTIEQQFKLLSKY

SEQ ID NO: 1801951 - protein, 24 aa, Staphylococcus epidermidis
STPSFIEMCLLLPNLNEQQYNSLK

SEQ ID NO: 1801952 - protein, 18 aa, Staphylococcus epidermidis
STRTRCAFETAAYDQGAH

SEQ ID NO: 1801953 - protein, 24 aa, Staphylococcus epidermidis
STSEIDEVILVGGSTRIPAVQEAV

SEQ ID NO: 1801954 - protein, 18 aa, Staphylococcus epidermidis
STWQGDEIVIHKDINISI

SEQ ID NO: 1801955 - protein, 19 aa, Staphylococcus epidermidis
STWQGDEIVIHKDINISIA

SEQ ID NO: 1801956 - protein, 20 aa, Staphylococcus epidermidis
STYYGIALALLRISKALLNN

SEQ ID NO: 1801957 - protein, 23 aa, Staphylococcus epidermidis
STYYGIALALLRISKALLNNENS

SEQ ID NO: 1801958 - protein, 30 aa, Staphylococcus epidermidis
SYFKSAYHILDLVFWFGHLSILTKNHYSIT

SEQ ID NO: 1801959 - protein, 19 aa, Staphylococcus epidermidis
SYGGFELYQRTGIPIHPMS

SEQ ID NO: 1801960 - protein, 18 aa, Staphylococcus epidermidis
SYKTFKLTLTKTYLNLVE

SEQ ID NO: 1801961 - protein, 33 aa, Staphylococcus epidermidis
SYRLEGYKRFMFLALLRRAMIRKLPYSRMNVNW

SEQ ID NO: 1801962 - protein, 21 aa, Staphylococcus epidermidis
SYVFHPYSMIKDHRTNEETGK

SEQ ID NO: 1801963 - protein, 22 aa, Staphylococcus epidermidis
TALSNKGYRVLLATTDPTKEIN

SEQ ID NO: 1801964 - protein, 24 aa, Staphylococcus epidermidis
TATALQWLLFDIGLDGSTKSFTPV

SEQ ID NO: 1801965 - protein, 26 aa, Staphylococcus epidermidis
TATPIPRTLAISVFGEMDVSSIKQLP

SEQ ID NO: 1801966 - protein, 18 aa, Staphylococcus epidermidis
TDIYEFIEASNLDVHSQE

SEQ ID NO: 1801967 - protein, 22 aa, Staphylococcus epidermidis
TDTYMPLPIFLSHQLAKRLSDV

SEQ ID NO: 1801968 - protein, 18 aa, Staphylococcus epidermidis
TEDLWKKLINLWKDQTVL

SEQ ID NO: 1801969 - protein, 22 aa, Staphylococcus epidermidis
TEEMPALGFAPDAEFPAIHGEK

SEQ ID NO: 1801970 - protein, 18 aa, Staphylococcus epidermidis
TESLLGFKTIHTNEEGHQ

SEQ ID NO: 1801971 - protein, 22 aa, Staphylococcus epidermidis
TETYPQLGRLIGFIPKEKVVDV

SEQ ID NO: 1801972 - protein, 24 aa, Staphylococcus epidermidis
TEVFRGNRPFAFTNLKTDEGLEKV

SEQ ID NO: 1801973 - protein, 17 aa, Staphylococcus epidermidis
TFMKSNIPYTMVGGQKF

SEQ ID NO: 1801974 - protein, 18 aa, Staphylococcus epidermidis
TFPLEIAGVPSGRAKQKA

SEQ ID NO: 1801975 - protein, 19 aa, Staphylococcus epidermidis
TFSRTQAFLNEFAESLSKA

SEQ ID NO: 1801976 - protein, 23 aa, Staphylococcus epidermidis
TGAGNDFLGWLDLPVDYDNEEFS

SEQ ID NO: 1801977 - protein, 23 aa, Staphylococcus epidermidis
THNGGKLKIHYELYQDEQKMGSY

SEQ ID NO: 1801978 - protein, 28 aa, Staphylococcus epidermidis
THSETFVIISFKHKVILIGGTEYAGEMK

SEQ ID NO: 1801979 - protein, 17 aa, Staphylococcus epidermidis
THVLPIEVDERIHILNF

SEQ ID NO: 1801980 - protein, 26 aa, Staphylococcus epidermidis
TIADVGCGYGPIGLAIGKASPHHQIT

SEQ ID NO: 1801981 - protein, 23 aa, Staphylococcus epidermidis
TIDFKQSLMGGGFQIDNPNAIAS

SEQ ID NO: 1801982 - protein, 18 aa, Staphylococcus epidermidis
TIEQSLREPLLFYRQLKP

SEQ ID NO: 1801983 - protein, 18 aa, Staphylococcus epidermidis
TIIKPGLQASVVRVEGTQ

SEQ ID NO: 1801984 - protein, 17 aa, Staphylococcus epidermidis
TIKRVMRLIDNIRQYGH

SEQ ID NO: 1801985 - protein, 23 aa, Staphylococcus epidermidis
TISDMMASFMFDNDYFMYGLETF

SEQ ID NO: 1801986 - protein, 18 aa, Staphylococcus epidermidis
TKGFWQQKFADFIRYEEQ

SEQ ID NO: 1801987 - protein, 22 aa, Staphylococcus epidermidis
TKLAETLSHVMKLPMHQVNCSV

SEQ ID NO: 1801988 - protein, 20 aa, Staphylococcus epidermidis
TKLAETLSHVMNLPMHQVNC

SEQ ID NO: 1801989 - protein, 23 aa, Staphylococcus epidermidis
TKMLRDYIIEFGQGVDFQQDKFG

SEQ ID NO: 1801990 - protein, 18 aa, Staphylococcus epidermidis
TKNGQMLVCQDPKCKTKK

SEQ ID NO: 1801991 - protein, 17 aa, Staphylococcus epidermidis
TKNGRKVLARRRRKGRK

SEQ ID NO: 1801992 - protein, 21 aa, Staphylococcus epidermidis
TKWNCKYHIVFAPKYRRQVIY

SEQ ID NO: 1801993 - protein, 21 aa, Staphylococcus epidermidis
TKWNCKYHIVFAPKYRRQVLY

SEQ ID NO: 1801994 - protein, 21 aa, Staphylococcus epidermidis
TKWNCKYHIVFVPKYRRQVIY

SEQ ID NO: 1801995 - protein, 19 aa, Staphylococcus epidermidis
TLAEMGYKQGIQPYSEGVY

SEQ ID NO: 1801996 - protein, 18 aa, Staphylococcus epidermidis
TLAVRNGAKFISTNPDVS

SEQ ID NO: 1801997 - protein, 23 aa, Staphylococcus epidermidis
TLLIKGHNAYGYLKAEKGVHRLV

SEQ ID NO: 1801998 - protein, 23 aa, Staphylococcus epidermidis
TMCYADCVPVYFYSESHGYIGLA

SEQ ID NO: 1801999 - protein, 21 aa, Staphylococcus epidermidis
TMIRQNLNPVIFVINNDGYTV

SEQ ID NO: 1802000 - protein, 17 aa, Staphylococcus epidermidis
TNIKVVLNGSGAAGIAI

SEQ ID NO: 1802001 - protein, 26 aa, Staphylococcus epidermidis
TNPSLIISFYPKFAVHPDHEATAEAV

SEQ ID NO: 1802002 - protein, 21 aa, Staphylococcus epidermidis
TQESWSVRYLEEYVNGLVSKD

SEQ ID NO: 1802003 - protein, 23 aa, Staphylococcus epidermidis
TQLLKWHIELPKVVKLQKDIEKK

SEQ ID NO: 1802004 - protein, 20 aa, Staphylococcus epidermidis
TQLQSGYPYLMFKDNANKVH

SEQ ID NO: 1802005 - protein, 25 aa, Staphylococcus epidermidis
TRDQYKWRLTCKELYAESQRIYGKK

SEQ ID NO: 1802006 - protein, 17 aa, Staphylococcus epidermidis
TRFQPGEQLLVKHNNTE

SEQ ID NO: 1802007 - protein, 17 aa, Staphylococcus epidermidis
TRILFAGLRCALKDMNI

SEQ ID NO: 1802008 - protein, 22 aa, Staphylococcus epidermidis
TRKGKYLISRNVHKSVFHGLDI

SEQ ID NO: 1802009 - protein, 18 aa, Staphylococcus epidermidis
TRQRKRAYEMLPVVMEYK

SEQ ID NO: 1802010 - protein, 27 aa, Staphylococcus epidermidis
TSDLISRYAGIRVPRNKAIVGQNTFSH

SEQ ID NO: 1802011 - protein, 17 aa, Staphylococcus epidermidis
TSFAYKVLPDLFYPEYI

SEQ ID NO: 1802012 - protein, 17 aa, Staphylococcus epidermidis
TSQPAIGDWIENFERLR

SEQ ID NO: 1802013 - protein, 19 aa, Staphylococcus epidermidis
TSREGFLLAQDISSYSLTI

SEQ ID NO: 1802014 - protein, 20 aa, Staphylococcus epidermidis
TTGLPEWVKEKYAKTALRIP

SEQ ID NO: 1802015 - protein, 23 aa, Staphylococcus epidermidis
TTTECPTCGKFMIKVKTKNGQML

SEQ ID NO: 1802016 - protein, 24 aa, Staphylococcus epidermidis
TVSALRLDVVLKEIIHKSRNIAQQ

SEQ ID NO: 1802017 - protein, 17 aa, Staphylococcus epidermidis
TWQGDEIVIHKDINISI

SEQ ID NO: 1802018 - protein, 19 aa, Staphylococcus epidermidis
TYFVIEFSDKIIGYVGLWL

SEQ ID NO: 1802019 - protein, 30 aa, Staphylococcus epidermidis
TYKIMTMFEPYFRDYKLIFINCPSRGKSSD

SEQ ID NO: 1802020 - protein, 31 aa, Staphylococcus epidermidis
TYKIMTMFEPYFRDYKLIFINCPSRGRSSDL

SEQ ID NO: 1802021 - protein, 24 aa, Staphylococcus epidermidis
TYSLGMKQKLGIAIAFLNQPQLII

SEQ ID NO: 1802022 - protein, 20 aa, Staphylococcus epidermidis
VADLKEYINHSVPKVMGVDY

SEQ ID NO: 1802023 - protein, 18 aa, Staphylococcus epidermidis
VAEQFKIMAARHPQRIDM

SEQ ID NO: 1802024 - protein, 25 aa, Staphylococcus epidermidis
VAIDLKINLMFSKVGVPRGRGKIER

SEQ ID NO: 1802025 - protein, 20 aa, Staphylococcus epidermidis
VAIKEAIELNPFITDYELCE

SEQ ID NO: 1802026 - protein, 18 aa, Staphylococcus epidermidis
VAKHVPMDRLLCETDAPY

SEQ ID NO: 1802027 - protein, 20 aa, Staphylococcus epidermidis
VAVGYYLRYALSYRDISEIL

SEQ ID NO: 1802028 - protein, 19 aa, Staphylococcus epidermidis
VCELLHLYQSFYQTFISFH

SEQ ID NO: 1802029 - protein, 17 aa, Staphylococcus epidermidis
VDALMGLNLPSGVDIEI

SEQ ID NO: 1802030 - protein, 17 aa, Staphylococcus epidermidis
VDEEALLEGLKQLVDVE

SEQ ID NO: 1802031 - protein, 18 aa, Staphylococcus epidermidis
VDEIKLEFMIKDNELEIT

SEQ ID NO: 1802032 - protein, 26 aa, Staphylococcus epidermidis
VDKYRGESALNYRLTAATFFIKMNQK

SEQ ID NO: 1802033 - protein, 28 aa, Staphylococcus epidermidis
VDSYRIHKGFHMLRFEGINNINDIEHLK

SEQ ID NO: 1802034 - protein, 17 aa, Staphylococcus epidermidis
VDTFKRMLTHIDSTGYI

SEQ ID NO: 1802035 - protein, 25 aa, Staphylococcus epidermidis
VDYNHVQSALNFKFMKRINEVGIPI

SEQ ID NO: 1802036 - protein, 27 aa, Staphylococcus epidermidis
VEAINKSRGKWCIKLSTGDKMVTDCVV

SEQ ID NO: 1802037 - protein, 19 aa, Staphylococcus epidermidis
VEAMQGYLMKSLKSEFAEV

SEQ ID NO: 1802038 - protein, 19 aa, Staphylococcus epidermidis
VEDLAKYSGVPVWNGLTDE

SEQ ID NO: 1802039 - protein, 23 aa, Staphylococcus epidermidis
VEERSAVSIGRRVQDPLSELVKI

SEQ ID NO: 1802040 - protein, 20 aa, Staphylococcus epidermidis
VEIPCVMRNAIGSGNALISA

SEQ ID NO: 1802041 - protein, 18 aa, Staphylococcus epidermidis
VELIYILKGYEGEDMKDF

SEQ ID NO: 1802042 - protein, 25 aa, Staphylococcus epidermidis
VELTKYLFFTGKGGVGKTTISSFIA

SEQ ID NO: 1802043 - protein, 23 aa, Staphylococcus epidermidis
VEMTWKKNWFKEIDLNKYDYIYV

SEQ ID NO: 1802044 - protein, 19 aa, Staphylococcus epidermidis
VFHYFKEAHPYFNQNVVII

SEQ ID NO: 1802045 - protein, 27 aa, Staphylococcus epidermidis
VGAEFLQRFNGGMGILLGGIPGVPKGK

SEQ ID NO: 1802046 - protein, 18 aa, Staphylococcus epidermidis
VGVARPGTRLFATEEGEL

SEQ ID NO: 1802047 - protein, 28 aa, Staphylococcus epidermidis
VGVLKEEILKFVDLMKSLGKEVSQQQAE

SEQ ID NO: 1802048 - protein, 23 aa, Staphylococcus epidermidis
VIDRVDHRYVYVNLGRIEAVLSE

SEQ ID NO: 1802049 - protein, 18 aa, Staphylococcus epidermidis
VIGDYVAGPSHVLPTNQT

SEQ ID NO: 1802050 - protein, 19 aa, Staphylococcus epidermidis
VITTMAITLAREYKTKHVV

SEQ ID NO: 1802051 - protein, 22 aa, Staphylococcus epidermidis
VKAKKAHAYDDFIIGYRLSPEE

SEQ ID NO: 1802052 - protein, 22 aa, Staphylococcus epidermidis
VKETLEGAGLNQAITYSLVSKN

SEQ ID NO: 1802053 - protein, 27 aa, Staphylococcus epidermidis
VKNFKQLRLWIWEVKKRDGKHHGTFAY

SEQ ID NO: 1802054 - protein, 19 aa, Staphylococcus epidermidis
VKRYLQGRKTRLVGPNCPG

SEQ ID NO: 1802055 - protein, 21 aa, Staphylococcus epidermidis
VKSSNLLPVRLDGATKEFFSW

SEQ ID NO: 1802056 - protein, 24 aa, Staphylococcus epidermidis
VKVQDIEITFNFNVMVNELENSQI

SEQ ID NO: 1802057 - protein, 18 aa, Staphylococcus epidermidis
VLANLMLPLNISKKDMPK

SEQ ID NO: 1802058 - protein, 18 aa, Staphylococcus epidermidis
VLDKPYVIVCLNTIVSDS

SEQ ID NO: 1802059 - protein, 23 aa, Staphylococcus epidermidis
VLQKFCLENKIGKYTLHSIRHTH

SEQ ID NO: 1802060 - protein, 23 aa, Staphylococcus epidermidis
VLTGRLSGNIGYVASNVAQEVKS

SEQ ID NO: 1802061 - protein, 23 aa, Staphylococcus epidermidis
VMSEHLWRVEIELKRDMVDYWND

SEQ ID NO: 1802062 - protein, 19 aa, Staphylococcus epidermidis
VNGTISIGCSSLIGQTLLP

SEQ ID NO: 1802063 - protein, 26 aa, Staphylococcus epidermidis
VNGVLRTVMRTELPSFEDIDDTKKRI

SEQ ID NO: 1802064 - protein, 32 aa, Staphylococcus epidermidis
VNLSNDAKITWSILRDRLDLSIRNNWVDKNGD

SEQ ID NO: 1802065 - protein, 20 aa, Staphylococcus epidermidis
VNPRSSRTVPFLSKITDIQM

SEQ ID NO: 1802066 - protein, 20 aa, Staphylococcus epidermidis
VPEFGTGFVRQMLEDTKPTT

SEQ ID NO: 1802067 - protein, 29 aa, Staphylococcus epidermidis
VPEFKNKHLRLAISQAINKKGYVNSVLND

SEQ ID NO: 1802068 - protein, 21 aa, Staphylococcus epidermidis
VPLEPGCYLMKDRNNQVIYVG

SEQ ID NO: 1802069 - protein, 20 aa, Staphylococcus epidermidis
VPMDLLPYLFFQFSSNGKRL

SEQ ID NO: 1802070 - protein, 19 aa, Staphylococcus epidermidis
VPRNKAIVGQNTFSHESGI

SEQ ID NO: 1802071 - protein, 19 aa, Staphylococcus epidermidis
VPSTISGTITELVVEEGQT

SEQ ID NO: 1802072 - protein, 20 aa, Staphylococcus epidermidis
VPVRETWDLKDLFTSDQAFY

SEQ ID NO: 1802073 - protein, 25 aa, Staphylococcus epidermidis
VQEAAKLGFKRAIIPQTNIGGWTFP

SEQ ID NO: 1802074 - protein, 17 aa, Staphylococcus epidermidis
VQEYAPILYQIWKKKHK

SEQ ID NO: 1802075 - protein, 29 aa, Staphylococcus epidermidis
VQGVGFRFYTQRIAHQFNIKGTVQNVEDY

SEQ ID NO: 1802076 - protein, 19 aa, Staphylococcus epidermidis
VQTFIPKNHIEDFKDSLNE

SEQ ID NO: 1802077 - protein, 18 aa, Staphylococcus epidermidis
VREAVVVPVYKNGKVVHL

SEQ ID NO: 1802078 - protein, 19 aa, Staphylococcus epidermidis
VRLPLWEDKLECQRTINAF

SEQ ID NO: 1802079 - protein, 23 aa, Staphylococcus epidermidis
VSDELWNRWKQWLENDELWPRHA

SEQ ID NO: 1802080 - protein, 22 aa, Staphylococcus epidermidis
VSEIPHGWMMVEADATNLVQTR

SEQ ID NO: 1802081 - protein, 19 aa, Staphylococcus epidermidis
VSGKWFFDRYSPVTHIKAV

SEQ ID NO: 1802082 - protein, 25 aa, Staphylococcus epidermidis
VSIIKRLSKASGHLGMVGGQALDME

SEQ ID NO: 1802083 - protein, 17 aa, Staphylococcus epidermidis
VSRLVKRRTLAKEISEQ

SEQ ID NO: 1802084 - protein, 25 aa, Staphylococcus epidermidis
VSSEFLRKRIVDLNEVNSMLGHRGC

SEQ ID NO: 1802085 - protein, 20 aa, Staphylococcus epidermidis
VSSVFLETFLFYSGFYYPLY

SEQ ID NO: 1802086 - protein, 21 aa, Staphylococcus epidermidis
VTAYRGSGHLIDYSATKGAIV

SEQ ID NO: 1802087 - protein, 24 aa, Staphylococcus epidermidis
VTFPNFLKRDKLTISVSTDGASPK

SEQ ID NO: 1802088 - protein, 21 aa, Staphylococcus epidermidis
VVAGTKYRGEFEERLKKVMEE

SEQ ID NO: 1802089 - protein, 19 aa, Staphylococcus epidermidis
VVMLRPTKSSIIFIQQLGR

SEQ ID NO: 1802090 - protein, 24 aa, Staphylococcus epidermidis
VVMLRPTKSSIIFIQQLGRGLRKS

SEQ ID NO: 1802091 - protein, 19 aa, Staphylococcus epidermidis
VVTSGIYERYFIQENQLFH

SEQ ID NO: 1802092 - protein, 19 aa, Staphylococcus epidermidis
VVVLPEMWNNGYALEELEQ

SEQ ID NO: 1802093 - protein, 17 aa, Staphylococcus epidermidis
VVYGIPMTAFDTYFNDF

SEQ ID NO: 1802094 - protein, 27 aa, Staphylococcus epidermidis
VWATAAPGWQKWVWSPFLSVLGMGATA

SEQ ID NO: 1802095 - protein, 24 aa, Staphylococcus epidermidis
VWEKRIKLLEPYRVTKELMKKTGN

SEQ ID NO: 1802096 - protein, 34 aa, Staphylococcus epidermidis
VYDPTCGSGSLLLRVGREADVRFYYGQEYNNTTF

SEQ ID NO: 1802097 - protein, 25 aa, Staphylococcus epidermidis
VYLEHMKLYRSFREEVPEEEYTIDI

SEQ ID NO: 1802098 - protein, 30 aa, Staphylococcus epidermidis
VYYDRPSEDWLWRDGFVKMDTLEVDVNDLM

SEQ ID NO: 1802099 - protein, 22 aa, Staphylococcus epidermidis
WADNYKFPVAVIDEVVKAKKAH

SEQ ID NO: 1802100 - protein, 19 aa, Staphylococcus epidermidis
WDEYPICMAKTQYSFSDDQ

SEQ ID NO: 1802101 - protein, 23 aa, Staphylococcus epidermidis
WEDEVFRVIIEYNNVPIGYGQIY

SEQ ID NO: 1802102 - protein, 24 aa, Staphylococcus epidermidis
WEIYFKNEGFYPVAVDAKHGKNLK

SEQ ID NO: 1802103 - protein, 18 aa, Staphylococcus epidermidis
WEYHDFYIEISFSVDKGQ

SEQ ID NO: 1802104 - protein, 24 aa, Staphylococcus epidermidis
WGECATRIVHMYRYVSKLQEQYQF

SEQ ID NO: 1802105 - protein, 19 aa, Staphylococcus epidermidis
WGIKAPFEVPDEFLMAIEL

SEQ ID NO: 1802106 - protein, 18 aa, Staphylococcus epidermidis
WHSAPRPIPLPNQTKNLL

SEQ ID NO: 1802107 - protein, 17 aa, Staphylococcus epidermidis
WLTHEFNIIDTGGIEIG

SEQ ID NO: 1802108 - protein, 20 aa, Staphylococcus epidermidis
WNKKEYLASEIFDLTESEEQ

SEQ ID NO: 1802109 - protein, 30 aa, Staphylococcus epidermidis; identical to SEQ ID NO: 1661089

SEQ ID NO: 1802110 - protein, 17 aa, Staphylococcus epidermidis
WSIELSKELDANQLYEE

SEQ ID NO: 1802111 - protein, 29 aa, Staphylococcus epidermidis
WSSVKPISGYPFVWWFATRPTYDGQGYGS

SEQ ID NO: 1802112 - protein, 19 aa, Staphylococcus epidermidis
WVGTLLKMKPVLRFEEDGK

SEQ ID NO: 1802113 - protein, 19 aa, Staphylococcus epidermidis
WVQEYAPILYRIWKKKHKK

SEQ ID NO: 1802114 - protein, 24 aa, Staphylococcus epidermidis
YAAGDVKGGLQFTYISLDDYRIIK

SEQ ID NO: 1802115 - protein, 17 aa, Staphylococcus epidermidis
YAGVRGFTASAGPGLSL

SEQ ID NO: 1802116 - protein, 17 aa, Staphylococcus epidermidis
YDIPTIYTKTLRERSLG

SEQ ID NO: 1802117 - protein, 17 aa, Staphylococcus epidermidis
YDLPEPSRAQAFHIDDL

SEQ ID NO: 1802118 - protein, 24 aa, Staphylococcus epidermidis
YDSDRYVPVLAIAIGKKAQDAHDS

SEQ ID NO: 1802119 - protein, 22 aa, Staphylococcus epidermidis
YEALVKIFYRYGEEKFSKQIAR

SEQ ID NO: 1802120 - protein, 18 aa, Staphylococcus epidermidis
YEKQTNWAFSENNEATFI

SEQ ID NO: 1802121 - protein, 18 aa, Staphylococcus epidermidis
YGARPLIRAIQKTVEDNL

SEQ ID NO: 1802122 - protein, 25 aa, Staphylococcus epidermidis
YGGYARHGGGCFSGKDPTKVDRSAA

SEQ ID NO: 1802123 - protein, 28 aa, Staphylococcus epidermidis
YGHYEVRLPLVPLEEAQCKQVERAFEQF

SEQ ID NO: 1802124 - protein, 19 aa, Staphylococcus epidermidis
YGNIIEICQTLGLQSAQSI

SEQ ID NO: 1802125 - protein, 18 aa, Staphylococcus epidermidis
YGRRRAYHNMSFSYHMLH

SEQ ID NO: 1802126 - protein, 27 aa, Staphylococcus epidermidis
YGTDAQPGWWREIIDGGYIPVHDYQFL

SEQ ID NO: 1802127 - protein, 19 aa, Staphylococcus epidermidis
YGYENALPLRIIVEAHNYG

SEQ ID NO: 1802128 - protein, 18 aa, Staphylococcus epidermidis
YIALEFASMFANFGTHVT

SEQ ID NO: 1802129 - protein, 24 aa, Staphylococcus epidermidis
YIQEGKWKSWGPYLLSGKDVYGAT

SEQ ID NO: 1802130 - protein, 24 aa, Staphylococcus epidermidis
YKDELRLGMDTQWMNRAGDGYPAF

SEQ ID NO: 1802131 - protein, 17 aa, Staphylococcus epidermidis
YKGETLGLVGESGCGKS

SEQ ID NO: 1802132 - protein, 23 aa, Staphylococcus epidermidis
YKIPNIYSYLNLMFFIQKNKEEF

SEQ ID NO: 1802133 - protein, 21 aa, Staphylococcus epidermidis
YKRGIYSGGVGYINCNHHLDF

SEQ ID NO: 1802134 - protein, 17 aa, Staphylococcus epidermidis
YKSRYDVTILINGLPLV

SEQ ID NO: 1802135 - protein, 20 aa, Staphylococcus epidermidis
YKTDELFADFREFGNKNLYM

SEQ ID NO: 1802136 - protein, 19 aa, Staphylococcus epidermidis
YKTKHVVYIGSSFNNNQLL

SEQ ID NO: 1802137 - protein, 19 aa, Staphylococcus epidermidis
YKYPRAIEFVEHLPKTNSG

SEQ ID NO: 1802138 - protein, 21 aa, Staphylococcus epidermidis
YKYPRAIEFVEHLPKTNSGKI

SEQ ID NO: 1802139 - protein, 17 aa, Staphylococcus epidermidis
YLAHRYGFKQQGVKGMN

SEQ ID NO: 1802140 - protein, 17 aa, Staphylococcus epidermidis
YLFEDAYFKKMSAEAKI

SEQ ID NO: 1802141 - protein, 17 aa, Staphylococcus epidermidis
YLKGHRQQAVLLLHSFT

SEQ ID NO: 1802142 - protein, 17 aa, Staphylococcus epidermidis
YLQAKNRLDEIGVPYQT

SEQ ID NO: 1802143 - protein, 17 aa, Staphylococcus epidermidis
YMFEMTLKVPAEVGLTE

SEQ ID NO: 1802144 - protein, 21 aa, Staphylococcus epidermidis
YMKPREFCLVSVLDGQGKLIV

SEQ ID NO: 1802145 - protein, 17 aa, Staphylococcus epidermidis
YNIAYEIRLQEALESNI

SEQ ID NO: 1802146 - protein, 33 aa, Staphylococcus epidermidis
YPEKIGVMSQNLWYFRYFIYYLIKENVIPKDKI

SEQ ID NO: 1802147 - protein, 17 aa, Staphylococcus epidermidis
YPLRGHNNVQGCSDMGS

SEQ ID NO: 1802148 - protein, 22 aa, Staphylococcus epidermidis
YQEQYKIIPACNVKAVDTTAAG

SEQ ID NO: 1802149 - protein, 24 aa, Staphylococcus epidermidis
YQGNKLMSWGRVPFIPFKNNPQEV

SEQ ID NO: 1802150 - protein, 22 aa, Staphylococcus epidermidis
YQLIKDCVFVAHNISFDLNFIK

SEQ ID NO: 1802151 - protein, 31 aa, Staphylococcus epidermidis
YRAKLLRQLPYPTKFIFLDFIQSENIQTLTS

SEQ ID NO: 1802152 - protein, 21 aa, Staphylococcus epidermidis
YRDEETWFALMNHLVNISIDY

SEQ ID NO: 1802153 - protein, 20 aa, Staphylococcus epidermidis
YREGEIEGTIDLNKYYYKNR

SEQ ID NO: 1802154 - protein, 20 aa, Staphylococcus epidermidis
YRNLHLFKDLGIIESTELDG

SEQ ID NO: 1802155 - protein, 23 aa, Staphylococcus epidermidis
YSEGNQGPIIWVEDTLIALQQLA

SEQ ID NO: 1802156 - protein, 20 aa, Staphylococcus epidermidis
YSEMLKEYAEGHIIGGHKKD

SEQ ID NO: 1802157 - protein, 17 aa, Staphylococcus epidermidis
YSKEKNTLFLISSHQLK

SEQ ID NO: 1802158 - protein, 28 aa, Staphylococcus epidermidis
YSLSEIQIIKGIILKAKRSFHDERADEI

SEQ ID NO: 1802159 - protein, 26 aa, Staphylococcus epidermidis
YTKHGIIRLIFKYRHNTLQRSVTNGA

SEQ ID NO: 1802160 - protein, 23 aa, Staphylococcus epidermidis
YTNEKLKSILNISSPNKLSKIKK

SEQ ID NO: 1802161 - protein, 20 aa, Staphylococcus epidermidis
YTRKDMDALTEFVNIYGAKG

SEQ ID NO: 1802162 - protein, 18 aa, Staphylococcus epidermidis
YVDEDWKARVRKTIPELP

SEQ ID NO: 1802163 - protein, 17 aa, Staphylococcus epidermidis
YVDMAKLAEARQVDPNK

SEQ ID NO: 1802164 - protein, 29 aa, Staphylococcus epidermidis
YVESDFKIVTGFIEPHFFAGFSGGPKGIM

SEQ ID NO: 1802165 - protein, 23 aa, Staphylococcus epidermidis
YVKGENPYFVSFMGDAPKKDPKV

SEQ ID NO: 1802166 - protein, 17 aa, Staphylococcus epidermidis
YVQFEFVKDDLTDLLAI

SEQ ID NO: 1802167 - protein, 19 aa, Staphylococcus epidermidis
YVQSGRLVIHMSQIDDVTE

SEQ ID NO: 1802168 - protein, 17 aa, Staphylococcus epidermidis
YVRKRIDPWIERYQYVG

SEQ ID NO: 1802169 - protein, 25 aa, Staphylococcus epidermidis
YWGTPLNVWICNDCNHEYAPSSIKD

SEQ ID NO: 1802170 - protein, 20 aa, Staphylococcus epidermidis
YYEEGYINFIELIVHRIDSI

SEQ ID NO: 1802171 - protein, 25 aa, Staphylococcus epidermidis
AAAISLALCHPEFDLKMITTVNGNV

SEQ ID NO: 1802172 - protein, 24 aa, Staphylococcus epidermidis
AAAQTLYFLYSMKLLDQSNSYEVI

SEQ ID NO: 1802173 - protein, 24 aa, Staphylococcus epidermidis
AADFWQRVIYKLIYNNEVLIVVND

SEQ ID NO: 1802174 - protein, 19 aa, Staphylococcus epidermidis
AAEELPINVGFTGKGQAVN

SEQ ID NO: 1802175 - protein, 20 aa, Staphylococcus epidermidis
AAELYKDFFPAKRKGIPELT

SEQ ID NO: 1802176 - protein, 26 aa, Staphylococcus epidermidis
AAGAHGEWTALMIFKAYHENNGQGHR

SEQ ID NO: 1802177 - protein, 24 aa, Staphylococcus epidermidis
AAGDARRGQSLVVWAIKEGRAVAQ

SEQ ID NO: 1802178 - protein, 25 aa, Staphylococcus epidermidis
AAGDTFRAGAIQQLQVWGERVGVEV

SEQ ID NO: 1802179 - protein, 24 aa, Staphylococcus epidermidis
AAGDVKGGLQFTYISLDDFRILQS

SEQ ID NO: 1802180 - protein, 21 aa, Staphylococcus epidermidis
AAHGGLHPYAATFFVFSDYLK

SEQ ID NO: 1802181 - protein, 21 aa, Staphylococcus epidermidis
AAHGGLHPYGATFFVFSDYLK

SEQ ID NO: 1802182 - protein, 17 aa, Staphylococcus epidermidis
AAKDLNDFLGINYYMSD

SEQ ID NO: 1802183 - protein, 22 aa, Staphylococcus epidermidis
AAKPAGICSCTDLTRDQIVTQI

SEQ ID NO: 1802184 - protein, 20 aa, Staphylococcus epidermidis
AAKQYRCVVRLKGGDPAIFG

SEQ ID NO: 1802185 - protein, 24 aa, Staphylococcus epidermidis
AALHSRCPEAMVIDINDTKMLTKM

SEQ ID NO: 1802186 - protein, 24 aa, Staphylococcus epidermidis
AAMAPCPYVYAVVAKRAIKDPALN

SEQ ID NO: 1802187 - protein, 24 aa, Staphylococcus epidermidis
AANEYKGELIFLHKVKDGAVDDSY

SEQ ID NO: 1802188 - protein, 20 aa, Staphylococcus epidermidis
AAPLRVKVRLIIKETGEVKE

SEQ ID NO: 1802189 - protein, 22 aa, Staphylococcus epidermidis
AAQESWSVRYLEEYVNGLVSKD

SEQ ID NO: 1802190 - protein, 17 aa, Staphylococcus epidermidis
AAQQFALEAGFPLMIKA

SEQ ID NO: 1802191 - protein, 20 aa, Staphylococcus epidermidis
AAQRLLALGITDFKMIDKAW

SEQ ID NO: 1802192 - protein, 20 aa, Staphylococcus epidermidis
AARARGRYGGRPEKLNKQDL

SEQ ID NO: 1802193 - protein, 21 aa, Staphylococcus epidermidis
AARARGRYGGRPEKLNKQDLN

SEQ ID NO: 1802194 - protein, 17 aa, Staphylococcus epidermidis
AARRIGEGSAMLRTKGE

SEQ ID NO: 1802195 - protein, 19 aa, Staphylococcus epidermidis
AASGVFSIPFAKEGAKVTS

SEQ ID NO: 1802196 - protein, 20 aa, Staphylococcus epidermidis
AASIAHIRLRVKINDDYVFT

SEQ ID NO: 1802197 - protein, 26 aa, Staphylococcus epidermidis
AASIPLQVCNVMKDFYISKLFTGGAT

SEQ ID NO: 1802198 - protein, 17 aa, Staphylococcus epidermidis
AATELFQFAMDLANEHD

SEQ ID NO: 1802199 - protein, 25 aa, Staphylococcus epidermidis
AATKAGAPKDCIQWIEVPSIVATKQ

SEQ ID NO: 1802200 - protein, 19 aa, Staphylococcus epidermidis
AATLYRDFFTAKRNEVPEV

SEQ ID NO: 1802201 - protein, 18 aa, Staphylococcus epidermidis
AATVGIVALTIVNPVAGA

SEQ ID NO: 1802202 - protein, 19 aa, Staphylococcus epidermidis
AAVCGEVFTSPTPDKILEA

SEQ ID NO: 1802203 - protein, 18 aa, Staphylococcus epidermidis
AAVDLKVILEYGESAPKI

SEQ ID NO: 1802204 - protein, 20 aa, Staphylococcus epidermidis
AAVRAVVRTAIYNNIEVYGI

SEQ ID NO: 1802205 - protein, 23 aa, Staphylococcus epidermidis
ACEALFRAGVRPDKIAHTLTHQE

SEQ ID NO: 1802206 - protein, 25 aa, Staphylococcus epidermidis
ACIAAHIHPIFGMTIYLTDGLYTIE

SEQ ID NO: 1802207 - protein, 17 aa, Staphylococcus epidermidis
ACINGVFHGIELKTNTG

SEQ ID NO: 1802208 - protein, 19 aa, Staphylococcus epidermidis
ADAATLIFENFEILEAKNQ

SEQ ID NO: 1802209 - protein, 19 aa, Staphylococcus epidermidis
ADAATLIFENFEILEARNA

SEQ ID NO: 1802210 - protein, 23 aa, Staphylococcus epidermidis
ADAETLKVLGVHIVSENAGDVIY

SEQ ID NO: 1802211 - protein, 17 aa, Staphylococcus epidermidis
ADAQYRWSDFLDKDIEN

SEQ ID NO: 1802212 - protein, 19 aa, Staphylococcus epidermidis
ADARLKRLKFEHESVEHFE

SEQ ID NO: 1802213 - protein, 19 aa, Staphylococcus epidermidis
ADDPLAFVRWHYDKKKRVI

SEQ ID NO: 1802214 - protein, 21 aa, Staphylococcus epidermidis
ADDRLKKVAQHLVVNHHKKTR

SEQ ID NO: 1802215 - protein, 21 aa, Staphylococcus epidermidis
ADDSFDLVIARNVTWLMTNPS

SEQ ID NO: 1802216 - protein, 20 aa, Staphylococcus epidermidis
ADDTRLKIVYALTQEDEMCV

SEQ ID NO: 1802217 - protein, 26 aa, Staphylococcus epidermidis
ADEDLKLQFDHAIQVAHDVLNKKDGS

SEQ ID NO: 1802218 - protein, 21 aa, Staphylococcus epidermidis
ADFRLFSGCSMCVGLSEDTLK

SEQ ID NO: 1802219 - protein, 23 aa, Staphylococcus epidermidis
ADGKSPMSVIYQFKVNNQTFKIH

SEQ ID NO: 1802220 - protein, 18 aa, Staphylococcus epidermidis
ADGVFIYIGMKPLTAPFT

SEQ ID NO: 1802221 - protein, 19 aa, Staphylococcus epidermidis
ADGVKFDYLFAAIGGGGLI

SEQ ID NO: 1802222 - protein, 23 aa, Staphylococcus epidermidis
ADIKTYIFYQLFEKYIIDYSMAS

SEQ ID NO: 1802223 - protein, 19 aa, Staphylococcus epidermidis
ADILRKVLFGPTITVKALL

SEQ ID NO: 1802224 - protein, 23 aa, Staphylococcus epidermidis
ADKFKVDALYPIATAAIRQSKNR

SEQ ID NO: 1802225 - protein, 25 aa, Staphylococcus epidermidis
ADKGELPHNVVFIFQPAEETGGGAN

SEQ ID NO: 1802226 - protein, 26 aa, Staphylococcus epidermidis
ADKILIGGGMAYTFMKAQGKEIGLSL

SEQ ID NO: 1802227 - protein, 24 aa, Staphylococcus epidermidis
ADKITYMPTWRPWEESEIINGNIK

SEQ ID NO: 1802228 - protein, 20 aa, Staphylococcus epidermidis
ADKKIGWIRTDYRVLKRDHD

SEQ ID NO: 1802229 - protein, 22 aa, Staphylococcus epidermidis
ADKLDIGDDIALYGEDGQLYGT

SEQ ID NO: 1802230 - protein, 20 aa, Staphylococcus epidermidis
ADLDVLKSRIAQRNRSFESH

SEQ ID NO: 1802231 - protein, 17 aa, Staphylococcus epidermidis
ADLEHTVNDIKKRIDQA

SEQ ID NO: 1802232 - protein, 17 aa, Staphylococcus epidermidis
ADLGVKYVVIGHSERRD

SEQ ID NO: 1802233 - protein, 25 aa, Staphylococcus epidermidis
ADLIKRIDTHLSIDFMDVSSYHGGT

SEQ ID NO: 1802234 - protein, 18 aa, Staphylococcus epidermidis
ADLILFGHNHRLHMFDGK

SEQ ID NO: 1802235 - protein, 21 aa, Staphylococcus epidermidis
ADLLLWFLRPEMKDLNTIENE

SEQ ID NO: 1802236 - protein, 30 aa, Staphylococcus epidermidis
ADLRKNKTLDERKLLETGFYNKTILTTLNK

SEQ ID NO: 1802237 - protein, 22 aa, Staphylococcus epidermidis
ADLTIGLILSVARRIVEGDHLS

SEQ ID NO: 1802238 - protein, 18 aa, Staphylococcus epidermidis
ADLTSKYHKPAIAICATS

SEQ ID NO: 1802239 - protein, 26 aa, Staphylococcus epidermidis
ADNGIKFFGSDGFKLSDDQENEIETL

SEQ ID NO: 1802240 - protein, 21 aa, Staphylococcus epidermidis
ADPAKKEAFDNAIKEAEDLLH

SEQ ID NO: 1802241 - protein, 19 aa, Staphylococcus epidermidis
ADPMTFLGLGGIGDLIVTC

SEQ ID NO: 1802242 - protein, 21 aa, Staphylococcus epidermidis
ADPTLKYFKNYRHMMMQPQQL

SEQ ID NO: 1802243 - protein, 24 aa, Staphylococcus epidermidis
ADQAICIGEANPLDSYLNIDRIIS

SEQ ID NO: 1802244 - protein, 20 aa, Staphylococcus epidermidis
ADQRQTMLFSATMPKAIQEL

SEQ ID NO: 1802245 - protein, 20 aa, Staphylococcus epidermidis
ADRALKALAKREVQFDVIFL

SEQ ID NO: 1802246 - protein, 22 aa, Staphylococcus epidermidis
ADRFKEWFDHLPSNIVRSKGIV

SEQ ID NO: 1802247 - protein, 23 aa, Staphylococcus epidermidis
ADSELPIEVSIQLLEGLNKRVVA

SEQ ID NO: 1802248 - protein, 24 aa, Staphylococcus epidermidis
ADSKVIFCEADDWKPFYEQNQTRI

SEQ ID NO: 1802249 - protein, 18 aa, Staphylococcus epidermidis
ADSLRYFLATGSSPGHDL

SEQ ID NO: 1802250 - protein, 20 aa, Staphylococcus epidermidis
ADSRQLLKLVNRKFDVTSTT

SEQ ID NO: 1802251 - protein, 22 aa, Staphylococcus epidermidis
ADSSWQLSFTVNRQQQFKEQPK

SEQ ID NO: 1802252 - protein, 17 aa, Staphylococcus epidermidis
ADTGISFVVGESDNPMK

SEQ ID NO: 1802253 - protein, 24 aa, Staphylococcus epidermidis
ADTKKLTGWYSRRIAVGENGEIKG

SEQ ID NO: 1802254 - protein, 19 aa, Staphylococcus epidermidis
ADVFIGVSVADILTQNMVK

SEQ ID NO: 1802255 - protein, 19 aa, Staphylococcus epidermidis
ADVFIGVSVADLLDKEMVE

SEQ ID NO: 1802256 - protein, 23 aa, Staphylococcus epidermidis
ADVNFKVVKEFVKTVSDRALGSD

SEQ ID NO: 1802257 - protein, 19 aa, Staphylococcus epidermidis
ADVTLSMIMLTLYARTIAK

SEQ ID NO: 1802258 - protein, 18 aa, Staphylococcus epidermidis
ADYGFPRAHAVSYSKIAY

SEQ ID NO: 1802259 - protein, 19 aa, Staphylococcus epidermidis
ADYKAGFISQEYQIDLYRK

SEQ ID NO: 1802260 - protein, 25 aa, Staphylococcus epidermidis
ADYKESKEAFDYIAKVVSKQEEGKT

SEQ ID NO: 1802261 - protein, 19 aa, Staphylococcus epidermidis
AEAAEYFSAELFKRDIPNN

SEQ ID NO: 1802262 - protein, 23 aa, Staphylococcus epidermidis
AEADLDMVICITEHIPVVDMVKV

SEQ ID NO: 1802263 - protein, 17 aa, Staphylococcus epidermidis
AEAHSSIIVNEKIYRQI

SEQ ID NO: 1802264 - protein, 17 aa, Staphylococcus epidermidis
AEAKIMYALLKDRFELS

SEQ ID NO: 1802265 - protein, 23 aa, Staphylococcus epidermidis
AEALAHAMVRIGNNVGRNTMAII

SEQ ID NO: 1802266 - protein, 19 aa, Staphylococcus epidermidis
AEALVKLDVNVTGIADDNN

SEQ ID NO: 1802267 - protein, 17 aa, Staphylococcus epidermidis
AEAPLSIHVHPDDSYAY

SEQ ID NO: 1802268 - protein, 20 aa, Staphylococcus epidermidis
AEAQAEGFNKMKFAMEMEAV

SEQ ID NO: 1802269 - protein, 25 aa, Staphylococcus epidermidis
AEARYKLQENLTCYFDASHVTDLMK

SEQ ID NO: 1802270 - protein, 17 aa, Staphylococcus epidermidis
AECVPTFNVSPNDIIGI

SEQ ID NO: 1802271 - protein, 27 aa, Staphylococcus epidermidis
AEDPFTCPHGRPIIINFSNYELEKLFK

SEQ ID NO: 1802272 - protein, 17 aa, Staphylococcus epidermidis
AEDYLKEHPDLVDMDGT

SEQ ID NO: 1802273 - protein, 18 aa, Staphylococcus epidermidis
AEEITWLKSDIFNYENVV

SEQ ID NO: 1802274 - protein, 21 aa, Staphylococcus epidermidis
AEEMAYCYARMKSDILECFKR

SEQ ID NO: 1802275 - protein, 20 aa, Staphylococcus epidermidis
AEFEEIRDQLLLIGGLSKSH

SEQ ID NO: 1802276 - protein, 24 aa, Staphylococcus epidermidis
AEFPEIRDQLLLIGGLSKSHSATG

SEQ ID NO: 1802277 - protein, 18 aa, Staphylococcus epidermidis
AEFPQFFERASFAPDGQD

SEQ ID NO: 1802278 - protein, 19 aa, Staphylococcus epidermidis
AEFSLEYIAFFPSDKPKKV

SEQ ID NO: 1802279 - protein, 22 aa, Staphylococcus epidermidis
AEGIVPKLVWTKRIETGEVVTA

SEQ ID NO: 1802280 - protein, 20 aa, Staphylococcus epidermidis
AEGKIKHKVSHKFNIGYMYI

SEQ ID NO: 1802281 - protein, 18 aa, Staphylococcus epidermidis
AEHGSNIWFEREAKDLLP

SEQ ID NO: 1802282 - protein, 20 aa, Staphylococcus epidermidis
AEIAYHQSLLPQFVTPNGET

SEQ ID NO: 1802283 - protein, 17 aa, Staphylococcus epidermidis
AEIFNVSIITIKSAYQI

SEQ ID NO: 1802284 - protein, 17 aa, Staphylococcus epidermidis
AEIGHPVIGDPLYGDST

SEQ ID NO: 1802285 - protein, 20 aa, Staphylococcus epidermidis
AEIKGFKFNVLHTPGHSPGS

SEQ ID NO: 1802286 - protein, 19 aa, Staphylococcus epidermidis
AEIKIIKTVLLKAKTSFNN

SEQ ID NO: 1802287 - protein, 21 aa, Staphylococcus epidermidis
AEIKQRGRKGTTLNKLTIQEK

SEQ ID NO: 1802288 - protein, 23 aa, Staphylococcus epidermidis
AEIQFQYGLTLCHLEMFDQAINQ

SEQ ID NO: 1802289 - protein, 20 aa, Staphylococcus epidermidis
AEIQIRTLAMNFWATIEHTL

SEQ ID NO: 1802290 - protein, 19 aa, Staphylococcus epidermidis
AEIRKKLNIVNQGLLNPDK

SEQ ID NO: 1802291 - protein, 20 aa, Staphylococcus epidermidis
AEISDQVMIDYGYTPLDKNN

SEQ ID NO: 1802292 - protein, 18 aa, Staphylococcus epidermidis
AEKAFQKRINDFHMRNGV

SEQ ID NO: 1802293 - protein, 27 aa, Staphylococcus epidermidis
AEKAKELGCLFAFYGHTHVAKYEQIGG

SEQ ID NO: 1802294 - protein, 32 aa, Staphylococcus epidermidis
AEKEIEILFAKRLKEIKQIIANMYEKYDRDEP

SEQ ID NO: 1802295 - protein, 24 aa, Staphylococcus epidermidis
AEKGHPVTIISVFRGTDSPYFELH

SEQ ID NO: 1802296 - protein, 23 aa, Staphylococcus epidermidis
AEKKHKLGGQIIFGANLQIGYYD

SEQ ID NO: 1802297 - protein, 20 aa, Staphylococcus epidermidis
AEKKPVILVADGEDTAKDMY

SEQ ID NO: 1802298 - protein, 20 aa, Staphylococcus epidermidis
AEKLEIGDDIALYGEDGQLY

SEQ ID NO: 1802299 - protein, 21 aa, Staphylococcus epidermidis
AEKQGCINYQDIISFDNDFLI

SEQ ID NO: 1802300 - protein, 24 aa, Staphylococcus epidermidis
AEKTRLRVQLDILDRESQDIEERY

SEQ ID NO: 1802301 - protein, 17 aa, Staphylococcus epidermidis
AEKVKHQYGHAFYDSAS

SEQ ID NO: 1802302 - protein, 17 aa, Staphylococcus epidermidis
AEKYANIATNCYDTAEI

SEQ ID NO: 1802303 - protein, 24 aa, Staphylococcus epidermidis
AEKYLKDHKQLLLVTNNLYQADKI

SEQ ID NO: 1802304 - protein, 17 aa, Staphylococcus epidermidis
AELIDWNKRMVKNGVPS

SEQ ID NO: 1802305 - protein, 27 aa, Staphylococcus epidermidis
AELNPTPKWSISRYKGLGEMNADQLWE

SEQ ID NO: 1802306 - protein, 22 aa, Staphylococcus epidermidis
AELNRSTIEQALTRVQQAQNAL

SEQ ID NO: 1802307 - protein, 30 aa, Staphylococcus epidermidis
AELRVQDAYSLRCIPQIHGASFQVFNYVRE

SEQ ID NO: 1802308 - protein, 24 aa, Staphylococcus epidermidis
AENNNIVFWYGWNEQAFNVVSSIV

SEQ ID NO: 1802309 - protein, 36 aa, Staphylococcus epidermidis
AENVIFIGLICKNAVWHAVVFEIGRGYTRELSIMNI

SEQ ID NO: 1802310 - protein, 30 aa, Staphylococcus epidermidis
AEQSYRLTIPNIYFKSNLKAIYDMINHYDY

SEQ ID NO: 1802311 - protein, 18 aa, Staphylococcus epidermidis
AERILKNDFTAMEKSDIY

SEQ ID NO: 1802312 - protein, 19 aa, Staphylococcus epidermidis
AERKRAIIAPSYYEPQEED

SEQ ID NO: 1802313 - protein, 18 aa, Staphylococcus epidermidis
AERLVIHGFLDPVVRELP

SEQ ID NO: 1802314 - protein, 20 aa, Staphylococcus epidermidis
AESVQLLFNVECEVKFEEGY

SEQ ID NO: 1802315 - protein, 17 aa, Staphylococcus epidermidis
AETAPLYALSAVSFEKE

SEQ ID NO: 1802316 - protein, 25 aa, Staphylococcus epidermidis
AETRKELKSLLSVESGGIVFTTMQK

SEQ ID NO: 1802317 - protein, 17 aa, Staphylococcus epidermidis
AEVKDYVFINSYDPRLF

SEQ ID NO: 1802318 - protein, 17 aa, Staphylococcus epidermidis
AEVLAMVMHIYQSFGLK

SEQ ID NO: 1802319 - protein, 19 aa, Staphylococcus epidermidis
AEYYTHFTSPIRRYPDLTV

SEQ ID NO: 1802320 - protein, 17 aa, Staphylococcus epidermidis
AFDEAHCISKWGHDFRP

SEQ ID NO: 1802321 - protein, 21 aa, Staphylococcus epidermidis
AFDEAHCISQWGHDFRPSYQS

SEQ ID NO: 1802322 - protein, 18 aa, Staphylococcus epidermidis
AFDEWRYLPDGSDNPEFN

SEQ ID NO: 1802323 - protein, 25 aa, Staphylococcus epidermidis
AFDKYPIEAVFGIHVNPFAEEGKVV

SEQ ID NO: 1802324 - protein, 22 aa, Staphylococcus epidermidis
AFDLRSKEAFHGGHMHGTINIP

SEQ ID NO: 1802325 - protein, 21 aa, Staphylococcus epidermidis
AFDLRSKEAFHGGHTQGTINI

SEQ ID NO: 1802326 - protein, 25 aa, Staphylococcus epidermidis
AFDRIDVEGPFYFKNLSKEDDFERV

SEQ ID NO: 1802327 - protein, 23 aa, Staphylococcus epidermidis
AFEIDQRLIPVLKDTLSPYDNVT

SEQ ID NO: 1802328 - protein, 17 aa, Staphylococcus epidermidis
AFENIKVGDPFDENVKM

SEQ ID NO: 1802329 - protein, 18 aa, Staphylococcus epidermidis
AFEQELHPYVLKDAGTFN

SEQ ID NO: 1802330 - protein, 17 aa, Staphylococcus epidermidis
AFGAFVSTDRNGMATTE

SEQ ID NO: 1802331 - protein, 25 aa, Staphylococcus epidermidis
AFIADECRLWITVHYLPYERYEDVV

SEQ ID NO: 1802332 - protein, 27 aa, Staphylococcus epidermidis
AFIEECKNLKWIAWYATGVNNLPLDYI

SEQ ID NO: 1802333 - protein, 18 aa, Staphylococcus epidermidis
AFINLPSIIFADEPTGAL

SEQ ID NO: 1802334 - protein, 20 aa, Staphylococcus epidermidis
AFIRIRINYNGSPVDLTKTD

SEQ ID NO: 1802335 - protein, 25 aa, Staphylococcus epidermidis
AFKLEELKQGVLYPYTTNEEYKNLM

SEQ ID NO: 1802336 - protein, 25 aa, Staphylococcus epidermidis
AFKLEELKQGVLYPYTTNEEYNNLM

SEQ ID NO: 1802337 - protein, 21 aa, Staphylococcus epidermidis
AFLDPRGQYILEVIVGSYEDL

SEQ ID NO: 1802338 - protein, 21 aa, Staphylococcus epidermidis
AFNGRKPSECIALQVNGDSMN

SEQ ID NO: 1802339 - protein, 27 aa, Staphylococcus epidermidis
AFQELDRGFDFYAPQTFVDKHGKRILI

SEQ ID NO: 1802340 - protein, 27 aa, Staphylococcus epidermidis
AFQKRINDFHMRNGVTILDPNSTYIGP

SEQ ID NO: 1802341 - protein, 22 aa, Staphylococcus epidermidis
AFSHPSKPIGLFYDKETAESIE

SEQ ID NO: 1802342 - protein, 26 aa, Staphylococcus epidermidis
AFSIKEMIEANIAKGYEFMVITDHSQ

SEQ ID NO: 1802343 - protein, 19 aa, Staphylococcus epidermidis
AFTDWLKSDVFRKAHKNVR

SEQ ID NO: 1802344 - protein, 19 aa, Staphylococcus epidermidis
AFVHRNHRNELWFDMSKKL

SEQ ID NO: 1802345 - protein, 21 aa, Staphylococcus epidermidis
AFVIGNLKPRAVIRHAEVVGN

SEQ ID NO: 1802346 - protein, 18 aa, Staphylococcus epidermidis
AGAESLYGNPRDFILKHN

SEQ ID NO: 1802347 - protein, 26 aa, Staphylococcus epidermidis
AGAGFPSIPLKIVFPELKVTIVDSLN

SEQ ID NO: 1802348 - protein, 18 aa, Staphylococcus epidermidis
AGALEGWKGMSLPLENVE

SEQ ID NO: 1802349 - protein, 30 aa, Staphylococcus epidermidis
AGANAIYEFLTLRIPMLLIPLGLDQSRGDQ

SEQ ID NO: 1802350 - protein, 18 aa, Staphylococcus epidermidis
AGASKIFVFDLSEERLEK

SEQ ID NO: 1802351 - protein, 31 aa, Staphylococcus epidermidis
AGDDILLRRIYKLPIGFKWENQPNVTLIGDA

SEQ ID NO: 1802352 - protein, 25 aa, Staphylococcus epidermidis
AGDTFIGAFVSRLERDLSNLEDAIR

SEQ ID NO: 1802353 - protein, 17 aa, Staphylococcus epidermidis
AGENLAYGQLNSIYAHE

SEQ ID NO: 1802354 - protein, 17 aa, Staphylococcus epidermidis
AGFDYVVTGSGFLYNMV

SEQ ID NO: 1802355 - protein, 22 aa, Staphylococcus epidermidis
AGGCFWCMTKPFDTFDGIEKVT

SEQ ID NO: 1802356 - protein, 25 aa, Staphylococcus epidermidis
AGGIFSTNINRVFNVAKAMRTGRIW

SEQ ID NO: 1802357 - protein, 24 aa, Staphylococcus epidermidis
AGGKRIRPVLLLLTLNMLKGDYDK

SEQ ID NO: 1802358 - protein, 23 aa, Staphylococcus epidermidis
AGHHIKTAVVMHLCNTTKKDAKL

SEQ ID NO: 1802359 - protein, 19 aa, Staphylococcus epidermidis
AGIGTCWKSPHYIFEPKVR

SEQ ID NO: 1802360 - protein, 25 aa, Staphylococcus epidermidis
AGIMTKCPKCKKIMYTKELAENLNV

SEQ ID NO: 1802361 - protein, 17 aa, Staphylococcus epidermidis
AGINHWFNSDTIYRAIL

SEQ ID NO: 1802362 - protein, 25 aa, Staphylococcus epidermidis
AGIVPWNAPIMVLMRKVIPAIVTGC

SEQ ID NO: 1802363 - protein, 23 aa, Staphylococcus epidermidis
AGKIFFKKCQEIIALYDNLPTEI

SEQ ID NO: 1802364 - protein, 17 aa, Staphylococcus epidermidis
AGKLPWGDLDIDVVLEC

SEQ ID NO: 1802365 - protein, 21 aa, Staphylococcus epidermidis
AGLFGGPLYTFHKIFSIIILS

SEQ ID NO: 1802366 - protein, 18 aa, Staphylococcus epidermidis
AGLFHIGILLPELSSLAD

SEQ ID NO: 1802367 - protein, 20 aa, Staphylococcus epidermidis
AGLKRFKDQYETVYLEVDNN

SEQ ID NO: 1802368 - protein, 19 aa, Staphylococcus epidermidis
AGLTPKEWGYHITTMGKVE

SEQ ID NO: 1802369 - protein, 18 aa, Staphylococcus epidermidis
AGNLAVYYQQLWNLPEKV

SEQ ID NO: 1802370 - protein, 27 aa, Staphylococcus epidermidis
AGRARRGELVSCFLLEIDDSLNSINFI

SEQ ID NO: 1802371 - protein, 21 aa, Staphylococcus epidermidis
AGTHEVYFRLTANAESKERCQ

SEQ ID NO: 1802372 - protein, 17 aa, Staphylococcus epidermidis
AGTKILPHSKVLLLTDG

SEQ ID NO: 1802373 - protein, 23 aa, Staphylococcus epidermidis
AGVPHEFAWGGLHGARKNYFAKG

SEQ ID NO: 1802374 - protein, 18 aa, Staphylococcus epidermidis
AGYFSPLANLARMTEEVG

SEQ ID NO: 1802375 - protein, 19 aa, Staphylococcus epidermidis
AGYSLNWLKKTFFENDSFE

SEQ ID NO: 1802376 - protein, 22 aa, Staphylococcus epidermidis
AHAEDLFHLDLAYAPPFSTTKD

SEQ ID NO: 1802377 - protein, 24 aa, Staphylococcus epidermidis
AHFGGHGTLAWVPAKEGLTPQEVK

SEQ ID NO: 1802378 - protein, 18 aa, Staphylococcus epidermidis
AHGPFNMTAPIPERQNLF

SEQ ID NO: 1802379 - protein, 17 aa, Staphylococcus epidermidis
AHHDVPVILFGVGASHL

SEQ ID NO: 1802380 - protein, 23 aa, Staphylococcus epidermidis
AHILEGLRIALDHIDEIITTIRE

SEQ ID NO: 1802381 - protein, 34 aa, Staphylococcus epidermidis
AHKLAGKGEVIFPRETMIGSMAYYISHAKNEKNF

SEQ ID NO: 1802382 - protein, 18 aa, Staphylococcus epidermidis
AHKLKKWGLPANRNTVRL

SEQ ID NO: 1802383 - protein, 27 aa, Staphylococcus epidermidis
AHLKNWNYSYAYSMRLTDDFSSINIIH

SEQ ID NO: 1802384 - protein, 20 aa, Staphylococcus epidermidis
AHLNPLWVTAYDDYPMQSIR

SEQ ID NO: 1802385 - protein, 17 aa, Staphylococcus epidermidis
AHLTMEFFTKGLVPITS

SEQ ID NO: 1802386 - protein, 17 aa, Staphylococcus epidermidis
AHPIIVGPITFVKLSKG

SEQ ID NO: 1802387 - protein, 20 aa, Staphylococcus epidermidis
AHRMKAQRGFLEGDSEYNDN

SEQ ID NO: 1802388 - protein, 17 aa, Staphylococcus epidermidis
AHSPLFIELLVTRNDFI

SEQ ID NO: 1802389 - protein, 17 aa, Staphylococcus epidermidis
AHSSIIVNEKIYRQITQ

SEQ ID NO: 1802390 - protein, 23 aa, Staphylococcus epidermidis
AHTKWNCKYHIVFAPKYRRQVIY

SEQ ID NO: 1802391 - protein, 25 aa, Staphylococcus epidermidis
AHTKWNCKYHIVFAPKYRRQVIYGK

SEQ ID NO: 1802392 - protein, 27 aa, Staphylococcus epidermidis
AHVRYDKELKPMEVIMYGELTALSNKY

SEQ ID NO: 1802393 - protein, 24 aa, Staphylococcus epidermidis
AIADFWECATAYLGKNAPKREDIE

SEQ ID NO: 1802394 - protein, 20 aa, Staphylococcus epidermidis
AIARAICMNPQYILFDEAIS

SEQ ID NO: 1802395 - protein, 20 aa, Staphylococcus epidermidis
AIARAICMQPDYILFDEAIS

SEQ ID NO: 1802396 - protein, 17 aa, Staphylococcus epidermidis
AIARYVLNKIPCTKNLK

SEQ ID NO: 1802397 - protein, 23 aa, Staphylococcus epidermidis
AIATRILPASTFYEAEAYHQDFY

SEQ ID NO: 1802398 - protein, 24 aa, Staphylococcus epidermidis
AIDAYGAGSFIVATKIKGMIAAEV

SEQ ID NO: 1802399 - protein, 23 aa, Staphylococcus epidermidis
AIDVYTMTSILWDVVKKQQKEIE

SEQ ID NO: 1802400 - protein, 19 aa, Staphylococcus epidermidis
AIEAIICGIGINMNHVEND

SEQ ID NO: 1802401 - protein, 17 aa, Staphylococcus epidermidis
AIEEMRLPIEYLANLLT

SEQ ID NO: 1802402 - protein, 26 aa, Staphylococcus epidermidis
AIEFARAGDTIVVWRLDRLGRNMEDL

SEQ ID NO: 1802403 - protein, 24 aa, Staphylococcus epidermidis
AIEKSKHAQLEWERVPQPTRAEHV

SEQ ID NO: 1802404 - protein, 18 aa, Staphylococcus epidermidis
AIEKVSVLDDIDFEVEIL

SEQ ID NO: 1802405 - protein, 31 aa, Staphylococcus epidermidis
AIERASEVIGSWRLEDCTLYVTLEPCVMCAG

SEQ ID NO: 1802406 - protein, 23 aa, Staphylococcus epidermidis
AIERGYRSIDTAMIYGNEETVGQ

SEQ ID NO: 1802407 - protein, 20 aa, Staphylococcus epidermidis
AIESSFGVEIFIRTKKQLIT

SEQ ID NO: 1802408 - protein, 17 aa, Staphylococcus epidermidis
AIEWCNFQATTISSLYK

SEQ ID NO: 1802409 - protein, 21 aa, Staphylococcus epidermidis
AIGAITKMWTITGVGGADDLN

SEQ ID NO: 1802410 - protein, 23 aa, Staphylococcus epidermidis
AIGKYKLQVDLERPVPYINELLA

SEQ ID NO: 1802411 - protein, 17 aa, Staphylococcus epidermidis
AIGRAAAIAYAKEGADV

SEQ ID NO: 1802412 - protein, 17 aa, Staphylococcus epidermidis
AIHRGVVSTASYEARAY

SEQ ID NO: 1802413 - protein, 18 aa, Staphylococcus epidermidis
AIILALLVQCDLNNELEK

SEQ ID NO: 1802414 - protein, 22 aa, Staphylococcus epidermidis
AIKEHMASLIYKLEEMGIDLEY

SEQ ID NO: 1802415 - protein, 21 aa, Staphylococcus epidermidis
AIKKAFHPDGLNIIQNNGEYA

SEQ ID NO: 1802416 - protein, 19 aa, Staphylococcus epidermidis
AIKQPKYLYGDAVVPFEGE

SEQ ID NO: 1802417 - protein, 23 aa, Staphylococcus epidermidis
AILKAEGNMNIFVIEYDESGNDI

SEQ ID NO: 1802418 - protein, 19 aa, Staphylococcus epidermidis
AIMGMNFHLVCPKELNPTD

SEQ ID NO: 1802419 - protein, 26 aa, Staphylococcus epidermidis
AIMSGNFVMRGEPAIYHKFKRTEMAL

SEQ ID NO: 1802420 - protein, 26 aa, Staphylococcus epidermidis
AINEFIKPKISVPIHYNTFPLIEQDP

SEQ ID NO: 1802421 - protein, 17 aa, Staphylococcus epidermidis
AINEIRPGMTVQEADAL

SEQ ID NO: 1802422 - protein, 34 aa, Staphylococcus epidermidis
AINFFNYLSGYSIKPEYNKLIVAPFDIRDVFIDR

SEQ ID NO: 1802423 - protein, 24 aa, Staphylococcus epidermidis
AINIARLAYLLARSKMNEDFTSKI

SEQ ID NO: 1802424 - protein, 18 aa, Staphylococcus epidermidis
AINKILIQDGIKKQQINE

SEQ ID NO: 1802425 - protein, 18 aa, Staphylococcus epidermidis
AINRFDLSFDRKFEAFLV

SEQ ID NO: 1802426 - protein, 19 aa, Staphylococcus epidermidis
AINRFDLSFDRKFEAFLVP

SEQ ID NO: 1802427 - protein, 17 aa, Staphylococcus epidermidis
AIQLGEWIAKNNHTLVF

SEQ ID NO: 1802428 - protein, 19 aa, Staphylococcus epidermidis
AIQSWAQWFTDHGITEIHL

SEQ ID NO: 1802429 - protein, 25 aa, Staphylococcus epidermidis
AIRIQAKIASLVTAFARVREGKEPL

SEQ ID NO: 1802430 - protein, 19 aa, Staphylococcus epidermidis
AISCSPKLLIADEPTTALD

SEQ ID NO: 1802431 - protein, 25 aa, Staphylococcus epidermidis
AISDRFPGFQLDYFKKTNYLDTDWK

SEQ ID NO: 1802432 - protein, 24 aa, Staphylococcus epidermidis
AISEGYRPGDFESITVTVDADQPS

SEQ ID NO: 1802433 - protein, 24 aa, Staphylococcus epidermidis
AISGIPFNYITKWSDFKKLNKQFT

SEQ ID NO: 1802434 - protein, 26 aa, Staphylococcus epidermidis
AITPWNFPAAMITRKMAPALAAGCTI

SEQ ID NO: 1802435 - protein, 17 aa, Staphylococcus epidermidis
AIVAEGAADKYTRKDMD

SEQ ID NO: 1802436 - protein, 31 aa, Staphylococcus epidermidis
AIVGGKGSEIAKYFLNKGVHVIQEQPVHSDD

SEQ ID NO: 1802437 - protein, 19 aa, Staphylococcus epidermidis
AIVNRETTGVFKLVADAET

SEQ ID NO: 1802438 - protein, 28 aa, Staphylococcus epidermidis
AIVRMEKRYKGPIAFEYTHINNSKERVW

SEQ ID NO: 1802439 - protein, 23 aa, Staphylococcus epidermidis
AKADIKFDEMMSFIESDLYMQIA

SEQ ID NO: 1802440 - protein, 18 aa, Staphylococcus epidermidis
AKAKFEITTGLKTNGIFI

SEQ ID NO: 1802441 - protein, 22 aa, Staphylococcus epidermidis
AKAKVQLAFCIDVRSEPFRRHL

SEQ ID NO: 1802442 - protein, 22 aa, Staphylococcus epidermidis
AKATALNNAMKALRDSIQNVDE

SEQ ID NO: 1802443 - protein, 20 aa, Staphylococcus epidermidis
AKDALNSIERLKAAKAKADK

SEQ ID NO: 1802444 - protein, 17 aa, Staphylococcus epidermidis
AKDDWVVSTIFELDSMS

SEQ ID NO: 1802445 - protein, 18 aa, Staphylococcus epidermidis
AKDFVEFNNRYLFNSHFG

SEQ ID NO: 1802446 - protein, 22 aa, Staphylococcus epidermidis
AKDGYIDCVMVYKTNRLARNTS

SEQ ID NO: 1802447 - protein, 21 aa, Staphylococcus epidermidis
AKDLIEGLVMTNSIFNGGSQV

SEQ ID NO: 1802448 - protein, 29 aa, Staphylococcus epidermidis
AKDLRMMMAALKISTDFERMGDNAASIAH

SEQ ID NO: 1802449 - protein, 19 aa, Staphylococcus epidermidis
AKDRAHILEGLRIALDHID

SEQ ID NO: 1802450 - protein, 18 aa, Staphylococcus epidermidis
AKDYYEVIEWASQQEWSN

SEQ ID NO: 1802451 - protein, 18 aa, Staphylococcus epidermidis
AKEEYRHQLGKVKSKLLV

SEQ ID NO: 1802452 - protein, 24 aa, Staphylococcus epidermidis
AKEFKFKAEVLDKIIEVYKNSDLY

SEQ ID NO: 1802453 - protein, 17 aa, Staphylococcus epidermidis
AKEGSIFVASKGYTVDS

SEQ ID NO: 1802454 - protein, 19 aa, Staphylococcus epidermidis
AKELDEMGADYIAVHTGYD

SEQ ID NO: 1802455 - protein, 20 aa, Staphylococcus epidermidis
AKELGAPFEILKQIKDKGRL

SEQ ID NO: 1802456 - protein, 22 aa, Staphylococcus epidermidis
AKELIIQLATLYGLTPDGMKKV

SEQ ID NO: 1802457 - protein, 23 aa, Staphylococcus epidermidis
AKELKGANIFLDMVSVGATINIM

SEQ ID NO: 1802458 - protein, 25 aa, Staphylococcus epidermidis
AKELNEAMKALRSEISKKDQVKGES

SEQ ID NO: 1802459 - protein, 21 aa, Staphylococcus epidermidis
AKEVLNPQLIFYGLGGATEAS

SEQ ID NO: 1802460 - protein, 17 aa, Staphylococcus epidermidis
AKEVQTFVTELRNDKLP

SEQ ID NO: 1802461 - protein, 20 aa, Staphylococcus epidermidis
AKEWLSDFNNSFSFTGGYVF

SEQ ID NO: 1802462 - protein, 23 aa, Staphylococcus epidermidis
AKEYLWSVLIDKLNEWNLHNDQY

SEQ ID NO: 1802463 - protein, 19 aa, Staphylococcus epidermidis
AKFDMSFIIEEDQDGYVVN

SEQ ID NO: 1802464 - protein, 18 aa, Staphylococcus epidermidis
AKGFGIDEDVARRLASKY

SEQ ID NO: 1802465 - protein, 25 aa, Staphylococcus epidermidis
AKGKDAYNFPRVWLEKDSYDFSFSG

SEQ ID NO: 1802466 - protein, 25 aa, Staphylococcus epidermidis
AKGTDTGWQTLPLVNGITQAGTLNK

SEQ ID NO: 1802467 - protein, 17 aa, Staphylococcus epidermidis
AKHKILYLHGGYNTLQP

SEQ ID NO: 1802468 - protein, 18 aa, Staphylococcus epidermidis
AKIDYLFDALEDDGPELI

SEQ ID NO: 1802469 - protein, 18 aa, Staphylococcus epidermidis
AKIEAFETHISYIEEQLT

SEQ ID NO: 1802470 - protein, 17 aa, Staphylococcus epidermidis
AKIKVRADIVYSGNEAQ

SEQ ID NO: 1802471 - protein, 17 aa, Staphylococcus epidermidis
AKISMKVKEYLDFAFKN

SEQ ID NO: 1802472 - protein, 22 aa, Staphylococcus epidermidis
AKIVEFGGWAMPVQFSSIKEEH

SEQ ID NO: 1802473 - protein, 26 aa, Staphylococcus epidermidis
AKIYKTCVLEDIFFGYEIEDKDNYFM

SEQ ID NO: 1802474 - protein, 24 aa, Staphylococcus epidermidis
AKKADTAPKRFIREFRNLNVDEYE

SEQ ID NO: 1802475 - protein, 20 aa, Staphylococcus epidermidis
AKKAELDRYLPIEDALKQLS

SEQ ID NO: 1802476 - protein, 20 aa, Staphylococcus epidermidis
AKKAIEMEPWQAIVEDNNAQ

SEQ ID NO: 1802477 - protein, 17 aa, Staphylococcus epidermidis
AKKFDLPIIEVIEGGDV

SEQ ID NO: 1802478 - protein, 34 aa, Staphylococcus epidermidis
AKKGIYKMPSFLLKDAFDDLDWYAKILYTIYRNR

SEQ ID NO: 1802479 - protein, 17 aa, Staphylococcus epidermidis
AKKIIAKGLVPIIEPEV

SEQ ID NO: 1802480 - protein, 21 aa, Staphylococcus epidermidis
AKKSTPLKVYVNGHFENVTFP

SEQ ID NO: 1802481 - protein, 19 aa, Staphylococcus epidermidis
AKLETRNGYNLSAMSIEPE

SEQ ID NO: 1802482 - protein, 23 aa, Staphylococcus epidermidis
AKLKFKNEIWKESNLSGLFISNE

SEQ ID NO: 1802483 - protein, 17 aa, Staphylococcus epidermidis
AKLNKRGIFTIGDLAKY

SEQ ID NO: 1802484 - protein, 24 aa, Staphylococcus epidermidis
AKLRKGMNAKENFMYSSEFGNVIH

SEQ ID NO: 1802485 - protein, 20 aa, Staphylococcus epidermidis
AKLSAKRFLIATGASPSLPQ

SEQ ID NO: 1802486 - protein, 19 aa, Staphylococcus epidermidis
AKLSFQNDWFDNEGRIYFN

SEQ ID NO: 1802487 - protein, 22 aa, Staphylococcus epidermidis
AKLYFEGVSVFDMLEIVENITL

SEQ ID NO: 1802488 - protein, 25 aa, Staphylococcus epidermidis
AKNYDIPLYLGRTLSNLKGTWIMSR

SEQ ID NO: 1802489 - protein, 18 aa, Staphylococcus epidermidis
AKNYKYTLMMGRTHGVHA

SEQ ID NO: 1802490 - protein, 22 aa, Staphylococcus epidermidis
AKPLNQSMENLRQSIKDVDNVK

SEQ ID NO: 1802491 - protein, 19 aa, Staphylococcus epidermidis
AKQFFEVVQFSPEDATRTE

SEQ ID NO: 1802492 - protein, 26 aa, Staphylococcus epidermidis
AKQKALELIELVGLKGRESAYPSELS

SEQ ID NO: 1802493 - protein, 21 aa, Staphylococcus epidermidis
AKQLRKGTVKRIVLTRPAVEA

SEQ ID NO: 1802494 - protein, 24 aa, Staphylococcus epidermidis
AKQLSEYIIAFILDDYKKMRTSYE

SEQ ID NO: 1802495 - protein, 17 aa, Staphylococcus epidermidis
AKQRVALNNDLKAGVLS

SEQ ID NO: 1802496 - protein, 19 aa, Staphylococcus epidermidis
AKQYKEKNIDVVIGLGGGK

SEQ ID NO: 1802497 - protein, 21 aa, Staphylococcus epidermidis
AKRFMFFIDECHNLINSNDED

SEQ ID NO: 1802498 - protein, 17 aa, Staphylococcus epidermidis
AKRIKVGNRLSFGDGKI

SEQ ID NO: 1802499 - protein, 20 aa, Staphylococcus epidermidis
AKRYIKAHTLQTVQTATPTY

SEQ ID NO: 1802500 - protein, 17 aa, Staphylococcus epidermidis
AKSEINRILSLNNQFDI

SEQ ID NO: 1802501 - protein, 21 aa, Staphylococcus epidermidis
AKSEIWRQIMADIFDTDLIVP

SEQ ID NO: 1802502 - protein, 19 aa, Staphylococcus epidermidis
AKSFLKYADKKGIDIYYIS

SEQ ID NO: 1802503 - protein, 21 aa, Staphylococcus epidermidis
AKSIWDFNGIYATSRHVPGVE

SEQ ID NO: 1802504 - protein, 25 aa, Staphylococcus epidermidis
AKSKPELILASFRQAHTKTIDEMKK

SEQ ID NO: 1802505 - protein, 26 aa, Staphylococcus epidermidis
AKTKNPRLAKEVLLSLPNDFDREVQT

SEQ ID NO: 1802506 - protein, 17 aa, Staphylococcus epidermidis
AKTKPAVQEALEKAKEL

SEQ ID NO: 1802507 - protein, 22 aa, Staphylococcus epidermidis
AKTLDTAMHGLRESIKDKSDIK

SEQ ID NO: 1802508 - protein, 25 aa, Staphylococcus epidermidis
AKTTALVGGAFTFNMLNNHQALAAS

SEQ ID NO: 1802509 - protein, 37 aa, Staphylococcus epidermidis
AKVDSMLFRGVHYEICCKDRKGYEWVIQSTKKANVGS

SEQ ID NO: 1802510 - protein, 33 aa, Staphylococcus epidermidis
AKVGGRLPGGVKIKRAKLRGERSEGMICSLQEI

SEQ ID NO: 1802511 - protein, 17 aa, Staphylococcus epidermidis
AKVIQKYGIGKLDAISK

SEQ ID NO: 1802512 - protein, 22 aa, Staphylococcus epidermidis
AKYAGLRFDEDVVFCEEHTFIV

SEQ ID NO: 1802513 - protein, 25 aa, Staphylococcus epidermidis
AKYIDLRLNTRMAFTDSQINVYKTK

SEQ ID NO: 1802514 - protein, 18 aa, Staphylococcus epidermidis
AKYQVEFKAKKDGFITEI

SEQ ID NO: 1802515 - protein, 19 aa, Staphylococcus epidermidis
AKYSGVPVWNGLTDEDHPT

SEQ ID NO: 1802516 - protein, 19 aa, Staphylococcus epidermidis
ALAHYLSCFDINKYANKPI

SEQ ID NO: 1802517 - protein, 18 aa, Staphylococcus epidermidis
ALAKEGAHVLALDISDQL

SEQ ID NO: 1802518 - protein, 24 aa, Staphylococcus epidermidis
ALDILESGPIFGFDTQVQGSVQIE

SEQ ID NO: 1802519 - protein, 25 aa, Staphylococcus epidermidis
ALDILESGPIWGFDTPIHGSVNIED

SEQ ID NO: 1802520 - protein, 33 aa, Staphylococcus epidermidis
ALDKEDFINLILLFLETWYFRASFSQKFGIIED

SEQ ID NO: 1802521 - protein, 25 aa, Staphylococcus epidermidis
ALDKYGEFFKGFTAVPVDKVANAFI

SEQ ID NO: 1802522 - protein, 33 aa, Staphylococcus epidermidis
ALDNQNRWLGYYGFNVSSEWMIPKIMEVKNKAP

SEQ ID NO: 1802523 - protein, 24 aa, Staphylococcus epidermidis
ALDYMYKLGKRDGFSTHDVDHIAG

SEQ ID NO: 1802524 - protein, 19 aa, Staphylococcus epidermidis
ALEAVWDYSYDKVGYLGTN

SEQ ID NO: 1802525 - protein, 22 aa, Staphylococcus epidermidis
ALEGVKAVLGYHNYPTLDIGEF

SEQ ID NO: 1802526 - protein, 27 aa, Staphylococcus epidermidis
ALELKEVPQRLAVIGSGYIAAELGQMF

SEQ ID NO: 1802527 - protein, 18 aa, Staphylococcus epidermidis
ALELLVLLIVKQEDQYGY

SEQ ID NO: 1802528 - protein, 17 aa, Staphylococcus epidermidis
ALENAGFETEIIGDTAK

SEQ ID NO: 1802529 - protein, 18 aa, Staphylococcus epidermidis
ALENIGFGAIELGGITPM

SEQ ID NO: 1802530 - protein, 17 aa, Staphylococcus epidermidis
ALESKYIHIDNCEATGF

SEQ ID NO: 1802531 - protein, 27 aa, Staphylococcus epidermidis
ALETLRRYCFDRAFIGMNGIDLKYGFT

SEQ ID NO: 1802532 - protein, 19 aa, Staphylococcus epidermidis
ALFGRWRKEENFILNNESY

SEQ ID NO: 1802533 - protein, 25 aa, Staphylococcus epidermidis
ALFKAYRSRRPIDFVSESYQISEEE

SEQ ID NO: 1802534 - protein, 20 aa, Staphylococcus epidermidis
ALFKSTGMTLMSNVGGASGP

SEQ ID NO: 1802535 - protein, 18 aa, Staphylococcus epidermidis
ALFPCGSITGAPKINTMQ

SEQ ID NO: 1802536 - protein, 19 aa, Staphylococcus epidermidis
ALFPCGSITGAPKLSTMKY

SEQ ID NO: 1802537 - protein, 22 aa, Staphylococcus epidermidis
ALGERALRYIIPDTTDFPYTIR

SEQ ID NO: 1802538 - protein, 24 aa, Staphylococcus epidermidis
ALGREILLDYDFVGKIKDGREDEI

SEQ ID NO: 1802539 - protein, 17 aa, Staphylococcus epidermidis
ALHRMLKGEPIQYIVGF

SEQ ID NO: 1802540 - protein, 19 aa, Staphylococcus epidermidis
ALICTPKSPLCLFCPVQEN

SEQ ID NO: 1802541 - protein, 18 aa, Staphylococcus epidermidis
ALIPLIKNRLIDIDSIIV

SEQ ID NO: 1802542 - protein, 23 aa, Staphylococcus epidermidis
ALIQHKYKLAGKMMEQDGFHEPY

SEQ ID NO: 1802543 - protein, 18 aa, Staphylococcus epidermidis
ALKAHPLLNSTWQGEEIV

SEQ ID NO: 1802544 - protein, 29 aa, Staphylococcus epidermidis
ALKEMHRVLKPGGMVVCLETSQPTLPLFK

SEQ ID NO: 1802545 - protein, 24 aa, Staphylococcus epidermidis
ALKKCRMLLKLNAYLELREEAIIL

SEQ ID NO: 1802546 - protein, 21 aa, Staphylococcus epidermidis
ALKLYKKLGFEDVGDIDLYGH

SEQ ID NO: 1802547 - protein, 26 aa, Staphylococcus epidermidis
ALKPKDIHKAMIFNLTLRPNSRKPKH

SEQ ID NO: 1802548 - protein, 19 aa, Staphylococcus epidermidis
ALKSFKNIVLTPHIGNATF

SEQ ID NO: 1802549 - protein, 24 aa, Staphylococcus epidermidis
ALLAKGRLTGIQFLELFTDDLYFK

SEQ ID NO: 1802550 - protein, 18 aa, Staphylococcus epidermidis
ALLKLNFITHSYPHDWRT

SEQ ID NO: 1802551 - protein, 25 aa, Staphylococcus epidermidis
ALLKYPYRQTELFISEVMNLEQVNM

SEQ ID NO: 1802552 - protein, 19 aa, Staphylococcus epidermidis
ALMNYLKQRHIPMAIATSS

SEQ ID NO: 1802553 - protein, 23 aa, Staphylococcus epidermidis
ALMRYGGGISYQLIDDDSQYISL

SEQ ID NO: 1802554 - protein, 17 aa, Staphylococcus epidermidis
ALNAISYTAKVKDPLHR

SEQ ID NO: 1802555 - protein, 19 aa, Staphylococcus epidermidis
ALNIAEIFTHSDMVLDIDK

SEQ ID NO: 1802556 - protein, 26 aa, Staphylococcus epidermidis
ALNNDLKAGVLSYAYGIASSEEIDEL

SEQ ID NO: 1802557 - protein, 22 aa, Staphylococcus epidermidis
ALNPDGAYGFQCFDVANQYWLY

SEQ ID NO: 1802558 - protein, 30 aa, Staphylococcus epidermidis
ALNSFKQPIIWLCGGLDRGNDFDELIPYMN

SEQ ID NO: 1802559 - protein, 17 aa, Staphylococcus epidermidis
ALPGLGHACGHNIIGTA

SEQ ID NO: 1802560 - protein, 24 aa, Staphylococcus epidermidis
ALQELPEHLAIIGGGVIGLEFASL

SEQ ID NO: 1802561 - protein, 23 aa, Staphylococcus epidermidis
ALQRKLDQFKMLKTEYLYNYMKR

SEQ ID NO: 1802562 - protein, 29 aa, Staphylococcus epidermidis
ALSHALDVADEFDIQIALHADTLNEAGFM

SEQ ID NO: 1802563 - protein, 22 aa, Staphylococcus epidermidis
ALSSKRLNATFINYKDDSLLTL

SEQ ID NO: 1802564 - protein, 24 aa, Staphylococcus epidermidis
ALTAVVAVPLWLDEQMYGVLLLGQ

SEQ ID NO: 1802565 - protein, 24 aa, Staphylococcus epidermidis
ALTRAKEQLILIGRVKKEKELTDL

SEQ ID NO: 1802566 - protein, 25 aa, Staphylococcus epidermidis
ALVKALQAWDIDHLYGIPGDSIDAV

SEQ ID NO: 1802567 - protein, 21 aa, Staphylococcus epidermidis
ALWPHMSVFQNVAYPLKVKKD

SEQ ID NO: 1802568 - protein, 25 aa, Staphylococcus epidermidis
ALYERKIPLVLVFEGMDAAGKGGNI

SEQ ID NO: 1802569 - protein, 17 aa, Staphylococcus epidermidis
AMAIAALKLKLSPNEVW

SEQ ID NO: 1802570 - protein, 25 aa, Staphylococcus epidermidis
AMAQEGHDFFGLLYIGAILTKDGPK

SEQ ID NO: 1802571 - protein, 22 aa, Staphylococcus epidermidis
AMDKFLECVLVYKSDVEKELFE

SEQ ID NO: 1802572 - protein, 23 aa, Staphylococcus epidermidis
AMESWKTKTPFRELIEQDSSITD

SEQ ID NO: 1802573 - protein, 18 aa, Staphylococcus epidermidis
AMGKMFFTMISAFAELEA

SEQ ID NO: 1802574 - protein, 24 aa, Staphylococcus epidermidis
AMIADPAIDIGMLLYNYVPQSKWS

SEQ ID NO: 1802575 - protein, 33 aa, Staphylococcus epidermidis
AMIQFKLEMPIIKRRPSFEMEERLVLEKIDYNK

SEQ ID NO: 1802576 - protein, 21 aa, Staphylococcus epidermidis
AMKKQTNWAFSENNEATFIDK

SEQ ID NO: 1802577 - protein, 19 aa, Staphylococcus epidermidis
AMLTYPEDFHVLKKLNKVL

SEQ ID NO: 1802578 - protein, 26 aa, Staphylococcus epidermidis
AMNSICPKLGLTVESRLKILSPDTKK

SEQ ID NO: 1802579 - protein, 26 aa, Staphylococcus epidermidis
AMPQLLIPELVKFFKRGQYPMDKMVK

SEQ ID NO: 1802580 - protein, 17 aa, Staphylococcus epidermidis
AMQGYLMKSLKSEFAEV

SEQ ID NO: 1802581 - protein, 19 aa, Staphylococcus epidermidis
AMSHPEIRISLVSDGKKIL

SEQ ID NO: 1802582 - protein, 24 aa, Staphylococcus epidermidis
AMSQLRVVIDLGDEPDLYLQISAI

SEQ ID NO: 1802583 - protein, 22 aa, Staphylococcus epidermidis
AMYRGELAISKILYAKNESLCE

SEQ ID NO: 1802584 - protein, 17 aa, Staphylococcus epidermidis
ANAMHQYAIWTALATQG

SEQ ID NO: 1802585 - protein, 17 aa, Staphylococcus epidermidis
ANAVLFLSSDLASYIHG

SEQ ID NO: 1802586 - protein, 24 aa, Staphylococcus epidermidis
ANDDKWSKVAFVFPQSQRSLIPEN

SEQ ID NO: 1802587 - protein, 18 aa, Staphylococcus epidermidis
ANDLLQMMIKTMEDRLNE

SEQ ID NO: 1802588 - protein, 18 aa, Staphylococcus epidermidis
ANEAIKHGAKHITHLYNA

SEQ ID NO: 1802589 - protein, 21 aa, Staphylococcus epidermidis
ANEAYQSWKKWSHKDRAELLL

SEQ ID NO: 1802590 - protein, 29 aa, Staphylococcus epidermidis
ANEIYKPYIEGFVKMLAPIAPHIGEELWS

SEQ ID NO: 1802591 - protein, 24 aa, Staphylococcus epidermidis
ANELKDSELRSHFDSMPNSASISQ

SEQ ID NO: 1802592 - protein, 23 aa, Staphylococcus epidermidis
ANFGKGIGYMPVRASKFNSVSSR

SEQ ID NO: 1802593 - protein, 18 aa, Staphylococcus epidermidis
ANGAVLVRYGDTVVLSTA

SEQ ID NO: 1802594 - protein, 18 aa, Staphylococcus epidermidis
ANHDKLNLVHFVNDKIKQ

SEQ ID NO: 1802595 - protein, 17 aa, Staphylococcus epidermidis
ANHFPGKIYLSVDAYQE

SEQ ID NO: 1802596 - protein, 30 aa, Staphylococcus epidermidis
ANKFKDFGTRVVLGRFGLILSDDGGALQTM

SEQ ID NO: 1802597 - protein, 30 aa, Staphylococcus epidermidis
ANKFKQFGTRVVLGRFGLILSDDGGALEMM

SEQ ID NO: 1802598 - protein, 26 aa, Staphylococcus epidermidis
ANKGYREAFKVNHPLSLGLNTFNGHV

SEQ ID NO: 1802599 - protein, 26 aa, Staphylococcus epidermidis
ANKIASCVKGKFSWGHINSDQRLTKP

SEQ ID NO: 1802600 - protein, 24 aa, Staphylococcus epidermidis
ANKKLPIHCRKELAINGKDILNHT

SEQ ID NO: 1802601 - protein, 26 aa, Staphylococcus epidermidis
ANKKPSLRWDNYYGLTHFIVPPVAKE

SEQ ID NO: 1802602 - protein, 17 aa, Staphylococcus epidermidis
ANKLLKENDELIASFSR

SEQ ID NO: 1802603 - protein, 18 aa, Staphylococcus epidermidis
ANKMRFILESHARSHYKI

SEQ ID NO: 1802604 - protein, 20 aa, Staphylococcus epidermidis
ANKRGIPFDRLHEEMYDIAG

SEQ ID NO: 1802605 - protein, 22 aa, Staphylococcus epidermidis
ANLEGLWYARNIKSLPLAMKEV

SEQ ID NO: 1802606 - protein, 23 aa, Staphylococcus epidermidis
ANLGHRFNINVGILGDSKVAFHQ

SEQ ID NO: 1802607 - protein, 18 aa, Staphylococcus epidermidis
ANLIKPDLAIAVDVGVAF

SEQ ID NO: 1802608 - protein, 18 aa, Staphylococcus epidermidis
ANLKRVLKEMEDMGFTDF

SEQ ID NO: 1802609 - protein, 32 aa, Staphylococcus epidermidis
ANNNGRFSPVVFKLASEHGIDLTQVIGTGFEG

SEQ ID NO: 1802610 - protein, 21 aa, Staphylococcus epidermidis
ANNYSTPAWIAGEKYDTPPTV

SEQ ID NO: 1802611 - protein, 24 aa, Staphylococcus epidermidis
ANPDYRVKPPFFIEWDNSRKQNLS

SEQ ID NO: 1802612 - protein, 24 aa, Staphylococcus epidermidis
ANPDYRVKPPFFIQWDESEASREA

SEQ ID NO: 1802613 - protein, 19 aa, Staphylococcus epidermidis
ANQALKFDREKAYGKHLDI

SEQ ID NO: 1802614 - protein, 17 aa, Staphylococcus epidermidis
ANQLCFSAYNVSRLFAQ

SEQ ID NO: 1802615 - protein, 21 aa, Staphylococcus epidermidis
ANRIANALIQRGVKASERVAL

SEQ ID NO: 1802616 - protein, 22 aa, Staphylococcus epidermidis
ANRLIGAVLMDLHDEWIYSSRK

SEQ ID NO: 1802617 - protein, 26 aa, Staphylococcus epidermidis
ANSPERLKAGLLYILEEECIKQGHTY

SEQ ID NO: 1802618 - protein, 22 aa, Staphylococcus epidermidis
ANSSWQLSFTVNRQQQFKEQPK

SEQ ID NO: 1802619 - protein, 19 aa, Staphylococcus epidermidis
ANTPIMASVSYNFDGEKDF

SEQ ID NO: 1802620 - protein, 20 aa, Staphylococcus epidermidis
ANVLDEAMQALKDEITRNAA

SEQ ID NO: 1802621 - protein, 17 aa, Staphylococcus epidermidis
ANYPNRHYITNVNQKTA

SEQ ID NO: 1802622 - protein, 24 aa, Staphylococcus epidermidis
APAKPKQRFGGSRPFNVLMTPSDK

SEQ ID NO: 1802623 - protein, 18 aa, Staphylococcus epidermidis
APDFPIIIEENFTFYNVD

SEQ ID NO: 1802624 - protein, 23 aa, Staphylococcus epidermidis
APFGATVPYYFTGHEGPDSCCID

SEQ ID NO: 1802625 - protein, 23 aa, Staphylococcus epidermidis
APFPRMTYAEAMDRYGSDKPDTR

SEQ ID NO: 1802626 - protein, 19 aa, Staphylococcus epidermidis
APINIKDNVWIGGNVTVLP

SEQ ID NO: 1802627 - protein, 27 aa, Staphylococcus epidermidis
APLSNERVVPVKGIRKAIAQNMVTSVS

SEQ ID NO: 1802628 - protein, 24 aa, Staphylococcus epidermidis
APNIECLRQADIVMSPELISWINQ

SEQ ID NO: 1802629 - protein, 22 aa, Staphylococcus epidermidis
APNKQKVAEIIAQANELNNAMK

SEQ ID NO: 1802630 - protein, 38 aa, Staphylococcus epidermidis
APQIFRKLNIEWVYRVLIDWKRIGRMISIPKFMLKVAI

SEQ ID NO: 1802631 - protein, 28 aa, Staphylococcus epidermidis
APSNLAIMGRYVLTPEIFDYLETQQEGA

SEQ ID NO: 1802632 - protein, 18 aa, Staphylococcus epidermidis
APTSLAIQLARDLNITAI

SEQ ID NO: 1802633 - protein, 23 aa, Staphylococcus epidermidis
APVGHKGAKLMGYYQDELYEYAK

SEQ ID NO: 1802634 - protein, 25 aa, Staphylococcus epidermidis
APVGPGPRKALDYMYQIAERDGFST

SEQ ID NO: 1802635 - protein, 24 aa, Staphylococcus epidermidis
APVIWRGPMLGKMLTNFFTEVQWG

SEQ ID NO: 1802636 - protein, 24 aa, Staphylococcus epidermidis
APVTEFDENLSLLLKDLEDTLYAE

SEQ ID NO: 1802637 - protein, 22 aa, Staphylococcus epidermidis
APVVISSRIRLARNLENHVHPL

SEQ ID NO: 1802638 - protein, 18 aa, Staphylococcus epidermidis
AQALTCYYGGDVIQGSCV

SEQ ID NO: 1802639 - protein, 18 aa, Staphylococcus epidermidis
AQANFALILGNEGEGVNP

SEQ ID NO: 1802640 - protein, 19 aa, Staphylococcus epidermidis
AQANFALVLGNEGEGVNPD

SEQ ID NO: 1802641 - protein, 18 aa, Staphylococcus epidermidis
AQCFDLANQYWYYVTGHA

SEQ ID NO: 1802642 - protein, 17 aa, Staphylococcus epidermidis
AQCVKQVEVIRAKRLLD

SEQ ID NO: 1802643 - protein, 28 aa, Staphylococcus epidermidis
AQDLKEVLKPGGVYYASFADLTNNPSSQ

SEQ ID NO: 1802644 - protein, 19 aa, Staphylococcus epidermidis
AQEGVTFLISSHILSELVK

SEQ ID NO: 1802645 - protein, 22 aa, Staphylococcus epidermidis
AQEGYIRIAFETTTDKFSHFNS

SEQ ID NO: 1802646 - protein, 17 aa, Staphylococcus epidermidis
AQEHGITVVIATGRAFY

SEQ ID NO: 1802647 - protein, 19 aa, Staphylococcus epidermidis
AQENLQLIIMIIEDGTYEM

SEQ ID NO: 1802648 - protein, 21 aa, Staphylococcus epidermidis
AQESWSVRYLEEYVNGLVSKD

SEQ ID NO: 1802649 - protein, 27 aa, Staphylococcus epidermidis
AQFAEGIEVGQVFKLGTKYSEAMNATF

SEQ ID NO: 1802650 - protein, 17 aa, Staphylococcus epidermidis
AQFFKYFNCNNESTTDV

SEQ ID NO: 1802651 - protein, 21 aa, Staphylococcus epidermidis
AQFLNKDLYGYVGKVKEINID

SEQ ID NO: 1802652 - protein, 18 aa, Staphylococcus epidermidis
AQFNAMMKVQEAMDQSDA

SEQ ID NO: 1802653 - protein, 17 aa, Staphylococcus epidermidis
AQFPYKNIEWLIQEGYT

SEQ ID NO: 1802654 - protein, 18 aa, Staphylococcus epidermidis
AQGGTLIYPSWKDGMDPI

SEQ ID NO: 1802655 - protein, 28 aa, Staphylococcus epidermidis
AQGLGFRGDIFGGYILYNLGFIESEDRY

SEQ ID NO: 1802656 - protein, 26 aa, Staphylococcus epidermidis
AQHIVPYPPGIPVMFRGELITIHMIK

SEQ ID NO: 1802657 - protein, 19 aa, Staphylococcus epidermidis
AQIRRELGDPIYYRFDDFI

SEQ ID NO: 1802658 - protein, 17 aa, Staphylococcus epidermidis
AQKELAEIVLIERQQSE

SEQ ID NO: 1802659 - protein, 22 aa, Staphylococcus epidermidis
AQKRKRLFSISIRKDIDNGKFE

SEQ ID NO: 1802660 - protein, 22 aa, Staphylococcus epidermidis
AQKTAYLAKAFGMKIVGVSKSG

SEQ ID NO: 1802661 - protein, 22 aa, Staphylococcus epidermidis
AQLDFLLPERFELTYIGSDGEQ

SEQ ID NO: 1802662 - protein, 26 aa, Staphylococcus epidermidis
AQLLKLLNDLAMIFLKAAHEEIQKSF

SEQ ID NO: 1802663 - protein, 23 aa, Staphylococcus epidermidis
AQLNPRAVIVGKPLVNIGRIAEN

SEQ ID NO: 1802664 - protein, 25 aa, Staphylococcus epidermidis
AQLSHKIGGYLLNKLDLNMINSSDE

SEQ ID NO: 1802665 - protein, 25 aa, Staphylococcus epidermidis
AQLSNKIGGYFLNKLDLNMINSSDE

SEQ ID NO: 1802666 - protein, 25 aa, Staphylococcus epidermidis
AQNDFLYDRVDVVVATNAFGMGIDK

SEQ ID NO: 1802667 - protein, 22 aa, Staphylococcus epidermidis
AQNKIRVEFKFTEELKSLTTDY

SEQ ID NO: 1802668 - protein, 17 aa, Staphylococcus epidermidis
AQPEKYDAIYFTGGHGV

SEQ ID NO: 1802669 - protein, 19 aa, Staphylococcus epidermidis
AQPNPNWSGSNPDPSSSYA

SEQ ID NO: 1802670 - protein, 17 aa, Staphylococcus epidermidis
AQPTFSDTGWLPLVLSN

SEQ ID NO: 1802671 - protein, 20 aa, Staphylococcus epidermidis
AQQLKVIANMAVGFDNIDIS

SEQ ID NO: 1802672 - protein, 21 aa, Staphylococcus epidermidis
AQREIKLWFSSNEIADYTSPR

SEQ ID NO: 1802673 - protein, 19 aa, Staphylococcus epidermidis
AQSAHPLFDDYWKARQVPL

SEQ ID NO: 1802674 - protein, 28 aa, Staphylococcus epidermidis
AQTCYQFKVPFIVTRAVSDLANGEAEIS

SEQ ID NO: 1802675 - protein, 18 aa, Staphylococcus epidermidis
AQTRIKGVEKAYLNLAEA

SEQ ID NO: 1802676 - protein, 21 aa, Staphylococcus epidermidis
AQVKSAILLASLFSKEATTLT

SEQ ID NO: 1802677 - protein, 24 aa, Staphylococcus epidermidis
AQVRPRSGKSLKTKLRVALGTIDK

SEQ ID NO: 1802678 - protein, 27 aa, Staphylococcus epidermidis
AQVTKRFAGICAISFFMNASLEDIKEL

SEQ ID NO: 1802679 - protein, 20 aa, Staphylococcus epidermidis
AQYSFLKLMNYMFKDEPYKY

SEQ ID NO: 1802680 - protein, 19 aa, Staphylococcus epidermidis
ARAILKNPIVIFADEPTGN

SEQ ID NO: 1802681 - protein, 18 aa, Staphylococcus epidermidis
ARAILKNPTVIFADEPTG

SEQ ID NO: 1802682 - protein, 19 aa, Staphylococcus epidermidis
ARAILKNPTVIFADEPTGN

SEQ ID NO: 1802683 - protein, 19 aa, Staphylococcus epidermidis
ARARGRYGGRPEKLNKQDL

SEQ ID NO: 1802684 - protein, 19 aa, Staphylococcus epidermidis
ARASEKISFLNITSQPREV

SEQ ID NO: 1802685 - protein, 20 aa, Staphylococcus epidermidis
ARDLLGRFHSIFTDKVDVSM

SEQ ID NO: 1802686 - protein, 24 aa, Staphylococcus epidermidis
ARDTLRLEAGLPLHGQDLTESITP

SEQ ID NO: 1802687 - protein, 18 aa, Staphylococcus epidermidis
AREALPKVIAAQRALTHI

SEQ ID NO: 1802688 - protein, 18 aa, Staphylococcus epidermidis
AREAMFTHDFVKKFKNTN

SEQ ID NO: 1802689 - protein, 28 aa, Staphylococcus epidermidis
AREAYKAGIRHFGENRLDGFKEKKESLP

SEQ ID NO: 1802690 - protein, 32 aa, Staphylococcus epidermidis
AREAYKAGIRHFGENRLDGFKGKKESLPSDIK

SEQ ID NO: 1802691 - protein, 18 aa, Staphylococcus epidermidis
AREIFLVITGANKRDMVE

SEQ ID NO: 1802692 - protein, 21 aa, Staphylococcus epidermidis
AREKWGEEQVHQWRRSYDVQP

SEQ ID NO: 1802693 - protein, 18 aa, Staphylococcus epidermidis
ARFKHVEELKHMGANIYS

SEQ ID NO: 1802694 - protein, 17 aa, Staphylococcus epidermidis
ARFKHVEELQRMGANIK

SEQ ID NO: 1802695 - protein, 19 aa, Staphylococcus epidermidis
ARFKYTVDRLGETWVTEEL

SEQ ID NO: 1802696 - protein, 20 aa, Staphylococcus epidermidis
ARFMSSGSFERHLNKMRRIY

SEQ ID NO: 1802697 - protein, 17 aa, Staphylococcus epidermidis
ARFRGRNGGRPSISNEI

SEQ ID NO: 1802698 - protein, 24 aa, Staphylococcus epidermidis
ARFRRETLGFVFQDFNVLNTMSNK

SEQ ID NO: 1802699 - protein, 18 aa, Staphylococcus epidermidis
ARGFIIGCPVAYSMGIGF

SEQ ID NO: 1802700 - protein, 24 aa, Staphylococcus epidermidis
ARHHTFFEMLGNFSIGDYFKQEAI

SEQ ID NO: 1802701 - protein, 19 aa, Staphylococcus epidermidis
ARHPRRVDMAIGRSPSFKN

SEQ ID NO: 1802702 - protein, 17 aa, Staphylococcus epidermidis
ARIDWEVLQKISSRIVN

SEQ ID NO: 1802703 - protein, 19 aa, Staphylococcus epidermidis
ARIPFIKKMQNEGLFASIS

SEQ ID NO: 1802704 - protein, 24 aa, Staphylococcus epidermidis
ARKGEIRALTWRDINFDDEFIHIN

SEQ ID NO: 1802705 - protein, 23 aa, Staphylococcus epidermidis
ARKLGFHIIYVVIGFSEDYKEWT

SEQ ID NO: 1802706 - protein, 22 aa, Staphylococcus epidermidis
ARKQVLVDHGFRLPSALDNRPL

SEQ ID NO: 1802707 - protein, 25 aa, Staphylococcus epidermidis
ARLDEARPKALDYINSLDKINNSQK

SEQ ID NO: 1802708 - protein, 17 aa, Staphylococcus epidermidis
ARLFVVRYPEFANGLIL

SEQ ID NO: 1802709 - protein, 18 aa, Staphylococcus epidermidis
ARLGHAIVALPGGCAIGS

SEQ ID NO: 1802710 - protein, 18 aa, Staphylococcus epidermidis
ARLNHLNVDFKFDREEET

SEQ ID NO: 1802711 - protein, 20 aa, Staphylococcus epidermidis
ARLQISDAFFSEKTKEHFAQ

SEQ ID NO: 1802712 - protein, 18 aa, Staphylococcus epidermidis
ARLSDLLEASRIVKGNKV

SEQ ID NO: 1802713 - protein, 20 aa, Staphylococcus epidermidis
ARMYYNLAYYLQIKITLEDM

SEQ ID NO: 1802714 - protein, 18 aa, Staphylococcus epidermidis
ARNIEIYKSVALSYGHNP

SEQ ID NO: 1802715 - protein, 26 aa, Staphylococcus epidermidis
ARNLLFLSFAGALAYQINAKHIITGV

SEQ ID NO: 1802716 - protein, 19 aa, Staphylococcus epidermidis
ARQNFKELISKVNEDSVTY

SEQ ID NO: 1802717 - protein, 17 aa, Staphylococcus epidermidis
ARRAKKVKSGFQANTQL

SEQ ID NO: 1802718 - protein, 26 aa, Staphylococcus epidermidis
ARRYGYEAALPLRIIVEAHNYGVSNL

SEQ ID NO: 1802719 - protein, 24 aa, Staphylococcus epidermidis
ARSARAYGSAALEIISVAKGQLAA

SEQ ID NO: 1802720 - protein, 25 aa, Staphylococcus epidermidis
ARSKRIFEVIGHAEAKIHGMSFEDV

SEQ ID NO: 1802721 - protein, 22 aa, Staphylococcus epidermidis
ARSNAIPIIYHVYAPRSITMKQ

SEQ ID NO: 1802722 - protein, 18 aa, Staphylococcus epidermidis
ARTFKSDEVIYIKYNNEN

SEQ ID NO: 1802723 - protein, 19 aa, Staphylococcus epidermidis
ARTILKFNASVKVANKQTL

SEQ ID NO: 1802724 - protein, 22 aa, Staphylococcus epidermidis
ARTKLIAKVMMNISTLPFVHSD

SEQ ID NO: 1802725 - protein, 23 aa, Staphylococcus epidermidis
ARTKLIAKVMMNISTLPFVHSDL

SEQ ID NO: 1802726 - protein, 17 aa, Staphylococcus epidermidis
ARTPLIISGEAEKSTSL

SEQ ID NO: 1802727 - protein, 19 aa, Staphylococcus epidermidis
ARTPMQWNNSINGGFTTGK

SEQ ID NO: 1802728 - protein, 25 aa, Staphylococcus epidermidis
ARVKNLRKSENYNYELEVIAKNESN

SEQ ID NO: 1802729 - protein, 17 aa, Staphylococcus epidermidis
ARYERFQSRSFKNLEYD

SEQ ID NO: 1802730 - protein, 19 aa, Staphylococcus epidermidis
ARYYRSFLKELSRIKSKLT

SEQ ID NO: 1802731 - protein, 25 aa, Staphylococcus epidermidis
ASAKENINCRCKLLYYIDEDELPTT

SEQ ID NO: 1802732 - protein, 19 aa, Staphylococcus epidermidis
ASCKAYIDAHAKYISEYEL

SEQ ID NO: 1802733 - protein, 18 aa, Staphylococcus epidermidis
ASEDEAYIDIIRKVKRCD

SEQ ID NO: 1802734 - protein, 30 aa, Staphylococcus epidermidis
ASEFEIPKTWKLIAQMPFGDVREEAKEKEI

SEQ ID NO: 1802735 - protein, 18 aa, Staphylococcus epidermidis
ASEGGMRDALSIMDQAIA

SEQ ID NO: 1802736 - protein, 22 aa, Staphylococcus epidermidis
ASEIDMVINIGALKDKRYDDVQ

SEQ ID NO: 1802737 - protein, 19 aa, Staphylococcus epidermidis
ASEKHVDWIAKAVIRAKSR

SEQ ID NO: 1802738 - protein, 18 aa, Staphylococcus epidermidis
ASESAGWIKELTHGGHEH

SEQ ID NO: 1802739 - protein, 23 aa, Staphylococcus epidermidis
ASEVAAWARSMIGRRVDVDGYYG

SEQ ID NO: 1802740 - protein, 17 aa, Staphylococcus epidermidis
ASFYKLKPNQVIATNGS

SEQ ID NO: 1802741 - protein, 22 aa, Staphylococcus epidermidis
ASGAVPGLWPHIRVLEQDWIDG

SEQ ID NO: 1802742 - protein, 17 aa, Staphylococcus epidermidis
ASGGIRHQHDLKRLEQL

SEQ ID NO: 1802743 - protein, 24 aa, Staphylococcus epidermidis
ASGIPDFRSMGGLFDEISKDGQSP

SEQ ID NO: 1802744 - protein, 29 aa, Staphylococcus epidermidis
ASGKTRLSNELLLHLDAKYSQFIATKSPE

SEQ ID NO: 1802745 - protein, 19 aa, Staphylococcus epidermidis
ASGKTRLSNELLLNLDAKY

SEQ ID NO: 1802746 - protein, 21 aa, Staphylococcus epidermidis
ASGLPSFTYTFLGFLPRKEKE

SEQ ID NO: 1802747 - protein, 23 aa, Staphylococcus epidermidis
ASGRYGIYNYFGIAAYDNNPNAS

SEQ ID NO: 1802748 - protein, 22 aa, Staphylococcus epidermidis
ASGSRSGIMNSLESMTNPSNYV

SEQ ID NO: 1802749 - protein, 18 aa, Staphylococcus epidermidis
ASHGLRLNERTKYELQNF

SEQ ID NO: 1802750 - protein, 31 aa, Staphylococcus epidermidis
ASHLKANIQAMLRGHFYLRELAASESEIKFE

SEQ ID NO: 1802751 - protein, 31 aa, Staphylococcus epidermidis
ASHLKANIQAMLRGHFYLRELATSESEVKFE

SEQ ID NO: 1802752 - protein, 25 aa, Staphylococcus epidermidis
ASIEIAIKMAYQYWKNIDAKRYAKK

SEQ ID NO: 1802753 - protein, 24 aa, Staphylococcus epidermidis
ASIISRYAFVKHMDHITRQINMDV

SEQ ID NO: 1802754 - protein, 17 aa, Staphylococcus epidermidis
ASIKAGVHLDKLTEERS

SEQ ID NO: 1802755 - protein, 30 aa, Staphylococcus epidermidis
ASITKRVAIEMASPLGWHKYVGTEGKVIGI

SEQ ID NO: 1802756 - protein, 21 aa, Staphylococcus epidermidis
ASKGGMKLMMETMSMEYAQYG

SEQ ID NO: 1802757 - protein, 26 aa, Staphylococcus epidermidis
ASKKIPRLICNFSKRISDTDISITSY

SEQ ID NO: 1802758 - protein, 26 aa, Staphylococcus epidermidis
ASKSFKPGRPIGGDFYLRSLIKCPEC

SEQ ID NO: 1802759 - protein, 20 aa, Staphylococcus epidermidis
ASLFKTTGMTLMSKIGGASG

SEQ ID NO: 1802760 - protein, 19 aa, Staphylococcus epidermidis
ASLGYRTIFTSLQIPEESK

SEQ ID NO: 1802761 - protein, 25 aa, Staphylococcus epidermidis
ASLIRFPESALRPLGRTAAGVKGIT

SEQ ID NO: 1802762 - protein, 18 aa, Staphylococcus epidermidis
ASLRKKLNYSENIDGMDK

SEQ ID NO: 1802763 - protein, 20 aa, Staphylococcus epidermidis
ASNIDFDGVVVFKNRNNKID

SEQ ID NO: 1802764 - protein, 22 aa, Staphylococcus epidermidis
ASNLKVIANMAVGYDNIDVNKA

SEQ ID NO: 1802765 - protein, 19 aa, Staphylococcus epidermidis
ASNVHGWQWSASTGTDAVP

SEQ ID NO: 1802766 - protein, 24 aa, Staphylococcus epidermidis
ASNYRSAGTIEFLVTEDAHYFIEM

SEQ ID NO: 1802767 - protein, 21 aa, Staphylococcus epidermidis
ASPIMSRPAKNMTVAIIGTGR

SEQ ID NO: 1802768 - protein, 22 aa, Staphylococcus epidermidis
ASPIMSRPAKNMTVAIIGTGRI

SEQ ID NO: 1802769 - protein, 25 aa, Staphylococcus epidermidis
ASPKFFKRMLVEFMEKTNYTCDIVT

SEQ ID NO: 1802770 - protein, 21 aa, Staphylococcus epidermidis
ASPKLGYRRIFNIKEKGTRHG

SEQ ID NO: 1802771 - protein, 19 aa, Staphylococcus epidermidis
ASPRPIKDSKWFDDNSDIG

SEQ ID NO: 1802772 - protein, 39 aa, Staphylococcus epidermidis
ASQKNQFPWVVAAFPTRDWAHRVYPELDVESAYIKFIDE

SEQ ID NO: 1802773 - protein, 33 aa, Staphylococcus epidermidis
ASQKNQFPWVVAAFPTRDWARRVYPDLDEEEAY

SEQ ID NO: 1802774 - protein, 22 aa, Staphylococcus epidermidis
ASRELKKLFSQVEEEMVDTFIK

SEQ ID NO: 1802775 - protein, 17 aa, Staphylococcus epidermidis
ASRIRKFSLLRDVVDKG

SEQ ID NO: 1802776 - protein, 25 aa, Staphylococcus epidermidis
ASRLAKEKHVYWIAKAVVKAKKEIP

SEQ ID NO: 1802777 - protein, 25 aa, Staphylococcus epidermidis
ASVEIAIKMAYQYWKNIDAKQYAKK

SEQ ID NO: 1802778 - protein, 24 aa, Staphylococcus epidermidis
ASYLKEFSNLYALLVPKVPTMEDV

SEQ ID NO: 1802779 - protein, 25 aa, Staphylococcus epidermidis
ASYLKEFTNIYAMLIPKMSSMDDVK

SEQ ID NO: 1802780 - protein, 25 aa, Staphylococcus epidermidis
ASYRLSEVKLGIDLNYITLNDFKFN

SEQ ID NO: 1802781 - protein, 18 aa, Staphylococcus epidermidis
ATAIRIGNPASWQKAVKA

SEQ ID NO: 1802782 - protein, 19 aa, Staphylococcus epidermidis
ATALSIGWHLSVIGQLYEQ

SEQ ID NO: 1802783 - protein, 20 aa, Staphylococcus epidermidis
ATAWSKNRISEMQLENRASK

SEQ ID NO: 1802784 - protein, 24 aa, Staphylococcus epidermidis
ATDIFKKNLEHFLNNYDVIENKVD

SEQ ID NO: 1802785 - protein, 23 aa, Staphylococcus epidermidis
ATDIGASLGFPAHMSLLTRIASG

SEQ ID NO: 1802786 - protein, 18 aa, Staphylococcus epidermidis
ATDNWKQIIMPISPFICI

SEQ ID NO: 1802787 - protein, 19 aa, Staphylococcus epidermidis
ATDPLAFVRWHYDKKKRII

SEQ ID NO: 1802788 - protein, 18 aa, Staphylococcus epidermidis
ATEARIQEELDYFDELVS

SEQ ID NO: 1802789 - protein, 24 aa, Staphylococcus epidermidis
ATEDLWKKLIELWDNQTVLIVEHK

SEQ ID NO: 1802790 - protein, 17 aa, Staphylococcus epidermidis
ATGCHYHVCHVSTKESV

SEQ ID NO: 1802791 - protein, 17 aa, Staphylococcus epidermidis
ATGEAFDTITLATEEEV

SEQ ID NO: 1802792 - protein, 20 aa, Staphylococcus epidermidis
ATGEPASIDEVRGLSQTIED

SEQ ID NO: 1802793 - protein, 26 aa, Staphylococcus epidermidis
ATGIDHNRLSLLMAVLEKKENYLLQQ

SEQ ID NO: 1802794 - protein, 18 aa, Staphylococcus epidermidis
ATGIRIGFLIGPEYLIEK

SEQ ID NO: 1802795 - protein, 24 aa, Staphylococcus epidermidis
ATIKVRCKYPVWVNNQITASEEKE

SEQ ID NO: 1802796 - protein, 34 aa, Staphylococcus epidermidis
ATILYKMYKERGFEIKPHIAGLMISAIISDSLLF

SEQ ID NO: 1802797 - protein, 24 aa, Staphylococcus epidermidis
ATIRPEVQDAVNLANQLNDAMKKL

SEQ ID NO: 1802798 - protein, 17 aa, Staphylococcus epidermidis
ATIRRDFSYFGELGKKG

SEQ ID NO: 1802799 - protein, 26 aa, Staphylococcus epidermidis
ATIYRRWKDKASIIMDMFVEQSHKIF

SEQ ID NO: 1802800 - protein, 23 aa, Staphylococcus epidermidis
ATKEIKNDMLVTVDAAQGKIFEG

SEQ ID NO: 1802801 - protein, 19 aa, Staphylococcus epidermidis
ATLAKEHKLLLAVDNTFMT

SEQ ID NO: 1802802 - protein, 18 aa, Staphylococcus epidermidis
ATLLRGVGFIQVPTTILA

SEQ ID NO: 1802803 - protein, 27 aa, Staphylococcus epidermidis
ATPALDAVKGMTHYSEEFIAAKRQMVE

SEQ ID NO: 1802804 - protein, 32 aa, Staphylococcus epidermidis
ATPIKLGQEISGWRYMLDKCEELLSESKKHIL

SEQ ID NO: 1802805 - protein, 18 aa, Staphylococcus epidermidis
ATQFKPQLILDFATLTGA

SEQ ID NO: 1802806 - protein, 17 aa, Staphylococcus epidermidis
ATRKWDSQIKKFIFASS

SEQ ID NO: 1802807 - protein, 22 aa, Staphylococcus epidermidis
ATRMGIPIVSHLGLTPQSVGVM

SEQ ID NO: 1802808 - protein, 24 aa, Staphylococcus epidermidis
ATTEIPRLINAAIQERRPVHLHLP

SEQ ID NO: 1802809 - protein, 25 aa, Staphylococcus epidermidis
ATVKIKCKFPVWLNKHTTVEDEKEK

SEQ ID NO: 1802810 - protein, 25 aa, Staphylococcus epidermidis
ATYDPKFLYGDKIVPFEGESREEVE

SEQ ID NO: 1802811 - protein, 18 aa, Staphylococcus epidermidis
ATYGSFRQWPAYLYTIEH

SEQ ID NO: 1802812 - protein, 24 aa, Staphylococcus epidermidis
ATYYIRLNPNFGVIEEKLNYLLEK

SEQ ID NO: 1802813 - protein, 18 aa, Staphylococcus epidermidis
AVAHRKYPIYGLQYHPES

SEQ ID NO: 1802814 - protein, 24 aa, Staphylococcus epidermidis
AVASIISRYAFVKHMDHISKKLHM

SEQ ID NO: 1802815 - protein, 24 aa, Staphylococcus epidermidis
AVATFPEYRGQGIATQLFKHLIDS

SEQ ID NO: 1802816 - protein, 24 aa, Staphylococcus epidermidis
AVDRELPYHLAIKKLKQLDEDFGV

SEQ ID NO: 1802817 - protein, 19 aa, Staphylococcus epidermidis
AVEKGLKVPEFVKTSLAPG

SEQ ID NO: 1802818 - protein, 25 aa, Staphylococcus epidermidis
AVETTLKAARRWAYDVKGIEPNKAE

SEQ ID NO: 1802819 - protein, 19 aa, Staphylococcus epidermidis
AVFVNCARGSLVDTKALLS

SEQ ID NO: 1802820 - protein, 19 aa, Staphylococcus epidermidis
AVFVNCARGSLVDTKDLLS

SEQ ID NO: 1802821 - protein, 18 aa, Staphylococcus epidermidis
AVGASGAVPGLWPHIRVL

SEQ ID NO: 1802822 - protein, 23 aa, Staphylococcus epidermidis
AVGDTKISLVLAYDDETIGVDFR

SEQ ID NO: 1802823 - protein, 19 aa, Staphylococcus epidermidis
AVGYYLRYALSYHDISEIL

SEQ ID NO: 1802824 - protein, 20 aa, Staphylococcus epidermidis
AVGYYLRYALSYHDISEILR

SEQ ID NO: 1802825 - protein, 18 aa, Staphylococcus epidermidis
AVGYYLRYALSYRDISEI

SEQ ID NO: 1802826 - protein, 20 aa, Staphylococcus epidermidis
AVGYYLRYALSYRDISEILR

SEQ ID NO: 1802827 - protein, 17 aa, Staphylococcus epidermidis
AVHGLKYWFNYTSDDLV

SEQ ID NO: 1802828 - protein, 34 aa, Staphylococcus epidermidis
AVIAAKAFVASAIKNGWKMNDFVGPVDHGAYNRI

SEQ ID NO: 1802829 - protein, 20 aa, Staphylococcus epidermidis
AVIPGLYAYEAGQAAVGDLF

SEQ ID NO: 1802830 - protein, 20 aa, Staphylococcus epidermidis
AVKYFYAYLKSVKVKKVAVI

SEQ ID NO: 1802831 - protein, 21 aa, Staphylococcus epidermidis
AVLERKSDKFVIATGTTQTVT

SEQ ID NO: 1802832 - protein, 18 aa, Staphylococcus epidermidis
AVLNEQLLVLSLLRTGTG

SEQ ID NO: 1802833 - protein, 25 aa, Staphylococcus epidermidis
AVMSMRKFIGILGEFHQLYPNITYN

SEQ ID NO: 1802834 - protein, 25 aa, Staphylococcus epidermidis
AVPVCGFPWIHWVVANVSVNSDTID

SEQ ID NO: 1802835 - protein, 17 aa, Staphylococcus epidermidis
AVQSIPMAIKYYDTFQR

SEQ ID NO: 1802836 - protein, 20 aa, Staphylococcus epidermidis
AVRLVKEEKKALVKDEAISK

SEQ ID NO: 1802837 - protein, 18 aa, Staphylococcus epidermidis
AVSAFCQWIENYIADDYE

SEQ ID NO: 1802838 - protein, 23 aa, Staphylococcus epidermidis
AVSDIKISGDFTIENDPEDSIVT

SEQ ID NO: 1802839 - protein, 34 aa, Staphylococcus epidermidis
AVSELIQFIFRGCIRNGKVLNCYIPSLRMRTLLY

SEQ ID NO: 1802840 - protein, 19 aa, Staphylococcus epidermidis
AVSFLKEKGYTVVTIKHHG

SEQ ID NO: 1802841 - protein, 21 aa, Staphylococcus epidermidis
AVSNGRAEIMIGRGSFIESFP

SEQ ID NO: 1802842 - protein, 26 aa, Staphylococcus epidermidis
AVTGYRPVMEIQFLGFVFEVFDEVAG

SEQ ID NO: 1802843 - protein, 26 aa, Staphylococcus epidermidis
AVTSLYRPGPMEEIPTYITRRHDPSK

SEQ ID NO: 1802844 - protein, 25 aa, Staphylococcus epidermidis
AVTSLYRPGPMEEISTYITRRHNPN

SEQ ID NO: 1802845 - protein, 21 aa, Staphylococcus epidermidis
AVTTLCPCSKEISEYSAHNQR

SEQ ID NO: 1802846 - protein, 18 aa, Staphylococcus epidermidis
AVVARGMGKCCVTGCSDV

SEQ ID NO: 1802847 - protein, 32 aa, Staphylococcus epidermidis
AVVAWNFPTLLASWKLGPALAAGNTVVIQPSS

SEQ ID NO: 1802848 - protein, 17 aa, Staphylococcus epidermidis
AVVGFEYGYNVENKGSF

SEQ ID NO: 1802849 - protein, 19 aa, Staphylococcus epidermidis
AWKKHALGNYSSWEMETLS

SEQ ID NO: 1802850 - protein, 27 aa, Staphylococcus epidermidis
AWVVAGRGELHLSILIENMRREGFELQ

SEQ ID NO: 1802851 - protein, 27 aa, Staphylococcus epidermidis
AYASRDGHYRGIATWEYDKDRGKLIGT

SEQ ID NO: 1802852 - protein, 24 aa, Staphylococcus epidermidis
AYEKKGVAVVICPNDLLTQKIKDT

SEQ ID NO: 1802853 - protein, 26 aa, Staphylococcus epidermidis
AYENPRFVEDLIRLIAADLVDFDWID

SEQ ID NO: 1802854 - protein, 18 aa, Staphylococcus epidermidis
AYFQKLWLEAWEETHERE

SEQ ID NO: 1802855 - protein, 28 aa, Staphylococcus epidermidis
AYGEKGGTPWLDQKHTVFGQLIDGESTL

SEQ ID NO: 1802856 - protein, 19 aa, Staphylococcus epidermidis
AYKQMLTIDGLEIYGPPKD

SEQ ID NO: 1802857 - protein, 18 aa, Staphylococcus epidermidis
AYNVSRLFAQFYEKKLKQ

SEQ ID NO: 1802858 - protein, 31 aa, Staphylococcus epidermidis
AYPHMLSGGMLQRLMIALALALKPKLIIADE

SEQ ID NO: 1802859 - protein, 23 aa, Staphylococcus epidermidis
AYQFTAGVLKNARGFTAVCNPLV

SEQ ID NO: 1802860 - protein, 28 aa, Staphylococcus epidermidis
AYQRGKRDLPYGRALIIYSDDDIVDNAK

SEQ ID NO: 1802861 - protein, 18 aa, Staphylococcus epidermidis
AYSKLKFENGAHRVQRVP

SEQ ID NO: 1802862 - protein, 17 aa, Staphylococcus epidermidis
AYSKLPIGFTLDEQIQF

SEQ ID NO: 1802863 - protein, 21 aa, Staphylococcus epidermidis
AYVEQAAKWGHRALAVTDHNV

SEQ ID NO: 1802864 - protein, 19 aa, Staphylococcus epidermidis
AYVKSHSFIQTLVLGISGG

SEQ ID NO: 1802865 - protein, 17 aa, Staphylococcus epidermidis
AYYKWRIDETYIKIKRK

SEQ ID NO: 1802866 - protein, 19 aa, Staphylococcus epidermidis
CAACGVAAPNLFKYDVEDI

SEQ ID NO: 1802867 - protein, 23 aa, Staphylococcus epidermidis
CASPYFTHSYVFISWTGKMAETF

SEQ ID NO: 1802868 - protein, 19 aa, Staphylococcus epidermidis
CAYKALLNLRDAMTKSTKY

SEQ ID NO: 1802869 - protein, 22 aa, Staphylococcus epidermidis
CCKDRKGYEWVIQSTKKANVGS

SEQ ID NO: 1802870 - protein, 23 aa, Staphylococcus epidermidis
CCTPTEYRMMAKLNNLQDYNLEH

SEQ ID NO: 1802871 - protein, 19 aa, Staphylococcus epidermidis
CCVVPSALMKSAFQNNSKI

SEQ ID NO: 1802872 - protein, 19 aa, Staphylococcus epidermidis
CDCFKFKEIVDYNGDEGIL

SEQ ID NO: 1802873 - protein, 19 aa, Staphylococcus epidermidis
CDCGAQLEASMKYIDENGG

SEQ ID NO: 1802874 - protein, 19 aa, Staphylococcus epidermidis
CDCGAQLEASMKYIEEHGG

SEQ ID NO: 1802875 - protein, 19 aa, Staphylococcus epidermidis
CDEKVTLLFTGPLTDLAKA

SEQ ID NO: 1802876 - protein, 20 aa, Staphylococcus epidermidis
CDFYIKIPMVGHVNSLNASV

SEQ ID NO: 1802877 - protein, 18 aa, Staphylococcus epidermidis
CDFYPEFLEEAITEENGV

SEQ ID NO: 1802878 - protein, 20 aa, Staphylococcus epidermidis
CDQLIILTAIDYVYVNYNTE

SEQ ID NO: 1802879 - protein, 24 aa, Staphylococcus epidermidis
CEEVKLKGDRALKNYNLTFDHVKT

SEQ ID NO: 1802880 - protein, 17 aa, Staphylococcus epidermidis
CEHVVAFELAKALLEEF

SEQ ID NO: 1802881 - protein, 21 aa, Staphylococcus epidermidis
CEHVVAFELAKAVLEEFQSNH

SEQ ID NO: 1802882 - protein, 18 aa, Staphylococcus epidermidis
CELIEARCQCLSPEEIES

SEQ ID NO: 1802883 - protein, 21 aa, Staphylococcus epidermidis
CELNNWSYELYKEIGSGSTID

SEQ ID NO: 1802884 - protein, 21 aa, Staphylococcus epidermidis
CENDGGWILGHLINGTQAEYV

SEQ ID NO: 1802885 - protein, 17 aa, Staphylococcus epidermidis
CENKEDFKSAGHNLYEI

SEQ ID NO: 1802886 - protein, 21 aa, Staphylococcus epidermidis
CERDPMGGYAIKGYINNNNKL

SEQ ID NO: 1802887 - protein, 25 aa, Staphylococcus epidermidis
CERLKKEILEETGIHCTVGIGSNML

SEQ ID NO: 1802888 - protein, 25 aa, Staphylococcus epidermidis
CEVAKCPKNYLANVLNRYGFSVKKE

SEQ ID NO: 1802889 - protein, 36 aa, Staphylococcus epidermidis
CEVCGAPMVIKMGRYGKFMACSNFPDCRNTKAIVKS

SEQ ID NO: 1802890 - protein, 17 aa, Staphylococcus epidermidis
CEYEYPKLDLAVLSNIK

SEQ ID NO: 1802891 - protein, 18 aa, Staphylococcus epidermidis
CFDAPSWYELVVEGRKIA

SEQ ID NO: 1802892 - protein, 18 aa, Staphylococcus epidermidis
CFEEFNFDIPHPSGHELL

SEQ ID NO: 1802893 - protein, 19 aa, Staphylococcus epidermidis
CFELLAMVTYADRLKSIIK

SEQ ID NO: 1802894 - protein, 18 aa, Staphylococcus epidermidis
CFEQLKIQLTVMDTPLQA

SEQ ID NO: 1802895 - protein, 24 aa, Staphylococcus epidermidis
CFKPKLHKPITICISNYSNDQIND

SEQ ID NO: 1802896 - protein, 19 aa, Staphylococcus epidermidis
CFNNPILQEVNYWGTFPSS

SEQ ID NO: 1802897 - protein, 27 aa, Staphylococcus epidermidis
CFPAHKWLYGPEGLGFLFVKKSIRNQL

SEQ ID NO: 1802898 - protein, 17 aa, Staphylococcus epidermidis
CFYEHNFQFNGIIRYPQ

SEQ ID NO: 1802899 - protein, 21 aa, Staphylococcus epidermidis
CGACRQVMMEACIYDQSKRRY

SEQ ID NO: 1802900 - protein, 17 aa, Staphylococcus epidermidis
CGCGSSFKTAKVSGNPE

SEQ ID NO: 1802901 - protein, 19 aa, Staphylococcus epidermidis
CGDESKMAKDVHLAIREVL

SEQ ID NO: 1802902 - protein, 19 aa, Staphylococcus epidermidis
CGFDFKAKYGDLGEGFIEI

SEQ ID NO: 1802903 - protein, 19 aa, Staphylococcus epidermidis
CGIGKPFSEEVALVMMVLR

SEQ ID NO: 1802904 - protein, 20 aa, Staphylococcus epidermidis
CGKGSKVLIEGNLKQDRFQD

SEQ ID NO: 1802905 - protein, 17 aa, Staphylococcus epidermidis
CGKYKRVRYKGMVCDRC

SEQ ID NO: 1802906 - protein, 19 aa, Staphylococcus epidermidis
CGLIDNYIAGMFIKKSSRN

SEQ ID NO: 1802907 - protein, 23 aa, Staphylococcus epidermidis
CGLRNNYIAGLFVKEEYRDKGIG

SEQ ID NO: 1802908 - protein, 20 aa, Staphylococcus epidermidis
CGSAKGLVRYMLHMDNPEKY

SEQ ID NO: 1802909 - protein, 19 aa, Staphylococcus epidermidis
CGSITGAPKLSTMKYIQQL

SEQ ID NO: 1802910 - protein, 26 aa, Staphylococcus epidermidis
CGVGIPGELCIGGVGLAKGYLNQPEL

SEQ ID NO: 1802911 - protein, 17 aa, Staphylococcus epidermidis
CHISKMISRYMVVNETD

SEQ ID NO: 1802912 - protein, 26 aa, Staphylococcus epidermidis
CHNYYPRPDTGLSRSFIDNKNQLIHV

SEQ ID NO: 1802913 - protein, 19 aa, Staphylococcus epidermidis
CICCAMKSDVSQQLHELYL

SEQ ID NO: 1802914 - protein, 25 aa, Staphylococcus epidermidis
CIDALQLRFILDWNSQSHRPQFKFD

SEQ ID NO: 1802915 - protein, 17 aa, Staphylococcus epidermidis
CIDYPGFYTHVSITHTE

SEQ ID NO: 1802916 - protein, 18 aa, Staphylococcus epidermidis
CIDYPGFYTHVSITHTEN

SEQ ID NO: 1802917 - protein, 18 aa, Staphylococcus epidermidis
CIFAESLGGTETFITFPY

SEQ ID NO: 1802918 - protein, 22 aa, Staphylococcus epidermidis
CIKNEDKLLCEMIQNLIQKHHL

SEQ ID NO: 1802919 - protein, 19 aa, Staphylococcus epidermidis
CITQMKYSVEFLGGELKGY

SEQ ID NO: 1802920 - protein, 19 aa, Staphylococcus epidermidis
CIYTRLEAASVGLSEAQAK

SEQ ID NO: 1802921 - protein, 19 aa, Staphylococcus epidermidis
CIYTRLEAASVGLSEEQAK

SEQ ID NO: 1802922 - protein, 20 aa, Staphylococcus epidermidis
CKDLFKEKGKDILAFSNRVA

SEQ ID NO: 1802923 - protein, 20 aa, Staphylococcus epidermidis
CKEDVLYFKAKDKHRLYNET

SEQ ID NO: 1802924 - protein, 19 aa, Staphylococcus epidermidis
CKKSIKANHYLKNNEMSDL

SEQ ID NO: 1802925 - protein, 19 aa, Staphylococcus epidermidis
CKRIGFYPKTVANISQISF

SEQ ID NO: 1802926 - protein, 24 aa, Staphylococcus epidermidis
CKSIRSDKNLVPILMLTAKDDEFD

SEQ ID NO: 1802927 - protein, 24 aa, Staphylococcus epidermidis
CKTLEEFLVLNALHIPLHAGKIEE

SEQ ID NO: 1802928 - protein, 17 aa, Staphylococcus epidermidis
CKTLESIGVDLLVIRHS

SEQ ID NO: 1802929 - protein, 26 aa, Staphylococcus epidermidis
CLIAQHLAKHCDFFSFGTNDLTQLTY

SEQ ID NO: 1802930 - protein, 24 aa, Staphylococcus epidermidis
CLNLPQTRLRKLLKKMDYYIKFEE

SEQ ID NO: 1802931 - protein, 24 aa, Staphylococcus epidermidis
CLPIVKKGGQFIALKSSKGEEELQ

SEQ ID NO: 1802932 - protein, 25 aa, Staphylococcus epidermidis
CLQIEMRSDIPLARGLGSSASALVG

SEQ ID NO: 1802933 - protein, 19 aa, Staphylococcus epidermidis
CLSDLGFKGALPEMEKALD

SEQ ID NO: 1802934 - protein, 20 aa, Staphylococcus epidermidis
CLTGDIFHSQRCDCGAQLEA

SEQ ID NO: 1802935 - protein, 18 aa, Staphylococcus epidermidis
CLVVLPLNKAISESTLNK

SEQ ID NO: 1802936 - protein, 19 aa, Staphylococcus epidermidis
CLYLNIWRKSCSSKIKPVV

SEQ ID NO: 1802937 - protein, 20 aa, Staphylococcus epidermidis
CMVASWKVGASYVPIDVTNP

SEQ ID NO: 1802938 - protein, 19 aa, Staphylococcus epidermidis
CNDWTRFECELKHEYAHDM

SEQ ID NO: 1802939 - protein, 19 aa, Staphylococcus epidermidis
CNEDFKLPLKITKKKVSTG

SEQ ID NO: 1802940 - protein, 22 aa, Staphylococcus epidermidis
CNHHLDFALAIRTMIIDEETVS

SEQ ID NO: 1802941 - protein, 25 aa, Staphylococcus epidermidis
CNISESYCSNLFVRYLNMNFKDYFT

SEQ ID NO: 1802942 - protein, 19 aa, Staphylococcus epidermidis
CNLFYRTSKGIFLTQKGNA

SEQ ID NO: 1802943 - protein, 20 aa, Staphylococcus epidermidis
CNLHGNGSGIGLRLTNNHAI

SEQ ID NO: 1802944 - protein, 31 aa, Staphylococcus epidermidis
CNNFCTFCIIPWARGLMRSRDPEKVVEQASQ

SEQ ID NO: 1802945 - protein, 18 aa, Staphylococcus epidermidis
CNRYKQIRDLEALDQGVV

SEQ ID NO: 1802946 - protein, 23 aa, Staphylococcus epidermidis
CNTRHGVCEKCYGKNLATGEKVE

SEQ ID NO: 1802947 - protein, 21 aa, Staphylococcus epidermidis
CPECGNNMICRRTYYKTKKSK

SEQ ID NO: 1802948 - protein, 23 aa, Staphylococcus epidermidis
CPKLRPVIRTLRRLAAFIEKTMT

SEQ ID NO: 1802949 - protein, 20 aa, Staphylococcus epidermidis
CPLFNEMPEILEAIKNQFKQ

SEQ ID NO: 1802950 - protein, 18 aa, Staphylococcus epidermidis
CPNCKKKMTLFGRGKEAV

SEQ ID NO: 1802951 - protein, 19 aa, Staphylococcus epidermidis
CPVSGVLQPGQTVRYDTVC

SEQ ID NO: 1802952 - protein, 20 aa, Staphylococcus epidermidis
CQDKATGLKAIICIHDTTLG

SEQ ID NO: 1802953 - protein, 25 aa, Staphylococcus epidermidis
CQEIRKVSRVPIMFISSRTDNMDQI

SEQ ID NO: 1802954 - protein, 19 aa, Staphylococcus epidermidis
CQLFYRTSKGIFLTQKGNA

SEQ ID NO: 1802955 - protein, 17 aa, Staphylococcus epidermidis
CQTGKDFDNRLAELGAE

SEQ ID NO: 1802956 - protein, 17 aa, Staphylococcus epidermidis
CRIKRDIVPTDIDYHVR

SEQ ID NO: 1802957 - protein, 17 aa, Staphylococcus epidermidis
CRNYTRAYIRHLIKAEE

SEQ ID NO: 1802958 - protein, 18 aa, Staphylococcus epidermidis
CSEFKPYYLTKALQKLKD

SEQ ID NO: 1802959 - protein, 21 aa, Staphylococcus epidermidis
CSNKDCDFIIFGMISNKNITP

SEQ ID NO: 1802960 - protein, 19 aa, Staphylococcus epidermidis
CSNNKRLGFKRYAYRYDKY

SEQ ID NO: 1802961 - protein, 17 aa, Staphylococcus epidermidis
CSYAQGFAQMRKASEDH

SEQ ID NO: 1802962 - protein, 17 aa, Staphylococcus epidermidis
CSYKRNERGYYIITTEQ

SEQ ID NO: 1802963 - protein, 20 aa, Staphylococcus epidermidis
CTAGTRVLVPESIKEDFLTA

SEQ ID NO: 1802964 - protein, 19 aa, Staphylococcus epidermidis
CTEPLEMGEYFQVVNNFAM

SEQ ID NO: 1802965 - protein, 32 aa, Staphylococcus epidermidis; identical to SEQ ID NO: 1661219

SEQ ID NO: 1802966 - protein, 22 aa, Staphylococcus epidermidis
CTGRMRYLGVLLYDADRVQEAA

SEQ ID NO: 1802967 - protein, 18 aa, Staphylococcus epidermidis
CTIQRRMQKLVEEAPSPI

SEQ ID NO: 1802968 - protein, 21 aa, Staphylococcus epidermidis
CTKNLKLKRLWANTQEPEGLK

SEQ ID NO: 1802969 - protein, 23 aa, Staphylococcus epidermidis
CTPTEYRMMAKLSHLEQYNLEHL

SEQ ID NO: 1802970 - protein, 20 aa, Staphylococcus epidermidis
CTRDIKSFNFMTDFSEYKTV

SEQ ID NO: 1802971 - protein, 20 aa, Staphylococcus epidermidis
CTTEACDFRDHLSDFNELDV

SEQ ID NO: 1802972 - protein, 21 aa, Staphylococcus epidermidis
CVCDLEGLLDIKQSKLSYHLK

SEQ ID NO: 1802973 - protein, 22 aa, Staphylococcus epidermidis
CVDNLPPVLLPKFVELMEQGNP

SEQ ID NO: 1802974 - protein, 23 aa, Staphylococcus epidermidis
CVKGISEALLRTSAPKLYVSNVM

SEQ ID NO: 1802975 - protein, 17 aa, Staphylococcus epidermidis
CYARMKSDILECFKRQV

SEQ ID NO: 1802976 - protein, 20 aa, Staphylococcus epidermidis
CYEGDEWRTVVLPSSDREQS

SEQ ID NO: 1802977 - protein, 22 aa, Staphylococcus epidermidis
CYEIYHPIERVGIYVPGGKASY

SEQ ID NO: 1802978 - protein, 17 aa, Staphylococcus epidermidis
CYFDMAHVDKLMKHIDI

SEQ ID NO: 1802979 - protein, 17 aa, Staphylococcus epidermidis
CYLLETYASATVLKDRI

SEQ ID NO: 1802980 - protein, 23 aa, Staphylococcus epidermidis
CYTGCGSFDVFTLIEKRLKMEGK

SEQ ID NO: 1802981 - protein, 17 aa, Staphylococcus epidermidis
CYVMGLLKRNWINKHDD

SEQ ID NO: 1802982 - protein, 22 aa, Staphylococcus epidermidis
DAANLLSGLGIQADLHDKKMSE

SEQ ID NO: 1802983 - protein, 27 aa, Staphylococcus epidermidis
DACIAADIHPIFGMTLILTDGLYKVET

SEQ ID NO: 1802984 - protein, 26 aa, Staphylococcus epidermidis
DACIAAHIHPIFGMTIYLTDGLYIIE

SEQ ID NO: 1802985 - protein, 19 aa, Staphylococcus epidermidis
DACRAIGITDLRKMGLRDK

SEQ ID NO: 1802986 - protein, 18 aa, Staphylococcus epidermidis
DACRGWRYCMTGCPYKKV

SEQ ID NO: 1802987 - protein, 22 aa, Staphylococcus epidermidis
DADLRILRRLTRDTKERGRSME

SEQ ID NO: 1802988 - protein, 20 aa, Staphylococcus epidermidis
DADVFLGVSVADILTQDMVK

SEQ ID NO: 1802989 - protein, 24 aa, Staphylococcus epidermidis
DADVPVWLDRDCPFNIEGGDELVL

SEQ ID NO: 1802990 - protein, 18 aa, Staphylococcus epidermidis
DAEAFTKHDFEFHEVMIF

SEQ ID NO: 1802991 - protein, 22 aa, Staphylococcus epidermidis
DAEDAFYLTVEAFNLAEEYQCP

SEQ ID NO: 1802992 - protein, 17 aa, Staphylococcus epidermidis
DAEEIIKDMINLVLEHK

SEQ ID NO: 1802993 - protein, 24 aa, Staphylococcus epidermidis
DAEGRMVLGDAVFYATQFQPHLIL

SEQ ID NO: 1802994 - protein, 24 aa, Staphylococcus epidermidis
DAESFTRWLKLFLNEQLTYADGLA

SEQ ID NO: 1802995 - protein, 21 aa, Staphylococcus epidermidis
DAESIGFVLSMTHEVDTYQII

SEQ ID NO: 1802996 - protein, 27 aa, Staphylococcus epidermidis
DAESKKRFEEMLGWFKYEIRQYTESDI

SEQ ID NO: 1802997 - protein, 19 aa, Staphylococcus epidermidis
DAFAKKLGYSIEKITKLTH

SEQ ID NO: 1802998 - protein, 26 aa, Staphylococcus epidermidis
DAFAKVKGRLIVSCYASNFIRIQQVL

SEQ ID NO: 1802999 - protein, 25 aa, Staphylococcus epidermidis
DAFETFKYSSEFAQPIELKVVLLHH

SEQ ID NO: 1803000 - protein, 19 aa, Staphylococcus epidermidis
DAFIGAIIYCILESRHTEC

SEQ ID NO: 1803001 - protein, 19 aa, Staphylococcus epidermidis
DAFIGAIIYCILQARHSEC

SEQ ID NO: 1803002 - protein, 24 aa, Staphylococcus epidermidis
DAFIGCNTNLIAPVTVGDHTLIAA

SEQ ID NO: 1803003 - protein, 18 aa, Staphylococcus epidermidis
DAFLANVEKLVWMGGTFL

SEQ ID NO: 1803004 - protein, 20 aa, Staphylococcus epidermidis
DAGNMLKPMLARGELHCIGA

SEQ ID NO: 1803005 - protein, 19 aa, Staphylococcus epidermidis
DAGRVELKEAVPVTVTLSY

SEQ ID NO: 1803006 - protein, 19 aa, Staphylococcus epidermidis
DAHDFCPYSKATRGNIDVN

SEQ ID NO: 1803007 - protein, 25 aa, Staphylococcus epidermidis
DAHQCFSGKFTVRHFFKDVKDITEY

SEQ ID NO: 1803008 - protein, 25 aa, Staphylococcus epidermidis
DAIAAKAKDGASCVTYIGPNGAGHY

SEQ ID NO: 1803009 - protein, 24 aa, Staphylococcus epidermidis
DAIKTGKALNKFKTFLSNQGGDDS

SEQ ID NO: 1803010 - protein, 19 aa, Staphylococcus epidermidis
DAIQIVPLIIKYKNLLYEN

SEQ ID NO: 1803011 - protein, 24 aa, Staphylococcus epidermidis
DAIYLPGGHGTVFDFANNEKLANI

SEQ ID NO: 1803012 - protein, 23 aa, Staphylococcus epidermidis
DAKACAMITYRLLKHYDDLQSML

SEQ ID NO: 1803013 - protein, 23 aa, Staphylococcus epidermidis
DAKEGYIDCVMVYKTNRLARNTS

SEQ ID NO: 1803014 - protein, 26 aa, Staphylococcus epidermidis
DAKEIKSTMVGTFFLQDSKELTDPQI

SEQ ID NO: 1803015 - protein, 25 aa, Staphylococcus epidermidis
DAKPEDYDALLIPGGFSPDHLRGDA

SEQ ID NO: 1803016 - protein, 25 aa, Staphylococcus epidermidis
DAKPEDYDALLIPGGFSPDHLRGDE

SEQ ID NO: 1803017 - protein, 20 aa, Staphylococcus epidermidis
DAKTFELLNSHGKPSGQQII

SEQ ID NO: 1803018 - protein, 19 aa, Staphylococcus epidermidis
DALCFYDLGSSEMNLDMAI

SEQ ID NO: 1803019 - protein, 19 aa, Staphylococcus epidermidis
DALMKAFQIDAPVNPGNSG

SEQ ID NO: 1803020 - protein, 21 aa, Staphylococcus epidermidis
DALNFKINASLIKSKNDYISL

SEQ ID NO: 1803021 - protein, 24 aa, Staphylococcus epidermidis
DAMISRSEFYTAYTPYQPEISQGE

SEQ ID NO: 1803022 - protein, 29 aa, Staphylococcus epidermidis
DAMVRLSQDWKLRHVLIEMHGNNGSIDND

SEQ ID NO: 1803023 - protein, 19 aa, Staphylococcus epidermidis
DANCLIPRPETEEVMLHFL

SEQ ID NO: 1803024 - protein, 25 aa, Staphylococcus epidermidis
DANGNQHLPGWGLDALKFLIEERGV

SEQ ID NO: 1803025 - protein, 21 aa, Staphylococcus epidermidis
DASIAYARRQGWTSPRNGIIG

SEQ ID NO: 1803026 - protein, 21 aa, Staphylococcus epidermidis
DASILRKAFHLNFDDVGENIE

SEQ ID NO: 1803027 - protein, 24 aa, Staphylococcus epidermidis
DASVEVAFRLGIDTRKNDQQIRGA

SEQ ID NO: 1803028 - protein, 25 aa, Staphylococcus epidermidis
DAVKIVRKRGQLMAQAFPNGVGSMA

SEQ ID NO: 1803029 - protein, 17 aa, Staphylococcus epidermidis
DAVLKEKYQRYDLNKNK

SEQ ID NO: 1803030 - protein, 23 aa, Staphylococcus epidermidis
DAVNRYNMTIIFVTHDLNLVRTY

SEQ ID NO: 1803031 - protein, 25 aa, Staphylococcus epidermidis
DAVRIVRKRGQLMAQAFPNGVGGMA

SEQ ID NO: 1803032 - protein, 24 aa, Staphylococcus epidermidis
DAVYAAGVDKVFGVPGDFNLAFLD

SEQ ID NO: 1803033 - protein, 20 aa, Staphylococcus epidermidis
DAWIVSIYLAHHFISQSSDV

SEQ ID NO: 1803034 - protein, 21 aa, Staphylococcus epidermidis
DCLKTILSQETKYWNIFGAFE

SEQ ID NO: 1803035 - protein, 23 aa, Staphylococcus epidermidis
DCRYFGKSYIEFEDWVQNINLYP

SEQ ID NO: 1803036 - protein, 17 aa, Staphylococcus epidermidis
DCTLGGAGHALYLLNQL

SEQ ID NO: 1803037 - protein, 25 aa, Staphylococcus epidermidis
DDAKRKVAIALRNRYRRSLLDEEAK

SEQ ID NO: 1803038 - protein, 25 aa, Staphylococcus epidermidis
DDALKKSLFHYLLLNMRYNRLDVAE

SEQ ID NO: 1803039 - protein, 17 aa, Staphylococcus epidermidis
DDALKYVRDYALEQNAK

SEQ ID NO: 1803040 - protein, 24 aa, Staphylococcus epidermidis
DDAYEIIETLYLEELNVPYIIIGH

SEQ ID NO: 1803041 - protein, 17 aa, Staphylococcus epidermidis
DDAYFKKIDAIEFAVKY

SEQ ID NO: 1803042 - protein, 23 aa, Staphylococcus epidermidis
DDEGKIEWLLPFLSNSGPTIIYV

SEQ ID NO: 1803043 - protein, 25 aa, Staphylococcus epidermidis
DDEVIWLYQYFSNIKIAPTTYTLDD

SEQ ID NO: 1803044 - protein, 18 aa, Staphylococcus epidermidis
DDEVWDVLEDVITEHPVL

SEQ ID NO: 1803045 - protein, 22 aa, Staphylococcus epidermidis
DDFLYDKPSVLIGRKGSIGKVK

SEQ ID NO: 1803046 - protein, 23 aa, Staphylococcus epidermidis
DDGESYSYLIFVQETWSMLHENR

SEQ ID NO: 1803047 - protein, 18 aa, Staphylococcus epidermidis
DDGNITWDPSKKHIKEGV

SEQ ID NO: 1803048 - protein, 23 aa, Staphylococcus epidermidis
DDHVPKIYAIRGPSGIGKTTVLN

SEQ ID NO: 1803049 - protein, 18 aa, Staphylococcus epidermidis
DDIGPRIQSTLIKKQAMM

SEQ ID NO: 1803050 - protein, 24 aa, Staphylococcus epidermidis
DDIIAHNHIKWIGNTNELNASYAA

SEQ ID NO: 1803051 - protein, 23 aa, Staphylococcus epidermidis
DDIKDLDCQIIILSSYDDFEYMK

SEQ ID NO: 1803052 - protein, 19 aa, Staphylococcus epidermidis
DDIKDLDCQVIILSSYDDF

SEQ ID NO: 1803053 - protein, 19 aa, Staphylococcus epidermidis
DDITSLVKTFHLVKENGEH

SEQ ID NO: 1803054 - protein, 24 aa, Staphylococcus epidermidis
DDIYNLPGQVFIFGGQTLFEEMID

SEQ ID NO: 1803055 - protein, 22 aa, Staphylococcus epidermidis
DDKNLRDAIEMYMSKKYTLDEI

SEQ ID NO: 1803056 - protein, 24 aa, Staphylococcus epidermidis
DDLKSFVCHIPYYTGVMEKLYSHK

SEQ ID NO: 1803057 - protein, 23 aa, Staphylococcus epidermidis
DDLPPSDLVGSFIMTGTQEDKPK

SEQ ID NO: 1803058 - protein, 17 aa, Staphylococcus epidermidis
DDLSIELIYYFINCVMA

SEQ ID NO: 1803059 - protein, 19 aa, Staphylococcus epidermidis
DDLTELVLTLGSQMVVLAG

SEQ ID NO: 1803060 - protein, 20 aa, Staphylococcus epidermidis
DDLVTRGMILKVNRNTRTSK

SEQ ID NO: 1803061 - protein, 20 aa, Staphylococcus epidermidis
DDLYLTPVIQNFISLIYNVN

SEQ ID NO: 1803062 - protein, 23 aa, Staphylococcus epidermidis
DDMFKKPMILITILEKPIQFQHN

SEQ ID NO: 1803063 - protein, 17 aa, Staphylococcus epidermidis
DDMYALHYPRMFIDPYT

SEQ ID NO: 1803064 - protein, 19 aa, Staphylococcus epidermidis
DDNLGIAIDAYGAGSFIVA

SEQ ID NO: 1803065 - protein, 21 aa, Staphylococcus epidermidis
DDPAGKPWSEFQRVRDEIKAA

SEQ ID NO: 1803066 - protein, 21 aa, Staphylococcus epidermidis
DDPAGKSWSEFQRVRDEIGQK

SEQ ID NO: 1803067 - protein, 18 aa, Staphylococcus epidermidis
DDPYKLELIDAIPDDESV

SEQ ID NO: 1803068 - protein, 18 aa, Staphylococcus epidermidis
DDPYKLELIDAIPEDENV

SEQ ID NO: 1803069 - protein, 20 aa, Staphylococcus epidermidis
DDQLKELYSYAINHNLEVLV

SEQ ID NO: 1803070 - protein, 26 aa, Staphylococcus epidermidis
DDQQLRLKAGLIRSFLDKVVPSLKED

SEQ ID NO: 1803071 - protein, 21 aa, Staphylococcus epidermidis
DDRFFRCHNSFVVNRHNIESI

SEQ ID NO: 1803072 - protein, 18 aa, Staphylococcus epidermidis
DDRLLVPIFDARREAVYT

SEQ ID NO: 1803073 - protein, 23 aa, Staphylococcus epidermidis
DDTFYKLNVRPNTDMSAADFWQR

SEQ ID NO: 1803074 - protein, 17 aa, Staphylococcus epidermidis
DDVDFAIFGPGVPLEAH

SEQ ID NO: 1803075 - protein, 24 aa, Staphylococcus epidermidis
DDVNFKLYLGLKHISPYIEEAVEQ

SEQ ID NO: 1803076 - protein, 18 aa, Staphylococcus epidermidis
DDVTLYIAAAQRKKQQIQ

SEQ ID NO: 1803077 - protein, 26 aa, Staphylococcus epidermidis
DDVYHRRLRFTLAHEYGHYIMEHDGM

SEQ ID NO: 1803078 - protein, 24 aa, Staphylococcus epidermidis
DDWDKLNVGDKVVFQNKIFNTKIK

SEQ ID NO: 1803079 - protein, 27 aa, Staphylococcus epidermidis
DDYDIYRLLKYLYYFDNVKDYQEFINE

SEQ ID NO: 1803080 - protein, 24 aa, Staphylococcus epidermidis
DDYFKEIYKFIPTSATKAEKAIKG

SEQ ID NO: 1803081 - protein, 21 aa, Staphylococcus epidermidis
DDYRIIKSHLFGDGSRTTENR

SEQ ID NO: 1803082 - protein, 18 aa, Staphylococcus epidermidis
DDYVLFGTFFKAYSESTI

SEQ ID NO: 1803083 - protein, 24 aa, Staphylococcus epidermidis
DDYWKARQVPLSNIRIPLLTCASW

SEQ ID NO: 1803084 - protein, 22 aa, Staphylococcus epidermidis
DEAALEFIAKASEGGMRDALSI

SEQ ID NO: 1803085 - protein, 18 aa, Staphylococcus epidermidis
DEAFKGLKPIFGTKNEVL

SEQ ID NO: 1803086 - protein, 21 aa, Staphylococcus epidermidis
DEAFLKESFFINGKFQHDLFA

SEQ ID NO: 1803087 - protein, 19 aa, Staphylococcus epidermidis
DEAFVCYIAMTRARQKVTF

SEQ ID NO: 1803088 - protein, 27 aa, Staphylococcus epidermidis
DEAIILTSLPFNASWLNQRYSEIMQAI

SEQ ID NO: 1803089 - protein, 20 aa, Staphylococcus epidermidis
DEAKLGSLHLKTIRISEIKS

SEQ ID NO: 1803090 - protein, 23 aa, Staphylococcus epidermidis
DEAKSMGAMALFGEKYGDIVRVV

SEQ ID NO: 1803091 - protein, 22 aa, Staphylococcus epidermidis
DEANVIRYAQYLNELSEQTQFI

SEQ ID NO: 1803092 - protein, 18 aa, Staphylococcus epidermidis
DEDLKDQFDHALSNARKA

SEQ ID NO: 1803093 - protein, 28 aa, Staphylococcus epidermidis
DEDRIRRLLKLYLERESFEIHEASNGKE

SEQ ID NO: 1803094 - protein, 17 aa, Staphylococcus epidermidis
DEEAMEALIRFSKAEGI

SEQ ID NO: 1803095 - protein, 24 aa, Staphylococcus epidermidis
DEEGRYGTFTKYFTQNDVPTFAIC

SEQ ID NO: 1803096 - protein, 21 aa, Staphylococcus epidermidis
DEEWKKRKLGEVVNYKNGGSF

SEQ ID NO: 1803097 - protein, 25 aa, Staphylococcus epidermidis
DEFERWSKGHLPYLIELGAIEISPK

SEQ ID NO: 1803098 - protein, 21 aa, Staphylococcus epidermidis
DEFGLKNDVIFVLPSSDEKLV

SEQ ID NO: 1803099 - protein, 30 aa, Staphylococcus epidermidis
DEFYFEEPFNFGATVGRYAGRIENASFKLD

SEQ ID NO: 1803100 - protein, 17 aa, Staphylococcus epidermidis
DEFYFENPFNFGATIGR

SEQ ID NO: 1803101 - protein, 24 aa, Staphylococcus epidermidis
DEGERVWVKYHFRTQQGIENYTDE

SEQ ID NO: 1803102 - protein, 18 aa, Staphylococcus epidermidis
DEGMDWLLRHAYHRVPQL

SEQ ID NO: 1803103 - protein, 20 aa, Staphylococcus epidermidis
DEGYEKFNHLLQEFNLSHEK

SEQ ID NO: 1803104 - protein, 38 aa, Staphylococcus epidermidis
DEGYLKLYKTWFCKSKLCPVCNWRRSMKNSYQAQKVIE

SEQ ID NO: 1803105 - protein, 19 aa, Staphylococcus epidermidis
DEHLLRLLYYNPIDENGNY

SEQ ID NO: 1803106 - protein, 26 aa, Staphylococcus epidermidis
DEHLRDLPFIAGFIGTCSFDLVRHEF

SEQ ID NO: 1803107 - protein, 17 aa, Staphylococcus epidermidis
DEIIILPHVFGEDARME

SEQ ID NO: 1803108 - protein, 17 aa, Staphylococcus epidermidis
DEIKLEFMIKSNELEIA

SEQ ID NO: 1803109 - protein, 23 aa, Staphylococcus epidermidis
DEILKYRFNNEHPFNQMRLKLTT

SEQ ID NO: 1803110 - protein, 25 aa, Staphylococcus epidermidis
DEINQLPIVEEFRSAQYDANDLLQM

SEQ ID NO: 1803111 - protein, 17 aa, Staphylococcus epidermidis
DEIREVIDQSQATNMDE

SEQ ID NO: 1803112 - protein, 24 aa, Staphylococcus epidermidis
DEIRMKEFVKDVAKYDEVYGLTNK

SEQ ID NO: 1803113 - protein, 22 aa, Staphylococcus epidermidis
DEIRQFPKILFMSGKEDQIIPY

SEQ ID NO: 1803114 - protein, 21 aa, Staphylococcus epidermidis
DEIYPKAWYQAGISLETMEKY

SEQ ID NO: 1803115 - protein, 22 aa, Staphylococcus epidermidis
DEKAKELIKLVDLPEEYLDRYP

SEQ ID NO: 1803116 - protein, 18 aa, Staphylococcus epidermidis
DEKGCPWDKIQTHETLKR

SEQ ID NO: 1803117 - protein, 24 aa, Staphylococcus epidermidis
DELDRVGVHLEHFGGHDYIVNSYP

SEQ ID NO: 1803118 - protein, 17 aa, Staphylococcus epidermidis
DELEFIGTIVGKAYPQP

SEQ ID NO: 1803119 - protein, 24 aa, Staphylococcus epidermidis
DELEIHFSDGLTVLSGETGSGKSI

SEQ ID NO: 1803120 - protein, 24 aa, Staphylococcus epidermidis
DELKEQQEIFLLTEILSGKNSHKL

SEQ ID NO: 1803121 - protein, 19 aa, Staphylococcus epidermidis
DELNENWLSIAGMTQKYLY

SEQ ID NO: 1803122 - protein, 26 aa, Staphylococcus epidermidis
DELQARIRVALRVSRKIDTEQNNFEN

SEQ ID NO: 1803123 - protein, 22 aa, Staphylococcus epidermidis
DELRAQNILQERAFKNEKVDFI

SEQ ID NO: 1803124 - protein, 18 aa, Staphylococcus epidermidis
DELSNCLNFLKKGDTLVV

SEQ ID NO: 1803125 - protein, 17 aa, Staphylococcus epidermidis
DEMARCFEASFEAQPEQ

SEQ ID NO: 1803126 - protein, 20 aa, Staphylococcus epidermidis
DEMIEAVSLGKPFDAAISFL

SEQ ID NO: 1803127 - protein, 18 aa, Staphylococcus epidermidis
DEPLEINNSYVLITPTYD

SEQ ID NO: 1803128 - protein, 23 aa, Staphylococcus epidermidis
DEQKAHFKPLIDNAQTRGEVDKQ

SEQ ID NO: 1803129 - protein, 17 aa, Staphylococcus epidermidis
DERRKIDTYTFIEVESD

SEQ ID NO: 1803130 - protein, 22 aa, Staphylococcus epidermidis
DESFKLGIVLSYLKQYQASQNL

SEQ ID NO: 1803131 - protein, 21 aa, Staphylococcus epidermidis
DESHVSIAGRLMTKRGKGKAG

SEQ ID NO: 1803132 - protein, 23 aa, Staphylococcus epidermidis
DESKSGMVPRSRLNDKNAEIDEL

SEQ ID NO: 1803133 - protein, 20 aa, Staphylococcus epidermidis
DESLGFPSFLFVEGDTIGFA

SEQ ID NO: 1803134 - protein, 23 aa, Staphylococcus epidermidis
DESRILFGAGLDEVILMISRAVL

SEQ ID NO: 1803135 - protein, 23 aa, Staphylococcus epidermidis
DESRTVKAIEELGERMGIQTPIR

SEQ ID NO: 1803136 - protein, 21 aa, Staphylococcus epidermidis
DESSIHYMISMFIPDNQKIAR

SEQ ID NO: 1803137 - protein, 24 aa, Staphylococcus epidermidis
DETAIPLLLGLGLDEFSMSATSIL

SEQ ID NO: 1803138 - protein, 25 aa, Staphylococcus epidermidis
DETDNGFKLAADIKVTLENISQEDA

SEQ ID NO: 1803139 - protein, 22 aa, Staphylococcus epidermidis
DETIKGVVLFHETLKTLNIKHE

SEQ ID NO: 1803140 - protein, 23 aa, Staphylococcus epidermidis
DETIKQLYNQVAIYKEQSNRDKE

SEQ ID NO: 1803141 - protein, 25 aa, Staphylococcus epidermidis
DETLKSNLEWAFKSYVFNLQNKKLF

SEQ ID NO: 1803142 - protein, 20 aa, Staphylococcus epidermidis
DETSPIDMLASWSGSEPTQS

SEQ ID NO: 1803143 - protein, 18 aa, Staphylococcus epidermidis
DEVIMRTGSTMMIHNAST

SEQ ID NO: 1803144 - protein, 28 aa, Staphylococcus epidermidis
DEVKDMYRRVNFLFGDIVKVTPSSKVVG

SEQ ID NO: 1803145 - protein, 28 aa, Staphylococcus epidermidis
DEVKEMYRRVNFLFGDLVKVTPSSKVVG

SEQ ID NO: 1803146 - protein, 20 aa, Staphylococcus epidermidis
DEVLQKSGYRDMLEREQTLE

SEQ ID NO: 1803147 - protein, 24 aa, Staphylococcus epidermidis
DEVQSHGFQCCLNASTITQEMLER

SEQ ID NO: 1803148 - protein, 19 aa, Staphylococcus epidermidis
DEVYEIFQTTMLKRANENE

SEQ ID NO: 1803149 - protein, 20 aa, Staphylococcus epidermidis
DEVYPKLEAYGIKQIAQRTA

SEQ ID NO: 1803150 - protein, 17 aa, Staphylococcus epidermidis
DEYALKHEGEYGKTECW

SEQ ID NO: 1803151 - protein, 21 aa, Staphylococcus epidermidis
DEYKDKGFVILGFPCNQFGGQ

SEQ ID NO: 1803152 - protein, 22 aa, Staphylococcus epidermidis
DFADIFCETGVFSVEESKRYME

SEQ ID NO: 1803153 - protein, 20 aa, Staphylococcus epidermidis
DFAFEFNGIPTVVPRHYNYQ

SEQ ID NO: 1803154 - protein, 21 aa, Staphylococcus epidermidis
DFDFPNVLRVIQFETQSKKQD

SEQ ID NO: 1803155 - protein, 27 aa, Staphylococcus epidermidis
DFDIPRVLGDIIICRDVAKEQSESYGH

SEQ ID NO: 1803156 - protein, 27 aa, Staphylococcus epidermidis
DFDIPRVLGDIIICTDVAKEQAESYGH

SEQ ID NO: 1803157 - protein, 20 aa, Staphylococcus epidermidis
DFDKSRVAIIGTRTPSLESV

SEQ ID NO: 1803158 - protein, 18 aa, Staphylococcus epidermidis
DFDKVRFVHHSIPSIDVS

SEQ ID NO: 1803159 - protein, 24 aa, Staphylococcus epidermidis
DFEEILRFINFAKYNINYIDDPIK

SEQ ID NO: 1803160 - protein, 25 aa, Staphylococcus epidermidis
DFEGYRKSYACLSYALNELGYDVNH

SEQ ID NO: 1803161 - protein, 17 aa, Staphylococcus epidermidis
DFEKMYHLFNVYEQHFD

SEQ ID NO: 1803162 - protein, 23 aa, Staphylococcus epidermidis
DFELIDDICFEWEERTHMELEFD

SEQ ID NO: 1803163 - protein, 25 aa, Staphylococcus epidermidis
DFEYGVKIYDVFTILYLLSPQAFNV

SEQ ID NO: 1803164 - protein, 18 aa, Staphylococcus epidermidis
DFGALMITHYQRLLNYIT

SEQ ID NO: 1803165 - protein, 18 aa, Staphylococcus epidermidis
DFIIFGMISNKNITPQIV

SEQ ID NO: 1803166 - protein, 19 aa, Staphylococcus epidermidis
DFKDGIVTEAEKTRLRVQL

SEQ ID NO: 1803167 - protein, 20 aa, Staphylococcus epidermidis
DFKKGFIYEEVILKPKEEIQ

SEQ ID NO: 1803168 - protein, 22 aa, Staphylococcus epidermidis
DFKREHMVFPGMVYISHPTEYG

SEQ ID NO: 1803169 - protein, 22 aa, Staphylococcus epidermidis
DFLPEQERQAVWVIYAVCRIID

SEQ ID NO: 1803170 - protein, 18 aa, Staphylococcus epidermidis
DFNALSFNTAISQLMVFI

SEQ ID NO: 1803171 - protein, 26 aa, Staphylococcus epidermidis
DFNNSFSFTGGYVFIHEYEINKPEFI

SEQ ID NO: 1803172 - protein, 20 aa, Staphylococcus epidermidis
DFQDALGLNSADSFRDLIKV

SEQ ID NO: 1803173 - protein, 29 aa, Staphylococcus epidermidis
DFQNLILLFLESWYLRASFSQKFGVIEEN

SEQ ID NO: 1803174 - protein, 22 aa, Staphylococcus epidermidis
DFRPGLKARDDFGVRSVLQEAK

SEQ ID NO: 1803175 - protein, 23 aa, Staphylococcus epidermidis
DFRPGLKARDEFGVRSVLQEANL

SEQ ID NO: 1803176 - protein, 18 aa, Staphylococcus epidermidis
DFSQEGFLAEFQNKDQKI

SEQ ID NO: 1803177 - protein, 24 aa, Staphylococcus epidermidis
DFVNEIKSALSVGDTCPICGNEIH

SEQ ID NO: 1803178 - protein, 18 aa, Staphylococcus epidermidis
DFYYFGFQDRAAIKDNLL

SEQ ID NO: 1803179 - protein, 19 aa, Staphylococcus epidermidis
DGDDIYYNLNVSFPQAALG

SEQ ID NO: 1803180 - protein, 18 aa, Staphylococcus epidermidis
DGDDYIWKSHSFVRKGFL

SEQ ID NO: 1803181 - protein, 20 aa, Staphylococcus epidermidis
DGDHGVNMVRGFEHLKEKID

SEQ ID NO: 1803182 - protein, 19 aa, Staphylococcus epidermidis
DGEILNLASGVYFANAYEV

SEQ ID NO: 1803183 - protein, 23 aa, Staphylococcus epidermidis
DGEILNLASGVYFANAYEVNYFS

SEQ ID NO: 1803184 - protein, 31 aa, Staphylococcus epidermidis
DGEITFCGGIEMPGWIELRVNVIKNGMEKYH

SEQ ID NO: 1803185 - protein, 25 aa, Staphylococcus epidermidis
DGEPCNECEICRGITQGTNSDVIEI

SEQ ID NO: 1803186 - protein, 25 aa, Staphylococcus epidermidis
DGFDNIRNGLDFGYADDPLAFVRWH

SEQ ID NO: 1803187 - protein, 19 aa, Staphylococcus epidermidis
DGFHPSNIGKLYIDEQTFV

SEQ ID NO: 1803188 - protein, 17 aa, Staphylococcus epidermidis
DGFTLTFKDGVIVDVKA

SEQ ID NO: 1803189 - protein, 24 aa, Staphylococcus epidermidis
DGFTRIDLAFDFEDDLSNYYAMTD

SEQ ID NO: 1803190 - protein, 23 aa, Staphylococcus epidermidis
DGFTRLDLAFDFEDDLSDYYTMT

SEQ ID NO: 1803191 - protein, 23 aa, Staphylococcus epidermidis
DGGFLTKVRTGAISGVATKYLAK

SEQ ID NO: 1803192 - protein, 24 aa, Staphylococcus epidermidis
DGGKAANIIPDFTHARFYTRATTR

SEQ ID NO: 1803193 - protein, 22 aa, Staphylococcus epidermidis
DGHGRLKGYKMLVTGGDSAIGR

SEQ ID NO: 1803194 - protein, 21 aa, Staphylococcus epidermidis
DGHPTLREKAKELSFPISEED

SEQ ID NO: 1803195 - protein, 19 aa, Staphylococcus epidermidis
DGHTLSKEEIEFFIKGYTK

SEQ ID NO: 1803196 - protein, 23 aa, Staphylococcus epidermidis
DGKPYAGFVYDVMKDVLYHAKVG

SEQ ID NO: 1803197 - protein, 24 aa, Staphylococcus epidermidis
DGKRLKDLIKVYLKENDFEVLDVT

SEQ ID NO: 1803198 - protein, 26 aa, Staphylococcus epidermidis
DGKSPMSVTYEFKLHNQIFKVHREAP

SEQ ID NO: 1803199 - protein, 26 aa, Staphylococcus epidermidis
DGKVARLTNFGAFINIGGVDGLVHVS

SEQ ID NO: 1803200 - protein, 25 aa, Staphylococcus epidermidis
DGKYKFANGCNGIFTVIYKNKKYRA

SEQ ID NO: 1803201 - protein, 18 aa, Staphylococcus epidermidis
DGLFKEHQLLYILIMHAF

SEQ ID NO: 1803202 - protein, 25 aa, Staphylococcus epidermidis
DGLVHEFKYRRNLLGHSGTFDLDSS

SEQ ID NO: 1803203 - protein, 25 aa, Staphylococcus epidermidis
DGMLVKRPLAISGEKITLGFKEETY

SEQ ID NO: 1803204 - protein, 27 aa, Staphylococcus epidermidis
DGNIMNRYGIPSVILGVGYENIHTTSE

SEQ ID NO: 1803205 - protein, 20 aa, Staphylococcus epidermidis
DGNKWLEIIQKYPITIWNSV

SEQ ID NO: 1803206 - protein, 24 aa, Staphylococcus epidermidis
DGQFLKYYFDFFKIDYTKYSLEKN

SEQ ID NO: 1803207 - protein, 23 aa, Staphylococcus epidermidis
DGQKPRHLYQWFGQTMRTQDEDI

SEQ ID NO: 1803208 - protein, 30 aa, Staphylococcus epidermidis
DGRATADIFGKCLHTYLIKDAIRDGNVLGF

SEQ ID NO: 1803209 - protein, 27 aa, Staphylococcus epidermidis
DGRDLKKRLEKFFDYFSKGEIEKINNQ

SEQ ID NO: 1803210 - protein, 22 aa, Staphylococcus epidermidis
DGRETPRKPRIVNSQKAIRTND

SEQ ID NO: 1803211 - protein, 24 aa, Staphylococcus epidermidis
DGRTAQRENIEWLIDQLEVEENDV

SEQ ID NO: 1803212 - protein, 26 aa, Staphylococcus epidermidis
DGSLKMLLSYQFPLILGNDFAGEISE

SEQ ID NO: 1803213 - protein, 17 aa, Staphylococcus epidermidis
DGTEINEALKYVVECGA

SEQ ID NO: 1803214 - protein, 21 aa, Staphylococcus epidermidis
DGTETGLWLEEAGEPYDILTQ

SEQ ID NO: 1803215 - protein, 26 aa, Staphylococcus epidermidis
DGTLDKARIEQALTELQHAREALHGE

SEQ ID NO: 1803216 - protein, 19 aa, Staphylococcus epidermidis
DGTMSFAVADVIGKGIPAA

SEQ ID NO: 1803217 - protein, 24 aa, Staphylococcus epidermidis
DGTPIIGICLGMQLLFEHSAEGDV

SEQ ID NO: 1803218 - protein, 24 aa, Staphylococcus epidermidis
DGVIIPKRRSVALTQTVAKASTGA

SEQ ID NO: 1803219 - protein, 24 aa, Staphylococcus epidermidis
DGWYSLHLFYAMDWTTFRLVPEEE

SEQ ID NO: 1803220 - protein, 17 aa, Staphylococcus epidermidis
DGWYSLHLFYAVDWTTF

SEQ ID NO: 1803221 - protein, 18 aa, Staphylococcus epidermidis
DGYARINGLGAMVTTFGV

SEQ ID NO: 1803222 - protein, 17 aa, Staphylococcus epidermidis
DGYKFAESLGHSITELF

SEQ ID NO: 1803223 - protein, 21 aa, Staphylococcus epidermidis
DGYKLQFLLNYAHENEKEVEV

SEQ ID NO: 1803224 - protein, 20 aa, Staphylococcus epidermidis
DGYPAFKKEYGYSFGTVRPM

SEQ ID NO: 1803225 - protein, 21 aa, Staphylococcus epidermidis
DHAMLKLAYIDLQDYLNTLQD

SEQ ID NO: 1803226 - protein, 21 aa, Staphylococcus epidermidis
DHDILKASCKAYIDAHAKYIS

SEQ ID NO: 1803227 - protein, 20 aa, Staphylococcus epidermidis
DHDWTKLGTSIVDIVENGVN

SEQ ID NO: 1803228 - protein, 18 aa, Staphylococcus epidermidis
DHEIFIKYLKIFQLPYKN

SEQ ID NO: 1803229 - protein, 24 aa, Staphylococcus epidermidis
DHFKALSVGKWVRAQGRIEEDSFV

SEQ ID NO: 1803230 - protein, 26 aa, Staphylococcus epidermidis
DHFKQGFKGICFRTKDIDQVKSTLEN

SEQ ID NO: 1803231 - protein, 27 aa, Staphylococcus epidermidis
DHFKQGFKGICFRTKDINQVKSTLENR

SEQ ID NO: 1803232 - protein, 24 aa, Staphylococcus epidermidis
DHHKPHIMPVWSIKNRARKVRDED

SEQ ID NO: 1803233 - protein, 20 aa, Staphylococcus epidermidis
DHHMKGCIMEKINDGAQEEA

SEQ ID NO: 1803234 - protein, 19 aa, Staphylococcus epidermidis
DHIDKGIKDLAEYVEELYN

SEQ ID NO: 1803235 - protein, 24 aa, Staphylococcus epidermidis
DHIDKKEARRMDRFTQYAVVAARE

SEQ ID NO: 1803236 - protein, 17 aa, Staphylococcus epidermidis
DHLLWKQFIHNIKTLHS

SEQ ID NO: 1803237 - protein, 23 aa, Staphylococcus epidermidis
DHPELDFDFIHWLVTGVKDHESV

SEQ ID NO: 1803238 - protein, 17 aa, Staphylococcus epidermidis
DHQMTIKVGQDIDVDTF

SEQ ID NO: 1803239 - protein, 26 aa, Staphylococcus epidermidis
DHRIIDGKEAVGFLKTIKELIENPED

SEQ ID NO: 1803240 - protein, 23 aa, Staphylococcus epidermidis
DHRKAPLRKLIRSVTPNNVSDAY

SEQ ID NO: 1803241 - protein, 22 aa, Staphylococcus epidermidis
DHRLSPDLYENWYHKTPVDKDI

SEQ ID NO: 1803242 - protein, 18 aa, Staphylococcus epidermidis
DHVKVHLRPSAQLVSEIV

SEQ ID NO: 1803243 - protein, 22 aa, Staphylococcus epidermidis
DHYRRGVNLAIQYLSYKKRTER

SEQ ID NO: 1803244 - protein, 22 aa, Staphylococcus epidermidis
DHYRRGVNMAIQYLSYKKRTEK

SEQ ID NO: 1803245 - protein, 25 aa, Staphylococcus epidermidis
DIAEGIDGLLFRTSMPQKELKQSMI

SEQ ID NO: 1803246 - protein, 21 aa, Staphylococcus epidermidis
DIAEVIAGWTGIPLTKINETE

SEQ ID NO: 1803247 - protein, 17 aa, Staphylococcus epidermidis
DIAIAKLTSLVVDLQEE

SEQ ID NO: 1803248 - protein, 17 aa, Staphylococcus epidermidis
DIANWLISGIKPPHYSS

SEQ ID NO: 1803249 - protein, 32 aa, Staphylococcus epidermidis
DIASGNGGFGLWSNYKEEFWLEIDKLTSCGYT

SEQ ID NO: 1803250 - protein, 20 aa, Staphylococcus epidermidis
DIDDLFDMFIFKNERLKAKM

SEQ ID NO: 1803251 - protein, 23 aa, Staphylococcus epidermidis
DIDDLFDMFKFKNERLKAKMKEN

SEQ ID NO: 1803252 - protein, 17 aa, Staphylococcus epidermidis
DIDEFKSGIELSDGKLK

SEQ ID NO: 1803253 - protein, 18 aa, Staphylococcus epidermidis
DIDEYGYLFATLESNVDY

SEQ ID NO: 1803254 - protein, 25 aa, Staphylococcus epidermidis
DIDLRVDELLTMVGLNPEQFKNRQP

SEQ ID NO: 1803255 - protein, 18 aa, Staphylococcus epidermidis
DIDQCYFIIPQEKFDKEA

SEQ ID NO: 1803256 - protein, 18 aa, Staphylococcus epidermidis
DIDTWFKWNNFVGIIAVK

SEQ ID NO: 1803257 - protein, 17 aa, Staphylococcus epidermidis
DIEAFKQLVSYFEHTKV

SEQ ID NO: 1803258 - protein, 25 aa, Staphylococcus epidermidis
DIEELLARIRAILRRQPQKDVIDIN

SEQ ID NO: 1803259 - protein, 25 aa, Staphylococcus epidermidis
DIEKWSFQTEMFFLCNRYKQIRDLE

SEQ ID NO: 1803260 - protein, 23 aa, Staphylococcus epidermidis
DIETRVVQFYTDLNTDGRFLNVG

SEQ ID NO: 1803261 - protein, 17 aa, Staphylococcus epidermidis
DIFYLKEEDLLPLERMG

SEQ ID NO: 1803262 - protein, 24 aa, Staphylococcus epidermidis
DIGNMIIDGFILRDPGNYKDVIDI

SEQ ID NO: 1803263 - protein, 30 aa, Staphylococcus epidermidis
DIHSVYETWHGVLLYSRWPMLEQQTINILI

SEQ ID NO: 1803264 - protein, 25 aa, Staphylococcus epidermidis
DIHTFAPKYHKLSEAERNWLNQQKS

SEQ ID NO: 1803265 - protein, 24 aa, Staphylococcus epidermidis
DIIEINCHGGILTINRILELTMTY

SEQ ID NO: 1803266 - protein, 19 aa, Staphylococcus epidermidis
DIIELRIDQWPSFNKALLN

SEQ ID NO: 1803267 - protein, 28 aa, Staphylococcus epidermidis
DIIKEGIPAKARRKGGHPAKRVFQAIRI

SEQ ID NO: 1803268 - protein, 32 aa, Staphylococcus epidermidis
DIIKHLQVKSGPWLKDVLRQIELAIITQQMNN

SEQ ID NO: 1803269 - protein, 25 aa, Staphylococcus epidermidis
DIIKRHRLLELFLIEILQYNWEEVH

SEQ ID NO: 1803270 - protein, 23 aa, Staphylococcus epidermidis
DIIKSEVPDMVLVHGDTVTTFSG

SEQ ID NO: 1803271 - protein, 17 aa, Staphylococcus epidermidis
DIINEFERDISYLKNII

SEQ ID NO: 1803272 - protein, 23 aa, Staphylococcus epidermidis
DIISHGFKCCLNASTLTDSMLAH

SEQ ID NO: 1803273 - protein, 31 aa, Staphylococcus epidermidis
DIIVITFNYRLGALGFLDWSALDPQFDYNNG

SEQ ID NO: 1803274 - protein, 24 aa, Staphylococcus epidermidis
DIKELKTAVSQPIFNDIEWIIVSL

SEQ ID NO: 1803275 - protein, 24 aa, Staphylococcus epidermidis
DIKGLKIAFPKEYVSEGISEEVKD

SEQ ID NO: 1803276 - protein, 20 aa, Staphylococcus epidermidis
DIKPISALIMYGTKDKILET

SEQ ID NO: 1803277 - protein, 20 aa, Staphylococcus epidermidis
DIKPISALIMYGTNDKILET

SEQ ID NO: 1803278 - protein, 18 aa, Staphylococcus epidermidis
DIKRVIAHLPNFESDTDT

SEQ ID NO: 1803279 - protein, 25 aa, Staphylococcus epidermidis
DILHFRYITLDGYVGYSPLYALAHE

SEQ ID NO: 1803280 - protein, 24 aa, Staphylococcus epidermidis
DILKKRDSMNWNEITQGIDHISGK

SEQ ID NO: 1803281 - protein, 24 aa, Staphylococcus epidermidis
DILKKRYILKNVVEKIREMYDFDH

SEQ ID NO: 1803282 - protein, 27 aa, Staphylococcus epidermidis
DILNQELFELKGSYSDVGLSFKALSKL

SEQ ID NO: 1803283 - protein, 20 aa, Staphylococcus epidermidis
DILRQRLASGWKFEDAIEAP

SEQ ID NO: 1803284 - protein, 21 aa, Staphylococcus epidermidis
DILSIPYYVIYSMEGEIKDMS

SEQ ID NO: 1803285 - protein, 31 aa, Staphylococcus epidermidis
DILSNMLYERILKLESIELENIIDIRLNVGS

SEQ ID NO: 1803286 - protein, 31 aa, Staphylococcus epidermidis
DILVCKTPKAKGGIYSISDWVKASKYTDDTV

SEQ ID NO: 1803287 - protein, 24 aa, Staphylococcus epidermidis
DILVLRLGGEYTVKRVRRTETKLH

SEQ ID NO: 1803288 - protein, 21 aa, Staphylococcus epidermidis
DINALRVSLSFINDKSDIQIL

SEQ ID NO: 1803289 - protein, 25 aa, Staphylococcus epidermidis
DINKEMFKRQGGYGRGRRMQIEKDA

SEQ ID NO: 1803290 - protein, 25 aa, Staphylococcus epidermidis
DINLRVDELLTMVGLNPEQFKNRKP

SEQ ID NO: 1803291 - protein, 28 aa, Staphylococcus epidermidis
DINRLVHLKQRYNAILIIDASHSLGLNL

SEQ ID NO: 1803292 - protein, 25 aa, Staphylococcus epidermidis
DIPFVEAVKELGERVNIQVDIGNTQ

SEQ ID NO: 1803293 - protein, 25 aa, Staphylococcus epidermidis
DIQQGLGRTGTWSSVSHYNFTPDLI

SEQ ID NO: 1803294 - protein, 27 aa, Staphylococcus epidermidis
DIREPCWKIQAKYAIPNLVQKMSQSGK

SEQ ID NO: 1803295 - protein, 26 aa, Staphylococcus epidermidis
DIREPCWKIQAKYTIPNLVQKMSQSG

SEQ ID NO: 1803296 - protein, 19 aa, Staphylococcus epidermidis
DIRMREFVKDVAKYDEVYG

SEQ ID NO: 1803297 - protein, 20 aa, Staphylococcus epidermidis
DIRPNGKVIQLWHGTPIKRL

SEQ ID NO: 1803298 - protein, 18 aa, Staphylococcus epidermidis
DIRWLDAYIAIRDDDQLN

SEQ ID NO: 1803299 - protein, 18 aa, Staphylococcus epidermidis
DIRWLDAYLAIRDDDQLN

SEQ ID NO: 1803300 - protein, 19 aa, Staphylococcus epidermidis
DISEARASEKISFLNITSQ

SEQ ID NO: 1803301 - protein, 18 aa, Staphylococcus epidermidis
DISYIIKLFNYIIKNQIV

SEQ ID NO: 1803302 - protein, 18 aa, Staphylococcus epidermidis
DIVLFKPLSVDDMSMIVD

SEQ ID NO: 1803303 - protein, 20 aa, Staphylococcus epidermidis
DIYADRGISGKFMNRPELQR

SEQ ID NO: 1803304 - protein, 19 aa, Staphylococcus epidermidis
DIYDLVKLSKRCISKSIKL

SEQ ID NO: 1803305 - protein, 18 aa, Staphylococcus epidermidis
DIYLPFHMMNDIEKYLKW

SEQ ID NO: 1803306 - protein, 24 aa, Staphylococcus epidermidis
DIYPHLKGICDLKIEPFNSSYIMN

SEQ ID NO: 1803307 - protein, 22 aa, Staphylococcus epidermidis
DIYPLLNRSLLYSAIILHDLGK

SEQ ID NO: 1803308 - protein, 26 aa, Staphylococcus epidermidis
DIYRVYKYKFGITFPIHAKINVNGEH

SEQ ID NO: 1803309 - protein, 28 aa, Staphylococcus epidermidis
DIYSRPRGKFRFPIQVSENEYTQKNESY

SEQ ID NO: 1803310 - protein, 30 aa, Staphylococcus epidermidis
DIYVCGTSRATGSFVSSDWVKASKYTDDTV

SEQ ID NO: 1803311 - protein, 19 aa, Staphylococcus epidermidis
DKADILYIGFISTKGAIGE

SEQ ID NO: 1803312 - protein, 26 aa, Staphylococcus epidermidis
DKADISLKRSFPFISQLAKEFNVDIV

SEQ ID NO: 1803313 - protein, 18 aa, Staphylococcus epidermidis
DKAEPAIAKSFPKKSNGG

SEQ ID NO: 1803314 - protein, 24 aa, Staphylococcus epidermidis
DKDSEHYGLWAFKRVWGTYLSEKI

SEQ ID NO: 1803315 - protein, 28 aa, Staphylococcus epidermidis
DKDSEHYGLWSFKRVWGTYLSEKIGEFD

SEQ ID NO: 1803316 - protein, 26 aa, Staphylococcus epidermidis
DKDYANKIIKAFDMESYINKRVKKYS

SEQ ID NO: 1803317 - protein, 22 aa, Staphylococcus epidermidis
DKDYARVIAFIFKKLSEQSKDQ

SEQ ID NO: 1803318 - protein, 24 aa, Staphylococcus epidermidis
DKDYATISFLNWFLDEQVEEESTF

SEQ ID NO: 1803319 - protein, 22 aa, Staphylococcus epidermidis
DKEADLILFGHNHRLHMFDDKS

SEQ ID NO: 1803320 - protein, 27 aa, Staphylococcus epidermidis
DKEDFARYEVTEGWYSSIIDTNANFNG

SEQ ID NO: 1803321 - protein, 19 aa, Staphylococcus epidermidis
DKETLRYGENPQQSAYFVR

SEQ ID NO: 1803322 - protein, 25 aa, Staphylococcus epidermidis
DKFAKAAPLSAVFEAQRLIDLDWID

SEQ ID NO: 1803323 - protein, 22 aa, Staphylococcus epidermidis
DKFEVENIFDLALLTILKGHIA

SEQ ID NO: 1803324 - protein, 17 aa, Staphylococcus epidermidis
DKFKAQGGTLIYPSWKD

SEQ ID NO: 1803325 - protein, 20 aa, Staphylococcus epidermidis
DKFPFKLLIEKIREINVPKK

SEQ ID NO: 1803326 - protein, 21 aa, Staphylococcus epidermidis
DKGEIFPSFTVPVEHPGFKQL

SEQ ID NO: 1803327 - protein, 26 aa, Staphylococcus epidermidis
DKGIREVIESFKILKDKGYKVKLLIV

SEQ ID NO: 1803328 - protein, 20 aa, Staphylococcus epidermidis
DKGSHVFRRVDLEEILETEN

SEQ ID NO: 1803329 - protein, 22 aa, Staphylococcus epidermidis
DKGTWIINSGMNIQLKGESLKS

SEQ ID NO: 1803330 - protein, 17 aa, Staphylococcus epidermidis
DKGTWIVHSKMVIEPKG

SEQ ID NO: 1803331 - protein, 19 aa, Staphylococcus epidermidis
DKGTWLLHSEMAIQRKGED

SEQ ID NO: 1803332 - protein, 22 aa, Staphylococcus epidermidis
DKHLFVEGAYMYYLGSFIDSDS

SEQ ID NO: 1803333 - protein, 18 aa, Staphylococcus epidermidis
DKIKEMPLQPELTVNPEA

SEQ ID NO: 1803334 - protein, 27 aa, Staphylococcus epidermidis
DKIKIVEKWRKGLIVLSGQSGVGKTTF

SEQ ID NO: 1803335 - protein, 17 aa, Staphylococcus epidermidis
DKILPLFIQEFFNNKYI

SEQ ID NO: 1803336 - protein, 24 aa, Staphylococcus epidermidis
DKINFGDGVARFDLRKEGATHFHH

SEQ ID NO: 1803337 - protein, 17 aa, Staphylococcus epidermidis
DKIPMNIADDIKFHVVI

SEQ ID NO: 1803338 - protein, 21 aa, Staphylococcus epidermidis
DKIPPYFKQYMLQLANYDDDL

SEQ ID NO: 1803339 - protein, 21 aa, Staphylococcus epidermidis
DKIYGTHLWSGYPSGTIYSRP

SEQ ID NO: 1803340 - protein, 17 aa, Staphylococcus epidermidis
DKKRYSMTVMFDNKGNP

SEQ ID NO: 1803341 - protein, 17 aa, Staphylococcus epidermidis
DKLAEWHITLPNIIRLQ

SEQ ID NO: 1803342 - protein, 19 aa, Staphylococcus epidermidis
DKLERVYKLDITKYKSNPS

SEQ ID NO: 1803343 - protein, 24 aa, Staphylococcus epidermidis
DKLIELKLNYYLYNRFINKTWDFK

SEQ ID NO: 1803344 - protein, 19 aa, Staphylococcus epidermidis
DKLKCFFTDTMPRVNKKQE

SEQ ID NO: 1803345 - protein, 25 aa, Staphylococcus epidermidis
DKLKGRYSIVVLDDFGSVTLDNHQL

SEQ ID NO: 1803346 - protein, 17 aa, Staphylococcus epidermidis
DKLKNRIYYEPKTTSKS

SEQ ID NO: 1803347 - protein, 17 aa, Staphylococcus epidermidis
DKLKQLVEYGWLHTDNY

SEQ ID NO: 1803348 - protein, 24 aa, Staphylococcus epidermidis
DKLLRISTDIPIYVIQNYPRIRIQ

SEQ ID NO: 1803349 - protein, 30 aa, Staphylococcus epidermidis
DKLRLKADLIREFLDSVIPHLEEGTAIDDA

SEQ ID NO: 1803350 - protein, 17 aa, Staphylococcus epidermidis
DKLSLGDMQVFRFNFRH

SEQ ID NO: 1803351 - protein, 24 aa, Staphylococcus epidermidis
DKLTSCGYTVVFIGHTSVDKNTDQ

SEQ ID NO: 1803352 - protein, 22 aa, Staphylococcus epidermidis
DKMFDYSYLYFLLRDDAINTFM

SEQ ID NO: 1803353 - protein, 19 aa, Staphylococcus epidermidis
DKMQLEFTNDMSMKLLDKV

SEQ ID NO: 1803354 - protein, 20 aa, Staphylococcus epidermidis
DKMYRRFSILTTISQNQPVG

SEQ ID NO: 1803355 - protein, 28 aa, Staphylococcus epidermidis
DKNAVILAEKDYNAILETMYLQSNPANV

SEQ ID NO: 1803356 - protein, 26 aa, Staphylococcus epidermidis
DKNGCPKCRPAINYYLNMVYPFEHQD

SEQ ID NO: 1803357 - protein, 20 aa, Staphylococcus epidermidis
DKNIQYRIMNAIIKERISPD

SEQ ID NO: 1803358 - protein, 23 aa, Staphylococcus epidermidis
DKNIVFWSGWNKLTMYALIELVK

SEQ ID NO: 1803359 - protein, 22 aa, Staphylococcus epidermidis
DKNLKLYAAHVIKNKKGTPGTI

SEQ ID NO: 1803360 - protein, 17 aa, Staphylococcus epidermidis
DKPFIIGGDGVKLLTSK

SEQ ID NO: 1803361 - protein, 21 aa, Staphylococcus epidermidis
DKPGLLASVLNTFALFNINLS

SEQ ID NO: 1803362 - protein, 23 aa, Staphylococcus epidermidis
DKPSFLSCGIQSYLENVSPSLDS

SEQ ID NO: 1803363 - protein, 18 aa, Staphylococcus epidermidis
DKPTPFLFGEDFSFYGQQ

SEQ ID NO: 1803364 - protein, 20 aa, Staphylococcus epidermidis
DKQHVSAMCSGVLTKENKEE

SEQ ID NO: 1803365 - protein, 29 aa, Staphylococcus epidermidis
DKQICHCFGCKKGGNVFQFTQEIKDIPFV

SEQ ID NO: 1803366 - protein, 17 aa, Staphylococcus epidermidis
DKQWKITHEDWRNREKW

SEQ ID NO: 1803367 - protein, 18 aa, Staphylococcus epidermidis
DKRIYDLQLSRQIAIQTA

SEQ ID NO: 1803368 - protein, 18 aa, Staphylococcus epidermidis
DKRRGRPTISKKWDQTTA

SEQ ID NO: 1803369 - protein, 20 aa, Staphylococcus epidermidis
DKRSASIYVAFDVKDDKGVV

SEQ ID NO: 1803370 - protein, 21 aa, Staphylococcus epidermidis
DKSDIKFVMFDNMPLEEFYEG

SEQ ID NO: 1803371 - protein, 20 aa, Staphylococcus epidermidis
DKSIALAIIDRDAFEMGKEV

SEQ ID NO: 1803372 - protein, 21 aa, Staphylococcus epidermidis
DKSNVRYVIHYNMPGDIESYY

SEQ ID NO: 1803373 - protein, 19 aa, Staphylococcus epidermidis
DKSSFATCYMKNPDKNYVD

SEQ ID NO: 1803374 - protein, 20 aa, Staphylococcus epidermidis
DKTRIIGVYRHYKSGGHAQS

SEQ ID NO: 1803375 - protein, 24 aa, Staphylococcus epidermidis
DKTVKRKYTALVHGNIPHDYGTVD

SEQ ID NO: 1803376 - protein, 17 aa, Staphylococcus epidermidis
DKVGLIIEGRLFALDTP

SEQ ID NO: 1803377 - protein, 23 aa, Staphylococcus epidermidis
DKVKYVGALFLGHFSPEVIGDYV

SEQ ID NO: 1803378 - protein, 19 aa, Staphylococcus epidermidis
DKVLPLTIVIIGEQLDVNR

SEQ ID NO: 1803379 - protein, 25 aa, Staphylococcus epidermidis
DKVRPEGKAFYRLKVMVNSEDTIAP

SEQ ID NO: 1803380 - protein, 19 aa, Staphylococcus epidermidis
DKVRPEGKSFYRLNVRINS

SEQ ID NO: 1803381 - protein, 25 aa, Staphylococcus epidermidis
DKVYRGGYLYDYRKQNQFSRNILTL

SEQ ID NO: 1803382 - protein, 23 aa, Staphylococcus epidermidis
DKYDEVMRFGKYHPDYKDIMLET

SEQ ID NO: 1803383 - protein, 17 aa, Staphylococcus epidermidis
DKYGRSLAYVYADGEML

SEQ ID NO: 1803384 - protein, 17 aa, Staphylococcus epidermidis
DKYKVMEILNDYAKEQA

SEQ ID NO: 1803385 - protein, 20 aa, Staphylococcus epidermidis
DKYYLYTIDGWKMCSVIPLA

SEQ ID NO: 1803386 - protein, 24 aa, Staphylococcus epidermidis
DLARAIRYRTRIVTLEGDVVNPGG

SEQ ID NO: 1803387 - protein, 24 aa, Staphylococcus epidermidis
DLDMTQKFFIAILIDLSDENQKII

SEQ ID NO: 1803388 - protein, 23 aa, Staphylococcus epidermidis
DLDRIFKIERILMDYLGELPYSL

SEQ ID NO: 1803389 - protein, 19 aa, Staphylococcus epidermidis
DLEAICMSNTDAIIIGGTD

SEQ ID NO: 1803390 - protein, 28 aa, Staphylococcus epidermidis
DLEENRTLPIFGKYVFSTAAGIHQQGIL

SEQ ID NO: 1803391 - protein, 21 aa, Staphylococcus epidermidis
DLEGSISLPHIYGEVKRSKMI

SEQ ID NO: 1803392 - protein, 20 aa, Staphylococcus epidermidis
DLEMTFFYELIFGEETDFYQ

SEQ ID NO: 1803393 - protein, 23 aa, Staphylococcus epidermidis
DLESEMRLEYGFVGTNLKVGRYR

SEQ ID NO: 1803394 - protein, 24 aa, Staphylococcus epidermidis
DLESSWRRLHIVDAVKEATGVNFY

SEQ ID NO: 1803395 - protein, 21 aa, Staphylococcus epidermidis
DLEVGSGSFIPGFEEQLEGMK

SEQ ID NO: 1803396 - protein, 19 aa, Staphylococcus epidermidis
DLFHSFKNAAQYGVTTCGK

SEQ ID NO: 1803397 - protein, 26 aa, Staphylococcus epidermidis
DLFKRCPYHFKLRYIDRLTELPNYEA

SEQ ID NO: 1803398 - protein, 18 aa, Staphylococcus epidermidis
DLFQFLVKIKDIYKTKLG

SEQ ID NO: 1803399 - protein, 17 aa, Staphylococcus epidermidis
DLGIKYLTLYAFSTENW

SEQ ID NO: 1803400 - protein, 25 aa, Staphylococcus epidermidis
DLGSSEMNLDMAIEMYEGQYEIVKI

SEQ ID NO: 1803401 - protein, 24 aa, Staphylococcus epidermidis
DLHVSGIVTFGHLLARAVGRDVGR

SEQ ID NO: 1803402 - protein, 19 aa, Staphylococcus epidermidis
DLICTASVNSFRGMNTPQL

SEQ ID NO: 1803403 - protein, 26 aa, Staphylococcus epidermidis
DLIEEVARIYGYDEIPSTLPVFKDVT

SEQ ID NO: 1803404 - protein, 24 aa, Staphylococcus epidermidis
DLIEEVARIYGYDNIPSTLPVFDD

SEQ ID NO: 1803405 - protein, 20 aa, Staphylococcus epidermidis
DLIGKRLQYPGAPGSGGIAI

SEQ ID NO: 1803406 - protein, 17 aa, Staphylococcus epidermidis
DLIKEIYLLFETIQKKH

SEQ ID NO: 1803407 - protein, 26 aa, Staphylococcus epidermidis
DLIKKSETIFIYGYGASFVVATDLYQ

SEQ ID NO: 1803408 - protein, 17 aa, Staphylococcus epidermidis
DLISLKAAYQKFGGGPV

SEQ ID NO: 1803409 - protein, 21 aa, Staphylococcus epidermidis
DLKVPYICLNGAEVRDESFNI

SEQ ID NO: 1803410 - protein, 22 aa, Staphylococcus epidermidis
DLKVPYICLNGAEVREESFNIM

SEQ ID NO: 1803411 - protein, 27 aa, Staphylococcus epidermidis
DLLAKRLKQEYGLKFEPCATKYLKISG

SEQ ID NO: 1803412 - protein, 17 aa, Staphylococcus epidermidis
DLLEYLCRKHNEIFESL

SEQ ID NO: 1803413 - protein, 21 aa, Staphylococcus epidermidis
DLLIMAGTNYPYVDYLPKKNI

SEQ ID NO: 1803414 - protein, 19 aa, Staphylococcus epidermidis
DLLIVLRNFMEGHRQSVEG

SEQ ID NO: 1803415 - protein, 20 aa, Staphylococcus epidermidis
DLLLKKKLVSGDAVYITDLC

SEQ ID NO: 1803416 - protein, 20 aa, Staphylococcus epidermidis
DLLNASWKKGNYVRKRIDPW

SEQ ID NO: 1803417 - protein, 26 aa, Staphylococcus epidermidis
DLLPVIPEFADYTLIGGNGSIISKNG

SEQ ID NO: 1803418 - protein, 36 aa, Staphylococcus epidermidis
DLLRIKGIGLYKAITLKAAFELGERLNATSTIDKVK

SEQ ID NO: 1803419 - protein, 24 aa, Staphylococcus epidermidis
DLLSQRLDADFSKLSNKIEENYNL

SEQ ID NO: 1803420 - protein, 24 aa, Staphylococcus epidermidis
DLNITVPVAIHLDHGSSFEKCKEA

SEQ ID NO: 1803421 - protein, 19 aa, Staphylococcus epidermidis
DLNVLKSRIAQRNRSFESH

SEQ ID NO: 1803422 - protein, 25 aa, Staphylococcus epidermidis
DLNWFIPDFTKSVVFKINEDDPTIL

SEQ ID NO: 1803423 - protein, 18 aa, Staphylococcus epidermidis
DLNWPKDTEFVYSPFMVE

SEQ ID NO: 1803424 - protein, 18 aa, Staphylococcus epidermidis
DLPGALSKKECHYMTEGS

SEQ ID NO: 1803425 - protein, 17 aa, Staphylococcus epidermidis
DLPHGQIQFVITVGEES

SEQ ID NO: 1803426 - protein, 24 aa, Staphylococcus epidermidis
DLPLEGRMGFGIHFAMDYLTEQTQ

SEQ ID NO: 1803427 - protein, 22 aa, Staphylococcus epidermidis
DLPSKAKLLYSLLTERQNLSKL

SEQ ID NO: 1803428 - protein, 18 aa, Staphylococcus epidermidis
DLQLWLKEVNDIKDTINP

SEQ ID NO: 1803429 - protein, 21 aa, Staphylococcus epidermidis
DLRGKELFKSLIKEIDIIKSR

SEQ ID NO: 1803430 - protein, 28 aa, Staphylococcus epidermidis
DLRKLDQLICNWLNIVDDILPQLIEEMH

SEQ ID NO: 1803431 - protein, 20 aa, Staphylococcus epidermidis
DLSPKFVVGYVETKEKHPDA

SEQ ID NO: 1803432 - protein, 26 aa, Staphylococcus epidermidis
DLSQFGYMWECPDYFELDGHDVILFC

SEQ ID NO: 1803433 - protein, 24 aa, Staphylococcus epidermidis
DLSRLARRGSGSASRSIFGGFAEW

SEQ ID NO: 1803434 - protein, 18 aa, Staphylococcus epidermidis
DLTELVLTLGSQMVVLAE

SEQ ID NO: 1803435 - protein, 24 aa, Staphylococcus epidermidis
DLTGRENLTFFARIYMRDKEDIKK

SEQ ID NO: 1803436 - protein, 18 aa, Staphylococcus epidermidis
DLTSLRKSIIRWCELILS

SEQ ID NO: 1803437 - protein, 18 aa, Staphylococcus epidermidis
DLVDVAVRLVKEEKKALV

SEQ ID NO: 1803438 - protein, 17 aa, Staphylococcus epidermidis
DLVIAIYYKEILKLLFQ

SEQ ID NO: 1803439 - protein, 21 aa, Staphylococcus epidermidis
DLVLECTGLFASKEKSQSHID

SEQ ID NO: 1803440 - protein, 28 aa, Staphylococcus epidermidis
DLYLDTATGVAYRFLKKGTTSPTYYWSP

SEQ ID NO: 1803441 - protein, 20 aa, Staphylococcus epidermidis
DMEEELKILLIPKDPNDEKD

SEQ ID NO: 1803442 - protein, 17 aa, Staphylococcus epidermidis
DMEFPKGKWTEIEPPEG

SEQ ID NO: 1803443 - protein, 23 aa, Staphylococcus epidermidis
DMEKDLPGPLLFDSSEVINNIKN

SEQ ID NO: 1803444 - protein, 19 aa, Staphylococcus epidermidis
DMGRVELREAIPVTVTLDY

SEQ ID NO: 1803445 - protein, 23 aa, Staphylococcus epidermidis
DMIKQMRSGSVIVDIAIDQGGIF

SEQ ID NO: 1803446 - protein, 23 aa, Staphylococcus epidermidis
DMLNRAKKSLGWENRNITFHSFK

SEQ ID NO: 1803447 - protein, 24 aa, Staphylococcus epidermidis
DMMSNPTIDCWSEIIFESQRKTKK

SEQ ID NO: 1803448 - protein, 24 aa, Staphylococcus epidermidis
DMQQLAPRVAYLAQIVQDVIHSFG

SEQ ID NO: 1803449 - protein, 24 aa, Staphylococcus epidermidis
DMRVGLEVLDSVKIDYKLVDNWKQ

SEQ ID NO: 1803450 - protein, 19 aa, Staphylococcus epidermidis
DMSFFNPGEMCIVGCSTSE

SEQ ID NO: 1803451 - protein, 17 aa, Staphylococcus epidermidis
DMSISFSSAEGLLVGSI

SEQ ID NO: 1803452 - protein, 22 aa, Staphylococcus epidermidis
DMYLKQGYTFLGYRYQILKENI

SEQ ID NO: 1803453 - protein, 24 aa, Staphylococcus epidermidis
DNAARIMAYLTKFWKINYKNEMPG

SEQ ID NO: 1803454 - protein, 22 aa, Staphylococcus epidermidis
DNAKELLLKGLEKLEYRGYDSA

SEQ ID NO: 1803455 - protein, 20 aa, Staphylococcus epidermidis
DNALETLAFSSVHYDEEKAL

SEQ ID NO: 1803456 - protein, 21 aa, Staphylococcus epidermidis
DNALWDSMRSCFAEDSRVNIS

SEQ ID NO: 1803457 - protein, 17 aa, Staphylococcus epidermidis
DNARTPMQWNNSINGGF

SEQ ID NO: 1803458 - protein, 23 aa, Staphylococcus epidermidis
DNDEVLEYYGLKVLVDKYDAPVL

SEQ ID NO: 1803459 - protein, 24 aa, Staphylococcus epidermidis
DNDRAMFEFGHYTVAMKNARQEIK

SEQ ID NO: 1803460 - protein, 25 aa, Staphylococcus epidermidis
DNEEKYLRLYAEFENYKRRIQNENQ

SEQ ID NO: 1803461 - protein, 22 aa, Staphylococcus epidermidis
DNGEHRYLFTGDFLCYEGDEWR

SEQ ID NO: 1803462 - protein, 24 aa, Staphylococcus epidermidis
DNGILKGKHNNLWQSDKLIAAQIP

SEQ ID NO: 1803463 - protein, 18 aa, Staphylococcus epidermidis
DNGRLFSIYSNDELMQKM

SEQ ID NO: 1803464 - protein, 19 aa, Staphylococcus epidermidis
DNHIEGVDYIFCTFDTDKY

SEQ ID NO: 1803465 - protein, 22 aa, Staphylococcus epidermidis
DNIKNPLLHIGFTSGTTGLPKA

SEQ ID NO: 1803466 - protein, 21 aa, Staphylococcus epidermidis
DNKGYIAIKGKSDYRSLNEEF

SEQ ID NO: 1803467 - protein, 28 aa, Staphylococcus epidermidis
DNKLLDFFIIDILNKLYLPSLNKRINHK

SEQ ID NO: 1803468 - protein, 23 aa, Staphylococcus epidermidis
DNKPSTSFWALLRTFEQILNNTL

SEQ ID NO: 1803469 - protein, 22 aa, Staphylococcus epidermidis
DNKVKVIAWYDNEWGYSNRVVE

SEQ ID NO: 1803470 - protein, 23 aa, Staphylococcus epidermidis
DNLERFLKYYLLYSEYNNYSIKT

SEQ ID NO: 1803471 - protein, 21 aa, Staphylococcus epidermidis
DNLKFPMAVINEVVKAKKEYA

SEQ ID NO: 1803472 - protein, 19 aa, Staphylococcus epidermidis
DNLKTFGVEKIFTEKQSGK

SEQ ID NO: 1803473 - protein, 17 aa, Staphylococcus epidermidis
DNLMLYHQQHWLAKLNH

SEQ ID NO: 1803474 - protein, 24 aa, Staphylococcus epidermidis
DNLNLTINEYFKFLLKTYPSDQTQ

SEQ ID NO: 1803475 - protein, 24 aa, Staphylococcus epidermidis
DNLPTEINSMFGLESGHINISMSA

SEQ ID NO: 1803476 - protein, 22 aa, Staphylococcus epidermidis
DNMKKYQWADLQPYYHQVLSIK

SEQ ID NO: 1803477 - protein, 28 aa, Staphylococcus epidermidis
DNMPDKLCLYYHIGQCMGPCVYDVDLEK

SEQ ID NO: 1803478 - protein, 28 aa, Staphylococcus epidermidis
DNMPDKLCLYYHIGQCMGPCVYDVDLNV

SEQ ID NO: 1803479 - protein, 24 aa, Staphylococcus epidermidis
DNNDRPLALCAALLHDLGHGPFSH

SEQ ID NO: 1803480 - protein, 23 aa, Staphylococcus epidermidis
DNNLKYRAEFMAKRMNLPETDLT

SEQ ID NO: 1803481 - protein, 19 aa, Staphylococcus epidermidis
DNNLLIKLIEYFENKPILG

SEQ ID NO: 1803482 - protein, 22 aa, Staphylococcus epidermidis
DNNMKDLARMSVGQVLNEHDID

SEQ ID NO: 1803483 - protein, 18 aa, Staphylococcus epidermidis
DNPFDLTKVWYKGDYPLI

SEQ ID NO: 1803484 - protein, 23 aa, Staphylococcus epidermidis
DNPMKQKVCDVATMAFENAMTKV

SEQ ID NO: 1803485 - protein, 23 aa, Staphylococcus epidermidis
DNQEVPRKLFLLSPLLDATLTNP

SEQ ID NO: 1803486 - protein, 26 aa, Staphylococcus epidermidis
DNQFFKCYFDRHLLQSSGFVKNIILQ

SEQ ID NO: 1803487 - protein, 22 aa, Staphylococcus epidermidis
DNRFISIMAGLSIDYIREQLNT

SEQ ID NO: 1803488 - protein, 28 aa, Staphylococcus epidermidis
DNRQIAELCYFIWRDMELDITKEITKDR

SEQ ID NO: 1803489 - protein, 29 aa, Staphylococcus epidermidis
DNRQIAELCYFIWRDMELDITKEITKDRI

SEQ ID NO: 1803490 - protein, 25 aa, Staphylococcus epidermidis
DNRYGCALAIDVLNRLKDENIDINL

SEQ ID NO: 1803491 - protein, 26 aa, Staphylococcus epidermidis
DNSFEHLLFGLGIRHLGVKASQVLAE

SEQ ID NO: 1803492 - protein, 18 aa, Staphylococcus epidermidis
DNSFQDFVIDYNGDTKVM

SEQ ID NO: 1803493 - protein, 23 aa, Staphylococcus epidermidis
DNTYKEHIGVVFDDLRVPNKLTL

SEQ ID NO: 1803494 - protein, 18 aa, Staphylococcus epidermidis
DNTYVAGYKVSMTSKTTQ

SEQ ID NO: 1803495 - protein, 18 aa, Staphylococcus epidermidis
DNVIKKFVEESAKAGVDV

SEQ ID NO: 1803496 - protein, 22 aa, Staphylococcus epidermidis
DNVKRALIPLRGYHLKGKRDRM

SEQ ID NO: 1803497 - protein, 17 aa, Staphylococcus epidermidis
DNVWIGGNVTVLPGITI

SEQ ID NO: 1803498 - protein, 24 aa, Staphylococcus epidermidis
DNYFHIFHKITFYYESGRLTLNDT

SEQ ID NO: 1803499 - protein, 17 aa, Staphylococcus epidermidis
DNYKWLQILPEKKRYSI

SEQ ID NO: 1803500 - protein, 32 aa, Staphylococcus epidermidis
DPEAALKICNDCFKHGVVIIAVAGNVLRFQPP

SEQ ID NO: 1803501 - protein, 24 aa, Staphylococcus epidermidis
DPETKAVVMIGEIGGTAEEEAAQW

SEQ ID NO: 1803502 - protein, 25 aa, Staphylococcus epidermidis
DPFAKLAYMILCNNFSYRVNETAAR

SEQ ID NO: 1803503 - protein, 21 aa, Staphylococcus epidermidis
DPFAPPSKMRVIMDRNTTGIP

SEQ ID NO: 1803504 - protein, 19 aa, Staphylococcus epidermidis
DPFIKVMVYDDRFNNKTSE

SEQ ID NO: 1803505 - protein, 24 aa, Staphylococcus epidermidis
DPFTKIQLWLPIKQEIYDLDEDYQ

SEQ ID NO: 1803506 - protein, 22 aa, Staphylococcus epidermidis
DPFTKIQLWLPIKQEVYDLEEL

SEQ ID NO: 1803507 - protein, 26 aa, Staphylococcus epidermidis
DPHNLPWKSLEIDLVLECTGLFASKE

SEQ ID NO: 1803508 - protein, 17 aa, Staphylococcus epidermidis
DPIKAILLNIKSDDFDT

SEQ ID NO: 1803509 - protein, 17 aa, Staphylococcus epidermidis
DPIPEMYYLDVASPGAE

SEQ ID NO: 1803510 - protein, 22 aa, Staphylococcus epidermidis
DPKLKEIFNIVLTSQKKAIEEI

SEQ ID NO: 1803511 - protein, 19 aa, Staphylococcus epidermidis
DPLKLIISYDGFKGYEVQQ

SEQ ID NO: 1803512 - protein, 22 aa, Staphylococcus epidermidis
DPLKYNLLFERFLNPERVTMPD

SEQ ID NO: 1803513 - protein, 25 aa, Staphylococcus epidermidis
DPLTNKWRRVSVVLNKNGKQSQKEA

SEQ ID NO: 1803514 - protein, 24 aa, Staphylococcus epidermidis
DPLWSRLTKFVIFPSIIPNSKQII

SEQ ID NO: 1803515 - protein, 19 aa, Staphylococcus epidermidis
DPNKVIELLNFMARSPQYS

SEQ ID NO: 1803516 - protein, 21 aa, Staphylococcus epidermidis
DPPLSRVGLIASEAKLQGYDI

SEQ ID NO: 1803517 - protein, 18 aa, Staphylococcus epidermidis
DPSAASFAERVIMLKDGD

SEQ ID NO: 1803518 - protein, 26 aa, Staphylococcus epidermidis
DPSELKMRIIDCLETAHTRLKLLSKE

SEQ ID NO: 1803519 - protein, 19 aa, Staphylococcus epidermidis
DPTLPLIVTTIQKMANAVK

SEQ ID NO: 1803520 - protein, 24 aa, Staphylococcus epidermidis
DPVLSRVSVHLANFLEIPFDVYPQ

SEQ ID NO: 1803521 - protein, 19 aa, Staphylococcus epidermidis
DPVQLGIEVSQVLKKQGAY

SEQ ID NO: 1803522 - protein, 20 aa, Staphylococcus epidermidis
DPYFILRFIQKSIIKAIDIA

SEQ ID NO: 1803523 - protein, 23 aa, Staphylococcus epidermidis
DPYRGVISSIRIIDGVVKAGDKI

SEQ ID NO: 1803524 - protein, 43 aa, Staphylococcus epidermidis
DQAIKFGKSKIWLGVWEHNPKALSFYKNRGFRVTGSHQFYTGS

SEQ ID NO: 1803525 - protein, 18 aa, Staphylococcus epidermidis
DQATLFAGCGIVKNSDPD

SEQ ID NO: 1803526 - protein, 23 aa, Staphylococcus epidermidis
DQEILKTLGSIWLNSNIATHNFI

SEQ ID NO: 1803527 - protein, 24 aa, Staphylococcus epidermidis
DQFELYRKYILQLHGQSEPRAFLN

SEQ ID NO: 1803528 - protein, 36 aa, Staphylococcus epidermidis
DQFRDIIKRMYFFSIANPNPFEWLNQLSHPYRDEEQ

SEQ ID NO: 1803529 - protein, 17 aa, Staphylococcus epidermidis
DQFSRMGRKSHQLTEEH

SEQ ID NO: 1803530 - protein, 32 aa, Staphylococcus epidermidis
DQIKIGATVLAGFGPRIVRINNFSLDFKPNQY

SEQ ID NO: 1803531 - protein, 25 aa, Staphylococcus epidermidis
DQILKEIISRLSFLNNVGLEYLTLD

SEQ ID NO: 1803532 - protein, 17 aa, Staphylococcus epidermidis
DQKHKKISVPELTPERK

SEQ ID NO: 1803533 - protein, 22 aa, Staphylococcus epidermidis
DQLDITLKVGRLAEVLEGAQRP

SEQ ID NO: 1803534 - protein, 17 aa, Staphylococcus epidermidis
DQLIEWIESTYPDVEIE

SEQ ID NO: 1803535 - protein, 20 aa, Staphylococcus epidermidis
DQLKAMGIEAAYLNSSLTQK

SEQ ID NO: 1803536 - protein, 21 aa, Staphylococcus epidermidis
DQLMLRKAMVQLIELNEEMKV

SEQ ID NO: 1803537 - protein, 17 aa, Staphylococcus epidermidis
DQLRLKGFYQDNNRKAE

SEQ ID NO: 1803538 - protein, 22 aa, Staphylococcus epidermidis
DQLTKVNIFFGRNGSGKSSLSE

SEQ ID NO: 1803539 - protein, 17 aa, Staphylococcus epidermidis
DQMPYSHFTQMEGNYEL

SEQ ID NO: 1803540 - protein, 18 aa, Staphylococcus epidermidis
DQPDAWVVAGRGELHLSI

SEQ ID NO: 1803541 - protein, 17 aa, Staphylococcus epidermidis
DQPRRVSTWGDDQQFWY

SEQ ID NO: 1803542 - protein, 25 aa, Staphylococcus epidermidis
DQQLRLKADLIRSFLDKVVPSLKED

SEQ ID NO: 1803543 - protein, 25 aa, Staphylococcus epidermidis
DQRREMIRQAAFRLVENIKHDIKPR

SEQ ID NO: 1803544 - protein, 23 aa, Staphylococcus epidermidis
DQSVFHLHFHLIPRYENDIDGFG

SEQ ID NO: 1803545 - protein, 24 aa, Staphylococcus epidermidis
DQVALWLKDVRDIDIYPNHASIQA

SEQ ID NO: 1803546 - protein, 18 aa, Staphylococcus epidermidis
DQVHVMYGGKVVKSGGPE

SEQ ID NO: 1803547 - protein, 19 aa, Staphylococcus epidermidis
DQYYLYLYDWRVIESESNE

SEQ ID NO: 1803548 - protein, 23 aa, Staphylococcus epidermidis
DRAAKVSGARFVYLTNEGAHLER

SEQ ID NO: 1803549 - protein, 33 aa, Staphylococcus epidermidis
DRAELLLRVAAIIRRRKEEISAVMVYEAGKPWD

SEQ ID NO: 1803550 - protein, 25 aa, Staphylococcus epidermidis
DRARLKDIIEIFLDSGLGKEAFSII

SEQ ID NO: 1803551 - protein, 19 aa, Staphylococcus epidermidis
DRDAFEMGKEVLVQVRKRQ

SEQ ID NO: 1803552 - protein, 21 aa, Staphylococcus epidermidis
DRDIPRFVNLYNQGRLNIDSL

SEQ ID NO: 1803553 - protein, 23 aa, Staphylococcus epidermidis
DREHPLHWISIQCNFNNNMFAGN

SEQ ID NO: 1803554 - protein, 18 aa, Staphylococcus epidermidis
DRERSLKALDNFARVYAV

SEQ ID NO: 1803555 - protein, 17 aa, Staphylococcus epidermidis
DRFELSIQNEWVDKNNN

SEQ ID NO: 1803556 - protein, 20 aa, Staphylococcus epidermidis
DRFFKKGNLQFVILKMLKEE

SEQ ID NO: 1803557 - protein, 19 aa, Staphylococcus epidermidis
DRFIYIGRFVKEKQLDHLI

SEQ ID NO: 1803558 - protein, 18 aa, Staphylococcus epidermidis
DRIEAVRPSFFIMSNPHN

SEQ ID NO: 1803559 - protein, 24 aa, Staphylococcus epidermidis
DRIKIRYLMCPCKIKHDEERFNSQ

SEQ ID NO: 1803560 - protein, 24 aa, Staphylococcus epidermidis
DRIKQTRVKLYFKLIHNDSISYPS

SEQ ID NO: 1803561 - protein, 17 aa, Staphylococcus epidermidis
DRITGRMLPGTKLQSGL

SEQ ID NO: 1803562 - protein, 18 aa, Staphylococcus epidermidis
DRITPPCMYYYKCGGCQL

SEQ ID NO: 1803563 - protein, 17 aa, Staphylococcus epidermidis
DRKGYEWVIQSTKKAEV

SEQ ID NO: 1803564 - protein, 25 aa, Staphylococcus epidermidis
DRKHLKHIRYQISYFDKTPRDVEDD

SEQ ID NO: 1803565 - protein, 24 aa, Staphylococcus epidermidis
DRKNIPFDELVLFSSARSAGKKVE

SEQ ID NO: 1803566 - protein, 17 aa, Staphylococcus epidermidis
DRLCGVGIPGELCIGGV

SEQ ID NO: 1803567 - protein, 18 aa, Staphylococcus epidermidis
DRLGWIEGVNNWNFTLFI

SEQ ID NO: 1803568 - protein, 24 aa, Staphylococcus epidermidis
DRLKAKMKEAFVEKAVAINDISEK

SEQ ID NO: 1803569 - protein, 19 aa, Staphylococcus epidermidis
DRLKMDHIDFNAAGENLAY

SEQ ID NO: 1803570 - protein, 26 aa, Staphylococcus epidermidis
DRLKRKLRNYGCVFMKTEEVFDLPKQ

SEQ ID NO: 1803571 - protein, 18 aa, Staphylococcus epidermidis
DRLNLKWGPNWEDDLAGG

SEQ ID NO: 1803572 - protein, 20 aa, Staphylococcus epidermidis
DRLVKGCTGVKRTTGQHPGG

SEQ ID NO: 1803573 - protein, 23 aa, Staphylococcus epidermidis
DRNHLSYRDKFFLNKIAYEHQRR

SEQ ID NO: 1803574 - protein, 19 aa, Staphylococcus epidermidis
DRNKILFSKSFKEIEEFIK

SEQ ID NO: 1803575 - protein, 22 aa, Staphylococcus epidermidis
DRPIGRCWLVQASKLKWIFKFE

SEQ ID NO: 1803576 - protein, 18 aa, Staphylococcus epidermidis
DRPVVKVGISNEADTEII

SEQ ID NO: 1803577 - protein, 24 aa, Staphylococcus epidermidis
DRQFGRYNGGGVHHGRDITSATIN

SEQ ID NO: 1803578 - protein, 23 aa, Staphylococcus epidermidis
DRRFKIPELHISKSELNQLLERQ

SEQ ID NO: 1803579 - protein, 21 aa, Staphylococcus epidermidis
DRSAAYAARYVAKNIVAAELA

SEQ ID NO: 1803580 - protein, 22 aa, Staphylococcus epidermidis
DRSAAYAARYVAKNIVAAGLAK

SEQ ID NO: 1803581 - protein, 24 aa, Staphylococcus epidermidis
DRSEQFFKTLGFEINKNPDMLDKM

SEQ ID NO: 1803582 - protein, 21 aa, Staphylococcus epidermidis
DRTMLELLYATGMRVSEIIQL

SEQ ID NO: 1803583 - protein, 17 aa, Staphylococcus epidermidis
DRTRASLKIQEGCNNFC

SEQ ID NO: 1803584 - protein, 24 aa, Staphylococcus epidermidis
DRVAIKWPNDIYIGNKKICGFLTE

SEQ ID NO: 1803585 - protein, 18 aa, Staphylococcus epidermidis
DRYFPEWHETYSKVSELN

SEQ ID NO: 1803586 - protein, 29 aa, Staphylococcus epidermidis
DSAKIAYCMFRDRFELSKMNNWIDDNGNV

SEQ ID NO: 1803587 - protein, 19 aa, Staphylococcus epidermidis
DSALNLIKGGGGALFREKV

SEQ ID NO: 1803588 - protein, 22 aa, Staphylococcus epidermidis
DSAMQLRDRYVLKRDDDTDLYI

SEQ ID NO: 1803589 - protein, 23 aa, Staphylococcus epidermidis
DSAMQLRDSYVLKRDDDTDLYLN

SEQ ID NO: 1803590 - protein, 22 aa, Staphylococcus epidermidis
DSATVTHWFINFYHLIMEERFG

SEQ ID NO: 1803591 - protein, 19 aa, Staphylococcus epidermidis
DSAVFKIELYDNGRKIDIK

SEQ ID NO: 1803592 - protein, 22 aa, Staphylococcus epidermidis
DSDARGAFFGLTRGTEKEHFIR

SEQ ID NO: 1803593 - protein, 25 aa, Staphylococcus epidermidis
DSDKAMAKYDIADMKNLNDAQKQAI

SEQ ID NO: 1803594 - protein, 22 aa, Staphylococcus epidermidis
DSERYIPVLAIAIGKKAQEAHS

SEQ ID NO: 1803595 - protein, 23 aa, Staphylococcus epidermidis
DSESFPMHIFRKYAKDVFEDDQL

SEQ ID NO: 1803596 - protein, 34 aa, Staphylococcus epidermidis
DSEVKCITPADIIASMSYFFNLLNGIGYTDDIDH

SEQ ID NO: 1803597 - protein, 25 aa, Staphylococcus epidermidis
DSFLKPLRLRKETILTRWTKELFSY

SEQ ID NO: 1803598 - protein, 21 aa, Staphylococcus epidermidis
DSGKYLFHRKSMLKFLNDYAE

SEQ ID NO: 1803599 - protein, 21 aa, Staphylococcus epidermidis
DSGRMNLVYNEHVETVEVPIK

SEQ ID NO: 1803600 - protein, 18 aa, Staphylococcus epidermidis
DSIAKLRLPVNVVGIIAS

SEQ ID NO: 1803601 - protein, 18 aa, Staphylococcus epidermidis
DSIDLKVKHIYKDTEPPI

SEQ ID NO: 1803602 - protein, 25 aa, Staphylococcus epidermidis
DSIVSRWEKGVSIPSAKRLKEIADI

SEQ ID NO: 1803603 - protein, 20 aa, Staphylococcus epidermidis
DSKGSFPQEVNFFIKDETGI

SEQ ID NO: 1803604 - protein, 22 aa, Staphylococcus epidermidis
DSKPDWEIFQLIANRLGANWEY

SEQ ID NO: 1803605 - protein, 25 aa, Staphylococcus epidermidis
DSKSISFGLGYQIKQIVELVLLQSK

SEQ ID NO: 1803606 - protein, 23 aa, Staphylococcus epidermidis
DSLKDIKKVYSIAPAISQTTNYI

SEQ ID NO: 1803607 - protein, 28 aa, Staphylococcus epidermidis
DSNIPKGRGFVKWLAFKTIPEQYQQIEQ

SEQ ID NO: 1803608 - protein, 22 aa, Staphylococcus epidermidis
DSNLIRSVKWTDIIFKNVSFKN

SEQ ID NO: 1803609 - protein, 21 aa, Staphylococcus epidermidis
DSNLKGCIFGMSLQTTHEEIY

SEQ ID NO: 1803610 - protein, 25 aa, Staphylococcus epidermidis
DSNRGGCCQSCRWDYDLLEVDSDGD

SEQ ID NO: 1803611 - protein, 25 aa, Staphylococcus epidermidis
DSNRGGCCQSCRWDYDLLQVDDDGE

SEQ ID NO: 1803612 - protein, 17 aa, Staphylococcus epidermidis
DSPPILIIHGGKDIQVG

SEQ ID NO: 1803613 - protein, 25 aa, Staphylococcus epidermidis
DSPQRIRAGALYVIEQMVALGDTKL

SEQ ID NO: 1803614 - protein, 20 aa, Staphylococcus epidermidis
DSPVKYTQHIGGTRHFNYET

SEQ ID NO: 1803615 - protein, 19 aa, Staphylococcus epidermidis
DSQEMRPLIVMSPKSLLRN

SEQ ID NO: 1803616 - protein, 17 aa, Staphylococcus epidermidis
DSQKRLVGAEIYGNDAG

SEQ ID NO: 1803617 - protein, 17 aa, Staphylococcus epidermidis
DSREFLSMQSLPDSITF

SEQ ID NO: 1803618 - protein, 17 aa, Staphylococcus epidermidis
DSREFLSMQSLPNSITF

SEQ ID NO: 1803619 - protein, 25 aa, Staphylococcus epidermidis
DSRLKLTVINELAWHNLFAHNMFIR

SEQ ID NO: 1803620 - protein, 25 aa, Staphylococcus epidermidis
DSSIYKGISYNVVYETLKEVILQVK

SEQ ID NO: 1803621 - protein, 21 aa, Staphylococcus epidermidis
DSSLMAMQFMLTAKAYGYDTN

SEQ ID NO: 1803622 - protein, 27 aa, Staphylococcus epidermidis
DSTALGFAGGFPGEFISKTLEDSQIQT

SEQ ID NO: 1803623 - protein, 26 aa, Staphylococcus epidermidis
DSTALGFSGGFPGDFITQTLEDSNIQ

SEQ ID NO: 1803624 - protein, 26 aa, Staphylococcus epidermidis
DSVFKDEIFGPVLAITTYRNFEQVIE

SEQ ID NO: 1803625 - protein, 21 aa, Staphylococcus epidermidis
DSVKIDYKLVDNWKQYLEDYL

SEQ ID NO: 1803626 - protein, 24 aa, Staphylococcus epidermidis
DSVLKRMRRKYTMEHFSERLTELH

SEQ ID NO: 1803627 - protein, 25 aa, Staphylococcus epidermidis
DSYEQITVWGPRAKEVQTFVTELRN

SEQ ID NO: 1803628 - protein, 22 aa, Staphylococcus epidermidis
DSYLKLRFIQKSILKAIDSEWI

SEQ ID NO: 1803629 - protein, 19 aa, Staphylococcus epidermidis
DSYPRNDALVFYSSEDKEK

SEQ ID NO: 1803630 - protein, 19 aa, Staphylococcus epidermidis
DSYTRRIYAKLGYAETETY

SEQ ID NO: 1803631 - protein, 24 aa, Staphylococcus epidermidis
DTANEFSEKCGYYTATKKTKNIQD

SEQ ID NO: 1803632 - protein, 21 aa, Staphylococcus epidermidis
DTASHFVLIFARKNVTAHTEY

SEQ ID NO: 1803633 - protein, 20 aa, Staphylococcus epidermidis
DTASHFVLIFARKNVTSHSD

SEQ ID NO: 1803634 - protein, 21 aa, Staphylococcus epidermidis
DTCKEKVNLALGVYINEHGIS

SEQ ID NO: 1803635 - protein, 21 aa, Staphylococcus epidermidis
DTCKYILKSVVQFEDDIEREK

SEQ ID NO: 1803636 - protein, 18 aa, Staphylococcus epidermidis
DTDIANTVAFLASDKAKY

SEQ ID NO: 1803637 - protein, 17 aa, Staphylococcus epidermidis
DTFHLPLVIATTGEKDT

SEQ ID NO: 1803638 - protein, 19 aa, Staphylococcus epidermidis
DTFIGAFLSELNKDLSNIE

SEQ ID NO: 1803639 - protein, 23 aa, Staphylococcus epidermidis
DTFKLGNYAGIHFRNTFSGTVTK

SEQ ID NO: 1803640 - protein, 18 aa, Staphylococcus epidermidis
DTGAIIVYTLVKPEIKKY

SEQ ID NO: 1803641 - protein, 19 aa, Staphylococcus epidermidis
DTGVSFVFQGCEHINRAIT

SEQ ID NO: 1803642 - protein, 23 aa, Staphylococcus epidermidis
DTIKKQRDGAVITYYYSGVPTLS

SEQ ID NO: 1803643 - protein, 32 aa, Staphylococcus epidermidis
DTKLAETLHSIFLEVVIAPKFTEEALEILTQK

SEQ ID NO: 1803644 - protein, 19 aa, Staphylococcus epidermidis
DTKPCDNEYILAQDADVMI

SEQ ID NO: 1803645 - protein, 26 aa, Staphylococcus epidermidis
DTKRYGMYWAARQGFDQIVEFHLDAA

SEQ ID NO: 1803646 - protein, 25 aa, Staphylococcus epidermidis
DTKVFRGNRPFAFTNLKTDEGLDEV

SEQ ID NO: 1803647 - protein, 22 aa, Staphylococcus epidermidis
DTLAKNVVKGFVNGHYDGGRHQ

SEQ ID NO: 1803648 - protein, 17 aa, Staphylococcus epidermidis
DTLKIKWIEQGDIHSYE

SEQ ID NO: 1803649 - protein, 24 aa, Staphylococcus epidermidis
DTLPDAHFSKIYLFSPNLDKITDF

SEQ ID NO: 1803650 - protein, 23 aa, Staphylococcus epidermidis
DTLPFIPEDFIFKVSDYGSKQFK

SEQ ID NO: 1803651 - protein, 21 aa, Staphylococcus epidermidis
DTLTFPAFVYSGDATVVPEGQ

SEQ ID NO: 1803652 - protein, 23 aa, Staphylococcus epidermidis
DTLWDFKVSKQLPQKNSTLQLVI

SEQ ID NO: 1803653 - protein, 24 aa, Staphylococcus epidermidis
DTMALPPCHTMFQFYVQDGKLSCQ

SEQ ID NO: 1803654 - protein, 17 aa, Staphylococcus epidermidis
DTMCCIIDIPIHRYTSQ

SEQ ID NO: 1803655 - protein, 18 aa, Staphylococcus epidermidis
DTMHIPRMPSEDSYRTSI

SEQ ID NO: 1803656 - protein, 25 aa, Staphylococcus epidermidis
DTNWPVCGIPEKFYTDHGSDFTSNH

SEQ ID NO: 1803657 - protein, 19 aa, Staphylococcus epidermidis
DTPEFPDMFKPTAAGQGRN

SEQ ID NO: 1803658 - protein, 24 aa, Staphylococcus epidermidis
DTPIYFNIEEVFNYITNVNNEVIN

SEQ ID NO: 1803659 - protein, 23 aa, Staphylococcus epidermidis
DTQNGLRAYAFAPVKNGKPDKKH

SEQ ID NO: 1803660 - protein, 21 aa, Staphylococcus epidermidis
DTRLKEIINELSLNTNYNYTY

SEQ ID NO: 1803661 - protein, 19 aa, Staphylococcus epidermidis
DTSQIRWLSVLDLEGKNEK

SEQ ID NO: 1803662 - protein, 29 aa, Staphylococcus epidermidis
DTTDLRLITLYIMEAFKVLGREEMLEDYI

SEQ ID NO: 1803663 - protein, 24 aa, Staphylococcus epidermidis
DTTLPAFWFDPIINLTAIAQVTSH

SEQ ID NO: 1803664 - protein, 19 aa, Staphylococcus epidermidis
DTVIRFAPPLVITKEELDL

SEQ ID NO: 1803665 - protein, 17 aa, Staphylococcus epidermidis
DTVRPALQIIKTKPGVS

SEQ ID NO: 1803666 - protein, 24 aa, Staphylococcus epidermidis
DTWFSSALWPFSTLGWPDTDSEDF

SEQ ID NO: 1803667 - protein, 19 aa, Staphylococcus epidermidis
DTYCGIGTIGLYMAPQAKH

SEQ ID NO: 1803668 - protein, 23 aa, Staphylococcus epidermidis
DTYIKDYDKVFLIIDDNVYHQFS

SEQ ID NO: 1803669 - protein, 21 aa, Staphylococcus epidermidis
DVANQYWLYLFGHTLKGVGAA

SEQ ID NO: 1803670 - protein, 24 aa, Staphylococcus epidermidis
DVASYYPALMIEYDYLSRNVPNKK

SEQ ID NO: 1803671 - protein, 18 aa, Staphylococcus epidermidis
DVCFVPIGDNFTMGIDDA

SEQ ID NO: 1803672 - protein, 17 aa, Staphylococcus epidermidis
DVCFVPIGDNFTMGIED

SEQ ID NO: 1803673 - protein, 22 aa, Staphylococcus epidermidis
DVDIRWLDAYQVIRDDERLNRG

SEQ ID NO: 1803674 - protein, 20 aa, Staphylococcus epidermidis
DVDYVFYPSVEEMYPDQLDI

SEQ ID NO: 1803675 - protein, 19 aa, Staphylococcus epidermidis
DVFEDLKYNYSEWIHYGDN

SEQ ID NO: 1803676 - protein, 24 aa, Staphylococcus epidermidis
DVFYLKYVAVVKVDGIGTIKIDDN

SEQ ID NO: 1803677 - protein, 17 aa, Staphylococcus epidermidis
DVGEFLMIRDIFKKLEI

SEQ ID NO: 1803678 - protein, 23 aa, Staphylococcus epidermidis
DVGLPKRMKKVFQNSKMIAMGGA

SEQ ID NO: 1803679 - protein, 17 aa, Staphylococcus epidermidis
DVGNLYLNRGCTAAVVG

SEQ ID NO: 1803680 - protein, 19 aa, Staphylococcus epidermidis
DVHQPELAIVFGRTKRRVD

SEQ ID NO: 1803681 - protein, 19 aa, Staphylococcus epidermidis
DVIDLGVGIVLNKKVGDRV

SEQ ID NO: 1803682 - protein, 22 aa, Staphylococcus epidermidis
DVILRRNVDILQQWIEQKKGPF

SEQ ID NO: 1803683 - protein, 27 aa, Staphylococcus epidermidis
DVKLAEALHSIFLEVIIAPQFTEEALK

SEQ ID NO: 1803684 - protein, 25 aa, Staphylococcus epidermidis
DVKQRLKSKWSRIEALAGAKPRIEA

SEQ ID NO: 1803685 - protein, 18 aa, Staphylococcus epidermidis
DVKRFFRSIMIQFDAFFE

SEQ ID NO: 1803686 - protein, 17 aa, Staphylococcus epidermidis
DVKRSGEDITVFCYGLM

SEQ ID NO: 1803687 - protein, 19 aa, Staphylococcus epidermidis
DVKSGSFLNILNLEIVEEI

SEQ ID NO: 1803688 - protein, 17 aa, Staphylococcus epidermidis
DVLLPAIGQGALGIECR

SEQ ID NO: 1803689 - protein, 29 aa, Staphylococcus epidermidis
DVLNRWQKRLEGMGWNALFIENHDQPRRV

SEQ ID NO: 1803690 - protein, 23 aa, Staphylococcus epidermidis
DVLQRSNYALSFSKMTFPHQMMR

SEQ ID NO: 1803691 - protein, 19 aa, Staphylococcus epidermidis
DVNAALHYLARLIEAGDLP

SEQ ID NO: 1803692 - protein, 18 aa, Staphylococcus epidermidis
DVNTGGWTLENYRKGGSR

SEQ ID NO: 1803693 - protein, 21 aa, Staphylococcus epidermidis
DVPRIRTIPVGSLHTLMYPQH

SEQ ID NO: 1803694 - protein, 22 aa, Staphylococcus epidermidis
DVPTFAICHGPLLLVDTDDLNG

SEQ ID NO: 1803695 - protein, 21 aa, Staphylococcus epidermidis
DVPTFAICHGPLVLIDTDDLN

SEQ ID NO: 1803696 - protein, 35 aa, Staphylococcus epidermidis
DVQFKELKFYLAFKRIKNFACVEILPNQQRLLLYV

SEQ ID NO: 1803697 - protein, 22 aa, Staphylococcus epidermidis
DVQKAHALAEIDKAEQEALKQI

SEQ ID NO: 1803698 - protein, 23 aa, Staphylococcus epidermidis
DVQRLIDLDVDFVLVCNNPKRDD

SEQ ID NO: 1803699 - protein, 25 aa, Staphylococcus epidermidis
DVSEIQRLIQFLLIELSYLKKPKLD

SEQ ID NO: 1803700 - protein, 22 aa, Staphylococcus epidermidis
DVSGKWFFDRFSPVTHIKAIGN

SEQ ID NO: 1803701 - protein, 25 aa, Staphylococcus epidermidis
DVSGTIEGRVLWKAKSFSIRGGDKM

SEQ ID NO: 1803702 - protein, 18 aa, Staphylococcus epidermidis
DVSMYSYLSVPRGDTGYF

SEQ ID NO: 1803703 - protein, 18 aa, Staphylococcus epidermidis
DVTLELKLLADVGLVGFP

SEQ ID NO: 1803704 - protein, 23 aa, Staphylococcus epidermidis
DVTLKFKGAVKNITTSGVAIATL

SEQ ID NO: 1803705 - protein, 25 aa, Staphylococcus epidermidis
DVTYPDKRIEFIIKDAEVAAVLTYG

SEQ ID NO: 1803706 - protein, 18 aa, Staphylococcus epidermidis
DVVACCLDVGEGKDLDVV

SEQ ID NO: 1803707 - protein, 25 aa, Staphylococcus epidermidis
DVVKRTCGYLGNPVQRPVIEGRQKE

SEQ ID NO: 1803708 - protein, 26 aa, Staphylococcus epidermidis
DVYDPRKYLGPAREAIKETVKGKIKE

SEQ ID NO: 1803709 - protein, 18 aa, Staphylococcus epidermidis
DVYEPFLIQKGFLERTPR

SEQ ID NO: 1803710 - protein, 20 aa, Staphylococcus epidermidis
DVYKEEVKVIKVTNNSPSEV

SEQ ID NO: 1803711 - protein, 24 aa, Staphylococcus epidermidis
DVYTKHNLCFYVFNNEMKRYLDNP

SEQ ID NO: 1803712 - protein, 25 aa, Staphylococcus epidermidis
DWFAVLRIAKQMFIPIGSVQDISHN

SEQ ID NO: 1803713 - protein, 23 aa, Staphylococcus epidermidis
DWLEVYNRNGVVTARAVTSHRMP

SEQ ID NO: 1803714 - protein, 19 aa, Staphylococcus epidermidis
DWSKLHWQADWNGEDLGFP

SEQ ID NO: 1803715 - protein, 28 aa, Staphylococcus epidermidis
DWSSPRLLCIAGGFTRYDEHAVKQINRN

SEQ ID NO: 1803716 - protein, 19 aa, Staphylococcus epidermidis
DYAGGLMILNEVGGIGTNL

SEQ ID NO: 1803717 - protein, 25 aa, Staphylococcus epidermidis
DYANLKRPILFYTYDLDKYKDELRG

SEQ ID NO: 1803718 - protein, 30 aa, Staphylococcus epidermidis
DYAVRDARISYEWYKMVVSIIGDGLTVSSI

SEQ ID NO: 1803719 - protein, 19 aa, Staphylococcus epidermidis
DYAVSIGFHVKVNVVIQKG

SEQ ID NO: 1803720 - protein, 21 aa, Staphylococcus epidermidis
DYCTEHHLPFILFSASGGARM

SEQ ID NO: 1803721 - protein, 21 aa, Staphylococcus epidermidis
DYDAIILAAAGLRRMGWSDDI

SEQ ID NO: 1803722 - protein, 22 aa, Staphylococcus epidermidis
DYDDYKFCRGMYINPNELPGPV

SEQ ID NO: 1803723 - protein, 23 aa, Staphylococcus epidermidis
DYDEIIQIGITFVRNQQIIDTYH

SEQ ID NO: 1803724 - protein, 19 aa, Staphylococcus epidermidis
DYDPTYIFMLAKYYEKNVM

SEQ ID NO: 1803725 - protein, 17 aa, Staphylococcus epidermidis
DYDRPWHYLNVLAQQAL

SEQ ID NO: 1803726 - protein, 21 aa, Staphylococcus epidermidis
DYESFPGKLIVHVIDDSQVGQ

SEQ ID NO: 1803727 - protein, 19 aa, Staphylococcus epidermidis
DYEYEAGEKQKLYAHDIIY

SEQ ID NO: 1803728 - protein, 24 aa, Staphylococcus epidermidis
DYFAKGGDMIDTWMNMTPMKRPGV

SEQ ID NO: 1803729 - protein, 19 aa, Staphylococcus epidermidis
DYFFDPRVKDCINYIQEHY

SEQ ID NO: 1803730 - protein, 26 aa, Staphylococcus epidermidis
DYFKQEAIEFAWEFLTSDKWMGMEPE

SEQ ID NO: 1803731 - protein, 17 aa, Staphylococcus epidermidis
DYFYKKWNRELEALYHI

SEQ ID NO: 1803732 - protein, 20 aa, Staphylococcus epidermidis
DYGALDVMKQLGLQNKIVSI

SEQ ID NO: 1803733 - protein, 18 aa, Staphylococcus epidermidis
DYIDAHGFGQEFGHSLGH

SEQ ID NO: 1803734 - protein, 26 aa, Staphylococcus epidermidis
DYIEVKIIRNVFDKMLTDSQFEDTKN

SEQ ID NO: 1803735 - protein, 24 aa, Staphylococcus epidermidis
DYIVNSYPVWFPKVEAEEIIKDMI

SEQ ID NO: 1803736 - protein, 21 aa, Staphylococcus epidermidis
DYKDLYFAGASTHPGAGVPIV

SEQ ID NO: 1803737 - protein, 24 aa, Staphylococcus epidermidis
DYKEVILRINADNFKSGTVIAKLP

SEQ ID NO: 1803738 - protein, 24 aa, Staphylococcus epidermidis
DYKEYRKRLIVKLKKPIGRDLYNR

SEQ ID NO: 1803739 - protein, 26 aa, Staphylococcus epidermidis
DYLFKHVPVKPGDFFYVPAGTVHAIG

SEQ ID NO: 1803740 - protein, 17 aa, Staphylococcus epidermidis
DYLSELKKQKNALDNGV

SEQ ID NO: 1803741 - protein, 19 aa, Staphylococcus epidermidis
DYMLLSRQFLYTMLTRTIN

SEQ ID NO: 1803742 - protein, 19 aa, Staphylococcus epidermidis
DYMQRFLVSKTFLKSEDKA

SEQ ID NO: 1803743 - protein, 19 aa, Staphylococcus epidermidis
DYNGYPLVIRKLSTWINSI

SEQ ID NO: 1803744 - protein, 18 aa, Staphylococcus epidermidis
DYNKGGIQHGFERQIQRR

SEQ ID NO: 1803745 - protein, 18 aa, Staphylococcus epidermidis
DYNLKRQFNKAVKDAREA

SEQ ID NO: 1803746 - protein, 22 aa, Staphylococcus epidermidis
DYPLSREKLSPVLAMVTAKSTG

SEQ ID NO: 1803747 - protein, 19 aa, Staphylococcus epidermidis
DYRKHFEPLIKESNDDFRK

SEQ ID NO: 1803748 - protein, 23 aa, Staphylococcus epidermidis
DYRNLTLVRFFFKSLTDYLKKRN

SEQ ID NO: 1803749 - protein, 22 aa, Staphylococcus epidermidis
DYRPNIYSYFGIKKNPNDTVLM

SEQ ID NO: 1803750 - protein, 17 aa, Staphylococcus epidermidis
DYRSKRKNIQFKETESN

SEQ ID NO: 1803751 - protein, 18 aa, Staphylococcus epidermidis
DYTLVSLLHKGNEASGTS

SEQ ID NO: 1803752 - protein, 25 aa, Staphylococcus epidermidis
DYVMLGHLHHPFSINNSFIKYSGSI

SEQ ID NO: 1803753 - protein, 26 aa, Staphylococcus epidermidis
DYVSGGKRPLICFFSNDLNIHRTKTE

SEQ ID NO: 1803754 - protein, 25 aa, Staphylococcus epidermidis
DYWNDCFGDLHILQPDWKTIERTSD

SEQ ID NO: 1803755 - protein, 24 aa, Staphylococcus epidermidis
DYYEKRKEELHSFNTHLEDIKNQL

SEQ ID NO: 1803756 - protein, 27 aa, Staphylococcus epidermidis
DYYGSSVNSEWMIPKILEMKHEAPELL

SEQ ID NO: 1803757 - protein, 20 aa, Staphylococcus epidermidis
EAAKNLLLHEGVKKLIVITL

SEQ ID NO: 1803758 - protein, 23 aa, Staphylococcus epidermidis
EAAREWLRSTGFKNIDELNKVLE

SEQ ID NO: 1803759 - protein, 24 aa, Staphylococcus epidermidis
EADASIKWALGLMNEGSQIIDNTT

SEQ ID NO: 1803760 - protein, 21 aa, Staphylococcus epidermidis
EADKNSLILFDELGAGTDPSE

SEQ ID NO: 1803761 - protein, 23 aa, Staphylococcus epidermidis
EADKYVFVSPMWNLSFPLVLKAY

SEQ ID NO: 1803762 - protein, 24 aa, Staphylococcus epidermidis
EADVPRQAVSMGLASILKAKRIIL

SEQ ID NO: 1803763 - protein, 23 aa, Staphylococcus epidermidis
EAEILEWFDAIGRRRGLLQKGNE

SEQ ID NO: 1803764 - protein, 25 aa, Staphylococcus epidermidis
EAERATRTQLSFVDQFREAMTKFPV

SEQ ID NO: 1803765 - protein, 22 aa, Staphylococcus epidermidis
EAERLSGISIKNEADMQQTGDY

SEQ ID NO: 1803766 - protein, 32 aa, Staphylococcus epidermidis
EAGAKFNGVLCGRATWAGAVQVYIEQGEEAAR

SEQ ID NO: 1803767 - protein, 30 aa, Staphylococcus epidermidis
EAGFHKLPLEDRVALFGLEKSEDGIVSVGN

SEQ ID NO: 1803768 - protein, 17 aa, Staphylococcus epidermidis
EAGHALINLLKDVDTRA

SEQ ID NO: 1803769 - protein, 40 aa, Staphylococcus epidermidis
EAGRSDYFWDLFIQMPAALMFPSGNPFYDWRYQTEEEPHM

SEQ ID NO: 1803770 - protein, 35 aa, Staphylococcus epidermidis
EAHKEGCAYVKEHAMFKCDHRFDVVIASNSGYPLD

SEQ ID NO: 1803771 - protein, 30 aa, Staphylococcus epidermidis
EAIDARGSMLDFVADANIGLRTVTDKDTPF

SEQ ID NO: 1803772 - protein, 22 aa, Staphylococcus epidermidis
EAIEKARRLSFQTEDMKRQSKV

SEQ ID NO: 1803773 - protein, 17 aa, Staphylococcus epidermidis
EAIICGIGINMNHVESD

SEQ ID NO: 1803774 - protein, 17 aa, Staphylococcus epidermidis
EAIKAYLSIAPDNTVLI

SEQ ID NO: 1803775 - protein, 17 aa, Staphylococcus epidermidis
EAIPHSRTVNISNVGHT

SEQ ID NO: 1803776 - protein, 18 aa, Staphylococcus epidermidis
EAIPSDLAKVITEKLTIP

SEQ ID NO: 1803777 - protein, 27 aa, Staphylococcus epidermidis
EAIRLLKEIPHRSSFSYILMDKNLNYA

SEQ ID NO: 1803778 - protein, 27 aa, Staphylococcus epidermidis
EAKDIKEPLELISLLGNISHIDDKPFA

SEQ ID NO: 1803779 - protein, 20 aa, Staphylococcus epidermidis
EAKFKTSALRSWKTDQADAH

SEQ ID NO: 1803780 - protein, 22 aa, Staphylococcus epidermidis
EAKFKTSALRSWKTDQADAHKL

SEQ ID NO: 1803781 - protein, 21 aa, Staphylococcus epidermidis
EAKFKTSTLRSWKTDQADAHK

SEQ ID NO: 1803782 - protein, 21 aa, Staphylococcus epidermidis
EAKIACLTIDTSMRHLDAIGD

SEQ ID NO: 1803783 - protein, 20 aa, Staphylococcus epidermidis
EAKISGNAMVKVKNRMFSHG

SEQ ID NO: 1803784 - protein, 20 aa, Staphylococcus epidermidis
EAKMSGQVILLLDEIHRLDK

SEQ ID NO: 1803785 - protein, 21 aa, Staphylococcus epidermidis
EAKPTHKVTVFAGQDKEATQT

SEQ ID NO: 1803786 - protein, 17 aa, Staphylococcus epidermidis
EALCSVGTSGVVLNVEY

SEQ ID NO: 1803787 - protein, 25 aa, Staphylococcus epidermidis
EALELAEQMGIIFIDEIDKVATNNQ

SEQ ID NO: 1803788 - protein, 17 aa, Staphylococcus epidermidis
EALFRAGITPDKITNSL

SEQ ID NO: 1803789 - protein, 18 aa, Staphylococcus epidermidis
EALIDFIPHVTHSKLKDV

SEQ ID NO: 1803790 - protein, 24 aa, Staphylococcus epidermidis
EALINRYISKYGFKNYQTNFQKLK

SEQ ID NO: 1803791 - protein, 22 aa, Staphylococcus epidermidis
EALKEKGLLCKETHDTVIRFAP

SEQ ID NO: 1803792 - protein, 24 aa, Staphylococcus epidermidis
EALKRGTAILITGGFHPSKFVIDY

SEQ ID NO: 1803793 - protein, 30 aa, Staphylococcus epidermidis
EALLNFVSRGEIDPVIRFYTWDPATLSIGY

SEQ ID NO: 1803794 - protein, 20 aa, Staphylococcus epidermidis
EALMGKYRISGVPIVDNHDD

SEQ ID NO: 1803795 - protein, 17 aa, Staphylococcus epidermidis
EALMRKGYKYDKIKTKL

SEQ ID NO: 1803796 - protein, 18 aa, Staphylococcus epidermidis
EALRHKDIVFSPELISWI

SEQ ID NO: 1803797 - protein, 25 aa, Staphylococcus epidermidis
EALSGTVTPQGFFAVIDKPQYDVSK

SEQ ID NO: 1803798 - protein, 21 aa, Staphylococcus epidermidis
EAMEALIRFSKAEGIIPAIES

SEQ ID NO: 1803799 - protein, 17 aa, Staphylococcus epidermidis
EAMGGKVPQSMKKHHTS

SEQ ID NO: 1803800 - protein, 25 aa, Staphylococcus epidermidis
EAMQALKDEITRNAAPVQSSLNYIN

SEQ ID NO: 1803801 - protein, 26 aa, Staphylococcus epidermidis
EAMRRAEPLLKVFRLENELKVFPSHF

SEQ ID NO: 1803802 - protein, 19 aa, Staphylococcus epidermidis
EANEGQILFKNEKIDNSNI

SEQ ID NO: 1803803 - protein, 17 aa, Staphylococcus epidermidis
EAPELLERTSYIMEAGD

SEQ ID NO: 1803804 - protein, 20 aa, Staphylococcus epidermidis
EAQANFALVLGNEGEGVNPD

SEQ ID NO: 1803805 - protein, 17 aa, Staphylococcus epidermidis
EAQFDMILIEGAGGIAV

SEQ ID NO: 1803806 - protein, 26 aa, Staphylococcus epidermidis
EAQLKKRLKVGDIMKLPTVEQLSQHI

SEQ ID NO: 1803807 - protein, 17 aa, Staphylococcus epidermidis
EAQRVFLATALVQEPQY

SEQ ID NO: 1803808 - protein, 21 aa, Staphylococcus epidermidis
EAQVLKIFKYFYSHRGPVLDF

SEQ ID NO: 1803809 - protein, 21 aa, Staphylococcus epidermidis
EARGKGGHVRANWKDVTDIIA

SEQ ID NO: 1803810 - protein, 19 aa, Staphylococcus epidermidis
EARSVFGYQPIEHGEQPLV

SEQ ID NO: 1803811 - protein, 29 aa, Staphylococcus epidermidis
EARSYRLLRVGSFLLSKDGYKIFVHESER

SEQ ID NO: 1803812 - protein, 26 aa, Staphylococcus epidermidis
EASIKKARLAEDIPEIKIEIPKDTKN

SEQ ID NO: 1803813 - protein, 20 aa, Staphylococcus epidermidis
EASLTRPVAEMVSTHTTQVE

SEQ ID NO: 1803814 - protein, 17 aa, Staphylococcus epidermidis
EASMKYIEEHGGMIIYL

SEQ ID NO: 1803815 - protein, 22 aa, Staphylococcus epidermidis
EASSPILRNHLDDIIMNTKPMI

SEQ ID NO: 1803816 - protein, 17 aa, Staphylococcus epidermidis
EASTYLTRNENFLYAIT

SEQ ID NO: 1803817 - protein, 19 aa, Staphylococcus epidermidis
EATAKCFTNDLSMSSDFYN

SEQ ID NO: 1803818 - protein, 24 aa, Staphylococcus epidermidis
EATRILTERGILLVPDVLASAGGV

SEQ ID NO: 1803819 - protein, 18 aa, Staphylococcus epidermidis
EAVKKAKAFISMSIEHTP

SEQ ID NO: 1803820 - protein, 20 aa, Staphylococcus epidermidis
EAVYGAGIARLYKLNKNTGE

SEQ ID NO: 1803821 - protein, 25 aa, Staphylococcus epidermidis
EAYEMGVSKAFKPIMENTLKYLNVG

SEQ ID NO: 1803822 - protein, 23 aa, Staphylococcus epidermidis
EAYKERNNPVLAFLNNEEPKLEN

SEQ ID NO: 1803823 - protein, 17 aa, Staphylococcus epidermidis
EAYLGFNDRAAHGYGGK

SEQ ID NO: 1803824 - protein, 19 aa, Staphylococcus epidermidis
EAYNFIKQVSEDGGKVLFV

SEQ ID NO: 1803825 - protein, 20 aa, Staphylococcus epidermidis
ECDDAVRLQRMEAINDEFDI

SEQ ID NO: 1803826 - protein, 18 aa, Staphylococcus epidermidis
ECGTSELALLVAELSNSN

SEQ ID NO: 1803827 - protein, 33 aa, Staphylococcus epidermidis
ECGYPSLTYDLEWLPQLFVMGGLADLELGPFAR

SEQ ID NO: 1803828 - protein, 18 aa, Staphylococcus epidermidis
ECGYSFRKSGKYYIGNEH

SEQ ID NO: 1803829 - protein, 18 aa, Staphylococcus epidermidis
ECQTFYIEYVPKFDPTTI

SEQ ID NO: 1803830 - protein, 19 aa, Staphylococcus epidermidis
EDAGRGYRRVVPSPQPKSI

SEQ ID NO: 1803831 - protein, 18 aa, Staphylococcus epidermidis
EDAIFKRSKVKKESSNDK

SEQ ID NO: 1803832 - protein, 24 aa, Staphylococcus epidermidis
EDDAKKGFLLDGFPRTIEQAEALN

SEQ ID NO: 1803833 - protein, 24 aa, Staphylococcus epidermidis
EDDIKAFVLIFRDLARLMQMLKTF

SEQ ID NO: 1803834 - protein, 23 aa, Staphylococcus epidermidis
EDDVLKQLDYVIAAIHQSFNQSE

SEQ ID NO: 1803835 - protein, 18 aa, Staphylococcus epidermidis
EDEIGFIALHIASNSEDL

SEQ ID NO: 1803836 - protein, 18 aa, Staphylococcus epidermidis
EDEIGFIALHIASNSEKL

SEQ ID NO: 1803837 - protein, 18 aa, Staphylococcus epidermidis
EDEYRYKIGNRLYGCDTC

SEQ ID NO: 1803838 - protein, 26 aa, Staphylococcus epidermidis
EDFDIGFKLYDVFTILYLLDPEAFNV

SEQ ID NO: 1803839 - protein, 18 aa, Staphylococcus epidermidis
EDFHLIKEIITEKGLNGF

SEQ ID NO: 1803840 - protein, 18 aa, Staphylococcus epidermidis
EDFHVLKKLNKVLEKRRE

SEQ ID NO: 1803841 - protein, 17 aa, Staphylococcus epidermidis
EDFKRLVAEAHQRDLKI

SEQ ID NO: 1803842 - protein, 23 aa, Staphylococcus epidermidis
EDFKRYYPTNALVTGYDIIFFWV

SEQ ID NO: 1803843 - protein, 23 aa, Staphylococcus epidermidis
EDFTGNLSLEFVDYRLGDPKYDL

SEQ ID NO: 1803844 - protein, 20 aa, Staphylococcus epidermidis
EDFYFMKLNQFYDDIVQYDS

SEQ ID NO: 1803845 - protein, 32 aa, Staphylococcus epidermidis
EDGDIRFTKVKLWLMHTGLNLNGSVFNKDVVE

SEQ ID NO: 1803846 - protein, 19 aa, Staphylococcus epidermidis
EDGDWGFSILDKEGNLEGS

SEQ ID NO: 1803847 - protein, 26 aa, Staphylococcus epidermidis
EDGIPVYLGMPMGIVVEAEGKTIYHT

SEQ ID NO: 1803848 - protein, 19 aa, Staphylococcus epidermidis
EDGKLVLDRDGHIMETPNG

SEQ ID NO: 1803849 - protein, 28 aa, Staphylococcus epidermidis
EDGMPGLTICGGYQFLGTKYITPDGTEL

SEQ ID NO: 1803850 - protein, 17 aa, Staphylococcus epidermidis
EDGVKDILNRFFNNEAF

SEQ ID NO: 1803851 - protein, 20 aa, Staphylococcus epidermidis
EDHFYCAMFIPSSEDHSNQL

SEQ ID NO: 1803852 - protein, 23 aa, Staphylococcus epidermidis
EDHGAEAVCHFCGNKYQYSESEL

SEQ ID NO: 1803853 - protein, 17 aa, Staphylococcus epidermidis
EDIAFADSRIRKETIAA

SEQ ID NO: 1803854 - protein, 21 aa, Staphylococcus epidermidis
EDIEDFFSIFMKYNNLEHGNF

SEQ ID NO: 1803855 - protein, 17 aa, Staphylococcus epidermidis
EDIELFRDIADKVKQTN

SEQ ID NO: 1803856 - protein, 17 aa, Staphylococcus epidermidis
EDIELICDRAIFLRDGH

SEQ ID NO: 1803857 - protein, 27 aa, Staphylococcus epidermidis
EDIKEFKPDLFISHYPLLMTYSHKLHL

SEQ ID NO: 1803858 - protein, 21 aa, Staphylococcus epidermidis
EDIQRALLCMNPENLVLNSKT

SEQ ID NO: 1803859 - protein, 20 aa, Staphylococcus epidermidis
EDITGCRSLEELPENARKYL

SEQ ID NO: 1803860 - protein, 20 aa, Staphylococcus epidermidis
EDKAEPAIATSFPKKSNGGK

SEQ ID NO: 1803861 - protein, 20 aa, Staphylococcus epidermidis
EDKGTWILDSEMAVKNDGED

SEQ ID NO: 1803862 - protein, 24 aa, Staphylococcus epidermidis
EDKNLKLLGEDDIDDDDDIPAETD

SEQ ID NO: 1803863 - protein, 18 aa, Staphylococcus epidermidis
EDKVLVKGSRGMKLEEVV

SEQ ID NO: 1803864 - protein, 17 aa, Staphylococcus epidermidis
EDLFKKAEHDLLTMIKH

SEQ ID NO: 1803865 - protein, 18 aa, Staphylococcus epidermidis
EDLKGIHVHLEFENLLHR

SEQ ID NO: 1803866 - protein, 25 aa, Staphylococcus epidermidis
EDLKGSWNVVCFYPADFSFVCPTEL

SEQ ID NO: 1803867 - protein, 17 aa, Staphylococcus epidermidis
EDLKTKINIFLFSCSTL

SEQ ID NO: 1803868 - protein, 26 aa, Staphylococcus epidermidis
EDLPKLKELWPQAGDYLLVTLRIDSN

SEQ ID NO: 1803869 - protein, 17 aa, Staphylococcus epidermidis
EDMEIEILHVLKRFKAM

SEQ ID NO: 1803870 - protein, 31 aa, Staphylococcus epidermidis
EDMEIEILHVLKRFKAMLIQKNETIEAMQGY

SEQ ID NO: 1803871 - protein, 17 aa, Staphylococcus epidermidis
EDMEIEILHVLKRFKAV

SEQ ID NO: 1803872 - protein, 24 aa, Staphylococcus epidermidis
EDPEKKLAYDNALSKAEQLLNQQN

SEQ ID NO: 1803873 - protein, 25 aa, Staphylococcus epidermidis
EDSETKAVVMIGEIGGTAEEEAAQW

SEQ ID NO: 1803874 - protein, 17 aa, Staphylococcus epidermidis
EDSRNALPETFSHKAAV

SEQ ID NO: 1803875 - protein, 17 aa, Staphylococcus epidermidis
EDTDVEKIIKRVNENKK

SEQ ID NO: 1803876 - protein, 35 aa, Staphylococcus epidermidis
EDTKFLMHFWDSWDHISYKQAFYIAENHIDNNCED

SEQ ID NO: 1803877 - protein, 17 aa, Staphylococcus epidermidis
EDTRIDVLDGFHRLLAV

SEQ ID NO: 1803878 - protein, 20 aa, Staphylococcus epidermidis
EDVLAEMKEQLSGSCTVEVA

SEQ ID NO: 1803879 - protein, 17 aa, Staphylococcus epidermidis
EDVLFCPKMEVEEVKAS

SEQ ID NO: 1803880 - protein, 21 aa, Staphylococcus epidermidis
EDVLKRLNISHLINKNIAELS

SEQ ID NO: 1803881 - protein, 23 aa, Staphylococcus epidermidis
EDVMPTLYLIKGDKELALRKAEE

SEQ ID NO: 1803882 - protein, 19 aa, Staphylococcus epidermidis
EDVYEPFLIQKGFLERTPR

SEQ ID NO: 1803883 - protein, 24 aa, Staphylococcus epidermidis
EDWCGDAMMNLPILKQISEVLNLE

SEQ ID NO: 1803884 - protein, 24 aa, Staphylococcus epidermidis
EDWKARLRMLKSFPTPTFDDIPLL

SEQ ID NO: 1803885 - protein, 22 aa, Staphylococcus epidermidis
EDYEAFIHFLNRITAGNYDIEK

SEQ ID NO: 1803886 - protein, 19 aa, Staphylococcus epidermidis
EDYELPVIMLTARDALSDK

SEQ ID NO: 1803887 - protein, 24 aa, Staphylococcus epidermidis
EDYGVYRFKRGFNVKIEELIGDFY

SEQ ID NO: 1803888 - protein, 24 aa, Staphylococcus epidermidis
EDYGVYRFKRGFNVQIEELIGDFY

SEQ ID NO: 1803889 - protein, 24 aa, Staphylococcus epidermidis
EEACGTWKLVYQRLQNIEHQTHQH

SEQ ID NO: 1803890 - protein, 17 aa, Staphylococcus epidermidis
EEAFYRALGRYVNTLNG

SEQ ID NO: 1803891 - protein, 25 aa, Staphylococcus epidermidis
EEAGYKAGIEYLNFDEQPATILDAE

SEQ ID NO: 1803892 - protein, 21 aa, Staphylococcus epidermidis
EEAKGADLLLHVVDASHPEYR

SEQ ID NO: 1803893 - protein, 22 aa, Staphylococcus epidermidis
EEAKVVIMIKDFFFEGKSTSDI

SEQ ID NO: 1803894 - protein, 23 aa, Staphylococcus epidermidis
EEALGYGRWAYRSITEDKNLDFD

SEQ ID NO: 1803895 - protein, 24 aa, Staphylococcus epidermidis
EEALKNIITALTWVNLNDSSIIKK

SEQ ID NO: 1803896 - protein, 26 aa, Staphylococcus epidermidis
EEAQVIWMSTFHSMCVRILRRDADRI

SEQ ID NO: 1803897 - protein, 25 aa, Staphylococcus epidermidis
EEAYTVKSVYRWYLQGLGYKKISQH

SEQ ID NO: 1803898 - protein, 21 aa, Staphylococcus epidermidis
EEAYYKYAHEFSGGQRQRIGI

SEQ ID NO: 1803899 - protein, 26 aa, Staphylococcus epidermidis
EEDLDPVFMWHLAYAYGQEERDKEAQ

SEQ ID NO: 1803900 - protein, 26 aa, Staphylococcus epidermidis
EEDLELLESVAFQIGSAIKRILLTDR

SEQ ID NO: 1803901 - protein, 22 aa, Staphylococcus epidermidis
EEDLQIFYSFIILKNNEVYFNL

SEQ ID NO: 1803902 - protein, 22 aa, Staphylococcus epidermidis
EEEEFYIFIGQFYSLNQHLLPK

SEQ ID NO: 1803903 - protein, 23 aa, Staphylococcus epidermidis
EEEIKYYLNEAIKTEKAGKKVEM

SEQ ID NO: 1803904 - protein, 24 aa, Staphylococcus epidermidis
EEEKAHITIFPKIENQEGIDNIDE

SEQ ID NO: 1803905 - protein, 25 aa, Staphylococcus epidermidis
EEEKAHSITAIWNFEKQNYYLKNLK

SEQ ID NO: 1803906 - protein, 20 aa, Staphylococcus epidermidis
EEEMFLGLRMNQGVNTERFK

SEQ ID NO: 1803907 - protein, 18 aa, Staphylococcus epidermidis
EEEWKLFTEAVEHFIEES

SEQ ID NO: 1803908 - protein, 22 aa, Staphylococcus epidermidis
EEEWYRAGKVTILRAAVLTPYM

SEQ ID NO: 1803909 - protein, 27 aa, Staphylococcus epidermidis
EEFELYGYCVGGFIAIETARILIENGK

SEQ ID NO: 1803910 - protein, 19 aa, Staphylococcus epidermidis
EEFKRVVNMIQEVYEDFGF

SEQ ID NO: 1803911 - protein, 22 aa, Staphylococcus epidermidis
EEGKKSVAIRLSYLDTENTLTD

SEQ ID NO: 1803912 - protein, 27 aa, Staphylococcus epidermidis
EEGRECKFIAVKLPYGIQKDADEVEDA

SEQ ID NO: 1803913 - protein, 21 aa, Staphylococcus epidermidis
EEGTSFILTKWLFNNEKELSS

SEQ ID NO: 1803914 - protein, 25 aa, Staphylococcus epidermidis
EEIAKRYGLRSGVGLAAPQINVAKR

SEQ ID NO: 1803915 - protein, 19 aa, Staphylococcus epidermidis
EEICDRLDTLFVNKHIGGI

SEQ ID NO: 1803916 - protein, 17 aa, Staphylococcus epidermidis
EEIEFFVNGYTRGEVPD

SEQ ID NO: 1803917 - protein, 23 aa, Staphylococcus epidermidis
EEIIQCDYCLVSIGRKPNTGKIG

SEQ ID NO: 1803918 - protein, 26 aa, Staphylococcus epidermidis
EEIKTQMLEWILPYYKGLSKEGMKDI

SEQ ID NO: 1803919 - protein, 25 aa, Staphylococcus epidermidis
EEIYRKSVENCFNYFKTFILENNSD

SEQ ID NO: 1803920 - protein, 24 aa, Staphylococcus epidermidis
EEKAHSITAIWNFEKQNYYLKDLK

SEQ ID NO: 1803921 - protein, 17 aa, Staphylococcus epidermidis
EEKILLYCPTWRGEDLN

SEQ ID NO: 1803922 - protein, 23 aa, Staphylococcus epidermidis
EEKLELFKKYLPQYDEYKTQLEE

SEQ ID NO: 1803923 - protein, 18 aa, Staphylococcus epidermidis
EEKLRYFLIEDYNQKEHS

SEQ ID NO: 1803924 - protein, 20 aa, Staphylococcus epidermidis
EEKPWNSIEMTIKDLDNHLI

SEQ ID NO: 1803925 - protein, 17 aa, Staphylococcus epidermidis
EEKSGLNCDIDYAKSSF

SEQ ID NO: 1803926 - protein, 19 aa, Staphylococcus epidermidis
EEKYHVLLHHQHAYDNIRD

SEQ ID NO: 1803927 - protein, 17 aa, Staphylococcus epidermidis
EELEGIISHAVKHVPSA

SEQ ID NO: 1803928 - protein, 17 aa, Staphylococcus epidermidis
EELEVSKQTVFNNIKRL

SEQ ID NO: 1803929 - protein, 21 aa, Staphylococcus epidermidis
EELEVTLELKLLADVGLVGFP

SEQ ID NO: 1803930 - protein, 25 aa, Staphylococcus epidermidis
EELGFKGNTWLFFGEQHFTTDFLYQ

SEQ ID NO: 1803931 - protein, 20 aa, Staphylococcus epidermidis
EELKAEKALSQMKNETRSML

SEQ ID NO: 1803932 - protein, 21 aa, Staphylococcus epidermidis
EELKMMLNIMKPEYFIPVQGE

SEQ ID NO: 1803933 - protein, 20 aa, Staphylococcus epidermidis
EELQLRLKLAEVEVPIKVEK

SEQ ID NO: 1803934 - protein, 25 aa, Staphylococcus epidermidis
EELQTRPKQIFDIALYRKVTSKVGV

SEQ ID NO: 1803935 - protein, 20 aa, Staphylococcus epidermidis
EELRETWEKSIEELLLNGSI

SEQ ID NO: 1803936 - protein, 26 aa, Staphylococcus epidermidis
EELSQTLFKRWFVDFEFPDENGNPYK

SEQ ID NO: 1803937 - protein, 30 aa, Staphylococcus epidermidis
EELSYGAKMAWRNSNRCIGRLFWDSLNVKD

SEQ ID NO: 1803938 - protein, 30 aa, Staphylococcus epidermidis
EELSYGAKMAWRNSNRCIGRLFWNSLNVKD

SEQ ID NO: 1803939 - protein, 19 aa, Staphylococcus epidermidis
EELYILGLLIINNKQTTFK

SEQ ID NO: 1803940 - protein, 17 aa, Staphylococcus epidermidis
EELYLLGLLIISDNKTT

SEQ ID NO: 1803941 - protein, 25 aa, Staphylococcus epidermidis
EEMIYCRRCIQLGRIDSVTEYRITE

SEQ ID NO: 1803942 - protein, 23 aa, Staphylococcus epidermidis
EEMYDIAGLRMMCQFVDDIDVVV

SEQ ID NO: 1803943 - protein, 17 aa, Staphylococcus epidermidis
EEPEIFKQTTMFADLKT

SEQ ID NO: 1803944 - protein, 18 aa, Staphylococcus epidermidis
EEPHLKYKSDKIIDNYHK

SEQ ID NO: 1803945 - protein, 20 aa, Staphylococcus epidermidis
EEPPWYKVSPTHFVKSWLLD

SEQ ID NO: 1803946 - protein, 17 aa, Staphylococcus epidermidis
EEPVLFCPKMEVEEVKQ

SEQ ID NO: 1803947 - protein, 24 aa, Staphylococcus epidermidis
EEQFLKDYCRAHHIELYVKHLDLS

SEQ ID NO: 1803948 - protein, 19 aa, Staphylococcus epidermidis
EEQRTKLYKGWKKAVEATQ

SEQ ID NO: 1803949 - protein, 18 aa, Staphylococcus epidermidis
EEQVHQWRRSYDVQPPAE

SEQ ID NO: 1803950 - protein, 25 aa, Staphylococcus epidermidis
EERAKAQGYEAIFVLCDTDYFENLD

SEQ ID NO: 1803951 - protein, 24 aa, Staphylococcus epidermidis
EERIKRGAIQFLYVAPERFENTFF

SEQ ID NO: 1803952 - protein, 30 aa, Staphylococcus epidermidis
EERPTPKLWLCKPDGTRIERIADFSKLGGT

SEQ ID NO: 1803953 - protein, 23 aa, Staphylococcus epidermidis
EERQLKYSFDTTMNNRQNINPQE

SEQ ID NO: 1803954 - protein, 22 aa, Staphylococcus epidermidis
EESGRWSAYGPELMRLKDRNGR

SEQ ID NO: 1803955 - protein, 22 aa, Staphylococcus epidermidis
EESKEVFFYYTLPGSDELHYYT

SEQ ID NO: 1803956 - protein, 18 aa, Staphylococcus epidermidis
EESLFPHIRAIKSDDDHE

SEQ ID NO: 1803957 - protein, 19 aa, Staphylococcus epidermidis
EETDWLAQHTHEYESETYQ

SEQ ID NO: 1803958 - protein, 25 aa, Staphylococcus epidermidis
EETFGVTCEFEFKKDYPALYNDPDF

SEQ ID NO: 1803959 - protein, 25 aa, Staphylococcus epidermidis
EETIKEAAMIAGYFSKAGNSGQIPV

SEQ ID NO: 1803960 - protein, 24 aa, Staphylococcus epidermidis
EETYFPDCEDYILLWKLEVLEKYQ

SEQ ID NO: 1803961 - protein, 23 aa, Staphylococcus epidermidis
EETYKSLLKEIGFTKIETFTDFN

SEQ ID NO: 1803962 - protein, 25 aa, Staphylococcus epidermidis
EEVNNLKNLFSFLMDMRILVEELFL

SEQ ID NO: 1803963 - protein, 22 aa, Staphylococcus epidermidis
EEYEWLQQSTFNFPDKQTLKRL

SEQ ID NO: 1803964 - protein, 17 aa, Staphylococcus epidermidis
EFEIKELIITSTQRETT

SEQ ID NO: 1803965 - protein, 20 aa, Staphylococcus epidermidis
EFESYLLKRHRELKSKKFQI

SEQ ID NO: 1803966 - protein, 18 aa, Staphylococcus epidermidis
EFFSGTLVDGFKEQLDVE

SEQ ID NO: 1803967 - protein, 20 aa, Staphylococcus epidermidis
EFIQSYVIILLIDIRLPVVR

SEQ ID NO: 1803968 - protein, 23 aa, Staphylococcus epidermidis
EFKEAKKTIFFVSHNIRQVREFC

SEQ ID NO: 1803969 - protein, 22 aa, Staphylococcus epidermidis
EFKFLFTDIDFLPPVTPPNNVI

SEQ ID NO: 1803970 - protein, 22 aa, Staphylococcus epidermidis
EFKSNKTILDYVWDQYPTMNEK

SEQ ID NO: 1803971 - protein, 23 aa, Staphylococcus epidermidis
EFKYLKECLDIFDIISTGGGIIE

SEQ ID NO: 1803972 - protein, 21 aa, Staphylococcus epidermidis
EFLKQEGFDDIEWGEDFGAPH

SEQ ID NO: 1803973 - protein, 23 aa, Staphylococcus epidermidis
EFNFEPKAHWDLVEDLKMADFDR

SEQ ID NO: 1803974 - protein, 20 aa, Staphylococcus epidermidis
EFNLTKYLVSQLMLSNEERV

SEQ ID NO: 1803975 - protein, 19 aa, Staphylococcus epidermidis
EFNNQLLYCHNYYPRPDTG

SEQ ID NO: 1803976 - protein, 22 aa, Staphylococcus epidermidis
EFPKYIKVCELLHLYQSFYQTF

SEQ ID NO: 1803977 - protein, 19 aa, Staphylococcus epidermidis
EFSFEPEKRIHSKRQSNMI

SEQ ID NO: 1803978 - protein, 19 aa, Staphylococcus epidermidis
EFYELSPFNVSPVIDTEET

SEQ ID NO: 1803979 - protein, 19 aa, Staphylococcus epidermidis
EGAALAMSILDYVRNLGSL

SEQ ID NO: 1803980 - protein, 29 aa, Staphylococcus epidermidis
EGAAVGIGGLNNAFGFKLDTYHNTSPPKS

SEQ ID NO: 1803981 - protein, 25 aa, Staphylococcus epidermidis
EGALIIKFFLCLDKKEQLKRFKDRE

SEQ ID NO: 1803982 - protein, 18 aa, Staphylococcus epidermidis
EGALPKSGESWFENYTVE

SEQ ID NO: 1803983 - protein, 22 aa, Staphylococcus epidermidis
EGAYKIKYIRRMDLSNIHPQLA

SEQ ID NO: 1803984 - protein, 25 aa, Staphylococcus epidermidis
EGDEAKEYWLCWVTTERSEQGPYYA

SEQ ID NO: 1803985 - protein, 24 aa, Staphylococcus epidermidis
EGDIVVGMLPWKKINTVSTETIDK

SEQ ID NO: 1803986 - protein, 19 aa, Staphylococcus epidermidis
EGDMNWRKVVGDFYNSFKQ

SEQ ID NO: 1803987 - protein, 19 aa, Staphylococcus epidermidis
EGEEVMLLRHMILAHHGKM

SEQ ID NO: 1803988 - protein, 22 aa, Staphylococcus epidermidis
EGEHAVHMADIFPTTAHLNPLW

SEQ ID NO: 1803989 - protein, 23 aa, Staphylococcus epidermidis
EGEINLEQGFECTAKFRYRQKDT

SEQ ID NO: 1803990 - protein, 20 aa, Staphylococcus epidermidis
EGEKSCLFSDTFYGEDNFVV

SEQ ID NO: 1803991 - protein, 23 aa, Staphylococcus epidermidis
EGELKDKLYINGHYYNEYVMAKI

SEQ ID NO: 1803992 - protein, 21 aa, Staphylococcus epidermidis
EGELVARLILDKVGNKKPIQR

SEQ ID NO: 1803993 - protein, 18 aa, Staphylococcus epidermidis
EGEMKFRIACTNHHHHHF

SEQ ID NO: 1803994 - protein, 22 aa, Staphylococcus epidermidis
EGEVPFKPSRVILQDFTGVPAV

SEQ ID NO: 1803995 - protein, 23 aa, Staphylococcus epidermidis
EGEVPFKPSRVILQDFTGVPAVV

SEQ ID NO: 1803996 - protein, 20 aa, Staphylococcus epidermidis
EGFELPYMQLVVITERELFK

SEQ ID NO: 1803997 - protein, 20 aa, Staphylococcus epidermidis
EGFITWDQVLHRLDLFGSGL

SEQ ID NO: 1803998 - protein, 18 aa, Staphylococcus epidermidis
EGFKLEKLDRLFTKQTKL

SEQ ID NO: 1803999 - protein, 18 aa, Staphylococcus epidermidis
EGFMPIRRIEKPVYKENK

SEQ ID NO: 1804000 - protein, 24 aa, Staphylococcus epidermidis
EGFYRRMVIIPMLRKFGKGGQKKD

SEQ ID NO: 1804001 - protein, 25 aa, Staphylococcus epidermidis
EGHSGEYLKKMHVFLVSLLNHAMKF

SEQ ID NO: 1804002 - protein, 20 aa, Staphylococcus epidermidis
EGHTPLIYCENLSQKLDIQL

SEQ ID NO: 1804003 - protein, 25 aa, Staphylococcus epidermidis
EGIFKGLPLYFNVMRYHSLMADPST

SEQ ID NO: 1804004 - protein, 25 aa, Staphylococcus epidermidis
EGILNRAIEEFKKVFPYEDESDFGL

SEQ ID NO: 1804005 - protein, 21 aa, Staphylococcus epidermidis
EGIQIAIRMKWVKKLDNNLYE

SEQ ID NO: 1804006 - protein, 24 aa, Staphylococcus epidermidis
EGIYLSGALLMFAGNKSYYLYGAS

SEQ ID NO: 1804007 - protein, 19 aa, Staphylococcus epidermidis
EGKAWGCDLSYDYVKINAL

SEQ ID NO: 1804008 - protein, 18 aa, Staphylococcus epidermidis
EGKDEFYRGDLNDVTQLI

SEQ ID NO: 1804009 - protein, 25 aa, Staphylococcus epidermidis
EGKEWLNQAPFSFDLSVMAIYPCLT

SEQ ID NO: 1804010 - protein, 26 aa, Staphylococcus epidermidis
EGKKINYIRACLRYDGKNQSVNNSAI

SEQ ID NO: 1804011 - protein, 21 aa, Staphylococcus epidermidis
EGKKLAQSRGQWVNSVTPYGY

SEQ ID NO: 1804012 - protein, 18 aa, Staphylococcus epidermidis
EGKKVVLMRPETSPEDIE

SEQ ID NO: 1804013 - protein, 22 aa, Staphylococcus epidermidis
EGKLPREVIRYEYSLEYGTNIL

SEQ ID NO: 1804014 - protein, 18 aa, Staphylococcus epidermidis
EGKNVWFGVREFAMGAAV

SEQ ID NO: 1804015 - protein, 21 aa, Staphylococcus epidermidis
EGLDCPSCAKTVEKGLKKLKG

SEQ ID NO: 1804016 - protein, 29 aa, Staphylococcus epidermidis
EGLKELLAKWLFKYENQFPIYASEINTDP

SEQ ID NO: 1804017 - protein, 20 aa, Staphylococcus epidermidis
EGLKIFANLIEDNWGERWFF

SEQ ID NO: 1804018 - protein, 19 aa, Staphylococcus epidermidis
EGLKSLLDHDEFEVTIQTD

SEQ ID NO: 1804019 - protein, 18 aa, Staphylococcus epidermidis
EGLLKEQFYTEGKYKDAY

SEQ ID NO: 1804020 - protein, 17 aa, Staphylococcus epidermidis
EGLMLLKVVHYDENGQP

SEQ ID NO: 1804021 - protein, 19 aa, Staphylococcus epidermidis
EGLVRAGIGKLTIVDRDYI

SEQ ID NO: 1804022 - protein, 26 aa, Staphylococcus epidermidis
EGLYRKRLISYGGLLKEIHKELNLDD

SEQ ID NO: 1804023 - protein, 18 aa, Staphylococcus epidermidis
EGMDWLLHHAYHRVPQLK

SEQ ID NO: 1804024 - protein, 19 aa, Staphylococcus epidermidis
EGNIDCVMIYKTNRLARNT

SEQ ID NO: 1804025 - protein, 19 aa, Staphylococcus epidermidis
EGNRSMFSIALRQEIQERL

SEQ ID NO: 1804026 - protein, 21 aa, Staphylococcus epidermidis
EGNYEYCFFESAGKGQFKPVG

SEQ ID NO: 1804027 - protein, 18 aa, Staphylococcus epidermidis
EGQLFNVHRIDIHEHETK

SEQ ID NO: 1804028 - protein, 20 aa, Staphylococcus epidermidis
EGQRLIPYILEILESQNDLL

SEQ ID NO: 1804029 - protein, 22 aa, Staphylococcus epidermidis
EGQSVVEIIKIVDFEHPQNNDF

SEQ ID NO: 1804030 - protein, 19 aa, Staphylococcus epidermidis
EGQTLFFGGLARIDYVSGG

SEQ ID NO: 1804031 - protein, 21 aa, Staphylococcus epidermidis
EGRKPSIRFRVPKDKTYTFND

SEQ ID NO: 1804032 - protein, 18 aa, Staphylococcus epidermidis
EGRRDLRDDLTITIDGAD

SEQ ID NO: 1804033 - protein, 17 aa, Staphylococcus epidermidis
EGSIPRVLKEVTPSMMV

SEQ ID NO: 1804034 - protein, 20 aa, Staphylococcus epidermidis
EGSLRCDANISLRPYGQKEF

SEQ ID NO: 1804035 - protein, 25 aa, Staphylococcus epidermidis
EGSMLPKIEAAIEFVESGNHKEAII

SEQ ID NO: 1804036 - protein, 19 aa, Staphylococcus epidermidis
EGTIAEWLKNVGDSVDKGE

SEQ ID NO: 1804037 - protein, 21 aa, Staphylococcus epidermidis
EGTKLPVYVYKLFPEGPITMT

SEQ ID NO: 1804038 - protein, 25 aa, Staphylococcus epidermidis
EGTVVRLANFGAFVEIAPAVQGLVH

SEQ ID NO: 1804039 - protein, 17 aa, Staphylococcus epidermidis
EGVDSVIFTAGSGGSTG

SEQ ID NO: 1804040 - protein, 21 aa, Staphylococcus epidermidis
EGVKSIFYVMDFLAIDKQPKA

SEQ ID NO: 1804041 - protein, 26 aa, Staphylococcus epidermidis
EGVTCLPEIMIPLVSTVEEFTTLKER

SEQ ID NO: 1804042 - protein, 17 aa, Staphylococcus epidermidis
EGYHVIMDIPLLYENDL

SEQ ID NO: 1804043 - protein, 38 aa, Staphylococcus epidermidis
EGYLKLHKTWFCKSKLCPVCNWRRAMKNSYQAQKVIEE

SEQ ID NO: 1804044 - protein, 21 aa, Staphylococcus epidermidis
EGYSKFKSLLQHFNLQHQKPL

SEQ ID NO: 1804045 - protein, 19 aa, Staphylococcus epidermidis
EGYTKLTLLVEYGGEGATI

SEQ ID NO: 1804046 - protein, 24 aa, Staphylococcus epidermidis
EHAYKIGNKDVRFYVNKKGYVIKG

SEQ ID NO: 1804047 - protein, 24 aa, Staphylococcus epidermidis
EHAYQLLLDEGFIYSKPRSGYYVS

SEQ ID NO: 1804048 - protein, 20 aa, Staphylococcus epidermidis
EHFGDFVIRAGVIAKVHDGR

SEQ ID NO: 1804049 - protein, 20 aa, Staphylococcus epidermidis
EHFGDFVIRSGVVAKVHDGR

SEQ ID NO: 1804050 - protein, 25 aa, Staphylococcus epidermidis
EHFNKMEVPFIYRVHEQPKSERLRQ

SEQ ID NO: 1804051 - protein, 18 aa, Staphylococcus epidermidis
EHGIDRYNFYGISGDFSE

SEQ ID NO: 1804052 - protein, 22 aa, Staphylococcus epidermidis
EHGIDYCIVINFSSRFANVTSD

SEQ ID NO: 1804053 - protein, 28 aa, Staphylococcus epidermidis
EHGIDYCIVINFSSRFASVTSDDFIKKY

SEQ ID NO: 1804054 - protein, 18 aa, Staphylococcus epidermidis
EHGINRYNFYGISGDFSE

SEQ ID NO: 1804055 - protein, 22 aa, Staphylococcus epidermidis
EHHQCGVALYQLIPSKKEGEPD

SEQ ID NO: 1804056 - protein, 29 aa, Staphylococcus epidermidis
EHINRLKHRIKMDEWPQNLMITAVNAQKA

SEQ ID NO: 1804057 - protein, 19 aa, Staphylococcus epidermidis
EHLDLVYRGSYVMRYLLDG

SEQ ID NO: 1804058 - protein, 17 aa, Staphylococcus epidermidis
EHLKGDYIYQERDHQDI

SEQ ID NO: 1804059 - protein, 18 aa, Staphylococcus epidermidis
EHLKGDYIYQERDHQDIE

SEQ ID NO: 1804060 - protein, 24 aa, Staphylococcus epidermidis
EHLKSRVQSLICSKMPTNELDNYD

SEQ ID NO: 1804061 - protein, 19 aa, Staphylococcus epidermidis
EHMLFYFAYKTFITTADEI

SEQ ID NO: 1804062 - protein, 24 aa, Staphylococcus epidermidis
EHMPIEVIYGFAQLKRGAALANHE

SEQ ID NO: 1804063 - protein, 23 aa, Staphylococcus epidermidis
EHNLSVMCEADWIIDVGPGPGLD

SEQ ID NO: 1804064 - protein, 18 aa, Staphylococcus epidermidis
EHQFKHFIYTPVGFVCEH

SEQ ID NO: 1804065 - protein, 19 aa, Staphylococcus epidermidis
EHQLLYILIMHAFANTYVS

SEQ ID NO: 1804066 - protein, 23 aa, Staphylococcus epidermidis
EHSSQPLFLYAIFRLFLMNEDVV

SEQ ID NO: 1804067 - protein, 19 aa, Staphylococcus epidermidis
EHTIIKLRIKDELTIYDTL

SEQ ID NO: 1804068 - protein, 21 aa, Staphylococcus epidermidis
EHTIKYVSDWTESMSKIEDIE

SEQ ID NO: 1804069 - protein, 18 aa, Staphylococcus epidermidis
EHVKPVVVKSELFRNEEF

SEQ ID NO: 1804070 - protein, 19 aa, Staphylococcus epidermidis
EHYIGCGENMFDLNTFQVV

SEQ ID NO: 1804071 - protein, 18 aa, Staphylococcus epidermidis
EIASHAGVCDMIKVEVIG

SEQ ID NO: 1804072 - protein, 19 aa, Staphylococcus epidermidis
EIDEAKALKEKLENIEVEV

SEQ ID NO: 1804073 - protein, 21 aa, Staphylococcus epidermidis
EIDEFKFFAQYANFNSLKDYK

SEQ ID NO: 1804074 - protein, 19 aa, Staphylococcus epidermidis
EIDNLVWYFSELFKSELKL

SEQ ID NO: 1804075 - protein, 21 aa, Staphylococcus epidermidis
EIDVRGRVLGVSQKTRYNQQE

SEQ ID NO: 1804076 - protein, 21 aa, Staphylococcus epidermidis
EIEAMGGKVPQSMKNAHTSNS

SEQ ID NO: 1804077 - protein, 20 aa, Staphylococcus epidermidis
EIEEFKFFSQYANFNSLKDY

SEQ ID NO: 1804078 - protein, 24 aa, Staphylococcus epidermidis
EIEEVLNLPFPIYAIGGISQQTIA

SEQ ID NO: 1804079 - protein, 21 aa, Staphylococcus epidermidis
EIEGRTAIIIDDIIDTAGTIT

SEQ ID NO: 1804080 - protein, 24 aa, Staphylococcus epidermidis
EIENFKFFVQYGNFKDFKDYKNGD

SEQ ID NO: 1804081 - protein, 24 aa, Staphylococcus epidermidis
EIENFKFFVQYGNFKDIKNYKDGD

SEQ ID NO: 1804082 - protein, 24 aa, Staphylococcus epidermidis
EIENFKFFVQYGNFKNLENYKDES

SEQ ID NO: 1804083 - protein, 23 aa, Staphylococcus epidermidis
EIENFKFFVQYGNFKNLKHYKDG

SEQ ID NO: 1804084 - protein, 24 aa, Staphylococcus epidermidis
EIENFKFFVQYGNFKNLKHYKDGE

SEQ ID NO: 1804085 - protein, 21 aa, Staphylococcus epidermidis
EIENFKFFVQYGSFKNSDDYK

SEQ ID NO: 1804086 - protein, 23 aa, Staphylococcus epidermidis
EIENFKFFVQYGSFKNSDDYKEG

SEQ ID NO: 1804087 - protein, 26 aa, Staphylococcus epidermidis
EIEPPEGIFTPCHFDGEKWIGTSHEE

SEQ ID NO: 1804088 - protein, 18 aa, Staphylococcus epidermidis
EIERHLTIPQDFKEETKL

SEQ ID NO: 1804089 - protein, 23 aa, Staphylococcus epidermidis
EIESKRGGGGYIRITKIENKDAT

SEQ ID NO: 1804090 - protein, 25 aa, Staphylococcus epidermidis
EIESNLSALSFKYLTSHDALGSIIV

SEQ ID NO: 1804091 - protein, 20 aa, Staphylococcus epidermidis
EIETLFAKRLKEIKQIIANM

SEQ ID NO: 1804092 - protein, 38 aa, Staphylococcus epidermidis
EIFATAMNRKGYFLYGYRHFSSRIKGGHTNNKIRVSTS

SEQ ID NO: 1804093 - protein, 24 aa, Staphylococcus epidermidis
EIFDKAGVPKGVFNLVNGDGSGVG

SEQ ID NO: 1804094 - protein, 19 aa, Staphylococcus epidermidis
EIFNDLNLSISEHERIGLV

SEQ ID NO: 1804095 - protein, 20 aa, Staphylococcus epidermidis
EIFTNKAFDGFEVEQVKDLF

SEQ ID NO: 1804096 - protein, 19 aa, Staphylococcus epidermidis
EIGFPVVLKAASGGGGKGI

SEQ ID NO: 1804097 - protein, 20 aa, Staphylococcus epidermidis
EIGGAVAKRARAFDMDVLYT

SEQ ID NO: 1804098 - protein, 25 aa, Staphylococcus epidermidis
EIGKSPAQVIIRWNVQHGVVVIPKS

SEQ ID NO: 1804099 - protein, 18 aa, Staphylococcus epidermidis
EIGQVFIVDVTLKVDLKD

SEQ ID NO: 1804100 - protein, 20 aa, Staphylococcus epidermidis
EIGTAIGYSSMQFANISKDI

SEQ ID NO: 1804101 - protein, 24 aa, Staphylococcus epidermidis
EIHEQPAVMRRIIQEYQDEEGNLK

SEQ ID NO: 1804102 - protein, 18 aa, Staphylococcus epidermidis
EIHFPKSDVYLYAPVTGQ

SEQ ID NO: 1804103 - protein, 24 aa, Staphylococcus epidermidis
EIIAFKKSFHGRTYGAMSATGQKK

SEQ ID NO: 1804104 - protein, 23 aa, Staphylococcus epidermidis
EIIICKMDFTLALLFILVANDDM

SEQ ID NO: 1804105 - protein, 19 aa, Staphylococcus epidermidis
EIILGNLKYSSGPNHQLPS

SEQ ID NO: 1804106 - protein, 19 aa, Staphylococcus epidermidis
EIKELVAQLTLNFLDGDVD

SEQ ID NO: 1804107 - protein, 19 aa, Staphylococcus epidermidis
EIKSLVNIPIIASGGGGNA

SEQ ID NO: 1804108 - protein, 26 aa, Staphylococcus epidermidis
EIKYPRIKRIQLLADYFNVPKSELTE

SEQ ID NO: 1804109 - protein, 25 aa, Staphylococcus epidermidis
EILNHKRLDAMIVLSDFNRRYLSGF

SEQ ID NO: 1804110 - protein, 18 aa, Staphylococcus epidermidis
EILNRMDDIVLFKPLSVD

SEQ ID NO: 1804111 - protein, 18 aa, Staphylococcus epidermidis
EILNRMDDIVLFKPLSVS

SEQ ID NO: 1804112 - protein, 27 aa, Staphylococcus epidermidis
EIMEIGVSKGFFGVAGFDLLVDDKNDV

SEQ ID NO: 1804113 - protein, 27 aa, Staphylococcus epidermidis
EIMEIGVSKGFFGVAGFDLLVDKNDDV

SEQ ID NO: 1804114 - protein, 20 aa, Staphylococcus epidermidis
EINEGSLFIPFKGENVDGHR

SEQ ID NO: 1804115 - protein, 34 aa, Staphylococcus epidermidis
EINEIKHFIKSYVQSHSFIKSLVLGISGGQDSTL

SEQ ID NO: 1804116 - protein, 23 aa, Staphylococcus epidermidis
EINSDFFIPGRKSFINEVENGNQ

SEQ ID NO: 1804117 - protein, 31 aa, Staphylococcus epidermidis
EIPIEAIEQAFKIAKAHGVTTILNPAPAIDL

SEQ ID NO: 1804118 - protein, 18 aa, Staphylococcus epidermidis
EIPISIEVPDEIDNINMN

SEQ ID NO: 1804119 - protein, 24 aa, Staphylococcus epidermidis
EIQEIKQFIKAYVKSHSFIQTLVL

SEQ ID NO: 1804120 - protein, 20 aa, Staphylococcus epidermidis
EIQKLCDEMAIMSQGNIEVQ

SEQ ID NO: 1804121 - protein, 19 aa, Staphylococcus epidermidis
EIRLRPSYFPFTEPSVEVD

SEQ ID NO: 1804122 - protein, 24 aa, Staphylococcus epidermidis
EISEDAKFGKFVVEPLERGYGTTL

SEQ ID NO: 1804123 - protein, 17 aa, Staphylococcus epidermidis
EISMLLKSIKLMRKELK

SEQ ID NO: 1804124 - protein, 23 aa, Staphylococcus epidermidis
EISQLKDLVGVFIGDSITEVNLR

SEQ ID NO: 1804125 - protein, 27 aa, Staphylococcus epidermidis
EISSDYLLCKAFGKTATNIEKYTSQGT

SEQ ID NO: 1804126 - protein, 34 aa, Staphylococcus epidermidis
EITEFPFTDLISFKEIKERLGLNYQTEVIVNEVV

SEQ ID NO: 1804127 - protein, 26 aa, Staphylococcus epidermidis
EITEIIPSYRAILIYFDNTKIKGNEL

SEQ ID NO: 1804128 - protein, 20 aa, Staphylococcus epidermidis
EITSKLIFELISSRISSEQI

SEQ ID NO: 1804129 - protein, 17 aa, Staphylococcus epidermidis
EITSLKMGNIEDQVETI

SEQ ID NO: 1804130 - protein, 18 aa, Staphylococcus epidermidis
EIVADFYSSGVIEVLRRW

SEQ ID NO: 1804131 - protein, 17 aa, Staphylococcus epidermidis
EIVAFAGDARSKFLEAL

SEQ ID NO: 1804132 - protein, 25 aa, Staphylococcus epidermidis
EIVEKKLPFLFGEDFSFYGQQLAPS

SEQ ID NO: 1804133 - protein, 18 aa, Staphylococcus epidermidis
EIVKWFVKAGDTIEEDDV

SEQ ID NO: 1804134 - protein, 25 aa, Staphylococcus epidermidis
EIVPIWKKEIWEDGAEWQGHQKGTH

SEQ ID NO: 1804135 - protein, 18 aa, Staphylococcus epidermidis
EIVYLALHIYHFEAQINI

SEQ ID NO: 1804136 - protein, 17 aa, Staphylococcus epidermidis
EIYEYVHQILPLSRKRE

SEQ ID NO: 1804137 - protein, 26 aa, Staphylococcus epidermidis
EIYNELLRRYDFVLIDTPPVNTVTDA

SEQ ID NO: 1804138 - protein, 19 aa, Staphylococcus epidermidis
EKADFIKRVIKSEEERFHE

SEQ ID NO: 1804139 - protein, 24 aa, Staphylococcus epidermidis
EKAKSLACQFAFYGHTHIAKYENI

SEQ ID NO: 1804140 - protein, 17 aa, Staphylococcus epidermidis
EKAPFYATPRKPAIHHT

SEQ ID NO: 1804141 - protein, 20 aa, Staphylococcus epidermidis
EKAQELIQGLVMTNSIVQGG

SEQ ID NO: 1804142 - protein, 22 aa, Staphylococcus epidermidis
EKAYQLLLDLGFSRDIMSLSPF

SEQ ID NO: 1804143 - protein, 26 aa, Staphylococcus epidermidis
EKDELFKCFAETYAPSMRDSEVLDVA

SEQ ID NO: 1804144 - protein, 23 aa, Staphylococcus epidermidis
EKDFKQGIKYAYHATKYEGKNDV

SEQ ID NO: 1804145 - protein, 22 aa, Staphylococcus epidermidis
EKDGRQAIQYLKQRGLGRATFL

SEQ ID NO: 1804146 - protein, 21 aa, Staphylococcus epidermidis
EKDIINYLLGVDVELFNTYHY

SEQ ID NO: 1804147 - protein, 19 aa, Staphylococcus epidermidis
EKDLFKYYFEHRFNQNDIV

SEQ ID NO: 1804148 - protein, 22 aa, Staphylococcus epidermidis
EKDMALRWGKENNIDVTTSTEL

SEQ ID NO: 1804149 - protein, 23 aa, Staphylococcus epidermidis
EKDPKLLPFQGYILQNFELDDEG

SEQ ID NO: 1804150 - protein, 19 aa, Staphylococcus epidermidis
EKDVLEAGSTVYIYEEIQD

SEQ ID NO: 1804151 - protein, 22 aa, Staphylococcus epidermidis
EKEFFDLYSKVVIEIPTHSPIE

SEQ ID NO: 1804152 - protein, 24 aa, Staphylococcus epidermidis
EKEITRLAQHLGWKGEGTNFDILP

SEQ ID NO: 1804153 - protein, 19 aa, Staphylococcus epidermidis
EKEKDFLQVIVKDEDSQLP

SEQ ID NO: 1804154 - protein, 19 aa, Staphylococcus epidermidis
EKELKQFGLTYSQYLVLLV

SEQ ID NO: 1804155 - protein, 18 aa, Staphylococcus epidermidis
EKELRDFLNNVPNDIPVL

SEQ ID NO: 1804156 - protein, 18 aa, Staphylococcus epidermidis
EKELRFLKFFHQQKYNVV

SEQ ID NO: 1804157 - protein, 18 aa, Staphylococcus epidermidis
EKEMFGRQDAILNEFGLT

SEQ ID NO: 1804158 - protein, 19 aa, Staphylococcus epidermidis
EKEMFGRQDAILNSYGLTR

SEQ ID NO: 1804159 - protein, 17 aa, Staphylococcus epidermidis
EKEREIGAKYVDLDTLL

SEQ ID NO: 1804160 - protein, 23 aa, Staphylococcus epidermidis
EKESFGLTLLEAMKTGVLPIGTN

SEQ ID NO: 1804161 - protein, 23 aa, Staphylococcus epidermidis
EKESFGLTLLEAMKTGVLPLGSR

SEQ ID NO: 1804162 - protein, 20 aa, Staphylococcus epidermidis
EKFGPFLLRDCNNIFQKKWK

SEQ ID NO: 1804163 - protein, 21 aa, Staphylococcus epidermidis
EKFGRQCICIAIDSYYDENRH

SEQ ID NO: 1804164 - protein, 17 aa, Staphylococcus epidermidis
EKFPQFNDYGCKILKSF

SEQ ID NO: 1804165 - protein, 26 aa, Staphylococcus epidermidis
EKFRGIRSNIMFSRAKDEIVSIIVTS

SEQ ID NO: 1804166 - protein, 21 aa, Staphylococcus epidermidis
EKFSQHLGLMFQIKDDLLDVY

SEQ ID NO: 1804167 - protein, 17 aa, Staphylococcus epidermidis
EKFYAIPQSEHFLPSQT

SEQ ID NO: 1804168 - protein, 22 aa, Staphylococcus epidermidis
EKFYLFEEIEAIIFDHYKSYFS

SEQ ID NO: 1804169 - protein, 23 aa, Staphylococcus epidermidis
EKGDEVLPITFIEGGIAKTGAYI

SEQ ID NO: 1804170 - protein, 22 aa, Staphylococcus epidermidis
EKGFTVVDTFGFDAPKTKEFKN

SEQ ID NO: 1804171 - protein, 23 aa, Staphylococcus epidermidis
EKGLYRKRMLSYGGLLKQKGSVA

SEQ ID NO: 1804172 - protein, 24 aa, Staphylococcus epidermidis
EKGLYRKRMLSYGGLLKQKHKILN

SEQ ID NO: 1804173 - protein, 25 aa, Staphylococcus epidermidis
EKGLYRKRMLSYGGLLKQKHKILNL

SEQ ID NO: 1804174 - protein, 24 aa, Staphylococcus epidermidis
EKGPEVPRGLPIIPEAYSPKLKRV

SEQ ID NO: 1804175 - protein, 20 aa, Staphylococcus epidermidis
EKGRIFCYILDKDQYVIGGP

SEQ ID NO: 1804176 - protein, 22 aa, Staphylococcus epidermidis
EKGVHRLVRISPFDSSGRRHTS

SEQ ID NO: 1804177 - protein, 24 aa, Staphylococcus epidermidis
EKHGLKMIYGMEGMLVDDGVPIAY

SEQ ID NO: 1804178 - protein, 19 aa, Staphylococcus epidermidis
EKHILMLVATGSDLHLEKK

SEQ ID NO: 1804179 - protein, 18 aa, Staphylococcus epidermidis
EKHPRLIVTRTVKKGTGK

SEQ ID NO: 1804180 - protein, 19 aa, Staphylococcus epidermidis
EKIEWLIPFLNYSGPTIIY

SEQ ID NO: 1804181 - protein, 17 aa, Staphylococcus epidermidis
EKILKVDGFLNHQIDAS

SEQ ID NO: 1804182 - protein, 24 aa, Staphylococcus epidermidis
EKIREAFKDRILIPQNDFDRSPKK

SEQ ID NO: 1804183 - protein, 19 aa, Staphylococcus epidermidis
EKIRKALYMSKICSYAQGF

SEQ ID NO: 1804184 - protein, 19 aa, Staphylococcus epidermidis
EKISIVPHFIKSYGQKDTH

SEQ ID NO: 1804185 - protein, 19 aa, Staphylococcus epidermidis
EKISIVPHFIKSYGQQDTH

SEQ ID NO: 1804186 - protein, 20 aa, Staphylococcus epidermidis
EKISIVPHFIKSYGQQDTQD

SEQ ID NO: 1804187 - protein, 27 aa, Staphylococcus epidermidis
EKITRAIHFVGTFTVEFFIDKEDNLYV

SEQ ID NO: 1804188 - protein, 25 aa, Staphylococcus epidermidis
EKIVFVNHLGKIIAMNDAASDILSE

SEQ ID NO: 1804189 - protein, 22 aa, Staphylococcus epidermidis
EKKEIFLYLMYVYQQIVKADIE

SEQ ID NO: 1804190 - protein, 17 aa, Staphylococcus epidermidis
EKKGFKLVGGKFMQVPM

SEQ ID NO: 1804191 - protein, 23 aa, Staphylococcus epidermidis
EKKHKGRMSLFYYAELTYQPTHC

SEQ ID NO: 1804192 - protein, 20 aa, Staphylococcus epidermidis
EKKPACTVITMYPHLDGVLS

SEQ ID NO: 1804193 - protein, 19 aa, Staphylococcus epidermidis
EKKRFKADIDRVVSKHECP

SEQ ID NO: 1804194 - protein, 19 aa, Staphylococcus epidermidis
EKKSISMTVRYDVEKIAYA

SEQ ID NO: 1804195 - protein, 20 aa, Staphylococcus epidermidis
EKKSKEIINEFWQYDQDDKN

SEQ ID NO: 1804196 - protein, 21 aa, Staphylococcus epidermidis
EKLGDIIDLFTFKVGDTESRK

SEQ ID NO: 1804197 - protein, 22 aa, Staphylococcus epidermidis
EKLKEAQALDEAMKQLENQVSK

SEQ ID NO: 1804198 - protein, 21 aa, Staphylococcus epidermidis
EKLKKMITFVIVNRDKAYQEV

SEQ ID NO: 1804199 - protein, 22 aa, Staphylococcus epidermidis
EKLKSEGVQFYFNENTQSVKKD

SEQ ID NO: 1804200 - protein, 17 aa, Staphylococcus epidermidis
EKLPSASVMKSLIQEPE

SEQ ID NO: 1804201 - protein, 19 aa, Staphylococcus epidermidis
EKLREAFHLNFDDVGKDIE

SEQ ID NO: 1804202 - protein, 34 aa, Staphylococcus epidermidis
EKLRRHMSFLMRKGKLYLPYNGNLLIHGCIPVNE

SEQ ID NO: 1804203 - protein, 23 aa, Staphylococcus epidermidis
EKLWELNSPYNLVICQKSKLEDW

SEQ ID NO: 1804204 - protein, 22 aa, Staphylococcus epidermidis
EKLYNFIIAKSFQQPVGSTFTY

SEQ ID NO: 1804205 - protein, 18 aa, Staphylococcus epidermidis
EKMALKLTFQMLFIMLRE

SEQ ID NO: 1804206 - protein, 24 aa, Staphylococcus epidermidis
EKMKLQSPRLMLGFKNQPLNESSE

SEQ ID NO: 1804207 - protein, 24 aa, Staphylococcus epidermidis
EKMPEIKIQGFLGSLGDKQGFAYI

SEQ ID NO: 1804208 - protein, 23 aa, Staphylococcus epidermidis
EKMPYRAKRHYSIVEGDKQHLTF

SEQ ID NO: 1804209 - protein, 24 aa, Staphylococcus epidermidis
EKMRFKGSSYTGGFVEGNAPEFPI

SEQ ID NO: 1804210 - protein, 29 aa, Staphylococcus epidermidis
EKNEIQEIKEFICIYSLSKSESSVLNLRT

SEQ ID NO: 1804211 - protein, 21 aa, Staphylococcus epidermidis
EKPKDIYIFEAPIDALSYRTL

SEQ ID NO: 1804212 - protein, 19 aa, Staphylococcus epidermidis
EKPWNSIEMTIKDLDNHLI

SEQ ID NO: 1804213 - protein, 23 aa, Staphylococcus epidermidis
EKQEKRHETTIEFYRKELQERSK

SEQ ID NO: 1804214 - protein, 18 aa, Staphylococcus epidermidis
EKQIKAVLKLLKENNTVP

SEQ ID NO: 1804215 - protein, 23 aa, Staphylococcus epidermidis
EKQKENDKGIAIEETQTKKGFWS

SEQ ID NO: 1804216 - protein, 25 aa, Staphylococcus epidermidis
EKRMILERILPILSDRERQIIQCTF

SEQ ID NO: 1804217 - protein, 17 aa, Staphylococcus epidermidis
EKRTWQAAIDPVGGENL

SEQ ID NO: 1804218 - protein, 28 aa, Staphylococcus epidermidis
EKSGWTDIFIYPGFEYKAIDGLITNFHL

SEQ ID NO: 1804219 - protein, 21 aa, Staphylococcus epidermidis
EKSIFKQGLLKAASLKYQRLA

SEQ ID NO: 1804220 - protein, 18 aa, Staphylococcus epidermidis
EKSLLTKKIEAMTDNKAQ

SEQ ID NO: 1804221 - protein, 20 aa, Staphylococcus epidermidis
EKSMPLYRECIDVNTEIKFK

SEQ ID NO: 1804222 - protein, 18 aa, Staphylococcus epidermidis
EKTPRWLEERTYEKQIKN

SEQ ID NO: 1804223 - protein, 17 aa, Staphylococcus epidermidis
EKTRKALEEYGINYDQI

SEQ ID NO: 1804224 - protein, 21 aa, Staphylococcus epidermidis
EKTYYSYRMDNLIVSYLIQAH

SEQ ID NO: 1804225 - protein, 17 aa, Staphylococcus epidermidis
EKVAALDGEHKLQQAKE

SEQ ID NO: 1804226 - protein, 21 aa, Staphylococcus epidermidis
EKVALLKRYGVNRISMGVQTF

SEQ ID NO: 1804227 - protein, 18 aa, Staphylococcus epidermidis
EKVDFIWSHTLKTINEKD

SEQ ID NO: 1804228 - protein, 21 aa, Staphylococcus epidermidis
EKVKIIMKILKAMSQAHSENK

SEQ ID NO: 1804229 - protein, 19 aa, Staphylococcus epidermidis
EKVKNIYRLSKMIEKEPNM

SEQ ID NO: 1804230 - protein, 25 aa, Staphylococcus epidermidis
EKVLETESDFGLAFDGDGDRIIAVD

SEQ ID NO: 1804231 - protein, 19 aa, Staphylococcus epidermidis
EKVLIHVSNFRKVKRIDTV

SEQ ID NO: 1804232 - protein, 24 aa, Staphylococcus epidermidis
EKVRNEVLEYFKGFEEITEIEDQQ

SEQ ID NO: 1804233 - protein, 23 aa, Staphylococcus epidermidis
EKVVEMYISLALVKKILQLVFNV

SEQ ID NO: 1804234 - protein, 26 aa, Staphylococcus epidermidis
EKWNIIRPPFNVTRLSEYAAIAALED

SEQ ID NO: 1804235 - protein, 18 aa, Staphylococcus epidermidis
EKWTDKRESLSYDIDGIV

SEQ ID NO: 1804236 - protein, 21 aa, Staphylococcus epidermidis
EKWVCSICAQGDNPWHQSHDD

SEQ ID NO: 1804237 - protein, 18 aa, Staphylococcus epidermidis
EKYCKYNLFNVIGIEKID

SEQ ID NO: 1804238 - protein, 29 aa, Staphylococcus epidermidis
EKYMLSLKLSDFIYVFRMFSLGIADYTLS

SEQ ID NO: 1804239 - protein, 24 aa, Staphylococcus epidermidis
EKYSRLRSLYCYEVYNEKGELATT

SEQ ID NO: 1804240 - protein, 25 aa, Staphylococcus epidermidis
EKYVPYCIEPSLGADRVTLAFLCDA

SEQ ID NO: 1804241 - protein, 21 aa, Staphylococcus epidermidis
ELACHNIHFEIIPGIPVTHRD

SEQ ID NO: 1804242 - protein, 32 aa, Staphylococcus epidermidis
ELAELTCLNPVQLRRVVSVLSDQHYITTVRGK

SEQ ID NO: 1804243 - protein, 19 aa, Staphylococcus epidermidis
ELAIVFGRTKRRVDELTSA

SEQ ID NO: 1804244 - protein, 17 aa, Staphylococcus epidermidis
ELALQYKDYSEWMANRD

SEQ ID NO: 1804245 - protein, 25 aa, Staphylococcus epidermidis
ELAQYRKAQKLSLSYKTFGIPMSYN

SEQ ID NO: 1804246 - protein, 23 aa, Staphylococcus epidermidis
ELCHALLDYQEFYASKKDQAGEL

SEQ ID NO: 1804247 - protein, 21 aa, Staphylococcus epidermidis
ELDDHFPLVVWQTGSGTQSNM

SEQ ID NO: 1804248 - protein, 17 aa, Staphylococcus epidermidis
ELDDLFNGRVHTIMSNP

SEQ ID NO: 1804249 - protein, 26 aa, Staphylococcus epidermidis
ELDLFTCLRPVRWFQGVPSPVKRPED

SEQ ID NO: 1804250 - protein, 17 aa, Staphylococcus epidermidis
ELDLTVFHNGKRSVARY

SEQ ID NO: 1804251 - protein, 21 aa, Staphylococcus epidermidis
ELDPTRVIVEFNKALIKQDAY

SEQ ID NO: 1804252 - protein, 18 aa, Staphylococcus epidermidis
ELEEIHALNMRRQNMKQH

SEQ ID NO: 1804253 - protein, 22 aa, Staphylococcus epidermidis
ELEELRLRVATTRPQENKNFSS

SEQ ID NO: 1804254 - protein, 18 aa, Staphylococcus epidermidis
ELEEYGGTPELFWQSREL

SEQ ID NO: 1804255 - protein, 21 aa, Staphylococcus epidermidis
ELEGHSVALLAQDYYYKDQSH

SEQ ID NO: 1804256 - protein, 23 aa, Staphylococcus epidermidis
ELEIPDKVEGTGVEFEYTDEEYN

SEQ ID NO: 1804257 - protein, 24 aa, Staphylococcus epidermidis
ELELSRTKLLVSIRRLIDKERLSK

SEQ ID NO: 1804258 - protein, 21 aa, Staphylococcus epidermidis
ELESKLPYYMIPTNIFQLDNL

SEQ ID NO: 1804259 - protein, 20 aa, Staphylococcus epidermidis
ELETSLFINKQWYPTVDKVS

SEQ ID NO: 1804260 - protein, 29 aa, Staphylococcus epidermidis
ELEVAHYFDRLFSQYGIRSHIDTVTDGRA

SEQ ID NO: 1804261 - protein, 28 aa, Staphylococcus epidermidis
ELEVAHYFERLFSQYGIRSHIDTVTDGR

SEQ ID NO: 1804262 - protein, 21 aa, Staphylococcus epidermidis
ELEVAKYLQTWFDKYGIESEL

SEQ ID NO: 1804263 - protein, 29 aa, Staphylococcus epidermidis
ELFDKKVIVTWCVGHLIQLAHMEDYDSNL

SEQ ID NO: 1804264 - protein, 22 aa, Staphylococcus epidermidis
ELFELDCDILVPAAISNQITED

SEQ ID NO: 1804265 - protein, 19 aa, Staphylococcus epidermidis
ELFKKLKGVGPYTQAAVMS

SEQ ID NO: 1804266 - protein, 19 aa, Staphylococcus epidermidis
ELFLKDVFFIEVSHFEAHH

SEQ ID NO: 1804267 - protein, 27 aa, Staphylococcus epidermidis
ELFMFELRMQWLNRLEKTSDEAIEIDY

SEQ ID NO: 1804268 - protein, 18 aa, Staphylococcus epidermidis
ELGDNLFVLLCIANSLGI

SEQ ID NO: 1804269 - protein, 25 aa, Staphylococcus epidermidis
ELGEIPKKWNILTINDFADDLIITG

SEQ ID NO: 1804270 - protein, 18 aa, Staphylococcus epidermidis
ELGFNYRLSNISAGIGRG

SEQ ID NO: 1804271 - protein, 20 aa, Staphylococcus epidermidis
ELGIDWPSVHADLEMVRDNL

SEQ ID NO: 1804272 - protein, 27 aa, Staphylococcus epidermidis
ELGLPYRRVILCTGDIGFSASKTYDLE

SEQ ID NO: 1804273 - protein, 25 aa, Staphylococcus epidermidis
ELGQDGYRFNTVWTSGLNDRIKIVN

SEQ ID NO: 1804274 - protein, 22 aa, Staphylococcus epidermidis
ELGTIFRPSVIGMINVLNYLFD

SEQ ID NO: 1804275 - protein, 20 aa, Staphylococcus epidermidis
ELGVHLKVGHLAQVLEGAQR

SEQ ID NO: 1804276 - protein, 24 aa, Staphylococcus epidermidis
ELIDKYEFVYGIIGWHPVDAIDCT

SEQ ID NO: 1804277 - protein, 17 aa, Staphylococcus epidermidis
ELIEKFKKDFPNHKVKI

SEQ ID NO: 1804278 - protein, 18 aa, Staphylococcus epidermidis
ELIIKTDMPHFVMFTFND

SEQ ID NO: 1804279 - protein, 17 aa, Staphylococcus epidermidis
ELIKELEEYGGTPELFW

SEQ ID NO: 1804280 - protein, 18 aa, Staphylococcus epidermidis
ELIVKKAQEGVTFLISSH

SEQ ID NO: 1804281 - protein, 18 aa, Staphylococcus epidermidis
ELKERKLRIEDALNSTRA

SEQ ID NO: 1804282 - protein, 17 aa, Staphylococcus epidermidis
ELKESYPELKLGIITPF

SEQ ID NO: 1804283 - protein, 21 aa, Staphylococcus epidermidis
ELKIKGRVYSFSISDEAKNKY

SEQ ID NO: 1804284 - protein, 22 aa, Staphylococcus epidermidis
ELKNRRATLVNLQRIDKVSAKR

SEQ ID NO: 1804285 - protein, 25 aa, Staphylococcus epidermidis
ELKNRRATLVNLQRIDQVSAKRIID

SEQ ID NO: 1804286 - protein, 22 aa, Staphylococcus epidermidis
ELKPDLILMDLLMDDMDGVEAT

SEQ ID NO: 1804287 - protein, 21 aa, Staphylococcus epidermidis
ELKPLCVNSNFVVIEEAEDYV

SEQ ID NO: 1804288 - protein, 32 aa, Staphylococcus epidermidis
ELKSSRPLTDIYNRLGFSFGTIGNHEFNYGLS

SEQ ID NO: 1804289 - protein, 19 aa, Staphylococcus epidermidis
ELKYDYVRLQNDLDKRESL

SEQ ID NO: 1804290 - protein, 17 aa, Staphylococcus epidermidis
ELLKPNWTDTDWQSLPL

SEQ ID NO: 1804291 - protein, 19 aa, Staphylococcus epidermidis
ELLNACADEIISLENGSLK

SEQ ID NO: 1804292 - protein, 25 aa, Staphylococcus epidermidis
ELLNHGITSYGYRIEAPTTPGTIDV

SEQ ID NO: 1804293 - protein, 21 aa, Staphylococcus epidermidis
ELLPSYVKDCYPHINEITLAV

SEQ ID NO: 1804294 - protein, 21 aa, Staphylococcus epidermidis
ELLRKSDLVVTIGYDPIEYEA

SEQ ID NO: 1804295 - protein, 17 aa, Staphylococcus epidermidis
ELLSCCLETEQQLHRVR

SEQ ID NO: 1804296 - protein, 19 aa, Staphylococcus epidermidis
ELLSESKLVTSMDLVEVNP

SEQ ID NO: 1804297 - protein, 17 aa, Staphylococcus epidermidis
ELLVRVFCDCFKFKEIV

SEQ ID NO: 1804298 - protein, 19 aa, Staphylococcus epidermidis
ELMERMVWTRILDQRSISL

SEQ ID NO: 1804299 - protein, 28 aa, Staphylococcus epidermidis
ELMNRLTGRRICEKCGTTYHLVFNPPKV

SEQ ID NO: 1804300 - protein, 26 aa, Staphylococcus epidermidis
ELMSNGYHNYAWDRYYLENVSEDCLK

SEQ ID NO: 1804301 - protein, 20 aa, Staphylococcus epidermidis
ELNDEIAFFKAVKAGLVKLL

SEQ ID NO: 1804302 - protein, 27 aa, Staphylococcus epidermidis
ELNEIKKKFKVDRLSAIEAEISEIKID

SEQ ID NO: 1804303 - protein, 20 aa, Staphylococcus epidermidis
ELNGFKVNRTIDWSKVETDH

SEQ ID NO: 1804304 - protein, 17 aa, Staphylococcus epidermidis
ELNHEVERLYVFTKAAS

SEQ ID NO: 1804305 - protein, 22 aa, Staphylococcus epidermidis
ELNLKGGQKMYFDQKIETYVPV

SEQ ID NO: 1804306 - protein, 22 aa, Staphylococcus epidermidis
ELNPDYCIPGPFDKRVAPSVAR

SEQ ID NO: 1804307 - protein, 26 aa, Staphylococcus epidermidis
ELNPSPKWSIARYKGLGEMNADQLWE

SEQ ID NO: 1804308 - protein, 26 aa, Staphylococcus epidermidis
ELNRRFPRIYWQTACLNVDSDSISTD

SEQ ID NO: 1804309 - protein, 20 aa, Staphylococcus epidermidis
ELPQRESLFYALNKYEYAGC

SEQ ID NO: 1804310 - protein, 22 aa, Staphylococcus epidermidis
ELQDMYEIYKSVPTQAQKIKEA

SEQ ID NO: 1804311 - protein, 27 aa, Staphylococcus epidermidis
ELQGAHTVVWNGPMGVFEFSNFAQGTI

SEQ ID NO: 1804312 - protein, 20 aa, Staphylococcus epidermidis
ELQKRIEYWETWKSDIDAKY

SEQ ID NO: 1804313 - protein, 21 aa, Staphylococcus epidermidis
ELQPRYELIPKFGKQRKTEYI

SEQ ID NO: 1804314 - protein, 20 aa, Staphylococcus epidermidis
ELRAQSTPVYDRHDKTEKRS

SEQ ID NO: 1804315 - protein, 20 aa, Staphylococcus epidermidis
ELREAIPVTVTLDYDQTGKF

SEQ ID NO: 1804316 - protein, 20 aa, Staphylococcus epidermidis
ELRECVRFHLEIENEQNRLK

SEQ ID NO: 1804317 - protein, 25 aa, Staphylococcus epidermidis
ELRELQSRLGITFIFVTHDQEEALA

SEQ ID NO: 1804318 - protein, 25 aa, Staphylococcus epidermidis
ELRELRLIKTLQHFDINISHKKARE

SEQ ID NO: 1804319 - protein, 26 aa, Staphylococcus epidermidis
ELREMKHRTAFEFHFEDLFTEEEWLN

SEQ ID NO: 1804320 - protein, 24 aa, Staphylococcus epidermidis
ELRFPEFSKEWEFQELGNLAQFSK

SEQ ID NO: 1804321 - protein, 23 aa, Staphylococcus epidermidis
ELRNAEVKEVVFFNEEVKYSKQN

SEQ ID NO: 1804322 - protein, 21 aa, Staphylococcus epidermidis
ELRQKMGMVFQSFNLFPHKKV

SEQ ID NO: 1804323 - protein, 19 aa, Staphylococcus epidermidis
ELSDRIKLNIPVISAGMDT

SEQ ID NO: 1804324 - protein, 20 aa, Staphylococcus epidermidis
ELSDYLPLMLQFLQIADWEN

SEQ ID NO: 1804325 - protein, 17 aa, Staphylococcus epidermidis
ELSKRLTGNKITFYSSG

SEQ ID NO: 1804326 - protein, 33 aa, Staphylococcus epidermidis
ELSRTQGFDGWAPLFFRGREVSGKTIGIIGLGE

SEQ ID NO: 1804327 - protein, 20 aa, Staphylococcus epidermidis
ELTEDLALKKCWMLNQMSSF

SEQ ID NO: 1804328 - protein, 30 aa, Staphylococcus epidermidis
ELTPRNAKWFKERFNIDIYTKYEVNQINDT

SEQ ID NO: 1804329 - protein, 26 aa, Staphylococcus epidermidis
ELTRHNIGFEVIDYLLERNQFTLDKQ

SEQ ID NO: 1804330 - protein, 24 aa, Staphylococcus epidermidis
ELTSELRKSLFVNHKSSRKSRENR

SEQ ID NO: 1804331 - protein, 18 aa, Staphylococcus epidermidis
ELTTNIEKVIDWLNHETI

SEQ ID NO: 1804332 - protein, 30 aa, Staphylococcus epidermidis
ELVDQLKFFINERIIPVIPQQGSLGASGDL

SEQ ID NO: 1804333 - protein, 20 aa, Staphylococcus epidermidis
ELVGAVPVLIKRNGKVDEKI

SEQ ID NO: 1804334 - protein, 21 aa, Staphylococcus epidermidis
ELWDSSFSLTDEWIKEYKQSF

SEQ ID NO: 1804335 - protein, 19 aa, Staphylococcus epidermidis
ELWNLFEYSLEYFEINGSY

SEQ ID NO: 1804336 - protein, 17 aa, Staphylococcus epidermidis
ELYDYATQLGLEVLVEV

SEQ ID NO: 1804337 - protein, 20 aa, Staphylococcus epidermidis
EMAPLFKWLNSSFNDNGFSL

SEQ ID NO: 1804338 - protein, 25 aa, Staphylococcus epidermidis
EMEFIKIIKIESVLFEEDLIRAMSQ

SEQ ID NO: 1804339 - protein, 20 aa, Staphylococcus epidermidis
EMGEYFQVVNNFAMEVGAGM

SEQ ID NO: 1804340 - protein, 21 aa, Staphylococcus epidermidis
EMHRVLKPGGKVVCLETSQPT

SEQ ID NO: 1804341 - protein, 20 aa, Staphylococcus epidermidis
EMHVIRRMCDEVAVMENGKV

SEQ ID NO: 1804342 - protein, 25 aa, Staphylococcus epidermidis
EMKRCDLKFSLHENILEIKYSNHII

SEQ ID NO: 1804343 - protein, 26 aa, Staphylococcus epidermidis
EMLNHGIPSFGYRIEAPITPGTINVD

SEQ ID NO: 1804344 - protein, 17 aa, Staphylococcus epidermidis
EMLWLKQNVIDYMEDDG

SEQ ID NO: 1804345 - protein, 23 aa, Staphylococcus epidermidis
EMMPMNILENGFSKLVINGNADD

SEQ ID NO: 1804346 - protein, 28 aa, Staphylococcus epidermidis
EMPIVMPRLRITYLYARTKKLLKQYNLS

SEQ ID NO: 1804347 - protein, 20 aa, Staphylococcus epidermidis
EMRKEIKTNLSHECKDWTFF

SEQ ID NO: 1804348 - protein, 21 aa, Staphylococcus epidermidis
EMSADAFIGADFVVAQLEVPF

SEQ ID NO: 1804349 - protein, 23 aa, Staphylococcus epidermidis
EMSLRLVDFKVEFGKTHDGTILL

SEQ ID NO: 1804350 - protein, 23 aa, Staphylococcus epidermidis
EMSLRLVDFKVEFGKTNSGKILL

SEQ ID NO: 1804351 - protein, 21 aa, Staphylococcus epidermidis
EMTASELIEWGFENNVKNRKF

SEQ ID NO: 1804352 - protein, 31 aa, Staphylococcus epidermidis
ENAFDFPGFVPAYIRPLFCEGKGPFRFAALS

SEQ ID NO: 1804353 - protein, 23 aa, Staphylococcus epidermidis
ENAHTTWELGVVWKKDKRLSHAT

SEQ ID NO: 1804354 - protein, 21 aa, Staphylococcus epidermidis
ENAKLKILNRFLNKNDNNDEK

SEQ ID NO: 1804355 - protein, 20 aa, Staphylococcus epidermidis
ENDGRTGLDKALNKSYDLII

SEQ ID NO: 1804356 - protein, 18 aa, Staphylococcus epidermidis
ENDIEPYPGIKMIHTGGH

SEQ ID NO: 1804357 - protein, 26 aa, Staphylococcus epidermidis
ENEDRYLLYLFDWRVIESESKGDNFN

SEQ ID NO: 1804358 - protein, 19 aa, Staphylococcus epidermidis
ENEKPIAPGMKYKHYSPET

SEQ ID NO: 1804359 - protein, 20 aa, Staphylococcus epidermidis
ENERGIVDIETLKATQSDII

SEQ ID NO: 1804360 - protein, 19 aa, Staphylococcus epidermidis
ENFEALLAQVSIKPVINQV

SEQ ID NO: 1804361 - protein, 17 aa, Staphylococcus epidermidis
ENFKIKPEWLMELNKCA

SEQ ID NO: 1804362 - protein, 30 aa, Staphylococcus epidermidis
ENGDLLFGTIDSWLVWKLSGKEAHITDYTN

SEQ ID NO: 1804363 - protein, 17 aa, Staphylococcus epidermidis
ENGFKEFYQLREQQHGH

SEQ ID NO: 1804364 - protein, 23 aa, Staphylococcus epidermidis
ENGFKTTFGLIFNHLSWMINQNQ

SEQ ID NO: 1804365 - protein, 23 aa, Staphylococcus epidermidis
ENGFKTTLGLIFNDLSWMINQNK

SEQ ID NO: 1804366 - protein, 26 aa, Staphylococcus epidermidis
ENGKEISRIGSTFGKTNRVIIDTDDH

SEQ ID NO: 1804367 - protein, 28 aa, Staphylococcus epidermidis
ENGNAYPEWEVMKLKDILSERKEYASKI

SEQ ID NO: 1804368 - protein, 23 aa, Staphylococcus epidermidis
ENGNSYPDWSIKKIEDISKVNKG

SEQ ID NO: 1804369 - protein, 23 aa, Staphylococcus epidermidis
ENGQLKSAISLLEEVSQKTKNLE

SEQ ID NO: 1804370 - protein, 23 aa, Staphylococcus epidermidis
ENGVRIALTEVWEKGGKGGIDLA

SEQ ID NO: 1804371 - protein, 20 aa, Staphylococcus epidermidis
ENGYKCPHCGNSDPKTVDVV

SEQ ID NO: 1804372 - protein, 20 aa, Staphylococcus epidermidis
ENIIIPFVYTSTIGMPHDNN

SEQ ID NO: 1804373 - protein, 17 aa, Staphylococcus epidermidis
ENIKFRSLNKLSKGQQC

SEQ ID NO: 1804374 - protein, 17 aa, Staphylococcus epidermidis
ENIKHVAKRAFLDKTLE

SEQ ID NO: 1804375 - protein, 18 aa, Staphylococcus epidermidis
ENILELIQFERFCRDNAL

SEQ ID NO: 1804376 - protein, 18 aa, Staphylococcus epidermidis
ENINVCIFAESLGGTETF

SEQ ID NO: 1804377 - protein, 17 aa, Staphylococcus epidermidis
ENIQPFLYHFYDMSVGI

SEQ ID NO: 1804378 - protein, 22 aa, Staphylococcus epidermidis
ENIVLVPKLLKWSKEKKDAKAK

SEQ ID NO: 1804379 - protein, 25 aa, Staphylococcus epidermidis
ENIVPYKTAARFWGYEDTIKVFLQH

SEQ ID NO: 1804380 - protein, 18 aa, Staphylococcus epidermidis
ENIYDWLSDFKLLSIPKS

SEQ ID NO: 1804381 - protein, 17 aa, Staphylococcus epidermidis
ENIYPYQIETIAKDFEG

SEQ ID NO: 1804382 - protein, 24 aa, Staphylococcus epidermidis
ENKGKIALFAGIDKCRFKKQVTPG

SEQ ID NO: 1804383 - protein, 19 aa, Staphylococcus epidermidis
ENLDICIFAESLGGTETFI

SEQ ID NO: 1804384 - protein, 18 aa, Staphylococcus epidermidis
ENLIPKKERDTFKYDFDE

SEQ ID NO: 1804385 - protein, 19 aa, Staphylococcus epidermidis
ENLKTFGVEKIFTEKQSGK

SEQ ID NO: 1804386 - protein, 19 aa, Staphylococcus epidermidis
ENLNVIACLMEIRRNPVNA

SEQ ID NO: 1804387 - protein, 18 aa, Staphylococcus epidermidis
ENLNVVAINASYPSETIA

SEQ ID NO: 1804388 - protein, 24 aa, Staphylococcus epidermidis
ENLSDRALGYGMHGEHVDGNDPIA

SEQ ID NO: 1804389 - protein, 25 aa, Staphylococcus epidermidis
ENLVPDYLDGLLFDDIPYLKVAQQE

SEQ ID NO: 1804390 - protein, 20 aa, Staphylococcus epidermidis
ENMVNIELMLPVNKPLTSNE

SEQ ID NO: 1804391 - protein, 18 aa, Staphylococcus epidermidis
ENNITFVPYFPLASGILA

SEQ ID NO: 1804392 - protein, 25 aa, Staphylococcus epidermidis
ENNYKEVTEALGIYDLGNKYPSEIS

SEQ ID NO: 1804393 - protein, 23 aa, Staphylococcus epidermidis
ENPETGMINLCFEIFDDKIKIVI

SEQ ID NO: 1804394 - protein, 18 aa, Staphylococcus epidermidis
ENQILAVAYSFKDVRHKK

SEQ ID NO: 1804395 - protein, 18 aa, Staphylococcus epidermidis
ENQLMKILGSKWKKYIGS

SEQ ID NO: 1804396 - protein, 20 aa, Staphylococcus epidermidis
ENRDNWGDLMYDFADATSKA

SEQ ID NO: 1804397 - protein, 17 aa, Staphylococcus epidermidis
ENREFEDKINLALNHPY

SEQ ID NO: 1804398 - protein, 19 aa, Staphylococcus epidermidis
ENRELIKIHVLQNNFDDKN

SEQ ID NO: 1804399 - protein, 32 aa, Staphylococcus epidermidis
ENRPELSFPADLYFEGSDQYRGWFNSSITTAV

SEQ ID NO: 1804400 - protein, 26 aa, Staphylococcus epidermidis
ENSALFKKRVKSIVNKAQRVSEETAM

SEQ ID NO: 1804401 - protein, 25 aa, Staphylococcus epidermidis
ENSSFRGLFQFIRFIDELIDRGRDF

SEQ ID NO: 1804402 - protein, 19 aa, Staphylococcus epidermidis
ENTYGLAMIDFHYPETTHK

SEQ ID NO: 1804403 - protein, 17 aa, Staphylococcus epidermidis
ENVGFLIEHPKLYDNKS

SEQ ID NO: 1804404 - protein, 17 aa, Staphylococcus epidermidis
ENVKFADNWLAPHPGTD

SEQ ID NO: 1804405 - protein, 30 aa, Staphylococcus epidermidis
ENYPKLSKLGLKWYAVPIISNMDLKIGGIT

SEQ ID NO: 1804406 - protein, 26 aa, Staphylococcus epidermidis
EPAPELVEGLKLVTGFVQDEHATQDD

SEQ ID NO: 1804407 - protein, 24 aa, Staphylococcus epidermidis
EPASELVEGLKLVTAFVQDENATL

SEQ ID NO: 1804408 - protein, 26 aa, Staphylococcus epidermidis
EPATELVEGLKLVTAFVQDENATQDD

SEQ ID NO: 1804409 - protein, 20 aa, Staphylococcus epidermidis
EPAVAFRLFKQLVEDKYGKD

SEQ ID NO: 1804410 - protein, 19 aa, Staphylococcus epidermidis
EPDFLIVIYHGGLNKISST

SEQ ID NO: 1804411 - protein, 21 aa, Staphylococcus epidermidis
EPDLARQLACIIRQKPVIFEN

SEQ ID NO: 1804412 - protein, 23 aa, Staphylococcus epidermidis
EPEDPLKLVVSFEGVTGYDVQKW

SEQ ID NO: 1804413 - protein, 28 aa, Staphylococcus epidermidis
EPEGGLRCTACFEMRLEIVAQAAVKYGY

SEQ ID NO: 1804414 - protein, 25 aa, Staphylococcus epidermidis
EPEILKPRLVPLLQMSNKEFKNTYG

SEQ ID NO: 1804415 - protein, 23 aa, Staphylococcus epidermidis
EPFPLTEVQQAYILGRNNAFEYS

SEQ ID NO: 1804416 - protein, 18 aa, Staphylococcus epidermidis
EPGKHIDSFMTRLSSFST

SEQ ID NO: 1804417 - protein, 19 aa, Staphylococcus epidermidis
EPGSLVAMIDLIKKSEPGY

SEQ ID NO: 1804418 - protein, 21 aa, Staphylococcus epidermidis
EPGVFGAAWLNKGLNTEMIVD

SEQ ID NO: 1804419 - protein, 17 aa, Staphylococcus epidermidis
EPIALGGVMGGDFSEVT

SEQ ID NO: 1804420 - protein, 24 aa, Staphylococcus epidermidis
EPIKRIANHRVLAMNRGEKEKVLS

SEQ ID NO: 1804421 - protein, 26 aa, Staphylococcus epidermidis
EPILTKRRFSAFTGSGLEVFLQANRI

SEQ ID NO: 1804422 - protein, 19 aa, Staphylococcus epidermidis
EPIPRFPGVTRDIALEVNH

SEQ ID NO: 1804423 - protein, 33 aa, Staphylococcus epidermidis
EPIQYIVGFQSFYGYKFKVDANCLIPRPETEEV

SEQ ID NO: 1804424 - protein, 22 aa, Staphylococcus epidermidis
EPKDVIIVEGIFALENKTLRDM

SEQ ID NO: 1804425 - protein, 21 aa, Staphylococcus epidermidis
EPMFSKKSIKNVVKPLLKYAY

SEQ ID NO: 1804426 - protein, 26 aa, Staphylococcus epidermidis
EPMIKTAKIVLNWLASERIEVSLLNI

SEQ ID NO: 1804427 - protein, 25 aa, Staphylococcus epidermidis
EPMVLPSRFPNLLVNGSTGISSGYA

SEQ ID NO: 1804428 - protein, 25 aa, Staphylococcus epidermidis
EPNQEGIEFVEFLISPNKGEPLKSL

SEQ ID NO: 1804429 - protein, 19 aa, Staphylococcus epidermidis
EPPAHKSIVSKWEKDISKP

SEQ ID NO: 1804430 - protein, 25 aa, Staphylococcus epidermidis
EPPISIKDGGLFKKGFNTQLDEYLE

SEQ ID NO: 1804431 - protein, 28 aa, Staphylococcus epidermidis
EPPKLPYLKEFNCVSSPTFKRRSMSLNQ

SEQ ID NO: 1804432 - protein, 26 aa, Staphylococcus epidermidis
EPTGLWLSELVHFYDAFKHTNVDIDM

SEQ ID NO: 1804433 - protein, 21 aa, Staphylococcus epidermidis
EPTTYLDICHQLEILELVQKL

SEQ ID NO: 1804434 - protein, 26 aa, Staphylococcus epidermidis
EQAFAYRLPVYNSFGMTETCSQFLTA

SEQ ID NO: 1804435 - protein, 25 aa, Staphylococcus epidermidis
EQALKDFAERLGVNYSYDDAELLKD

SEQ ID NO: 1804436 - protein, 19 aa, Staphylococcus epidermidis
EQALPKFAVLNEQLLVLSL

SEQ ID NO: 1804437 - protein, 22 aa, Staphylococcus epidermidis
EQCNQLGLELAEKIAPNHQVAV

SEQ ID NO: 1804438 - protein, 23 aa, Staphylococcus epidermidis
EQCNQLGLELAEKIAPNHQVAVY

SEQ ID NO: 1804439 - protein, 22 aa, Staphylococcus epidermidis
EQEGAKLFAKEGYMDDVDGLII

SEQ ID NO: 1804440 - protein, 26 aa, Staphylococcus epidermidis
EQEIYNHMLWKGFKPFKITNITQETS

SEQ ID NO: 1804441 - protein, 24 aa, Staphylococcus epidermidis
EQEKRMWFVQSLHIEDEWIRANDG

SEQ ID NO: 1804442 - protein, 23 aa, Staphylococcus epidermidis
EQERFYKLYKFLFEDDYFRKLSD

SEQ ID NO: 1804443 - protein, 20 aa, Staphylococcus epidermidis
EQFALFVKRGFVTPEEYLEL

SEQ ID NO: 1804444 - protein, 24 aa, Staphylococcus epidermidis
EQFGISVMVGFGYRAQEPKHGKVR

SEQ ID NO: 1804445 - protein, 17 aa, Staphylococcus epidermidis
EQFMEWSEDTARLQVRM

SEQ ID NO: 1804446 - protein, 27 aa, Staphylococcus epidermidis
EQHPAMGSIQSWAQWFTDHGITEIHLD

SEQ ID NO: 1804447 - protein, 23 aa, Staphylococcus epidermidis
EQISYDVVEVILLFEKVDQNHAD

SEQ ID NO: 1804448 - protein, 29 aa, Staphylococcus epidermidis
EQKERITLYMRYNVKGFKSIKFTEIKKNP

SEQ ID NO: 1804449 - protein, 26 aa, Staphylococcus epidermidis
EQKFGLRLPGEFNREMMKEAVQLAHH

SEQ ID NO: 1804450 - protein, 18 aa, Staphylococcus epidermidis
EQLLKYDVTPCGLGARDT

SEQ ID NO: 1804451 - protein, 20 aa, Staphylococcus epidermidis
EQLNALYLSRISRYNEIAFI

SEQ ID NO: 1804452 - protein, 17 aa, Staphylococcus epidermidis
EQLRHCSTLFINKIDKV

SEQ ID NO: 1804453 - protein, 17 aa, Staphylococcus epidermidis
EQMLSIDGLEIYGPPKD

SEQ ID NO: 1804454 - protein, 31 aa, Staphylococcus epidermidis
EQPAQQPNYHQYPNNNQQSGSNKNNSSENNK

SEQ ID NO: 1804455 - protein, 24 aa, Staphylococcus epidermidis
EQPDYIKTLTFNSAVHTLKSELPT

SEQ ID NO: 1804456 - protein, 20 aa, Staphylococcus epidermidis
EQPLTFPLISLIVSGGHTEL

SEQ ID NO: 1804457 - protein, 20 aa, Staphylococcus epidermidis
EQQERITLYLKYNTKNLILS

SEQ ID NO: 1804458 - protein, 18 aa, Staphylococcus epidermidis
EQQWLKLPLEEDIIQLGT

SEQ ID NO: 1804459 - protein, 22 aa, Staphylococcus epidermidis
EQRAIALANFLSETSMNKNNVC

SEQ ID NO: 1804460 - protein, 21 aa, Staphylococcus epidermidis
EQRLSKAAMEMMIYHIVQQHE

SEQ ID NO: 1804461 - protein, 23 aa, Staphylococcus epidermidis
EQSFDLMFVKWIPRKQNKEANQL

SEQ ID NO: 1804462 - protein, 24 aa, Staphylococcus epidermidis
EQSHIFAAAYSFKSVNSIKNIKKV

SEQ ID NO: 1804463 - protein, 24 aa, Staphylococcus epidermidis
EQTSSFGVEGLFWNIPDYKYSNDE

SEQ ID NO: 1804464 - protein, 25 aa, Staphylococcus epidermidis
EQVALEWLQSLGYDYKKGNEMSITG

SEQ ID NO: 1804465 - protein, 27 aa, Staphylococcus epidermidis
EQYADYWKAYDFNSGYFMALKVNHVNP

SEQ ID NO: 1804466 - protein, 25 aa, Staphylococcus epidermidis
EQYIKYKLYFKKKIFGEIKDIPTSI

SEQ ID NO: 1804467 - protein, 21 aa, Staphylococcus epidermidis
ERAGLGFVGRNGFVISPELGT

SEQ ID NO: 1804468 - protein, 20 aa, Staphylococcus epidermidis
ERATVPKQGWIGVNTSTYYG

SEQ ID NO: 1804469 - protein, 21 aa, Staphylococcus epidermidis
ERDNLRLIYYALRNPYLSPDR

SEQ ID NO: 1804470 - protein, 23 aa, Staphylococcus epidermidis
EREDGGDVFVHFSAIVEDGYKSL

SEQ ID NO: 1804471 - protein, 28 aa, Staphylococcus epidermidis
EREYLTCEGILWNKWDDAVEILQSKGGV

SEQ ID NO: 1804472 - protein, 24 aa, Staphylococcus epidermidis
ERFSEHLAQSGIEFSSKRQNVSYK

SEQ ID NO: 1804473 - protein, 17 aa, Staphylococcus epidermidis
ERGFLPGNGAITSVVSV

SEQ ID NO: 1804474 - protein, 23 aa, Staphylococcus epidermidis
ERHLAALSFLTFVALGEDGKPIN

SEQ ID NO: 1804475 - protein, 17 aa, Staphylococcus epidermidis
ERIAQMLIESSVDIGNM

SEQ ID NO: 1804476 - protein, 17 aa, Staphylococcus epidermidis
ERICGVGVPGELCIGGA

SEQ ID NO: 1804477 - protein, 23 aa, Staphylococcus epidermidis
ERIFPYNIPTTFTKSLRERSLGV

SEQ ID NO: 1804478 - protein, 17 aa, Staphylococcus epidermidis
ERIKKELVVSGLMINKR

SEQ ID NO: 1804479 - protein, 17 aa, Staphylococcus epidermidis
ERIKKFGAEGIRNKDMH

SEQ ID NO: 1804480 - protein, 19 aa, Staphylococcus epidermidis
ERLDGEHFGDFVIRAGVIA

SEQ ID NO: 1804481 - protein, 35 aa, Staphylococcus epidermidis
ERLEFLGDAVLELTVSRYLFDRHPHLPEGNLTKMR

SEQ ID NO: 1804482 - protein, 17 aa, Staphylococcus epidermidis
ERLGVRYPIIQAGMAGS

SEQ ID NO: 1804483 - protein, 25 aa, Staphylococcus epidermidis
ERLIPYFMYHNYWFLFYHDENYFAV

SEQ ID NO: 1804484 - protein, 26 aa, Staphylococcus epidermidis
ERLIRAADVILFDRLVNPFILQYASS

SEQ ID NO: 1804485 - protein, 26 aa, Staphylococcus epidermidis
ERLKAAKAKADKFIESLAHINQAQLA

SEQ ID NO: 1804486 - protein, 17 aa, Staphylococcus epidermidis
ERLNLGRKLGFELSTAK

SEQ ID NO: 1804487 - protein, 17 aa, Staphylococcus epidermidis
ERLQNMIGVYNVAIDSK

SEQ ID NO: 1804488 - protein, 21 aa, Staphylococcus epidermidis
ERLSGRELLDVFEYHVRRAFD

SEQ ID NO: 1804489 - protein, 35 aa, Staphylococcus epidermidis
ERMQAENVIFIGLLCKYGQWNAVIFDIGRGHTREL

SEQ ID NO: 1804490 - protein, 22 aa, Staphylococcus epidermidis
ERNAINLPAKVNHGVLIGEVKE

SEQ ID NO: 1804491 - protein, 19 aa, Staphylococcus epidermidis
ERNFKEFLSQYLPAQSGDM

SEQ ID NO: 1804492 - protein, 19 aa, Staphylococcus epidermidis
ERNFKEFLSQYLPAQSGEM

SEQ ID NO: 1804493 - protein, 18 aa, Staphylococcus epidermidis
ERPVILVADGEDTAKDMY

SEQ ID NO: 1804494 - protein, 19 aa, Staphylococcus epidermidis
ERQRIPLIINQENAVLAIG

SEQ ID NO: 1804495 - protein, 22 aa, Staphylococcus epidermidis
ERRFMKPKKLKANIEYTTPHGH

SEQ ID NO: 1804496 - protein, 21 aa, Staphylococcus epidermidis
ERRKSEERMKDAIQEAEKLAK

SEQ ID NO: 1804497 - protein, 25 aa, Staphylococcus epidermidis
ERRNRSKVRLALKRGTKVERAGREG

SEQ ID NO: 1804498 - protein, 21 aa, Staphylococcus epidermidis
ERSAKLFEWARLVDEHKNELA

SEQ ID NO: 1804499 - protein, 26 aa, Staphylococcus epidermidis
ERSGLSFKKFVLFTGYEVNVDTQELI

SEQ ID NO: 1804500 - protein, 20 aa, Staphylococcus epidermidis
ERSLDMIVGMLGILKSGAGY

SEQ ID NO: 1804501 - protein, 26 aa, Staphylococcus epidermidis
ERSLEHLLFGLGIRHLGVKASQVLAE

SEQ ID NO: 1804502 - protein, 18 aa, Staphylococcus epidermidis
ERSLLFGPFAGFSPKFLK

SEQ ID NO: 1804503 - protein, 24 aa, Staphylococcus epidermidis
ERTIKRYYICSLFNRSGSSACHSN

SEQ ID NO: 1804504 - protein, 19 aa, Staphylococcus epidermidis
ERTKIQLLAPVVSHRKGTH

SEQ ID NO: 1804505 - protein, 24 aa, Staphylococcus epidermidis
ERTPRGRKATAFAYEHFKNIDEKR

SEQ ID NO: 1804506 - protein, 18 aa, Staphylococcus epidermidis
ERVAGAKFDSKWTDTWRN

SEQ ID NO: 1804507 - protein, 20 aa, Staphylococcus epidermidis
ERVHLKFLSTLPVGGLGLDF

SEQ ID NO: 1804508 - protein, 18 aa, Staphylococcus epidermidis
ERVKVALTKVFLSEVNTL

SEQ ID NO: 1804509 - protein, 24 aa, Staphylococcus epidermidis
ERVWLKRRIETPYKANLNNNQKKE

SEQ ID NO: 1804510 - protein, 19 aa, Staphylococcus epidermidis
ERYELFYNKFCLLDDGKAT

SEQ ID NO: 1804511 - protein, 22 aa, Staphylococcus epidermidis
ERYKGVIGKTVILPIVGRELPI

SEQ ID NO: 1804512 - protein, 25 aa, Staphylococcus epidermidis
ERYPKAIKPWILPNFESLVTHEKIT

SEQ ID NO: 1804513 - protein, 20 aa, Staphylococcus epidermidis
ERYYEYKKFGMIPEYEDERE

SEQ ID NO: 1804514 - protein, 21 aa, Staphylococcus epidermidis
ESAKYYALIHHNKFESFIDDF

SEQ ID NO: 1804515 - protein, 20 aa, Staphylococcus epidermidis
ESAPKIFRKVTDLVKEQVKY

SEQ ID NO: 1804516 - protein, 28 aa, Staphylococcus epidermidis
ESARMIAKCIVGSSLVKTAIFGEDPNWG

SEQ ID NO: 1804517 - protein, 20 aa, Staphylococcus epidermidis
ESCKMLEEFEIPYDKKVVSA

SEQ ID NO: 1804518 - protein, 18 aa, Staphylococcus epidermidis
ESCNEQDAIYGFVYGDVN

SEQ ID NO: 1804519 - protein, 27 aa, Staphylococcus epidermidis
ESDEEIILFKGFFARFEFKQINKRMRE

SEQ ID NO: 1804520 - protein, 20 aa, Staphylococcus epidermidis
ESDLKEGCDMMIVKPALSYL

SEQ ID NO: 1804521 - protein, 26 aa, Staphylococcus epidermidis
ESDRISLKEDEDWMKEMISTIEPPDA

SEQ ID NO: 1804522 - protein, 22 aa, Staphylococcus epidermidis
ESDYFAFEACEYRRHFLSYHPD

SEQ ID NO: 1804523 - protein, 22 aa, Staphylococcus epidermidis
ESEFEKHMYAIHTLTSLYTSND

SEQ ID NO: 1804524 - protein, 18 aa, Staphylococcus epidermidis
ESEIAFIVLHFGGSIKNQ

SEQ ID NO: 1804525 - protein, 30 aa, Staphylococcus epidermidis
ESELSFSPTEFKFFDKLLEIVQKLKEKFEA

SEQ ID NO: 1804526 - protein, 20 aa, Staphylococcus epidermidis
ESFDSMPTVVGFLPNVVEGD

SEQ ID NO: 1804527 - protein, 24 aa, Staphylococcus epidermidis
ESFDVILSSLAFHYVADYENLIKK

SEQ ID NO: 1804528 - protein, 21 aa, Staphylococcus epidermidis
ESFPETKILILTMFDDEEYLF

SEQ ID NO: 1804529 - protein, 22 aa, Staphylococcus epidermidis
ESFPETKILILTMFDDEEYLFH

SEQ ID NO: 1804530 - protein, 22 aa, Staphylococcus epidermidis
ESFRMECLDWTDGQVGNNDDAN

SEQ ID NO: 1804531 - protein, 22 aa, Staphylococcus epidermidis
ESGCGKSILNKSIIKLLPDKIS

SEQ ID NO: 1804532 - protein, 26 aa, Staphylococcus epidermidis
ESHGYVGLAHAGWRGTYGEIVKEMVK

SEQ ID NO: 1804533 - protein, 25 aa, Staphylococcus epidermidis
ESHLLSLPGWAGMMYYRAEKNEHEK

SEQ ID NO: 1804534 - protein, 18 aa, Staphylococcus epidermidis
ESHMKHNDESKVPEDMTS

SEQ ID NO: 1804535 - protein, 19 aa, Staphylococcus epidermidis
ESHRFYPNQFEYVIETALK

SEQ ID NO: 1804536 - protein, 17 aa, Staphylococcus epidermidis
ESHSFPFGVVSLKRQFF

SEQ ID NO: 1804537 - protein, 22 aa, Staphylococcus epidermidis
ESIHLLPFNVFFVPARGGLGEN

SEQ ID NO: 1804538 - protein, 22 aa, Staphylococcus epidermidis
ESITPYEGGIAFAAKPLIANDF

SEQ ID NO: 1804539 - protein, 23 aa, Staphylococcus epidermidis
ESKACSIIDKIIKSFNENTTLNI

SEQ ID NO: 1804540 - protein, 23 aa, Staphylococcus epidermidis
ESKDPHSVLNFYKALIQLKKSDD

SEQ ID NO: 1804541 - protein, 24 aa, Staphylococcus epidermidis
ESKIKTVLHGLNFTENDFDKPIND

SEQ ID NO: 1804542 - protein, 24 aa, Staphylococcus epidermidis
ESKIKTVLHGLNFTENDFNKPIND

SEQ ID NO: 1804543 - protein, 17 aa, Staphylococcus epidermidis
ESKSRSNINLTLNAKKE

SEQ ID NO: 1804544 - protein, 20 aa, Staphylococcus epidermidis
ESKSSGFDWFKRKSNKKDTY

SEQ ID NO: 1804545 - protein, 19 aa, Staphylococcus epidermidis
ESKVGYSTRKICKDLIDLI

SEQ ID NO: 1804546 - protein, 18 aa, Staphylococcus epidermidis
ESKVGYSTRKICKDLLDL

SEQ ID NO: 1804547 - protein, 26 aa, Staphylococcus epidermidis
ESLAKRLGFKEGLKFIESSTVGVDPK

SEQ ID NO: 1804548 - protein, 20 aa, Staphylococcus epidermidis
ESLESLGYEIKKGIHRNNED

SEQ ID NO: 1804549 - protein, 18 aa, Staphylococcus epidermidis
ESLFKSVLERANIDVDQL

SEQ ID NO: 1804550 - protein, 24 aa, Staphylococcus epidermidis
ESLGARKGEMLDMLTTDNGLTRLI

SEQ ID NO: 1804551 - protein, 19 aa, Staphylococcus epidermidis
ESLKCSFCGKDQDQVKKLV

SEQ ID NO: 1804552 - protein, 21 aa, Staphylococcus epidermidis
ESLKKQYGIRGELHKLASNEN

SEQ ID NO: 1804553 - protein, 32 aa, Staphylococcus epidermidis
ESLQGVEFEFCTPFGSFPVRSPYVGRFNISNI

SEQ ID NO: 1804554 - protein, 27 aa, Staphylococcus epidermidis
ESLQVMKILSRWMKAGYDISFSDMMSN

SEQ ID NO: 1804555 - protein, 25 aa, Staphylococcus epidermidis
ESLRERICEAAIQLMENIKYVNAGT

SEQ ID NO: 1804556 - protein, 25 aa, Staphylococcus epidermidis
ESLRQIKGGFTFAILTKDALYGAVD

SEQ ID NO: 1804557 - protein, 23 aa, Staphylococcus epidermidis
ESLSARENLVFFGNLMGLKGKEL

SEQ ID NO: 1804558 - protein, 24 aa, Staphylococcus epidermidis
ESLSKADQVFLCEIFGSIRENTGD

SEQ ID NO: 1804559 - protein, 19 aa, Staphylococcus epidermidis
ESMLIPLIARAKEYEYEKP

SEQ ID NO: 1804560 - protein, 36 aa, Staphylococcus epidermidis
ESNHDVDMLRMCRYPWKTKQRILSDMGHVSNEDAGL

SEQ ID NO: 1804561 - protein, 28 aa, Staphylococcus epidermidis
ESNLPFELIGAVPVLIKRSGKVDEKILN

SEQ ID NO: 1804562 - protein, 24 aa, Staphylococcus epidermidis
ESPFKVDLFIKANIELTKDIYGTS

SEQ ID NO: 1804563 - protein, 24 aa, Staphylococcus epidermidis
ESPMANALIGKGLNDEVRVPLPNG

SEQ ID NO: 1804564 - protein, 25 aa, Staphylococcus epidermidis
ESQIKRLKFDYLYIDNAQLTSPYLM

SEQ ID NO: 1804565 - protein, 22 aa, Staphylococcus epidermidis
ESRIQTWSYPFVIKPGDDLPTA

SEQ ID NO: 1804566 - protein, 21 aa, Staphylococcus epidermidis
ESRLDDLILMQLIHSPSYSSY

SEQ ID NO: 1804567 - protein, 21 aa, Staphylococcus epidermidis
ESSLPCKVNKLLILINSSDYE

SEQ ID NO: 1804568 - protein, 20 aa, Staphylococcus epidermidis
ESSNYWVWHERLIITKEYKH

SEQ ID NO: 1804569 - protein, 17 aa, Staphylococcus epidermidis
ESSVLIPTNNISRHVND

SEQ ID NO: 1804570 - protein, 23 aa, Staphylococcus epidermidis
ESTEFQDRLNIFASGGLRTPLDA

SEQ ID NO: 1804571 - protein, 23 aa, Staphylococcus epidermidis
ESTLFRLQKQFAYTKEDINKYMA

SEQ ID NO: 1804572 - protein, 23 aa, Staphylococcus epidermidis
ESVERYSGFVLLPPQNGVYKGIK

SEQ ID NO: 1804573 - protein, 19 aa, Staphylococcus epidermidis
ESVFARFISSIKEERVNAS

SEQ ID NO: 1804574 - protein, 19 aa, Staphylococcus epidermidis
ESVQLLFNVECEVKFEEGY

SEQ ID NO: 1804575 - protein, 19 aa, Staphylococcus epidermidis
ESVQLLFNVECQVKFEEGY

SEQ ID NO: 1804576 - protein, 32 aa, Staphylococcus epidermidis
ESVRSIEILDIYGVEWFARYCIETLESYQIDT

SEQ ID NO: 1804577 - protein, 24 aa, Staphylococcus epidermidis
ESYIKFCIKPLLKKIEDELNAKLI

SEQ ID NO: 1804578 - protein, 19 aa, Staphylococcus epidermidis
ESYILIKTSPGFAQSINYY

SEQ ID NO: 1804579 - protein, 26 aa, Staphylococcus epidermidis
ESYPELKLGIITPFLGHTNRWNEQNQ

SEQ ID NO: 1804580 - protein, 25 aa, Staphylococcus epidermidis
ESYVLPILGIHNMKNAAIAIAVGHE

SEQ ID NO: 1804581 - protein, 25 aa, Staphylococcus epidermidis
ETAFPLLYTHFVRRGNWSLQQLVDY

SEQ ID NO: 1804582 - protein, 19 aa, Staphylococcus epidermidis
ETAGPLYYRAEPVGCTATI

SEQ ID NO: 1804583 - protein, 19 aa, Staphylococcus epidermidis
ETALKKDIKIITTIDPLQY

SEQ ID NO: 1804584 - protein, 26 aa, Staphylococcus epidermidis
ETARKFGIEVFNVFLSQEPITEDIEQ

SEQ ID NO: 1804585 - protein, 20 aa, Staphylococcus epidermidis
ETDLPFNRNDVIYVDCQSGI

SEQ ID NO: 1804586 - protein, 21 aa, Staphylococcus epidermidis
ETEETIYLLKRKHFIQMDNNA

SEQ ID NO: 1804587 - protein, 26 aa, Staphylococcus epidermidis
ETEIYICGGTHFLKSIIEALKELNVD

SEQ ID NO: 1804588 - protein, 21 aa, Staphylococcus epidermidis
ETESMTAISMMSYDIENANNN

SEQ ID NO: 1804589 - protein, 19 aa, Staphylococcus epidermidis
ETFIRSQVGDVVMVEQIGD

SEQ ID NO: 1804590 - protein, 26 aa, Staphylococcus epidermidis
ETFVIISFKHKVILIGGTEYAGEMKK

SEQ ID NO: 1804591 - protein, 23 aa, Staphylococcus epidermidis
ETGEMAHLHFKDVIDYLNPGDTL

SEQ ID NO: 1804592 - protein, 20 aa, Staphylococcus epidermidis
ETGMINLCFEIFDDRIKIVI

SEQ ID NO: 1804593 - protein, 25 aa, Staphylococcus epidermidis
ETIGCPIGNYIPEWNDLVYHQDFKS

SEQ ID NO: 1804594 - protein, 17 aa, Staphylococcus epidermidis
ETIGIAGFFGLPIQKEV

SEQ ID NO: 1804595 - protein, 25 aa, Staphylococcus epidermidis
ETIKGRKTILYFYPRDNTLTCTTEA

SEQ ID NO: 1804596 - protein, 17 aa, Staphylococcus epidermidis
ETIKNTFDSASTFGRKI

SEQ ID NO: 1804597 - protein, 24 aa, Staphylococcus epidermidis
ETILKRPVKGYLYFFKFGTLEIDN

SEQ ID NO: 1804598 - protein, 19 aa, Staphylococcus epidermidis
ETISELSLLQYSEEDDKWS

SEQ ID NO: 1804599 - protein, 18 aa, Staphylococcus epidermidis
ETITEGIPPVGYNSKYGP

SEQ ID NO: 1804600 - protein, 22 aa, Staphylococcus epidermidis
ETKGAFPTWLAPKQVEIIPVNV

SEQ ID NO: 1804601 - protein, 22 aa, Staphylococcus epidermidis
ETKGAFPTWLAPMQVEIIPVNV

SEQ ID NO: 1804602 - protein, 23 aa, Staphylococcus epidermidis
ETKGAYQILNWAYKTYGDDIVYS

SEQ ID NO: 1804603 - protein, 24 aa, Staphylococcus epidermidis
ETKGGRRFALEGGIPDVLNQNILF

SEQ ID NO: 1804604 - protein, 19 aa, Staphylococcus epidermidis
ETKGYKGSTAFTSLKVSGC

SEQ ID NO: 1804605 - protein, 17 aa, Staphylococcus epidermidis
ETLDFKVKLIGSFNKEQ

SEQ ID NO: 1804606 - protein, 24 aa, Staphylococcus epidermidis
ETLDRVYRSLGILQNSRIISMEEA

SEQ ID NO: 1804607 - protein, 18 aa, Staphylococcus epidermidis
ETLEEMILQLSEEKKLIL

SEQ ID NO: 1804608 - protein, 21 aa, Staphylococcus epidermidis
ETLFAHFNIPISIQGKTIQTL

SEQ ID NO: 1804609 - protein, 31 aa, Staphylococcus epidermidis
ETLHPMGGLQERVWNPLQIMNDFGIDVFSPS

SEQ ID NO: 1804610 - protein, 32 aa, Staphylococcus epidermidis
ETLHPMGGLQERVWNPLQIMNDFGIDVFSPTT

SEQ ID NO: 1804611 - protein, 26 aa, Staphylococcus epidermidis
ETLIRLHKDYQFHIGAKTEMSSKLLS

SEQ ID NO: 1804612 - protein, 24 aa, Staphylococcus epidermidis
ETLKGRKAILYFYPRDNTPTCTTE

SEQ ID NO: 1804613 - protein, 21 aa, Staphylococcus epidermidis
ETLKLGKGYYEILAKKNENEC

SEQ ID NO: 1804614 - protein, 24 aa, Staphylococcus epidermidis
ETLKRYLLEETFELFEAIDNEDDW

SEQ ID NO: 1804615 - protein, 20 aa, Staphylococcus epidermidis
ETLLAPVPLFHKNHETGKED

SEQ ID NO: 1804616 - protein, 17 aa, Staphylococcus epidermidis
ETLNLYMKFAKKHKLYV

SEQ ID NO: 1804617 - protein, 18 aa, Staphylococcus epidermidis
ETMDTFGHIDILFNNAGI

SEQ ID NO: 1804618 - protein, 20 aa, Staphylococcus epidermidis
ETMGGLIRKNLKCDTYSVKL

SEQ ID NO: 1804619 - protein, 29 aa, Staphylococcus epidermidis
ETNTMPQWAGSCWYYLRYIDPDNEKMIAD

SEQ ID NO: 1804620 - protein, 22 aa, Staphylococcus epidermidis
ETPEGKNIWFGVREFAMGAAVN

SEQ ID NO: 1804621 - protein, 18 aa, Staphylococcus epidermidis
ETPFAAIILAEIFDKAGV

SEQ ID NO: 1804622 - protein, 25 aa, Staphylococcus epidermidis
ETPQDIKAGYDFGSKGIGLVRTEHM

SEQ ID NO: 1804623 - protein, 20 aa, Staphylococcus epidermidis
ETPSNPLLRVTDIKASAEIA

SEQ ID NO: 1804624 - protein, 23 aa, Staphylococcus epidermidis
ETPTEMCGLKVIAIEDFETGKKT

SEQ ID NO: 1804625 - protein, 19 aa, Staphylococcus epidermidis
ETPYVCGTSKSFGSAGNPS

SEQ ID NO: 1804626 - protein, 26 aa, Staphylococcus epidermidis
ETQTLLSLPFDYIFFTGSEKVGKIVY

SEQ ID NO: 1804627 - protein, 24 aa, Staphylococcus epidermidis
ETQTLLSLPFDYMFFTGSEKVGKI

SEQ ID NO: 1804628 - protein, 27 aa, Staphylococcus epidermidis
ETRPKRIKLKWSTSIIKDLETIRLLNF

SEQ ID NO: 1804629 - protein, 27 aa, Staphylococcus epidermidis
ETRPKRIKLKWSTSLIKDLETIRLLNL

SEQ ID NO: 1804630 - protein, 18 aa, Staphylococcus epidermidis
ETSIKRLLLNLNTKDDFD

SEQ ID NO: 1804631 - protein, 23 aa, Staphylococcus epidermidis
ETSMNKNNVCIVFDDPVSSLDHK

SEQ ID NO: 1804632 - protein, 19 aa, Staphylococcus epidermidis
ETSRWDYLISPNRYSSEIF

SEQ ID NO: 1804633 - protein, 18 aa, Staphylococcus epidermidis
ETTEFILNQLPCWLTYTN

SEQ ID NO: 1804634 - protein, 19 aa, Staphylococcus epidermidis
ETTHSLEVYEMCKNIIHRY

SEQ ID NO: 1804635 - protein, 22 aa, Staphylococcus epidermidis
ETTIPHAFGIKTERNKIVANDT

SEQ ID NO: 1804636 - protein, 30 aa, Staphylococcus epidermidis
ETTLLTLRLAELFRASTIPAGLFQIVPGTG

SEQ ID NO: 1804637 - protein, 30 aa, Staphylococcus epidermidis
ETTLLTLRLAELFRASTIPAGLIQIIPGTG

SEQ ID NO: 1804638 - protein, 30 aa, Staphylococcus epidermidis
ETTLLTVRLAELFRASTIPAGLIQIVPGTG

SEQ ID NO: 1804639 - protein, 23 aa, Staphylococcus epidermidis
ETVCYLWLRFEHDESFNDFKLTD

SEQ ID NO: 1804640 - protein, 23 aa, Staphylococcus epidermidis
ETVCYLWLRFEHDKYFNDFKLTD

SEQ ID NO: 1804641 - protein, 17 aa, Staphylococcus epidermidis
ETVEAMQGYLMKSLKSE

SEQ ID NO: 1804642 - protein, 17 aa, Staphylococcus epidermidis
ETWAPKLILRAVLGQMS

SEQ ID NO: 1804643 - protein, 20 aa, Staphylococcus epidermidis
ETYTDFKMGIQIRHYTVQAL

SEQ ID NO: 1804644 - protein, 22 aa, Staphylococcus epidermidis
EVACLNKHLHFHGTTEDFKSLD

SEQ ID NO: 1804645 - protein, 25 aa, Staphylococcus epidermidis
EVAEACLKLGASIINDQWAGLYDPK

SEQ ID NO: 1804646 - protein, 23 aa, Staphylococcus epidermidis
EVAEHPEELVVYGGIGKAARNWK

SEQ ID NO: 1804647 - protein, 19 aa, Staphylococcus epidermidis
EVAHACAYLCSTMSKSITG

SEQ ID NO: 1804648 - protein, 20 aa, Staphylococcus epidermidis
EVALALYVRRDHYGIESQIK

SEQ ID NO: 1804649 - protein, 22 aa, Staphylococcus epidermidis
EVANFRKQYLGFIFQDYSVLPT

SEQ ID NO: 1804650 - protein, 22 aa, Staphylococcus epidermidis
EVARTDYIRKLGFSYADMEKEG

SEQ ID NO: 1804651 - protein, 27 aa, Staphylococcus epidermidis
EVDAALWGARAAFIGGFDSTSNVRAGK

SEQ ID NO: 1804652 - protein, 25 aa, Staphylococcus epidermidis
EVDERAKAGLFLAMQYPSEITGVTN

SEQ ID NO: 1804653 - protein, 37 aa, Staphylococcus epidermidis; identical to SEQ ID NO: 1657868

SEQ ID NO: 1804654 - protein, 20 aa, Staphylococcus epidermidis
EVDKEFFSPFGNFTGLTNFD

SEQ ID NO: 1804655 - protein, 26 aa, Staphylococcus epidermidis
EVDQAKLNLGYRFPTYYGKQNYYAFV

SEQ ID NO: 1804656 - protein, 24 aa, Staphylococcus epidermidis
EVDTYRGSIPISQEALDDSVANLT

SEQ ID NO: 1804657 - protein, 21 aa, Staphylococcus epidermidis
EVEGRFKTTFHAVQDHFTTVF

SEQ ID NO: 1804658 - protein, 20 aa, Staphylococcus epidermidis
EVEKQGLNFDEWRKNIIDKK

SEQ ID NO: 1804659 - protein, 29 aa, Staphylococcus epidermidis
EVFIKELYKLLHFIADSNMSPIFKITTQR

SEQ ID NO: 1804660 - protein, 21 aa, Staphylococcus epidermidis
EVFQLLKVEMPIVLPRLRISY

SEQ ID NO: 1804661 - protein, 20 aa, Staphylococcus epidermidis
EVGELWIGGISVAKGYYDMP

SEQ ID NO: 1804662 - protein, 23 aa, Staphylococcus epidermidis
EVGEYEPLCEVITDKVTAEVPST

SEQ ID NO: 1804663 - protein, 25 aa, Staphylococcus epidermidis
EVGLLPRVHGSGLFTRGQTQALSVL

SEQ ID NO: 1804664 - protein, 17 aa, Staphylococcus epidermidis
EVIDVWFDSGSMPFAQH

SEQ ID NO: 1804665 - protein, 20 aa, Staphylococcus epidermidis
EVIGDYVAGPSHVLPTNQTA

SEQ ID NO: 1804666 - protein, 29 aa, Staphylococcus epidermidis
EVIKELASSFSFPVLDLYNESNLRVWNET

SEQ ID NO: 1804667 - protein, 19 aa, Staphylococcus epidermidis
EVIKNPRAIQSLLAPRIET

SEQ ID NO: 1804668 - protein, 20 aa, Staphylococcus epidermidis
EVILDLKLIFSTNAILNFPP

SEQ ID NO: 1804669 - protein, 23 aa, Staphylococcus epidermidis
EVILKKGDVCIALPGGPGTLEEI

SEQ ID NO: 1804670 - protein, 19 aa, Staphylococcus epidermidis
EVIPFSRITDGVIASTTTA

SEQ ID NO: 1804671 - protein, 20 aa, Staphylococcus epidermidis
EVIQLCGALMQYYRETGIYA

SEQ ID NO: 1804672 - protein, 21 aa, Staphylococcus epidermidis
EVIQLCGALMQYYRETGIYAE

SEQ ID NO: 1804673 - protein, 21 aa, Staphylococcus epidermidis
EVIQQLHIHPLLTVTQGDILF

SEQ ID NO: 1804674 - protein, 25 aa, Staphylococcus epidermidis
EVIREREHFAIFPASHFVTREEKMK

SEQ ID NO: 1804675 - protein, 20 aa, Staphylococcus epidermidis
EVITRIIATSKFKPEYDKEK

SEQ ID NO: 1804676 - protein, 19 aa, Staphylococcus epidermidis
EVIWLYQYFTDIKIAPTTY

SEQ ID NO: 1804677 - protein, 19 aa, Staphylococcus epidermidis
EVKISVTLSKRLHFIRDKR

SEQ ID NO: 1804678 - protein, 33 aa, Staphylococcus epidermidis
EVKLSTALKLYHFYFDYWATIVGIDIGTSEFLS

SEQ ID NO: 1804679 - protein, 25 aa, Staphylococcus epidermidis
EVLDPSLPIDLIIDYAHTADGMNKL

SEQ ID NO: 1804680 - protein, 19 aa, Staphylococcus epidermidis
EVLEALLSYAKEVAKDEKS

SEQ ID NO: 1804681 - protein, 25 aa, Staphylococcus epidermidis
EVLELKRIKIANLELDQSLNDGEFR

SEQ ID NO: 1804682 - protein, 18 aa, Staphylococcus epidermidis
EVLFPYITISHFKDDVDK

SEQ ID NO: 1804683 - protein, 30 aa, Staphylococcus epidermidis
EVLHPMGGLQERIWNSLQIMNDFGKNVFCP

SEQ ID NO: 1804684 - protein, 22 aa, Staphylococcus epidermidis
EVLKPAVMMNLLGRDLDLLENE

SEQ ID NO: 1804685 - protein, 24 aa, Staphylococcus epidermidis
EVLLEARVSVYERRGNYQIYVNKM

SEQ ID NO: 1804686 - protein, 19 aa, Staphylococcus epidermidis
EVLNAKWVHLLNSRECHPQ

SEQ ID NO: 1804687 - protein, 21 aa, Staphylococcus epidermidis
EVLQITSVMKVDICLWTETIS

SEQ ID NO: 1804688 - protein, 25 aa, Staphylococcus epidermidis
EVLTHKAIHACKTYHVNRLIVAGGV

SEQ ID NO: 1804689 - protein, 24 aa, Staphylococcus epidermidis
EVMAEGKALFFVKGQYVAGAGGKA

SEQ ID NO: 1804690 - protein, 20 aa, Staphylococcus epidermidis
EVNEKIKLFNSDEMMGKDAF

SEQ ID NO: 1804691 - protein, 21 aa, Staphylococcus epidermidis
EVNELINFYKKVLARIENEVL

SEQ ID NO: 1804692 - protein, 23 aa, Staphylococcus epidermidis
EVNILKMQLLIWITETNTGDIQE

SEQ ID NO: 1804693 - protein, 17 aa, Staphylococcus epidermidis
EVNRLINDMIYFVRDTI

SEQ ID NO: 1804694 - protein, 23 aa, Staphylococcus epidermidis
EVPEGLVPLLKIQGLGSKKIAKL

SEQ ID NO: 1804695 - protein, 17 aa, Staphylococcus epidermidis
EVPIWHDQYPKLAELGL

SEQ ID NO: 1804696 - protein, 24 aa, Staphylococcus epidermidis
EVRDHKTRMALFPLKEYAQSKLDE

SEQ ID NO: 1804697 - protein, 19 aa, Staphylococcus epidermidis
EVRGRGLFIGIELHESARP

SEQ ID NO: 1804698 - protein, 18 aa, Staphylococcus epidermidis
EVRNAFTPKTVAEMIDAF

SEQ ID NO: 1804699 - protein, 21 aa, Staphylococcus epidermidis
EVSEAAVLNANYIKARLKDHF

SEQ ID NO: 1804700 - protein, 23 aa, Staphylococcus epidermidis
EVSILKMQLLIWITETATGDIQE

SEQ ID NO: 1804701 - protein, 22 aa, Staphylococcus epidermidis
EVSRIYLNFSDPWPKKRHAKRR

SEQ ID NO: 1804702 - protein, 21 aa, Staphylococcus epidermidis
EVTCGKGTYIRTLATDIGLKL

SEQ ID NO: 1804703 - protein, 27 aa, Staphylococcus epidermidis
EVTPEQCNQLGLALAEKFAPNHQVAVY

SEQ ID NO: 1804704 - protein, 20 aa, Staphylococcus epidermidis
EVTPSMMVFTNFFRDQMDRF

SEQ ID NO: 1804705 - protein, 19 aa, Staphylococcus epidermidis
EVVDLIDKREHLVFEGVYT

SEQ ID NO: 1804706 - protein, 22 aa, Staphylococcus epidermidis
EVVDLRTVYPLDKETIIERASK

SEQ ID NO: 1804707 - protein, 25 aa, Staphylococcus epidermidis
EVVKGFSDGQSFLSFLKENEQPDIV

SEQ ID NO: 1804708 - protein, 24 aa, Staphylococcus epidermidis
EVVKIDLYRPVPNFKNISQVKSLV

SEQ ID NO: 1804709 - protein, 29 aa, Staphylococcus epidermidis
EVVKKDFTGISFLNLVDFDALYGHRRDKE

SEQ ID NO: 1804710 - protein, 23 aa, Staphylococcus epidermidis
EVVTRGAHPCIISMEGLDKDGDT

SEQ ID NO: 1804711 - protein, 18 aa, Staphylococcus epidermidis
EVVYEAWTKEELLKQWFM

SEQ ID NO: 1804712 - protein, 20 aa, Staphylococcus epidermidis
EVYKETKRRESILEKDYPEN

SEQ ID NO: 1804713 - protein, 27 aa, Staphylococcus epidermidis
EVYKPYIEGFVKMLAPIAPHIGEELWD

SEQ ID NO: 1804714 - protein, 27 aa, Staphylococcus epidermidis
EWFLNPDHLPLILGMEKGWFSEQNLEI

SEQ ID NO: 1804715 - protein, 22 aa, Staphylococcus epidermidis
EWIEAIRVARNILKQKAMDPFN

SEQ ID NO: 1804716 - protein, 19 aa, Staphylococcus epidermidis
EWLAKKLYQSEAYRKANKI

SEQ ID NO: 1804717 - protein, 17 aa, Staphylococcus epidermidis
EYAQHFITHFVFENKDE

SEQ ID NO: 1804718 - protein, 20 aa, Staphylococcus epidermidis
EYCGFRVSNQLIYQTVKYMM

SEQ ID NO: 1804719 - protein, 19 aa, Staphylococcus epidermidis
EYEGFAFDFSKYNDVNDLY

SEQ ID NO: 1804720 - protein, 19 aa, Staphylococcus epidermidis
EYEPKASYLDTILNNKSLV

SEQ ID NO: 1804721 - protein, 22 aa, Staphylococcus epidermidis
EYFLTDWENIGGISQFSNIERV

SEQ ID NO: 1804722 - protein, 19 aa, Staphylococcus epidermidis
EYFVVKAIGDGSVKRGFDK

SEQ ID NO: 1804723 - protein, 25 aa, Staphylococcus epidermidis
EYGKTECWYILDAQPGAEIIYGVNA

SEQ ID NO: 1804724 - protein, 22 aa, Staphylococcus epidermidis
EYGTDIDILFILGGDGTVNELV

SEQ ID NO: 1804725 - protein, 18 aa, Staphylococcus epidermidis
EYHELLAFYNFKAEVNPS

SEQ ID NO: 1804726 - protein, 23 aa, Staphylococcus epidermidis
EYKEVKEIICERLGIDSKLISSS

SEQ ID NO: 1804727 - protein, 20 aa, Staphylococcus epidermidis
EYKNLCQYYSFIDPESDFKN

SEQ ID NO: 1804728 - protein, 21 aa, Staphylococcus epidermidis
EYKNLMFEYSVINQTGMAKTG

SEQ ID NO: 1804729 - protein, 18 aa, Staphylococcus epidermidis
EYLEGPIFISTDKPDPLL

SEQ ID NO: 1804730 - protein, 25 aa, Staphylococcus epidermidis
EYLEKIKLNYEFELFNDSYKITDIQ

SEQ ID NO: 1804731 - protein, 18 aa, Staphylococcus epidermidis
EYLSEHNIHVIPLSITVN

SEQ ID NO: 1804732 - protein, 24 aa, Staphylococcus epidermidis
EYMNALNIWALCGGKERNYNEFEE

SEQ ID NO: 1804733 - protein, 23 aa, Staphylococcus epidermidis
EYNHPRINRIIYFHSPQSEKQLS

SEQ ID NO: 1804734 - protein, 19 aa, Staphylococcus epidermidis
EYNKWFRMTASTAIPSTNS

SEQ ID NO: 1804735 - protein, 19 aa, Staphylococcus epidermidis
EYNNLMFEYSVINQTGMAK

SEQ ID NO: 1804736 - protein, 37 aa, Staphylococcus epidermidis
EYNQFMGAYRLQWDMIKFALNNNIPRYNFYGITGNFS

SEQ ID NO: 1804737 - protein, 18 aa, Staphylococcus epidermidis
EYQFCKDNNFIIVKVECD

SEQ ID NO: 1804738 - protein, 25 aa, Staphylococcus epidermidis
EYQFFKEGLILFTYLHLANEEKLTQ

SEQ ID NO: 1804739 - protein, 19 aa, Staphylococcus epidermidis
EYQNLISILEDVKKTIKKL

SEQ ID NO: 1804740 - protein, 21 aa, Staphylococcus epidermidis
EYVDPFKGLVRLTVPDDYLKA

SEQ ID NO: 1804741 - protein, 23 aa, Staphylococcus epidermidis
EYYYEYKKFGVLPEKEYAINKVK

SEQ ID NO: 1804742 - protein, 25 aa, Staphylococcus epidermidis
FAAGDARRGQSLVVWAIKEGREVAQ

SEQ ID NO: 1804743 - protein, 17 aa, Staphylococcus epidermidis
FAAKVIQKYGIGKLDAI

SEQ ID NO: 1804744 - protein, 17 aa, Staphylococcus epidermidis
FADHFLKLYDETKNRQF

SEQ ID NO: 1804745 - protein, 17 aa, Staphylococcus epidermidis
FAEHFLKLYDETKNKHF

SEQ ID NO: 1804746 - protein, 21 aa, Staphylococcus epidermidis
FAEKVPHAYDDLEIQKSLQYM

SEQ ID NO: 1804747 - protein, 19 aa, Staphylococcus epidermidis
FAGVKGGFMRRIKSYDSLL

SEQ ID NO: 1804748 - protein, 19 aa, Staphylococcus epidermidis
FAHIAARAGSEVHIIHRGQ

SEQ ID NO: 1804749 - protein, 18 aa, Staphylococcus epidermidis
FAIHTGVKLTELLNMKVK

SEQ ID NO: 1804750 - protein, 20 aa, Staphylococcus epidermidis
FAKIFREFCVDIMKADIKEN

SEQ ID NO: 1804751 - protein, 24 aa, Staphylococcus epidermidis
FAKRLKEIKQIIANMYEKYDRDEP

SEQ ID NO: 1804752 - protein, 26 aa, Staphylococcus epidermidis
FAKTVLKSPRYIYAYAQASEQGASVV

SEQ ID NO: 1804753 - protein, 23 aa, Staphylococcus epidermidis
FALCRDIELHWGEPVESLRKRFQ

SEQ ID NO: 1804754 - protein, 18 aa, Staphylococcus epidermidis
FALFVKRGFVTPEEYLEL

SEQ ID NO: 1804755 - protein, 19 aa, Staphylococcus epidermidis
FALFVKRGFVTPEEYLELT

SEQ ID NO: 1804756 - protein, 17 aa, Staphylococcus epidermidis
FALSYQYFKMCDDRAPL

SEQ ID NO: 1804757 - protein, 20 aa, Staphylococcus epidermidis
FAMSPKDLKLIESIPQMMEL

SEQ ID NO: 1804758 - protein, 17 aa, Staphylococcus epidermidis
FANIFFMIMNYYSIERS

SEQ ID NO: 1804759 - protein, 18 aa, Staphylococcus epidermidis
FANIFFMMMNYYSIERSM

SEQ ID NO: 1804760 - protein, 19 aa, Staphylococcus epidermidis
FANVTSEAFIQEYVINNHV

SEQ ID NO: 1804761 - protein, 20 aa, Staphylococcus epidermidis
FAQKRWCASSGLENVITLSD

SEQ ID NO: 1804762 - protein, 18 aa, Staphylococcus epidermidis
FAQLKRGAALANHELGKL

SEQ ID NO: 1804763 - protein, 17 aa, Staphylococcus epidermidis
FARVYAVLCPSWNIDHY

SEQ ID NO: 1804764 - protein, 17 aa, Staphylococcus epidermidis
FASGLSYHVLTMLRIAK

SEQ ID NO: 1804765 - protein, 19 aa, Staphylococcus epidermidis
FASIMVKSGVEVNVIHHTN

SEQ ID NO: 1804766 - protein, 23 aa, Staphylococcus epidermidis
FASKFKIGYETDGGFAGENGIDL

SEQ ID NO: 1804767 - protein, 25 aa, Staphylococcus epidermidis
FATGSSREYAVWALKDYGFKIIVAE

SEQ ID NO: 1804768 - protein, 24 aa, Staphylococcus epidermidis
FATIKGKYGEHFFKQYPEAENRNS

SEQ ID NO: 1804769 - protein, 21 aa, Staphylococcus epidermidis
FAVVGDTLFNNGIGRTDLYKG

SEQ ID NO: 1804770 - protein, 17 aa, Staphylococcus epidermidis
FAYHGPALIEVRISPVE

SEQ ID NO: 1804771 - protein, 21 aa, Staphylococcus epidermidis
FAYKIPFKDVIQIELDETLGN

SEQ ID NO: 1804772 - protein, 19 aa, Staphylococcus epidermidis
FCNDDVYKLPIGTPAMATG

SEQ ID NO: 1804773 - protein, 23 aa, Staphylococcus epidermidis
FCVRICTYCDFNKYFIDKQPVDE

SEQ ID NO: 1804774 - protein, 18 aa, Staphylococcus epidermidis
FDADPGWLGPKRMNQLSV

SEQ ID NO: 1804775 - protein, 26 aa, Staphylococcus epidermidis
FDCSYKTLELFDLKVKSIRINASNVK

SEQ ID NO: 1804776 - protein, 31 aa, Staphylococcus epidermidis
FDCVKKLAEMNLEFELGVLLSKKQYWYKLPN

SEQ ID NO: 1804777 - protein, 17 aa, Staphylococcus epidermidis
FDDCDIFFIGGGSDREQ

SEQ ID NO: 1804778 - protein, 18 aa, Staphylococcus epidermidis
FDDLEHVINYAYHNNQNT

SEQ ID NO: 1804779 - protein, 18 aa, Staphylococcus epidermidis
FDDLRVPNKLTLTSVDKV

SEQ ID NO: 1804780 - protein, 18 aa, Staphylococcus epidermidis
FDEAFYRKMATQKWQQQD

SEQ ID NO: 1804781 - protein, 18 aa, Staphylococcus epidermidis
FDEAFYRKMATQKWQQQN

SEQ ID NO: 1804782 - protein, 19 aa, Staphylococcus epidermidis
FDEKARIPFIKKMQNEGLF

SEQ ID NO: 1804783 - protein, 25 aa, Staphylococcus epidermidis
FDGNKWVCATREEWLKSQKPVEVKP

SEQ ID NO: 1804784 - protein, 20 aa, Staphylococcus epidermidis
FDHLERYRAIVVSTQQQKED

SEQ ID NO: 1804785 - protein, 25 aa, Staphylococcus epidermidis
FDHLFKHVPVHPGEFYYVPAGTVHA

SEQ ID NO: 1804786 - protein, 20 aa, Staphylococcus epidermidis
FDILIVMSHVGVFFDEKLCQ

SEQ ID NO: 1804787 - protein, 17 aa, Staphylococcus epidermidis
FDILMCNSKLYHQEGKY

SEQ ID NO: 1804788 - protein, 27 aa, Staphylococcus epidermidis
FDIRHGIRFNIDLEVYMEFMAGGILRI

SEQ ID NO: 1804789 - protein, 20 aa, Staphylococcus epidermidis
FDISKARYHKIVIMTDADVD

SEQ ID NO: 1804790 - protein, 23 aa, Staphylococcus epidermidis
FDKETKEGHAFVLTEHTAETNIY

SEQ ID NO: 1804791 - protein, 17 aa, Staphylococcus epidermidis
FDKETRQSIARDLSKLG

SEQ ID NO: 1804792 - protein, 19 aa, Staphylococcus epidermidis
FDKKREFDPNLAPGTEKVV

SEQ ID NO: 1804793 - protein, 19 aa, Staphylococcus epidermidis
FDKKREFNPDLKPGEERVK

SEQ ID NO: 1804794 - protein, 24 aa, Staphylococcus epidermidis
FDKTKWYSINYEKLEGMKRPSYQN

SEQ ID NO: 1804795 - protein, 21 aa, Staphylococcus epidermidis
FDLDMLYKMIDIINDTLVSIR

SEQ ID NO: 1804796 - protein, 19 aa, Staphylococcus epidermidis
FDLDSRYFVSGLKKDGDHY

SEQ ID NO: 1804797 - protein, 20 aa, Staphylococcus epidermidis
FDLSDMQKAYAIGRQPQQEL

SEQ ID NO: 1804798 - protein, 27 aa, Staphylococcus epidermidis
FDLSFDRKFEVFLVPTVIGEIKRYLRD

SEQ ID NO: 1804799 - protein, 19 aa, Staphylococcus epidermidis
FDLSTPFGDYHVKSPYVGR

SEQ ID NO: 1804800 - protein, 22 aa, Staphylococcus epidermidis
FDLTGRLALYTSLPVIASGGIR

SEQ ID NO: 1804801 - protein, 18 aa, Staphylococcus epidermidis
FDMEPLILTLRPNASYKN

SEQ ID NO: 1804802 - protein, 19 aa, Staphylococcus epidermidis
FDNAIKEAEDLLHNNPGIL

SEQ ID NO: 1804803 - protein, 19 aa, Staphylococcus epidermidis
FDNRINLLTKELVYLRVKK

SEQ ID NO: 1804804 - protein, 18 aa, Staphylococcus epidermidis
FDPNLAPGTEKVVQKGEP

SEQ ID NO: 1804805 - protein, 17 aa, Staphylococcus epidermidis
FDPYFDLHLEKAVNQME

SEQ ID NO: 1804806 - protein, 31 aa, Staphylococcus epidermidis
FDQGEAVSMEWLFRPLLKMLAEGDPVPVEDI

SEQ ID NO: 1804807 - protein, 20 aa, Staphylococcus epidermidis
FDRDDMEIIAGNHDEAIMTL

SEQ ID NO: 1804808 - protein, 17 aa, Staphylococcus epidermidis
FDRNRFETIFKELIDKN

SEQ ID NO: 1804809 - protein, 19 aa, Staphylococcus epidermidis
FDSKIIWKHLETIYRNKNL

SEQ ID NO: 1804810 - protein, 17 aa, Staphylococcus epidermidis
FDSMPTVVGFLPNVVEG

SEQ ID NO: 1804811 - protein, 20 aa, Staphylococcus epidermidis
FDSSHIVGLIGKNGVGKTTI

SEQ ID NO: 1804812 - protein, 17 aa, Staphylococcus epidermidis
FDTDYGWNVKFGKNVFI

SEQ ID NO: 1804813 - protein, 17 aa, Staphylococcus epidermidis
FDTILKLIIRERLEQLN

SEQ ID NO: 1804814 - protein, 28 aa, Staphylococcus epidermidis
FDTKEMKKAASTEFKNTFINQGLREAFG

SEQ ID NO: 1804815 - protein, 18 aa, Staphylococcus epidermidis
FDTWGTRVCEEIKPQKGD

SEQ ID NO: 1804816 - protein, 20 aa, Staphylococcus epidermidis
FDTYAKRRVRLLGVDTPERG

SEQ ID NO: 1804817 - protein, 17 aa, Staphylococcus epidermidis
FDVAFGLENQLVPYKVM

SEQ ID NO: 1804818 - protein, 25 aa, Staphylococcus epidermidis
FDVDVPRTDWDWMIYPKGLYDQIMR

SEQ ID NO: 1804819 - protein, 20 aa, Staphylococcus epidermidis
FDVERFNADFAYTMDGSQFG

SEQ ID NO: 1804820 - protein, 22 aa, Staphylococcus epidermidis
FDVQLDDGMAFLSGVVSRKKQV

SEQ ID NO: 1804821 - protein, 19 aa, Staphylococcus epidermidis
FDVTVEVYEDLLLLRSLSD

SEQ ID NO: 1804822 - protein, 19 aa, Staphylococcus epidermidis
FDYEFPYNFVDIGGGTGEF

SEQ ID NO: 1804823 - protein, 24 aa, Staphylococcus epidermidis
FDYHKKRWGLFGYCRYIPYLKKRL

SEQ ID NO: 1804824 - protein, 20 aa, Staphylococcus epidermidis
FDYQVKRKPNQIAVIDQHRK

SEQ ID NO: 1804825 - protein, 25 aa, Staphylococcus epidermidis
FECGKAEDIILEWKAQGIKPDVVMV

SEQ ID NO: 1804826 - protein, 18 aa, Staphylococcus epidermidis
FEDFCNMTGYTLNELQTY

SEQ ID NO: 1804827 - protein, 18 aa, Staphylococcus epidermidis
FEDLKELVEQGVYVKATG

SEQ ID NO: 1804828 - protein, 29 aa, Staphylococcus epidermidis
FEDNAIIVIEWSKFIKDFLPPNHLTININ

SEQ ID NO: 1804829 - protein, 20 aa, Staphylococcus epidermidis
FEDYFLIVSDLIHYAKTHDV

SEQ ID NO: 1804830 - protein, 20 aa, Staphylococcus epidermidis
FEEDALRIIRGLRFQSQLNF

SEQ ID NO: 1804831 - protein, 18 aa, Staphylococcus epidermidis
FEEEFNHWADSNATELLN

SEQ ID NO: 1804832 - protein, 19 aa, Staphylococcus epidermidis
FEEKLRYFLIEDYNQKEHS

SEQ ID NO: 1804833 - protein, 19 aa, Staphylococcus epidermidis
FEEVARIISLALKHTDDEA

SEQ ID NO: 1804834 - protein, 20 aa, Staphylococcus epidermidis
FEGIRLARQLGHNIAILSPR

SEQ ID NO: 1804835 - protein, 17 aa, Staphylococcus epidermidis
FEGNHFFPFKTSSSYYL

SEQ ID NO: 1804836 - protein, 20 aa, Staphylococcus epidermidis
FEGRQGIGVLTHIASPSVAT

SEQ ID NO: 1804837 - protein, 23 aa, Staphylococcus epidermidis
FEGVLKIGQTVKVAYFKQTEETL

SEQ ID NO: 1804838 - protein, 22 aa, Staphylococcus epidermidis
FEHFKNRLLKYFSENDIFFKGD

SEQ ID NO: 1804839 - protein, 17 aa, Staphylococcus epidermidis
FEIEMVQLIDLIEEIEH

SEQ ID NO: 1804840 - protein, 26 aa, Staphylococcus epidermidis
FEIITTMMFLYFGEIHPVDFVIIEAG

SEQ ID NO: 1804841 - protein, 22 aa, Staphylococcus epidermidis
FEIITTMMFLYFGEINPVDFVV

SEQ ID NO: 1804842 - protein, 19 aa, Staphylococcus epidermidis
FEKASNWCIQAPFEVPDEF

SEQ ID NO: 1804843 - protein, 19 aa, Staphylococcus epidermidis
FEKHDVLVVAGFQGINDEF

SEQ ID NO: 1804844 - protein, 17 aa, Staphylococcus epidermidis
FEKPRLGKVPDYNQNQN

SEQ ID NO: 1804845 - protein, 19 aa, Staphylococcus epidermidis
FEKRMELMHDALVYRIERL

SEQ ID NO: 1804846 - protein, 27 aa, Staphylococcus epidermidis
FEKSGYRIGYGGGYYDKFLNQYKTQTV

SEQ ID NO: 1804847 - protein, 18 aa, Staphylococcus epidermidis
FEKTMARGYRREEVDAFL

SEQ ID NO: 1804848 - protein, 24 aa, Staphylococcus epidermidis
FELDMLYRMIDIINDTLVSIRFSV

SEQ ID NO: 1804849 - protein, 20 aa, Staphylococcus epidermidis
FELHPMLKARFTEEGLQQIL

SEQ ID NO: 1804850 - protein, 18 aa, Staphylococcus epidermidis
FELLDEIEETLNIETYPM

SEQ ID NO: 1804851 - protein, 22 aa, Staphylococcus epidermidis
FELYTPLLRKGGLVVTDNVLYH

SEQ ID NO: 1804852 - protein, 19 aa, Staphylococcus epidermidis
FEMEPLILTLRPGASYKNF

SEQ ID NO: 1804853 - protein, 17 aa, Staphylococcus epidermidis
FENIRYIGIYNPRFNQI

SEQ ID NO: 1804854 - protein, 24 aa, Staphylococcus epidermidis
FENMYEWLSNFELFKVPKTLITKN

SEQ ID NO: 1804855 - protein, 21 aa, Staphylococcus epidermidis
FENMYEWLSNFKLFKVPKTLI

SEQ ID NO: 1804856 - protein, 27 aa, Staphylococcus epidermidis
FENVTFPESFKVFGSEHSKVIFCEANE

SEQ ID NO: 1804857 - protein, 21 aa, Staphylococcus epidermidis
FEPEAGLYFIAKGSEETLDHL

SEQ ID NO: 1804858 - protein, 17 aa, Staphylococcus epidermidis
FEQIKWAIEEQKVSHLF

SEQ ID NO: 1804859 - protein, 18 aa, Staphylococcus epidermidis
FEQLPSIHQEYLLYVRYT

SEQ ID NO: 1804860 - protein, 25 aa, Staphylococcus epidermidis
FEQTEVRLVLSFLRTVDNPLQDIYL

SEQ ID NO: 1804861 - protein, 27 aa, Staphylococcus epidermidis
FERELGFLALHGFLHLLGYDHMNDNDE

SEQ ID NO: 1804862 - protein, 27 aa, Staphylococcus epidermidis
FERELGFLALHGFLHLLGYDHMTEDDE

SEQ ID NO: 1804863 - protein, 24 aa, Staphylococcus epidermidis
FERVKASEIDYDFYDVVQPYTKSI

SEQ ID NO: 1804864 - protein, 17 aa, Staphylococcus epidermidis
FESGLVVDDSIKYNHTT

SEQ ID NO: 1804865 - protein, 27 aa, Staphylococcus epidermidis
FESINWLINYVKQYPHTVLFVTHDRYF

SEQ ID NO: 1804866 - protein, 24 aa, Staphylococcus epidermidis
FESNCGWPSFSKALDDDEIVELVD

SEQ ID NO: 1804867 - protein, 25 aa, Staphylococcus epidermidis
FESNTSWPLAMPVFKMDYAHKECEA

SEQ ID NO: 1804868 - protein, 17 aa, Staphylococcus epidermidis
FESPSAEILELKIRPYR

SEQ ID NO: 1804869 - protein, 18 aa, Staphylococcus epidermidis
FESRFLKRNQYLQDVSGF

SEQ ID NO: 1804870 - protein, 28 aa, Staphylococcus epidermidis
FESTFFDHQLLRRFVSFMYEKPSTLIDY

SEQ ID NO: 1804871 - protein, 17 aa, Staphylococcus epidermidis
FESWSKISKEERADYLL

SEQ ID NO: 1804872 - protein, 21 aa, Staphylococcus epidermidis
FETIGIAGFFGLPIQKEALDE

SEQ ID NO: 1804873 - protein, 24 aa, Staphylococcus epidermidis
FEVKELLFRIKAVLRRYQINAESE

SEQ ID NO: 1804874 - protein, 25 aa, Staphylococcus epidermidis
FEVMKDLRILASELRNDIQGIARNF

SEQ ID NO: 1804875 - protein, 18 aa, Staphylococcus epidermidis
FEVVPGITSGIAAPAYAG

SEQ ID NO: 1804876 - protein, 17 aa, Staphylococcus epidermidis
FEYEVFEGNHFFPFKTS

SEQ ID NO: 1804877 - protein, 17 aa, Staphylococcus epidermidis
FFAGFSGGPKGIMPGIA

SEQ ID NO: 1804878 - protein, 17 aa, Staphylococcus epidermidis
FFAQYANFNSLKDYKNG

SEQ ID NO: 1804879 - protein, 24 aa, Staphylococcus epidermidis
FFDHQLLRRLVAFMYEKPSTLIDY

SEQ ID NO: 1804880 - protein, 22 aa, Staphylococcus epidermidis
FFDHQLLRRLVAFMYEQPSTII

SEQ ID NO: 1804881 - protein, 18 aa, Staphylococcus epidermidis
FFEICKKHHITIISVNDG

SEQ ID NO: 1804882 - protein, 18 aa, Staphylococcus epidermidis
FFEKALKVIRPVYLNQST

SEQ ID NO: 1804883 - protein, 18 aa, Staphylococcus epidermidis
FFEMYSWAQIGIHQKPIG

SEQ ID NO: 1804884 - protein, 26 aa, Staphylococcus epidermidis
FFEVFDVLQELGLTKVNGGFIVTGGS

SEQ ID NO: 1804885 - protein, 21 aa, Staphylococcus epidermidis
FFEVFDVLQELGLTKVNGGFV

SEQ ID NO: 1804886 - protein, 24 aa, Staphylococcus epidermidis
FFGEQHFTTDFLYQTEWQEWLNDG

SEQ ID NO: 1804887 - protein, 19 aa, Staphylococcus epidermidis
FFHQLFKLLEDVRIFEHIR

SEQ ID NO: 1804888 - protein, 25 aa, Staphylococcus epidermidis
FFNIYKDFYLSLSKFSNLFHINRQS

SEQ ID NO: 1804889 - protein, 18 aa, Staphylococcus epidermidis
FFNKCKEIIALYDNLPTE

SEQ ID NO: 1804890 - protein, 17 aa, Staphylococcus epidermidis
FFPFLNPQHFVFCGRKN

SEQ ID NO: 1804891 - protein, 28 aa, Staphylococcus epidermidis
FFRALVINARLTVHIDLIRGGNTHHEIE

SEQ ID NO: 1804892 - protein, 23 aa, Staphylococcus epidermidis
FFSNYRPQFYFRTTDVTGVVNLP

SEQ ID NO: 1804893 - protein, 18 aa, Staphylococcus epidermidis
FFSPFGNFTGLTNFDSTL

SEQ ID NO: 1804894 - protein, 25 aa, Staphylococcus epidermidis
FFTIVKWEISGTLNYMKPREFCLIS

SEQ ID NO: 1804895 - protein, 22 aa, Staphylococcus epidermidis
FGACPTCDGLGQKLTVDLDLVV

SEQ ID NO: 1804896 - protein, 20 aa, Staphylococcus epidermidis
FGARPLKRFVQRQIETPLAR

SEQ ID NO: 1804897 - protein, 23 aa, Staphylococcus epidermidis
FGAYYRGYCSDITRTFAVGEPDP

SEQ ID NO: 1804898 - protein, 19 aa, Staphylococcus epidermidis
FGDPEAQVLLTRMESDLMQ

SEQ ID NO: 1804899 - protein, 18 aa, Staphylococcus epidermidis
FGDSLLVINDDEIVKVHV

SEQ ID NO: 1804900 - protein, 20 aa, Staphylococcus epidermidis
FGDYGEIFGRMIKAQMRNYQ

SEQ ID NO: 1804901 - protein, 22 aa, Staphylococcus epidermidis
FGEDKLFFAELISKSKSASMTT

SEQ ID NO: 1804902 - protein, 31 aa, Staphylococcus epidermidis
FGEVGRALYNFIWDEFCDWYIEMSKIPMNSD

SEQ ID NO: 1804903 - protein, 19 aa, Staphylococcus epidermidis
FGEVPAPVETFLKNETNQN

SEQ ID NO: 1804904 - protein, 17 aa, Staphylococcus epidermidis
FGFTASFNRCVITGNDD

SEQ ID NO: 1804905 - protein, 21 aa, Staphylococcus epidermidis
FGGGLTADVKIFKLLKSANES

SEQ ID NO: 1804906 - protein, 17 aa, Staphylococcus epidermidis
FGGQSFIEQCINKIEQL

SEQ ID NO: 1804907 - protein, 17 aa, Staphylococcus epidermidis
FGGSIKNQGNRFLNILV

SEQ ID NO: 1804908 - protein, 23 aa, Staphylococcus epidermidis
FGHEEIKRLVAFQQEIIDHIQPV

SEQ ID NO: 1804909 - protein, 26 aa, Staphylococcus epidermidis
FGHIPSRIPLRASFNQKGKRDRFKAK

SEQ ID NO: 1804910 - protein, 17 aa, Staphylococcus epidermidis
FGHLEGINLTYVGDGRN

SEQ ID NO: 1804911 - protein, 27 aa, Staphylococcus epidermidis
FGHQLRFDLSKGFPLLTTKKVSFKLIA

SEQ ID NO: 1804912 - protein, 25 aa, Staphylococcus epidermidis
FGHTKTIWVWTGFLFEYLKQQNDAR

SEQ ID NO: 1804913 - protein, 20 aa, Staphylococcus epidermidis
FGKNFGVVMEELRLLARSVF

SEQ ID NO: 1804914 - protein, 24 aa, Staphylococcus epidermidis
FGKQFKRGRYNDVINSGLNYGYSI

SEQ ID NO: 1804915 - protein, 19 aa, Staphylococcus epidermidis
FGLQNGKIMKMKPEYEDLK

SEQ ID NO: 1804916 - protein, 23 aa, Staphylococcus epidermidis
FGNAYSSLKSWTGSMYDKAHDRF

SEQ ID NO: 1804917 - protein, 21 aa, Staphylococcus epidermidis
FGNDLLRNFVRRVCNCTGEWT

SEQ ID NO: 1804918 - protein, 18 aa, Staphylococcus epidermidis
FGPIDLKGLNAGEGRVLT

SEQ ID NO: 1804919 - protein, 19 aa, Staphylococcus epidermidis
FGPIDLKGLNAGEGRVLTP

SEQ ID NO: 1804920 - protein, 19 aa, Staphylococcus epidermidis
FGPTITVKALLSMRMENKV

SEQ ID NO: 1804921 - protein, 17 aa, Staphylococcus epidermidis
FGRRKMDLTPNEIYNLV

SEQ ID NO: 1804922 - protein, 19 aa, Staphylococcus epidermidis
FGSIAALKFLAETHHHIEG

SEQ ID NO: 1804923 - protein, 18 aa, Staphylococcus epidermidis
FGSIPSRVPLKSSFNKKG

SEQ ID NO: 1804924 - protein, 28 aa, Staphylococcus epidermidis
FGSMNGRVLDLVMFLRKTAFSDLSRMIE

SEQ ID NO: 1804925 - protein, 24 aa, Staphylococcus epidermidis
FGTAGIRGIFGIGPGRMNAFTVRK

SEQ ID NO: 1804926 - protein, 20 aa, Staphylococcus epidermidis
FGTQYEVHHIWEWENGENEP

SEQ ID NO: 1804927 - protein, 17 aa, Staphylococcus epidermidis
FGVNYIRSVYDDWDVVE

SEQ ID NO: 1804928 - protein, 17 aa, Staphylococcus epidermidis
FGVPGDFNLAFLDDIIS

SEQ ID NO: 1804929 - protein, 24 aa, Staphylococcus epidermidis
FGVQKRSRNILDFSDYEHFALCIL

SEQ ID NO: 1804930 - protein, 21 aa, Staphylococcus epidermidis
FGYKSFRPGQEEIITKILNHQ

SEQ ID NO: 1804931 - protein, 17 aa, Staphylococcus epidermidis
FHFLPIAVRYDGQKAPV

SEQ ID NO: 1804932 - protein, 27 aa, Staphylococcus epidermidis
FHKLSKEELKEIVTMMVNKLTARLSEQ

SEQ ID NO: 1804933 - protein, 17 aa, Staphylococcus epidermidis
FHLPLVIATTGEKDTLI

SEQ ID NO: 1804934 - protein, 25 aa, Staphylococcus epidermidis
FHLQNEIKKRGAIYRYGRVPFTSTL

SEQ ID NO: 1804935 - protein, 17 aa, Staphylococcus epidermidis
FHQLFKLLEDVRIFDII

SEQ ID NO: 1804936 - protein, 27 aa, Staphylococcus epidermidis
FHRHVPILGVCLGFQLIIEYFGGNIIH

SEQ ID NO: 1804937 - protein, 19 aa, Staphylococcus epidermidis
FHTKDIPGSHVVILNNHPS

SEQ ID NO: 1804938 - protein, 17 aa, Staphylococcus epidermidis
FIAEILETIYSFTKSPM

SEQ ID NO: 1804939 - protein, 18 aa, Staphylococcus epidermidis
FIAGGILRTMYAWIQDGQ

SEQ ID NO: 1804940 - protein, 17 aa, Staphylococcus epidermidis
FIAKLIVTGGVNVKVET

SEQ ID NO: 1804941 - protein, 19 aa, Staphylococcus epidermidis
FIAVLFACNLLELEPVLML

SEQ ID NO: 1804942 - protein, 22 aa, Staphylococcus epidermidis
FIDNCEAYGCGDDGITTHHSRY

SEQ ID NO: 1804943 - protein, 18 aa, Staphylococcus epidermidis
FIDVETMLTLLDLANVYV

SEQ ID NO: 1804944 - protein, 22 aa, Staphylococcus epidermidis
FIESAYKYYTTINHSVNYCIFC

SEQ ID NO: 1804945 - protein, 18 aa, Staphylococcus epidermidis
FIFKNGFKPRIYEEENMK

SEQ ID NO: 1804946 - protein, 26 aa, Staphylococcus epidermidis
FIFPESMKSLLPESAQFISLCKNAQD

SEQ ID NO: 1804947 - protein, 17 aa, Staphylococcus epidermidis
FIGHEMGALIAADMSVR

SEQ ID NO: 1804948 - protein, 19 aa, Staphylococcus epidermidis
FIGNEPFAVLLGDDIVESD

SEQ ID NO: 1804949 - protein, 17 aa, Staphylococcus epidermidis
FIHKPLGFNTDLKVVKL

SEQ ID NO: 1804950 - protein, 26 aa, Staphylococcus epidermidis
FIKLQKRSDYGLGIIGELPHTMTLDE

SEQ ID NO: 1804951 - protein, 31 aa, Staphylococcus epidermidis
FIKSELGSRMRLRIIPDLTFEYDESIEYGNK

SEQ ID NO: 1804952 - protein, 17 aa, Staphylococcus epidermidis
FINDNVELFGVEAAGEG

SEQ ID NO: 1804953 - protein, 19 aa, Staphylococcus epidermidis
FINFDKWLNISFTEKYYSR

SEQ ID NO: 1804954 - protein, 18 aa, Staphylococcus epidermidis
FINIKAREAGFEPSAVVV

SEQ ID NO: 1804955 - protein, 26 aa, Staphylococcus epidermidis
FIPSMNFKSHIYRKFLKMTVGQNTAF

SEQ ID NO: 1804956 - protein, 19 aa, Staphylococcus epidermidis
FIQHHFLFIESFENYVDNV

SEQ ID NO: 1804957 - protein, 17 aa, Staphylococcus epidermidis
FIQKSIIKAIDIAWIEQ

SEQ ID NO: 1804958 - protein, 21 aa, Staphylococcus epidermidis
FIRDEIRFEGMFTKEKLPFID

SEQ ID NO: 1804959 - protein, 21 aa, Staphylococcus epidermidis
FIRHIQFLIYRLTKGENVAAQ

SEQ ID NO: 1804960 - protein, 23 aa, Staphylococcus epidermidis
FIRHIQFLIYRLTKGEYLEAQEN

SEQ ID NO: 1804961 - protein, 20 aa, Staphylococcus epidermidis
FIRMTIKPLLNLIVTELNAK

SEQ ID NO: 1804962 - protein, 21 aa, Staphylococcus epidermidis
FIRTLKSGFKDGSFERKLERV

SEQ ID NO: 1804963 - protein, 25 aa, Staphylococcus epidermidis
FISDFPWERMLEIDEYLSGISTVFQ

SEQ ID NO: 1804964 - protein, 17 aa, Staphylococcus epidermidis
FITGKKFAAGRHPKISL

SEQ ID NO: 1804965 - protein, 17 aa, Staphylococcus epidermidis
FITKFLERYYKLDQQLS

SEQ ID NO: 1804966 - protein, 17 aa, Staphylococcus epidermidis
FIVATKIKGMIAAEVSD

SEQ ID NO: 1804967 - protein, 17 aa, Staphylococcus epidermidis
FIVPFVFLFEKEGNFLF

SEQ ID NO: 1804968 - protein, 18 aa, Staphylococcus epidermidis
FIYISTISVGAVFEAHVE

SEQ ID NO: 1804969 - protein, 18 aa, Staphylococcus epidermidis
FIYNLLVQITLDYPNIYI

SEQ ID NO: 1804970 - protein, 21 aa, Staphylococcus epidermidis
FIYNRKKLWITYSKNLTNTFI

SEQ ID NO: 1804971 - protein, 25 aa, Staphylococcus epidermidis
FIYSKPRSGYYVSDIESLPVVNTES

SEQ ID NO: 1804972 - protein, 23 aa, Staphylococcus epidermidis
FKADFLKYNFDVSIERIIKIKEF

SEQ ID NO: 1804973 - protein, 20 aa, Staphylococcus epidermidis
FKADGVSIVDHLTAAKQFEM

SEQ ID NO: 1804974 - protein, 17 aa, Staphylococcus epidermidis
FKADIDRVVSKHECPSC

SEQ ID NO: 1804975 - protein, 24 aa, Staphylococcus epidermidis
FKAIFKDDHVIGISELIQDFDVEE

SEQ ID NO: 1804976 - protein, 20 aa, Staphylococcus epidermidis
FKAKHLLNQNLFHLSGGQKQ

SEQ ID NO: 1804977 - protein, 18 aa, Staphylococcus epidermidis
FKAKIEVVSTLFSTKSDF

SEQ ID NO: 1804978 - protein, 19 aa, Staphylococcus epidermidis
FKAMLFHVMQDLAKKIAKD

SEQ ID NO: 1804979 - protein, 20 aa, Staphylococcus epidermidis
FKATGTKLLYDRPIHTQLRY

SEQ ID NO: 1804980 - protein, 18 aa, Staphylococcus epidermidis
FKCNCGKSGCIETVASAT

SEQ ID NO: 1804981 - protein, 20 aa, Staphylococcus epidermidis
FKDILINEYIYFASKNKKLI

SEQ ID NO: 1804982 - protein, 21 aa, Staphylococcus epidermidis
FKDKHVITISLEIVNERYLKD

SEQ ID NO: 1804983 - protein, 24 aa, Staphylococcus epidermidis
FKDKKIKLGVIPNFSLYKLHEKNY

SEQ ID NO: 1804984 - protein, 24 aa, Staphylococcus epidermidis
FKDKKLKEAHSFPFGVVTLKRQFF

SEQ ID NO: 1804985 - protein, 21 aa, Staphylococcus epidermidis
FKDYGVGIAKVGKYGGKGITA

SEQ ID NO: 1804986 - protein, 17 aa, Staphylococcus epidermidis
FKEASEQLAQWVQENKI

SEQ ID NO: 1804987 - protein, 22 aa, Staphylococcus epidermidis
FKEAVPRVGDIVNVIDDLIGLN

SEQ ID NO: 1804988 - protein, 23 aa, Staphylococcus epidermidis
FKEEKVLPVTFIDKVFENLVKEH

SEQ ID NO: 1804989 - protein, 26 aa, Staphylococcus epidermidis
FKEFFPENRVEYFVSYYDYYQPEAYV

SEQ ID NO: 1804990 - protein, 18 aa, Staphylococcus epidermidis
FKEGELTGDIYISNQNTK

SEQ ID NO: 1804991 - protein, 19 aa, Staphylococcus epidermidis
FKEGVGIDLARLSLEKAEA

SEQ ID NO: 1804992 - protein, 19 aa, Staphylococcus epidermidis
FKEGVGIDLARLSLEKAET

SEQ ID NO: 1804993 - protein, 20 aa, Staphylococcus epidermidis
FKEIATVTIHFSIKDTHNQD

SEQ ID NO: 1804994 - protein, 21 aa, Staphylococcus epidermidis
FKEKELFIRATVKRTSVDNLM

SEQ ID NO: 1804995 - protein, 27 aa, Staphylococcus epidermidis
FKERHHLKMITIKSLVAFRKAVELNVN

SEQ ID NO: 1804996 - protein, 21 aa, Staphylococcus epidermidis
FKESDAWNQLDAVKNNRVHEV

SEQ ID NO: 1804997 - protein, 20 aa, Staphylococcus epidermidis
FKESVAHLLSILKLPHNIMS

SEQ ID NO: 1804998 - protein, 17 aa, Staphylococcus epidermidis
FKETMGLKVNENATPIK

SEQ ID NO: 1804999 - protein, 17 aa, Staphylococcus epidermidis
FKFAEFNNFSSFKSLVT

SEQ ID NO: 1805000 - protein, 20 aa, Staphylococcus epidermidis
FKFDKEKIGIAGQTFEDFKG

SEQ ID NO: 1805001 - protein, 25 aa, Staphylococcus epidermidis
FKGAAKPGPVVAIFGDTKPCDNEYI

SEQ ID NO: 1805002 - protein, 25 aa, Staphylococcus epidermidis
FKGKAKPGPIISIFGDTKPCENEYK

SEQ ID NO: 1805003 - protein, 31 aa, Staphylococcus epidermidis; identical to SEQ ID NO: 1667036

SEQ ID NO: 1805004 - protein, 18 aa, Staphylococcus epidermidis
FKGKYLNLYDEVRKKDKR

SEQ ID NO: 1805005 - protein, 18 aa, Staphylococcus epidermidis
FKGLGSSASKAWGNVNAT

SEQ ID NO: 1805006 - protein, 27 aa, Staphylococcus epidermidis
FKGLLHEVFKEYGVLFIDAQYTDLRRM

SEQ ID NO: 1805007 - protein, 22 aa, Staphylococcus epidermidis
FKGPVGRYETVLAIIEDKQPTV

SEQ ID NO: 1805008 - protein, 18 aa, Staphylococcus epidermidis
FKGQKMPGRMGGNTVTVQ

SEQ ID NO: 1805009 - protein, 18 aa, Staphylococcus epidermidis
FKGQNLVHFIPREHIEGR

SEQ ID NO: 1805010 - protein, 20 aa, Staphylococcus epidermidis
FKIDGEFIMLLVRGHHELNE

SEQ ID NO: 1805011 - protein, 17 aa, Staphylococcus epidermidis
FKIESFITPEYQRKIND

SEQ ID NO: 1805012 - protein, 18 aa, Staphylococcus epidermidis
FKIIKRYNEDPIIKDIDN

SEQ ID NO: 1805013 - protein, 19 aa, Staphylococcus epidermidis
FKIIKRYNEDPIIKDINNN

SEQ ID NO: 1805014 - protein, 18 aa, Staphylococcus epidermidis
FKIKPEWLMELNKCANRD

SEQ ID NO: 1805015 - protein, 24 aa, Staphylococcus epidermidis
FKIKRLQNTFPEFQKSTISLLRLF

SEQ ID NO: 1805016 - protein, 18 aa, Staphylococcus epidermidis
FKIRDALRTALKALELEL

SEQ ID NO: 1805017 - protein, 21 aa, Staphylococcus epidermidis
FKISFNDVEFLPPVTPPNNVI

SEQ ID NO: 1805018 - protein, 26 aa, Staphylococcus epidermidis
FKITVPKSSYYLIMIRNDGSFTRIKF

SEQ ID NO: 1805019 - protein, 20 aa, Staphylococcus epidermidis
FKKAEHDLLTMIKHGVLTIE

SEQ ID NO: 1805020 - protein, 18 aa, Staphylococcus epidermidis
FKKAPGNHDYAFWDKAIE

SEQ ID NO: 1805021 - protein, 18 aa, Staphylococcus epidermidis
FKKASGNHDYAFWDKAIE

SEQ ID NO: 1805022 - protein, 24 aa, Staphylococcus epidermidis
FKKDDTSFFDIVAFGKTAQLLNDY

SEQ ID NO: 1805023 - protein, 28 aa, Staphylococcus epidermidis
FKKDFPNHKVKIIPLIAMTTSKERMKAI

SEQ ID NO: 1805024 - protein, 20 aa, Staphylococcus epidermidis
FKKGFIYDEVILKPIDEIQL

SEQ ID NO: 1805025 - protein, 20 aa, Staphylococcus epidermidis
FKKGLERYNLEYEYNAKTKT

SEQ ID NO: 1805026 - protein, 18 aa, Staphylococcus epidermidis
FKKHFKINRLTWKEKIRI

SEQ ID NO: 1805027 - protein, 20 aa, Staphylococcus epidermidis
FKKLNATVINTEYKSIEESA

SEQ ID NO: 1805028 - protein, 20 aa, Staphylococcus epidermidis
FKKMHVRPRREIVALDLEED

SEQ ID NO: 1805029 - protein, 17 aa, Staphylococcus epidermidis
FKKRGLTSHDVVFKLRK

SEQ ID NO: 1805030 - protein, 20 aa, Staphylococcus epidermidis
FKKSGLKYNISYASKAFTCI

SEQ ID NO: 1805031 - protein, 20 aa, Staphylococcus epidermidis
FKKSKASLLTSEYEGFGLTV

SEQ ID NO: 1805032 - protein, 22 aa, Staphylococcus epidermidis
FKKSNCRYISESGFHTKEDVEK

SEQ ID NO: 1805033 - protein, 17 aa, Staphylococcus epidermidis
FKKTNYLDTDWKDRISS

SEQ ID NO: 1805034 - protein, 17 aa, Staphylococcus epidermidis
FKLDTYHNTSPPKSDAK

SEQ ID NO: 1805035 - protein, 22 aa, Staphylococcus epidermidis
FKLIATELLWFIKGDTNIQYLL

SEQ ID NO: 1805036 - protein, 19 aa, Staphylococcus epidermidis
FKLLKIKYKNYKIIDPSGI

SEQ ID NO: 1805037 - protein, 18 aa, Staphylococcus epidermidis
FKLLVPKKSKLTFRDYVN

SEQ ID NO: 1805038 - protein, 21 aa, Staphylococcus epidermidis
FKLNDLMSEFNISRSTALRDI

SEQ ID NO: 1805039 - protein, 26 aa, Staphylococcus epidermidis
FKLYECDDCSECPLKNQCMNFNSKTN

SEQ ID NO: 1805040 - protein, 19 aa, Staphylococcus epidermidis
FKLYIGLKHISPYIEEAVE

SEQ ID NO: 1805041 - protein, 17 aa, Staphylococcus epidermidis
FKMKPVGLIGNSGGIVS

SEQ ID NO: 1805042 - protein, 20 aa, Staphylococcus epidermidis
FKNADLTGVLDVEEAPLVSV

SEQ ID NO: 1805043 - protein, 26 aa, Staphylococcus epidermidis
FKNALLESWKIFSLEDKADFIKMAIK

SEQ ID NO: 1805044 - protein, 20 aa, Staphylococcus epidermidis
FKNDDLRFITNIPSKQRLIK

SEQ ID NO: 1805045 - protein, 24 aa, Staphylococcus epidermidis
FKNEGISVVSVRANHYFKPSKTRN

SEQ ID NO: 1805046 - protein, 18 aa, Staphylococcus epidermidis
FKNIMIIAPLADGYGNLP

SEQ ID NO: 1805047 - protein, 30 aa, Staphylococcus epidermidis
FKNMKEIQAFNYIPFFKAFNMNKVFINEPL

SEQ ID NO: 1805048 - protein, 18 aa, Staphylococcus epidermidis
FKNNNGYNYPNWNEEKLG

SEQ ID NO: 1805049 - protein, 25 aa, Staphylococcus epidermidis
FKNPSRILGSFFIKHHGYRVRIDDI

SEQ ID NO: 1805050 - protein, 29 aa, Staphylococcus epidermidis
FKNTESKLTVAMGYRINNEPLLMDIAKTP

SEQ ID NO: 1805051 - protein, 21 aa, Staphylococcus epidermidis
FKNTFINQGLREAFGNKGTFT

SEQ ID NO: 1805052 - protein, 20 aa, Staphylococcus epidermidis
FKNTYGHLAGAWRGKKPIQR

SEQ ID NO: 1805053 - protein, 19 aa, Staphylococcus epidermidis
FKPYVEIFEHDFKDKSLKV

SEQ ID NO: 1805054 - protein, 22 aa, Staphylococcus epidermidis
FKQFKYNTSLFTDWINQAEMII

SEQ ID NO: 1805055 - protein, 18 aa, Staphylococcus epidermidis
FKQQGYQLVDFNLIEKLN

SEQ ID NO: 1805056 - protein, 23 aa, Staphylococcus epidermidis
FKQSLELALKMDIDHISSYGLIL

SEQ ID NO: 1805057 - protein, 21 aa, Staphylococcus epidermidis
FKRIDEYGLKKGISIDSPQRI

SEQ ID NO: 1805058 - protein, 19 aa, Staphylococcus epidermidis
FKSDAALLATGRKPNTDGL

SEQ ID NO: 1805059 - protein, 19 aa, Staphylococcus epidermidis
FKSGFKKGLNIDFKPLELT

SEQ ID NO: 1805060 - protein, 21 aa, Staphylococcus epidermidis
FKSLLATPMVTSFPQLYILGM

SEQ ID NO: 1805061 - protein, 17 aa, Staphylococcus epidermidis
FKSNKHSMLLLALISND

SEQ ID NO: 1805062 - protein, 19 aa, Staphylococcus epidermidis
FKSNQSIMVALYVVSQHYT

SEQ ID NO: 1805063 - protein, 19 aa, Staphylococcus epidermidis
FKSVGLAIVDIIVAQYFYK

SEQ ID NO: 1805064 - protein, 18 aa, Staphylococcus epidermidis
FKSVKVCPLIYWTEDEVW

SEQ ID NO: 1805065 - protein, 20 aa, Staphylococcus epidermidis
FKSYKLFNEIIRLIIENKSF

SEQ ID NO: 1805066 - protein, 20 aa, Staphylococcus epidermidis
FKTAELFGKLVNLGDDIGKG

SEQ ID NO: 1805067 - protein, 28 aa, Staphylococcus epidermidis
FKTAYHILDIVFWFGHLDILTTNQYDII

SEQ ID NO: 1805068 - protein, 22 aa, Staphylococcus epidermidis
FKTEVVKDFKDGIVTEAEKTRL

SEQ ID NO: 1805069 - protein, 19 aa, Staphylococcus epidermidis
FKTKEEFEALIKDDQFIEF

SEQ ID NO: 1805070 - protein, 20 aa, Staphylococcus epidermidis
FKVAKTESLEQLFNQFNTED

SEQ ID NO: 1805071 - protein, 18 aa, Staphylococcus epidermidis
FKVGDKVTITAGHMPGMK

SEQ ID NO: 1805072 - protein, 17 aa, Staphylococcus epidermidis
FKVGDKVYGRPRKSKIG

SEQ ID NO: 1805073 - protein, 20 aa, Staphylococcus epidermidis
FKVKELFHLHQSFYKNPISL

SEQ ID NO: 1805074 - protein, 24 aa, Staphylococcus epidermidis
FKVQRIIERSCKFYGNSYLSKKSE

SEQ ID NO: 1805075 - protein, 19 aa, Staphylococcus epidermidis
FKVRFLINEVCHKYQIPWV

SEQ ID NO: 1805076 - protein, 20 aa, Staphylococcus epidermidis
FKYKDAHNEIELDFTNGASQ

SEQ ID NO: 1805077 - protein, 21 aa, Staphylococcus epidermidis
FKYKDFENEIELDFTEGTATQ

SEQ ID NO: 1805078 - protein, 17 aa, Staphylococcus epidermidis
FKYTAYISLNNELQDIP

SEQ ID NO: 1805079 - protein, 20 aa, Staphylococcus epidermidis
FLCGEVLDIHGYTGGYNITS

SEQ ID NO: 1805080 - protein, 19 aa, Staphylococcus epidermidis
FLCTAICPEIADYSIDIKD

SEQ ID NO: 1805081 - protein, 21 aa, Staphylococcus epidermidis
FLDDIRVNIVYEIPLSEVVFD

SEQ ID NO: 1805082 - protein, 21 aa, Staphylococcus epidermidis
FLDKCDEAGVYGLIIPDLPYE

SEQ ID NO: 1805083 - protein, 24 aa, Staphylococcus epidermidis
FLDKTLERKAVWDKWMEQDKNNNK

SEQ ID NO: 1805084 - protein, 26 aa, Staphylococcus epidermidis
FLDPQYFRKGYGTEILQTLISEHKIQ

SEQ ID NO: 1805085 - protein, 21 aa, Staphylococcus epidermidis
FLEKIRKALYMSKICSYAQGF

SEQ ID NO: 1805086 - protein, 23 aa, Staphylococcus epidermidis
FLEKYKGKVLIIVNTATNCALSD

SEQ ID NO: 1805087 - protein, 19 aa, Staphylococcus epidermidis
FLEMDLKYSVFEEVQANFL

SEQ ID NO: 1805088 - protein, 18 aa, Staphylococcus epidermidis
FLERVPSHIPVLIDEAYV

SEQ ID NO: 1805089 - protein, 25 aa, Staphylococcus epidermidis
FLETTRNAFFIGRTIDYNVSQEGAL

SEQ ID NO: 1805090 - protein, 27 aa, Staphylococcus epidermidis
FLFSQGRLEEARAFILNQSYEIQQHRV

SEQ ID NO: 1805091 - protein, 23 aa, Staphylococcus epidermidis
FLFSQGRLEEARTYILNQSYEIQ

SEQ ID NO: 1805092 - protein, 17 aa, Staphylococcus epidermidis
FLGNIRVFNPIETLNDF

SEQ ID NO: 1805093 - protein, 18 aa, Staphylococcus epidermidis
FLHKWVVDSKETLNFYKN

SEQ ID NO: 1805094 - protein, 17 aa, Staphylococcus epidermidis
FLHLLGYDHMNDNDEKE

SEQ ID NO: 1805095 - protein, 24 aa, Staphylococcus epidermidis
FLHRYDLYESHYWSVFDEIQGIGH

SEQ ID NO: 1805096 - protein, 20 aa, Staphylococcus epidermidis
FLIGKGMSLSSGERVQIEPL

SEQ ID NO: 1805097 - protein, 20 aa, Staphylococcus epidermidis
FLKDFKGVYINSPENGAPHI

SEQ ID NO: 1805098 - protein, 18 aa, Staphylococcus epidermidis
FLKEQPFGQSINLKKIIE

SEQ ID NO: 1805099 - protein, 24 aa, Staphylococcus epidermidis
FLKRGQALLNISGYTTMFFNIEPT

SEQ ID NO: 1805100 - protein, 29 aa, Staphylococcus epidermidis
FLLGYSMGGRVALYYAIHGNETLSGLLLE

SEQ ID NO: 1805101 - protein, 19 aa, Staphylococcus epidermidis
FLLVKREIFSSGKSICRIN

SEQ ID NO: 1805102 - protein, 25 aa, Staphylococcus epidermidis
FLNAKLRPGIDVVLEETQFKQRIKD

SEQ ID NO: 1805103 - protein, 23 aa, Staphylococcus epidermidis
FLNELFYLIELYLKAFKGQKKTD

SEQ ID NO: 1805104 - protein, 24 aa, Staphylococcus epidermidis
FLNIPSKITPIIKIAISHYYFGYI

SEQ ID NO: 1805105 - protein, 19 aa, Staphylococcus epidermidis
FLNLLRKIDIHLIAFDEAH

SEQ ID NO: 1805106 - protein, 19 aa, Staphylococcus epidermidis
FLNLLRKIKIPLIAFDEAH

SEQ ID NO: 1805107 - protein, 21 aa, Staphylococcus epidermidis
FLPSRIDLMVDAFKKNKETDI

SEQ ID NO: 1805108 - protein, 26 aa, Staphylococcus epidermidis
FLRKQTACNIIFRTAIVKAHHIRFNE

SEQ ID NO: 1805109 - protein, 17 aa, Staphylococcus epidermidis
FLSAASFQETTRVLTDA

SEQ ID NO: 1805110 - protein, 17 aa, Staphylococcus epidermidis
FLSGTVYAIGGDIQRVG

SEQ ID NO: 1805111 - protein, 17 aa, Staphylococcus epidermidis
FLSPIVFSSNLGEDLLN

SEQ ID NO: 1805112 - protein, 20 aa, Staphylococcus epidermidis
FLSTLPVGGLGLDFVHDNGY

SEQ ID NO: 1805113 - protein, 19 aa, Staphylococcus epidermidis
FLTAKARYARSIKGTKPTF

SEQ ID NO: 1805114 - protein, 19 aa, Staphylococcus epidermidis
FMAASKFYDTYALKTRDKS

SEQ ID NO: 1805115 - protein, 20 aa, Staphylococcus epidermidis
FMAREGRGLICAPIDKSIAE

SEQ ID NO: 1805116 - protein, 18 aa, Staphylococcus epidermidis
FMDSLKRIDISPLGAAAL

SEQ ID NO: 1805117 - protein, 17 aa, Staphylococcus epidermidis
FMGPLDAAIAWSEKGLD

SEQ ID NO: 1805118 - protein, 27 aa, Staphylococcus epidermidis
FMHRKKPANGFVCYMIGRLILENCKDV

SEQ ID NO: 1805119 - protein, 23 aa, Staphylococcus epidermidis
FMKKGRPSTHLTVICKPDTAFEF

SEQ ID NO: 1805120 - protein, 21 aa, Staphylococcus epidermidis
FMKMAEAYGINGYLIDTPDKL

SEQ ID NO: 1805121 - protein, 23 aa, Staphylococcus epidermidis
FMKMAEAYGVKGFLIDSPDKLES

SEQ ID NO: 1805122 - protein, 26 aa, Staphylococcus epidermidis
FMKRFEEFQSHIALIQTFDLPMKNIS

SEQ ID NO: 1805123 - protein, 21 aa, Staphylococcus epidermidis
FMLDAGLMFPEDEMLGVDIVI

SEQ ID NO: 1805124 - protein, 17 aa, Staphylococcus epidermidis
FMRGFEIDCRIKHFQGR

SEQ ID NO: 1805125 - protein, 17 aa, Staphylococcus epidermidis
FNADFAYTMDGSQFGEL

SEQ ID NO: 1805126 - protein, 19 aa, Staphylococcus epidermidis
FNAEKGFGFIEREDGGDVF

SEQ ID NO: 1805127 - protein, 21 aa, Staphylococcus epidermidis
FNAICPKKIIIEKDVWIASGV

SEQ ID NO: 1805128 - protein, 17 aa, Staphylococcus epidermidis
FNALGHQFAKEHDIPYV

SEQ ID NO: 1805129 - protein, 18 aa, Staphylococcus epidermidis
FNAPTREEVAKRFEKAEQ

SEQ ID NO: 1805130 - protein, 21 aa, Staphylococcus epidermidis
FNDEVCRAQGLSVPEKDTARL

SEQ ID NO: 1805131 - protein, 18 aa, Staphylococcus epidermidis
FNDFEMHFYRYVFPYYDT

SEQ ID NO: 1805132 - protein, 26 aa, Staphylococcus epidermidis
FNEDLDIYIDWSFLLEYMKYVNKFIR

SEQ ID NO: 1805133 - protein, 29 aa, Staphylococcus epidermidis
FNEDQGRYFVRLSFVKTWNKGDEIVNKPE

SEQ ID NO: 1805134 - protein, 17 aa, Staphylococcus epidermidis
FNGELDKAVAAMIIANG

SEQ ID NO: 1805135 - protein, 25 aa, Staphylococcus epidermidis
FNGRHELMDSVFLWQSGSKYRVKAH

SEQ ID NO: 1805136 - protein, 19 aa, Staphylococcus epidermidis
FNHDAFYVMATRNGMIKKS

SEQ ID NO: 1805137 - protein, 21 aa, Staphylococcus epidermidis
FNIHVTDEWIIQIAYDKLIIM

SEQ ID NO: 1805138 - protein, 18 aa, Staphylococcus epidermidis
FNIPDFLEDLLVDGYIKE

SEQ ID NO: 1805139 - protein, 24 aa, Staphylococcus epidermidis
FNIYKAHSGFSIETQFMPNDINMY

SEQ ID NO: 1805140 - protein, 20 aa, Staphylococcus epidermidis
FNKGEFPKEEILLNQTDALN

SEQ ID NO: 1805141 - protein, 27 aa, Staphylococcus epidermidis
FNLAEEYQCPVIILSDLQLSLGKQTVK

SEQ ID NO: 1805142 - protein, 18 aa, Staphylococcus epidermidis
FNLDEYVGLKASHQQSYH

SEQ ID NO: 1805143 - protein, 19 aa, Staphylococcus epidermidis
FNLDEYVGLKASHQQSYHT

SEQ ID NO: 1805144 - protein, 17 aa, Staphylococcus epidermidis
FNLDEYVGLQPKHPQSY

SEQ ID NO: 1805145 - protein, 29 aa, Staphylococcus epidermidis
FNLIKENKIWLGVHLGRGVSGFIVPEHYE

SEQ ID NO: 1805146 - protein, 19 aa, Staphylococcus epidermidis
FNLIPRGNFTLEDIAKNIG

SEQ ID NO: 1805147 - protein, 20 aa, Staphylococcus epidermidis
FNLLNRCFEKLFEKDIGLAM

SEQ ID NO: 1805148 - protein, 22 aa, Staphylococcus epidermidis
FNLPVHVIGIDIVREKDGLAKS

SEQ ID NO: 1805149 - protein, 24 aa, Staphylococcus epidermidis
FNLWKEGKTGFPIIDAAMGELNTT

SEQ ID NO: 1805150 - protein, 25 aa, Staphylococcus epidermidis
FNMIFQFEHLGLWSTGDTKFDVKAY

SEQ ID NO: 1805151 - protein, 25 aa, Staphylococcus epidermidis
FNMIFQFEHLGLWSTGDTQFDVKSY

SEQ ID NO: 1805152 - protein, 23 aa, Staphylococcus epidermidis
FNNIKRLNIETIKQDNTSFIKND

SEQ ID NO: 1805153 - protein, 24 aa, Staphylococcus epidermidis
FNNIKRLNIETVKQDNTSFIKNDV

SEQ ID NO: 1805154 - protein, 24 aa, Staphylococcus epidermidis
FNNTEVNLFFTLCNKLKDKGNLTV

SEQ ID NO: 1805155 - protein, 21 aa, Staphylococcus epidermidis
FNPADAMIREGMLKDVLPIAF

SEQ ID NO: 1805156 - protein, 20 aa, Staphylococcus epidermidis
FNPRTIFLLQHACRDNDYEL

SEQ ID NO: 1805157 - protein, 18 aa, Staphylococcus epidermidis
FNPSQGFRAFKKAKAGDK

SEQ ID NO: 1805158 - protein, 18 aa, Staphylococcus epidermidis
FNQAKERLDEIGIPYQTL

SEQ ID NO: 1805159 - protein, 30 aa, Staphylococcus epidermidis
FNQGEVCSAGSRLLVQSSIYNELLPKLKEA

SEQ ID NO: 1805160 - protein, 27 aa, Staphylococcus epidermidis
FNQLGAFKEALPFLMTAAELDDDRDLE

SEQ ID NO: 1805161 - protein, 21 aa, Staphylococcus epidermidis
FNQLPLFNFKIYQFLDEAYLL

SEQ ID NO: 1805162 - protein, 19 aa, Staphylococcus epidermidis
FNQSIDWWRTLYTDEDAYF

SEQ ID NO: 1805163 - protein, 50 aa, Staphylococcus epidermidis
FNRNWSSSKGKGLWMSLVLRPNVPFALIPKFNLFIALGIRDAIQQFSNDR

SEQ ID NO: 1805164 - protein, 22 aa, Staphylococcus epidermidis
FNRWIENGAIIYVCGDESKMAK

SEQ ID NO: 1805165 - protein, 28 aa, Staphylococcus epidermidis
FNSKEDPELCVLKVIPRSIKLMNDDELD

SEQ ID NO: 1805166 - protein, 18 aa, Staphylococcus epidermidis
FNSLTFISGTLTFNHSFD

SEQ ID NO: 1805167 - protein, 17 aa, Staphylococcus epidermidis
FNSMKAFIATPALDAVK

SEQ ID NO: 1805168 - protein, 17 aa, Staphylococcus epidermidis
FNSWHEMYEKALGEYTF

SEQ ID NO: 1805169 - protein, 18 aa, Staphylococcus epidermidis
FNTEVPFVVQSLQQTVRE

SEQ ID NO: 1805170 - protein, 27 aa, Staphylococcus epidermidis
FNTFKARVEKSINDWDIHLTDTYYVSK

SEQ ID NO: 1805171 - protein, 17 aa, Staphylococcus epidermidis
FNTHGIKYRELNLKEKL

SEQ ID NO: 1805172 - protein, 25 aa, Staphylococcus epidermidis
FNTKGPFNFKIIKDINWEELFISQT

SEQ ID NO: 1805173 - protein, 23 aa, Staphylococcus epidermidis
FNTRPEEVVGIIAGGQEAMMVAV

SEQ ID NO: 1805174 - protein, 19 aa, Staphylococcus epidermidis
FNVITIFCDSLNYLSTIDD

SEQ ID NO: 1805175 - protein, 21 aa, Staphylococcus epidermidis
FNYPVQLVFEPLIGAIAAGNT

SEQ ID NO: 1805176 - protein, 17 aa, Staphylococcus epidermidis
FPDKYRGMFEQSQPNTV

SEQ ID NO: 1805177 - protein, 17 aa, Staphylococcus epidermidis
FPDMFKPTAAGQGRNLQ

SEQ ID NO: 1805178 - protein, 21 aa, Staphylococcus epidermidis
FPEHLAKYLMNYSLSEIQIIK

SEQ ID NO: 1805179 - protein, 24 aa, Staphylococcus epidermidis
FPEKLSKYISNWFSKHNVTVVPNS

SEQ ID NO: 1805180 - protein, 21 aa, Staphylococcus epidermidis
FPEMFEGVLNHSILKRAQDKE

SEQ ID NO: 1805181 - protein, 27 aa, Staphylococcus epidermidis
FPENRARLVIYPAAMRYAGPREAILHA

SEQ ID NO: 1805182 - protein, 22 aa, Staphylococcus epidermidis
FPERNRLISGLSRGVFITEAEE

SEQ ID NO: 1805183 - protein, 26 aa, Staphylococcus epidermidis
FPEYYPDRRYNFYVKNTEVIDDIISA

SEQ ID NO: 1805184 - protein, 17 aa, Staphylococcus epidermidis
FPGIFRGALDVEATHIN

SEQ ID NO: 1805185 - protein, 20 aa, Staphylococcus epidermidis
FPGKLLKLHSGGKHHKFGTF

SEQ ID NO: 1805186 - protein, 20 aa, Staphylococcus epidermidis
FPIVELDASYYAIQPERNIL

SEQ ID NO: 1805187 - protein, 29 aa, Staphylococcus epidermidis
FPKKAQRIVHRFSQKWLRKPTGKLTIQRE

SEQ ID NO: 1805188 - protein, 21 aa, Staphylococcus epidermidis
FPKKYLERFYYKAATIQTIGS

SEQ ID NO: 1805189 - protein, 19 aa, Staphylococcus epidermidis
FPKLFKVKELFHLHQSFYK

SEQ ID NO: 1805190 - protein, 22 aa, Staphylococcus epidermidis
FPNFLKRDKLTISVSTDGASPK

SEQ ID NO: 1805191 - protein, 17 aa, Staphylococcus epidermidis
FPNGSFHAEFFLTDSGE

SEQ ID NO: 1805192 - protein, 22 aa, Staphylococcus epidermidis
FPNIFKRNRLTIGVSTEGASPK

SEQ ID NO: 1805193 - protein, 22 aa, Staphylococcus epidermidis
FPPEKIIKLPARFHRHPLPIPK

SEQ ID NO: 1805194 - protein, 17 aa, Staphylococcus epidermidis
FPQGLLDDMFLYFEQEI

SEQ ID NO: 1805195 - protein, 17 aa, Staphylococcus epidermidis
FPRKGLNVSDERLTELS

SEQ ID NO: 1805196 - protein, 22 aa, Staphylococcus epidermidis
FPSFLFVEGDTIGFARTVFGPT

SEQ ID NO: 1805197 - protein, 22 aa, Staphylococcus epidermidis
FPSRDYKTIIINGSASLGSLKE

SEQ ID NO: 1805198 - protein, 18 aa, Staphylococcus epidermidis
FPTMVRDFQSVIGNEIKA

SEQ ID NO: 1805199 - protein, 22 aa, Staphylococcus epidermidis
FPTSNIYLYAPITGMHAFDRLD

SEQ ID NO: 1805200 - protein, 27 aa, Staphylococcus epidermidis
FPTYYGKQNYYAFVVFNMMFGGDPSSV

SEQ ID NO: 1805201 - protein, 22 aa, Staphylococcus epidermidis
FPVEAPKEYLAFEQKYTITDKR

SEQ ID NO: 1805202 - protein, 19 aa, Staphylococcus epidermidis
FPVVYASAVNGTASLDSEK

SEQ ID NO: 1805203 - protein, 19 aa, Staphylococcus epidermidis
FPVVYASAVNGTASLDSEN

SEQ ID NO: 1805204 - protein, 19 aa, Staphylococcus epidermidis
FPVVYASAVNGTASLESDK

SEQ ID NO: 1805205 - protein, 17 aa, Staphylococcus epidermidis
FPYDLPTIYTKTLRERS

SEQ ID NO: 1805206 - protein, 23 aa, Staphylococcus epidermidis
FPYSPRIGTPAARMDDQIDEGIK

SEQ ID NO: 1805207 - protein, 25 aa, Staphylococcus epidermidis
FPYVVKNSMEGFVFEYGLIQHSLSK

SEQ ID NO: 1805208 - protein, 18 aa, Staphylococcus epidermidis
FQAELEIMNGYEEISLRD

SEQ ID NO: 1805209 - protein, 17 aa, Staphylococcus epidermidis
FQAELEIMNGYNEISLS

SEQ ID NO: 1805210 - protein, 18 aa, Staphylococcus epidermidis
FQALNGMRIGELLAIQPN

SEQ ID NO: 1805211 - protein, 18 aa, Staphylococcus epidermidis
FQALTPLYPEERILLETA

SEQ ID NO: 1805212 - protein, 26 aa, Staphylococcus epidermidis
FQANGIKCVMIAKLPFMNKHNTKYWL

SEQ ID NO: 1805213 - protein, 19 aa, Staphylococcus epidermidis
FQDALGLNSADSFRDLIKI

SEQ ID NO: 1805214 - protein, 17 aa, Staphylococcus epidermidis
FQELFKEMMGNLDEDVQ

SEQ ID NO: 1805215 - protein, 25 aa, Staphylococcus epidermidis
FQERIWGGSALTQFGYDIPSNSTGE

SEQ ID NO: 1805216 - protein, 17 aa, Staphylococcus epidermidis
FQERLWGGTNLTQFGYD

SEQ ID NO: 1805217 - protein, 20 aa, Staphylococcus epidermidis
FQERLWGGTNLTQFGYDIPN

SEQ ID NO: 1805218 - protein, 21 aa, Staphylococcus epidermidis
FQFSGHFGEPMWTETKFSNEA

SEQ ID NO: 1805219 - protein, 19 aa, Staphylococcus epidermidis
FQFSGHFNEPMWTESPYHS

SEQ ID NO: 1805220 - protein, 17 aa, Staphylococcus epidermidis
FQGCEHINRAITMESTN

SEQ ID NO: 1805221 - protein, 17 aa, Staphylococcus epidermidis
FQHFNLLNSKTVYKNVA

SEQ ID NO: 1805222 - protein, 17 aa, Staphylococcus epidermidis
FQIGSAIKRILLTDREK

SEQ ID NO: 1805223 - protein, 17 aa, Staphylococcus epidermidis
FQIKLNGYRMELEEIET

SEQ ID NO: 1805224 - protein, 19 aa, Staphylococcus epidermidis
FQISLPRFLSHEDYLLFTH

SEQ ID NO: 1805225 - protein, 19 aa, Staphylococcus epidermidis
FQKDRVMHTLGDFLIQYCI

SEQ ID NO: 1805226 - protein, 24 aa, Staphylococcus epidermidis
FQKMFKRKKVISATKGYVRKLEIT

SEQ ID NO: 1805227 - protein, 19 aa, Staphylococcus epidermidis
FQKRMFLKDYFPEYRMKPY

SEQ ID NO: 1805228 - protein, 18 aa, Staphylococcus epidermidis
FQLIANRLGANWEYQHPS

SEQ ID NO: 1805229 - protein, 17 aa, Staphylococcus epidermidis
FQPEKYYTLSIKVDGYE

SEQ ID NO: 1805230 - protein, 18 aa, Staphylococcus epidermidis
FQPLTNCCLIDAKDMLEN

SEQ ID NO: 1805231 - protein, 20 aa, Staphylococcus epidermidis
FQQSCMYRFGKNHKRYIEIK

SEQ ID NO: 1805232 - protein, 28 aa, Staphylococcus epidermidis
FQRIRKGPNIKLPSYQLLEAPEPHEKDQ

SEQ ID NO: 1805233 - protein, 25 aa, Staphylococcus epidermidis
FQRIRKGPNIKLPSYQLLEEPEPHE

SEQ ID NO: 1805234 - protein, 20 aa, Staphylococcus epidermidis
FQSSFSYRIIGSCGLDSIRV

SEQ ID NO: 1805235 - protein, 18 aa, Staphylococcus epidermidis
FQYAYGLPDYGVIDKVLP

SEQ ID NO: 1805236 - protein, 22 aa, Staphylococcus epidermidis
FQYELTELIKHISMYFKQVNQS

SEQ ID NO: 1805237 - protein, 19 aa, Staphylococcus epidermidis
FQYSFGMPDYEVINGNYPL

SEQ ID NO: 1805238 - protein, 23 aa, Staphylococcus epidermidis
FRAKQIFEWLYQKRVNTIDEMTN

SEQ ID NO: 1805239 - protein, 25 aa, Staphylococcus epidermidis
FRAKQIFEWLYQKRVNTIDEMTNLS

SEQ ID NO: 1805240 - protein, 22 aa, Staphylococcus epidermidis
FRANKFPGHGNILNGLDNLLAG

SEQ ID NO: 1805241 - protein, 24 aa, Staphylococcus epidermidis
FRDDALRLAHEDLYETKSILENVI

SEQ ID NO: 1805242 - protein, 17 aa, Staphylococcus epidermidis
FRDGNQIIQAVKPTDLK

SEQ ID NO: 1805243 - protein, 17 aa, Staphylococcus epidermidis
FRDRLDIPDSYRMSNIN

SEQ ID NO: 1805244 - protein, 20 aa, Staphylococcus epidermidis
FRERLDIPKSYRMTDINKNV

SEQ ID NO: 1805245 - protein, 17 aa, Staphylococcus epidermidis
FRERLDIPNSYRMTNIN

SEQ ID NO: 1805246 - protein, 17 aa, Staphylococcus epidermidis
FRGEVYDPFETLTLSEQ

SEQ ID NO: 1805247 - protein, 18 aa, Staphylococcus epidermidis
FRGGMPSEGGFGVTVAEL

SEQ ID NO: 1805248 - protein, 17 aa, Staphylococcus epidermidis
FRGLLAATGVGLAITGV

SEQ ID NO: 1805249 - protein, 17 aa, Staphylococcus epidermidis
FRKQIALAKRVQLPIII

SEQ ID NO: 1805250 - protein, 19 aa, Staphylococcus epidermidis
FRKSGKYYIGNEHDSLVLN

SEQ ID NO: 1805251 - protein, 18 aa, Staphylococcus epidermidis
FRLKSNLWQLAKDTYQEW

SEQ ID NO: 1805252 - protein, 20 aa, Staphylococcus epidermidis
FRLTIPFDFKSLGFNDYYIK

SEQ ID NO: 1805253 - protein, 18 aa, Staphylococcus epidermidis
FRSLNKLSKGQQCTAILN

SEQ ID NO: 1805254 - protein, 17 aa, Staphylococcus epidermidis
FRTMPMVWYCPPLSPIM

SEQ ID NO: 1805255 - protein, 21 aa, Staphylococcus epidermidis
FRTSTEYPEIVFVGNHLSSSY

SEQ ID NO: 1805256 - protein, 33 aa, Staphylococcus epidermidis
FRTTGNAIAMAWYRYPKGFKFYRNTRNFVPKPG

SEQ ID NO: 1805257 - protein, 17 aa, Staphylococcus epidermidis
FSAQMHSLVAMDAQNKR

SEQ ID NO: 1805258 - protein, 18 aa, Staphylococcus epidermidis
FSDFLWSYVNNKPIDMGY

SEQ ID NO: 1805259 - protein, 26 aa, Staphylococcus epidermidis
FSDTGWLPLVLSNGVQPYSTGYTPQY

SEQ ID NO: 1805260 - protein, 28 aa, Staphylococcus epidermidis
FSDYLKPALRLSAIMGLNSTFIFTHDSI

SEQ ID NO: 1805261 - protein, 22 aa, Staphylococcus epidermidis
FSEINQAKGYRIVRIKEKQDIE

SEQ ID NO: 1805262 - protein, 27 aa, Staphylococcus epidermidis
FSELFKSELKLAIGPIERGGAGGGIAA

SEQ ID NO: 1805263 - protein, 27 aa, Staphylococcus epidermidis
FSERLKLGHMLYFIVNYLFVGRGFVVK

SEQ ID NO: 1805264 - protein, 21 aa, Staphylococcus epidermidis
FSETSRDGFLLAQDISSYSLT

SEQ ID NO: 1805265 - protein, 18 aa, Staphylococcus epidermidis
FSEVEKVLAQRHQKSNNF

SEQ ID NO: 1805266 - protein, 24 aa, Staphylococcus epidermidis
FSFDSSRIVGLIGKNGVGKTTIMK

SEQ ID NO: 1805267 - protein, 17 aa, Staphylococcus epidermidis
FSFEPEKRIHSKRQSNM

SEQ ID NO: 1805268 - protein, 29 aa, Staphylococcus epidermidis
FSFNNPKGMCDTCSGLGYVEDIDLNELLD

SEQ ID NO: 1805269 - protein, 25 aa, Staphylococcus epidermidis
FSGAEHRKAQNFAEVKLKLDNHSQK

SEQ ID NO: 1805270 - protein, 20 aa, Staphylococcus epidermidis
FSGDFIFVGDIGRPDLLEKS

SEQ ID NO: 1805271 - protein, 24 aa, Staphylococcus epidermidis
FSGGMKRRLSLAITLLSNPNLIIL

SEQ ID NO: 1805272 - protein, 25 aa, Staphylococcus epidermidis
FSGGMKRRLSLAMALLGQPDLIILD

SEQ ID NO: 1805273 - protein, 25 aa, Staphylococcus epidermidis
FSHYLKVRPGAFFLTGCGNEDKGIT

SEQ ID NO: 1805274 - protein, 24 aa, Staphylococcus epidermidis
FSIKEMIEANIAKGYEFMVITDHS

SEQ ID NO: 1805275 - protein, 18 aa, Staphylococcus epidermidis
FSKFLWSYVNHQPINMGY

SEQ ID NO: 1805276 - protein, 17 aa, Staphylococcus epidermidis
FSKLLNVIETYLFQWNL

SEQ ID NO: 1805277 - protein, 18 aa, Staphylococcus epidermidis
FSKNYPLYMTYNKFDTQK

SEQ ID NO: 1805278 - protein, 21 aa, Staphylococcus epidermidis
FSKPKWSKLINKLSVPIEANY

SEQ ID NO: 1805279 - protein, 20 aa, Staphylococcus epidermidis
FSNAALIAANVGEIDAKQAS

SEQ ID NO: 1805280 - protein, 24 aa, Staphylococcus epidermidis
FSNFTTSEAIKWQAQHSKATAWSK

SEQ ID NO: 1805281 - protein, 18 aa, Staphylococcus epidermidis
FSNGLTVNDFMTRNSVIQ

SEQ ID NO: 1805282 - protein, 22 aa, Staphylococcus epidermidis
FSNQIFKIKLTEDILSKNERTF

SEQ ID NO: 1805283 - protein, 18 aa, Staphylococcus epidermidis
FSPSIAREIYEMYEAVSM

SEQ ID NO: 1805284 - protein, 20 aa, Staphylococcus epidermidis
FSQECIKHSKAFSSKIVMKL

SEQ ID NO: 1805285 - protein, 17 aa, Staphylococcus epidermidis
FSQEEVSQMIKDRLARK

SEQ ID NO: 1805286 - protein, 23 aa, Staphylococcus epidermidis
FSRNGIREGFAMNLIRKRHPHEF

SEQ ID NO: 1805287 - protein, 26 aa, Staphylococcus epidermidis
FSRSIPFKRYLYFLIRSVKYDYLRKL

SEQ ID NO: 1805288 - protein, 18 aa, Staphylococcus epidermidis
FSRTGKKGGPFIDSNGHR

SEQ ID NO: 1805289 - protein, 28 aa, Staphylococcus epidermidis
FSSNTWFYKMMPSMNQWLEDINVQQRLH

SEQ ID NO: 1805290 - protein, 17 aa, Staphylococcus epidermidis
FSSSGTDSGLRIDLSQN

SEQ ID NO: 1805291 - protein, 23 aa, Staphylococcus epidermidis
FSTAESWDNVGLLIGDENQQVNG

SEQ ID NO: 1805292 - protein, 28 aa, Staphylococcus epidermidis
FSTGMKMKLSLAVAFSHHAELFILDEPT

SEQ ID NO: 1805293 - protein, 17 aa, Staphylococcus epidermidis
FSTNQFVYGMVLEATNG

SEQ ID NO: 1805294 - protein, 17 aa, Staphylococcus epidermidis
FSVNQNVHFEVLLVKLA

SEQ ID NO: 1805295 - protein, 20 aa, Staphylococcus epidermidis
FSVPIGKWTSIVGHNGSGKS

SEQ ID NO: 1805296 - protein, 22 aa, Staphylococcus epidermidis
FSVRGRIAALHGLDYHTLSQSL

SEQ ID NO: 1805297 - protein, 19 aa, Staphylococcus epidermidis
FSVSELRSIFKKSYQRKRL

SEQ ID NO: 1805298 - protein, 20 aa, Staphylococcus epidermidis
FSYEELSLLGGTDLPLINFE

SEQ ID NO: 1805299 - protein, 17 aa, Staphylococcus epidermidis
FSYKGMDYKEYRLAKEK

SEQ ID NO: 1805300 - protein, 24 aa, Staphylococcus epidermidis
FSYMKKPVIFYHFDVKKFFRKGIL

SEQ ID NO: 1805301 - protein, 18 aa, Staphylococcus epidermidis
FSYPTEYGEIFKQLTRAV

SEQ ID NO: 1805302 - protein, 17 aa, Staphylococcus epidermidis
FSYPTEYGQIFKTLTES

SEQ ID NO: 1805303 - protein, 17 aa, Staphylococcus epidermidis
FSYYKSKNLLPIVEEVS

SEQ ID NO: 1805304 - protein, 20 aa, Staphylococcus epidermidis
FTADTPVIINIGEWDEEDEE

SEQ ID NO: 1805305 - protein, 22 aa, Staphylococcus epidermidis
FTAGWCPDCKVIEPDLPKLEKK

SEQ ID NO: 1805306 - protein, 17 aa, Staphylococcus epidermidis
FTASFVGHFSAGKSTLI

SEQ ID NO: 1805307 - protein, 19 aa, Staphylococcus epidermidis
FTATIPYNGKLVVMKDEYT

SEQ ID NO: 1805308 - protein, 18 aa, Staphylococcus epidermidis
FTERKEFTGDTPVIVNIG

SEQ ID NO: 1805309 - protein, 18 aa, Staphylococcus epidermidis
FTESFDFSQFDINVTTPV

SEQ ID NO: 1805310 - protein, 26 aa, Staphylococcus epidermidis
FTEVGIFSVMWSEHCSYKHSKPFLKQ

SEQ ID NO: 1805311 - protein, 20 aa, Staphylococcus epidermidis
FTGDIKTPVKYASKELKHLF

SEQ ID NO: 1805312 - protein, 21 aa, Staphylococcus epidermidis
FTGDIKTPVKYASRELKKLFS

SEQ ID NO: 1805313 - protein, 17 aa, Staphylococcus epidermidis
FTGGHGVMYDFPENKYI

SEQ ID NO: 1805314 - protein, 18 aa, Staphylococcus epidermidis
FTGLTEFYYKVHGEGGVQ

SEQ ID NO: 1805315 - protein, 28 aa, Staphylococcus epidermidis
FTGLTRYLKRHKGLFVLVDPYILENNRD

SEQ ID NO: 1805316 - protein, 26 aa, Staphylococcus epidermidis
FTGRVCPAPCENSCVMKINRESVAIK

SEQ ID NO: 1805317 - protein, 24 aa, Staphylococcus epidermidis
FTHWEELKSTWKFVDAIQDEWTMV

SEQ ID NO: 1805318 - protein, 24 aa, Staphylococcus epidermidis
FTIIKPSFFMDNFLRITKVENGEI

SEQ ID NO: 1805319 - protein, 18 aa, Staphylococcus epidermidis
FTKANPFTRFIRAKATLT

SEQ ID NO: 1805320 - protein, 25 aa, Staphylococcus epidermidis
FTKHDFEFHEVMIFASNHQYLKTFW

SEQ ID NO: 1805321 - protein, 17 aa, Staphylococcus epidermidis
FTKRQDLNRKRVKAYPI

SEQ ID NO: 1805322 - protein, 24 aa, Staphylococcus epidermidis
FTLKELKALDFGFYKGEKFKGERI

SEQ ID NO: 1805323 - protein, 24 aa, Staphylococcus epidermidis
FTNEGKLNVAFAYIDWKNSEFGPL

SEQ ID NO: 1805324 - protein, 17 aa, Staphylococcus epidermidis
FTNILLLDIDMRYSTTL

SEQ ID NO: 1805325 - protein, 23 aa, Staphylococcus epidermidis
FTNKLKLLNKMYGVDVAKYQPFY

SEQ ID NO: 1805326 - protein, 21 aa, Staphylococcus epidermidis
FTNVNTLHFDLPLQVFSEDTK

SEQ ID NO: 1805327 - protein, 20 aa, Staphylococcus epidermidis
FTPKYHKLSEAERNWLNQQE

SEQ ID NO: 1805328 - protein, 17 aa, Staphylococcus epidermidis
FTPTLPVNDVYSTKMSV

SEQ ID NO: 1805329 - protein, 19 aa, Staphylococcus epidermidis
FTPVLAPFITIRSMVGMID

SEQ ID NO: 1805330 - protein, 18 aa, Staphylococcus epidermidis
FTQPRVAVAGVGSVQAGK

SEQ ID NO: 1805331 - protein, 24 aa, Staphylococcus epidermidis
FTRTFSAPINKVFDAYTKRELFEQ

SEQ ID NO: 1805332 - protein, 21 aa, Staphylococcus epidermidis
FTSKCIPNFRNFREIHCNYRN

SEQ ID NO: 1805333 - protein, 24 aa, Staphylococcus epidermidis
FTSTEIDILFSLCNKLKEQDIKEV

SEQ ID NO: 1805334 - protein, 22 aa, Staphylococcus epidermidis
FTSVGFNPFYLVIDELGSLIAE

SEQ ID NO: 1805335 - protein, 18 aa, Staphylococcus epidermidis
FTTKCELPVSIVMTNGIV

SEQ ID NO: 1805336 - protein, 17 aa, Staphylococcus epidermidis
FTVMYLLICKMFEDEDV

SEQ ID NO: 1805337 - protein, 17 aa, Staphylococcus epidermidis
FTVRDSLINQIESDIKV

SEQ ID NO: 1805338 - protein, 17 aa, Staphylococcus epidermidis
FTWASPIMSRPVKNMTV

SEQ ID NO: 1805339 - protein, 35 aa, Staphylococcus epidermidis
FVDQFREAMTKFPVWMGATTLFFGAINGAKEMLDV

SEQ ID NO: 1805340 - protein, 17 aa, Staphylococcus epidermidis
FVDTPIIVISARTEEQT

SEQ ID NO: 1805341 - protein, 21 aa, Staphylococcus epidermidis
FVDYAEFCFKEFPEVKYWTTF

SEQ ID NO: 1805342 - protein, 19 aa, Staphylococcus epidermidis
FVEYWGRGYTQDCLDRLLN

SEQ ID NO: 1805343 - protein, 17 aa, Staphylococcus epidermidis
FVGKDVADILGYSRGAK

SEQ ID NO: 1805344 - protein, 24 aa, Staphylococcus epidermidis
FVGNEIRRELGFEESKDPLMNEHL

SEQ ID NO: 1805345 - protein, 17 aa, Staphylococcus epidermidis
FVINFYRQVERWLNRKI

SEQ ID NO: 1805346 - protein, 29 aa, Staphylococcus epidermidis
FVINKNLPKGRYFLEIVYNQMKFPSRDYK

SEQ ID NO: 1805347 - protein, 20 aa, Staphylococcus epidermidis
FVKDLFEKVIRHVGENYLTV

SEQ ID NO: 1805348 - protein, 20 aa, Staphylococcus epidermidis
FVKVKGRLIVSCYASNFVRI

SEQ ID NO: 1805349 - protein, 18 aa, Staphylococcus epidermidis
FVLERSEGNIVIFHSGRI

SEQ ID NO: 1805350 - protein, 19 aa, Staphylococcus epidermidis
FVLVKVDAFSCNYRDKAII

SEQ ID NO: 1805351 - protein, 18 aa, Staphylococcus epidermidis
FVNAKKAFVASLTNSELS

SEQ ID NO: 1805352 - protein, 26 aa, Staphylococcus epidermidis
FVNDLLPVDALKMWSQKFNEPPNLSI

SEQ ID NO: 1805353 - protein, 24 aa, Staphylococcus epidermidis
FVQTGRAYFKLVVQGKGGHGSSPH

SEQ ID NO: 1805354 - protein, 18 aa, Staphylococcus epidermidis
FVRRVCNCTGEWTMENFI

SEQ ID NO: 1805355 - protein, 18 aa, Staphylococcus epidermidis
FVSDYNVQFIFNLDEKSI

SEQ ID NO: 1805356 - protein, 27 aa, Staphylococcus epidermidis
FVSEKMKLQSPRLMLGFKNEPLDESAT

SEQ ID NO: 1805357 - protein, 17 aa, Staphylococcus epidermidis
FVTKFKDKHVITISLEI

SEQ ID NO: 1805358 - protein, 17 aa, Staphylococcus epidermidis
FVVGGMYEFGLSRYFTA

SEQ ID NO: 1805359 - protein, 26 aa, Staphylococcus epidermidis
FVVRYPEFANGLILTGTGMFPKWKGI

SEQ ID NO: 1805360 - protein, 19 aa, Staphylococcus epidermidis
FVVYDLRKADMKNIGTYRA

SEQ ID NO: 1805361 - protein, 20 aa, Staphylococcus epidermidis
FVYKVAAMDFIFKDDPSELK

SEQ ID NO: 1805362 - protein, 22 aa, Staphylococcus epidermidis
FVYKVAAMDFIFKDDPSELKTR

SEQ ID NO: 1805363 - protein, 24 aa, Staphylococcus epidermidis
FWRDDTIEFLGRMDYQISLRGHRI

SEQ ID NO: 1805364 - protein, 23 aa, Staphylococcus epidermidis
FYAAELPSTFIYSGAAPEDGEIY

SEQ ID NO: 1805365 - protein, 23 aa, Staphylococcus epidermidis
FYDNSLEFLALFEKLSLEMNDVV

SEQ ID NO: 1805366 - protein, 18 aa, Staphylococcus epidermidis
FYEISFNTLDDFIESDLD

SEQ ID NO: 1805367 - protein, 18 aa, Staphylococcus epidermidis
FYEISFNTLDNFIESDLE

SEQ ID NO: 1805368 - protein, 19 aa, Staphylococcus epidermidis
FYEKFAFVEYWGRGYTQDC

SEQ ID NO: 1805369 - protein, 30 aa, Staphylococcus epidermidis
FYFENPFNFGATIGRYAGRIANASFELEGQ

SEQ ID NO: 1805370 - protein, 21 aa, Staphylococcus epidermidis
FYGEDNFVVAICGSNMSKYQA

SEQ ID NO: 1805371 - protein, 19 aa, Staphylococcus epidermidis
FYHFKYPFADGEGYIEIAT

SEQ ID NO: 1805372 - protein, 19 aa, Staphylococcus epidermidis
FYHIPFPDKYRGMFEQSQP

SEQ ID NO: 1805373 - protein, 23 aa, Staphylococcus epidermidis
FYHNCGFKIGSVDTMLYANFENN

SEQ ID NO: 1805374 - protein, 33 aa, Staphylococcus epidermidis
FYKEFKGGHQWKSWKPLLGDILLQFLSNQINGK

SEQ ID NO: 1805375 - protein, 21 aa, Staphylococcus epidermidis
FYKEGYIDFVQLNIHRIDSLN

SEQ ID NO: 1805376 - protein, 23 aa, Staphylococcus epidermidis
FYKKWNRELEALYHIKSQLNSST

SEQ ID NO: 1805377 - protein, 24 aa, Staphylococcus epidermidis
FYKKWRPYLMKRSVFSYDIKDIAK

SEQ ID NO: 1805378 - protein, 18 aa, Staphylococcus epidermidis
FYKKYGIKKTFFKDKKLV

SEQ ID NO: 1805379 - protein, 21 aa, Staphylococcus epidermidis
FYLAMAPQFFGVISDFLKSSG

SEQ ID NO: 1805380 - protein, 33 aa, Staphylococcus epidermidis
FYLEAEARSIADWLVGMNFTRYVTLEMKQLGID

SEQ ID NO: 1805381 - protein, 20 aa, Staphylococcus epidermidis
FYMNCTKNAMLPIALEKEAR

SEQ ID NO: 1805382 - protein, 19 aa, Staphylococcus epidermidis
FYPHFSRTKIKEIIEEYKG

SEQ ID NO: 1805383 - protein, 24 aa, Staphylococcus epidermidis
FYPHYRSQMFFKSFLTDNKSDINY

SEQ ID NO: 1805384 - protein, 18 aa, Staphylococcus epidermidis
FYQFILRLPDEVLRLKGY

SEQ ID NO: 1805385 - protein, 18 aa, Staphylococcus epidermidis
FYQPKPGTDLAWLSAVTK

SEQ ID NO: 1805386 - protein, 18 aa, Staphylococcus epidermidis
FYQPKPGTDLVWLGAVTK

SEQ ID NO: 1805387 - protein, 18 aa, Staphylococcus epidermidis
FYSSGVIEVLRRWVENDY

SEQ ID NO: 1805388 - protein, 21 aa, Staphylococcus epidermidis
FYVYEVREGWARVYSESSNYW

SEQ ID NO: 1805389 - protein, 17 aa, Staphylococcus epidermidis
FYYKVHGEGGVQKVADP

SEQ ID NO: 1805390 - protein, 30 aa, Staphylococcus epidermidis
FYYNRFKYFKDRVLVPLAYIDFNEYLEELN

SEQ ID NO: 1805391 - protein, 25 aa, Staphylococcus epidermidis
GAADMKSGLAALAIALIEIKESNQL

SEQ ID NO: 1805392 - protein, 19 aa, Staphylococcus epidermidis
GAAGFVQKFTEGFTALPGW

SEQ ID NO: 1805393 - protein, 17 aa, Staphylococcus epidermidis
GACENFVALNLLGRNQK

SEQ ID NO: 1805394 - protein, 20 aa, Staphylococcus epidermidis
GACPECHGKGVIKTELAFMP

SEQ ID NO: 1805395 - protein, 23 aa, Staphylococcus epidermidis
GADEFMKKVFVGFDGSVSAPSNV

SEQ ID NO: 1805396 - protein, 19 aa, Staphylococcus epidermidis
GAEKWPTFLEKDLVDGIFT

SEQ ID NO: 1805397 - protein, 17 aa, Staphylococcus epidermidis
GAFTIRIDDQLNVDLID

SEQ ID NO: 1805398 - protein, 27 aa, Staphylococcus epidermidis
GAGKSTWIKHLIGLVNLKKAQFTIDGQ

SEQ ID NO: 1805399 - protein, 17 aa, Staphylococcus epidermidis
GAGPIGLLTIVAAKAAG

SEQ ID NO: 1805400 - protein, 18 aa, Staphylococcus epidermidis
GAGTVKHFGLQDKIDFQI

SEQ ID NO: 1805401 - protein, 17 aa, Staphylococcus epidermidis
GAHSLGGYLAQYNAVKF

SEQ ID NO: 1805402 - protein, 26 aa, Staphylococcus epidermidis
GAIAKFIYYFAQYRIKTEHDEPFIKD

SEQ ID NO: 1805403 - protein, 18 aa, Staphylococcus epidermidis
GAIALVGNHELRWLERTD

SEQ ID NO: 1805404 - protein, 24 aa, Staphylococcus epidermidis
GAINEIKTAVSLREEDQPFYENNG

SEQ ID NO: 1805405 - protein, 23 aa, Staphylococcus epidermidis
GAKIVEFGGWAMPVQFSSIKEEH

SEQ ID NO: 1805406 - protein, 20 aa, Staphylococcus epidermidis
GAKSIRFMCLIAAPEGVEKM

SEQ ID NO: 1805407 - protein, 20 aa, Staphylococcus epidermidis
GALRFYDFLNQQSFKVGDKE

SEQ ID NO: 1805408 - protein, 17 aa, Staphylococcus epidermidis
GALRVLNHSGFFKQKSR

SEQ ID NO: 1805409 - protein, 19 aa, Staphylococcus epidermidis
GAMLEKYFECEHLSPDETE

SEQ ID NO: 1805410 - protein, 19 aa, Staphylococcus epidermidis
GANFEKLKNFGLEHRVREI

SEQ ID NO: 1805411 - protein, 19 aa, Staphylococcus epidermidis
GANFEKLKSFGLEHKVKEI

SEQ ID NO: 1805412 - protein, 17 aa, Staphylococcus epidermidis
GANRLIKAGAFDKYPIE

SEQ ID NO: 1805413 - protein, 22 aa, Staphylococcus epidermidis
GANRLIKAGAFDKYPIEAVFGF

SEQ ID NO: 1805414 - protein, 29 aa, Staphylococcus epidermidis
GANVKGYFLWSLMDVFSWSNGYEKRYGLF

SEQ ID NO: 1805415 - protein, 25 aa, Staphylococcus epidermidis
GAPKPRLPFEHIFHKNSYDASNDKQ

SEQ ID NO: 1805416 - protein, 25 aa, Staphylococcus epidermidis
GAPLKRGAATIAMLGKAPILTAAYV

SEQ ID NO: 1805417 - protein, 20 aa, Staphylococcus epidermidis
GAQALTCYYGGEVIQGTKIM

SEQ ID NO: 1805418 - protein, 19 aa, Staphylococcus epidermidis
GAQGVQMGTAFLITDESAA

SEQ ID NO: 1805419 - protein, 23 aa, Staphylococcus epidermidis
GARCMDCGTPFCQTGLSYGRETI

SEQ ID NO: 1805420 - protein, 23 aa, Staphylococcus epidermidis
GASGPLYGFSFVKMASVVKDEID

SEQ ID NO: 1805421 - protein, 19 aa, Staphylococcus epidermidis
GASLLQIYSSLVIEGPGLT

SEQ ID NO: 1805422 - protein, 25 aa, Staphylococcus epidermidis
GASTHPGAGVPIVLTSAKITVNEML

SEQ ID NO: 1805423 - protein, 25 aa, Staphylococcus epidermidis
GATKDSAYCTKWFKEASDETLNQLS

SEQ ID NO: 1805424 - protein, 20 aa, Staphylococcus epidermidis
GAVFVNCARGSLVDTKALLS

SEQ ID NO: 1805425 - protein, 22 aa, Staphylococcus epidermidis
GAVNLHWPGNVNVREVFQKYVD

SEQ ID NO: 1805426 - protein, 17 aa, Staphylococcus epidermidis
GAVSYGCLGEPQAPGQI

SEQ ID NO: 1805427 - protein, 26 aa, Staphylococcus epidermidis
GCAGGIARPAATHALHYDKLPDRLVT

SEQ ID NO: 1805428 - protein, 19 aa, Staphylococcus epidermidis
GCDGIHPGYGFLAENGDFA

SEQ ID NO: 1805429 - protein, 24 aa, Staphylococcus epidermidis
GCDYRCSWCDSAFTWDGSAKEDIR

SEQ ID NO: 1805430 - protein, 18 aa, Staphylococcus epidermidis
GCGAPLQSEDKNAPGYVP

SEQ ID NO: 1805431 - protein, 19 aa, Staphylococcus epidermidis
GCGECPACHLRARGLKHYL

SEQ ID NO: 1805432 - protein, 21 aa, Staphylococcus epidermidis
GCHKIDRLILPTVFHDSANVI

SEQ ID NO: 1805433 - protein, 26 aa, Staphylococcus epidermidis
GCLQNCGICSSGLYALVDGDIVEGDT

SEQ ID NO: 1805434 - protein, 17 aa, Staphylococcus epidermidis
GCLWGTQAFFKTIPGVV

SEQ ID NO: 1805435 - protein, 25 aa, Staphylococcus epidermidis
GCPNGCARPALAEVAFIGKAPGKYN

SEQ ID NO: 1805436 - protein, 20 aa, Staphylococcus epidermidis
GCQRCTRYRSGSCSILKKAL

SEQ ID NO: 1805437 - protein, 24 aa, Staphylococcus epidermidis
GCSRYPDCDFISWDKPVGRDCPKC

SEQ ID NO: 1805438 - protein, 21 aa, Staphylococcus epidermidis
GCTHYPLLYKPIYDYFDGTKT

SEQ ID NO: 1805439 - protein, 24 aa, Staphylococcus epidermidis
GDAAHLMSPFAGEGVNMAFYDAYL

SEQ ID NO: 1805440 - protein, 27 aa, Staphylococcus epidermidis
GDAEGRYGTFAKYFTKNDVPTFAICHG

SEQ ID NO: 1805441 - protein, 24 aa, Staphylococcus epidermidis
GDAKSIRQFNQWEIDYVSCSPFRV

SEQ ID NO: 1805442 - protein, 24 aa, Staphylococcus epidermidis
GDAKSIRQFNQWGIDYVSCSPFRV

SEQ ID NO: 1805443 - protein, 23 aa, Staphylococcus epidermidis
GDAKSIYQFNNWNIDYVSCSPFR

SEQ ID NO: 1805444 - protein, 22 aa, Staphylococcus epidermidis
GDALKYAGTPAHSLGISLEDTS

SEQ ID NO: 1805445 - protein, 18 aa, Staphylococcus epidermidis
GDASAIIVESCFVENHGR

SEQ ID NO: 1805446 - protein, 17 aa, Staphylococcus epidermidis
GDDLQYTMTVTFEEAVF

SEQ ID NO: 1805447 - protein, 21 aa, Staphylococcus epidermidis
GDESKRLGVGLRFSKSSKNKV

SEQ ID NO: 1805448 - protein, 21 aa, Staphylococcus epidermidis
GDFFRQLNIAYNYGLFHEHMV

SEQ ID NO: 1805449 - protein, 17 aa, Staphylococcus epidermidis
GDFIFVGDVGRPDLLEK

SEQ ID NO: 1805450 - protein, 19 aa, Staphylococcus epidermidis
GDGILKSRARHEAMINGKR

SEQ ID NO: 1805451 - protein, 17 aa, Staphylococcus epidermidis
GDGSYRGAQRISEECKE

SEQ ID NO: 1805452 - protein, 21 aa, Staphylococcus epidermidis
GDGYPAFKKEYGYSFGTVRPM

SEQ ID NO: 1805453 - protein, 25 aa, Staphylococcus epidermidis
GDICDHYNLWLHVDGAYGLSHILSD

SEQ ID NO: 1805454 - protein, 18 aa, Staphylococcus epidermidis
GDIGKAFARRLQGFDARI

SEQ ID NO: 1805455 - protein, 17 aa, Staphylococcus epidermidis
GDIIPEVVKSILDRRPD

SEQ ID NO: 1805456 - protein, 27 aa, Staphylococcus epidermidis
GDIKAIYKRDYLCIIGQTVHEKLGHEM

SEQ ID NO: 1805457 - protein, 19 aa, Staphylococcus epidermidis
GDIKHSYADITPLKRLGYS

SEQ ID NO: 1805458 - protein, 19 aa, Staphylococcus epidermidis
GDIKRVIAHLPNFESDTDT

SEQ ID NO: 1805459 - protein, 18 aa, Staphylococcus epidermidis
GDILLQVLLHTSIGKKEG

SEQ ID NO: 1805460 - protein, 20 aa, Staphylococcus epidermidis
GDIPFVIKLYNLVDRIKQTR

SEQ ID NO: 1805461 - protein, 18 aa, Staphylococcus epidermidis
GDIPRLDYHFKRIQKSSA

SEQ ID NO: 1805462 - protein, 19 aa, Staphylococcus epidermidis
GDIQKLLKAYFEKLGVEND

SEQ ID NO: 1805463 - protein, 27 aa, Staphylococcus epidermidis
GDKLIKVLIDKDCRIKRDIVPTDIDYH

SEQ ID NO: 1805464 - protein, 19 aa, Staphylococcus epidermidis
GDKPVYPTFTFESTNGSDI

SEQ ID NO: 1805465 - protein, 18 aa, Staphylococcus epidermidis
GDKVLLPLAYIDLDEYIE

SEQ ID NO: 1805466 - protein, 18 aa, Staphylococcus epidermidis
GDKWLQIDSDKWGFLLKI

SEQ ID NO: 1805467 - protein, 19 aa, Staphylococcus epidermidis
GDLGEGFIEIHHLKPMFSI

SEQ ID NO: 1805468 - protein, 19 aa, Staphylococcus epidermidis
GDLKITFDPKYEVKSYDMY

SEQ ID NO: 1805469 - protein, 22 aa, Staphylococcus epidermidis
GDLKPPLNVYFSGYRSLEGFEG

SEQ ID NO: 1805470 - protein, 18 aa, Staphylococcus epidermidis
GDLMYDFADATSKAIQQV

SEQ ID NO: 1805471 - protein, 18 aa, Staphylococcus epidermidis
GDLPGVIEKLDYLKDLGI

SEQ ID NO: 1805472 - protein, 18 aa, Staphylococcus epidermidis
GDNGYRYYSVEDITKLQH

SEQ ID NO: 1805473 - protein, 23 aa, Staphylococcus epidermidis
GDNLFRHSLTLERVQKIVELAKK

SEQ ID NO: 1805474 - protein, 22 aa, Staphylococcus epidermidis
GDPDLLTIKGLKAIKEADVILY

SEQ ID NO: 1805475 - protein, 19 aa, Staphylococcus epidermidis
GDPRANLKRVLKEMEDMGF

SEQ ID NO: 1805476 - protein, 17 aa, Staphylococcus epidermidis
GDQFCIFITEKVANYIG

SEQ ID NO: 1805477 - protein, 17 aa, Staphylococcus epidermidis
GDRFIVESIDRLGRNYD

SEQ ID NO: 1805478 - protein, 22 aa, Staphylococcus epidermidis
GDRICGVGVPGELCIGGAGLAK

SEQ ID NO: 1805479 - protein, 21 aa, Staphylococcus epidermidis
GDSLKALQLIQLIKEELSINL

SEQ ID NO: 1805480 - protein, 24 aa, Staphylococcus epidermidis
GDTFFPPYTFEEWEVDSSVEGQLD

SEQ ID NO: 1805481 - protein, 22 aa, Staphylococcus epidermidis
GDTLTFPAFVYSGDATVVPEGQ

SEQ ID NO: 1805482 - protein, 17 aa, Staphylococcus epidermidis
GDTPVIVNIGEWDEGDE

SEQ ID NO: 1805483 - protein, 19 aa, Staphylococcus epidermidis
GDVNAAPFSFFNVVNHTPP

SEQ ID NO: 1805484 - protein, 20 aa, Staphylococcus epidermidis
GDVTLGPQFVYVAAYEGGIV

SEQ ID NO: 1805485 - protein, 19 aa, Staphylococcus epidermidis
GDVTLPLKEIIRIVNEEDE

SEQ ID NO: 1805486 - protein, 20 aa, Staphylococcus epidermidis
GDVVFRKGDKVLQLVNRPND

SEQ ID NO: 1805487 - protein, 19 aa, Staphylococcus epidermidis
GDYCGYSFAFEATKDHTRL

SEQ ID NO: 1805488 - protein, 17 aa, Staphylococcus epidermidis
GDYGKILLIGGSANMGG

SEQ ID NO: 1805489 - protein, 19 aa, Staphylococcus epidermidis
GDYKNILVVGADKLSKITD

SEQ ID NO: 1805490 - protein, 25 aa, Staphylococcus epidermidis
GDYMAVKFELTFSVYKGYSESLYAT

SEQ ID NO: 1805491 - protein, 22 aa, Staphylococcus epidermidis
GDYPKWKMYIQVMTEKQAKNHP

SEQ ID NO: 1805492 - protein, 22 aa, Staphylococcus epidermidis
GEAEISFEEFLGKAAVSSSETV

SEQ ID NO: 1805493 - protein, 25 aa, Staphylococcus epidermidis
GEAFKVQLDDGMAFLSGVVSRKKQV

SEQ ID NO: 1805494 - protein, 32 aa, Staphylococcus epidermidis
GEARRYASDWSEIRPEWGLAKNAEFIIGKREI

SEQ ID NO: 1805495 - protein, 23 aa, Staphylococcus epidermidis
GEDTDIANTVAFLASDKAKYITG

SEQ ID NO: 1805496 - protein, 20 aa, Staphylococcus epidermidis
GEDVLGILCHVDVVPAGDGW

SEQ ID NO: 1805497 - protein, 18 aa, Staphylococcus epidermidis
GEELKTGHPMEGLLTASS

SEQ ID NO: 1805498 - protein, 19 aa, Staphylococcus epidermidis
GEEPLSVYHEMTFFVSQQN

SEQ ID NO: 1805499 - protein, 18 aa, Staphylococcus epidermidis
GEEVLKTGHFGSGAQDDE

SEQ ID NO: 1805500 - protein, 19 aa, Staphylococcus epidermidis
GEFQLKQGFSPAFNVEQRE

SEQ ID NO: 1805501 - protein, 19 aa, Staphylococcus epidermidis
GEFSGSGIKTSLGMGKYSI

SEQ ID NO: 1805502 - protein, 21 aa, Staphylococcus epidermidis
GEGHYAVGLFFSKEKVKDSAH

SEQ ID NO: 1805503 - protein, 20 aa, Staphylococcus epidermidis
GEGKGITFLRIADDAPAETI

SEQ ID NO: 1805504 - protein, 18 aa, Staphylococcus epidermidis
GEHGLAILKQALKGGFID

SEQ ID NO: 1805505 - protein, 25 aa, Staphylococcus epidermidis
GEHLDLLSKIAITFSEEENVDRIVN

SEQ ID NO: 1805506 - protein, 19 aa, Staphylococcus epidermidis
GEHRCSAIADAIQDYFNTG

SEQ ID NO: 1805507 - protein, 23 aa, Staphylococcus epidermidis
GEIASNWEGQAFNRFEEQFQQLS

SEQ ID NO: 1805508 - protein, 19 aa, Staphylococcus epidermidis
GEIGPFIEAYLRKEMDRQD

SEQ ID NO: 1805509 - protein, 31 aa, Staphylococcus epidermidis
GEIKIPEFINPNVKFAMISSIDIAKIASTLF

SEQ ID NO: 1805510 - protein, 19 aa, Staphylococcus epidermidis
GEIMKRVVIRLYLTKSTEQ

SEQ ID NO: 1805511 - protein, 20 aa, Staphylococcus epidermidis
GEIRDAYVAKCVIQASLSGH

SEQ ID NO: 1805512 - protein, 19 aa, Staphylococcus epidermidis
GEISGRPKHIYSIYRKMMK

SEQ ID NO: 1805513 - protein, 17 aa, Staphylococcus epidermidis
GEKEFFELYSKIVVEIP

SEQ ID NO: 1805514 - protein, 21 aa, Staphylococcus epidermidis
GEKEKALSVKIEFDTTRIKKD

SEQ ID NO: 1805515 - protein, 22 aa, Staphylococcus epidermidis
GELCIAGKSLTAGYLNRPELTA

SEQ ID NO: 1805516 - protein, 22 aa, Staphylococcus epidermidis
GELDEHFPLVVWQTGSGTQSNM

SEQ ID NO: 1805517 - protein, 20 aa, Staphylococcus epidermidis
GELDKAVAAMIIANGAKAAG

SEQ ID NO: 1805518 - protein, 19 aa, Staphylococcus epidermidis
GELLFGDTVAVFGAGPIGL

SEQ ID NO: 1805519 - protein, 21 aa, Staphylococcus epidermidis
GELYEKLHAVKEWEEGDFDLQ

SEQ ID NO: 1805520 - protein, 23 aa, Staphylococcus epidermidis
GEMNRKYMGELVFKHPEQRLELN

SEQ ID NO: 1805521 - protein, 26 aa, Staphylococcus epidermidis
GENERYLEVWNLVFSEFNHNKDHTYT

SEQ ID NO: 1805522 - protein, 21 aa, Staphylococcus epidermidis
GENIKYSFSYTNKKGETSEKT

SEQ ID NO: 1805523 - protein, 18 aa, Staphylococcus epidermidis
GENMFDLNTFQVVKNSID

SEQ ID NO: 1805524 - protein, 29 aa, Staphylococcus epidermidis
GENMIFETFSFYGACLLGDDVTPAMKNST

SEQ ID NO: 1805525 - protein, 19 aa, Staphylococcus epidermidis
GEPFEPMPKLLAVSEQVTK

SEQ ID NO: 1805526 - protein, 26 aa, Staphylococcus epidermidis
GEQKFGLRLPGEFNRDAMQEAVALAH

SEQ ID NO: 1805527 - protein, 28 aa, Staphylococcus epidermidis
GEQRWWPAESPIEMMLGAILVQNTNWKN

SEQ ID NO: 1805528 - protein, 17 aa, Staphylococcus epidermidis
GERRRLIDSPKVATYDL

SEQ ID NO: 1805529 - protein, 19 aa, Staphylococcus epidermidis
GESAVTVAIDIDSRAEEKA

SEQ ID NO: 1805530 - protein, 27 aa, Staphylococcus epidermidis
GESLPVYKPTLLPMVFGARDKKVKGGQ

SEQ ID NO: 1805531 - protein, 20 aa, Staphylococcus epidermidis
GESLRFPVFKMVRDDKDEVS

SEQ ID NO: 1805532 - protein, 19 aa, Staphylococcus epidermidis
GESRKEYLLTKDGFTLYMF

SEQ ID NO: 1805533 - protein, 20 aa, Staphylococcus epidermidis
GESSMIGAIDSPVVRDLQTK

SEQ ID NO: 1805534 - protein, 25 aa, Staphylococcus epidermidis
GESTSRTSHRVILDGDYVFRNVATT

SEQ ID NO: 1805535 - protein, 19 aa, Staphylococcus epidermidis
GETKIPRYFLLSETEDFEP

SEQ ID NO: 1805536 - protein, 23 aa, Staphylococcus epidermidis
GETRTKHYFKTCKDYFSERFGEA

SEQ ID NO: 1805537 - protein, 24 aa, Staphylococcus epidermidis
GETRTKHYFRTCKDYFSERFGEAN

SEQ ID NO: 1805538 - protein, 19 aa, Staphylococcus epidermidis
GETYIDMKLTTSLVNEFIN

SEQ ID NO: 1805539 - protein, 22 aa, Staphylococcus epidermidis
GEVDYANSYIKWYAEEAKRIYG

SEQ ID NO: 1805540 - protein, 21 aa, Staphylococcus epidermidis
GEVLDDHMFCFLCKIDDVKEA

SEQ ID NO: 1805541 - protein, 24 aa, Staphylococcus epidermidis
GEVSEGRGIISYEMGSDGSGGKYL

SEQ ID NO: 1805542 - protein, 17 aa, Staphylococcus epidermidis
GEYKLSHRVCKNCGSYN

SEQ ID NO: 1805543 - protein, 20 aa, Staphylococcus epidermidis
GEYRDCYVMGLLKRNWINKH

SEQ ID NO: 1805544 - protein, 19 aa, Staphylococcus epidermidis
GEYRKAYNRSRRRVKLYNA

SEQ ID NO: 1805545 - protein, 17 aa, Staphylococcus epidermidis
GEYSDCKDADLVVITAG

SEQ ID NO: 1805546 - protein, 23 aa, Staphylococcus epidermidis
GEYYLPDVLSLILEDGGKAEIYH

SEQ ID NO: 1805547 - protein, 18 aa, Staphylococcus epidermidis
GFDVPSMHTMYIDKPMKG

SEQ ID NO: 1805548 - protein, 23 aa, Staphylococcus epidermidis
GFEAYYVGGSVRDYLMGREIHDI

SEQ ID NO: 1805549 - protein, 27 aa, Staphylococcus epidermidis
GFGDEVKRRIFLGTFALSSGYYDAFYK

SEQ ID NO: 1805550 - protein, 26 aa, Staphylococcus epidermidis
GFGRIGRLAFRSMLDMENVEVVAIND

SEQ ID NO: 1805551 - protein, 19 aa, Staphylococcus epidermidis
GFHHYSRFIQLFKNTYGYT

SEQ ID NO: 1805552 - protein, 20 aa, Staphylococcus epidermidis
GFIEIHHLKPMFSIKREIKV

SEQ ID NO: 1805553 - protein, 24 aa, Staphylococcus epidermidis
GFIFKFDVRKGSKFEGKLKPNVRY

SEQ ID NO: 1805554 - protein, 21 aa, Staphylococcus epidermidis
GFKALRFLRPLVKGRHYIIIT

SEQ ID NO: 1805555 - protein, 18 aa, Staphylococcus epidermidis
GFKEASKQLAQWVQENKI

SEQ ID NO: 1805556 - protein, 22 aa, Staphylococcus epidermidis
GFKYVDGYLGYYGDYYYNPRQM

SEQ ID NO: 1805557 - protein, 17 aa, Staphylococcus epidermidis
GFLAEYDALPGLGHACG

SEQ ID NO: 1805558 - protein, 18 aa, Staphylococcus epidermidis
GFLGGKIGEFIAEKLNHN

SEQ ID NO: 1805559 - protein, 19 aa, Staphylococcus epidermidis
GFLTSLPFVGQHFIGTYDS

SEQ ID NO: 1805560 - protein, 26 aa, Staphylococcus epidermidis
GFNKMKFAMEMEAVWWGETESAFFNF

SEQ ID NO: 1805561 - protein, 24 aa, Staphylococcus epidermidis
GFNKSEAMIILFPKLFHNQDKAMR

SEQ ID NO: 1805562 - protein, 19 aa, Staphylococcus epidermidis
GFNKSRKRNLFSIEHRLNK

SEQ ID NO: 1805563 - protein, 21 aa, Staphylococcus epidermidis
GFPDHGKFAEIFKMADTPQGI

SEQ ID NO: 1805564 - protein, 18 aa, Staphylococcus epidermidis
GFQCFDVANQYWLYLFGH

SEQ ID NO: 1805565 - protein, 24 aa, Staphylococcus epidermidis
GFSDICLGVPTILGNHGIEKIVEV

SEQ ID NO: 1805566 - protein, 24 aa, Staphylococcus epidermidis
GFSLSEIYKLLGVVDKDEVRCQDM

SEQ ID NO: 1805567 - protein, 17 aa, Staphylococcus epidermidis
GFTLPKMLWVQQHEPDI

SEQ ID NO: 1805568 - protein, 20 aa, Staphylococcus epidermidis
GFTTICPMPNTRPVPDSVEH

SEQ ID NO: 1805569 - protein, 18 aa, Staphylococcus epidermidis
GFVSEFKGDNLVIINRDH

SEQ ID NO: 1805570 - protein, 26 aa, Staphylococcus epidermidis
GGAFKDIPAYELGATVIRQILEHSQI

SEQ ID NO: 1805571 - protein, 23 aa, Staphylococcus epidermidis
GGANRLIKAGAFDKYPIEAVFGI

SEQ ID NO: 1805572 - protein, 18 aa, Staphylococcus epidermidis
GGELKHGTIALIEEGTPV

SEQ ID NO: 1805573 - protein, 27 aa, Staphylococcus epidermidis
GGEPMFSKKSIKNVVKPLLKYAKHRGI

SEQ ID NO: 1805574 - protein, 19 aa, Staphylococcus epidermidis
GGEVKDCIDYALCVNEKGD

SEQ ID NO: 1805575 - protein, 26 aa, Staphylococcus epidermidis
GGFALYTVKEIIRFIVDANLNRKQAN

SEQ ID NO: 1805576 - protein, 22 aa, Staphylococcus epidermidis
GGFKARQVIINKFAVELNKDIY

SEQ ID NO: 1805577 - protein, 18 aa, Staphylococcus epidermidis
GGFMRRIKSYDSLLHSFD

SEQ ID NO: 1805578 - protein, 22 aa, Staphylococcus epidermidis
GGGNTALDWARDIAKIANRVTV

SEQ ID NO: 1805579 - protein, 18 aa, Staphylococcus epidermidis
GGGTRGNGRIQFKDTNIE

SEQ ID NO: 1805580 - protein, 17 aa, Staphylococcus epidermidis
GGIAIENLNDAFIQQIK

SEQ ID NO: 1805581 - protein, 19 aa, Staphylococcus epidermidis
GGIKTDWGFIAADKLADSA

SEQ ID NO: 1805582 - protein, 25 aa, Staphylococcus epidermidis
GGKGLLCVYEGFLKGLKGEKVEAKT

SEQ ID NO: 1805583 - protein, 22 aa, Staphylococcus epidermidis
GGKKLTDVRVYDWVQEVEHLGA

SEQ ID NO: 1805584 - protein, 22 aa, Staphylococcus epidermidis
GGKKLTDVRVYDWVQEVELLGA

SEQ ID NO: 1805585 - protein, 21 aa, Staphylococcus epidermidis
GGKKLTDVRVYDWVQQVEHLG

SEQ ID NO: 1805586 - protein, 25 aa, Staphylococcus epidermidis
GGKKLTDVSVYDWVQEVEHLGAGEL

SEQ ID NO: 1805587 - protein, 18 aa, Staphylococcus epidermidis
GGKKYSEMAILYRTNAQS

SEQ ID NO: 1805588 - protein, 20 aa, Staphylococcus epidermidis
GGKLPANFLNLERHIEVFTP

SEQ ID NO: 1805589 - protein, 23 aa, Staphylococcus epidermidis
GGKRIRPVILLLTLKMLNKDYQQ

SEQ ID NO: 1805590 - protein, 20 aa, Staphylococcus epidermidis
GGLALGLAVTGYRPVMEIQF

SEQ ID NO: 1805591 - protein, 19 aa, Staphylococcus epidermidis
GGLALRFVQSLVEEQQPVP

SEQ ID NO: 1805592 - protein, 19 aa, Staphylococcus epidermidis
GGLGLDFVHDNGYNLKQIK

SEQ ID NO: 1805593 - protein, 22 aa, Staphylococcus epidermidis
GGLKARQVIINKFAVELNKDIY

SEQ ID NO: 1805594 - protein, 26 aa, Staphylococcus epidermidis
GGLLGLECARGLLDQGMEVTVLHLAE

SEQ ID NO: 1805595 - protein, 18 aa, Staphylococcus epidermidis
GGNYHFLLFNKINDRYLS

SEQ ID NO: 1805596 - protein, 17 aa, Staphylococcus epidermidis
GGPRIFDVVNRHKLKTP

SEQ ID NO: 1805597 - protein, 23 aa, Staphylococcus epidermidis
GGQKRILDFALTLVGQPEFLILD

SEQ ID NO: 1805598 - protein, 22 aa, Staphylococcus epidermidis
GGSDITGAIIARGVRASLYENF

SEQ ID NO: 1805599 - protein, 17 aa, Staphylococcus epidermidis
GGSMLLLAHDLQTAKNI

SEQ ID NO: 1805600 - protein, 26 aa, Staphylococcus epidermidis
GGTLPYLKWRINETLNTQKYVMEDPK

SEQ ID NO: 1805601 - protein, 21 aa, Staphylococcus epidermidis
GGVILRWLRDEILASEVETAK

SEQ ID NO: 1805602 - protein, 18 aa, Staphylococcus epidermidis
GGVPAIINELMKKDGILH

SEQ ID NO: 1805603 - protein, 19 aa, Staphylococcus epidermidis
GGVTKFPHFILMAKNRKGF

SEQ ID NO: 1805604 - protein, 19 aa, Staphylococcus epidermidis
GGWTFPEGIQVIGVSSVHE

SEQ ID NO: 1805605 - protein, 25 aa, Staphylococcus epidermidis
GHALDACGINGLHISECDFKGFLDI

SEQ ID NO: 1805606 - protein, 19 aa, Staphylococcus epidermidis
GHALQICEDTLKFGGLGHT

SEQ ID NO: 1805607 - protein, 26 aa, Staphylococcus epidermidis
GHDLCSYLYHKGHRHIIFINESGQYA

SEQ ID NO: 1805608 - protein, 18 aa, Staphylococcus epidermidis
GHDSIAIYELVDNGKSLK

SEQ ID NO: 1805609 - protein, 24 aa, Staphylococcus epidermidis
GHEEIKMVQDLGVDVIVTDHHEIG

SEQ ID NO: 1805610 - protein, 23 aa, Staphylococcus epidermidis
GHEYLSYMIERFIEDKLVVGTRF

SEQ ID NO: 1805611 - protein, 23 aa, Staphylococcus epidermidis
GHGAGSPCGKALGAVPMSTLGYE

SEQ ID NO: 1805612 - protein, 22 aa, Staphylococcus epidermidis
GHIEIFDRSWYGRVLVERVEGF

SEQ ID NO: 1805613 - protein, 17 aa, Staphylococcus epidermidis
GHIYLVWDNSGGTNTQT

SEQ ID NO: 1805614 - protein, 20 aa, Staphylococcus epidermidis
GHKSAVIWFTGLSGSGKSTV

SEQ ID NO: 1805615 - protein, 22 aa, Staphylococcus epidermidis
GHLDEIVEALTLSEQTEKLKEL

SEQ ID NO: 1805616 - protein, 19 aa, Staphylococcus epidermidis
GHLHHPFSINDNTIKYSGS

SEQ ID NO: 1805617 - protein, 18 aa, Staphylococcus epidermidis
GHLSKWLVKNGEHVHPGT

SEQ ID NO: 1805618 - protein, 20 aa, Staphylococcus epidermidis
GHNPKAPKLILNGHVDVASV

SEQ ID NO: 1805619 - protein, 25 aa, Staphylococcus epidermidis
GHPIGASGARILVTLLHQLNETTQN

SEQ ID NO: 1805620 - protein, 18 aa, Staphylococcus epidermidis
GHPVEFNPLLQMNKGVKL

SEQ ID NO: 1805621 - protein, 23 aa, Staphylococcus epidermidis
GHQLKRHGFFYAPTVLDNVRKDY

SEQ ID NO: 1805622 - protein, 19 aa, Staphylococcus epidermidis
GHRANLLLVDEFVKVDEDL

SEQ ID NO: 1805623 - protein, 21 aa, Staphylococcus epidermidis
GHRELPIRADFVGKNIPTARD

SEQ ID NO: 1805624 - protein, 18 aa, Staphylococcus epidermidis
GHSERFGQPKAFAEIDGQ

SEQ ID NO: 1805625 - protein, 23 aa, Staphylococcus epidermidis
GHSKTIWIWTGFLFEYLKHQTDE

SEQ ID NO: 1805626 - protein, 22 aa, Staphylococcus epidermidis
GHTYHVIQGLRINEEVNEDNSL

SEQ ID NO: 1805627 - protein, 25 aa, Staphylococcus epidermidis
GHVFAKVRHAIRCPGSIKNGATIYN

SEQ ID NO: 1805628 - protein, 17 aa, Staphylococcus epidermidis
GHYQFKGLENGSYTVEF

SEQ ID NO: 1805629 - protein, 19 aa, Staphylococcus epidermidis
GIACYIHIDLIKGLSHDEF

SEQ ID NO: 1805630 - protein, 24 aa, Staphylococcus epidermidis
GIDPSLRKEIWKQLRELTNKDKSV

SEQ ID NO: 1805631 - protein, 17 aa, Staphylococcus epidermidis
GIDYCIVGTKGIQHLQW

SEQ ID NO: 1805632 - protein, 23 aa, Staphylococcus epidermidis
GIEAAEAFAKAGIETTIVDIADR

SEQ ID NO: 1805633 - protein, 23 aa, Staphylococcus epidermidis
GIEEIKKSVVYAREKGIKNVAVG

SEQ ID NO: 1805634 - protein, 19 aa, Staphylococcus epidermidis
GIEFKAAGENLAYGQLNSI

SEQ ID NO: 1805635 - protein, 29 aa, Staphylococcus epidermidis
GIELGIPEHLVWRQPFPGPGLGIRVLGEI

SEQ ID NO: 1805636 - protein, 19 aa, Staphylococcus epidermidis
GIELLNYIKRIFTILHEAE

SEQ ID NO: 1805637 - protein, 17 aa, Staphylococcus epidermidis
GIELQSLLFFMKNYSNG

SEQ ID NO: 1805638 - protein, 27 aa, Staphylococcus epidermidis
GIELTRPARALKLWITLQVIGEDEIIE

SEQ ID NO: 1805639 - protein, 19 aa, Staphylococcus epidermidis
GIEREAWLNVLNTLLEEGY

SEQ ID NO: 1805640 - protein, 17 aa, Staphylococcus epidermidis
GIETGFKLSVGKNYKFI

SEQ ID NO: 1805641 - protein, 24 aa, Staphylococcus epidermidis
GIFKDLPLYFNVMRYHSLMADPLQ

SEQ ID NO: 1805642 - protein, 17 aa, Staphylococcus epidermidis
GIFSNEGTLNFPVGQLS

SEQ ID NO: 1805643 - protein, 20 aa, Staphylococcus epidermidis
GIGPGRMNAFTVRKVALGIA

SEQ ID NO: 1805644 - protein, 17 aa, Staphylococcus epidermidis
GIGTIGLYMAPQAKHVY

SEQ ID NO: 1805645 - protein, 17 aa, Staphylococcus epidermidis
GIHARPATMLVQTASKF

SEQ ID NO: 1805646 - protein, 25 aa, Staphylococcus epidermidis
GIHNKDDIKRSSAYVNADPTKISAY

SEQ ID NO: 1805647 - protein, 20 aa, Staphylococcus epidermidis
GIHQGGGWNAIFWCNHDQPR

SEQ ID NO: 1805648 - protein, 25 aa, Staphylococcus epidermidis
GIIDLGYAISCHRSQGSGFKTLVGA

SEQ ID NO: 1805649 - protein, 24 aa, Staphylococcus epidermidis
GIIKEALHKLGFDDGMYDLIKEPL

SEQ ID NO: 1805650 - protein, 17 aa, Staphylococcus epidermidis
GIINYNFDIQREAKLEI

SEQ ID NO: 1805651 - protein, 22 aa, Staphylococcus epidermidis
GIIWPKSVTPFDIHLITINPKK

SEQ ID NO: 1805652 - protein, 20 aa, Staphylococcus epidermidis
GIIWPKSVTPFELHLITINP

SEQ ID NO: 1805653 - protein, 27 aa, Staphylococcus epidermidis
GIKAFSSNGRFGGFLNKDLGIKHVDKN

SEQ ID NO: 1805654 - protein, 17 aa, Staphylococcus epidermidis
GIKFPDDNLLGIDYVIP

SEQ ID NO: 1805655 - protein, 32 aa, Staphylococcus epidermidis
GIKKCKKHRLEFLGHTLLEGFDYQVKRKPNQI

SEQ ID NO: 1805656 - protein, 24 aa, Staphylococcus epidermidis
GIKKDIGMIFQHFNLLNSKTVYKN

SEQ ID NO: 1805657 - protein, 18 aa, Staphylococcus epidermidis
GILDMKGGFTDSFTNAFS

SEQ ID NO: 1805658 - protein, 23 aa, Staphylococcus epidermidis
GILGCVEAGLGIAFLPMSVLNKG

SEQ ID NO: 1805659 - protein, 20 aa, Staphylococcus epidermidis
GILGKIPFFGICLGHQLFAL

SEQ ID NO: 1805660 - protein, 23 aa, Staphylococcus epidermidis
GILKGAKAVLGFHNYPTLKVGEF

SEQ ID NO: 1805661 - protein, 19 aa, Staphylococcus epidermidis
GILRQRLASGWKFEDAIEA

SEQ ID NO: 1805662 - protein, 17 aa, Staphylococcus epidermidis
GIMSGHIPTVAALKTGY

SEQ ID NO: 1805663 - protein, 17 aa, Staphylococcus epidermidis
GINDFKFGISADNTGRL

SEQ ID NO: 1805664 - protein, 24 aa, Staphylococcus epidermidis
GIPSERLDILIVVDMFLTGFDSKK

SEQ ID NO: 1805665 - protein, 26 aa, Staphylococcus epidermidis
GIPSKSLFKKCYKALINKKETDLIKE

SEQ ID NO: 1805666 - protein, 22 aa, Staphylococcus epidermidis
GIPTITIGVALRYMHSNVSVLN

SEQ ID NO: 1805667 - protein, 18 aa, Staphylococcus epidermidis
GIQIGVRVIVPFGPRTIQ

SEQ ID NO: 1805668 - protein, 24 aa, Staphylococcus epidermidis
GIRHFGENRLEGFKEKKAALPDDA

SEQ ID NO: 1805669 - protein, 19 aa, Staphylococcus epidermidis
GIRMFKRYAAITTSAKILS

SEQ ID NO: 1805670 - protein, 19 aa, Staphylococcus epidermidis
GISGETLLPLIKKEHNSKI

SEQ ID NO: 1805671 - protein, 25 aa, Staphylococcus epidermidis
GISGKFMNRPELQRMLKDAKEGNID

SEQ ID NO: 1805672 - protein, 26 aa, Staphylococcus epidermidis
GISPNEFKFGLSFLTRSVALSRFPWL

SEQ ID NO: 1805673 - protein, 20 aa, Staphylococcus epidermidis
GISYLKAMQQFAPRMSALTI

SEQ ID NO: 1805674 - protein, 19 aa, Staphylococcus epidermidis
GITFFKWLQNHTHIDAYYV

SEQ ID NO: 1805675 - protein, 25 aa, Staphylococcus epidermidis
GITLREGDEVVGLDVAHAESEDEVL

SEQ ID NO: 1805676 - protein, 28 aa, Staphylococcus epidermidis
GITPEGINAEMLIGKMIVGETLTFENES

SEQ ID NO: 1805677 - protein, 24 aa, Staphylococcus epidermidis
GITQRCNEEGYAIKSTISTSEESL

SEQ ID NO: 1805678 - protein, 25 aa, Staphylococcus epidermidis
GIVADCKLVLENLCHEQVLTSTHEE

SEQ ID NO: 1805679 - protein, 24 aa, Staphylococcus epidermidis
GIVADCKRVLEALFSENVSTAPHE

SEQ ID NO: 1805680 - protein, 19 aa, Staphylococcus epidermidis
GIVCPVSGTANWTDIRQFN

SEQ ID NO: 1805681 - protein, 17 aa, Staphylococcus epidermidis
GIVFKTGVEIGVDMDRE

SEQ ID NO: 1805682 - protein, 24 aa, Staphylococcus epidermidis
GIVKCPKCGAAMEASNTTNTLKDG

SEQ ID NO: 1805683 - protein, 25 aa, Staphylococcus epidermidis
GIYYYCNLSSPFVCDEEALKYIDYD

SEQ ID NO: 1805684 - protein, 19 aa, Staphylococcus epidermidis
GKAFARRLQGFDARIIYHN

SEQ ID NO: 1805685 - protein, 20 aa, Staphylococcus epidermidis
GKAHSFIDCITTLGKILEIN

SEQ ID NO: 1805686 - protein, 22 aa, Staphylococcus epidermidis
GKAKLKDAFGFNSRQLTTSSAM

SEQ ID NO: 1805687 - protein, 22 aa, Staphylococcus epidermidis
GKAKRDVMISGLGFITIDEGAK

SEQ ID NO: 1805688 - protein, 22 aa, Staphylococcus epidermidis
GKALFAAAFITHFSGQTPHIHF

SEQ ID NO: 1805689 - protein, 22 aa, Staphylococcus epidermidis
GKAQHVVNFMYFIAEELREILA

SEQ ID NO: 1805690 - protein, 26 aa, Staphylococcus epidermidis
GKASLRIVEHIKFYFGLLDKKPNHFK

SEQ ID NO: 1805691 - protein, 19 aa, Staphylococcus epidermidis
GKASYPSTVLMTATLAQVA

SEQ ID NO: 1805692 - protein, 19 aa, Staphylococcus epidermidis
GKCHKLFTERKEFTGDTPV

SEQ ID NO: 1805693 - protein, 30 aa, Staphylococcus epidermidis
GKCKDFLVHRLVAFAFIPAVVGKECINHID

SEQ ID NO: 1805694 - protein, 22 aa, Staphylococcus epidermidis
GKDEKFPFLMFGPGNGPHQINE

SEQ ID NO: 1805695 - protein, 19 aa, Staphylococcus epidermidis
GKDTPILYIDGFNFENKKA

SEQ ID NO: 1805696 - protein, 17 aa, Staphylococcus epidermidis
GKEFIPDSYTRRIFRKL

SEQ ID NO: 1805697 - protein, 19 aa, Staphylococcus epidermidis
GKEKLQLQEFINQYDLGDI

SEQ ID NO: 1805698 - protein, 25 aa, Staphylococcus epidermidis
GKEKQKYRPCVVVSNDFVNQNSPFV

SEQ ID NO: 1805699 - protein, 24 aa, Staphylococcus epidermidis
GKELFKRVLPDALIKLEKAGYETS

SEQ ID NO: 1805700 - protein, 25 aa, Staphylococcus epidermidis
GKELFKRVLPDVLIKLEKAGYETSA

SEQ ID NO: 1805701 - protein, 17 aa, Staphylococcus epidermidis
GKELVFERTRYVYNEQL

SEQ ID NO: 1805702 - protein, 30 aa, Staphylococcus epidermidis
GKERMPIEVVYGFAQLKRGAALANHELGKL

SEQ ID NO: 1805703 - protein, 24 aa, Staphylococcus epidermidis
GKETTTYELMKAMLNSPMYTPSYE

SEQ ID NO: 1805704 - protein, 18 aa, Staphylococcus epidermidis
GKEVIMLEKFAAIGGNTI

SEQ ID NO: 1805705 - protein, 20 aa, Staphylococcus epidermidis
GKFGCANCYATFKDDIIDIV

SEQ ID NO: 1805706 - protein, 17 aa, Staphylococcus epidermidis
GKGILVWQENSHGNVPG

SEQ ID NO: 1805707 - protein, 20 aa, Staphylococcus epidermidis
GKGIYRFKLNDETGVIEALE

SEQ ID NO: 1805708 - protein, 22 aa, Staphylococcus epidermidis
GKGKDVLGILCHVDVVPAGDGW

SEQ ID NO: 1805709 - protein, 19 aa, Staphylococcus epidermidis
GKGKSSFAIQKINKGVNTG

SEQ ID NO: 1805710 - protein, 23 aa, Staphylococcus epidermidis
GKGMTVNRMFWRARRRESIFISY

SEQ ID NO: 1805711 - protein, 17 aa, Staphylococcus epidermidis
GKGSGLILRPERAAEII

SEQ ID NO: 1805712 - protein, 17 aa, Staphylococcus epidermidis
GKHAVVIGRSHIVGQPV

SEQ ID NO: 1805713 - protein, 19 aa, Staphylococcus epidermidis
GKIAGLLSFVDSEILALPE

SEQ ID NO: 1805714 - protein, 17 aa, Staphylococcus epidermidis
GKILRYVFHNIEKMKKS

SEQ ID NO: 1805715 - protein, 26 aa, Staphylococcus epidermidis
GKINELRIGEALFRGVDTTTNEPIAS

SEQ ID NO: 1805716 - protein, 19 aa, Staphylococcus epidermidis
GKINFKKNEMIKFKIMLLE

SEQ ID NO: 1805717 - protein, 20 aa, Staphylococcus epidermidis
GKIRPIIDKVFDFKETQKAI

SEQ ID NO: 1805718 - protein, 24 aa, Staphylococcus epidermidis
GKISEGAICYTGDILNVERSNIYT

SEQ ID NO: 1805719 - protein, 25 aa, Staphylococcus epidermidis
GKISNESPMAIALIGKGLNDQVRVP

SEQ ID NO: 1805720 - protein, 20 aa, Staphylococcus epidermidis
GKIVFYRLVSNHVHHLMQEA

SEQ ID NO: 1805721 - protein, 18 aa, Staphylococcus epidermidis
GKIYTEFKTFENGPDYDT

SEQ ID NO: 1805722 - protein, 21 aa, Staphylococcus epidermidis
GKKAGEAIAILKLTNKASSPV

SEQ ID NO: 1805723 - protein, 27 aa, Staphylococcus epidermidis
GKKAMLKEFYNAFPLVTNDVINEAIKL

SEQ ID NO: 1805724 - protein, 18 aa, Staphylococcus epidermidis
GKKDELYVFNGYAGSDKD

SEQ ID NO: 1805725 - protein, 27 aa, Staphylococcus epidermidis
GKKIPDEFVVGYGLDYGELYRNLPYIG

SEQ ID NO: 1805726 - protein, 47 aa, Staphylococcus epidermidis
GKKLQHLSLLSGGERALSAIALLFAILKVRSAPFVILDEVEAALDEA

SEQ ID NO: 1805727 - protein, 26 aa, Staphylococcus epidermidis
GKKPRVKFEKVFAEHFLKLYDETKNK

SEQ ID NO: 1805728 - protein, 20 aa, Staphylococcus epidermidis
GKKTTFRLLLIDTPETKDPR

SEQ ID NO: 1805729 - protein, 17 aa, Staphylococcus epidermidis
GKLAAWINQDEDFPIEE

SEQ ID NO: 1805730 - protein, 17 aa, Staphylococcus epidermidis
GKLAAWINQDEDFPMEE

SEQ ID NO: 1805731 - protein, 25 aa, Staphylococcus epidermidis
GKLEFRLLKGSSLVMVHLYDYIPKL

SEQ ID NO: 1805732 - protein, 23 aa, Staphylococcus epidermidis
GKLGSGQQWYSWIHIDDLIRGIL

SEQ ID NO: 1805733 - protein, 18 aa, Staphylococcus epidermidis
GKLIFKDISCAINDQHLL

SEQ ID NO: 1805734 - protein, 24 aa, Staphylococcus epidermidis
GKLKMPFNKFISVIDYEEAEMLVQ

SEQ ID NO: 1805735 - protein, 21 aa, Staphylococcus epidermidis
GKLKSKHAVIIGAGEMSELSL

SEQ ID NO: 1805736 - protein, 23 aa, Staphylococcus epidermidis
GKLNEVLLAMGLSDSRIEGSIRI

SEQ ID NO: 1805737 - protein, 20 aa, Staphylococcus epidermidis
GKLNVAFAYIDWKNSEFGPM

SEQ ID NO: 1805738 - protein, 19 aa, Staphylococcus epidermidis
GKLPNHYANALPEYDLNHS

SEQ ID NO: 1805739 - protein, 21 aa, Staphylococcus epidermidis
GKLSTAMIIGRLVILSDLNQI

SEQ ID NO: 1805740 - protein, 19 aa, Staphylococcus epidermidis
GKLYKAIAGEGAYVNQSPL

SEQ ID NO: 1805741 - protein, 24 aa, Staphylococcus epidermidis
GKMKEIPSNVPVALKGTTNQSRHT

SEQ ID NO: 1805742 - protein, 20 aa, Staphylococcus epidermidis
GKMRKVAMDKGFKHCQAGPL

SEQ ID NO: 1805743 - protein, 18 aa, Staphylococcus epidermidis
GKNGFIVEMEPIEIASKI

SEQ ID NO: 1805744 - protein, 24 aa, Staphylococcus epidermidis
GKNLKIAIVVSRFNDFITGRLLEG

SEQ ID NO: 1805745 - protein, 20 aa, Staphylococcus epidermidis
GKNLKIITNYGAGFNNVDID

SEQ ID NO: 1805746 - protein, 25 aa, Staphylococcus epidermidis
GKNPFPKEWRMHAFFMDALPILNET

SEQ ID NO: 1805747 - protein, 21 aa, Staphylococcus epidermidis
GKNTCPKCNSIFEVSVFNDDF

SEQ ID NO: 1805748 - protein, 18 aa, Staphylococcus epidermidis
GKNVEHFDEVYTIEELDD

SEQ ID NO: 1805749 - protein, 27 aa, Staphylococcus epidermidis
GKPEHIVKLKLTYKWINADNPQEVLEV

SEQ ID NO: 1805750 - protein, 18 aa, Staphylococcus epidermidis
GKPFSISSITYIISNPFY

SEQ ID NO: 1805751 - protein, 22 aa, Staphylococcus epidermidis
GKPYAGFVYDVMKDVLYHSKVG

SEQ ID NO: 1805752 - protein, 19 aa, Staphylococcus epidermidis
GKQENIYFSDSMNFMPSED

SEQ ID NO: 1805753 - protein, 24 aa, Staphylococcus epidermidis
GKQGLEIRKPFYIYNEDGTYSDEM

SEQ ID NO: 1805754 - protein, 17 aa, Staphylococcus epidermidis
GKQILGVDPAFRTGCKL

SEQ ID NO: 1805755 - protein, 20 aa, Staphylococcus epidermidis
GKQLMLRLEKELSKLHEAFT

SEQ ID NO: 1805756 - protein, 17 aa, Staphylococcus epidermidis
GKQYKSSILNWLENAGI

SEQ ID NO: 1805757 - protein, 20 aa, Staphylococcus epidermidis
GKRHRRRRASQMTEGSSSDS

SEQ ID NO: 1805758 - protein, 23 aa, Staphylococcus epidermidis
GKRHRRRRQAYSKHNQSKITQQK

SEQ ID NO: 1805759 - protein, 24 aa, Staphylococcus epidermidis
GKRKIRKDAVKHIDGMITSDNEFF

SEQ ID NO: 1805760 - protein, 19 aa, Staphylococcus epidermidis
GKRRRLKWVNQLLNKTFNK

SEQ ID NO: 1805761 - protein, 24 aa, Staphylococcus epidermidis
GKRTARAAIQIAVDLVNEGLISRE

SEQ ID NO: 1805762 - protein, 18 aa, Staphylococcus epidermidis
GKSFYRLNVRINSEDIIA

SEQ ID NO: 1805763 - protein, 20 aa, Staphylococcus epidermidis
GKSIALAIIDRGAFEMGKKV

SEQ ID NO: 1805764 - protein, 19 aa, Staphylococcus epidermidis
GKSLLTRTILGMKPSQLSY

SEQ ID NO: 1805765 - protein, 23 aa, Staphylococcus epidermidis
GKSMNRPELQRMLKDAKEGNIDC

SEQ ID NO: 1805766 - protein, 24 aa, Staphylococcus epidermidis
GKSNIISVFHFLKSSINTIKNNER

SEQ ID NO: 1805767 - protein, 19 aa, Staphylococcus epidermidis
GKSTLLKALSRLLSIKEGR

SEQ ID NO: 1805768 - protein, 24 aa, Staphylococcus epidermidis
GKSTLLLQICAALSQSKNVLYITG

SEQ ID NO: 1805769 - protein, 19 aa, Staphylococcus epidermidis
GKSTLLSAMSRLFNCDNGT

SEQ ID NO: 1805770 - protein, 17 aa, Staphylococcus epidermidis
GKSYPRILSELTDSHEL

SEQ ID NO: 1805771 - protein, 21 aa, Staphylococcus epidermidis
GKTGAFGIPLIEKVVGQEGVQ

SEQ ID NO: 1805772 - protein, 23 aa, Staphylococcus epidermidis
GKTGEMQLHLNVYKQKYCKICGH

SEQ ID NO: 1805773 - protein, 21 aa, Staphylococcus epidermidis
GKTIVAAICMYALKTAGYQSA

SEQ ID NO: 1805774 - protein, 17 aa, Staphylococcus epidermidis
GKTLAAYAAGQGQHVAL

SEQ ID NO: 1805775 - protein, 20 aa, Staphylococcus epidermidis
GKTPSGTFMNTFNGAHRAVD

SEQ ID NO: 1805776 - protein, 17 aa, Staphylococcus epidermidis
GKTQVEVILDLKLIFST

SEQ ID NO: 1805777 - protein, 24 aa, Staphylococcus epidermidis
GKTTTFRMILGLSETTEGTITYEG

SEQ ID NO: 1805778 - protein, 23 aa, Staphylococcus epidermidis
GKTTTIKCLLGMENFDSGSAEIF

SEQ ID NO: 1805779 - protein, 19 aa, Staphylococcus epidermidis
GKTYTLKASVLTTDERQSG

SEQ ID NO: 1805780 - protein, 18 aa, Staphylococcus epidermidis
GKVINIGKVIQKYQDDIK

SEQ ID NO: 1805781 - protein, 17 aa, Staphylococcus epidermidis
GKVIQLWHGTPIKRLFL

SEQ ID NO: 1805782 - protein, 25 aa, Staphylococcus epidermidis
GKVQLNYRQIKSFLMKQLSRQEVPS

SEQ ID NO: 1805783 - protein, 26 aa, Staphylococcus epidermidis
GKVQLNYRQIKSFLMKQLSRQEVPSK

SEQ ID NO: 1805784 - protein, 18 aa, Staphylococcus epidermidis
GKVTGIKKFGAFVELPEG

SEQ ID NO: 1805785 - protein, 18 aa, Staphylococcus epidermidis
GKYAFAYASGIAAISAVL

SEQ ID NO: 1805786 - protein, 19 aa, Staphylococcus epidermidis
GKYGVLIRPEHVHIQEHDH

SEQ ID NO: 1805787 - protein, 18 aa, Staphylococcus epidermidis
GKYHKLFTERKEFTGDTP

SEQ ID NO: 1805788 - protein, 19 aa, Staphylococcus epidermidis
GKYSIFVAIKKSLYPLEIT

SEQ ID NO: 1805789 - protein, 28 aa, Staphylococcus epidermidis
GLAKRKIDLRFVPGVTFTNPSIATVGLT

SEQ ID NO: 1805790 - protein, 21 aa, Staphylococcus epidermidis
GLASLCIGGGQGIATLVSHYD

SEQ ID NO: 1805791 - protein, 17 aa, Staphylococcus epidermidis
GLDFFRFGRIQRIYEQL

SEQ ID NO: 1805792 - protein, 20 aa, Staphylococcus epidermidis
GLEAMTIHRLIGWNQDTQPQ

SEQ ID NO: 1805793 - protein, 21 aa, Staphylococcus epidermidis
GLEAMTIHRLIGWNQETQPED

SEQ ID NO: 1805794 - protein, 20 aa, Staphylococcus epidermidis
GLFGGPLYTFHKIFSIITLS

SEQ ID NO: 1805795 - protein, 32 aa, Staphylococcus epidermidis
GLFKARVDSMLFRGVHYEICCIDRKGYEWVIQ

SEQ ID NO: 1805796 - protein, 17 aa, Staphylococcus epidermidis
GLFKDARKKLKNGELDY

SEQ ID NO: 1805797 - protein, 17 aa, Staphylococcus epidermidis
GLFKEARKKLKNGDLDY

SEQ ID NO: 1805798 - protein, 18 aa, Staphylococcus epidermidis
GLFLRCKNPDVIQRHYAK

SEQ ID NO: 1805799 - protein, 17 aa, Staphylococcus epidermidis
GLFSTIQDIGRIGYQDL

SEQ ID NO: 1805800 - protein, 20 aa, Staphylococcus epidermidis
GLGNIMMRYVMKKKNVDSLP

SEQ ID NO: 1805801 - protein, 33 aa, Staphylococcus epidermidis
GLGRAISVGIKFLGKLTIPLTIATTIFGVSYEK

SEQ ID NO: 1805802 - protein, 25 aa, Staphylococcus epidermidis
GLHVKQDWVDMGFGIANTIAKIVDQ

SEQ ID NO: 1805803 - protein, 23 aa, Staphylococcus epidermidis
GLIDCLHPTPALGGYPKAEALEF

SEQ ID NO: 1805804 - protein, 19 aa, Staphylococcus epidermidis
GLIDMKICEPVIYMVDGKE

SEQ ID NO: 1805805 - protein, 21 aa, Staphylococcus epidermidis
GLILMKLRYQDLIDASYENLY

SEQ ID NO: 1805806 - protein, 17 aa, Staphylococcus epidermidis
GLINALRIVDKDLSDIK

SEQ ID NO: 1805807 - protein, 17 aa, Staphylococcus epidermidis
GLINRGVEPLIEEKLKD

SEQ ID NO: 1805808 - protein, 24 aa, Staphylococcus epidermidis
GLIPEDWGGDTIFVPLSALSGDGI

SEQ ID NO: 1805809 - protein, 19 aa, Staphylococcus epidermidis
GLISIGAEVMRLGVISTPG

SEQ ID NO: 1805810 - protein, 20 aa, Staphylococcus epidermidis
GLKAIICIHDTTLGPALGGC

SEQ ID NO: 1805811 - protein, 18 aa, Staphylococcus epidermidis
GLKDGMVIYDEIHRMESY

SEQ ID NO: 1805812 - protein, 25 aa, Staphylococcus epidermidis
GLKDYGIEIVDRIELIVPETQHNHS

SEQ ID NO: 1805813 - protein, 24 aa, Staphylococcus epidermidis
GLLAIPLPGASFLKSTGKSMSKLA

SEQ ID NO: 1805814 - protein, 23 aa, Staphylococcus epidermidis
GLLAVRSEMVFSGYVGQSNQEGS

SEQ ID NO: 1805815 - protein, 18 aa, Staphylococcus epidermidis
GLLKEIHKELNLDDAEDG

SEQ ID NO: 1805816 - protein, 17 aa, Staphylococcus epidermidis
GLLTERNIKNKDLAELL

SEQ ID NO: 1805817 - protein, 18 aa, Staphylococcus epidermidis
GLMEAREIFLVITGANKR

SEQ ID NO: 1805818 - protein, 18 aa, Staphylococcus epidermidis
GLNLKVKKYSFGMKKKLG

SEQ ID NO: 1805819 - protein, 25 aa, Staphylococcus epidermidis
GLQDGLLFKGIHKLFNGIHSAASKA

SEQ ID NO: 1805820 - protein, 18 aa, Staphylococcus epidermidis
GLQKMAMMRSYMRSQITN

SEQ ID NO: 1805821 - protein, 19 aa, Staphylococcus epidermidis
GLQKRSGFTIIKGNHEEIL

SEQ ID NO: 1805822 - protein, 18 aa, Staphylococcus epidermidis
GLRGFYMNYMKDLPGPIY

SEQ ID NO: 1805823 - protein, 24 aa, Staphylococcus epidermidis
GLRPQDGFEVIKEFQITTEHLEIL

SEQ ID NO: 1805824 - protein, 18 aa, Staphylococcus epidermidis
GLSDHAVAGIMGNMERES

SEQ ID NO: 1805825 - protein, 17 aa, Staphylococcus epidermidis
GLSLLQIPEGVDWNGEE

SEQ ID NO: 1805826 - protein, 23 aa, Staphylococcus epidermidis
GLSLYPEYAFNMARYVDDNQDNI

SEQ ID NO: 1805827 - protein, 23 aa, Staphylococcus epidermidis
GLSRDRVDIILPAVSVFKTLFKK

SEQ ID NO: 1805828 - protein, 19 aa, Staphylococcus epidermidis
GLTELALRFNQGINTDGDA

SEQ ID NO: 1805829 - protein, 24 aa, Staphylococcus epidermidis
GLTMRSIVPSVTFSTGHFKDSSNR

SEQ ID NO: 1805830 - protein, 21 aa, Staphylococcus epidermidis
GLTRCIPMIFLNPAPGQELEN

SEQ ID NO: 1805831 - protein, 18 aa, Staphylococcus epidermidis
GLVIQKFGTTYVLTTKKD

SEQ ID NO: 1805832 - protein, 19 aa, Staphylococcus epidermidis
GLVLSEYPPHSAISKYKFP

SEQ ID NO: 1805833 - protein, 17 aa, Staphylococcus epidermidis
GLVPYEINKVFRAVGPP

SEQ ID NO: 1805834 - protein, 24 aa, Staphylococcus epidermidis
GLYEEMNHLLYCSSAGHEPGYVYR

SEQ ID NO: 1805835 - protein, 29 aa, Staphylococcus epidermidis
GLYPMDSPGGWQIIGRTPLKVFDLNREPM

SEQ ID NO: 1805836 - protein, 25 aa, Staphylococcus epidermidis
GMAHPEGYRKALRLMKQAEKFNRPV

SEQ ID NO: 1805837 - protein, 23 aa, Staphylococcus epidermidis
GMARGFRAPLKFYEAHQKDELEE

SEQ ID NO: 1805838 - protein, 19 aa, Staphylococcus epidermidis
GMERFCCVNQINYIQMNPL

SEQ ID NO: 1805839 - protein, 20 aa, Staphylococcus epidermidis
GMEVMKRGVTIEAIHFHSPP

SEQ ID NO: 1805840 - protein, 20 aa, Staphylococcus epidermidis
GMGKCCVTGCSDVEIDTVNK

SEQ ID NO: 1805841 - protein, 30 aa, Staphylococcus epidermidis
GMGRIGRMVLRIALKNENLNVVAINASYPS

SEQ ID NO: 1805842 - protein, 29 aa, Staphylococcus epidermidis
GMKQARKDLDYEANCDVVTTLFSTKKHFT

SEQ ID NO: 1805843 - protein, 23 aa, Staphylococcus epidermidis
GMNEYGLVMAYNFMHRKKPENGF

SEQ ID NO: 1805844 - protein, 17 aa, Staphylococcus epidermidis
GMNGIDLKYGFTTPDEQ

SEQ ID NO: 1805845 - protein, 17 aa, Staphylococcus epidermidis
GMPQKSYSWGWGNASRS

SEQ ID NO: 1805846 - protein, 21 aa, Staphylococcus epidermidis
GMRFYGYHGVLPAENEIGQVF

SEQ ID NO: 1805847 - protein, 22 aa, Staphylococcus epidermidis
GMTEHWEKVISRTLKFPSNLEV

SEQ ID NO: 1805848 - protein, 25 aa, Staphylococcus epidermidis
GMTSFAEACILAFSHTKKNKVVVSK

SEQ ID NO: 1805849 - protein, 18 aa, Staphylococcus epidermidis
GMYTYAFNLSYFDGNLDL

SEQ ID NO: 1805850 - protein, 17 aa, Staphylococcus epidermidis
GNADVTYGLAIDGEKVT

SEQ ID NO: 1805851 - protein, 18 aa, Staphylococcus epidermidis
GNALKPLIEKGIKVDGLI

SEQ ID NO: 1805852 - protein, 19 aa, Staphylococcus epidermidis
GNCTEIFQYMHVSDIKDYY

SEQ ID NO: 1805853 - protein, 23 aa, Staphylococcus epidermidis
GNDEKRVAFGLSGSDANDGIIKF

SEQ ID NO: 1805854 - protein, 21 aa, Staphylococcus epidermidis
GNDTPPYVAVMFAKTMEDGSR

SEQ ID NO: 1805855 - protein, 21 aa, Staphylococcus epidermidis
GNETRVAWEVALESENTPTSL

SEQ ID NO: 1805856 - protein, 26 aa, Staphylococcus epidermidis
GNEVKLRLKGYPAIVFQHEIDHLNGV

SEQ ID NO: 1805857 - protein, 18 aa, Staphylococcus epidermidis
GNEVLPITFIEGNIAKTG

SEQ ID NO: 1805858 - protein, 19 aa, Staphylococcus epidermidis
GNFMAGMPVIVVQYRAENV

SEQ ID NO: 1805859 - protein, 22 aa, Staphylococcus epidermidis
GNGFIGQSFMKYDGFETLLEKR

SEQ ID NO: 1805860 - protein, 17 aa, Staphylococcus epidermidis
GNGVIPLLLAAKCNQDI

SEQ ID NO: 1805861 - protein, 20 aa, Staphylococcus epidermidis
GNHELRWLERTDKRATEWHH

SEQ ID NO: 1805862 - protein, 23 aa, Staphylococcus epidermidis
GNIGRGFIGYILADNNVKVTFAD

SEQ ID NO: 1805863 - protein, 23 aa, Staphylococcus epidermidis
GNIIAEVFNRFSITDTSMMLDRM

SEQ ID NO: 1805864 - protein, 30 aa, Staphylococcus epidermidis; identical to SEQ ID NO: 1667620

SEQ ID NO: 1805865 - protein, 24 aa, Staphylococcus epidermidis
GNKFFPESFFREPLYDRDRNEREF

SEQ ID NO: 1805866 - protein, 24 aa, Staphylococcus epidermidis
GNLEHKGILGTGIVRIFDMTIAQT

SEQ ID NO: 1805867 - protein, 18 aa, Staphylococcus epidermidis
GNLKGALKSFEKALLTIN

SEQ ID NO: 1805868 - protein, 19 aa, Staphylococcus epidermidis
GNLNGEWCINDVNAVSKIA

SEQ ID NO: 1805869 - protein, 20 aa, Staphylococcus epidermidis
GNLTKDVELLDGLYDQNKKY

SEQ ID NO: 1805870 - protein, 30 aa, Staphylococcus epidermidis
GNLYGHIYIKDCNVRKAFELASPKHTEGLI

SEQ ID NO: 1805871 - protein, 25 aa, Staphylococcus epidermidis
GNMPNLWPQISSIAVRTFILTGEKD

SEQ ID NO: 1805872 - protein, 20 aa, Staphylococcus epidermidis
GNPKWLFIYVNKYRKDIDAY

SEQ ID NO: 1805873 - protein, 23 aa, Staphylococcus epidermidis
GNPSPMTAYGIYIAMKRTAKEKF

SEQ ID NO: 1805874 - protein, 17 aa, Staphylococcus epidermidis
GNPYAIFLYLVNHKEYR

SEQ ID NO: 1805875 - protein, 26 aa, Staphylococcus epidermidis
GNQYAKLKSIFGVRDMFFISENGAVI

SEQ ID NO: 1805876 - protein, 24 aa, Staphylococcus epidermidis
GNRYDVGEKLGFVKTTIEYALKDP

SEQ ID NO: 1805877 - protein, 28 aa, Staphylococcus epidermidis
GNSGVILSQLFRGFCKNIENEKEINAQQ

SEQ ID NO: 1805878 - protein, 23 aa, Staphylococcus epidermidis
GNSLKFYVDHDFEFWNYDEDHRV

SEQ ID NO: 1805879 - protein, 25 aa, Staphylococcus epidermidis
GNSLSFRAFYALPLLSNKAGIHTNA

SEQ ID NO: 1805880 - protein, 19 aa, Staphylococcus epidermidis
GNSPLKFVEDLGFSEEEWY

SEQ ID NO: 1805881 - protein, 22 aa, Staphylococcus epidermidis
GNTDAMIKYLLPKATVVTPNLF

SEQ ID NO: 1805882 - protein, 20 aa, Staphylococcus epidermidis
GNTEAMIQYLLPKATVVTPN

SEQ ID NO: 1805883 - protein, 23 aa, Staphylococcus epidermidis
GNVPEFDHYFAIGKQTARTILKF

SEQ ID NO: 1805884 - protein, 17 aa, Staphylococcus epidermidis
GNVPGNMKLMFDEYLKR

SEQ ID NO: 1805885 - protein, 18 aa, Staphylococcus epidermidis
GNVSFYGASRGKAFINGK

SEQ ID NO: 1805886 - protein, 19 aa, Staphylococcus epidermidis
GNWNFTLFIQNGRVKDTED

SEQ ID NO: 1805887 - protein, 20 aa, Staphylococcus epidermidis
GNYRKPGAGAYPLRGHNNVQ

SEQ ID NO: 1805888 - protein, 23 aa, Staphylococcus epidermidis
GPEFMKVTPGIRPKGAAQNDQQR

SEQ ID NO: 1805889 - protein, 18 aa, Staphylococcus epidermidis
GPEIYRQKLYQLGIEATI

SEQ ID NO: 1805890 - protein, 25 aa, Staphylococcus epidermidis
GPERLVEMRRFILASNHDERVEALE

SEQ ID NO: 1805891 - protein, 20 aa, Staphylococcus epidermidis
GPFAQLRPGSNLGADVKVGN

SEQ ID NO: 1805892 - protein, 17 aa, Staphylococcus epidermidis
GPFNYPVQLVFEPLIGA

SEQ ID NO: 1805893 - protein, 28 aa, Staphylococcus epidermidis
GPFQGHPACVHIAIGKGVCGTAVSENTT

SEQ ID NO: 1805894 - protein, 20 aa, Staphylococcus epidermidis
GPFRSCPVSGVLQPGQTVRY

SEQ ID NO: 1805895 - protein, 25 aa, Staphylococcus epidermidis
GPFYRYDPDQCILCGRCVEACQDVE

SEQ ID NO: 1805896 - protein, 17 aa, Staphylococcus epidermidis
GPGRPSDYPILATILTE

SEQ ID NO: 1805897 - protein, 21 aa, Staphylococcus epidermidis
GPKVKEFESMWAKELGINYIS

SEQ ID NO: 1805898 - protein, 20 aa, Staphylococcus epidermidis
GPLDAAIAWSENGLDGSRRF

SEQ ID NO: 1805899 - protein, 21 aa, Staphylococcus epidermidis
GPLDLLLHLIQKFEIDIYDIP

SEQ ID NO: 1805900 - protein, 17 aa, Staphylococcus epidermidis
GPLHLEMSLSRSKFEEL

SEQ ID NO: 1805901 - protein, 26 aa, Staphylococcus epidermidis
GPLKIVFKTTNPIVLMRTVAEGLGIG

SEQ ID NO: 1805902 - protein, 26 aa, Staphylococcus epidermidis
GPLLHYRMVHELPTFFSSNFDYSELE

SEQ ID NO: 1805903 - protein, 17 aa, Staphylococcus epidermidis
GPMGDAVIEGYINNNKE

SEQ ID NO: 1805904 - protein, 26 aa, Staphylococcus epidermidis
GPPKDRRAGVITFNLEDIHPHDVATA

SEQ ID NO: 1805905 - protein, 26 aa, Staphylococcus epidermidis
GPPKDRRAGVITFNLSDIHPHDVATA

SEQ ID NO: 1805906 - protein, 26 aa, Staphylococcus epidermidis
GPRGLSILERLACRFENLSLNHHIEI

SEQ ID NO: 1805907 - protein, 19 aa, Staphylococcus epidermidis
GPRGPLLMQDIYYLEQMSH

SEQ ID NO: 1805908 - protein, 19 aa, Staphylococcus epidermidis
GPRSDLRNAIEKQLVARGF

SEQ ID NO: 1805909 - protein, 17 aa, Staphylococcus epidermidis
GPSDSNYLFDEFITMMN

SEQ ID NO: 1805910 - protein, 25 aa, Staphylococcus epidermidis
GPSETGIGFALSIERLLLALEEEDI

SEQ ID NO: 1805911 - protein, 21 aa, Staphylococcus epidermidis
GPTPRYISIVYRDDLYLTPVI

SEQ ID NO: 1805912 - protein, 20 aa, Staphylococcus epidermidis
GPVNNGGVILRWLRDEILAS

SEQ ID NO: 1805913 - protein, 22 aa, Staphylococcus epidermidis
GPVRAVLELAGITDILSKSLGS

SEQ ID NO: 1805914 - protein, 20 aa, Staphylococcus epidermidis
GPVVIDFPKDMGILSTNVGL

SEQ ID NO: 1805915 - protein, 17 aa, Staphylococcus epidermidis
GPWHIHRMLEAAEELPI

SEQ ID NO: 1805916 - protein, 17 aa, Staphylococcus epidermidis
GPWHIHRMLEAAEEMPI

SEQ ID NO: 1805917 - protein, 21 aa, Staphylococcus epidermidis
GPYTQAAVMSIAFDQPLATVD

SEQ ID NO: 1805918 - protein, 19 aa, Staphylococcus epidermidis
GQALLNQGLNVFVVQLPSG

SEQ ID NO: 1805919 - protein, 29 aa, Staphylococcus epidermidis
GQALSRLLKEWQMSASHLMAFGDANNDKD

SEQ ID NO: 1805920 - protein, 19 aa, Staphylococcus epidermidis
GQALTRLLNEWEMSSDELM

SEQ ID NO: 1805921 - protein, 25 aa, Staphylococcus epidermidis
GQAPYKFLLSHGFFMDGEGKKMSKS

SEQ ID NO: 1805922 - protein, 19 aa, Staphylococcus epidermidis
GQEALKYIDFNSGKISKQL

SEQ ID NO: 1805923 - protein, 21 aa, Staphylococcus epidermidis
GQEATQIGMAYAMKEGDISSP

SEQ ID NO: 1805924 - protein, 18 aa, Staphylococcus epidermidis
GQEIEFFGPEIESFKQVV

SEQ ID NO: 1805925 - protein, 24 aa, Staphylococcus epidermidis
GQEVLKYIDFNAGKIAKQLLNICE

SEQ ID NO: 1805926 - protein, 17 aa, Staphylococcus epidermidis
GQFACKPPMKEQEINAT

SEQ ID NO: 1805927 - protein, 19 aa, Staphylococcus epidermidis
GQGFYKYPNPIFEKNNFFD

SEQ ID NO: 1805928 - protein, 25 aa, Staphylococcus epidermidis
GQGHLKGHILRIGHMGKVSPFDILS

SEQ ID NO: 1805929 - protein, 19 aa, Staphylococcus epidermidis
GQGIHYFKVNGLTIGTIGL

SEQ ID NO: 1805930 - protein, 19 aa, Staphylococcus epidermidis
GQGIPIILIHGLDGNLSGF

SEQ ID NO: 1805931 - protein, 25 aa, Staphylococcus epidermidis
GQGMSGGVSYIFPSDIERFKKDNAL

SEQ ID NO: 1805932 - protein, 24 aa, Staphylococcus epidermidis
GQGMSGGVSYIFPSDVETFKKVNA

SEQ ID NO: 1805933 - protein, 18 aa, Staphylococcus epidermidis
GQGNAFLPSSLAEFKDDK

SEQ ID NO: 1805934 - protein, 27 aa, Staphylococcus epidermidis
GQGPAFPFAECGAMSQAYIGYQLQESL

SEQ ID NO: 1805935 - protein, 18 aa, Staphylococcus epidermidis
GQGTRLGYKGPKGSFEIE

SEQ ID NO: 1805936 - protein, 23 aa, Staphylococcus epidermidis
GQGYPVVLVHTAFDNYAVFNDLA

SEQ ID NO: 1805937 - protein, 19 aa, Staphylococcus epidermidis
GQHFLKRVIAEMGGKDAIV

SEQ ID NO: 1805938 - protein, 17 aa, Staphylococcus epidermidis
GQIPLTLDGTIVSDDVQ

SEQ ID NO: 1805939 - protein, 23 aa, Staphylococcus epidermidis
GQKQKLKFLSFLLEDNSLIILDE

SEQ ID NO: 1805940 - protein, 18 aa, Staphylococcus epidermidis
GQKRRLSVATALSSKADI

SEQ ID NO: 1805941 - protein, 21 aa, Staphylococcus epidermidis
GQLLLKYAMNYARFSCDVMSL

SEQ ID NO: 1805942 - protein, 19 aa, Staphylococcus epidermidis
GQLRKSYTAKEWMKHIQYV

SEQ ID NO: 1805943 - protein, 21 aa, Staphylococcus epidermidis
GQNASFIFAVCEYLKHEDNPK

SEQ ID NO: 1805944 - protein, 18 aa, Staphylococcus epidermidis
GQNLNFETVDSLKDAISE

SEQ ID NO: 1805945 - protein, 20 aa, Staphylococcus epidermidis
GQPGICILGSLVKYIDQSNF

SEQ ID NO: 1805946 - protein, 22 aa, Staphylococcus epidermidis
GQSPRLAEKMHAAMIMDKVVSQ

SEQ ID NO: 1805947 - protein, 27 aa, Staphylococcus epidermidis
GQVLTFVKGRYDAYLGGGINVKKFDQT

SEQ ID NO: 1805948 - protein, 18 aa, Staphylococcus epidermidis
GQYKIVFTTTILERGFTM

SEQ ID NO: 1805949 - protein, 25 aa, Staphylococcus epidermidis
GQYLLNCLNKAFIDHPRVTDIRGKG

SEQ ID NO: 1805950 - protein, 21 aa, Staphylococcus epidermidis
GRADKWYDIAFCVRSIREDIG

SEQ ID NO: 1805951 - protein, 17 aa, Staphylococcus epidermidis
GRAKQKALELIELVGLK

SEQ ID NO: 1805952 - protein, 28 aa, Staphylococcus epidermidis
GRAKQKALELVELVGLKGRESAYPSELS

SEQ ID NO: 1805953 - protein, 21 aa, Staphylococcus epidermidis
GRASKRLHESTGLEAMTIHRL

SEQ ID NO: 1805954 - protein, 20 aa, Staphylococcus epidermidis
GRASKRLQESTGLEAMTIHR

SEQ ID NO: 1805955 - protein, 23 aa, Staphylococcus epidermidis
GRAVELFKGTGFQIEGELKDKLY

SEQ ID NO: 1805956 - protein, 18 aa, Staphylococcus epidermidis
GRDIGTVVLPDAELKVYM

SEQ ID NO: 1805957 - protein, 18 aa, Staphylococcus epidermidis
GRDIGTVVLPNAELKVYM

SEQ ID NO: 1805958 - protein, 23 aa, Staphylococcus epidermidis
GREFKNAKGVELLVEVIVNQNKE

SEQ ID NO: 1805959 - protein, 18 aa, Staphylococcus epidermidis
GREGVLTYDTLDFIKEIM

SEQ ID NO: 1805960 - protein, 18 aa, Staphylococcus epidermidis
GREGVLTYDVVRYVQEIL

SEQ ID NO: 1805961 - protein, 17 aa, Staphylococcus epidermidis
GREMPKVGLGTYRVENS

SEQ ID NO: 1805962 - protein, 25 aa, Staphylococcus epidermidis
GRFDDVTFPESFKVFGSADSKVIFC

SEQ ID NO: 1805963 - protein, 20 aa, Staphylococcus epidermidis
GRFEYEIGQMSSSFEQEDFD

SEQ ID NO: 1805964 - protein, 19 aa, Staphylococcus epidermidis
GRFKETFHAVQSHFTTVLK

SEQ ID NO: 1805965 - protein, 22 aa, Staphylococcus epidermidis
GRGDILQKFIKVMANDEHLLRL

SEQ ID NO: 1805966 - protein, 18 aa, Staphylococcus epidermidis
GRIERAKLFGDFFGEGDV

SEQ ID NO: 1805967 - protein, 18 aa, Staphylococcus epidermidis
GRIFCYVLDEDHYVIGGP

SEQ ID NO: 1805968 - protein, 24 aa, Staphylococcus epidermidis
GRIGAATGKIYAGFGAKVVGYDAY

SEQ ID NO: 1805969 - protein, 25 aa, Staphylococcus epidermidis
GRIGAATGKIYAGFGAKVVGYDAYP

SEQ ID NO: 1805970 - protein, 18 aa, Staphylococcus epidermidis
GRISLEILIKAAKIDVGI

SEQ ID NO: 1805971 - protein, 18 aa, Staphylococcus epidermidis
GRKLKISGGGRCNVTNRL

SEQ ID NO: 1805972 - protein, 22 aa, Staphylococcus epidermidis
GRKLSIGVMPQGPLTIPYVENE

SEQ ID NO: 1805973 - protein, 18 aa, Staphylococcus epidermidis
GRLLDSFIDYLQRVKQKD

SEQ ID NO: 1805974 - protein, 18 aa, Staphylococcus epidermidis
GRLLESFIEYLQQVNQID

SEQ ID NO: 1805975 - protein, 19 aa, Staphylococcus epidermidis
GRLSPEKGFDLLINAVAKL

SEQ ID NO: 1805976 - protein, 26 aa, Staphylococcus epidermidis
GRMLNIHPSLLPKYKGLDAIGQAYES

SEQ ID NO: 1805977 - protein, 28 aa, Staphylococcus epidermidis
GRMRKLCRPETPAIIVTRGLEPPEELIR

SEQ ID NO: 1805978 - protein, 17 aa, Staphylococcus epidermidis
GRMSAQIGAEFLQKVNG

SEQ ID NO: 1805979 - protein, 18 aa, Staphylococcus epidermidis
GRPAMKRLLQDVKDNKIE

SEQ ID NO: 1805980 - protein, 28 aa, Staphylococcus epidermidis
GRPKHIYSIYRKMMKQKKQFDQIFDLLA

SEQ ID NO: 1805981 - protein, 21 aa, Staphylococcus epidermidis
GRSFEKFVLFTSYKVDLDEEC

SEQ ID NO: 1805982 - protein, 19 aa, Staphylococcus epidermidis
GRSGKGLLRQTPKQAETRK

SEQ ID NO: 1805983 - protein, 20 aa, Staphylococcus epidermidis
GRSRWKGVRPTVRGSVMNPN

SEQ ID NO: 1805984 - protein, 23 aa, Staphylococcus epidermidis
GRTGKLFAYEHYDIIPDIITLAK

SEQ ID NO: 1805985 - protein, 19 aa, Staphylococcus epidermidis
GRTLLSLKDASKMKKIGKQ

SEQ ID NO: 1805986 - protein, 21 aa, Staphylococcus epidermidis
GRTMPKIGLGTYRVKDSDECR

SEQ ID NO: 1805987 - protein, 18 aa, Staphylococcus epidermidis
GRVIEEGRTNMVLQQPRH

SEQ ID NO: 1805988 - protein, 17 aa, Staphylococcus epidermidis
GRVYKKLMEYLNRYDTQ

SEQ ID NO: 1805989 - protein, 17 aa, Staphylococcus epidermidis
GRWSNFEKTECGLHVAD

SEQ ID NO: 1805990 - protein, 17 aa, Staphylococcus epidermidis
GRYAYSLPQSDIEDISI

SEQ ID NO: 1805991 - protein, 21 aa, Staphylococcus epidermidis
GRYGIYNYFGISAYDNNPDAS

SEQ ID NO: 1805992 - protein, 18 aa, Staphylococcus epidermidis
GRYIKNFLLNKAIIEGYH

SEQ ID NO: 1805993 - protein, 25 aa, Staphylococcus epidermidis
GRYIYKLKNIYYLRISTLPLSLGNE

SEQ ID NO: 1805994 - protein, 27 aa, Staphylococcus epidermidis
GRYYISHQWFPLGAVHGLKYWFNYTSD

SEQ ID NO: 1805995 - protein, 20 aa, Staphylococcus epidermidis
GSAYIRITIRDNNEVLDFNK

SEQ ID NO: 1805996 - protein, 17 aa, Staphylococcus epidermidis
GSDITGAIIARGVKASI

SEQ ID NO: 1805997 - protein, 23 aa, Staphylococcus epidermidis
GSEFPIVIMPIVKQYFRMLQRPI

SEQ ID NO: 1805998 - protein, 23 aa, Staphylococcus epidermidis
GSFIESFPLFGYNLNDYEELFNE

SEQ ID NO: 1805999 - protein, 17 aa, Staphylococcus epidermidis
GSFLCKVDEHIAPINFF

SEQ ID NO: 1806000 - protein, 17 aa, Staphylococcus epidermidis
GSFVIYSLQLVEKGYTA

SEQ ID NO: 1806001 - protein, 20 aa, Staphylococcus epidermidis
GSGKLIKLDIEKLGNLEQLV

SEQ ID NO: 1806002 - protein, 27 aa, Staphylococcus epidermidis
GSGKSITCKALLGLNPERFRVSGDIYF

SEQ ID NO: 1806003 - protein, 22 aa, Staphylococcus epidermidis
GSGKSLAYLLAALMYNIETGRH

SEQ ID NO: 1806004 - protein, 23 aa, Staphylococcus epidermidis
GSGKSSLISAAFEHDDCAIFIDQ

SEQ ID NO: 1806005 - protein, 19 aa, Staphylococcus epidermidis
GSHFHRAPGSVGMASDASR

SEQ ID NO: 1806006 - protein, 22 aa, Staphylococcus epidermidis
GSHYIWMARKFRSYNPRHLLFS

SEQ ID NO: 1806007 - protein, 28 aa, Staphylococcus epidermidis
GSIKNFRVTKIFGYFGLKREEIEEAQAG

SEQ ID NO: 1806008 - protein, 23 aa, Staphylococcus epidermidis
GSIPLVNRITHEIAFVRYHGRNR

SEQ ID NO: 1806009 - protein, 27 aa, Staphylococcus epidermidis
GSIPLVNRITSDIAFVRYHGRNHYGWT

SEQ ID NO: 1806010 - protein, 17 aa, Staphylococcus epidermidis
GSISAAMAEDLNEAEQE

SEQ ID NO: 1806011 - protein, 23 aa, Staphylococcus epidermidis
GSKDIFGKFSYIRSTVKTLLNPV

SEQ ID NO: 1806012 - protein, 21 aa, Staphylococcus epidermidis
GSKRQRIIGALKKHYGEDRVL

SEQ ID NO: 1806013 - protein, 17 aa, Staphylococcus epidermidis
GSLLQYSFSEINQAKGY

SEQ ID NO: 1806014 - protein, 19 aa, Staphylococcus epidermidis
GSLVYKGDIPSLIQQSDDH

SEQ ID NO: 1806015 - protein, 24 aa, Staphylococcus epidermidis
GSMLPKIESAISFIENNPEGSVLI

SEQ ID NO: 1806016 - protein, 22 aa, Staphylococcus epidermidis
GSNGSIGRILVKRLKKRYRIIT

SEQ ID NO: 1806017 - protein, 25 aa, Staphylococcus epidermidis
GSPKPRLPFKHIFHKDQYDANHHQQ

SEQ ID NO: 1806018 - protein, 23 aa, Staphylococcus epidermidis
GSPRPRFRNAGKFVQTYMPTSYT

SEQ ID NO: 1806019 - protein, 18 aa, Staphylococcus epidermidis
GSRLLRKEKVDEYIKSKK

SEQ ID NO: 1806020 - protein, 17 aa, Staphylococcus epidermidis
GSTIGIIGGGQLGKMMA

SEQ ID NO: 1806021 - protein, 18 aa, Staphylococcus epidermidis
GSTITVKALLSMRMENKV

SEQ ID NO: 1806022 - protein, 24 aa, Staphylococcus epidermidis
GSTPRALVISAYRNVSVNNFTAIG

SEQ ID NO: 1806023 - protein, 21 aa, Staphylococcus epidermidis
GSTTLQFARAIVHKQNLTVIT

SEQ ID NO: 1806024 - protein, 27 aa, Staphylococcus epidermidis
GSTYLPRKFKIGIAVPPSNDIDVYSQD

SEQ ID NO: 1806025 - protein, 24 aa, Staphylococcus epidermidis
GSVGMASDASRVFKGQKMPGRMGG

SEQ ID NO: 1806026 - protein, 32 aa, Staphylococcus epidermidis
GTDDKYYIAGHVFRIVSCLNQVLFACNNAYCI

SEQ ID NO: 1806027 - protein, 19 aa, Staphylococcus epidermidis
GTEAAIAYQSGFNCNMAAI

SEQ ID NO: 1806028 - protein, 24 aa, Staphylococcus epidermidis
GTEFEIMLSGPIAFTDRFIDPATR

SEQ ID NO: 1806029 - protein, 23 aa, Staphylococcus epidermidis
GTELRGPLFKGLPTIESHRSAHP

SEQ ID NO: 1806030 - protein, 24 aa, Staphylococcus epidermidis
GTEPKIKIYFSLNVEDIESVIKDF

SEQ ID NO: 1806031 - protein, 22 aa, Staphylococcus epidermidis
GTERLVRAAIQYAIDNDRKSVT

SEQ ID NO: 1806032 - protein, 21 aa, Staphylococcus epidermidis
GTESGLRIDLSQNFRSRQEVL

SEQ ID NO: 1806033 - protein, 19 aa, Staphylococcus epidermidis
GTFKFTNVNTLHFDLPLQV

SEQ ID NO: 1806034 - protein, 21 aa, Staphylococcus epidermidis
GTFLRGEIILGNLKYSSGPNH

SEQ ID NO: 1806035 - protein, 20 aa, Staphylococcus epidermidis
GTFLRGEIILGNMKYSSGPN

SEQ ID NO: 1806036 - protein, 17 aa, Staphylococcus epidermidis
GTFTSPFIESFNERISL

SEQ ID NO: 1806037 - protein, 27 aa, Staphylococcus epidermidis
GTGAGVRRIEALTGKSAFLYLEDIQSK

SEQ ID NO: 1806038 - protein, 24 aa, Staphylococcus epidermidis
GTGELTVGFLLAKLSWHERHHLEH

SEQ ID NO: 1806039 - protein, 29 aa, Staphylococcus epidermidis
GTGHMPNLWPHLSSIRIPTLIIVGEKDKK

SEQ ID NO: 1806040 - protein, 24 aa, Staphylococcus epidermidis
GTGIKEMIDHYGIQQEETLVIGDS

SEQ ID NO: 1806041 - protein, 25 aa, Staphylococcus epidermidis
GTGIKEMIEHFGIKQEETLVIGDSD

SEQ ID NO: 1806042 - protein, 23 aa, Staphylococcus epidermidis
GTGKSHLAYAIAKAIKNEGYSVA

SEQ ID NO: 1806043 - protein, 25 aa, Staphylococcus epidermidis
GTGKSTLIELIRYALDIAPTSQNTN

SEQ ID NO: 1806044 - protein, 17 aa, Staphylococcus epidermidis
GTGPLSMKIVCYFTSKE

SEQ ID NO: 1806045 - protein, 25 aa, Staphylococcus epidermidis
GTGTRVLGGLSYRESHFALELLSES

SEQ ID NO: 1806046 - protein, 17 aa, Staphylococcus epidermidis
GTICFDGNHIDQSIKNR

SEQ ID NO: 1806047 - protein, 23 aa, Staphylococcus epidermidis
GTICGDDTCLLICRNEEASEEIK

SEQ ID NO: 1806048 - protein, 26 aa, Staphylococcus epidermidis
GTIEPLKDLRVMGKFGDSVTTDHISP

SEQ ID NO: 1806049 - protein, 19 aa, Staphylococcus epidermidis
GTIKLKGINVNGLEVEINN

SEQ ID NO: 1806050 - protein, 23 aa, Staphylococcus epidermidis
GTIRGDLGLTVGRNIIHGSDSVE

SEQ ID NO: 1806051 - protein, 18 aa, Staphylococcus epidermidis
GTLNIWYITTIQRLIDLI

SEQ ID NO: 1806052 - protein, 24 aa, Staphylococcus epidermidis
GTLSKAIGVVGGYVAGSQQLIDWL

SEQ ID NO: 1806053 - protein, 25 aa, Staphylococcus epidermidis
GTLTHLHLIKPLGFSTDDKMLKRAG

SEQ ID NO: 1806054 - protein, 17 aa, Staphylococcus epidermidis
GTMERYSNIKFILAHAG

SEQ ID NO: 1806055 - protein, 26 aa, Staphylococcus epidermidis
GTMTEEDWNRFTIAVGKLSRTKIFID

SEQ ID NO: 1806056 - protein, 22 aa, Staphylococcus epidermidis
GTNVIRLLPPLSITKKQLEKGI

SEQ ID NO: 1806057 - protein, 19 aa, Staphylococcus epidermidis
GTPIFKKYMNREGKEVIYE

SEQ ID NO: 1806058 - protein, 17 aa, Staphylococcus epidermidis
GTPIKRLFLDSKEPHQN

SEQ ID NO: 1806059 - protein, 24 aa, Staphylococcus epidermidis
GTRNEVKQLLKKGAVEVNDKKIKT

SEQ ID NO: 1806060 - protein, 25 aa, Staphylococcus epidermidis
GTSDMKGGLAALVISLIELKEEDAL

SEQ ID NO: 1806061 - protein, 20 aa, Staphylococcus epidermidis
GTSIFPTPVVGMVGLIEDIN

SEQ ID NO: 1806062 - protein, 36 aa, Staphylococcus epidermidis; identical to SEQ ID NO: 1582818

SEQ ID NO: 1806063 - protein, 26 aa, Staphylococcus epidermidis
GTTIPSLRTETLYKIDIDLPKKNIQK

SEQ ID NO: 1806064 - protein, 17 aa, Staphylococcus epidermidis
GTVDAILFQNNDNFYTV

SEQ ID NO: 1806065 - protein, 17 aa, Staphylococcus epidermidis
GTVDTILFQNTDNFYTV

SEQ ID NO: 1806066 - protein, 25 aa, Staphylococcus epidermidis
GTVKGQISYKDKVHQSSDYINADPA

SEQ ID NO: 1806067 - protein, 23 aa, Staphylococcus epidermidis
GTVNLPMAISMVRAIKNAVDQTK

SEQ ID NO: 1806068 - protein, 17 aa, Staphylococcus epidermidis
GTYFKSVAVTTTMGPGV

SEQ ID NO: 1806069 - protein, 22 aa, Staphylococcus epidermidis
GTYHYQRMQVLLDDLSKTDGLY

SEQ ID NO: 1806070 - protein, 27 aa, Staphylococcus epidermidis
GTYRALTKVFTRFGIDVDFVDTTKIEN

SEQ ID NO: 1806071 - protein, 26 aa, Staphylococcus epidermidis
GTYRALTKVFTRFGVEVDFVDTTHIE

SEQ ID NO: 1806072 - protein, 27 aa, Staphylococcus epidermidis
GTYTMPCARTLVPVEVPLDVTTSEVFD

SEQ ID NO: 1806073 - protein, 23 aa, Staphylococcus epidermidis
GVDFRLIEPEAFYHTLQHFTGSK

SEQ ID NO: 1806074 - protein, 17 aa, Staphylococcus epidermidis
GVDIRHGLFGAGIESSH

SEQ ID NO: 1806075 - protein, 23 aa, Staphylococcus epidermidis
GVDPAFRTGCKLAVINPFGTFIA

SEQ ID NO: 1806076 - protein, 18 aa, Staphylococcus epidermidis
GVDSCPMEGFDLDKVTEI

SEQ ID NO: 1806077 - protein, 19 aa, Staphylococcus epidermidis
GVFALKLSLNRDVKGIVTM

SEQ ID NO: 1806078 - protein, 18 aa, Staphylococcus epidermidis
GVFHSKYLLAWSKHKEDA

SEQ ID NO: 1806079 - protein, 23 aa, Staphylococcus epidermidis
GVGMGYSLHAGMVVVADGSERAE

SEQ ID NO: 1806080 - protein, 19 aa, Staphylococcus epidermidis
GVHDLPFICVIINNKYAIS

SEQ ID NO: 1806081 - protein, 24 aa, Staphylococcus epidermidis
GVIDRVDHRYVYVNFGRIEAVLSE

SEQ ID NO: 1806082 - protein, 25 aa, Staphylococcus epidermidis
GVIDSGRVYKELMEYLNQYDTQIAT

SEQ ID NO: 1806083 - protein, 30 aa, Staphylococcus epidermidis
GVIEKLDYLKDLGIDVIWLSPMYKSPNDDN

SEQ ID NO: 1806084 - protein, 21 aa, Staphylococcus epidermidis
GVIGMSIARQLSATQYDVAIV

SEQ ID NO: 1806085 - protein, 20 aa, Staphylococcus epidermidis
GVKPELIVKGGLINSAVNGD

SEQ ID NO: 1806086 - protein, 19 aa, Staphylococcus epidermidis
GVKRLGVVRADIDNLGATF

SEQ ID NO: 1806087 - protein, 18 aa, Staphylococcus epidermidis
GVLDAAECVPTFNTRPEE

SEQ ID NO: 1806088 - protein, 21 aa, Staphylococcus epidermidis
GVLKYKKRKAESINKLDHTED

SEQ ID NO: 1806089 - protein, 19 aa, Staphylococcus epidermidis
GVLPELFTAQTACFRSEAG

SEQ ID NO: 1806090 - protein, 25 aa, Staphylococcus epidermidis
GVLRSTSGSMRWNLNANSLDYFDGA

SEQ ID NO: 1806091 - protein, 23 aa, Staphylococcus epidermidis
GVLTIESKSGYGLDKENELKQLR

SEQ ID NO: 1806092 - protein, 17 aa, Staphylococcus epidermidis
GVMHACGHDAHTAYMLI

SEQ ID NO: 1806093 - protein, 20 aa, Staphylococcus epidermidis
GVNELKRTSLSMIDSDLINV

SEQ ID NO: 1806094 - protein, 24 aa, Staphylococcus epidermidis
GVNYLIKVLENWSKDGVDTKEKAI

SEQ ID NO: 1806095 - protein, 24 aa, Staphylococcus epidermidis
GVPSDQWLRVRAEYLQNRNSNGDN

SEQ ID NO: 1806096 - protein, 23 aa, Staphylococcus epidermidis
GVQFPRDHFEDITPQQVKESFMT

SEQ ID NO: 1806097 - protein, 23 aa, Staphylococcus epidermidis
GVQKRSRNILDFSDYEHFALCIL

SEQ ID NO: 1806098 - protein, 26 aa, Staphylococcus epidermidis
GVQTFKPELLKILGRTHKTEDIYNAV

SEQ ID NO: 1806099 - protein, 23 aa, Staphylococcus epidermidis
GVRLKAYFNELTFDDTLRTNIKN

SEQ ID NO: 1806100 - protein, 20 aa, Staphylococcus epidermidis
GVSAAMLLQFNHYSIKATHI

SEQ ID NO: 1806101 - protein, 18 aa, Staphylococcus epidermidis
GVSKSGKNVEHFDEVYTI

SEQ ID NO: 1806102 - protein, 31 aa, Staphylococcus epidermidis
GVTEPQPSFSTCFGAPFLPLNPTKYADLLGN

SEQ ID NO: 1806103 - protein, 18 aa, Staphylococcus epidermidis
GVTLELVDQLKFFINERI

SEQ ID NO: 1806104 - protein, 20 aa, Staphylococcus epidermidis
GVTSMPYRYEFLAHRINPSK

SEQ ID NO: 1806105 - protein, 24 aa, Staphylococcus epidermidis
GVVTRPFGFEGRKRQTQAAAGVEA

SEQ ID NO: 1806106 - protein, 19 aa, Staphylococcus epidermidis
GVYGKRWLDEDIFNVEQFN

SEQ ID NO: 1806107 - protein, 18 aa, Staphylococcus epidermidis
GVYRLKVTLNKEGELNYE

SEQ ID NO: 1806108 - protein, 33 aa, Staphylococcus epidermidis
GWAEPKGMETWDFAHCLPYFKKLETTYGASPYD

SEQ ID NO: 1806109 - protein, 23 aa, Staphylococcus epidermidis
GWAVKRLLDTGAIKPFDDYEEVK

SEQ ID NO: 1806110 - protein, 19 aa, Staphylococcus epidermidis
GWHDMKIVPYAPLEVSPAA

SEQ ID NO: 1806111 - protein, 18 aa, Staphylococcus epidermidis
GWTGGKYGIGRRISLHYT

SEQ ID NO: 1806112 - protein, 18 aa, Staphylococcus epidermidis
GWTKKDMTDQEWRDVRYL

SEQ ID NO: 1806113 - protein, 23 aa, Staphylococcus epidermidis
GYAPRKYYGEYLLHVLSVIENNL

SEQ ID NO: 1806114 - protein, 20 aa, Staphylococcus epidermidis
GYDIELAFEAGLLSRNEENF

SEQ ID NO: 1806115 - protein, 22 aa, Staphylococcus epidermidis
GYDKGHLEPIFILGKNNKQKRN

SEQ ID NO: 1806116 - protein, 19 aa, Staphylococcus epidermidis
GYDSEAFEQLLLKEKSILV

SEQ ID NO: 1806117 - protein, 17 aa, Staphylococcus epidermidis
GYEELLAYREIMMNYTL

SEQ ID NO: 1806118 - protein, 19 aa, Staphylococcus epidermidis
GYENGGLVTKHQIAEVGEG

SEQ ID NO: 1806119 - protein, 17 aa, Staphylococcus epidermidis
GYGPNALAFQNAYEEGT

SEQ ID NO: 1806120 - protein, 26 aa, Staphylococcus epidermidis
GYGTKMMMFLPEYVQALFPDFTHLYL

SEQ ID NO: 1806121 - protein, 20 aa, Staphylococcus epidermidis
GYIALEFASMFANFGTHVTI

SEQ ID NO: 1806122 - protein, 21 aa, Staphylococcus epidermidis
GYISFEFAHIAARAGSEVHII

SEQ ID NO: 1806123 - protein, 23 aa, Staphylococcus epidermidis
GYIYFTPIGGWWNQVMLSQKVTI

SEQ ID NO: 1806124 - protein, 18 aa, Staphylococcus epidermidis
GYKCPHCGNNDPKTVDVV

SEQ ID NO: 1806125 - protein, 22 aa, Staphylococcus epidermidis
GYKDELMELFTIQNEYSFLNAI

SEQ ID NO: 1806126 - protein, 37 aa, Staphylococcus epidermidis
GYLKLHKTWFCKSKLCPVCNWRRAMKNSYQAQKVIEE

SEQ ID NO: 1806127 - protein, 18 aa, Staphylococcus epidermidis
GYLNHFDMDFLYLTDTKN

SEQ ID NO: 1806128 - protein, 27 aa, Staphylococcus epidermidis
GYLNLAPEEFIVWVLGFIKNVDELKQK

SEQ ID NO: 1806129 - protein, 19 aa, Staphylococcus epidermidis
GYMQKIFSQELCFTKLSSS

SEQ ID NO: 1806130 - protein, 17 aa, Staphylococcus epidermidis
GYMRLIGQDLLQAYEGR

SEQ ID NO: 1806131 - protein, 19 aa, Staphylococcus epidermidis
GYNDARWVLIDLANVVVHI

SEQ ID NO: 1806132 - protein, 18 aa, Staphylococcus epidermidis
GYNHPLGYALYGLYQNKE

SEQ ID NO: 1806133 - protein, 17 aa, Staphylococcus epidermidis
GYNVIAMGYLFLPKTSI

SEQ ID NO: 1806134 - protein, 22 aa, Staphylococcus epidermidis
GYPMPAVGLGVYKIADDQMEEV

SEQ ID NO: 1806135 - protein, 25 aa, Staphylococcus epidermidis
GYRQMKTLKLELIKMNASYLIRKQR

SEQ ID NO: 1806136 - protein, 23 aa, Staphylococcus epidermidis
GYRSEPHERLFALLVQANGEDVL

SEQ ID NO: 1806137 - protein, 18 aa, Staphylococcus epidermidis
GYSFIGLGSDGGFAEFTN

SEQ ID NO: 1806138 - protein, 26 aa, Staphylococcus epidermidis
GYSGDALKGLIFVSSREEAYQLANQL

SEQ ID NO: 1806139 - protein, 19 aa, Staphylococcus epidermidis
GYSKFKSLLQYFNLQHQKP

SEQ ID NO: 1806140 - protein, 17 aa, Staphylococcus epidermidis
GYSLKPRQFLFKNETIK

SEQ ID NO: 1806141 - protein, 18 aa, Staphylococcus epidermidis
GYSLVGCMCQPGFEYEHF

SEQ ID NO: 1806142 - protein, 30 aa, Staphylococcus epidermidis
GYSPDGVVGGDGIGFAFSPGPLGQIGKEGA

SEQ ID NO: 1806143 - protein, 18 aa, Staphylococcus epidermidis
GYTATDIISRYKRMQGYN

SEQ ID NO: 1806144 - protein, 25 aa, Staphylococcus epidermidis
GYTEEYPGVFAFIGSDSKFDLHHPN

SEQ ID NO: 1806145 - protein, 18 aa, Staphylococcus epidermidis
GYTIPHIYKECRIGDIKH

SEQ ID NO: 1806146 - protein, 22 aa, Staphylococcus epidermidis
GYTKRSFIMTAYIMEFQALNGM

SEQ ID NO: 1806147 - protein, 19 aa, Staphylococcus epidermidis
GYVGHPLLVKFGYHQTIFP

SEQ ID NO: 1806148 - protein, 19 aa, Staphylococcus epidermidis
GYVPQCPNCDISLTYHKTT

SEQ ID NO: 1806149 - protein, 17 aa, Staphylococcus epidermidis
GYVPYYLERAETDQKSK

SEQ ID NO: 1806150 - protein, 18 aa, Staphylococcus epidermidis
HAEGVLYVTLPKVIDEDE

SEQ ID NO: 1806151 - protein, 23 aa, Staphylococcus epidermidis
HAEYEYIEMIPLLMNENDELDSH

SEQ ID NO: 1806152 - protein, 26 aa, Staphylococcus epidermidis
HAFDRLDVEGPFYFKNLSKEDDFERV

SEQ ID NO: 1806153 - protein, 17 aa, Staphylococcus epidermidis
HAFNYKTNKSIYNILIG

SEQ ID NO: 1806154 - protein, 20 aa, Staphylococcus epidermidis
HAGGSLSTYAYQHMKDPIVV

SEQ ID NO: 1806155 - protein, 25 aa, Staphylococcus epidermidis
HAGQVCSAGSRILVHNSIKDQFEKA

SEQ ID NO: 1806156 - protein, 25 aa, Staphylococcus epidermidis
HAGVIGLKVHEDWGATPSALSHALD

SEQ ID NO: 1806157 - protein, 18 aa, Staphylococcus epidermidis
HAIEMAEKVKKGFIDKGY

SEQ ID NO: 1806158 - protein, 20 aa, Staphylococcus epidermidis
HAKKVMSFEIDQRLIPVLND

SEQ ID NO: 1806159 - protein, 25 aa, Staphylococcus epidermidis
HAKLPAGVGDYLFERLRLTANHMVN

SEQ ID NO: 1806160 - protein, 25 aa, Staphylococcus epidermidis
HALDACGLNGIHITNCSFEGFLDID

SEQ ID NO: 1806161 - protein, 19 aa, Staphylococcus epidermidis
HALEHARELNVINALLYTD

SEQ ID NO: 1806162 - protein, 19 aa, Staphylococcus epidermidis
HALLKPQFIHDFDDKIVYN

SEQ ID NO: 1806163 - protein, 28 aa, Staphylococcus epidermidis
HANDWSEVRPEWGLARNAEFIIGKRQIT

SEQ ID NO: 1806164 - protein, 23 aa, Staphylococcus epidermidis
HAPCTELSMGMSNDYQIAVEEGA

SEQ ID NO: 1806165 - protein, 24 aa, Staphylococcus epidermidis
HAPFGYRYRKGCFVVQEEEAYTVK

SEQ ID NO: 1806166 - protein, 26 aa, Staphylococcus epidermidis
HAQCMDLVIDYCLWISDNQFRIRGNA

SEQ ID NO: 1806167 - protein, 29 aa, Staphylococcus epidermidis
HAQGLGFRGDIFGGYILYNIGFIESEDRY

SEQ ID NO: 1806168 - protein, 25 aa, Staphylococcus epidermidis
HAQLPAGVGDYLFERLRLTANHMVN

SEQ ID NO: 1806169 - protein, 21 aa, Staphylococcus epidermidis
HARAEVEKGVKWITDKSQVEG

SEQ ID NO: 1806170 - protein, 23 aa, Staphylococcus epidermidis
HARDMLKRERLFFDKMQAHIGEV

SEQ ID NO: 1806171 - protein, 25 aa, Staphylococcus epidermidis
HAREPRLDDLILMQLIHSPSYSSYV

SEQ ID NO: 1806172 - protein, 26 aa, Staphylococcus epidermidis
HASLLPKYRGGAPIHQAIIDGEKETG

SEQ ID NO: 1806173 - protein, 19 aa, Staphylococcus epidermidis
HAVHWLIKKLHSHGKQLKK

SEQ ID NO: 1806174 - protein, 17 aa, Staphylococcus epidermidis
HCLARKPKCEICPLLND

SEQ ID NO: 1806175 - protein, 20 aa, Staphylococcus epidermidis
HCYKADPEYGKGVAKALDFD

SEQ ID NO: 1806176 - protein, 20 aa, Staphylococcus epidermidis
HCYKADPEYGKGVAKALDID

SEQ ID NO: 1806177 - protein, 18 aa, Staphylococcus epidermidis
HDDLGMAVSNSLAAIEGG

SEQ ID NO: 1806178 - protein, 26 aa, Staphylococcus epidermidis
HDFERWSFHLQIYFLAERFKEQKRMF

SEQ ID NO: 1806179 - protein, 24 aa, Staphylococcus epidermidis
HDGKERLNYGASWFESNHLYIRTK

SEQ ID NO: 1806180 - protein, 23 aa, Staphylococcus epidermidis
HDGRERLNYGAKWFENNQLYIRT

SEQ ID NO: 1806181 - protein, 23 aa, Staphylococcus epidermidis
HDGTKLGFMSFFTKAAVAALKKY

SEQ ID NO: 1806182 - protein, 19 aa, Staphylococcus epidermidis
HDIDYCIVINFSSRFANVT

SEQ ID NO: 1806183 - protein, 24 aa, Staphylococcus epidermidis
HDKPIIGICLGMQLLFQHSAEGDI

SEQ ID NO: 1806184 - protein, 24 aa, Staphylococcus epidermidis
HDKPIIGICLGMQLLFQHSAEGDV

SEQ ID NO: 1806185 - protein, 17 aa, Staphylococcus epidermidis
HDLGEFIFKNGFKPRIY

SEQ ID NO: 1806186 - protein, 21 aa, Staphylococcus epidermidis
HDSLGYLAHRYHFKQEGVNGM

SEQ ID NO: 1806187 - protein, 17 aa, Staphylococcus epidermidis
HDYAFWDKAIEDVIDRF

SEQ ID NO: 1806188 - protein, 20 aa, Staphylococcus epidermidis
HEAFQSWKQVDAHERSAKLF

SEQ ID NO: 1806189 - protein, 18 aa, Staphylococcus epidermidis
HEAMKEYGLSNIIVHAPY

SEQ ID NO: 1806190 - protein, 17 aa, Staphylococcus epidermidis
HEDIIVITFNYRLGALG

SEQ ID NO: 1806191 - protein, 23 aa, Staphylococcus epidermidis
HEEIQKSFDLFSMLEDVEKHLEV

SEQ ID NO: 1806192 - protein, 17 aa, Staphylococcus epidermidis
HEEKFYKYCQESEKSLE

SEQ ID NO: 1806193 - protein, 26 aa, Staphylococcus epidermidis
HEIKVEIRLDAVYIYEEIIPGSGGLP

SEQ ID NO: 1806194 - protein, 22 aa, Staphylococcus epidermidis
HEISIYPFLCYLDKELVAIGYL

SEQ ID NO: 1806195 - protein, 21 aa, Staphylococcus epidermidis
HEKWVCSVCAQGENPWLHSND

SEQ ID NO: 1806196 - protein, 18 aa, Staphylococcus epidermidis
HELCHYFLHLAGEGYQHR

SEQ ID NO: 1806197 - protein, 20 aa, Staphylococcus epidermidis
HELCHYFLHLAGRGYQHRDR

SEQ ID NO: 1806198 - protein, 26 aa, Staphylococcus epidermidis
HESKGKMAFRVYPTWEKDLNRVAQKT

SEQ ID NO: 1806199 - protein, 22 aa, Staphylococcus epidermidis
HESLLRALKDNGLEEIQAEGQE

SEQ ID NO: 1806200 - protein, 25 aa, Staphylococcus epidermidis
HETWAPKLAMRLVLGEMSTVVLDTQ

SEQ ID NO: 1806201 - protein, 20 aa, Staphylococcus epidermidis
HETWAPKLILRTVLGQMSTV

SEQ ID NO: 1806202 - protein, 26 aa, Staphylococcus epidermidis
HEVAKADSVAICWAMGITQQDIGSDS

SEQ ID NO: 1806203 - protein, 26 aa, Staphylococcus epidermidis
HEVAKAESVAICWAMGITQQDIGSDS

SEQ ID NO: 1806204 - protein, 22 aa, Staphylococcus epidermidis
HEVLKYIDFNAGKIAKQLLNIC

SEQ ID NO: 1806205 - protein, 23 aa, Staphylococcus epidermidis
HEVLKYIDFNAGKIAKQLLNICE

SEQ ID NO: 1806206 - protein, 36 aa, Staphylococcus epidermidis
HEWNLKLGELAMIWREGCIIRAQFLQKIKDAYDNNS

SEQ ID NO: 1806207 - protein, 17 aa, Staphylococcus epidermidis
HEYKKKAKVLSELDQQI

SEQ ID NO: 1806208 - protein, 24 aa, Staphylococcus epidermidis
HFDGSDIIFEFNIGTVPMREIKTE

SEQ ID NO: 1806209 - protein, 19 aa, Staphylococcus epidermidis
HFDNEIGFYNVLRHSSSTY

SEQ ID NO: 1806210 - protein, 24 aa, Staphylococcus epidermidis
HFDVKKFFRKGILRSIKDTFIGDI

SEQ ID NO: 1806211 - protein, 17 aa, Staphylococcus epidermidis
HFEDIVAVTSLYRPGPM

SEQ ID NO: 1806212 - protein, 23 aa, Staphylococcus epidermidis
HFEKGMDCRLGISQLPTHGLAIR

SEQ ID NO: 1806213 - protein, 21 aa, Staphylococcus epidermidis
HFEKRYAKRSQLREFNVEEMN

SEQ ID NO: 1806214 - protein, 27 aa, Staphylococcus epidermidis
HFGVSGPAALRCSQFVYKEQKNQKKQD

SEQ ID NO: 1806215 - protein, 27 aa, Staphylococcus epidermidis
HFIEHCINLKWIGWFATGVNNLPLNYI

SEQ ID NO: 1806216 - protein, 19 aa, Staphylococcus epidermidis
HFITYTITTVWGLGYKFER

SEQ ID NO: 1806217 - protein, 32 aa, Staphylococcus epidermidis
HFKTDNRGLFAFSIESMSQFGMYFTKMNLNLH

SEQ ID NO: 1806218 - protein, 32 aa, Staphylococcus epidermidis
HFKTDNRGLFAFSLESMSQFGMYFTKMNLNLH

SEQ ID NO: 1806219 - protein, 33 aa, Staphylococcus epidermidis
HFKTTGNAIAMAWYRYPRGFKFYRNTRNFVPKP

SEQ ID NO: 1806220 - protein, 17 aa, Staphylococcus epidermidis
HFKVLSADSEYESYMPI

SEQ ID NO: 1806221 - protein, 17 aa, Staphylococcus epidermidis
HFLSFIKGLIRHFTANE

SEQ ID NO: 1806222 - protein, 24 aa, Staphylococcus epidermidis
HFNYFKDYFLTDGGVKNWEQISEK

SEQ ID NO: 1806223 - protein, 23 aa, Staphylococcus epidermidis
HFPCLNCTKSIIQAGIKTIYYAE

SEQ ID NO: 1806224 - protein, 20 aa, Staphylococcus epidermidis
HFSSRIKGGHTNNKIRVSTS

SEQ ID NO: 1806225 - protein, 18 aa, Staphylococcus epidermidis
HFSYKRYLENQIRDAFGF

SEQ ID NO: 1806226 - protein, 24 aa, Staphylococcus epidermidis
HFTLELVQRCNFVTAIEIDHKLCK

SEQ ID NO: 1806227 - protein, 21 aa, Staphylococcus epidermidis
HFWQHHKHLYALRNDFTDQLF

SEQ ID NO: 1806228 - protein, 21 aa, Staphylococcus epidermidis
HFYDMSVGICHNGNLINAQSL

SEQ ID NO: 1806229 - protein, 20 aa, Staphylococcus epidermidis
HGADTLRLYEMFMGPLDAAI

SEQ ID NO: 1806230 - protein, 21 aa, Staphylococcus epidermidis
HGAEAVCHFCGNKYQYSEGEL

SEQ ID NO: 1806231 - protein, 19 aa, Staphylococcus epidermidis
HGAFEIINTGILKGAKAVL

SEQ ID NO: 1806232 - protein, 20 aa, Staphylococcus epidermidis
HGAFGCLAVGIGSSQVEHVL

SEQ ID NO: 1806233 - protein, 20 aa, Staphylococcus epidermidis
HGAGSPCGKALGSLPTTTLG

SEQ ID NO: 1806234 - protein, 18 aa, Staphylococcus epidermidis
HGAKAFLKAYAKVDDQLA

SEQ ID NO: 1806235 - protein, 19 aa, Staphylococcus epidermidis
HGAMHACGHDIHMASILAT

SEQ ID NO: 1806236 - protein, 20 aa, Staphylococcus epidermidis
HGDSELAVWSQANVAGISVF

SEQ ID NO: 1806237 - protein, 19 aa, Staphylococcus epidermidis
HGDVFKLNGKKGHKKVSRL

SEQ ID NO: 1806238 - protein, 27 aa, Staphylococcus epidermidis
HGEDIPQHILLRFIFVCQQAECSDDIL

SEQ ID NO: 1806239 - protein, 19 aa, Staphylococcus epidermidis
HGKGVIKTELAFMPDFSQI

SEQ ID NO: 1806240 - protein, 17 aa, Staphylococcus epidermidis
HGKYSFDTFSHMKSYTF

SEQ ID NO: 1806241 - protein, 21 aa, Staphylococcus epidermidis
HGLHFKGGETVQSLSGNQNGE

SEQ ID NO: 1806242 - protein, 19 aa, Staphylococcus epidermidis
HGMPQKSYSWGWGNASRSQ

SEQ ID NO: 1806243 - protein, 25 aa, Staphylococcus epidermidis
HGNELPISAGYFVINPFEVVYYAGG

SEQ ID NO: 1806244 - protein, 22 aa, Staphylococcus epidermidis
HGNETLSGLLLESTSAGIQDET

SEQ ID NO: 1806245 - protein, 25 aa, Staphylococcus epidermidis
HGQSEPRAFLNPKLQRNEERSKASK

SEQ ID NO: 1806246 - protein, 25 aa, Staphylococcus epidermidis
HGRDRTGVCSVQFAERIQEGDTVPI

SEQ ID NO: 1806247 - protein, 25 aa, Staphylococcus epidermidis
HGRQRARVALDLFASKIHKYIGSYA

SEQ ID NO: 1806248 - protein, 17 aa, Staphylococcus epidermidis
HGTEIYFKDDAYKLAIG

SEQ ID NO: 1806249 - protein, 17 aa, Staphylococcus epidermidis
HGTTEPKKAIQLMHQLF

SEQ ID NO: 1806250 - protein, 18 aa, Staphylococcus epidermidis
HHEFKSNQSIMVALYVVS

SEQ ID NO: 1806251 - protein, 21 aa, Staphylococcus epidermidis
HHIEGFFSIAGFKEDAQDIDE

SEQ ID NO: 1806252 - protein, 21 aa, Staphylococcus epidermidis
HHIEGLFSIAGFKEDAHDIDE

SEQ ID NO: 1806253 - protein, 18 aa, Staphylococcus epidermidis
HHIVRQGLEFLLSTVEDL

SEQ ID NO: 1806254 - protein, 21 aa, Staphylococcus epidermidis
HHKEDRFVFIGRLGKQKQVDH

SEQ ID NO: 1806255 - protein, 20 aa, Staphylococcus epidermidis
HHKLKAGAFTKQYGDKVSPI

SEQ ID NO: 1806256 - protein, 18 aa, Staphylococcus epidermidis
HHLASAIEIYSMYTRTDI

SEQ ID NO: 1806257 - protein, 17 aa, Staphylococcus epidermidis
HHLDIGFDLNYLYPDAK

SEQ ID NO: 1806258 - protein, 17 aa, Staphylococcus epidermidis
HHMDCYRLEDQEEDLGF

SEQ ID NO: 1806259 - protein, 18 aa, Staphylococcus epidermidis
HHMQRSFSHIELPEQAYL

SEQ ID NO: 1806260 - protein, 21 aa, Staphylococcus epidermidis
HHSPEIFVEFDASSKGLEILL

SEQ ID NO: 1806261 - protein, 18 aa, Staphylococcus epidermidis
HHSVKIISLIAMTASDAR

SEQ ID NO: 1806262 - protein, 24 aa, Staphylococcus epidermidis
HHYLWRFAKEMPKSGHVEIFDRSW

SEQ ID NO: 1806263 - protein, 23 aa, Staphylococcus epidermidis
HIGEVNGTISIGCSSLIGQTLLP

SEQ ID NO: 1806264 - protein, 20 aa, Staphylococcus epidermidis
HIGKFSLRGGIIDIYPLIGT

SEQ ID NO: 1806265 - protein, 20 aa, Staphylococcus epidermidis
HIGKIDAAIFNLGYLPKGNK

SEQ ID NO: 1806266 - protein, 17 aa, Staphylococcus epidermidis
HIKEPKCNVKNQVEEGN

SEQ ID NO: 1806267 - protein, 25 aa, Staphylococcus epidermidis
HIKKGLELLRSLLLNSQMTVDEWLD

SEQ ID NO: 1806268 - protein, 17 aa, Staphylococcus epidermidis
HIKLQIVNLLTLSETAK

SEQ ID NO: 1806269 - protein, 19 aa, Staphylococcus epidermidis
HIMTLDMAKEISMIQRSEI

SEQ ID NO: 1806270 - protein, 21 aa, Staphylococcus epidermidis
HIPEDAFRLLGSMEDVIEKAK

SEQ ID NO: 1806271 - protein, 17 aa, Staphylococcus epidermidis
HIPFCVRICTYCDFNKY

SEQ ID NO: 1806272 - protein, 18 aa, Staphylococcus epidermidis
HIPVKYVGLGEKLDDLQP

SEQ ID NO: 1806273 - protein, 25 aa, Staphylococcus epidermidis
HIRYCEKCGQILRPDIVLYGEMLNQ

SEQ ID NO: 1806274 - protein, 22 aa, Staphylococcus epidermidis
HISEFKYPLYMDFLGTKGKLEF

SEQ ID NO: 1806275 - protein, 17 aa, Staphylococcus epidermidis
HKAEFELIVMKKLGREF

SEQ ID NO: 1806276 - protein, 24 aa, Staphylococcus epidermidis
HKAFKKLKYVPVHHYNQYLNGELS

SEQ ID NO: 1806277 - protein, 21 aa, Staphylococcus epidermidis
HKAILDKGFKIDIITDQTSAH

SEQ ID NO: 1806278 - protein, 26 aa, Staphylococcus epidermidis
HKDIARFRREMMGFVFQDFNVLNTMS

SEQ ID NO: 1806279 - protein, 21 aa, Staphylococcus epidermidis
HKDIVFSPELISWIEQRSLDI

SEQ ID NO: 1806280 - protein, 17 aa, Staphylococcus epidermidis
HKEFIELTGDEMTPYAT

SEQ ID NO: 1806281 - protein, 32 aa, Staphylococcus epidermidis
HKEGCAYVKDHAMFKCDQRFDIVIASNSGYPL

SEQ ID NO: 1806282 - protein, 21 aa, Staphylococcus epidermidis
HKEGKWTGMCGEMAGDETAIP

SEQ ID NO: 1806283 - protein, 19 aa, Staphylococcus epidermidis
HKEQLKDSGIRVLTASNLV

SEQ ID NO: 1806284 - protein, 19 aa, Staphylococcus epidermidis
HKEYRRFLHKWVVDSKETL

SEQ ID NO: 1806285 - protein, 19 aa, Staphylococcus epidermidis
HKEYWHFSEYLAYQTKQKE

SEQ ID NO: 1806286 - protein, 23 aa, Staphylococcus epidermidis
HKFEVETIFDLALFTILKGHVAV

SEQ ID NO: 1806287 - protein, 23 aa, Staphylococcus epidermidis
HKFGGPKGAGILLVKENTPIEFN

SEQ ID NO: 1806288 - protein, 17 aa, Staphylococcus epidermidis
HKFLLNNRIEVSVDEYE

SEQ ID NO: 1806289 - protein, 24 aa, Staphylococcus epidermidis
HKFSKAAPLSAVFQAQHLIDIDWI

SEQ ID NO: 1806290 - protein, 24 aa, Staphylococcus epidermidis
HKGSMPMELFLRLKKHEQTGRLQL

SEQ ID NO: 1806291 - protein, 23 aa, Staphylococcus epidermidis
HKHGKELLVDMIAVQDLEKRAKE

SEQ ID NO: 1806292 - protein, 25 aa, Staphylococcus epidermidis
HKIANWKGLDNVIGVNAIKDNANLV

SEQ ID NO: 1806293 - protein, 21 aa, Staphylococcus epidermidis
HKIGKGPVLILIPGANGTGDI

SEQ ID NO: 1806294 - protein, 22 aa, Staphylococcus epidermidis
HKIQLHPAVCFTMLGHDLGVNV

SEQ ID NO: 1806295 - protein, 24 aa, Staphylococcus epidermidis
HKITFNISYLLNVFEYLKDDVKTQ

SEQ ID NO: 1806296 - protein, 19 aa, Staphylococcus epidermidis
HKKNIDVFLGIPYAKPFNK

SEQ ID NO: 1806297 - protein, 22 aa, Staphylococcus epidermidis
HKLKSDFIDKICLDSLENLCNS

SEQ ID NO: 1806298 - protein, 17 aa, Staphylococcus epidermidis
HKLYYPKELILNIDNLE

SEQ ID NO: 1806299 - protein, 19 aa, Staphylococcus epidermidis
HKQDVINDIHLIRANNHLI

SEQ ID NO: 1806300 - protein, 25 aa, Staphylococcus epidermidis
HKQKYRALNNISFSVEKGEFVAVMG

SEQ ID NO: 1806301 - protein, 19 aa, Staphylococcus epidermidis
HKQMKAEAQAEGFNKMKFA

SEQ ID NO: 1806302 - protein, 20 aa, Staphylococcus epidermidis
HKQTFLLGGGHDIAYAQYLA

SEQ ID NO: 1806303 - protein, 23 aa, Staphylococcus epidermidis
HKRTKFLPELQFAILDEVDSIIL

SEQ ID NO: 1806304 - protein, 24 aa, Staphylococcus epidermidis
HKRWSRAEMGQFIMGGQRYNDENG

SEQ ID NO: 1806305 - protein, 17 aa, Staphylococcus epidermidis
HKSERHLGYAIKKEIIE

SEQ ID NO: 1806306 - protein, 25 aa, Staphylococcus epidermidis
HKTLRGPRGGMILCKEEYKKDIDKT

SEQ ID NO: 1806307 - protein, 19 aa, Staphylococcus epidermidis
HKTVRFKLNKSVKDKLKAE

SEQ ID NO: 1806308 - protein, 19 aa, Staphylococcus epidermidis
HKYKVQKSILKDRNSYSKT

SEQ ID NO: 1806309 - protein, 18 aa, Staphylococcus epidermidis
HLATLKVIGVGGGGNNAV

SEQ ID NO: 1806310 - protein, 23 aa, Staphylococcus epidermidis
HLDIPAGAAVRFEPGDEKEIQLV

SEQ ID NO: 1806311 - protein, 17 aa, Staphylococcus epidermidis
HLDRGYVNLHGKLKDLG

SEQ ID NO: 1806312 - protein, 18 aa, Staphylococcus epidermidis
HLEFYKLMFNIGKDSNLH

SEQ ID NO: 1806313 - protein, 24 aa, Staphylococcus epidermidis
HLEQSRLTQYVGHLNVVLFAPEDL

SEQ ID NO: 1806314 - protein, 19 aa, Staphylococcus epidermidis
HLESIELENIIDIQLNVGS

SEQ ID NO: 1806315 - protein, 21 aa, Staphylococcus epidermidis
HLEYIMKWCLQELENNFNYEE

SEQ ID NO: 1806316 - protein, 17 aa, Staphylococcus epidermidis
HLGFQFDHLLWKQFIHN

SEQ ID NO: 1806317 - protein, 18 aa, Staphylococcus epidermidis
HLHQYPELSLHEFETTKY

SEQ ID NO: 1806318 - protein, 24 aa, Staphylococcus epidermidis
HLHYEMNKHGFGSMTGHSIDPVKW

SEQ ID NO: 1806319 - protein, 19 aa, Staphylococcus epidermidis
HLKLLRQSFNLKILSQHIN

SEQ ID NO: 1806320 - protein, 19 aa, Staphylococcus epidermidis
HLKTLPVRFKQSVSNAERL

SEQ ID NO: 1806321 - protein, 19 aa, Staphylococcus epidermidis
HLKYLQAKRTYLMDQFLSE

SEQ ID NO: 1806322 - protein, 27 aa, Staphylococcus epidermidis
HLLARAVGRDVGRIMGFDETTLNEISK

SEQ ID NO: 1806323 - protein, 20 aa, Staphylococcus epidermidis
HLLIQWYSKGIYKFRYNVIE

SEQ ID NO: 1806324 - protein, 22 aa, Staphylococcus epidermidis
HLLNHSYDWLIFSSKNAVKYFY

SEQ ID NO: 1806325 - protein, 18 aa, Staphylococcus epidermidis
HLLRCHVNDYIVYSYALL

SEQ ID NO: 1806326 - protein, 25 aa, Staphylococcus epidermidis
HLMNLKELFLVQLQERAIPFELNGS

SEQ ID NO: 1806327 - protein, 24 aa, Staphylococcus epidermidis
HLMNLKELFLVSLQERAIPFELNG

SEQ ID NO: 1806328 - protein, 18 aa, Staphylococcus epidermidis
HLNSLNAPQRETVKTNIN

SEQ ID NO: 1806329 - protein, 17 aa, Staphylococcus epidermidis
HLPESLIAQTPLKNRDQ

SEQ ID NO: 1806330 - protein, 25 aa, Staphylococcus epidermidis
HLPFVHSKGGIYIWLHTPPGYDSEA

SEQ ID NO: 1806331 - protein, 18 aa, Staphylococcus epidermidis
HLPLGGVIYTDISKDGKL

SEQ ID NO: 1806332 - protein, 18 aa, Staphylococcus epidermidis
HLPNDIMGAIDVIIDGHT

SEQ ID NO: 1806333 - protein, 26 aa, Staphylococcus epidermidis
HLRYIRKEVGVVFQFPESQLFEDSVE

SEQ ID NO: 1806334 - protein, 22 aa, Staphylococcus epidermidis
HLSKNIGWFLVERIMSRAKFSF

SEQ ID NO: 1806335 - protein, 21 aa, Staphylococcus epidermidis
HLSNLYGAYINSFVTKFKDKH

SEQ ID NO: 1806336 - protein, 23 aa, Staphylococcus epidermidis
HLSYLCLVENDLTYFNPQKLETI

SEQ ID NO: 1806337 - protein, 23 aa, Staphylococcus epidermidis
HLTLTCYAYIPSSSKGKLTGNIY

SEQ ID NO: 1806338 - protein, 17 aa, Staphylococcus epidermidis
HLVNLCKINDIPYKIDI

SEQ ID NO: 1806339 - protein, 20 aa, Staphylococcus epidermidis
HMAMFEFKQNVQLFGKSIIL

SEQ ID NO: 1806340 - protein, 17 aa, Staphylococcus epidermidis
HMASLRKKLNYSENIDG

SEQ ID NO: 1806341 - protein, 26 aa, Staphylococcus epidermidis
HMDESAPHMHLHFIPVNHQGRLSART

SEQ ID NO: 1806342 - protein, 17 aa, Staphylococcus epidermidis
HMIDLDFNKMIDGIESV

SEQ ID NO: 1806343 - protein, 24 aa, Staphylococcus epidermidis
HMIIFKPSQPITWKQHKVKLVFFL

SEQ ID NO: 1806344 - protein, 19 aa, Staphylococcus epidermidis
HMVIYTFNEPQNWDSDFNI

SEQ ID NO: 1806345 - protein, 17 aa, Staphylococcus epidermidis
HNFASGLSYHVLTMLRI

SEQ ID NO: 1806346 - protein, 19 aa, Staphylococcus epidermidis
HNFASGLSYHVLTMLRIAK

SEQ ID NO: 1806347 - protein, 20 aa, Staphylococcus epidermidis
HNFASGLSYHVLTMLRVAKS

SEQ ID NO: 1806348 - protein, 25 aa, Staphylococcus epidermidis
HNGKRSVARYIFFEKALKVIRPVYL

SEQ ID NO: 1806349 - protein, 33 aa, Staphylococcus epidermidis
HNHIPPWILIIPLNFGETIKWFSILKPKDKQSV

SEQ ID NO: 1806350 - protein, 17 aa, Staphylococcus epidermidis
HNIDPTFQIGKGGINEN

SEQ ID NO: 1806351 - protein, 18 aa, Staphylococcus epidermidis
HNITGIPLNTLWYQKDRG

SEQ ID NO: 1806352 - protein, 22 aa, Staphylococcus epidermidis
HNLDMLAGGYAHNIGGLGDTKI

SEQ ID NO: 1806353 - protein, 19 aa, Staphylococcus epidermidis
HNLESAYDFYVEKLGFEHI

SEQ ID NO: 1806354 - protein, 26 aa, Staphylococcus epidermidis
HNPANLIGIRAFKKLLPNIPHVAVFD

SEQ ID NO: 1806355 - protein, 18 aa, Staphylococcus epidermidis
HNTFNLKSGSSMFYTDIL

SEQ ID NO: 1806356 - protein, 19 aa, Staphylococcus epidermidis
HNVTRFLIVKNHTHFDKNA

SEQ ID NO: 1806357 - protein, 20 aa, Staphylococcus epidermidis
HNWGNYKLVFNTRHNANIQT

SEQ ID NO: 1806358 - protein, 27 aa, Staphylococcus epidermidis
HPDGIYLSGALLMFAGNKSYYLYGASS

SEQ ID NO: 1806359 - protein, 24 aa, Staphylococcus epidermidis
HPEFSYPFQYLCGAGVAYKLAQAL

SEQ ID NO: 1806360 - protein, 20 aa, Staphylococcus epidermidis
HPGKLVDKVMDFMKVNFGQG

SEQ ID NO: 1806361 - protein, 18 aa, Staphylococcus epidermidis
HPGKTIAIRADFDALPIK

SEQ ID NO: 1806362 - protein, 17 aa, Staphylococcus epidermidis
HPIEIVGVDIVREDDGL

SEQ ID NO: 1806363 - protein, 18 aa, Staphylococcus epidermidis
HPNKRRISNTGQRAITHI

SEQ ID NO: 1806364 - protein, 17 aa, Staphylococcus epidermidis
HPNVYEMSSSNRVNKAE

SEQ ID NO: 1806365 - protein, 26 aa, Staphylococcus epidermidis
HPREIKNKIGFVYSEIYFNQKWTVKK

SEQ ID NO: 1806366 - protein, 20 aa, Staphylococcus epidermidis
HPRFIEKAIHELTLEKSPNL

SEQ ID NO: 1806367 - protein, 19 aa, Staphylococcus epidermidis
HPSLSEVLMELGLKVEDRA

SEQ ID NO: 1806368 - protein, 17 aa, Staphylococcus epidermidis
HPYQFELNKDFNFSAAH

SEQ ID NO: 1806369 - protein, 33 aa, Staphylococcus epidermidis
HPYQFELNKDFNFSAAHYIPSEDAGKCMRTHGH

SEQ ID NO: 1806370 - protein, 20 aa, Staphylococcus epidermidis
HPYRVKLALNQARNYQLNDL

SEQ ID NO: 1806371 - protein, 25 aa, Staphylococcus epidermidis
HQHIPEIIQALKIFNPNIQNIQFST

SEQ ID NO: 1806372 - protein, 20 aa, Staphylococcus epidermidis
HQHLPGWGLDALKFLIEERG

SEQ ID NO: 1806373 - protein, 22 aa, Staphylococcus epidermidis
HQIIDFYPDFSLENEQTRMDII

SEQ ID NO: 1806374 - protein, 17 aa, Staphylococcus epidermidis
HQLFSKIEWIIVSLGAN

SEQ ID NO: 1806375 - protein, 18 aa, Staphylococcus epidermidis
HQLGKVKSKLLVKSKKHL

SEQ ID NO: 1806376 - protein, 26 aa, Staphylococcus epidermidis
HQLVIKYSSAWSFLVPEILQIDESTI

SEQ ID NO: 1806377 - protein, 23 aa, Staphylococcus epidermidis
HQRIIKIPVLYGNDYGPDLEEVA

SEQ ID NO: 1806378 - protein, 20 aa, Staphylococcus epidermidis
HQRLYRAIAGVGAYENNQLM

SEQ ID NO: 1806379 - protein, 18 aa, Staphylococcus epidermidis
HQRRIPFTRVPFNDHDSI

SEQ ID NO: 1806380 - protein, 18 aa, Staphylococcus epidermidis
HQVQGLGPVIIKVNELSV

SEQ ID NO: 1806381 - protein, 24 aa, Staphylococcus epidermidis
HQVVIRCIFVYLGQLTKEEALELN

SEQ ID NO: 1806382 - protein, 17 aa, Staphylococcus epidermidis
HQYQDVFSKYKDKRKEL

SEQ ID NO: 1806383 - protein, 18 aa, Staphylococcus epidermidis
HRAIRLSDRKHLKHIRYQ

SEQ ID NO: 1806384 - protein, 24 aa, Staphylococcus epidermidis
HRAQRQGFPEVIFGEGKTKEQIHQ

SEQ ID NO: 1806385 - protein, 19 aa, Staphylococcus epidermidis
HRDPFKSGLETFIDNDLDL

SEQ ID NO: 1806386 - protein, 17 aa, Staphylococcus epidermidis
HRELKSKKFQIAVNEEF

SEQ ID NO: 1806387 - protein, 25 aa, Staphylococcus epidermidis
HRFEDCPNFVKGHVPELYIENDRIK

SEQ ID NO: 1806388 - protein, 18 aa, Staphylococcus epidermidis
HRHLLKGNVVFIFQYGEE

SEQ ID NO: 1806389 - protein, 22 aa, Staphylococcus epidermidis
HRHPLPIPKFKYFKLKSTRKQN

SEQ ID NO: 1806390 - protein, 21 aa, Staphylococcus epidermidis
HRKDGYFYKSYKEWEDEIYLS

SEQ ID NO: 1806391 - protein, 27 aa, Staphylococcus epidermidis
HRLNHQITKIGVFGTFSAGKSSLINAL

SEQ ID NO: 1806392 - protein, 19 aa, Staphylococcus epidermidis
HRNAFDLTIAVLLSAQCTD

SEQ ID NO: 1806393 - protein, 22 aa, Staphylococcus epidermidis
HRNELWFDMSKKLEGLPRHTST

SEQ ID NO: 1806394 - protein, 19 aa, Staphylococcus epidermidis
HRNGHKSAVIWFTGLSGSG

SEQ ID NO: 1806395 - protein, 21 aa, Staphylococcus epidermidis
HRNKKFILLTAHRRENIGQPM

SEQ ID NO: 1806396 - protein, 20 aa, Staphylococcus epidermidis
HRNNLVVPPGAWGDWINGGG

SEQ ID NO: 1806397 - protein, 19 aa, Staphylococcus epidermidis
HRQFKTIGIMLFQQNKQFI

SEQ ID NO: 1806398 - protein, 19 aa, Staphylococcus epidermidis
HRQFKTIGVMLFQPDKQFI

SEQ ID NO: 1806399 - protein, 27 aa, Staphylococcus epidermidis
HRSSFKASEVPSAIFGTKKRRPIENGV

SEQ ID NO: 1806400 - protein, 20 aa, Staphylococcus epidermidis
HRVLEELSFGGGAINDTLMH

SEQ ID NO: 1806401 - protein, 19 aa, Staphylococcus epidermidis
HRVTYWVKLSRDIELHRLM

SEQ ID NO: 1806402 - protein, 20 aa, Staphylococcus epidermidis
HSDLKYNNLQAIIQAIEDVY

SEQ ID NO: 1806403 - protein, 20 aa, Staphylococcus epidermidis
HSFDAFKNWFNDHTEFNTYE

SEQ ID NO: 1806404 - protein, 19 aa, Staphylococcus epidermidis
HSFPTPPVKPVVMAFTKSY

SEQ ID NO: 1806405 - protein, 21 aa, Staphylococcus epidermidis
HSGLTALFWNHGHLASELEAG

SEQ ID NO: 1806406 - protein, 20 aa, Staphylococcus epidermidis
HSIDPVKWLKTHNGSKGGGS

SEQ ID NO: 1806407 - protein, 19 aa, Staphylococcus epidermidis
HSITELFPTEVPITSNEPF

SEQ ID NO: 1806408 - protein, 28 aa, Staphylococcus epidermidis
HSKEGVQLLWASCREVYNVIQADEIGAD

SEQ ID NO: 1806409 - protein, 21 aa, Staphylococcus epidermidis
HSYHLKPRILITKHDIASEQE

SEQ ID NO: 1806410 - protein, 17 aa, Staphylococcus epidermidis
HSYNLIVSDKHCMYTRS

SEQ ID NO: 1806411 - protein, 23 aa, Staphylococcus epidermidis
HTELKRTLCVVMRKDNKKNDINV

SEQ ID NO: 1806412 - protein, 24 aa, Staphylococcus epidermidis
HTELKRTMCAISKYDNKKTDIDLM

SEQ ID NO: 1806413 - protein, 20 aa, Staphylococcus epidermidis
HTFSRTQAFLNEFAESLNKA

SEQ ID NO: 1806414 - protein, 22 aa, Staphylococcus epidermidis
HTFSRTQAFLNEFAESLSKADQ

SEQ ID NO: 1806415 - protein, 28 aa, Staphylococcus epidermidis
HTLLTIGRYPICYINIQMDPILVDVNVH

SEQ ID NO: 1806416 - protein, 17 aa, Staphylococcus epidermidis
HTNIALIKYWGKADEAY

SEQ ID NO: 1806417 - protein, 18 aa, Staphylococcus epidermidis
HTNIALIKYWGKADETYI

SEQ ID NO: 1806418 - protein, 20 aa, Staphylococcus epidermidis
HTNKALAIYMIHPEKAHEIK

SEQ ID NO: 1806419 - protein, 26 aa, Staphylococcus epidermidis
HTPGHPPESISFLLTDEGGGSSIPMG

SEQ ID NO: 1806420 - protein, 22 aa, Staphylococcus epidermidis
HTPHKWLARFDWCRPNSTHFKT

SEQ ID NO: 1806421 - protein, 26 aa, Staphylococcus epidermidis
HTVTRLKGGDPFVFGRGGEEAEELAC

SEQ ID NO: 1806422 - protein, 21 aa, Staphylococcus epidermidis
HTVVLRFTKRQDLNRKRVKAY

SEQ ID NO: 1806423 - protein, 17 aa, Staphylococcus epidermidis
HTYYGISGFVRPPYHAE

SEQ ID NO: 1806424 - protein, 20 aa, Staphylococcus epidermidis
HVACALSGKAANVLSQNGLK

SEQ ID NO: 1806425 - protein, 21 aa, Staphylococcus epidermidis
HVEIFDRSWYGRVLVERVEGF

SEQ ID NO: 1806426 - protein, 23 aa, Staphylococcus epidermidis
HVFEIKNGMYAGLFFNVKNVAPA

SEQ ID NO: 1806427 - protein, 19 aa, Staphylococcus epidermidis
HVFMLPKDYLRYCLTDQIH

SEQ ID NO: 1806428 - protein, 23 aa, Staphylococcus epidermidis
HVHEPRIKFENWSKIDEEKLDKE

SEQ ID NO: 1806429 - protein, 18 aa, Staphylococcus epidermidis
HVLVKFEEEIHCEIVNKD

SEQ ID NO: 1806430 - protein, 27 aa, Staphylococcus epidermidis
HVRSGMGGFKGRALKKYDVIATQVNHN

SEQ ID NO: 1806431 - protein, 27 aa, Staphylococcus epidermidis
HVSVFRGKFICPRCGGTLTMNTATRKR

SEQ ID NO: 1806432 - protein, 20 aa, Staphylococcus epidermidis
HVVNWFVEMREIYNIEIIVA

SEQ ID NO: 1806433 - protein, 19 aa, Staphylococcus epidermidis
HWDNYKIKYLRPIDIHDDI

SEQ ID NO: 1806434 - protein, 18 aa, Staphylococcus epidermidis
HYDKLGGLVLPQSEQYEI

SEQ ID NO: 1806435 - protein, 24 aa, Staphylococcus epidermidis
HYDKLPDRLVTVFAGQDKEATQQA

SEQ ID NO: 1806436 - protein, 18 aa, Staphylococcus epidermidis
HYEHLLTEYGVWHPKAWD

SEQ ID NO: 1806437 - protein, 18 aa, Staphylococcus epidermidis
HYFYEVGEQVVGYLKLNI

SEQ ID NO: 1806438 - protein, 17 aa, Staphylococcus epidermidis
HYINVNIGRDFDVTEYG

SEQ ID NO: 1806439 - protein, 27 aa, Staphylococcus epidermidis
HYKAEGQNGFNCAYKIIQHQDYKEVIL

SEQ ID NO: 1806440 - protein, 20 aa, Staphylococcus epidermidis
HYPLTHYVFMNELKINLLDF

SEQ ID NO: 1806441 - protein, 17 aa, Staphylococcus epidermidis
HYQPQVDTFKRMLTHID

SEQ ID NO: 1806442 - protein, 18 aa, Staphylococcus epidermidis
HYQPQVDTFKRMLTHIDS

SEQ ID NO: 1806443 - protein, 20 aa, Staphylococcus epidermidis
IAAEIRLGIVSGAITTDTLL

SEQ ID NO: 1806444 - protein, 20 aa, Staphylococcus epidermidis
IAAKAAGASKIFVFDLSEER

SEQ ID NO: 1806445 - protein, 26 aa, Staphylococcus epidermidis
IAALKLKLSPNEVWNAVTVNAAKAID

SEQ ID NO: 1806446 - protein, 17 aa, Staphylococcus epidermidis
IAANWEGQAFSRFEEQF

SEQ ID NO: 1806447 - protein, 20 aa, Staphylococcus epidermidis
IAAQILKYFNIEKIKLLSNN

SEQ ID NO: 1806448 - protein, 21 aa, Staphylococcus epidermidis
IAARARGRYGGRPEKLNKQDL

SEQ ID NO: 1806449 - protein, 22 aa, Staphylococcus epidermidis
IAARARGRYGGRPEKLNKQDLN

SEQ ID NO: 1806450 - protein, 22 aa, Staphylococcus epidermidis
IAARARGRYGGRPEKLNKQDLT

SEQ ID NO: 1806451 - protein, 19 aa, Staphylococcus epidermidis
IADEYLDVFQIGARNMQNF

SEQ ID NO: 1806452 - protein, 17 aa, Staphylococcus epidermidis
IADILALTVSEAIAQFD

SEQ ID NO: 1806453 - protein, 26 aa, Staphylococcus epidermidis
IADLEHGKHGFAFGSGMAAISAVIML

SEQ ID NO: 1806454 - protein, 18 aa, Staphylococcus epidermidis
IADSDWKGETRSKSDEHK

SEQ ID NO: 1806455 - protein, 23 aa, Staphylococcus epidermidis
IADVPVVAGFGIRNEKHVKDIGE

SEQ ID NO: 1806456 - protein, 25 aa, Staphylococcus epidermidis
IAEELREILASLGLETVEDLVGRTD

SEQ ID NO: 1806457 - protein, 20 aa, Staphylococcus epidermidis
IAEELVIIEKPMRAFSENSN

SEQ ID NO: 1806458 - protein, 26 aa, Staphylococcus epidermidis
IAEFILKTYIEIHWPTLIIEKDGKPY

SEQ ID NO: 1806459 - protein, 19 aa, Staphylococcus epidermidis
IAEGVAFANRYGAKIYVTT

SEQ ID NO: 1806460 - protein, 23 aa, Staphylococcus epidermidis
IAEIPLTREEYRLEKNEQKRCEK

SEQ ID NO: 1806461 - protein, 23 aa, Staphylococcus epidermidis
IAEIPLTREEYRLEQNERKRCEK

SEQ ID NO: 1806462 - protein, 26 aa, Staphylococcus epidermidis
IAEKHPKLGGQIIFGANLQIGYYDQK

SEQ ID NO: 1806463 - protein, 25 aa, Staphylococcus epidermidis
IAELNIKLHLPIIIISGNHDGKERL

SEQ ID NO: 1806464 - protein, 21 aa, Staphylococcus epidermidis
IAELNSFWVYQDLNKKNRFKV

SEQ ID NO: 1806465 - protein, 22 aa, Staphylococcus epidermidis
IAEPTKSMIFYAHKGSMDCKVS

SEQ ID NO: 1806466 - protein, 18 aa, Staphylococcus epidermidis
IAEVKANIDGFTKDTKGY

SEQ ID NO: 1806467 - protein, 17 aa, Staphylococcus epidermidis
IAFADSRIRKETIAAED

SEQ ID NO: 1806468 - protein, 20 aa, Staphylococcus epidermidis
IAFDEAHCISKWGHDFRPSY

SEQ ID NO: 1806469 - protein, 17 aa, Staphylococcus epidermidis
IAGEGAYVNQSPLLPPP

SEQ ID NO: 1806470 - protein, 18 aa, Staphylococcus epidermidis
IAGERGSGKICLNGAASR

SEQ ID NO: 1806471 - protein, 18 aa, Staphylococcus epidermidis
IAGFKEIEYEVMRDKNDN

SEQ ID NO: 1806472 - protein, 34 aa, Staphylococcus epidermidis
IAGLNRAKATYKFAGGKGINVSRVLKTLDVDSTA

SEQ ID NO: 1806473 - protein, 21 aa, Staphylococcus epidermidis
IAGTCTNYGCNAKILLEGPYE

SEQ ID NO: 1806474 - protein, 25 aa, Staphylococcus epidermidis
IAIADFWECATAYLGKNAPKREDIE

SEQ ID NO: 1806475 - protein, 34 aa, Staphylococcus epidermidis
IAICEVKGLLILADLEFSHIAPFLNDMLFDRFNT

SEQ ID NO: 1806476 - protein, 24 aa, Staphylococcus epidermidis
IAIDHGFHHYSRFIQLFKNTYGYT

SEQ ID NO: 1806477 - protein, 24 aa, Staphylococcus epidermidis
IAIEHGFHHYSRFIQLFKDTYGQT

SEQ ID NO: 1806478 - protein, 18 aa, Staphylococcus epidermidis
IAISAGFTLEQFAVQDFF

SEQ ID NO: 1806479 - protein, 20 aa, Staphylococcus epidermidis
IAISHYYFGYIHPFYDGNGR

SEQ ID NO: 1806480 - protein, 19 aa, Staphylococcus epidermidis
IAKDFKNIMIIAPLADGYG

SEQ ID NO: 1806481 - protein, 19 aa, Staphylococcus epidermidis
IAKIFNEPVENIFIIEEGD

SEQ ID NO: 1806482 - protein, 24 aa, Staphylococcus epidermidis
IAKKLKKEFNILIIHCALLNEGHE

SEQ ID NO: 1806483 - protein, 22 aa, Staphylococcus epidermidis
IAKSCLVSSMTVSRVINQAASD

SEQ ID NO: 1806484 - protein, 17 aa, Staphylococcus epidermidis
IALALLRISKALLNNEN

SEQ ID NO: 1806485 - protein, 26 aa, Staphylococcus epidermidis
IALLPKEFVKNLMFFSISAPRNKNSG

SEQ ID NO: 1806486 - protein, 26 aa, Staphylococcus epidermidis
IALRTEPKLSLPSARSIIAIAVGYPN

SEQ ID NO: 1806487 - protein, 26 aa, Staphylococcus epidermidis
IAMLPKEFVRNLVFFSISAPRNKNNG

SEQ ID NO: 1806488 - protein, 18 aa, Staphylococcus epidermidis
IANDVRWLASGPRAGLAE

SEQ ID NO: 1806489 - protein, 23 aa, Staphylococcus epidermidis
IANEVKLPVVLYNVPSRTNMTIE

SEQ ID NO: 1806490 - protein, 17 aa, Staphylococcus epidermidis
IANIRWISIYSNCNTKI

SEQ ID NO: 1806491 - protein, 23 aa, Staphylococcus epidermidis
IANPHRRNVLLIGDGSLQLTVQS

SEQ ID NO: 1806492 - protein, 25 aa, Staphylococcus epidermidis
IAPKEIYNLVIYQLGALNGFCKVHG

SEQ ID NO: 1806493 - protein, 20 aa, Staphylococcus epidermidis
IAPSPIWMQARLMKAGIRPI

SEQ ID NO: 1806494 - protein, 17 aa, Staphylococcus epidermidis
IARALCQESEIILADEP

SEQ ID NO: 1806495 - protein, 17 aa, Staphylococcus epidermidis
IASCCGKSREFYFHNDA

SEQ ID NO: 1806496 - protein, 23 aa, Staphylococcus epidermidis
IASEAFKGLKPVFGSKNEVLILT

SEQ ID NO: 1806497 - protein, 17 aa, Staphylococcus epidermidis
IASRGLFAVEGQAISKE

SEQ ID NO: 1806498 - protein, 18 aa, Staphylococcus epidermidis
IASVLMLDPELIIADEPV

SEQ ID NO: 1806499 - protein, 30 aa, Staphylococcus epidermidis
IATDLRMMMAALKISTDFERMGDNAASIAH

SEQ ID NO: 1806500 - protein, 17 aa, Staphylococcus epidermidis
IATDSYLKLRFIQKSIL

SEQ ID NO: 1806501 - protein, 23 aa, Staphylococcus epidermidis
IATGRPYRASQMYYHELNMNTPV

SEQ ID NO: 1806502 - protein, 19 aa, Staphylococcus epidermidis
IATQIAKFYGLKVITTASR

SEQ ID NO: 1806503 - protein, 18 aa, Staphylococcus epidermidis
IATSILKANGLEVTLQEL

SEQ ID NO: 1806504 - protein, 19 aa, Staphylococcus epidermidis
IATSPIHLEHKLKMTQAEV

SEQ ID NO: 1806505 - protein, 18 aa, Staphylococcus epidermidis
IAVGHELGLPYATIKENI

SEQ ID NO: 1806506 - protein, 17 aa, Staphylococcus epidermidis
IAVKCVFFNQPYLKKKI

SEQ ID NO: 1806507 - protein, 21 aa, Staphylococcus epidermidis
IAVKVVNLRKEMGWSQRQLAE

SEQ ID NO: 1806508 - protein, 17 aa, Staphylococcus epidermidis
IAVVWSGVAAPLVQDND

SEQ ID NO: 1806509 - protein, 17 aa, Staphylococcus epidermidis
IAYSFKYDGAISESALY

SEQ ID NO: 1806510 - protein, 19 aa, Staphylococcus epidermidis
ICCIDRKGYEWVIQSTKKA

SEQ ID NO: 1806511 - protein, 22 aa, Staphylococcus epidermidis
ICDCIKNAGIDYEVFKEDLQKS

SEQ ID NO: 1806512 - protein, 20 aa, Staphylococcus epidermidis
ICGKCGSGKSTLAKIIAGLD

SEQ ID NO: 1806513 - protein, 18 aa, Staphylococcus epidermidis
ICGNEIHSLGEHIDFESI

SEQ ID NO: 1806514 - protein, 18 aa, Staphylococcus epidermidis
ICGVGVPGELCIGGAGLA

SEQ ID NO: 1806515 - protein, 19 aa, Staphylococcus epidermidis
ICTSNFKGEAQIRRELGDP

SEQ ID NO: 1806516 - protein, 17 aa, Staphylococcus epidermidis
IDACNELDIPVYDAYHS

SEQ ID NO: 1806517 - protein, 24 aa, Staphylococcus epidermidis
IDADGQRILIGWMGLPDTEYPTDK

SEQ ID NO: 1806518 - protein, 25 aa, Staphylococcus epidermidis
IDAHSPPILIIHGGKDWQVGIHQAY

SEQ ID NO: 1806519 - protein, 24 aa, Staphylococcus epidermidis
IDALSYYQFYILKLVVGEKRIEEA

SEQ ID NO: 1806520 - protein, 17 aa, Staphylococcus epidermidis
IDALVNYISSLGYLSED

SEQ ID NO: 1806521 - protein, 22 aa, Staphylococcus epidermidis
IDAYGAGSFIVATKIKGMIAAE

SEQ ID NO: 1806522 - protein, 18 aa, Staphylococcus epidermidis
IDDASYAINEFIKPKISV

SEQ ID NO: 1806523 - protein, 23 aa, Staphylococcus epidermidis
IDDMLKAVIDHFGHIDIVVNSAG

SEQ ID NO: 1806524 - protein, 22 aa, Staphylococcus epidermidis
IDDTMEFSRLQIPTEVLNFLNS

SEQ ID NO: 1806525 - protein, 21 aa, Staphylococcus epidermidis
IDDYRVMIVHPWQYEHTIGEK

SEQ ID NO: 1806526 - protein, 19 aa, Staphylococcus epidermidis
IDDYSYPIGCSYKKHERGY

SEQ ID NO: 1806527 - protein, 20 aa, Staphylococcus epidermidis
IDEIHDFYRNGGYYDEKEID

SEQ ID NO: 1806528 - protein, 17 aa, Staphylococcus epidermidis
IDEKEGRIRMDIAPINV

SEQ ID NO: 1806529 - protein, 23 aa, Staphylococcus epidermidis
IDELEFINFKAIEKIDQKVVNYF

SEQ ID NO: 1806530 - protein, 20 aa, Staphylococcus epidermidis
IDELLSFKLDDSLIQQLETK

SEQ ID NO: 1806531 - protein, 22 aa, Staphylococcus epidermidis
IDESKLNFLWVTDWPLLEYDED

SEQ ID NO: 1806532 - protein, 21 aa, Staphylococcus epidermidis
IDETKAKFVLKQHPYLQYHAT

SEQ ID NO: 1806533 - protein, 18 aa, Staphylococcus epidermidis
IDEYLSGISTVFQKVIKA

SEQ ID NO: 1806534 - protein, 17 aa, Staphylococcus epidermidis
IDFEELRKGDPTRDLAG

SEQ ID NO: 1806535 - protein, 23 aa, Staphylococcus epidermidis
IDFIQERGFELGLMELYVVEGED

SEQ ID NO: 1806536 - protein, 24 aa, Staphylococcus epidermidis
IDGEVWSTICSFGQSQKNIELLNI

SEQ ID NO: 1806537 - protein, 19 aa, Staphylococcus epidermidis
IDGIPEMYFHSYVAGATIN

SEQ ID NO: 1806538 - protein, 21 aa, Staphylococcus epidermidis
IDGKNGFLFVLSGVSADKYER

SEQ ID NO: 1806539 - protein, 21 aa, Staphylococcus epidermidis
IDGLYQFLFEFIFDIDERYIR

SEQ ID NO: 1806540 - protein, 23 aa, Staphylococcus epidermidis
IDGVKSIFYVMDFISVDKEDDAN

SEQ ID NO: 1806541 - protein, 23 aa, Staphylococcus epidermidis
IDGWKMCSVIPLAEDMFNIGNYA

SEQ ID NO: 1806542 - protein, 18 aa, Staphylococcus epidermidis
IDHLYGIPGDSIDAVVDS

SEQ ID NO: 1806543 - protein, 19 aa, Staphylococcus epidermidis
IDIDASRITSGVLRSTSGS

SEQ ID NO: 1806544 - protein, 23 aa, Staphylococcus epidermidis
IDIDELFDMFIFKNDRLKAKMKE

SEQ ID NO: 1806545 - protein, 22 aa, Staphylococcus epidermidis
IDIDKGRPLGEDDFANKVTSEI

SEQ ID NO: 1806546 - protein, 24 aa, Staphylococcus epidermidis
IDIDMKYVLLSGDWIDVGLPKRMK

SEQ ID NO: 1806547 - protein, 18 aa, Staphylococcus epidermidis
IDIESLYTIDDWIDAYDV

SEQ ID NO: 1806548 - protein, 21 aa, Staphylococcus epidermidis
IDIFPKTRLNLSLSTNDVITD

SEQ ID NO: 1806549 - protein, 23 aa, Staphylococcus epidermidis
IDIGEDLTQIAFYERGELVDADS

SEQ ID NO: 1806550 - protein, 20 aa, Staphylococcus epidermidis
IDIPEGYILHSDQGSVYTSY

SEQ ID NO: 1806551 - protein, 22 aa, Staphylococcus epidermidis
IDIPKRVFDALDIVPNTEPIRG

SEQ ID NO: 1806552 - protein, 17 aa, Staphylococcus epidermidis
IDIPSDVTVTFDGNHVT

SEQ ID NO: 1806553 - protein, 26 aa, Staphylococcus epidermidis
IDIRLPVVRLYIIRDIVDTCEGEKDN

SEQ ID NO: 1806554 - protein, 17 aa, Staphylococcus epidermidis
IDISSSMVRNRIKNKQT

SEQ ID NO: 1806555 - protein, 17 aa, Staphylococcus epidermidis
IDIYRTISFDDKKILKT

SEQ ID NO: 1806556 - protein, 24 aa, Staphylococcus epidermidis
IDKDYEVQFIFNLKEKEIRDIYRD

SEQ ID NO: 1806557 - protein, 25 aa, Staphylococcus epidermidis
IDKGSDIKHAFNFSTTEKPKDIYIF

SEQ ID NO: 1806558 - protein, 32 aa, Staphylococcus epidermidis
IDKLGFPFIVKTRFGGYDGKGQILIRDDSELD

SEQ ID NO: 1806559 - protein, 20 aa, Staphylococcus epidermidis
IDKQVKIRGFRIELSEIEKA

SEQ ID NO: 1806560 - protein, 17 aa, Staphylococcus epidermidis
IDKSISFIDYMTSLSMS

SEQ ID NO: 1806561 - protein, 19 aa, Staphylococcus epidermidis
IDKSSPFFKGDGNTVKNGD

SEQ ID NO: 1806562 - protein, 20 aa, Staphylococcus epidermidis
IDKSSPFFKGDGNTVKNGDI

SEQ ID NO: 1806563 - protein, 17 aa, Staphylococcus epidermidis
IDKVRVVMHHKGSIYRS

SEQ ID NO: 1806564 - protein, 24 aa, Staphylococcus epidermidis
IDLTRTWEILGEIIGESASDELID

SEQ ID NO: 1806565 - protein, 18 aa, Staphylococcus epidermidis
IDLYKEREMSVGYKYGED

SEQ ID NO: 1806566 - protein, 17 aa, Staphylococcus epidermidis
IDLYRPVAHQQHIEEVK

SEQ ID NO: 1806567 - protein, 17 aa, Staphylococcus epidermidis
IDMAIGRSPSFKNVNAA

SEQ ID NO: 1806568 - protein, 26 aa, Staphylococcus epidermidis
IDMAKKVKKGFLDKGYQLYFDSPTNQ

SEQ ID NO: 1806569 - protein, 25 aa, Staphylococcus epidermidis
IDMLNPYLCIIFCNSRENANELANS

SEQ ID NO: 1806570 - protein, 19 aa, Staphylococcus epidermidis
IDMRSSHRLILVDENSLTF

SEQ ID NO: 1806571 - protein, 25 aa, Staphylococcus epidermidis
IDNGSFKILAEFNLSNENHVNTYDD

SEQ ID NO: 1806572 - protein, 17 aa, Staphylococcus epidermidis
IDNLTGLTNAQKQTLND

SEQ ID NO: 1806573 - protein, 17 aa, Staphylococcus epidermidis
IDNQLFINVDQRFNQVD

SEQ ID NO: 1806574 - protein, 34 aa, Staphylococcus epidermidis
IDPDVLRFFMISVHYRSPINYNLELVGAARSGLE

SEQ ID NO: 1806575 - protein, 21 aa, Staphylococcus epidermidis
IDQLLNFDVHFALTNEKINHE

SEQ ID NO: 1806576 - protein, 18 aa, Staphylococcus epidermidis
IDRHFIEHCINLKWIGWF

SEQ ID NO: 1806577 - protein, 23 aa, Staphylococcus epidermidis
IDRKEARRMDRFTQYAVVAAREA

SEQ ID NO: 1806578 - protein, 17 aa, Staphylococcus epidermidis
IDRQLFYQFILRLPDEV

SEQ ID NO: 1806579 - protein, 23 aa, Staphylococcus epidermidis
IDRVPSIEKVRMVSSGTEATLDT

SEQ ID NO: 1806580 - protein, 19 aa, Staphylococcus epidermidis
IDRVSKIKVGNGFDEDTEM

SEQ ID NO: 1806581 - protein, 17 aa, Staphylococcus epidermidis
IDRYNFYGISGDFSEDA

SEQ ID NO: 1806582 - protein, 18 aa, Staphylococcus epidermidis
IDSGVKWLNQNKGQDYKG

SEQ ID NO: 1806583 - protein, 21 aa, Staphylococcus epidermidis
IDSIRIRPEFFEVYKDEELLE

SEQ ID NO: 1806584 - protein, 19 aa, Staphylococcus epidermidis
IDSKGFMYCKRYFHNNEKN

SEQ ID NO: 1806585 - protein, 18 aa, Staphylococcus epidermidis
IDTGMGLERMASISQNVR

SEQ ID NO: 1806586 - protein, 17 aa, Staphylococcus epidermidis
IDTGMGLERMTSISQNV

SEQ ID NO: 1806587 - protein, 18 aa, Staphylococcus epidermidis
IDTLKPVWYTDAELLMND

SEQ ID NO: 1806588 - protein, 22 aa, Staphylococcus epidermidis
IDTSCSRGEWGFDPKYDLASMT

SEQ ID NO: 1806589 - protein, 19 aa, Staphylococcus epidermidis
IDTSMGFTPLAGVTMGTRS

SEQ ID NO: 1806590 - protein, 22 aa, Staphylococcus epidermidis
IDVEALKAIGLNPGPKYQEVKV

SEQ ID NO: 1806591 - protein, 21 aa, Staphylococcus epidermidis
IDVLKRFRIIIKKKNESVQSM

SEQ ID NO: 1806592 - protein, 22 aa, Staphylococcus epidermidis
IDVLKRFRIIIKKKNESVQSMQ

SEQ ID NO: 1806593 - protein, 18 aa, Staphylococcus epidermidis
IDVQFEWDSTQAPSYVLN

SEQ ID NO: 1806594 - protein, 21 aa, Staphylococcus epidermidis
IDVRLGDGLAVINHADNIDNI

SEQ ID NO: 1806595 - protein, 24 aa, Staphylococcus epidermidis
IDVSRVARDYVLTGLEFACGIPGS

SEQ ID NO: 1806596 - protein, 21 aa, Staphylococcus epidermidis
IDVTARHIVKLAASQAQPIIY

SEQ ID NO: 1806597 - protein, 23 aa, Staphylococcus epidermidis
IDVYKPKMLIKIIEQCDIIINCT

SEQ ID NO: 1806598 - protein, 17 aa, Staphylococcus epidermidis
IDYAIKHNIPVSINHDS

SEQ ID NO: 1806599 - protein, 19 aa, Staphylococcus epidermidis
IDYDELIIGLGCEDKYHNV

SEQ ID NO: 1806600 - protein, 21 aa, Staphylococcus epidermidis
IDYDELIIGLGCEDKYHNVPG

SEQ ID NO: 1806601 - protein, 20 aa, Staphylococcus epidermidis
IDYFFLNKFQNIINIEHELK

SEQ ID NO: 1806602 - protein, 33 aa, Staphylococcus epidermidis
IDYITRIQTWAIKFDIYLSIKKKQGIMIDASTT

SEQ ID NO: 1806603 - protein, 17 aa, Staphylococcus epidermidis
IDYPYSIDSLWNKEKEK

SEQ ID NO: 1806604 - protein, 24 aa, Staphylococcus epidermidis
IDYQGPCLKCLLQTIPDTGESCAI

SEQ ID NO: 1806605 - protein, 19 aa, Staphylococcus epidermidis
IDYSYALHVRQFIRLSRYF

SEQ ID NO: 1806606 - protein, 17 aa, Staphylococcus epidermidis
IDYWLLQYTEGVVEPIQ

SEQ ID NO: 1806607 - protein, 19 aa, Staphylococcus epidermidis
IEAAEAFAKADIDTTIVDV

SEQ ID NO: 1806608 - protein, 18 aa, Staphylococcus epidermidis
IEAALYFDDKGSIPREDV

SEQ ID NO: 1806609 - protein, 18 aa, Staphylococcus epidermidis
IEAGNPFFQTGHNGCATG

SEQ ID NO: 1806610 - protein, 28 aa, Staphylococcus epidermidis
IEAMKILKAKGIQFVVGGMYEFGLSRYF

SEQ ID NO: 1806611 - protein, 25 aa, Staphylococcus epidermidis
IEANYKYARGVAVYGDIKDGANDHG

SEQ ID NO: 1806612 - protein, 30 aa, Staphylococcus epidermidis
IEAQLKSRGFKVLVPPAYLGGQNDKNFINR

SEQ ID NO: 1806613 - protein, 21 aa, Staphylococcus epidermidis
IEAQSTFALLLGNEGEGVNQE

SEQ ID NO: 1806614 - protein, 19 aa, Staphylococcus epidermidis
IEARCQCLSPEEIESLNQL

SEQ ID NO: 1806615 - protein, 17 aa, Staphylococcus epidermidis
IEATSYIQEGKWKSWGP

SEQ ID NO: 1806616 - protein, 22 aa, Staphylococcus epidermidis
IECDTYRKYGHFEGDEQKVKSP

SEQ ID NO: 1806617 - protein, 26 aa, Staphylococcus epidermidis
IEDEVELGQSLILQGLIINKFIVEQV

SEQ ID NO: 1806618 - protein, 24 aa, Staphylococcus epidermidis
IEDKARLFLNDEVTTIEDAIEGAK

SEQ ID NO: 1806619 - protein, 24 aa, Staphylococcus epidermidis
IEDKPKGSGLGFYGMKERAELVNG

SEQ ID NO: 1806620 - protein, 23 aa, Staphylococcus epidermidis
IEDRSAGIIKEIYDNTVELKKKG

SEQ ID NO: 1806621 - protein, 25 aa, Staphylococcus epidermidis
IEEAFAVALEAAFLAGTGKEQPIGL

SEQ ID NO: 1806622 - protein, 18 aa, Staphylococcus epidermidis
IEEDFCIDVDKFYKEMGE

SEQ ID NO: 1806623 - protein, 21 aa, Staphylococcus epidermidis
IEEFKQIILKTIFGENEVEEY

SEQ ID NO: 1806624 - protein, 19 aa, Staphylococcus epidermidis
IEEGYKPAMVIATAGTTNT

SEQ ID NO: 1806625 - protein, 17 aa, Staphylococcus epidermidis
IEEHGGMIIYLPQEGRG

SEQ ID NO: 1806626 - protein, 26 aa, Staphylococcus epidermidis
IEEIPGELIMKILAFDSDLGKIDLVG

SEQ ID NO: 1806627 - protein, 17 aa, Staphylococcus epidermidis
IEERYLLFMLEQSQIDD

SEQ ID NO: 1806628 - protein, 23 aa, Staphylococcus epidermidis
IEEYRDCFDEEIFASRYSDILDK

SEQ ID NO: 1806629 - protein, 25 aa, Staphylococcus epidermidis
IEFARAGDTIVVWRLDRLGRNMEDL

SEQ ID NO: 1806630 - protein, 17 aa, Staphylococcus epidermidis
IEFGNGIILQNPPKSVI

SEQ ID NO: 1806631 - protein, 19 aa, Staphylococcus epidermidis
IEFRKRLIDLYKIADTPEK

SEQ ID NO: 1806632 - protein, 18 aa, Staphylococcus epidermidis
IEFYRKELQERSKLLENQ

SEQ ID NO: 1806633 - protein, 23 aa, Staphylococcus epidermidis
IEGLEELSHYWATVRPYYTDFES

SEQ ID NO: 1806634 - protein, 24 aa, Staphylococcus epidermidis
IEGQKYLFDYSACKYPVGVVEDQI

SEQ ID NO: 1806635 - protein, 17 aa, Staphylococcus epidermidis
IEGRTAYKGPLQDTVYQ

SEQ ID NO: 1806636 - protein, 25 aa, Staphylococcus epidermidis
IEGSDLPSVIGWRTIEDTERIIDIA

SEQ ID NO: 1806637 - protein, 17 aa, Staphylococcus epidermidis
IEGYAIIFNSMSDDLGG

SEQ ID NO: 1806638 - protein, 23 aa, Staphylococcus epidermidis
IEHELRYPILSQTLILPPLLNQT

SEQ ID NO: 1806639 - protein, 26 aa, Staphylococcus epidermidis
IEHKIWYKLLVNLGINSITAIGHQTA

SEQ ID NO: 1806640 - protein, 20 aa, Staphylococcus epidermidis
IEHLKGDYLYQERDHEDIEL

SEQ ID NO: 1806641 - protein, 25 aa, Staphylococcus epidermidis
IEHNLSIMCEADWIIDVGPGPGLDG

SEQ ID NO: 1806642 - protein, 17 aa, Staphylococcus epidermidis
IEHRGYTYLTMKSNDDD

SEQ ID NO: 1806643 - protein, 23 aa, Staphylococcus epidermidis
IEIAHILSLTLAKIKVRADIVYS

SEQ ID NO: 1806644 - protein, 17 aa, Staphylococcus epidermidis
IEICQTLGLQSAQSIFE

SEQ ID NO: 1806645 - protein, 17 aa, Staphylococcus epidermidis
IEIKRGELLQSDIEREE

SEQ ID NO: 1806646 - protein, 27 aa, Staphylococcus epidermidis
IEILHVLKRFKAVLIQKNETVEAMQGY

SEQ ID NO: 1806647 - protein, 26 aa, Staphylococcus epidermidis
IEIPDARYKNWFPNFTLGDLISDNTA

SEQ ID NO: 1806648 - protein, 17 aa, Staphylococcus epidermidis
IEISELGLGCMSLGTDY

SEQ ID NO: 1806649 - protein, 24 aa, Staphylococcus epidermidis
IEISGNEAFQFVQYILSNDANNLT

SEQ ID NO: 1806650 - protein, 18 aa, Staphylococcus epidermidis
IEKGNILSLNHSKYLLIE

SEQ ID NO: 1806651 - protein, 23 aa, Staphylococcus epidermidis
IEKGSEVLKTFSPEFYTEGYGYV

SEQ ID NO: 1806652 - protein, 21 aa, Staphylococcus epidermidis
IEKKWQDYWAENKTFKTSDNL

SEQ ID NO: 1806653 - protein, 19 aa, Staphylococcus epidermidis
IEKVIDWLNHETIDSLHLT

SEQ ID NO: 1806654 - protein, 20 aa, Staphylococcus epidermidis
IEKYCKYNLFEVIGVTQYDL

SEQ ID NO: 1806655 - protein, 26 aa, Staphylococcus epidermidis
IELANRYVLNEAWKKHALGNYSSWEM

SEQ ID NO: 1806656 - protein, 17 aa, Staphylococcus epidermidis
IELFKKLEFKQLLSDID

SEQ ID NO: 1806657 - protein, 27 aa, Staphylococcus epidermidis
IELIYYFINCVMAFTFEENENEAIMEL

SEQ ID NO: 1806658 - protein, 19 aa, Staphylococcus epidermidis
IELLVPRIAELVHQHHYDI

SEQ ID NO: 1806659 - protein, 19 aa, Staphylococcus epidermidis
IELTEKYGDEILAVAGDQE

SEQ ID NO: 1806660 - protein, 21 aa, Staphylococcus epidermidis
IEMRSDIPLARGLGSSASALV

SEQ ID NO: 1806661 - protein, 18 aa, Staphylococcus epidermidis
IENFKFFSQYANFKNIEK

SEQ ID NO: 1806662 - protein, 17 aa, Staphylococcus epidermidis
IENFKFFSQYGNFKDLK

SEQ ID NO: 1806663 - protein, 18 aa, Staphylococcus epidermidis
IENFKFFSQYGNFKDLKD

SEQ ID NO: 1806664 - protein, 21 aa, Staphylococcus epidermidis
IENPEFISHFSAFKNLKYFSI

SEQ ID NO: 1806665 - protein, 17 aa, Staphylococcus epidermidis
IENRPVLQEALNFVRMG

SEQ ID NO: 1806666 - protein, 17 aa, Staphylococcus epidermidis
IEPEFRTLIKRKYPDYL

SEQ ID NO: 1806667 - protein, 18 aa, Staphylococcus epidermidis
IEPQEMEIIYFLNECKEI

SEQ ID NO: 1806668 - protein, 18 aa, Staphylococcus epidermidis
IEQCAGLTPKEWGYHITT

SEQ ID NO: 1806669 - protein, 25 aa, Staphylococcus epidermidis
IEQCAGLTPKEWRYHITTMGKVEIR

SEQ ID NO: 1806670 - protein, 25 aa, Staphylococcus epidermidis
IEQRSTEGWQGWPKDGKIGHLHLKT

SEQ ID NO: 1806671 - protein, 17 aa, Staphylococcus epidermidis
IEQSLREPLLFYRQLIR

SEQ ID NO: 1806672 - protein, 19 aa, Staphylococcus epidermidis
IERFGRSEVRRGNKAIRIN

SEQ ID NO: 1806673 - protein, 17 aa, Staphylococcus epidermidis
IERFILFNHYRIHKKDK

SEQ ID NO: 1806674 - protein, 23 aa, Staphylococcus epidermidis
IERIVRVAFDLAQNRRKKLTSVD

SEQ ID NO: 1806675 - protein, 17 aa, Staphylococcus epidermidis
IERLIKPELNHLVHELT

SEQ ID NO: 1806676 - protein, 21 aa, Staphylococcus epidermidis
IESGHFYTLLGPSGCGKTTIL

SEQ ID NO: 1806677 - protein, 34 aa, Staphylococcus epidermidis
IESGKFVSLLGASGCGKTTLLRLIAGLETPDSGS

SEQ ID NO: 1806678 - protein, 24 aa, Staphylococcus epidermidis
IESGNGFIGQGFMKYESFDALLEN

SEQ ID NO: 1806679 - protein, 21 aa, Staphylococcus epidermidis
IESKRGGGGYIRITKIENKDA

SEQ ID NO: 1806680 - protein, 20 aa, Staphylococcus epidermidis
IESLGMRFEQFLAESDIPNY

SEQ ID NO: 1806681 - protein, 25 aa, Staphylococcus epidermidis
IESLKESKPYLFAESKPSGRTPDDG

SEQ ID NO: 1806682 - protein, 23 aa, Staphylococcus epidermidis
IESMASFLNSFPMFKDDTRNTHP

SEQ ID NO: 1806683 - protein, 31 aa, Staphylococcus epidermidis
IESMCGQTFLFRLPKHAFDYANHFPGNVIKS

SEQ ID NO: 1806684 - protein, 25 aa, Staphylococcus epidermidis
IETCKEVAPRLEIHLSTQQSLSNYK

SEQ ID NO: 1806685 - protein, 19 aa, Staphylococcus epidermidis
IETPLARMMIKESLPEGTT

SEQ ID NO: 1806686 - protein, 20 aa, Staphylococcus epidermidis
IETPRACLIAQHLAKHCDFF

SEQ ID NO: 1806687 - protein, 35 aa, Staphylococcus epidermidis
IETTKALSIRVFYCLKGNCKMTINLQEFDLSKDEI

SEQ ID NO: 1806688 - protein, 17 aa, Staphylococcus epidermidis
IEVDERIHILNFTDIIA

SEQ ID NO: 1806689 - protein, 20 aa, Staphylococcus epidermidis
IEVGCPVLSYDVRYGPNEII

SEQ ID NO: 1806690 - protein, 23 aa, Staphylococcus epidermidis
IEVLEPLTYLLIGGEVLNAKWVN

SEQ ID NO: 1806691 - protein, 29 aa, Staphylococcus epidermidis
IEVNRAESWLRSNIKEINFQLYNYAQENE

SEQ ID NO: 1806692 - protein, 22 aa, Staphylococcus epidermidis
IEVTCGKGTYIRTLATDIGASL

SEQ ID NO: 1806693 - protein, 24 aa, Staphylococcus epidermidis
IEVTRPRGTSVIVAIFGHPVEFNP

SEQ ID NO: 1806694 - protein, 22 aa, Staphylococcus epidermidis
IEVYRRKLSYIPEAPVIYEELT

SEQ ID NO: 1806695 - protein, 23 aa, Staphylococcus epidermidis
IEWLKRYEEHLIIIFKEAELSHK

SEQ ID NO: 1806696 - protein, 17 aa, Staphylococcus epidermidis
IEYKRIPFSPEYVAQYL

SEQ ID NO: 1806697 - protein, 17 aa, Staphylococcus epidermidis
IFAESLGGTETFITFSY

SEQ ID NO: 1806698 - protein, 25 aa, Staphylococcus epidermidis
IFARKGAAASNHFEGGAFVRSNDEV

SEQ ID NO: 1806699 - protein, 32 aa, Staphylococcus epidermidis
IFATAMNRKGYFLYGYRHFSSRIKGGHTNNKI

SEQ ID NO: 1806700 - protein, 19 aa, Staphylococcus epidermidis
IFDLAKKYVNPFFVNDLLP

SEQ ID NO: 1806701 - protein, 19 aa, Staphylococcus epidermidis
IFDLILKFADYGFPRAHAV

SEQ ID NO: 1806702 - protein, 18 aa, Staphylococcus epidermidis
IFDQIDLGILDYSSIYYD

SEQ ID NO: 1806703 - protein, 23 aa, Staphylococcus epidermidis
IFEKEGPRIMSLEPQDDNRDGVA

SEQ ID NO: 1806704 - protein, 17 aa, Staphylococcus epidermidis
IFGAMKCSNCGKEIGKE

SEQ ID NO: 1806705 - protein, 20 aa, Staphylococcus epidermidis
IFGPILPILTYDSFDEAIEI

SEQ ID NO: 1806706 - protein, 29 aa, Staphylococcus epidermidis
IFHRHVPILGVCLGFQLIIEYFGGNIIHN

SEQ ID NO: 1806707 - protein, 18 aa, Staphylococcus epidermidis
IFIKGAISGVSMKEMAFA

SEQ ID NO: 1806708 - protein, 27 aa, Staphylococcus epidermidis
IFIYGHSFGALLAFYVTYQLENEYGIE

SEQ ID NO: 1806709 - protein, 31 aa, Staphylococcus epidermidis
IFKEAGFEWREPGCSMCLGMNPDQVPEGVHC

SEQ ID NO: 1806710 - protein, 21 aa, Staphylococcus epidermidis
IFKYFYSHRGPVLDFNNEKLV

SEQ ID NO: 1806711 - protein, 27 aa, Staphylococcus epidermidis
IFMKKSRPSTQLTLICKLHDKIYFEQL

SEQ ID NO: 1806712 - protein, 24 aa, Staphylococcus epidermidis
IFMNELKINLLDFREQMDNLEAIG

SEQ ID NO: 1806713 - protein, 26 aa, Staphylococcus epidermidis
IFNGDIGVIVGIFWAKENALNKDVLV

SEQ ID NO: 1806714 - protein, 23 aa, Staphylococcus epidermidis
IFNHLFKQAITFAKRAHSETDIA

SEQ ID NO: 1806715 - protein, 25 aa, Staphylococcus epidermidis
IFNNIKRLNIETVKQENTSFIKEDT

SEQ ID NO: 1806716 - protein, 22 aa, Staphylococcus epidermidis
IFPKHVLFHKGILRHHESKGKM

SEQ ID NO: 1806717 - protein, 17 aa, Staphylococcus epidermidis
IFQGLEFTDRRPFNDVL

SEQ ID NO: 1806718 - protein, 20 aa, Staphylococcus epidermidis
IFQQLKLPKKDLHQLNMSKE

SEQ ID NO: 1806719 - protein, 23 aa, Staphylococcus epidermidis
IFRDKRIPVVKGVSFDCPTGASI

SEQ ID NO: 1806720 - protein, 20 aa, Staphylococcus epidermidis
IFRNCKGRIIFASFASNIYR

SEQ ID NO: 1806721 - protein, 21 aa, Staphylococcus epidermidis
IFRNCKGRIIFATFASNIYRV

SEQ ID NO: 1806722 - protein, 31 aa, Staphylococcus epidermidis
IFRPQLRALLRASAYGKLNIMFPMVATIKEF

SEQ ID NO: 1806723 - protein, 26 aa, Staphylococcus epidermidis
IFSDLRGDLFGLFDKLRESFKGDNQE

SEQ ID NO: 1806724 - protein, 33 aa, Staphylococcus epidermidis
IFSELSFTLYKLFKRLRKLFIENTQEPWTSCEF

SEQ ID NO: 1806725 - protein, 26 aa, Staphylococcus epidermidis
IFSPFIRYKYHFYKFEGNSIILKEAF

SEQ ID NO: 1806726 - protein, 28 aa, Staphylococcus epidermidis
IFTAGKGRSGFVANSFAMRLNQLDKNAY

SEQ ID NO: 1806727 - protein, 22 aa, Staphylococcus epidermidis
IFTHDLPFLLLMQNKSSEKQLD

SEQ ID NO: 1806728 - protein, 18 aa, Staphylococcus epidermidis
IFTNEPLEIILPEYGVIQ

SEQ ID NO: 1806729 - protein, 21 aa, Staphylococcus epidermidis
IGADCYLEPSLSASIKIINRF

SEQ ID NO: 1806730 - protein, 19 aa, Staphylococcus epidermidis
IGAEVMRLGIISTPGVAYL

SEQ ID NO: 1806731 - protein, 20 aa, Staphylococcus epidermidis
IGAITKMWTITGVGGADDLN

SEQ ID NO: 1806732 - protein, 26 aa, Staphylococcus epidermidis
IGCSGRLSGYIKSYGVHAIHGRALPL

SEQ ID NO: 1806733 - protein, 18 aa, Staphylococcus epidermidis
IGDDIALYGEDGQLYGTL

SEQ ID NO: 1806734 - protein, 23 aa, Staphylococcus epidermidis
IGDEIKQQWPGTITTIVHRIGPL

SEQ ID NO: 1806735 - protein, 25 aa, Staphylococcus epidermidis
IGDGCGECPACKLRARGLHHYLKSK

SEQ ID NO: 1806736 - protein, 20 aa, Staphylococcus epidermidis
IGDIPFPYFMSYVSGAGLSL

SEQ ID NO: 1806737 - protein, 18 aa, Staphylococcus epidermidis
IGDRIQFSLNYEAVSQSM

SEQ ID NO: 1806738 - protein, 24 aa, Staphylococcus epidermidis
IGDTCPICGNEIQSLGEHIDFESI

SEQ ID NO: 1806739 - protein, 20 aa, Staphylococcus epidermidis
IGEEGVLCLLSDSTNALVPD

SEQ ID NO: 1806740 - protein, 18 aa, Staphylococcus epidermidis
IGEHGDSELAVWSQANVA

SEQ ID NO: 1806741 - protein, 24 aa, Staphylococcus epidermidis
IGELKEGLSPMSVIASLLPTGTVS

SEQ ID NO: 1806742 - protein, 27 aa, Staphylococcus epidermidis
IGFPGVKGEVLVNAFSKHGVMVSTTSA

SEQ ID NO: 1806743 - protein, 22 aa, Staphylococcus epidermidis
IGGEKMAQCFIQSFDASPSQML

SEQ ID NO: 1806744 - protein, 26 aa, Staphylococcus epidermidis
IGGIGRTNIGISFPVEAPKEYLAFEQ

SEQ ID NO: 1806745 - protein, 17 aa, Staphylococcus epidermidis
IGGTAKDKLIFALPGST

SEQ ID NO: 1806746 - protein, 21 aa, Staphylococcus epidermidis
IGHYHCQCGFKREDPTYEVSS

SEQ ID NO: 1806747 - protein, 25 aa, Staphylococcus epidermidis
IGIFNPRLNRIYTYDMTQADSDILE

SEQ ID NO: 1806748 - protein, 25 aa, Staphylococcus epidermidis
IGIHAFKLAFIKSAVDRELPYHLAI

SEQ ID NO: 1806749 - protein, 19 aa, Staphylococcus epidermidis
IGIKEVKLLNEFAINGLYP

SEQ ID NO: 1806750 - protein, 17 aa, Staphylococcus epidermidis
IGITPLVPMFNEVVENG

SEQ ID NO: 1806751 - protein, 26 aa, Staphylococcus epidermidis
IGKDARRRREILGRKLHIGHSNGKQL

SEQ ID NO: 1806752 - protein, 23 aa, Staphylococcus epidermidis
IGKGIPAALAMSMIKFGMDSYGH

SEQ ID NO: 1806753 - protein, 24 aa, Staphylococcus epidermidis
IGLIDRLHPTPALGGYPKEEALDF

SEQ ID NO: 1806754 - protein, 36 aa, Staphylococcus epidermidis
IGLPANLFFGTSIPTCVLVFKKCRQADDDVVFIDAS

SEQ ID NO: 1806755 - protein, 36 aa, Staphylococcus epidermidis
IGLPANLFFGTSIPTCVLVFKKCRQQDDDVVFIDAS

SEQ ID NO: 1806756 - protein, 24 aa, Staphylococcus epidermidis
IGLPANLFFGTSIPTSILVFKKCR

SEQ ID NO: 1806757 - protein, 29 aa, Staphylococcus epidermidis
IGLYKAVIIQAAFELGERINSTSTFDKVQ

SEQ ID NO: 1806758 - protein, 29 aa, Staphylococcus epidermidis
IGLYKAVILQAAFELGERINSTSTLDKVQ

SEQ ID NO: 1806759 - protein, 19 aa, Staphylococcus epidermidis
IGMSIARHLSATHLDVAVI

SEQ ID NO: 1806760 - protein, 17 aa, Staphylococcus epidermidis
IGNVTINGFPNVAQRLK

SEQ ID NO: 1806761 - protein, 18 aa, Staphylococcus epidermidis
IGPKGRNVVLDKEYTTPL

SEQ ID NO: 1806762 - protein, 19 aa, Staphylococcus epidermidis
IGQIKVIFTTTIKEKEDHY

SEQ ID NO: 1806763 - protein, 27 aa, Staphylococcus epidermidis
IGRPGYLRFKVSVLPKRVSFSGKQSLK

SEQ ID NO: 1806764 - protein, 24 aa, Staphylococcus epidermidis
IGSALINISIEWAKHKNLHGLMLE

SEQ ID NO: 1806765 - protein, 19 aa, Staphylococcus epidermidis
IGSNYAGVRGFTASSGPGL

SEQ ID NO: 1806766 - protein, 20 aa, Staphylococcus epidermidis
IGTAPYWHPVLLKNHLKRMS

SEQ ID NO: 1806767 - protein, 20 aa, Staphylococcus epidermidis
IGTCSFDLVRHEFEKLQEIK

SEQ ID NO: 1806768 - protein, 26 aa, Staphylococcus epidermidis
IGTDIPFCIYNKTAVCTGRGEKVTFL

SEQ ID NO: 1806769 - protein, 28 aa, Staphylococcus epidermidis
IGTFSYMVFKSWYRKLGITSEEQYRSMQ

SEQ ID NO: 1806770 - protein, 19 aa, Staphylococcus epidermidis
IGTGAGFLAILCSKYDCDV

SEQ ID NO: 1806771 - protein, 17 aa, Staphylococcus epidermidis
IGVRVIVPFGPRTIQGY

SEQ ID NO: 1806772 - protein, 18 aa, Staphylococcus epidermidis
IGYEIKPAGGVFVSGGSM

SEQ ID NO: 1806773 - protein, 27 aa, Staphylococcus epidermidis
IGYHPDYEFLKSIGIEINTNEYGTAPV

SEQ ID NO: 1806774 - protein, 26 aa, Staphylococcus epidermidis
IGYKPKNMFFHIAVSPINLITSDNPV

SEQ ID NO: 1806775 - protein, 17 aa, Staphylococcus epidermidis
IGYVANFYKEIYGENSN

SEQ ID NO: 1806776 - protein, 18 aa, Staphylococcus epidermidis
IHAVRILGMNDVGRNYLK

SEQ ID NO: 1806777 - protein, 17 aa, Staphylococcus epidermidis
IHDLRVIEGNSGLFVAM

SEQ ID NO: 1806778 - protein, 19 aa, Staphylococcus epidermidis
IHEDPRKVYEYTIKGNTVA

SEQ ID NO: 1806779 - protein, 30 aa, Staphylococcus epidermidis
IHELKMVLNKTVPKDLFFIISLSGETYQLT

SEQ ID NO: 1806780 - protein, 19 aa, Staphylococcus epidermidis
IHENPRKVYEYTIKANTVA

SEQ ID NO: 1806781 - protein, 28 aa, Staphylococcus epidermidis
IHERIAIFDLYFRSMPFNSGYAVFNGLK

SEQ ID NO: 1806782 - protein, 32 aa, Staphylococcus epidermidis
IHGMKEPYNDIKMWDYKALPAVFGGDNVAVHD

SEQ ID NO: 1806783 - protein, 20 aa, Staphylococcus epidermidis
IHILNFTDIIALSVNNGITT

SEQ ID NO: 1806784 - protein, 19 aa, Staphylococcus epidermidis
IHKKEYKDQMEILQNRMRE

SEQ ID NO: 1806785 - protein, 25 aa, Staphylococcus epidermidis
IHLIPETRKSTILSGKKVGDAVHLE

SEQ ID NO: 1806786 - protein, 26 aa, Staphylococcus epidermidis
IHLKRAYRSPARLQLFEHVMAPLADF

SEQ ID NO: 1806787 - protein, 23 aa, Staphylococcus epidermidis
IHLVKSKRQGQSMIYALDDMHVS

SEQ ID NO: 1806788 - protein, 18 aa, Staphylococcus epidermidis
IHPSEFRSNATVDSQTDH

SEQ ID NO: 1806789 - protein, 26 aa, Staphylococcus epidermidis
IHQAESWLRSNIKDINFQLYNYAQEH

SEQ ID NO: 1806790 - protein, 18 aa, Staphylococcus epidermidis
IHQYKIMRDFYLAEVLAR

SEQ ID NO: 1806791 - protein, 17 aa, Staphylococcus epidermidis
IHRGMLKLYNLENLKYD

SEQ ID NO: 1806792 - protein, 17 aa, Staphylococcus epidermidis
IHRLIGWNQETQPEDIL

SEQ ID NO: 1806793 - protein, 19 aa, Staphylococcus epidermidis
IHRMLPHPINIVRIRLTGK

SEQ ID NO: 1806794 - protein, 18 aa, Staphylococcus epidermidis
IHRMLPHPINLVRVRLTG

SEQ ID NO: 1806795 - protein, 18 aa, Staphylococcus epidermidis
IHTQLRYITYIPQKAQLD

SEQ ID NO: 1806796 - protein, 17 aa, Staphylococcus epidermidis
IIAEVKDYVFINSYDPR

SEQ ID NO: 1806797 - protein, 19 aa, Staphylococcus epidermidis
IIAEVKDYVFINSYDPRLF

SEQ ID NO: 1806798 - protein, 24 aa, Staphylococcus epidermidis
IIDIPKRVFEALDIVPNTEPIRGG

SEQ ID NO: 1806799 - protein, 18 aa, Staphylococcus epidermidis
IIDKKVVRLLDSVKIVIQ

SEQ ID NO: 1806800 - protein, 24 aa, Staphylococcus epidermidis
IIDLDIRAQYGINIIAIKRAKEFI

SEQ ID NO: 1806801 - protein, 36 aa, Staphylococcus epidermidis
IIDMGELRGKIFYRKNFKTRVVSFVEWLDKKQRLRS

SEQ ID NO: 1806802 - protein, 27 aa, Staphylococcus epidermidis
IIDRFSFKNYLYVFLANHFISSELSNH

SEQ ID NO: 1806803 - protein, 27 aa, Staphylococcus epidermidis
IIECASGVGMLIKFEGVEELVFYEHTQ

SEQ ID NO: 1806804 - protein, 18 aa, Staphylococcus epidermidis
IIEGIFIAYEYDKRTHGL

SEQ ID NO: 1806805 - protein, 24 aa, Staphylococcus epidermidis
IIEGRPGTGKSLLLYDIAKKLKKE

SEQ ID NO: 1806806 - protein, 19 aa, Staphylococcus epidermidis
IIEIAPLAYMRGRTLDDAF

SEQ ID NO: 1806807 - protein, 29 aa, Staphylococcus epidermidis
IIEKLDYLKYLGVDYLWLTPIYESPMNDN

SEQ ID NO: 1806808 - protein, 18 aa, Staphylococcus epidermidis
IIENCKRIGFYPKTVANI

SEQ ID NO: 1806809 - protein, 19 aa, Staphylococcus epidermidis
IIEVSRFIPSMNFKSHIYR

SEQ ID NO: 1806810 - protein, 25 aa, Staphylococcus epidermidis
IIFASEIDYKCVTTMRLEDQAHEYT

SEQ ID NO: 1806811 - protein, 25 aa, Staphylococcus epidermidis
IIFAYKRLKQNQVISNPFAIETQHL

SEQ ID NO: 1806812 - protein, 24 aa, Staphylococcus epidermidis
IIGHSMGSIIARLFVEKYPDIAQG

SEQ ID NO: 1806813 - protein, 21 aa, Staphylococcus epidermidis
IIGSCGLDSIRVIKGQFGAHI

SEQ ID NO: 1806814 - protein, 21 aa, Staphylococcus epidermidis
IIHLWLNKQIEIHDFDADPGW

SEQ ID NO: 1806815 - protein, 18 aa, Staphylococcus epidermidis
IIHPREVFNIAIRESSNA

SEQ ID NO: 1806816 - protein, 18 aa, Staphylococcus epidermidis
IIHPREVFNIAIRESSNS

SEQ ID NO: 1806817 - protein, 20 aa, Staphylococcus epidermidis
IIHPREVFNIAIRESSNSII

SEQ ID NO: 1806818 - protein, 19 aa, Staphylococcus epidermidis
IIHPSEFKASATVDSQTDH

SEQ ID NO: 1806819 - protein, 25 aa, Staphylococcus epidermidis
IIIFLKDFCDKYCFKPKLHKPITIC

SEQ ID NO: 1806820 - protein, 17 aa, Staphylococcus epidermidis
IIIKIFTEKGITSKDKL

SEQ ID NO: 1806821 - protein, 20 aa, Staphylococcus epidermidis
IIITRYVKFYDYQYDKKNPQ

SEQ ID NO: 1806822 - protein, 17 aa, Staphylococcus epidermidis
IIKACQLVNYDMVYRIG

SEQ ID NO: 1806823 - protein, 23 aa, Staphylococcus epidermidis
IIKEALHKLGFDDGMYDLIKEPI

SEQ ID NO: 1806824 - protein, 24 aa, Staphylococcus epidermidis
IIKGLNLDPSKPVLLYAPTWKTNP

SEQ ID NO: 1806825 - protein, 25 aa, Staphylococcus epidermidis
IIKNDLRKRIGFMIENPEFISHFSA

SEQ ID NO: 1806826 - protein, 25 aa, Staphylococcus epidermidis
IIKRAGGLHQFMNWDGPILTDSGGF

SEQ ID NO: 1806827 - protein, 24 aa, Staphylococcus epidermidis
IIKRHRLLELFLIEILQYNWEEVH

SEQ ID NO: 1806828 - protein, 18 aa, Staphylococcus epidermidis
IIKSTLKISDFGLVERSH

SEQ ID NO: 1806829 - protein, 18 aa, Staphylococcus epidermidis
IIKTWKKAYQEIADVFIS

SEQ ID NO: 1806830 - protein, 34 aa, Staphylococcus epidermidis
IILDAAYRGAYPIFYWKEFDYIIEKHGGTSPVNP

SEQ ID NO: 1806831 - protein, 17 aa, Staphylococcus epidermidis
IILLDRAKLSFQNDWFD

SEQ ID NO: 1806832 - protein, 17 aa, Staphylococcus epidermidis
IILNHLGNTHFLNNETE

SEQ ID NO: 1806833 - protein, 24 aa, Staphylococcus epidermidis
IIMPRAIATYELYIAALKLGIAII

SEQ ID NO: 1806834 - protein, 18 aa, Staphylococcus epidermidis
IINFKAIVRFDSLVELDY

SEQ ID NO: 1806835 - protein, 19 aa, Staphylococcus epidermidis
IINYQYPVGYSYKKDSRGY

SEQ ID NO: 1806836 - protein, 18 aa, Staphylococcus epidermidis
IIPIPAIYLKITEDYPTA

SEQ ID NO: 1806837 - protein, 26 aa, Staphylococcus epidermidis
IIQKRFTLNILYPYIETIHITKDKNL

SEQ ID NO: 1806838 - protein, 17 aa, Staphylococcus epidermidis
IIQKYPITIWNSVPTLF

SEQ ID NO: 1806839 - protein, 19 aa, Staphylococcus epidermidis
IISAGIYEKYIEAILKLDR

SEQ ID NO: 1806840 - protein, 18 aa, Staphylococcus epidermidis
IITDMGFEDYFLIVSDLI

SEQ ID NO: 1806841 - protein, 18 aa, Staphylococcus epidermidis
IITGAVSLWTWWKNNNFS

SEQ ID NO: 1806842 - protein, 22 aa, Staphylococcus epidermidis
IIVAGGAWSSQLLKNYNLHRKV

SEQ ID NO: 1806843 - protein, 20 aa, Staphylococcus epidermidis
IIVANPKTGYIISEDAKDKI

SEQ ID NO: 1806844 - protein, 26 aa, Staphylococcus epidermidis
IIVVTFNYRLGALGYLDWSYFNQHLN

SEQ ID NO: 1806845 - protein, 19 aa, Staphylococcus epidermidis
IIYKKRHLQEKQGIKGTTF

SEQ ID NO: 1806846 - protein, 17 aa, Staphylococcus epidermidis
IIYRGERIINWDPQART

SEQ ID NO: 1806847 - protein, 20 aa, Staphylococcus epidermidis
IIYRRLDEIPNLRTLSITGG

SEQ ID NO: 1806848 - protein, 17 aa, Staphylococcus epidermidis
IIYRRLDEIPNLRTMSI

SEQ ID NO: 1806849 - protein, 19 aa, Staphylococcus epidermidis
IIYYDGEAALALLRLYQKD

SEQ ID NO: 1806850 - protein, 26 aa, Staphylococcus epidermidis
IKAARHLLKEGGRFIMVHRAERLMDV

SEQ ID NO: 1806851 - protein, 17 aa, Staphylococcus epidermidis
IKAATIIDAENVKKSDK

SEQ ID NO: 1806852 - protein, 20 aa, Staphylococcus epidermidis
IKAGCGYVPIDTSVPEERVK

SEQ ID NO: 1806853 - protein, 17 aa, Staphylococcus epidermidis
IKAGVHLDKLTEERSKR

SEQ ID NO: 1806854 - protein, 22 aa, Staphylococcus epidermidis
IKAHNKIGIMITHDTSLFEYAD

SEQ ID NO: 1806855 - protein, 17 aa, Staphylococcus epidermidis
IKAIDGFQGNKFFPESF

SEQ ID NO: 1806856 - protein, 23 aa, Staphylococcus epidermidis
IKAIEYGAKVGMIERGTVGGTCV

SEQ ID NO: 1806857 - protein, 17 aa, Staphylococcus epidermidis
IKALKRGPQIVVGTPGR

SEQ ID NO: 1806858 - protein, 21 aa, Staphylococcus epidermidis
IKAQLLDWILPYYKNLSREGM

SEQ ID NO: 1806859 - protein, 22 aa, Staphylococcus epidermidis
IKASEFDLIVSLGKGETKIPRY

SEQ ID NO: 1806860 - protein, 23 aa, Staphylococcus epidermidis
IKDADVFIGVSVVDILTQDMVKT

SEQ ID NO: 1806861 - protein, 28 aa, Staphylococcus epidermidis
IKDDKKRIAIKYSIPKWIVDHWVTHHGI

SEQ ID NO: 1806862 - protein, 22 aa, Staphylococcus epidermidis
IKDFDLRLPELMNHLREDDLVI

SEQ ID NO: 1806863 - protein, 18 aa, Staphylococcus epidermidis
IKDFKDNKLEIVTVATDY

SEQ ID NO: 1806864 - protein, 19 aa, Staphylococcus epidermidis
IKDFKDNKLEIVTVATDYC

SEQ ID NO: 1806865 - protein, 28 aa, Staphylococcus epidermidis
IKDIRMREVISYFATYVFEKGAEVPALL

SEQ ID NO: 1806866 - protein, 23 aa, Staphylococcus epidermidis
IKDKGRLPVVNFAAGGVATPQDA

SEQ ID NO: 1806867 - protein, 20 aa, Staphylococcus epidermidis
IKDKVIDIMNMFANHHDVNY

SEQ ID NO: 1806868 - protein, 18 aa, Staphylococcus epidermidis
IKDKVIDIMNMFVNHHNV

SEQ ID NO: 1806869 - protein, 23 aa, Staphylococcus epidermidis
IKDLGRKKAIVVHGANGMDEATL

SEQ ID NO: 1806870 - protein, 17 aa, Staphylococcus epidermidis
IKDLPDYIQIWPGHGAG

SEQ ID NO: 1806871 - protein, 25 aa, Staphylococcus epidermidis
IKDLRCRGLIKEEREFISLTERGKV

SEQ ID NO: 1806872 - protein, 17 aa, Staphylococcus epidermidis
IKDNVWIGGNVTVLPGI

SEQ ID NO: 1806873 - protein, 29 aa, Staphylococcus epidermidis
IKDSLKRLIMPSIEREIRGDLTQKAETHA

SEQ ID NO: 1806874 - protein, 17 aa, Staphylococcus epidermidis
IKDVSIFDIRNAANKYK

SEQ ID NO: 1806875 - protein, 24 aa, Staphylococcus epidermidis
IKDYKIKGEFPSNLEYVDNYIDPN

SEQ ID NO: 1806876 - protein, 26 aa, Staphylococcus epidermidis
IKEAYDLGIRAIMFFGVPNEKDDIGS

SEQ ID NO: 1806877 - protein, 26 aa, Staphylococcus epidermidis
IKEAYDLGIRAIMFFGVPNEKDDVGS

SEQ ID NO: 1806878 - protein, 17 aa, Staphylococcus epidermidis
IKEEGPAHHRLFTSEVI

SEQ ID NO: 1806879 - protein, 31 aa, Staphylococcus epidermidis
IKEGVKGSLQRLGLDHIDLYQLHGGTIDDPL

SEQ ID NO: 1806880 - protein, 20 aa, Staphylococcus epidermidis
IKEHMASLIYKLEEMGVDLE

SEQ ID NO: 1806881 - protein, 20 aa, Staphylococcus epidermidis
IKEHMASLVYKLEEMGVNLD

SEQ ID NO: 1806882 - protein, 24 aa, Staphylococcus epidermidis
IKEIQLLRVMGLPFNGQKITDKED

SEQ ID NO: 1806883 - protein, 20 aa, Staphylococcus epidermidis
IKEIVLMGGSTGRGNVTPLA

SEQ ID NO: 1806884 - protein, 25 aa, Staphylococcus epidermidis
IKENGRLALDLIGGFHFNAIEGEYC

SEQ ID NO: 1806885 - protein, 19 aa, Staphylococcus epidermidis
IKEQLIFPEIDYDKVTKVR

SEQ ID NO: 1806886 - protein, 22 aa, Staphylococcus epidermidis
IKETPLYFLQHGILFMKPHDNP

SEQ ID NO: 1806887 - protein, 23 aa, Staphylococcus epidermidis
IKFPIILNEALTAVVAVPLWLDE

SEQ ID NO: 1806888 - protein, 21 aa, Staphylococcus epidermidis
IKFYPEMFQTVIPHHDHEGNL

SEQ ID NO: 1806889 - protein, 21 aa, Staphylococcus epidermidis
IKGAIVGFFTPELFHGVGSAG

SEQ ID NO: 1806890 - protein, 17 aa, Staphylococcus epidermidis
IKGDLIIVQGTDDDWTN

SEQ ID NO: 1806891 - protein, 19 aa, Staphylococcus epidermidis
IKGIGYQSVKLIIDERQQN

SEQ ID NO: 1806892 - protein, 17 aa, Staphylococcus epidermidis
IKGKRRKKTLENMKSSF

SEQ ID NO: 1806893 - protein, 23 aa, Staphylococcus epidermidis
IKGKTILDVGCNQGGFLRKLYDT

SEQ ID NO: 1806894 - protein, 17 aa, Staphylococcus epidermidis
IKGMPIIQDVSFKLDEG

SEQ ID NO: 1806895 - protein, 36 aa, Staphylococcus epidermidis
IKGQVNAAFSKKRFDILKLTAFGAIPKDMLDLGPKY

SEQ ID NO: 1806896 - protein, 19 aa, Staphylococcus epidermidis
IKGQWCYLYRAIDADGHTL

SEQ ID NO: 1806897 - protein, 20 aa, Staphylococcus epidermidis
IKGVGYQSVKLIVDERYNNG

SEQ ID NO: 1806898 - protein, 18 aa, Staphylococcus epidermidis
IKHIHHFTIIPYYFTCHE

SEQ ID NO: 1806899 - protein, 24 aa, Staphylococcus epidermidis
IKHIKTDVLVGTRASFNILISKYA

SEQ ID NO: 1806900 - protein, 20 aa, Staphylococcus epidermidis
IKHVAKRAFLDKTLERKAVW

SEQ ID NO: 1806901 - protein, 21 aa, Staphylococcus epidermidis
IKIDLDYADVLGLQSQGRDNV

SEQ ID NO: 1806902 - protein, 17 aa, Staphylococcus epidermidis
IKIDVVFIGSCTNGRIE

SEQ ID NO: 1806903 - protein, 20 aa, Staphylococcus epidermidis
IKIHLLHLLKGTPMVKQYEK

SEQ ID NO: 1806904 - protein, 22 aa, Staphylococcus epidermidis
IKIKGKWSYLYRAIDTEGHTLD

SEQ ID NO: 1806905 - protein, 18 aa, Staphylococcus epidermidis
IKISMGYLDNLSLDLSSN

SEQ ID NO: 1806906 - protein, 24 aa, Staphylococcus epidermidis
IKKDGYWWIRFKYVQPGSSNKHFY

SEQ ID NO: 1806907 - protein, 17 aa, Staphylococcus epidermidis
IKKEEKIGVLGLGLSFY

SEQ ID NO: 1806908 - protein, 18 aa, Staphylococcus epidermidis
IKKELSYAEEVFKKLNAT

SEQ ID NO: 1806909 - protein, 24 aa, Staphylococcus epidermidis
IKKELVIQVAREFAQNAIDTNGRS

SEQ ID NO: 1806910 - protein, 20 aa, Staphylococcus epidermidis
IKKELVVSGLMINKRATFGK

SEQ ID NO: 1806911 - protein, 18 aa, Staphylococcus epidermidis
IKKFGAFVELPEGKSGLV

SEQ ID NO: 1806912 - protein, 20 aa, Staphylococcus epidermidis
IKKKYVAKLKGYLMREEIKQ

SEQ ID NO: 1806913 - protein, 25 aa, Staphylococcus epidermidis
IKKKYVAKLKGYLMREEVKELEKGI

SEQ ID NO: 1806914 - protein, 22 aa, Staphylococcus epidermidis
IKKLKMRNHVFLLGHRKNPFYV

SEQ ID NO: 1806915 - protein, 25 aa, Staphylococcus epidermidis
IKKLREYLDDFPIVAIGGINESNVA

SEQ ID NO: 1806916 - protein, 21 aa, Staphylococcus epidermidis
IKKRTKHTFDLLTALEYDKRL

SEQ ID NO: 1806917 - protein, 18 aa, Staphylococcus epidermidis
IKLAERGHDIHFITSNIP

SEQ ID NO: 1806918 - protein, 17 aa, Staphylococcus epidermidis
IKLESTHLVEYMDDKYP

SEQ ID NO: 1806919 - protein, 18 aa, Staphylococcus epidermidis
IKLIAFIFKTTPEWLLYG

SEQ ID NO: 1806920 - protein, 19 aa, Staphylococcus epidermidis
IKLLLNYTDTYISGHDIAK

SEQ ID NO: 1806921 - protein, 18 aa, Staphylococcus epidermidis
IKLLQYYSNLGIKVEGLK

SEQ ID NO: 1806922 - protein, 17 aa, Staphylococcus epidermidis
IKLNASIYVSGESDDML

SEQ ID NO: 1806923 - protein, 18 aa, Staphylococcus epidermidis
IKLTEDILSKNERTFLPI

SEQ ID NO: 1806924 - protein, 19 aa, Staphylococcus epidermidis
IKLVDEFSSTKIIREVDRL

SEQ ID NO: 1806925 - protein, 20 aa, Staphylococcus epidermidis
IKMLNLFNFLLLSECFNNPI

SEQ ID NO: 1806926 - protein, 23 aa, Staphylococcus epidermidis
IKNAKFPVLLAGMRSSSQAETEA

SEQ ID NO: 1806927 - protein, 26 aa, Staphylococcus epidermidis
IKNCMLYTSLQLIWAQAIKNGRKYKN

SEQ ID NO: 1806928 - protein, 20 aa, Staphylococcus epidermidis
IKNDVDVEKVIQRVIRNKKK

SEQ ID NO: 1806929 - protein, 17 aa, Staphylococcus epidermidis
IKNESFDNYFVIPYGGL

SEQ ID NO: 1806930 - protein, 17 aa, Staphylococcus epidermidis
IKNEVVKELGFDFSNSH

SEQ ID NO: 1806931 - protein, 27 aa, Staphylococcus epidermidis
IKNHQSFNFPKFIKLIKDRDSEAIYEE

SEQ ID NO: 1806932 - protein, 22 aa, Staphylococcus epidermidis
IKNIQIGMAHRGRLNVLTHVLE

SEQ ID NO: 1806933 - protein, 17 aa, Staphylococcus epidermidis
IKNSLSPYEEIVDSANA

SEQ ID NO: 1806934 - protein, 19 aa, Staphylococcus epidermidis
IKPGEVVGLIGKNGSGKST

SEQ ID NO: 1806935 - protein, 32 aa, Staphylococcus epidermidis
IKPHLEKGNALAFAHGFNIHFSVIEPPSDVDV

SEQ ID NO: 1806936 - protein, 18 aa, Staphylococcus epidermidis
IKPLGHIATIVAFNDKQD

SEQ ID NO: 1806937 - protein, 21 aa, Staphylococcus epidermidis
IKPLHHIIDIPKRVFAKLDIT

SEQ ID NO: 1806938 - protein, 18 aa, Staphylococcus epidermidis
IKPLRELEVIEGDYDDVI

SEQ ID NO: 1806939 - protein, 19 aa, Staphylococcus epidermidis
IKPNFTIVSAPHFKADPEV

SEQ ID NO: 1806940 - protein, 17 aa, Staphylococcus epidermidis
IKQIILVSPTLGSHMLV

SEQ ID NO: 1806941 - protein, 22 aa, Staphylococcus epidermidis
IKQLIKQYGLLYIIDDKFNYST

SEQ ID NO: 1806942 - protein, 21 aa, Staphylococcus epidermidis
IKQNFKNAQYFGFTGTPRFEE

SEQ ID NO: 1806943 - protein, 17 aa, Staphylococcus epidermidis
IKRAKLRGERSEGMICS

SEQ ID NO: 1806944 - protein, 22 aa, Staphylococcus epidermidis
IKRHFDCAMIFISHDLTVINQL

SEQ ID NO: 1806945 - protein, 20 aa, Staphylococcus epidermidis
IKRILNYSYGNSFDFVLNDD

SEQ ID NO: 1806946 - protein, 18 aa, Staphylococcus epidermidis
IKRISYKVLQAAKRAQRG

SEQ ID NO: 1806947 - protein, 21 aa, Staphylococcus epidermidis
IKRNIKPGGTIVYSTCTIEQM

SEQ ID NO: 1806948 - protein, 20 aa, Staphylococcus epidermidis
IKSIRPIARLGYYDYTVVDE

SEQ ID NO: 1806949 - protein, 18 aa, Staphylococcus epidermidis
IKSIRTIARLGYYDYTVV

SEQ ID NO: 1806950 - protein, 17 aa, Staphylococcus epidermidis
IKSKLLLPQSSIEEDIE

SEQ ID NO: 1806951 - protein, 26 aa, Staphylococcus epidermidis
IKSLAIKFDIEYVLKECNRIEKEALT

SEQ ID NO: 1806952 - protein, 43 aa, Staphylococcus epidermidis
IKSLFYSKGKECGAREVFLDYVWNVQFAMQFSYSFSLLHTTAY

SEQ ID NO: 1806953 - protein, 25 aa, Staphylococcus epidermidis
IKSLKISFNKVFGYFIEITRANLQG

SEQ ID NO: 1806954 - protein, 17 aa, Staphylococcus epidermidis
IKSPLAIFKMINTTEDI

SEQ ID NO: 1806955 - protein, 17 aa, Staphylococcus epidermidis
IKSREIYETPGAKVILK

SEQ ID NO: 1806956 - protein, 20 aa, Staphylococcus epidermidis
IKSRGKDACETFIFDPEKVE

SEQ ID NO: 1806957 - protein, 20 aa, Staphylococcus epidermidis
IKSSYKIALENSDKVAQYLL

SEQ ID NO: 1806958 - protein, 18 aa, Staphylococcus epidermidis
IKTFKFFSQYGNFKEMDS

SEQ ID NO: 1806959 - protein, 25 aa, Staphylococcus epidermidis
IKTFRKCKYVFINGNSWDKVYKSSE

SEQ ID NO: 1806960 - protein, 30 aa, Staphylococcus epidermidis
IKTKYIYGSRKAWRIPSFINEVDKEFFSPF

SEQ ID NO: 1806961 - protein, 18 aa, Staphylococcus epidermidis
IKTSKNILNQMVKQGSIT

SEQ ID NO: 1806962 - protein, 26 aa, Staphylococcus epidermidis
IKTVTELGKAFALCATKPTAQELNDE

SEQ ID NO: 1806963 - protein, 22 aa, Staphylococcus epidermidis
IKVIRNYLGLIIQKQIIKTSKS

SEQ ID NO: 1806964 - protein, 17 aa, Staphylococcus epidermidis
IKVPLAPKGTDFQQKVW

SEQ ID NO: 1806965 - protein, 17 aa, Staphylococcus epidermidis
IKVSYIRMFDDLRTELE

SEQ ID NO: 1806966 - protein, 19 aa, Staphylococcus epidermidis
IKVSYIRMFDELRSELEKK

SEQ ID NO: 1806967 - protein, 19 aa, Staphylococcus epidermidis
IKVTRLAQGLSVGGDLEYA

SEQ ID NO: 1806968 - protein, 19 aa, Staphylococcus epidermidis
IKWNFTKFLIDREGNVIKR

SEQ ID NO: 1806969 - protein, 17 aa, Staphylococcus epidermidis
IKWNFTKFLVDREGNVV

SEQ ID NO: 1806970 - protein, 20 aa, Staphylococcus epidermidis
IKYFYCALGKITDKEAKIKK

SEQ ID NO: 1806971 - protein, 20 aa, Staphylococcus epidermidis
IKYGEGLAEYAEEYVSSLDN

SEQ ID NO: 1806972 - protein, 19 aa, Staphylococcus epidermidis
IKYQLKLSINNKFDMYEHI

SEQ ID NO: 1806973 - protein, 19 aa, Staphylococcus epidermidis
IKYSIMGHVHFRKEIKENG

SEQ ID NO: 1806974 - protein, 24 aa, Staphylococcus epidermidis
IKYSNALLKEIRRMIKVLNLYSSQ

SEQ ID NO: 1806975 - protein, 22 aa, Staphylococcus epidermidis
IKYSNHIIKAFFNLHKNSKVIF

SEQ ID NO: 1806976 - protein, 17 aa, Staphylococcus epidermidis
ILDALTSGLARRGINVN

SEQ ID NO: 1806977 - protein, 20 aa, Staphylococcus epidermidis
ILDFRLKVINGDIKHHKNPL

SEQ ID NO: 1806978 - protein, 25 aa, Staphylococcus epidermidis
ILDIEIPGITGLEILSYIRKKQLNT

SEQ ID NO: 1806979 - protein, 20 aa, Staphylococcus epidermidis
ILDLPDYTFPLFGMAVGEPA

SEQ ID NO: 1806980 - protein, 23 aa, Staphylococcus epidermidis
ILDQLPCWLTYTNGETHKVIDDN

SEQ ID NO: 1806981 - protein, 19 aa, Staphylococcus epidermidis
ILDRICIRKPGTYEFNDYQ

SEQ ID NO: 1806982 - protein, 17 aa, Staphylococcus epidermidis
ILDRTGYTPVERQQIET

SEQ ID NO: 1806983 - protein, 26 aa, Staphylococcus epidermidis
ILDVMVEPFFEWVIEKDAWYGEELNH

SEQ ID NO: 1806984 - protein, 17 aa, Staphylococcus epidermidis
ILEGCRHHKVGNLIYAS

SEQ ID NO: 1806985 - protein, 17 aa, Staphylococcus epidermidis
ILERTAVVIKNHQIEAR

SEQ ID NO: 1806986 - protein, 25 aa, Staphylococcus epidermidis
ILEVNYKLAILISLMNSVFEFEEDD

SEQ ID NO: 1806987 - protein, 20 aa, Staphylococcus epidermidis
ILFSKSFKEIEEFIKNYKSP

SEQ ID NO: 1806988 - protein, 23 aa, Staphylococcus epidermidis
ILFVPTFKFELNINNLKELIVLN

SEQ ID NO: 1806989 - protein, 17 aa, Staphylococcus epidermidis
ILGIPSFLVFKEGELLG

SEQ ID NO: 1806990 - protein, 24 aa, Staphylococcus epidermidis
ILGSKWKKYIGSVAKDMKSLGVDA

SEQ ID NO: 1806991 - protein, 24 aa, Staphylococcus epidermidis
ILIADPRIEGGAFYLGSENYEQAI

SEQ ID NO: 1806992 - protein, 18 aa, Staphylococcus epidermidis
ILIDLANVVVHVFHKDER

SEQ ID NO: 1806993 - protein, 26 aa, Staphylococcus epidermidis
ILIRSNVMGLNILKGYLWSDYMIENI

SEQ ID NO: 1806994 - protein, 20 aa, Staphylococcus epidermidis
ILKAKRRGFHYISESGIHSI

SEQ ID NO: 1806995 - protein, 17 aa, Staphylococcus epidermidis
ILKDDGVLVSLQNGVPE

SEQ ID NO: 1806996 - protein, 26 aa, Staphylococcus epidermidis
ILKDQKRLLPSIAYLDGEYGFSDICL

SEQ ID NO: 1806997 - protein, 18 aa, Staphylococcus epidermidis
ILKGYLWSDYMIENIDEE

SEQ ID NO: 1806998 - protein, 23 aa, Staphylococcus epidermidis
ILKKRYILKNVVEKIRQNYNFDF

SEQ ID NO: 1806999 - protein, 18 aa, Staphylococcus epidermidis
ILKNFGCSKIFKEKVSGR

SEQ ID NO: 1807000 - protein, 18 aa, Staphylococcus epidermidis
ILKNKDFYISTSIEEQKR

SEQ ID NO: 1807001 - protein, 17 aa, Staphylococcus epidermidis
ILKVDGFLNHQIDASLM

SEQ ID NO: 1807002 - protein, 17 aa, Staphylococcus epidermidis
ILLATGFVNQLGAQPFV

SEQ ID NO: 1807003 - protein, 25 aa, Staphylococcus epidermidis
ILLFWPIEGSMHFQQFMKERILTDE

SEQ ID NO: 1807004 - protein, 19 aa, Staphylococcus epidermidis
ILLHSCCAPCSTYTLEFLT

SEQ ID NO: 1807005 - protein, 27 aa, Staphylococcus epidermidis
ILMEHLRLAKYQDMMLISGKQFEVGNA

SEQ ID NO: 1807006 - protein, 17 aa, Staphylococcus epidermidis
ILNDLACAYLDINSDQL

SEQ ID NO: 1807007 - protein, 17 aa, Staphylococcus epidermidis
ILNDSGLAIEPAATMAE

SEQ ID NO: 1807008 - protein, 24 aa, Staphylococcus epidermidis
ILNFPQRPGALREFVNDVLGSQDD

SEQ ID NO: 1807009 - protein, 21 aa, Staphylococcus epidermidis
ILNKLKYKSLVNEVGEGDSTK

SEQ ID NO: 1807010 - protein, 17 aa, Staphylococcus epidermidis
ILNLVMLCGCQGVNGGG

SEQ ID NO: 1807011 - protein, 19 aa, Staphylococcus epidermidis
ILNLYFPFIDVETMLTLLD

SEQ ID NO: 1807012 - protein, 22 aa, Staphylococcus epidermidis
ILNQLPCWLTYTNGDTHQVIDD

SEQ ID NO: 1807013 - protein, 17 aa, Staphylococcus epidermidis
ILNRIGTYYFGSDEVSI

SEQ ID NO: 1807014 - protein, 27 aa, Staphylococcus epidermidis
ILPVEHPPRILGFDAAGIVEQVGEDVT

SEQ ID NO: 1807015 - protein, 24 aa, Staphylococcus epidermidis
ILQHLAAKHGINFHEMAFKEEKNA

SEQ ID NO: 1807016 - protein, 17 aa, Staphylococcus epidermidis
ILQKLPINKMNSLSIHQ

SEQ ID NO: 1807017 - protein, 23 aa, Staphylococcus epidermidis
ILRHSIKLGKIDHIFITHMHGDH

SEQ ID NO: 1807018 - protein, 20 aa, Staphylococcus epidermidis
ILRQRLASGWKFEDAIEAPI

SEQ ID NO: 1807019 - protein, 21 aa, Staphylococcus epidermidis
ILRRKLDLSKTINLIITHTHT

SEQ ID NO: 1807020 - protein, 24 aa, Staphylococcus epidermidis
ILSDINYVIEWLREGHEPNNYNAI

SEQ ID NO: 1807021 - protein, 25 aa, Staphylococcus epidermidis
ILSEDCILCTYTLFNTTNNTITNRS

SEQ ID NO: 1807022 - protein, 17 aa, Staphylococcus epidermidis
ILSETLPEYMIPVHFMK

SEQ ID NO: 1807023 - protein, 17 aa, Staphylococcus epidermidis
ILSEYGHEQLKLFLNEA

SEQ ID NO: 1807024 - protein, 18 aa, Staphylococcus epidermidis
ILSKVLVRATQKWPNDKA

SEQ ID NO: 1807025 - protein, 18 aa, Staphylococcus epidermidis
ILSSVLMLEHLGWQEAAD

SEQ ID NO: 1807026 - protein, 30 aa, Staphylococcus epidermidis
ILTEYYREVPILGVCLGFQVIVEHFGGQII

SEQ ID NO: 1807027 - protein, 23 aa, Staphylococcus epidermidis
ILTGNFLLALGLQHLSEIKDSRV

SEQ ID NO: 1807028 - protein, 19 aa, Staphylococcus epidermidis
ILTINDFADDLIITGKTPS

SEQ ID NO: 1807029 - protein, 18 aa, Staphylococcus epidermidis
ILYKKIVPEEGIVKQFSH

SEQ ID NO: 1807030 - protein, 17 aa, Staphylococcus epidermidis
IMASVSYNFDGEKDFEG

SEQ ID NO: 1807031 - protein, 19 aa, Staphylococcus epidermidis
IMEGIKYLIDHPEIKHGTI

SEQ ID NO: 1807032 - protein, 36 aa, Staphylococcus epidermidis
IMEGIKYLIEHPEIKHGRIRIGFTPDEEIGRGPHKF

SEQ ID NO: 1807033 - protein, 20 aa, Staphylococcus epidermidis
IMFTDGFNLKGLNRATATYK

SEQ ID NO: 1807034 - protein, 18 aa, Staphylococcus epidermidis
IMGAKACYPQMIKATLME

SEQ ID NO: 1807035 - protein, 17 aa, Staphylococcus epidermidis
IMGMNFHLVCPKELNPT

SEQ ID NO: 1807036 - protein, 19 aa, Staphylococcus epidermidis
IMIGDEIQFILTKRLESYI

SEQ ID NO: 1807037 - protein, 18 aa, Staphylococcus epidermidis
IMKESCKMLEEFEIPYDK

SEQ ID NO: 1807038 - protein, 17 aa, Staphylococcus epidermidis
IMLDIVINHTSTHHEWF

SEQ ID NO: 1807039 - protein, 18 aa, Staphylococcus epidermidis
IMNHLVDISIDYVVAQVE

SEQ ID NO: 1807040 - protein, 27 aa, Staphylococcus epidermidis
IMNPNYCGRVINQYGQFDNMFPSIVSA

SEQ ID NO: 1807041 - protein, 23 aa, Staphylococcus epidermidis
IMPPEHFSSCFIANIILEGKSTK

SEQ ID NO: 1807042 - protein, 18 aa, Staphylococcus epidermidis
IMQPFKVYPDGFPDELVK

SEQ ID NO: 1807043 - protein, 25 aa, Staphylococcus epidermidis
IMSGNFVMRGEPAIYHKFKRTEMAL

SEQ ID NO: 1807044 - protein, 19 aa, Staphylococcus epidermidis
IMTEIPFKFFDQLTDIKVP

SEQ ID NO: 1807045 - protein, 19 aa, Staphylococcus epidermidis
IMTKCTKTLIRYVYEEYDI

SEQ ID NO: 1807046 - protein, 34 aa, Staphylococcus epidermidis
IMTSICKKWYINSFRYFRNMYKRFYYSRPNELDK

SEQ ID NO: 1807047 - protein, 17 aa, Staphylococcus epidermidis
INADPAKKEAFDNAIKE

SEQ ID NO: 1807048 - protein, 17 aa, Staphylococcus epidermidis
INAESKWGQLTRPTKVK

SEQ ID NO: 1807049 - protein, 22 aa, Staphylococcus epidermidis
INAHPEFGHKVAKYISKNTGYA

SEQ ID NO: 1807050 - protein, 22 aa, Staphylococcus epidermidis
INAHPEFGHKVAKYISQNTGYA

SEQ ID NO: 1807051 - protein, 25 aa, Staphylococcus epidermidis
INAMKRNDLVFGIGPAGTGKTFLAV

SEQ ID NO: 1807052 - protein, 17 aa, Staphylococcus epidermidis
INASLIKSKNDYISLGL

SEQ ID NO: 1807053 - protein, 18 aa, Staphylococcus epidermidis
INAYIPGIGHNLQEHSVV

SEQ ID NO: 1807054 - protein, 17 aa, Staphylococcus epidermidis
INAYRLAERYSNIATNC

SEQ ID NO: 1807055 - protein, 25 aa, Staphylococcus epidermidis
INDFAYKHQIPWIYGGVVQSTYVQA

SEQ ID NO: 1807056 - protein, 26 aa, Staphylococcus epidermidis
INDKYCNLSFLAKILYSILSKLQFRN

SEQ ID NO: 1807057 - protein, 19 aa, Staphylococcus epidermidis
INDLLKIKGIGLYKAVILQ

SEQ ID NO: 1807058 - protein, 17 aa, Staphylococcus epidermidis
INDVKRVCTIISKSIQE

SEQ ID NO: 1807059 - protein, 25 aa, Staphylococcus epidermidis
INEALKQLVECGADVVGLNCHHGPH

SEQ ID NO: 1807060 - protein, 26 aa, Staphylococcus epidermidis
INEELGITILINLHFVDLAREYGSRI

SEQ ID NO: 1807061 - protein, 22 aa, Staphylococcus epidermidis
INEFKFFAQYANFKELKDYKNG

SEQ ID NO: 1807062 - protein, 17 aa, Staphylococcus epidermidis
INELKKYRGHLADQEAF

SEQ ID NO: 1807063 - protein, 17 aa, Staphylococcus epidermidis
INELPIVEEFRSAQYEA

SEQ ID NO: 1807064 - protein, 26 aa, Staphylococcus epidermidis
INEMIPVEWERVYTMAYIDDQGGEVF

SEQ ID NO: 1807065 - protein, 19 aa, Staphylococcus epidermidis
INENFKIFIIMDTDDCNKE

SEQ ID NO: 1807066 - protein, 21 aa, Staphylococcus epidermidis
INESIATRMEVELEKMKNQIV

SEQ ID NO: 1807067 - protein, 26 aa, Staphylococcus epidermidis
INFMAKEGRGLICAPIDRSIARRLEL

SEQ ID NO: 1807068 - protein, 22 aa, Staphylococcus epidermidis
INFPSDKFNNGFTLQDTPGVDS

SEQ ID NO: 1807069 - protein, 25 aa, Staphylococcus epidermidis
INFREEIKDILSLVEEIIERTKNAQ

SEQ ID NO: 1807070 - protein, 24 aa, Staphylococcus epidermidis
INFYKYDFNIAVQFNHHKSALVFA

SEQ ID NO: 1807071 - protein, 24 aa, Staphylococcus epidermidis
INGEIRPGIVHRIDKDTSGLLMVA

SEQ ID NO: 1807072 - protein, 23 aa, Staphylococcus epidermidis
INGGKFNGIIPISQLSTHHIESP

SEQ ID NO: 1807073 - protein, 18 aa, Staphylococcus epidermidis
INGLGAMVTTFGVGELSA

SEQ ID NO: 1807074 - protein, 19 aa, Staphylococcus epidermidis
INGVLPPIISIVASYEVAE

SEQ ID NO: 1807075 - protein, 17 aa, Staphylococcus epidermidis
INGVLPPVISMIASYEV

SEQ ID NO: 1807076 - protein, 21 aa, Staphylococcus epidermidis
INHDWTKLGTSIVDIVQNGVT

SEQ ID NO: 1807077 - protein, 23 aa, Staphylococcus epidermidis
INHKVILECISFNMTGQYLLICG

SEQ ID NO: 1807078 - protein, 21 aa, Staphylococcus epidermidis
INHLPVAMIINQKRLGGNSRS

SEQ ID NO: 1807079 - protein, 18 aa, Staphylococcus epidermidis
INHYGDKVLLPLAYIDLD

SEQ ID NO: 1807080 - protein, 17 aa, Staphylococcus epidermidis
INIDMDLQFTDENINTV

SEQ ID NO: 1807081 - protein, 17 aa, Staphylococcus epidermidis
INIGCIPTKTLIHDGIE

SEQ ID NO: 1807082 - protein, 29 aa, Staphylococcus epidermidis
INILSFREAMIRSQILGLIDNYDYEGALN

SEQ ID NO: 1807083 - protein, 27 aa, Staphylococcus epidermidis
INIPVGVLLPFKSQCFVRHYNKGQIVY

SEQ ID NO: 1807084 - protein, 19 aa, Staphylococcus epidermidis
INISIAVADKDKLYVPVIK

SEQ ID NO: 1807085 - protein, 17 aa, Staphylococcus epidermidis
INISMSAVMSMRKFIGI

SEQ ID NO: 1807086 - protein, 26 aa, Staphylococcus epidermidis
INITLDMDDRIPINVWTGESISRSGN

SEQ ID NO: 1807087 - protein, 24 aa, Staphylococcus epidermidis
INKEMFKRQGGYGRGRRMQIEKDT

SEQ ID NO: 1807088 - protein, 20 aa, Staphylococcus epidermidis
INKGEFLAIVGPNGAGKSTL

SEQ ID NO: 1807089 - protein, 21 aa, Staphylococcus epidermidis
INKGEFLAIVGPNGAGKSTLL

SEQ ID NO: 1807090 - protein, 18 aa, Staphylococcus epidermidis
INKLSAGMWIVGKDIEPG

SEQ ID NO: 1807091 - protein, 23 aa, Staphylococcus epidermidis
INKNGKIAISFKEDDELIAVRLT

SEQ ID NO: 1807092 - protein, 22 aa, Staphylococcus epidermidis
INKNVKIEWKVPDIQPQDIINY

SEQ ID NO: 1807093 - protein, 17 aa, Staphylococcus epidermidis
INKQWYPTVDKVSFKLE

SEQ ID NO: 1807094 - protein, 23 aa, Staphylococcus epidermidis
INKRANHVISCFVQVNVSGEESK

SEQ ID NO: 1807095 - protein, 24 aa, Staphylococcus epidermidis
INKRVDIMLGHGLFKEVQQLVEQG

SEQ ID NO: 1807096 - protein, 25 aa, Staphylococcus epidermidis
INKVFRAVGPPGKIFKRSTVIDNDI

SEQ ID NO: 1807097 - protein, 24 aa, Staphylococcus epidermidis
INKVKEFIDHLPFELTDAQKTSVN

SEQ ID NO: 1807098 - protein, 18 aa, Staphylococcus epidermidis
INKYREVVTFYEITRDYD

SEQ ID NO: 1807099 - protein, 22 aa, Staphylococcus epidermidis
INLEVFKGDHIAIIGPNGVGKT

SEQ ID NO: 1807100 - protein, 25 aa, Staphylococcus epidermidis
INLKSSGRMVGIISHVSELKQRIPL

SEQ ID NO: 1807101 - protein, 20 aa, Staphylococcus epidermidis
INLMNCFKILDSVSIPQGAV

SEQ ID NO: 1807102 - protein, 21 aa, Staphylococcus epidermidis
INLNRYIYKDIKGEFIEILHD

SEQ ID NO: 1807103 - protein, 22 aa, Staphylococcus epidermidis
INLNRYIYKDIKGEFIEILHDI

SEQ ID NO: 1807104 - protein, 22 aa, Staphylococcus epidermidis
INLRYPEGFKFEDAIDRFRSEI

SEQ ID NO: 1807105 - protein, 26 aa, Staphylococcus epidermidis
INLSEPKALIGFAGRRVIEQTINEKL

SEQ ID NO: 1807106 - protein, 23 aa, Staphylococcus epidermidis
INNCVTIEPGIYIEGLGGVRIED

SEQ ID NO: 1807107 - protein, 17 aa, Staphylococcus epidermidis
INNELEDIFTIMLENSF

SEQ ID NO: 1807108 - protein, 22 aa, Staphylococcus epidermidis
INPDLIGGFRVKVGTNVMDGSV

SEQ ID NO: 1807109 - protein, 21 aa, Staphylococcus epidermidis
INPIMRHHLNIYLNVDAPKGF

SEQ ID NO: 1807110 - protein, 26 aa, Staphylococcus epidermidis
INQGLFYLDWLLDHKAEFELIVMKKL

SEQ ID NO: 1807111 - protein, 23 aa, Staphylococcus epidermidis
INQLKHVLNIDAKHVDAIYNLGL

SEQ ID NO: 1807112 - protein, 23 aa, Staphylococcus epidermidis
INQLPRYIEMTVKGKKILFIHYE

SEQ ID NO: 1807113 - protein, 19 aa, Staphylococcus epidermidis
INQLPYYKVIDQYIFVHAG

SEQ ID NO: 1807114 - protein, 17 aa, Staphylococcus epidermidis
INQPSWMHQLLKFYQLA

SEQ ID NO: 1807115 - protein, 22 aa, Staphylococcus epidermidis
INRDLFKYIPFDGSIITISELQ

SEQ ID NO: 1807116 - protein, 20 aa, Staphylococcus epidermidis
INRLIKIINVLGYEYNKDTG

SEQ ID NO: 1807117 - protein, 25 aa, Staphylococcus epidermidis
INRLIPLSEGYIYFKEKPISDYPVY

SEQ ID NO: 1807118 - protein, 24 aa, Staphylococcus epidermidis
INRLKSQYYFVLAIGNNTVREKIF

SEQ ID NO: 1807119 - protein, 17 aa, Staphylococcus epidermidis
INSGLFSQMLLNGDIEG

SEQ ID NO: 1807120 - protein, 17 aa, Staphylococcus epidermidis
INSWVPLMMEGRQSDEA

SEQ ID NO: 1807121 - protein, 26 aa, Staphylococcus epidermidis
INSYDPRLFEGFSMGNPKIQTGNLLE

SEQ ID NO: 1807122 - protein, 25 aa, Staphylococcus epidermidis
INTELPQHITICSGLIKADKYEWMI

SEQ ID NO: 1807123 - protein, 21 aa, Staphylococcus epidermidis
INTLFFRRLFEAALKERQYYF

SEQ ID NO: 1807124 - protein, 23 aa, Staphylococcus epidermidis
INTSGRLGKAIMLYHSKVVNKCH

SEQ ID NO: 1807125 - protein, 17 aa, Staphylococcus epidermidis
INTVITMIGEHMDSNER

SEQ ID NO: 1807126 - protein, 24 aa, Staphylococcus epidermidis
INVKEIRLSPTIEEHDFQTKLKNG

SEQ ID NO: 1807127 - protein, 25 aa, Staphylococcus epidermidis
INVPEARLLVISPYDKTSVADIEKA

SEQ ID NO: 1807128 - protein, 19 aa, Staphylococcus epidermidis
INVPKKCTRDIKSFNFMTD

SEQ ID NO: 1807129 - protein, 24 aa, Staphylococcus epidermidis
INYHSNYDMLSWLQDPFTKNKTGK

SEQ ID NO: 1807130 - protein, 24 aa, Staphylococcus epidermidis
INYHSTYDILSWVQDPVFKNNPGK

SEQ ID NO: 1807131 - protein, 18 aa, Staphylococcus epidermidis
IPAAFSVEPGESFRMECL

SEQ ID NO: 1807132 - protein, 27 aa, Staphylococcus epidermidis
IPCILYGELYTRYGAILNKVYSKTDSK

SEQ ID NO: 1807133 - protein, 19 aa, Staphylococcus epidermidis
IPDGKKFAPAFDVDMNQPG

SEQ ID NO: 1807134 - protein, 21 aa, Staphylococcus epidermidis
IPDSIFPLFMYSKGNINLLDF

SEQ ID NO: 1807135 - protein, 22 aa, Staphylococcus epidermidis
IPDSLGICIHTSYGSIVYTGEF

SEQ ID NO: 1807136 - protein, 30 aa, Staphylococcus epidermidis
IPDTGFYRFWIQGIFARWPKNPNIEDLIKA

SEQ ID NO: 1807137 - protein, 24 aa, Staphylococcus epidermidis
IPEIAKLACLTIDTSMRHLDDITK

SEQ ID NO: 1807138 - protein, 22 aa, Staphylococcus epidermidis
IPEMLTENFIPRTELRETTMTI

SEQ ID NO: 1807139 - protein, 17 aa, Staphylococcus epidermidis
IPEMYYLDVASPGAERP

SEQ ID NO: 1807140 - protein, 20 aa, Staphylococcus epidermidis
IPESYLRKFDYLVFPDNVAI

SEQ ID NO: 1807141 - protein, 21 aa, Staphylococcus epidermidis
IPEVIGVRLTHSLPQGSTATD

SEQ ID NO: 1807142 - protein, 19 aa, Staphylococcus epidermidis
IPEVIGVRLTNSLPQGSTA

SEQ ID NO: 1807143 - protein, 26 aa, Staphylococcus epidermidis
IPFFGICLGHQLFALSQGATSFKMKF

SEQ ID NO: 1807144 - protein, 24 aa, Staphylococcus epidermidis
IPFKGQMWLNRLGFVDDEQAYHKH

SEQ ID NO: 1807145 - protein, 17 aa, Staphylococcus epidermidis
IPGIGKLSTAMIIGEIG

SEQ ID NO: 1807146 - protein, 17 aa, Staphylococcus epidermidis
IPGLYAYEAGQPAVGDL

SEQ ID NO: 1807147 - protein, 17 aa, Staphylococcus epidermidis
IPGSHVVILNNHPSEET

SEQ ID NO: 1807148 - protein, 18 aa, Staphylococcus epidermidis
IPGVIAVIPLKEEGDEVI

SEQ ID NO: 1807149 - protein, 23 aa, Staphylococcus epidermidis
IPGVIQYRNYIGIQFHPEKSGTY

SEQ ID NO: 1807150 - protein, 17 aa, Staphylococcus epidermidis
IPHLGWNELKSTHPLLQ

SEQ ID NO: 1807151 - protein, 26 aa, Staphylococcus epidermidis
IPHNKIWLDPGIGFAKTREEGNEVMA

SEQ ID NO: 1807152 - protein, 25 aa, Staphylococcus epidermidis
IPHNKIWLDPGIGFPKTREEENEVM

SEQ ID NO: 1807153 - protein, 20 aa, Staphylococcus epidermidis
IPIDHCYKCDYDGDFETTEN

SEQ ID NO: 1807154 - protein, 21 aa, Staphylococcus epidermidis
IPIHLYMRITGHHILSSGSKI

SEQ ID NO: 1807155 - protein, 17 aa, Staphylococcus epidermidis
IPISTGITEASKIANTI

SEQ ID NO: 1807156 - protein, 24 aa, Staphylococcus epidermidis
IPKEQIVAGSVEFGATFEGPGKSK

SEQ ID NO: 1807157 - protein, 21 aa, Staphylococcus epidermidis
IPKIAMEGILSRIVEIDYMQR

SEQ ID NO: 1807158 - protein, 21 aa, Staphylococcus epidermidis
IPKLFWPIYYFIQAPIQGLFM

SEQ ID NO: 1807159 - protein, 19 aa, Staphylococcus epidermidis
IPKPLRDLGYRLFANNRDK

SEQ ID NO: 1807160 - protein, 20 aa, Staphylococcus epidermidis
IPLERALENLSTFKPFEKVL

SEQ ID NO: 1807161 - protein, 21 aa, Staphylococcus epidermidis
IPLKIKEPLNFEVRGEAYMPR

SEQ ID NO: 1807162 - protein, 17 aa, Staphylococcus epidermidis
IPMCGVPYHSADNYIET

SEQ ID NO: 1807163 - protein, 19 aa, Staphylococcus epidermidis
IPMCGVPYHSADSYIETLI

SEQ ID NO: 1807164 - protein, 23 aa, Staphylococcus epidermidis
IPMLEILKKLDVHDVCVVVTRYF

SEQ ID NO: 1807165 - protein, 26 aa, Staphylococcus epidermidis
IPMLEILKKLEIHNVCVVVTRYFGGI

SEQ ID NO: 1807166 - protein, 21 aa, Staphylococcus epidermidis
IPNYRLGYKKDHIHIEHNIID

SEQ ID NO: 1807167 - protein, 28 aa, Staphylococcus epidermidis
IPQEMPSRIPIGLPISGTTVYVMQGDRI

SEQ ID NO: 1807168 - protein, 28 aa, Staphylococcus epidermidis
IPQEMPSRIPIGLPISGTTVYVMQGERI

SEQ ID NO: 1807169 - protein, 19 aa, Staphylococcus epidermidis
IPQGITLIVGGGYHGKSTL

SEQ ID NO: 1807170 - protein, 25 aa, Staphylococcus epidermidis
IPQGKIWLDPGVGFAKTREEENEVM

SEQ ID NO: 1807171 - protein, 19 aa, Staphylococcus epidermidis
IPQRLIAYINQQPVGIVDL

SEQ ID NO: 1807172 - protein, 19 aa, Staphylococcus epidermidis
IPRLNVLDLQRLIRVIPKP

SEQ ID NO: 1807173 - protein, 19 aa, Staphylococcus epidermidis
IPSKALLHASHRFVEAQHS

SEQ ID NO: 1807174 - protein, 18 aa, Staphylococcus epidermidis
IPSLTLGCGSHGRNSISH

SEQ ID NO: 1807175 - protein, 17 aa, Staphylococcus epidermidis
IPSNILIKNLSDGQKQK

SEQ ID NO: 1807176 - protein, 17 aa, Staphylococcus epidermidis
IPTEYTRWFMQSGSTRP

SEQ ID NO: 1807177 - protein, 18 aa, Staphylococcus epidermidis
IPTITIGVPLRYMHSNVS

SEQ ID NO: 1807178 - protein, 19 aa, Staphylococcus epidermidis
IPVDEVIGAMDRVGRNLPA

SEQ ID NO: 1807179 - protein, 18 aa, Staphylococcus epidermidis
IPVDYDLVPKCVYTYPEV

SEQ ID NO: 1807180 - protein, 18 aa, Staphylococcus epidermidis
IQAGLGRSGKLFATDWDN

SEQ ID NO: 1807181 - protein, 17 aa, Staphylococcus epidermidis
IQAPFEVPDEFLMAIEL

SEQ ID NO: 1807182 - protein, 19 aa, Staphylococcus epidermidis
IQDEGRIGYQDLGFSGAGA

SEQ ID NO: 1807183 - protein, 25 aa, Staphylococcus epidermidis
IQEAAKLGFKRAIIPQTNIGGWTFP

SEQ ID NO: 1807184 - protein, 18 aa, Staphylococcus epidermidis
IQEAMKLGDRICLLNEGH

SEQ ID NO: 1807185 - protein, 18 aa, Staphylococcus epidermidis
IQEAMKLGDRICLLNNGH

SEQ ID NO: 1807186 - protein, 17 aa, Staphylococcus epidermidis
IQEAVLNSLKYAEVNEI

SEQ ID NO: 1807187 - protein, 19 aa, Staphylococcus epidermidis
IQELIKLSLSNQGITNIDC

SEQ ID NO: 1807188 - protein, 24 aa, Staphylococcus epidermidis
IQFEIRHGVEFNVDIDILADFIAG

SEQ ID NO: 1807189 - protein, 17 aa, Staphylococcus epidermidis
IQFGPIDLKGLNAGEGR

SEQ ID NO: 1807190 - protein, 36 aa, Staphylococcus epidermidis
IQFKQAIDMIIKYHVPVCCFTFGIPDHETIQKLKEA

SEQ ID NO: 1807191 - protein, 29 aa, Staphylococcus epidermidis
IQFRPKKVMDTLELFKIAFPTDKSYQLSE

SEQ ID NO: 1807192 - protein, 24 aa, Staphylococcus epidermidis
IQGHNEFKMAYINKFNEMENAIQN

SEQ ID NO: 1807193 - protein, 26 aa, Staphylococcus epidermidis
IQGPDFPTAGLILGKSGIRRAYETGR

SEQ ID NO: 1807194 - protein, 18 aa, Staphylococcus epidermidis
IQGPIIWVEDTLIALQQL

SEQ ID NO: 1807195 - protein, 19 aa, Staphylococcus epidermidis
IQGTIGGIGERAGNTSIEQ

SEQ ID NO: 1807196 - protein, 20 aa, Staphylococcus epidermidis
IQIGHTFRTKMINNFRTILN

SEQ ID NO: 1807197 - protein, 17 aa, Staphylococcus epidermidis
IQILKFEHAFYCEACGN

SEQ ID NO: 1807198 - protein, 23 aa, Staphylococcus epidermidis
IQIPADVCTATFNDSLLTEMGSP

SEQ ID NO: 1807199 - protein, 24 aa, Staphylococcus epidermidis
IQKRFTLNILYPYIETIHITKDKN

SEQ ID NO: 1807200 - protein, 25 aa, Staphylococcus epidermidis
IQKRFTLNILYPYIETIHITKDKNL

SEQ ID NO: 1807201 - protein, 24 aa, Staphylococcus epidermidis
IQKRFTLNMLYPYIDEILITKSKT

SEQ ID NO: 1807202 - protein, 21 aa, Staphylococcus epidermidis
IQKRFTYGLSEVMNISHCNRF

SEQ ID NO: 1807203 - protein, 24 aa, Staphylococcus epidermidis
IQKSVKKIHDWDWLNKIQKKEKVQ

SEQ ID NO: 1807204 - protein, 17 aa, Staphylococcus epidermidis
IQLIIRGICCLKPGIPG

SEQ ID NO: 1807205 - protein, 22 aa, Staphylococcus epidermidis
IQLQEECIPVYKGTEMIDNTFY

SEQ ID NO: 1807206 - protein, 23 aa, Staphylococcus epidermidis
IQMAAQCLIQAIGGEGYVYIKGY

SEQ ID NO: 1807207 - protein, 25 aa, Staphylococcus epidermidis
IQNLKDLRNGIAVEVPTYDYANHTR

SEQ ID NO: 1807208 - protein, 24 aa, Staphylococcus epidermidis
IQNRKLRRPDLTFATLDHNVPTID

SEQ ID NO: 1807209 - protein, 21 aa, Staphylococcus epidermidis
IQNVWYYKLVDVYDITQTNAK

SEQ ID NO: 1807210 - protein, 24 aa, Staphylococcus epidermidis
IQPDKLVLSLAWKYAETLMNTGAE

SEQ ID NO: 1807211 - protein, 25 aa, Staphylococcus epidermidis
IQPGDDIGRAFSFETTEFILNQLPC

SEQ ID NO: 1807212 - protein, 23 aa, Staphylococcus epidermidis
IQPGDDVGRAFSYETTEYILDQL

SEQ ID NO: 1807213 - protein, 36 aa, Staphylococcus epidermidis
IQQAILRTRIKGLGKDRMTAIFPKLVFSIKKGVNFN

SEQ ID NO: 1807214 - protein, 23 aa, Staphylococcus epidermidis
IQQGLGRTGKWSSVDHYYFTPDL

SEQ ID NO: 1807215 - protein, 26 aa, Staphylococcus epidermidis
IQQGYLPLSWINKWKLYSPVQLPKRW

SEQ ID NO: 1807216 - protein, 29 aa, Staphylococcus epidermidis
IQQHFTLSMLYRYIDEIHISKNKSLVGIY

SEQ ID NO: 1807217 - protein, 18 aa, Staphylococcus epidermidis
IQRARLQISDAFFSEKTK

SEQ ID NO: 1807218 - protein, 23 aa, Staphylococcus epidermidis
IQSEFNITLNLEEIFNYHNLKQM

SEQ ID NO: 1807219 - protein, 24 aa, Staphylococcus epidermidis
IQSRFPYENIEWLIKEGYTKLTLL

SEQ ID NO: 1807220 - protein, 17 aa, Staphylococcus epidermidis
IQSRGFVYVRESEELLN

SEQ ID NO: 1807221 - protein, 20 aa, Staphylococcus epidermidis
IQTFSCIQLLIQTLSHTRKQ

SEQ ID NO: 1807222 - protein, 24 aa, Staphylococcus epidermidis
IQVISLRANHYFNPRKTYNKQGEP

SEQ ID NO: 1807223 - protein, 24 aa, Staphylococcus epidermidis
IQVITLRANHYFKPCKTHNKQGEP

SEQ ID NO: 1807224 - protein, 17 aa, Staphylococcus epidermidis
IQYRHYIGIQFHPEKSG

SEQ ID NO: 1807225 - protein, 22 aa, Staphylococcus epidermidis
IRAGYPANMFNKAEFRSFDHSI

SEQ ID NO: 1807226 - protein, 17 aa, Staphylococcus epidermidis
IRALIDLSDLATVIPIE

SEQ ID NO: 1807227 - protein, 23 aa, Staphylococcus epidermidis
IRAPQWRGGGIVFGPTPRSYSYK

SEQ ID NO: 1807228 - protein, 17 aa, Staphylococcus epidermidis
IRDAFGFEGTPIHIIPR

SEQ ID NO: 1807229 - protein, 26 aa, Staphylococcus epidermidis
IRDEETWMLFGTLPIYPCINDENDQK

SEQ ID NO: 1807230 - protein, 26 aa, Staphylococcus epidermidis
IRDGRARVSVGARSSVFAPFKNLGII

SEQ ID NO: 1807231 - protein, 20 aa, Staphylococcus epidermidis
IRDKFHIKDVHVIPGDSDSN

SEQ ID NO: 1807232 - protein, 18 aa, Staphylococcus epidermidis
IRDMLKERNIILEDTPQG

SEQ ID NO: 1807233 - protein, 18 aa, Staphylococcus epidermidis
IRDQLLLIGGLSKSHSAT

SEQ ID NO: 1807234 - protein, 19 aa, Staphylococcus epidermidis
IRDSTGYVHRHIGKVKENE

SEQ ID NO: 1807235 - protein, 34 aa, Staphylococcus epidermidis
IRDVFGYSVSKGWMCVQVFFIRQGNMIKRDATMI

SEQ ID NO: 1807236 - protein, 23 aa, Staphylococcus epidermidis
IRDVSKRVLAHILGVDLPNPSMI

SEQ ID NO: 1807237 - protein, 19 aa, Staphylococcus epidermidis
IREAFKDKILIPQNDLNRT

SEQ ID NO: 1807238 - protein, 27 aa, Staphylococcus epidermidis
IREGMLKDVLPIAFPFTPNVDVAGKIE

SEQ ID NO: 1807239 - protein, 18 aa, Staphylococcus epidermidis
IREIRIIKSVLLKGKKSF

SEQ ID NO: 1807240 - protein, 17 aa, Staphylococcus epidermidis
IREKIRKMEIVKYPFNV

SEQ ID NO: 1807241 - protein, 24 aa, Staphylococcus epidermidis
IREKVIEMLKFVGLANKKNQFPDE

SEQ ID NO: 1807242 - protein, 21 aa, Staphylococcus epidermidis
IRELIFREFYYVLMTYYPETA

SEQ ID NO: 1807243 - protein, 18 aa, Staphylococcus epidermidis
IRELIMRHLNTEFEDIFI

SEQ ID NO: 1807244 - protein, 18 aa, Staphylococcus epidermidis
IRESWSVRQLEQYVNTYL

SEQ ID NO: 1807245 - protein, 21 aa, Staphylococcus epidermidis
IREVNYLTGEVIREREHFAIF

SEQ ID NO: 1807246 - protein, 21 aa, Staphylococcus epidermidis
IRFYEKRGFEITGSHEFYTGD

SEQ ID NO: 1807247 - protein, 17 aa, Staphylococcus epidermidis
IRGLSPWPVAYTTMDDK

SEQ ID NO: 1807248 - protein, 19 aa, Staphylococcus epidermidis
IRGQVLTTFSTMKVLDPLG

SEQ ID NO: 1807249 - protein, 24 aa, Staphylococcus epidermidis
IRHLEKKRVVIFAAGIGNPYFSTD

SEQ ID NO: 1807250 - protein, 21 aa, Staphylococcus epidermidis
IRHLGVKASQVLAEKYETMDR

SEQ ID NO: 1807251 - protein, 17 aa, Staphylococcus epidermidis
IRHLIKAEETFGIRLTT

SEQ ID NO: 1807252 - protein, 19 aa, Staphylococcus epidermidis
IRHLKHLGKLILIVHHDLS

SEQ ID NO: 1807253 - protein, 25 aa, Staphylococcus epidermidis
IRHLLEFKTQRPIDISRVEPASEIV

SEQ ID NO: 1807254 - protein, 19 aa, Staphylococcus epidermidis
IRHLLEFKTRQSIDISRVE

SEQ ID NO: 1807255 - protein, 19 aa, Staphylococcus epidermidis
IRHLLEFKTRQTIDISRVE

SEQ ID NO: 1807256 - protein, 18 aa, Staphylococcus epidermidis
IRHVQLTGMRMERHQTDD

SEQ ID NO: 1807257 - protein, 17 aa, Staphylococcus epidermidis
IRIAGGREVNLRSLQAI

SEQ ID NO: 1807258 - protein, 25 aa, Staphylococcus epidermidis
IRIDGGVMAYTWPGEMLSDESWKNS

SEQ ID NO: 1807259 - protein, 18 aa, Staphylococcus epidermidis
IRIGFLIGPEYLIEKLTF

SEQ ID NO: 1807260 - protein, 18 aa, Staphylococcus epidermidis
IRIGFLLGPEYLIEKLTF

SEQ ID NO: 1807261 - protein, 21 aa, Staphylococcus epidermidis
IRIGNPASWQKAVKALDESNG

SEQ ID NO: 1807262 - protein, 19 aa, Staphylococcus epidermidis
IRIGSGGVMLPHYSPYKVA

SEQ ID NO: 1807263 - protein, 23 aa, Staphylococcus epidermidis
IRIIANDIAWWSIIDQYPILMRE

SEQ ID NO: 1807264 - protein, 17 aa, Staphylococcus epidermidis
IRIPLLTCASWSTQGLH

SEQ ID NO: 1807265 - protein, 17 aa, Staphylococcus epidermidis
IRIPTLIIVGEKDKKFV

SEQ ID NO: 1807266 - protein, 18 aa, Staphylococcus epidermidis
IRKAFKPTSEDSVILSAD

SEQ ID NO: 1807267 - protein, 18 aa, Staphylococcus epidermidis
IRKAFKPTSKDSVILSAD

SEQ ID NO: 1807268 - protein, 25 aa, Staphylococcus epidermidis
IRKMEIVKYPFNVNGYFLDIEDDLF

SEQ ID NO: 1807269 - protein, 19 aa, Staphylococcus epidermidis
IRKQERFADFDFKEVRKHW

SEQ ID NO: 1807270 - protein, 19 aa, Staphylococcus epidermidis
IRKQIPLKRTKIKKYKKQI

SEQ ID NO: 1807271 - protein, 19 aa, Staphylococcus epidermidis
IRLFGGSNRPSRVSLNNIN

SEQ ID NO: 1807272 - protein, 25 aa, Staphylococcus epidermidis
IRLIAADLVDFDWIDGFDIECRNEE

SEQ ID NO: 1807273 - protein, 19 aa, Staphylococcus epidermidis
IRLKNHVIDKVLYFEKAMS

SEQ ID NO: 1807274 - protein, 20 aa, Staphylococcus epidermidis
IRLLYARVGKPYCPYHDIEI

SEQ ID NO: 1807275 - protein, 17 aa, Staphylococcus epidermidis
IRLSSKLSLLPADSSLA

SEQ ID NO: 1807276 - protein, 19 aa, Staphylococcus epidermidis
IRLYIPLNERISADDYRKY

SEQ ID NO: 1807277 - protein, 28 aa, Staphylococcus epidermidis
IRNFKPEEYWTIEGEFRYKKSKFNAKFL

SEQ ID NO: 1807278 - protein, 18 aa, Staphylococcus epidermidis
IRNIIRIVVDYGGINPSS

SEQ ID NO: 1807279 - protein, 19 aa, Staphylococcus epidermidis
IRNLLAMCYLYLSEYETAK

SEQ ID NO: 1807280 - protein, 28 aa, Staphylococcus epidermidis
IRPLLSKELEGFGELFRYLSYTEDVGTR

SEQ ID NO: 1807281 - protein, 22 aa, Staphylococcus epidermidis
IRPNLGRKIFINYLKKRKHSEQ

SEQ ID NO: 1807282 - protein, 17 aa, Staphylococcus epidermidis
IRPSYDLEKQLLKILEK

SEQ ID NO: 1807283 - protein, 19 aa, Staphylococcus epidermidis
IRQKLNIVNQALFNPEKFK

SEQ ID NO: 1807284 - protein, 18 aa, Staphylococcus epidermidis
IRQKYLDFFVEKGHMVEP

SEQ ID NO: 1807285 - protein, 18 aa, Staphylococcus epidermidis
IRQKYLNFFVEKGHMIEP

SEQ ID NO: 1807286 - protein, 18 aa, Staphylococcus epidermidis
IRQLHPFPKDTIQQSIDK

SEQ ID NO: 1807287 - protein, 18 aa, Staphylococcus epidermidis
IRQNLDRIVKSQSNQKKL

SEQ ID NO: 1807288 - protein, 18 aa, Staphylococcus epidermidis
IRQQWAKLGLGLDYSRER

SEQ ID NO: 1807289 - protein, 22 aa, Staphylococcus epidermidis
IRRELLDHYAELGMDEQDLVIL

SEQ ID NO: 1807290 - protein, 21 aa, Staphylococcus epidermidis
IRRMIKVLNLYSSQKNQSNMV

SEQ ID NO: 1807291 - protein, 19 aa, Staphylococcus epidermidis
IRSIRSYNIRHIGHHKATD

SEQ ID NO: 1807292 - protein, 18 aa, Staphylococcus epidermidis
IRTDELETLQAIKNLKKQ

SEQ ID NO: 1807293 - protein, 18 aa, Staphylococcus epidermidis
IRTEAMLFAASRREHLVE

SEQ ID NO: 1807294 - protein, 17 aa, Staphylococcus epidermidis
IRVARNILKQKAMDPYN

SEQ ID NO: 1807295 - protein, 19 aa, Staphylococcus epidermidis
IRVDIAGSVDSIYDITKDD

SEQ ID NO: 1807296 - protein, 22 aa, Staphylococcus epidermidis
IRVFYRDEFLCTAICPEIADYS

SEQ ID NO: 1807297 - protein, 28 aa, Staphylococcus epidermidis
IRVFYRDEFLCTAISPDLADYSIDIKDI

SEQ ID NO: 1807298 - protein, 21 aa, Staphylococcus epidermidis
IRYAKEQSYRTIVAGIDASNM

SEQ ID NO: 1807299 - protein, 18 aa, Staphylococcus epidermidis
IRYGMTVEGQLRESASID

SEQ ID NO: 1807300 - protein, 22 aa, Staphylococcus epidermidis
IRYHTRIAPGIEIPDARYKNWF

SEQ ID NO: 1807301 - protein, 17 aa, Staphylococcus epidermidis
IRYRTYKKYIKYNEMYH

SEQ ID NO: 1807302 - protein, 37 aa, Staphylococcus epidermidis
IRYSDSVLLSTKFKAPRWLVNPIKNYSLRKHREISYL

SEQ ID NO: 1807303 - protein, 20 aa, Staphylococcus epidermidis
ISAGSKFMAAYPITPASEIM

SEQ ID NO: 1807304 - protein, 19 aa, Staphylococcus epidermidis
ISAKVFFSSIGFENLAFEK

SEQ ID NO: 1807305 - protein, 26 aa, Staphylococcus epidermidis
ISAMMFKGNASKLGFEPKEGDEVLLE

SEQ ID NO: 1807306 - protein, 17 aa, Staphylococcus epidermidis
ISAVMVYEAGKPWDEAV

SEQ ID NO: 1807307 - protein, 22 aa, Staphylococcus epidermidis
ISDGRPKLMGLREIIESYLNHQ

SEQ ID NO: 1807308 - protein, 34 aa, Staphylococcus epidermidis
ISDIYASVRLLWSRIGEPFVGYSDIFSFNNPKGM

SEQ ID NO: 1807309 - protein, 25 aa, Staphylococcus epidermidis
ISDRRKGDSLVMIDIAVPRDIEPGI

SEQ ID NO: 1807310 - protein, 22 aa, Staphylococcus epidermidis
ISECLGGKLFRKQMSMNKTNYM

SEQ ID NO: 1807311 - protein, 45 aa, Staphylococcus epidermidis
ISEFDFKSKEIIELISITILVSRLIKEIENVFTFDNLLELISSKE

SEQ ID NO: 1807312 - protein, 19 aa, Staphylococcus epidermidis
ISEIKCILERENLSNIGFE

SEQ ID NO: 1807313 - protein, 18 aa, Staphylococcus epidermidis
ISEKVFLLVLENIERQDL

SEQ ID NO: 1807314 - protein, 18 aa, Staphylococcus epidermidis
ISELQSMQIFDKKQEYQN

SEQ ID NO: 1807315 - protein, 17 aa, Staphylococcus epidermidis
ISEMNWVAPYIVSTRTI

SEQ ID NO: 1807316 - protein, 25 aa, Staphylococcus epidermidis
ISENLPGTKWAKLIINSAFSGMSAA

SEQ ID NO: 1807317 - protein, 33 aa, Staphylococcus epidermidis
ISETGSVVLPGRFFVDIIKKLPGKDVKLSTNEQ

SEQ ID NO: 1807318 - protein, 20 aa, Staphylococcus epidermidis
ISFEVPKGFVTGFIGGNGAG

SEQ ID NO: 1807319 - protein, 22 aa, Staphylococcus epidermidis
ISGACGRLMCCLKYENDHYEEA

SEQ ID NO: 1807320 - protein, 20 aa, Staphylococcus epidermidis
ISGCNYDFINSYGLDAKPLY

SEQ ID NO: 1807321 - protein, 23 aa, Staphylococcus epidermidis
ISGKKANEEFLRVILTDNQAEAI

SEQ ID NO: 1807322 - protein, 17 aa, Staphylococcus epidermidis
ISGLSILGGEPFCNLNI

SEQ ID NO: 1807323 - protein, 19 aa, Staphylococcus epidermidis
ISHCNRFIANPGCYATATE

SEQ ID NO: 1807324 - protein, 20 aa, Staphylococcus epidermidis
ISIIIPCHRVVGKDGSLTGY

SEQ ID NO: 1807325 - protein, 17 aa, Staphylococcus epidermidis
ISIKLSHLSNVSSQYSM

SEQ ID NO: 1807326 - protein, 17 aa, Staphylococcus epidermidis
ISISIISGFLGSGKTTL

SEQ ID NO: 1807327 - protein, 18 aa, Staphylococcus epidermidis
ISISYVIDAENGQRAVEE

SEQ ID NO: 1807328 - protein, 17 aa, Staphylococcus epidermidis
ISKDTRFKVGITPHDLT

SEQ ID NO: 1807329 - protein, 19 aa, Staphylococcus epidermidis
ISKFDLALHRMLKGEPIQY

SEQ ID NO: 1807330 - protein, 21 aa, Staphylococcus epidermidis
ISKFYLDDHFETFSINVTSFG

SEQ ID NO: 1807331 - protein, 24 aa, Staphylococcus epidermidis
ISKIPRFPFDKFEKGERELGTQMK

SEQ ID NO: 1807332 - protein, 21 aa, Staphylococcus epidermidis
ISKKNAMRTAVKRAKTAISTD

SEQ ID NO: 1807333 - protein, 22 aa, Staphylococcus epidermidis
ISKSFDGEDIFTDVDFEVKTSE

SEQ ID NO: 1807334 - protein, 22 aa, Staphylococcus epidermidis
ISKSIAQHHYLILASNHDEACQ

SEQ ID NO: 1807335 - protein, 18 aa, Staphylococcus epidermidis
ISLAVKFSKARLIDNIII

SEQ ID NO: 1807336 - protein, 28 aa, Staphylococcus epidermidis
ISLIKLAIDQHIPYTVLRDNIYTHPTMT

SEQ ID NO: 1807337 - protein, 24 aa, Staphylococcus epidermidis
ISLKLEKGKMLGFLGRNGAGKTTT

SEQ ID NO: 1807338 - protein, 35 aa, Staphylococcus epidermidis; identical to SEQ ID NO: 1747035

SEQ ID NO: 1807339 - protein, 22 aa, Staphylococcus epidermidis
ISLREFYVLYELYKAKDKKYKI

SEQ ID NO: 1807340 - protein, 24 aa, Staphylococcus epidermidis
ISNDYRISYKFIQSIQELSGIPTY

SEQ ID NO: 1807341 - protein, 20 aa, Staphylococcus epidermidis
ISNQYIDLWEYFAAIAEDDY

SEQ ID NO: 1807342 - protein, 21 aa, Staphylococcus epidermidis
ISNREFANWLKRRGYQSDEIF

SEQ ID NO: 1807343 - protein, 21 aa, Staphylococcus epidermidis
ISNTAEFGDYVSGPRVITPDV

SEQ ID NO: 1807344 - protein, 21 aa, Staphylococcus epidermidis
ISNTAEFGDYVSGPRVITPEV

SEQ ID NO: 1807345 - protein, 19 aa, Staphylococcus epidermidis
ISNTGQRAITHIIDSKMIK

SEQ ID NO: 1807346 - protein, 19 aa, Staphylococcus epidermidis
ISPEGKYSIFVAIKKSLYP

SEQ ID NO: 1807347 - protein, 30 aa, Staphylococcus epidermidis
ISQELRSKYDWSTKFLIKVEDNFKPYVEIF

SEQ ID NO: 1807348 - protein, 21 aa, Staphylococcus epidermidis
ISQGFKCCLNASTLTDSMLAH

SEQ ID NO: 1807349 - protein, 18 aa, Staphylococcus epidermidis
ISQLKLSVLTIHQSVPIE

SEQ ID NO: 1807350 - protein, 35 aa, Staphylococcus epidermidis
ISQNLRHKYVWSTPFLMRVEENFRPYMNIMEHDFK

SEQ ID NO: 1807351 - protein, 19 aa, Staphylococcus epidermidis
ISQQLTIPVIGIGAGKDTD

SEQ ID NO: 1807352 - protein, 24 aa, Staphylococcus epidermidis
ISRPGLEMAGYFSHYASDRIQLLG

SEQ ID NO: 1807353 - protein, 17 aa, Staphylococcus epidermidis
ISRRLPRIYHHSDEYEV

SEQ ID NO: 1807354 - protein, 19 aa, Staphylococcus epidermidis
ISSAILAYYLFSPTELDSD

SEQ ID NO: 1807355 - protein, 18 aa, Staphylococcus epidermidis
ISSEILIKAAKIDVEIIL

SEQ ID NO: 1807356 - protein, 18 aa, Staphylococcus epidermidis
ISSEILIKAAKIGVGVIL

SEQ ID NO: 1807357 - protein, 20 aa, Staphylococcus epidermidis
ISSKISKYAEVIGYYDKIIA

SEQ ID NO: 1807358 - protein, 18 aa, Staphylococcus epidermidis
ISSLKQRGAKSIRFMCLI

SEQ ID NO: 1807359 - protein, 19 aa, Staphylococcus epidermidis
ISVLCAGTSDLAVAEEAAL

SEQ ID NO: 1807360 - protein, 23 aa, Staphylococcus epidermidis
ISVLKRFKAMLLQKNETVEAMQG

SEQ ID NO: 1807361 - protein, 25 aa, Staphylococcus epidermidis
ISVPEARLLVISPYDKTSVDDIEKA

SEQ ID NO: 1807362 - protein, 25 aa, Staphylococcus epidermidis
ISYLSSDLFKGIGKKTAQNIVNTLG

SEQ ID NO: 1807363 - protein, 18 aa, Staphylococcus epidermidis
ITAIGFIRDGNFNIYSHP

SEQ ID NO: 1807364 - protein, 23 aa, Staphylococcus epidermidis
ITDKTILVSIMFVNNEIGTVQNM

SEQ ID NO: 1807365 - protein, 22 aa, Staphylococcus epidermidis
ITERHARAVLVLSEEEQEDLIE

SEQ ID NO: 1807366 - protein, 17 aa, Staphylococcus epidermidis
ITFAEKVPHAYDDLEIQ

SEQ ID NO: 1807367 - protein, 31 aa, Staphylococcus epidermidis
ITFIGAGIISIEFASIMIKSGVEVNVIHHTN

SEQ ID NO: 1807368 - protein, 20 aa, Staphylococcus epidermidis
ITGAQAWVGTLLKMKPVLHF

SEQ ID NO: 1807369 - protein, 24 aa, Staphylococcus epidermidis
ITGHYRNGILLSPIIGRDIANWLI

SEQ ID NO: 1807370 - protein, 22 aa, Staphylococcus epidermidis
ITGRMLPGTKLQSGLHQAIEAL

SEQ ID NO: 1807371 - protein, 18 aa, Staphylococcus epidermidis
ITHEIAFVRYHGRNRHGW

SEQ ID NO: 1807372 - protein, 18 aa, Staphylococcus epidermidis
ITHEMHVIRRMCDEVAVM

SEQ ID NO: 1807373 - protein, 17 aa, Staphylococcus epidermidis
ITHFRFLIGEGNKPFDV

SEQ ID NO: 1807374 - protein, 19 aa, Staphylococcus epidermidis
ITIDLQAKLGYPPNNLPDF

SEQ ID NO: 1807375 - protein, 29 aa, Staphylococcus epidermidis
ITKLSQLLGIQIHYIFTGHVHHHFVKEHG

SEQ ID NO: 1807376 - protein, 17 aa, Staphylococcus epidermidis
ITKLVIIKYNARISKIL

SEQ ID NO: 1807377 - protein, 17 aa, Staphylococcus epidermidis
ITKNVVIEKCYFGRSDH

SEQ ID NO: 1807378 - protein, 22 aa, Staphylococcus epidermidis
ITKRLGFEKGHKFEEPLVEFFY

SEQ ID NO: 1807379 - protein, 24 aa, Staphylococcus epidermidis
ITLDHIKHFIAIYTQILVTPLIAY

SEQ ID NO: 1807380 - protein, 22 aa, Staphylococcus epidermidis
ITLDHIKHFIAVYTQTLVTPLI

SEQ ID NO: 1807381 - protein, 32 aa, Staphylococcus epidermidis; identical to SEQ ID NO: 1668719

SEQ ID NO: 1807382 - protein, 24 aa, Staphylococcus epidermidis
ITLGHKRISIGFWVNENALDTGEY

SEQ ID NO: 1807383 - protein, 17 aa, Staphylococcus epidermidis
ITLKRNIIRNLCLSIIT

SEQ ID NO: 1807384 - protein, 25 aa, Staphylococcus epidermidis
ITLPNIIRLQIDFEHKYQISLPKLA

SEQ ID NO: 1807385 - protein, 22 aa, Staphylococcus epidermidis
ITLSELETLIFAEIGRQNYSAK

SEQ ID NO: 1807386 - protein, 18 aa, Staphylococcus epidermidis
ITLWNSRQAFYDWQNSKA

SEQ ID NO: 1807387 - protein, 24 aa, Staphylococcus epidermidis
ITMYPHLDGVLSLDLTTVLILNQL

SEQ ID NO: 1807388 - protein, 19 aa, Staphylococcus epidermidis
ITNEFNMRVLISSHKLEDI

SEQ ID NO: 1807389 - protein, 19 aa, Staphylococcus epidermidis
ITNTNLFKYNGKTYEVVGE

SEQ ID NO: 1807390 - protein, 25 aa, Staphylococcus epidermidis
ITPDSIGLILGFLVQRFLEHKEEMH

SEQ ID NO: 1807391 - protein, 25 aa, Staphylococcus epidermidis
ITPDSIGLILGFLVQRFMQDKEEMH

SEQ ID NO: 1807392 - protein, 17 aa, Staphylococcus epidermidis
ITPENQAAIKFAQEHGI

SEQ ID NO: 1807393 - protein, 19 aa, Staphylococcus epidermidis
ITPSMMVFTNFFRDQMDRF

SEQ ID NO: 1807394 - protein, 17 aa, Staphylococcus epidermidis
ITQEEFNNMSVAERTNL

SEQ ID NO: 1807395 - protein, 30 aa, Staphylococcus epidermidis
ITRERRGENGFGYDPVFFVPDKDRTMAEIS

SEQ ID NO: 1807396 - protein, 19 aa, Staphylococcus epidermidis
ITRGDIFVRGAIKEHMASL

SEQ ID NO: 1807397 - protein, 25 aa, Staphylococcus epidermidis
ITSLPNNHKWLGIGLRVVPKPLRDL

SEQ ID NO: 1807398 - protein, 18 aa, Staphylococcus epidermidis
ITSNIPFRIRKPLPNMTF

SEQ ID NO: 1807399 - protein, 25 aa, Staphylococcus epidermidis
ITTQIAHMIIRYFKDGPIRAHEVSY

SEQ ID NO: 1807400 - protein, 24 aa, Staphylococcus epidermidis
ITVHGCKGEESVVYIGGDDYQLID

SEQ ID NO: 1807401 - protein, 21 aa, Staphylococcus epidermidis
IVACNSCGDDGHTSYAGNSIV

SEQ ID NO: 1807402 - protein, 18 aa, Staphylococcus epidermidis
IVAGGAWSSQLLTQYHLQ

SEQ ID NO: 1807403 - protein, 18 aa, Staphylococcus epidermidis
IVALPEIFDKVDVFESEL

SEQ ID NO: 1807404 - protein, 17 aa, Staphylococcus epidermidis
IVANLETLDIAALKNIL

SEQ ID NO: 1807405 - protein, 20 aa, Staphylococcus epidermidis
IVASGYRGALPHGVASDKLI

SEQ ID NO: 1807406 - protein, 25 aa, Staphylococcus epidermidis
IVCRYKESLVTIDFVLPFQWNDEFY

SEQ ID NO: 1807407 - protein, 19 aa, Staphylococcus epidermidis
IVDIMMKGMDGFELCQKLK

SEQ ID NO: 1807408 - protein, 24 aa, Staphylococcus epidermidis
IVDISGRPYLSFNAKLSKEKVGTF

SEQ ID NO: 1807409 - protein, 18 aa, Staphylococcus epidermidis
IVDLALQKEVDFIIIAGD

SEQ ID NO: 1807410 - protein, 21 aa, Staphylococcus epidermidis
IVEDRLGGIFGKKNATHGTKS

SEQ ID NO: 1807411 - protein, 22 aa, Staphylococcus epidermidis
IVEELYKINVEFFSLTEKIEIA

SEQ ID NO: 1807412 - protein, 18 aa, Staphylococcus epidermidis
IVENALCYRNINGSQLQQ

SEQ ID NO: 1807413 - protein, 19 aa, Staphylococcus epidermidis
IVFILAWVNQFLATKHISP

SEQ ID NO: 1807414 - protein, 19 aa, Staphylococcus epidermidis
IVFQRKSIGLGEFKYTAYI

SEQ ID NO: 1807415 - protein, 23 aa, Staphylococcus epidermidis
IVGEAIPLPSLVNLPKPNPEPKS

SEQ ID NO: 1807416 - protein, 20 aa, Staphylococcus epidermidis
IVGLLAERSLDMIVGMLGIL

SEQ ID NO: 1807417 - protein, 18 aa, Staphylococcus epidermidis
IVGNTGWYDYSYADTRFT

SEQ ID NO: 1807418 - protein, 24 aa, Staphylococcus epidermidis
IVGRGGGSIEDLWNFNEEDVVKTI

SEQ ID NO: 1807419 - protein, 25 aa, Staphylococcus epidermidis
IVGYEIKTGAPLVYELTDDLDVKDK

SEQ ID NO: 1807420 - protein, 18 aa, Staphylococcus epidermidis
IVIHKDINISIAVADKDK

SEQ ID NO: 1807421 - protein, 19 aa, Staphylococcus epidermidis
IVIKPKFKRDIKKVAKDII

SEQ ID NO: 1807422 - protein, 20 aa, Staphylococcus epidermidis
IVLDCIHQGIYLLDVPLSEY

SEQ ID NO: 1807423 - protein, 24 aa, Staphylococcus epidermidis
IVNDFKKLLSVESMHVDRKGKTQV

SEQ ID NO: 1807424 - protein, 29 aa, Staphylococcus epidermidis
IVNEARSARAYGSAALEIISVAKGQLAAY

SEQ ID NO: 1807425 - protein, 25 aa, Staphylococcus epidermidis
IVNESIWRKELEGISKIAKSKTFFN

SEQ ID NO: 1807426 - protein, 21 aa, Staphylococcus epidermidis
IVNKDFKLVGIVTSREIINMN

SEQ ID NO: 1807427 - protein, 22 aa, Staphylococcus epidermidis
IVNRLPKSMPQYHVGHIKNIKA

SEQ ID NO: 1807428 - protein, 27 aa, Staphylococcus epidermidis
IVNYTDGYTGILSWNEKYGIQFSNYDV

SEQ ID NO: 1807429 - protein, 24 aa, Staphylococcus epidermidis
IVPLNGFKKWLTPVDLWKDHQMTI

SEQ ID NO: 1807430 - protein, 24 aa, Staphylococcus epidermidis
IVPLNGFKKWLTPVDLWKDHQMTL

SEQ ID NO: 1807431 - protein, 18 aa, Staphylococcus epidermidis
IVQFYTDLNTDGRFLNVG

SEQ ID NO: 1807432 - protein, 18 aa, Staphylococcus epidermidis
IVQTLQFFNKNLQNIQFS

SEQ ID NO: 1807433 - protein, 27 aa, Staphylococcus epidermidis
IVRDADRLDAIGAIGIARTFQFSGHFN

SEQ ID NO: 1807434 - protein, 19 aa, Staphylococcus epidermidis
IVSAPNFKANPELDGTNSE

SEQ ID NO: 1807435 - protein, 24 aa, Staphylococcus epidermidis
IVSVLKRFKAMLIQKNESVDAMQG

SEQ ID NO: 1807436 - protein, 18 aa, Staphylococcus epidermidis
IVTKQAWVYKGTLNSSII

SEQ ID NO: 1807437 - protein, 22 aa, Staphylococcus epidermidis
IVTMAGLINALKIVNKELTDIK

SEQ ID NO: 1807438 - protein, 20 aa, Staphylococcus epidermidis
IVTMAGLINALRIVDKDLSD

SEQ ID NO: 1807439 - protein, 22 aa, Staphylococcus epidermidis
IVVGMLPWKKINTVKSEYVNKV

SEQ ID NO: 1807440 - protein, 19 aa, Staphylococcus epidermidis
IVVGNTYGRIRAMVNDLGK

SEQ ID NO: 1807441 - protein, 20 aa, Staphylococcus epidermidis
IWANHCIKRYPRENEDLIFI

SEQ ID NO: 1807442 - protein, 19 aa, Staphylococcus epidermidis
IWENSCGSGAASIGVLVNY

SEQ ID NO: 1807443 - protein, 18 aa, Staphylococcus epidermidis
IWEQVHVFMLPKDYLRYC

SEQ ID NO: 1807444 - protein, 37 aa, Staphylococcus epidermidis; identical to SEQ ID NO: 1647312

SEQ ID NO: 1807445 - protein, 17 aa, Staphylococcus epidermidis
IWIALMLAQQPIEDSLK

SEQ ID NO: 1807446 - protein, 21 aa, Staphylococcus epidermidis
IWRGPMLGKMLTNFFTEVQWG

SEQ ID NO: 1807447 - protein, 19 aa, Staphylococcus epidermidis
IWTDAQWRSIYAKGQDVLV

SEQ ID NO: 1807448 - protein, 17 aa, Staphylococcus epidermidis
IYAKLGYAETETYDKFK

SEQ ID NO: 1807449 - protein, 19 aa, Staphylococcus epidermidis
IYCDNRITLGYPLVRNAIR

SEQ ID NO: 1807450 - protein, 24 aa, Staphylococcus epidermidis
IYDGKELFKLMALESQHAGLSWLT

SEQ ID NO: 1807451 - protein, 23 aa, Staphylococcus epidermidis
IYDLTSAGGFGFKRIDEYGLKKG

SEQ ID NO: 1807452 - protein, 26 aa, Staphylococcus epidermidis
IYDPFKFDDVRTFFNILVLGKMGMGK

SEQ ID NO: 1807453 - protein, 19 aa, Staphylococcus epidermidis
IYDSFSAWEHKFIVEEYIE

SEQ ID NO: 1807454 - protein, 21 aa, Staphylococcus epidermidis
IYDVIGYEVKPHFITEDELAN

SEQ ID NO: 1807455 - protein, 17 aa, Staphylococcus epidermidis
IYERLRPGEPPTVENAK

SEQ ID NO: 1807456 - protein, 17 aa, Staphylococcus epidermidis
IYFARVSILDGLSIITS

SEQ ID NO: 1807457 - protein, 18 aa, Staphylococcus epidermidis
IYFDCLLKTFTETTQDTS

SEQ ID NO: 1807458 - protein, 18 aa, Staphylococcus epidermidis
IYFIYTVKQLEDILNCGN

SEQ ID NO: 1807459 - protein, 19 aa, Staphylococcus epidermidis
IYGAKGLAWVKVVEDGLSG

SEQ ID NO: 1807460 - protein, 17 aa, Staphylococcus epidermidis
IYGGPLALGLIRNKLEE

SEQ ID NO: 1807461 - protein, 33 aa, Staphylococcus epidermidis
IYGKYLMGAFRFDVKQADKNAGFFVTFEDATEP

SEQ ID NO: 1807462 - protein, 34 aa, Staphylococcus epidermidis
IYHKIIKFPLTINGKVDCKRLLKDVKATNNIEVK

SEQ ID NO: 1807463 - protein, 19 aa, Staphylococcus epidermidis
IYHRVLEMLEEGKSISNIA

SEQ ID NO: 1807464 - protein, 17 aa, Staphylococcus epidermidis
IYHRVVEMLEEGQAISK

SEQ ID NO: 1807465 - protein, 18 aa, Staphylococcus epidermidis
IYIEAVATFPEYRGQGIA

SEQ ID NO: 1807466 - protein, 20 aa, Staphylococcus epidermidis
IYIEIGSGMGQFITTLASQH

SEQ ID NO: 1807467 - protein, 22 aa, Staphylococcus epidermidis
IYIIDCGSTVFNEILRRKLDLS

SEQ ID NO: 1807468 - protein, 17 aa, Staphylococcus epidermidis
IYILIITGSRFKPVQHL

SEQ ID NO: 1807469 - protein, 18 aa, Staphylococcus epidermidis
IYINCPLFNEMPEILEAI

SEQ ID NO: 1807470 - protein, 20 aa, Staphylococcus epidermidis
IYINDEGSEAFFFFTKNNDN

SEQ ID NO: 1807471 - protein, 18 aa, Staphylococcus epidermidis
IYKECRIGDIKHSYADIT

SEQ ID NO: 1807472 - protein, 17 aa, Staphylococcus epidermidis
IYLDLAPVVTTGKNRLV

SEQ ID NO: 1807473 - protein, 18 aa, Staphylococcus epidermidis
IYLEDLIIIFTDGVTEAR

SEQ ID NO: 1807474 - protein, 20 aa, Staphylococcus epidermidis
IYLKITEDYPTAALLNQLIY

SEQ ID NO: 1807475 - protein, 18 aa, Staphylococcus epidermidis
IYLRAYTYIRTMGAEGLK

SEQ ID NO: 1807476 - protein, 22 aa, Staphylococcus epidermidis
IYMKSEDFFTMIDEYSDTNMMY

SEQ ID NO: 1807477 - protein, 17 aa, Staphylococcus epidermidis
IYNGMPLRTEYRTFVNF

SEQ ID NO: 1807478 - protein, 26 aa, Staphylococcus epidermidis
IYNRPRGKFRFPMQVSEETSAQYEEH

SEQ ID NO: 1807479 - protein, 32 aa, Staphylococcus epidermidis
IYNSFPEWQKHFPFWSVMTIKRAVYSLEKQNL

SEQ ID NO: 1807480 - protein, 21 aa, Staphylococcus epidermidis
IYPGQEIRITDQILPEIEKGN

SEQ ID NO: 1807481 - protein, 26 aa, Staphylococcus epidermidis
IYPLKNCTRIIPFSSISYLDVLDRNE

SEQ ID NO: 1807482 - protein, 18 aa, Staphylococcus epidermidis
IYQRYGHIYLVWDNSGGT

SEQ ID NO: 1807483 - protein, 18 aa, Staphylococcus epidermidis
IYQSFGLKHLKLVINSIG

SEQ ID NO: 1807484 - protein, 18 aa, Staphylococcus epidermidis
IYQYCKTNNISIIGLADH

SEQ ID NO: 1807485 - protein, 19 aa, Staphylococcus epidermidis
IYRHLEARMSGEFITTEDS

SEQ ID NO: 1807486 - protein, 17 aa, Staphylococcus epidermidis
IYRRNYQSKSWLVIANF

SEQ ID NO: 1807487 - protein, 18 aa, Staphylococcus epidermidis
IYRTELKNEKEAAAKIEK

SEQ ID NO: 1807488 - protein, 28 aa, Staphylococcus epidermidis
IYRYLRDDLKLGLELTVVALNPYDLRDY

SEQ ID NO: 1807489 - protein, 23 aa, Staphylococcus epidermidis
IYSETKIVLCIENVEFKLTGNVA

SEQ ID NO: 1807490 - protein, 17 aa, Staphylococcus epidermidis
IYSKLLIYMKFKSGLDV

SEQ ID NO: 1807491 - protein, 17 aa, Staphylococcus epidermidis
IYSLRYDEMQQWLIDHG

SEQ ID NO: 1807492 - protein, 24 aa, Staphylococcus epidermidis
IYSNELNTGIGLGMPAFDSPVNPL

SEQ ID NO: 1807493 - protein, 33 aa, Staphylococcus epidermidis; identical to SEQ ID NO: 1658613

SEQ ID NO: 1807494 - protein, 20 aa, Staphylococcus epidermidis
IYTLAGGFALYTVKEIIRFI

SEQ ID NO: 1807495 - protein, 17 aa, Staphylococcus epidermidis
IYVPMVNPWGFANQERE

SEQ ID NO: 1807496 - protein, 17 aa, Staphylococcus epidermidis
IYYALDLGKSYRLIDKS

SEQ ID NO: 1807497 - protein, 24 aa, Staphylococcus epidermidis
KAAELLGKRYMMWTDKQQIETTAT

SEQ ID NO: 1807498 - protein, 19 aa, Staphylococcus epidermidis
KAAKIGVGIILSKSAPTSL

SEQ ID NO: 1807499 - protein, 18 aa, Staphylococcus epidermidis
KAALPDDAIFHFIGSLQS

SEQ ID NO: 1807500 - protein, 18 aa, Staphylococcus epidermidis
KAAYANKQVDGFTTNPSL

SEQ ID NO: 1807501 - protein, 23 aa, Staphylococcus epidermidis
KADEKRVEFHLHTAMSQMDGIPN

SEQ ID NO: 1807502 - protein, 19 aa, Staphylococcus epidermidis
KADIGVKNGYIFKIGKAGN

SEQ ID NO: 1807503 - protein, 18 aa, Staphylococcus epidermidis
KADNVLQDRLRSLENVDI

SEQ ID NO: 1807504 - protein, 18 aa, Staphylococcus epidermidis
KADPRNVGGGGAFGAFVS

SEQ ID NO: 1807505 - protein, 18 aa, Staphylococcus epidermidis
KADWEIFQLIANQLGANW

SEQ ID NO: 1807506 - protein, 19 aa, Staphylococcus epidermidis
KAEAVVISGSLPKGLDSNY

SEQ ID NO: 1807507 - protein, 19 aa, Staphylococcus epidermidis
KAELAGVLHDYCKYDDLSK

SEQ ID NO: 1807508 - protein, 22 aa, Staphylococcus epidermidis
KAELSALIRMNGALSLSNQQFV

SEQ ID NO: 1807509 - protein, 17 aa, Staphylococcus epidermidis
KAERALIKHLMKDKDTF

SEQ ID NO: 1807510 - protein, 17 aa, Staphylococcus epidermidis
KAFHLNFDDVGENIEAF

SEQ ID NO: 1807511 - protein, 31 aa, Staphylococcus epidermidis
KAFLTRDQHRLYKLIWERFVASQMAPAILDT

SEQ ID NO: 1807512 - protein, 24 aa, Staphylococcus epidermidis
KAFRENYGTLGIAFIKQYESKQEE

SEQ ID NO: 1807513 - protein, 18 aa, Staphylococcus epidermidis
KAFSDALFKNQIYQRERI

SEQ ID NO: 1807514 - protein, 20 aa, Staphylococcus epidermidis
KAGLIGTLAAFITRRPVRIY

SEQ ID NO: 1807515 - protein, 27 aa, Staphylococcus epidermidis
KAGVDVFRIFDSLNWVDQMKVANEAVQ

SEQ ID NO: 1807516 - protein, 18 aa, Staphylococcus epidermidis
KAHVKGVSVLVESKEVKQ

SEQ ID NO: 1807517 - protein, 17 aa, Staphylococcus epidermidis
KAIAEWFASKKNEIVQH

SEQ ID NO: 1807518 - protein, 23 aa, Staphylococcus epidermidis
KAILRCDPDVILIGEIRDAYVAK

SEQ ID NO: 1807519 - protein, 23 aa, Staphylococcus epidermidis
KAIMLPPGLAFVAYSDRAKERFA

SEQ ID NO: 1807520 - protein, 17 aa, Staphylococcus epidermidis
KAISRMKLGQIDKLTTA

SEQ ID NO: 1807521 - protein, 25 aa, Staphylococcus epidermidis
KAKAFKRWITNEVLPSIRKTGSYQV

SEQ ID NO: 1807522 - protein, 23 aa, Staphylococcus epidermidis
KAKGLKPRAIRAMIVGIPNVGKS

SEQ ID NO: 1807523 - protein, 26 aa, Staphylococcus epidermidis
KAKGTDTGWQTLPLVNGITQAGTLNK

SEQ ID NO: 1807524 - protein, 20 aa, Staphylococcus epidermidis
KAKIVPYVKKGMHGFIQEYG

SEQ ID NO: 1807525 - protein, 23 aa, Staphylococcus epidermidis
KAKKEGYRALAITDTNVLYGYPK

SEQ ID NO: 1807526 - protein, 19 aa, Staphylococcus epidermidis
KAKKMFNQFNIFTTDKDLT

SEQ ID NO: 1807527 - protein, 24 aa, Staphylococcus epidermidis
KAKMRVAVRRLLKKYGYPPDLQKM

SEQ ID NO: 1807528 - protein, 21 aa, Staphylococcus epidermidis
KAKNRRGKIGVEHADVKDIRE

SEQ ID NO: 1807529 - protein, 20 aa, Staphylococcus epidermidis
KAKVQLAFCIDVRSEPFRRH

SEQ ID NO: 1807530 - protein, 25 aa, Staphylococcus epidermidis
KALAENDFDVVLAIGQAGGRFEITP

SEQ ID NO: 1807531 - protein, 23 aa, Staphylococcus epidermidis
KALCNKMNIGLEEVIAFGDSLND

SEQ ID NO: 1807532 - protein, 22 aa, Staphylococcus epidermidis
KALESRGMVLYMDRNTRTTHGY

SEQ ID NO: 1807533 - protein, 25 aa, Staphylococcus epidermidis
KALPYYKQFIQEVAQFLESENVPIT

SEQ ID NO: 1807534 - protein, 17 aa, Staphylococcus epidermidis
KALRKLRHPSRSKRLKD

SEQ ID NO: 1807535 - protein, 20 aa, Staphylococcus epidermidis
KAMALIGVIELLKQAKNRRL

SEQ ID NO: 1807536 - protein, 19 aa, Staphylococcus epidermidis
KAMIDEVAKILGIPPSLIH

SEQ ID NO: 1807537 - protein, 37 aa, Staphylococcus epidermidis
KAMINRLNLFKAYHYQAKILLLAWNRYLTQTASQYIN

SEQ ID NO: 1807538 - protein, 20 aa, Staphylococcus epidermidis
KAMSEAKCIKHRQVFPQDTN

SEQ ID NO: 1807539 - protein, 23 aa, Staphylococcus epidermidis
KANFTRMKVELLDNFAKVSGDPT

SEQ ID NO: 1807540 - protein, 17 aa, Staphylococcus epidermidis
KANLERLAHLPSIDRHH

SEQ ID NO: 1807541 - protein, 18 aa, Staphylococcus epidermidis
KANVKFQKIENVNYLSPE

SEQ ID NO: 1807542 - protein, 22 aa, Staphylococcus epidermidis
KAQKEGFNKLSLTVVKDNDKAL

SEQ ID NO: 1807543 - protein, 20 aa, Staphylococcus epidermidis
KAQKSHIWFHTKDIPGSHVV

SEQ ID NO: 1807544 - protein, 22 aa, Staphylococcus epidermidis
KAQRIGIRVADLLEKDTFERRL

SEQ ID NO: 1807545 - protein, 17 aa, Staphylococcus epidermidis
KARGLKLNHPEALALIS

SEQ ID NO: 1807546 - protein, 22 aa, Staphylococcus epidermidis
KARKLLFWVIMNIIRGQHHYDN

SEQ ID NO: 1807547 - protein, 19 aa, Staphylococcus epidermidis
KARLKHLDVEFKFDREEET

SEQ ID NO: 1807548 - protein, 21 aa, Staphylococcus epidermidis
KASAVIGGAFTFNMLNDHQAF

SEQ ID NO: 1807549 - protein, 21 aa, Staphylococcus epidermidis
KASDRLKARDLLGRFHSIFTD

SEQ ID NO: 1807550 - protein, 22 aa, Staphylococcus epidermidis
KASGFPKERVIGQSGVLDTARY

SEQ ID NO: 1807551 - protein, 18 aa, Staphylococcus epidermidis
KASILFVPTFKFELNINN

SEQ ID NO: 1807552 - protein, 17 aa, Staphylococcus epidermidis
KASVLHTYLFVRLKYYL

SEQ ID NO: 1807553 - protein, 23 aa, Staphylococcus epidermidis
KATGDLQGPFGLQDIIGLDTTLD

SEQ ID NO: 1807554 - protein, 18 aa, Staphylococcus epidermidis
KATIFISDMNNFQKINEI

SEQ ID NO: 1807555 - protein, 25 aa, Staphylococcus epidermidis
KATITLDAGYLPDGFEEEVSGATKL

SEQ ID NO: 1807556 - protein, 21 aa, Staphylococcus epidermidis
KATKFLLALYNVFIEKDCSIV

SEQ ID NO: 1807557 - protein, 17 aa, Staphylococcus epidermidis
KATSYGILQTKYKGKPY

SEQ ID NO: 1807558 - protein, 17 aa, Staphylococcus epidermidis
KAVDFALNHNVKKFVQL

SEQ ID NO: 1807559 - protein, 21 aa, Staphylococcus epidermidis
KAVGMSRPFLNQVEQTGITNT

SEQ ID NO: 1807560 - protein, 18 aa, Staphylococcus epidermidis
KAVLTYRTSFQSDLPQMD

SEQ ID NO: 1807561 - protein, 20 aa, Staphylococcus epidermidis
KAVRDVRELIVKKAQEGVTF

SEQ ID NO: 1807562 - protein, 17 aa, Staphylococcus epidermidis
KAVRDVRQLILSKAKGG

SEQ ID NO: 1807563 - protein, 21 aa, Staphylococcus epidermidis
KAVTHSHGWGYAHLQMAPKHW

SEQ ID NO: 1807564 - protein, 17 aa, Staphylococcus epidermidis
KAVVSLADHYGSVEKLL

SEQ ID NO: 1807565 - protein, 31 aa, Staphylococcus epidermidis
KAWDNRYGCVLAIEILELLKDVQLDVDLYVG

SEQ ID NO: 1807566 - protein, 22 aa, Staphylococcus epidermidis
KAWHLENKKIIIVHGGGQVISD

SEQ ID NO: 1807567 - protein, 19 aa, Staphylococcus epidermidis
KAYITEMQLDFQTNQVKIT

SEQ ID NO: 1807568 - protein, 21 aa, Staphylococcus epidermidis
KAYKSRDAMQFIKKDSPPILI

SEQ ID NO: 1807569 - protein, 27 aa, Staphylococcus epidermidis
KAYQFVNRFTKRWLRKPEAKLTIEREH

SEQ ID NO: 1807570 - protein, 17 aa, Staphylococcus epidermidis
KAYSESTIDRWFTTALK

SEQ ID NO: 1807571 - protein, 23 aa, Staphylococcus epidermidis
KAYSESTIDRWFTTALKVLDEQL

SEQ ID NO: 1807572 - protein, 18 aa, Staphylococcus epidermidis
KAYYKWRVDETYIKIKGQ

SEQ ID NO: 1807573 - protein, 30 aa, Staphylococcus epidermidis
KCHNFVKFRLDEFGNLPAIKDFEQILTVCA

SEQ ID NO: 1807574 - protein, 30 aa, Staphylococcus epidermidis
KCIAVNFLSEPWLRNIVEVIGTPGTDLSAY

SEQ ID NO: 1807575 - protein, 19 aa, Staphylococcus epidermidis
KCILERENLSNIGFEGHLI

SEQ ID NO: 1807576 - protein, 22 aa, Staphylococcus epidermidis
KCTTCKKAAKFLDEHDVNFESI

SEQ ID NO: 1807577 - protein, 17 aa, Staphylococcus epidermidis
KDADLVVITAGAPQKPG

SEQ ID NO: 1807578 - protein, 17 aa, Staphylococcus epidermidis
KDAFIDERIDVLHQSSR

SEQ ID NO: 1807579 - protein, 17 aa, Staphylococcus epidermidis
KDAIKILESLAIDVDED

SEQ ID NO: 1807580 - protein, 24 aa, Staphylococcus epidermidis
KDAKAKELIKLVDLPEEYLDRYPA

SEQ ID NO: 1807581 - protein, 20 aa, Staphylococcus epidermidis
KDALKFQILEELPDQIKSYL

SEQ ID NO: 1807582 - protein, 25 aa, Staphylococcus epidermidis
KDAMEMERLFSGLKKEGAILMPKTE

SEQ ID NO: 1807583 - protein, 19 aa, Staphylococcus epidermidis
KDCNVRQSFELASPKHTEG

SEQ ID NO: 1807584 - protein, 24 aa, Staphylococcus epidermidis
KDDAIKNKVSFLIDKKSGYFYIVN

SEQ ID NO: 1807585 - protein, 22 aa, Staphylococcus epidermidis
KDDGLNNIAQITIWDTDQAPLT

SEQ ID NO: 1807586 - protein, 17 aa, Staphylococcus epidermidis
KDDLIIFLGDYIDRGKQ

SEQ ID NO: 1807587 - protein, 19 aa, Staphylococcus epidermidis
KDDYVLFGTFFKAYSESTI

SEQ ID NO: 1807588 - protein, 19 aa, Staphylococcus epidermidis
KDEALKFQAIVNDLIRLLV

SEQ ID NO: 1807589 - protein, 19 aa, Staphylococcus epidermidis
KDEFLSTISEENRANFRSL

SEQ ID NO: 1807590 - protein, 17 aa, Staphylococcus epidermidis
KDEFRPDNQPEKERLSN

SEQ ID NO: 1807591 - protein, 22 aa, Staphylococcus epidermidis
KDEIFGPVLAITTYRDFEQVIE

SEQ ID NO: 1807592 - protein, 23 aa, Staphylococcus epidermidis
KDEIKYYLNEAIKTEKAGKNVPM

SEQ ID NO: 1807593 - protein, 19 aa, Staphylococcus epidermidis
KDELREFVEAAKIPVIHTL

SEQ ID NO: 1807594 - protein, 18 aa, Staphylococcus epidermidis
KDELYVIATNLFSNKSKD

SEQ ID NO: 1807595 - protein, 21 aa, Staphylococcus epidermidis
KDEMGYSFSREAFNTLNSNVK

SEQ ID NO: 1807596 - protein, 26 aa, Staphylococcus epidermidis
KDENVPLWLDRDCPFNIEGGDELVLS

SEQ ID NO: 1807597 - protein, 19 aa, Staphylococcus epidermidis
KDEPAFINVLEILALEYAK

SEQ ID NO: 1807598 - protein, 17 aa, Staphylococcus epidermidis
KDEQEFLNVLQLAQEQH

SEQ ID NO: 1807599 - protein, 25 aa, Staphylococcus epidermidis
KDETIKQLYNQVAIYKEQSNRDKEQ

SEQ ID NO: 1807600 - protein, 25 aa, Staphylococcus epidermidis
KDEVIFSELLRFAGIGESKLETLLI

SEQ ID NO: 1807601 - protein, 30 aa, Staphylococcus epidermidis
KDFIEDFLEPCHIAKMISRYMIVNETDKIL

SEQ ID NO: 1807602 - protein, 20 aa, Staphylococcus epidermidis
KDFIEDFLESCHISKMISRY

SEQ ID NO: 1807603 - protein, 17 aa, Staphylococcus epidermidis
KDFKAFDVDGLENRMEA

SEQ ID NO: 1807604 - protein, 23 aa, Staphylococcus epidermidis
KDGNGRYLLQDSIINTAGNTVLG

SEQ ID NO: 1807605 - protein, 19 aa, Staphylococcus epidermidis
KDGRIVGLGAHLKKGDKHA

SEQ ID NO: 1807606 - protein, 26 aa, Staphylococcus epidermidis
KDGRLFICYLGDFKTTGGIFATTENG

SEQ ID NO: 1807607 - protein, 27 aa, Staphylococcus epidermidis
KDGRLFVCYLGDFKTTGGIFATNEEGE

SEQ ID NO: 1807608 - protein, 20 aa, Staphylococcus epidermidis
KDGVCVAFFTLHEGDGPKDY

SEQ ID NO: 1807609 - protein, 21 aa, Staphylococcus epidermidis
KDGYDSILVWGRNEKDYIYLM

SEQ ID NO: 1807610 - protein, 20 aa, Staphylococcus epidermidis
KDIEILLSLHHLLKQNGLTT

SEQ ID NO: 1807611 - protein, 18 aa, Staphylococcus epidermidis
KDIENFIVPFTNIIEQNK

SEQ ID NO: 1807612 - protein, 27 aa, Staphylococcus epidermidis
KDIIIKEILEIASTKEIVRFISTHPDE

SEQ ID NO: 1807613 - protein, 32 aa, Staphylococcus epidermidis
KDIKIKVLVDYRFKPKNLKAIVANRVKTYTPF

SEQ ID NO: 1807614 - protein, 19 aa, Staphylococcus epidermidis
KDILINEYIYFASKNKKLV

SEQ ID NO: 1807615 - protein, 19 aa, Staphylococcus epidermidis
KDIMFEFNIGKVPMKQIKT

SEQ ID NO: 1807616 - protein, 17 aa, Staphylococcus epidermidis
KDINISIAVADKDKLYV

SEQ ID NO: 1807617 - protein, 22 aa, Staphylococcus epidermidis
KDIPAYDLGATVIKHIVKSSGI

SEQ ID NO: 1807618 - protein, 21 aa, Staphylococcus epidermidis
KDIRFKSMLNSYFGILYGKNN

SEQ ID NO: 1807619 - protein, 19 aa, Staphylococcus epidermidis
KDIRNILEHDFNILENELK

SEQ ID NO: 1807620 - protein, 17 aa, Staphylococcus epidermidis
KDKCIAVNFLSEPWLRN

SEQ ID NO: 1807621 - protein, 17 aa, Staphylococcus epidermidis
KDKEDKYHYTGFTDEAI

SEQ ID NO: 1807622 - protein, 19 aa, Staphylococcus epidermidis
KDKISRITVGYTRDRRPIT

SEQ ID NO: 1807623 - protein, 29 aa, Staphylococcus epidermidis
KDKLFELEGDLPLFPGHGPYTTVDDEQLN

SEQ ID NO: 1807624 - protein, 18 aa, Staphylococcus epidermidis
KDKLHALNQEYVYVGFNI

SEQ ID NO: 1807625 - protein, 19 aa, Staphylococcus epidermidis
KDLFKEKGKDILAFSNRVA

SEQ ID NO: 1807626 - protein, 20 aa, Staphylococcus epidermidis
KDLNDFLGINYYMSDWMRGY

SEQ ID NO: 1807627 - protein, 20 aa, Staphylococcus epidermidis
KDLREQSARELVDLDFPGYA

SEQ ID NO: 1807628 - protein, 28 aa, Staphylococcus epidermidis
KDLRHIKKDIGMIFQHFNLLNSKSVYKN

SEQ ID NO: 1807629 - protein, 17 aa, Staphylococcus epidermidis
KDLSFGKNFGVVMEELR

SEQ ID NO: 1807630 - protein, 17 aa, Staphylococcus epidermidis
KDLSNAGAHVVDKSVVV

SEQ ID NO: 1807631 - protein, 24 aa, Staphylococcus epidermidis
KDLSSAMDKIRNGYQSKDSKQIKK

SEQ ID NO: 1807632 - protein, 20 aa, Staphylococcus epidermidis
KDMLDLGPKYIADYMEKLLG

SEQ ID NO: 1807633 - protein, 25 aa, Staphylococcus epidermidis
KDNASLCKVKLHTGRTHQIRVHFQH

SEQ ID NO: 1807634 - protein, 19 aa, Staphylococcus epidermidis
KDNDYLKIIEKITKKEKTT

SEQ ID NO: 1807635 - protein, 24 aa, Staphylococcus epidermidis
KDNGLDMKKRWYATKDTRTRDTHR

SEQ ID NO: 1807636 - protein, 21 aa, Staphylococcus epidermidis
KDNICFRCNKTTPNRIYSSND

SEQ ID NO: 1807637 - protein, 18 aa, Staphylococcus epidermidis
KDNSEFFDGVDMNLVDWL

SEQ ID NO: 1807638 - protein, 21 aa, Staphylococcus epidermidis
KDNYEIIKFFIEINEEKRQEH

SEQ ID NO: 1807639 - protein, 23 aa, Staphylococcus epidermidis
KDPLHREIEAMYAISNQHQTAII

SEQ ID NO: 1807640 - protein, 20 aa, Staphylococcus epidermidis
KDPRVGFLTITDVELTNDLS

SEQ ID NO: 1807641 - protein, 25 aa, Staphylococcus epidermidis
KDPYRVGLKLRDGGWVYVQGLTHFE

SEQ ID NO: 1807642 - protein, 17 aa, Staphylococcus epidermidis
KDQFKALWNIRDDRYSD

SEQ ID NO: 1807643 - protein, 18 aa, Staphylococcus epidermidis
KDQLKEKALYLLEKVGLK

SEQ ID NO: 1807644 - protein, 17 aa, Staphylococcus epidermidis
KDQMEILQNRMRELQFA

SEQ ID NO: 1807645 - protein, 21 aa, Staphylococcus epidermidis
KDRIIKPLTYLYEKGLERDGL

SEQ ID NO: 1807646 - protein, 25 aa, Staphylococcus epidermidis
KDSEFKLGMKQAYNATNYKGKTDIV

SEQ ID NO: 1807647 - protein, 23 aa, Staphylococcus epidermidis
KDSEHYGLWAFKRVWGTYLSEKI

SEQ ID NO: 1807648 - protein, 23 aa, Staphylococcus epidermidis
KDSLRTSKVFWRSFDRNHLSYRD

SEQ ID NO: 1807649 - protein, 21 aa, Staphylococcus epidermidis
KDSRIPMDQKFIFNPYETKSI

SEQ ID NO: 1807650 - protein, 17 aa, Staphylococcus epidermidis
KDSTGICFIGERNFKEF

SEQ ID NO: 1807651 - protein, 20 aa, Staphylococcus epidermidis
KDTKTCVVTETFDKDIVTTA

SEQ ID NO: 1807652 - protein, 19 aa, Staphylococcus epidermidis
KDTLERVVPFWTDHISQHL

SEQ ID NO: 1807653 - protein, 21 aa, Staphylococcus epidermidis
KDTLERVVPFWTDHISQHLLD

SEQ ID NO: 1807654 - protein, 17 aa, Staphylococcus epidermidis
KDTPLLYLDGFNFENKK

SEQ ID NO: 1807655 - protein, 18 aa, Staphylococcus epidermidis
KDTTCFQYNISKHIATDF

SEQ ID NO: 1807656 - protein, 24 aa, Staphylococcus epidermidis
KDVDFLIAGGLDFEKIKRLEKYSF

SEQ ID NO: 1807657 - protein, 17 aa, Staphylococcus epidermidis
KDVEAQLGRHKRMTSSV

SEQ ID NO: 1807658 - protein, 20 aa, Staphylococcus epidermidis
KDVISRPIVTNALTHGLSLV

SEQ ID NO: 1807659 - protein, 20 aa, Staphylococcus epidermidis
KDVTCHTCDGEGAKPGTSKK

SEQ ID NO: 1807660 - protein, 25 aa, Staphylococcus epidermidis
KDYANKIIKAFDMESYINKKVKKYS

SEQ ID NO: 1807661 - protein, 22 aa, Staphylococcus epidermidis
KDYATISFLNWFLDEQVEEEST

SEQ ID NO: 1807662 - protein, 18 aa, Staphylococcus epidermidis
KDYLRYCLTDQIHMEYSD

SEQ ID NO: 1807663 - protein, 24 aa, Staphylococcus epidermidis
KDYLWTILIHRLQKWELNDKTYFD

SEQ ID NO: 1807664 - protein, 24 aa, Staphylococcus epidermidis
KDYLWTILIHRLREWELNDKTYFN

SEQ ID NO: 1807665 - protein, 20 aa, Staphylococcus epidermidis
KEAIDRQGLIAILTIPVNND

SEQ ID NO: 1807666 - protein, 18 aa, Staphylococcus epidermidis
KEAIEKLEIIKQEKRLKT

SEQ ID NO: 1807667 - protein, 19 aa, Staphylococcus epidermidis
KEAKEKGYETVSSRFPFQA

SEQ ID NO: 1807668 - protein, 21 aa, Staphylococcus epidermidis
KEARGKGGHVRANWKDVTDII

SEQ ID NO: 1807669 - protein, 18 aa, Staphylococcus epidermidis
KEARRMLDEAGFTDAKII

SEQ ID NO: 1807670 - protein, 20 aa, Staphylococcus epidermidis
KEAVPRVGDIVNVVDDLIGL

SEQ ID NO: 1807671 - protein, 21 aa, Staphylococcus epidermidis
KECNLSEKMFKNSMDKLERVY

SEQ ID NO: 1807672 - protein, 23 aa, Staphylococcus epidermidis
KEDESHVAIAGRLMTKRGKGKAG

SEQ ID NO: 1807673 - protein, 24 aa, Staphylococcus epidermidis
KEDGCKDWNDVLVNHVYKEKDRNF

SEQ ID NO: 1807674 - protein, 23 aa, Staphylococcus epidermidis
KEDIKKRVNLCSSMVQLDNDLDK

SEQ ID NO: 1807675 - protein, 25 aa, Staphylococcus epidermidis
KEDKMKNVCFQWKNQDGEIVGSDKR

SEQ ID NO: 1807676 - protein, 20 aa, Staphylococcus epidermidis
KEDKVVFIIDECHRTQFGEM

SEQ ID NO: 1807677 - protein, 19 aa, Staphylococcus epidermidis
KEDVKAVLKNVHRTLEERG

SEQ ID NO: 1807678 - protein, 24 aa, Staphylococcus epidermidis
KEEDGQWFIQGRIDFQIKLNGYRM

SEQ ID NO: 1807679 - protein, 18 aa, Staphylococcus epidermidis
KEEFNYYLSEYVGRETPL

SEQ ID NO: 1807680 - protein, 26 aa, Staphylococcus epidermidis
KEEGRNCKFIAVKLPYGVQQDANEVE

SEQ ID NO: 1807681 - protein, 31 aa, Staphylococcus epidermidis
KEEIYRKSVENCFNYFIDFLLRNHDDNYSID

SEQ ID NO: 1807682 - protein, 26 aa, Staphylococcus epidermidis
KEEKIKELQDFIARFSANASKSKQAT

SEQ ID NO: 1807683 - protein, 22 aa, Staphylococcus epidermidis
KEEKKSISMIVRYDVEKIAYAS

SEQ ID NO: 1807684 - protein, 30 aa, Staphylococcus epidermidis
KEEKKYYLILGCLPKYKGYLNLSTRPTNKH

SEQ ID NO: 1807685 - protein, 24 aa, Staphylococcus epidermidis
KEEKQCPTCHMTLKDIAHVGKFGC

SEQ ID NO: 1807686 - protein, 21 aa, Staphylococcus epidermidis
KEEKTNHFLVAFDAGKTTFRH

SEQ ID NO: 1807687 - protein, 24 aa, Staphylococcus epidermidis
KEELNRRLGWKIEEARDFEFEHNG

SEQ ID NO: 1807688 - protein, 23 aa, Staphylococcus epidermidis
KEEMRRLDSLIIQAADKARVPAG

SEQ ID NO: 1807689 - protein, 21 aa, Staphylococcus epidermidis
KEENGLGYSTLEWIKNHQSFN

SEQ ID NO: 1807690 - protein, 24 aa, Staphylococcus epidermidis
KEENIDLYDGYSFIGLGSDGGFAE

SEQ ID NO: 1807691 - protein, 28 aa, Staphylococcus epidermidis
KEEVHGNLSLELDVLFGVSSLVTAFLKY

SEQ ID NO: 1807692 - protein, 18 aa, Staphylococcus epidermidis
KEEVPEAYYTVPLGKADV

SEQ ID NO: 1807693 - protein, 20 aa, Staphylococcus epidermidis
KEEYASFIRQQWAKLGLGLD

SEQ ID NO: 1807694 - protein, 25 aa, Staphylococcus epidermidis
KEFDLRKKRLMEIRDDINTHYEGYP

SEQ ID NO: 1807695 - protein, 20 aa, Staphylococcus epidermidis
KEFFELYSKIVVEIPTDKPI

SEQ ID NO: 1807696 - protein, 17 aa, Staphylococcus epidermidis
KEFQRRDQEVFDNITDE

SEQ ID NO: 1807697 - protein, 17 aa, Staphylococcus epidermidis
KEFSEYLPVNEETPQLT

SEQ ID NO: 1807698 - protein, 28 aa, Staphylococcus epidermidis
KEFTEAILEKCIQFVFSLDDDQFELYRK

SEQ ID NO: 1807699 - protein, 21 aa, Staphylococcus epidermidis
KEGDLSRGTFYLHYKDKYDLA

SEQ ID NO: 1807700 - protein, 33 aa, Staphylococcus epidermidis
KEGIKLILKIFEAWKIPIIFVTHSNYEAQQMAH

SEQ ID NO: 1807701 - protein, 23 aa, Staphylococcus epidermidis
KEGKDRFLRISIDKEGGVDLNDC

SEQ ID NO: 1807702 - protein, 23 aa, Staphylococcus epidermidis
KEGLNHVISRHFKIRDALRTALK

SEQ ID NO: 1807703 - protein, 18 aa, Staphylococcus epidermidis
KEGMLLCEYLNIKPEILT

SEQ ID NO: 1807704 - protein, 20 aa, Staphylococcus epidermidis
KEGNIDCVMIYKTNRLARNT

SEQ ID NO: 1807705 - protein, 25 aa, Staphylococcus epidermidis
KEGPKVIEFNARFGDPEAQVLLTRM

SEQ ID NO: 1807706 - protein, 17 aa, Staphylococcus epidermidis
KEGSIPLVNRITHEIAF

SEQ ID NO: 1807707 - protein, 17 aa, Staphylococcus epidermidis
KEGSIPLVNRITSDIAF

SEQ ID NO: 1807708 - protein, 20 aa, Staphylococcus epidermidis
KEGSNLWFDNMVIPKTAQNK

SEQ ID NO: 1807709 - protein, 28 aa, Staphylococcus epidermidis
KEHGKLAMVLVQFPPWFDCNVQNINYIL

SEQ ID NO: 1807710 - protein, 19 aa, Staphylococcus epidermidis
KEHKLLLAVDNTFMTPLGQ

SEQ ID NO: 1807711 - protein, 23 aa, Staphylococcus epidermidis
KEHPDVVKRIAFHEPPINTFLPN

SEQ ID NO: 1807712 - protein, 20 aa, Staphylococcus epidermidis
KEHQLLYILIMHAFANTYVS

SEQ ID NO: 1807713 - protein, 19 aa, Staphylococcus epidermidis
KEHVRRDALKHLANEYHIE

SEQ ID NO: 1807714 - protein, 17 aa, Staphylococcus epidermidis
KEIDAFLAGVGTGGTLS

SEQ ID NO: 1807715 - protein, 21 aa, Staphylococcus epidermidis
KEIDWALTVTGTSDFRHRSIN

SEQ ID NO: 1807716 - protein, 17 aa, Staphylococcus epidermidis
KEIEAQSTFALLLGNEG

SEQ ID NO: 1807717 - protein, 18 aa, Staphylococcus epidermidis
KEIGYKLFERSRKGTFLT

SEQ ID NO: 1807718 - protein, 17 aa, Staphylococcus epidermidis
KEIIAYLETKYGKSAMK

SEQ ID NO: 1807719 - protein, 20 aa, Staphylococcus epidermidis
KEIIPIYNFVRENEFPTRHN

SEQ ID NO: 1807720 - protein, 20 aa, Staphylococcus epidermidis
KEIITEKGLNGFNITIPHKE

SEQ ID NO: 1807721 - protein, 30 aa, Staphylococcus epidermidis
KEIKKTLSDISMKVYSEFNINQDEAKELIA

SEQ ID NO: 1807722 - protein, 24 aa, Staphylococcus epidermidis
KEINPTHVAVCWDMGQQTFRNEMF

SEQ ID NO: 1807723 - protein, 17 aa, Staphylococcus epidermidis
KEIRIAGGREVNLRSLQ

SEQ ID NO: 1807724 - protein, 24 aa, Staphylococcus epidermidis
KEISFSVSGSGAYSKLKFENGAHR

SEQ ID NO: 1807725 - protein, 20 aa, Staphylococcus epidermidis
KEITAAFAGEVFEAHKEGCA

SEQ ID NO: 1807726 - protein, 26 aa, Staphylococcus epidermidis
KEIVPIWKKEIWDDGAEWQGHQKGTY

SEQ ID NO: 1807727 - protein, 21 aa, Staphylococcus epidermidis
KEKAQELIQGLVMTNSIVHGG

SEQ ID NO: 1807728 - protein, 22 aa, Staphylococcus epidermidis
KEKEIMSVPVLLVMNKDQEVKR

SEQ ID NO: 1807729 - protein, 20 aa, Staphylococcus epidermidis
KEKHPRLLVTRTVKKNSGKY

SEQ ID NO: 1807730 - protein, 23 aa, Staphylococcus epidermidis
KEKLPCIHEKPDLNINHKIKTHR

SEQ ID NO: 1807731 - protein, 24 aa, Staphylococcus epidermidis
KEKNFGDSVPTGFFIYPVSQAADI

SEQ ID NO: 1807732 - protein, 21 aa, Staphylococcus epidermidis
KEKPKARWLFLTLSTKNAIDG

SEQ ID NO: 1807733 - protein, 23 aa, Staphylococcus epidermidis
KEKPKARWLFLTLSTRNAIDGDT

SEQ ID NO: 1807734 - protein, 33 aa, Staphylococcus epidermidis
KEKRKIIDTCCGCGFHSKFLIDKGHHVISFDKS

SEQ ID NO: 1807735 - protein, 20 aa, Staphylococcus epidermidis
KEKVKESFGFNSRQLTTSSA

SEQ ID NO: 1807736 - protein, 25 aa, Staphylococcus epidermidis
KEKYHIKNKLAVYVPTYRESKVANR

SEQ ID NO: 1807737 - protein, 22 aa, Staphylococcus epidermidis
KELAENLNVCFNCDHHIALTAH

SEQ ID NO: 1807738 - protein, 21 aa, Staphylococcus epidermidis
KELFENYILDNWDKVNQSINE

SEQ ID NO: 1807739 - protein, 20 aa, Staphylococcus epidermidis
KELHEIREHIGAYLIVDDLK

SEQ ID NO: 1807740 - protein, 25 aa, Staphylococcus epidermidis
KELIVCGIKSAYILKNTSDTFKEDA

SEQ ID NO: 1807741 - protein, 23 aa, Staphylococcus epidermidis
KELKQRLGNKLLKELKKVDYDKK

SEQ ID NO: 1807742 - protein, 19 aa, Staphylococcus epidermidis
KELLGLLRLHLSLFEKYDK

SEQ ID NO: 1807743 - protein, 20 aa, Staphylococcus epidermidis
KELLKKIGLEEQLNSYPHML

SEQ ID NO: 1807744 - protein, 19 aa, Staphylococcus epidermidis
KELLVDMIAVQNLEQRAAE

SEQ ID NO: 1807745 - protein, 22 aa, Staphylococcus epidermidis
KELNSAMQALRDAVGQQNDVHQ

SEQ ID NO: 1807746 - protein, 21 aa, Staphylococcus epidermidis
KELQEVGLLEQIRTGFNKPNK

SEQ ID NO: 1807747 - protein, 17 aa, Staphylococcus epidermidis
KELTARVNVQLRNINNK

SEQ ID NO: 1807748 - protein, 25 aa, Staphylococcus epidermidis
KELTEPKIKVGDTVTEGDVIGYIEA

SEQ ID NO: 1807749 - protein, 19 aa, Staphylococcus epidermidis
KEMAEAIVGNVIGNNLGSQ

SEQ ID NO: 1807750 - protein, 17 aa, Staphylococcus epidermidis
KEMFGRQDAILNEFGLT

SEQ ID NO: 1807751 - protein, 19 aa, Staphylococcus epidermidis
KEMGYKFKIISGGNSSMLP

SEQ ID NO: 1807752 - protein, 17 aa, Staphylococcus epidermidis
KEMISTIEPPDAVSQSE

SEQ ID NO: 1807753 - protein, 19 aa, Staphylococcus epidermidis
KEMLNSHVRKCENHTSENV

SEQ ID NO: 1807754 - protein, 34 aa, Staphylococcus epidermidis
KEMRKEVKINLSRECKDWTASLNIKMKKLKKEMK

SEQ ID NO: 1807755 - protein, 24 aa, Staphylococcus epidermidis
KEMTLPELIEWVSITQKKLKVELL

SEQ ID NO: 1807756 - protein, 22 aa, Staphylococcus epidermidis
KENALDLIQFVAPIKTIITDII

SEQ ID NO: 1807757 - protein, 23 aa, Staphylococcus epidermidis
KENEELKAEKALSQMKNETRTML

SEQ ID NO: 1807758 - protein, 27 aa, Staphylococcus epidermidis
KENFDLIVDYCRDRGFLVLTYDNGYII

SEQ ID NO: 1807759 - protein, 18 aa, Staphylococcus epidermidis
KENGEWYNMEKEWRKAID

SEQ ID NO: 1807760 - protein, 24 aa, Staphylococcus epidermidis
KENGLDMKKRWYATKDTRTRDTHR

SEQ ID NO: 1807761 - protein, 24 aa, Staphylococcus epidermidis
KENGLEIANPLIINATSIKETDAQ

SEQ ID NO: 1807762 - protein, 21 aa, Staphylococcus epidermidis
KENIDSLMLKMIINKSSNLEQ

SEQ ID NO: 1807763 - protein, 22 aa, Staphylococcus epidermidis
KENKGKVVLVTAMSPTPAGEGK

SEQ ID NO: 1807764 - protein, 17 aa, Staphylococcus epidermidis
KENKLGGNPIVFFRNQK

SEQ ID NO: 1807765 - protein, 22 aa, Staphylococcus epidermidis
KENNLKGRILVSTEGINGTLSG

SEQ ID NO: 1807766 - protein, 25 aa, Staphylococcus epidermidis
KENRKQFDFRGLQCPGPIVNISKEI

SEQ ID NO: 1807767 - protein, 24 aa, Staphylococcus epidermidis
KEPIKRIANHRVLAMNRGEKEKVL

SEQ ID NO: 1807768 - protein, 18 aa, Staphylococcus epidermidis
KEQLALVYTLEELEAHSA

SEQ ID NO: 1807769 - protein, 17 aa, Staphylococcus epidermidis
KEQLSGSCTVEVAAFNE

SEQ ID NO: 1807770 - protein, 25 aa, Staphylococcus epidermidis
KERHNLKMITIESLIAYRKQTESHV

SEQ ID NO: 1807771 - protein, 20 aa, Staphylococcus epidermidis
KERLDGEHFGDFVIRSGVVA

SEQ ID NO: 1807772 - protein, 17 aa, Staphylococcus epidermidis
KERLLPGGYLFLSDLVG

SEQ ID NO: 1807773 - protein, 19 aa, Staphylococcus epidermidis
KERLRELKERMRAETQDMV

SEQ ID NO: 1807774 - protein, 28 aa, Staphylococcus epidermidis
KERNELRYRWEYMGEAIGSGVVPFNNLQ

SEQ ID NO: 1807775 - protein, 21 aa, Staphylococcus epidermidis
KERNKTCVIVTHDERLTHFCD

SEQ ID NO: 1807776 - protein, 20 aa, Staphylococcus epidermidis
KESFKEAIVNFYQRQYGVTL

SEQ ID NO: 1807777 - protein, 23 aa, Staphylococcus epidermidis
KESFMTNIFGMMFLSQAAVPYLS

SEQ ID NO: 1807778 - protein, 20 aa, Staphylococcus epidermidis
KESIHQICGLDVKAIEDYQL

SEQ ID NO: 1807779 - protein, 20 aa, Staphylococcus epidermidis
KESINQCYFIIPTEEFEEEA

SEQ ID NO: 1807780 - protein, 24 aa, Staphylococcus epidermidis
KESIYECGQSVIISQSLSPSLKNI

SEQ ID NO: 1807781 - protein, 20 aa, Staphylococcus epidermidis
KESLELIHKYGLPEPSLAQT

SEQ ID NO: 1807782 - protein, 17 aa, Staphylococcus epidermidis
KESTDAIIRMVKTTICG

SEQ ID NO: 1807783 - protein, 19 aa, Staphylococcus epidermidis
KESVIPASITKRVAIEMAS

SEQ ID NO: 1807784 - protein, 30 aa, Staphylococcus epidermidis
KESVISAMMFKGNASKLGFEPKEGDEVLIE

SEQ ID NO: 1807785 - protein, 21 aa, Staphylococcus epidermidis
KESYEGFANFYIEQAKEERYH

SEQ ID NO: 1807786 - protein, 26 aa, Staphylococcus epidermidis
KETDVLVCTVIGFPLGATTTNAKIFE

SEQ ID NO: 1807787 - protein, 23 aa, Staphylococcus epidermidis
KETFMTNIFGMMFLSQAAVPHLS

SEQ ID NO: 1807788 - protein, 23 aa, Staphylococcus epidermidis
KETFMTNIFGMMFLSQSAVPYLS

SEQ ID NO: 1807789 - protein, 19 aa, Staphylococcus epidermidis
KETGITIMYMVKKLDAGNI

SEQ ID NO: 1807790 - protein, 21 aa, Staphylococcus epidermidis
KETLEGAGLDQAITYSLVSKN

SEQ ID NO: 1807791 - protein, 33 aa, Staphylococcus epidermidis
KETLEIYAPLAHRLGINTIKWELEDTALRYIDS

SEQ ID NO: 1807792 - protein, 20 aa, Staphylococcus epidermidis
KETRLFKKPSSLLLSSYFDA

SEQ ID NO: 1807793 - protein, 19 aa, Staphylococcus epidermidis
KETRQSIAKDLSMLGSNAN

SEQ ID NO: 1807794 - protein, 17 aa, Staphylococcus epidermidis
KETRQSIARDLSKLGAN

SEQ ID NO: 1807795 - protein, 20 aa, Staphylococcus epidermidis
KEVIYENFVTKDFVVDYQGK

SEQ ID NO: 1807796 - protein, 22 aa, Staphylococcus epidermidis
KEVSEAAVLNANYIKSRLKNHF

SEQ ID NO: 1807797 - protein, 24 aa, Staphylococcus epidermidis
KEVTRLAEHLGWKGKGSNFDILPL

SEQ ID NO: 1807798 - protein, 17 aa, Staphylococcus epidermidis
KEVYPNIIIFVDNCYGE

SEQ ID NO: 1807799 - protein, 20 aa, Staphylococcus epidermidis
KEVYPNIIIFVDNCYGEFVE

SEQ ID NO: 1807800 - protein, 18 aa, Staphylococcus epidermidis
KEYCDFHHFEVKDIYADR

SEQ ID NO: 1807801 - protein, 21 aa, Staphylococcus epidermidis
KEYFYVPSVHKGGFTGGATGS

SEQ ID NO: 1807802 - protein, 26 aa, Staphylococcus epidermidis
KEYIDFRYLINLSYHLEKMRGLKKEF

SEQ ID NO: 1807803 - protein, 21 aa, Staphylococcus epidermidis
KEYKKDKVIMILNYPNNPTGY

SEQ ID NO: 1807804 - protein, 24 aa, Staphylococcus epidermidis
KEYMDFTDIIPISALEGLNVDHFI

SEQ ID NO: 1807805 - protein, 26 aa, Staphylococcus epidermidis
KEYSDHIIDAFGMRPYIKKKVKKYSM

SEQ ID NO: 1807806 - protein, 19 aa, Staphylococcus epidermidis
KFAKLLRMYDESIKITSSN

SEQ ID NO: 1807807 - protein, 25 aa, Staphylococcus epidermidis
KFARLPESLNFISWLQHLQENGIAD

SEQ ID NO: 1807808 - protein, 28 aa, Staphylococcus epidermidis
KFEADWCPDCKAMDMWIDPIVEKYNNYQ

SEQ ID NO: 1807809 - protein, 28 aa, Staphylococcus epidermidis
KFEADWCPDCKAMDMWIDPIVEKYNNYS

SEQ ID NO: 1807810 - protein, 19 aa, Staphylococcus epidermidis
KFEINRIYKSTPIDNKLIN

SEQ ID NO: 1807811 - protein, 21 aa, Staphylococcus epidermidis
KFEKEYVCLAYGRTKSKGVIE

SEQ ID NO: 1807812 - protein, 23 aa, Staphylococcus epidermidis
KFETRLGDDMVEREYLTCEGILW

SEQ ID NO: 1807813 - protein, 19 aa, Staphylococcus epidermidis
KFHETFGHPVAEVPQPISK

SEQ ID NO: 1807814 - protein, 20 aa, Staphylococcus epidermidis
KFHKCVDSNFKIILTKQKEN

SEQ ID NO: 1807815 - protein, 20 aa, Staphylococcus epidermidis
KFHKEHFNDWTYFQIKLVIV

SEQ ID NO: 1807816 - protein, 25 aa, Staphylococcus epidermidis
KFIRILNFPFYFRGEVYDPFETLTL

SEQ ID NO: 1807817 - protein, 26 aa, Staphylococcus epidermidis
KFITCGFNNCIFESVHFYKDLYKDST

SEQ ID NO: 1807818 - protein, 19 aa, Staphylococcus epidermidis
KFKANCHSFNVTPSNAVLT

SEQ ID NO: 1807819 - protein, 21 aa, Staphylococcus epidermidis
KFKEAMFLKGFNLSDLSRETG

SEQ ID NO: 1807820 - protein, 21 aa, Staphylococcus epidermidis
KFLEEPPKNTIAILLSTKPEQ

SEQ ID NO: 1807821 - protein, 19 aa, Staphylococcus epidermidis
KFLPNFEKQSIYSLRYDEM

SEQ ID NO: 1807822 - protein, 25 aa, Staphylococcus epidermidis
KFNEPLCVKIGMELFYQTGPALIKS

SEQ ID NO: 1807823 - protein, 19 aa, Staphylococcus epidermidis
KFNGLKGQGLLLIKNIQNI

SEQ ID NO: 1807824 - protein, 19 aa, Staphylococcus epidermidis
KFNYILRLSKYENYLKTYN

SEQ ID NO: 1807825 - protein, 25 aa, Staphylococcus epidermidis
KFPERNRLISGLSRGLLITEAEEKS

SEQ ID NO: 1807826 - protein, 18 aa, Staphylococcus epidermidis
KFQILELFHQTFPGLERL

SEQ ID NO: 1807827 - protein, 18 aa, Staphylococcus epidermidis
KFQILELLHQTFPGLERL

SEQ ID NO: 1807828 - protein, 26 aa, Staphylococcus epidermidis
KFQKEMRKFMAGVIFATQSPQELIPE

SEQ ID NO: 1807829 - protein, 24 aa, Staphylococcus epidermidis
KFRCFACYRYNKFTVLKNLVNEFE

SEQ ID NO: 1807830 - protein, 34 aa, Staphylococcus epidermidis; identical to SEQ ID NO: 1647346

SEQ ID NO: 1807831 - protein, 22 aa, Staphylococcus epidermidis
KFRKEYQAYINVWKDMIEEKHK

SEQ ID NO: 1807832 - protein, 20 aa, Staphylococcus epidermidis
KFRQVDEFKDNINSNSQGAS

SEQ ID NO: 1807833 - protein, 25 aa, Staphylococcus epidermidis
KFTSTEINLFFAMCNKLKEKETNTL

SEQ ID NO: 1807834 - protein, 18 aa, Staphylococcus epidermidis
KFYGCLFATVDGFNVKSF

SEQ ID NO: 1807835 - protein, 18 aa, Staphylococcus epidermidis
KFYQLPKVFFTNPDYMKL

SEQ ID NO: 1807836 - protein, 23 aa, Staphylococcus epidermidis
KGAEDGPTIAFRADFDALPVQEL

SEQ ID NO: 1807837 - protein, 23 aa, Staphylococcus epidermidis
KGAEVPALLGAYILEGSKAGATA

SEQ ID NO: 1807838 - protein, 20 aa, Staphylococcus epidermidis
KGAMLEKYFECEHLSPDETE

SEQ ID NO: 1807839 - protein, 20 aa, Staphylococcus epidermidis
KGAQHALDLLGLATLSLLDT

SEQ ID NO: 1807840 - protein, 19 aa, Staphylococcus epidermidis
KGASGEHRIEFEVIDHIGA

SEQ ID NO: 1807841 - protein, 17 aa, Staphylococcus epidermidis
KGASRAVLARELSLDEI

SEQ ID NO: 1807842 - protein, 25 aa, Staphylococcus epidermidis
KGDHILIIKVTRDFFGISSEENWKK

SEQ ID NO: 1807843 - protein, 19 aa, Staphylococcus epidermidis
KGDLAEIVKEFLINFQEKY

SEQ ID NO: 1807844 - protein, 22 aa, Staphylococcus epidermidis
KGDLRRARAAALNIAPTSTGAA

SEQ ID NO: 1807845 - protein, 19 aa, Staphylococcus epidermidis
KGDLSEIVKDFLINFQEKY

SEQ ID NO: 1807846 - protein, 21 aa, Staphylococcus epidermidis
KGDYDYFSFEAMRSKNNSDLH

SEQ ID NO: 1807847 - protein, 22 aa, Staphylococcus epidermidis
KGEDAFKLYDTYGFPVELTEEL

SEQ ID NO: 1807848 - protein, 25 aa, Staphylococcus epidermidis
KGEGLKTRRMVLFMNRNTRTSKGKF

SEQ ID NO: 1807849 - protein, 19 aa, Staphylococcus epidermidis
KGELCIIGCSTSEVIGEKI

SEQ ID NO: 1807850 - protein, 36 aa, Staphylococcus epidermidis
KGENRLKLIHHWINGRMPLVGIGSVFTPDDALHAVN

SEQ ID NO: 1807851 - protein, 35 aa, Staphylococcus epidermidis
KGENRLKLIHQWINGRMPLIGIGSVFTAEDALNAV

SEQ ID NO: 1807852 - protein, 23 aa, Staphylococcus epidermidis
KGESLKSREMVLYINRNTRTTKG

SEQ ID NO: 1807853 - protein, 23 aa, Staphylococcus epidermidis
KGFKTWLSNTLSWIRSVGKDMGD

SEQ ID NO: 1807854 - protein, 32 aa, Staphylococcus epidermidis
KGGGSRAASAWRPEVIKALKMNGLPASSAYVN

SEQ ID NO: 1807855 - protein, 18 aa, Staphylococcus epidermidis
KGGLKLMMETMSMEYAQY

SEQ ID NO: 1807856 - protein, 26 aa, Staphylococcus epidermidis
KGHDAFKLYDTYGFPIELTEELATQE

SEQ ID NO: 1807857 - protein, 21 aa, Staphylococcus epidermidis
KGHISKILAAYHQYYAVNKAV

SEQ ID NO: 1807858 - protein, 23 aa, Staphylococcus epidermidis
KGHPLEYYFDINIKNITQKGNAR

SEQ ID NO: 1807859 - protein, 23 aa, Staphylococcus epidermidis
KGHQIRWRLLYIANPDYTVKPPF

SEQ ID NO: 1807860 - protein, 18 aa, Staphylococcus epidermidis
KGIDGVTYKADFKDRKAI

SEQ ID NO: 1807861 - protein, 21 aa, Staphylococcus epidermidis
KGIDVPAPFPRMTYAEAMDRY

SEQ ID NO: 1807862 - protein, 29 aa, Staphylococcus epidermidis
KGIDVSGPFPRMTYAEAMDRYGSDKPDTR

SEQ ID NO: 1807863 - protein, 22 aa, Staphylococcus epidermidis
KGIECIYALYKKNRRSLQIYGF

SEQ ID NO: 1807864 - protein, 18 aa, Staphylococcus epidermidis
KGKDFIFDATVTVEPEVE

SEQ ID NO: 1807865 - protein, 25 aa, Staphylococcus epidermidis
KGKGLKTRRMVLFMNRNTRTSKGKF

SEQ ID NO: 1807866 - protein, 20 aa, Staphylococcus epidermidis
KGKHSFRGVFKSKKPGIDYK

SEQ ID NO: 1807867 - protein, 22 aa, Staphylococcus epidermidis
KGKKLREARQDFQMIFQDPYAS

SEQ ID NO: 1807868 - protein, 20 aa, Staphylococcus epidermidis
KGKLADDWLQNIKLMNDKNK

SEQ ID NO: 1807869 - protein, 17 aa, Staphylococcus epidermidis
KGKLEFLIIGYTTDYIN

SEQ ID NO: 1807870 - protein, 17 aa, Staphylococcus epidermidis
KGKQYLQTLTHLNDAQR

SEQ ID NO: 1807871 - protein, 19 aa, Staphylococcus epidermidis
KGKRTITKFKENSDVLLNY

SEQ ID NO: 1807872 - protein, 19 aa, Staphylococcus epidermidis
KGKSKKVEYAWTDDELEKL

SEQ ID NO: 1807873 - protein, 19 aa, Staphylococcus epidermidis
KGKSTIEGLGISMKDENGQ

SEQ ID NO: 1807874 - protein, 17 aa, Staphylococcus epidermidis
KGKSVVVTTHVMDEAER

SEQ ID NO: 1807875 - protein, 18 aa, Staphylococcus epidermidis
KGKVEVYAEFVFNEDGKV

SEQ ID NO: 1807876 - protein, 20 aa, Staphylococcus epidermidis
KGKVTGIKKFGAFVELPEGK

SEQ ID NO: 1807877 - protein, 19 aa, Staphylococcus epidermidis
KGKVVGFATYGSFRQWPAY

SEQ ID NO: 1807878 - protein, 33 aa, Staphylococcus epidermidis
KGLEGPFHFETFVSLTCQKCPDVVQALNLMSVI

SEQ ID NO: 1807879 - protein, 26 aa, Staphylococcus epidermidis
KGLIHEVFKDYGILFIDAQYPELRQM

SEQ ID NO: 1807880 - protein, 17 aa, Staphylococcus epidermidis
KGLLVPVVKHADRKSIF

SEQ ID NO: 1807881 - protein, 23 aa, Staphylococcus epidermidis
KGLPTDYIMPEFLRDIFKEKLLS

SEQ ID NO: 1807882 - protein, 17 aa, Staphylococcus epidermidis
KGLYWDGKMYVFDERIS

SEQ ID NO: 1807883 - protein, 19 aa, Staphylococcus epidermidis
KGMKKRYATLMDIDENTPV

SEQ ID NO: 1807884 - protein, 20 aa, Staphylococcus epidermidis
KGNANYAWIEHMISKLAPNG

SEQ ID NO: 1807885 - protein, 18 aa, Staphylococcus epidermidis
KGNLQFVILKMLKEESRH

SEQ ID NO: 1807886 - protein, 20 aa, Staphylococcus epidermidis
KGNRPITYFLTDRPQETGKT

SEQ ID NO: 1807887 - protein, 22 aa, Staphylococcus epidermidis
KGNYDYYSFEGIRPKNNSELHV

SEQ ID NO: 1807888 - protein, 18 aa, Staphylococcus epidermidis
KGPFRFAALSGDPKDIER

SEQ ID NO: 1807889 - protein, 18 aa, Staphylococcus epidermidis
KGPGHLVRRTFVEGSAVP

SEQ ID NO: 1807890 - protein, 20 aa, Staphylococcus epidermidis
KGPTGYMIPTVIEWMKQQYK

SEQ ID NO: 1807891 - protein, 20 aa, Staphylococcus epidermidis
KGQGLLLIKNIQNIEPVIHG

SEQ ID NO: 1807892 - protein, 19 aa, Staphylococcus epidermidis
KGQIAVIGPTAMHYQNVIQ

SEQ ID NO: 1807893 - protein, 18 aa, Staphylococcus epidermidis
KGQNLGAIDGHKVLVQIT

SEQ ID NO: 1807894 - protein, 19 aa, Staphylococcus epidermidis
KGQSEPIVLVIFTNKDNKS

SEQ ID NO: 1807895 - protein, 22 aa, Staphylococcus epidermidis
KGRIKEVYAYDLSLLDGGRNSY

SEQ ID NO: 1807896 - protein, 18 aa, Staphylococcus epidermidis
KGRKIEWLEFTFDAEKRI

SEQ ID NO: 1807897 - protein, 20 aa, Staphylococcus epidermidis
KGSFEIEGVSLFELQARQLI

SEQ ID NO: 1807898 - protein, 20 aa, Staphylococcus epidermidis
KGSIPREDVASVLKEVVTSD

SEQ ID NO: 1807899 - protein, 18 aa, Staphylococcus epidermidis
KGSMDFRITSKGRSSHSS

SEQ ID NO: 1807900 - protein, 20 aa, Staphylococcus epidermidis
KGSSVGYKHIEFTFVENKEE

SEQ ID NO: 1807901 - protein, 18 aa, Staphylococcus epidermidis
KGSSVGYNHLEFTFVENK

SEQ ID NO: 1807902 - protein, 19 aa, Staphylococcus epidermidis
KGSSVGYNHLEFTFVENKK

SEQ ID NO: 1807903 - protein, 25 aa, Staphylococcus epidermidis
KGTDLPGQIARRVDQNILRKLSEQV

SEQ ID NO: 1807904 - protein, 26 aa, Staphylococcus epidermidis
KGTDVLVCTVIGFPLGATTTAVKSYE

SEQ ID NO: 1807905 - protein, 21 aa, Staphylococcus epidermidis
KGTELDTYYLLDQAINANVDI

SEQ ID NO: 1807906 - protein, 24 aa, Staphylococcus epidermidis
KGTKKYFRFAFPIIDENGEKIIIN

SEQ ID NO: 1807907 - protein, 17 aa, Staphylococcus epidermidis
KGTNGSSGFLSGGVVAG

SEQ ID NO: 1807908 - protein, 21 aa, Staphylococcus epidermidis
KGTRKFLNLGHTFGHAVEYEH

SEQ ID NO: 1807909 - protein, 37 aa, Staphylococcus epidermidis
KGVDGELPGSVSFAPFSLVVKCGYDGLDLIDAALAEN

SEQ ID NO: 1807910 - protein, 26 aa, Staphylococcus epidermidis
KGVNYLIKVLENWSKDGVDTKEKAIS

SEQ ID NO: 1807911 - protein, 25 aa, Staphylococcus epidermidis
KGVRVVSMPNWFAFEQQSDEYKESV

SEQ ID NO: 1807912 - protein, 24 aa, Staphylococcus epidermidis
KGYIRISYAYEMEMLKEGMRRLEK

SEQ ID NO: 1807913 - protein, 20 aa, Staphylococcus epidermidis
KGYKAGRFLRESDLGIESEN

SEQ ID NO: 1807914 - protein, 21 aa, Staphylococcus epidermidis
KGYKGSTTFTSLKVSGCDLYS

SEQ ID NO: 1807915 - protein, 19 aa, Staphylococcus epidermidis
KGYKILRLNQLVLSPQNLW

SEQ ID NO: 1807916 - protein, 17 aa, Staphylococcus epidermidis
KGYVRLRVDGEIVDVNE

SEQ ID NO: 1807917 - protein, 17 aa, Staphylococcus epidermidis
KHDLFEFIEETVAPIVN

SEQ ID NO: 1807918 - protein, 21 aa, Staphylococcus epidermidis
KHFDDVISMVANWFPSQATLY

SEQ ID NO: 1807919 - protein, 19 aa, Staphylococcus epidermidis
KHFDDVMNMITNWFPSQST

SEQ ID NO: 1807920 - protein, 21 aa, Staphylococcus epidermidis
KHFMKKKQGLLLFSGPTGSGK

SEQ ID NO: 1807921 - protein, 18 aa, Staphylococcus epidermidis
KHHLPPNLWQQFNEGFYP

SEQ ID NO: 1807922 - protein, 21 aa, Staphylococcus epidermidis
KHHYSQRHLKLFENLSDKRTT

SEQ ID NO: 1807923 - protein, 26 aa, Staphylococcus epidermidis
KHIADVGCGYGPIGLTIAKISPHHQL

SEQ ID NO: 1807924 - protein, 25 aa, Staphylococcus epidermidis
KHKLKRDFIDKICLESMEGGCDAIK

SEQ ID NO: 1807925 - protein, 19 aa, Staphylococcus epidermidis
KHKLKYFSKDNFDISLKNV

SEQ ID NO: 1807926 - protein, 19 aa, Staphylococcus epidermidis
KHLAENLGYRTELTNKGAL

SEQ ID NO: 1807927 - protein, 17 aa, Staphylococcus epidermidis
KHLGRYSRRINHQHRVV

SEQ ID NO: 1807928 - protein, 23 aa, Staphylococcus epidermidis
KHLKFHKVEPISIDFYRQSIGGA

SEQ ID NO: 1807929 - protein, 22 aa, Staphylococcus epidermidis
KHLSAKDLILLNGDLGAGKTTL

SEQ ID NO: 1807930 - protein, 24 aa, Staphylococcus epidermidis
KHNMVKQLYSPVQFIKSTEWLIEQ

SEQ ID NO: 1807931 - protein, 17 aa, Staphylococcus epidermidis
KHNREGYSMVAKQMKQW

SEQ ID NO: 1807932 - protein, 18 aa, Staphylococcus epidermidis
KHNVKGYKTIHFSEMKRN

SEQ ID NO: 1807933 - protein, 18 aa, Staphylococcus epidermidis
KHPIRYAQMFKTYKKGLD

SEQ ID NO: 1807934 - protein, 18 aa, Staphylococcus epidermidis
KHQLDEINKANATDESKA

SEQ ID NO: 1807935 - protein, 19 aa, Staphylococcus epidermidis
KHRKRPATAKPVLLGITKA

SEQ ID NO: 1807936 - protein, 18 aa, Staphylococcus epidermidis
KHSKAFSSKIVMKLWEDR

SEQ ID NO: 1807937 - protein, 19 aa, Staphylococcus epidermidis
KHSLGFEQDTVWLSVLPIY

SEQ ID NO: 1807938 - protein, 23 aa, Staphylococcus epidermidis
KHTLFPKYDFFRADTDYADIAKF

SEQ ID NO: 1807939 - protein, 18 aa, Staphylococcus epidermidis
KHVAVYLRLSRGEDESEL

SEQ ID NO: 1807940 - protein, 18 aa, Staphylococcus epidermidis
KHYRVCRPLLEVSKEDIL

SEQ ID NO: 1807941 - protein, 19 aa, Staphylococcus epidermidis
KHYVMVSTYDSRREAFDPS

SEQ ID NO: 1807942 - protein, 18 aa, Staphylococcus epidermidis
KIAGDFNAYNAIAAYTVL

SEQ ID NO: 1807943 - protein, 18 aa, Staphylococcus epidermidis
KIAGGVAVNLTRLRGRGA

SEQ ID NO: 1807944 - protein, 19 aa, Staphylococcus epidermidis
KIAHGLPAETVVSVANSGK

SEQ ID NO: 1807945 - protein, 17 aa, Staphylococcus epidermidis
KIALPKEYLGEGVSEEV

SEQ ID NO: 1807946 - protein, 26 aa, Staphylococcus epidermidis
KIAPALATGCSLVMKPSEITPLTTIR

SEQ ID NO: 1807947 - protein, 20 aa, Staphylococcus epidermidis
KIASDSLVYYGMKAHAHEFE

SEQ ID NO: 1807948 - protein, 18 aa, Staphylococcus epidermidis
KIASHSIVYYGMKKFAHD

SEQ ID NO: 1807949 - protein, 18 aa, Staphylococcus epidermidis
KIASHSIVYYGMKKFAHE

SEQ ID NO: 1807950 - protein, 23 aa, Staphylococcus epidermidis
KICPTCKGQRLNSKILSSKIMSK

SEQ ID NO: 1807951 - protein, 31 aa, Staphylococcus epidermidis
KIDIPRVRFTTSHPWDFTDRMIEVIANGGNI

SEQ ID NO: 1807952 - protein, 21 aa, Staphylococcus epidermidis
KIDQCVLQFGDIKIMIADDTE

SEQ ID NO: 1807953 - protein, 20 aa, Staphylococcus epidermidis
KIDVVRRISGGGAVYHDTGN

SEQ ID NO: 1807954 - protein, 23 aa, Staphylococcus epidermidis
KIEEIKAFIEFHDIDVVVTNDEL

SEQ ID NO: 1807955 - protein, 17 aa, Staphylococcus epidermidis
KIEIPLIAFDEAHCISQ

SEQ ID NO: 1807956 - protein, 19 aa, Staphylococcus epidermidis
KIELDSCGNIEIVFKDTLE

SEQ ID NO: 1807957 - protein, 18 aa, Staphylococcus epidermidis
KIEWLEFTFDAEKRIHSK

SEQ ID NO: 1807958 - protein, 17 aa, Staphylococcus epidermidis
KIFALCRDIELHWGEPV

SEQ ID NO: 1807959 - protein, 17 aa, Staphylococcus epidermidis
KIFIDIKGAVKHPNVYE

SEQ ID NO: 1807960 - protein, 22 aa, Staphylococcus epidermidis
KIFRNCKGRIIFATFASNIYRV

SEQ ID NO: 1807961 - protein, 27 aa, Staphylococcus epidermidis
KIGEGWISETMMFKIVEDIFENYECER

SEQ ID NO: 1807962 - protein, 19 aa, Staphylococcus epidermidis
KIGKQAIRESWSVRQLEQY

SEQ ID NO: 1807963 - protein, 19 aa, Staphylococcus epidermidis
KIHAAGLCHSDLSVINGNR

SEQ ID NO: 1807964 - protein, 27 aa, Staphylococcus epidermidis
KIHQEAPISLEFYKQFIGGETTGLHTY

SEQ ID NO: 1807965 - protein, 27 aa, Staphylococcus epidermidis
KIIDGVYKLVAPDGYKFITVEENESEE

SEQ ID NO: 1807966 - protein, 19 aa, Staphylococcus epidermidis
KIIEKCKYIRPFIPETVQG

SEQ ID NO: 1807967 - protein, 18 aa, Staphylococcus epidermidis
KIILNHLGKTHFLNNETE

SEQ ID NO: 1807968 - protein, 19 aa, Staphylococcus epidermidis
KIISEKGIDGFNVTIPHKE

SEQ ID NO: 1807969 - protein, 20 aa, Staphylococcus epidermidis
KIITDMGFEDYFLIVSDLIH

SEQ ID NO: 1807970 - protein, 28 aa, Staphylococcus epidermidis
KIKIGATVFAGFGPRIVRINDYSLDFKP

SEQ ID NO: 1807971 - protein, 18 aa, Staphylococcus epidermidis
KIKNLKLGYLTQQMTLNS

SEQ ID NO: 1807972 - protein, 22 aa, Staphylococcus epidermidis
KIKQLKELLDIEAITQEEYEQK

SEQ ID NO: 1807973 - protein, 29 aa, Staphylococcus epidermidis
KIKRTALDEWLFLRFDSVNTHIHKEYPSN

SEQ ID NO: 1807974 - protein, 20 aa, Staphylococcus epidermidis
KIKSQFPKAMAVEMEATAIA

SEQ ID NO: 1807975 - protein, 27 aa, Staphylococcus epidermidis
KILSKRELEILPLIAKGYGNKDIAEKL

SEQ ID NO: 1807976 - protein, 30 aa, Staphylococcus epidermidis
KILSVYAPLWKLGHVDGKIIDVKRELTGSN

SEQ ID NO: 1807977 - protein, 22 aa, Staphylococcus epidermidis
KILTELHGAPGFEDEVRSYMKS

SEQ ID NO: 1807978 - protein, 18 aa, Staphylococcus epidermidis
KIMPVIRATSFDKKTKEG

SEQ ID NO: 1807979 - protein, 20 aa, Staphylococcus epidermidis
KIMTEHLNIFVGLTDEAQNA

SEQ ID NO: 1807980 - protein, 19 aa, Staphylococcus epidermidis
KINGIELYKGKKIYKTFKN

SEQ ID NO: 1807981 - protein, 17 aa, Staphylococcus epidermidis
KINQEVSEINWLQVMSK

SEQ ID NO: 1807982 - protein, 25 aa, Staphylococcus epidermidis
KIPHGHAVMIGILYQFIVANEILGT

SEQ ID NO: 1807983 - protein, 23 aa, Staphylococcus epidermidis
KIPKALALDYIYGYTIINDITDR

SEQ ID NO: 1807984 - protein, 22 aa, Staphylococcus epidermidis
KIPLKAQRNLPNILINENYLAH

SEQ ID NO: 1807985 - protein, 25 aa, Staphylococcus epidermidis
KIPLRREAVVLLGMIEDEDILPYIY

SEQ ID NO: 1807986 - protein, 18 aa, Staphylococcus epidermidis
KIQLIIRGICCLKPGIPG

SEQ ID NO: 1807987 - protein, 18 aa, Staphylococcus epidermidis
KIQTGFFTQVFGEIKNVP

SEQ ID NO: 1807988 - protein, 17 aa, Staphylococcus epidermidis
KIRINEIGFILQSTNLV

SEQ ID NO: 1807989 - protein, 19 aa, Staphylococcus epidermidis
KISANWPNNVSVFSNQVET

SEQ ID NO: 1807990 - protein, 18 aa, Staphylococcus epidermidis
KISKEERADYLLEISNKI

SEQ ID NO: 1807991 - protein, 21 aa, Staphylococcus epidermidis
KISRKNLYRDVKIEAKDDGIY

SEQ ID NO: 1807992 - protein, 22 aa, Staphylococcus epidermidis
KITRNAGVRVIRDGIVLFEGEL

SEQ ID NO: 1807993 - protein, 20 aa, Staphylococcus epidermidis
KITTIPTLFHKIVPKALSHF

SEQ ID NO: 1807994 - protein, 18 aa, Staphylococcus epidermidis
KIVEDIFENYECERHCRP

SEQ ID NO: 1807995 - protein, 25 aa, Staphylococcus epidermidis
KIVFVNRYGKIIAMNDAAKDILTEE

SEQ ID NO: 1807996 - protein, 17 aa, Staphylococcus epidermidis
KIVKEIKEEIAGCEKEV

SEQ ID NO: 1807997 - protein, 18 aa, Staphylococcus epidermidis
KIVKVLLENNWIVATQGN

SEQ ID NO: 1807998 - protein, 20 aa, Staphylococcus epidermidis
KIVLARRRLIKFDKEIDIPY

SEQ ID NO: 1807999 - protein, 18 aa, Staphylococcus epidermidis
KIVNHLQLLLNFLNIPSK

SEQ ID NO: 1808000 - protein, 19 aa, Staphylococcus epidermidis
KIVSHVSVFRGKFICPRCG

SEQ ID NO: 1808001 - protein, 19 aa, Staphylococcus epidermidis
KIVTLKVISRIQINKEHYI

SEQ ID NO: 1808002 - protein, 18 aa, Staphylococcus epidermidis
KIYKDALKKIGVTTAGGY

SEQ ID NO: 1808003 - protein, 19 aa, Staphylococcus epidermidis
KKAELAGILHDYCKYEDLS

SEQ ID NO: 1808004 - protein, 19 aa, Staphylococcus epidermidis
KKAGIKHYVMVSTYDSRRE

SEQ ID NO: 1808005 - protein, 20 aa, Staphylococcus epidermidis
KKALFIVYANPLALGLLTPP

SEQ ID NO: 1808006 - protein, 25 aa, Staphylococcus epidermidis
KKAREYFKIFFSKLLSSITINPQIN

SEQ ID NO: 1808007 - protein, 18 aa, Staphylococcus epidermidis
KKATRRMVNQMIKDNKMD

SEQ ID NO: 1808008 - protein, 20 aa, Staphylococcus epidermidis
KKDAIVYACDRILKGELDEH

SEQ ID NO: 1808009 - protein, 21 aa, Staphylococcus epidermidis
KKDDTSFFDIVAFGKTAQLLN

SEQ ID NO: 1808010 - protein, 23 aa, Staphylococcus epidermidis
KKDFKRLGVRGDFINPYITLTPE

SEQ ID NO: 1808011 - protein, 18 aa, Staphylococcus epidermidis
KKDGATIAIGGKRPERED

SEQ ID NO: 1808012 - protein, 21 aa, Staphylococcus epidermidis
KKDIYEIFDQIDLGILDYSSI

SEQ ID NO: 1808013 - protein, 18 aa, Staphylococcus epidermidis
KKDMQSFIITLFDSNIET

SEQ ID NO: 1808014 - protein, 22 aa, Staphylococcus epidermidis
KKDNFYIISIEIVFFHLSKNFM

SEQ ID NO: 1808015 - protein, 20 aa, Staphylococcus epidermidis
KKDVINRFTLSEYKVSSKTN

SEQ ID NO: 1808016 - protein, 23 aa, Staphylococcus epidermidis
KKEFNNLFSVNQFCFDEQFIKKT

SEQ ID NO: 1808017 - protein, 21 aa, Staphylococcus epidermidis
KKEIIPIYNFVRENEFPTRHN

SEQ ID NO: 1808018 - protein, 17 aa, Staphylococcus epidermidis
KKELHFESFDDIYEDNA

SEQ ID NO: 1808019 - protein, 19 aa, Staphylococcus epidermidis
KKELIKFNLLTQERVGLNK

SEQ ID NO: 1808020 - protein, 18 aa, Staphylococcus epidermidis
KKEMAPYVDEFLQNKMGG

SEQ ID NO: 1808021 - protein, 21 aa, Staphylococcus epidermidis
KKETVDFYLAKGVVDRVAEKL

SEQ ID NO: 1808022 - protein, 17 aa, Staphylococcus epidermidis
KKFAPAFDVDMNQPGIQ

SEQ ID NO: 1808023 - protein, 24 aa, Staphylococcus epidermidis
KKFGDHNLAFAIEFCSKTIANNTK

SEQ ID NO: 1808024 - protein, 17 aa, Staphylococcus epidermidis
KKFIRYIYDYDKYMENR

SEQ ID NO: 1808025 - protein, 19 aa, Staphylococcus epidermidis
KKFQIAVNEEFVRKDDIIQ

SEQ ID NO: 1808026 - protein, 18 aa, Staphylococcus epidermidis
KKFSEYKLSYVENSIAHF

SEQ ID NO: 1808027 - protein, 21 aa, Staphylococcus epidermidis
KKGAVTYAYECTKDIRVAMNV

SEQ ID NO: 1808028 - protein, 26 aa, Staphylococcus epidermidis
KKGHQLRWRLLYIANPDYRVKPPFFI

SEQ ID NO: 1808029 - protein, 19 aa, Staphylococcus epidermidis
KKGIAKMFDFMLPKTSLKM

SEQ ID NO: 1808030 - protein, 17 aa, Staphylococcus epidermidis
KKGIFSVMNYLLPIQDI

SEQ ID NO: 1808031 - protein, 17 aa, Staphylococcus epidermidis
KKGIFSVMNYLLPMQDI

SEQ ID NO: 1808032 - protein, 28 aa, Staphylococcus epidermidis
KKGKFVSIQLYNALSFNFYYLGNKDESI

SEQ ID NO: 1808033 - protein, 19 aa, Staphylococcus epidermidis
KKGLERYDLEYEYEPKTKT

SEQ ID NO: 1808034 - protein, 19 aa, Staphylococcus epidermidis
KKGNQWCIDMLNYPPFKNE

SEQ ID NO: 1808035 - protein, 19 aa, Staphylococcus epidermidis
KKGNYVRKRIDPWIERYQY

SEQ ID NO: 1808036 - protein, 20 aa, Staphylococcus epidermidis
KKGPKGGIIEVFIDDKSKGT

SEQ ID NO: 1808037 - protein, 20 aa, Staphylococcus epidermidis
KKGRKIEWIEFTFDPEKRIH

SEQ ID NO: 1808038 - protein, 23 aa, Staphylococcus epidermidis
KKGRKIEWLEFIFDAEKCIHSKR

SEQ ID NO: 1808039 - protein, 19 aa, Staphylococcus epidermidis
KKGRVGFGTGKAQEVPEAI

SEQ ID NO: 1808040 - protein, 17 aa, Staphylococcus epidermidis
KKGRYAYSLPQSDIEDI

SEQ ID NO: 1808041 - protein, 24 aa, Staphylococcus epidermidis
KKHALAIGRGRPGVLHGSKMYLIQ

SEQ ID NO: 1808042 - protein, 19 aa, Staphylococcus epidermidis
KKHFKGYGLNVFSNPKVFN

SEQ ID NO: 1808043 - protein, 26 aa, Staphylococcus epidermidis
KKHNCLYLRVDPYLPYQYLNHDGEVI

SEQ ID NO: 1808044 - protein, 26 aa, Staphylococcus epidermidis
KKIFALCRDIELHWGEPVDSLRKRFQ

SEQ ID NO: 1808045 - protein, 18 aa, Staphylococcus epidermidis
KKIGYPVIIKATAGGGGK

SEQ ID NO: 1808046 - protein, 25 aa, Staphylococcus epidermidis
KKIKHLPNVLSFASKEHFEVASKAN

SEQ ID NO: 1808047 - protein, 27 aa, Staphylococcus epidermidis
KKIPFERAAAFGCAIITGIGAVVNTAQ

SEQ ID NO: 1808048 - protein, 20 aa, Staphylococcus epidermidis
KKIREEVAIMMSCKKSIKAN

SEQ ID NO: 1808049 - protein, 19 aa, Staphylococcus epidermidis
KKISVPELTPERKANANHR

SEQ ID NO: 1808050 - protein, 19 aa, Staphylococcus epidermidis
KKITGVIAPEHFKKHHDHE

SEQ ID NO: 1808051 - protein, 19 aa, Staphylococcus epidermidis
KKITGVIAPEHFKRHHDHE

SEQ ID NO: 1808052 - protein, 20 aa, Staphylococcus epidermidis
KKITWNWGGTFYPNAPKSGI

SEQ ID NO: 1808053 - protein, 22 aa, Staphylococcus epidermidis
KKKAAEKIGMISEIVHLDESTS

SEQ ID NO: 1808054 - protein, 23 aa, Staphylococcus epidermidis
KKKAAEKIGMISEIVHLDETTSE

SEQ ID NO: 1808055 - protein, 18 aa, Staphylococcus epidermidis
KKKAIVIGGGLLGLECAR

SEQ ID NO: 1808056 - protein, 20 aa, Staphylococcus epidermidis
KKKAPDFYMLPGGKYDGSEN

SEQ ID NO: 1808057 - protein, 17 aa, Staphylococcus epidermidis
KKKEAISKLLNEQVTED

SEQ ID NO: 1808058 - protein, 20 aa, Staphylococcus epidermidis
KKKGGFLLDEAFVYEYRSFI

SEQ ID NO: 1808059 - protein, 17 aa, Staphylococcus epidermidis
KKKIMIVAGHGYNDPGA

SEQ ID NO: 1808060 - protein, 20 aa, Staphylococcus epidermidis
KKKKLAIVFEDKLNGKQIFY

SEQ ID NO: 1808061 - protein, 19 aa, Staphylococcus epidermidis
KKKLAIALDLDETVLDNSP

SEQ ID NO: 1808062 - protein, 20 aa, Staphylococcus epidermidis
KKKPNMIWHVYKNRHSKFKG

SEQ ID NO: 1808063 - protein, 17 aa, Staphylococcus epidermidis
KKKRERDKTGLALIEGI

SEQ ID NO: 1808064 - protein, 17 aa, Staphylococcus epidermidis
KKKRERDKTGLALVEGI

SEQ ID NO: 1808065 - protein, 20 aa, Staphylococcus epidermidis
KKLASFYVACELFKEMSQQP

SEQ ID NO: 1808066 - protein, 22 aa, Staphylococcus epidermidis
KKLASFYVACELFKQIQQYPHT

SEQ ID NO: 1808067 - protein, 22 aa, Staphylococcus epidermidis
KKLEWLKKKYFNLDIISVLLFL

SEQ ID NO: 1808068 - protein, 17 aa, Staphylococcus epidermidis
KKLGNAVTRNRIKRAIR

SEQ ID NO: 1808069 - protein, 17 aa, Staphylococcus epidermidis
KKLIPIYINEETILFPV

SEQ ID NO: 1808070 - protein, 18 aa, Staphylococcus epidermidis
KKLISVIPSIDTGVCDSQ

SEQ ID NO: 1808071 - protein, 23 aa, Staphylococcus epidermidis
KKLKLNELWLSYPNNPNYLVSNL

SEQ ID NO: 1808072 - protein, 20 aa, Staphylococcus epidermidis
KKLKMDRYIHKKAKTYSLGM

SEQ ID NO: 1808073 - protein, 26 aa, Staphylococcus epidermidis
KKLKVKVLEKRVFDTFQQLFNYYDND

SEQ ID NO: 1808074 - protein, 26 aa, Staphylococcus epidermidis
KKLLEMRRNIGMIFQHFNLVKRSTVL

SEQ ID NO: 1808075 - protein, 17 aa, Staphylococcus epidermidis
KKLLNLEKLRQSIEKTN

SEQ ID NO: 1808076 - protein, 17 aa, Staphylococcus epidermidis
KKLLPNIPHVAVFDTSF

SEQ ID NO: 1808077 - protein, 20 aa, Staphylococcus epidermidis
KKLNEHYDIYIATAAMDVPT

SEQ ID NO: 1808078 - protein, 30 aa, Staphylococcus epidermidis
KKLNLEKLYPIYLECFKKARTMINSYFINK

SEQ ID NO: 1808079 - protein, 23 aa, Staphylococcus epidermidis
KKLNLKAVIFMPVTTPLQKINQV

SEQ ID NO: 1808080 - protein, 17 aa, Staphylococcus epidermidis
KKLSADIQKNFDKVNKL

SEQ ID NO: 1808081 - protein, 37 aa, Staphylococcus epidermidis
KKLSASTINRKMCALKEFIKYLSSYGYDIDINIINQL

SEQ ID NO: 1808082 - protein, 19 aa, Staphylococcus epidermidis
KKLTHNITLMFDGDFAGKE

SEQ ID NO: 1808083 - protein, 17 aa, Staphylococcus epidermidis
KKLVSGDAVYITDLCIL

SEQ ID NO: 1808084 - protein, 20 aa, Staphylococcus epidermidis
KKNAIVYACDRILNGELDDH

SEQ ID NO: 1808085 - protein, 24 aa, Staphylococcus epidermidis
KKNDLYYLYFYIKSMKKYIEDLGS

SEQ ID NO: 1808086 - protein, 26 aa, Staphylococcus epidermidis
KKNGKKRISHQMDMIFTHFGVSGPAA

SEQ ID NO: 1808087 - protein, 25 aa, Staphylococcus epidermidis
KKNHILRYYVCPKNMNASRFVCDFK

SEQ ID NO: 1808088 - protein, 18 aa, Staphylococcus epidermidis
KKNHVNIVACENAIMATD

SEQ ID NO: 1808089 - protein, 19 aa, Staphylococcus epidermidis
KKNPKVIVYAGMSLAQKND

SEQ ID NO: 1808090 - protein, 17 aa, Staphylococcus epidermidis
KKNVFVIDIDWDANKNI

SEQ ID NO: 1808091 - protein, 25 aa, Staphylococcus epidermidis
KKNYRPETRHAFLAINAARTITEFL

SEQ ID NO: 1808092 - protein, 19 aa, Staphylococcus epidermidis
KKPLVEFGKSKASLLTSKY

SEQ ID NO: 1808093 - protein, 23 aa, Staphylococcus epidermidis
KKQAHPIPLHWDAETLVTNYFQC

SEQ ID NO: 1808094 - protein, 17 aa, Staphylococcus epidermidis
KKQSFGFSENEALRVFR

SEQ ID NO: 1808095 - protein, 19 aa, Staphylococcus epidermidis
KKRGNRFSHDISYVAKEDD

SEQ ID NO: 1808096 - protein, 21 aa, Staphylococcus epidermidis
KKRISQEEAFEFFDSLDTVNL

SEQ ID NO: 1808097 - protein, 27 aa, Staphylococcus epidermidis
KKRQLITFKYLLPFRMPIKEIENIDFI

SEQ ID NO: 1808098 - protein, 20 aa, Staphylococcus epidermidis
KKRYYNFLKEHNFEDKLEKF

SEQ ID NO: 1808099 - protein, 22 aa, Staphylococcus epidermidis
KKSAYDFCGLVLDYDEQTQLAT

SEQ ID NO: 1808100 - protein, 18 aa, Staphylococcus epidermidis
KKTGLSYKEKLEYETLMT

SEQ ID NO: 1808101 - protein, 18 aa, Staphylococcus epidermidis
KKTLLVDFINQYHLNDLI

SEQ ID NO: 1808102 - protein, 24 aa, Staphylococcus epidermidis
KKTQLPQLFGFQAEGASPIVQNKV

SEQ ID NO: 1808103 - protein, 19 aa, Staphylococcus epidermidis
KKTQRAVAVIEDYNGDDVL

SEQ ID NO: 1808104 - protein, 20 aa, Staphylococcus epidermidis
KKTTPLKVYVNGRFDDVTFP

SEQ ID NO: 1808105 - protein, 18 aa, Staphylococcus epidermidis
KKVEYAWTDDELEKLQKQ

SEQ ID NO: 1808106 - protein, 17 aa, Staphylococcus epidermidis
KKVFKHLLVSSRQVDVF

SEQ ID NO: 1808107 - protein, 19 aa, Staphylococcus epidermidis
KKVFPYEDESDFGLLTGKR

SEQ ID NO: 1808108 - protein, 17 aa, Staphylococcus epidermidis
KKVLIKECNLMNVHNNT

SEQ ID NO: 1808109 - protein, 22 aa, Staphylococcus epidermidis
KKVPKLYFTSHMDTVVPGINIK

SEQ ID NO: 1808110 - protein, 21 aa, Staphylococcus epidermidis
KKVREALDMIINRKDIAKNVS

SEQ ID NO: 1808111 - protein, 25 aa, Staphylococcus epidermidis
KKVTRLGAILDEFLEADKYVFVSPM

SEQ ID NO: 1808112 - protein, 19 aa, Staphylococcus epidermidis
KKWIQRKLNENYKDIKQDA

SEQ ID NO: 1808113 - protein, 17 aa, Staphylococcus epidermidis
KKYDIGDEITVSGNDFE

SEQ ID NO: 1808114 - protein, 20 aa, Staphylococcus epidermidis
KKYFDRLGKEIIYENYVTGD

SEQ ID NO: 1808115 - protein, 17 aa, Staphylococcus epidermidis
KKYIAKLKGYLMREEIK

SEQ ID NO: 1808116 - protein, 19 aa, Staphylococcus epidermidis
KKYILEGNLDIKEYQRQIN

SEQ ID NO: 1808117 - protein, 18 aa, Staphylococcus epidermidis
KKYKVLHEVAGKSMIEHV

SEQ ID NO: 1808118 - protein, 29 aa, Staphylococcus epidermidis
KKYLAEMKEHYKAGGLGDVKVKKYLNEII

SEQ ID NO: 1808119 - protein, 20 aa, Staphylococcus epidermidis
KKYLFSISSLVTFEKCNKLR

SEQ ID NO: 1808120 - protein, 20 aa, Staphylococcus epidermidis
KKYMNREGKEVIYENFVTKD

SEQ ID NO: 1808121 - protein, 19 aa, Staphylococcus epidermidis
KLADDRFLLIVNAANTDKD

SEQ ID NO: 1808122 - protein, 17 aa, Staphylococcus epidermidis
KLAHFILDKNIELSEEI

SEQ ID NO: 1808123 - protein, 20 aa, Staphylococcus epidermidis
KLAIEKAEIKAENFKKKIRN

SEQ ID NO: 1808124 - protein, 25 aa, Staphylococcus epidermidis
KLALDLYESEWIQWYYDQMKSHKIQ

SEQ ID NO: 1808125 - protein, 25 aa, Staphylococcus epidermidis
KLALELYDATWIHWYHDQMKLKKAK

SEQ ID NO: 1808126 - protein, 18 aa, Staphylococcus epidermidis
KLAMSGKLPNHYANALPE

SEQ ID NO: 1808127 - protein, 19 aa, Staphylococcus epidermidis
KLAQLVIVPIWTPELKEVE

SEQ ID NO: 1808128 - protein, 30 aa, Staphylococcus epidermidis
KLAVEYKMAFPLHPEFRTMPMVWYCPPLSP

SEQ ID NO: 1808129 - protein, 20 aa, Staphylococcus epidermidis
KLCQEIPEIDVIFGSHTHHY

SEQ ID NO: 1808130 - protein, 20 aa, Staphylococcus epidermidis
KLDAKCIVIPSGETSKSFEH

SEQ ID NO: 1808131 - protein, 23 aa, Staphylococcus epidermidis
KLDFLNCAFGLVPTELNNFESTI

SEQ ID NO: 1808132 - protein, 21 aa, Staphylococcus epidermidis
KLDFPESVVSFFKGEIGQPVN

SEQ ID NO: 1808133 - protein, 17 aa, Staphylococcus epidermidis
KLDKAWKRLFELHPMLK

SEQ ID NO: 1808134 - protein, 18 aa, Staphylococcus epidermidis
KLDKVVFSICNWGDDFLD

SEQ ID NO: 1808135 - protein, 24 aa, Staphylococcus epidermidis
KLEKRGRNYIGLCPFHDEKTPSFT

SEQ ID NO: 1808136 - protein, 17 aa, Staphylococcus epidermidis
KLELKKRKDIFIDALKT

SEQ ID NO: 1808137 - protein, 18 aa, Staphylococcus epidermidis
KLENEMSINLNSDLKEIL

SEQ ID NO: 1808138 - protein, 17 aa, Staphylococcus epidermidis
KLENLFNQFAIKNVEKN

SEQ ID NO: 1808139 - protein, 18 aa, Staphylococcus epidermidis
KLEQYKGDVMLIVNTASE

SEQ ID NO: 1808140 - protein, 25 aa, Staphylococcus epidermidis
KLETRDIAEAVVYTLTQPSHVNVNE

SEQ ID NO: 1808141 - protein, 18 aa, Staphylococcus epidermidis
KLEVDAVGFIHYPDSKRH

SEQ ID NO: 1808142 - protein, 18 aa, Staphylococcus epidermidis
KLEVLDTYQRRGYAKQLL

SEQ ID NO: 1808143 - protein, 25 aa, Staphylococcus epidermidis
KLEYKIGLDISCMFNDTAQFKSLAS

SEQ ID NO: 1808144 - protein, 19 aa, Staphylococcus epidermidis
KLFKGNAIVNGRQSPYTLY

SEQ ID NO: 1808145 - protein, 19 aa, Staphylococcus epidermidis
KLFKYDHKKALAFTPEDRE

SEQ ID NO: 1808146 - protein, 19 aa, Staphylococcus epidermidis
KLFPYDIPTIYTKTLRERS

SEQ ID NO: 1808147 - protein, 20 aa, Staphylococcus epidermidis
KLFSEARFNVDVLKVEVPVN

SEQ ID NO: 1808148 - protein, 21 aa, Staphylococcus epidermidis
KLGYLRYWVAEHHQVYSVVSS

SEQ ID NO: 1808149 - protein, 18 aa, Staphylococcus epidermidis
KLHFAIPQKTYDEWFQQF

SEQ ID NO: 1808150 - protein, 24 aa, Staphylococcus epidermidis
KLIEKGDMITLDFGAYYRGYCSDI

SEQ ID NO: 1808151 - protein, 18 aa, Staphylococcus epidermidis
KLIFEFMNITHFRFLIGE

SEQ ID NO: 1808152 - protein, 18 aa, Staphylococcus epidermidis
KLIGRTEANFELKEENST

SEQ ID NO: 1808153 - protein, 18 aa, Staphylococcus epidermidis
KLINGINVSESFKNMKEI

SEQ ID NO: 1808154 - protein, 23 aa, Staphylococcus epidermidis
KLIRAADVILYDRLVNPLILQYA

SEQ ID NO: 1808155 - protein, 22 aa, Staphylococcus epidermidis
KLIRKDYRTTSIFQNESEEIDL

SEQ ID NO: 1808156 - protein, 17 aa, Staphylococcus epidermidis
KLKAEKIKFDDLKKEQN

SEQ ID NO: 1808157 - protein, 18 aa, Staphylococcus epidermidis
KLKAEKIKFDDLKKEQNY

SEQ ID NO: 1808158 - protein, 19 aa, Staphylococcus epidermidis
KLKDYFIKQIRAYMKGDTP

SEQ ID NO: 1808159 - protein, 19 aa, Staphylococcus epidermidis
KLKFKERRDNLLAFYEQLK

SEQ ID NO: 1808160 - protein, 21 aa, Staphylococcus epidermidis
KLKHFRVGCPIQAGQLAGSYY

SEQ ID NO: 1808161 - protein, 24 aa, Staphylococcus epidermidis
KLKKDLAAFNVHFDNWFSETSLYE

SEQ ID NO: 1808162 - protein, 29 aa, Staphylococcus epidermidis
KLKMNGREVFKFAVRIMGDASTRVVDKAG

SEQ ID NO: 1808163 - protein, 24 aa, Staphylococcus epidermidis
KLKNSFKNASEFVRNNPFKKGNLV

SEQ ID NO: 1808164 - protein, 21 aa, Staphylococcus epidermidis
KLKPQEQSCCSVKIEEKTDKK

SEQ ID NO: 1808165 - protein, 19 aa, Staphylococcus epidermidis
KLKPSGWYKTIPPKKDGGT

SEQ ID NO: 1808166 - protein, 21 aa, Staphylococcus epidermidis
KLKQNEFVLFDLGVVYHHYCS

SEQ ID NO: 1808167 - protein, 26 aa, Staphylococcus epidermidis
KLKRRIKCPYCQSTLTNLTIKKENYS

SEQ ID NO: 1808168 - protein, 19 aa, Staphylococcus epidermidis
KLKSMGIVETALKKANGAP

SEQ ID NO: 1808169 - protein, 18 aa, Staphylococcus epidermidis
KLLEDVRIFDIIRNERPS

SEQ ID NO: 1808170 - protein, 18 aa, Staphylococcus epidermidis
KLLGINFLATEYTTGKNH

SEQ ID NO: 1808171 - protein, 29 aa, Staphylococcus epidermidis
KLLHLGAPFESFAGFKSYRLLRPLEGNTY

SEQ ID NO: 1808172 - protein, 19 aa, Staphylococcus epidermidis
KLLHSYGVRDMIMCDSKGA

SEQ ID NO: 1808173 - protein, 20 aa, Staphylococcus epidermidis
KLLPDLISFVKLNSNKIDLI

SEQ ID NO: 1808174 - protein, 17 aa, Staphylococcus epidermidis
KLLSFLAEYKNVFINSP

SEQ ID NO: 1808175 - protein, 18 aa, Staphylococcus epidermidis
KLLSTAGAYWRGDSNNKM

SEQ ID NO: 1808176 - protein, 19 aa, Staphylococcus epidermidis
KLLTEKYATWSSSYRNSLK

SEQ ID NO: 1808177 - protein, 19 aa, Staphylococcus epidermidis
KLNCTYFKEILKRSPFSIG

SEQ ID NO: 1808178 - protein, 19 aa, Staphylococcus epidermidis
KLNFEPVVPGFKFAEFNNF

SEQ ID NO: 1808179 - protein, 19 aa, Staphylococcus epidermidis
KLNLGRKAEHLFYENIVND

SEQ ID NO: 1808180 - protein, 20 aa, Staphylococcus epidermidis
KLNSKIRIIKAIPATRNLNN

SEQ ID NO: 1808181 - protein, 19 aa, Staphylococcus epidermidis
KLPDIKATMLEKAKNDEHS

SEQ ID NO: 1808182 - protein, 18 aa, Staphylococcus epidermidis
KLPESSDWIEYDLINGAI

SEQ ID NO: 1808183 - protein, 18 aa, Staphylococcus epidermidis
KLPHLKEAEILFFIDNID

SEQ ID NO: 1808184 - protein, 21 aa, Staphylococcus epidermidis
KLPHNIMSLMLEYLRFAEYDN

SEQ ID NO: 1808185 - protein, 19 aa, Staphylococcus epidermidis
KLPSAKYQVEFKAKKDGFI

SEQ ID NO: 1808186 - protein, 26 aa, Staphylococcus epidermidis
KLPWGDLDIDVVLECTGFYTDKDKAQ

SEQ ID NO: 1808187 - protein, 26 aa, Staphylococcus epidermidis
KLPWGDLDIDVVLECTGFYTDKEKAQ

SEQ ID NO: 1808188 - protein, 25 aa, Staphylococcus epidermidis
KLQAIYRRVYEFGVEEKRTLNWQDT

SEQ ID NO: 1808189 - protein, 24 aa, Staphylococcus epidermidis
KLQNYKRVVGVVSRDKDKMNKIID

SEQ ID NO: 1808190 - protein, 17 aa, Staphylococcus epidermidis
KLQYKDYSEWMVHRDLS

SEQ ID NO: 1808191 - protein, 18 aa, Staphylococcus epidermidis
KLREKLGIFDGDVEETES

SEQ ID NO: 1808192 - protein, 18 aa, Staphylococcus epidermidis
KLRKQKGLTLQQLSDELH

SEQ ID NO: 1808193 - protein, 21 aa, Staphylococcus epidermidis
KLSHLRPAFKKDGSVTAGNAS

SEQ ID NO: 1808194 - protein, 17 aa, Staphylococcus epidermidis
KLSKPFYLGFEKGLNAI

SEQ ID NO: 1808195 - protein, 25 aa, Staphylococcus epidermidis
KLSSEAWKNSFFTGLMERTPTTKDF

SEQ ID NO: 1808196 - protein, 17 aa, Staphylococcus epidermidis
KLSSIGVDHFIETKKNV

SEQ ID NO: 1808197 - protein, 26 aa, Staphylococcus epidermidis
KLTKESRKSIVLMLYGPSGVGKTEMS

SEQ ID NO: 1808198 - protein, 21 aa, Staphylococcus epidermidis
KLTNELKNFIEYLAKSKKYED

SEQ ID NO: 1808199 - protein, 17 aa, Staphylococcus epidermidis
KLTNHLGIEYEFISMSR

SEQ ID NO: 1808200 - protein, 17 aa, Staphylococcus epidermidis
KLTNHLGIEYEFISMTR

SEQ ID NO: 1808201 - protein, 24 aa, Staphylococcus epidermidis
KLTSQFYPTQFIKFEEATIETDHT

SEQ ID NO: 1808202 - protein, 17 aa, Staphylococcus epidermidis
KLVFSIKKGVNFNPTDP

SEQ ID NO: 1808203 - protein, 24 aa, Staphylococcus epidermidis
KLVNRSIRIIQDICDLSEQDAQNL

SEQ ID NO: 1808204 - protein, 17 aa, Staphylococcus epidermidis
KLWSEEKYHVLLHHQHA

SEQ ID NO: 1808205 - protein, 25 aa, Staphylococcus epidermidis
KLYECDDCSECPLKNQCMNFNSKTN

SEQ ID NO: 1808206 - protein, 26 aa, Staphylococcus epidermidis
KLYLKHGQCKVLLGVARGKKLHDKRQ

SEQ ID NO: 1808207 - protein, 25 aa, Staphylococcus epidermidis
KLYMIELLEPLPFLEKISKLTTVKS

SEQ ID NO: 1808208 - protein, 25 aa, Staphylococcus epidermidis
KLYNKKRYVAARVISQVSRFFTGIE

SEQ ID NO: 1808209 - protein, 17 aa, Staphylococcus epidermidis
KLYVAVQGVYIGDDNTI

SEQ ID NO: 1808210 - protein, 25 aa, Staphylococcus epidermidis
KMDKRFEVVDYNFGLAHKDLNRKFE

SEQ ID NO: 1808211 - protein, 18 aa, Staphylococcus epidermidis
KMEGKAHSFIDCITTLGK

SEQ ID NO: 1808212 - protein, 23 aa, Staphylococcus epidermidis
KMENRLRYQYGRPSKLLAKSFEL

SEQ ID NO: 1808213 - protein, 26 aa, Staphylococcus epidermidis
KMGMQTMKFDMCGAANVVGMIDSIAK

SEQ ID NO: 1808214 - protein, 19 aa, Staphylococcus epidermidis
KMICAYSGVNRSTFYDHFQ

SEQ ID NO: 1808215 - protein, 18 aa, Staphylococcus epidermidis
KMIISGLWTHFGYADEFD

SEQ ID NO: 1808216 - protein, 18 aa, Staphylococcus epidermidis
KMIPKLDSALSHYHDKIE

SEQ ID NO: 1808217 - protein, 25 aa, Staphylococcus epidermidis
KMLAKEILNDLGILKEGVFTHDIDP

SEQ ID NO: 1808218 - protein, 25 aa, Staphylococcus epidermidis
KMLAKEILNDLGILKEGVFTHEIDP

SEQ ID NO: 1808219 - protein, 19 aa, Staphylococcus epidermidis
KMLDHREFTLILYVNDIVG

SEQ ID NO: 1808220 - protein, 17 aa, Staphylococcus epidermidis
KMLELTIRYEDDEVIER

SEQ ID NO: 1808221 - protein, 27 aa, Staphylococcus epidermidis
KMLNSRLKVSIYFYFAPPKSWTKNQKL

SEQ ID NO: 1808222 - protein, 19 aa, Staphylococcus epidermidis
KMLYRLGAMGVTKGSEISI

SEQ ID NO: 1808223 - protein, 21 aa, Staphylococcus epidermidis
KMNEDRLGFTFNEQQKEAIRK

SEQ ID NO: 1808224 - protein, 22 aa, Staphylococcus epidermidis
KMSAEAKIMYALLKDRFELSIQ

SEQ ID NO: 1808225 - protein, 22 aa, Staphylococcus epidermidis
KMSDLKGTLDLLAKKLFGPERE

SEQ ID NO: 1808226 - protein, 33 aa, Staphylococcus epidermidis
KMSRSEGFGEEVKRRIFLGTFALSSGYYDAYYK

SEQ ID NO: 1808227 - protein, 20 aa, Staphylococcus epidermidis
KMTEFYSTVLGFTIKAQHAQ

SEQ ID NO: 1808228 - protein, 24 aa, Staphylococcus epidermidis
KMTFPHQMMRVILIEQIYRAFKIM

SEQ ID NO: 1808229 - protein, 18 aa, Staphylococcus epidermidis
KMVHDFPIYPIRQSHKVI

SEQ ID NO: 1808230 - protein, 27 aa, Staphylococcus epidermidis
KMVQMAKKYHCVIRLKGGDPAIFGRVT

SEQ ID NO: 1808231 - protein, 21 aa, Staphylococcus epidermidis
KNAAIAIAVGHELGLPYATIK

SEQ ID NO: 1808232 - protein, 17 aa, Staphylococcus epidermidis
KNAITLQLKQWLDEHEE

SEQ ID NO: 1808233 - protein, 17 aa, Staphylococcus epidermidis
KNAIVVVDEFNRIKETE

SEQ ID NO: 1808234 - protein, 21 aa, Staphylococcus epidermidis
KNARFKYTVDRLGEQWVKEEL

SEQ ID NO: 1808235 - protein, 19 aa, Staphylococcus epidermidis
KNARIAKQVSSWYAHYKDE

SEQ ID NO: 1808236 - protein, 24 aa, Staphylococcus epidermidis
KNDALSHLCIYILIITGSRFKPVQ

SEQ ID NO: 1808237 - protein, 29 aa, Staphylococcus epidermidis
KNDEAIILVSLPFNASWLNQRYSEIMQAI

SEQ ID NO: 1808238 - protein, 22 aa, Staphylococcus epidermidis
KNDFPVGFHFLHNDLVGIEEKD

SEQ ID NO: 1808239 - protein, 25 aa, Staphylococcus epidermidis
KNDIPIERFPVFIHPSSIISPSAKI

SEQ ID NO: 1808240 - protein, 19 aa, Staphylococcus epidermidis
KNDPSELFKDIGKQVYNQF

SEQ ID NO: 1808241 - protein, 24 aa, Staphylococcus epidermidis
KNDRPVTGKWSWLAPPLSPTLTSN

SEQ ID NO: 1808242 - protein, 17 aa, Staphylococcus epidermidis
KNDVVGIGVDFTSSTII

SEQ ID NO: 1808243 - protein, 18 aa, Staphylococcus epidermidis
KNDYKLTLENYVLIYYLE

SEQ ID NO: 1808244 - protein, 24 aa, Staphylococcus epidermidis
KNDYKLTLENYVLIYYLEKIIFQA

SEQ ID NO: 1808245 - protein, 17 aa, Staphylococcus epidermidis
KNEKVDFIWSHTLKTIN

SEQ ID NO: 1808246 - protein, 22 aa, Staphylococcus epidermidis
KNELKASLNHFFKEIKETVHTQ

SEQ ID NO: 1808247 - protein, 23 aa, Staphylococcus epidermidis
KNELKASLNHFFKEMKETVHTQD

SEQ ID NO: 1808248 - protein, 18 aa, Staphylococcus epidermidis
KNELSYLAIFILIVAGGR

SEQ ID NO: 1808249 - protein, 18 aa, Staphylococcus epidermidis
KNELYVDNNFVFTDVNGY

SEQ ID NO: 1808250 - protein, 22 aa, Staphylococcus epidermidis
KNETDRLISVEWVKSKDSTQRY

SEQ ID NO: 1808251 - protein, 19 aa, Staphylococcus epidermidis
KNEVEIIKNLSLTFSSNAI

SEQ ID NO: 1808252 - protein, 34 aa, Staphylococcus epidermidis
KNEVLRENYGYIVMKRDRLNTIIQQLKYHFDSDK

SEQ ID NO: 1808253 - protein, 22 aa, Staphylococcus epidermidis
KNFKYSMSVVLECHIYTLRQEY

SEQ ID NO: 1808254 - protein, 26 aa, Staphylococcus epidermidis
KNFLSEKLYNERELYVFESVWTEENH

SEQ ID NO: 1808255 - protein, 24 aa, Staphylococcus epidermidis
KNFRDIFNKIAWLNKGKMEEALKG

SEQ ID NO: 1808256 - protein, 25 aa, Staphylococcus epidermidis
KNFTPRLKTVDGYYITANINFVEVL

SEQ ID NO: 1808257 - protein, 23 aa, Staphylococcus epidermidis
KNGKGHAMDGFMSSDEQKIIRKV

SEQ ID NO: 1808258 - protein, 22 aa, Staphylococcus epidermidis
KNHGVYKLITLKSVNTEGKLCN

SEQ ID NO: 1808259 - protein, 18 aa, Staphylococcus epidermidis
KNHISPILMKTEIEYKVP

SEQ ID NO: 1808260 - protein, 17 aa, Staphylococcus epidermidis
KNHLKRMSDEQMRRDYL

SEQ ID NO: 1808261 - protein, 19 aa, Staphylococcus epidermidis
KNIIFTSKCIPNFRNFREI

SEQ ID NO: 1808262 - protein, 26 aa, Staphylococcus epidermidis
KNINLKLAEYGYIGGFDLGEVSDDFK

SEQ ID NO: 1808263 - protein, 23 aa, Staphylococcus epidermidis
KNIPGNGKFLYSPFSVFDNESII

SEQ ID NO: 1808264 - protein, 19 aa, Staphylococcus epidermidis
KNIYPIFKQLGLDTYIDVV

SEQ ID NO: 1808265 - protein, 22 aa, Staphylococcus epidermidis
KNKDGQVIMGFYRQRSHDIIDM

SEQ ID NO: 1808266 - protein, 17 aa, Staphylococcus epidermidis
KNKEFTRVKNGLEPTEV

SEQ ID NO: 1808267 - protein, 22 aa, Staphylococcus epidermidis
KNKGCMHACGHDGHTAILLGVA

SEQ ID NO: 1808268 - protein, 28 aa, Staphylococcus epidermidis
KNKKLIIDGTIHWRKEGNNLGFKDTTKT

SEQ ID NO: 1808269 - protein, 26 aa, Staphylococcus epidermidis
KNKLLGREFLSDKSIEEFAQDIDKIK

SEQ ID NO: 1808270 - protein, 17 aa, Staphylococcus epidermidis
KNKLWWAKMTYPQNKEI

SEQ ID NO: 1808271 - protein, 20 aa, Staphylococcus epidermidis
KNKRETAVLIGVHAQTDRQF

SEQ ID NO: 1808272 - protein, 25 aa, Staphylococcus epidermidis
KNKRIKLGVIPSFSLYKLHEKKYIN

SEQ ID NO: 1808273 - protein, 24 aa, Staphylococcus epidermidis
KNKVSFKGSFTFNNKLYNLNIKKQ

SEQ ID NO: 1808274 - protein, 23 aa, Staphylococcus epidermidis
KNLASFYVACELFKQIQQSPHTK

SEQ ID NO: 1808275 - protein, 18 aa, Staphylococcus epidermidis
KNLAYRAAKLMVETYNIK

SEQ ID NO: 1808276 - protein, 17 aa, Staphylococcus epidermidis
KNLEDFYDKEGYRDEEF

SEQ ID NO: 1808277 - protein, 17 aa, Staphylococcus epidermidis
KNLGHAFGYGSHGTTFG

SEQ ID NO: 1808278 - protein, 18 aa, Staphylococcus epidermidis
KNLHVGKLKTCTSGSKKF

SEQ ID NO: 1808279 - protein, 20 aa, Staphylococcus epidermidis
KNLLERKGKTQTDMAKDLDL

SEQ ID NO: 1808280 - protein, 25 aa, Staphylococcus epidermidis
KNLNRCVKKINNRYLKKQVNIKIQP

SEQ ID NO: 1808281 - protein, 23 aa, Staphylococcus epidermidis
KNLSERRKAEVLYEELAHHKLTY

SEQ ID NO: 1808282 - protein, 23 aa, Staphylococcus epidermidis
KNLTELHGAPGFENEVRDYMKKE

SEQ ID NO: 1808283 - protein, 18 aa, Staphylococcus epidermidis
KNLVSLMLEYLRFAEYSH

SEQ ID NO: 1808284 - protein, 18 aa, Staphylococcus epidermidis
KNMFLFCIKLGRKSIKSL

SEQ ID NO: 1808285 - protein, 19 aa, Staphylococcus epidermidis
KNMIENYGLIALKDDYIEV

SEQ ID NO: 1808286 - protein, 17 aa, Staphylococcus epidermidis
KNMYKWMDLGRKVDERL

SEQ ID NO: 1808287 - protein, 24 aa, Staphylococcus epidermidis
KNNEKFKGFVFDYENPLESDTGNY

SEQ ID NO: 1808288 - protein, 19 aa, Staphylococcus epidermidis
KNNFDSIGKLNVWYITTIE

SEQ ID NO: 1808289 - protein, 19 aa, Staphylococcus epidermidis
KNNFDSIGTLNIWYITTIE

SEQ ID NO: 1808290 - protein, 21 aa, Staphylococcus epidermidis
KNNGVEYVFGIPGAKIDYLFD

SEQ ID NO: 1808291 - protein, 20 aa, Staphylococcus epidermidis
KNNLNGIARLDEARPKALDY

SEQ ID NO: 1808292 - protein, 35 aa, Staphylococcus epidermidis
KNNWLGIKTGTDWVGRNVLDPAFDRVKHIYSIEKG

SEQ ID NO: 1808293 - protein, 22 aa, Staphylococcus epidermidis
KNQGAWLFVYPYLKALVADRYD

SEQ ID NO: 1808294 - protein, 18 aa, Staphylococcus epidermidis
KNREGRRIAVIVNDMSEV

SEQ ID NO: 1808295 - protein, 23 aa, Staphylococcus epidermidis
KNRFDLKCYLTLLDVLDSHNIDR

SEQ ID NO: 1808296 - protein, 22 aa, Staphylococcus epidermidis
KNRIDLYFKYNLKNYHSLTIKD

SEQ ID NO: 1808297 - protein, 17 aa, Staphylococcus epidermidis
KNRLDIPKTYQMNDITK

SEQ ID NO: 1808298 - protein, 17 aa, Staphylococcus epidermidis
KNRTATISIHGASGSEE

SEQ ID NO: 1808299 - protein, 17 aa, Staphylococcus epidermidis
KNRVLMAPMTIQSGYFD

SEQ ID NO: 1808300 - protein, 19 aa, Staphylococcus epidermidis
KNTGTYMFHCHILEHEENG

SEQ ID NO: 1808301 - protein, 23 aa, Staphylococcus epidermidis
KNTLNPFNFIKDKQEAIDARGSM

SEQ ID NO: 1808302 - protein, 18 aa, Staphylococcus epidermidis
KNTLPCQFCSYQSVCHVD

SEQ ID NO: 1808303 - protein, 21 aa, Staphylococcus epidermidis
KNTLVELSRFLNVHLVKQQKL

SEQ ID NO: 1808304 - protein, 17 aa, Staphylococcus epidermidis
KNTLYRMRWNPKNPGYM

SEQ ID NO: 1808305 - protein, 24 aa, Staphylococcus epidermidis
KNTYPRLRITGAPFEAVGLPDCIQ

SEQ ID NO: 1808306 - protein, 22 aa, Staphylococcus epidermidis
KNVKRLIFVAAPGIYDELPESF

SEQ ID NO: 1808307 - protein, 23 aa, Staphylococcus epidermidis
KNVLKGDLLVSGKSTAYFNIGGL

SEQ ID NO: 1808308 - protein, 32 aa, Staphylococcus epidermidis
KNVTEAIKFLKEVPHRSSFSYILMDRHSNYAI

SEQ ID NO: 1808309 - protein, 22 aa, Staphylococcus epidermidis
KNWKSPKLVMKVFLFVLRSKLN

SEQ ID NO: 1808310 - protein, 26 aa, Staphylococcus epidermidis
KNWLHYWRDECGYTIKPVSETNDVRI

SEQ ID NO: 1808311 - protein, 19 aa, Staphylococcus epidermidis
KPAIHHTMGGLKINTQAQV

SEQ ID NO: 1808312 - protein, 26 aa, Staphylococcus epidermidis
KPCPEIEIRIDFSYSNLFNYLVNFIA

SEQ ID NO: 1808313 - protein, 19 aa, Staphylococcus epidermidis
KPDKKGYRKYKIKTVEGPD

SEQ ID NO: 1808314 - protein, 26 aa, Staphylococcus epidermidis
KPDLAIAVDVGVAFDVPGMTNEKNEG

SEQ ID NO: 1808315 - protein, 26 aa, Staphylococcus epidermidis
KPEFSGKGYAKFAFEKAINYAFDILN

SEQ ID NO: 1808316 - protein, 17 aa, Staphylococcus epidermidis
KPETIIMSKSLDILGLE

SEQ ID NO: 1808317 - protein, 29 aa, Staphylococcus epidermidis
KPFDPMELYYRVALHLNNDKTSYCYKNLK

SEQ ID NO: 1808318 - protein, 19 aa, Staphylococcus epidermidis
KPFSPRELVLRTNNLLTRI

SEQ ID NO: 1808319 - protein, 20 aa, Staphylococcus epidermidis
KPFSPREVVARVKAILRRSK

SEQ ID NO: 1808320 - protein, 20 aa, Staphylococcus epidermidis
KPGKGSAFVRSKLRNLRTGA

SEQ ID NO: 1808321 - protein, 19 aa, Staphylococcus epidermidis
KPGPLLPNYNDYIVFEGIS

SEQ ID NO: 1808322 - protein, 21 aa, Staphylococcus epidermidis
KPGSIPREDVATVLKEVVTSD

SEQ ID NO: 1808323 - protein, 22 aa, Staphylococcus epidermidis
KPGTDLAWLSAVTKYIIDNNLH

SEQ ID NO: 1808324 - protein, 25 aa, Staphylococcus epidermidis
KPGTDLVWLGAVTKYIIDNDLHDKA

SEQ ID NO: 1808325 - protein, 18 aa, Staphylococcus epidermidis
KPGVGYPKRWEDQSHYKG

SEQ ID NO: 1808326 - protein, 18 aa, Staphylococcus epidermidis
KPHVIFIDYLTLMQSDVP

SEQ ID NO: 1808327 - protein, 21 aa, Staphylococcus epidermidis
KPIEDLRIISCHIGNGASIAA

SEQ ID NO: 1808328 - protein, 19 aa, Staphylococcus epidermidis
KPIGTLRDGQLELVHNSRT

SEQ ID NO: 1808329 - protein, 18 aa, Staphylococcus epidermidis
KPIQRLWISSVTKKAIQE

SEQ ID NO: 1808330 - protein, 29 aa, Staphylococcus epidermidis
KPKDFLVHRLVAFAFIPAVKGKECINHID

SEQ ID NO: 1808331 - protein, 18 aa, Staphylococcus epidermidis
KPKDLKKVEDLFIVTATH

SEQ ID NO: 1808332 - protein, 19 aa, Staphylococcus epidermidis
KPKIEICYLNAGNTLIDFE

SEQ ID NO: 1808333 - protein, 20 aa, Staphylococcus epidermidis
KPKLIQRVKENFGSIQNIEL

SEQ ID NO: 1808334 - protein, 17 aa, Staphylococcus epidermidis
KPKPLSLYLFSEDENAS

SEQ ID NO: 1808335 - protein, 23 aa, Staphylococcus epidermidis
KPLKLQAKEGLALINGTQAMTAQ

SEQ ID NO: 1808336 - protein, 19 aa, Staphylococcus epidermidis
KPLRRAILWNDTRNSEQCR

SEQ ID NO: 1808337 - protein, 19 aa, Staphylococcus epidermidis
KPLRREFLSSTAFDEKTLF

SEQ ID NO: 1808338 - protein, 24 aa, Staphylococcus epidermidis
KPLSRQGIWKMIKQNGIKANINKT

SEQ ID NO: 1808339 - protein, 17 aa, Staphylococcus epidermidis
KPMKGTMPRGKNVKEDE

SEQ ID NO: 1808340 - protein, 27 aa, Staphylococcus epidermidis
KPMLVAGDIYRPAAIDQLQTVGKQIDI

SEQ ID NO: 1808341 - protein, 19 aa, Staphylococcus epidermidis
KPNFTIVSAPNFKANPELD

SEQ ID NO: 1808342 - protein, 23 aa, Staphylococcus epidermidis
KPNIPSYRKSSMPDGVHPNEKGH

SEQ ID NO: 1808343 - protein, 24 aa, Staphylococcus epidermidis
KPNIPSYRKSSMPDGVHPNEKGHE

SEQ ID NO: 1808344 - protein, 19 aa, Staphylococcus epidermidis
KPNSRYMVFYNDDLTLYTK

SEQ ID NO: 1808345 - protein, 19 aa, Staphylococcus epidermidis
KPNVKRLRIIADDMNITVS

SEQ ID NO: 1808346 - protein, 17 aa, Staphylococcus epidermidis
KPPHALSPEERKKPVDI

SEQ ID NO: 1808347 - protein, 18 aa, Staphylococcus epidermidis
KPPHALSPEERKKPVDIK

SEQ ID NO: 1808348 - protein, 19 aa, Staphylococcus epidermidis
KPPIHEWADKGLLTIVDEP

SEQ ID NO: 1808349 - protein, 18 aa, Staphylococcus epidermidis
KPPVARIMDYGKYKFEQQ

SEQ ID NO: 1808350 - protein, 22 aa, Staphylococcus epidermidis
KPPYKFEIEMLKAQKFDSDLKN

SEQ ID NO: 1808351 - protein, 27 aa, Staphylococcus epidermidis
KPRGLFRKKKFSPIVGDIVDFEVQNQQ

SEQ ID NO: 1808352 - protein, 19 aa, Staphylococcus epidermidis
KPRMYRLVEDNALINRMGF

SEQ ID NO: 1808353 - protein, 25 aa, Staphylococcus epidermidis
KPSIYPKFILGFGGIKQDELEDHVN

SEQ ID NO: 1808354 - protein, 19 aa, Staphylococcus epidermidis
KPSLPTFCNTRFAIDMTDI

SEQ ID NO: 1808355 - protein, 25 aa, Staphylococcus epidermidis
KPTEWSLSRLDVFSTEQLAAKIALN

SEQ ID NO: 1808356 - protein, 21 aa, Staphylococcus epidermidis
KPVEIKHMYIDIGVASKEEAE

SEQ ID NO: 1808357 - protein, 20 aa, Staphylococcus epidermidis
KPVGCTRVSVWSEEPYYRGT

SEQ ID NO: 1808358 - protein, 21 aa, Staphylococcus epidermidis
KPVMESLILISMRQRMTNDPK

SEQ ID NO: 1808359 - protein, 18 aa, Staphylococcus epidermidis
KPVYGAKSFLKYADKKGI

SEQ ID NO: 1808360 - protein, 21 aa, Staphylococcus epidermidis
KPYDIKKGMHFILTSEDQTIT

SEQ ID NO: 1808361 - protein, 18 aa, Staphylococcus epidermidis
KPYVIVCLNTIVSDSDEQ

SEQ ID NO: 1808362 - protein, 19 aa, Staphylococcus epidermidis
KPYVIVCLNTIVSDSDEQA

SEQ ID NO: 1808363 - protein, 20 aa, Staphylococcus epidermidis
KQALVAYFIRQLRLDSDDII

SEQ ID NO: 1808364 - protein, 20 aa, Staphylococcus epidermidis
KQALVAYFIRQLRLNSEDII

SEQ ID NO: 1808365 - protein, 17 aa, Staphylococcus epidermidis
KQAYDIILCPNVLHNSK

SEQ ID NO: 1808366 - protein, 18 aa, Staphylococcus epidermidis
KQCLSRFDTIVLTGGLGP

SEQ ID NO: 1808367 - protein, 24 aa, Staphylococcus epidermidis
KQDAVRYQIAFYMKRYETDPESVH

SEQ ID NO: 1808368 - protein, 26 aa, Staphylococcus epidermidis
KQDDLKPRYALNVLVEMANQSDLDLD

SEQ ID NO: 1808369 - protein, 19 aa, Staphylococcus epidermidis
KQEGIIRAYGISSIRPNVI

SEQ ID NO: 1808370 - protein, 24 aa, Staphylococcus epidermidis
KQELDVFLMHKCEQLSLNDVAGLL

SEQ ID NO: 1808371 - protein, 18 aa, Staphylococcus epidermidis
KQFIYPLIHIPKIGSLIW

SEQ ID NO: 1808372 - protein, 24 aa, Staphylococcus epidermidis
KQFKSKRMLLYAGLIPILRDHIAP

SEQ ID NO: 1808373 - protein, 25 aa, Staphylococcus epidermidis
KQFLDKCVEAGVFGLIIPDLPFELI

SEQ ID NO: 1808374 - protein, 26 aa, Staphylococcus epidermidis
KQFLNHCATKFGIPIQLLTGDIAEVE

SEQ ID NO: 1808375 - protein, 18 aa, Staphylococcus epidermidis
KQGIPINIRGQIDRIDTY

SEQ ID NO: 1808376 - protein, 26 aa, Staphylococcus epidermidis
KQGITKFRIVPLLIFSAMHYVSDIPQ

SEQ ID NO: 1808377 - protein, 21 aa, Staphylococcus epidermidis
KQHALNIYGFDECANKMTMLG

SEQ ID NO: 1808378 - protein, 24 aa, Staphylococcus epidermidis
KQHEVKLVFFLAMSKKDLNINRKI

SEQ ID NO: 1808379 - protein, 24 aa, Staphylococcus epidermidis
KQHGLYFKGGETVQSLSGDNDGYV

SEQ ID NO: 1808380 - protein, 23 aa, Staphylococcus epidermidis
KQIIMPISPFICIEFQDISINSS

SEQ ID NO: 1808381 - protein, 24 aa, Staphylococcus epidermidis
KQILEIGTAIGYSSMQFASVASDI

SEQ ID NO: 1808382 - protein, 24 aa, Staphylococcus epidermidis
KQILELVPFLISLVKGMTVIIDEI

SEQ ID NO: 1808383 - protein, 18 aa, Staphylococcus epidermidis
KQIRLNINLENWNKDKLY

SEQ ID NO: 1808384 - protein, 19 aa, Staphylococcus epidermidis
KQISFRVSEDEYLKLQQSA

SEQ ID NO: 1808385 - protein, 23 aa, Staphylococcus epidermidis
KQITEIKDALVLLDNQLIAFYIL

SEQ ID NO: 1808386 - protein, 32 aa, Staphylococcus epidermidis
KQKFEFTTEGAWQKRRAEFIRYEEKIEEAKVN

SEQ ID NO: 1808387 - protein, 19 aa, Staphylococcus epidermidis
KQKKCKVCGHSIETKVIAG

SEQ ID NO: 1808388 - protein, 20 aa, Staphylococcus epidermidis
KQKYNYFVMKWVNKEYKKIF

SEQ ID NO: 1808389 - protein, 18 aa, Staphylococcus epidermidis
KQLALKLKSLCQTYQVPF

SEQ ID NO: 1808390 - protein, 22 aa, Staphylococcus epidermidis
KQLEIFEGKSIMFTASHNVYEH

SEQ ID NO: 1808391 - protein, 19 aa, Staphylococcus epidermidis
KQLGGRVFDCVQKDAVYPY

SEQ ID NO: 1808392 - protein, 19 aa, Staphylococcus epidermidis
KQLIAFGLLEEIRLGKNKP

SEQ ID NO: 1808393 - protein, 23 aa, Staphylococcus epidermidis
KQLLEDGWHVRAFTRNKNNEKLT

SEQ ID NO: 1808394 - protein, 23 aa, Staphylococcus epidermidis
KQLLHALQLWLMRINYLNQPKSY

SEQ ID NO: 1808395 - protein, 17 aa, Staphylococcus epidermidis
KQLLYLNDRFKQIEQSL

SEQ ID NO: 1808396 - protein, 26 aa, Staphylococcus epidermidis
KQLYPQCFNTAYKILKMIQRQFDVII

SEQ ID NO: 1808397 - protein, 19 aa, Staphylococcus epidermidis
KQNLRGEQKLADDKANAER

SEQ ID NO: 1808398 - protein, 17 aa, Staphylococcus epidermidis
KQNYGISLREFYVLYEL

SEQ ID NO: 1808399 - protein, 17 aa, Staphylococcus epidermidis
KQQCLLNGPSIVEINGQ

SEQ ID NO: 1808400 - protein, 24 aa, Staphylococcus epidermidis
KQQEDYCIILGYFIDGEPKLSYIY

SEQ ID NO: 1808401 - protein, 24 aa, Staphylococcus epidermidis
KQQEDYCIILGYFVDGAPQLSYIY

SEQ ID NO: 1808402 - protein, 18 aa, Staphylococcus epidermidis
KQQFDTALQQARNTLAKA

SEQ ID NO: 1808403 - protein, 23 aa, Staphylococcus epidermidis
KQQLPYLISFLSFHNYAIYQILL

SEQ ID NO: 1808404 - protein, 18 aa, Staphylococcus epidermidis
KQRCNRQPQLIIGTPTRI

SEQ ID NO: 1808405 - protein, 20 aa, Staphylococcus epidermidis
KQRHKTCIIVTHDERLTQFC

SEQ ID NO: 1808406 - protein, 19 aa, Staphylococcus epidermidis
KQRIETLSGGQFQRVWIAK

SEQ ID NO: 1808407 - protein, 19 aa, Staphylococcus epidermidis
KQRQSILEILAQVEVNIDY

SEQ ID NO: 1808408 - protein, 35 aa, Staphylococcus epidermidis
KQSFLEYLLFHYRFKSRITVWVLNYLKANHDKLNL

SEQ ID NO: 1808409 - protein, 25 aa, Staphylococcus epidermidis
KQSLGYDQDTKWLSVLPIYHISGLS

SEQ ID NO: 1808410 - protein, 25 aa, Staphylococcus epidermidis
KQSLLRARRTYAFTELFMFELRMQW

SEQ ID NO: 1808411 - protein, 26 aa, Staphylococcus epidermidis
KQTKGMVKREVVRIVTPGTVMEQGGV

SEQ ID NO: 1808412 - protein, 24 aa, Staphylococcus epidermidis
KQTLKRLFFEAGLNDIKVRSFTGG

SEQ ID NO: 1808413 - protein, 17 aa, Staphylococcus epidermidis
KQVKPEIKIGVCGELGG

SEQ ID NO: 1808414 - protein, 21 aa, Staphylococcus epidermidis
KQVQILKDFYEIWTKKESYTK

SEQ ID NO: 1808415 - protein, 18 aa, Staphylococcus epidermidis
KQWIADKILIPTPFTLES

SEQ ID NO: 1808416 - protein, 22 aa, Staphylococcus epidermidis
KQYAELLVRVGMNVQPHQPVFI

SEQ ID NO: 1808417 - protein, 23 aa, Staphylococcus epidermidis
KQYDIPSGEWLYIKLKTGKFNDA

SEQ ID NO: 1808418 - protein, 36 aa, Staphylococcus epidermidis
KQYFRMLQRPILYTGLTRAKQSLVLLGDPQAFEIGL

SEQ ID NO: 1808419 - protein, 17 aa, Staphylococcus epidermidis
KQYITRLFQLSNNETWE

SEQ ID NO: 1808420 - protein, 24 aa, Staphylococcus epidermidis
KQYKMTTACLLFFGKYNAISDRFP

SEQ ID NO: 1808421 - protein, 23 aa, Staphylococcus epidermidis
KQYVYRKMNLLKEITDGEISSVL

SEQ ID NO: 1808422 - protein, 22 aa, Staphylococcus epidermidis
KRAGEGIVEVKQRLNGESEDVH

SEQ ID NO: 1808423 - protein, 21 aa, Staphylococcus epidermidis
KRAKEVVSMISQQIKAHNKIG

SEQ ID NO: 1808424 - protein, 21 aa, Staphylococcus epidermidis
KRAQRGITLLKELKKKPHRIV

SEQ ID NO: 1808425 - protein, 23 aa, Staphylococcus epidermidis
KRAVLKDEIKAVKNLPQYILDKT

SEQ ID NO: 1808426 - protein, 17 aa, Staphylococcus epidermidis
KRDELERQLNLLLNTKV

SEQ ID NO: 1808427 - protein, 18 aa, Staphylococcus epidermidis
KRDENTRVILMCPQGRPF

SEQ ID NO: 1808428 - protein, 24 aa, Staphylococcus epidermidis
KRDGLKGGGYYVEYRTDDARLTIE

SEQ ID NO: 1808429 - protein, 19 aa, Staphylococcus epidermidis
KRDIGVILRQLCERKGVEI

SEQ ID NO: 1808430 - protein, 19 aa, Staphylococcus epidermidis
KREDYSFTERLIKEAFAHE

SEQ ID NO: 1808431 - protein, 18 aa, Staphylococcus epidermidis
KREGQGCVSLKSIAEENK

SEQ ID NO: 1808432 - protein, 31 aa, Staphylococcus epidermidis
KREKPGLFGSPIKWNFTKFIIDRNGKVVGKY

SEQ ID NO: 1808433 - protein, 18 aa, Staphylococcus epidermidis
KRESLSYDIDGIVIKVND

SEQ ID NO: 1808434 - protein, 17 aa, Staphylococcus epidermidis
KRFEPRMFIGAISNLKN

SEQ ID NO: 1808435 - protein, 19 aa, Staphylococcus epidermidis
KRFEPRMFIGAISNLKNEL

SEQ ID NO: 1808436 - protein, 21 aa, Staphylococcus epidermidis
KRGMAEMQKGGVIMDVVNAEQ

SEQ ID NO: 1808437 - protein, 18 aa, Staphylococcus epidermidis
KRGRFRSAYQDETFRMRL

SEQ ID NO: 1808438 - protein, 17 aa, Staphylococcus epidermidis
KRHAPPVVDGRITKGDT

SEQ ID NO: 1808439 - protein, 18 aa, Staphylococcus epidermidis
KRHAPPVVDGRMTKGDTL

SEQ ID NO: 1808440 - protein, 17 aa, Staphylococcus epidermidis
KRHFLKVAKTYSVHLLY

SEQ ID NO: 1808441 - protein, 21 aa, Staphylococcus epidermidis
KRIDDELSEIIGISHKLNQTM

SEQ ID NO: 1808442 - protein, 17 aa, Staphylococcus epidermidis
KRIEAIEYSVKYDDGKH

SEQ ID NO: 1808443 - protein, 17 aa, Staphylococcus epidermidis
KRIIYHRVVEMLEEGQA

SEQ ID NO: 1808444 - protein, 23 aa, Staphylococcus epidermidis
KRIIYHRVVEMLKEGTAISKIAK

SEQ ID NO: 1808445 - protein, 20 aa, Staphylococcus epidermidis
KRIKDNLIIYEDIRSTSGPK

SEQ ID NO: 1808446 - protein, 26 aa, Staphylococcus epidermidis
KRISKTGFGPFAFDEWRYLPDGSDNP

SEQ ID NO: 1808447 - protein, 21 aa, Staphylococcus epidermidis
KRISVLEAMLPSAIKAKYSKA

SEQ ID NO: 1808448 - protein, 19 aa, Staphylococcus epidermidis
KRKGIPELTVKVSSSLDGK

SEQ ID NO: 1808449 - protein, 18 aa, Staphylococcus epidermidis
KRKIEFLAGRFAVKEAFS

SEQ ID NO: 1808450 - protein, 18 aa, Staphylococcus epidermidis
KRKIIGNEFVYVFDDEAA

SEQ ID NO: 1808451 - protein, 18 aa, Staphylococcus epidermidis
KRKMVFEGVVPNIDRRYH

SEQ ID NO: 1808452 - protein, 19 aa, Staphylococcus epidermidis
KRLGINATIRREQGSDIDA

SEQ ID NO: 1808453 - protein, 17 aa, Staphylococcus epidermidis
KRLGYMRMLGYKDIDQC

SEQ ID NO: 1808454 - protein, 17 aa, Staphylococcus epidermidis
KRLKLQEEYIKALENKY

SEQ ID NO: 1808455 - protein, 25 aa, Staphylococcus epidermidis
KRLKQPLKRRVPGIELLEECLKIAH

SEQ ID NO: 1808456 - protein, 20 aa, Staphylococcus epidermidis
KRLNQKKAFQVEFGQKGTNL

SEQ ID NO: 1808457 - protein, 21 aa, Staphylococcus epidermidis
KRLREEFSVYLMSNGRISVAS

SEQ ID NO: 1808458 - protein, 20 aa, Staphylococcus epidermidis
KRLRHLHQLSYIFITHDIQA

SEQ ID NO: 1808459 - protein, 18 aa, Staphylococcus epidermidis
KRLSMDFDKKRMLLPREF

SEQ ID NO: 1808460 - protein, 18 aa, Staphylococcus epidermidis
KRLTEISEQLGIEDLLEK

SEQ ID NO: 1808461 - protein, 20 aa, Staphylococcus epidermidis
KRLVGAEIYGNDAGDLVNLL

SEQ ID NO: 1808462 - protein, 22 aa, Staphylococcus epidermidis
KRLYSDNAVDSFIYIPEEGYSH

SEQ ID NO: 1808463 - protein, 18 aa, Staphylococcus epidermidis
KRLYYLRISTLPLSLGNE

SEQ ID NO: 1808464 - protein, 36 aa, Staphylococcus epidermidis
KRMAELNEVNPMLGHRGCRLAVTYPELYEMQVEAII

SEQ ID NO: 1808465 - protein, 19 aa, Staphylococcus epidermidis
KRNIIRNLCLSIITFDKHG

SEQ ID NO: 1808466 - protein, 20 aa, Staphylococcus epidermidis
KRNMVKQLYSPVQFIQSTEW

SEQ ID NO: 1808467 - protein, 21 aa, Staphylococcus epidermidis
KRNPYAFERIAQMLIESSVDI

SEQ ID NO: 1808468 - protein, 21 aa, Staphylococcus epidermidis
KRNPYAFERIGQMLIESSVDI

SEQ ID NO: 1808469 - protein, 19 aa, Staphylococcus epidermidis
KRPGKELENLVPDHLSGLL

SEQ ID NO: 1808470 - protein, 20 aa, Staphylococcus epidermidis
KRPGKELENLVPDHLSGLLF

SEQ ID NO: 1808471 - protein, 20 aa, Staphylococcus epidermidis
KRSELDKCLEYLREEDTLVV

SEQ ID NO: 1808472 - protein, 20 aa, Staphylococcus epidermidis
KRSELDKCLEYLREGDTLVV

SEQ ID NO: 1808473 - protein, 24 aa, Staphylococcus epidermidis
KRSKALLPEKGMGRLPGIDGKAKM

SEQ ID NO: 1808474 - protein, 20 aa, Staphylococcus epidermidis
KRSLQWGNDAYTMILDRLNI

SEQ ID NO: 1808475 - protein, 20 aa, Staphylococcus epidermidis
KRSNSGTCYNQRPIVSVGDV

SEQ ID NO: 1808476 - protein, 26 aa, Staphylococcus epidermidis
KRSSYLIDLLENFVLERGIYGKRWLD

SEQ ID NO: 1808477 - protein, 17 aa, Staphylococcus epidermidis
KRTKRIMSWIENQTGAF

SEQ ID NO: 1808478 - protein, 20 aa, Staphylococcus epidermidis
KRVIDNKVAEWKGTNMEKYL

SEQ ID NO: 1808479 - protein, 18 aa, Staphylococcus epidermidis
KRVLNINKLIPIFIDNDT

SEQ ID NO: 1808480 - protein, 17 aa, Staphylococcus epidermidis
KRVLPLAVSGPFHSSMM

SEQ ID NO: 1808481 - protein, 18 aa, Staphylococcus epidermidis
KRVLPLAVSGPFHSSMMS

SEQ ID NO: 1808482 - protein, 17 aa, Staphylococcus epidermidis
KRYGNNIAVDNVSFNIK

SEQ ID NO: 1808483 - protein, 20 aa, Staphylococcus epidermidis
KSAETLLDMDAKSFTMGDYV

SEQ ID NO: 1808484 - protein, 26 aa, Staphylococcus epidermidis
KSAGIEFVSLSVLDYKYFEEITNVEK

SEQ ID NO: 1808485 - protein, 18 aa, Staphylococcus epidermidis
KSAYQILEKLDIIVANPK

SEQ ID NO: 1808486 - protein, 17 aa, Staphylococcus epidermidis
KSCEVPKALEHVGFGAI

SEQ ID NO: 1808487 - protein, 25 aa, Staphylococcus epidermidis
KSDALRRYHNCLKWEDLRTNDIRLN

SEQ ID NO: 1808488 - protein, 22 aa, Staphylococcus epidermidis
KSDDFKVGGLFNKKKKKEEEQE

SEQ ID NO: 1808489 - protein, 18 aa, Staphylococcus epidermidis
KSDILKQTKLQRVEDLYR

SEQ ID NO: 1808490 - protein, 19 aa, Staphylococcus epidermidis
KSDYGWFPTRPFENMEEYE

SEQ ID NO: 1808491 - protein, 18 aa, Staphylococcus epidermidis
KSEEGRVSFATKIVQDNF

SEQ ID NO: 1808492 - protein, 17 aa, Staphylococcus epidermidis
KSEELINIIKLAIDQHI

SEQ ID NO: 1808493 - protein, 19 aa, Staphylococcus epidermidis
KSEGVSIVDHLTASKQFEM

SEQ ID NO: 1808494 - protein, 20 aa, Staphylococcus epidermidis
KSELVQVIGSMIVLYRESEE

SEQ ID NO: 1808495 - protein, 24 aa, Staphylococcus epidermidis
KSEYKYQASSYFYLVKENPKIIYK

SEQ ID NO: 1808496 - protein, 19 aa, Staphylococcus epidermidis
KSFEKVFGYTIPHIYKECR

SEQ ID NO: 1808497 - protein, 24 aa, Staphylococcus epidermidis
KSFRENYGTLGLAFIKQYESKKDV

SEQ ID NO: 1808498 - protein, 24 aa, Staphylococcus epidermidis
KSFYQKEAFLLLSMDMSGIQDFIY

SEQ ID NO: 1808499 - protein, 17 aa, Staphylococcus epidermidis
KSGCGYVPIDTSVPKER

SEQ ID NO: 1808500 - protein, 23 aa, Staphylococcus epidermidis
KSGEFPEWIKLDIVTSTEKILFK

SEQ ID NO: 1808501 - protein, 21 aa, Staphylococcus epidermidis
KSGEVTQELQKGYKLKDRVLR

SEQ ID NO: 1808502 - protein, 30 aa, Staphylococcus epidermidis; identical to SEQ ID NO: 1657983

SEQ ID NO: 1808503 - protein, 19 aa, Staphylococcus epidermidis
KSGRVPSNILNKLNPKLIV

SEQ ID NO: 1808504 - protein, 24 aa, Staphylococcus epidermidis
KSGTAISPRPAFILKSSKHKDLAK

SEQ ID NO: 1808505 - protein, 17 aa, Staphylococcus epidermidis
KSIEFGNGIILQNPPKS

SEQ ID NO: 1808506 - protein, 21 aa, Staphylococcus epidermidis
KSIKIARKELKNWTKTKQVDT

SEQ ID NO: 1808507 - protein, 19 aa, Staphylococcus epidermidis
KSIKNVVKPLLKYAYDRGI

SEQ ID NO: 1808508 - protein, 20 aa, Staphylococcus epidermidis
KSISYGLGYQIQHIVDLIEK

SEQ ID NO: 1808509 - protein, 27 aa, Staphylococcus epidermidis
KSITNRPVFQEALNFVRMGDRFVVESI

SEQ ID NO: 1808510 - protein, 19 aa, Staphylococcus epidermidis
KSKAMELLEKVGLVHVKDQ

SEQ ID NO: 1808511 - protein, 19 aa, Staphylococcus epidermidis
KSKFWLQLQADIFNMEVKK

SEQ ID NO: 1808512 - protein, 25 aa, Staphylococcus epidermidis
KSKLKQWLYSMLHTGNLNNQVKQTT

SEQ ID NO: 1808513 - protein, 31 aa, Staphylococcus epidermidis
KSKRLMVMKQSFKKVVIKNCENMQDVADELS

SEQ ID NO: 1808514 - protein, 23 aa, Staphylococcus epidermidis
KSKRPGLDKAIEFARSGDTIVVW

SEQ ID NO: 1808515 - protein, 19 aa, Staphylococcus epidermidis
KSKYSPNKIYGYYSNNDSI

SEQ ID NO: 1808516 - protein, 17 aa, Staphylococcus epidermidis
KSLASYINFYIKQLERQ

SEQ ID NO: 1808517 - protein, 19 aa, Staphylococcus epidermidis
KSLEGVSIFGDAFSEPTEQ

SEQ ID NO: 1808518 - protein, 18 aa, Staphylococcus epidermidis
KSLGNFILVHDIIKEIDP

SEQ ID NO: 1808519 - protein, 23 aa, Staphylococcus epidermidis
KSLKDLFYRYFLKLRQKVKTVTI

SEQ ID NO: 1808520 - protein, 17 aa, Staphylococcus epidermidis
KSLKTMLLLHGLSSDTS

SEQ ID NO: 1808521 - protein, 26 aa, Staphylococcus epidermidis
KSLLGGTCLHKGCIPTKSLLKSAEVH

SEQ ID NO: 1808522 - protein, 25 aa, Staphylococcus epidermidis
KSLNTESIIAYAIYLSRYEYSIYKN

SEQ ID NO: 1808523 - protein, 22 aa, Staphylococcus epidermidis
KSLNTLTIFRVFIIDSQALTRS

SEQ ID NO: 1808524 - protein, 25 aa, Staphylococcus epidermidis
KSMKKSVSKRMLKETLNLYMKFAKK

SEQ ID NO: 1808525 - protein, 25 aa, Staphylococcus epidermidis
KSMKRHKQTFLLGGGHDIAYAQYLA

SEQ ID NO: 1808526 - protein, 18 aa, Staphylococcus epidermidis
KSMLKFLNDYAEEIVERS

SEQ ID NO: 1808527 - protein, 17 aa, Staphylococcus epidermidis
KSMTHRAIMLASLATGQ

SEQ ID NO: 1808528 - protein, 25 aa, Staphylococcus epidermidis
KSNLLNRHKMGILFQKTEFPKYIKV

SEQ ID NO: 1808529 - protein, 22 aa, Staphylococcus epidermidis
KSNYLPSYRYAQIYYEDNDLAI

SEQ ID NO: 1808530 - protein, 24 aa, Staphylococcus epidermidis
KSPLLIGVGEGFNVIASDALAMLQ

SEQ ID NO: 1808531 - protein, 26 aa, Staphylococcus epidermidis
KSPNEIARLITLEWLDHKQTFKPKQV

SEQ ID NO: 1808532 - protein, 23 aa, Staphylococcus epidermidis
KSQLKALYLAVIDRIDIRKDSNH

SEQ ID NO: 1808533 - protein, 24 aa, Staphylococcus epidermidis
KSRFKNCNFNEGIFKNIEAICNCK

SEQ ID NO: 1808534 - protein, 20 aa, Staphylococcus epidermidis
KSRSIPIFVFMNDSYEQITV

SEQ ID NO: 1808535 - protein, 18 aa, Staphylococcus epidermidis
KSRVASLQKNVLFEKMKI

SEQ ID NO: 1808536 - protein, 25 aa, Staphylococcus epidermidis
KSSDIKPKLLNYLESFGLTEHLLQK

SEQ ID NO: 1808537 - protein, 27 aa, Staphylococcus epidermidis
KSSEQIFIQTWHGFPLKKMVNDLNEQH

SEQ ID NO: 1808538 - protein, 19 aa, Staphylococcus epidermidis
KSSILNWLENAGIDPKRRG

SEQ ID NO: 1808539 - protein, 27 aa, Staphylococcus epidermidis
KSSKASAKRNWYIWADPKPDGSEPNNW

SEQ ID NO: 1808540 - protein, 24 aa, Staphylococcus epidermidis
KSSTVPRPIGWISTVSKKGKDNLA

SEQ ID NO: 1808541 - protein, 34 aa, Staphylococcus epidermidis
KSSYEQHLLKLLSNEGVQWIVLAGYMRLVSEDLL

SEQ ID NO: 1808542 - protein, 18 aa, Staphylococcus epidermidis
KSTELKYEEGVILNEIEA

SEQ ID NO: 1808543 - protein, 23 aa, Staphylococcus epidermidis
KSTQDLLKRLKLMNEKFNTTIIM

SEQ ID NO: 1808544 - protein, 20 aa, Staphylococcus epidermidis
KSTQEIPTIFNFIDKEEIGS

SEQ ID NO: 1808545 - protein, 19 aa, Staphylococcus epidermidis
KSTYIKALNRMVELVPSVK

SEQ ID NO: 1808546 - protein, 22 aa, Staphylococcus epidermidis
KSVFNQRILPLLLDDDSHYRLY

SEQ ID NO: 1808547 - protein, 25 aa, Staphylococcus epidermidis
KSVKKTWDWKGRFYPNTTIKVRKKP

SEQ ID NO: 1808548 - protein, 21 aa, Staphylococcus epidermidis
KSVLIDLGLIIGKDARHRRNI

SEQ ID NO: 1808549 - protein, 22 aa, Staphylococcus epidermidis
KSVLIDLGLIIGKDARRRREIL

SEQ ID NO: 1808550 - protein, 21 aa, Staphylococcus epidermidis
KSVLIDLGLIIGKDARYRRNI

SEQ ID NO: 1808551 - protein, 21 aa, Staphylococcus epidermidis
KSVNVASIIAFDKVIEILGAI

SEQ ID NO: 1808552 - protein, 19 aa, Staphylococcus epidermidis
KSVSELTQFPEIMDGRVKT

SEQ ID NO: 1808553 - protein, 26 aa, Staphylococcus epidermidis
KSWKDLNTQLDFIWKELNTTEVNALR

SEQ ID NO: 1808554 - protein, 23 aa, Staphylococcus epidermidis
KSYKRLPLTLFQIQSKFRDEKRP

SEQ ID NO: 1808555 - protein, 17 aa, Staphylococcus epidermidis
KSYSWGWGNASRSQTSK

SEQ ID NO: 1808556 - protein, 28 aa, Staphylococcus epidermidis
KTADLPNQFNALKWQKFQLTNDDGSIVT

SEQ ID NO: 1808557 - protein, 24 aa, Staphylococcus epidermidis
KTAEMELRILTKIKEALEDGKPVR

SEQ ID NO: 1808558 - protein, 18 aa, Staphylococcus epidermidis
KTAIEYVKTFSVDKPKSL

SEQ ID NO: 1808559 - protein, 23 aa, Staphylococcus epidermidis
KTALKETLIRLESRREELKNRES

SEQ ID NO: 1808560 - protein, 21 aa, Staphylococcus epidermidis
KTARRPMILPVIMKVNEDKGN

SEQ ID NO: 1808561 - protein, 23 aa, Staphylococcus epidermidis
KTCKHCNEVKLAVDNRYFSKDTK

SEQ ID NO: 1808562 - protein, 19 aa, Staphylococcus epidermidis
KTDELFADFREFGNKNLYM

SEQ ID NO: 1808563 - protein, 25 aa, Staphylococcus epidermidis
KTDMPHFVMFTFNDPQVWNNDFNIY

SEQ ID NO: 1808564 - protein, 25 aa, Staphylococcus epidermidis
KTDYKACVLLDMHIGHLKSIMELLK

SEQ ID NO: 1808565 - protein, 28 aa, Staphylococcus epidermidis
KTEFPKYIKVCELLHLYQSFYQTFISFH

SEQ ID NO: 1808566 - protein, 25 aa, Staphylococcus epidermidis
KTEKANELWKSQLGSVLTPPHNAEN

SEQ ID NO: 1808567 - protein, 25 aa, Staphylococcus epidermidis
KTELPIEGILLFSPMLELKKDYKGR

SEQ ID NO: 1808568 - protein, 33 aa, Staphylococcus epidermidis
KTFKHWIHTNHYWKYVEKYGVLGIALDNPLHVQ

SEQ ID NO: 1808569 - protein, 18 aa, Staphylococcus epidermidis
KTFRQLGVDYEMDKLKKD

SEQ ID NO: 1808570 - protein, 25 aa, Staphylococcus epidermidis
KTFRVPAEQAIPIWTNKERDELQAF

SEQ ID NO: 1808571 - protein, 25 aa, Staphylococcus epidermidis
KTFRVPAEQAVPIWTNKERDELQAF

SEQ ID NO: 1808572 - protein, 17 aa, Staphylococcus epidermidis
KTFTTLLIESEHLTVKR

SEQ ID NO: 1808573 - protein, 31 aa, Staphylococcus epidermidis
KTGIKESKHIGGFPVSGLFLRCKNPDVIQRH

SEQ ID NO: 1808574 - protein, 21 aa, Staphylococcus epidermidis
KTGKALNKFKTFLSNQGGDDS

SEQ ID NO: 1808575 - protein, 25 aa, Staphylococcus epidermidis
KTGLIRHLVVRTGYHTDEMMVIFVT

SEQ ID NO: 1808576 - protein, 25 aa, Staphylococcus epidermidis
KTHELGIPVMILFEGVPASGKTRLS

SEQ ID NO: 1808577 - protein, 19 aa, Staphylococcus epidermidis
KTIKEGRFKGQYKGKRTPT

SEQ ID NO: 1808578 - protein, 19 aa, Staphylococcus epidermidis
KTIKEGRFKGQYRGKRTPT

SEQ ID NO: 1808579 - protein, 17 aa, Staphylococcus epidermidis
KTIKTHVSHIFNKLQVT

SEQ ID NO: 1808580 - protein, 29 aa, Staphylococcus epidermidis
KTINIKLDMDGRIPINVWTGESIARSGSG

SEQ ID NO: 1808581 - protein, 18 aa, Staphylococcus epidermidis
KTIPRVNLTEVYRQQDGS

SEQ ID NO: 1808582 - protein, 19 aa, Staphylococcus epidermidis
KTITPLRYVLPFNEQNRYL

SEQ ID NO: 1808583 - protein, 26 aa, Staphylococcus epidermidis
KTKELSLRLSKELIDTVHEYFNGLYI

SEQ ID NO: 1808584 - protein, 26 aa, Staphylococcus epidermidis
KTKNPRLAKEILLSLPNDFDREVQTE

SEQ ID NO: 1808585 - protein, 17 aa, Staphylococcus epidermidis
KTKRTELDKCLDYLREG

SEQ ID NO: 1808586 - protein, 19 aa, Staphylococcus epidermidis
KTKRYTYTHIQRILMTILL

SEQ ID NO: 1808587 - protein, 19 aa, Staphylococcus epidermidis
KTKSRFDIINTLPTTKTVT

SEQ ID NO: 1808588 - protein, 20 aa, Staphylococcus epidermidis
KTKSRLDIINTLPTSNKVSH

SEQ ID NO: 1808589 - protein, 20 aa, Staphylococcus epidermidis
KTKTFHLFDVVQRKADYYIK

SEQ ID NO: 1808590 - protein, 18 aa, Staphylococcus epidermidis
KTKTVYTDLLFLYLEHAF

SEQ ID NO: 1808591 - protein, 17 aa, Staphylococcus epidermidis
KTKVLEIADHVEAANGQ

SEQ ID NO: 1808592 - protein, 24 aa, Staphylococcus epidermidis
KTLEIDGTIHWRNEGNAVGFKDTT

SEQ ID NO: 1808593 - protein, 17 aa, Staphylococcus epidermidis
KTLSSRYYTNWNTIEKQ

SEQ ID NO: 1808594 - protein, 19 aa, Staphylococcus epidermidis
KTLYTKAIKALGMTYRPQQ

SEQ ID NO: 1808595 - protein, 18 aa, Staphylococcus epidermidis
KTNFGIKIGDSIDEVIDE

SEQ ID NO: 1808596 - protein, 19 aa, Staphylococcus epidermidis
KTNLEKISRKNLYRDVKIE

SEQ ID NO: 1808597 - protein, 19 aa, Staphylococcus epidermidis
KTNLNLPHDKKVIMYAPTW

SEQ ID NO: 1808598 - protein, 21 aa, Staphylococcus epidermidis
KTNYLDTDWKDRISSGDLGNE

SEQ ID NO: 1808599 - protein, 18 aa, Staphylococcus epidermidis
KTPFLDQLLINCLNQEID

SEQ ID NO: 1808600 - protein, 20 aa, Staphylococcus epidermidis
KTPRLLMRGAGDPKGSSVGY

SEQ ID NO: 1808601 - protein, 25 aa, Staphylococcus epidermidis
KTQQSFTRYGCSYIPMDETLARTVV

SEQ ID NO: 1808602 - protein, 24 aa, Staphylococcus epidermidis
KTQQSFTRYGCSYVPMDEALARTV

SEQ ID NO: 1808603 - protein, 20 aa, Staphylococcus epidermidis
KTRIIDCLETAHTRLKLLSK

SEQ ID NO: 1808604 - protein, 22 aa, Staphylococcus epidermidis
KTRKLLEALILVGAFDNFDKNR

SEQ ID NO: 1808605 - protein, 43 aa, Staphylococcus epidermidis; identical to SEQ ID NO: 1747145

SEQ ID NO: 1808606 - protein, 24 aa, Staphylococcus epidermidis
KTSDFSFKVYVEVNDGINIPQRKT

SEQ ID NO: 1808607 - protein, 27 aa, Staphylococcus epidermidis
KTSDLISRYAGIRVPRNKAIVGQNAFS

SEQ ID NO: 1808608 - protein, 33 aa, Staphylococcus epidermidis; identical to SEQ ID NO: 1663744

SEQ ID NO: 1808609 - protein, 18 aa, Staphylococcus epidermidis
KTSEDLTSLAETISNTTN

SEQ ID NO: 1808610 - protein, 22 aa, Staphylococcus epidermidis
KTSGEFTLDFETIELPYFESIG

SEQ ID NO: 1808611 - protein, 23 aa, Staphylococcus epidermidis
KTSGEFTLDFETIELPYFESIGY

SEQ ID NO: 1808612 - protein, 19 aa, Staphylococcus epidermidis
KTSIATMIHLIYRKLNKSS

SEQ ID NO: 1808613 - protein, 17 aa, Staphylococcus epidermidis
KTSIIGINPNWLTKPIM

SEQ ID NO: 1808614 - protein, 24 aa, Staphylococcus epidermidis
KTVRSRLGNPIQYINKGRYRFEVK

SEQ ID NO: 1808615 - protein, 23 aa, Staphylococcus epidermidis
KTVSELYAPISGKIVEINEELED

SEQ ID NO: 1808616 - protein, 28 aa, Staphylococcus epidermidis
KTVYTDLLFLYLERAFLSQNFFDIPTIH

SEQ ID NO: 1808617 - protein, 21 aa, Staphylococcus epidermidis
KTYQGESVFEPEVLVKMRNRM

SEQ ID NO: 1808618 - protein, 26 aa, Staphylococcus epidermidis
KTYSLGMKQKLGIAIAFLNHPQLIVL

SEQ ID NO: 1808619 - protein, 18 aa, Staphylococcus epidermidis
KVALGFAHYLTSSIAHPV

SEQ ID NO: 1808620 - protein, 25 aa, Staphylococcus epidermidis
KVATRRTKTLLAYTKHIHVVSPTIT

SEQ ID NO: 1808621 - protein, 18 aa, Staphylococcus epidermidis
KVATSYVHTATQFFNKEG

SEQ ID NO: 1808622 - protein, 27 aa, Staphylococcus epidermidis
KVCKKHEIPLFMDGARLGYGLMSENTD

SEQ ID NO: 1808623 - protein, 23 aa, Staphylococcus epidermidis
KVDIKHVSKLVAHHESVETTQIY

SEQ ID NO: 1808624 - protein, 24 aa, Staphylococcus epidermidis
KVDLRYLGPLGCGFMTGSGAVFNS

SEQ ID NO: 1808625 - protein, 27 aa, Staphylococcus epidermidis
KVEAEEIIKDMIELVLKHKSVDVKKIR

SEQ ID NO: 1808626 - protein, 22 aa, Staphylococcus epidermidis
KVEEDGIYCFSEDPTDGLEEVG

SEQ ID NO: 1808627 - protein, 24 aa, Staphylococcus epidermidis
KVEKDEILPFCLHITGQPIINSRA

SEQ ID NO: 1808628 - protein, 23 aa, Staphylococcus epidermidis
KVEKDIYKATALTMKYSSFTVAI

SEQ ID NO: 1808629 - protein, 20 aa, Staphylococcus epidermidis
KVFHIKRFNSELFVFKANGW

SEQ ID NO: 1808630 - protein, 22 aa, Staphylococcus epidermidis
KVFSGKYARGIHNAFIDEMNQY

SEQ ID NO: 1808631 - protein, 19 aa, Staphylococcus epidermidis
KVFYREGFVQTGRAYFKLV

SEQ ID NO: 1808632 - protein, 17 aa, Staphylococcus epidermidis
KVGDKVTITAGHMPGMK

SEQ ID NO: 1808633 - protein, 17 aa, Staphylococcus epidermidis
KVGVPKGVFNLVNGDGE

SEQ ID NO: 1808634 - protein, 25 aa, Staphylococcus epidermidis
KVHPQLKICACLGLTKEEQAKKLKT

SEQ ID NO: 1808635 - protein, 29 aa, Staphylococcus epidermidis
KVIAACLLTAVPVMKFFKYFYSNRGPVID

SEQ ID NO: 1808636 - protein, 22 aa, Staphylococcus epidermidis
KVIDEMAERFVVIADENKLVDY

SEQ ID NO: 1808637 - protein, 17 aa, Staphylococcus epidermidis
KVIKRTTAPFNNNSYTL

SEQ ID NO: 1808638 - protein, 30 aa, Staphylococcus epidermidis
KVIMFGGGGYNIWRVVPRAWSHVFLSLIGE

SEQ ID NO: 1808639 - protein, 18 aa, Staphylococcus epidermidis
KVIYEKAKSINISSYTEM

SEQ ID NO: 1808640 - protein, 21 aa, Staphylococcus epidermidis
KVKDKFGVYVIFDEKKPVFVG

SEQ ID NO: 1808641 - protein, 21 aa, Staphylococcus epidermidis
KVKDKFGVYVIFDQEKPVFVG

SEQ ID NO: 1808642 - protein, 22 aa, Staphylococcus epidermidis
KVKDKFGVYVIFDQKKPVFVGQ

SEQ ID NO: 1808643 - protein, 21 aa, Staphylococcus epidermidis
KVKETHLLISNRFKTDSSFWK

SEQ ID NO: 1808644 - protein, 24 aa, Staphylococcus epidermidis
KVKIDYYKAYCFPREKTKHNNIEY

SEQ ID NO: 1808645 - protein, 25 aa, Staphylococcus epidermidis
KVKKLHLPQGFNIRVDSLLYSGYQV

SEQ ID NO: 1808646 - protein, 22 aa, Staphylococcus epidermidis
KVKPENIVLIGMRDLDKGEREY

SEQ ID NO: 1808647 - protein, 17 aa, Staphylococcus epidermidis
KVLCAMSGGVDSSVVAV

SEQ ID NO: 1808648 - protein, 20 aa, Staphylococcus epidermidis
KVLEVCRDFYQNQRIYTKIK

SEQ ID NO: 1808649 - protein, 19 aa, Staphylococcus epidermidis
KVLFELNKNILLKGPTGSG

SEQ ID NO: 1808650 - protein, 17 aa, Staphylococcus epidermidis
KVMESYMLKEYYQNYYV

SEQ ID NO: 1808651 - protein, 27 aa, Staphylococcus epidermidis
KVMESYMLKEYYQNYYVLMAVLNSILK

SEQ ID NO: 1808652 - protein, 28 aa, Staphylococcus epidermidis
KVMLEYKKAFQWKNMYVDRDFIFTNHKG

SEQ ID NO: 1808653 - protein, 21 aa, Staphylococcus epidermidis
KVMNERVFRVFASNNSNDKSL

SEQ ID NO: 1808654 - protein, 21 aa, Staphylococcus epidermidis
KVNIPSIKVLNPVGSGDSTVA

SEQ ID NO: 1808655 - protein, 19 aa, Staphylococcus epidermidis
KVPAEVGLTEYNHSVNIEP

SEQ ID NO: 1808656 - protein, 18 aa, Staphylococcus epidermidis
KVPQPFVKQLERIGNVVM

SEQ ID NO: 1808657 - protein, 25 aa, Staphylococcus epidermidis
KVPSSDVPLHLYLSVLGMPGQTAYH

SEQ ID NO: 1808658 - protein, 23 aa, Staphylococcus epidermidis
KVQKEIFLLSEILAGKNDYKLTL

SEQ ID NO: 1808659 - protein, 18 aa, Staphylococcus epidermidis
KVQRDWRNKVNFIRQIGY

SEQ ID NO: 1808660 - protein, 23 aa, Staphylococcus epidermidis
KVSDARPILQHIYYNDNTIVATD

SEQ ID NO: 1808661 - protein, 26 aa, Staphylococcus epidermidis
KVSLFDYMKRTMLKHGLDEVTSITEN

SEQ ID NO: 1808662 - protein, 19 aa, Staphylococcus epidermidis
KVSNVPIMFISSRTDNMDQ

SEQ ID NO: 1808663 - protein, 19 aa, Staphylococcus epidermidis
KVSPFIIDAHSSLLGIGSQ

SEQ ID NO: 1808664 - protein, 21 aa, Staphylococcus epidermidis
KVSPTHFVKSWLLDARAPKVT

SEQ ID NO: 1808665 - protein, 18 aa, Staphylococcus epidermidis
KVSRTTIYRYLNKLNNQE

SEQ ID NO: 1808666 - protein, 18 aa, Staphylococcus epidermidis
KVSSLCKVASLKGNKVTL

SEQ ID NO: 1808667 - protein, 17 aa, Staphylococcus epidermidis
KVTGRPRGVLRKFEMSR

SEQ ID NO: 1808668 - protein, 19 aa, Staphylococcus epidermidis
KVTILRAAVLTPYMNEQEN

SEQ ID NO: 1808669 - protein, 18 aa, Staphylococcus epidermidis
KVTRELYGKTGGNEGHVI

SEQ ID NO: 1808670 - protein, 24 aa, Staphylococcus epidermidis
KVTRKELTIEAAVTTLCPCSKEIS

SEQ ID NO: 1808671 - protein, 18 aa, Staphylococcus epidermidis
KVTYEVLEELGLGAKDIG

SEQ ID NO: 1808672 - protein, 26 aa, Staphylococcus epidermidis
KVVKGGRRFRFTALVVVGDKKGRVGF

SEQ ID NO: 1808673 - protein, 20 aa, Staphylococcus epidermidis
KVYIIEEFEKLTVQGENSIL

SEQ ID NO: 1808674 - protein, 27 aa, Staphylococcus epidermidis
KVYLELWVKVQRDWRNKVNFIRQIGYI

SEQ ID NO: 1808675 - protein, 27 aa, Staphylococcus epidermidis
KVYLKREDLQWVRSFKLRGAYNAISVL

SEQ ID NO: 1808676 - protein, 18 aa, Staphylococcus epidermidis
KVYRGMGSLGAMEKGSND

SEQ ID NO: 1808677 - protein, 20 aa, Staphylococcus epidermidis
KWESTKIKNIFKVVSGSTPL

SEQ ID NO: 1808678 - protein, 18 aa, Staphylococcus epidermidis
KWGTPREFNFEPKAHWDL

SEQ ID NO: 1808679 - protein, 17 aa, Staphylococcus epidermidis
KWIPQVLHQDMISFDSW

SEQ ID NO: 1808680 - protein, 19 aa, Staphylococcus epidermidis
KWIVDHWVTHHGIETTEAI

SEQ ID NO: 1808681 - protein, 19 aa, Staphylococcus epidermidis
KWNCKYHIVFAPKYRRQVI

SEQ ID NO: 1808682 - protein, 18 aa, Staphylococcus epidermidis
KWRVMNDMLQQDVADKLG

SEQ ID NO: 1808683 - protein, 25 aa, Staphylococcus epidermidis
KWTIYKFYWITALNIIIKKKINTDI

SEQ ID NO: 1808684 - protein, 22 aa, Staphylococcus epidermidis
KWTSKRGSLSYDIDGIVIKVND

SEQ ID NO: 1808685 - protein, 18 aa, Staphylococcus epidermidis
KWYAEKDFASLLHEDLKI

SEQ ID NO: 1808686 - protein, 17 aa, Staphylococcus epidermidis
KYCSSRNTINLNKIHTL

SEQ ID NO: 1808687 - protein, 25 aa, Staphylococcus epidermidis
KYDDVRTAMKMVLPKKWTLNQLVDY

SEQ ID NO: 1808688 - protein, 20 aa, Staphylococcus epidermidis
KYDGRIILYLKEERLSTFLS

SEQ ID NO: 1808689 - protein, 26 aa, Staphylococcus epidermidis
KYDIPFQLKLIFVESDNGLTITTFTP

SEQ ID NO: 1808690 - protein, 19 aa, Staphylococcus epidermidis
KYDLAYKYQIEIMKKVQTI

SEQ ID NO: 1808691 - protein, 19 aa, Staphylococcus epidermidis
KYDLLKLLIQKLIFRVREK

SEQ ID NO: 1808692 - protein, 17 aa, Staphylococcus epidermidis
KYDYTRLQNDLEKRESL

SEQ ID NO: 1808693 - protein, 23 aa, Staphylococcus epidermidis
KYEVMSIPTLIVFKDGQPVDKVV

SEQ ID NO: 1808694 - protein, 28 aa, Staphylococcus epidermidis
KYFNLDIISVLLFLEINKTYKLMKNNYD

SEQ ID NO: 1808695 - protein, 22 aa, Staphylococcus epidermidis
KYFSSHIDYRLKGIAFDLLEYA

SEQ ID NO: 1808696 - protein, 19 aa, Staphylococcus epidermidis
KYGDEILAVAGDQEALSNF

SEQ ID NO: 1808697 - protein, 33 aa, Staphylococcus epidermidis
KYGNATNHWYEWLKHNLTLEGYHVTLFNLDADA

SEQ ID NO: 1808698 - protein, 18 aa, Staphylococcus epidermidis
KYGVEPIVALNAFIHDTA

SEQ ID NO: 1808699 - protein, 26 aa, Staphylococcus epidermidis
KYGVGRRISLHYTRQMVNQAISGQLK

SEQ ID NO: 1808700 - protein, 17 aa, Staphylococcus epidermidis
KYGYDYQTMAVLTAIDE

SEQ ID NO: 1808701 - protein, 18 aa, Staphylococcus epidermidis
KYHYTGFTSKAIYKTQNA

SEQ ID NO: 1808702 - protein, 22 aa, Staphylococcus epidermidis
KYIDLIEEYGFDLIRGEASFID

SEQ ID NO: 1808703 - protein, 24 aa, Staphylococcus epidermidis
KYIIPELQRRALFKNSYNQSTLRT

SEQ ID NO: 1808704 - protein, 17 aa, Staphylococcus epidermidis
KYIKAFYDDVGALNVKK

SEQ ID NO: 1808705 - protein, 20 aa, Staphylococcus epidermidis
KYIPNERIKVYVNKVEQTTK

SEQ ID NO: 1808706 - protein, 20 aa, Staphylococcus epidermidis
KYIQDIWGYIAPNTKKEQQP

SEQ ID NO: 1808707 - protein, 17 aa, Staphylococcus epidermidis
KYKEYFGSASEFQKGEH

SEQ ID NO: 1808708 - protein, 19 aa, Staphylococcus epidermidis
KYKHNIRYFKIFNGSKDTI

SEQ ID NO: 1808709 - protein, 19 aa, Staphylococcus epidermidis
KYKKMVRIIKEIRYQLIDS

SEQ ID NO: 1808710 - protein, 29 aa, Staphylococcus epidermidis
KYKLKKSFIGESFLAVFNKLLETPLFSYA

SEQ ID NO: 1808711 - protein, 17 aa, Staphylococcus epidermidis
KYKTVAVKSTFGSRDFT

SEQ ID NO: 1808712 - protein, 27 aa, Staphylococcus epidermidis
KYLAEMKEHYKAGGLGDVKVKKYLNEI

SEQ ID NO: 1808713 - protein, 18 aa, Staphylococcus epidermidis
KYLFEDAYFKKMSAEAKI

SEQ ID NO: 1808714 - protein, 17 aa, Staphylococcus epidermidis
KYLKDAHDFCPYSKATR

SEQ ID NO: 1808715 - protein, 18 aa, Staphylococcus epidermidis
KYLLAWSKHKEDAITNYA

SEQ ID NO: 1808716 - protein, 21 aa, Staphylococcus epidermidis
KYLNDWKEIYIKEYVSSKTYK

SEQ ID NO: 1808717 - protein, 23 aa, Staphylococcus epidermidis
KYLRPETLFGTKFEGYLNQELQP

SEQ ID NO: 1808718 - protein, 28 aa, Staphylococcus epidermidis
KYLYKALKTRGYRVCIFKPFQTEEIGGG

SEQ ID NO: 1808719 - protein, 22 aa, Staphylococcus epidermidis
KYNAAFLKSEFDKWEQRIDDMY

SEQ ID NO: 1808720 - protein, 22 aa, Staphylococcus epidermidis
KYNAAFLKSEFDKWEQRIEDMY

SEQ ID NO: 1808721 - protein, 18 aa, Staphylococcus epidermidis
KYNARISKILSKYHHLNS

SEQ ID NO: 1808722 - protein, 24 aa, Staphylococcus epidermidis
KYNGKRVPKNLVWSKTPHYIAKAD

SEQ ID NO: 1808723 - protein, 26 aa, Staphylococcus epidermidis
KYNGQRKSLAWEYISTLNLEDEAEFS

SEQ ID NO: 1808724 - protein, 22 aa, Staphylococcus epidermidis
KYNNNIWNEWAFENYIQSNDYQ

SEQ ID NO: 1808725 - protein, 21 aa, Staphylococcus epidermidis
KYNNNIWNEWAFENYVQSNDY

SEQ ID NO: 1808726 - protein, 20 aa, Staphylococcus epidermidis
KYPEYTWDLTTIFKDDNAFE

SEQ ID NO: 1808727 - protein, 26 aa, Staphylococcus epidermidis
KYPFKELPLYEIGWRLIPEVWGNGIA

SEQ ID NO: 1808728 - protein, 20 aa, Staphylococcus epidermidis
KYPKEIVESGRIGIPNKGEW

SEQ ID NO: 1808729 - protein, 23 aa, Staphylococcus epidermidis
KYQAELLLNLGIEEVIIAIDKEY

SEQ ID NO: 1808730 - protein, 27 aa, Staphylococcus epidermidis
KYQVILCFDGLDFLRFGRIQRAYEQLR

SEQ ID NO: 1808731 - protein, 21 aa, Staphylococcus epidermidis
KYRDGEIEGTIDLNQYYYKNR

SEQ ID NO: 1808732 - protein, 20 aa, Staphylococcus epidermidis
KYSLGMKQKLAIAVSLINKP

SEQ ID NO: 1808733 - protein, 17 aa, Staphylococcus epidermidis
KYTIAKFYKLYMERSNE

SEQ ID NO: 1808734 - protein, 19 aa, Staphylococcus epidermidis
KYTPGLPFKIVGTKNGSLL

SEQ ID NO: 1808735 - protein, 17 aa, Staphylococcus epidermidis
KYVLKYDKDLDEFKIID

SEQ ID NO: 1808736 - protein, 26 aa, Staphylococcus epidermidis
KYVQMKWRCPIIFYTCIRENDENYRD

SEQ ID NO: 1808737 - protein, 19 aa, Staphylococcus epidermidis
KYWFNYTSDDLVHFESQGP

SEQ ID NO: 1808738 - protein, 19 aa, Staphylococcus epidermidis
KYWLNELNISIYNEKAKTG

SEQ ID NO: 1808739 - protein, 22 aa, Staphylococcus epidermidis
LAAAGLRRMGWSDDIVTTYLDK

SEQ ID NO: 1808740 - protein, 21 aa, Staphylococcus epidermidis
LAAGVCGLAKHWLETSKLTPE

SEQ ID NO: 1808741 - protein, 17 aa, Staphylococcus epidermidis
LAAKGKDIYDFPRVWLE

SEQ ID NO: 1808742 - protein, 17 aa, Staphylococcus epidermidis
LAAMIEGSFVIYSLQLV

SEQ ID NO: 1808743 - protein, 18 aa, Staphylococcus epidermidis
LADFVRYEVGEGMEKREE

SEQ ID NO: 1808744 - protein, 23 aa, Staphylococcus epidermidis
LADKAIEVITQFVAQNRGKFSDD

SEQ ID NO: 1808745 - protein, 22 aa, Staphylococcus epidermidis
LADKAMDTIVQFIAENLGKFSQ

SEQ ID NO: 1808746 - protein, 23 aa, Staphylococcus epidermidis
LADKGIVPFLKVDKGLAEQQNGV

SEQ ID NO: 1808747 - protein, 25 aa, Staphylococcus epidermidis
LADKSYPGLRFGFIHVPFIPEQTIN

SEQ ID NO: 1808748 - protein, 18 aa, Staphylococcus epidermidis
LADSLIRKTMEPTRQALK

SEQ ID NO: 1808749 - protein, 18 aa, Staphylococcus epidermidis
LAEAKAKGKQYLQTLTHL

SEQ ID NO: 1808750 - protein, 20 aa, Staphylococcus epidermidis
LAEEKGHEIVGVIDRTPKAS

SEQ ID NO: 1808751 - protein, 18 aa, Staphylococcus epidermidis
LAERVGPIKLHLVPFTEI

SEQ ID NO: 1808752 - protein, 18 aa, Staphylococcus epidermidis
LAEVVDRGKGFNIEDKPK

SEQ ID NO: 1808753 - protein, 17 aa, Staphylococcus epidermidis
LAGDRFVVFSDEKQARR

SEQ ID NO: 1808754 - protein, 19 aa, Staphylococcus epidermidis
LAGQLYSEFKEFFPENRVE

SEQ ID NO: 1808755 - protein, 19 aa, Staphylococcus epidermidis
LAHGDLLIITRETFFHYAY

SEQ ID NO: 1808756 - protein, 25 aa, Staphylococcus epidermidis
LAIIDRGAFEMGKKVIVQIRKRQVE

SEQ ID NO: 1808757 - protein, 23 aa, Staphylococcus epidermidis
LAIPELFWSIELSKELDANQLYE

SEQ ID NO: 1808758 - protein, 24 aa, Staphylococcus epidermidis
LAITDTHVLYGFPKFYDACIAADI

SEQ ID NO: 1808759 - protein, 17 aa, Staphylococcus epidermidis
LAIYMGIKRLGHIIEQI

SEQ ID NO: 1808760 - protein, 24 aa, Staphylococcus epidermidis
LAKDVFRKDLKIFNINDEKGVINY

SEQ ID NO: 1808761 - protein, 22 aa, Staphylococcus epidermidis
LAKELKLSPIVKKVLESKNLVQ

SEQ ID NO: 1808762 - protein, 34 aa, Staphylococcus epidermidis
LAKRDCMEMKPLYEWLGLTASLGFIDIPDYEYEA

SEQ ID NO: 1808763 - protein, 18 aa, Staphylococcus epidermidis
LALANGLKQKDLIHSDDH

SEQ ID NO: 1808764 - protein, 18 aa, Staphylococcus epidermidis
LALDLYDSEWIQWYYNQM

SEQ ID NO: 1808765 - protein, 23 aa, Staphylococcus epidermidis
LALKEEGYRVILVNSNPATIMTD

SEQ ID NO: 1808766 - protein, 19 aa, Staphylococcus epidermidis
LAMPQHAYDEWFEQIRNDK

SEQ ID NO: 1808767 - protein, 20 aa, Staphylococcus epidermidis
LAMVMHIYQSFGLKHLKLVI

SEQ ID NO: 1808768 - protein, 25 aa, Staphylococcus epidermidis
LANAVYDLGCSIGIDMNLKSQGVTE

SEQ ID NO: 1808769 - protein, 18 aa, Staphylococcus epidermidis
LANGKCYVSGRIRELIMR

SEQ ID NO: 1808770 - protein, 26 aa, Staphylococcus epidermidis
LANKISLKFAKKIYTTFEDTLTYLPK

SEQ ID NO: 1808771 - protein, 21 aa, Staphylococcus epidermidis
LANVEKLVWMGGTFLDKGNVE

SEQ ID NO: 1808772 - protein, 27 aa, Staphylococcus epidermidis
LAQEGKPVLGVCNGFQILTEIGLLPGA

SEQ ID NO: 1808773 - protein, 17 aa, Staphylococcus epidermidis
LAQEVLKDINLSVDEGE

SEQ ID NO: 1808774 - protein, 19 aa, Staphylococcus epidermidis
LAQGVHEIGGLAVIINEHM

SEQ ID NO: 1808775 - protein, 24 aa, Staphylococcus epidermidis
LAQLKPGETIHFEWISVEEATQQL

SEQ ID NO: 1808776 - protein, 25 aa, Staphylococcus epidermidis
LAQMKPGDIIQFEWITVEEASKKLK

SEQ ID NO: 1808777 - protein, 18 aa, Staphylococcus epidermidis
LAQRLGYNYDANWDDVIN

SEQ ID NO: 1808778 - protein, 17 aa, Staphylococcus epidermidis
LARKASIAVGKKGTDLP

SEQ ID NO: 1808779 - protein, 18 aa, Staphylococcus epidermidis
LARKYCLEEQVLMQAFLK

SEQ ID NO: 1808780 - protein, 18 aa, Staphylococcus epidermidis
LASLLIDKVRVVMHHKGS

SEQ ID NO: 1808781 - protein, 17 aa, Staphylococcus epidermidis
LASPFAAIYDTKAKNKV

SEQ ID NO: 1808782 - protein, 17 aa, Staphylococcus epidermidis
LASVSGFEPTKTNAVYG

SEQ ID NO: 1808783 - protein, 30 aa, Staphylococcus epidermidis
LATQIICYDLRFPELLRYPAKSGAKIAFYV

SEQ ID NO: 1808784 - protein, 18 aa, Staphylococcus epidermidis
LATSRKSYIKEMMNQDSS

SEQ ID NO: 1808785 - protein, 18 aa, Staphylococcus epidermidis
LAVNRTFTNAQGEREADF

SEQ ID NO: 1808786 - protein, 18 aa, Staphylococcus epidermidis
LAVSGPFHSSMMSVIEED

SEQ ID NO: 1808787 - protein, 20 aa, Staphylococcus epidermidis
LCGGIHKLIQSGFETLVEAG

SEQ ID NO: 1808788 - protein, 17 aa, Staphylococcus epidermidis
LCIAGESLTSGYLNRPE

SEQ ID NO: 1808789 - protein, 20 aa, Staphylococcus epidermidis
LCNHYEIKTPLKSYHEHNKE

SEQ ID NO: 1808790 - protein, 19 aa, Staphylococcus epidermidis
LCPNGYYVTSRFDAYREVS

SEQ ID NO: 1808791 - protein, 20 aa, Staphylococcus epidermidis
LCPNGYYVTSRFGAYREASQ

SEQ ID NO: 1808792 - protein, 24 aa, Staphylococcus epidermidis
LCQAELVYHQSLLPQFVTPNGEVA

SEQ ID NO: 1808793 - protein, 19 aa, Staphylococcus epidermidis
LCQEIPEIDVIFGSHTHHH

SEQ ID NO: 1808794 - protein, 25 aa, Staphylococcus epidermidis
LDAGYCAFDTAYFYGNEKALGSALK

SEQ ID NO: 1808795 - protein, 25 aa, Staphylococcus epidermidis
LDAHMIKWSKLYIDDFQSSWTMPQR

SEQ ID NO: 1808796 - protein, 19 aa, Staphylococcus epidermidis
LDAKLQPGIELVLEETHFQ

SEQ ID NO: 1808797 - protein, 20 aa, Staphylococcus epidermidis
LDAKPLYSVKRLTDNKEIAT

SEQ ID NO: 1808798 - protein, 19 aa, Staphylococcus epidermidis
LDASFSKRILRTHTSRIDA

SEQ ID NO: 1808799 - protein, 21 aa, Staphylococcus epidermidis
LDDHDVRIALDRAIDDSDRGL

SEQ ID NO: 1808800 - protein, 23 aa, Staphylococcus epidermidis
LDDYRIIKSHLFGDGSRTTENRG

SEQ ID NO: 1808801 - protein, 21 aa, Staphylococcus epidermidis
LDEAIKILNNFEGIKVTQVSD

SEQ ID NO: 1808802 - protein, 17 aa, Staphylococcus epidermidis
LDEALHFSGKESYKEGI

SEQ ID NO: 1808803 - protein, 25 aa, Staphylococcus epidermidis
LDEEIFKYVINYLIAYIKKEDDQEA

SEQ ID NO: 1808804 - protein, 19 aa, Staphylococcus epidermidis
LDEEVTYEKLAVATLGVRN

SEQ ID NO: 1808805 - protein, 21 aa, Staphylococcus epidermidis
LDEFQPRKAVDHEYLIVNMKG

SEQ ID NO: 1808806 - protein, 18 aa, Staphylococcus epidermidis
LDEGLEIFVGVPSERYPA

SEQ ID NO: 1808807 - protein, 17 aa, Staphylococcus epidermidis
LDEKLALKFKEDIKLVS

SEQ ID NO: 1808808 - protein, 20 aa, Staphylococcus epidermidis
LDEKYAKRFMFFIDECHNLI

SEQ ID NO: 1808809 - protein, 23 aa, Staphylococcus epidermidis
LDELPKWLEASFKNDPGFSELGE

SEQ ID NO: 1808810 - protein, 24 aa, Staphylococcus epidermidis
LDELPQRIVFVGGGYISFEFAHIA

SEQ ID NO: 1808811 - protein, 17 aa, Staphylococcus epidermidis
LDERQPIDFKWKDEAVV

SEQ ID NO: 1808812 - protein, 18 aa, Staphylococcus epidermidis
LDESLIRPFYEQQNDIEI

SEQ ID NO: 1808813 - protein, 18 aa, Staphylococcus epidermidis
LDEYGVSYEPIDIVQHTP

SEQ ID NO: 1808814 - protein, 24 aa, Staphylococcus epidermidis
LDEYICQWIRGLDDIIPRLVEKME

SEQ ID NO: 1808815 - protein, 25 aa, Staphylococcus epidermidis
LDEYICQWIRGLDNIIPRLVEKMET

SEQ ID NO: 1808816 - protein, 22 aa, Staphylococcus epidermidis
LDFELGQTVSFGIKTKDAHFFD

SEQ ID NO: 1808817 - protein, 19 aa, Staphylococcus epidermidis
LDFLLPERFDLTYIGQDGE

SEQ ID NO: 1808818 - protein, 17 aa, Staphylococcus epidermidis
LDFSTAGPFIISNPGCY

SEQ ID NO: 1808819 - protein, 24 aa, Staphylococcus epidermidis
LDFYKKGKMAYYFIKDDEIKEFFS

SEQ ID NO: 1808820 - protein, 25 aa, Staphylococcus epidermidis
LDGDTRGGAALSIRSVTQKPIKFVG

SEQ ID NO: 1808821 - protein, 21 aa, Staphylococcus epidermidis
LDGEMKFRIACTNHHHHHFIC

SEQ ID NO: 1808822 - protein, 23 aa, Staphylococcus epidermidis
LDGIKYGVAVMDARFRMGSMGSV

SEQ ID NO: 1808823 - protein, 19 aa, Staphylococcus epidermidis
LDGKWKLPIIKLDNNLEFI

SEQ ID NO: 1808824 - protein, 18 aa, Staphylococcus epidermidis
LDGLNYLAGKTIDEVNTK

SEQ ID NO: 1808825 - protein, 26 aa, Staphylococcus epidermidis
LDGSRRFLDRVWRLIVTEDGTLNNKI

SEQ ID NO: 1808826 - protein, 17 aa, Staphylococcus epidermidis
LDGVCLNLFLDNHYCKS

SEQ ID NO: 1808827 - protein, 23 aa, Staphylococcus epidermidis
LDHHMKSCIMNKVNNGAQEEAME

SEQ ID NO: 1808828 - protein, 25 aa, Staphylococcus epidermidis
LDHHPKGSGLGLYGMRERADLVNGH

SEQ ID NO: 1808829 - protein, 25 aa, Staphylococcus epidermidis
LDHLLKEMRSVVIAFSGGVDSSLVL

SEQ ID NO: 1808830 - protein, 25 aa, Staphylococcus epidermidis
LDIEIPGITGLEILSYVRKKQLNTR

SEQ ID NO: 1808831 - protein, 22 aa, Staphylococcus epidermidis
LDIESGEFIAFIGTSGSGKTTA

SEQ ID NO: 1808832 - protein, 29 aa, Staphylococcus epidermidis
LDIIKRHRLLELFLIEILHYNWEEVHQEA

SEQ ID NO: 1808833 - protein, 17 aa, Staphylococcus epidermidis
LDIKMIFEDNIFISQDI

SEQ ID NO: 1808834 - protein, 23 aa, Staphylococcus epidermidis
LDIKNDEILAGFLYLTDLEVEPT

SEQ ID NO: 1808835 - protein, 17 aa, Staphylococcus epidermidis
LDIPIEDFHLIKEIITE

SEQ ID NO: 1808836 - protein, 27 aa, Staphylococcus epidermidis
LDIVKQLLKRGAHVTVLARNIEKFNQI

SEQ ID NO: 1808837 - protein, 21 aa, Staphylococcus epidermidis
LDKDVIRRRVSLMKDAGILFK

SEQ ID NO: 1808838 - protein, 24 aa, Staphylococcus epidermidis
LDKERLADMEVWMAFRNDIHEYGQ

SEQ ID NO: 1808839 - protein, 24 aa, Staphylococcus epidermidis
LDKKRLKEKLTFLSDSKMIEVDNA

SEQ ID NO: 1808840 - protein, 24 aa, Staphylococcus epidermidis
LDKKRLKEKLTYLSESKMKEVDNA

SEQ ID NO: 1808841 - protein, 22 aa, Staphylococcus epidermidis
LDKKVIKYIIDYGSISKGEALK

SEQ ID NO: 1808842 - protein, 29 aa, Staphylococcus epidermidis
LDKNIPAGRGMVKWAPFATLPEQFETIHQ

SEQ ID NO: 1808843 - protein, 21 aa, Staphylococcus epidermidis
LDKYYYCLLALDTGVRAEALN

SEQ ID NO: 1808844 - protein, 18 aa, Staphylococcus epidermidis
LDLFRLHLTLFEKHSTEE

SEQ ID NO: 1808845 - protein, 24 aa, Staphylococcus epidermidis
LDLGCGTGSLTHRLVTLGHITGMD

SEQ ID NO: 1808846 - protein, 17 aa, Staphylococcus epidermidis
LDLIRQLIRMNRTKNIL

SEQ ID NO: 1808847 - protein, 21 aa, Staphylococcus epidermidis
LDLKGKVVLERADFNVPLKDG

SEQ ID NO: 1808848 - protein, 22 aa, Staphylococcus epidermidis
LDLPFGKCHFALASKPQTTAYK

SEQ ID NO: 1808849 - protein, 26 aa, Staphylococcus epidermidis
LDLPKKQGRICISFDNLFFDGYSMFQ

SEQ ID NO: 1808850 - protein, 17 aa, Staphylococcus epidermidis
LDMIYIRDFEGLRIDNE

SEQ ID NO: 1808851 - protein, 20 aa, Staphylococcus epidermidis
LDNLCTTIWEIEEGRITEYK

SEQ ID NO: 1808852 - protein, 24 aa, Staphylococcus epidermidis
LDPEVNGVLPICLGHATRISDYVM

SEQ ID NO: 1808853 - protein, 17 aa, Staphylococcus epidermidis
LDPGMAFGTGDHPTTSM

SEQ ID NO: 1808854 - protein, 17 aa, Staphylococcus epidermidis
LDPTFNWISDKAKKIYS

SEQ ID NO: 1808855 - protein, 17 aa, Staphylococcus epidermidis
LDQVNWVGFYLIEGNGL

SEQ ID NO: 1808856 - protein, 19 aa, Staphylococcus epidermidis
LDQYSLKVAQTLIGNEGPA

SEQ ID NO: 1808857 - protein, 25 aa, Staphylococcus epidermidis
LDRGFIPRLEYHYQRISTSSEHLGF

SEQ ID NO: 1808858 - protein, 18 aa, Staphylococcus epidermidis
LDRHQRLVGAEIYSNDAN

SEQ ID NO: 1808859 - protein, 18 aa, Staphylococcus epidermidis
LDRKKIRALTEEALEMIL

SEQ ID NO: 1808860 - protein, 20 aa, Staphylococcus epidermidis
LDSARFRYLISKELGVTASS

SEQ ID NO: 1808861 - protein, 17 aa, Staphylococcus epidermidis
LDSDYSGYMSFNGTAKE

SEQ ID NO: 1808862 - protein, 20 aa, Staphylococcus epidermidis
LDSIVLPLMDAFHISEKAMQ

SEQ ID NO: 1808863 - protein, 22 aa, Staphylococcus epidermidis
LDSIVLPLMDAFHISEKTMQEN

SEQ ID NO: 1808864 - protein, 17 aa, Staphylococcus epidermidis
LDSKGRPSISTFSPQST

SEQ ID NO: 1808865 - protein, 18 aa, Staphylococcus epidermidis
LDSLDFIDCIVADKDFKS

SEQ ID NO: 1808866 - protein, 30 aa, Staphylococcus epidermidis
LDSNVPKGRGFVKWLAFKTIPEQYQQIERY

SEQ ID NO: 1808867 - protein, 20 aa, Staphylococcus epidermidis
LDSYFDLIINYFKQINNIDE

SEQ ID NO: 1808868 - protein, 25 aa, Staphylococcus epidermidis
LDTEILWKMHFGLYPTPIKRLQNYL

SEQ ID NO: 1808869 - protein, 17 aa, Staphylococcus epidermidis
LDTESLLGFKTIHTNEE

SEQ ID NO: 1808870 - protein, 20 aa, Staphylococcus epidermidis
LDTESLLGFKTIQTNEEGHQ

SEQ ID NO: 1808871 - protein, 25 aa, Staphylococcus epidermidis
LDTLKEIIWNPLIKDRCFDHTYVAQ

SEQ ID NO: 1808872 - protein, 17 aa, Staphylococcus epidermidis
LDVITRVGVAVVTAARY

SEQ ID NO: 1808873 - protein, 27 aa, Staphylococcus epidermidis
LDVQEGLRVYWYYDLIDNEIKIVCIDP

SEQ ID NO: 1808874 - protein, 22 aa, Staphylococcus epidermidis
LDVSEKPFLLALESVAGEDLAQ

SEQ ID NO: 1808875 - protein, 18 aa, Staphylococcus epidermidis
LDYKAKFISNNEIALLDE

SEQ ID NO: 1808876 - protein, 17 aa, Staphylococcus epidermidis
LDYKYFEEITNVEKQID

SEQ ID NO: 1808877 - protein, 23 aa, Staphylococcus epidermidis
LDYLFEMINPYSLNQQGQDKGQK

SEQ ID NO: 1808878 - protein, 19 aa, Staphylococcus epidermidis
LDYPLDIISQLNFDDTYRF

SEQ ID NO: 1808879 - protein, 20 aa, Staphylococcus epidermidis
LDYSCSAFMMYIGIDKDITD

SEQ ID NO: 1808880 - protein, 19 aa, Staphylococcus epidermidis
LDYTLSVTILKDLNDTLNI

SEQ ID NO: 1808881 - protein, 24 aa, Staphylococcus epidermidis
LDYVKRGAANLALIAEDPDLLNGI

SEQ ID NO: 1808882 - protein, 20 aa, Staphylococcus epidermidis
LDYYTHTAFEVMMDNPNYDG

SEQ ID NO: 1808883 - protein, 19 aa, Staphylococcus epidermidis
LEAGMVITIEPGVYVPHVA

SEQ ID NO: 1808884 - protein, 25 aa, Staphylococcus epidermidis
LEAKFKTSALRSWKTDQADAHKLAY

SEQ ID NO: 1808885 - protein, 25 aa, Staphylococcus epidermidis
LEAKFKTSTLRSWKTDQADAHKLAC

SEQ ID NO: 1808886 - protein, 17 aa, Staphylococcus epidermidis
LEAKRLRNNPIRTFMCD

SEQ ID NO: 1808887 - protein, 17 aa, Staphylococcus epidermidis
LEALLSYAKEVAKDEKS

SEQ ID NO: 1808888 - protein, 19 aa, Staphylococcus epidermidis
LEDIFTIMLENSFPSHERE

SEQ ID NO: 1808889 - protein, 20 aa, Staphylococcus epidermidis
LEDLDLYTAKQFAYGKAKDN

SEQ ID NO: 1808890 - protein, 25 aa, Staphylococcus epidermidis
LEDLNSRLYHYWALGHIHEREQLSD

SEQ ID NO: 1808891 - protein, 25 aa, Staphylococcus epidermidis
LEDLPIIPKYMKTIVIGKTSKQFKI

SEQ ID NO: 1808892 - protein, 32 aa, Staphylococcus epidermidis
LEDMEIEILHVLKRFKAILIQKNETVEAMQGY

SEQ ID NO: 1808893 - protein, 17 aa, Staphylococcus epidermidis
LEECLQYAYDEIKDRKG

SEQ ID NO: 1808894 - protein, 22 aa, Staphylococcus epidermidis
LEEIDGLILPGGESTTLRRLMD

SEQ ID NO: 1808895 - protein, 17 aa, Staphylococcus epidermidis
LEEIHALNMRRQNMKQH

SEQ ID NO: 1808896 - protein, 17 aa, Staphylococcus epidermidis
LEELGVKAKAYAHDLKD

SEQ ID NO: 1808897 - protein, 17 aa, Staphylococcus epidermidis
LEELHALNMRRQNMPRY

SEQ ID NO: 1808898 - protein, 24 aa, Staphylococcus epidermidis
LEELKKKLAKEGYFDNNIKKPIPK

SEQ ID NO: 1808899 - protein, 20 aa, Staphylococcus epidermidis
LEEPPAHAIFILATTEPHKI

SEQ ID NO: 1808900 - protein, 23 aa, Staphylococcus epidermidis
LEFKTRQSIDISRVEPASEIVKR

SEQ ID NO: 1808901 - protein, 21 aa, Staphylococcus epidermidis
LEFKTRQTIDISRVEPASEIV

SEQ ID NO: 1808902 - protein, 23 aa, Staphylococcus epidermidis
LEFLGDAVLELTVSRYLFDKHPH

SEQ ID NO: 1808903 - protein, 23 aa, Staphylococcus epidermidis
LEFYPHVQGGFDIVYNDNVYDDL

SEQ ID NO: 1808904 - protein, 21 aa, Staphylococcus epidermidis
LEGALPYPPGIFCVVPGEKWS

SEQ ID NO: 1808905 - protein, 17 aa, Staphylococcus epidermidis
LEGFRKVEFGDVNQLKA

SEQ ID NO: 1808906 - protein, 25 aa, Staphylococcus epidermidis
LEGNTYKIYFGFASRTAYEDFKASD

SEQ ID NO: 1808907 - protein, 17 aa, Staphylococcus epidermidis
LEGSITLPNTFGEVNRS

SEQ ID NO: 1808908 - protein, 19 aa, Staphylococcus epidermidis
LEHETKFFAFRDSFDQEPY

SEQ ID NO: 1808909 - protein, 25 aa, Staphylococcus epidermidis
LEHFKALSVGKWVRAQGRIEEDTFV

SEQ ID NO: 1808910 - protein, 21 aa, Staphylococcus epidermidis
LEHHMKSCIMEKINQGTEEEA

SEQ ID NO: 1808911 - protein, 20 aa, Staphylococcus epidermidis
LEHRRQFLFENQFEKQDDID

SEQ ID NO: 1808912 - protein, 19 aa, Staphylococcus epidermidis
LEHRRQFLYENNFEKQEEI

SEQ ID NO: 1808913 - protein, 18 aa, Staphylococcus epidermidis
LEIDVFDFHSNKSRHISS

SEQ ID NO: 1808914 - protein, 20 aa, Staphylococcus epidermidis
LEIGSGSFIPGFEEQIEGMK

SEQ ID NO: 1808915 - protein, 21 aa, Staphylococcus epidermidis
LEIIKMKKLKALKIIFSNPKK

SEQ ID NO: 1808916 - protein, 24 aa, Staphylococcus epidermidis
LEIKSLYHIDEWINAYDVYFKSLI

SEQ ID NO: 1808917 - protein, 17 aa, Staphylococcus epidermidis
LEILPLIAKGYGNKEIA

SEQ ID NO: 1808918 - protein, 19 aa, Staphylococcus epidermidis
LEIWVDNKYVFPSDKKTKI

SEQ ID NO: 1808919 - protein, 24 aa, Staphylococcus epidermidis
LEIYPCAQDGFDLVYNANAYDNLT

SEQ ID NO: 1808920 - protein, 24 aa, Staphylococcus epidermidis
LEKEFKSRILPTLTPLGIDAYHPF

SEQ ID NO: 1808921 - protein, 21 aa, Staphylococcus epidermidis
LEKEKDFLQVIVKDEDSQLPT

SEQ ID NO: 1808922 - protein, 21 aa, Staphylococcus epidermidis
LEKELASIIGNGFSVIYLISQ

SEQ ID NO: 1808923 - protein, 19 aa, Staphylococcus epidermidis
LEKLGRYLMDSFVNIEGTG

SEQ ID NO: 1808924 - protein, 26 aa, Staphylococcus epidermidis
LEKLSQNMPIFFSANMSYGIHALTKI

SEQ ID NO: 1808925 - protein, 25 aa, Staphylococcus epidermidis
LEKLTRLPGKFKYFEHNVAAHSFKV

SEQ ID NO: 1808926 - protein, 19 aa, Staphylococcus epidermidis
LEKQLLKILEKVLEREDIG

SEQ ID NO: 1808927 - protein, 21 aa, Staphylococcus epidermidis
LEKRELIKIHILQNNFDDKKD

SEQ ID NO: 1808928 - protein, 25 aa, Staphylococcus epidermidis
LEKRIEVGYFLPCKVVRSQCVYCTT

SEQ ID NO: 1808929 - protein, 20 aa, Staphylococcus epidermidis
LEKVAEAFDFGTLKNNSFNR

SEQ ID NO: 1808930 - protein, 18 aa, Staphylococcus epidermidis
LELALMLEKAGIETIETG

SEQ ID NO: 1808931 - protein, 17 aa, Staphylococcus epidermidis
LELANLIYDAGFLTGIY

SEQ ID NO: 1808932 - protein, 20 aa, Staphylococcus epidermidis
LELASKYGLIISNVPSYSPR

SEQ ID NO: 1808933 - protein, 21 aa, Staphylococcus epidermidis
LELDILRFSLGKPVKIYAAQL

SEQ ID NO: 1808934 - protein, 17 aa, Staphylococcus epidermidis
LELEGFNLYHFNDLTQL

SEQ ID NO: 1808935 - protein, 17 aa, Staphylococcus epidermidis
LELFKKGLERYNLEYEY

SEQ ID NO: 1808936 - protein, 17 aa, Staphylococcus epidermidis
LELIDAIPEDENVTLYT

SEQ ID NO: 1808937 - protein, 25 aa, Staphylococcus epidermidis
LELKIRPYRHNELYNLYYIPTSEIL

SEQ ID NO: 1808938 - protein, 26 aa, Staphylococcus epidermidis
LELKKIPKRLTVIGSGYIGMELGQLF

SEQ ID NO: 1808939 - protein, 21 aa, Staphylococcus epidermidis
LELTTALRKAFFKNGDTSTKN

SEQ ID NO: 1808940 - protein, 20 aa, Staphylococcus epidermidis
LELTVSRYLFDKHPHLPEGN

SEQ ID NO: 1808941 - protein, 17 aa, Staphylococcus epidermidis
LEMTFFYELVFGEETEF

SEQ ID NO: 1808942 - protein, 22 aa, Staphylococcus epidermidis
LEMYIKGYLIDYTLFINKKDIL

SEQ ID NO: 1808943 - protein, 21 aa, Staphylococcus epidermidis
LENDALCFYDIGSAGMNLDTA

SEQ ID NO: 1808944 - protein, 18 aa, Staphylococcus epidermidis
LENEMSINLNSDLKEILL

SEQ ID NO: 1808945 - protein, 22 aa, Staphylococcus epidermidis
LENLFGGAIPNFGQNNEEEEEP

SEQ ID NO: 1808946 - protein, 35 aa, Staphylococcus epidermidis
LENLGLDYIDLFLIHWPCEKDGLFIESYKALEKLY

SEQ ID NO: 1808947 - protein, 19 aa, Staphylococcus epidermidis
LENLSTFKPFEKVLNLKEV

SEQ ID NO: 1808948 - protein, 21 aa, Staphylococcus epidermidis
LENNLNCYFDMAHVDKLMKHI

SEQ ID NO: 1808949 - protein, 22 aa, Staphylococcus epidermidis
LENVSIPLIYNGMGSKERKDKV

SEQ ID NO: 1808950 - protein, 19 aa, Staphylococcus epidermidis
LEPSMAFKTMEFVRKGRGL

SEQ ID NO: 1808951 - protein, 25 aa, Staphylococcus epidermidis
LEQDLKNWHGAFIIVSHDRAFLDNL

SEQ ID NO: 1808952 - protein, 17 aa, Staphylococcus epidermidis
LEQEIWQIIAQTVEDIF

SEQ ID NO: 1808953 - protein, 19 aa, Staphylococcus epidermidis
LEQRISIEVSDKAKKWLGE

SEQ ID NO: 1808954 - protein, 20 aa, Staphylococcus epidermidis
LEQYLDFRLNTERENFNNHF

SEQ ID NO: 1808955 - protein, 20 aa, Staphylococcus epidermidis
LERDKGRFMDSLKRIDVSPL

SEQ ID NO: 1808956 - protein, 18 aa, Staphylococcus epidermidis
LERHFKFDDINKEAITAN

SEQ ID NO: 1808957 - protein, 19 aa, Staphylococcus epidermidis
LERIAVMSAPHKKRESEIA

SEQ ID NO: 1808958 - protein, 26 aa, Staphylococcus epidermidis
LERKKAIDIGNAMLKDGYKEGDVVPI

SEQ ID NO: 1808959 - protein, 25 aa, Staphylococcus epidermidis
LERLSKCKKLIGPINFEITQHDQTV

SEQ ID NO: 1808960 - protein, 25 aa, Staphylococcus epidermidis
LERLVGEIDKWVSLLNDLKIASPIL

SEQ ID NO: 1808961 - protein, 17 aa, Staphylococcus epidermidis
LERQLNLLLNTKVEKSK

SEQ ID NO: 1808962 - protein, 32 aa, Staphylococcus epidermidis
LERRIASKYRLRLIELGFSMKQFSLYERYVSN

SEQ ID NO: 1808963 - protein, 17 aa, Staphylococcus epidermidis
LESAHAKSVTTANGTIV

SEQ ID NO: 1808964 - protein, 26 aa, Staphylococcus epidermidis
LESAKARGAEIYAEIVGYGSTGDAYH

SEQ ID NO: 1808965 - protein, 20 aa, Staphylococcus epidermidis
LESKHIFIDNCEAYGCGDDG

SEQ ID NO: 1808966 - protein, 19 aa, Staphylococcus epidermidis
LESKHIFIDNCEVYGCGDD

SEQ ID NO: 1808967 - protein, 20 aa, Staphylococcus epidermidis
LESLKQVWYTDATLLTNNLI

SEQ ID NO: 1808968 - protein, 19 aa, Staphylococcus epidermidis
LESRMNLLNNLKRKYGKDI

SEQ ID NO: 1808969 - protein, 18 aa, Staphylococcus epidermidis
LESTFKCINYGQEFLNHV

SEQ ID NO: 1808970 - protein, 18 aa, Staphylococcus epidermidis
LESTFKCINYGQEFLNNV

SEQ ID NO: 1808971 - protein, 19 aa, Staphylococcus epidermidis
LETESFLSAASFQETTRVL

SEQ ID NO: 1808972 - protein, 19 aa, Staphylococcus epidermidis
LETKLPFIHKSVTQVAKDG

SEQ ID NO: 1808973 - protein, 18 aa, Staphylococcus epidermidis
LETLPYSEILSGYAEVYK

SEQ ID NO: 1808974 - protein, 18 aa, Staphylococcus epidermidis
LETRGMVLKINRNTQTSK

SEQ ID NO: 1808975 - protein, 32 aa, Staphylococcus epidermidis
LETTKWLEDYLKYFKGAIVIISHDRYFLDKIV

SEQ ID NO: 1808976 - protein, 25 aa, Staphylococcus epidermidis
LETYKMRIPQLFRFNEVLVTSDGIN

SEQ ID NO: 1808977 - protein, 24 aa, Staphylococcus epidermidis
LEVEGAELPKVFHYFKEAHPYFNQ

SEQ ID NO: 1808978 - protein, 20 aa, Staphylococcus epidermidis
LEVIIAPQFTEEALKILTQK

SEQ ID NO: 1808979 - protein, 18 aa, Staphylococcus epidermidis
LEVKVMSDFVKFAEKVIN

SEQ ID NO: 1808980 - protein, 17 aa, Staphylococcus epidermidis
LEVLDTYQRRGYAKQLL

SEQ ID NO: 1808981 - protein, 18 aa, Staphylococcus epidermidis
LEVRRNAREFGAFEDLTQ

SEQ ID NO: 1808982 - protein, 19 aa, Staphylococcus epidermidis
LEWLKRYDDNLIIIFKDVE

SEQ ID NO: 1808983 - protein, 22 aa, Staphylococcus epidermidis
LEYLKIKFYYEAGREKSVDEFL

SEQ ID NO: 1808984 - protein, 18 aa, Staphylococcus epidermidis
LEYLKYAKDYGFSDRVIA

SEQ ID NO: 1808985 - protein, 17 aa, Staphylococcus epidermidis
LEYYFDINIKNITQKGN

SEQ ID NO: 1808986 - protein, 18 aa, Staphylococcus epidermidis
LFAGCGIVKNSDPDSEVA

SEQ ID NO: 1808987 - protein, 17 aa, Staphylococcus epidermidis
LFDMELIVFMGKEDIKR

SEQ ID NO: 1808988 - protein, 19 aa, Staphylococcus epidermidis
LFDSLDIVIKPKFKRDIKK

SEQ ID NO: 1808989 - protein, 17 aa, Staphylococcus epidermidis
LFEKFAIEMGEDVIDDD

SEQ ID NO: 1808990 - protein, 17 aa, Staphylococcus epidermidis
LFEPSDVLSEPYVIVCL

SEQ ID NO: 1808991 - protein, 17 aa, Staphylococcus epidermidis
LFEPSEVLDKPYVIVCL

SEQ ID NO: 1808992 - protein, 18 aa, Staphylococcus epidermidis
LFERSRKGTFLTEEGQRL

SEQ ID NO: 1808993 - protein, 25 aa, Staphylococcus epidermidis
LFFPDREDFTLLKLGDNVKFVAKEK

SEQ ID NO: 1808994 - protein, 18 aa, Staphylococcus epidermidis
LFGASAIEKMMKVIQALN

SEQ ID NO: 1808995 - protein, 19 aa, Staphylococcus epidermidis
LFGGPLYTFHKIFSIVTLC

SEQ ID NO: 1808996 - protein, 17 aa, Staphylococcus epidermidis
LFIDEIHRLSSVVEEVL

SEQ ID NO: 1808997 - protein, 19 aa, Staphylococcus epidermidis
LFIEGAYIYYLGSFIDSDS

SEQ ID NO: 1808998 - protein, 17 aa, Staphylococcus epidermidis
LFIMCGKEDFLYHDNLQ

SEQ ID NO: 1808999 - protein, 18 aa, Staphylococcus epidermidis
LFINLAIDQAIKFGKSKI

SEQ ID NO: 1809000 - protein, 18 aa, Staphylococcus epidermidis
LFIYELLKDNDILPTIEQ

SEQ ID NO: 1809001 - protein, 17 aa, Staphylococcus epidermidis
LFKKYVGLTPFQYLLHY

SEQ ID NO: 1809002 - protein, 25 aa, Staphylococcus epidermidis
LFKLAIESRGMFPLLSESLMNETGI

SEQ ID NO: 1809003 - protein, 21 aa, Staphylococcus epidermidis
LFKMKKSAKWAGVDRGALVLI

SEQ ID NO: 1809004 - protein, 25 aa, Staphylococcus epidermidis
LFKQAETIFIYGYGASFVVATDLYQ

SEQ ID NO: 1809005 - protein, 18 aa, Staphylococcus epidermidis
LFLDHFGEDIMIKHITRN

SEQ ID NO: 1809006 - protein, 19 aa, Staphylococcus epidermidis
LFLSNCLKDAVYDGYLTKD

SEQ ID NO: 1809007 - protein, 19 aa, Staphylococcus epidermidis
LFMDGARLGYGLMSNHTNV

SEQ ID NO: 1809008 - protein, 27 aa, Staphylococcus epidermidis
LFNDLKNAFNIKKLKNHYEIKTNQVEA

SEQ ID NO: 1809009 - protein, 17 aa, Staphylococcus epidermidis
LFNFQWLAATQGVKVVN

SEQ ID NO: 1809010 - protein, 18 aa, Staphylococcus epidermidis
LFNSERFDEIRHLLLENV

SEQ ID NO: 1809011 - protein, 17 aa, Staphylococcus epidermidis
LFNSERFDEIRHLLVEN

SEQ ID NO: 1809012 - protein, 23 aa, Staphylococcus epidermidis
LFNVRKLECRYSTDEVKGNIFYF

SEQ ID NO: 1809013 - protein, 22 aa, Staphylococcus epidermidis
LFPEGPITMTLIHEMRLMWQEM

SEQ ID NO: 1809014 - protein, 23 aa, Staphylococcus epidermidis
LFPIPDKPFFTARLVQQKKNIDK

SEQ ID NO: 1809015 - protein, 18 aa, Staphylococcus epidermidis
LFQTALDNQNRWLGYYGF

SEQ ID NO: 1809016 - protein, 35 aa, Staphylococcus epidermidis
LFRKIVLNHRGGFCYEMNHLFGTYLEEKGFDVHRA

SEQ ID NO: 1809017 - protein, 18 aa, Staphylococcus epidermidis
LFRKPSEVLTHLEDIASH

SEQ ID NO: 1809018 - protein, 23 aa, Staphylococcus epidermidis
LFSKEEWCALSLAERQEQEKAFR

SEQ ID NO: 1809019 - protein, 18 aa, Staphylococcus epidermidis
LFSKIEWIIVSLGANGAF

SEQ ID NO: 1809020 - protein, 25 aa, Staphylococcus epidermidis
LFSVDEFKFGAGEWLTITGKNGAGK

SEQ ID NO: 1809021 - protein, 28 aa, Staphylococcus epidermidis
LFTCKGHANAFGVEFHVSDALEVLKAIE

SEQ ID NO: 1809022 - protein, 19 aa, Staphylococcus epidermidis
LFTEKRIIATIKEERRFEL

SEQ ID NO: 1809023 - protein, 23 aa, Staphylococcus epidermidis
LFTRDFKSAISFNVKQPNPKHID

SEQ ID NO: 1809024 - protein, 24 aa, Staphylococcus epidermidis
LFVRLKYYLIDIFRKESYRMEMMG

SEQ ID NO: 1809025 - protein, 24 aa, Staphylococcus epidermidis
LFYVYEIIDGWCRVHGPSDNYWVR

SEQ ID NO: 1809026 - protein, 24 aa, Staphylococcus epidermidis
LFYYVREVLKEGIKYGGTSISDYR

SEQ ID NO: 1809027 - protein, 17 aa, Staphylococcus epidermidis
LGADVFVTGDIKHHDAL

SEQ ID NO: 1809028 - protein, 25 aa, Staphylococcus epidermidis
LGADVRRTRKADGMIGAQKEAKTYA

SEQ ID NO: 1809029 - protein, 27 aa, Staphylococcus epidermidis
LGAIPYEHPLFLGMGGMHGSYASNMAL

SEQ ID NO: 1809030 - protein, 27 aa, Staphylococcus epidermidis
LGAIPYHHPLFLGMGGMHGSYASNMAL

SEQ ID NO: 1809031 - protein, 17 aa, Staphylococcus epidermidis
LGAKTFEQSIGFLRIVD

SEQ ID NO: 1809032 - protein, 18 aa, Staphylococcus epidermidis
LGALNGFCKVHGVKINHV

SEQ ID NO: 1809033 - protein, 18 aa, Staphylococcus epidermidis
LGALSGFCKINHVKMMHV

SEQ ID NO: 1809034 - protein, 21 aa, Staphylococcus epidermidis
LGATVIKHIVKSSGIDPKEVN

SEQ ID NO: 1809035 - protein, 22 aa, Staphylococcus epidermidis
LGCGSHGRNSISHNVSAVDLLN

SEQ ID NO: 1809036 - protein, 22 aa, Staphylococcus epidermidis
LGDCPNVKLYPAIKQNMVNQLY

SEQ ID NO: 1809037 - protein, 21 aa, Staphylococcus epidermidis
LGDLCQLLSAYQITYIIDVTP

SEQ ID NO: 1809038 - protein, 22 aa, Staphylococcus epidermidis
LGDLCQLLSAYQITYIIDVTPS

SEQ ID NO: 1809039 - protein, 18 aa, Staphylococcus epidermidis
LGDPIYYRFDDFIEFAEL

SEQ ID NO: 1809040 - protein, 17 aa, Staphylococcus epidermidis
LGDRICLLNEGHVEQID

SEQ ID NO: 1809041 - protein, 22 aa, Staphylococcus epidermidis
LGDTFNALIAFLIDNIDKLSEF

SEQ ID NO: 1809042 - protein, 18 aa, Staphylococcus epidermidis
LGEISAETQFALDHFNVE

SEQ ID NO: 1809043 - protein, 21 aa, Staphylococcus epidermidis
LGELCQLLSSYDITYIIDVNP

SEQ ID NO: 1809044 - protein, 25 aa, Staphylococcus epidermidis
LGENILPKEVEAILREYKYIKNCAV

SEQ ID NO: 1809045 - protein, 22 aa, Staphylococcus epidermidis
LGEVFRRYTIENFRELKYYFDE

SEQ ID NO: 1809046 - protein, 17 aa, Staphylococcus epidermidis
LGFGSAFNSVEYGNTSG

SEQ ID NO: 1809047 - protein, 18 aa, Staphylococcus epidermidis
LGFPRLGRKREWKKAIES

SEQ ID NO: 1809048 - protein, 21 aa, Staphylococcus epidermidis
LGGELKGYIIGTAEKPGDIKK

SEQ ID NO: 1809049 - protein, 25 aa, Staphylococcus epidermidis
LGGHSLRATLVVNRIEAQLKKRLKV

SEQ ID NO: 1809050 - protein, 27 aa, Staphylococcus epidermidis
LGGLFTLRLAEQFDLERIVVMSAPHKK

SEQ ID NO: 1809051 - protein, 17 aa, Staphylococcus epidermidis
LGGNPIVFFRNQKNTSF

SEQ ID NO: 1809052 - protein, 19 aa, Staphylococcus epidermidis
LGGVGEIAKNMYIVEVDDE

SEQ ID NO: 1809053 - protein, 20 aa, Staphylococcus epidermidis
LGHACGHNIIGTASVLGGTA

SEQ ID NO: 1809054 - protein, 18 aa, Staphylococcus epidermidis
LGHADIHTTLKIYSHLIK

SEQ ID NO: 1809055 - protein, 21 aa, Staphylococcus epidermidis
LGHDMGGIIGREFTETYQHKV

SEQ ID NO: 1809056 - protein, 18 aa, Staphylococcus epidermidis
LGHFRGAVRPDITRFRDL

SEQ ID NO: 1809057 - protein, 20 aa, Staphylococcus epidermidis
LGICTYPNYYGEIFDVGHFI

SEQ ID NO: 1809058 - protein, 17 aa, Staphylococcus epidermidis
LGIIPMGTVNDFGRALH

SEQ ID NO: 1809059 - protein, 23 aa, Staphylococcus epidermidis
LGILKSGAGYLPIDPDYPDDRTA

SEQ ID NO: 1809060 - protein, 19 aa, Staphylococcus epidermidis
LGIPLTIITESVFARFISS

SEQ ID NO: 1809061 - protein, 19 aa, Staphylococcus epidermidis
LGIQIGTDIPFCIYNKTAV

SEQ ID NO: 1809062 - protein, 22 aa, Staphylococcus epidermidis
LGISSPDVFKALNLNEQHVVYN

SEQ ID NO: 1809063 - protein, 25 aa, Staphylococcus epidermidis
LGIYRFLKNKPKIYARTLDHPVVEE

SEQ ID NO: 1809064 - protein, 24 aa, Staphylococcus epidermidis
LGKEAFSIISQGRVDEILNAKPID

SEQ ID NO: 1809065 - protein, 22 aa, Staphylococcus epidermidis
LGKKLVNRVVEYARDNNLKIIA

SEQ ID NO: 1809066 - protein, 17 aa, Staphylococcus epidermidis
LGKPFDAAISFLAVVKD

SEQ ID NO: 1809067 - protein, 19 aa, Staphylococcus epidermidis
LGLDVIFKEAGFEWREPGC

SEQ ID NO: 1809068 - protein, 17 aa, Staphylococcus epidermidis
LGLDWRTSIKQADKMGV

SEQ ID NO: 1809069 - protein, 18 aa, Staphylococcus epidermidis
LGLGAAVKKSADFEEQMS

SEQ ID NO: 1809070 - protein, 17 aa, Staphylococcus epidermidis
LGLLPLQKGEIFVEGHL

SEQ ID NO: 1809071 - protein, 18 aa, Staphylococcus epidermidis
LGLNKPNMLYLIKPEVTE

SEQ ID NO: 1809072 - protein, 25 aa, Staphylococcus epidermidis
LGPDAIRYAGLLARLKRMGHDVIDK

SEQ ID NO: 1809073 - protein, 18 aa, Staphylococcus epidermidis
LGQARAFYIDELGLEHIS

SEQ ID NO: 1809074 - protein, 19 aa, Staphylococcus epidermidis
LGRRPYFLATKYNEKHQIL

SEQ ID NO: 1809075 - protein, 24 aa, Staphylococcus epidermidis
LGSGHAAWHAALTLKQFGKSVAIV

SEQ ID NO: 1809076 - protein, 17 aa, Staphylococcus epidermidis
LGSLVMATTHYPELKAY

SEQ ID NO: 1809077 - protein, 18 aa, Staphylococcus epidermidis
LGTAFANFGSEVTILEGA

SEQ ID NO: 1809078 - protein, 24 aa, Staphylococcus epidermidis
LGTISELGIIIGMKKQAQKTIDRL

SEQ ID NO: 1809079 - protein, 20 aa, Staphylococcus epidermidis
LGTKYSEAMNATFLDNQGKA

SEQ ID NO: 1809080 - protein, 30 aa, Staphylococcus epidermidis
LGTLFRNNFYRFIPDNVVPVIPSSLVATYP

SEQ ID NO: 1809081 - protein, 18 aa, Staphylococcus epidermidis
LGVEGLKILKNVKDKFNL

SEQ ID NO: 1809082 - protein, 17 aa, Staphylococcus epidermidis
LGVGQFASVSGRYYAMD

SEQ ID NO: 1809083 - protein, 17 aa, Staphylococcus epidermidis
LGVSSFVGYLKGKSSLM

SEQ ID NO: 1809084 - protein, 21 aa, Staphylococcus epidermidis
LGVTLFKRSGRNIILTVEGRQ

SEQ ID NO: 1809085 - protein, 22 aa, Staphylococcus epidermidis
LGWQRKKYFAARSDSFGATILN

SEQ ID NO: 1809086 - protein, 27 aa, Staphylococcus epidermidis
LGYAIKKEIIEELGFDFSHSHNPYNEN

SEQ ID NO: 1809087 - protein, 25 aa, Staphylococcus epidermidis
LGYGERAKMGLALNKLVRDGEISAP

SEQ ID NO: 1809088 - protein, 18 aa, Staphylococcus epidermidis
LGYKGPKGSFEIEGVSLF

SEQ ID NO: 1809089 - protein, 17 aa, Staphylococcus epidermidis
LGYMRMLGYKDIDQCRR

SEQ ID NO: 1809090 - protein, 17 aa, Staphylococcus epidermidis
LGYRVVLMADKDPKLIG

SEQ ID NO: 1809091 - protein, 25 aa, Staphylococcus epidermidis
LHDLGFGPKLSMAIYQFYMSDTLKI

SEQ ID NO: 1809092 - protein, 17 aa, Staphylococcus epidermidis
LHEEMYDIAGLRMMCQF

SEQ ID NO: 1809093 - protein, 18 aa, Staphylococcus epidermidis
LHEGVSLSMILAKKDIVS

SEQ ID NO: 1809094 - protein, 21 aa, Staphylococcus epidermidis
LHEIANPLLMEAAFANIIGAD

SEQ ID NO: 1809095 - protein, 20 aa, Staphylococcus epidermidis
LHFDLPLQVFSEDTKQIERN

SEQ ID NO: 1809096 - protein, 17 aa, Staphylococcus epidermidis
LHFQPKVNLNERVTDIR

SEQ ID NO: 1809097 - protein, 21 aa, Staphylococcus epidermidis
LHGDLWKGNILFQKNGDPILC

SEQ ID NO: 1809098 - protein, 17 aa, Staphylococcus epidermidis
LHGERKLDNDKHTQTYA

SEQ ID NO: 1809099 - protein, 18 aa, Staphylococcus epidermidis
LHGSLNRFYCINCYEEYS

SEQ ID NO: 1809100 - protein, 18 aa, Staphylococcus epidermidis
LHKGLEIGTQYDKWMERM

SEQ ID NO: 1809101 - protein, 23 aa, Staphylococcus epidermidis
LHKTCVGGLDFGSVRDFTAVGLL

SEQ ID NO: 1809102 - protein, 18 aa, Staphylococcus epidermidis
LHLGFLIERVTSHFVEQL

SEQ ID NO: 1809103 - protein, 19 aa, Staphylococcus epidermidis
LHMGGRIGVLTVVEGSTDE

SEQ ID NO: 1809104 - protein, 24 aa, Staphylococcus epidermidis
LHMVWPDLIFPESEIAFIVLHFGG

SEQ ID NO: 1809105 - protein, 18 aa, Staphylococcus epidermidis
LHNRSIFFSSHDEVKKFL

SEQ ID NO: 1809106 - protein, 17 aa, Staphylococcus epidermidis
LHSKGVYRLKVTLNKEG

SEQ ID NO: 1809107 - protein, 19 aa, Staphylococcus epidermidis
LHSRLLLGTGKFENEDIQS

SEQ ID NO: 1809108 - protein, 23 aa, Staphylococcus epidermidis
LHTLLHETTHAFYHQKENPEKTT

SEQ ID NO: 1809109 - protein, 18 aa, Staphylococcus epidermidis
LHTLQLWLMRINYLNQPK

SEQ ID NO: 1809110 - protein, 19 aa, Staphylococcus epidermidis
LHTYLFVRLKYYLIDIFRK

SEQ ID NO: 1809111 - protein, 19 aa, Staphylococcus epidermidis
LHVDGAYGLSHILSDKAQH

SEQ ID NO: 1809112 - protein, 18 aa, Staphylococcus epidermidis
LIACTMSMEVMGITKEEL

SEQ ID NO: 1809113 - protein, 24 aa, Staphylococcus epidermidis
LIAERSLEMIIGMLGILKAGAGYI

SEQ ID NO: 1809114 - protein, 17 aa, Staphylococcus epidermidis
LICDEITSNLDVVAEQN

SEQ ID NO: 1809115 - protein, 17 aa, Staphylococcus epidermidis
LIDMEMDGLLQLINPVV

SEQ ID NO: 1809116 - protein, 23 aa, Staphylococcus epidermidis
LIDNCDLNFYPGYVNHIVGKNGV

SEQ ID NO: 1809117 - protein, 24 aa, Staphylococcus epidermidis
LIDNICSLFDAVAIYNNINRTISF

SEQ ID NO: 1809118 - protein, 17 aa, Staphylococcus epidermidis
LIDREGNVIKRFSPQKK

SEQ ID NO: 1809119 - protein, 18 aa, Staphylococcus epidermidis
LIDYRYNGYRDIFVIDDI

SEQ ID NO: 1809120 - protein, 21 aa, Staphylococcus epidermidis
LIDYYAASNVHGWQWSASTGT

SEQ ID NO: 1809121 - protein, 25 aa, Staphylococcus epidermidis
LIEFDKSWEKIGVRLVDKLLETFPV

SEQ ID NO: 1809122 - protein, 17 aa, Staphylococcus epidermidis
LIEILDQSNLTEINIED

SEQ ID NO: 1809123 - protein, 17 aa, Staphylococcus epidermidis
LIEKDIKLDGLISNPPY

SEQ ID NO: 1809124 - protein, 26 aa, Staphylococcus epidermidis
LIEKLTFMHAYNCICANVPAQIACIA

SEQ ID NO: 1809125 - protein, 17 aa, Staphylococcus epidermidis
LIEKSIAGFKEIEYEVM

SEQ ID NO: 1809126 - protein, 24 aa, Staphylococcus epidermidis
LIEYLCKTHEDIFVRLFELLSETQ

SEQ ID NO: 1809127 - protein, 29 aa, Staphylococcus epidermidis
LIFMRPKFNLYFMFNWLENFQLKWNKYGQ

SEQ ID NO: 1809128 - protein, 17 aa, Staphylococcus epidermidis
LIFSTNAILNFPPEHAK

SEQ ID NO: 1809129 - protein, 17 aa, Staphylococcus epidermidis
LIFVNRLNEGLYCILNQ

SEQ ID NO: 1809130 - protein, 17 aa, Staphylococcus epidermidis
LIGALLIGINAAKALAF

SEQ ID NO: 1809131 - protein, 23 aa, Staphylococcus epidermidis
LIGELRSAVDLPIHLHTHDTSGN

SEQ ID NO: 1809132 - protein, 18 aa, Staphylococcus epidermidis
LIGIVSLKIDMHNVEGMA

SEQ ID NO: 1809133 - protein, 24 aa, Staphylococcus epidermidis
LIIGKDARYRRNILGRKLHIGHSN

SEQ ID NO: 1809134 - protein, 28 aa, Staphylococcus epidermidis
LIKDLRRLGLRVYFNIKNALVSLSEEKR

SEQ ID NO: 1809135 - protein, 17 aa, Staphylococcus epidermidis
LIKEGYTKLTLLVEYGG

SEQ ID NO: 1809136 - protein, 23 aa, Staphylococcus epidermidis
LIKGENVMNGYLYPEHLTDTFED

SEQ ID NO: 1809137 - protein, 17 aa, Staphylococcus epidermidis
LIKHISMYFKQVNQSNI

SEQ ID NO: 1809138 - protein, 23 aa, Staphylococcus epidermidis
LIKHPPQHFIALAAIGTIADLVS

SEQ ID NO: 1809139 - protein, 24 aa, Staphylococcus epidermidis
LIKKFPNEEFKFYKKAETIPTEDR

SEQ ID NO: 1809140 - protein, 18 aa, Staphylococcus epidermidis
LIKNRLIDIDSIIVDAKS

SEQ ID NO: 1809141 - protein, 26 aa, Staphylococcus epidermidis
LIKVTHIFKALSDFNRVRIMEFLENG

SEQ ID NO: 1809142 - protein, 25 aa, Staphylococcus epidermidis
LIKYIRRIDLSGVHPQLAKVNIQLM

SEQ ID NO: 1809143 - protein, 24 aa, Staphylococcus epidermidis
LIKYMPSKIAFIFQTMDIEHILKI

SEQ ID NO: 1809144 - protein, 22 aa, Staphylococcus epidermidis
LILEELEHTLSHVDDTDYERFT

SEQ ID NO: 1809145 - protein, 20 aa, Staphylococcus epidermidis
LILTLRPGASYKNFKPSDSD

SEQ ID NO: 1809146 - protein, 24 aa, Staphylococcus epidermidis
LIMNELKPSNVILLSGTPIDGKYE

SEQ ID NO: 1809147 - protein, 19 aa, Staphylococcus epidermidis
LIMSFKLTLGKLAIVKEPI

SEQ ID NO: 1809148 - protein, 27 aa, Staphylococcus epidermidis
LINDFSYKYGIPWIYGGVVQSTYVEAT

SEQ ID NO: 1809149 - protein, 24 aa, Staphylococcus epidermidis
LINEDVAMAFGFFDGMHRGHDKVF

SEQ ID NO: 1809150 - protein, 21 aa, Staphylococcus epidermidis
LINIIKLAIDQHIPYTVLRDN

SEQ ID NO: 1809151 - protein, 20 aa, Staphylococcus epidermidis
LINKPAQPNPNWSGSNPDPS

SEQ ID NO: 1809152 - protein, 18 aa, Staphylococcus epidermidis
LINVPAIKEAKVRFECKL

SEQ ID NO: 1809153 - protein, 19 aa, Staphylococcus epidermidis
LIPEDWGGDTIFVPLSALS

SEQ ID NO: 1809154 - protein, 20 aa, Staphylococcus epidermidis
LIPKLKEAFENIKVGDPFDE

SEQ ID NO: 1809155 - protein, 26 aa, Staphylococcus epidermidis
LIPKNKLLKGKRIKAISIDKKDPLEM

SEQ ID NO: 1809156 - protein, 21 aa, Staphylococcus epidermidis
LIPNVDFFSATVFHSMNIPHD

SEQ ID NO: 1809157 - protein, 18 aa, Staphylococcus epidermidis
LIQKLMLIMPEGPVLTLN

SEQ ID NO: 1809158 - protein, 25 aa, Staphylococcus epidermidis
LIQRKTLRPDGIFYYVKDKLLRIST

SEQ ID NO: 1809159 - protein, 24 aa, Staphylococcus epidermidis
LIQYKDNLICLGNEFKEALNKSLF

SEQ ID NO: 1809160 - protein, 23 aa, Staphylococcus epidermidis
LIRGAKILALMGLELIENEQLFN

SEQ ID NO: 1809161 - protein, 20 aa, Staphylococcus epidermidis
LIRIPCKYQELINQLKHKYE

SEQ ID NO: 1809162 - protein, 17 aa, Staphylococcus epidermidis
LISEMDIHCDLHITPSI

SEQ ID NO: 1809163 - protein, 23 aa, Staphylococcus epidermidis
LISEYHIIRIADILHIYIDGYYS

SEQ ID NO: 1809164 - protein, 18 aa, Staphylococcus epidermidis
LISIGAEVMRLGIISTPG

SEQ ID NO: 1809165 - protein, 18 aa, Staphylococcus epidermidis
LISLFKMTKLFLKEKPLI

SEQ ID NO: 1809166 - protein, 18 aa, Staphylococcus epidermidis
LISTDFIEDFSVFDGQTI

SEQ ID NO: 1809167 - protein, 25 aa, Staphylococcus epidermidis
LITEFKSELNSIVQLEETFSHEIKQ

SEQ ID NO: 1809168 - protein, 24 aa, Staphylococcus epidermidis
LITEHCFVRPTYLFLNQMNNCDTW

SEQ ID NO: 1809169 - protein, 20 aa, Staphylococcus epidermidis
LIYKEIRKTGYIGLTEHYQT

SEQ ID NO: 1809170 - protein, 18 aa, Staphylococcus epidermidis
LIYMKFKSGLDVSSQQVA

SEQ ID NO: 1809171 - protein, 19 aa, Staphylococcus epidermidis
LKAAFNVTQSVIPQFINQQ

SEQ ID NO: 1809172 - protein, 23 aa, Staphylococcus epidermidis
LKADNGLELLVHIGLDTVQLDGE

SEQ ID NO: 1809173 - protein, 24 aa, Staphylococcus epidermidis
LKAEIFCPISHLYHQLTMSQNGNY

SEQ ID NO: 1809174 - protein, 20 aa, Staphylococcus epidermidis
LKAHGETGVECGVDEDNVFI

SEQ ID NO: 1809175 - protein, 25 aa, Staphylococcus epidermidis
LKAISPRTTLPILTGIKIDAKDNEV

SEQ ID NO: 1809176 - protein, 25 aa, Staphylococcus epidermidis
LKAKRIILLAFGPKKKEAISKLLNE

SEQ ID NO: 1809177 - protein, 21 aa, Staphylococcus epidermidis
LKALDNFARVYAVLCPSWNID

SEQ ID NO: 1809178 - protein, 20 aa, Staphylococcus epidermidis
LKATEKMAGQSIIDLDIRAQ

SEQ ID NO: 1809179 - protein, 25 aa, Staphylococcus epidermidis
LKAYAPEFEKVIPLNIMLIEKNHIV

SEQ ID NO: 1809180 - protein, 18 aa, Staphylococcus epidermidis
LKAYQTVYSKGFKPYMEA

SEQ ID NO: 1809181 - protein, 20 aa, Staphylococcus epidermidis
LKDGRAYNSLYHAALARSEA

SEQ ID NO: 1809182 - protein, 18 aa, Staphylococcus epidermidis
LKDISFEVPKGFVTGFIG

SEQ ID NO: 1809183 - protein, 18 aa, Staphylococcus epidermidis
LKDKEDKYHYTGFTDEAI

SEQ ID NO: 1809184 - protein, 19 aa, Staphylococcus epidermidis
LKDKGYKVKLLIVGALEKD

SEQ ID NO: 1809185 - protein, 18 aa, Staphylococcus epidermidis
LKDLGADKVVVQDLEDDF

SEQ ID NO: 1809186 - protein, 21 aa, Staphylococcus epidermidis
LKDNILKFGLYTDDTHIVINA

SEQ ID NO: 1809187 - protein, 30 aa, Staphylococcus epidermidis
LKDNMNVHFSRTYLRLMRHVYLNNPLTSQI

SEQ ID NO: 1809188 - protein, 29 aa, Staphylococcus epidermidis
LKDQFDHALSNARKAIVKATGKNLDETEI

SEQ ID NO: 1809189 - protein, 24 aa, Staphylococcus epidermidis
LKDRIGKLPLLMDFINNDSIDPSV

SEQ ID NO: 1809190 - protein, 23 aa, Staphylococcus epidermidis
LKDTLERVVPIWTDRISQHLLDG

SEQ ID NO: 1809191 - protein, 20 aa, Staphylococcus epidermidis
LKDYGFKIIVAENFGEIFYK

SEQ ID NO: 1809192 - protein, 21 aa, Staphylococcus epidermidis
LKDYGVGIAKVGKYGGKGITA

SEQ ID NO: 1809193 - protein, 26 aa, Staphylococcus epidermidis
LKEAIKKLYGVNGISIMKLDQSDVVR

SEQ ID NO: 1809194 - protein, 17 aa, Staphylococcus epidermidis
LKEARYILTKRSGFVQS

SEQ ID NO: 1809195 - protein, 18 aa, Staphylococcus epidermidis
LKEAVPVTVTLSYDQTGK

SEQ ID NO: 1809196 - protein, 18 aa, Staphylococcus epidermidis
LKECGAILGIELLDHIII

SEQ ID NO: 1809197 - protein, 20 aa, Staphylococcus epidermidis
LKEELCLDLAEEELEFIGTV

SEQ ID NO: 1809198 - protein, 17 aa, Staphylococcus epidermidis
LKEESRHGYQIIKDLEE

SEQ ID NO: 1809199 - protein, 20 aa, Staphylococcus epidermidis
LKEEVPETYYTVPLGKADVK

SEQ ID NO: 1809200 - protein, 19 aa, Staphylococcus epidermidis
LKEFIRWSEENGFSDKLTL

SEQ ID NO: 1809201 - protein, 18 aa, Staphylococcus epidermidis
LKEGQLIHDFYRSEDHIQ

SEQ ID NO: 1809202 - protein, 17 aa, Staphylococcus epidermidis
LKEISYIQAEGFAGGEL

SEQ ID NO: 1809203 - protein, 18 aa, Staphylococcus epidermidis
LKEKALYLLEKVGLKDKA

SEQ ID NO: 1809204 - protein, 25 aa, Staphylococcus epidermidis
LKEKLKHFNELGIGKKLEVQGKISR

SEQ ID NO: 1809205 - protein, 25 aa, Staphylococcus epidermidis
LKEKLKHFNELGIGKKLEVQGKVSK

SEQ ID NO: 1809206 - protein, 20 aa, Staphylococcus epidermidis
LKEKLTELGKTYLKADRLEE

SEQ ID NO: 1809207 - protein, 17 aa, Staphylococcus epidermidis
LKERKLRIEDALNSTRA

SEQ ID NO: 1809208 - protein, 19 aa, Staphylococcus epidermidis
LKESEGIVDVSIKDNINHV

SEQ ID NO: 1809209 - protein, 17 aa, Staphylococcus epidermidis
LKEVIKQLKIFHLKILV

SEQ ID NO: 1809210 - protein, 20 aa, Staphylococcus epidermidis
LKFEDVRIVRDMRNSVNRLV

SEQ ID NO: 1809211 - protein, 20 aa, Staphylococcus epidermidis
LKFEPCATKYLKISGGDVGG

SEQ ID NO: 1809212 - protein, 18 aa, Staphylococcus epidermidis
LKFPELHPEDDFLRDVED

SEQ ID NO: 1809213 - protein, 19 aa, Staphylococcus epidermidis
LKFQILELFHQTFPGLERL

SEQ ID NO: 1809214 - protein, 20 aa, Staphylococcus epidermidis
LKFQILELLHQTFPGLERLF

SEQ ID NO: 1809215 - protein, 18 aa, Staphylococcus epidermidis
LKGDTCIAGGGSDGNIMN

SEQ ID NO: 1809216 - protein, 21 aa, Staphylococcus epidermidis
LKGENTFKVSAYRKAAQSLEI

SEQ ID NO: 1809217 - protein, 21 aa, Staphylococcus epidermidis
LKGETHVACIHSGMDEVEKRD

SEQ ID NO: 1809218 - protein, 17 aa, Staphylococcus epidermidis
LKGGDPAIFGRVTEEIT

SEQ ID NO: 1809219 - protein, 29 aa, Staphylococcus epidermidis
LKGIAFDLLEYALKFAFEHYSIHKVYFKI

SEQ ID NO: 1809220 - protein, 25 aa, Staphylococcus epidermidis
LKGINKDVSIEWNIPDITPQNVIDY

SEQ ID NO: 1809221 - protein, 19 aa, Staphylococcus epidermidis
LKGKQILVYSGLFKEARKK

SEQ ID NO: 1809222 - protein, 18 aa, Staphylococcus epidermidis
LKGLLSIESVRDDSQASN

SEQ ID NO: 1809223 - protein, 19 aa, Staphylococcus epidermidis
LKGLNRATATYKFAGGKGI

SEQ ID NO: 1809224 - protein, 20 aa, Staphylococcus epidermidis
LKGLPPVYMYGGGKEIGNPD

SEQ ID NO: 1809225 - protein, 18 aa, Staphylococcus epidermidis
LKGPVTRFDGSLKTLYTK

SEQ ID NO: 1809226 - protein, 22 aa, Staphylococcus epidermidis
LKGQILRIGHMGKISPFDILAV

SEQ ID NO: 1809227 - protein, 17 aa, Staphylococcus epidermidis
LKGRSLLKESDFTKEEF

SEQ ID NO: 1809228 - protein, 25 aa, Staphylococcus epidermidis
LKGSDTRSALMWEAVRIMEECKPKW

SEQ ID NO: 1809229 - protein, 18 aa, Staphylococcus epidermidis
LKGSSIGYKDIEFSFVDN

SEQ ID NO: 1809230 - protein, 18 aa, Staphylococcus epidermidis
LKGTWIMSRTDLLEKKAV

SEQ ID NO: 1809231 - protein, 28 aa, Staphylococcus epidermidis
LKGYWWDFDGVYGAQCFDLANQYWYYVT

SEQ ID NO: 1809232 - protein, 20 aa, Staphylococcus epidermidis
LKGYYSRRINHEHRLVYTIK

SEQ ID NO: 1809233 - protein, 22 aa, Staphylococcus epidermidis
LKHFEGTIIFVSHDRYFINQLA

SEQ ID NO: 1809234 - protein, 21 aa, Staphylococcus epidermidis
LKHNVVPCGLGARDTLRLEAG

SEQ ID NO: 1809235 - protein, 19 aa, Staphylococcus epidermidis
LKIASPILENHLDDIIENA

SEQ ID NO: 1809236 - protein, 17 aa, Staphylococcus epidermidis
LKIDFTQFVQRKKKVVQ

SEQ ID NO: 1809237 - protein, 25 aa, Staphylococcus epidermidis
LKIKDIKLGDDFFKLGGDSLKALQL

SEQ ID NO: 1809238 - protein, 17 aa, Staphylococcus epidermidis
LKIKKAFNVKQCGNVLE

SEQ ID NO: 1809239 - protein, 21 aa, Staphylococcus epidermidis
LKIKNGEIVPIEIEILPSSTY

SEQ ID NO: 1809240 - protein, 20 aa, Staphylococcus epidermidis
LKIKNLKASSDYYDKIANAI

SEQ ID NO: 1809241 - protein, 19 aa, Staphylococcus epidermidis
LKIKNLQLMVKIDSYDDES

SEQ ID NO: 1809242 - protein, 17 aa, Staphylococcus epidermidis
LKIKWIEQGDIHSYEDF

SEQ ID NO: 1809243 - protein, 24 aa, Staphylococcus epidermidis
LKINLRDFFPFIEIQEVNEMSQSI

SEQ ID NO: 1809244 - protein, 21 aa, Staphylococcus epidermidis
LKIQKRLYIKLSTTENAPYTY

SEQ ID NO: 1809245 - protein, 17 aa, Staphylococcus epidermidis
LKISFNSKYMMDALKAI

SEQ ID NO: 1809246 - protein, 17 aa, Staphylococcus epidermidis
LKISGGGRCNVTNRLPY

SEQ ID NO: 1809247 - protein, 18 aa, Staphylococcus epidermidis
LKIVYALTQEDEMCVCDV

SEQ ID NO: 1809248 - protein, 24 aa, Staphylococcus epidermidis
LKKAKLHPAICFTMLGHHLGLDIN

SEQ ID NO: 1809249 - protein, 22 aa, Staphylococcus epidermidis
LKKCWMLNQMSSFLELREEAII

SEQ ID NO: 1809250 - protein, 17 aa, Staphylococcus epidermidis
LKKDNYEIIKFFIEINE

SEQ ID NO: 1809251 - protein, 21 aa, Staphylococcus epidermidis
LKKELIKFNLLTQERVGLNKP

SEQ ID NO: 1809252 - protein, 20 aa, Staphylococcus epidermidis
LKKELISFNLLTQERVGLNK

SEQ ID NO: 1809253 - protein, 23 aa, Staphylococcus epidermidis
LKKERPECLIGVCGCMSQEESVV

SEQ ID NO: 1809254 - protein, 21 aa, Staphylococcus epidermidis
LKKGFIPYEISIELKPCPEIE

SEQ ID NO: 1809255 - protein, 17 aa, Staphylococcus epidermidis
LKKGGILIIDLMNPAFF

SEQ ID NO: 1809256 - protein, 21 aa, Staphylococcus epidermidis
LKKHFKGYGLNVFSNPKVFNA

SEQ ID NO: 1809257 - protein, 24 aa, Staphylococcus epidermidis
LKKLKEVVARLSINEFKTMLIDES

SEQ ID NO: 1809258 - protein, 22 aa, Staphylococcus epidermidis
LKKLRQTRQLSYIFITHDIQAA

SEQ ID NO: 1809259 - protein, 21 aa, Staphylococcus epidermidis
LKKNANKIFGKNTVNRDEFET

SEQ ID NO: 1809260 - protein, 20 aa, Staphylococcus epidermidis
LKKRNIKFKWYVVGNGKIKK

SEQ ID NO: 1809261 - protein, 19 aa, Staphylococcus epidermidis
LKKSAAKTTALVGGAFTFN

SEQ ID NO: 1809262 - protein, 19 aa, Staphylococcus epidermidis
LKKSELLNIKQNYQIFTNH

SEQ ID NO: 1809263 - protein, 21 aa, Staphylococcus epidermidis
LKKVSGVGCLVINTIKSATSS

SEQ ID NO: 1809264 - protein, 17 aa, Staphylococcus epidermidis
LKKYSLKAEEVGLAYAK

SEQ ID NO: 1809265 - protein, 21 aa, Staphylococcus epidermidis
LKLDGVDALETWKSIKKRTKH

SEQ ID NO: 1809266 - protein, 24 aa, Staphylococcus epidermidis
LKLIKQLVKNGAIALVGNHELRWL

SEQ ID NO: 1809267 - protein, 28 aa, Staphylococcus epidermidis
LKLKDDLKELISLVGREEAVLIFVNRLN

SEQ ID NO: 1809268 - protein, 19 aa, Staphylococcus epidermidis
LKLLKSIHLVKSKRQGQSM

SEQ ID NO: 1809269 - protein, 18 aa, Staphylococcus epidermidis
LKLLKSTYLVKSKRQGQS

SEQ ID NO: 1809270 - protein, 25 aa, Staphylococcus epidermidis
LKLQELRNTLLPKLMSGEIEIPDDI

SEQ ID NO: 1809271 - protein, 20 aa, Staphylococcus epidermidis
LKLQLERFMHKVLESNYYEG

SEQ ID NO: 1809272 - protein, 26 aa, Staphylococcus epidermidis
LKLSHIQLVGLAFNFMCFKSEAPNEK

SEQ ID NO: 1809273 - protein, 20 aa, Staphylococcus epidermidis
LKLSVLTIHQSVPIEDKATI

SEQ ID NO: 1809274 - protein, 19 aa, Staphylococcus epidermidis
LKLTFQMLFIMLREFNQLE

SEQ ID NO: 1809275 - protein, 19 aa, Staphylococcus epidermidis
LKLVGGKLMQVPKELAEKH

SEQ ID NO: 1809276 - protein, 20 aa, Staphylococcus epidermidis
LKNAGLRLKFLKSETSGTAV

SEQ ID NO: 1809277 - protein, 17 aa, Staphylococcus epidermidis
LKNDRPVVKVGISNEAD

SEQ ID NO: 1809278 - protein, 17 aa, Staphylococcus epidermidis
LKNFGCSKIFKEKVSGR

SEQ ID NO: 1809279 - protein, 22 aa, Staphylococcus epidermidis
LKNGKSYILYYGYSGNSHIYIK

SEQ ID NO: 1809280 - protein, 25 aa, Staphylococcus epidermidis
LKNIKSYAIGVGPEYTDLNIKNTRH

SEQ ID NO: 1809281 - protein, 25 aa, Staphylococcus epidermidis
LKNKYGIERELFKLASNENLYGPTP

SEQ ID NO: 1809282 - protein, 19 aa, Staphylococcus epidermidis
LKNSHIVIFDIHAEYESAF

SEQ ID NO: 1809283 - protein, 17 aa, Staphylococcus epidermidis
LKNYKVDVQDTWKNELY

SEQ ID NO: 1809284 - protein, 20 aa, Staphylococcus epidermidis
LKPELVDAFVERRKGKATKE

SEQ ID NO: 1809285 - protein, 31 aa, Staphylococcus epidermidis
LKPFVKTKIKGWMRQLLWMSIYQYVYLDKVP

SEQ ID NO: 1809286 - protein, 17 aa, Staphylococcus epidermidis
LKPGVVGTVLSAQKLSN

SEQ ID NO: 1809287 - protein, 20 aa, Staphylococcus epidermidis
LKPISDEGIGFYNLDDKTAV

SEQ ID NO: 1809288 - protein, 27 aa, Staphylococcus epidermidis
LKPKSVKFTHEFMFARPVNRTPDMIKH

SEQ ID NO: 1809289 - protein, 21 aa, Staphylococcus epidermidis
LKPLIEKGIKVDGLISNPPYI

SEQ ID NO: 1809290 - protein, 17 aa, Staphylococcus epidermidis
LKPLLNEGTVTVGNSCM

SEQ ID NO: 1809291 - protein, 19 aa, Staphylococcus epidermidis
LKPMEEWAQKYVELETNAS

SEQ ID NO: 1809292 - protein, 25 aa, Staphylococcus epidermidis
LKQKIKCPCCNATLTNMTIRKKNHT

SEQ ID NO: 1809293 - protein, 25 aa, Staphylococcus epidermidis
LKQKIKCPCCNATLTNMTVRKKNHI

SEQ ID NO: 1809294 - protein, 18 aa, Staphylococcus epidermidis
LKQLDAGSWFNRKHPEYA

SEQ ID NO: 1809295 - protein, 18 aa, Staphylococcus epidermidis
LKQMVPWEDYHFTTVYTA

SEQ ID NO: 1809296 - protein, 19 aa, Staphylococcus epidermidis
LKQQYSLLKEMPIQFALGT

SEQ ID NO: 1809297 - protein, 25 aa, Staphylococcus epidermidis
LKRAYSKRHKKLFENLGETRTTDWG

SEQ ID NO: 1809298 - protein, 17 aa, Staphylococcus epidermidis
LKREDIFNYLSERKERI

SEQ ID NO: 1809299 - protein, 22 aa, Staphylococcus epidermidis
LKRLILPSIEREIRGDLTQNAE

SEQ ID NO: 1809300 - protein, 18 aa, Staphylococcus epidermidis
LKRQLGVVNSEMKANLSA

SEQ ID NO: 1809301 - protein, 25 aa, Staphylococcus epidermidis
LKSDKSSIMLFILLITGGRFSEVNR

SEQ ID NO: 1809302 - protein, 20 aa, Staphylococcus epidermidis
LKSDVFRKAHKNVRHQSADA

SEQ ID NO: 1809303 - protein, 20 aa, Staphylococcus epidermidis
LKSFHSCGVYGMAAITSIVA

SEQ ID NO: 1809304 - protein, 19 aa, Staphylococcus epidermidis
LKSIIPEDIIKVDEPLKRY

SEQ ID NO: 1809305 - protein, 17 aa, Staphylococcus epidermidis
LKSILNISSPNKLSKIK

SEQ ID NO: 1809306 - protein, 19 aa, Staphylococcus epidermidis
LKSLFGYVNKCEMASLRVH

SEQ ID NO: 1809307 - protein, 21 aa, Staphylococcus epidermidis
LKSLYLTIIDRIDIRKDEHHK

SEQ ID NO: 1809308 - protein, 20 aa, Staphylococcus epidermidis
LKSRFNITIAGGQGHLKGHI

SEQ ID NO: 1809309 - protein, 17 aa, Staphylococcus epidermidis
LKSSFNKKGKDDRFKAK

SEQ ID NO: 1809310 - protein, 20 aa, Staphylococcus epidermidis
LKSSLPLTSIYNRLGFDFGT

SEQ ID NO: 1809311 - protein, 18 aa, Staphylococcus epidermidis
LKTDVLLATYGYLNMNLS

SEQ ID NO: 1809312 - protein, 22 aa, Staphylococcus epidermidis
LKTESDGIELIYHFNESYIDVT

SEQ ID NO: 1809313 - protein, 19 aa, Staphylococcus epidermidis
LKTFADAIAQRGKVELNEK

SEQ ID NO: 1809314 - protein, 21 aa, Staphylococcus epidermidis
LKTFNIVPHYDLNIMKTGQTL

SEQ ID NO: 1809315 - protein, 17 aa, Staphylococcus epidermidis
LKTIRISEIKSYYLNYF

SEQ ID NO: 1809316 - protein, 27 aa, Staphylococcus epidermidis
LKTKINIFLFSCSTLIYPQPLNKKQKS

SEQ ID NO: 1809317 - protein, 20 aa, Staphylococcus epidermidis
LKTKRYTQTYIQRVLMNVLL

SEQ ID NO: 1809318 - protein, 23 aa, Staphylococcus epidermidis
LKTKRYTQTYIQRVLMNVLLNIT

SEQ ID NO: 1809319 - protein, 17 aa, Staphylococcus epidermidis
LKTLHLRIDRSQENAQR

SEQ ID NO: 1809320 - protein, 20 aa, Staphylococcus epidermidis
LKTLPLDHFELHFQKKMKQG

SEQ ID NO: 1809321 - protein, 25 aa, Staphylococcus epidermidis
LKTVQKFPIMYSVMDKLFNYSNPIL

SEQ ID NO: 1809322 - protein, 18 aa, Staphylococcus epidermidis
LKVAQSEGIHFPKQTVDD

SEQ ID NO: 1809323 - protein, 24 aa, Staphylococcus epidermidis
LKVKPELLKFMLKVFKDLEFIYDD

SEQ ID NO: 1809324 - protein, 25 aa, Staphylococcus epidermidis
LKVNLKYNAVYLIKIYKKDNRLKRR

SEQ ID NO: 1809325 - protein, 21 aa, Staphylococcus epidermidis
LKVPAEVGLTEYNHSVNIEPE

SEQ ID NO: 1809326 - protein, 21 aa, Staphylococcus epidermidis
LKVPAEVGLTEYNHSVNIEPK

SEQ ID NO: 1809327 - protein, 17 aa, Staphylococcus epidermidis
LKVQYKQSGQWLLYSNI

SEQ ID NO: 1809328 - protein, 18 aa, Staphylococcus epidermidis
LKVRRRIEAIFKSENLTT

SEQ ID NO: 1809329 - protein, 18 aa, Staphylococcus epidermidis
LKWRGLIYQQTDEQGIED

SEQ ID NO: 1809330 - protein, 20 aa, Staphylococcus epidermidis
LKYDMANSVINQIKDIYSKQ

SEQ ID NO: 1809331 - protein, 18 aa, Staphylococcus epidermidis
LKYNTLPVSHLIYLHSAA

SEQ ID NO: 1809332 - protein, 24 aa, Staphylococcus epidermidis
LLADLELPLAKILSEMEEIGIYTD

SEQ ID NO: 1809333 - protein, 24 aa, Staphylococcus epidermidis
LLARAVARDVGRIMGFDETSLNEI

SEQ ID NO: 1809334 - protein, 25 aa, Staphylococcus epidermidis
LLASKFKNLCVVGDSDQSIYGWRGA

SEQ ID NO: 1809335 - protein, 22 aa, Staphylococcus epidermidis
LLAVRSEMVFSGYVGQSNQEGS

SEQ ID NO: 1809336 - protein, 19 aa, Staphylococcus epidermidis
LLAYKLRLNNQIEPNDMVA

SEQ ID NO: 1809337 - protein, 25 aa, Staphylococcus epidermidis
LLCGCQGVNGGGWAHYVGQEKCRPI

SEQ ID NO: 1809338 - protein, 18 aa, Staphylococcus epidermidis
LLDAVKSYSNLPIDVHLM

SEQ ID NO: 1809339 - protein, 19 aa, Staphylococcus epidermidis
LLDFYKRYKALSEYIDKEY

SEQ ID NO: 1809340 - protein, 26 aa, Staphylococcus epidermidis
LLDLPFGKCHFALAAKPETSRYKKVA

SEQ ID NO: 1809341 - protein, 18 aa, Staphylococcus epidermidis
LLDTPGILWPKFEDEKVG

SEQ ID NO: 1809342 - protein, 21 aa, Staphylococcus epidermidis
LLDTYFDLIINYFKQINNIDE

SEQ ID NO: 1809343 - protein, 18 aa, Staphylococcus epidermidis
LLEAEGFNVHSIRKPSAI

SEQ ID NO: 1809344 - protein, 23 aa, Staphylococcus epidermidis
LLECKQIHFTPVIKCVAGDKHIV

SEQ ID NO: 1809345 - protein, 17 aa, Staphylococcus epidermidis
LLEEKKLSASTINRKMC

SEQ ID NO: 1809346 - protein, 24 aa, Staphylococcus epidermidis
LLEELRPFIFRKIGYLTSNQFDIE

SEQ ID NO: 1809347 - protein, 19 aa, Staphylococcus epidermidis
LLEKACERKGIPFEPKELD

SEQ ID NO: 1809348 - protein, 18 aa, Staphylococcus epidermidis
LLEKACERKGIQFEPKKI

SEQ ID NO: 1809349 - protein, 20 aa, Staphylococcus epidermidis
LLELYPHPRVFVIGKGSSIN

SEQ ID NO: 1809350 - protein, 26 aa, Staphylococcus epidermidis
LLETKITEVLSRLSIEPSEELEQEFQ

SEQ ID NO: 1809351 - protein, 27 aa, Staphylococcus epidermidis
LLEYCNFGCPYFVLRHIPADELIEEVE

SEQ ID NO: 1809352 - protein, 27 aa, Staphylococcus epidermidis
LLGAYLISRLEGVQIFIDQPLSMIDKS

SEQ ID NO: 1809353 - protein, 26 aa, Staphylococcus epidermidis
LLGDFKAPMGCRSFLPSWKDAEGHFE

SEQ ID NO: 1809354 - protein, 26 aa, Staphylococcus epidermidis
LLGEDCRRTMDIFKQLGVTIEEQDNS

SEQ ID NO: 1809355 - protein, 28 aa, Staphylococcus epidermidis
LLGEDCRRTMEIFKLLGVSITENEDTIV

SEQ ID NO: 1809356 - protein, 19 aa, Staphylococcus epidermidis
LLGGKGRRANLYGLINKAI

SEQ ID NO: 1809357 - protein, 18 aa, Staphylococcus epidermidis
LLHLPSEIMTMVREGELS

SEQ ID NO: 1809358 - protein, 19 aa, Staphylococcus epidermidis
LLHLRRLVELKGEKIGVME

SEQ ID NO: 1809359 - protein, 24 aa, Staphylococcus epidermidis
LLIKGENVMNGYLYPKDLKDTFDN

SEQ ID NO: 1809360 - protein, 17 aa, Staphylococcus epidermidis
LLINIGFTVIEPEDPLK

SEQ ID NO: 1809361 - protein, 17 aa, Staphylococcus epidermidis
LLIQKLIFRVREKHSTT

SEQ ID NO: 1809362 - protein, 17 aa, Staphylococcus epidermidis
LLKEGGRLVLVHRAERL

SEQ ID NO: 1809363 - protein, 18 aa, Staphylococcus epidermidis
LLKKYGFIIYFKDPEDMH

SEQ ID NO: 1809364 - protein, 21 aa, Staphylococcus epidermidis
LLKLNPKRIVYISCNPSTQQR

SEQ ID NO: 1809365 - protein, 25 aa, Staphylococcus epidermidis
LLKLNYKSCEGFFLSYEVPHIGHEI

SEQ ID NO: 1809366 - protein, 23 aa, Staphylococcus epidermidis
LLKRGLSCYDDLMIYYVKSLNGL

SEQ ID NO: 1809367 - protein, 44 aa, Staphylococcus epidermidis
LLKRKMIRMPVVLIISPRYNWLSSDAKIIYSMMLELTRTNNPLY

SEQ ID NO: 1809368 - protein, 17 aa, Staphylococcus epidermidis
LLKRLRHLHQLSYIFIT

SEQ ID NO: 1809369 - protein, 22 aa, Staphylococcus epidermidis
LLKSMSKFGFTASFDHCAITGI

SEQ ID NO: 1809370 - protein, 18 aa, Staphylococcus epidermidis
LLKTYGFIIYFKNPDDMY

SEQ ID NO: 1809371 - protein, 17 aa, Staphylococcus epidermidis
LLLAFEESNGYMVEPFV

SEQ ID NO: 1809372 - protein, 18 aa, Staphylococcus epidermidis
LLLESVRLIQDYLRSLNY

SEQ ID NO: 1809373 - protein, 25 aa, Staphylococcus epidermidis
LLLKEIYHFPYVIFYKGTKQLFNQP

SEQ ID NO: 1809374 - protein, 21 aa, Staphylococcus epidermidis
LLLKERVKIAILTNGKSKEQI

SEQ ID NO: 1809375 - protein, 18 aa, Staphylococcus epidermidis
LLLSIAASVGKPVINYVK

SEQ ID NO: 1809376 - protein, 18 aa, Staphylococcus epidermidis
LLMIKSKLLLPQSSIEED

SEQ ID NO: 1809377 - protein, 18 aa, Staphylococcus epidermidis
LLMIKSKLLLPQTSVEDD

SEQ ID NO: 1809378 - protein, 23 aa, Staphylococcus epidermidis
LLMLKTVFIKLEYIQLEKCSYLY

SEQ ID NO: 1809379 - protein, 18 aa, Staphylococcus epidermidis
LLMRGFEIDCRIKHYQGR

SEQ ID NO: 1809380 - protein, 18 aa, Staphylococcus epidermidis
LLNELIKINIVEKTGERP

SEQ ID NO: 1809381 - protein, 18 aa, Staphylococcus epidermidis
LLNGPSVVEVNGQYLSLR

SEQ ID NO: 1809382 - protein, 18 aa, Staphylococcus epidermidis
LLNKLSWSKIKDNAKYYG

SEQ ID NO: 1809383 - protein, 24 aa, Staphylococcus epidermidis
LLNNLRFSKMFFSSNGVKDGVAMT

SEQ ID NO: 1809384 - protein, 18 aa, Staphylococcus epidermidis
LLNRHKFAGYDVNVTAIL

SEQ ID NO: 1809385 - protein, 18 aa, Staphylococcus epidermidis
LLNSLRFGELSVKQNQRL

SEQ ID NO: 1809386 - protein, 17 aa, Staphylococcus epidermidis
LLNSTWQGEEIVIHKDI

SEQ ID NO: 1809387 - protein, 17 aa, Staphylococcus epidermidis
LLNVSIRMMWLSQNQKF

SEQ ID NO: 1809388 - protein, 21 aa, Staphylococcus epidermidis
LLNVYCMMMDYYSLDESMKIA

SEQ ID NO: 1809389 - protein, 21 aa, Staphylococcus epidermidis
LLPDELDDLFELPADELRERL

SEQ ID NO: 1809390 - protein, 17 aa, Staphylococcus epidermidis
LLPEYHLNVKIVLINNG

SEQ ID NO: 1809391 - protein, 17 aa, Staphylococcus epidermidis
LLPNIPHVAVFDTSFHQ

SEQ ID NO: 1809392 - protein, 18 aa, Staphylococcus epidermidis
LLPTHNWGNYKLVFNTRH

SEQ ID NO: 1809393 - protein, 18 aa, Staphylococcus epidermidis
LLPTHNWGNYKLVFSTRH

SEQ ID NO: 1809394 - protein, 17 aa, Staphylococcus epidermidis
LLPTRRDLANFLYHAIQ

SEQ ID NO: 1809395 - protein, 25 aa, Staphylococcus epidermidis
LLQEKSILVAPGIPFGENGNDYVRI

SEQ ID NO: 1809396 - protein, 25 aa, Staphylococcus epidermidis
LLQIKLELDSLVTLHEQIFKSLSKK

SEQ ID NO: 1809397 - protein, 26 aa, Staphylococcus epidermidis
LLQKARSGDTLIVYKLDRISRKYDDV

SEQ ID NO: 1809398 - protein, 24 aa, Staphylococcus epidermidis
LLQRGEVQGVYALRQQIAHYLFNS

SEQ ID NO: 1809399 - protein, 20 aa, Staphylococcus epidermidis
LLQRQFKASCPMEVLTTDIT

SEQ ID NO: 1809400 - protein, 18 aa, Staphylococcus epidermidis
LLRLFTFNDAIFLGNTLR

SEQ ID NO: 1809401 - protein, 20 aa, Staphylococcus epidermidis
LLRMYQRYGEQKGFKVETVD

SEQ ID NO: 1809402 - protein, 19 aa, Staphylococcus epidermidis
LLRNGKLELNDFVITSRGT

SEQ ID NO: 1809403 - protein, 26 aa, Staphylococcus epidermidis
LLRTFSKAYGLAGLRVGYVVASADAI

SEQ ID NO: 1809404 - protein, 18 aa, Staphylococcus epidermidis
LLSECFNNPILQEVNYWG

SEQ ID NO: 1809405 - protein, 20 aa, Staphylococcus epidermidis
LLSPACASWDQYHTFEERGE

SEQ ID NO: 1809406 - protein, 20 aa, Staphylococcus epidermidis
LLSPACASWDQYNTFEERGE

SEQ ID NO: 1809407 - protein, 18 aa, Staphylococcus epidermidis
LLTCASWSTQGLHNRGSF

SEQ ID NO: 1809408 - protein, 17 aa, Staphylococcus epidermidis
LLTEALLSYSKTPIEER

SEQ ID NO: 1809409 - protein, 17 aa, Staphylococcus epidermidis
LLTKMKFIGSLSDHDIT

SEQ ID NO: 1809410 - protein, 18 aa, Staphylococcus epidermidis
LLTMLKRMEMEPITPEIM

SEQ ID NO: 1809411 - protein, 18 aa, Staphylococcus epidermidis
LLTQINLLGWKIKEKMFL

SEQ ID NO: 1809412 - protein, 22 aa, Staphylococcus epidermidis
LLVCDVHSFKIILNDLACAYLD

SEQ ID NO: 1809413 - protein, 27 aa, Staphylococcus epidermidis
LLVFNRKDLVYPFATYNNVMWEFLEGE

SEQ ID NO: 1809414 - protein, 20 aa, Staphylococcus epidermidis
LLYNACKLHLFDEINLKRHT

SEQ ID NO: 1809415 - protein, 24 aa, Staphylococcus epidermidis
LMAREEIAAEWDLEYGDRHTQFVI

SEQ ID NO: 1809416 - protein, 20 aa, Staphylococcus epidermidis
LMEKEIKFIGGVVNDPHKPV

SEQ ID NO: 1809417 - protein, 18 aa, Staphylococcus epidermidis
LMGAKACYPQIIKATLME

SEQ ID NO: 1809418 - protein, 25 aa, Staphylococcus epidermidis
LMGYLFEIIDPYSLNRQGPDIGEKY

SEQ ID NO: 1809419 - protein, 20 aa, Staphylococcus epidermidis
LMGYSFKFDGAISQEVAYQD

SEQ ID NO: 1809420 - protein, 20 aa, Staphylococcus epidermidis
LMIDWKDGREGVLTYDTLDF

SEQ ID NO: 1809421 - protein, 20 aa, Staphylococcus epidermidis
LMIKAFEKFENLPLDTQKQL

SEQ ID NO: 1809422 - protein, 24 aa, Staphylococcus epidermidis
LMLEFQKNGAVAFDYGNNIRQVAY

SEQ ID NO: 1809423 - protein, 18 aa, Staphylococcus epidermidis
LMLLKYDVIQDMLYNLDY

SEQ ID NO: 1809424 - protein, 25 aa, Staphylococcus epidermidis
LMNHDWNDRYCCYYPNHLNHGYYFH

SEQ ID NO: 1809425 - protein, 20 aa, Staphylococcus epidermidis
LMNHLVDISITYVVAQIEAG

SEQ ID NO: 1809426 - protein, 18 aa, Staphylococcus epidermidis
LMNHLVNISIDYVVAQVE

SEQ ID NO: 1809427 - protein, 17 aa, Staphylococcus epidermidis
LMNSEELESLFIETNEK

SEQ ID NO: 1809428 - protein, 17 aa, Staphylococcus epidermidis
LMQLDIGDFPGVGKASK

SEQ ID NO: 1809429 - protein, 17 aa, Staphylococcus epidermidis
LMQLKYVRAIDGSPYKF

SEQ ID NO: 1809430 - protein, 28 aa, Staphylococcus epidermidis
LMQYLKKRHIPMAIATSSYKKNIYPIFK

SEQ ID NO: 1809431 - protein, 22 aa, Staphylococcus epidermidis
LMSKNVRSGFEGARSSVANYIT

SEQ ID NO: 1809432 - protein, 25 aa, Staphylococcus epidermidis
LMSRVRRYPLPLALEVSNVESVMPG

SEQ ID NO: 1809433 - protein, 19 aa, Staphylococcus epidermidis
LMVNYCLQAADILAEDGIN

SEQ ID NO: 1809434 - protein, 19 aa, Staphylococcus epidermidis
LMVNYCLQAADILANDGID

SEQ ID NO: 1809435 - protein, 19 aa, Staphylococcus epidermidis
LMVNYCLQAADILASDGID

SEQ ID NO: 1809436 - protein, 18 aa, Staphylococcus epidermidis
LMYGLPWQSVMAGDNDMY

SEQ ID NO: 1809437 - protein, 22 aa, Staphylococcus epidermidis
LNAHMIKWSKLYVDDFQSSWTM

SEQ ID NO: 1809438 - protein, 25 aa, Staphylococcus epidermidis
LNANYIKARLKDHFEIPYEQYCKHE

SEQ ID NO: 1809439 - protein, 18 aa, Staphylococcus epidermidis
LNAQGKLDVSRAVGTDGS

SEQ ID NO: 1809440 - protein, 22 aa, Staphylococcus epidermidis
LNARLAQSMDFLKENEYERHNL

SEQ ID NO: 1809441 - protein, 25 aa, Staphylococcus epidermidis
LNDEKRQSIKIGDTIVFTNIESPEK

SEQ ID NO: 1809442 - protein, 25 aa, Staphylococcus epidermidis
LNDFKFNELMVGIQSPFLIDEDDDK

SEQ ID NO: 1809443 - protein, 22 aa, Staphylococcus epidermidis
LNDKYKRLAVSDFLTRSMHQHI

SEQ ID NO: 1809444 - protein, 20 aa, Staphylococcus epidermidis
LNDLYRIHLLLDKYSSNKDI

SEQ ID NO: 1809445 - protein, 23 aa, Staphylococcus epidermidis
LNDRVSLSIKNNWIDDNGDIYFI

SEQ ID NO: 1809446 - protein, 22 aa, Staphylococcus epidermidis
LNDRVSLSIKNNWVDDNGDIYF

SEQ ID NO: 1809447 - protein, 23 aa, Staphylococcus epidermidis
LNDRVSLSIKNNWVDDNGDIYFI

SEQ ID NO: 1809448 - protein, 19 aa, Staphylococcus epidermidis
LNDYAKIIMSHNVTSQVRR

SEQ ID NO: 1809449 - protein, 18 aa, Staphylococcus epidermidis
LNDYCGKGSKVLIEGNLK

SEQ ID NO: 1809450 - protein, 19 aa, Staphylococcus epidermidis
LNDYRVMLIHPWQYDHTIG

SEQ ID NO: 1809451 - protein, 17 aa, Staphylococcus epidermidis
LNECKEIKEAIQEKTFN

SEQ ID NO: 1809452 - protein, 18 aa, Staphylococcus epidermidis
LNEETLLFLGTGAIAQRA

SEQ ID NO: 1809453 - protein, 22 aa, Staphylococcus epidermidis
LNEFDKIIGVDRIKVVHVNDSK

SEQ ID NO: 1809454 - protein, 19 aa, Staphylococcus epidermidis
LNEFLPYNYDFVSNVFSDF

SEQ ID NO: 1809455 - protein, 19 aa, Staphylococcus epidermidis
LNEKIKWNFTKFLVDREGN

SEQ ID NO: 1809456 - protein, 23 aa, Staphylococcus epidermidis
LNEKYSLFYFLREMFQDLLHHYI

SEQ ID NO: 1809457 - protein, 18 aa, Staphylococcus epidermidis
LNEPLRRRVPGIELLEEC

SEQ ID NO: 1809458 - protein, 23 aa, Staphylococcus epidermidis
LNERLRESLSLSDVEHVKIFKND

SEQ ID NO: 1809459 - protein, 18 aa, Staphylococcus epidermidis
LNEVKGYIKRREDAKQVM

SEQ ID NO: 1809460 - protein, 20 aa, Staphylococcus epidermidis
LNEWEMSSDELMAFGDANND

SEQ ID NO: 1809461 - protein, 19 aa, Staphylococcus epidermidis
LNEYCIQKDILIIVDEVQT

SEQ ID NO: 1809462 - protein, 18 aa, Staphylococcus epidermidis
LNEYISGCNYDFINSYGL

SEQ ID NO: 1809463 - protein, 24 aa, Staphylococcus epidermidis
LNGEVSLQLGNQVYKACKEDVLYF

SEQ ID NO: 1809464 - protein, 20 aa, Staphylococcus epidermidis
LNGILIKNFNMWRAASTESY

SEQ ID NO: 1809465 - protein, 22 aa, Staphylococcus epidermidis
LNGKVFKVKDMIPGINAPPMHP

SEQ ID NO: 1809466 - protein, 20 aa, Staphylococcus epidermidis
LNGKVFKVKDMMPGVNAPPM

SEQ ID NO: 1809467 - protein, 25 aa, Staphylococcus epidermidis
LNGLKRNIVHMGHFEAGEAINTVPS

SEQ ID NO: 1809468 - protein, 24 aa, Staphylococcus epidermidis
LNGPLDLTFLFGLVSHLSNKLKYL

SEQ ID NO: 1809469 - protein, 17 aa, Staphylococcus epidermidis
LNGVKLLNADKQAAQQS

SEQ ID NO: 1809470 - protein, 27 aa, Staphylococcus epidermidis
LNHGFKSSEVPSAIFGTKKRRPIENGV

SEQ ID NO: 1809471 - protein, 26 aa, Staphylococcus epidermidis
LNHHYLWRFAKKMPKSGHIEIFDRSW

SEQ ID NO: 1809472 - protein, 17 aa, Staphylococcus epidermidis
LNHKAKKVYVVFNNNSG

SEQ ID NO: 1809473 - protein, 20 aa, Staphylococcus epidermidis
LNHLPRYIETTIKGKKVLFI

SEQ ID NO: 1809474 - protein, 17 aa, Staphylococcus epidermidis
LNHPEALALISDELLEG

SEQ ID NO: 1809475 - protein, 18 aa, Staphylococcus epidermidis
LNIAEIFTHPDMVLHLIK

SEQ ID NO: 1809476 - protein, 17 aa, Staphylococcus epidermidis
LNIIGLINIQFVIAHDG

SEQ ID NO: 1809477 - protein, 17 aa, Staphylococcus epidermidis
LNILREFYFYSEDKIQC

SEQ ID NO: 1809478 - protein, 21 aa, Staphylococcus epidermidis
LNIMFPMVATIKEFRDAKSIL

SEQ ID NO: 1809479 - protein, 18 aa, Staphylococcus epidermidis
LNIMGINTAEEFSERLNE

SEQ ID NO: 1809480 - protein, 25 aa, Staphylococcus epidermidis
LNIPELRKRIKLVAEQNYGQIKSIE

SEQ ID NO: 1809481 - protein, 23 aa, Staphylococcus epidermidis
LNIPIAKLNRWGGAIASGHPYGA

SEQ ID NO: 1809482 - protein, 17 aa, Staphylococcus epidermidis
LNIPRYVDKFEEEEPID

SEQ ID NO: 1809483 - protein, 17 aa, Staphylococcus epidermidis
LNKEAIEKLEIIKQEKR

SEQ ID NO: 1809484 - protein, 22 aa, Staphylococcus epidermidis
LNKGEIVGLIGLNGAGKSTTIK

SEQ ID NO: 1809485 - protein, 25 aa, Staphylococcus epidermidis
LNKIEIHKLSLLEIVFSGIENQKGV

SEQ ID NO: 1809486 - protein, 18 aa, Staphylococcus epidermidis
LNKKVGMYSQQAMSQYEG

SEQ ID NO: 1809487 - protein, 23 aa, Staphylococcus epidermidis
LNKLLENQQILALESNKKIQKLE

SEQ ID NO: 1809488 - protein, 23 aa, Staphylococcus epidermidis
LNKLLENQQILSLENNKKIQKLE

SEQ ID NO: 1809489 - protein, 17 aa, Staphylococcus epidermidis
LNKPLFNTFVHDLIDLA

SEQ ID NO: 1809490 - protein, 22 aa, Staphylococcus epidermidis
LNKVGKLIASIYMDEQLDAVVT

SEQ ID NO: 1809491 - protein, 19 aa, Staphylococcus epidermidis
LNLAYSRLGKQVYELEHVT

SEQ ID NO: 1809492 - protein, 17 aa, Staphylococcus epidermidis
LNLFECHADIDIVTSSL

SEQ ID NO: 1809493 - protein, 29 aa, Staphylococcus epidermidis
LNLFKEYHYSARIVLLAWNRYLTDTASNY

SEQ ID NO: 1809494 - protein, 23 aa, Staphylococcus epidermidis
LNLIKGGGGALFREKVIDEMAER

SEQ ID NO: 1809495 - protein, 17 aa, Staphylococcus epidermidis
LNLLRKIEIPLIAFDEA

SEQ ID NO: 1809496 - protein, 18 aa, Staphylococcus epidermidis
LNLPEYLFDAQFEAWQYG

SEQ ID NO: 1809497 - protein, 19 aa, Staphylococcus epidermidis
LNLRDRGWTYLPYTKSRDN

SEQ ID NO: 1809498 - protein, 18 aa, Staphylococcus epidermidis
LNLWRDVTGIDEITQVHA

SEQ ID NO: 1809499 - protein, 21 aa, Staphylococcus epidermidis
LNLYKKFGFSIVGEINKSPFY

SEQ ID NO: 1809500 - protein, 18 aa, Staphylococcus epidermidis
LNNALTFVVETAVNQVGV

SEQ ID NO: 1809501 - protein, 21 aa, Staphylococcus epidermidis
LNNAMKAMRDSIANQEQVRQG

SEQ ID NO: 1809502 - protein, 23 aa, Staphylococcus epidermidis
LNNAMKTLRDGIHNKDDIKRSSA

SEQ ID NO: 1809503 - protein, 18 aa, Staphylococcus epidermidis
LNNIISFEQHKVWRKHVM

SEQ ID NO: 1809504 - protein, 24 aa, Staphylococcus epidermidis
LNNKANHTFLHYYLQGYEESMYTR

SEQ ID NO: 1809505 - protein, 26 aa, Staphylococcus epidermidis
LNNLKRKYGKDISELIAYQGKLEEEI

SEQ ID NO: 1809506 - protein, 25 aa, Staphylococcus epidermidis
LNNLKRKYGKDITELIGYQSKLANE

SEQ ID NO: 1809507 - protein, 17 aa, Staphylococcus epidermidis
LNNLPVIIDDQIQAEAK

SEQ ID NO: 1809508 - protein, 19 aa, Staphylococcus epidermidis
LNNYRVMLIHPWQYNHTIG

SEQ ID NO: 1809509 - protein, 26 aa, Staphylococcus epidermidis
LNPFYYEIPKKYKFADETSLIQALGK

SEQ ID NO: 1809510 - protein, 18 aa, Staphylococcus epidermidis
LNPMRQRIAQNMRQSLNN

SEQ ID NO: 1809511 - protein, 24 aa, Staphylococcus epidermidis
LNQDDIRLALDRAINDKERGLSTY

SEQ ID NO: 1809512 - protein, 24 aa, Staphylococcus epidermidis
LNQLRLKFCLIDILTTHKPIEEIA

SEQ ID NO: 1809513 - protein, 25 aa, Staphylococcus epidermidis
LNQTILGYIPLHWHNDLQLMVVTHG

SEQ ID NO: 1809514 - protein, 19 aa, Staphylococcus epidermidis
LNREDVFTYLSLNKEDATH

SEQ ID NO: 1809515 - protein, 18 aa, Staphylococcus epidermidis
LNRFKPLLNEGTVTVGNS

SEQ ID NO: 1809516 - protein, 17 aa, Staphylococcus epidermidis
LNRKRVKAYPIYNEGVT

SEQ ID NO: 1809517 - protein, 19 aa, Staphylococcus epidermidis
LNRLHRNLKNAIQFFEICK

SEQ ID NO: 1809518 - protein, 21 aa, Staphylococcus epidermidis
LNRLLENQQILALESNKKIQK

SEQ ID NO: 1809519 - protein, 23 aa, Staphylococcus epidermidis
LNRRHFAGYGVNVIAILEIYFPT

SEQ ID NO: 1809520 - protein, 26 aa, Staphylococcus epidermidis
LNRVAEADIWLRENPLEFEWGGESMI

SEQ ID NO: 1809521 - protein, 25 aa, Staphylococcus epidermidis
LNSEMKPRVSIVVDHYEDVSTEEVT

SEQ ID NO: 1809522 - protein, 24 aa, Staphylococcus epidermidis
LNSGNIPAGMELFNSISKSQWEII

SEQ ID NO: 1809523 - protein, 23 aa, Staphylococcus epidermidis
LNSHGKPSGQQIIVFQGTDNNES

SEQ ID NO: 1809524 - protein, 17 aa, Staphylococcus epidermidis
LNSKIRIIKAIPATRNL

SEQ ID NO: 1809525 - protein, 20 aa, Staphylococcus epidermidis
LNSLKPGMYYGNNFINAPVP

SEQ ID NO: 1809526 - protein, 18 aa, Staphylococcus epidermidis
LNSSAYYKYLSRRIGSIV

SEQ ID NO: 1809527 - protein, 17 aa, Staphylococcus epidermidis
LNSYSSYIIGYMKNNSI

SEQ ID NO: 1809528 - protein, 19 aa, Staphylococcus epidermidis
LNTFALFNINLSWIESRPL

SEQ ID NO: 1809529 - protein, 21 aa, Staphylococcus epidermidis
LNTKINTVITMIGEHMDSNER

SEQ ID NO: 1809530 - protein, 18 aa, Staphylococcus epidermidis
LNTMYIRDFEGLRIDAEQ

SEQ ID NO: 1809531 - protein, 19 aa, Staphylococcus epidermidis
LNTPFFIGIMPIASYNNAL

SEQ ID NO: 1809532 - protein, 19 aa, Staphylococcus epidermidis
LNTWLRKPDKFYVNIIELS

SEQ ID NO: 1809533 - protein, 18 aa, Staphylococcus epidermidis
LNVATPVFIDNIGEDDEK

SEQ ID NO: 1809534 - protein, 24 aa, Staphylococcus epidermidis
LNVGENQWGLRDWYSVDDIEEKIA

SEQ ID NO: 1809535 - protein, 17 aa, Staphylococcus epidermidis
LNVINALLYTDSKLIED

SEQ ID NO: 1809536 - protein, 17 aa, Staphylococcus epidermidis
LNVKIVLINNGTLGMVK

SEQ ID NO: 1809537 - protein, 18 aa, Staphylococcus epidermidis
LNVYPTKNLENFYDKEGY

SEQ ID NO: 1809538 - protein, 18 aa, Staphylococcus epidermidis
LNYAIFLEYTIAKKDFSF

SEQ ID NO: 1809539 - protein, 23 aa, Staphylococcus epidermidis
LNYKQARSFKSFVGVLDDDYIMI

SEQ ID NO: 1809540 - protein, 23 aa, Staphylococcus epidermidis
LNYMKPREFCLISVLEGDGKIII

SEQ ID NO: 1809541 - protein, 23 aa, Staphylococcus epidermidis
LNYMKSREFCLVSVLDGQGKLIV

SEQ ID NO: 1809542 - protein, 18 aa, Staphylococcus epidermidis
LPARGRTILGRIAKHTLI

SEQ ID NO: 1809543 - protein, 19 aa, Staphylococcus epidermidis
LPCQFCSYQSVCHVDGMID

SEQ ID NO: 1809544 - protein, 17 aa, Staphylococcus epidermidis
LPDFEKQSIYSLRYDEM

SEQ ID NO: 1809545 - protein, 21 aa, Staphylococcus epidermidis
LPDKKCPTCGNDLIKEGQDIP

SEQ ID NO: 1809546 - protein, 19 aa, Staphylococcus epidermidis
LPDVLEIDEVIALLETPDL

SEQ ID NO: 1809547 - protein, 24 aa, Staphylococcus epidermidis
LPEERLFRKYAHTIRNWDDEEQDK

SEQ ID NO: 1809548 - protein, 24 aa, Staphylococcus epidermidis
LPEIVEIAEEFGLLTYVDDAHGSG

SEQ ID NO: 1809549 - protein, 24 aa, Staphylococcus epidermidis
LPEIYKSIQAQILFNKVAQRPGSV

SEQ ID NO: 1809550 - protein, 17 aa, Staphylococcus epidermidis
LPEPSLAQTFRIDDLDA

SEQ ID NO: 1809551 - protein, 19 aa, Staphylococcus epidermidis
LPESIRFQYLGSVLHGVLM

SEQ ID NO: 1809552 - protein, 22 aa, Staphylococcus epidermidis
LPEVEGKLHGMALRVPTKNVSL

SEQ ID NO: 1809553 - protein, 17 aa, Staphylococcus epidermidis
LPFSMKMNQLLGFDSSF

SEQ ID NO: 1809554 - protein, 20 aa, Staphylococcus epidermidis
LPGESGLVVLDWHNGNRSVL

SEQ ID NO: 1809555 - protein, 17 aa, Staphylococcus epidermidis
LPGKGKSSFAIQKINKG

SEQ ID NO: 1809556 - protein, 18 aa, Staphylococcus epidermidis
LPGPVCTHINDVISSINN

SEQ ID NO: 1809557 - protein, 20 aa, Staphylococcus epidermidis
LPGRSLELGEYFKSELQKIE

SEQ ID NO: 1809558 - protein, 18 aa, Staphylococcus epidermidis
LPHAIKTGMIATKETMEL

SEQ ID NO: 1809559 - protein, 18 aa, Staphylococcus epidermidis
LPHIKVVMLTSFIEDKEV

SEQ ID NO: 1809560 - protein, 17 aa, Staphylococcus epidermidis
LPHPINIVRIRLTGKQL

SEQ ID NO: 1809561 - protein, 18 aa, Staphylococcus epidermidis
LPIGFTLDEQIQFSKKAL

SEQ ID NO: 1809562 - protein, 17 aa, Staphylococcus epidermidis
LPIIAGGTGLYIQSLLY

SEQ ID NO: 1809563 - protein, 17 aa, Staphylococcus epidermidis
LPITKGNNVSLCVTFEN

SEQ ID NO: 1809564 - protein, 22 aa, Staphylococcus epidermidis
LPITNKNLFKYNGKTYEVVGEP

SEQ ID NO: 1809565 - protein, 17 aa, Staphylococcus epidermidis
LPKAKIDANNEIDQKVK

SEQ ID NO: 1809566 - protein, 18 aa, Staphylococcus epidermidis
LPKECLFIGDSYKNDVLG

SEQ ID NO: 1809567 - protein, 19 aa, Staphylococcus epidermidis
LPKEILKQRIETLSGGQFQ

SEQ ID NO: 1809568 - protein, 18 aa, Staphylococcus epidermidis
LPKQFKVNATVKFDSLDE

SEQ ID NO: 1809569 - protein, 25 aa, Staphylococcus epidermidis
LPKSYIFEIASNWKKIGISNAKQAY

SEQ ID NO: 1809570 - protein, 21 aa, Staphylococcus epidermidis
LPKYDGFYWCRKMRQESNVPI

SEQ ID NO: 1809571 - protein, 18 aa, Staphylococcus epidermidis
LPLLTPMSEVAGRMSAQV

SEQ ID NO: 1809572 - protein, 21 aa, Staphylococcus epidermidis
LPLMHIYKMVASFVDEPLEVG

SEQ ID NO: 1809573 - protein, 26 aa, Staphylococcus epidermidis
LPLTDKRVSPLYGELKGLPPVYMYGG

SEQ ID NO: 1809574 - protein, 20 aa, Staphylococcus epidermidis
LPLVKKGGQFLALKSSKGKE

SEQ ID NO: 1809575 - protein, 19 aa, Staphylococcus epidermidis
LPMDIIYRRLDEIPNLRTL

SEQ ID NO: 1809576 - protein, 19 aa, Staphylococcus epidermidis
LPMDIIYRRLDEIPNLRTM

SEQ ID NO: 1809577 - protein, 20 aa, Staphylococcus epidermidis
LPMFGTCAGLIVLAKDVEGE

SEQ ID NO: 1809578 - protein, 17 aa, Staphylococcus epidermidis
LPNAPKEKGIMVLNDDY

SEQ ID NO: 1809579 - protein, 17 aa, Staphylococcus epidermidis
LPNFEKQSIYSLRYDEM

SEQ ID NO: 1809580 - protein, 24 aa, Staphylococcus epidermidis
LPNGVELRNRFVLAPLTHISSNDD

SEQ ID NO: 1809581 - protein, 19 aa, Staphylococcus epidermidis
LPNHAPLIVAEQFGTMETM

SEQ ID NO: 1809582 - protein, 24 aa, Staphylococcus epidermidis
LPNLDYSKIYLFNPNLDKITIFRD

SEQ ID NO: 1809583 - protein, 25 aa, Staphylococcus epidermidis
LPNLKYPTFERFILQMDDFESKFTI

SEQ ID NO: 1809584 - protein, 23 aa, Staphylococcus epidermidis
LPPGTQYIAWTLIDYDAVPVCGF

SEQ ID NO: 1809585 - protein, 19 aa, Staphylococcus epidermidis
LPQIKVVMLTSFIEDKEVY

SEQ ID NO: 1809586 - protein, 19 aa, Staphylococcus epidermidis
LPRPFFILAPMEDVTDIVF

SEQ ID NO: 1809587 - protein, 27 aa, Staphylococcus epidermidis
LPSEESYFLFYINRPSIIVGKNQNTIE

SEQ ID NO: 1809588 - protein, 17 aa, Staphylococcus epidermidis
LPSIEIIMWDERLSTMA

SEQ ID NO: 1809589 - protein, 19 aa, Staphylococcus epidermidis
LPTAGGYGVMICYNDEDLE

SEQ ID NO: 1809590 - protein, 19 aa, Staphylococcus epidermidis
LPTAGGYGVMICYNDTDLA

SEQ ID NO: 1809591 - protein, 27 aa, Staphylococcus epidermidis
LPTTGLRFFTVYGPWGRPDMALFKFTK

SEQ ID NO: 1809592 - protein, 23 aa, Staphylococcus epidermidis
LPVDCKVAKEFSNDAKITEVSID

SEQ ID NO: 1809593 - protein, 20 aa, Staphylococcus epidermidis
LPYLFIKKDVVHYINVDHIE

SEQ ID NO: 1809594 - protein, 18 aa, Staphylococcus epidermidis
LPYVEAIGEAAFYGPKLD

SEQ ID NO: 1809595 - protein, 21 aa, Staphylococcus epidermidis
LQADMSLAIVIGSEGQGMSRL

SEQ ID NO: 1809596 - protein, 17 aa, Staphylococcus epidermidis
LQCPGPIVNISKEINNI

SEQ ID NO: 1809597 - protein, 23 aa, Staphylococcus epidermidis
LQDEFKLSYLFIAHDLSVVKHIS

SEQ ID NO: 1809598 - protein, 25 aa, Staphylococcus epidermidis
LQDKGTEITSIFYPKMFEANPELLN

SEQ ID NO: 1809599 - protein, 29 aa, Staphylococcus epidermidis
LQEAKLPFVHSKGGIYSWLHTPPGYNSEE

SEQ ID NO: 1809600 - protein, 18 aa, Staphylococcus epidermidis
LQELKRKKPHLFTVPQKH

SEQ ID NO: 1809601 - protein, 28 aa, Staphylococcus epidermidis
LQERTQRDYLFFKFAIHTGVKLTELLNM

SEQ ID NO: 1809602 - protein, 18 aa, Staphylococcus epidermidis
LQESTGLEAMTIHRLIGW

SEQ ID NO: 1809603 - protein, 21 aa, Staphylococcus epidermidis
LQFDKERIIVIPPLNKSHGIN

SEQ ID NO: 1809604 - protein, 18 aa, Staphylococcus epidermidis
LQGAVVVFTGHVREWTKG

SEQ ID NO: 1809605 - protein, 17 aa, Staphylococcus epidermidis
LQGFDARIIYHNRKRDL

SEQ ID NO: 1809606 - protein, 18 aa, Staphylococcus epidermidis
LQHLATKHGINFQEMAFK

SEQ ID NO: 1809607 - protein, 37 aa, Staphylococcus epidermidis
LQHLKEAGYHLAIATGRPRTETIIPFESLGLKTYFDD

SEQ ID NO: 1809608 - protein, 18 aa, Staphylococcus epidermidis
LQILKMLFQNEGKYVSRT

SEQ ID NO: 1809609 - protein, 23 aa, Staphylococcus epidermidis
LQILPDKKRYSITVMFDNKGNPL

SEQ ID NO: 1809610 - protein, 20 aa, Staphylococcus epidermidis
LQIPEGVDWNGEEVKVVVGI

SEQ ID NO: 1809611 - protein, 18 aa, Staphylococcus epidermidis
LQKEVDFAVQLGLVDKED

SEQ ID NO: 1809612 - protein, 23 aa, Staphylococcus epidermidis
LQKLTQNVTLMFDGDYAGKEATI

SEQ ID NO: 1809613 - protein, 17 aa, Staphylococcus epidermidis
LQKQVKHKSERHLGYAI

SEQ ID NO: 1809614 - protein, 18 aa, Staphylococcus epidermidis
LQKTGVANVGRFKNNEEE

SEQ ID NO: 1809615 - protein, 17 aa, Staphylococcus epidermidis
LQKTVDVYRSYKSKKEE

SEQ ID NO: 1809616 - protein, 28 aa, Staphylococcus epidermidis
LQLASHAQYRLGIRPEDLHLVEDNEISH

SEQ ID NO: 1809617 - protein, 27 aa, Staphylococcus epidermidis
LQLFEHVMAPLADFPVRKIVDAQHIIA

SEQ ID NO: 1809618 - protein, 18 aa, Staphylococcus epidermidis
LQLIKYEGNMFYRDQLLS

SEQ ID NO: 1809619 - protein, 23 aa, Staphylococcus epidermidis
LQLLKLRSYGCNCIFIESEDRNI

SEQ ID NO: 1809620 - protein, 19 aa, Staphylococcus epidermidis
LQLLTLAAVNGFFEDMMHA

SEQ ID NO: 1809621 - protein, 24 aa, Staphylococcus epidermidis
LQLMMLEPKFAILDEIDSGLDIDA

SEQ ID NO: 1809622 - protein, 17 aa, Staphylococcus epidermidis
LQLPNAVVLPHIGSASR

SEQ ID NO: 1809623 - protein, 17 aa, Staphylococcus epidermidis
LQMVEHEADFGFGQCFK

SEQ ID NO: 1809624 - protein, 25 aa, Staphylococcus epidermidis
LQNRISAYELHEFLIHLTGVLETGY

SEQ ID NO: 1809625 - protein, 17 aa, Staphylococcus epidermidis
LQPAAGAHGEWTALMIF

SEQ ID NO: 1809626 - protein, 17 aa, Staphylococcus epidermidis
LQPLALKAANSIFVGDY

SEQ ID NO: 1809627 - protein, 25 aa, Staphylococcus epidermidis
LQPLNIDMAHGFSYQMELPKIITNV

SEQ ID NO: 1809628 - protein, 18 aa, Staphylococcus epidermidis
LQQQIQFIAQGQMDEERK

SEQ ID NO: 1809629 - protein, 19 aa, Staphylococcus epidermidis
LQRERDITLLFIAHDLSMV

SEQ ID NO: 1809630 - protein, 21 aa, Staphylococcus epidermidis
LQSFQKFIVPFVFLFEKEGNF

SEQ ID NO: 1809631 - protein, 23 aa, Staphylococcus epidermidis
LQSGDFRTPVQFFTYVNDGPYPD

SEQ ID NO: 1809632 - protein, 19 aa, Staphylococcus epidermidis
LQSRLLLGTGKFENEEVQS

SEQ ID NO: 1809633 - protein, 23 aa, Staphylococcus epidermidis
LQSYKRVVGVVSRDKDKMNKIID

SEQ ID NO: 1809634 - protein, 17 aa, Staphylococcus epidermidis
LQTEFKPEMDADQRHKL

SEQ ID NO: 1809635 - protein, 23 aa, Staphylococcus epidermidis
LQTKHSYKIVCRYKESLVTIDFV

SEQ ID NO: 1809636 - protein, 28 aa, Staphylococcus epidermidis
LQTLQLWEGWLKSWGLKDIHLDITAQPP

SEQ ID NO: 1809637 - protein, 24 aa, Staphylococcus epidermidis
LQTRLYGVSSLKALAATVKDDDRL

SEQ ID NO: 1809638 - protein, 23 aa, Staphylococcus epidermidis
LQVNLIRSHACGIGKPFSEEVAL

SEQ ID NO: 1809639 - protein, 17 aa, Staphylococcus epidermidis
LQWLSEIANHFPGKIYL

SEQ ID NO: 1809640 - protein, 19 aa, Staphylococcus epidermidis
LQYPGAPGSGGIAIAKTMI

SEQ ID NO: 1809641 - protein, 24 aa, Staphylococcus epidermidis
LRARRTNLIGAIIPRMNSYAVDET

SEQ ID NO: 1809642 - protein, 17 aa, Staphylococcus epidermidis
LRAVFIHKSISRIQSSN

SEQ ID NO: 1809643 - protein, 18 aa, Staphylococcus epidermidis
LRAVSDFEYELRLTSMNK

SEQ ID NO: 1809644 - protein, 23 aa, Staphylococcus epidermidis
LRCALKDMNIELSAEIKYQRMPE

SEQ ID NO: 1809645 - protein, 26 aa, Staphylococcus epidermidis
LRDETSLRTGVRIVIDVRKDANASVI

SEQ ID NO: 1809646 - protein, 17 aa, Staphylococcus epidermidis
LRDNISPVYDRHEKTEK

SEQ ID NO: 1809647 - protein, 18 aa, Staphylococcus epidermidis
LRDNISPVYDRHEKTEKR

SEQ ID NO: 1809648 - protein, 25 aa, Staphylococcus epidermidis
LRDYKEKLIIPGFFGISKQNDIVTF

SEQ ID NO: 1809649 - protein, 22 aa, Staphylococcus epidermidis
LRDYRKHFEPLIKESNDDFKKH

SEQ ID NO: 1809650 - protein, 19 aa, Staphylococcus epidermidis
LREIKRYASTEVTSIERHN

SEQ ID NO: 1809651 - protein, 17 aa, Staphylococcus epidermidis
LREKGAMTNVLFMTATP

SEQ ID NO: 1809652 - protein, 20 aa, Staphylococcus epidermidis
LRELCRKLNKTIIIVLHDIN

SEQ ID NO: 1809653 - protein, 24 aa, Staphylococcus epidermidis
LRELQSRLGITFIFVTHDQEEALA

SEQ ID NO: 1809654 - protein, 18 aa, Staphylococcus epidermidis
LREPGFFRRLKVMPHAQE

SEQ ID NO: 1809655 - protein, 17 aa, Staphylococcus epidermidis
LRETMEFVISSIGKHLE

SEQ ID NO: 1809656 - protein, 22 aa, Staphylococcus epidermidis
LREYKYIKNCAVLGVDDEELGQ

SEQ ID NO: 1809657 - protein, 25 aa, Staphylococcus epidermidis
LRFGDANLSPGTRLHFVEIPTNDYI

SEQ ID NO: 1809658 - protein, 24 aa, Staphylococcus epidermidis
LRFPEFREEWNIEQVSDFLIESKI

SEQ ID NO: 1809659 - protein, 17 aa, Staphylococcus epidermidis
LRGFYMDYMKDLPGPIY

SEQ ID NO: 1809660 - protein, 20 aa, Staphylococcus epidermidis
LRGMLRRMVGHPKKDIDAYN

SEQ ID NO: 1809661 - protein, 17 aa, Staphylococcus epidermidis
LRHKQLPAFSVQYHPEA

SEQ ID NO: 1809662 - protein, 22 aa, Staphylococcus epidermidis
LRIDQWPSFNKALLKEVIKQLK

SEQ ID NO: 1809663 - protein, 20 aa, Staphylococcus epidermidis
LRIDQWPSFNKALLNEVIKQ

SEQ ID NO: 1809664 - protein, 18 aa, Staphylococcus epidermidis
LRIKDELTIYDRLSFPIY

SEQ ID NO: 1809665 - protein, 20 aa, Staphylococcus epidermidis
LRIKDELTIYDTLSFPIYKK

SEQ ID NO: 1809666 - protein, 23 aa, Staphylococcus epidermidis
LRIPENQKYGAFHGKESFKEAIV

SEQ ID NO: 1809667 - protein, 17 aa, Staphylococcus epidermidis
LRIPLTDIDRGVEYEPL

SEQ ID NO: 1809668 - protein, 21 aa, Staphylococcus epidermidis
LRKADMKNIGTYRARFASYKD

SEQ ID NO: 1809669 - protein, 18 aa, Staphylococcus epidermidis
LRKAFFKNGDTSTKNRTN

SEQ ID NO: 1809670 - protein, 32 aa, Staphylococcus epidermidis
LRKGKDALLKNGRRLKLYHGYNGNSHIYIKGG

SEQ ID NO: 1809671 - protein, 22 aa, Staphylococcus epidermidis
LRKILKSYGIRILDAPLKTGLV

SEQ ID NO: 1809672 - protein, 19 aa, Staphylococcus epidermidis
LRKKLPSYMIPKIYHKIIK

SEQ ID NO: 1809673 - protein, 20 aa, Staphylococcus epidermidis
LRKPDWLKIKLNTNENYTGL

SEQ ID NO: 1809674 - protein, 25 aa, Staphylococcus epidermidis
LRKQYLEEFRKGFKQQIENTKVIDP

SEQ ID NO: 1809675 - protein, 19 aa, Staphylococcus epidermidis
LRKRFYPINNRNYYIRFHG

SEQ ID NO: 1809676 - protein, 19 aa, Staphylococcus epidermidis
LRKSKSFYDRINFKVQNFF

SEQ ID NO: 1809677 - protein, 19 aa, Staphylococcus epidermidis
LRKYARVRLSNNIEINAYI

SEQ ID NO: 1809678 - protein, 20 aa, Staphylococcus epidermidis
LRKYARVRLSNNIEVNAYIP

SEQ ID NO: 1809679 - protein, 19 aa, Staphylococcus epidermidis
LRLITFKLIPLLNQTQGKK

SEQ ID NO: 1809680 - protein, 27 aa, Staphylococcus epidermidis
LRLLINGSDFSTGWIFYIDEEGHHDLV

SEQ ID NO: 1809681 - protein, 20 aa, Staphylococcus epidermidis
LRLLYKNDVLDFYKKGKMAY

SEQ ID NO: 1809682 - protein, 19 aa, Staphylococcus epidermidis
LRLLYYNPIDENGNYIEFT

SEQ ID NO: 1809683 - protein, 26 aa, Staphylococcus epidermidis
LRLPDEVLRLKGYVQFRDHPNATYEF

SEQ ID NO: 1809684 - protein, 18 aa, Staphylococcus epidermidis
LRLPVNVVGIIASAENMI

SEQ ID NO: 1809685 - protein, 20 aa, Staphylococcus epidermidis
LRLTDVGYELGMISEERYAR

SEQ ID NO: 1809686 - protein, 17 aa, Staphylococcus epidermidis
LRMMCQFVDDIDVVVDI

SEQ ID NO: 1809687 - protein, 24 aa, Staphylococcus epidermidis
LRNECMIGEFFKIPPGEHGISATD

SEQ ID NO: 1809688 - protein, 24 aa, Staphylococcus epidermidis
LRNGESLPPEFSRPEVAEVLIKGL

SEQ ID NO: 1809689 - protein, 24 aa, Staphylococcus epidermidis
LRNGSFKILAEFNALNTDYIQIYD

SEQ ID NO: 1809690 - protein, 18 aa, Staphylococcus epidermidis
LRNIMTFLGVPSYETVII

SEQ ID NO: 1809691 - protein, 20 aa, Staphylococcus epidermidis
LRNSDEFIPDLSLVALHKDK

SEQ ID NO: 1809692 - protein, 25 aa, Staphylococcus epidermidis
LRNVRDFNDEVCIEHGLSVPDKDTA

SEQ ID NO: 1809693 - protein, 25 aa, Staphylococcus epidermidis
LRPIRKKVGIVFQFSESQLFEDSVE

SEQ ID NO: 1809694 - protein, 17 aa, Staphylococcus epidermidis
LRPLLTLDKEDIIKKAK

SEQ ID NO: 1809695 - protein, 19 aa, Staphylococcus epidermidis
LRPLYDGLNTVLGREQTQR

SEQ ID NO: 1809696 - protein, 18 aa, Staphylococcus epidermidis
LRPPHRKEVLKAREDDIK

SEQ ID NO: 1809697 - protein, 21 aa, Staphylococcus epidermidis
LRQFNHLHLGFLIERVTSHFV

SEQ ID NO: 1809698 - protein, 17 aa, Staphylococcus epidermidis
LRQIVNLEIPKIAMEGI

SEQ ID NO: 1809699 - protein, 20 aa, Staphylococcus epidermidis
LRQLPTYIRKQFEDIEILSI

SEQ ID NO: 1809700 - protein, 33 aa, Staphylococcus epidermidis
LRRFKEWIKENGYWRYVETNGIIGVALDNPKII

SEQ ID NO: 1809701 - protein, 27 aa, Staphylococcus epidermidis
LRRFTSTEVDLFFTLCNKLKEQDTRKV

SEQ ID NO: 1809702 - protein, 18 aa, Staphylococcus epidermidis
LRRINRKTALLIQLSTQV

SEQ ID NO: 1809703 - protein, 22 aa, Staphylococcus epidermidis
LRRTNPERLLETSIKGMLPSSR

SEQ ID NO: 1809704 - protein, 24 aa, Staphylococcus epidermidis
LRSDEDYLGMAWLATAFNVGARRS

SEQ ID NO: 1809705 - protein, 27 aa, Staphylococcus epidermidis
LRSFGTRVELGIALGKGERVNIGVTDN

SEQ ID NO: 1809706 - protein, 18 aa, Staphylococcus epidermidis
LRSGAMASVAPIINEVKR

SEQ ID NO: 1809707 - protein, 17 aa, Staphylococcus epidermidis
LRSKEAYHGGHIEGTIN

SEQ ID NO: 1809708 - protein, 21 aa, Staphylococcus epidermidis
LRSLQAIALKAANSIFVGDYL

SEQ ID NO: 1809709 - protein, 20 aa, Staphylococcus epidermidis
LRSNMRSEIIKIHKQMKATT

SEQ ID NO: 1809710 - protein, 21 aa, Staphylococcus epidermidis
LRSPKKAFICKDMSKEDQRAT

SEQ ID NO: 1809711 - protein, 19 aa, Staphylococcus epidermidis
LRSTCRRLSVGATIVKDNR

SEQ ID NO: 1809712 - protein, 17 aa, Staphylococcus epidermidis
LRSVSPWDQETVLDSVK

SEQ ID NO: 1809713 - protein, 18 aa, Staphylococcus epidermidis
LRTEVKQLLQQAKDLNSV

SEQ ID NO: 1809714 - protein, 17 aa, Staphylococcus epidermidis
LRTILKKRQRKFRIRIN

SEQ ID NO: 1809715 - protein, 19 aa, Staphylococcus epidermidis
LRVCSFLKQGTLADIGSDH

SEQ ID NO: 1809716 - protein, 18 aa, Staphylococcus epidermidis
LRVMPLFEENYHMYVPKS

SEQ ID NO: 1809717 - protein, 17 aa, Staphylococcus epidermidis
LRVMPLFEENYYMYVPK

SEQ ID NO: 1809718 - protein, 18 aa, Staphylococcus epidermidis
LSAPHAYVNESVQVEFSN

SEQ ID NO: 1809719 - protein, 24 aa, Staphylococcus epidermidis
LSAREMKHRVDIRIQEASFKDPNN

SEQ ID NO: 1809720 - protein, 18 aa, Staphylococcus epidermidis
LSDFNRRYLSGFTGTSGG

SEQ ID NO: 1809721 - protein, 20 aa, Staphylococcus epidermidis
LSDIKVVLNGAGAAGIAIVK

SEQ ID NO: 1809722 - protein, 18 aa, Staphylococcus epidermidis
LSDIRKGLVGQIPDYLKD

SEQ ID NO: 1809723 - protein, 17 aa, Staphylococcus epidermidis
LSDVHGFIFPTDFSSRG

SEQ ID NO: 1809724 - protein, 18 aa, Staphylococcus epidermidis
LSEACKKEGIHLTIPSPV

SEQ ID NO: 1809725 - protein, 26 aa, Staphylococcus epidermidis
LSEEIIEFWKDYGLGTFFEGFMKSIN

SEQ ID NO: 1809726 - protein, 18 aa, Staphylococcus epidermidis
LSEFMSIEPQIRLWDILQ

SEQ ID NO: 1809727 - protein, 32 aa, Staphylococcus epidermidis
LSEKFGVNGIRISIAWSRIFPKGYGEVNAKGV

SEQ ID NO: 1809728 - protein, 24 aa, Staphylococcus epidermidis
LSEKHKNIMFILAQIQYFSLEDHT

SEQ ID NO: 1809729 - protein, 18 aa, Staphylococcus epidermidis
LSELEFVDKYGVNPNKYK

SEQ ID NO: 1809730 - protein, 26 aa, Staphylococcus epidermidis
LSEMKRLGLPVPDGFTITTEACIDYL

SEQ ID NO: 1809731 - protein, 22 aa, Staphylococcus epidermidis
LSERPEYELVLLRENIKNKVLR

SEQ ID NO: 1809732 - protein, 19 aa, Staphylococcus epidermidis
LSESHLNYPITYIEINQQF

SEQ ID NO: 1809733 - protein, 17 aa, Staphylococcus epidermidis
LSEWMSHYHVTKRISVL

SEQ ID NO: 1809734 - protein, 22 aa, Staphylococcus epidermidis
LSEYYLCLKQLITLIDRDQSIN

SEQ ID NO: 1809735 - protein, 22 aa, Staphylococcus epidermidis
LSFPLVLKAYIDAIAVAGKTFK

SEQ ID NO: 1809736 - protein, 19 aa, Staphylococcus epidermidis
LSGAHGRTLLSLKDASKMK

SEQ ID NO: 1809737 - protein, 17 aa, Staphylococcus epidermidis
LSGFEYRYQKEKYDNLT

SEQ ID NO: 1809738 - protein, 28 aa, Staphylococcus epidermidis
LSGKASKGASGWFGRLGGSLLTTIDRFG

SEQ ID NO: 1809739 - protein, 19 aa, Staphylococcus epidermidis
LSGLLVLRMLELCESIPIH

SEQ ID NO: 1809740 - protein, 20 aa, Staphylococcus epidermidis
LSGPKRPQDLIFLSDMKTEF

SEQ ID NO: 1809741 - protein, 17 aa, Staphylococcus epidermidis
LSGREMIEAVKGAVATN

SEQ ID NO: 1809742 - protein, 22 aa, Staphylococcus epidermidis
LSGRPLFERNLQLVKYAYQQTQ

SEQ ID NO: 1809743 - protein, 24 aa, Staphylococcus epidermidis
LSGRSTRSALGMSLISNYKHYRVC

SEQ ID NO: 1809744 - protein, 29 aa, Staphylococcus epidermidis
LSGRVGYHPTWKMILGLFPKEDKVKAMNA

SEQ ID NO: 1809745 - protein, 29 aa, Staphylococcus epidermidis
LSGRVGYHPTWKMVLGLFPKEDKIKAMNA

SEQ ID NO: 1809746 - protein, 22 aa, Staphylococcus epidermidis
LSGRYKNLIIWYLKEKDRRYKQ

SEQ ID NO: 1809747 - protein, 25 aa, Staphylococcus epidermidis
LSGTVRNVVDFGAFVDIGVKQDGLV

SEQ ID NO: 1809748 - protein, 24 aa, Staphylococcus epidermidis
LSHALDVADEFDIQVALHADTLNE

SEQ ID NO: 1809749 - protein, 20 aa, Staphylococcus epidermidis
LSHLRVIVRSLLGIAVPTQI

SEQ ID NO: 1809750 - protein, 17 aa, Staphylococcus epidermidis
LSHRVFQEVGGYTEQRL

SEQ ID NO: 1809751 - protein, 20 aa, Staphylococcus epidermidis
LSIDGLEIYGPPKDRRAGVI

SEQ ID NO: 1809752 - protein, 19 aa, Staphylococcus epidermidis
LSIEIAKKFNGEVISGDSM

SEQ ID NO: 1809753 - protein, 24 aa, Staphylococcus epidermidis
LSIFTVPVDLIFFNGKEMHRQARF

SEQ ID NO: 1809754 - protein, 18 aa, Staphylococcus epidermidis
LSIKKVLLSGDWIHKNLY

SEQ ID NO: 1809755 - protein, 26 aa, Staphylococcus epidermidis
LSILGGEPFCNLSITLQLVEAFRQRF

SEQ ID NO: 1809756 - protein, 17 aa, Staphylococcus epidermidis
LSILKLPHNIMSLMLEY

SEQ ID NO: 1809757 - protein, 20 aa, Staphylococcus epidermidis
LSIYLAYGVLDIIQIFNDLL

SEQ ID NO: 1809758 - protein, 20 aa, Staphylococcus epidermidis
LSKDEFDLFLDLYRETEART

SEQ ID NO: 1809759 - protein, 30 aa, Staphylococcus epidermidis
LSKGYNMSGFRVGFAVGNKEMIQALKKYQT

SEQ ID NO: 1809760 - protein, 17 aa, Staphylococcus epidermidis
LSKIRINEIGFILQSTN

SEQ ID NO: 1809761 - protein, 21 aa, Staphylococcus epidermidis
LSKKECHYMTEGSCWCVQAYH

SEQ ID NO: 1809762 - protein, 17 aa, Staphylococcus epidermidis
LSKLGYKSVAYWSKVQE

SEQ ID NO: 1809763 - protein, 21 aa, Staphylococcus epidermidis
LSKQFPDYGFDKNAGYGTKQH

SEQ ID NO: 1809764 - protein, 18 aa, Staphylococcus epidermidis
LSKQVDGIIFLGGTISEE

SEQ ID NO: 1809765 - protein, 17 aa, Staphylococcus epidermidis
LSKRELEILPLIAKGYG

SEQ ID NO: 1809766 - protein, 17 aa, Staphylococcus epidermidis
LSKSAPTSLAIQLARDL

SEQ ID NO: 1809767 - protein, 22 aa, Staphylococcus epidermidis
LSLEEAYALINWIKDNENRKAL

SEQ ID NO: 1809768 - protein, 22 aa, Staphylococcus epidermidis
LSLLDTPTFLFGMRNGETVEIE

SEQ ID NO: 1809769 - protein, 22 aa, Staphylococcus epidermidis
LSLLLRRPPGREAYPGDVFYLH

SEQ ID NO: 1809770 - protein, 18 aa, Staphylococcus epidermidis
LSLNRDVKGIVTMCAPMD

SEQ ID NO: 1809771 - protein, 17 aa, Staphylococcus epidermidis
LSLVYAETLFKRNGKEE

SEQ ID NO: 1809772 - protein, 18 aa, Staphylococcus epidermidis
LSLYPTKNLEDFYDKEGF

SEQ ID NO: 1809773 - protein, 17 aa, Staphylococcus epidermidis
LSNAGAHVVDKSVVVDN

SEQ ID NO: 1809774 - protein, 28 aa, Staphylococcus epidermidis
LSNDAKIAYAILRDRLELSIQNNWVDQD

SEQ ID NO: 1809775 - protein, 26 aa, Staphylococcus epidermidis
LSNELIYHFISFIVAYTLEENETESV

SEQ ID NO: 1809776 - protein, 18 aa, Staphylococcus epidermidis
LSNFEIREIRIIKSVLLK

SEQ ID NO: 1809777 - protein, 31 aa, Staphylococcus epidermidis
LSNGKVMSGMQKWFHGLTVDSKKAWDKMGKN

SEQ ID NO: 1809778 - protein, 26 aa, Staphylococcus epidermidis
LSNKLRERICDAAIQLMKNIKYVNAG

SEQ ID NO: 1809779 - protein, 23 aa, Staphylococcus epidermidis
LSNYKAVEFWKEEGLDRVVLARE

SEQ ID NO: 1809780 - protein, 25 aa, Staphylococcus epidermidis
LSPNCGLNLSLSHYLNQNHYRNRNR

SEQ ID NO: 1809781 - protein, 20 aa, Staphylococcus epidermidis
LSPQLIEQAFAYRLPVYNSF

SEQ ID NO: 1809782 - protein, 19 aa, Staphylococcus epidermidis
LSPSISINEIDLFIKDISQ

SEQ ID NO: 1809783 - protein, 18 aa, Staphylococcus epidermidis
LSQDVKEPFIFVDNSTQK

SEQ ID NO: 1809784 - protein, 19 aa, Staphylococcus epidermidis
LSQEIYLDLAPVVTTGKNR

SEQ ID NO: 1809785 - protein, 18 aa, Staphylococcus epidermidis
LSQFSNAALIAANVGEID

SEQ ID NO: 1809786 - protein, 26 aa, Staphylococcus epidermidis
LSQGFLVLILLEGYEGVYFWDDGHNF

SEQ ID NO: 1809787 - protein, 18 aa, Staphylococcus epidermidis
LSQLISLELNESTEELKN

SEQ ID NO: 1809788 - protein, 22 aa, Staphylococcus epidermidis
LSQLNMKAPVLVSGTDGVGTKL

SEQ ID NO: 1809789 - protein, 23 aa, Staphylococcus epidermidis
LSQLNMKAPVLVSGTDGVGTKLK

SEQ ID NO: 1809790 - protein, 22 aa, Staphylococcus epidermidis
LSQNLQSRFAVIVPNQNEYKLI

SEQ ID NO: 1809791 - protein, 23 aa, Staphylococcus epidermidis
LSQRMISDLAYFARYSEMPWSPY

SEQ ID NO: 1809792 - protein, 19 aa, Staphylococcus epidermidis
LSRALTFVVETAVNQVGVD

SEQ ID NO: 1809793 - protein, 19 aa, Staphylococcus epidermidis
LSRNLKPSSGVIYLNQQDL

SEQ ID NO: 1809794 - protein, 22 aa, Staphylococcus epidermidis
LSSDLFKGIGKKTAQNIVNALG

SEQ ID NO: 1809795 - protein, 25 aa, Staphylococcus epidermidis
LSSGGKRVRPVFVILSSQFGDSKDT

SEQ ID NO: 1809796 - protein, 17 aa, Staphylococcus epidermidis
LSSKLSLLPADSSLANL

SEQ ID NO: 1809797 - protein, 17 aa, Staphylococcus epidermidis
LSSKSLEGVSIFGDAFS

SEQ ID NO: 1809798 - protein, 23 aa, Staphylococcus epidermidis
LSSKYKIFCFSHAGGSASRFLPW

SEQ ID NO: 1809799 - protein, 27 aa, Staphylococcus epidermidis
LSSLKIYNRWHKFKILIAKKYARLYRI

SEQ ID NO: 1809800 - protein, 17 aa, Staphylococcus epidermidis
LSSRYYTNWDTIEKQVN

SEQ ID NO: 1809801 - protein, 17 aa, Staphylococcus epidermidis
LSSRYYTNWNTIEKQVN

SEQ ID NO: 1809802 - protein, 20 aa, Staphylococcus epidermidis
LSSYYKFKQPSLLYDQQIQK

SEQ ID NO: 1809803 - protein, 17 aa, Staphylococcus epidermidis
LSTDERVLWVTETTTNR

SEQ ID NO: 1809804 - protein, 17 aa, Staphylococcus epidermidis
LSTYSGYIAKNMPENPK

SEQ ID NO: 1809805 - protein, 27 aa, Staphylococcus epidermidis
LSVDCHFPRTSRKLFVEKLKSAQYDLK

SEQ ID NO: 1809806 - protein, 19 aa, Staphylococcus epidermidis
LSVEGIIILVIYHGHEEGK

SEQ ID NO: 1809807 - protein, 25 aa, Staphylococcus epidermidis
LSVELRPSSLDDLGIEAAFNSYFKQ

SEQ ID NO: 1809808 - protein, 20 aa, Staphylococcus epidermidis
LSVHAYSPMYTYKALAKKHK

SEQ ID NO: 1809809 - protein, 25 aa, Staphylococcus epidermidis
LSVIGGRWKIAIVYHLLQSNRLRLS

SEQ ID NO: 1809810 - protein, 19 aa, Staphylococcus epidermidis
LSVKGRVSYAIDYFPDNLN

SEQ ID NO: 1809811 - protein, 18 aa, Staphylococcus epidermidis
LSYHLKKLVDANVLIAEK

SEQ ID NO: 1809812 - protein, 25 aa, Staphylococcus epidermidis
LSYQKLRSGMTMKEIAERQNVKINT

SEQ ID NO: 1809813 - protein, 24 aa, Staphylococcus epidermidis
LSYYLKCHSQFRVIEQSCTHQHLT

SEQ ID NO: 1809814 - protein, 30 aa, Staphylococcus epidermidis
LTAKGYYRRVWRDGKARNRVQVVQLTDGML

SEQ ID NO: 1809815 - protein, 24 aa, Staphylococcus epidermidis
LTAKNSFKLIYSILAKHQSASLPH

SEQ ID NO: 1809816 - protein, 17 aa, Staphylococcus epidermidis
LTALPIGTRYVALTLNN

SEQ ID NO: 1809817 - protein, 26 aa, Staphylococcus epidermidis
LTANAESKERCQLLIKPIRDEILNRI

SEQ ID NO: 1809818 - protein, 18 aa, Staphylococcus epidermidis
LTAWQALFDHYHLQSNDR

SEQ ID NO: 1809819 - protein, 17 aa, Staphylococcus epidermidis
LTCREIVNIMWKDDECG

SEQ ID NO: 1809820 - protein, 23 aa, Staphylococcus epidermidis
LTDEKYFGGSFERLNQLSKVTSL

SEQ ID NO: 1809821 - protein, 24 aa, Staphylococcus epidermidis
LTDFTYQSQCRWYSENKKLKLQLE

SEQ ID NO: 1809822 - protein, 25 aa, Staphylococcus epidermidis
LTDIEIVELLAFISFTHCQQEFGAM

SEQ ID NO: 1809823 - protein, 25 aa, Staphylococcus epidermidis
LTDLEIVELLAFVSFTHCQQEFGAM

SEQ ID NO: 1809824 - protein, 18 aa, Staphylococcus epidermidis
LTDLFVSVIFELNIVKAH

SEQ ID NO: 1809825 - protein, 22 aa, Staphylococcus epidermidis
LTDMLINLLGYVAENERAYIKE

SEQ ID NO: 1809826 - protein, 17 aa, Staphylococcus epidermidis
LTDSFAPYLTMAEGLKL

SEQ ID NO: 1809827 - protein, 26 aa, Staphylococcus epidermidis
LTDWIKNSGGTTFSLSMTASTGGAKN

SEQ ID NO: 1809828 - protein, 24 aa, Staphylococcus epidermidis
LTDYLKKRNCLYVLVDPYLLENLR

SEQ ID NO: 1809829 - protein, 22 aa, Staphylococcus epidermidis
LTEAKFSILMLLLYEENLTLSP

SEQ ID NO: 1809830 - protein, 24 aa, Staphylococcus epidermidis
LTEAKIKADKFIKQLDALNDAQTD

SEQ ID NO: 1809831 - protein, 29 aa, Staphylococcus epidermidis
LTEARSLKFFKYFYTHRGPVMDYRNLTLV

SEQ ID NO: 1809832 - protein, 29 aa, Staphylococcus epidermidis
LTEARSLKFFKYFYTHRGPVMNFNNLVLV

SEQ ID NO: 1809833 - protein, 18 aa, Staphylococcus epidermidis
LTEFEFEVGDAIINKING

SEQ ID NO: 1809834 - protein, 18 aa, Staphylococcus epidermidis
LTELALRFNKGINTDGDA

SEQ ID NO: 1809835 - protein, 24 aa, Staphylococcus epidermidis
LTERSFEMIACMVASWKVGASYVP

SEQ ID NO: 1809836 - protein, 25 aa, Staphylococcus epidermidis
LTESFRRLFKYKKVSKNLIGFMRST

SEQ ID NO: 1809837 - protein, 19 aa, Staphylococcus epidermidis
LTEYGVWHPKAWDNAPRPV

SEQ ID NO: 1809838 - protein, 24 aa, Staphylococcus epidermidis
LTEYGVWHPRAWQSAPRPIPLPNQ

SEQ ID NO: 1809839 - protein, 20 aa, Staphylococcus epidermidis
LTEYNHAINISPKIDTTISL

SEQ ID NO: 1809840 - protein, 19 aa, Staphylococcus epidermidis
LTFDIPENYFIKMGDTKHE

SEQ ID NO: 1809841 - protein, 22 aa, Staphylococcus epidermidis
LTFDKGELVAIVGPSGSGKSTF

SEQ ID NO: 1809842 - protein, 37 aa, Staphylococcus epidermidis
LTFGKDRIGSNIVAFPHINKGLFIPFLDQHSIANYDD

SEQ ID NO: 1809843 - protein, 23 aa, Staphylococcus epidermidis
LTGNFLLAMGLKYLSEISDTRVH

SEQ ID NO: 1809844 - protein, 18 aa, Staphylococcus epidermidis
LTHHVVRKALTYLEDHIP

SEQ ID NO: 1809845 - protein, 17 aa, Staphylococcus epidermidis
LTHKAGLDGVVCSPLEA

SEQ ID NO: 1809846 - protein, 19 aa, Staphylococcus epidermidis
LTHTNARIEPGAFIREQAI

SEQ ID NO: 1809847 - protein, 19 aa, Staphylococcus epidermidis
LTIITESVFARFISSIKEE

SEQ ID NO: 1809848 - protein, 30 aa, Staphylococcus epidermidis
LTKDLFIDWIWGESFFKQKLIDYYAASNVH

SEQ ID NO: 1809849 - protein, 30 aa, Staphylococcus epidermidis
LTKGRLQKDLINWFIDDQFKLFYKKQDLSK

SEQ ID NO: 1809850 - protein, 25 aa, Staphylococcus epidermidis
LTKKDLKTILKNGGLTVGGTKRDLI

SEQ ID NO: 1809851 - protein, 19 aa, Staphylococcus epidermidis
LTKLARIVDKANVLDEAMQ

SEQ ID NO: 1809852 - protein, 17 aa, Staphylococcus epidermidis
LTKRKIVNPKSQKDIQV

SEQ ID NO: 1809853 - protein, 24 aa, Staphylococcus epidermidis
LTKSIPHRIDRVAVVVNPTLELVT

SEQ ID NO: 1809854 - protein, 19 aa, Staphylococcus epidermidis
LTKVRTGAISGVATKYLAK

SEQ ID NO: 1809855 - protein, 17 aa, Staphylococcus epidermidis
LTLAKIKVRADIVYSGN

SEQ ID NO: 1809856 - protein, 21 aa, Staphylococcus epidermidis
LTLGFLASEGIFLKRNDLQSI

SEQ ID NO: 1809857 - protein, 19 aa, Staphylococcus epidermidis
LTLPMKTSVFIPVNDISRH

SEQ ID NO: 1809858 - protein, 25 aa, Staphylococcus epidermidis
LTLTHEFKYQVSRSYMKTFKQQLGL

SEQ ID NO: 1809859 - protein, 25 aa, Staphylococcus epidermidis
LTMAEGLKLAALTFDKDVSKLSCCA

SEQ ID NO: 1809860 - protein, 24 aa, Staphylococcus epidermidis
LTMCYADCVPVYFYSESHGYVGLA

SEQ ID NO: 1809861 - protein, 17 aa, Staphylococcus epidermidis
LTNCCLIDAKDMLENGF

SEQ ID NO: 1809862 - protein, 18 aa, Staphylococcus epidermidis
LTNRIIVIKDGQIVDEFK

SEQ ID NO: 1809863 - protein, 25 aa, Staphylococcus epidermidis
LTPDELRQCKLYWGEGDYTEDDYIY

SEQ ID NO: 1809864 - protein, 20 aa, Staphylococcus epidermidis
LTPVDLWKDHQMTIKVGQDI

SEQ ID NO: 1809865 - protein, 24 aa, Staphylococcus epidermidis
LTQIKELFYDLEITNLQDLHEAQP

SEQ ID NO: 1809866 - protein, 25 aa, Staphylococcus epidermidis
LTRIQFGPLDLKGLNAGEGRVLTPH

SEQ ID NO: 1809867 - protein, 19 aa, Staphylococcus epidermidis
LTRKESFLYAITKEGEECG

SEQ ID NO: 1809868 - protein, 17 aa, Staphylococcus epidermidis
LTSFKASQLLSQEENIK

SEQ ID NO: 1809869 - protein, 24 aa, Staphylococcus epidermidis
LTSGWTGDVKYHLGGVKTTDSYGT

SEQ ID NO: 1809870 - protein, 18 aa, Staphylococcus epidermidis
LTSHELNQLINITTHILN

SEQ ID NO: 1809871 - protein, 25 aa, Staphylococcus epidermidis
LTSIYNRLGFDFGTVGNHEFNYGLP

SEQ ID NO: 1809872 - protein, 19 aa, Staphylococcus epidermidis
LTSQLSIYLAYGVLDIIQI

SEQ ID NO: 1809873 - protein, 20 aa, Staphylococcus epidermidis
LTSREYDLLLFLVNNRNQVL

SEQ ID NO: 1809874 - protein, 18 aa, Staphylococcus epidermidis
LTTALRKAFFNNGDTNTK

SEQ ID NO: 1809875 - protein, 19 aa, Staphylococcus epidermidis
LTTEFYPTQYIKFEEATIN

SEQ ID NO: 1809876 - protein, 18 aa, Staphylococcus epidermidis
LTTHLAIERNKKVLNIDG

SEQ ID NO: 1809877 - protein, 25 aa, Staphylococcus epidermidis
LTWKDLFHDFEMHFYRYVFPYYDTL

SEQ ID NO: 1809878 - protein, 18 aa, Staphylococcus epidermidis
LTYAERYFLMKFFNIPTD

SEQ ID NO: 1809879 - protein, 19 aa, Staphylococcus epidermidis
LTYAERYFLMKFFNIPTDE

SEQ ID NO: 1809880 - protein, 20 aa, Staphylococcus epidermidis
LTYGAEWAYKNNWLGIKTGT

SEQ ID NO: 1809881 - protein, 19 aa, Staphylococcus epidermidis
LTYHPRLILQSNIQTQVLR

SEQ ID NO: 1809882 - protein, 17 aa, Staphylococcus epidermidis
LVAQLTLNFLDGDVDKE

SEQ ID NO: 1809883 - protein, 26 aa, Staphylococcus epidermidis
LVARGFTVKVPPEYLGGQNNKNFINR

SEQ ID NO: 1809884 - protein, 18 aa, Staphylococcus epidermidis
LVDAPCSGLGVLRHKPEI

SEQ ID NO: 1809885 - protein, 21 aa, Staphylococcus epidermidis
LVDEGESLTAPLLNKIMLDVY

SEQ ID NO: 1809886 - protein, 17 aa, Staphylococcus epidermidis
LVDNWKQYLEDYLLNEN

SEQ ID NO: 1809887 - protein, 20 aa, Staphylococcus epidermidis
LVEKLRLLIQQLKQSIHHLK

SEQ ID NO: 1809888 - protein, 19 aa, Staphylococcus epidermidis
LVEMVRPQLSSVIQPLYDI

SEQ ID NO: 1809889 - protein, 25 aa, Staphylococcus epidermidis
LVFERVRYAYNDVLEHFEKNFSREI

SEQ ID NO: 1809890 - protein, 19 aa, Staphylococcus epidermidis
LVFMRDGEIILKENKEELL

SEQ ID NO: 1809891 - protein, 26 aa, Staphylococcus epidermidis
LVGGDCPKVKAKPCITQMKYSVEFLG

SEQ ID NO: 1809892 - protein, 19 aa, Staphylococcus epidermidis
LVHQFKLIFEFMNITHFRF

SEQ ID NO: 1809893 - protein, 25 aa, Staphylococcus epidermidis
LVIPELKGKLDGVSQRVPVSAGSLT

SEQ ID NO: 1809894 - protein, 24 aa, Staphylococcus epidermidis
LVKFLKRKNLLYTYQNFLRYPPKN

SEQ ID NO: 1809895 - protein, 23 aa, Staphylococcus epidermidis
LVKKTFPGYVLVELVMTDESWYV

SEQ ID NO: 1809896 - protein, 25 aa, Staphylococcus epidermidis
LVKRLKKRYRIITTYHSKKRNPTDI

SEQ ID NO: 1809897 - protein, 19 aa, Staphylococcus epidermidis
LVMMVLRLNTLLKGHSGVT

SEQ ID NO: 1809898 - protein, 20 aa, Staphylococcus epidermidis
LVNNGMDYREHVVLKEKYVE

SEQ ID NO: 1809899 - protein, 24 aa, Staphylococcus epidermidis
LVNVLKRFKAMLLQKNETVEAMQG

SEQ ID NO: 1809900 - protein, 21 aa, Staphylococcus epidermidis
LVPAKEEWLKAFLAPTTSLYF

SEQ ID NO: 1809901 - protein, 18 aa, Staphylococcus epidermidis
LVPEGFKVDGIISSNGTT

SEQ ID NO: 1809902 - protein, 29 aa, Staphylococcus epidermidis
LVPGYEAPCYIAWSGKNRSPLVRVPSSRG

SEQ ID NO: 1809903 - protein, 19 aa, Staphylococcus epidermidis
LVPNPAFEVMYNHIQENAK

SEQ ID NO: 1809904 - protein, 18 aa, Staphylococcus epidermidis
LVPNTAWLQDAVELNGRG

SEQ ID NO: 1809905 - protein, 24 aa, Staphylococcus epidermidis
LVQASKLKWIFKFEISSGDKIHCV

SEQ ID NO: 1809906 - protein, 24 aa, Staphylococcus epidermidis
LVRHLEFILTPLVRIHEAKIDFRF

SEQ ID NO: 1809907 - protein, 25 aa, Staphylococcus epidermidis
LVRKEGMFHEVEWEEALQVIANNFE

SEQ ID NO: 1809908 - protein, 19 aa, Staphylococcus epidermidis
LVSAPDVFAALHVGAKVTV

SEQ ID NO: 1809909 - protein, 23 aa, Staphylococcus epidermidis
LVSCPYCSSLVGYVRTSGTVRSY

SEQ ID NO: 1809910 - protein, 17 aa, Staphylococcus epidermidis
LVSGDAVYITDLCILAD

SEQ ID NO: 1809911 - protein, 42 aa, Staphylococcus epidermidis
LVTQIICYDLRFPEILRYPARKGAKIAFYVAQWPNSRLDHWL

SEQ ID NO: 1809912 - protein, 18 aa, Staphylococcus epidermidis
LVVIGKKQGINFSQTLQR

SEQ ID NO: 1809913 - protein, 18 aa, Staphylococcus epidermidis
LVVPKIPISTGITEASKI

SEQ ID NO: 1809914 - protein, 27 aa, Staphylococcus epidermidis
LVWATAAPGWQKWVWSPFLSILGTGAT

SEQ ID NO: 1809915 - protein, 25 aa, Staphylococcus epidermidis
LVYIKSGNEPIIFAGSRSGMPIPAR

SEQ ID NO: 1809916 - protein, 22 aa, Staphylococcus epidermidis
LVYKAGYSPFYVYEVREGWARV

SEQ ID NO: 1809917 - protein, 18 aa, Staphylococcus epidermidis
LWDKLEISNDDFIRTTEE

SEQ ID NO: 1809918 - protein, 21 aa, Staphylococcus epidermidis
LWDLPNYIFNRYWHFKTTGNA

SEQ ID NO: 1809919 - protein, 19 aa, Staphylococcus epidermidis
LWDSSFSLTNEWINEYKQS

SEQ ID NO: 1809920 - protein, 25 aa, Staphylococcus epidermidis
LWHIYRKIKFIKVLKQTLIIEIARF

SEQ ID NO: 1809921 - protein, 17 aa, Staphylococcus epidermidis
LWLKEVNDIKDTINPTL

SEQ ID NO: 1809922 - protein, 20 aa, Staphylococcus epidermidis
LWQEMIEYGVKNGLIKNQTE

SEQ ID NO: 1809923 - protein, 21 aa, Staphylococcus epidermidis
LWTGKYSSLFGKRAMTTFERY

SEQ ID NO: 1809924 - protein, 20 aa, Staphylococcus epidermidis
LYAECIRLFHSIDISDCPYT

SEQ ID NO: 1809925 - protein, 19 aa, Staphylococcus epidermidis
LYAGCGIVKNSNPDSEVAE

SEQ ID NO: 1809926 - protein, 27 aa, Staphylococcus epidermidis
LYDIIDEFKSLGGYEYEDIETRVVQFY

SEQ ID NO: 1809927 - protein, 26 aa, Staphylococcus epidermidis
LYDSKELFKLIALESQHAGLSWLTIL

SEQ ID NO: 1809928 - protein, 22 aa, Staphylococcus epidermidis
LYDTCKTLESIGVDLLVIRHSQ

SEQ ID NO: 1809929 - protein, 18 aa, Staphylococcus epidermidis
LYDTYGFPVELTEELATQ

SEQ ID NO: 1809930 - protein, 19 aa, Staphylococcus epidermidis
LYECDDCSECSLKQQCTNF

SEQ ID NO: 1809931 - protein, 17 aa, Staphylococcus epidermidis
LYEELIHSRDSFIETYK

SEQ ID NO: 1809932 - protein, 23 aa, Staphylococcus epidermidis
LYEPEIEYAPAISYKMASQKLLG

SEQ ID NO: 1809933 - protein, 22 aa, Staphylococcus epidermidis
LYEPNSLIAWMALGQNSHPTSI

SEQ ID NO: 1809934 - protein, 22 aa, Staphylococcus epidermidis
LYEPNSLISWMALGQNSHPTSI

SEQ ID NO: 1809935 - protein, 18 aa, Staphylococcus epidermidis
LYFKCHLPNTSYARDIYE

SEQ ID NO: 1809936 - protein, 24 aa, Staphylococcus epidermidis
LYIAALKLGIAIIPSSEMLRTKDL

SEQ ID NO: 1809937 - protein, 24 aa, Staphylococcus epidermidis
LYIAGEGLAECYWNDATKTKHSFF

SEQ ID NO: 1809938 - protein, 20 aa, Staphylococcus epidermidis
LYIHDFPIVAIGGINETNVQ

SEQ ID NO: 1809939 - protein, 21 aa, Staphylococcus epidermidis
LYIKLPKPFHIKELKNCRVRN

SEQ ID NO: 1809940 - protein, 27 aa, Staphylococcus epidermidis
LYINMKYLSTWQGWSLVNPDYSKTLNW

SEQ ID NO: 1809941 - protein, 17 aa, Staphylococcus epidermidis
LYIYKLAVIANMKLQSL

SEQ ID NO: 1809942 - protein, 18 aa, Staphylococcus epidermidis
LYKFFLLVARYIKRKEAF

SEQ ID NO: 1809943 - protein, 25 aa, Staphylococcus epidermidis
LYKKNRRSLQIYGFSPCHEISIMLA

SEQ ID NO: 1809944 - protein, 26 aa, Staphylococcus epidermidis
LYLFSGFHRSILPLKLEKYMLSLKLS

SEQ ID NO: 1809945 - protein, 17 aa, Staphylococcus epidermidis
LYLLGLLIISDNKTTFK

SEQ ID NO: 1809946 - protein, 22 aa, Staphylococcus epidermidis
LYLNPRASKFLDDYTEFDRTEL

SEQ ID NO: 1809947 - protein, 17 aa, Staphylococcus epidermidis
LYLSVLGMPGQTAYHGL

SEQ ID NO: 1809948 - protein, 21 aa, Staphylococcus epidermidis
LYMSKICSYAQGFAQMRKASE

SEQ ID NO: 1809949 - protein, 27 aa, Staphylococcus epidermidis
LYNQYPFQLLMRFQYELTELIKHISMY

SEQ ID NO: 1809950 - protein, 20 aa, Staphylococcus epidermidis
LYPELPHSEYICFYPMDKRR

SEQ ID NO: 1809951 - protein, 28 aa, Staphylococcus epidermidis
LYPMDSPGGWQIIGRTPIKVFDLNRSPM

SEQ ID NO: 1809952 - protein, 23 aa, Staphylococcus epidermidis
LYQELPSNFKIMRYHSLISNPNQ

SEQ ID NO: 1809953 - protein, 19 aa, Staphylococcus epidermidis
LYQTLPFDFLSEIVYQWER

SEQ ID NO: 1809954 - protein, 31 aa, Staphylococcus epidermidis
LYRKMLEFYHPEFKKEYVVLAEEGAQSDEDD

SEQ ID NO: 1809955 - protein, 21 aa, Staphylococcus epidermidis
LYTDETFKKFVRVGWITPEQF

SEQ ID NO: 1809956 - protein, 19 aa, Staphylococcus epidermidis
LYTFHKIFSIITLSRQLSE

SEQ ID NO: 1809957 - protein, 17 aa, Staphylococcus epidermidis
LYTTSILEFEPGDHVVV

SEQ ID NO: 1809958 - protein, 19 aa, Staphylococcus epidermidis
LYVDEEWKERVRQTIPELP

SEQ ID NO: 1809959 - protein, 17 aa, Staphylococcus epidermidis
LYVSETITIPAHTTTIV

SEQ ID NO: 1809960 - protein, 17 aa, Staphylococcus epidermidis
LYVSNVMTQPGETDNYD

SEQ ID NO: 1809961 - protein, 18 aa, Staphylococcus epidermidis
LYYFKDKWTQLTYNLPIK

SEQ ID NO: 1809962 - protein, 18 aa, Staphylococcus epidermidis
LYYQCKILGQKGYSGQQI

SEQ ID NO: 1809963 - protein, 21 aa, Staphylococcus epidermidis
MAAYCDKESYEGFANFYIEQA

SEQ ID NO: 1809964 - protein, 18 aa, Staphylococcus epidermidis
MADEPIWVYVKDNHIVGY

SEQ ID NO: 1809965 - protein, 25 aa, Staphylococcus epidermidis
MADIDRFGIQEVIERALEYLKSRNI

SEQ ID NO: 1809966 - protein, 19 aa, Staphylococcus epidermidis
MAGKGSEVGRSFEEIAQII

SEQ ID NO: 1809967 - protein, 24 aa, Staphylococcus epidermidis
MAHNVKKAIIAWGDDDYLRKLEVD

SEQ ID NO: 1809968 - protein, 26 aa, Staphylococcus epidermidis
MAKELEREGFHILAIKDMAGLLKPKA

SEQ ID NO: 1809969 - protein, 20 aa, Staphylococcus epidermidis
MALAAKDIRIEAPIPGTSLV

SEQ ID NO: 1809970 - protein, 19 aa, Staphylococcus epidermidis
MALLFRHFYATSLHNQFMY

SEQ ID NO: 1809971 - protein, 18 aa, Staphylococcus epidermidis
MANERPVILVADGEDTAK

SEQ ID NO: 1809972 - protein, 17 aa, Staphylococcus epidermidis
MAQLVFLLGELDVKDLS

SEQ ID NO: 1809973 - protein, 20 aa, Staphylococcus epidermidis
MASDASKVFKGQKMPGRMGG

SEQ ID NO: 1809974 - protein, 26 aa, Staphylococcus epidermidis
MASFHFDVPCLFAKKAKPSTLKDGFY

SEQ ID NO: 1809975 - protein, 22 aa, Staphylococcus epidermidis
MASLKVPVVAIVIGEGGSGGAL

SEQ ID NO: 1809976 - protein, 23 aa, Staphylococcus epidermidis
MASSGSLPGVWPATTVNGQKHFD

SEQ ID NO: 1809977 - protein, 23 aa, Staphylococcus epidermidis
MAVVLPHGVLFRGAAEGTIRKYL

SEQ ID NO: 1809978 - protein, 24 aa, Staphylococcus epidermidis
MAVVLPHGVLFRGAAEGTIRKYLI

SEQ ID NO: 1809979 - protein, 30 aa, Staphylococcus epidermidis
MDANEFKNYILGLIFYRFLSEKVEESSAKL

SEQ ID NO: 1809980 - protein, 30 aa, Staphylococcus epidermidis
MDANEFKNYILGLIFYRFLSEKVEETSGRL

SEQ ID NO: 1809981 - protein, 18 aa, Staphylococcus epidermidis
MDDALKSVVIGVKSKNIT

SEQ ID NO: 1809982 - protein, 25 aa, Staphylococcus epidermidis
MDDFFYKVIQFWNIEAELLMLLISD

SEQ ID NO: 1809983 - protein, 19 aa, Staphylococcus epidermidis
MDEAIKLADKICIMSKGQV

SEQ ID NO: 1809984 - protein, 25 aa, Staphylococcus epidermidis
MDESAPHMHLHFIPVNHQGRLSART

SEQ ID NO: 1809985 - protein, 17 aa, Staphylococcus epidermidis
MDGLLQLINPVVQSQSD

SEQ ID NO: 1809986 - protein, 17 aa, Staphylococcus epidermidis
MDGRDIGTVVLPDAELK

SEQ ID NO: 1809987 - protein, 17 aa, Staphylococcus epidermidis
MDGRDIGTVVLPNAELK

SEQ ID NO: 1809988 - protein, 22 aa, Staphylococcus epidermidis
MDIAEINGFWVYQNTKNKKFTV

SEQ ID NO: 1809989 - protein, 18 aa, Staphylococcus epidermidis
MDIVISAPFYPAYMTKER

SEQ ID NO: 1809990 - protein, 22 aa, Staphylococcus epidermidis
MDKDIYPTGPIVFQRKSIGLGE

SEQ ID NO: 1809991 - protein, 21 aa, Staphylococcus epidermidis
MDLPHGIHALGYTNVPVKLDK

SEQ ID NO: 1809992 - protein, 17 aa, Staphylococcus epidermidis
MDLPQGIHALGYTNVPV

SEQ ID NO: 1809993 - protein, 24 aa, Staphylococcus epidermidis
MDYKEYRLAKEKLRQLINRRDPYF

SEQ ID NO: 1809994 - protein, 25 aa, Staphylococcus epidermidis
MEAFWPGPISFILPLKSGYLCETVT

SEQ ID NO: 1809995 - protein, 19 aa, Staphylococcus epidermidis
MEARGMVLHINRNTRTTKG

SEQ ID NO: 1809996 - protein, 22 aa, Staphylococcus epidermidis
MEECKPKWIVWENVPDAISRKN

SEQ ID NO: 1809997 - protein, 22 aa, Staphylococcus epidermidis
MEECLDSAIAYHLDEVGEVVNF

SEQ ID NO: 1809998 - protein, 17 aa, Staphylococcus epidermidis
MEHILRAAIDTDETTQK

SEQ ID NO: 1809999 - protein, 26 aa, Staphylococcus epidermidis
MEKARPMDRLLCGDVGYGKTEVAVRA

SEQ ID NO: 1810000 - protein, 18 aa, Staphylococcus epidermidis
MEKLGMTFLDHFEYPNLS

SEQ ID NO: 1810001 - protein, 26 aa, Staphylococcus epidermidis
MEKSRLKALYLSVIDRINIRKDGNHK

SEQ ID NO: 1810002 - protein, 18 aa, Staphylococcus epidermidis
MENKELKEQIEFLESESD

SEQ ID NO: 1810003 - protein, 23 aa, Staphylococcus epidermidis
MERESRFKPGAQEQGGTGIGLVQ

SEQ ID NO: 1810004 - protein, 18 aa, Staphylococcus epidermidis
MERFCCVNQINYIQMNPL

SEQ ID NO: 1810005 - protein, 28 aa, Staphylococcus epidermidis
MERYSNIKFILAHAGGTLPYLKWRINET

SEQ ID NO: 1810006 - protein, 23 aa, Staphylococcus epidermidis
MESIEMGCPVLSYNVRYGPSEII

SEQ ID NO: 1810007 - protein, 23 aa, Staphylococcus epidermidis
MESIEVGCPVIAYDVRYGPGEII

SEQ ID NO: 1810008 - protein, 23 aa, Staphylococcus epidermidis
MESIEVGCPVISYDVRYGPGEII

SEQ ID NO: 1810009 - protein, 19 aa, Staphylococcus epidermidis
MESRGMVLFINRNTRTSKG

SEQ ID NO: 1810010 - protein, 24 aa, Staphylococcus epidermidis
MESYMLKEYYQNYYVLMAVLNSIL

SEQ ID NO: 1810011 - protein, 18 aa, Staphylococcus epidermidis
MEVAGKLIAFPFDHNAEL

SEQ ID NO: 1810012 - protein, 17 aa, Staphylococcus epidermidis
MEVTVLHLADWLMEMQL

SEQ ID NO: 1810013 - protein, 23 aa, Staphylococcus epidermidis
MEVTVLHLADWLMEMQLDRKAGD

SEQ ID NO: 1810014 - protein, 23 aa, Staphylococcus epidermidis
MEVTVLHLAEWLMEMQLDRKAAD

SEQ ID NO: 1810015 - protein, 26 aa, Staphylococcus epidermidis
MFARVFRKHLEGGFIQNIRQVGNDRR

SEQ ID NO: 1810016 - protein, 23 aa, Staphylococcus epidermidis
MFDCVLPTRIARNGTCMTTKGRV

SEQ ID NO: 1810017 - protein, 18 aa, Staphylococcus epidermidis
MFEAGFSLMFVKANSGTD

SEQ ID NO: 1810018 - protein, 21 aa, Staphylococcus epidermidis
MFEHLWRVEIELKRDMVDYWN

SEQ ID NO: 1810019 - protein, 18 aa, Staphylococcus epidermidis
MFKGEVVTSHMIDLLNKY

SEQ ID NO: 1810020 - protein, 19 aa, Staphylococcus epidermidis
MFNMIRYGYETTLSSNFKM

SEQ ID NO: 1810021 - protein, 20 aa, Staphylococcus epidermidis
MFPYPSGAGLHVGHPEGYTA

SEQ ID NO: 1810022 - protein, 22 aa, Staphylococcus epidermidis
MFRFREHRIVAFSGGRFLIHGT

SEQ ID NO: 1810023 - protein, 23 aa, Staphylococcus epidermidis
MFRGELITIHMIKLLQYYSNLGI

SEQ ID NO: 1810024 - protein, 25 aa, Staphylococcus epidermidis
MFVYQGAESFKIWTNQMPDIQTMKQ

SEQ ID NO: 1810025 - protein, 30 aa, Staphylococcus epidermidis; identical to SEQ ID NO: 1660051

SEQ ID NO: 1810026 - protein, 24 aa, Staphylococcus epidermidis
MGARRLKQWVDRPLINKNQINERL

SEQ ID NO: 1810027 - protein, 19 aa, Staphylococcus epidermidis
MGEALPFKQEEIIINGHAI

SEQ ID NO: 1810028 - protein, 26 aa, Staphylococcus epidermidis
MGEGISELFKSMGATHIISGGQTMNP

SEQ ID NO: 1810029 - protein, 23 aa, Staphylococcus epidermidis
MGGHKAGEVASQFVTNELQKRFE

SEQ ID NO: 1810030 - protein, 23 aa, Staphylococcus epidermidis
MGGLNANIATCWFNKRNKINQTD

SEQ ID NO: 1810031 - protein, 26 aa, Staphylococcus epidermidis
MGHSEYYPKFGFEKASNWCIQAPFEV

SEQ ID NO: 1810032 - protein, 24 aa, Staphylococcus epidermidis
MGIANKRSIGFGVAKVLDKLGAKL

SEQ ID NO: 1810033 - protein, 17 aa, Staphylococcus epidermidis
MGIDIDTLVKFNLKKDQ

SEQ ID NO: 1810034 - protein, 18 aa, Staphylococcus epidermidis
MGIIKMKLPIEDLEKTKK

SEQ ID NO: 1810035 - protein, 17 aa, Staphylococcus epidermidis
MGIPSILIFQNGEKLAH

SEQ ID NO: 1810036 - protein, 19 aa, Staphylococcus epidermidis
MGIQVKRFYDVGVSGIHRL

SEQ ID NO: 1810037 - protein, 17 aa, Staphylococcus epidermidis
MGIVVEAEGKTIYHTGD

SEQ ID NO: 1810038 - protein, 22 aa, Staphylococcus epidermidis
MGKCPNCGAWNQMEEIVEKAAN

SEQ ID NO: 1810039 - protein, 17 aa, Staphylococcus epidermidis
MGKGAGTVKHFGLQDKI

SEQ ID NO: 1810040 - protein, 17 aa, Staphylococcus epidermidis
MGKTYHATVTLGMSTTT

SEQ ID NO: 1810041 - protein, 20 aa, Staphylococcus epidermidis
MGLEEKVPFLTQSKLEEQGA

SEQ ID NO: 1810042 - protein, 17 aa, Staphylococcus epidermidis
MGNGRTFLIKTYGCQMN

SEQ ID NO: 1810043 - protein, 18 aa, Staphylococcus epidermidis
MGVNFSSPFPEIKDSNDE

SEQ ID NO: 1810044 - protein, 18 aa, Staphylococcus epidermidis
MGYELGLISEERYAKFNE

SEQ ID NO: 1810045 - protein, 17 aa, Staphylococcus epidermidis
MHEETFGPIAPVMTYSD

SEQ ID NO: 1810046 - protein, 25 aa, Staphylococcus epidermidis
MHGDHIFGLPGLLTSRSFQGGENKP

SEQ ID NO: 1810047 - protein, 18 aa, Staphylococcus epidermidis
MHIGHLKSIMELLKRQGI

SEQ ID NO: 1810048 - protein, 24 aa, Staphylococcus epidermidis
MHPQLKICACLGLTKEEQAEKLKE

SEQ ID NO: 1810049 - protein, 24 aa, Staphylococcus epidermidis
MHRKKPENGFVCYMVGRLILENCK

SEQ ID NO: 1810050 - protein, 22 aa, Staphylococcus epidermidis
MIATGRPYRASQIYYHELNMNT

SEQ ID NO: 1810051 - protein, 19 aa, Staphylococcus epidermidis
MICNDAIELNEYFKDEEVS

SEQ ID NO: 1810052 - protein, 19 aa, Staphylococcus epidermidis
MICNDAIELNEYFQDNEIS

SEQ ID NO: 1810053 - protein, 23 aa, Staphylococcus epidermidis
MIETAKIVLNWLSDNDIQVDLLN

SEQ ID NO: 1810054 - protein, 24 aa, Staphylococcus epidermidis
MIGGKKLKIVNYILDNVHLSNNTM

SEQ ID NO: 1810055 - protein, 22 aa, Staphylococcus epidermidis
MIHRFRELARFEGEDTRVLDKD

SEQ ID NO: 1810056 - protein, 22 aa, Staphylococcus epidermidis
MIKHSRLLEASMLQDLQKQRPT

SEQ ID NO: 1810057 - protein, 22 aa, Staphylococcus epidermidis
MINHIAVKCVFFNQPYLKKKLE

SEQ ID NO: 1810058 - protein, 18 aa, Staphylococcus epidermidis
MIQESKVLITYFTRLQSL

SEQ ID NO: 1810059 - protein, 17 aa, Staphylococcus epidermidis
MIRDIFKKLEITSKYHM

SEQ ID NO: 1810060 - protein, 24 aa, Staphylococcus epidermidis
MIRDLDFDALVPWVSIEGESPVFF

SEQ ID NO: 1810061 - protein, 20 aa, Staphylococcus epidermidis
MIRQDLKPIIFVINNDGYTV

SEQ ID NO: 1810062 - protein, 24 aa, Staphylococcus epidermidis
MISYIKNRVNAMYTNQNLISSKSK

SEQ ID NO: 1810063 - protein, 24 aa, Staphylococcus epidermidis
MITKEYPSELAFVIGNATKYISRS

SEQ ID NO: 1810064 - protein, 20 aa, Staphylococcus epidermidis
MIYPSLSSVAYRAINSKEHI

SEQ ID NO: 1810065 - protein, 19 aa, Staphylococcus epidermidis
MKAKQLDIPFIYLTAKTQE

SEQ ID NO: 1810066 - protein, 18 aa, Staphylococcus epidermidis
MKALLPLVLESLDIHLSD

SEQ ID NO: 1810067 - protein, 17 aa, Staphylococcus epidermidis
MKDIYEYKEVVDLINKR

SEQ ID NO: 1810068 - protein, 17 aa, Staphylococcus epidermidis
MKDLINYDLIKNGIPDE

SEQ ID NO: 1810069 - protein, 18 aa, Staphylococcus epidermidis
MKDLINYDLIKNGIPDES

SEQ ID NO: 1810070 - protein, 19 aa, Staphylococcus epidermidis
MKDLLGGKGANLSEMKRLG

SEQ ID NO: 1810071 - protein, 22 aa, Staphylococcus epidermidis
MKEEPIKLLALITSNYRLYYQC

SEQ ID NO: 1810072 - protein, 25 aa, Staphylococcus epidermidis
MKEIIRRLSKVYGIKSISPVIKTDK

SEQ ID NO: 1810073 - protein, 19 aa, Staphylococcus epidermidis
MKEMCLGAYEHQEYPFENL

SEQ ID NO: 1810074 - protein, 19 aa, Staphylococcus epidermidis
MKGGFADSVTNAFSSGNNV

SEQ ID NO: 1810075 - protein, 17 aa, Staphylococcus epidermidis
MKGKQILGVDPAFRTGC

SEQ ID NO: 1810076 - protein, 17 aa, Staphylococcus epidermidis
MKGMIRGSDAFMFESNH

SEQ ID NO: 1810077 - protein, 17 aa, Staphylococcus epidermidis
MKHCHAFSKNFKSSAKG

SEQ ID NO: 1810078 - protein, 17 aa, Staphylococcus epidermidis
MKHHHIDIYNGIGRIMG

SEQ ID NO: 1810079 - protein, 20 aa, Staphylococcus epidermidis
MKHHHIDIYNGIGRIMGTSI

SEQ ID NO: 1810080 - protein, 25 aa, Staphylococcus epidermidis
MKHVAVNFAKLILCDENHQCELKVD

SEQ ID NO: 1810081 - protein, 22 aa, Staphylococcus epidermidis
MKIPEGFTVREYIELGRYSYGS

SEQ ID NO: 1810082 - protein, 17 aa, Staphylococcus epidermidis
MKIPTIAFYGPHAKEVI

SEQ ID NO: 1810083 - protein, 18 aa, Staphylococcus epidermidis
MKKDIHSVYETWHGVLLY

SEQ ID NO: 1810084 - protein, 18 aa, Staphylococcus epidermidis
MKKGIFSVMNYLLPMQDI

SEQ ID NO: 1810085 - protein, 17 aa, Staphylococcus epidermidis
MKKKLGIIQAVVNKPKL

SEQ ID NO: 1810086 - protein, 23 aa, Staphylococcus epidermidis
MKKYDNCILEISKKYSNDAADKV

SEQ ID NO: 1810087 - protein, 17 aa, Staphylococcus epidermidis
MKLARPFIITKKSRARL

SEQ ID NO: 1810088 - protein, 22 aa, Staphylococcus epidermidis
MKLFSEDRFNVDVLKVEVPVNM

SEQ ID NO: 1810089 - protein, 17 aa, Staphylococcus epidermidis
MKLKKAKLHPAICFTML

SEQ ID NO: 1810090 - protein, 20 aa, Staphylococcus epidermidis
MKMFEFKQNVDLFGKKVILS

SEQ ID NO: 1810091 - protein, 27 aa, Staphylococcus epidermidis
MKQALYCLDCLPSQFDTAQLKEIVDLF

SEQ ID NO: 1810092 - protein, 20 aa, Staphylococcus epidermidis
MKQKESIISAGIYEKYIEAI

SEQ ID NO: 1810093 - protein, 33 aa, Staphylococcus epidermidis
MKRAMKMSYILGQKEAIDYLLLLIDTSHENVLL

SEQ ID NO: 1810094 - protein, 19 aa, Staphylococcus epidermidis
MKRIRNLDFQYVIASDLAS

SEQ ID NO: 1810095 - protein, 21 aa, Staphylococcus epidermidis
MKRVDDIKTYIKHDVPKVMGV

SEQ ID NO: 1810096 - protein, 25 aa, Staphylococcus epidermidis
MKSSARGMFDKGWLFVDDEDVVEFL

SEQ ID NO: 1810097 - protein, 19 aa, Staphylococcus epidermidis
MKTGLPKLDKAYLNNDADK

SEQ ID NO: 1810098 - protein, 19 aa, Staphylococcus epidermidis
MKTSVFIPVNDISRHVNNI

SEQ ID NO: 1810099 - protein, 19 aa, Staphylococcus epidermidis
MKVDICLWTETISNTRYFE

SEQ ID NO: 1810100 - protein, 18 aa, Staphylococcus epidermidis
MKVIHFFNKIENYYESSV

SEQ ID NO: 1810101 - protein, 25 aa, Staphylococcus epidermidis
MKYAKKAVVVGGGYIGIEAAEAFAK

SEQ ID NO: 1810102 - protein, 17 aa, Staphylococcus epidermidis
MKYGVATAQKGFVKKDR

SEQ ID NO: 1810103 - protein, 26 aa, Staphylococcus epidermidis
MKYIKGPDFPTGGIIQGVDGIKKAYE

SEQ ID NO: 1810104 - protein, 25 aa, Staphylococcus epidermidis
MLAIPELFWSIELSKELDTDQLYEE

SEQ ID NO: 1810105 - protein, 25 aa, Staphylococcus epidermidis
MLAKLKVLYEMFGLKMVDNELSDYL

SEQ ID NO: 1810106 - protein, 25 aa, Staphylococcus epidermidis
MLCGCQGVNGGGWAHYVGQEKCRPI

SEQ ID NO: 1810107 - protein, 18 aa, Staphylococcus epidermidis
MLDGLKIANPELDVIEDT

SEQ ID NO: 1810108 - protein, 23 aa, Staphylococcus epidermidis
MLEDCFEIRKCVFVEEQGVPLEN

SEQ ID NO: 1810109 - protein, 19 aa, Staphylococcus epidermidis
MLEEYKKEVSQTISEATDV

SEQ ID NO: 1810110 - protein, 19 aa, Staphylococcus epidermidis
MLGALRLLINGSDFSTGWI

SEQ ID NO: 1810111 - protein, 24 aa, Staphylococcus epidermidis
MLGILKAGAGYIPIDPDYPEERIN

SEQ ID NO: 1810112 - protein, 22 aa, Staphylococcus epidermidis
MLGMFANTLVYRGHPTDDKTWE

SEQ ID NO: 1810113 - protein, 21 aa, Staphylococcus epidermidis
MLGMFANTLVYRGRPHDQKTW

SEQ ID NO: 1810114 - protein, 18 aa, Staphylococcus epidermidis
MLGPTGIGVLYGKRDLLK

SEQ ID NO: 1810115 - protein, 19 aa, Staphylococcus epidermidis
MLKERVLQIAAALQKQGLQ

SEQ ID NO: 1810116 - protein, 18 aa, Staphylococcus epidermidis
MLLEKGFITKLFSKGVRI

SEQ ID NO: 1810117 - protein, 18 aa, Staphylococcus epidermidis
MLLIPEPWLYNKSNDKNV

SEQ ID NO: 1810118 - protein, 29 aa, Staphylococcus epidermidis
MLNFRLKALKLFYKMPMPQWGGDLSELNF

SEQ ID NO: 1810119 - protein, 20 aa, Staphylococcus epidermidis
MLNIDVELRLLKYKYQDENL

SEQ ID NO: 1810120 - protein, 19 aa, Staphylococcus epidermidis
MLNNETWFTASEAVEKGFA

SEQ ID NO: 1810121 - protein, 18 aa, Staphylococcus epidermidis
MLPSSRLGEKQGKKLFVY

SEQ ID NO: 1810122 - protein, 19 aa, Staphylococcus epidermidis
MLSNNVMFRKHVKDSQDEI

SEQ ID NO: 1810123 - protein, 17 aa, Staphylococcus epidermidis
MMERYMLTVPFENISVQ

SEQ ID NO: 1810124 - protein, 20 aa, Staphylococcus epidermidis
MMKLPYRLYVGGKLGSGRQW

SEQ ID NO: 1810125 - protein, 25 aa, Staphylococcus epidermidis
MMNDIKRFDLVLVYKLDRLTRNVRD

SEQ ID NO: 1810126 - protein, 22 aa, Staphylococcus epidermidis
MMVQLWPEFFVEGNVDVQYIIR

SEQ ID NO: 1810127 - protein, 17 aa, Staphylococcus epidermidis
MNAKNFLSEKLYNEREL

SEQ ID NO: 1810128 - protein, 20 aa, Staphylococcus epidermidis
MNALKWVHHYIEYFGGDPNN

SEQ ID NO: 1810129 - protein, 25 aa, Staphylococcus epidermidis
MNANIPLIRLMNKFELKKASNQDLK

SEQ ID NO: 1810130 - protein, 19 aa, Staphylococcus epidermidis
MNDIGCYFLDIQLEADMNG

SEQ ID NO: 1810131 - protein, 25 aa, Staphylococcus epidermidis
MNDIIKIIIEYHLHVAFSIDKIEQI

SEQ ID NO: 1810132 - protein, 27 aa, Staphylococcus epidermidis
MNDLEIPRVLGDIIICTDVAQEQAESY

SEQ ID NO: 1810133 - protein, 24 aa, Staphylococcus epidermidis
MNEKDVRAVLGRFLFVQEDVKKII

SEQ ID NO: 1810134 - protein, 22 aa, Staphylococcus epidermidis
MNENVVGFARYLHTNGGVMYNK

SEQ ID NO: 1810135 - protein, 25 aa, Staphylococcus epidermidis
MNFNNLVLVRFFFKSLTAYLKKHNC

SEQ ID NO: 1810136 - protein, 19 aa, Staphylococcus epidermidis
MNGEGRILVRPSGTEPLVR

SEQ ID NO: 1810137 - protein, 20 aa, Staphylococcus epidermidis
MNGHITLPVLLEMRKDQAFK

SEQ ID NO: 1810138 - protein, 17 aa, Staphylococcus epidermidis
MNGLDPKAVRDVRQLIL

SEQ ID NO: 1810139 - protein, 20 aa, Staphylococcus epidermidis
MNGLDPRAVRDVRELIVKKA

SEQ ID NO: 1810140 - protein, 32 aa, Staphylococcus epidermidis
MNGNLYGHIYIKDCNVRKAFELASPKHTEGLI

SEQ ID NO: 1810141 - protein, 18 aa, Staphylococcus epidermidis
MNIADDIKFHVVIYSENN

SEQ ID NO: 1810142 - protein, 20 aa, Staphylococcus epidermidis
MNRPELQRILKDAKDGYIDC

SEQ ID NO: 1810143 - protein, 19 aa, Staphylococcus epidermidis
MNRPELQRILKDAKEGYID

SEQ ID NO: 1810144 - protein, 25 aa, Staphylococcus epidermidis
MNSGKWNVLTGGFGVIMAVKRSGEW

SEQ ID NO: 1810145 - protein, 20 aa, Staphylococcus epidermidis
MPATRATVVMAVYQMYHTLP

SEQ ID NO: 1810146 - protein, 19 aa, Staphylococcus epidermidis
MPEILEAIKNQFKQYSRNE

SEQ ID NO: 1810147 - protein, 17 aa, Staphylococcus epidermidis
MPFDQKRIISSTEALQL

SEQ ID NO: 1810148 - protein, 17 aa, Staphylococcus epidermidis
MPKRDRLDAGYDIYSAE

SEQ ID NO: 1810149 - protein, 18 aa, Staphylococcus epidermidis
MPLEELIEILTLIYEEED

SEQ ID NO: 1810150 - protein, 19 aa, Staphylococcus epidermidis
MPLLSEKPLFIYISQSGET

SEQ ID NO: 1810151 - protein, 21 aa, Staphylococcus epidermidis
MPLRTEYRTFVNFDTNEVIGT

SEQ ID NO: 1810152 - protein, 24 aa, Staphylococcus epidermidis
MPSILAYNFAMLWNGNNVAYESSP

SEQ ID NO: 1810153 - protein, 20 aa, Staphylococcus epidermidis
MPSVRKYARENGVNIKAVTG

SEQ ID NO: 1810154 - protein, 25 aa, Staphylococcus epidermidis
MPVDKAPRVLGFDAVSVIEKIGDQV

SEQ ID NO: 1810155 - protein, 19 aa, Staphylococcus epidermidis
MPVKGEWKQESYGYDNISF

SEQ ID NO: 1810156 - protein, 18 aa, Staphylococcus epidermidis
MPYDRWKKTMDVNLNSMV

SEQ ID NO: 1810157 - protein, 25 aa, Staphylococcus epidermidis
MQEGELCFGNEPLIRVEAPLIQAQL

SEQ ID NO: 1810158 - protein, 20 aa, Staphylococcus epidermidis
MQELTEYGLIPEDWGGDTIF

SEQ ID NO: 1810159 - protein, 17 aa, Staphylococcus epidermidis
MQKGGVIMDVVNAEQAK

SEQ ID NO: 1810160 - protein, 23 aa, Staphylococcus epidermidis
MQKLAPRVAYLAQIVKDVIEAFS

SEQ ID NO: 1810161 - protein, 26 aa, Staphylococcus epidermidis
MQKYYPNYRYVWSLKNPDKSVIPGNA

SEQ ID NO: 1810162 - protein, 22 aa, Staphylococcus epidermidis
MQNMGMIPRFAGGSKKKNWLEN

SEQ ID NO: 1810163 - protein, 25 aa, Staphylococcus epidermidis
MQNMKAFNYIPFFKSFEMSHLHIDE

SEQ ID NO: 1810164 - protein, 17 aa, Staphylococcus epidermidis
MQPSLRSEYEYPVFSHV

SEQ ID NO: 1810165 - protein, 25 aa, Staphylococcus epidermidis
MQVPLEHIIKFSCKPVQQFYGQYDI

SEQ ID NO: 1810166 - protein, 23 aa, Staphylococcus epidermidis
MRAGELLALKWSDIDFENNTINI

SEQ ID NO: 1810167 - protein, 23 aa, Staphylococcus epidermidis
MREHCSVCHAVLPQIQDLLNEYP

SEQ ID NO: 1810168 - protein, 17 aa, Staphylococcus epidermidis
MREIINFIEYIKSKRNS

SEQ ID NO: 1810169 - protein, 17 aa, Staphylococcus epidermidis
MREPWRVVHVAKDKLGD

SEQ ID NO: 1810170 - protein, 17 aa, Staphylococcus epidermidis
MRFGKYHPDYKRIMMET

SEQ ID NO: 1810171 - protein, 20 aa, Staphylococcus epidermidis
MRGTFLVTKFLLPLMMKQGG

SEQ ID NO: 1810172 - protein, 24 aa, Staphylococcus epidermidis
MRHWDEYQFGYFILMMRDNQKVVG

SEQ ID NO: 1810173 - protein, 22 aa, Staphylococcus epidermidis
MRLHDFRWEASILSQSIKDLKV

SEQ ID NO: 1810174 - protein, 20 aa, Staphylococcus epidermidis
MRLMWQEMMMILKQLKVPSV

SEQ ID NO: 1810175 - protein, 19 aa, Staphylococcus epidermidis
MRPLIQLAYQTYVSKKAIN

SEQ ID NO: 1810176 - protein, 26 aa, Staphylococcus epidermidis
MRRSVRWVGNVIFRMAQFESYQNGQT

SEQ ID NO: 1810177 - protein, 17 aa, Staphylococcus epidermidis
MRTAVKRAKTAISTDAE

SEQ ID NO: 1810178 - protein, 17 aa, Staphylococcus epidermidis
MRTSYENQLAHRFDSKL

SEQ ID NO: 1810179 - protein, 23 aa, Staphylococcus epidermidis
MRYGDDIKALFNYPSQATDETQW

SEQ ID NO: 1810180 - protein, 18 aa, Staphylococcus epidermidis
MRYVMKKKNVDSLPSLIN

SEQ ID NO: 1810181 - protein, 21 aa, Staphylococcus epidermidis
MSAGLFIVGRIKGVARPALVV

SEQ ID NO: 1810182 - protein, 17 aa, Staphylococcus epidermidis
MSAQIGAEFLQKVNGGM

SEQ ID NO: 1810183 - protein, 25 aa, Staphylococcus epidermidis
MSASRAYLRPAMRRRNLDVETRAFV

SEQ ID NO: 1810184 - protein, 18 aa, Staphylococcus epidermidis
MSCEHCRNAVESALAKLN

SEQ ID NO: 1810185 - protein, 17 aa, Staphylococcus epidermidis
MSEACEVLKTPVVSGNV

SEQ ID NO: 1810186 - protein, 26 aa, Staphylococcus epidermidis
MSEERTVEVPVHLVGEAVGAKEGGVV

SEQ ID NO: 1810187 - protein, 23 aa, Staphylococcus epidermidis
MSEFKKENEHLFEQSKPSGRTPD

SEQ ID NO: 1810188 - protein, 23 aa, Staphylococcus epidermidis
MSFSIFFKKEFQKIINTVNKSII

SEQ ID NO: 1810189 - protein, 18 aa, Staphylococcus epidermidis
MSGGTYLTTGIKMPNNSR

SEQ ID NO: 1810190 - protein, 17 aa, Staphylococcus epidermidis
MSGKIAGLLSFVDSEIL

SEQ ID NO: 1810191 - protein, 17 aa, Staphylococcus epidermidis
MSGQVILLLDEIHRLDK

SEQ ID NO: 1810192 - protein, 21 aa, Staphylococcus epidermidis
MSGSLKSMFEQQGIDVIMGKG

SEQ ID NO: 1810193 - protein, 27 aa, Staphylococcus epidermidis
MSIVVLLKCMAKFGFTASFNRCVITGN

SEQ ID NO: 1810194 - protein, 23 aa, Staphylococcus epidermidis
MSKEEILILLTLWEEGSMTLKEM

SEQ ID NO: 1810195 - protein, 22 aa, Staphylococcus epidermidis
MSKLNFESFKLAFRDPDARVKL

SEQ ID NO: 1810196 - protein, 25 aa, Staphylococcus epidermidis
MSNKALFKFEHGAIIRGKKTLFSVD

SEQ ID NO: 1810197 - protein, 19 aa, Staphylococcus epidermidis
MSPLSKIFWMKHEQPEIYN

SEQ ID NO: 1810198 - protein, 18 aa, Staphylococcus epidermidis
MSPYMIVGMIGAIKAGCG

SEQ ID NO: 1810199 - protein, 25 aa, Staphylococcus epidermidis
MSQLCRNILEEGLKVAQSEGIHFPK

SEQ ID NO: 1810200 - protein, 26 aa, Staphylococcus epidermidis
MSQPVILKEEMSVYDAICTIFLEDAG

SEQ ID NO: 1810201 - protein, 30 aa, Staphylococcus epidermidis
MSQQRFKVLANGFVELYGYVTINVDRDVTV

SEQ ID NO: 1810202 - protein, 28 aa, Staphylococcus epidermidis
MSQSEWLKRAEIFIDGFHNFSTLEYRMI

SEQ ID NO: 1810203 - protein, 21 aa, Staphylococcus epidermidis
MSRRIAVDLYDEIIRLKPEWH

SEQ ID NO: 1810204 - protein, 20 aa, Staphylococcus epidermidis
MSRSEGFGDEVKRRIFLGTF

SEQ ID NO: 1810205 - protein, 32 aa, Staphylococcus epidermidis
MSRSEGFGEEVKRRIFLGTFALSSGYYDAYYK

SEQ ID NO: 1810206 - protein, 20 aa, Staphylococcus epidermidis
MSSDELMAFGDANNDKDMLE

SEQ ID NO: 1810207 - protein, 22 aa, Staphylococcus epidermidis
MSSDLYRLWQNAFVVGKDDPVK

SEQ ID NO: 1810208 - protein, 21 aa, Staphylococcus epidermidis
MSVDSKFIYIILLDRAKLSFQ

SEQ ID NO: 1810209 - protein, 18 aa, Staphylococcus epidermidis
MSYFEMFRRAYGDDELDK

SEQ ID NO: 1810210 - protein, 23 aa, Staphylococcus epidermidis
MSYLKVHYPHYFYANILSNVIGS

SEQ ID NO: 1810211 - protein, 19 aa, Staphylococcus epidermidis
MSYSVLKRDYGEFDINTNE

SEQ ID NO: 1810212 - protein, 17 aa, Staphylococcus epidermidis
MTDYCYRNYKMYLQEAI

SEQ ID NO: 1810213 - protein, 17 aa, Staphylococcus epidermidis
MTEEAPVVISSRIRLAR

SEQ ID NO: 1810214 - protein, 28 aa, Staphylococcus epidermidis
MTGKEHIKYFCNILKYDVSQSEIEDLFK

SEQ ID NO: 1810215 - protein, 24 aa, Staphylococcus epidermidis
MTGWTKEDVLAFEDLTHIKVSTKG

SEQ ID NO: 1810216 - protein, 18 aa, Staphylococcus epidermidis
MTHLKIIVKDNIYDLTNP

SEQ ID NO: 1810217 - protein, 17 aa, Staphylococcus epidermidis
MTILKHHINNAIKDLSE

SEQ ID NO: 1810218 - protein, 18 aa, Staphylococcus epidermidis
MTKCTKALIRYVYEVYDI

SEQ ID NO: 1810219 - protein, 24 aa, Staphylococcus epidermidis
MTKCTKALIRYVYEVYDINRIEIR

SEQ ID NO: 1810220 - protein, 17 aa, Staphylococcus epidermidis
MTLKCGIVNLPYGGGKG

SEQ ID NO: 1810221 - protein, 20 aa, Staphylococcus epidermidis
MTLPFPPHKLINYILELNHT

SEQ ID NO: 1810222 - protein, 23 aa, Staphylococcus epidermidis
MTLPKRIGLRDAIISFKPQVLKE

SEQ ID NO: 1810223 - protein, 22 aa, Staphylococcus epidermidis
MTRNMIKRVEILFPVEDKNIGK

SEQ ID NO: 1810224 - protein, 25 aa, Staphylococcus epidermidis
MTSELRKGRQAYVICPLIESSEHLE

SEQ ID NO: 1810225 - protein, 18 aa, Staphylococcus epidermidis
MTTFERYFIEDKVSHKEE

SEQ ID NO: 1810226 - protein, 25 aa, Staphylococcus epidermidis
MVATIKEFRDAKSILLEEKENLLRE

SEQ ID NO: 1810227 - protein, 23 aa, Staphylococcus epidermidis
MVEQIGDYFVWFNEPRGDFYTEQ

SEQ ID NO: 1810228 - protein, 25 aa, Staphylococcus epidermidis
MVFDSKGGFYFTDFRGYSTKPLGGV

SEQ ID NO: 1810229 - protein, 23 aa, Staphylococcus epidermidis
MVQESYDAMAIVHQCREAGLPCY

SEQ ID NO: 1810230 - protein, 19 aa, Staphylococcus epidermidis
MVSDMLWKRMKEFHQHGIY

SEQ ID NO: 1810231 - protein, 18 aa, Staphylococcus epidermidis
MVWYCPPLSPIMSYFEGQ

SEQ ID NO: 1810232 - protein, 18 aa, Staphylococcus epidermidis
MVYGHSYYDYILEIYDYV

SEQ ID NO: 1810233 - protein, 19 aa, Staphylococcus epidermidis
MYDAWRMLKEQVDQNTLEI

SEQ ID NO: 1810234 - protein, 24 aa, Staphylococcus epidermidis
MYDLRLMLESFAFSRLKDQDTQTI

SEQ ID NO: 1810235 - protein, 18 aa, Staphylococcus epidermidis
MYEMTLKVPAEVGLTEYN

SEQ ID NO: 1810236 - protein, 24 aa, Staphylococcus epidermidis
MYFNKRSSNSFLRIYDKKIQQIDT

SEQ ID NO: 1810237 - protein, 24 aa, Staphylococcus epidermidis
MYHIFNMGIGYTIIVDKKDVQTAL

SEQ ID NO: 1810238 - protein, 23 aa, Staphylococcus epidermidis
MYLDTKSGYAYTFTKSGTSYSWK

SEQ ID NO: 1810239 - protein, 19 aa, Staphylococcus epidermidis
MYLGGGFKGERLNKLYKEN

SEQ ID NO: 1810240 - protein, 19 aa, Staphylococcus epidermidis
MYNALSFNFYYLGNKDESV

SEQ ID NO: 1810241 - protein, 19 aa, Staphylococcus epidermidis
MYNIFNMGIGYIVIVDKKD

SEQ ID NO: 1810242 - protein, 25 aa, Staphylococcus epidermidis
MYPQHPRCPYSIMTASRLASEKHVD

SEQ ID NO: 1810243 - protein, 17 aa, Staphylococcus epidermidis
MYREIAFHGGIPDTGFY

SEQ ID NO: 1810244 - protein, 20 aa, Staphylococcus epidermidis
MYRTIILEIMGKHSNLILVD

SEQ ID NO: 1810245 - protein, 18 aa, Staphylococcus epidermidis
NAASGVFVNGHISIEDTR

SEQ ID NO: 1810246 - protein, 22 aa, Staphylococcus epidermidis
NAATGFAHREPGVFGAAWLNKG

SEQ ID NO: 1810247 - protein, 17 aa, Staphylococcus epidermidis
NADLSGVLDVEEAPLVS

SEQ ID NO: 1810248 - protein, 25 aa, Staphylococcus epidermidis
NAEQFRQLFILPQGEFKKFLQSNSK

SEQ ID NO: 1810249 - protein, 23 aa, Staphylococcus epidermidis
NAETEIRGLTSLNEPQKNAEIAK

SEQ ID NO: 1810250 - protein, 19 aa, Staphylococcus epidermidis
NAEVVQMLQMLGFDNGEEL

SEQ ID NO: 1810251 - protein, 27 aa, Staphylococcus epidermidis
NAFTEIKEAPDFITVFLGTNDYGLVGG

SEQ ID NO: 1810252 - protein, 20 aa, Staphylococcus epidermidis
NAGIHKLFIGKDHCIKDDLT

SEQ ID NO: 1810253 - protein, 20 aa, Staphylococcus epidermidis
NAHIGECWGISAHPNGKSEI

SEQ ID NO: 1810254 - protein, 24 aa, Staphylococcus epidermidis
NAHQLLKLKDWHDIELQSLKEQAE

SEQ ID NO: 1810255 - protein, 22 aa, Staphylococcus epidermidis
NAHTTWELGVVWKKDKRLSHAT

SEQ ID NO: 1810256 - protein, 20 aa, Staphylococcus epidermidis
NAIASCGCGSSFKTAKVSGN

SEQ ID NO: 1810257 - protein, 29 aa, Staphylococcus epidermidis
NAIKALCKRLQIPLEEVIVFGDSLNDKSM

SEQ ID NO: 1810258 - protein, 24 aa, Staphylococcus epidermidis
NAIQEFYPDFELDYDVDPDRQQIA

SEQ ID NO: 1810259 - protein, 19 aa, Staphylococcus epidermidis
NAITKAGALAANYPFATID

SEQ ID NO: 1810260 - protein, 19 aa, Staphylococcus epidermidis
NAKLLATMCNMPSVREGLA

SEQ ID NO: 1810261 - protein, 25 aa, Staphylococcus epidermidis
NAKMIRRHPHIFGEAQADSVEDLKE

SEQ ID NO: 1810262 - protein, 22 aa, Staphylococcus epidermidis
NAKMIRRHPHIFGNAHVTSQED

SEQ ID NO: 1810263 - protein, 17 aa, Staphylococcus epidermidis
NAKQEIDNLTGLTNAQK

SEQ ID NO: 1810264 - protein, 20 aa, Staphylococcus epidermidis
NALDLVQFIAPIKTIITDMI

SEQ ID NO: 1810265 - protein, 18 aa, Staphylococcus epidermidis
NALPETFSHKAAVQNSAI

SEQ ID NO: 1810266 - protein, 21 aa, Staphylococcus epidermidis
NANFSKLGLDYTYEALDIPIE

SEQ ID NO: 1810267 - protein, 22 aa, Staphylococcus epidermidis
NANKFYKFAIYGKFGTGKTTFL

SEQ ID NO: 1810268 - protein, 21 aa, Staphylococcus epidermidis
NAPKLEWHVENLRNYAFLQPE

SEQ ID NO: 1810269 - protein, 17 aa, Staphylococcus epidermidis
NAQYFGFTGTPRFEENA

SEQ ID NO: 1810270 - protein, 20 aa, Staphylococcus epidermidis
NARFKYTVDRLGETWVTEEL

SEQ ID NO: 1810271 - protein, 28 aa, Staphylococcus epidermidis
NARVDLSLNVRRVFFSTFDRSELNESYE

SEQ ID NO: 1810272 - protein, 23 aa, Staphylococcus epidermidis
NASGEVLVTMFGLIGSIERSTLI

SEQ ID NO: 1810273 - protein, 21 aa, Staphylococcus epidermidis
NASIAYARRQGWTSPRNGIIG

SEQ ID NO: 1810274 - protein, 33 aa, Staphylococcus epidermidis
NATIHRFTRKLGFDGYSDFKSFLKFENEKKNQL

SEQ ID NO: 1810275 - protein, 21 aa, Staphylococcus epidermidis
NAVLNAIEFLKTRGFTGEQAY

SEQ ID NO: 1810276 - protein, 17 aa, Staphylococcus epidermidis
NAYHYGLEFAVKQFLKA

SEQ ID NO: 1810277 - protein, 18 aa, Staphylococcus epidermidis
NCDFYPEFLEEEITEENG

SEQ ID NO: 1810278 - protein, 24 aa, Staphylococcus epidermidis
NCGIHPEWLYCAKANLVLEPAYTG

SEQ ID NO: 1810279 - protein, 18 aa, Staphylococcus epidermidis
NCYLMDGGGITFGDNVFI

SEQ ID NO: 1810280 - protein, 25 aa, Staphylococcus epidermidis
NCYNAARKELHWCIETFGKDDFYVE

SEQ ID NO: 1810281 - protein, 26 aa, Staphylococcus epidermidis
NDAKACAMITFRLLKHYDDLPSMLNI

SEQ ID NO: 1810282 - protein, 19 aa, Staphylococcus epidermidis
NDALKFQVLEELPNQIKDY

SEQ ID NO: 1810283 - protein, 29 aa, Staphylococcus epidermidis
NDAMRDLRDKLKSTVNPVKASINYQNADY

SEQ ID NO: 1810284 - protein, 38 aa, Staphylococcus epidermidis
NDARFAYDCYRRLLQMFGEVVYGIPMLAFDTYFDDFKN

SEQ ID NO: 1810285 - protein, 19 aa, Staphylococcus epidermidis
NDARFLDAPLIKQTHQTKN

SEQ ID NO: 1810286 - protein, 21 aa, Staphylococcus epidermidis
NDCYAILGLVHTLWKPMPGRF

SEQ ID NO: 1810287 - protein, 24 aa, Staphylococcus epidermidis
NDDALKPFILLVVEKKEEGLKAAN

SEQ ID NO: 1810288 - protein, 24 aa, Staphylococcus epidermidis
NDDFTHWRKIMGAAPISDEERENM

SEQ ID NO: 1810289 - protein, 24 aa, Staphylococcus epidermidis
NDDGLCSICEGIINISNDLRDKSF

SEQ ID NO: 1810290 - protein, 19 aa, Staphylococcus epidermidis
NDDSFKAVAVVIGNKKIVL

SEQ ID NO: 1810291 - protein, 23 aa, Staphylococcus epidermidis
NDEGGEALMILSIDQQATDEVIK

SEQ ID NO: 1810292 - protein, 19 aa, Staphylococcus epidermidis
NDELFRITSKILRVKGDKS

SEQ ID NO: 1810293 - protein, 19 aa, Staphylococcus epidermidis
NDEMMKVIHFFNKIENYYE

SEQ ID NO: 1810294 - protein, 24 aa, Staphylococcus epidermidis
NDEWSRSQLQDWIKEDLVKVNDKV

SEQ ID NO: 1810295 - protein, 26 aa, Staphylococcus epidermidis
NDFGKNVFCPSTYPPLHYTFDHIIIK

SEQ ID NO: 1810296 - protein, 24 aa, Staphylococcus epidermidis
NDFKLKKHQSALRIRVKDNQYEMT

SEQ ID NO: 1810297 - protein, 31 aa, Staphylococcus epidermidis
NDIDSVVLIHACWLAHIEIAMINTRLTRHEM

SEQ ID NO: 1810298 - protein, 19 aa, Staphylococcus epidermidis
NDIFFKGDIVEYFNEKHPL

SEQ ID NO: 1810299 - protein, 37 aa, Staphylococcus epidermidis
NDIFKKRDSMNWNEITEGIGHIPGRHFTLSTEPNMKV

SEQ ID NO: 1810300 - protein, 18 aa, Staphylococcus epidermidis
NDINVAWDLIYKLLNKSN

SEQ ID NO: 1810301 - protein, 21 aa, Staphylococcus epidermidis
NDIRVGKVLYMTVNEPTDEAV

SEQ ID NO: 1810302 - protein, 27 aa, Staphylococcus epidermidis
NDIYDFYSLGFGDPYPISGSHGLGLGD

SEQ ID NO: 1810303 - protein, 18 aa, Staphylococcus epidermidis
NDKGTWIINSKMIVEPKG

SEQ ID NO: 1810304 - protein, 23 aa, Staphylococcus epidermidis
NDKTSYCYKNLKIDFNSTEVKVK

SEQ ID NO: 1810305 - protein, 20 aa, Staphylococcus epidermidis
NDLKRTYVFELNYDAIMNVS

SEQ ID NO: 1810306 - protein, 24 aa, Staphylococcus epidermidis
NDLSVDSYMIWGGVSDIHLMYEER

SEQ ID NO: 1810307 - protein, 17 aa, Staphylococcus epidermidis
NDNVELFGVEAAGEGAN

SEQ ID NO: 1810308 - protein, 19 aa, Staphylococcus epidermidis
NDPAKSWTTNDLKDLHIKD

SEQ ID NO: 1810309 - protein, 27 aa, Staphylococcus epidermidis
NDPSGSFYIWFEFSISINVKKLFNESI

SEQ ID NO: 1810310 - protein, 18 aa, Staphylococcus epidermidis
NDRIKIVNYTDGYTGILS

SEQ ID NO: 1810311 - protein, 17 aa, Staphylococcus epidermidis
NDSEYGLAGGIFSTNIN

SEQ ID NO: 1810312 - protein, 26 aa, Staphylococcus epidermidis
NDSIDPSVIFSRFKNYYEFLIKNKII

SEQ ID NO: 1810313 - protein, 23 aa, Staphylococcus epidermidis
NDSRVKYKFIKPLFYKSTDELHH

SEQ ID NO: 1810314 - protein, 25 aa, Staphylococcus epidermidis
NDSTVCILEAMKLFNEIQAETSGEI

SEQ ID NO: 1810315 - protein, 26 aa, Staphylococcus epidermidis
NDSTVCILEAMKLFNEIQAETTGEIV

SEQ ID NO: 1810316 - protein, 21 aa, Staphylococcus epidermidis
NDTKYGLAGYVIGKDQDTLRK

SEQ ID NO: 1810317 - protein, 26 aa, Staphylococcus epidermidis
NDVFKKAIKPEGMFWNTTQSLIINVT

SEQ ID NO: 1810318 - protein, 24 aa, Staphylococcus epidermidis
NDVNFKLYLGLKHISPYIEDAVKK

SEQ ID NO: 1810319 - protein, 19 aa, Staphylococcus epidermidis
NDVTDEFVEPFIIDNQNNG

SEQ ID NO: 1810320 - protein, 24 aa, Staphylococcus epidermidis
NDWEGWKQLTDCIGDKVQLVGDDL

SEQ ID NO: 1810321 - protein, 23 aa, Staphylococcus epidermidis
NDWKHFGQAGFGYVKFEFPENVK

SEQ ID NO: 1810322 - protein, 17 aa, Staphylococcus epidermidis
NDWTYFQIKLVIVGIER

SEQ ID NO: 1810323 - protein, 23 aa, Staphylococcus epidermidis
NDYGMGSSRDWAAKGTNLLGVKT

SEQ ID NO: 1810324 - protein, 25 aa, Staphylococcus epidermidis
NDYPKWIFKKFEEIFKVVPSKKYQI

SEQ ID NO: 1810325 - protein, 31 aa, Staphylococcus epidermidis
NDYVGRIGIGRVFRGKMRVGDNVSLIKLDGS

SEQ ID NO: 1810326 - protein, 21 aa, Staphylococcus epidermidis
NEAKFKVICANVFDEQGQLPN

SEQ ID NO: 1810327 - protein, 34 aa, Staphylococcus epidermidis
NEDAIKFPSFRPDSWRGKRYLYTGLFDNDKKLKD

SEQ ID NO: 1810328 - protein, 22 aa, Staphylococcus epidermidis
NEDSLKFIGLMDEIDNDIYKKA

SEQ ID NO: 1810329 - protein, 23 aa, Staphylococcus epidermidis
NEDSLKFIGLMDEIDNDMYKKAT

SEQ ID NO: 1810330 - protein, 22 aa, Staphylococcus epidermidis
NEDYPIAIVFNATCYNQQVVTG

SEQ ID NO: 1810331 - protein, 18 aa, Staphylococcus epidermidis
NEEMMKVIHFFNKIENYY

SEQ ID NO: 1810332 - protein, 18 aa, Staphylococcus epidermidis
NEENFSYYDRFRNRIMFP

SEQ ID NO: 1810333 - protein, 28 aa, Staphylococcus epidermidis
NEEQGRYFVRLSFVKTWNKGDEIVNKPE

SEQ ID NO: 1810334 - protein, 24 aa, Staphylococcus epidermidis
NEETIGFIIGPRLNAVGRLEDASL

SEQ ID NO: 1810335 - protein, 22 aa, Staphylococcus epidermidis
NEEYKEIDIYSGTEMDILPDGT

SEQ ID NO: 1810336 - protein, 24 aa, Staphylococcus epidermidis
NEEYVKISLIGSGMRDMSGVASKA

SEQ ID NO: 1810337 - protein, 25 aa, Staphylococcus epidermidis
NEFKELIMKRIEAVKLQKHFTPLQL

SEQ ID NO: 1810338 - protein, 23 aa, Staphylococcus epidermidis
NEFKKAYEYTRPKIEKSVRNDLK

SEQ ID NO: 1810339 - protein, 20 aa, Staphylococcus epidermidis
NEFPDKEVLMSILSNHATAS

SEQ ID NO: 1810340 - protein, 21 aa, Staphylococcus epidermidis
NEGKLDCIMVYKTNRLARNTS

SEQ ID NO: 1810341 - protein, 22 aa, Staphylococcus epidermidis
NEGKLNVAFAYIDWKNSEFDPM

SEQ ID NO: 1810342 - protein, 24 aa, Staphylococcus epidermidis
NEGSTPLIYCEKLSKKLDIELYVK

SEQ ID NO: 1810343 - protein, 20 aa, Staphylococcus epidermidis
NEGYSLVGCMCQPAFEFEHF

SEQ ID NO: 1810344 - protein, 18 aa, Staphylococcus epidermidis
NEHLIFFNIAASMGSIRF

SEQ ID NO: 1810345 - protein, 32 aa, Staphylococcus epidermidis
NEHLLSLKVARKSALKRYVFTGDIVLENKKLS

SEQ ID NO: 1810346 - protein, 25 aa, Staphylococcus epidermidis
NEIEKGYCLLVGVGKDSTEEDAKVI

SEQ ID NO: 1810347 - protein, 21 aa, Staphylococcus epidermidis
NEIGIRLKQPIDLQYGDILFQ

SEQ ID NO: 1810348 - protein, 21 aa, Staphylococcus epidermidis
NEIGIRLKQPIDLQYGDILYQ

SEQ ID NO: 1810349 - protein, 23 aa, Staphylococcus epidermidis
NEIIHRLSKVYGIKSISPVIKID

SEQ ID NO: 1810350 - protein, 17 aa, Staphylococcus epidermidis
NEIKATHVYNLLSNQSQ

SEQ ID NO: 1810351 - protein, 23 aa, Staphylococcus epidermidis
NEIKEILLELPLVSIDHLGLTNE

SEQ ID NO: 1810352 - protein, 21 aa, Staphylococcus epidermidis
NEIKEKVEILLPEIKSIGMAL

SEQ ID NO: 1810353 - protein, 23 aa, Staphylococcus epidermidis
NEIKIIKLVLLKAKTSFNNSIDT

SEQ ID NO: 1810354 - protein, 21 aa, Staphylococcus epidermidis
NEILAIGCLYVHERFKDLIMI

SEQ ID NO: 1810355 - protein, 26 aa, Staphylococcus epidermidis
NEIMQRLGRAFALLQVTGEVLNDIDG

SEQ ID NO: 1810356 - protein, 26 aa, Staphylococcus epidermidis
NEIMQRLGRSFALLQVAGEVLNDING

SEQ ID NO: 1810357 - protein, 17 aa, Staphylococcus epidermidis
NEIQSEFNITLNLEEIF

SEQ ID NO: 1810358 - protein, 17 aa, Staphylococcus epidermidis
NEKAIGFQVHKNNVFLR

SEQ ID NO: 1810359 - protein, 17 aa, Staphylococcus epidermidis
NEKDVRMINKFIHDVES

SEQ ID NO: 1810360 - protein, 17 aa, Staphylococcus epidermidis
NEKFLKDKTPLFEKGLD

SEQ ID NO: 1810361 - protein, 19 aa, Staphylococcus epidermidis
NEKFPSIRKAAEIFNVSII

SEQ ID NO: 1810362 - protein, 20 aa, Staphylococcus epidermidis
NEKLFGHVYIKDCNVRQSFE

SEQ ID NO: 1810363 - protein, 22 aa, Staphylococcus epidermidis
NEKLVECFFTGLTRYLKRHKGL

SEQ ID NO: 1810364 - protein, 23 aa, Staphylococcus epidermidis
NEKNLKLFSAFIVKGKKVIQEQL

SEQ ID NO: 1810365 - protein, 21 aa, Staphylococcus epidermidis
NELCIELDPGMAFGTGDHPTT

SEQ ID NO: 1810366 - protein, 17 aa, Staphylococcus epidermidis
NELEITKRAILDNHPYE

SEQ ID NO: 1810367 - protein, 19 aa, Staphylococcus epidermidis
NELFQRGLVSFVANDAILP

SEQ ID NO: 1810368 - protein, 19 aa, Staphylococcus epidermidis
NELKLKLMKNIFEKKELIE

SEQ ID NO: 1810369 - protein, 19 aa, Staphylococcus epidermidis
NELKRPPVSNIDELVIVMS

SEQ ID NO: 1810370 - protein, 21 aa, Staphylococcus epidermidis
NELWLKTVENLMDRFIEKKYW

SEQ ID NO: 1810371 - protein, 17 aa, Staphylococcus epidermidis
NEMCAHVRKTLADLSSQ

SEQ ID NO: 1810372 - protein, 20 aa, Staphylococcus epidermidis
NEMLKPRGYLIMIEATLESY

SEQ ID NO: 1810373 - protein, 18 aa, Staphylococcus epidermidis
NEMMVIFVTNGKKFKHSE

SEQ ID NO: 1810374 - protein, 24 aa, Staphylococcus epidermidis
NENIFQMFKKGVVFVNCARGSLVD

SEQ ID NO: 1810375 - protein, 20 aa, Staphylococcus epidermidis
NENYLIWKGQKYVIKSTELK

SEQ ID NO: 1810376 - protein, 25 aa, Staphylococcus epidermidis
NEPFMYKLVDIVAEIMEPYYPNVKE

SEQ ID NO: 1810377 - protein, 22 aa, Staphylococcus epidermidis
NEPNKAFLFGINYVILSDDKDF

SEQ ID NO: 1810378 - protein, 22 aa, Staphylococcus epidermidis
NEPNKAFLFGINYVLLTNDQEF

SEQ ID NO: 1810379 - protein, 24 aa, Staphylococcus epidermidis
NEQKEIYSCFAGMYEPTQKDVQLG

SEQ ID NO: 1810380 - protein, 20 aa, Staphylococcus epidermidis
NEQLLVLSLLRTGTGKQIDP

SEQ ID NO: 1810381 - protein, 22 aa, Staphylococcus epidermidis
NEQLMSLPIGTRYVVLTLNNPA

SEQ ID NO: 1810382 - protein, 18 aa, Staphylococcus epidermidis
NEQYGGVEIKQLTERYKN

SEQ ID NO: 1810383 - protein, 17 aa, Staphylococcus epidermidis
NERFGRLTVIGMSDKKS

SEQ ID NO: 1810384 - protein, 18 aa, Staphylococcus epidermidis
NERFNNFYLSKNNVDILS

SEQ ID NO: 1810385 - protein, 19 aa, Staphylococcus epidermidis
NERLMEGLLAIPLPGASFL

SEQ ID NO: 1810386 - protein, 27 aa, Staphylococcus epidermidis
NERQKMGWSQVKMKAVLHNEAIKNVTQ

SEQ ID NO: 1810387 - protein, 34 aa, Staphylococcus epidermidis
NERWLRKVINSLVYDYAYPIGCSYKRNERGYYII

SEQ ID NO: 1810388 - protein, 24 aa, Staphylococcus epidermidis
NESDFLKIRGNDIGMIFQEPMTAL

SEQ ID NO: 1810389 - protein, 23 aa, Staphylococcus epidermidis
NESFKATEFLQEFNDLQQLFIVS

SEQ ID NO: 1810390 - protein, 25 aa, Staphylococcus epidermidis
NETIKHLYNQLDIYKEQSKRDKEQI

SEQ ID NO: 1810391 - protein, 22 aa, Staphylococcus epidermidis
NETNAMPGFTSFSMYPSLWENM

SEQ ID NO: 1810392 - protein, 22 aa, Staphylococcus epidermidis
NETPKRFQFIVKIHQALTLHAD

SEQ ID NO: 1810393 - protein, 22 aa, Staphylococcus epidermidis
NETPNRFQFVVKIHQALTLHAD

SEQ ID NO: 1810394 - protein, 25 aa, Staphylococcus epidermidis
NETTGFFDMCHILNLLVNQWEKYPQ

SEQ ID NO: 1810395 - protein, 23 aa, Staphylococcus epidermidis
NETVEAMQGYLMKSLKSEFAEMH

SEQ ID NO: 1810396 - protein, 17 aa, Staphylococcus epidermidis
NEVCHKYQIPWVYGAAV

SEQ ID NO: 1810397 - protein, 24 aa, Staphylococcus epidermidis
NEVKQRIATHVLPDFEEVTTSLTN

SEQ ID NO: 1810398 - protein, 27 aa, Staphylococcus epidermidis
NEVYKPYIEGFVKMLSPIAPHIGEELW

SEQ ID NO: 1810399 - protein, 17 aa, Staphylococcus epidermidis
NEYARIQAYLADHRPQL

SEQ ID NO: 1810400 - protein, 22 aa, Staphylococcus epidermidis
NEYMPDYVEFIYTLKTNTDVVA

SEQ ID NO: 1810401 - protein, 20 aa, Staphylococcus epidermidis
NFAISIGIYYNGEPYAGFVY

SEQ ID NO: 1810402 - protein, 24 aa, Staphylococcus epidermidis
NFDEWRKNIIDKKMLSLISKEKDY

SEQ ID NO: 1810403 - protein, 28 aa, Staphylococcus epidermidis
NFDKLKGRLILMITRFSVYLRKATPEAK

SEQ ID NO: 1810404 - protein, 24 aa, Staphylococcus epidermidis
NFHWYVKGPNFFSLHTKFEELYDE

SEQ ID NO: 1810405 - protein, 19 aa, Staphylococcus epidermidis
NFIKRSVLNTVLKKIRGTF

SEQ ID NO: 1810406 - protein, 23 aa, Staphylococcus epidermidis
NFINKIWNAARFSLMNIGEGFKV

SEQ ID NO: 1810407 - protein, 18 aa, Staphylococcus epidermidis
NFKKKICNGQKFHKKVLS

SEQ ID NO: 1810408 - protein, 19 aa, Staphylococcus epidermidis
NFKPNERALVLSGRSNTSM

SEQ ID NO: 1810409 - protein, 22 aa, Staphylococcus epidermidis
NFLERIDRLVINQGNKVETLKR

SEQ ID NO: 1810410 - protein, 18 aa, Staphylococcus epidermidis
NFLLVLADSLSLVDVDAL

SEQ ID NO: 1810411 - protein, 27 aa, Staphylococcus epidermidis
NFLNLCVEIETTLAPRELLSCCLETEQ

SEQ ID NO: 1810412 - protein, 18 aa, Staphylococcus epidermidis
NFLQSTIHERNFFNMAYI

SEQ ID NO: 1810413 - protein, 23 aa, Staphylococcus epidermidis
NFMKATLPKLYSGKGKSTIEGLG

SEQ ID NO: 1810414 - protein, 17 aa, Staphylococcus epidermidis
NFNATKGGSAFYAIQAP

SEQ ID NO: 1810415 - protein, 24 aa, Staphylococcus epidermidis
NFNPYQWPSFDIKYLDLPKKQGRI

SEQ ID NO: 1810416 - protein, 20 aa, Staphylococcus epidermidis
NFQKKLDFLRKGVANIIGSL

SEQ ID NO: 1810417 - protein, 17 aa, Staphylococcus epidermidis
NFRKVKRIDTIIETFAK

SEQ ID NO: 1810418 - protein, 17 aa, Staphylococcus epidermidis
NFRKVKRIDTVIETFAK

SEQ ID NO: 1810419 - protein, 18 aa, Staphylococcus epidermidis
NFRPIRLDRYFPEWHETY

SEQ ID NO: 1810420 - protein, 22 aa, Staphylococcus epidermidis
NFTELTNAFQLFKEIKSTQIKD

SEQ ID NO: 1810421 - protein, 19 aa, Staphylococcus epidermidis
NFTKSIAIEYGRENIRANA

SEQ ID NO: 1810422 - protein, 25 aa, Staphylococcus epidermidis
NFVSRGEIDPVIRFYTWNPATLSIG

SEQ ID NO: 1810423 - protein, 26 aa, Staphylococcus epidermidis
NFVSRGEIDPVIRFYTWNPATLSIGY

SEQ ID NO: 1810424 - protein, 27 aa, Staphylococcus epidermidis
NGATKIKYIRMFDELKRQINARATEIQ

SEQ ID NO: 1810425 - protein, 23 aa, Staphylococcus epidermidis
NGCGKSTLLKALSRLLSIKDGAI

SEQ ID NO: 1810426 - protein, 28 aa, Staphylococcus epidermidis
NGDALAFIGDVKRGVLFADRTDVSVQWI

SEQ ID NO: 1810427 - protein, 22 aa, Staphylococcus epidermidis
NGDPMLTITFVILEGEFADNKI

SEQ ID NO: 1810428 - protein, 18 aa, Staphylococcus epidermidis
NGECRFISGNELGLILMK

SEQ ID NO: 1810429 - protein, 24 aa, Staphylococcus epidermidis
NGEEVKVVVGIAGKDGEHLDLLSK

SEQ ID NO: 1810430 - protein, 17 aa, Staphylococcus epidermidis
NGEFRAILDTEDYYHVQ

SEQ ID NO: 1810431 - protein, 23 aa, Staphylococcus epidermidis
NGELKPIKAYNMRKSRQRKDDHL

SEQ ID NO: 1810432 - protein, 17 aa, Staphylococcus epidermidis
NGFCIYNDVAITAKYLV

SEQ ID NO: 1810433 - protein, 17 aa, Staphylococcus epidermidis
NGFRTTRSIDWSKVTTD

SEQ ID NO: 1810434 - protein, 20 aa, Staphylococcus epidermidis
NGFSVIYLISQRLVKKSLDD

SEQ ID NO: 1810435 - protein, 23 aa, Staphylococcus epidermidis
NGGFTKGTPWFPVNPNYKTINVE

SEQ ID NO: 1810436 - protein, 24 aa, Staphylococcus epidermidis
NGGLYLEKFIENFRHIEIQIIGDS

SEQ ID NO: 1810437 - protein, 17 aa, Staphylococcus epidermidis
NGGTRKRTMVFEGVVPN

SEQ ID NO: 1810438 - protein, 18 aa, Staphylococcus epidermidis
NGGVSGFVTSAAVELKNG

SEQ ID NO: 1810439 - protein, 22 aa, Staphylococcus epidermidis
NGHLLIQWYSKGIYKFRFPILE

SEQ ID NO: 1810440 - protein, 18 aa, Staphylococcus epidermidis
NGHRVVVAGLDMDFRGEP

SEQ ID NO: 1810441 - protein, 21 aa, Staphylococcus epidermidis
NGHVLPIIAQFLLDNTNDVTS

SEQ ID NO: 1810442 - protein, 31 aa, Staphylococcus epidermidis
NGHVPTLMCAKLWPEFEIYKSFVKETLILKE

SEQ ID NO: 1810443 - protein, 17 aa, Staphylococcus epidermidis
NGIEVLDMIDGETYGIK

SEQ ID NO: 1810444 - protein, 19 aa, Staphylococcus epidermidis
NGIHFSLSFLKDYFNQKIK

SEQ ID NO: 1810445 - protein, 21 aa, Staphylococcus epidermidis
NGITRRVIKWIAEDYNIPFKE

SEQ ID NO: 1810446 - protein, 23 aa, Staphylococcus epidermidis
NGKGHSMDGFMSANEQKVIKKVL

SEQ ID NO: 1810447 - protein, 20 aa, Staphylococcus epidermidis
NGKGHSMLGYLGKREQREIK

SEQ ID NO: 1810448 - protein, 21 aa, Staphylococcus epidermidis
NGKGIYRFELNELEGTIKNVE

SEQ ID NO: 1810449 - protein, 19 aa, Staphylococcus epidermidis
NGLDPRAVRDVRELIVKKA

SEQ ID NO: 1810450 - protein, 32 aa, Staphylococcus epidermidis
NGLIAMKLAREYGRPVLMVKRIGEYFKGSGRN

SEQ ID NO: 1810451 - protein, 17 aa, Staphylococcus epidermidis
NGLKGTQIHLDFPSVGA

SEQ ID NO: 1810452 - protein, 24 aa, Staphylococcus epidermidis
NGLKRVIDFIENFGFSDSDIAYLK

SEQ ID NO: 1810453 - protein, 20 aa, Staphylococcus epidermidis
NGLVSVWSHYFLSDYNPVDE

SEQ ID NO: 1810454 - protein, 24 aa, Staphylococcus epidermidis
NGLYNEFFQLKGLEQLAIKFYTEE

SEQ ID NO: 1810455 - protein, 21 aa, Staphylococcus epidermidis
NGLYPDLTIYLDVSAEVGRQR

SEQ ID NO: 1810456 - protein, 28 aa, Staphylococcus epidermidis
NGMKYYMVGSTYRFKKSDVDEFMEQLTA

SEQ ID NO: 1810457 - protein, 18 aa, Staphylococcus epidermidis
NGMSVPDYVLQRFSKEEM

SEQ ID NO: 1810458 - protein, 20 aa, Staphylococcus epidermidis
NGNYPLTIVLIGEQLDVNRL

SEQ ID NO: 1810459 - protein, 30 aa, Staphylococcus epidermidis
NGPPPGYAFHWAHPGIDLPYHYEKVQSTTS

SEQ ID NO: 1810460 - protein, 18 aa, Staphylococcus epidermidis
NGQAIIVHKNEEDEYVYP

SEQ ID NO: 1810461 - protein, 18 aa, Staphylococcus epidermidis
NGQAVIVYKNEEDEYVYP

SEQ ID NO: 1810462 - protein, 17 aa, Staphylococcus epidermidis
NGQGRIVGYSGRTYTNQ

SEQ ID NO: 1810463 - protein, 17 aa, Staphylococcus epidermidis
NGSFHAEFFLTDSGEIY

SEQ ID NO: 1810464 - protein, 21 aa, Staphylococcus epidermidis
NGSGIGLRLTNNHAIVNGVTS

SEQ ID NO: 1810465 - protein, 21 aa, Staphylococcus epidermidis
NGSGIGLRLTNNHAMISGITA

SEQ ID NO: 1810466 - protein, 19 aa, Staphylococcus epidermidis
NGSLIKAFRQCGFEIDKVV

SEQ ID NO: 1810467 - protein, 18 aa, Staphylococcus epidermidis
NGTNRLYTQLSLIGTRTH

SEQ ID NO: 1810468 - protein, 27 aa, Staphylococcus epidermidis
NGWYDRHGYKRFTKAYISMSRKNGKTL

SEQ ID NO: 1810469 - protein, 17 aa, Staphylococcus epidermidis
NGYEHDGVIPGGALDDL

SEQ ID NO: 1810470 - protein, 23 aa, Staphylococcus epidermidis
NGYEKRYGLFYVDFDTQERYPKK

SEQ ID NO: 1810471 - protein, 17 aa, Staphylococcus epidermidis
NGYHFYTQLEVGDNIII

SEQ ID NO: 1810472 - protein, 21 aa, Staphylococcus epidermidis
NGYLFVFVLDYYRHHLVDEVA

SEQ ID NO: 1810473 - protein, 21 aa, Staphylococcus epidermidis
NGYPMPSIGLGVYKITDEEMD

SEQ ID NO: 1810474 - protein, 21 aa, Staphylococcus epidermidis
NHADYLLAFAQYYPYGPEYFI

SEQ ID NO: 1810475 - protein, 25 aa, Staphylococcus epidermidis
NHDEIDLLIAILKGYKGIKLDRLTL

SEQ ID NO: 1810476 - protein, 20 aa, Staphylococcus epidermidis
NHETLFHFLERVPSHIPVLI

SEQ ID NO: 1810477 - protein, 19 aa, Staphylococcus epidermidis
NHIGECWGISAHPHGKSVI

SEQ ID NO: 1810478 - protein, 25 aa, Staphylococcus epidermidis
NHIHLPKINASDFLMYYANETEKQN

SEQ ID NO: 1810479 - protein, 24 aa, Staphylococcus epidermidis
NHIKALFHAGTGRLLDYNYLLPYL

SEQ ID NO: 1810480 - protein, 24 aa, Staphylococcus epidermidis
NHIKRKDVDLAIQFIKDVRPSAIE

SEQ ID NO: 1810481 - protein, 27 aa, Staphylococcus epidermidis
NHIQLVGVAFNFMCFKSAAPEENDVFM

SEQ ID NO: 1810482 - protein, 23 aa, Staphylococcus epidermidis
NHISPCSGVICGMGESNEDIIDM

SEQ ID NO: 1810483 - protein, 30 aa, Staphylococcus epidermidis
NHLDFESIRWLINYVKQYPHTVLFVTHDRY

SEQ ID NO: 1810484 - protein, 19 aa, Staphylococcus epidermidis
NHLGELVITIAKYSDSKVL

SEQ ID NO: 1810485 - protein, 18 aa, Staphylococcus epidermidis
NHLGELVLTIAKSSNSTI

SEQ ID NO: 1810486 - protein, 24 aa, Staphylococcus epidermidis
NHLLPRTGAYHEIWLDGEKVLDSS

SEQ ID NO: 1810487 - protein, 19 aa, Staphylococcus epidermidis
NHLNHGYYFHEILNRHHLD

SEQ ID NO: 1810488 - protein, 29 aa, Staphylococcus epidermidis
NHPCVHGQALHCCSVEFIHPIYRSHYLIN

SEQ ID NO: 1810489 - protein, 17 aa, Staphylococcus epidermidis
NHPNVITTYDLLYRAGL

SEQ ID NO: 1810490 - protein, 19 aa, Staphylococcus epidermidis
NHSKSNHLLTEFVTKHQIP

SEQ ID NO: 1810491 - protein, 22 aa, Staphylococcus epidermidis
NHSVNYCIFCHQDISNIKLIDK

SEQ ID NO: 1810492 - protein, 22 aa, Staphylococcus epidermidis
NHTLRLDIQIHFAHCHAREPRL

SEQ ID NO: 1810493 - protein, 22 aa, Staphylococcus epidermidis
NHTRSKETIAFEPKDVIIVEGI

SEQ ID NO: 1810494 - protein, 18 aa, Staphylococcus epidermidis
NHTYGQREIYEFIDNANR

SEQ ID NO: 1810495 - protein, 17 aa, Staphylococcus epidermidis
NHYSIKATHIMSQWPTH

SEQ ID NO: 1810496 - protein, 24 aa, Staphylococcus epidermidis
NIAILSPRVDVVIEISQRIKDAFK

SEQ ID NO: 1810497 - protein, 24 aa, Staphylococcus epidermidis
NIAVPLDLPALFKGYYKDEERTKA

SEQ ID NO: 1810498 - protein, 26 aa, Staphylococcus epidermidis
NIDELRARIRVALRMSRSTETIQSRF

SEQ ID NO: 1810499 - protein, 17 aa, Staphylococcus epidermidis
NIDGVYHSIAFANIEDL

SEQ ID NO: 1810500 - protein, 17 aa, Staphylococcus epidermidis
NIDGVYHSIAFANMEDL

SEQ ID NO: 1810501 - protein, 17 aa, Staphylococcus epidermidis
NIDVELRLLKYKHKDKV

SEQ ID NO: 1810502 - protein, 20 aa, Staphylococcus epidermidis
NIEAFAAYMDKIIKNPLTKV

SEQ ID NO: 1810503 - protein, 24 aa, Staphylococcus epidermidis
NIEARPVWKPMHLQPLYEGYEFFK

SEQ ID NO: 1810504 - protein, 17 aa, Staphylococcus epidermidis
NIEGAQKIYELFKPTLE

SEQ ID NO: 1810505 - protein, 23 aa, Staphylococcus epidermidis
NIEHCINAEFGRWQIGKNDKLLL

SEQ ID NO: 1810506 - protein, 19 aa, Staphylococcus epidermidis
NIEHRRWGAPFPVIEIVKR

SEQ ID NO: 1810507 - protein, 21 aa, Staphylococcus epidermidis
NIEKGETIAIIGPSGSGKSTL

SEQ ID NO: 1810508 - protein, 26 aa, Staphylococcus epidermidis
NIEKIIFEFAKKGIAILWITHSDDQS

SEQ ID NO: 1810509 - protein, 23 aa, Staphylococcus epidermidis
NIEYKNACFKGMFNETCPTFDEI

SEQ ID NO: 1810510 - protein, 17 aa, Staphylococcus epidermidis
NIGELGKTFSKGLLMGA

SEQ ID NO: 1810511 - protein, 20 aa, Staphylococcus epidermidis
NIGENFYANMDCMFLDVNYI

SEQ ID NO: 1810512 - protein, 27 aa, Staphylococcus epidermidis
NIGFPGVKGEVLVNAFSKQNVMVSTTS

SEQ ID NO: 1810513 - protein, 18 aa, Staphylococcus epidermidis
NIGIKYLTLYAFSTENWS

SEQ ID NO: 1810514 - protein, 24 aa, Staphylococcus epidermidis
NIIQRLSKASGHLGMVGGQALDME

SEQ ID NO: 1810515 - protein, 25 aa, Staphylococcus epidermidis
NIIVAAGRLEYEKGFDLLLESVRLI

SEQ ID NO: 1810516 - protein, 27 aa, Staphylococcus epidermidis
NIIVVTFNYRLGALGYLDWSYLNQHLN

SEQ ID NO: 1810517 - protein, 23 aa, Staphylococcus epidermidis
NIKEALETFGGVKRRFNETKVSN

SEQ ID NO: 1810518 - protein, 19 aa, Staphylococcus epidermidis
NIKEIPSNILIKNLSDGQK

SEQ ID NO: 1810519 - protein, 25 aa, Staphylococcus epidermidis
NIKFLKGRIKFGGAVNSAPFPSAIV

SEQ ID NO: 1810520 - protein, 25 aa, Staphylococcus epidermidis
NIKKYLMNRLVGFTRKILGVLEDYN

SEQ ID NO: 1810521 - protein, 17 aa, Staphylococcus epidermidis
NILIDMHIGDSISVNGA

SEQ ID NO: 1810522 - protein, 30 aa, Staphylococcus epidermidis
NIMFPMVATIKEFRDAKAILLEEKKNLENE

SEQ ID NO: 1810523 - protein, 22 aa, Staphylococcus epidermidis
NIMKPEYFIPVQGEFKMQIAHA

SEQ ID NO: 1810524 - protein, 18 aa, Staphylococcus epidermidis
NIPEGYVGLLTSRSGVSS

SEQ ID NO: 1810525 - protein, 17 aa, Staphylococcus epidermidis
NIPEPKGKQLLVKIQSM

SEQ ID NO: 1810526 - protein, 21 aa, Staphylococcus epidermidis
NIPKHLVTVFTGRSGSGKSSL

SEQ ID NO: 1810527 - protein, 21 aa, Staphylococcus epidermidis
NIRFDKEILPLIEAELSLVYA

SEQ ID NO: 1810528 - protein, 28 aa, Staphylococcus epidermidis
NIRIRKAKELNKRIEALEEKAAKNGKLS

SEQ ID NO: 1810529 - protein, 19 aa, Staphylococcus epidermidis
NIRKDYRFAVGSKILSQSI

SEQ ID NO: 1810530 - protein, 24 aa, Staphylococcus epidermidis
NIRKLKINRQFIFATHNANIPVFG

SEQ ID NO: 1810531 - protein, 24 aa, Staphylococcus epidermidis
NIRNRFNIKVSVFKSADEAIDSAD

SEQ ID NO: 1810532 - protein, 21 aa, Staphylococcus epidermidis
NISAKVFFSSIGFENLAFEKN

SEQ ID NO: 1810533 - protein, 20 aa, Staphylococcus epidermidis
NISNIMAAIIAVWSKGATME

SEQ ID NO: 1810534 - protein, 22 aa, Staphylococcus epidermidis
NISPCSGVICGMGETNEDVINM

SEQ ID NO: 1810535 - protein, 24 aa, Staphylococcus epidermidis
NITICGMGGPLIASILKEGQEKLT

SEQ ID NO: 1810536 - protein, 27 aa, Staphylococcus epidermidis
NITSEPRIKMGILESTSQWIAKVTQIH

SEQ ID NO: 1810537 - protein, 21 aa, Staphylococcus epidermidis
NIVIKQSWIYKGTLNSSIIHP

SEQ ID NO: 1810538 - protein, 26 aa, Staphylococcus epidermidis
NIWFEREAKDLLPEGFTHPGSPNGEF

SEQ ID NO: 1810539 - protein, 24 aa, Staphylococcus epidermidis
NIYFEKALKVLRPIYLEQSPVPTF

SEQ ID NO: 1810540 - protein, 18 aa, Staphylococcus epidermidis
NIYTRKDYNLSRNIDGLI

SEQ ID NO: 1810541 - protein, 21 aa, Staphylococcus epidermidis
NKADQVFLCEIFGSIRENTGD

SEQ ID NO: 1810542 - protein, 25 aa, Staphylococcus epidermidis
NKAHMKRLAINSCIELISKTISQVE

SEQ ID NO: 1810543 - protein, 24 aa, Staphylococcus epidermidis
NKARHLYHKLGFKEDATIHLYGHQ

SEQ ID NO: 1810544 - protein, 17 aa, Staphylococcus epidermidis
NKDCPVCENQEYDLLNL

SEQ ID NO: 1810545 - protein, 24 aa, Staphylococcus epidermidis
NKDELIREGFSYHERRIHNNQMFD

SEQ ID NO: 1810546 - protein, 24 aa, Staphylococcus epidermidis
NKDKLKGIFLSHGHEHAIGAVSYV

SEQ ID NO: 1810547 - protein, 22 aa, Staphylococcus epidermidis
NKDNWGDLMYDFADAMKKAIER

SEQ ID NO: 1810548 - protein, 29 aa, Staphylococcus epidermidis
NKDSEVLESFYIIGIPTEYTRWFMQSGST

SEQ ID NO: 1810549 - protein, 17 aa, Staphylococcus epidermidis
NKEEVPIEWLKRYEEHL

SEQ ID NO: 1810550 - protein, 24 aa, Staphylococcus epidermidis
NKEGFKFAETVYDLAGTPIFKKYM

SEQ ID NO: 1810551 - protein, 23 aa, Staphylococcus epidermidis
NKEGIQMVLLQDWGKPTVVHVDK

SEQ ID NO: 1810552 - protein, 32 aa, Staphylococcus epidermidis
NKEIKFKAFLEHALKLGADYVATGHYARIRRH

SEQ ID NO: 1810553 - protein, 19 aa, Staphylococcus epidermidis
NKEIKTIQNVWYYKLVDVY

SEQ ID NO: 1810554 - protein, 18 aa, Staphylococcus epidermidis
NKENWTPTMEEFINALYE

SEQ ID NO: 1810555 - protein, 19 aa, Staphylococcus epidermidis
NKENYRVTILMKDITSKTP

SEQ ID NO: 1810556 - protein, 17 aa, Staphylococcus epidermidis
NKETIKRTRNQRTNKQT

SEQ ID NO: 1810557 - protein, 27 aa, Staphylococcus epidermidis
NKEWNRKAFRGIELYGKTLGVIGAGRI

SEQ ID NO: 1810558 - protein, 27 aa, Staphylococcus epidermidis
NKEWNRKAFRGVELYGKTLGIIGAGRI

SEQ ID NO: 1810559 - protein, 19 aa, Staphylococcus epidermidis
NKFPKGWKIVENKPSTIPK

SEQ ID NO: 1810560 - protein, 22 aa, Staphylococcus epidermidis
NKGDMTFKLFPDIAPKTVENFV

SEQ ID NO: 1810561 - protein, 22 aa, Staphylococcus epidermidis
NKGEVIVLCGKSGSGKSTLLQT

SEQ ID NO: 1810562 - protein, 20 aa, Staphylococcus epidermidis
NKGKAIHALMDWLNQHHFDY

SEQ ID NO: 1810563 - protein, 17 aa, Staphylococcus epidermidis
NKGKLILQVLSIDESGK

SEQ ID NO: 1810564 - protein, 18 aa, Staphylococcus epidermidis
NKGLKLVGGKLMQVPKEL

SEQ ID NO: 1810565 - protein, 25 aa, Staphylococcus epidermidis
NKGNMLKPWFVSSIDNPVTKKNYYS

SEQ ID NO: 1810566 - protein, 25 aa, Staphylococcus epidermidis
NKHQRFAKQYAEAMQKIENVIDGNQ

SEQ ID NO: 1810567 - protein, 18 aa, Staphylococcus epidermidis
NKHRYQLLLNYTGLEIDG

SEQ ID NO: 1810568 - protein, 20 aa, Staphylococcus epidermidis
NKHYISIFINGRYIKNFLLN

SEQ ID NO: 1810569 - protein, 25 aa, Staphylococcus epidermidis
NKIATCVKGKFSWGHINSDQRLTKP

SEQ ID NO: 1810570 - protein, 23 aa, Staphylococcus epidermidis
NKIIPTERIENFNVKKEIEEFKF

SEQ ID NO: 1810571 - protein, 17 aa, Staphylococcus epidermidis
NKIREGTQFNGYTDYGL

SEQ ID NO: 1810572 - protein, 18 aa, Staphylococcus epidermidis
NKKAIQWESMYQDRGFIF

SEQ ID NO: 1810573 - protein, 19 aa, Staphylococcus epidermidis
NKKEYLTSELFDLTESEKQ

SEQ ID NO: 1810574 - protein, 23 aa, Staphylococcus epidermidis
NKKFKTYYLEWLVANGKDKLSIK

SEQ ID NO: 1810575 - protein, 21 aa, Staphylococcus epidermidis
NKKLKDLGIDLEDFMKNSESV

SEQ ID NO: 1810576 - protein, 22 aa, Staphylococcus epidermidis
NKKTDIDLMWQFIHTMMNQTAQ

SEQ ID NO: 1810577 - protein, 20 aa, Staphylococcus epidermidis
NKKYDLFVLVVTDIINSDSK

SEQ ID NO: 1810578 - protein, 17 aa, Staphylococcus epidermidis
NKLEIVTVATDYCKENS

SEQ ID NO: 1810579 - protein, 17 aa, Staphylococcus epidermidis
NKLGRRPYFLATKYNEK

SEQ ID NO: 1810580 - protein, 26 aa, Staphylococcus epidermidis
NKLKEEFPHIELHLYGFGAEERKLKD

SEQ ID NO: 1810581 - protein, 17 aa, Staphylococcus epidermidis
NKLLKFKKSNCRYISES

SEQ ID NO: 1810582 - protein, 21 aa, Staphylococcus epidermidis
NKLNYCYKNHAPITIYYWNNG

SEQ ID NO: 1810583 - protein, 26 aa, Staphylococcus epidermidis
NKLRGRIAKYPIFTILYEKVEYDEKG

SEQ ID NO: 1810584 - protein, 24 aa, Staphylococcus epidermidis
NKLSIKAKLLYALITERQNLSKLS

SEQ ID NO: 1810585 - protein, 23 aa, Staphylococcus epidermidis
NKLSKREVEVLREMVKGKTNKEI

SEQ ID NO: 1810586 - protein, 24 aa, Staphylococcus epidermidis
NKLYIKLPEVHYSKEVKNLHVGKL

SEQ ID NO: 1810587 - protein, 23 aa, Staphylococcus epidermidis
NKMKIYTTVFAFQSFTQQIGGKY

SEQ ID NO: 1810588 - protein, 24 aa, Staphylococcus epidermidis
NKMRRIYRDKLNYILKKLAQYSEQ

SEQ ID NO: 1810589 - protein, 17 aa, Staphylococcus epidermidis
NKNCRKYDGQKLMMKTI

SEQ ID NO: 1810590 - protein, 17 aa, Staphylococcus epidermidis
NKNDIFTIIAYQQQKHS

SEQ ID NO: 1810591 - protein, 18 aa, Staphylococcus epidermidis
NKNMKLALANGLKQKDLI

SEQ ID NO: 1810592 - protein, 23 aa, Staphylococcus epidermidis
NKPEAKLFILLVGERPEEVTDIE

SEQ ID NO: 1810593 - protein, 20 aa, Staphylococcus epidermidis
NKPILLKRGLSATIEEFIYA

SEQ ID NO: 1810594 - protein, 24 aa, Staphylococcus epidermidis
NKPPQGIILPCYYDGKQWVGQTEE

SEQ ID NO: 1810595 - protein, 23 aa, Staphylococcus epidermidis
NKQIAELCYIIWEDMELDITQAL

SEQ ID NO: 1810596 - protein, 18 aa, Staphylococcus epidermidis
NKQLLDIRVVITRPANDP

SEQ ID NO: 1810597 - protein, 18 aa, Staphylococcus epidermidis
NKQLNAFVGIDIKRYQSG

SEQ ID NO: 1810598 - protein, 22 aa, Staphylococcus epidermidis
NKRMKWYTVIQSIGMVQWYEEQ

SEQ ID NO: 1810599 - protein, 25 aa, Staphylococcus epidermidis
NKRRVKEWLKKSARKYGLEAEDVVL

SEQ ID NO: 1810600 - protein, 21 aa, Staphylococcus epidermidis
NKRTAFTSMVIFLKLNSINFE

SEQ ID NO: 1810601 - protein, 19 aa, Staphylococcus epidermidis
NKRVKHYNYVLAGDELILK

SEQ ID NO: 1810602 - protein, 25 aa, Staphylococcus epidermidis
NKSMFKNYWFYKFVIPIYNEPNIEN

SEQ ID NO: 1810603 - protein, 25 aa, Staphylococcus epidermidis
NKSRFKNCNFNEGIFKNIKAISNTK

SEQ ID NO: 1810604 - protein, 17 aa, Staphylococcus epidermidis
NKSSAYLGTNGFQINEK

SEQ ID NO: 1810605 - protein, 18 aa, Staphylococcus epidermidis
NKTRFEVFKRDNFTCQYC

SEQ ID NO: 1810606 - protein, 23 aa, Staphylococcus epidermidis
NKVAGELLCQYYFVKFGVDTRSV

SEQ ID NO: 1810607 - protein, 19 aa, Staphylococcus epidermidis
NKVCGSGLKAIQLAYQSIV

SEQ ID NO: 1810608 - protein, 21 aa, Staphylococcus epidermidis
NKVCGSGMKAIQLAYQSIAAG

SEQ ID NO: 1810609 - protein, 18 aa, Staphylococcus epidermidis
NKVESLRASYYMMGAMLG

SEQ ID NO: 1810610 - protein, 26 aa, Staphylococcus epidermidis
NKVFRYDGIDALDWEAISGYDTSVIQ

SEQ ID NO: 1810611 - protein, 23 aa, Staphylococcus epidermidis
NKVKYVGALFLGHFSPEVIGDYV

SEQ ID NO: 1810612 - protein, 19 aa, Staphylococcus epidermidis
NKVKYWLFNTLDRIRNKLK

SEQ ID NO: 1810613 - protein, 19 aa, Staphylococcus epidermidis
NKVKYWLFTTLNRIRKKIK

SEQ ID NO: 1810614 - protein, 22 aa, Staphylococcus epidermidis
NKYARGVAVYGDIKDDTDENGD

SEQ ID NO: 1810615 - protein, 22 aa, Staphylococcus epidermidis
NKYLPQREIVSIKDFESRIQAW

SEQ ID NO: 1810616 - protein, 21 aa, Staphylococcus epidermidis
NLDGLPAKVFLTDETGVKYIY

SEQ ID NO: 1810617 - protein, 17 aa, Staphylococcus epidermidis
NLDPSLLLAPWDVIESR

SEQ ID NO: 1810618 - protein, 20 aa, Staphylococcus epidermidis
NLDPSLLLAPWDVIETRLKE

SEQ ID NO: 1810619 - protein, 24 aa, Staphylococcus epidermidis
NLEIRCIKGVMNKAKTNYNTHVSF

SEQ ID NO: 1810620 - protein, 23 aa, Staphylococcus epidermidis
NLETRGVVLFLNRNNKKATGKFY

SEQ ID NO: 1810621 - protein, 19 aa, Staphylococcus epidermidis
NLFEEILGYTLFRRNEYGK

SEQ ID NO: 1810622 - protein, 26 aa, Staphylococcus epidermidis
NLFVLLCIANSLGIDMTESFNETMDK

SEQ ID NO: 1810623 - protein, 25 aa, Staphylococcus epidermidis
NLGGLPCFLNHQWSESTVKQLVEKY

SEQ ID NO: 1810624 - protein, 19 aa, Staphylococcus epidermidis
NLHGNGSGIGLRLTNNHAM

SEQ ID NO: 1810625 - protein, 24 aa, Staphylococcus epidermidis
NLIGAFYRPNAVIYDLDFLETLPY

SEQ ID NO: 1810626 - protein, 22 aa, Staphylococcus epidermidis
NLIGFNLLYKVLRPQFVQHAHI

SEQ ID NO: 1810627 - protein, 17 aa, Staphylococcus epidermidis
NLIKAIILALLVQCDLN

SEQ ID NO: 1810628 - protein, 18 aa, Staphylococcus epidermidis
NLILRFSYKGMDYKEYRL

SEQ ID NO: 1810629 - protein, 20 aa, Staphylococcus epidermidis
NLKCNKCGNTYDYYKFSNGH

SEQ ID NO: 1810630 - protein, 25 aa, Staphylococcus epidermidis
NLKNALKLIKLCQTYHVHILSVHDG

SEQ ID NO: 1810631 - protein, 31 aa, Staphylococcus epidermidis; identical to SEQ ID NO: 1671069

SEQ ID NO: 1810632 - protein, 20 aa, Staphylococcus epidermidis
NLKQYGLVQMSRLDMKKVAS

SEQ ID NO: 1810633 - protein, 26 aa, Staphylococcus epidermidis
NLKVGRYRFGDGINEQGVAISNHYFT

SEQ ID NO: 1810634 - protein, 24 aa, Staphylococcus epidermidis
NLKVREIKGLITTKFLQAQEKEIP

SEQ ID NO: 1810635 - protein, 27 aa, Staphylococcus epidermidis
NLLGWKIKEKMFLSHYTYREWDEKEMK

SEQ ID NO: 1810636 - protein, 23 aa, Staphylococcus epidermidis
NLLNKHKMGILFQKTEFPKYIKV

SEQ ID NO: 1810637 - protein, 26 aa, Staphylococcus epidermidis
NLLQRQFKASCPMEVLTTDITYLPFG

SEQ ID NO: 1810638 - protein, 17 aa, Staphylococcus epidermidis
NLLRIKWDQEIDYPLIE

SEQ ID NO: 1810639 - protein, 18 aa, Staphylococcus epidermidis
NLNIPRYVDTFEEEEPID

SEQ ID NO: 1810640 - protein, 20 aa, Staphylococcus epidermidis
NLNQKFNVITIFCDSLNYLS

SEQ ID NO: 1810641 - protein, 19 aa, Staphylococcus epidermidis
NLNRYIYKNIQGEFLEILH

SEQ ID NO: 1810642 - protein, 23 aa, Staphylococcus epidermidis
NLPDFFELQAGIAYGENNSIDGF

SEQ ID NO: 1810643 - protein, 25 aa, Staphylococcus epidermidis
NLPNKEFQLIFLLVSNPKHIFTRDD

SEQ ID NO: 1810644 - protein, 22 aa, Staphylococcus epidermidis
NLRELGFDVVRFKTGTPPRVNA

SEQ ID NO: 1810645 - protein, 19 aa, Staphylococcus epidermidis
NLRNYAARRGKSWKDLNTQ

SEQ ID NO: 1810646 - protein, 24 aa, Staphylococcus epidermidis
NLRSSGRMVGIISHVSELKQRIPL

SEQ ID NO: 1810647 - protein, 23 aa, Staphylococcus epidermidis
NLSKKFKKSFGVKELNFKLNQGE

SEQ ID NO: 1810648 - protein, 20 aa, Staphylococcus epidermidis
NLSLKCFKYTNNGANPLQLS

SEQ ID NO: 1810649 - protein, 24 aa, Staphylococcus epidermidis
NLTDFKYAELSKMGSHMYEVMTNR

SEQ ID NO: 1810650 - protein, 19 aa, Staphylococcus epidermidis
NLTHGFKNITIAGGGVLGS

SEQ ID NO: 1810651 - protein, 21 aa, Staphylococcus epidermidis
NLVIQEIKNSLSPYEEIVDSA

SEQ ID NO: 1810652 - protein, 23 aa, Staphylococcus epidermidis
NLVKDYATHISIMQQGQLIESGE

SEQ ID NO: 1810653 - protein, 25 aa, Staphylococcus epidermidis
NLVLLGIKTRGAFLANRIQDKIHSI

SEQ ID NO: 1810654 - protein, 18 aa, Staphylococcus epidermidis
NLYFDLAGKVLPYQLPTL

SEQ ID NO: 1810655 - protein, 23 aa, Staphylococcus epidermidis
NMADKFTKACIMTRPTKEDDKVI

SEQ ID NO: 1810656 - protein, 19 aa, Staphylococcus epidermidis
NMALEAFKATDCSGLVRAD

SEQ ID NO: 1810657 - protein, 23 aa, Staphylococcus epidermidis
NMAPFSIELCGGIHVNNTSEIGL

SEQ ID NO: 1810658 - protein, 18 aa, Staphylococcus epidermidis
NMAVFSMSVVSKLTELSP

SEQ ID NO: 1810659 - protein, 17 aa, Staphylococcus epidermidis
NMIRFIHKPLGFNTDLK

SEQ ID NO: 1810660 - protein, 25 aa, Staphylococcus epidermidis
NMLYRLGALGLNIGSEISIKQKCLL

SEQ ID NO: 1810661 - protein, 19 aa, Staphylococcus epidermidis
NMNFKDYFTSLKVIHAIKL

SEQ ID NO: 1810662 - protein, 26 aa, Staphylococcus epidermidis
NMNPVELRRSIGYVIQQIGLMPHMTI

SEQ ID NO: 1810663 - protein, 20 aa, Staphylococcus epidermidis
NMPVGVGSYVHYDRKLDGRI

SEQ ID NO: 1810664 - protein, 17 aa, Staphylococcus epidermidis
NNAKSVISPIIITNSDQ

SEQ ID NO: 1810665 - protein, 24 aa, Staphylococcus epidermidis
NNAVTEINKLTALNDAQRQKAIQN

SEQ ID NO: 1810666 - protein, 25 aa, Staphylococcus epidermidis
NNEFRMCNGGIRFLGVKDGKNAADP

SEQ ID NO: 1810667 - protein, 24 aa, Staphylococcus epidermidis
NNEGIKVGMIHGGLTPRERKQQMK

SEQ ID NO: 1810668 - protein, 22 aa, Staphylococcus epidermidis
NNEKLANILVHFRDKDKIISSV

SEQ ID NO: 1810669 - protein, 20 aa, Staphylococcus epidermidis
NNEKSVIFNTRYLKNNIEQV

SEQ ID NO: 1810670 - protein, 21 aa, Staphylococcus epidermidis
NNEKWKDTAFIFPESMKSLLP

SEQ ID NO: 1810671 - protein, 23 aa, Staphylococcus epidermidis
NNEYRFQILVKYKREPQLHHALQ

SEQ ID NO: 1810672 - protein, 18 aa, Staphylococcus epidermidis
NNFFKNDPSELFKDIGKQ

SEQ ID NO: 1810673 - protein, 25 aa, Staphylococcus epidermidis
NNFKGKEIFSALSKYEVKRRGDMED

SEQ ID NO: 1810674 - protein, 26 aa, Staphylococcus epidermidis
NNGKFKDFFDFARRIPKRVKTRKLLE

SEQ ID NO: 1810675 - protein, 25 aa, Staphylococcus epidermidis
NNHDPRLFEGFSMGNPKIQTGNLLE

SEQ ID NO: 1810676 - protein, 21 aa, Staphylococcus epidermidis
NNHLLPYFKSMDVFNMTTQDV

SEQ ID NO: 1810677 - protein, 18 aa, Staphylococcus epidermidis
NNHLVILIMVFSSGHVEN

SEQ ID NO: 1810678 - protein, 18 aa, Staphylococcus epidermidis
NNHREMFGDFPSKDFPLM

SEQ ID NO: 1810679 - protein, 26 aa, Staphylococcus epidermidis
NNHVKEVIAGFDFTFGKFGKGNMTVL

SEQ ID NO: 1810680 - protein, 23 aa, Staphylococcus epidermidis
NNIKLAEPILVIGNPLGTDFKGS

SEQ ID NO: 1810681 - protein, 17 aa, Staphylococcus epidermidis
NNIPKHELLILCTGSQG

SEQ ID NO: 1810682 - protein, 24 aa, Staphylococcus epidermidis
NNKYLPQREIVSIKDFESHIQAWS

SEQ ID NO: 1810683 - protein, 23 aa, Staphylococcus epidermidis
NNKYLPQREIVSIKDFESRIQTW

SEQ ID NO: 1810684 - protein, 25 aa, Staphylococcus epidermidis
NNLDHKRFNGVEVLRELSKYHGENI

SEQ ID NO: 1810685 - protein, 18 aa, Staphylococcus epidermidis
NNLIKFLKEENGLGYSTL

SEQ ID NO: 1810686 - protein, 20 aa, Staphylococcus epidermidis
NNLKRISPYYHIINEVEGLK

SEQ ID NO: 1810687 - protein, 22 aa, Staphylococcus epidermidis
NNLRTKFSHRMMQIDKGEVVCL

SEQ ID NO: 1810688 - protein, 22 aa, Staphylococcus epidermidis
NNLRVFKDIGIVKELTYGDASS

SEQ ID NO: 1810689 - protein, 24 aa, Staphylococcus epidermidis
NNNELGIGVGKGFYDYTNGVPYES

SEQ ID NO: 1810690 - protein, 18 aa, Staphylococcus epidermidis
NNPLKGKLADDWLQNIKL

SEQ ID NO: 1810691 - protein, 23 aa, Staphylococcus epidermidis
NNPLKGKVADDWIQNIKLMNNSN

SEQ ID NO: 1810692 - protein, 24 aa, Staphylococcus epidermidis
NNPLLEMLNFISIFSSNLDEFFMV

SEQ ID NO: 1810693 - protein, 17 aa, Staphylococcus epidermidis
NNQEVNELINFYKKVLA

SEQ ID NO: 1810694 - protein, 23 aa, Staphylococcus epidermidis
NNRFKGIIGLVTMKKVREPLEVT

SEQ ID NO: 1810695 - protein, 24 aa, Staphylococcus epidermidis
NNRIKRYIAKYTINPAITHGISDY

SEQ ID NO: 1810696 - protein, 24 aa, Staphylococcus epidermidis
NNRIKRYIAKYTINPAITHGISEY

SEQ ID NO: 1810697 - protein, 17 aa, Staphylococcus epidermidis
NNSELHVTSTHYDDPTL

SEQ ID NO: 1810698 - protein, 21 aa, Staphylococcus epidermidis
NNSYFSWLPLLNIDKLINLDK

SEQ ID NO: 1810699 - protein, 17 aa, Staphylococcus epidermidis
NNTRLVEMVRPQLSSVI

SEQ ID NO: 1810700 - protein, 18 aa, Staphylococcus epidermidis
NNTSILLEELCKDNIDVV

SEQ ID NO: 1810701 - protein, 17 aa, Staphylococcus epidermidis
NNTVPFIARYRKEATGG

SEQ ID NO: 1810702 - protein, 28 aa, Staphylococcus epidermidis
NNVKPNWCPGCGDFSVQAAIQKAAANVG

SEQ ID NO: 1810703 - protein, 21 aa, Staphylococcus epidermidis
NNVRFLRSRVDSLQKNVLFEK

SEQ ID NO: 1810704 - protein, 24 aa, Staphylococcus epidermidis
NNVTEVAMGYGFSTTSYFIQVFKE

SEQ ID NO: 1810705 - protein, 29 aa, Staphylococcus epidermidis
NNYMTIFKFRGHRIVAFNGGRFLIHEMTH

SEQ ID NO: 1810706 - protein, 27 aa, Staphylococcus epidermidis
NNYVYFDLYYKAAFMVDLYEYNNIDEN

SEQ ID NO: 1810707 - protein, 27 aa, Staphylococcus epidermidis
NPAPLAIKGTRILKTPLSPLLSSYFDT

SEQ ID NO: 1810708 - protein, 17 aa, Staphylococcus epidermidis
NPDEKWHGFNGYGKDQY

SEQ ID NO: 1810709 - protein, 27 aa, Staphylococcus epidermidis
NPDELFDAVLMTVKYIVREAGVSKEDI

SEQ ID NO: 1810710 - protein, 20 aa, Staphylococcus epidermidis
NPELARPEFETITWEVDTYR

SEQ ID NO: 1810711 - protein, 24 aa, Staphylococcus epidermidis
NPELPRPVGEDIVHYSDYFEGAQK

SEQ ID NO: 1810712 - protein, 21 aa, Staphylococcus epidermidis
NPFSDSMVRIGLGGIGGNGKK

SEQ ID NO: 1810713 - protein, 27 aa, Staphylococcus epidermidis
NPGRMQYATAIEWCNFQATTINSLYKK

SEQ ID NO: 1810714 - protein, 23 aa, Staphylococcus epidermidis
NPHKRGIYSGGVGYINCNHNLDF

SEQ ID NO: 1810715 - protein, 29 aa, Staphylococcus epidermidis
NPKQCKHEFLRYPYIESFENVDEVIQVAR

SEQ ID NO: 1810716 - protein, 23 aa, Staphylococcus epidermidis
NPKTKEIGSWMIVDHKEDAGETN

SEQ ID NO: 1810717 - protein, 18 aa, Staphylococcus epidermidis
NPKVFNAVHLFDENGFKT

SEQ ID NO: 1810718 - protein, 19 aa, Staphylococcus epidermidis
NPKVLAPLFDAYDVSPNQV

SEQ ID NO: 1810719 - protein, 18 aa, Staphylococcus epidermidis
NPLDGFVITVYINNDNTN

SEQ ID NO: 1810720 - protein, 24 aa, Staphylococcus epidermidis
NPLFKITDIHAVATLAKEHKLLLA

SEQ ID NO: 1810721 - protein, 19 aa, Staphylococcus epidermidis
NPLPKGWKIIRNERATVPK

SEQ ID NO: 1810722 - protein, 24 aa, Staphylococcus epidermidis
NPLSGQKLPIWIADYVLSTYGTGA

SEQ ID NO: 1810723 - protein, 19 aa, Staphylococcus epidermidis
NPLSMRAGIALLEVLEQDG

SEQ ID NO: 1810724 - protein, 27 aa, Staphylococcus epidermidis
NPLTEMIKFKYPRLFENIHKALHMVWP

SEQ ID NO: 1810725 - protein, 20 aa, Staphylococcus epidermidis
NPMGGYFFYGYVNHDKDYNF

SEQ ID NO: 1810726 - protein, 23 aa, Staphylococcus epidermidis
NPMSRTLFTWSIDKAELVIYRHL

SEQ ID NO: 1810727 - protein, 24 aa, Staphylococcus epidermidis
NPMTRIFNYFSFLILVSESLSSGA

SEQ ID NO: 1810728 - protein, 17 aa, Staphylococcus epidermidis
NPNLDKITIFRDELIQN

SEQ ID NO: 1810729 - protein, 25 aa, Staphylococcus epidermidis
NPNLKAFAPVREWAWSREEEIDYAI

SEQ ID NO: 1810730 - protein, 20 aa, Staphylococcus epidermidis
NPNLLYWNQFMNVTIAIHGY

SEQ ID NO: 1810731 - protein, 26 aa, Staphylococcus epidermidis
NPNMKFSLKFGGRALAIYLMQYKYFY

SEQ ID NO: 1810732 - protein, 28 aa, Staphylococcus epidermidis
NPNVRIIFRRGPLLASLKECYKVDFVKQ

SEQ ID NO: 1810733 - protein, 32 aa, Staphylococcus epidermidis
NPPEWLDKDAIKEWHRILPLIQELPIAALDMG

SEQ ID NO: 1810734 - protein, 18 aa, Staphylococcus epidermidis
NPPLNVKVATRLGHVKGY

SEQ ID NO: 1810735 - protein, 18 aa, Staphylococcus epidermidis
NPTGAYFVSGYINKNKKY

SEQ ID NO: 1810736 - protein, 18 aa, Staphylococcus epidermidis
NPYDLRDYFLIQSYYYHV

SEQ ID NO: 1810737 - protein, 26 aa, Staphylococcus epidermidis
NPYEEFKEYLNSRFENVNLKVKNVDQ

SEQ ID NO: 1810738 - protein, 18 aa, Staphylococcus epidermidis
NPYFCGQLDVPLTEKGMQ

SEQ ID NO: 1810739 - protein, 23 aa, Staphylococcus epidermidis
NQEGKKLGSQRFDYTPSANGLKL

SEQ ID NO: 1810740 - protein, 27 aa, Staphylococcus epidermidis
NQEGRRIFVTEVVCDSVQFLEPKNAQQ

SEQ ID NO: 1810741 - protein, 27 aa, Staphylococcus epidermidis
NQEGRRIFVTEVVCDSVQFLEPKNSQQ

SEQ ID NO: 1810742 - protein, 23 aa, Staphylococcus epidermidis
NQEPWTSCEFDFNNEGKLNVAFA

SEQ ID NO: 1810743 - protein, 24 aa, Staphylococcus epidermidis
NQEPWTSCEFDFTNEGKLNVAFAY

SEQ ID NO: 1810744 - protein, 24 aa, Staphylococcus epidermidis
NQEPWTSCEFDFTNKGKLNVAFAY

SEQ ID NO: 1810745 - protein, 17 aa, Staphylococcus epidermidis
NQFGVTIQQGYGLGEGI

SEQ ID NO: 1810746 - protein, 22 aa, Staphylococcus epidermidis
NQFPAGAPFGGYKKSGIGREVY

SEQ ID NO: 1810747 - protein, 21 aa, Staphylococcus epidermidis
NQFRIGLSRMERVVRERMSIQ

SEQ ID NO: 1810748 - protein, 27 aa, Staphylococcus epidermidis
NQFTQRISMPFLRSPFVHHIHPQPFHL

SEQ ID NO: 1810749 - protein, 19 aa, Staphylococcus epidermidis
NQGEICALIGRNGAGKSTL

SEQ ID NO: 1810750 - protein, 29 aa, Staphylococcus epidermidis
NQGEVCSAGSRLLVQSSIYDELLPKLKEA

SEQ ID NO: 1810751 - protein, 30 aa, Staphylococcus epidermidis
NQGEVCSAGSRLLVQSSIYDKLIPKLKEAF

SEQ ID NO: 1810752 - protein, 26 aa, Staphylococcus epidermidis
NQGGFLRKLYDATPFKEGVGIDLARL

SEQ ID NO: 1810753 - protein, 25 aa, Staphylococcus epidermidis
NQGGFLRKLYDTTPFKEGVGIDLAR

SEQ ID NO: 1810754 - protein, 23 aa, Staphylococcus epidermidis
NQHMHVLLCVENSYFKNKANYIT

SEQ ID NO: 1810755 - protein, 17 aa, Staphylococcus epidermidis
NQIDWRYVDHSSGLEPM

SEQ ID NO: 1810756 - protein, 28 aa, Staphylococcus epidermidis
NQIHLRKSLSRPYIFGMRKLEEDNSFSS

SEQ ID NO: 1810757 - protein, 25 aa, Staphylococcus epidermidis
NQILKEIISRLSFLNNVGLEYLTLN

SEQ ID NO: 1810758 - protein, 22 aa, Staphylococcus epidermidis
NQINNVLAFPGIFRGALDVEAT

SEQ ID NO: 1810759 - protein, 17 aa, Staphylococcus epidermidis
NQIPLFKICNHNLIQDV

SEQ ID NO: 1810760 - protein, 17 aa, Staphylococcus epidermidis
NQISQFRSAVVKNKQKY

SEQ ID NO: 1810761 - protein, 19 aa, Staphylococcus epidermidis
NQKDELYIFSGYAGSDKES

SEQ ID NO: 1810762 - protein, 24 aa, Staphylococcus epidermidis
NQLHRLRTKWDIHIIDIFNNEEIN

SEQ ID NO: 1810763 - protein, 32 aa, Staphylococcus epidermidis
NQLKSLGLNSNWDMLFIVFSIHLIDIAKQLKK

SEQ ID NO: 1810764 - protein, 22 aa, Staphylococcus epidermidis
NQNSPFVWILPITNRLKRFPSD

SEQ ID NO: 1810765 - protein, 24 aa, Staphylococcus epidermidis
NQPPQGIILPCYYDGKQWVGQTQD

SEQ ID NO: 1810766 - protein, 26 aa, Staphylococcus epidermidis
NQPYLKKKIELHGTVTVKGKWNRAKQ

SEQ ID NO: 1810767 - protein, 17 aa, Staphylococcus epidermidis
NQQRLLLYVKVDMSNVV

SEQ ID NO: 1810768 - protein, 17 aa, Staphylococcus epidermidis
NQQVLALESNKKIQKLE

SEQ ID NO: 1810769 - protein, 21 aa, Staphylococcus epidermidis
NRAQLIKKCEAFTDEVIKKDV

SEQ ID NO: 1810770 - protein, 31 aa, Staphylococcus epidermidis
NRATATYKFAGGKGINVSRVLKTLDVDSTAL

SEQ ID NO: 1810771 - protein, 21 aa, Staphylococcus epidermidis
NRCGKEIIGVVANIPKHFRTG

SEQ ID NO: 1810772 - protein, 25 aa, Staphylococcus epidermidis
NRDLRFIEDFSIKISDVMTKENLIT

SEQ ID NO: 1810773 - protein, 17 aa, Staphylococcus epidermidis
NRDNARTPMQWNNSING

SEQ ID NO: 1810774 - protein, 24 aa, Staphylococcus epidermidis
NRDQEVLDAFDIRLEPKYNSDIVP

SEQ ID NO: 1810775 - protein, 17 aa, Staphylococcus epidermidis
NREKMNFGVINILLQFV

SEQ ID NO: 1810776 - protein, 33 aa, Staphylococcus epidermidis
NRFHPDYYITVSWQRLREGKNIKEQDLVLLRHE

SEQ ID NO: 1810777 - protein, 20 aa, Staphylococcus epidermidis
NRFMHVAEFRRMNANINVEG

SEQ ID NO: 1810778 - protein, 20 aa, Staphylococcus epidermidis
NRGAANLALIAEDPELLSGI

SEQ ID NO: 1810779 - protein, 17 aa, Staphylococcus epidermidis
NRHILKLVSSIQETTQH

SEQ ID NO: 1810780 - protein, 18 aa, Staphylococcus epidermidis
NRIHTRFNQTLAQTGRLS

SEQ ID NO: 1810781 - protein, 17 aa, Staphylococcus epidermidis
NRIKRILNYSYGNSFDF

SEQ ID NO: 1810782 - protein, 26 aa, Staphylococcus epidermidis
NRITLEINRGELLGLIGPSGSGKTTT

SEQ ID NO: 1810783 - protein, 19 aa, Staphylococcus epidermidis
NRIYFGITEYGRLLLGADY

SEQ ID NO: 1810784 - protein, 21 aa, Staphylococcus epidermidis
NRKAEISKRFSSIQDYLLEYC

SEQ ID NO: 1810785 - protein, 18 aa, Staphylococcus epidermidis
NRKGHKIYEWEKIIQTVS

SEQ ID NO: 1810786 - protein, 20 aa, Staphylococcus epidermidis
NRKKIKLVVHHIKELADHPE

SEQ ID NO: 1810787 - protein, 17 aa, Staphylococcus epidermidis
NRLFYLAMSPKFFGVAT

SEQ ID NO: 1810788 - protein, 18 aa, Staphylococcus epidermidis
NRLKRFPSDISIETKNNS

SEQ ID NO: 1810789 - protein, 18 aa, Staphylococcus epidermidis
NRLLKGQVKSLMKTNATV

SEQ ID NO: 1810790 - protein, 21 aa, Staphylococcus epidermidis
NRLYTQLSLIGTRTHRITTKR

SEQ ID NO: 1810791 - protein, 24 aa, Staphylococcus epidermidis
NRNWESSKGKGLWMSLVLRPDVPF

SEQ ID NO: 1810792 - protein, 41 aa, Staphylococcus epidermidis
NRPDVKRKLSEAKYLNGKMEELKAIVAKAPSVRQNSNYINE

SEQ ID NO: 1810793 - protein, 17 aa, Staphylococcus epidermidis
NRPEVRNAFTPKTVAEM

SEQ ID NO: 1810794 - protein, 21 aa, Staphylococcus epidermidis
NRPNFHLFFHEFGFHATGRKK

SEQ ID NO: 1810795 - protein, 24 aa, Staphylococcus epidermidis
NRQVRRMFEHFGHQVNKLTRIQFG

SEQ ID NO: 1810796 - protein, 23 aa, Staphylococcus epidermidis
NRQVRRMFEYFGHQVNKLVRIQF

SEQ ID NO: 1810797 - protein, 20 aa, Staphylococcus epidermidis
NRRILKVILNEAITNEDFQN

SEQ ID NO: 1810798 - protein, 17 aa, Staphylococcus epidermidis
NRRLMIVPFKAKFTNTD

SEQ ID NO: 1810799 - protein, 18 aa, Staphylococcus epidermidis
NRTLDLAHQYEIIFTSGA

SEQ ID NO: 1810800 - protein, 22 aa, Staphylococcus epidermidis
NRTPNLYSFSLKSVYSDRKYPI

SEQ ID NO: 1810801 - protein, 25 aa, Staphylococcus epidermidis
NRVFKDKPGGLIVDYVGIAESLKEA

SEQ ID NO: 1810802 - protein, 17 aa, Staphylococcus epidermidis
NRVKYWLNELNISIYNE

SEQ ID NO: 1810803 - protein, 23 aa, Staphylococcus epidermidis
NRYKVKCVIYAPEGFSEEKISIM

SEQ ID NO: 1810804 - protein, 23 aa, Staphylococcus epidermidis
NRYLRKHADGISKIIQTMALVGD

SEQ ID NO: 1810805 - protein, 26 aa, Staphylococcus epidermidis
NRYRHFAGSYAIQWKMINYALEHGIN

SEQ ID NO: 1810806 - protein, 17 aa, Staphylococcus epidermidis
NSADSFRDLIKVLVELE

SEQ ID NO: 1810807 - protein, 18 aa, Staphylococcus epidermidis
NSAKNWLGKTTKNAVSNF

SEQ ID NO: 1810808 - protein, 18 aa, Staphylococcus epidermidis
NSAPLLFQAISKLKKHFK

SEQ ID NO: 1810809 - protein, 19 aa, Staphylococcus epidermidis
NSCGKCKGQIGELLQYTLG

SEQ ID NO: 1810810 - protein, 23 aa, Staphylococcus epidermidis
NSDFSSGWEGWINVDPQYSIVDK

SEQ ID NO: 1810811 - protein, 19 aa, Staphylococcus epidermidis
NSDVFTATRIISADIASTK

SEQ ID NO: 1810812 - protein, 18 aa, Staphylococcus epidermidis
NSEFDPMARKNYYKYKKF

SEQ ID NO: 1810813 - protein, 22 aa, Staphylococcus epidermidis
NSERYGAVYLVNLFSNIKTPEN

SEQ ID NO: 1810814 - protein, 17 aa, Staphylococcus epidermidis
NSESALKKYSLKAEEVG

SEQ ID NO: 1810815 - protein, 17 aa, Staphylococcus epidermidis
NSETGMINLCFEIFDDR

SEQ ID NO: 1810816 - protein, 28 aa, Staphylococcus epidermidis
NSFASCLLFPLNVRYKYRNVLNEYDVAD

SEQ ID NO: 1810817 - protein, 22 aa, Staphylococcus epidermidis
NSFNISTTVAFVVASAGVPVIK

SEQ ID NO: 1810818 - protein, 23 aa, Staphylococcus epidermidis
NSFQRLYERAGVVAQGERNAAAK

SEQ ID NO: 1810819 - protein, 17 aa, Staphylococcus epidermidis
NSGPWLKDTLREIEIAV

SEQ ID NO: 1810820 - protein, 29 aa, Staphylococcus epidermidis
NSGYSFNLFELELFKILLNTIEDFPVPTS

SEQ ID NO: 1810821 - protein, 17 aa, Staphylococcus epidermidis
NSHHRFSIHKSKYSFIV

SEQ ID NO: 1810822 - protein, 25 aa, Staphylococcus epidermidis
NSIEAMASFLNSFPMFKDDTRNTNP

SEQ ID NO: 1810823 - protein, 19 aa, Staphylococcus epidermidis
NSIFISLCENKEDFKSAGH

SEQ ID NO: 1810824 - protein, 19 aa, Staphylococcus epidermidis
NSIGFRGEASLQYKEKLQE

SEQ ID NO: 1810825 - protein, 19 aa, Staphylococcus epidermidis
NSIKAELGDNLFVLLCIAN

SEQ ID NO: 1810826 - protein, 25 aa, Staphylococcus epidermidis
NSIRAAQELLNFIGDYTIVTILTVV

SEQ ID NO: 1810827 - protein, 17 aa, Staphylococcus epidermidis
NSKFHSGAHSLGGYLAQ

SEQ ID NO: 1810828 - protein, 24 aa, Staphylococcus epidermidis
NSKGKFVGMPKLIEQFRDGMKGMT

SEQ ID NO: 1810829 - protein, 20 aa, Staphylococcus epidermidis
NSKGMPINIDMDLQFTDENI

SEQ ID NO: 1810830 - protein, 22 aa, Staphylococcus epidermidis
NSKRVLPEFQHAFESFDRHYTI

SEQ ID NO: 1810831 - protein, 20 aa, Staphylococcus epidermidis
NSKVFQLRVKNIVNKAQTVS

SEQ ID NO: 1810832 - protein, 22 aa, Staphylococcus epidermidis
NSLCVSCIATPGLVSITSSETL

SEQ ID NO: 1810833 - protein, 17 aa, Staphylococcus epidermidis
NSLGFGGHNAVLVFKKF

SEQ ID NO: 1810834 - protein, 25 aa, Staphylococcus epidermidis
NSLQPKPGSSFIVFGVGTVGLSAIM

SEQ ID NO: 1810835 - protein, 18 aa, Staphylococcus epidermidis
NSLRGIIEERYLLFILEQ

SEQ ID NO: 1810836 - protein, 18 aa, Staphylococcus epidermidis
NSLRGLIEERYLLFMLEQ

SEQ ID NO: 1810837 - protein, 23 aa, Staphylococcus epidermidis
NSMNCLMEVLGLALPYNGTALSV

SEQ ID NO: 1810838 - protein, 19 aa, Staphylococcus epidermidis
NSNEIMYLDLVKIINSALP

SEQ ID NO: 1810839 - protein, 28 aa, Staphylococcus epidermidis
NSNFKGVNWSTRLCQDMAVVQKEVEKTT

SEQ ID NO: 1810840 - protein, 25 aa, Staphylococcus epidermidis
NSNLIRLIFDEGFIAIRPSGTEPKI

SEQ ID NO: 1810841 - protein, 22 aa, Staphylococcus epidermidis
NSNPIWIYRALCDYYLNKKKDL

SEQ ID NO: 1810842 - protein, 19 aa, Staphylococcus epidermidis
NSPGGNAFDGLEIYNYLKD

SEQ ID NO: 1810843 - protein, 23 aa, Staphylococcus epidermidis
NSPKLLKTLILLHGLSSDETTYI

SEQ ID NO: 1810844 - protein, 25 aa, Staphylococcus epidermidis
NSSNCPYRNFLFSWYYKKYDKEPDF

SEQ ID NO: 1810845 - protein, 25 aa, Staphylococcus epidermidis
NSSYLIDLLENFALERGVYGKRWLD

SEQ ID NO: 1810846 - protein, 22 aa, Staphylococcus epidermidis
NSTSEIGQFFVGRYSINANKEI

SEQ ID NO: 1810847 - protein, 25 aa, Staphylococcus epidermidis
NSYDPRLFEGFSMGNPKIQTGNLLE

SEQ ID NO: 1810848 - protein, 17 aa, Staphylococcus epidermidis
NSYLFKNNNDIKVFFKY

SEQ ID NO: 1810849 - protein, 18 aa, Staphylococcus epidermidis
NTAIEYVKTFSVDKPKSL

SEQ ID NO: 1810850 - protein, 24 aa, Staphylococcus epidermidis
NTDKAYEIYQIWCANNGYHHMNKM

SEQ ID NO: 1810851 - protein, 18 aa, Staphylococcus epidermidis
NTDLYYEKMIELIKPLGH

SEQ ID NO: 1810852 - protein, 19 aa, Staphylococcus epidermidis
NTEDIYAGIEFKEGTSEVK

SEQ ID NO: 1810853 - protein, 22 aa, Staphylococcus epidermidis
NTEIKFKLTIEDEIYSINEIEQ

SEQ ID NO: 1810854 - protein, 26 aa, Staphylococcus epidermidis
NTELEVVEGMQFDRGYQSPYMVTDSD

SEQ ID NO: 1810855 - protein, 24 aa, Staphylococcus epidermidis
NTELPQNITICSGLIKADKYEWMI

SEQ ID NO: 1810856 - protein, 21 aa, Staphylococcus epidermidis
NTFFNRESWETMLKEAHFNPL

SEQ ID NO: 1810857 - protein, 17 aa, Staphylococcus epidermidis
NTFTLFNINLSWIESRP

SEQ ID NO: 1810858 - protein, 18 aa, Staphylococcus epidermidis
NTFTLFNINLSWIESRPL

SEQ ID NO: 1810859 - protein, 20 aa, Staphylococcus epidermidis
NTGTPWLGPDVQDLTRDLYN

SEQ ID NO: 1810860 - protein, 24 aa, Staphylococcus epidermidis
NTHARIPVCGAISSYNHPEDDIGP

SEQ ID NO: 1810861 - protein, 18 aa, Staphylococcus epidermidis
NTIFLRYDVNVEKKDGFK

SEQ ID NO: 1810862 - protein, 17 aa, Staphylococcus epidermidis
NTIPSIVKLYVTLDIDI

SEQ ID NO: 1810863 - protein, 20 aa, Staphylococcus epidermidis
NTISKLARFASFQEANGLVP

SEQ ID NO: 1810864 - protein, 18 aa, Staphylococcus epidermidis
NTKINTVITMIGEHMDSN

SEQ ID NO: 1810865 - protein, 23 aa, Staphylococcus epidermidis
NTKSRFEAYGWNYILVKDGNDLE

SEQ ID NO: 1810866 - protein, 24 aa, Staphylococcus epidermidis
NTLKSQYYVYAFIKLFKEKYNNDV

SEQ ID NO: 1810867 - protein, 21 aa, Staphylococcus epidermidis
NTLPINFDNIFEIANQIDKLI

SEQ ID NO: 1810868 - protein, 20 aa, Staphylococcus epidermidis
NTLPRAIDYLDLNWPKDTEF

SEQ ID NO: 1810869 - protein, 17 aa, Staphylococcus epidermidis
NTLQIRQLHPFPKDTIQ

SEQ ID NO: 1810870 - protein, 24 aa, Staphylococcus epidermidis
NTNERYKLIILRKGRGLAGTVMKT

SEQ ID NO: 1810871 - protein, 25 aa, Staphylococcus epidermidis
NTNWPVCGIPEKFYTDHGSDFTSHH

SEQ ID NO: 1810872 - protein, 21 aa, Staphylococcus epidermidis
NTNYPSVFSNFISVGKGQEVA

SEQ ID NO: 1810873 - protein, 17 aa, Staphylococcus epidermidis
NTQMVFGNYIDVYDMTQ

SEQ ID NO: 1810874 - protein, 28 aa, Staphylococcus epidermidis
NTRGSIFTVAMGKLQIFLEQDIAKMTST

SEQ ID NO: 1810875 - protein, 24 aa, Staphylococcus epidermidis
NTRKLKINRQFIFATHNANIPVFG

SEQ ID NO: 1810876 - protein, 17 aa, Staphylococcus epidermidis
NTSGLVVFAKFGHVHHL

SEQ ID NO: 1810877 - protein, 30 aa, Staphylococcus epidermidis
NTSTIIPMCHPLPLTGIDVQFEWDSTQAPS

SEQ ID NO: 1810878 - protein, 35 aa, Staphylococcus epidermidis
NTSTIIPMCHPLPLTGIDVSFKWGSNNDDSYRLNI

SEQ ID NO: 1810879 - protein, 20 aa, Staphylococcus epidermidis
NTSYAPWYIVLADHKKTSRI

SEQ ID NO: 1810880 - protein, 19 aa, Staphylococcus epidermidis
NTSYAPWYIVPADHKKTGR

SEQ ID NO: 1810881 - protein, 18 aa, Staphylococcus epidermidis
NTTFPIYAAAGVQMSTIT

SEQ ID NO: 1810882 - protein, 19 aa, Staphylococcus epidermidis
NTWRYRISLGKDAKTGKYK

SEQ ID NO: 1810883 - protein, 21 aa, Staphylococcus epidermidis
NTYGRIRAMVNDLGKRIKSAG

SEQ ID NO: 1810884 - protein, 20 aa, Staphylococcus epidermidis
NVAERRLERLINPQLNGDLP

SEQ ID NO: 1810885 - protein, 21 aa, Staphylococcus epidermidis
NVDEVKRGSNYVNEDQTEQHN

SEQ ID NO: 1810886 - protein, 21 aa, Staphylococcus epidermidis
NVDLFLRNAHRIPDYASNRVT

SEQ ID NO: 1810887 - protein, 19 aa, Staphylococcus epidermidis
NVEEVYKTLVLENANHEHF

SEQ ID NO: 1810888 - protein, 25 aa, Staphylococcus epidermidis
NVEIYYKTVCNFEYTFDGTYRNIYC

SEQ ID NO: 1810889 - protein, 28 aa, Staphylococcus epidermidis
NVESSGIIKKLFLLGIMANINQSLDEET

SEQ ID NO: 1810890 - protein, 34 aa, Staphylococcus epidermidis
NVFSKYPNIKWIVPHCGALLPVIAQRVAMGNKMF

SEQ ID NO: 1810891 - protein, 25 aa, Staphylococcus epidermidis
NVGDPLIRFDLEYIKNNAKSVISPI

SEQ ID NO: 1810892 - protein, 20 aa, Staphylococcus epidermidis
NVIEQGCRIVVVNRELELEG

SEQ ID NO: 1810893 - protein, 24 aa, Staphylococcus epidermidis
NVIHFVGTFTVEFFIDRNNKLYVN

SEQ ID NO: 1810894 - protein, 23 aa, Staphylococcus epidermidis
NVIHLKAVFIHKSISRIQSLNVD

SEQ ID NO: 1810895 - protein, 18 aa, Staphylococcus epidermidis
NVIKRLIQVQNQFKTFYN

SEQ ID NO: 1810896 - protein, 19 aa, Staphylococcus epidermidis
NVIPQEFQHLYDAKQSGED

SEQ ID NO: 1810897 - protein, 24 aa, Staphylococcus epidermidis
NVIYEMKSTIALLHKFEVETIFDL

SEQ ID NO: 1810898 - protein, 28 aa, Staphylococcus epidermidis
NVKIIDRFSWEYFYYVTVAKYFILNMRQ

SEQ ID NO: 1810899 - protein, 18 aa, Staphylococcus epidermidis
NVKLKNILIKNGGGKGND

SEQ ID NO: 1810900 - protein, 22 aa, Staphylococcus epidermidis
NVKVYLPPVIKAYLNDDNTNIV

SEQ ID NO: 1810901 - protein, 17 aa, Staphylococcus epidermidis
NVLDVRNVEEWNNGHLD

SEQ ID NO: 1810902 - protein, 20 aa, Staphylococcus epidermidis
NVLLDSFNCKVILVGNKNSI

SEQ ID NO: 1810903 - protein, 20 aa, Staphylococcus epidermidis
NVQFDVMLASYIIDPSRAID

SEQ ID NO: 1810904 - protein, 24 aa, Staphylococcus epidermidis
NVRNFNDEVCMEHGLSVPEKDTAR

SEQ ID NO: 1810905 - protein, 24 aa, Staphylococcus epidermidis
NVSFPDLPGALTYGKGIEEAIEMA

SEQ ID NO: 1810906 - protein, 18 aa, Staphylococcus epidermidis
NVSSRKGLKEGDQGIDDL

SEQ ID NO: 1810907 - protein, 23 aa, Staphylococcus epidermidis
NVSSTARASFYVYNTKEDVDQLV

SEQ ID NO: 1810908 - protein, 17 aa, Staphylococcus epidermidis
NVTFNDFYMCYKYDTRL

SEQ ID NO: 1810909 - protein, 20 aa, Staphylococcus epidermidis
NVTGKWSWLAPPLSPTLTSN

SEQ ID NO: 1810910 - protein, 28 aa, Staphylococcus epidermidis
NVTIALMSGNFVMRGEPAIYNKFTRTEM

SEQ ID NO: 1810911 - protein, 19 aa, Staphylococcus epidermidis
NVTLFKRSGRNIILTAEGK

SEQ ID NO: 1810912 - protein, 18 aa, Staphylococcus epidermidis
NVVNLDGGYMAYEQQHNN

SEQ ID NO: 1810913 - protein, 25 aa, Staphylococcus epidermidis
NVVTRPIMEEWLFNTVAFIGGPSEI

SEQ ID NO: 1810914 - protein, 26 aa, Staphylococcus epidermidis
NVVTRPVVEEWLFNTVAFIGGPSEIK

SEQ ID NO: 1810915 - protein, 25 aa, Staphylococcus epidermidis
NVYGVACPGFVPLVEQMRYNDPTIT

SEQ ID NO: 1810916 - protein, 19 aa, Staphylococcus epidermidis
NVYLAGPIQLLNRPKHDEF

SEQ ID NO: 1810917 - protein, 17 aa, Staphylococcus epidermidis
NVYPTKNLEDFYDKEGY

SEQ ID NO: 1810918 - protein, 17 aa, Staphylococcus epidermidis
NWESIFNGSTWEFDEST

SEQ ID NO: 1810919 - protein, 29 aa, Staphylococcus epidermidis
NWKNETHFFKSHESFIIYYLKQLNVDLSV

SEQ ID NO: 1810920 - protein, 21 aa, Staphylococcus epidermidis
NWKNLMRYKEQVINPMSETLT

SEQ ID NO: 1810921 - protein, 18 aa, Staphylococcus epidermidis
NWLHYWEEECGYTVRDVH

SEQ ID NO: 1810922 - protein, 25 aa, Staphylococcus epidermidis
NWLHYWRNECGYTIKPVSETNDVRI

SEQ ID NO: 1810923 - protein, 17 aa, Staphylococcus epidermidis
NYCRYCEKVEYYFKDKP

SEQ ID NO: 1810924 - protein, 27 aa, Staphylococcus epidermidis
NYDVLKEMFISMIYKNVSSIYLDFSLN

SEQ ID NO: 1810925 - protein, 18 aa, Staphylococcus epidermidis
NYEWDRYYLENVGIDRLK

SEQ ID NO: 1810926 - protein, 17 aa, Staphylococcus epidermidis
NYFFIKKPKRMKYINKF

SEQ ID NO: 1810927 - protein, 19 aa, Staphylococcus epidermidis
NYGERGIKVCDEWHNLKEF

SEQ ID NO: 1810928 - protein, 20 aa, Staphylococcus epidermidis
NYIEEMRPLIQLAYQTYVSK

SEQ ID NO: 1810929 - protein, 26 aa, Staphylococcus epidermidis
NYKHFAYVIKMLPQIIEKLRDNGKKI

SEQ ID NO: 1810930 - protein, 29 aa, Staphylococcus epidermidis
NYKLLSGSIIPRPIAFVTTQNLKGDVNAA

SEQ ID NO: 1810931 - protein, 24 aa, Staphylococcus epidermidis
NYLYRPNHPRSFSFIPGPASRLSW

SEQ ID NO: 1810932 - protein, 22 aa, Staphylococcus epidermidis
NYMKRIKLKYVTYYDKDYPLLL

SEQ ID NO: 1810933 - protein, 18 aa, Staphylococcus epidermidis
NYMLNLQKRKEEVIHNID

SEQ ID NO: 1810934 - protein, 24 aa, Staphylococcus epidermidis
NYMRIQSLEFAWSLLEDERQKLKS

SEQ ID NO: 1810935 - protein, 24 aa, Staphylococcus epidermidis
NYNDFKYLYIVTMFNGFNTLIGFK

SEQ ID NO: 1810936 - protein, 17 aa, Staphylococcus epidermidis
NYNGIKVYNEYGGQLLP

SEQ ID NO: 1810937 - protein, 20 aa, Staphylococcus epidermidis
NYNIPFEVVPGITSGIAAPA

SEQ ID NO: 1810938 - protein, 19 aa, Staphylococcus epidermidis
NYPEIKVPLAPKGTDFQQK

SEQ ID NO: 1810939 - protein, 24 aa, Staphylococcus epidermidis
NYQRLKGIKEWSFGLFEGESVSLL

SEQ ID NO: 1810940 - protein, 26 aa, Staphylococcus epidermidis
NYQVCPRETMFSGFKLNCTYFKEILK

SEQ ID NO: 1810941 - protein, 20 aa, Staphylococcus epidermidis
NYRKPGAGAYPLRGHNNVQG

SEQ ID NO: 1810942 - protein, 17 aa, Staphylococcus epidermidis
NYRTIWRNVSSKLSDIK

SEQ ID NO: 1810943 - protein, 17 aa, Staphylococcus epidermidis
NYSPVIIEYKRTTNENV

SEQ ID NO: 1810944 - protein, 38 aa, Staphylococcus epidermidis
NYTAIGIMCDFKLGCRNSCDPLKINGTFRKWIKRVEDE

SEQ ID NO: 1810945 - protein, 18 aa, Staphylococcus epidermidis
NYTKKPLVEFGKSKASLL

SEQ ID NO: 1810946 - protein, 17 aa, Staphylococcus epidermidis
NYVKHLAENLGYRTELT

SEQ ID NO: 1810947 - protein, 19 aa, Staphylococcus epidermidis
NYVMKWKETEIFFDKLTDL

SEQ ID NO: 1810948 - protein, 18 aa, Staphylococcus epidermidis
NYWNKRSQSFVQHKKEEL

SEQ ID NO: 1810949 - protein, 17 aa, Staphylococcus epidermidis
NYYGEIFDVGHFISNLH

SEQ ID NO: 1810950 - protein, 26 aa, Staphylococcus epidermidis
NYYPFELSGGMAQRVAFIMSLIRQPE

SEQ ID NO: 1810951 - protein, 20 aa, Staphylococcus epidermidis
NYYRYKKFGIPPEFEYEREE

SEQ ID NO: 1810952 - protein, 19 aa, Staphylococcus epidermidis
NYYVKRFMITVPFENINVQ

SEQ ID NO: 1810953 - protein, 17 aa, Staphylococcus epidermidis
PAARSMVVMAVYQMYND

SEQ ID NO: 1810954 - protein, 19 aa, Staphylococcus epidermidis
PAEYRVCKTNEGLLNIKRT

SEQ ID NO: 1810955 - protein, 18 aa, Staphylococcus epidermidis
PAGALSVAALENYRTQIK

SEQ ID NO: 1810956 - protein, 19 aa, Staphylococcus epidermidis
PAGKPWSEFQRVRDEIKAA

SEQ ID NO: 1810957 - protein, 19 aa, Staphylococcus epidermidis
PAGNKYIMRHMKVLSKAKI

SEQ ID NO: 1810958 - protein, 25 aa, Staphylococcus epidermidis
PAHLESRFLPGRHYATFNLQGEIDY

SEQ ID NO: 1810959 - protein, 19 aa, Staphylococcus epidermidis
PAIEEMRLPIQYLANLLTA

SEQ ID NO: 1810960 - protein, 17 aa, Staphylococcus epidermidis
PAKNFKGPIGRYETVLA

SEQ ID NO: 1810961 - protein, 21 aa, Staphylococcus epidermidis
PAKNRIIEFVINKNLPKGRYF

SEQ ID NO: 1810962 - protein, 17 aa, Staphylococcus epidermidis
PALCSLASRIPYGEALS

SEQ ID NO: 1810963 - protein, 25 aa, Staphylococcus epidermidis
PALKDGKIVLCDRYIDSSLAYQGYA

SEQ ID NO: 1810964 - protein, 18 aa, Staphylococcus epidermidis
PANDPALFDATVKNVAKF

SEQ ID NO: 1810965 - protein, 34 aa, Staphylococcus epidermidis
PAPPAELIPQFDYVKEISQQFGFVNVGVSNYEAD

SEQ ID NO: 1810966 - protein, 23 aa, Staphylococcus epidermidis
PAPRGVPQIEVTFDIDKNGIVNV

SEQ ID NO: 1810967 - protein, 21 aa, Staphylococcus epidermidis
PAQEPPYTRLIDSARRQPEET

SEQ ID NO: 1810968 - protein, 17 aa, Staphylococcus epidermidis
PASEARNKDCGLLLAYE

SEQ ID NO: 1810969 - protein, 19 aa, Staphylococcus epidermidis
PASGTQIIDEWGKHQMETG

SEQ ID NO: 1810970 - protein, 22 aa, Staphylococcus epidermidis
PASSAYVNAWIRQIQSESGGNA

SEQ ID NO: 1810971 - protein, 24 aa, Staphylococcus epidermidis
PATAEILKGIPLAAFDVQSELTTP

SEQ ID NO: 1810972 - protein, 17 aa, Staphylococcus epidermidis
PATIFNLNYGKLHKDSY

SEQ ID NO: 1810973 - protein, 20 aa, Staphylococcus epidermidis
PATQCLIEKSIAGFKEIEYE

SEQ ID NO: 1810974 - protein, 24 aa, Staphylococcus epidermidis
PAVLGIYPHTVFELAKRIIPSEKV

SEQ ID NO: 1810975 - protein, 18 aa, Staphylococcus epidermidis
PCGACRQVLKELCDDDMP

SEQ ID NO: 1810976 - protein, 18 aa, Staphylococcus epidermidis
PCSFPESLLITGQTYDCI

SEQ ID NO: 1810977 - protein, 20 aa, Staphylococcus epidermidis
PCSGLGVLRHKPEIKYTQSK

SEQ ID NO: 1810978 - protein, 21 aa, Staphylococcus epidermidis
PDAKVSLLKLVREVKEDNEVT

SEQ ID NO: 1810979 - protein, 22 aa, Staphylococcus epidermidis
PDAYSQKGAISLNTRLDSNRSF

SEQ ID NO: 1810980 - protein, 23 aa, Staphylococcus epidermidis
PDDRLFPFICKLDDPLEVDNPEM

SEQ ID NO: 1810981 - protein, 25 aa, Staphylococcus epidermidis
PDFDKVVKYESVFNFDEMIENAVEN

SEQ ID NO: 1810982 - protein, 17 aa, Staphylococcus epidermidis
PDFKGKRVLDLGCGYGW

SEQ ID NO: 1810983 - protein, 20 aa, Staphylococcus epidermidis
PDFLNCGIDIHFDGNLTEND

SEQ ID NO: 1810984 - protein, 17 aa, Staphylococcus epidermidis
PDFSTKVLEMLIAEHEV

SEQ ID NO: 1810985 - protein, 18 aa, Staphylococcus epidermidis
PDGTLYFYNKDSNWTTTD

SEQ ID NO: 1810986 - protein, 17 aa, Staphylococcus epidermidis
PDIILSVHGVDIHYRDP

SEQ ID NO: 1810987 - protein, 18 aa, Staphylococcus epidermidis
PDINKFVAGLTVDKTEAD

SEQ ID NO: 1810988 - protein, 21 aa, Staphylococcus epidermidis
PDKFKRYEASISNEEMFIVIG

SEQ ID NO: 1810989 - protein, 17 aa, Staphylococcus epidermidis
PDKGSAEEITWLKSDIF

SEQ ID NO: 1810990 - protein, 18 aa, Staphylococcus epidermidis
PDKTEFDDMISLMSMHKK

SEQ ID NO: 1810991 - protein, 17 aa, Staphylococcus epidermidis
PDLIKSASYPNILPSST

SEQ ID NO: 1810992 - protein, 29 aa, Staphylococcus epidermidis
PDLPELLKYLKLKLSDFIQLHTGEQYFVS

SEQ ID NO: 1810993 - protein, 17 aa, Staphylococcus epidermidis
PDMPNTDPLFIGAIVDE

SEQ ID NO: 1810994 - protein, 20 aa, Staphylococcus epidermidis
PDNFKTLTLKDGYYEVGKDI

SEQ ID NO: 1810995 - protein, 24 aa, Staphylococcus epidermidis
PDNSIKAAGGFIIQVMPGAKDETV

SEQ ID NO: 1810996 - protein, 25 aa, Staphylococcus epidermidis
PDPEIFKATTSFNFDVLSERLQESA

SEQ ID NO: 1810997 - protein, 19 aa, Staphylococcus epidermidis
PDQWYSGIVQPIIEELDTF

SEQ ID NO: 1810998 - protein, 20 aa, Staphylococcus epidermidis
PDSIEYLTICQRLDDSERDK

SEQ ID NO: 1810999 - protein, 19 aa, Staphylococcus epidermidis
PDSKANRWLTALTIDCEKT

SEQ ID NO: 1811000 - protein, 25 aa, Staphylococcus epidermidis
PDSLQYCLVMAIRGLNRLLKNNRFT

SEQ ID NO: 1811001 - protein, 30 aa, Staphylococcus epidermidis
PDTSRHHLRLCGGFQFSSHKSDDEWREYGL

SEQ ID NO: 1811002 - protein, 23 aa, Staphylococcus epidermidis
PDTTYPKGTFKVAHVENNAQSEL

SEQ ID NO: 1811003 - protein, 31 aa, Staphylococcus epidermidis
PDVRNAVFEMMNWWFEKGIDGFRVDAITHIK

SEQ ID NO: 1811004 - protein, 31 aa, Staphylococcus epidermidis
PDVRQAVFDMMNWWFEKGIDGFRVDAITHIK

SEQ ID NO: 1811005 - protein, 21 aa, Staphylococcus epidermidis
PDVSIPKERGFLPGNGAITSV

SEQ ID NO: 1811006 - protein, 18 aa, Staphylococcus epidermidis
PDYDRPWNYLNVLAQQAL

SEQ ID NO: 1811007 - protein, 21 aa, Staphylococcus epidermidis
PDYSKTLNWQKYKLTNDDGTL

SEQ ID NO: 1811008 - protein, 27 aa, Staphylococcus epidermidis
PEANKVLQFYVRYGGEFQLKQGFSPAF

SEQ ID NO: 1811009 - protein, 17 aa, Staphylococcus epidermidis
PEARPGPSDSNYLFDEF

SEQ ID NO: 1811010 - protein, 25 aa, Staphylococcus epidermidis
PEDPRFTDRFELFIVGREHANAFTE

SEQ ID NO: 1811011 - protein, 20 aa, Staphylococcus epidermidis
PEEAPGVGMRFIQINEIKLA

SEQ ID NO: 1811012 - protein, 20 aa, Staphylococcus epidermidis
PEELKRQISMTTETVTVREN

SEQ ID NO: 1811013 - protein, 17 aa, Staphylococcus epidermidis
PEELSRILSKIVPKSLF

SEQ ID NO: 1811014 - protein, 26 aa, Staphylococcus epidermidis
PEEMPARIPIGQPINGTTVYVMQGDR

SEQ ID NO: 1811015 - protein, 24 aa, Staphylococcus epidermidis
PEENDVFMINKFVSAVEKEMGYKF

SEQ ID NO: 1811016 - protein, 17 aa, Staphylococcus epidermidis
PEFGDKVAKFISDNTGY

SEQ ID NO: 1811017 - protein, 17 aa, Staphylococcus epidermidis
PEFIGFVDLIVKRKGTN

SEQ ID NO: 1811018 - protein, 17 aa, Staphylococcus epidermidis
PEGAAALLWKDSNLAKI

SEQ ID NO: 1811019 - protein, 17 aa, Staphylococcus epidermidis
PEGAAALLWKDSNLAQI

SEQ ID NO: 1811020 - protein, 26 aa, Staphylococcus epidermidis
PEGIYLSGALLMFAGNKSYYLYGASS

SEQ ID NO: 1811021 - protein, 17 aa, Staphylococcus epidermidis
PEHPGWLVMEVCGGQTE

SEQ ID NO: 1811022 - protein, 18 aa, Staphylococcus epidermidis
PEHPGWLVMEVCGGQTES

SEQ ID NO: 1811023 - protein, 17 aa, Staphylococcus epidermidis
PEIFVEFDASSKGLEIL

SEQ ID NO: 1811024 - protein, 17 aa, Staphylococcus epidermidis
PEIKDMLTHFYAENIEH

SEQ ID NO: 1811025 - protein, 18 aa, Staphylococcus epidermidis
PEIKDMLTHFYAENIEHR

SEQ ID NO: 1811026 - protein, 23 aa, Staphylococcus epidermidis
PEIKNKQSLILLHITKIMKIETR

SEQ ID NO: 1811027 - protein, 24 aa, Staphylococcus epidermidis
PEILADFYSSGVIEVLRRWVENDY

SEQ ID NO: 1811028 - protein, 21 aa, Staphylococcus epidermidis
PEIRMPKVGGRVMSLQDPTKK

SEQ ID NO: 1811029 - protein, 18 aa, Staphylococcus epidermidis
PEISSFVKSIINLRNIPE

SEQ ID NO: 1811030 - protein, 18 aa, Staphylococcus epidermidis
PEIYKQKLYQLGIEPKII

SEQ ID NO: 1811031 - protein, 22 aa, Staphylococcus epidermidis
PEKYDAIYFTGGHGVMYDFPEN

SEQ ID NO: 1811032 - protein, 24 aa, Staphylococcus epidermidis
PEKYIKLFAEHGADMISVHVEATP

SEQ ID NO: 1811033 - protein, 21 aa, Staphylococcus epidermidis
PEKYYTLSIKVDGYEFTFNTQ

SEQ ID NO: 1811034 - protein, 23 aa, Staphylococcus epidermidis
PELKHSRILKEWSGVRPYTDNEV

SEQ ID NO: 1811035 - protein, 21 aa, Staphylococcus epidermidis
PELMSELASPFAAIYDTKAKN

SEQ ID NO: 1811036 - protein, 17 aa, Staphylococcus epidermidis
PELPNTIEVLGKEKVLS

SEQ ID NO: 1811037 - protein, 20 aa, Staphylococcus epidermidis
PEMGVSFSNPFPEIKNANDQ

SEQ ID NO: 1811038 - protein, 18 aa, Staphylococcus epidermidis
PENCLKRRKSYGSTGQES

SEQ ID NO: 1811039 - protein, 21 aa, Staphylococcus epidermidis
PENQAAIKFAQEHGITVVIAT

SEQ ID NO: 1811040 - protein, 17 aa, Staphylococcus epidermidis
PEPYKGKGIRYQGEYVR

SEQ ID NO: 1811041 - protein, 31 aa, Staphylococcus epidermidis
PEQLFAAGYASCFNGAFDLILKQNKVRDAEP

SEQ ID NO: 1811042 - protein, 30 aa, Staphylococcus epidermidis
PEQLFAAGYSACFNSALSLILSQNKVNDAN

SEQ ID NO: 1811043 - protein, 24 aa, Staphylococcus epidermidis
PEQLPRARYQIHFQAQKDGMITEM

SEQ ID NO: 1811044 - protein, 23 aa, Staphylococcus epidermidis
PEQLYYLMSRGISRTEAERLVIH

SEQ ID NO: 1811045 - protein, 29 aa, Staphylococcus epidermidis
PEQMLKFGLPRLVKYLNMNIEKEQQRLKE

SEQ ID NO: 1811046 - protein, 23 aa, Staphylococcus epidermidis
PEQMVISTMMLRSMQQAHYDDVN

SEQ ID NO: 1811047 - protein, 17 aa, Staphylococcus epidermidis
PEQQNFTLLKLGDNVTF

SEQ ID NO: 1811048 - protein, 24 aa, Staphylococcus epidermidis
PERFWPADLVLLSIGFVGTETTIP

SEQ ID NO: 1811049 - protein, 21 aa, Staphylococcus epidermidis
PERHPAMVAIQSWSQWFTDHG

SEQ ID NO: 1811050 - protein, 24 aa, Staphylococcus epidermidis
PERTEGYEGFYHLMKFEGNVEKAT

SEQ ID NO: 1811051 - protein, 30 aa, Staphylococcus epidermidis
PESEVNYIMNLPVNFLKTFLPELIEKNVKV

SEQ ID NO: 1811052 - protein, 17 aa, Staphylococcus epidermidis
PESFVKVKDGWVYTNPI

SEQ ID NO: 1811053 - protein, 19 aa, Staphylococcus epidermidis
PESISFLLTDEGAGAQVPM

SEQ ID NO: 1811054 - protein, 26 aa, Staphylococcus epidermidis
PESSLRAGAFGLPITYAIIGGNPRRF

SEQ ID NO: 1811055 - protein, 20 aa, Staphylococcus epidermidis
PETLMPAIIELKKAYEDAKL

SEQ ID NO: 1811056 - protein, 21 aa, Staphylococcus epidermidis
PETLMPAIIELKKAYHVAKKD

SEQ ID NO: 1811057 - protein, 21 aa, Staphylococcus epidermidis
PETLPILNGVLDYRRQITNPY

SEQ ID NO: 1811058 - protein, 23 aa, Staphylococcus epidermidis
PETSWKERARVKNLRKSENYNYE

SEQ ID NO: 1811059 - protein, 26 aa, Staphylococcus epidermidis
PETSYPLKIRVRRHGDVFKLNGKKGH

SEQ ID NO: 1811060 - protein, 20 aa, Staphylococcus epidermidis
PEVFDEVGYELTLMDDYKEY

SEQ ID NO: 1811061 - protein, 21 aa, Staphylococcus epidermidis
PEVHPGPTLLNVGRIDYAENF

SEQ ID NO: 1811062 - protein, 21 aa, Staphylococcus epidermidis
PEVHPGPTLLNVGRIDYSDEF

SEQ ID NO: 1811063 - protein, 23 aa, Staphylococcus epidermidis
PEVIPQKRSITILYGSETGNAQG

SEQ ID NO: 1811064 - protein, 19 aa, Staphylococcus epidermidis
PEVQSLIWENSCGSGAASI

SEQ ID NO: 1811065 - protein, 20 aa, Staphylococcus epidermidis
PEVRMPKVGGRVMSLQDPTK

SEQ ID NO: 1811066 - protein, 19 aa, Staphylococcus epidermidis
PEVYPKLESYGIKQIAQRT

SEQ ID NO: 1811067 - protein, 20 aa, Staphylococcus epidermidis
PEYMIPVHFMKVDRIPITMN

SEQ ID NO: 1811068 - protein, 23 aa, Staphylococcus epidermidis
PFAQKRWCASNGLDNVITLSDHK

SEQ ID NO: 1811069 - protein, 25 aa, Staphylococcus epidermidis
PFCNLNITLRIARAFRQRFGHSKTI

SEQ ID NO: 1811070 - protein, 24 aa, Staphylococcus epidermidis
PFDFLSEIVYQWERFANKFKQFGT

SEQ ID NO: 1811071 - protein, 19 aa, Staphylococcus epidermidis
PFDPPMFARVFRKHLEGGF

SEQ ID NO: 1811072 - protein, 18 aa, Staphylococcus epidermidis
PFEEVAFEHYLECLTLKK

SEQ ID NO: 1811073 - protein, 18 aa, Staphylococcus epidermidis
PFEEVAFEHYLECLTMKK

SEQ ID NO: 1811074 - protein, 24 aa, Staphylococcus epidermidis
PFELTDVQYAYWIGRNRNEPLGGI

SEQ ID NO: 1811075 - protein, 17 aa, Staphylococcus epidermidis
PFETYEVCKVLLEKGYT

SEQ ID NO: 1811076 - protein, 17 aa, Staphylococcus epidermidis
PFFLEFMAKDVSKGNAI

SEQ ID NO: 1811077 - protein, 23 aa, Staphylococcus epidermidis
PFGGTCALRGCDPKKVLHGAAEL

SEQ ID NO: 1811078 - protein, 22 aa, Staphylococcus epidermidis
PFHQAESWDNVGLLIGNDNLDI

SEQ ID NO: 1811079 - protein, 18 aa, Staphylococcus epidermidis
PFIDCIKITQTKQLQGIY

SEQ ID NO: 1811080 - protein, 22 aa, Staphylococcus epidermidis
PFKKGEPFNGHIVSKVLKSNAE

SEQ ID NO: 1811081 - protein, 17 aa, Staphylococcus epidermidis
PFLYKYNDALILDTKTL

SEQ ID NO: 1811082 - protein, 23 aa, Staphylococcus epidermidis
PFMKQIHASYNFTDYYLEAHQDL

SEQ ID NO: 1811083 - protein, 21 aa, Staphylococcus epidermidis
PFPSEHVKPYVTYKQCINEAI

SEQ ID NO: 1811084 - protein, 21 aa, Staphylococcus epidermidis
PFPSEHVKPYVTYKQSINEAI

SEQ ID NO: 1811085 - protein, 23 aa, Staphylococcus epidermidis
PFQEGRDGFVMGEGAGIVVLESL

SEQ ID NO: 1811086 - protein, 26 aa, Staphylococcus epidermidis
PFSKECFKLSAILSKLRIEYNQYIRV

SEQ ID NO: 1811087 - protein, 24 aa, Staphylococcus epidermidis
PFSPREVVLRVKALLRRTQSANSE

SEQ ID NO: 1811088 - protein, 18 aa, Staphylococcus epidermidis
PFSPSIVISALERLVGEI

SEQ ID NO: 1811089 - protein, 20 aa, Staphylococcus epidermidis
PFVCGCRNLGEAARRIGEGS

SEQ ID NO: 1811090 - protein, 24 aa, Staphylococcus epidermidis
PFVHSKGGLYIWLHTPPGYDSEAF

SEQ ID NO: 1811091 - protein, 23 aa, Staphylococcus epidermidis
PFVKQKLIFLVGMAGERDMTKTP

SEQ ID NO: 1811092 - protein, 17 aa, Staphylococcus epidermidis
PFYDRWDHEIFIKYLKF

SEQ ID NO: 1811093 - protein, 18 aa, Staphylococcus epidermidis
PFYDRWDHEIFIKYLKIF

SEQ ID NO: 1811094 - protein, 18 aa, Staphylococcus epidermidis
PFYDRWDHEIFIKYLNFF

SEQ ID NO: 1811095 - protein, 18 aa, Staphylococcus epidermidis
PFYEGAMCVCGTGGDGSN

SEQ ID NO: 1811096 - protein, 20 aa, Staphylococcus epidermidis
PGAEGLIFHPYLAGERAPLW

SEQ ID NO: 1811097 - protein, 24 aa, Staphylococcus epidermidis
PGAKLRKGMDAFETFKYSSEFAQP

SEQ ID NO: 1811098 - protein, 20 aa, Staphylococcus epidermidis
PGAWGDWINGGGWLVINGYH

SEQ ID NO: 1811099 - protein, 17 aa, Staphylococcus epidermidis
PGDMTIKVTHTYDADQR

SEQ ID NO: 1811100 - protein, 18 aa, Staphylococcus epidermidis
PGHADLIGGMKYNHRDLR

SEQ ID NO: 1811101 - protein, 19 aa, Staphylococcus epidermidis
PGINAPPMHPWCRSTTVPH

SEQ ID NO: 1811102 - protein, 28 aa, Staphylococcus epidermidis
PGLANKIALKFAKKIYTTFEDTLAYLPK

SEQ ID NO: 1811103 - protein, 28 aa, Staphylococcus epidermidis
PGLANKIALKFAKKIYTTFEDTLNYLPK

SEQ ID NO: 1811104 - protein, 18 aa, Staphylococcus epidermidis
PGLNKKYYEAMVQAGREY

SEQ ID NO: 1811105 - protein, 25 aa, Staphylococcus epidermidis
PGLPDLKGFGRRKMDLTPNEIYNLV

SEQ ID NO: 1811106 - protein, 21 aa, Staphylococcus epidermidis
PGLPDLQGFGRRTMDIAPKEI

SEQ ID NO: 1811107 - protein, 18 aa, Staphylococcus epidermidis
PGLPMGAAPMAYTLWTRH

SEQ ID NO: 1811108 - protein, 18 aa, Staphylococcus epidermidis
PGMTGLEILAQIRAKGLN

SEQ ID NO: 1811109 - protein, 17 aa, Staphylococcus epidermidis
PGNRPLKSLSHMLKGKQ

SEQ ID NO: 1811110 - protein, 22 aa, Staphylococcus epidermidis
PGNYEKRVTFGLSGSDANDGII

SEQ ID NO: 1811111 - protein, 22 aa, Staphylococcus epidermidis
PGPASRLSWLGDILTTANNIHA

SEQ ID NO: 1811112 - protein, 25 aa, Staphylococcus epidermidis
PGPFDKRVAPSVARSVAKAAMESGV

SEQ ID NO: 1811113 - protein, 20 aa, Staphylococcus epidermidis
PGRRYYGGCEHVDVTEAIAI

SEQ ID NO: 1811114 - protein, 18 aa, Staphylococcus epidermidis
PGSMGKGIPGSFVTIIDD

SEQ ID NO: 1811115 - protein, 23 aa, Staphylococcus epidermidis
PGSTPRALLISAYKNVSVNNFTA

SEQ ID NO: 1811116 - protein, 18 aa, Staphylococcus epidermidis
PGVSAPAVLGIYPHTVFE

SEQ ID NO: 1811117 - protein, 22 aa, Staphylococcus epidermidis
PHATIFLMNAVYDFDTVREYQI

SEQ ID NO: 1811118 - protein, 17 aa, Staphylococcus epidermidis
PHFEKVIRESLDYLYEH

SEQ ID NO: 1811119 - protein, 20 aa, Staphylococcus epidermidis
PHGDFYIRIDNQLNIDLIKD

SEQ ID NO: 1811120 - protein, 24 aa, Staphylococcus epidermidis
PHHHRHASDILKMIDDSTLSPRVK

SEQ ID NO: 1811121 - protein, 18 aa, Staphylococcus epidermidis
PHKLINYILELNHTSLQV

SEQ ID NO: 1811122 - protein, 22 aa, Staphylococcus epidermidis
PHKRIVYHRVIELLNKGESISK

SEQ ID NO: 1811123 - protein, 19 aa, Staphylococcus epidermidis
PHPFTQLLHDAIRLAYNYD

SEQ ID NO: 1811124 - protein, 24 aa, Staphylococcus epidermidis
PHQKEWERLSGIPIEEQTYERNIE

SEQ ID NO: 1811125 - protein, 24 aa, Staphylococcus epidermidis
PHQKEWERLSGIPIEEQTYERNLE

SEQ ID NO: 1811126 - protein, 20 aa, Staphylococcus epidermidis
PHRKEVLKAREDDIKDRVQN

SEQ ID NO: 1811127 - protein, 18 aa, Staphylococcus epidermidis
PHSEYICFYPMDKRRNET

SEQ ID NO: 1811128 - protein, 21 aa, Staphylococcus epidermidis
PHSIPERYHLTLIDRMPFHGL

SEQ ID NO: 1811129 - protein, 18 aa, Staphylococcus epidermidis
PHTYCLVSMINGHGQVSI

SEQ ID NO: 1811130 - protein, 19 aa, Staphylococcus epidermidis
PIDHIWLKVPQRYYNKRRR

SEQ ID NO: 1811131 - protein, 22 aa, Staphylococcus epidermidis
PIDKRSSYGLGEVLKAALDNDA

SEQ ID NO: 1811132 - protein, 24 aa, Staphylococcus epidermidis
PIDLKTLTFHQACDEWLDRYVKTS

SEQ ID NO: 1811133 - protein, 24 aa, Staphylococcus epidermidis
PIDTDFSGFIFKIQANMDPKHRDR

SEQ ID NO: 1811134 - protein, 19 aa, Staphylococcus epidermidis
PIEETDTFFELFKMAEEKH

SEQ ID NO: 1811135 - protein, 17 aa, Staphylococcus epidermidis
PIEGFKHHFLKIKKGTL

SEQ ID NO: 1811136 - protein, 18 aa, Staphylococcus epidermidis
PIERSFRLMSPTPLDDLQ

SEQ ID NO: 1811137 - protein, 26 aa, Staphylococcus epidermidis
PIFAVSRASGWIAHILEQYRDNRIMR

SEQ ID NO: 1811138 - protein, 17 aa, Staphylococcus epidermidis
PIHFNLPFREPLTPDLN

SEQ ID NO: 1811139 - protein, 18 aa, Staphylococcus epidermidis
PIHGEYRMLKAHGETGVE

SEQ ID NO: 1811140 - protein, 19 aa, Staphylococcus epidermidis
PIIDTIKALMNYLKQRHIP

SEQ ID NO: 1811141 - protein, 17 aa, Staphylococcus epidermidis
PIIKELGFLFKNLNINK

SEQ ID NO: 1811142 - protein, 28 aa, Staphylococcus epidermidis
PIKDDDLFCGECGHKISRHPQSVRNAES

SEQ ID NO: 1811143 - protein, 25 aa, Staphylococcus epidermidis
PILEILRQYRNVIAHGQRFYSFKSN

SEQ ID NO: 1811144 - protein, 17 aa, Staphylococcus epidermidis
PIMEMIRSLIEVIQSNW

SEQ ID NO: 1811145 - protein, 17 aa, Staphylococcus epidermidis
PIMKKILDRMLEDNQIT

SEQ ID NO: 1811146 - protein, 38 aa, Staphylococcus epidermidis
PIPIKALTAHLGFGNYELRLPLIPLENAERKVLEQAYD

SEQ ID NO: 1811147 - protein, 21 aa, Staphylococcus epidermidis
PIPKFPKKIAVLTASTGAAIR

SEQ ID NO: 1811148 - protein, 21 aa, Staphylococcus epidermidis
PIQGMTCTGCEEHVTEALEQA

SEQ ID NO: 1811149 - protein, 22 aa, Staphylococcus epidermidis
PIQYIVGFQSFYGYQFKVNQHC

SEQ ID NO: 1811150 - protein, 17 aa, Staphylococcus epidermidis
PIRDLLPVIPEFADYTL

SEQ ID NO: 1811151 - protein, 25 aa, Staphylococcus epidermidis
PISFAHHVLTYFWMLERDKGRFEDS

SEQ ID NO: 1811152 - protein, 20 aa, Staphylococcus epidermidis
PISGEIVGIVGPNGAGKSSL

SEQ ID NO: 1811153 - protein, 21 aa, Staphylococcus epidermidis
PISSGKLRRYLSFENAKDVFK

SEQ ID NO: 1811154 - protein, 23 aa, Staphylococcus epidermidis
PITFELWIAILIVQQPKDVQLSS

SEQ ID NO: 1811155 - protein, 24 aa, Staphylococcus epidermidis
PITQKRASIKYFINARKIIGIHSS

SEQ ID NO: 1811156 - protein, 25 aa, Staphylococcus epidermidis
PITVNRAGSMIGYFLNEGPVTNFDE

SEQ ID NO: 1811157 - protein, 25 aa, Staphylococcus epidermidis
PITVNRAGSMIGYFLNKGPVTNFDE

SEQ ID NO: 1811158 - protein, 18 aa, Staphylococcus epidermidis
PIVEEFRSAQYEANDLLQ

SEQ ID NO: 1811159 - protein, 24 aa, Staphylococcus epidermidis
PIVPDILSSLNFNQFELVASQCEP

SEQ ID NO: 1811160 - protein, 17 aa, Staphylococcus epidermidis
PIWHDQYPKLAELGLKW

SEQ ID NO: 1811161 - protein, 22 aa, Staphylococcus epidermidis
PIYTNEAICHFVWKESNVNTEY

SEQ ID NO: 1811162 - protein, 25 aa, Staphylococcus epidermidis
PKDGKRSTIQLVHEMGLEKARRIYG

SEQ ID NO: 1811163 - protein, 30 aa, Staphylococcus epidermidis
PKDLEDFGPAWIERFVRLQIEEAFAVALEA

SEQ ID NO: 1811164 - protein, 17 aa, Staphylococcus epidermidis
PKDSWTPDEIIKKEHLD

SEQ ID NO: 1811165 - protein, 20 aa, Staphylococcus epidermidis
PKDVIIVEGIFALENKTLRD

SEQ ID NO: 1811166 - protein, 19 aa, Staphylococcus epidermidis
PKEEIQLLLQHLKEAGYHL

SEQ ID NO: 1811167 - protein, 21 aa, Staphylococcus epidermidis
PKEKRLLAVDVARMGGNSNDA

SEQ ID NO: 1811168 - protein, 21 aa, Staphylococcus epidermidis
PKGQSEPIVLVIFTNKDNKSD

SEQ ID NO: 1811169 - protein, 19 aa, Staphylococcus epidermidis
PKGTLLCSALENTNLVSVE

SEQ ID NO: 1811170 - protein, 17 aa, Staphylococcus epidermidis
PKGVDFVASILAIMLNG

SEQ ID NO: 1811171 - protein, 17 aa, Staphylococcus epidermidis
PKHKLGDYMMRVAKNTL

SEQ ID NO: 1811172 - protein, 40 aa, Staphylococcus epidermidis
PKIFQKLNIEWVFRLLIDWKRIGRMVSIPKFMLKVAKQKR

SEQ ID NO: 1811173 - protein, 19 aa, Staphylococcus epidermidis
PKIHFLRDNTFTIIGGTSN

SEQ ID NO: 1811174 - protein, 18 aa, Staphylococcus epidermidis
PKIIPKINEAYVYNIKKA

SEQ ID NO: 1811175 - protein, 20 aa, Staphylococcus epidermidis
PKILLCDEATSALDPATTSS

SEQ ID NO: 1811176 - protein, 19 aa, Staphylococcus epidermidis
PKKASVCHADLRYYTGNRR

SEQ ID NO: 1811177 - protein, 19 aa, Staphylococcus epidermidis
PKLAFLMGLIAGDGTFGRD

SEQ ID NO: 1811178 - protein, 19 aa, Staphylococcus epidermidis
PKLDSALSHYHDKIEVELH

SEQ ID NO: 1811179 - protein, 17 aa, Staphylococcus epidermidis
PKLIVAGASAYSRTIDF

SEQ ID NO: 1811180 - protein, 20 aa, Staphylococcus epidermidis
PKLKQVFALTQAKFLLNMEE

SEQ ID NO: 1811181 - protein, 19 aa, Staphylococcus epidermidis
PKLVFSIKKGINFGPEDPN

SEQ ID NO: 1811182 - protein, 18 aa, Staphylococcus epidermidis
PKMMLKVILYAYTQSVFS

SEQ ID NO: 1811183 - protein, 25 aa, Staphylococcus epidermidis
PKNNGRFSPVVFKLASEHNIDLTQV

SEQ ID NO: 1811184 - protein, 17 aa, Staphylococcus epidermidis
PKNRRIAAGPEIQSRGF

SEQ ID NO: 1811185 - protein, 20 aa, Staphylococcus epidermidis
PKPWDIAAQFLFAKELGLKM

SEQ ID NO: 1811186 - protein, 27 aa, Staphylococcus epidermidis
PKRRDNEFWKSIAFGVSTGNRNQTLTS

SEQ ID NO: 1811187 - protein, 23 aa, Staphylococcus epidermidis
PKRRLDYYYGCTHFIVPPISSNN

SEQ ID NO: 1811188 - protein, 25 aa, Staphylococcus epidermidis
PKRSKAVINEAYFRTPSTTDYNGVY

SEQ ID NO: 1811189 - protein, 19 aa, Staphylococcus epidermidis
PKSYIFEIASNWNKKDIKT

SEQ ID NO: 1811190 - protein, 17 aa, Staphylococcus epidermidis
PKYFVFISEILKNKALS

SEQ ID NO: 1811191 - protein, 28 aa, Staphylococcus epidermidis
PKYNAYMGAYRLQWDMIQFAKEHNIDRY

SEQ ID NO: 1811192 - protein, 30 aa, Staphylococcus epidermidis
PKYNAYMGAYRLQWEMIKFAKEHNIDRYNF

SEQ ID NO: 1811193 - protein, 22 aa, Staphylococcus epidermidis
PKYVQRPSVEQIHAFQNVANGL

SEQ ID NO: 1811194 - protein, 18 aa, Staphylococcus epidermidis
PLACAVSIAALDVIVDED

SEQ ID NO: 1811195 - protein, 25 aa, Staphylococcus epidermidis
PLAGPVVACAVILNKDHHYLGLNDS

SEQ ID NO: 1811196 - protein, 18 aa, Staphylococcus epidermidis
PLDHEGLLQFGTNLQQSM

SEQ ID NO: 1811197 - protein, 22 aa, Staphylococcus epidermidis
PLEEGFKYLVNKDVTKAQVEAF

SEQ ID NO: 1811198 - protein, 18 aa, Staphylococcus epidermidis
PLEIYVELVYGIQQEMVY

SEQ ID NO: 1811199 - protein, 21 aa, Staphylococcus epidermidis
PLELIKRQYILGNYSKAEKYT

SEQ ID NO: 1811200 - protein, 17 aa, Staphylococcus epidermidis
PLFAWDLNMGGLMNALE

SEQ ID NO: 1811201 - protein, 19 aa, Staphylococcus epidermidis
PLFDRSKRSLVLTDAGKIF

SEQ ID NO: 1811202 - protein, 23 aa, Staphylococcus epidermidis
PLFKLKKRDALRYMNYLREDRKM

SEQ ID NO: 1811203 - protein, 24 aa, Staphylococcus epidermidis
PLGIYRFLEKETKVYARTLNHPVI

SEQ ID NO: 1811204 - protein, 17 aa, Staphylococcus epidermidis
PLGKLSGKHAFAEKLKA

SEQ ID NO: 1811205 - protein, 28 aa, Staphylococcus epidermidis
PLGKLSGKLAFAEKLKVLGYDISPEDQI

SEQ ID NO: 1811206 - protein, 26 aa, Staphylococcus epidermidis
PLHLDKEWYIAIAKKRINDFKGEHTK

SEQ ID NO: 1811207 - protein, 18 aa, Staphylococcus epidermidis
PLKFKFNSANNFTISSKK

SEQ ID NO: 1811208 - protein, 25 aa, Staphylococcus epidermidis
PLKIRMKYNAVYLVEIYIKGKINKR

SEQ ID NO: 1811209 - protein, 20 aa, Staphylococcus epidermidis
PLKYKVGLDISCMVDDPTQF

SEQ ID NO: 1811210 - protein, 17 aa, Staphylococcus epidermidis
PLLKRMEQVDLIKRERS

SEQ ID NO: 1811211 - protein, 17 aa, Staphylococcus epidermidis
PLMKWLNVSSTARASFY

SEQ ID NO: 1811212 - protein, 21 aa, Staphylococcus epidermidis
PLQKGEIFVEGHLYKGNKSSL

SEQ ID NO: 1811213 - protein, 24 aa, Staphylococcus epidermidis
PLRDRFGVHLRLEYYNENELKEII

SEQ ID NO: 1811214 - protein, 24 aa, Staphylococcus epidermidis
PLRFLQVRIPVRMDDGTVKTFTGY

SEQ ID NO: 1811215 - protein, 20 aa, Staphylococcus epidermidis
PLSFEIWIALMLAQQPIEDS

SEQ ID NO: 1811216 - protein, 17 aa, Staphylococcus epidermidis
PLSKIFWMRHEEPEIFK

SEQ ID NO: 1811217 - protein, 18 aa, Staphylococcus epidermidis
PLSPYEIETLNQWIDVDQ

SEQ ID NO: 1811218 - protein, 19 aa, Staphylococcus epidermidis
PLTEGRVIIYMKYSKEYLE

SEQ ID NO: 1811219 - protein, 24 aa, Staphylococcus epidermidis
PLVLPKHHTCLIMPVNHDTIRTTI

SEQ ID NO: 1811220 - protein, 20 aa, Staphylococcus epidermidis
PMDLLPYLFFQFAKDGKRLY

SEQ ID NO: 1811221 - protein, 25 aa, Staphylococcus epidermidis
PMDRVLKPLLKMNARISGVEDNYTP

SEQ ID NO: 1811222 - protein, 24 aa, Staphylococcus epidermidis
PMRIKEFELLWYLASREGEVISKS

SEQ ID NO: 1811223 - protein, 25 aa, Staphylococcus epidermidis
PMRIKEFELLWYLASRENDVISKSE

SEQ ID NO: 1811224 - protein, 22 aa, Staphylococcus epidermidis
PMTHAIKFQSPEKFEIQLDLPS

SEQ ID NO: 1811225 - protein, 24 aa, Staphylococcus epidermidis
PNAELKVYMIASVEERAERRQKEN

SEQ ID NO: 1811226 - protein, 20 aa, Staphylococcus epidermidis
PNAFAVKYWAGNKFTVNGIP

SEQ ID NO: 1811227 - protein, 18 aa, Staphylococcus epidermidis
PNAHVHMIGFSRGGLQGL

SEQ ID NO: 1811228 - protein, 27 aa, Staphylococcus epidermidis
PNASVYMLGGNGLKTALTQAGLTVKDD

SEQ ID NO: 1811229 - protein, 20 aa, Staphylococcus epidermidis
PNATVYMIGGHGLKTALTDA

SEQ ID NO: 1811230 - protein, 18 aa, Staphylococcus epidermidis
PNAVAFYIKNGFKKYGES

SEQ ID NO: 1811231 - protein, 19 aa, Staphylococcus epidermidis
PNEKYPIISQFRTFFKTTY

SEQ ID NO: 1811232 - protein, 20 aa, Staphylococcus epidermidis
PNFLFLEAKASFPTSNNDNI

SEQ ID NO: 1811233 - protein, 20 aa, Staphylococcus epidermidis
PNIEELSQLISLELNESTEE

SEQ ID NO: 1811234 - protein, 19 aa, Staphylococcus epidermidis
PNIEFLKFDYQMGYGGVGI

SEQ ID NO: 1811235 - protein, 18 aa, Staphylococcus epidermidis
PNIFTGCGNFHGPFEYAS

SEQ ID NO: 1811236 - protein, 18 aa, Staphylococcus epidermidis
PNILLTMCYADCVPVYFY

SEQ ID NO: 1811237 - protein, 17 aa, Staphylococcus epidermidis
PNITKKDIENFIVPFTN

SEQ ID NO: 1811238 - protein, 21 aa, Staphylococcus epidermidis
PNKDWSPIHYSGLEINSDNIG

SEQ ID NO: 1811239 - protein, 20 aa, Staphylococcus epidermidis
PNKEGRFPVVMSADTYGKDN

SEQ ID NO: 1811240 - protein, 23 aa, Staphylococcus epidermidis
PNKEHMEMPGLHSLEHLMAENIR

SEQ ID NO: 1811241 - protein, 20 aa, Staphylococcus epidermidis
PNKLHALGFEFKFNNLKNAL

SEQ ID NO: 1811242 - protein, 23 aa, Staphylococcus epidermidis
PNKPEYHGASILITGDNFGCGSS

SEQ ID NO: 1811243 - protein, 24 aa, Staphylococcus epidermidis
PNKRGYKMLPHFQIGLFRDQLFIM

SEQ ID NO: 1811244 - protein, 30 aa, Staphylococcus epidermidis
PNLEAGNALAFAHGFNIHFGVIQPPADVDV

SEQ ID NO: 1811245 - protein, 20 aa, Staphylococcus epidermidis
PNLIPRKPYQVRNILLNPNY

SEQ ID NO: 1811246 - protein, 21 aa, Staphylococcus epidermidis
PNLLKRKFPITNAYDSSKMVP

SEQ ID NO: 1811247 - protein, 37 aa, Staphylococcus epidermidis
PNLNMIIGHWGEFVPFFLERMDDILFADHLEHPISYY

SEQ ID NO: 1811248 - protein, 26 aa, Staphylococcus epidermidis
PNMKVSEVLYYLGFLSKINQKDFDKY

SEQ ID NO: 1811249 - protein, 19 aa, Staphylococcus epidermidis
PNNCLWLTNLDVFIRHKDL

SEQ ID NO: 1811250 - protein, 23 aa, Staphylococcus epidermidis
PNNDKWVYDFLGMDATSPNDVID

SEQ ID NO: 1811251 - protein, 26 aa, Staphylococcus epidermidis
PNPLLPEEVRFILKQMGLKEKTIDVE

SEQ ID NO: 1811252 - protein, 20 aa, Staphylococcus epidermidis
PNQRYWCVKDLKEWGFGLFE

SEQ ID NO: 1811253 - protein, 17 aa, Staphylococcus epidermidis
PNQVSLVDVKRWMSEVE

SEQ ID NO: 1811254 - protein, 22 aa, Staphylococcus epidermidis
PNTEIFYDRGLAYGKDDPAEEM

SEQ ID NO: 1811255 - protein, 19 aa, Staphylococcus epidermidis
PNTSIKVRRNWGLNGEEVP

SEQ ID NO: 1811256 - protein, 20 aa, Staphylococcus epidermidis
PNTVSLDWECFIISKTDMLL

SEQ ID NO: 1811257 - protein, 26 aa, Staphylococcus epidermidis
PNVAKKILLNYCERVLFFNNDKELGA

SEQ ID NO: 1811258 - protein, 17 aa, Staphylococcus epidermidis
PNVEDIALRNQLEDWLD

SEQ ID NO: 1811259 - protein, 17 aa, Staphylococcus epidermidis
PNWGRIIAAAGYADTTF

SEQ ID NO: 1811260 - protein, 21 aa, Staphylococcus epidermidis
PNWTDTDWQSLPLVNGVAQAG

SEQ ID NO: 1811261 - protein, 20 aa, Staphylococcus epidermidis
PNYCGRVINKYGTFNDIVPP

SEQ ID NO: 1811262 - protein, 19 aa, Staphylococcus epidermidis
PNYRKHWQVIFDLDNKQKL

SEQ ID NO: 1811263 - protein, 21 aa, Staphylococcus epidermidis
PPEYFNEGSLLKAMENPQNYI

SEQ ID NO: 1811264 - protein, 22 aa, Staphylococcus epidermidis
PPGKRMGHAGAIISGGKGTADE

SEQ ID NO: 1811265 - protein, 23 aa, Staphylococcus epidermidis
PPGREAYPGDVFYLHSRLLERAA

SEQ ID NO: 1811266 - protein, 21 aa, Staphylococcus epidermidis
PPHRKEVLKAREDDIKEKVQN

SEQ ID NO: 1811267 - protein, 31 aa, Staphylococcus epidermidis
PPIGDAFARRSRYALDIDFREEPPWYKVSPT

SEQ ID NO: 1811268 - protein, 24 aa, Staphylococcus epidermidis
PPISVKDGGLFKTGFNEQLDEYLE

SEQ ID NO: 1811269 - protein, 25 aa, Staphylococcus epidermidis
PPKDRRAGVITFNLADIHPHDVATA

SEQ ID NO: 1811270 - protein, 19 aa, Staphylococcus epidermidis
PPLSRVGLIASEAKLQGYD

SEQ ID NO: 1811271 - protein, 20 aa, Staphylococcus epidermidis
PPPLMEFIFDTTRTIIYMSQ

SEQ ID NO: 1811272 - protein, 19 aa, Staphylococcus epidermidis
PPSGCPFQTRCPLVQDKCK

SEQ ID NO: 1811273 - protein, 35 aa, Staphylococcus epidermidis
PPSNWPRTAKFEGLIHRFRRSFLLNDNFEKKRFKA

SEQ ID NO: 1811274 - protein, 17 aa, Staphylococcus epidermidis
PPVDTWVAFAPNKRGYK

SEQ ID NO: 1811275 - protein, 22 aa, Staphylococcus epidermidis
PPYKLEIDMLKSQEFDPDLKNK

SEQ ID NO: 1811276 - protein, 28 aa, Staphylococcus epidermidis
PQDSYLLIRGIKTLGLRMEQINRNVDGI

SEQ ID NO: 1811277 - protein, 17 aa, Staphylococcus epidermidis
PQELVIVGGGYIALEFA

SEQ ID NO: 1811278 - protein, 22 aa, Staphylococcus epidermidis
PQEYTFSIEIMRDHEIDTPYIE

SEQ ID NO: 1811279 - protein, 37 aa, Staphylococcus epidermidis
PQFENKLTFSDEVVEKIAGIAAREVKGILDMKGGFAD

SEQ ID NO: 1811280 - protein, 25 aa, Staphylococcus epidermidis
PQFNDYGCKILKSFEEAKNKITKEL

SEQ ID NO: 1811281 - protein, 24 aa, Staphylococcus epidermidis
PQFSTQLLDRFLVIAHSYHLEPRI

SEQ ID NO: 1811282 - protein, 19 aa, Staphylococcus epidermidis
PQFTPEIFMKVSAKNVMKQ

SEQ ID NO: 1811283 - protein, 26 aa, Staphylococcus epidermidis
PQIKTSESFKAFIYYIEQHKKVFKHL

SEQ ID NO: 1811284 - protein, 24 aa, Staphylococcus epidermidis
PQKIVRWRAAMFVFDEGNENQLSS

SEQ ID NO: 1811285 - protein, 19 aa, Staphylococcus epidermidis
PQKRIIYHRVLEMLEEGKS

SEQ ID NO: 1811286 - protein, 26 aa, Staphylococcus epidermidis
PQLTYLRKNVRLIYVPMVNPWGFANQ

SEQ ID NO: 1811287 - protein, 27 aa, Staphylococcus epidermidis
PQMVLRFKRRFGDDVAVLHSGLSKGER

SEQ ID NO: 1811288 - protein, 23 aa, Staphylococcus epidermidis
PQNFKIKPEWLKELEKCANRDTA

SEQ ID NO: 1811289 - protein, 17 aa, Staphylococcus epidermidis
PQPKSIVELASIKTLIE

SEQ ID NO: 1811290 - protein, 27 aa, Staphylococcus epidermidis
PQRLEYVIKQCLSRFDTIVLTGGLGPT

SEQ ID NO: 1811291 - protein, 24 aa, Staphylococcus epidermidis
PQSKKAVVVGGGYIGIEAAEAFAK

SEQ ID NO: 1811292 - protein, 17 aa, Staphylococcus epidermidis
PQTEIIKRQNLEARLSF

SEQ ID NO: 1811293 - protein, 30 aa, Staphylococcus epidermidis
PQTGEKRAKEPKTDERKKTRQDSSNSKESP

SEQ ID NO: 1811294 - protein, 17 aa, Staphylococcus epidermidis
PRAKEVQTFVTELRNDK

SEQ ID NO: 1811295 - protein, 17 aa, Staphylococcus epidermidis
PREVFNIAIRESSNSII

SEQ ID NO: 1811296 - protein, 20 aa, Staphylococcus epidermidis
PREYKEMKVPDVLLSGNHAH

SEQ ID NO: 1811297 - protein, 20 aa, Staphylococcus epidermidis
PRGGKHVEHILGIGKGVQIV

SEQ ID NO: 1811298 - protein, 20 aa, Staphylococcus epidermidis
PRKFVPEGIEGRTAYKGPLQ

SEQ ID NO: 1811299 - protein, 18 aa, Staphylococcus epidermidis
PRKFWLNGEKDWVYIHSV

SEQ ID NO: 1811300 - protein, 23 aa, Staphylococcus epidermidis
PRNVGGGGAFGAFVSTDRNGMAT

SEQ ID NO: 1811301 - protein, 18 aa, Staphylococcus epidermidis
PRQMLFQNLTRAREKIKI

SEQ ID NO: 1811302 - protein, 25 aa, Staphylococcus epidermidis
PRRATEWRSSSIANILQNEVYVGNI

SEQ ID NO: 1811303 - protein, 19 aa, Staphylococcus epidermidis
PRRVSTWGDDQQFWYESAT

SEQ ID NO: 1811304 - protein, 25 aa, Staphylococcus epidermidis
PRSTKGVSIADNWDMVGMRATESHD

SEQ ID NO: 1811305 - protein, 21 aa, Staphylococcus epidermidis
PRSYYKGVFIKCHLEHSHESV

SEQ ID NO: 1811306 - protein, 21 aa, Staphylococcus epidermidis
PRTRIQLSNEILEEFEKIRRG

SEQ ID NO: 1811307 - protein, 18 aa, Staphylococcus epidermidis
PRVGYYYSGKSKNKIINE

SEQ ID NO: 1811308 - protein, 17 aa, Staphylococcus epidermidis
PRVKDCINYIQEHYEHK

SEQ ID NO: 1811309 - protein, 21 aa, Staphylococcus epidermidis
PRYGKQLKAERFEKELPQTKD

SEQ ID NO: 1811310 - protein, 18 aa, Staphylococcus epidermidis
PRYHIKKKYVAKLKGYLM

SEQ ID NO: 1811311 - protein, 19 aa, Staphylococcus epidermidis
PSAFPNDILNNIKRYYNIE

SEQ ID NO: 1811312 - protein, 23 aa, Staphylococcus epidermidis
PSDLKAHRMVNVILDKEAAAGLP

SEQ ID NO: 1811313 - protein, 20 aa, Staphylococcus epidermidis
PSDYPILATILTEYYREVPI

SEQ ID NO: 1811314 - protein, 19 aa, Staphylococcus epidermidis
PSEDAGKCMRTHGHTYFIN

SEQ ID NO: 1811315 - protein, 25 aa, Staphylococcus epidermidis
PSEIKYWAELKGVFDTLNVEMPIVM

SEQ ID NO: 1811316 - protein, 27 aa, Staphylococcus epidermidis
PSEVSINWKDLMNFKRTFTDDVPEKKE

SEQ ID NO: 1811317 - protein, 18 aa, Staphylococcus epidermidis
PSGAYYGGDTLKATKIYV

SEQ ID NO: 1811318 - protein, 32 aa, Staphylococcus epidermidis
PSGMVIKDAELRGVASSGMICSMKELNLPNAP

SEQ ID NO: 1811319 - protein, 18 aa, Staphylococcus epidermidis
PSISRGAVFDNLLDTTEF

SEQ ID NO: 1811320 - protein, 23 aa, Staphylococcus epidermidis
PSKIKTTWNWGGKFTANSTIKVR

SEQ ID NO: 1811321 - protein, 36 aa, Staphylococcus epidermidis
PSKLKSIVGPFAYYIKGFEMLPQMKAVDIRIEYDDK

SEQ ID NO: 1811322 - protein, 24 aa, Staphylococcus epidermidis
PSKRLKINLRHKLEINPIKNGEYR

SEQ ID NO: 1811323 - protein, 19 aa, Staphylococcus epidermidis
PSKTMLRAGEINGLAQNNP

SEQ ID NO: 1811324 - protein, 21 aa, Staphylococcus epidermidis
PSLHKPVLVLRDSTERPEGVN

SEQ ID NO: 1811325 - protein, 20 aa, Staphylococcus epidermidis
PSLHKPVLVLRETTERPEGV

SEQ ID NO: 1811326 - protein, 20 aa, Staphylococcus epidermidis
PSLKLCINIAKKLNVTLNDL

SEQ ID NO: 1811327 - protein, 19 aa, Staphylococcus epidermidis
PSLVYAHKGSMDFRIKSKG

SEQ ID NO: 1811328 - protein, 24 aa, Staphylococcus epidermidis
PSPFHWRLLDKLTLNTLHEVVLPI

SEQ ID NO: 1811329 - protein, 20 aa, Staphylococcus epidermidis
PSPIFPRLDTEAEISYIKES

SEQ ID NO: 1811330 - protein, 21 aa, Staphylococcus epidermidis
PSPKPMKVLLVAGHGKGAYSN

SEQ ID NO: 1811331 - protein, 18 aa, Staphylococcus epidermidis
PSPMTADMYYLMQLLYCN

SEQ ID NO: 1811332 - protein, 24 aa, Staphylococcus epidermidis
PSQASEVFTPINPITITATDNSGK

SEQ ID NO: 1811333 - protein, 24 aa, Staphylococcus epidermidis
PSSLEQLDLLLLEIPKSRKIHSDG

SEQ ID NO: 1811334 - protein, 24 aa, Staphylococcus epidermidis
PSSLEQLDLLLLEIPKSRKVHSDG

SEQ ID NO: 1811335 - protein, 17 aa, Staphylococcus epidermidis
PSTDFHKAMPIIIHGDA

SEQ ID NO: 1811336 - protein, 20 aa, Staphylococcus epidermidis
PSTIPKKGWIAVYTAGTYSR

SEQ ID NO: 1811337 - protein, 19 aa, Staphylococcus epidermidis
PSYFYTLLGPSGCGKTTIF

SEQ ID NO: 1811338 - protein, 17 aa, Staphylococcus epidermidis
PSYQSVIHKVFTLPQDF

SEQ ID NO: 1811339 - protein, 21 aa, Staphylococcus epidermidis
PSYSLKPGQVITVREKSQDLD

SEQ ID NO: 1811340 - protein, 21 aa, Staphylococcus epidermidis
PSYSLKPGQVITVREKSQNLN

SEQ ID NO: 1811341 - protein, 17 aa, Staphylococcus epidermidis
PSYYGKSNYYAFIILNM

SEQ ID NO: 1811342 - protein, 19 aa, Staphylococcus epidermidis
PTAAFVAARAGAMAKHTDH

SEQ ID NO: 1811343 - protein, 23 aa, Staphylococcus epidermidis
PTEKKGPSVLGIIEYSVQGQNEF

SEQ ID NO: 1811344 - protein, 21 aa, Staphylococcus epidermidis
PTFCNTRFAIDMTDIELDIEK

SEQ ID NO: 1811345 - protein, 20 aa, Staphylococcus epidermidis
PTFKQLISYCLLENEKGEIL

SEQ ID NO: 1811346 - protein, 22 aa, Staphylococcus epidermidis
PTGKLHIGHYIGSLKKRVEIQD

SEQ ID NO: 1811347 - protein, 17 aa, Staphylococcus epidermidis
PTIKYIIEQGGKLVLFS

SEQ ID NO: 1811348 - protein, 17 aa, Staphylococcus epidermidis
PTKPRVVVEKSKYTFQQ

SEQ ID NO: 1811349 - protein, 21 aa, Staphylococcus epidermidis
PTKQMILNFGHYRFTDLKDSG

SEQ ID NO: 1811350 - protein, 17 aa, Staphylococcus epidermidis
PTLNGFHWCQEIRKVSR

SEQ ID NO: 1811351 - protein, 18 aa, Staphylococcus epidermidis
PTLNLAMEEYVLKNLPSE

SEQ ID NO: 1811352 - protein, 18 aa, Staphylococcus epidermidis
PTSEDSVILSADYSQIEL

SEQ ID NO: 1811353 - protein, 20 aa, Staphylococcus epidermidis
PTTLILKKVVFILFEKSFNT

SEQ ID NO: 1811354 - protein, 22 aa, Staphylococcus epidermidis
PTTSQPAIGEWLENYEKLKNEG

SEQ ID NO: 1811355 - protein, 23 aa, Staphylococcus epidermidis
PTTWKLAKMNLAIRGIDNDLGER

SEQ ID NO: 1811356 - protein, 37 aa, Staphylococcus epidermidis
PTYTLQQYLDFGFKGNKLGFTFVIKGTFKERVAVDEL

SEQ ID NO: 1811357 - protein, 17 aa, Staphylococcus epidermidis
PVAIQLAQICHQVTDGN

SEQ ID NO: 1811358 - protein, 18 aa, Staphylococcus epidermidis
PVAKRSDIILSYGQTDEN

SEQ ID NO: 1811359 - protein, 19 aa, Staphylococcus epidermidis
PVEYQVLIIYALTKGYLDD

SEQ ID NO: 1811360 - protein, 25 aa, Staphylococcus epidermidis
PVFKLKHQFTHLTWDIEVYNVTAPL

SEQ ID NO: 1811361 - protein, 24 aa, Staphylococcus epidermidis
PVGAIGVCTYGIYQRYGHIYLVWD

SEQ ID NO: 1811362 - protein, 25 aa, Staphylococcus epidermidis
PVGNAGNITAYWKGFVEYHDKKKTQ

SEQ ID NO: 1811363 - protein, 24 aa, Staphylococcus epidermidis
PVGRDCPKCNHYLVDKKKGRSSQV

SEQ ID NO: 1811364 - protein, 18 aa, Staphylococcus epidermidis
PVGRLDYDTSGILLLTND

SEQ ID NO: 1811365 - protein, 24 aa, Staphylococcus epidermidis
PVHTYKMKFIKSFEAKDLHHTIFD

SEQ ID NO: 1811366 - protein, 25 aa, Staphylococcus epidermidis
PVKLLGVKNANVWGNFQNELSVECD

SEQ ID NO: 1811367 - protein, 22 aa, Staphylococcus epidermidis
PVKRTDGFITKFNRLIERRLLN

SEQ ID NO: 1811368 - protein, 19 aa, Staphylococcus epidermidis
PVMESLILLSMRHRMDTNK

SEQ ID NO: 1811369 - protein, 17 aa, Staphylococcus epidermidis
PVMKKLNQIHVIINAKF

SEQ ID NO: 1811370 - protein, 18 aa, Staphylococcus epidermidis
PVNIDWDYEYTKDHYIYM

SEQ ID NO: 1811371 - protein, 21 aa, Staphylococcus epidermidis
PVNVPRLLKEVSDEGWQGIPD

SEQ ID NO: 1811372 - protein, 24 aa, Staphylococcus epidermidis
PVPFAANLEAAYMPNADKVLNIAS

SEQ ID NO: 1811373 - protein, 30 aa, Staphylococcus epidermidis
PVQFSNCKALRAVYPAGVPIGHPAYSARLD

SEQ ID NO: 1811374 - protein, 21 aa, Staphylococcus epidermidis
PVRAETMTEWEIDHFEQLPSI

SEQ ID NO: 1811375 - protein, 26 aa, Staphylococcus epidermidis
PVRIKCATLAWKALEKGTVEKEGKTE

SEQ ID NO: 1811376 - protein, 19 aa, Staphylococcus epidermidis
PVRSFAVKIQKDLAAKKGI

SEQ ID NO: 1811377 - protein, 21 aa, Staphylococcus epidermidis
PVRSFAVKIQKELAAKKGIVM

SEQ ID NO: 1811378 - protein, 18 aa, Staphylococcus epidermidis
PVSGTANWTDIRQFNLMF

SEQ ID NO: 1811379 - protein, 21 aa, Staphylococcus epidermidis
PVTHIEAVIGLGVYLDKIENL

SEQ ID NO: 1811380 - protein, 22 aa, Staphylococcus epidermidis
PVTQKRASIKYFINARNIIGIH

SEQ ID NO: 1811381 - protein, 18 aa, Staphylococcus epidermidis
PVVAAGGIMDGRGLLASM

SEQ ID NO: 1811382 - protein, 19 aa, Staphylococcus epidermidis
PVVFMRVALEKNFADVSPN

SEQ ID NO: 1811383 - protein, 17 aa, Staphylococcus epidermidis
PVVIDDMIAIRNMVNLC

SEQ ID NO: 1811384 - protein, 17 aa, Staphylococcus epidermidis
PVVIDFPKDMGVLKTDV

SEQ ID NO: 1811385 - protein, 19 aa, Staphylococcus epidermidis
PVVKEVAYKHCALQVPPAG

SEQ ID NO: 1811386 - protein, 17 aa, Staphylococcus epidermidis
PVYVYKLFPEGPITMTL

SEQ ID NO: 1811387 - protein, 23 aa, Staphylococcus epidermidis
PWGRPDMALFKFTKAVVNDESID

SEQ ID NO: 1811388 - protein, 20 aa, Staphylococcus epidermidis
PWGSVRSISGYPFVWWFATK

SEQ ID NO: 1811389 - protein, 17 aa, Staphylococcus epidermidis
PYAGVTMGEEFMFNGKH

SEQ ID NO: 1811390 - protein, 18 aa, Staphylococcus epidermidis
PYCVKITYEIDENDDWLE

SEQ ID NO: 1811391 - protein, 22 aa, Staphylococcus epidermidis
PYDKYFYAYDVDEFYRLPHALF

SEQ ID NO: 1811392 - protein, 26 aa, Staphylococcus epidermidis
PYEQRMPKIVIVIDELADLMMMAPQE

SEQ ID NO: 1811393 - protein, 22 aa, Staphylococcus epidermidis
PYFAGTKVKWILDHVDGAREKA

SEQ ID NO: 1811394 - protein, 18 aa, Staphylococcus epidermidis
PYGAPAEVYEQTYHKIYD

SEQ ID NO: 1811395 - protein, 25 aa, Staphylococcus epidermidis
PYGPEYFIFGGLYKIKKIEPEVFDE

SEQ ID NO: 1811396 - protein, 21 aa, Staphylococcus epidermidis
PYHLKMMLKVVLYAYTQFVFS

SEQ ID NO: 1811397 - protein, 18 aa, Staphylococcus epidermidis
PYKVFTSFYKKWRPYLMK

SEQ ID NO: 1811398 - protein, 30 aa, Staphylococcus epidermidis
PYLIYMLGFMPGFPYLGGLDKKLHTPRRSE

SEQ ID NO: 1811399 - protein, 18 aa, Staphylococcus epidermidis
PYLKKRLNNKIVIMEYKP

SEQ ID NO: 1811400 - protein, 17 aa, Staphylococcus epidermidis
PYLTRDQHRLYKLIWER

SEQ ID NO: 1811401 - protein, 25 aa, Staphylococcus epidermidis
PYNKNFINQIGWYLNFEKDIDLIGD

SEQ ID NO: 1811402 - protein, 18 aa, Staphylococcus epidermidis
PYPNYNRIMLSNILQNKM

SEQ ID NO: 1811403 - protein, 18 aa, Staphylococcus epidermidis
PYQARRIAFNINIPKESI

SEQ ID NO: 1811404 - protein, 20 aa, Staphylococcus epidermidis
PYQYQPRLDYLKAVDKLILD

SEQ ID NO: 1811405 - protein, 18 aa, Staphylococcus epidermidis
PYSANWSAESSFLDDERF

SEQ ID NO: 1811406 - protein, 18 aa, Staphylococcus epidermidis
PYSGVTMGEEFMFNGKHV

SEQ ID NO: 1811407 - protein, 19 aa, Staphylococcus epidermidis
PYSKATRANIDVNLNVEVV

SEQ ID NO: 1811408 - protein, 24 aa, Staphylococcus epidermidis
PYSKFEFYWERYIQEIKKSITVEE

SEQ ID NO: 1811409 - protein, 23 aa, Staphylococcus epidermidis
PYTKSKFYSEIKVLEAVNDGLDA

SEQ ID NO: 1811410 - protein, 20 aa, Staphylococcus epidermidis
PYVGKLTFFRVYSGTLTSGS

SEQ ID NO: 1811411 - protein, 18 aa, Staphylococcus epidermidis
PYVQYGIKYERNQALRNE

SEQ ID NO: 1811412 - protein, 21 aa, Staphylococcus epidermidis
PYYASGGFIHYCEYPKLNHNL

SEQ ID NO: 1811413 - protein, 19 aa, Staphylococcus epidermidis
PYYSARVVHDVTIAPSPIW

SEQ ID NO: 1811414 - protein, 24 aa, Staphylococcus epidermidis
PYYVKELRPLTGLDEPVYNYVMKW

SEQ ID NO: 1811415 - protein, 19 aa, Staphylococcus epidermidis
QAATTRPAVTQQLEDAKAL

SEQ ID NO: 1811416 - protein, 17 aa, Staphylococcus epidermidis
QAEKVIDILPSFPNGSF

SEQ ID NO: 1811417 - protein, 24 aa, Staphylococcus epidermidis
QAFDRFKLNIFISLAELESDNIGE

SEQ ID NO: 1811418 - protein, 25 aa, Staphylococcus epidermidis
QAGLKTDVLLAAYGYHHMDVDIVNE

SEQ ID NO: 1811419 - protein, 18 aa, Staphylococcus epidermidis
QAGREYFVVKAIGDGSVK

SEQ ID NO: 1811420 - protein, 25 aa, Staphylococcus epidermidis
QAHPGHNRWHPDIPAAFSVEPGESF

SEQ ID NO: 1811421 - protein, 18 aa, Staphylococcus epidermidis
QAIELGRSLGVDVLETEM

SEQ ID NO: 1811422 - protein, 18 aa, Staphylococcus epidermidis
QAIHLGGKEGLSIARQLG

SEQ ID NO: 1811423 - protein, 17 aa, Staphylococcus epidermidis
QAINGATTREQVAEKLK

SEQ ID NO: 1811424 - protein, 17 aa, Staphylococcus epidermidis
QAISHYFNQKYGFTYSE

SEQ ID NO: 1811425 - protein, 22 aa, Staphylococcus epidermidis
QAKFVKQFADFSIGIEGLKQYN

SEQ ID NO: 1811426 - protein, 17 aa, Staphylococcus epidermidis
QAKWFLQDFQVLINGQR

SEQ ID NO: 1811427 - protein, 22 aa, Staphylococcus epidermidis
QALKEIGYICAKVRDTMKEATQ

SEQ ID NO: 1811428 - protein, 23 aa, Staphylococcus epidermidis
QALKEIGYICAKVRDTMREATKP

SEQ ID NO: 1811429 - protein, 18 aa, Staphylococcus epidermidis
QALPEVVLPDHLPQLQSL

SEQ ID NO: 1811430 - protein, 17 aa, Staphylococcus epidermidis
QAMMRGFLVAEFADDFK

SEQ ID NO: 1811431 - protein, 17 aa, Staphylococcus epidermidis
QAPVRQIAENAGLEGSI

SEQ ID NO: 1811432 - protein, 25 aa, Staphylococcus epidermidis
QAQAILDMRLRRLTGLERDKIESEY

SEQ ID NO: 1811433 - protein, 25 aa, Staphylococcus epidermidis
QAQMLNERLLNMIGVHTVSIDIERN

SEQ ID NO: 1811434 - protein, 18 aa, Staphylococcus epidermidis
QAQTRPDVERVINKAKPL

SEQ ID NO: 1811435 - protein, 20 aa, Staphylococcus epidermidis
QAQYLLKREDIFNYLSERKE

SEQ ID NO: 1811436 - protein, 25 aa, Staphylococcus epidermidis
QASRYRSAGTIEFLVTEDAHYFIEM

SEQ ID NO: 1811437 - protein, 18 aa, Staphylococcus epidermidis
QASSLAMAIFFQDMNEEE

SEQ ID NO: 1811438 - protein, 17 aa, Staphylococcus epidermidis
QATFKSFETSLVKSSSF

SEQ ID NO: 1811439 - protein, 18 aa, Staphylococcus epidermidis
QAWDWKEEYASFIRQQWA

SEQ ID NO: 1811440 - protein, 21 aa, Staphylococcus epidermidis
QCLYVKLDPYWMYQLYDKDIN

SEQ ID NO: 1811441 - protein, 23 aa, Staphylococcus epidermidis
QDAEKAFAISLMGAELYGDLQHA

SEQ ID NO: 1811442 - protein, 17 aa, Staphylococcus epidermidis
QDAIKLNFEPVVPGFKF

SEQ ID NO: 1811443 - protein, 20 aa, Staphylococcus epidermidis
QDCYKFLRNLIFNETELEEN

SEQ ID NO: 1811444 - protein, 23 aa, Staphylococcus epidermidis
QDDLFDDVCEFMVNEGHISTSLI

SEQ ID NO: 1811445 - protein, 21 aa, Staphylococcus epidermidis
QDDYDCFFCIVDQHAITVPQD

SEQ ID NO: 1811446 - protein, 19 aa, Staphylococcus epidermidis
QDDYVKIAFNINRKTHPHV

SEQ ID NO: 1811447 - protein, 24 aa, Staphylococcus epidermidis
QDETVCYMWIRFEHDEQFKRFSPE

SEQ ID NO: 1811448 - protein, 23 aa, Staphylococcus epidermidis
QDEYFRRKIAKFSQFPINDSGKY

SEQ ID NO: 1811449 - protein, 17 aa, Staphylococcus epidermidis
QDFALWPHMSVFQNVAY

SEQ ID NO: 1811450 - protein, 25 aa, Staphylococcus epidermidis
QDFKHWRLVAILEVIEIKSCHYAAS

SEQ ID NO: 1811451 - protein, 23 aa, Staphylococcus epidermidis
QDGLKGGGYYVEYRTDDARLTIE

SEQ ID NO: 1811452 - protein, 24 aa, Staphylococcus epidermidis
QDHQCSISQLFDCDKQQHTVKGIY

SEQ ID NO: 1811453 - protein, 21 aa, Staphylococcus epidermidis
QDIANPFGMILSLALCLRESL

SEQ ID NO: 1811454 - protein, 17 aa, Staphylococcus epidermidis
QDIEAIIVTGTRAEELQ

SEQ ID NO: 1811455 - protein, 19 aa, Staphylococcus epidermidis
QDIFIPKGQNLGAIDGHKV

SEQ ID NO: 1811456 - protein, 25 aa, Staphylococcus epidermidis
QDIFIPKGQSLGAVDGHKVLVQITK

SEQ ID NO: 1811457 - protein, 18 aa, Staphylococcus epidermidis
QDIKLIACTMSMDVMGIS

SEQ ID NO: 1811458 - protein, 17 aa, Staphylococcus epidermidis
QDIKRAKELLAQEGYSK

SEQ ID NO: 1811459 - protein, 17 aa, Staphylococcus epidermidis
QDIPELNIEYIDVLEVG

SEQ ID NO: 1811460 - protein, 27 aa, Staphylococcus epidermidis
QDLKDRYEFIGGLSPLAGTTDRQAEAL

SEQ ID NO: 1811461 - protein, 24 aa, Staphylococcus epidermidis
QDLPVDSYIIWGGVSDIHLMYEER

SEQ ID NO: 1811462 - protein, 19 aa, Staphylococcus epidermidis
QDPELCVLKVQPKSIKLMN

SEQ ID NO: 1811463 - protein, 18 aa, Staphylococcus epidermidis
QDSLKRLILPSIEREIRG

SEQ ID NO: 1811464 - protein, 28 aa, Staphylococcus epidermidis
QDVKDNKIEMVLSWKLNRISRSMRDVFN

SEQ ID NO: 1811465 - protein, 21 aa, Staphylococcus epidermidis
QDVYRVKGFVRFSDQQHVYLV

SEQ ID NO: 1811466 - protein, 17 aa, Staphylococcus epidermidis
QEAIRIAEIANHAGVCD

SEQ ID NO: 1811467 - protein, 18 aa, Staphylococcus epidermidis
QEAIRIAEIASHAGVCDM

SEQ ID NO: 1811468 - protein, 26 aa, Staphylococcus epidermidis
QEDFKGSWSVVCFYPADFSFVCPTEL

SEQ ID NO: 1811469 - protein, 20 aa, Staphylococcus epidermidis
QEEREKLILKKTEKNPNNKN

SEQ ID NO: 1811470 - protein, 22 aa, Staphylococcus epidermidis
QEFPEHLATYLMNYSLSEIQII

SEQ ID NO: 1811471 - protein, 23 aa, Staphylococcus epidermidis
QEGRRFLFETVVKVNHPKHDITI

SEQ ID NO: 1811472 - protein, 19 aa, Staphylococcus epidermidis
QEIENTFSYLDRVDYNLLT

SEQ ID NO: 1811473 - protein, 17 aa, Staphylococcus epidermidis
QEIKSLYSYQLLTKDEY

SEQ ID NO: 1811474 - protein, 19 aa, Staphylococcus epidermidis
QEIPDTGSITLYILPDEVN

SEQ ID NO: 1811475 - protein, 17 aa, Staphylococcus epidermidis
QEKHYPKALDIWERSVI

SEQ ID NO: 1811476 - protein, 25 aa, Staphylococcus epidermidis
QELDNGFDFYAPQTFIDADGQRILI

SEQ ID NO: 1811477 - protein, 22 aa, Staphylococcus epidermidis
QELNNAMGGLRNSIQDQGSVRQ

SEQ ID NO: 1811478 - protein, 20 aa, Staphylococcus epidermidis
QELNSFQLLTYVLSMLNQLR

SEQ ID NO: 1811479 - protein, 17 aa, Staphylococcus epidermidis
QEPMTALNPVFKIKNQI

SEQ ID NO: 1811480 - protein, 25 aa, Staphylococcus epidermidis
QEPWTSCEFDFTKEGKLNVSFDYID

SEQ ID NO: 1811481 - protein, 19 aa, Staphylococcus epidermidis
QEPWTSCEFDFTNKGKLNV

SEQ ID NO: 1811482 - protein, 21 aa, Staphylococcus epidermidis
QERIEREFGIELIATAPSVIY

SEQ ID NO: 1811483 - protein, 18 aa, Staphylococcus epidermidis
QERIKYEYFREKIGEVTN

SEQ ID NO: 1811484 - protein, 17 aa, Staphylococcus epidermidis
QERLAKLAGGVAVIKVG

SEQ ID NO: 1811485 - protein, 17 aa, Staphylococcus epidermidis
QERLIQFAHEVAKADSV

SEQ ID NO: 1811486 - protein, 17 aa, Staphylococcus epidermidis
QESRGVIVLTDPDFPGD

SEQ ID NO: 1811487 - protein, 21 aa, Staphylococcus epidermidis
QESSKMCLFEPRVFSDTQDIA

SEQ ID NO: 1811488 - protein, 21 aa, Staphylococcus epidermidis
QEVPGKLVVVGGGYIGSELGT

SEQ ID NO: 1811489 - protein, 20 aa, Staphylococcus epidermidis
QEVPNHLVVVGGGYIGLELG

SEQ ID NO: 1811490 - protein, 18 aa, Staphylococcus epidermidis
QEWRDVRYLYNYNDEELS

SEQ ID NO: 1811491 - protein, 22 aa, Staphylococcus epidermidis
QEYQHVEVALKIDNETVQVKSL

SEQ ID NO: 1811492 - protein, 21 aa, Staphylococcus epidermidis
QFAKREVYQHYALSELPFPKK

SEQ ID NO: 1811493 - protein, 26 aa, Staphylococcus epidermidis
QFDEELCVKIGMELFYQTGPEFIQSL

SEQ ID NO: 1811494 - protein, 24 aa, Staphylococcus epidermidis
QFDQIFDLLAIRIIVNSINDCYAT

SEQ ID NO: 1811495 - protein, 23 aa, Staphylococcus epidermidis
QFDQIFDLLAIRVIVNSINDCYA

SEQ ID NO: 1811496 - protein, 18 aa, Staphylococcus epidermidis
QFDRNRFETIFKELIDKN

SEQ ID NO: 1811497 - protein, 23 aa, Staphylococcus epidermidis
QFECKWGNETLVWTLKKMAKGGL

SEQ ID NO: 1811498 - protein, 18 aa, Staphylococcus epidermidis
QFEDEFKKHFKINRLTWK

SEQ ID NO: 1811499 - protein, 17 aa, Staphylococcus epidermidis
QFEILDMLVGFNTESPP

SEQ ID NO: 1811500 - protein, 24 aa, Staphylococcus epidermidis
QFENKPLYCLMPFSNTIKNKLEYL

SEQ ID NO: 1811501 - protein, 23 aa, Staphylococcus epidermidis
QFETRAAALLRYYTGLLESSKKT

SEQ ID NO: 1811502 - protein, 26 aa, Staphylococcus epidermidis
QFETRAGTLLRYYTGLLESSRDNHFA

SEQ ID NO: 1811503 - protein, 26 aa, Staphylococcus epidermidis
QFETRAGTLLRYYTGLLESSRETPFG

SEQ ID NO: 1811504 - protein, 21 aa, Staphylococcus epidermidis
QFGGPHCGYFATTKKLMRKVP

SEQ ID NO: 1811505 - protein, 25 aa, Staphylococcus epidermidis
QFILTKRLESYIMFELTRIKGATVK

SEQ ID NO: 1811506 - protein, 20 aa, Staphylococcus epidermidis
QFIRLTRYFIDILRQSNNGR

SEQ ID NO: 1811507 - protein, 18 aa, Staphylococcus epidermidis
QFKSRMHIFHSAEDERLK

SEQ ID NO: 1811508 - protein, 26 aa, Staphylococcus epidermidis
QFLTKDLFIDWTWGEEYFRQKLIDYD

SEQ ID NO: 1811509 - protein, 19 aa, Staphylococcus epidermidis
QFMLDSGISSTRFVYNNLS

SEQ ID NO: 1811510 - protein, 24 aa, Staphylococcus epidermidis
QFNDYGCKILKSFEEAKNKITKEL

SEQ ID NO: 1811511 - protein, 20 aa, Staphylococcus epidermidis
QFNDYGYKILKSFEDAKIKI

SEQ ID NO: 1811512 - protein, 19 aa, Staphylococcus epidermidis
QFNQLDWLKDQEIALVGVG

SEQ ID NO: 1811513 - protein, 18 aa, Staphylococcus epidermidis
QFRGYGLGQLLLKYVKNY

SEQ ID NO: 1811514 - protein, 19 aa, Staphylococcus epidermidis
QGALPVGLLPKIVVDDKEY

SEQ ID NO: 1811515 - protein, 23 aa, Staphylococcus epidermidis
QGASEISMMFGIREEDAEKAVLS

SEQ ID NO: 1811516 - protein, 17 aa, Staphylococcus epidermidis
QGATMLVTGSYFFKQDN

SEQ ID NO: 1811517 - protein, 19 aa, Staphylococcus epidermidis
QGDLSHMRYILTDTNKDDL

SEQ ID NO: 1811518 - protein, 17 aa, Staphylococcus epidermidis
QGGEVFFNFIQPDSNDI

SEQ ID NO: 1811519 - protein, 26 aa, Staphylococcus epidermidis
QGGIEFKERYFRTGSGYTTAITIYEL

SEQ ID NO: 1811520 - protein, 18 aa, Staphylococcus epidermidis
QGGKLVLFSHLGKVKEES

SEQ ID NO: 1811521 - protein, 22 aa, Staphylococcus epidermidis
QGHLFLLLAKENWHEGVLGIVA

SEQ ID NO: 1811522 - protein, 30 aa, Staphylococcus epidermidis
QGIGLKIAERLFKDGYHLAIVDYNEEGAKQ

SEQ ID NO: 1811523 - protein, 17 aa, Staphylococcus epidermidis
QGIKIHLLHLLKGTPMV

SEQ ID NO: 1811524 - protein, 24 aa, Staphylococcus epidermidis
QGKPNRLYILYPLTELELRQLEST

SEQ ID NO: 1811525 - protein, 19 aa, Staphylococcus epidermidis
QGKYLGVSFHPELTDDYRV

SEQ ID NO: 1811526 - protein, 25 aa, Staphylococcus epidermidis
QGLKSLLEDWLFEYKDELPIEASDI

SEQ ID NO: 1811527 - protein, 17 aa, Staphylococcus epidermidis
QGLLKAASLKYQRLAKN

SEQ ID NO: 1811528 - protein, 23 aa, Staphylococcus epidermidis
QGLYRKRMLSYGGLLKKKHKLLN

SEQ ID NO: 1811529 - protein, 18 aa, Staphylococcus epidermidis
QGNRLFYLAMAPQFFGVI

SEQ ID NO: 1811530 - protein, 21 aa, Staphylococcus epidermidis
QGPCLKCLMQTMPETGESCAI

SEQ ID NO: 1811531 - protein, 17 aa, Staphylococcus epidermidis
QGQTIGFVPTMGALHEG

SEQ ID NO: 1811532 - protein, 28 aa, Staphylococcus epidermidis
QGRVLVFNKRGYPIGQILMPGRDDGKML

SEQ ID NO: 1811533 - protein, 24 aa, Staphylococcus epidermidis
QGSGFKTLVGALSFSDYMLLSRQF

SEQ ID NO: 1811534 - protein, 21 aa, Staphylococcus epidermidis
QGTKLTFLPYVVKALVSALKK

SEQ ID NO: 1811535 - protein, 21 aa, Staphylococcus epidermidis
QGYDVVNLEGGYKAYEEKNVS

SEQ ID NO: 1811536 - protein, 24 aa, Staphylococcus epidermidis
QGYFARPTIFINVDNQMTIAQEEI

SEQ ID NO: 1811537 - protein, 25 aa, Staphylococcus epidermidis
QHAELPAGVGDYLFERLRLTAHHMV

SEQ ID NO: 1811538 - protein, 18 aa, Staphylococcus epidermidis
QHAYDEWFEQIRNDKSQF

SEQ ID NO: 1811539 - protein, 19 aa, Staphylococcus epidermidis
QHDLKRLEQLNVHAAIVGK

SEQ ID NO: 1811540 - protein, 21 aa, Staphylococcus epidermidis
QHEAPNYIALEHNINELRERL

SEQ ID NO: 1811541 - protein, 17 aa, Staphylococcus epidermidis
QHFLKSTIKVSINEYRM

SEQ ID NO: 1811542 - protein, 20 aa, Staphylococcus epidermidis
QHIPEIVQTLQFFNKNLQNI

SEQ ID NO: 1811543 - protein, 25 aa, Staphylococcus epidermidis
QHMHVLLCVENAYFRKKENYITQEE

SEQ ID NO: 1811544 - protein, 21 aa, Staphylococcus epidermidis
QHMHVLLCVENSYFKNKANYI

SEQ ID NO: 1811545 - protein, 22 aa, Staphylococcus epidermidis
QHPDELKELLINELKKYRGHLA

SEQ ID NO: 1811546 - protein, 17 aa, Staphylococcus epidermidis
QHPKYVQRPSVEQIHAF

SEQ ID NO: 1811547 - protein, 29 aa, Staphylococcus epidermidis
QHQGIRKGPNIKLPSFDLLEEPEPHEINE

SEQ ID NO: 1811548 - protein, 31 aa, Staphylococcus epidermidis
QHRTNLYMTMFRFREYRIVAFSGGRFLIHGT

SEQ ID NO: 1811549 - protein, 23 aa, Staphylococcus epidermidis
QHTLPIESSVLIPTNNISRHVND

SEQ ID NO: 1811550 - protein, 23 aa, Staphylococcus epidermidis
QHTLPMESSVLIPTNNISRHVND

SEQ ID NO: 1811551 - protein, 18 aa, Staphylococcus epidermidis
QHTLPMETSVLIPTNEIS

SEQ ID NO: 1811552 - protein, 17 aa, Staphylococcus epidermidis
QHTQLFYGGGITNIDKA

SEQ ID NO: 1811553 - protein, 21 aa, Staphylococcus epidermidis
QHWEDELSMIFVVINNKSKKV

SEQ ID NO: 1811554 - protein, 22 aa, Staphylococcus epidermidis
QHYAQCLVKLNISKKAEHLFYE

SEQ ID NO: 1811555 - protein, 18 aa, Staphylococcus epidermidis
QIDACNELDIPVYDAYHS

SEQ ID NO: 1811556 - protein, 18 aa, Staphylococcus epidermidis
QIERRYGREAMREKSDKA

SEQ ID NO: 1811557 - protein, 19 aa, Staphylococcus epidermidis
QIFISAHCRHAPFIEQIES

SEQ ID NO: 1811558 - protein, 23 aa, Staphylococcus epidermidis
QIGHYHCECGFKREVPTYEVSSF

SEQ ID NO: 1811559 - protein, 17 aa, Staphylococcus epidermidis
QIHGASFQVFNYVREKL

SEQ ID NO: 1811560 - protein, 23 aa, Staphylococcus epidermidis
QIHQRLYLEQSLITERIKKYFNT

SEQ ID NO: 1811561 - protein, 21 aa, Staphylococcus epidermidis
QIIELNRYLRGTGVEHTTLGN

SEQ ID NO: 1811562 - protein, 20 aa, Staphylococcus epidermidis
QIIKGIILKAKRSFHDERTD

SEQ ID NO: 1811563 - protein, 23 aa, Staphylococcus epidermidis
QIIPHRQPFLLIDRVVEYEEGKR

SEQ ID NO: 1811564 - protein, 19 aa, Staphylococcus epidermidis
QIKDCIFVAHNISFDLNFI

SEQ ID NO: 1811565 - protein, 23 aa, Staphylococcus epidermidis
QIKDLPMVMVMLYASLGSVLLRE

SEQ ID NO: 1811566 - protein, 24 aa, Staphylococcus epidermidis
QIKDLPMVMVMLYASLGSVLLREF

SEQ ID NO: 1811567 - protein, 24 aa, Staphylococcus epidermidis
QILKEIISRLSFLNNVGLEYLTLE

SEQ ID NO: 1811568 - protein, 17 aa, Staphylococcus epidermidis
QILVYSGLFKEARKKLK

SEQ ID NO: 1811569 - protein, 24 aa, Staphylococcus epidermidis
QINKGYCLLVGVGQSSTEEDVKVI

SEQ ID NO: 1811570 - protein, 25 aa, Staphylococcus epidermidis
QINVLKWVHQYIEHFGGDPNNVTLI

SEQ ID NO: 1811571 - protein, 27 aa, Staphylococcus epidermidis
QIRALIYGVWLLSWSKIKLSESSIKAD

SEQ ID NO: 1811572 - protein, 24 aa, Staphylococcus epidermidis
QIRALIYGVWLLSWSKVKLSESSI

SEQ ID NO: 1811573 - protein, 24 aa, Staphylococcus epidermidis
QISEGARGYLVFGNPLNIEKIADS

SEQ ID NO: 1811574 - protein, 25 aa, Staphylococcus epidermidis
QISLWLQEKVYNWDEFKKNILEEKL

SEQ ID NO: 1811575 - protein, 28 aa, Staphylococcus epidermidis
QIYHLNGRLKLQLLDEVKSVYNSQMTQN

SEQ ID NO: 1811576 - protein, 27 aa, Staphylococcus epidermidis
QIYLITHPIEWQLKYLLLRRTLNENEL

SEQ ID NO: 1811577 - protein, 24 aa, Staphylococcus epidermidis
QIYSSRPAPYFKYDAHDDNFIRLG

SEQ ID NO: 1811578 - protein, 25 aa, Staphylococcus epidermidis
QKANIRMSLFTSLFILHNINRNNET

SEQ ID NO: 1811579 - protein, 20 aa, Staphylococcus epidermidis
QKDKKSFVLFKVQTHQDEIN

SEQ ID NO: 1811580 - protein, 24 aa, Staphylococcus epidermidis
QKEALKELGHLNSLNAPQRETVKT

SEQ ID NO: 1811581 - protein, 18 aa, Staphylococcus epidermidis
QKEYLASEIFDLTEEEKS

SEQ ID NO: 1811582 - protein, 17 aa, Staphylococcus epidermidis
QKFLKDYGRGHFLNNGQ

SEQ ID NO: 1811583 - protein, 28 aa, Staphylococcus epidermidis
QKFRAKQIFEWLYQKRVNSIDEMTNLSK

SEQ ID NO: 1811584 - protein, 23 aa, Staphylococcus epidermidis
QKGHIKIGLSPMMNVQMFTNALN

SEQ ID NO: 1811585 - protein, 24 aa, Staphylococcus epidermidis
QKGHPVTIISVFRGAETPYFQLHK

SEQ ID NO: 1811586 - protein, 21 aa, Staphylococcus epidermidis
QKGRIELFMKYNVKGYKNTHF

SEQ ID NO: 1811587 - protein, 19 aa, Staphylococcus epidermidis
QKGTGKWTSINALELGIPL

SEQ ID NO: 1811588 - protein, 18 aa, Staphylococcus epidermidis
QKIARFVSALSEELSSHL

SEQ ID NO: 1811589 - protein, 26 aa, Staphylococcus epidermidis
QKIFNEWKIPIIFVTHSNYEAEKMAH

SEQ ID NO: 1811590 - protein, 18 aa, Staphylococcus epidermidis
QKIGYLIEHPKLYQDLSG

SEQ ID NO: 1811591 - protein, 23 aa, Staphylococcus epidermidis
QKIIARTNIKSMGKNVLSKCYGG

SEQ ID NO: 1811592 - protein, 17 aa, Staphylococcus epidermidis
QKLDLLILNIQKLSVDC

SEQ ID NO: 1811593 - protein, 25 aa, Staphylococcus epidermidis
QKLFFKLLFYSGARKGEIRALTWRD

SEQ ID NO: 1811594 - protein, 17 aa, Staphylococcus epidermidis
QKLIEEAPCAALTEQRR

SEQ ID NO: 1811595 - protein, 21 aa, Staphylococcus epidermidis
QKLIHRSIRIIQDVCDLNHQE

SEQ ID NO: 1811596 - protein, 20 aa, Staphylococcus epidermidis
QKLKSGLNLKEIAQQQNVKL

SEQ ID NO: 1811597 - protein, 26 aa, Staphylococcus epidermidis
QKLNFVYLYHCFEFSNNIVKAKDNES

SEQ ID NO: 1811598 - protein, 18 aa, Staphylococcus epidermidis
QKLYEDIYADSFEDLKRT

SEQ ID NO: 1811599 - protein, 20 aa, Staphylococcus epidermidis
QKMIDWCSGNQAALIKLIND

SEQ ID NO: 1811600 - protein, 18 aa, Staphylococcus epidermidis
QKMRGKGSIVIFQEITEF

SEQ ID NO: 1811601 - protein, 24 aa, Staphylococcus epidermidis
QKNMFEIRLSKIWEKLLNKSPILK

SEQ ID NO: 1811602 - protein, 21 aa, Staphylococcus epidermidis
QKQKYLLLEFGNFEQEVDDKQ

SEQ ID NO: 1811603 - protein, 21 aa, Staphylococcus epidermidis
QKRELNQLINAANTRTKVQEE

SEQ ID NO: 1811604 - protein, 23 aa, Staphylococcus epidermidis
QKRSQEYNGHFVISTVHQLFRFK

SEQ ID NO: 1811605 - protein, 18 aa, Staphylococcus epidermidis
QKSGRITGAQAWVGTLLK

SEQ ID NO: 1811606 - protein, 31 aa, Staphylococcus epidermidis
QKSRIDLYFKYNLKKYTAMKITKVEKNPMGD

SEQ ID NO: 1811607 - protein, 24 aa, Staphylococcus epidermidis
QKSRLDLYFKYNLRKYGSMKITKV

SEQ ID NO: 1811608 - protein, 17 aa, Staphylococcus epidermidis
QKSTISLLRLFTFNDAI

SEQ ID NO: 1811609 - protein, 22 aa, Staphylococcus epidermidis
QKVLDRGGFWYAAHVTSDNGIL

SEQ ID NO: 1811610 - protein, 23 aa, Staphylococcus epidermidis
QKVLEYRPDVLILDLSMPPGESG

SEQ ID NO: 1811611 - protein, 22 aa, Staphylococcus epidermidis
QKYIFDYSACNYPVGVVEDQIY

SEQ ID NO: 1811612 - protein, 22 aa, Staphylococcus epidermidis
QKYYQLLVEWNKKMNLTSITDE

SEQ ID NO: 1811613 - protein, 25 aa, Staphylococcus epidermidis
QLAEARLQLMSDFSSRLYGKQSEIM

SEQ ID NO: 1811614 - protein, 17 aa, Staphylococcus epidermidis
QLAGMRGLMAAPSGKII

SEQ ID NO: 1811615 - protein, 19 aa, Staphylococcus epidermidis
QLATYFGVSMDYLIGLEDD

SEQ ID NO: 1811616 - protein, 24 aa, Staphylococcus epidermidis
QLATYIRKHFENIEVLSITLYGER

SEQ ID NO: 1811617 - protein, 18 aa, Staphylococcus epidermidis
QLAYAIGVAEPVSISIDT

SEQ ID NO: 1811618 - protein, 20 aa, Staphylococcus epidermidis
QLDFLLPERFDLTYIGQDGE

SEQ ID NO: 1811619 - protein, 20 aa, Staphylococcus epidermidis
QLDLPIGVIPGGTFNDFTKT

SEQ ID NO: 1811620 - protein, 17 aa, Staphylococcus epidermidis
QLEDFPMCVEFRHQSWF

SEQ ID NO: 1811621 - protein, 19 aa, Staphylococcus epidermidis
QLEIFEGKPVMFTASHNIN

SEQ ID NO: 1811622 - protein, 17 aa, Staphylococcus epidermidis
QLEMMKVAVQFEDAEAF

SEQ ID NO: 1811623 - protein, 21 aa, Staphylococcus epidermidis
QLERVNIASVLMLDPELIIAD

SEQ ID NO: 1811624 - protein, 29 aa, Staphylococcus epidermidis
QLERVYIASVLMLKPPLIIADEPVASLDV

SEQ ID NO: 1811625 - protein, 22 aa, Staphylococcus epidermidis
QLESFKFPGEILELQNGGRHHH

SEQ ID NO: 1811626 - protein, 20 aa, Staphylococcus epidermidis
QLFALIVEKIREAFKDRILI

SEQ ID NO: 1811627 - protein, 18 aa, Staphylococcus epidermidis
QLFIPLTIGGGIQTLDDI

SEQ ID NO: 1811628 - protein, 18 aa, Staphylococcus epidermidis
QLFKEIFKASTDLQKSEN

SEQ ID NO: 1811629 - protein, 26 aa, Staphylococcus epidermidis
QLFYSTQIPVCLWFISNNKGQNGKKE

SEQ ID NO: 1811630 - protein, 18 aa, Staphylococcus epidermidis
QLHHPSLYIDIGDHVDLS

SEQ ID NO: 1811631 - protein, 18 aa, Staphylococcus epidermidis
QLHPNFKIASEQLLTSHA

SEQ ID NO: 1811632 - protein, 21 aa, Staphylococcus epidermidis
QLIKDCVFVAHNISFDLNFIK

SEQ ID NO: 1811633 - protein, 22 aa, Staphylococcus epidermidis
QLKDIYKYKICIKTEETENGQI

SEQ ID NO: 1811634 - protein, 25 aa, Staphylococcus epidermidis
QLKDLGITFTLLRPTVKADLEKMIS

SEQ ID NO: 1811635 - protein, 20 aa, Staphylococcus epidermidis
QLKLARLSRRTHELGIPIMV

SEQ ID NO: 1811636 - protein, 24 aa, Staphylococcus epidermidis
QLLDDYRWQFGIPPKGNANYAWIE

SEQ ID NO: 1811637 - protein, 22 aa, Staphylococcus epidermidis
QLLDEGLEWVLIQGQMGIELWT

SEQ ID NO: 1811638 - protein, 22 aa, Staphylococcus epidermidis
QLLIREELRMETSLVAQSGETR

SEQ ID NO: 1811639 - protein, 18 aa, Staphylococcus epidermidis
QLLKRFDEQPLFNLNHIR

SEQ ID NO: 1811640 - protein, 39 aa, Staphylococcus epidermidis
QLLKRYPFELSGGMAQRVAFIMSLIRRPDYLFLDEPTSA

SEQ ID NO: 1811641 - protein, 20 aa, Staphylococcus epidermidis
QLLLKYVKNYASHTCEVMSL

SEQ ID NO: 1811642 - protein, 17 aa, Staphylococcus epidermidis
QLLSLADTFKEKEEELT

SEQ ID NO: 1811643 - protein, 18 aa, Staphylococcus epidermidis
QLLVEWNEKMNLTSITEE

SEQ ID NO: 1811644 - protein, 23 aa, Staphylococcus epidermidis
QLNDMYRLLGIAKYEDRFVVPSS

SEQ ID NO: 1811645 - protein, 22 aa, Staphylococcus epidermidis
QLNGQYGFKDVYLGLPTLINQN

SEQ ID NO: 1811646 - protein, 28 aa, Staphylococcus epidermidis
QLNNKTSECFSFFISYHYNKFDLGVQQL

SEQ ID NO: 1811647 - protein, 24 aa, Staphylococcus epidermidis
QLPKGRKPIITSWAKHERYDQVLT

SEQ ID NO: 1811648 - protein, 22 aa, Staphylococcus epidermidis
QLRECVDTPIIVISARTEEETI

SEQ ID NO: 1811649 - protein, 18 aa, Staphylococcus epidermidis
QLRKGSVKRIVLTRPAVE

SEQ ID NO: 1811650 - protein, 24 aa, Staphylococcus epidermidis
QLSKIGGGVAINLSKLRARGEAIK

SEQ ID NO: 1811651 - protein, 25 aa, Staphylococcus epidermidis
QLSKIGGGVAINLSKLRARGEAIKG

SEQ ID NO: 1811652 - protein, 24 aa, Staphylococcus epidermidis
QLSLSRKRGEGVYLNGPESKKREF

SEQ ID NO: 1811653 - protein, 18 aa, Staphylococcus epidermidis
QLSQDFVKGSTFKVDVKR

SEQ ID NO: 1811654 - protein, 21 aa, Staphylococcus epidermidis
QLTHFLLKFGEFSGSGIKTSL

SEQ ID NO: 1811655 - protein, 23 aa, Staphylococcus epidermidis
QLTWFKNKMNVHWLNKETMSLQM

SEQ ID NO: 1811656 - protein, 18 aa, Staphylococcus epidermidis
QLWIKAILKKTDITNKQI

SEQ ID NO: 1811657 - protein, 20 aa, Staphylococcus epidermidis
QLYLSEFIYNLLVQITLDYP

SEQ ID NO: 1811658 - protein, 18 aa, Staphylococcus epidermidis
QMAESVAFTKAIKEKYPN

SEQ ID NO: 1811659 - protein, 17 aa, Staphylococcus epidermidis
QMDIEFIVGSREQEIDN

SEQ ID NO: 1811660 - protein, 26 aa, Staphylococcus epidermidis
QMEKQESRHEITIEFYRKELQERSKL

SEQ ID NO: 1811661 - protein, 17 aa, Staphylococcus epidermidis
QMIDFLFTSALFGRVVA

SEQ ID NO: 1811662 - protein, 20 aa, Staphylococcus epidermidis
QMKIFKKHFDKIKALPNDYS

SEQ ID NO: 1811663 - protein, 24 aa, Staphylococcus epidermidis
QMNEFERMILLRSIDSHWTDHIDT

SEQ ID NO: 1811664 - protein, 18 aa, Staphylococcus epidermidis
QMVEAGNGFAIISKSALH

SEQ ID NO: 1811665 - protein, 24 aa, Staphylococcus epidermidis
QMWADKRQYLGVDFLGTSYAAVPP

SEQ ID NO: 1811666 - protein, 33 aa, Staphylococcus epidermidis
QMYLSSAWMKSHWAYDSMRSFTRQMLKKKSEDD

SEQ ID NO: 1811667 - protein, 18 aa, Staphylococcus epidermidis
QNALEVVEDVPLFDRTKK

SEQ ID NO: 1811668 - protein, 23 aa, Staphylococcus epidermidis
QNDMLRKKLALTSQIERIENRMA

SEQ ID NO: 1811669 - protein, 22 aa, Staphylococcus epidermidis
QNEGYNLTFFAFFVKAVADALK

SEQ ID NO: 1811670 - protein, 26 aa, Staphylococcus epidermidis
QNFDVSRILGLPAFIDILTILEPNSQ

SEQ ID NO: 1811671 - protein, 23 aa, Staphylococcus epidermidis
QNFKRINNSLARLEMPEVDEEAL

SEQ ID NO: 1811672 - protein, 23 aa, Staphylococcus epidermidis
QNFLDFIKTYSIHLSSSRLVSGN

SEQ ID NO: 1811673 - protein, 23 aa, Staphylococcus epidermidis
QNKRLTENITWADNRASRYADLI

SEQ ID NO: 1811674 - protein, 28 aa, Staphylococcus epidermidis
QNKTNQSYHQPAQSTPQQSSQHNNQSDS

SEQ ID NO: 1811675 - protein, 21 aa, Staphylococcus epidermidis
QNLFARWRKEETLYSEDEKKE

SEQ ID NO: 1811676 - protein, 20 aa, Staphylococcus epidermidis
QNLFEKFGFTKVGEAEIDYH

SEQ ID NO: 1811677 - protein, 25 aa, Staphylococcus epidermidis
QNLGLQNPEIWDSRNSKFGTPESQI

SEQ ID NO: 1811678 - protein, 17 aa, Staphylococcus epidermidis
QNLRFLKKQVQFTSVDY

SEQ ID NO: 1811679 - protein, 26 aa, Staphylococcus epidermidis
QNNGFKAYFVGGSVRDYIMQRPIHDV

SEQ ID NO: 1811680 - protein, 26 aa, Staphylococcus epidermidis
QNRLVELGFDIAKSHFSNARDLIVTP

SEQ ID NO: 1811681 - protein, 28 aa, Staphylococcus epidermidis
QNSFEVFCTLAYTGMRAGELLALKWSDI

SEQ ID NO: 1811682 - protein, 25 aa, Staphylococcus epidermidis
QNVLINLGFKQVFNLSGGNKNYQRY

SEQ ID NO: 1811683 - protein, 19 aa, Staphylococcus epidermidis
QNYHPFFGFNKSRKRNLFS

SEQ ID NO: 1811684 - protein, 25 aa, Staphylococcus epidermidis
QNYIKEQYKGIGIMYKNHQWYFVVA

SEQ ID NO: 1811685 - protein, 23 aa, Staphylococcus epidermidis
QPAAYCGVVGMKPTYGRVSRFGL

SEQ ID NO: 1811686 - protein, 23 aa, Staphylococcus epidermidis
QPDFINRLFEIDGVKSIFYVMDF

SEQ ID NO: 1811687 - protein, 21 aa, Staphylococcus epidermidis
QPEGAFYIFPSIKKFTDNDFD

SEQ ID NO: 1811688 - protein, 19 aa, Staphylococcus epidermidis
QPELIVLDVMLPKKDGIEV

SEQ ID NO: 1811689 - protein, 23 aa, Staphylococcus epidermidis
QPFMIECYDTVFQMTSMVSGQLK

SEQ ID NO: 1811690 - protein, 24 aa, Staphylococcus epidermidis
QPIDLRPDLALNIDNLITLCIDCH

SEQ ID NO: 1811691 - protein, 17 aa, Staphylococcus epidermidis
QPIELKVVLLHHSVSRV

SEQ ID NO: 1811692 - protein, 23 aa, Staphylococcus epidermidis
QPILKDKFESLGLQVKEDHASSI

SEQ ID NO: 1811693 - protein, 17 aa, Staphylococcus epidermidis
QPIPPYDQGDMWTQGSQ

SEQ ID NO: 1811694 - protein, 26 aa, Staphylococcus epidermidis
QPIVLRKTIQGFYIVVGERRFRASQI

SEQ ID NO: 1811695 - protein, 30 aa, Staphylococcus epidermidis; identical to SEQ ID NO: 1671869

SEQ ID NO: 1811696 - protein, 21 aa, Staphylococcus epidermidis
QPKWSELINRLSIPQNNTNKY

SEQ ID NO: 1811697 - protein, 20 aa, Staphylococcus epidermidis
QPKWSELVNRLSIPQNNTNK

SEQ ID NO: 1811698 - protein, 21 aa, Staphylococcus epidermidis
QPLREDMSFLTRFINSSEVNE

SEQ ID NO: 1811699 - protein, 19 aa, Staphylococcus epidermidis
QPLTFPLMALIVSGGHTEL

SEQ ID NO: 1811700 - protein, 19 aa, Staphylococcus epidermidis
QPLTFPLMSLIVSGGHTEL

SEQ ID NO: 1811701 - protein, 18 aa, Staphylococcus epidermidis
QPNHFLVAFDAGKTTFRH

SEQ ID NO: 1811702 - protein, 20 aa, Staphylococcus epidermidis
QPPGKRKISFQIGETNLGFY

SEQ ID NO: 1811703 - protein, 18 aa, Staphylococcus epidermidis
QPQELVIIGGGYIALEFA

SEQ ID NO: 1811704 - protein, 25 aa, Staphylococcus epidermidis
QPSPFHWRLLDKLALNTLNEVVLPI

SEQ ID NO: 1811705 - protein, 22 aa, Staphylococcus epidermidis
QPTVRELLGYLSAGGGHLTLIG

SEQ ID NO: 1811706 - protein, 17 aa, Staphylococcus epidermidis
QPVELSGTYVLLASEDS

SEQ ID NO: 1811707 - protein, 25 aa, Staphylococcus epidermidis
QPVPDLPPVEAFKGPVGRYETVLAI

SEQ ID NO: 1811708 - protein, 24 aa, Staphylococcus epidermidis
QPYLKDTFKKMGLNVIEDEASKND

SEQ ID NO: 1811709 - protein, 18 aa, Staphylococcus epidermidis
QQALKMVLENKVVSKNGR

SEQ ID NO: 1811710 - protein, 17 aa, Staphylococcus epidermidis
QQDEWHEFLSPNIRSQA

SEQ ID NO: 1811711 - protein, 20 aa, Staphylococcus epidermidis
QQFAPRMSALTIKREGSLHH

SEQ ID NO: 1811712 - protein, 23 aa, Staphylococcus epidermidis
QQFKALRRFFKIYVRGIKGASQL

SEQ ID NO: 1811713 - protein, 17 aa, Staphylococcus epidermidis
QQFKMLSNNVMFRKHVK

SEQ ID NO: 1811714 - protein, 25 aa, Staphylococcus epidermidis
QQIEWKWSGTFYPNTSIKVRRNWGL

SEQ ID NO: 1811715 - protein, 24 aa, Staphylococcus epidermidis
QQKLLECLTALSIAEGLNQLVEEE

SEQ ID NO: 1811716 - protein, 20 aa, Staphylococcus epidermidis
QQKLLKYLTALSMAEGLNQL

SEQ ID NO: 1811717 - protein, 17 aa, Staphylococcus epidermidis
QQLNLKGLAFISATDSY

SEQ ID NO: 1811718 - protein, 17 aa, Staphylococcus epidermidis
QQLPEIYIDKMLEAQKD

SEQ ID NO: 1811719 - protein, 22 aa, Staphylococcus epidermidis
QQLPYLISFLSFHNYSIYQILS

SEQ ID NO: 1811720 - protein, 24 aa, Staphylococcus epidermidis
QQQLKGRYSIVIFDHYGKITLDNS

SEQ ID NO: 1811721 - protein, 18 aa, Staphylococcus epidermidis
QQYAELLVKVGMNVQENQ

SEQ ID NO: 1811722 - protein, 20 aa, Staphylococcus epidermidis
QRADTFLPYMKDALKVRQRV

SEQ ID NO: 1811723 - protein, 18 aa, Staphylococcus epidermidis
QRAGAGAAYLNIFHSDVI

SEQ ID NO: 1811724 - protein, 34 aa, Staphylococcus epidermidis
QRDKHLQDVPGFKALRFLRPKTYGRHYIIVTLWE

SEQ ID NO: 1811725 - protein, 27 aa, Staphylococcus epidermidis
QREFRKIFGDSHFDYAIDFSGYSMFWA

SEQ ID NO: 1811726 - protein, 17 aa, Staphylococcus epidermidis
QREIYEFIDNANRMVRP

SEQ ID NO: 1811727 - protein, 19 aa, Staphylococcus epidermidis
QRERGLNLYISDAIKTFIK

SEQ ID NO: 1811728 - protein, 21 aa, Staphylococcus epidermidis
QRESFSKALFGRWRKEENFIL

SEQ ID NO: 1811729 - protein, 22 aa, Staphylococcus epidermidis
QRFDCVPSQLNYVIKTRFTNEH

SEQ ID NO: 1811730 - protein, 25 aa, Staphylococcus epidermidis
QRFKEMNNHITFRFDRLNKEMNNKF

SEQ ID NO: 1811731 - protein, 25 aa, Staphylococcus epidermidis
QRGGIPCIFNHQWSNERIYQLVKSY

SEQ ID NO: 1811732 - protein, 22 aa, Staphylococcus epidermidis
QRIKENFDIFDFNLELTDVAEI

SEQ ID NO: 1811733 - protein, 21 aa, Staphylococcus epidermidis
QRIPYQHVHQAVVYISGQKVA

SEQ ID NO: 1811734 - protein, 17 aa, Staphylococcus epidermidis
QRIRQNLDRIVKSQSNQ

SEQ ID NO: 1811735 - protein, 20 aa, Staphylococcus epidermidis
QRKIDVESVFGIMKPILSFT

SEQ ID NO: 1811736 - protein, 19 aa, Staphylococcus epidermidis
QRKRKSLRKKGKKNQNKST

SEQ ID NO: 1811737 - protein, 25 aa, Staphylococcus epidermidis
QRLDYPILCANIFENGKPFTGQGIT

SEQ ID NO: 1811738 - protein, 17 aa, Staphylococcus epidermidis
QRLKGSLIGSEDTVKQK

SEQ ID NO: 1811739 - protein, 17 aa, Staphylococcus epidermidis
QRMLDAFAKEVVNGALV

SEQ ID NO: 1811740 - protein, 19 aa, Staphylococcus epidermidis
QRMYMPIIVQKILHLFGKR

SEQ ID NO: 1811741 - protein, 23 aa, Staphylococcus epidermidis
QRPSEVSETIFAQCNNFVTLKLT

SEQ ID NO: 1811742 - protein, 17 aa, Staphylococcus epidermidis
QRRKHLKQNIASPSTTD

SEQ ID NO: 1811743 - protein, 17 aa, Staphylococcus epidermidis
QRRKHLKQNIASPSTTE

SEQ ID NO: 1811744 - protein, 20 aa, Staphylococcus epidermidis
QRSFTRYGSAYIPMDETLAR

SEQ ID NO: 1811745 - protein, 19 aa, Staphylococcus epidermidis
QRSNYALSFSNMTFPHQMM

SEQ ID NO: 1811746 - protein, 18 aa, Staphylococcus epidermidis
QRTGEAIIIDPVRDLTKY

SEQ ID NO: 1811747 - protein, 26 aa, Staphylococcus epidermidis
QRVIFFSKRLTGYDFENFDYNRISTF

SEQ ID NO: 1811748 - protein, 22 aa, Staphylococcus epidermidis
QRVIRNKKKYGFESTNTSSEKV

SEQ ID NO: 1811749 - protein, 17 aa, Staphylococcus epidermidis
QRVKFKAKIVPYVKKGM

SEQ ID NO: 1811750 - protein, 21 aa, Staphylococcus epidermidis
QRWADEREHVGIDFLGVSYAA

SEQ ID NO: 1811751 - protein, 17 aa, Staphylococcus epidermidis
QRYAKLIQRVHGLDKIR

SEQ ID NO: 1811752 - protein, 24 aa, Staphylococcus epidermidis
QRYRWEYMGEAIGSGVVPFNNLQI

SEQ ID NO: 1811753 - protein, 23 aa, Staphylococcus epidermidis
QSAKMYGGTCINIGCIPSKTLVH

SEQ ID NO: 1811754 - protein, 26 aa, Staphylococcus epidermidis
QSEAYRKANKIGIVLSMPHEVNTYPI

SEQ ID NO: 1811755 - protein, 17 aa, Staphylococcus epidermidis
QSELIIIHRHLRPDPDA

SEQ ID NO: 1811756 - protein, 20 aa, Staphylococcus epidermidis
QSENKFSFIYGENGSGKSNI

SEQ ID NO: 1811757 - protein, 23 aa, Staphylococcus epidermidis
QSFELMFVKWVPREQNKEANQYA

SEQ ID NO: 1811758 - protein, 24 aa, Staphylococcus epidermidis
QSGRYSYKMKRLYYLRISTLPLSL

SEQ ID NO: 1811759 - protein, 24 aa, Staphylococcus epidermidis
QSGSTRPSKWIDFMEDADSIAKDI

SEQ ID NO: 1811760 - protein, 18 aa, Staphylococcus epidermidis
QSHLPIDVHLMIEQPENY

SEQ ID NO: 1811761 - protein, 20 aa, Staphylococcus epidermidis
QSIFKNIRYIGIFNPRLNRI

SEQ ID NO: 1811762 - protein, 17 aa, Staphylococcus epidermidis
QSIKDFKDKISYNEHHP

SEQ ID NO: 1811763 - protein, 20 aa, Staphylococcus epidermidis
QSILRTLFNSERFDEIRHLL

SEQ ID NO: 1811764 - protein, 21 aa, Staphylococcus epidermidis
QSILRTLFNSERFDEIRHLLL

SEQ ID NO: 1811765 - protein, 21 aa, Staphylococcus epidermidis
QSILRTLFNSERFDEIRHLLV

SEQ ID NO: 1811766 - protein, 24 aa, Staphylococcus epidermidis
QSILRTLFNSERFDEIRHLLVENV

SEQ ID NO: 1811767 - protein, 25 aa, Staphylococcus epidermidis
QSILRTLFNSERFEEIRSYLMDSVK

SEQ ID NO: 1811768 - protein, 21 aa, Staphylococcus epidermidis
QSIPMAIKYYDTFQRLKNEGV

SEQ ID NO: 1811769 - protein, 18 aa, Staphylococcus epidermidis
QSKMKLVAKHLVSPELIK

SEQ ID NO: 1811770 - protein, 19 aa, Staphylococcus epidermidis
QSKWSKWFKTYGVEESMNL

SEQ ID NO: 1811771 - protein, 25 aa, Staphylococcus epidermidis
QSLHFRVYLLGGEMRDLTEAFVGEM

SEQ ID NO: 1811772 - protein, 24 aa, Staphylococcus epidermidis
QSLLPHLIEAVAYNVARKNTDVKL

SEQ ID NO: 1811773 - protein, 18 aa, Staphylococcus epidermidis
QSLQGFNGIEVWQIARDD

SEQ ID NO: 1811774 - protein, 26 aa, Staphylococcus epidermidis
QSMTLCKLKSLFDYLNIELTTMDTPL

SEQ ID NO: 1811775 - protein, 22 aa, Staphylococcus epidermidis
QSNMPSRFLKEIPEDLLDSHTG

SEQ ID NO: 1811776 - protein, 19 aa, Staphylococcus epidermidis
QSNMPSRFLREIPEDLLES

SEQ ID NO: 1811777 - protein, 22 aa, Staphylococcus epidermidis
QSQRPSGFSVLYEIGSARHSRY

SEQ ID NO: 1811778 - protein, 22 aa, Staphylococcus epidermidis
QSQVQFVGFVGEHSRYDLMLVQ

SEQ ID NO: 1811779 - protein, 17 aa, Staphylococcus epidermidis
QSSTSWGCAPSSNTSWF

SEQ ID NO: 1811780 - protein, 27 aa, Staphylococcus epidermidis
QSTICNCPKCSNGRIKKLLSKNKKLFY

SEQ ID NO: 1811781 - protein, 18 aa, Staphylococcus epidermidis
QSTLIKKQAMMRGFLVAE

SEQ ID NO: 1811782 - protein, 20 aa, Staphylococcus epidermidis
QSYSYLIFVQETWSMLHENR

SEQ ID NO: 1811783 - protein, 17 aa, Staphylococcus epidermidis
QTFIPKNYIEDFKDSLN

SEQ ID NO: 1811784 - protein, 17 aa, Staphylococcus epidermidis
QTFIPKNYVEDFKDSLN

SEQ ID NO: 1811785 - protein, 18 aa, Staphylococcus epidermidis
QTFNFKIDETWKNKLVNG

SEQ ID NO: 1811786 - protein, 25 aa, Staphylococcus epidermidis
QTLHFRVYLLGGEMRDLTEAFVGEM

SEQ ID NO: 1811787 - protein, 19 aa, Staphylococcus epidermidis
QTLIIEIARFIPSMKLKNK

SEQ ID NO: 1811788 - protein, 17 aa, Staphylococcus epidermidis
QTLKWLMDAGLTQPFSL

SEQ ID NO: 1811789 - protein, 17 aa, Staphylococcus epidermidis
QTLKWLMDAGLTQPYSI

SEQ ID NO: 1811790 - protein, 17 aa, Staphylococcus epidermidis
QTLLIAMYGGFNQIGRT

SEQ ID NO: 1811791 - protein, 24 aa, Staphylococcus epidermidis
QTMELPYRFYVGGKLGSGQQWYSW

SEQ ID NO: 1811792 - protein, 23 aa, Staphylococcus epidermidis
QTNARIAQPIARAMSQEGYHFFG

SEQ ID NO: 1811793 - protein, 26 aa, Staphylococcus epidermidis
QTNHYWKYVEKYGVLGIALDNPLHVQ

SEQ ID NO: 1811794 - protein, 30 aa, Staphylococcus epidermidis
QTNLRIYFTSTWPSKLVYIAKPQLEKGTVA

SEQ ID NO: 1811795 - protein, 19 aa, Staphylococcus epidermidis
QTPNSYRFQTYLDKEVQIY

SEQ ID NO: 1811796 - protein, 24 aa, Staphylococcus epidermidis
QTPQRPTTQTPVRQNPQTGEKRAK

SEQ ID NO: 1811797 - protein, 18 aa, Staphylococcus epidermidis
QTSKVIHSSQFINEDQPE

SEQ ID NO: 1811798 - protein, 23 aa, Staphylococcus epidermidis
QTSRLKKAPFNRELYEEVEKGMT

SEQ ID NO: 1811799 - protein, 24 aa, Staphylococcus epidermidis
QTTRKFTEVFSVPKKMMDQDLSKL

SEQ ID NO: 1811800 - protein, 19 aa, Staphylococcus epidermidis
QTVIERFEYQVAHHPDKIA

SEQ ID NO: 1811801 - protein, 18 aa, Staphylococcus epidermidis
QTWHGFPLKKMVNDLNEQ

SEQ ID NO: 1811802 - protein, 19 aa, Staphylococcus epidermidis
QTWHGFPLKKMVNDLNEQH

SEQ ID NO: 1811803 - protein, 22 aa, Staphylococcus epidermidis
QTWLDRLDLISTFSNEEEIEKN

SEQ ID NO: 1811804 - protein, 20 aa, Staphylococcus epidermidis
QTYDVFLLGYSMGGRVALYY

SEQ ID NO: 1811805 - protein, 17 aa, Staphylococcus epidermidis
QTYPLVVIHVMREHCSV

SEQ ID NO: 1811806 - protein, 21 aa, Staphylococcus epidermidis
QVATCKEMLLSGVGVTVLPEI

SEQ ID NO: 1811807 - protein, 28 aa, Staphylococcus epidermidis
QVEHMNAWLKPYRRAFNLEEPVVNVTEE

SEQ ID NO: 1811808 - protein, 20 aa, Staphylococcus epidermidis
QVETWWRWYRNGESYRFSQH

SEQ ID NO: 1811809 - protein, 25 aa, Staphylococcus epidermidis
QVEVIRAKRLLDGRASTSGYFDNIE

SEQ ID NO: 1811810 - protein, 19 aa, Staphylococcus epidermidis
QVGKEIFPGGSRAYNDNFL

SEQ ID NO: 1811811 - protein, 25 aa, Staphylococcus epidermidis
QVGKEIFPSGLRAYGEKSILKSIQK

SEQ ID NO: 1811812 - protein, 18 aa, Staphylococcus epidermidis
QVHPRREWCKYLMENDIF

SEQ ID NO: 1811813 - protein, 17 aa, Staphylococcus epidermidis
QVIFDTWGTRVCEEIKP

SEQ ID NO: 1811814 - protein, 19 aa, Staphylococcus epidermidis
QVIQECLGHLIDLGQSSKS

SEQ ID NO: 1811815 - protein, 20 aa, Staphylococcus epidermidis
QVKSAILLASLFSKEATTLT

SEQ ID NO: 1811816 - protein, 23 aa, Staphylococcus epidermidis
QVNDIRVGKVLYMTVDEATDEAV

SEQ ID NO: 1811817 - protein, 18 aa, Staphylococcus epidermidis
QVQKKWERSDYVFPGKMS

SEQ ID NO: 1811818 - protein, 23 aa, Staphylococcus epidermidis
QVRNDLYHNFKIRTDELETLQAI

SEQ ID NO: 1811819 - protein, 28 aa, Staphylococcus epidermidis
QVTKDYKPELAFAIGNAIKYISRANHKN

SEQ ID NO: 1811820 - protein, 23 aa, Staphylococcus epidermidis
QVVIRCFFVYFKMITKEEALSTE

SEQ ID NO: 1811821 - protein, 25 aa, Staphylococcus epidermidis
QVYSLYFKFVMPIFGKMFAKSKEEY

SEQ ID NO: 1811822 - protein, 19 aa, Staphylococcus epidermidis
QWLEECKIDNHFEEVKYEP

SEQ ID NO: 1811823 - protein, 18 aa, Staphylococcus epidermidis
QYFKMCDDRAPLYDIIKN

SEQ ID NO: 1811824 - protein, 27 aa, Staphylococcus epidermidis
QYFKVERLKGVFAWGFRIKSSEPEEGL

SEQ ID NO: 1811825 - protein, 18 aa, Staphylococcus epidermidis
QYGAVYLVNLFSNIKSPE

SEQ ID NO: 1811826 - protein, 18 aa, Staphylococcus epidermidis
QYGHLKAGIYPVNPPERK

SEQ ID NO: 1811827 - protein, 18 aa, Staphylococcus epidermidis
QYIIRLIPFGSLEHTKDV

SEQ ID NO: 1811828 - protein, 23 aa, Staphylococcus epidermidis
QYLKDGLSKLGFDTGKSESPITP

SEQ ID NO: 1811829 - protein, 26 aa, Staphylococcus epidermidis
QYLNHIRLKFCLIDILTTHRPIEDIA

SEQ ID NO: 1811830 - protein, 30 aa, Staphylococcus epidermidis
QYLREQPEIYICGGTKFLHSIINSLKELNY

SEQ ID NO: 1811831 - protein, 17 aa, Staphylococcus epidermidis
QYLTCLDYQKSNGSMLR

SEQ ID NO: 1811832 - protein, 26 aa, Staphylococcus epidermidis
QYLVSKGILVFPGFEISTSEKVHIVC

SEQ ID NO: 1811833 - protein, 24 aa, Staphylococcus epidermidis
QYNGKFGSVSGIGACDAVTLNFYN

SEQ ID NO: 1811834 - protein, 26 aa, Staphylococcus epidermidis
QYPPFQLTEVGGWLYGRGVSDMKGGM

SEQ ID NO: 1811835 - protein, 17 aa, Staphylococcus epidermidis
QYQRFIRHIQFLIYRLT

SEQ ID NO: 1811836 - protein, 25 aa, Staphylococcus epidermidis
QYRTVMPGFEYEAPPSQNKLNPYEV

SEQ ID NO: 1811837 - protein, 19 aa, Staphylococcus epidermidis
QYSNLLHQYQDVFSKYKDK

SEQ ID NO: 1811838 - protein, 22 aa, Staphylococcus epidermidis
QYYKLAICTYPNYYGETFEISQ

SEQ ID NO: 1811839 - protein, 22 aa, Staphylococcus epidermidis
RAAYPIEHIDNIVLPSKAAHPN

SEQ ID NO: 1811840 - protein, 26 aa, Staphylococcus epidermidis
RACEIGPRGDLALVLDTSENQALGQG

SEQ ID NO: 1811841 - protein, 17 aa, Staphylococcus epidermidis
RAEGKARKERIKARMKR

SEQ ID NO: 1811842 - protein, 21 aa, Staphylococcus epidermidis
RAEHVKLLIPLLEKNRDEIAQ

SEQ ID NO: 1811843 - protein, 22 aa, Staphylococcus epidermidis
RAEHVKLLIPLLEQNRDEIAQL

SEQ ID NO: 1811844 - protein, 18 aa, Staphylococcus epidermidis
RAEVFLKEQFERLRKEQI

SEQ ID NO: 1811845 - protein, 17 aa, Staphylococcus epidermidis
RAFDMDVLYTGPHRKEE

SEQ ID NO: 1811846 - protein, 17 aa, Staphylococcus epidermidis
RAFKSVDTPAIFMDHAE

SEQ ID NO: 1811847 - protein, 17 aa, Staphylococcus epidermidis
RAGAKARTTKQQARINR

SEQ ID NO: 1811848 - protein, 28 aa, Staphylococcus epidermidis
RAGDSQIMNWLPYVKTLAERNKLYPNPE

SEQ ID NO: 1811849 - protein, 23 aa, Staphylococcus epidermidis
RAGISKGGLFYHFKSKDELIKEL

SEQ ID NO: 1811850 - protein, 20 aa, Staphylococcus epidermidis
RAGLGNPDAPGFEKWAENFN

SEQ ID NO: 1811851 - protein, 25 aa, Staphylococcus epidermidis
RAIDELPVIALLCTQASGTCIIKDA

SEQ ID NO: 1811852 - protein, 25 aa, Staphylococcus epidermidis
RAIDELPVIALLCTQASNSCIIKDA

SEQ ID NO: 1811853 - protein, 17 aa, Staphylococcus epidermidis
RAIERSASYFDLHDNKI

SEQ ID NO: 1811854 - protein, 19 aa, Staphylococcus epidermidis
RAIIKQCLNLPQTRLRKLL

SEQ ID NO: 1811855 - protein, 22 aa, Staphylococcus epidermidis
RAIKIFPGLVTYVAETHEQAMA

SEQ ID NO: 1811856 - protein, 25 aa, Staphylococcus epidermidis
RAIKQPRYLYGDAVVPFGGESRSEV

SEQ ID NO: 1811857 - protein, 17 aa, Staphylococcus epidermidis
RAKELLAQEGYSKSHPL

SEQ ID NO: 1811858 - protein, 20 aa, Staphylococcus epidermidis
RAKHSVRFSFNEEMTEQQIK

SEQ ID NO: 1811859 - protein, 19 aa, Staphylococcus epidermidis
RAKHSVRFSFNEQTTPQEI

SEQ ID NO: 1811860 - protein, 17 aa, Staphylococcus epidermidis
RAKKVIELSMDEARKLH

SEQ ID NO: 1811861 - protein, 22 aa, Staphylococcus epidermidis
RAKLAKSRAESHLENDDDNSDI

SEQ ID NO: 1811862 - protein, 19 aa, Staphylococcus epidermidis
RALIARPKLLLADEPTGAL

SEQ ID NO: 1811863 - protein, 20 aa, Staphylococcus epidermidis
RALNQLIARHEILRTQYVID

SEQ ID NO: 1811864 - protein, 26 aa, Staphylococcus epidermidis
RAMSQEGYHFFGLLYIGAILTKEGPK

SEQ ID NO: 1811865 - protein, 25 aa, Staphylococcus epidermidis
RANECDSGLDLYVSETITIPAHTTT

SEQ ID NO: 1811866 - protein, 20 aa, Staphylococcus epidermidis
RANNHLIILVMVFSSGHVEN

SEQ ID NO: 1811867 - protein, 20 aa, Staphylococcus epidermidis
RAPWKLKRPQSVYEAEFPQF

SEQ ID NO: 1811868 - protein, 21 aa, Staphylococcus epidermidis
RAQENLKLVIMIIEDGTYEMA

SEQ ID NO: 1811869 - protein, 19 aa, Staphylococcus epidermidis
RAQKLFGQKSYVFDIRKHE

SEQ ID NO: 1811870 - protein, 24 aa, Staphylococcus epidermidis
RAQQLKVIANMAVGFDNIDISLAK

SEQ ID NO: 1811871 - protein, 20 aa, Staphylococcus epidermidis
RAQRGITLLKELKKNPHRIV

SEQ ID NO: 1811872 - protein, 20 aa, Staphylococcus epidermidis
RAQRLLNGRATTSGYFENIE

SEQ ID NO: 1811873 - protein, 20 aa, Staphylococcus epidermidis
RAQSFGMKILAFDPYLTEDK

SEQ ID NO: 1811874 - protein, 19 aa, Staphylococcus epidermidis
RASDYYKDRTTVAIKKSTR

SEQ ID NO: 1811875 - protein, 19 aa, Staphylococcus epidermidis
RASKFLGRCHGYVSDRLKA

SEQ ID NO: 1811876 - protein, 18 aa, Staphylococcus epidermidis
RATISMGYIGLYEAATMF

SEQ ID NO: 1811877 - protein, 29 aa, Staphylococcus epidermidis
RATLKRLPLYYRFVSTLKSKGIDRVNSKA

SEQ ID NO: 1811878 - protein, 18 aa, Staphylococcus epidermidis
RAYTYIRTMGAEGLKEVS

SEQ ID NO: 1811879 - protein, 26 aa, Staphylococcus epidermidis
RCADEGIKFIGPHLEHLDMFGDKVKA

SEQ ID NO: 1811880 - protein, 26 aa, Staphylococcus epidermidis
RCAEEGIKFIGPHLEHLDMFGDKVKA

SEQ ID NO: 1811881 - protein, 20 aa, Staphylococcus epidermidis
RCLIGTFLFIIVDYIIDGIY

SEQ ID NO: 1811882 - protein, 24 aa, Staphylococcus epidermidis
RCNFRCDYCMPKEIFGDDFVFLPK

SEQ ID NO: 1811883 - protein, 20 aa, Staphylococcus epidermidis
RCPYGPRPGEEVKQFTTEIA

SEQ ID NO: 1811884 - protein, 18 aa, Staphylococcus epidermidis
RDADRIGIERNFTIIDPT

SEQ ID NO: 1811885 - protein, 18 aa, Staphylococcus epidermidis
RDDIVFCSSLTFCASANP

SEQ ID NO: 1811886 - protein, 23 aa, Staphylococcus epidermidis
RDDKNLRDAIEMYMSKKYTLDEI

SEQ ID NO: 1811887 - protein, 23 aa, Staphylococcus epidermidis
RDDKNLRDAIEMYMSKNYTLDEI

SEQ ID NO: 1811888 - protein, 21 aa, Staphylococcus epidermidis
RDEEKWEQALFNLIKQQTDKN

SEQ ID NO: 1811889 - protein, 19 aa, Staphylococcus epidermidis
RDEETWFAIMNHLVDISID

SEQ ID NO: 1811890 - protein, 18 aa, Staphylococcus epidermidis
RDEFERWHGRYGGKSDED

SEQ ID NO: 1811891 - protein, 21 aa, Staphylococcus epidermidis
RDEILNRIGTYYFGSDEVSIE

SEQ ID NO: 1811892 - protein, 24 aa, Staphylococcus epidermidis
RDESRTIKAIEELGERMGIQTPIR

SEQ ID NO: 1811893 - protein, 28 aa, Staphylococcus epidermidis
RDETDRTGLRIAIELKKDVNSESIKNYL

SEQ ID NO: 1811894 - protein, 28 aa, Staphylococcus epidermidis
RDFKSVMAKKDFRLILVGGDCPKVKAKP

SEQ ID NO: 1811895 - protein, 19 aa, Staphylococcus epidermidis
RDGEIPEFTGISAPYEAPE

SEQ ID NO: 1811896 - protein, 23 aa, Staphylococcus epidermidis
RDGEISAPIVIGRDHLDSGSVAS

SEQ ID NO: 1811897 - protein, 20 aa, Staphylococcus epidermidis
RDGKSLTREEIEFFVNGYTR

SEQ ID NO: 1811898 - protein, 24 aa, Staphylococcus epidermidis
RDHFECQRCKRLGKVTIDELEIKK

SEQ ID NO: 1811899 - protein, 18 aa, Staphylococcus epidermidis
RDHLEEIYAHTFKADDAL

SEQ ID NO: 1811900 - protein, 23 aa, Staphylococcus epidermidis
RDIAEINGFWAYQNTRNKEFTVN

SEQ ID NO: 1811901 - protein, 17 aa, Staphylococcus epidermidis
RDIGVILRQLCERKGVE

SEQ ID NO: 1811902 - protein, 20 aa, Staphylococcus epidermidis
RDISCNLGSLNIVNVMESGK

SEQ ID NO: 1811903 - protein, 18 aa, Staphylococcus epidermidis
RDKIDVDRLLVVTFTNLS

SEQ ID NO: 1811904 - protein, 18 aa, Staphylococcus epidermidis
RDKYNSALEKLRNQDDTT

SEQ ID NO: 1811905 - protein, 24 aa, Staphylococcus epidermidis
RDLARLMQMLKTFDEFKFDKEKIG

SEQ ID NO: 1811906 - protein, 21 aa, Staphylococcus epidermidis
RDLDNRFLIELTALEDQYDHE

SEQ ID NO: 1811907 - protein, 22 aa, Staphylococcus epidermidis
RDLGIEVGDFISFDPRTIITSS

SEQ ID NO: 1811908 - protein, 21 aa, Staphylococcus epidermidis
RDLKAPIRMHRLLQGDVGSGK

SEQ ID NO: 1811909 - protein, 22 aa, Staphylococcus epidermidis
RDLKGDQTIGLFSYGSGSVGEF

SEQ ID NO: 1811910 - protein, 17 aa, Staphylococcus epidermidis
RDLKIMLDIVINHTSTH

SEQ ID NO: 1811911 - protein, 25 aa, Staphylococcus epidermidis
RDLNGIYKLIFKLPVNKSDQHKLVE

SEQ ID NO: 1811912 - protein, 18 aa, Staphylococcus epidermidis
RDLNKYKTYLEERKITHI

SEQ ID NO: 1811913 - protein, 19 aa, Staphylococcus epidermidis
RDLVDVAVRLVKDGKKSLV

SEQ ID NO: 1811914 - protein, 21 aa, Staphylococcus epidermidis
RDMIEANIAKGYQFMVITDHS

SEQ ID NO: 1811915 - protein, 25 aa, Staphylococcus epidermidis
RDNHSAYAFIKRLIKQFGKASKGSY

SEQ ID NO: 1811916 - protein, 25 aa, Staphylococcus epidermidis
RDNHSAYAFIKRLIKQFGKPQKVIT

SEQ ID NO: 1811917 - protein, 25 aa, Staphylococcus epidermidis
RDNHSAYAFIKRLIKQFGKPQKVVT

SEQ ID NO: 1811918 - protein, 25 aa, Staphylococcus epidermidis
RDNIIKGGMIPKVESAIHTVQSGVA

SEQ ID NO: 1811919 - protein, 19 aa, Staphylococcus epidermidis
RDNLQLFVVIGQLNQLIKG

SEQ ID NO: 1811920 - protein, 19 aa, Staphylococcus epidermidis
RDNPKLKGKPVIVGGKAIH

SEQ ID NO: 1811921 - protein, 19 aa, Staphylococcus epidermidis
RDNPKLKGKPVIVGGKASN

SEQ ID NO: 1811922 - protein, 26 aa, Staphylococcus epidermidis
RDQHRLYKLIWERFVASQMAPAILDT

SEQ ID NO: 1811923 - protein, 19 aa, Staphylococcus epidermidis
RDQLWLGCRDFTLIDVYLN

SEQ ID NO: 1811924 - protein, 21 aa, Staphylococcus epidermidis
RDRLKCYLEPLRLNLNNYRVM

SEQ ID NO: 1811925 - protein, 19 aa, Staphylococcus epidermidis
RDRVIIELLYATGIRVSEL

SEQ ID NO: 1811926 - protein, 31 aa, Staphylococcus epidermidis
RDTFVPAICYNESMGPIQTCDTCMVEIDGEI

SEQ ID NO: 1811927 - protein, 17 aa, Staphylococcus epidermidis
RDTKFLIAGGLDIKHLK

SEQ ID NO: 1811928 - protein, 24 aa, Staphylococcus epidermidis
RDTKYLMHFITSWDHISYKQAFYI

SEQ ID NO: 1811929 - protein, 19 aa, Staphylococcus epidermidis
RDTSWIYDADFEKLSNQDI

SEQ ID NO: 1811930 - protein, 19 aa, Staphylococcus epidermidis
RDVPQIIWHGLPLTEAFLF

SEQ ID NO: 1811931 - protein, 24 aa, Staphylococcus epidermidis
RDYLKDKLESLGFDLTAQPEGAFY

SEQ ID NO: 1811932 - protein, 20 aa, Staphylococcus epidermidis
RDYRKHFEPLIKESDDDFKK

SEQ ID NO: 1811933 - protein, 19 aa, Staphylococcus epidermidis
REACSKLNIHRNLTSHAFR

SEQ ID NO: 1811934 - protein, 25 aa, Staphylococcus epidermidis
RECKECLRSDIDINDDGLCSICEGI

SEQ ID NO: 1811935 - protein, 27 aa, Staphylococcus epidermidis
REDAVWDLPMVFAEFGEEDFHPKTLLQ

SEQ ID NO: 1811936 - protein, 22 aa, Staphylococcus epidermidis
REDILPTFKKLGLDDYIDVIVG

SEQ ID NO: 1811937 - protein, 25 aa, Staphylococcus epidermidis
REDTIKWSINMGADIVLNHRKDLRQ

SEQ ID NO: 1811938 - protein, 19 aa, Staphylococcus epidermidis
REEPLDHVLLFGPPGLGKT

SEQ ID NO: 1811939 - protein, 20 aa, Staphylococcus epidermidis
REEYGLEPKQLIDVKAFMGD

SEQ ID NO: 1811940 - protein, 19 aa, Staphylococcus epidermidis
REEYSWKDELRELIENAKT

SEQ ID NO: 1811941 - protein, 22 aa, Staphylococcus epidermidis
REFEDKINLALNHPYITEEDTI

SEQ ID NO: 1811942 - protein, 22 aa, Staphylococcus epidermidis
REFKQHFPQSGWVEHDANEIWT

SEQ ID NO: 1811943 - protein, 21 aa, Staphylococcus epidermidis
REFLSMQSLPNSITFIGAGII

SEQ ID NO: 1811944 - protein, 21 aa, Staphylococcus epidermidis
REFNPDLKPGEERVKQKGEPG

SEQ ID NO: 1811945 - protein, 23 aa, Staphylococcus epidermidis
REGFHICKGELFGKHRQGEDCLL

SEQ ID NO: 1811946 - protein, 21 aa, Staphylococcus epidermidis
REGLEVKLLYDDVGSKKVRLS

SEQ ID NO: 1811947 - protein, 18 aa, Staphylococcus epidermidis
REGTQFNGYTDYGLTVYG

SEQ ID NO: 1811948 - protein, 21 aa, Staphylococcus epidermidis
REIFNQIIFKLLELEEDKTYF

SEQ ID NO: 1811949 - protein, 24 aa, Staphylococcus epidermidis
REILPIKVKGAWFDRDESIKPRLT

SEQ ID NO: 1811950 - protein, 17 aa, Staphylococcus epidermidis
REIRIIKSVLLKGKKSF

SEQ ID NO: 1811951 - protein, 20 aa, Staphylococcus epidermidis
REIRLRPSYFPFTEPSVEVD

SEQ ID NO: 1811952 - protein, 25 aa, Staphylococcus epidermidis
REKEKGLKPRAIRAMIVGIPNVGKS

SEQ ID NO: 1811953 - protein, 19 aa, Staphylococcus epidermidis
REKERGVCLYGPHRDDLGF

SEQ ID NO: 1811954 - protein, 21 aa, Staphylococcus epidermidis
REKHLELIMKWCAQELKNNFQ

SEQ ID NO: 1811955 - protein, 18 aa, Staphylococcus epidermidis
REKIKIIIINNTDLYKKI

SEQ ID NO: 1811956 - protein, 17 aa, Staphylococcus epidermidis
REKINWQPFATIPEQFE

SEQ ID NO: 1811957 - protein, 26 aa, Staphylococcus epidermidis
REKLKQPRSSVCFDAPSWYELVVEGR

SEQ ID NO: 1811958 - protein, 20 aa, Staphylococcus epidermidis
REKRVKYDKYHTVIGTFSYM

SEQ ID NO: 1811959 - protein, 17 aa, Staphylococcus epidermidis
RELDEKRETALLDQYHS

SEQ ID NO: 1811960 - protein, 17 aa, Staphylococcus epidermidis
RELEILPLIAKGYGNKE

SEQ ID NO: 1811961 - protein, 23 aa, Staphylococcus epidermidis
RELHDSLKLAGYNHFTIVMNDDG

SEQ ID NO: 1811962 - protein, 26 aa, Staphylococcus epidermidis
RELHKIVNYWIDFGVDGFRFDVINLI

SEQ ID NO: 1811963 - protein, 25 aa, Staphylococcus epidermidis
RELVLRTNNLLTRISKYQSSNRIEQ

SEQ ID NO: 1811964 - protein, 17 aa, Staphylococcus epidermidis
REMYDFDHIFIDVPPTI

SEQ ID NO: 1811965 - protein, 24 aa, Staphylococcus epidermidis
RENIKRIEPISVSFKKNIKHDEKE

SEQ ID NO: 1811966 - protein, 18 aa, Staphylococcus epidermidis
RENIQLFVVIGQLNQLIK

SEQ ID NO: 1811967 - protein, 18 aa, Staphylococcus epidermidis
RENSYLKSFEDQFVSKDI

SEQ ID NO: 1811968 - protein, 20 aa, Staphylococcus epidermidis
RENYEALLIYYKNSIDNPVV

SEQ ID NO: 1811969 - protein, 18 aa, Staphylococcus epidermidis
RERIPSKLILLGDGPELL

SEQ ID NO: 1811970 - protein, 20 aa, Staphylococcus epidermidis
RERLDIPSSYRMTHINQKVL

SEQ ID NO: 1811971 - protein, 17 aa, Staphylococcus epidermidis
RERLVVSKQLFYNDSSM

SEQ ID NO: 1811972 - protein, 24 aa, Staphylococcus epidermidis
RERPMDRLLCGDVGYGKTEVAVRA

SEQ ID NO: 1811973 - protein, 22 aa, Staphylococcus epidermidis
RERWKLETEFEPKMEEEQRTKL

SEQ ID NO: 1811974 - protein, 21 aa, Staphylococcus epidermidis
RERYYEYKKFGMIPEYEDERE

SEQ ID NO: 1811975 - protein, 29 aa, Staphylococcus epidermidis
RESLDIVELRIDQWIDFNMEPFETTIHQL

SEQ ID NO: 1811976 - protein, 20 aa, Staphylococcus epidermidis
RETEARTGFVSKTDQYFYNF

SEQ ID NO: 1811977 - protein, 17 aa, Staphylococcus epidermidis
RETFFHYAYLVKKLNSK

SEQ ID NO: 1811978 - protein, 18 aa, Staphylococcus epidermidis
RETYEIMTPQLVGVSTTE

SEQ ID NO: 1811979 - protein, 17 aa, Staphylococcus epidermidis
REVEPPKKGFWSRLFGN

SEQ ID NO: 1811980 - protein, 17 aa, Staphylococcus epidermidis
REVEPPKKRFWSRLFGN

SEQ ID NO: 1811981 - protein, 21 aa, Staphylococcus epidermidis
REVIEDYTVLRGFKPYYIEHG

SEQ ID NO: 1811982 - protein, 17 aa, Staphylococcus epidermidis
REVKGILDMKGGFADSV

SEQ ID NO: 1811983 - protein, 29 aa, Staphylococcus epidermidis
REVVENYTVLRGFKPYYIENGAFSGAIGA

SEQ ID NO: 1811984 - protein, 17 aa, Staphylococcus epidermidis
RFAGGSKKKNWLENITD

SEQ ID NO: 1811985 - protein, 18 aa, Staphylococcus epidermidis
RFDCVPSQLNYVIKTRFT

SEQ ID NO: 1811986 - protein, 21 aa, Staphylococcus epidermidis
RFDDWFPLLADNGTFAINTFI

SEQ ID NO: 1811987 - protein, 21 aa, Staphylococcus epidermidis
RFDEIRHLLLENVKQEKVQIE

SEQ ID NO: 1811988 - protein, 21 aa, Staphylococcus epidermidis
RFDEIRHLLVENVKQEKVQIE

SEQ ID NO: 1811989 - protein, 20 aa, Staphylococcus epidermidis
RFEDELNHWADANATELLSE

SEQ ID NO: 1811990 - protein, 19 aa, Staphylococcus epidermidis
RFEEIRSYLMDSVKNEKLQ

SEQ ID NO: 1811991 - protein, 17 aa, Staphylococcus epidermidis
RFETYVIAGERGSGKIC

SEQ ID NO: 1811992 - protein, 18 aa, Staphylococcus epidermidis
RFIHLVWDIRDVMNSNIK

SEQ ID NO: 1811993 - protein, 22 aa, Staphylococcus epidermidis
RFINAHALAVVHIMRDNCTVCH

SEQ ID NO: 1811994 - protein, 18 aa, Staphylococcus epidermidis
RFISEAKKELSADIDQLV

SEQ ID NO: 1811995 - protein, 18 aa, Staphylococcus epidermidis
RFKKLKLMDIIKEMKKAN

SEQ ID NO: 1811996 - protein, 22 aa, Staphylococcus epidermidis
RFKLNYQKTWACETVDAVAEDV

SEQ ID NO: 1811997 - protein, 18 aa, Staphylococcus epidermidis
RFKNILITKNESVENMQS

SEQ ID NO: 1811998 - protein, 20 aa, Staphylococcus epidermidis
RFKNYYEFLIKNKIIENELS

SEQ ID NO: 1811999 - protein, 19 aa, Staphylococcus epidermidis
RFLKERKSGSAVRLELDCR

SEQ ID NO: 1812000 - protein, 19 aa, Staphylococcus epidermidis
RFLSHEDYLLFTHAIEEEF

SEQ ID NO: 1812001 - protein, 24 aa, Staphylococcus epidermidis
RFNDYPVEVERLLDIVEIKVHALH

SEQ ID NO: 1812002 - protein, 23 aa, Staphylococcus epidermidis
RFNKSPYDGFAIRSEDSKGASGE

SEQ ID NO: 1812003 - protein, 17 aa, Staphylococcus epidermidis
RFNSELFVFKANGWQKI

SEQ ID NO: 1812004 - protein, 19 aa, Staphylococcus epidermidis
RFNSWHEMYEKALGEYTFN

SEQ ID NO: 1812005 - protein, 17 aa, Staphylococcus epidermidis
RFNVPDEVYEIFQTTML

SEQ ID NO: 1812006 - protein, 23 aa, Staphylococcus epidermidis
RFNYCIKEKMKLSEKDRLKTYKK

SEQ ID NO: 1812007 - protein, 18 aa, Staphylococcus epidermidis
RFQELFKEMMGNLDEDIK

SEQ ID NO: 1812008 - protein, 26 aa, Staphylococcus epidermidis
RFQTYLDKEVQIYTSLIVREDAQLLY

SEQ ID NO: 1812009 - protein, 18 aa, Staphylococcus epidermidis
RFRFKSFVLERSEGNIVI

SEQ ID NO: 1812010 - protein, 22 aa, Staphylococcus epidermidis
RFSEKTYLLGYTEEPLKFKVRL

SEQ ID NO: 1812011 - protein, 20 aa, Staphylococcus epidermidis
RFSGRPSQLLVTFNEADIEE

SEQ ID NO: 1812012 - protein, 19 aa, Staphylococcus epidermidis
RFSIHKSKYSFIVKDTYFG

SEQ ID NO: 1812013 - protein, 20 aa, Staphylococcus epidermidis
RFTGDSDSHCQISKKIAHTM

SEQ ID NO: 1812014 - protein, 26 aa, Staphylococcus epidermidis
RFVHKTSEELIKWQKYMESISDSIEG

SEQ ID NO: 1812015 - protein, 17 aa, Staphylococcus epidermidis
RGAGDPKGSSVGYKNLE

SEQ ID NO: 1812016 - protein, 20 aa, Staphylococcus epidermidis
RGCSTEDVYNLSIITAAQAL

SEQ ID NO: 1812017 - protein, 26 aa, Staphylococcus epidermidis
RGDIFILAKVLHDWNDKQAIKILNNV

SEQ ID NO: 1812018 - protein, 25 aa, Staphylococcus epidermidis
RGDMTKWTKLAEISDQVMIDYGYTP

SEQ ID NO: 1812019 - protein, 19 aa, Staphylococcus epidermidis
RGDTGYFFNTAYLPDGALN

SEQ ID NO: 1812020 - protein, 20 aa, Staphylococcus epidermidis
RGFNCYDELMIYYIKSLNGL

SEQ ID NO: 1812021 - protein, 19 aa, Staphylococcus epidermidis
RGFVPASLISTDFIEDFSV

SEQ ID NO: 1812022 - protein, 21 aa, Staphylococcus epidermidis
RGGGSIEDLWNFNEEDVVKAI

SEQ ID NO: 1812023 - protein, 20 aa, Staphylococcus epidermidis
RGHDSIAMFEVLKDGRSLRS

SEQ ID NO: 1812024 - protein, 19 aa, Staphylococcus epidermidis
RGHEVYFITSNIPFRIRKP

SEQ ID NO: 1812025 - protein, 22 aa, Staphylococcus epidermidis
RGICCLKPGIPGISENIEVVSI

SEQ ID NO: 1812026 - protein, 22 aa, Staphylococcus epidermidis
RGIDEHLIRLSVGIEDYNDIEI

SEQ ID NO: 1812027 - protein, 19 aa, Staphylococcus epidermidis
RGISRAEAERLVIHGFLDP

SEQ ID NO: 1812028 - protein, 20 aa, Staphylococcus epidermidis
RGIVKRSALSNFSRINKNGK

SEQ ID NO: 1812029 - protein, 19 aa, Staphylococcus epidermidis
RGKQFLSPIVFSSNLGEDL

SEQ ID NO: 1812030 - protein, 19 aa, Staphylococcus epidermidis
RGKTMKNYDLIIIGFGKAG

SEQ ID NO: 1812031 - protein, 17 aa, Staphylococcus epidermidis
RGKYPILGTGGIMDYAD

SEQ ID NO: 1812032 - protein, 21 aa, Staphylococcus epidermidis
RGLKILTEVELSYLISEAPII

SEQ ID NO: 1812033 - protein, 24 aa, Staphylococcus epidermidis
RGMPKGFRNMHGFGSHTYSMYNDE

SEQ ID NO: 1812034 - protein, 24 aa, Staphylococcus epidermidis
RGNFIRGFDKARDFAPMIKEQGGK

SEQ ID NO: 1812035 - protein, 19 aa, Staphylococcus epidermidis
RGNSKYLFNYFVKHNPTVE

SEQ ID NO: 1812036 - protein, 26 aa, Staphylococcus epidermidis
RGQAPYKFLLSHGFVMDGEGKKMSKS

SEQ ID NO: 1812037 - protein, 24 aa, Staphylococcus epidermidis
RGQNARLAAKLTGWKIDIKSETDA

SEQ ID NO: 1812038 - protein, 19 aa, Staphylococcus epidermidis
RGSGKICLNGAASRLVEVG

SEQ ID NO: 1812039 - protein, 18 aa, Staphylococcus epidermidis
RGVCTRVGTMTPRKPNSA

SEQ ID NO: 1812040 - protein, 20 aa, Staphylococcus epidermidis
RGVKSLGNYHFQMGYNADGT

SEQ ID NO: 1812041 - protein, 21 aa, Staphylococcus epidermidis
RGVRYVLNDVVKRTAGVTDIH

SEQ ID NO: 1812042 - protein, 28 aa, Staphylococcus epidermidis
RGYAKKAFKMAIDYAFLVLNMNKVYLYV

SEQ ID NO: 1812043 - protein, 18 aa, Staphylococcus epidermidis
RGYIVYRSNEMIMTRYKH

SEQ ID NO: 1812044 - protein, 19 aa, Staphylococcus epidermidis
RHADAGLLYISYITNPTTG

SEQ ID NO: 1812045 - protein, 24 aa, Staphylococcus epidermidis
RHCRPNFLEGLEIDIYVPELKIGF

SEQ ID NO: 1812046 - protein, 17 aa, Staphylococcus epidermidis
RHDGQIIFMGREDNQVK

SEQ ID NO: 1812047 - protein, 24 aa, Staphylococcus epidermidis
RHELLRMISWKVGIETGFKLSVGK

SEQ ID NO: 1812048 - protein, 19 aa, Staphylococcus epidermidis
RHFLWSTAHGYQLYEEDAQ

SEQ ID NO: 1812049 - protein, 20 aa, Staphylococcus epidermidis
RHGIDLKKANALLLEEAGVP

SEQ ID NO: 1812050 - protein, 26 aa, Staphylococcus epidermidis
RHGKTPAQVVLRWHLAHDRIIIPKSK

SEQ ID NO: 1812051 - protein, 21 aa, Staphylococcus epidermidis
RHGQTVFNLKGKIQGASDSPL

SEQ ID NO: 1812052 - protein, 22 aa, Staphylococcus epidermidis
RHGQTVFNLKGKIQGASDSPLT

SEQ ID NO: 1812053 - protein, 20 aa, Staphylococcus epidermidis
RHLRESAFRNVYKAYGSHNN

SEQ ID NO: 1812054 - protein, 19 aa, Staphylococcus epidermidis
RHMALDIVDLLAKRLKQEY

SEQ ID NO: 1812055 - protein, 30 aa, Staphylococcus epidermidis
RHMSFLMREGKLYLPYNGNLLIHGCIPVDE

SEQ ID NO: 1812056 - protein, 20 aa, Staphylococcus epidermidis
RHNEELKDCYGISPEEKVLI

SEQ ID NO: 1812057 - protein, 20 aa, Staphylococcus epidermidis
RHNEELKDCYGISSEEKVLI

SEQ ID NO: 1812058 - protein, 17 aa, Staphylococcus epidermidis
RHPEIINGYGPTENTTF

SEQ ID NO: 1812059 - protein, 20 aa, Staphylococcus epidermidis
RHPLPVPQFKYFKLNQSRVQ

SEQ ID NO: 1812060 - protein, 26 aa, Staphylococcus epidermidis
RHSKFKGKLYLYIDFDTMRMEDLFMT

SEQ ID NO: 1812061 - protein, 23 aa, Staphylococcus epidermidis
RIAKQNNLRLAVDNTFMTPLGQS

SEQ ID NO: 1812062 - protein, 17 aa, Staphylococcus epidermidis
RIAQGVVSINAFKGVSF

SEQ ID NO: 1812063 - protein, 25 aa, Staphylococcus epidermidis
RIASPEFMFPSFYGIDVSTTAELIS

SEQ ID NO: 1812064 - protein, 20 aa, Staphylococcus epidermidis
RIDFDLKDLQVVIGPSTSNT

SEQ ID NO: 1812065 - protein, 27 aa, Staphylococcus epidermidis
RIDKVSAKRIIDFLSGTVYAIGGDIQR

SEQ ID NO: 1812066 - protein, 31 aa, Staphylococcus epidermidis
RIDQVSAKRIIDFLSGTVYAIGGDIQRVGTD

SEQ ID NO: 1812067 - protein, 20 aa, Staphylococcus epidermidis
RIDVLDGFHRLLAVQRALRE

SEQ ID NO: 1812068 - protein, 17 aa, Staphylococcus epidermidis
RIEEIRGQRICLYYDEA

SEQ ID NO: 1812069 - protein, 26 aa, Staphylococcus epidermidis
RIEKAPNLKLAITAGVGSDHVDLDAA

SEQ ID NO: 1812070 - protein, 18 aa, Staphylococcus epidermidis
RIELFMKHNVKGYKTIHF

SEQ ID NO: 1812071 - protein, 18 aa, Staphylococcus epidermidis
RIEWKEVLAGQKAYDETG

SEQ ID NO: 1812072 - protein, 20 aa, Staphylococcus epidermidis
RIGEVLKAFNPTSVSNVDDL

SEQ ID NO: 1812073 - protein, 22 aa, Staphylococcus epidermidis
RIIDEFDELPYLFIKKDVVHYI

SEQ ID NO: 1812074 - protein, 17 aa, Staphylococcus epidermidis
RIIFASFASNIYRVQQA

SEQ ID NO: 1812075 - protein, 22 aa, Staphylococcus epidermidis
RIIGQEFNKVIVILDEGFKYVD

SEQ ID NO: 1812076 - protein, 22 aa, Staphylococcus epidermidis
RIIGSCGLDSIRVIKGQFGAHI

SEQ ID NO: 1812077 - protein, 32 aa, Staphylococcus epidermidis
RIINDSTYGFGYRLNLYMSLIILNNKEMLFLE

SEQ ID NO: 1812078 - protein, 27 aa, Staphylococcus epidermidis
RIINLSLRAKYLFDYNLDYFVSNGEIV

SEQ ID NO: 1812079 - protein, 20 aa, Staphylococcus epidermidis
RIIRGLRFQSQLNFQIVNET

SEQ ID NO: 1812080 - protein, 23 aa, Staphylococcus epidermidis
RIKENYFKPEHINVIKCDLMQRK

SEQ ID NO: 1812081 - protein, 29 aa, Staphylococcus epidermidis
RIKGLGKDRVTAIFPKLVFSIKKGVNFSP

SEQ ID NO: 1812082 - protein, 23 aa, Staphylococcus epidermidis
RILHPNVVLDWILTEAPELDNEA

SEQ ID NO: 1812083 - protein, 23 aa, Staphylococcus epidermidis
RINCQLQKLWKKRGNRFSHDISY

SEQ ID NO: 1812084 - protein, 23 aa, Staphylococcus epidermidis
RINEAGIPIIFVINQIDKHNEEE

SEQ ID NO: 1812085 - protein, 24 aa, Staphylococcus epidermidis
RINEVGIPVVFVINQIDKHNEEEI

SEQ ID NO: 1812086 - protein, 18 aa, Staphylococcus epidermidis
RINNEVIGVLDIDAPIKD

SEQ ID NO: 1812087 - protein, 19 aa, Staphylococcus epidermidis
RINSAMLILRPIDKMFDYS

SEQ ID NO: 1812088 - protein, 17 aa, Staphylococcus epidermidis
RINVVAFSKDVTYDEAY

SEQ ID NO: 1812089 - protein, 29 aa, Staphylococcus epidermidis
RINYTGEEIIEWKFDYLSELKKQKNALDN

SEQ ID NO: 1812090 - protein, 21 aa, Staphylococcus epidermidis
RIPFIKKMHHEGLFASISVGV

SEQ ID NO: 1812091 - protein, 17 aa, Staphylococcus epidermidis
RIPVLIRSSPIKYDKEE

SEQ ID NO: 1812092 - protein, 20 aa, Staphylococcus epidermidis
RIQHENLPFIAMWTDENVAE

SEQ ID NO: 1812093 - protein, 18 aa, Staphylococcus epidermidis
RIQKSSADLKFNLNTQKW

SEQ ID NO: 1812094 - protein, 19 aa, Staphylococcus epidermidis
RIQSWSYPFVIKPGDDLPT

SEQ ID NO: 1812095 - protein, 24 aa, Staphylococcus epidermidis
RIRDVIPVYAIPVGFSEEATESNF

SEQ ID NO: 1812096 - protein, 17 aa, Staphylococcus epidermidis
RIRPLNTHICKIERVAI

SEQ ID NO: 1812097 - protein, 19 aa, Staphylococcus epidermidis
RISGMLAVSKMCADIFENI

SEQ ID NO: 1812098 - protein, 20 aa, Staphylococcus epidermidis
RISNTGQRAITHILSSQMIK

SEQ ID NO: 1812099 - protein, 17 aa, Staphylococcus epidermidis
RITAIELQEHFNESTLS

SEQ ID NO: 1812100 - protein, 22 aa, Staphylococcus epidermidis
RITDLRSKCRRLKQEHGLDMIV

SEQ ID NO: 1812101 - protein, 24 aa, Staphylococcus epidermidis
RITHGEIDAVIAMHSLTKEFEGVK

SEQ ID NO: 1812102 - protein, 25 aa, Staphylococcus epidermidis
RITHGEIDAVISFSSLTKEFENVKE

SEQ ID NO: 1812103 - protein, 18 aa, Staphylococcus epidermidis
RITIEHRLVYKIKNDSIF

SEQ ID NO: 1812104 - protein, 28 aa, Staphylococcus epidermidis
RITLGYPLVRNAIRDGLARLIEKHFSEV

SEQ ID NO: 1812105 - protein, 19 aa, Staphylococcus epidermidis
RIVRIAFNLANHRRKKLTS

SEQ ID NO: 1812106 - protein, 24 aa, Staphylococcus epidermidis
RIYFSESSLARFDVSIENEFNHRI

SEQ ID NO: 1812107 - protein, 24 aa, Staphylococcus epidermidis
RKAGQLMYGKLDFLNCAFGLVPTE

SEQ ID NO: 1812108 - protein, 19 aa, Staphylococcus epidermidis
RKALSEADLILFVLNNNEP

SEQ ID NO: 1812109 - protein, 17 aa, Staphylococcus epidermidis
RKCIISNEMHPKKDMIR

SEQ ID NO: 1812110 - protein, 17 aa, Staphylococcus epidermidis
RKDALGLSLMMQYIKQK

SEQ ID NO: 1812111 - protein, 20 aa, Staphylococcus epidermidis
RKDELFVINFYRQVERWLNR

SEQ ID NO: 1812112 - protein, 18 aa, Staphylococcus epidermidis
RKDMDALTEFVNIYGAKG

SEQ ID NO: 1812113 - protein, 26 aa, Staphylococcus epidermidis
RKEALEKKLPMALFHEGIGTIEESKH

SEQ ID NO: 1812114 - protein, 20 aa, Staphylococcus epidermidis
RKEQIFVYICHGNHDPLTSK

SEQ ID NO: 1812115 - protein, 18 aa, Staphylococcus epidermidis
RKEQIFVYVCHGNHDPLT

SEQ ID NO: 1812116 - protein, 18 aa, Staphylococcus epidermidis
RKEVDLSQSVLVINMTQG

SEQ ID NO: 1812117 - protein, 17 aa, Staphylococcus epidermidis
RKFDILMCNSKLYHQEG

SEQ ID NO: 1812118 - protein, 17 aa, Staphylococcus epidermidis
RKFRHDYVNILSTLSEF

SEQ ID NO: 1812119 - protein, 17 aa, Staphylococcus epidermidis
RKGADLIKYIRRIDLSG

SEQ ID NO: 1812120 - protein, 18 aa, Staphylococcus epidermidis
RKGVEIIEAEACKYPVGV

SEQ ID NO: 1812121 - protein, 23 aa, Staphylococcus epidermidis
RKIDIKDGERFTVSVEHEATGET

SEQ ID NO: 1812122 - protein, 18 aa, Staphylococcus epidermidis
RKIFEDWLNYHDINIENK

SEQ ID NO: 1812123 - protein, 21 aa, Staphylococcus epidermidis
RKIIEGFKHLTPNTNQYRTVM

SEQ ID NO: 1812124 - protein, 24 aa, Staphylococcus epidermidis
RKIKRELYDTRGFLSCTRILSTDQ

SEQ ID NO: 1812125 - protein, 19 aa, Staphylococcus epidermidis
RKIPREYLDSNVPKGRGFV

SEQ ID NO: 1812126 - protein, 25 aa, Staphylococcus epidermidis
RKIRKKLSCYSRFEYIDTKWGVGYK

SEQ ID NO: 1812127 - protein, 20 aa, Staphylococcus epidermidis
RKIRQHGVLRAGFTDNKDDI

SEQ ID NO: 1812128 - protein, 23 aa, Staphylococcus epidermidis
RKKFPDALFIFLAPPSLDDLRER

SEQ ID NO: 1812129 - protein, 40 aa, Staphylococcus epidermidis
RKKRQKVSMIFQHFNLLWSRNVLKNVTFPLEIAGVPSGRA

SEQ ID NO: 1812130 - protein, 36 aa, Staphylococcus epidermidis
RKKRQKVSMIFQHFNLLWSRTVLKNITFPLEIAGVP

SEQ ID NO: 1812131 - protein, 19 aa, Staphylococcus epidermidis
RKKVKSIIKGYVRKLEITY

SEQ ID NO: 1812132 - protein, 20 aa, Staphylococcus epidermidis
RKLESAGVIESRSLGMKGTF

SEQ ID NO: 1812133 - protein, 23 aa, Staphylococcus epidermidis
RKLIESLAYRYSKGQSHHEDLVQ

SEQ ID NO: 1812134 - protein, 23 aa, Staphylococcus epidermidis
RKLKSFCEINDWSVSDVFIDAGF

SEQ ID NO: 1812135 - protein, 29 aa, Staphylococcus epidermidis
RKLVNIKGLDMILEKIIGIDINNIKEEKE

SEQ ID NO: 1812136 - protein, 20 aa, Staphylococcus epidermidis
RKNYGCTHFIVGRDHAGVGD

SEQ ID NO: 1812137 - protein, 17 aa, Staphylococcus epidermidis
RKPEAKLTIEREHGQYS

SEQ ID NO: 1812138 - protein, 21 aa, Staphylococcus epidermidis
RKPEIMQSIGPGAKLFSAKYA

SEQ ID NO: 1812139 - protein, 19 aa, Staphylococcus epidermidis
RKPNQIAVIDQHRKLTYKE

SEQ ID NO: 1812140 - protein, 25 aa, Staphylococcus epidermidis
RKQKLEPAYSFMIRVRVPGGKATPD

SEQ ID NO: 1812141 - protein, 23 aa, Staphylococcus epidermidis
RKQLPKLYSFDIFDTLIQRKTLR

SEQ ID NO: 1812142 - protein, 19 aa, Staphylococcus epidermidis
RKQSFKFIPAVQNTFIQQK

SEQ ID NO: 1812143 - protein, 21 aa, Staphylococcus epidermidis
RKRAYEMLPVVMDYKTKEVAL

SEQ ID NO: 1812144 - protein, 18 aa, Staphylococcus epidermidis
RKRVKAYPIYNEGVTSMP

SEQ ID NO: 1812145 - protein, 18 aa, Staphylococcus epidermidis
RKRYDIPTNQALKLLLKG

SEQ ID NO: 1812146 - protein, 19 aa, Staphylococcus epidermidis
RKSDRLIVGGVNVYPSEIE

SEQ ID NO: 1812147 - protein, 22 aa, Staphylococcus epidermidis
RKSIGLGEFKYTAYISLNNELQ

SEQ ID NO: 1812148 - protein, 20 aa, Staphylococcus epidermidis
RKSIIRWCELILSNKSMALI

SEQ ID NO: 1812149 - protein, 18 aa, Staphylococcus epidermidis
RKSPFSVRKQKQYERLNL

SEQ ID NO: 1812150 - protein, 17 aa, Staphylococcus epidermidis
RKTMFVRTAGCDYRCSW

SEQ ID NO: 1812151 - protein, 25 aa, Staphylococcus epidermidis
RKVAKRLDKTVALLLDTKGPEIRTH

SEQ ID NO: 1812152 - protein, 24 aa, Staphylococcus epidermidis
RKVAPNLFKLGGIQKVANQKWGYT

SEQ ID NO: 1812153 - protein, 24 aa, Staphylococcus epidermidis
RKVLQKRRFKKALQAKRQQNQNSE

SEQ ID NO: 1812154 - protein, 20 aa, Staphylococcus epidermidis
RKWIHYGLTSTDVVDTALSY

SEQ ID NO: 1812155 - protein, 17 aa, Staphylococcus epidermidis
RKYDFFYSEEEIIVTNG

SEQ ID NO: 1812156 - protein, 18 aa, Staphylococcus epidermidis
RKYGLSLMVVSQRPSEVS

SEQ ID NO: 1812157 - protein, 26 aa, Staphylococcus epidermidis
RLAEAKVKAEKVLKTFKDLNNAQRES

SEQ ID NO: 1812158 - protein, 18 aa, Staphylococcus epidermidis
RLAERCRHTESIDEVLYS

SEQ ID NO: 1812159 - protein, 19 aa, Staphylococcus epidermidis
RLAIKEARKAQELGEVPIG

SEQ ID NO: 1812160 - protein, 22 aa, Staphylococcus epidermidis
RLALEHKPKLIVAGASAYSRTI

SEQ ID NO: 1812161 - protein, 18 aa, Staphylococcus epidermidis
RLAQLVVVPVVYPTPKEV

SEQ ID NO: 1812162 - protein, 19 aa, Staphylococcus epidermidis
RLDEWKRTEFSTDSDGIIE

SEQ ID NO: 1812163 - protein, 28 aa, Staphylococcus epidermidis
RLDGATKEFFSWGFRVGFMTFGIDHETL

SEQ ID NO: 1812164 - protein, 20 aa, Staphylococcus epidermidis
RLDRYFPEWHETYSKVNQLN

SEQ ID NO: 1812165 - protein, 20 aa, Staphylococcus epidermidis
RLDSRLVEAFNQLKEIQNNI

SEQ ID NO: 1812166 - protein, 18 aa, Staphylococcus epidermidis
RLDTEAEISYIKESMQPP

SEQ ID NO: 1812167 - protein, 19 aa, Staphylococcus epidermidis
RLDTLFVNKHIGGIGRTNI

SEQ ID NO: 1812168 - protein, 21 aa, Staphylococcus epidermidis
RLDYHFKRIQKSSADLKFNLN

SEQ ID NO: 1812169 - protein, 20 aa, Staphylococcus epidermidis
RLEQLNVHAAIVGKAAHHAS

SEQ ID NO: 1812170 - protein, 18 aa, Staphylococcus epidermidis
RLETAVLVGVHAQTDNQF

SEQ ID NO: 1812171 - protein, 31 aa, Staphylococcus epidermidis
RLFRRTKASINEVFSRMQSVSSQIDRITVQL

SEQ ID NO: 1812172 - protein, 17 aa, Staphylococcus epidermidis
RLFSMNDLDRLLEIKSL

SEQ ID NO: 1812173 - protein, 17 aa, Staphylococcus epidermidis
RLGEIYTSIARKVIAST

SEQ ID NO: 1812174 - protein, 17 aa, Staphylococcus epidermidis
RLGELYNSIARKVIAST

SEQ ID NO: 1812175 - protein, 18 aa, Staphylococcus epidermidis
RLGINATIRREQGSDIDA

SEQ ID NO: 1812176 - protein, 26 aa, Staphylococcus epidermidis
RLGKSRPYIANMLRLLHLPSEIMTMV

SEQ ID NO: 1812177 - protein, 22 aa, Staphylococcus epidermidis
RLGLDYLDLYLMHWPGTNEAVM

SEQ ID NO: 1812178 - protein, 21 aa, Staphylococcus epidermidis
RLGNVEWTDNLIITAINAKSG

SEQ ID NO: 1812179 - protein, 20 aa, Staphylococcus epidermidis
RLHDFRWEASILSQSIKDLK

SEQ ID NO: 1812180 - protein, 21 aa, Staphylococcus epidermidis
RLHDFRWEASILSQSIKDLKV

SEQ ID NO: 1812181 - protein, 25 aa, Staphylococcus epidermidis
RLIERGVIEIAPLAYMRGRTLDDAF

SEQ ID NO: 1812182 - protein, 20 aa, Staphylococcus epidermidis
RLINKMGTIVLKNKFNEDQG

SEQ ID NO: 1812183 - protein, 21 aa, Staphylococcus epidermidis
RLINKMGTIVLKNKFNEEQGR

SEQ ID NO: 1812184 - protein, 25 aa, Staphylococcus epidermidis
RLIRSADVILFDRLVNPFILQYASS

SEQ ID NO: 1812185 - protein, 17 aa, Staphylococcus epidermidis
RLKAIFTKHVADVIKVY

SEQ ID NO: 1812186 - protein, 20 aa, Staphylococcus epidermidis
RLKDLDVTFTLLRPTTESEF

SEQ ID NO: 1812187 - protein, 26 aa, Staphylococcus epidermidis
RLKEHESFNFFSLFTFHEPVEQVVTH

SEQ ID NO: 1812188 - protein, 20 aa, Staphylococcus epidermidis
RLKFHAKYDVTPISHLKLLE

SEQ ID NO: 1812189 - protein, 20 aa, Staphylococcus epidermidis
RLKFLAKYDVTPISHLKLLE

SEQ ID NO: 1812190 - protein, 26 aa, Staphylococcus epidermidis
RLKHEYEIITNMGFEDYFLIVSDLIH

SEQ ID NO: 1812191 - protein, 17 aa, Staphylococcus epidermidis
RLLDLGAPGIIVQNEKR

SEQ ID NO: 1812192 - protein, 21 aa, Staphylococcus epidermidis
RLLEFIELNFEFIKVLIMNMN

SEQ ID NO: 1812193 - protein, 17 aa, Staphylococcus epidermidis
RLLPGGYLFLSDLVGNP

SEQ ID NO: 1812194 - protein, 24 aa, Staphylococcus epidermidis
RLLSALQLWLLRIHYLDQPHFYPS

SEQ ID NO: 1812195 - protein, 22 aa, Staphylococcus epidermidis
RLMKQAEKFNRPVFTFIDTKGA

SEQ ID NO: 1812196 - protein, 26 aa, Staphylococcus epidermidis
RLNNGYKYWVDLGWKETDKKDDMILF

SEQ ID NO: 1812197 - protein, 21 aa, Staphylococcus epidermidis
RLNYAGFYRLHHSYKKKVMMA

SEQ ID NO: 1812198 - protein, 23 aa, Staphylococcus epidermidis
RLPEICQLLIKHGRSIDTPVALV

SEQ ID NO: 1812199 - protein, 28 aa, Staphylococcus epidermidis
RLQIPTEVLNFLNSYKFSTSQVAKAFGL

SEQ ID NO: 1812200 - protein, 19 aa, Staphylococcus epidermidis
RLQLLTLSAVNGFFEDIMH

SEQ ID NO: 1812201 - protein, 18 aa, Staphylococcus epidermidis
RLQPEHFEDIVAVTSLYR

SEQ ID NO: 1812202 - protein, 20 aa, Staphylococcus epidermidis
RLQPEHFEDIVAVTSLYRPG

SEQ ID NO: 1812203 - protein, 24 aa, Staphylococcus epidermidis
RLQPWDFAGGLLILNEVGGIGTNL

SEQ ID NO: 1812204 - protein, 17 aa, Staphylococcus epidermidis
RLQPWDYAGGLMILNEV

SEQ ID NO: 1812205 - protein, 18 aa, Staphylococcus epidermidis
RLQRISSELLKEYDSTEL

SEQ ID NO: 1812206 - protein, 17 aa, Staphylococcus epidermidis
RLQRLNKKVGMYSQQAM

SEQ ID NO: 1812207 - protein, 19 aa, Staphylococcus epidermidis
RLRKKLADINMDEAIETKV

SEQ ID NO: 1812208 - protein, 23 aa, Staphylococcus epidermidis
RLRNNPIRTFMCDDCKSRLDTPK

SEQ ID NO: 1812209 - protein, 17 aa, Staphylococcus epidermidis
RLRTGTMTEEDWNRFTI

SEQ ID NO: 1812210 - protein, 17 aa, Staphylococcus epidermidis
RLRTGTMTEEDWSRFTI

SEQ ID NO: 1812211 - protein, 18 aa, Staphylococcus epidermidis
RLSMIYVDTGAMYRAITY

SEQ ID NO: 1812212 - protein, 20 aa, Staphylococcus epidermidis
RLSSHYQFGHIPSRIPLRAS

SEQ ID NO: 1812213 - protein, 28 aa, Staphylococcus epidermidis
RLTANAESKERCQLLIKPIRDEILNRVG

SEQ ID NO: 1812214 - protein, 19 aa, Staphylococcus epidermidis
RLTEDKGLKETVLTFDKQQ

SEQ ID NO: 1812215 - protein, 18 aa, Staphylococcus epidermidis
RLTKPLVRKEGMFHEVEW

SEQ ID NO: 1812216 - protein, 19 aa, Staphylococcus epidermidis
RLTNRIIVIKDGQIVDEFK

SEQ ID NO: 1812217 - protein, 18 aa, Staphylococcus epidermidis
RLVELKGEKIGVMEMRNH

SEQ ID NO: 1812218 - protein, 25 aa, Staphylococcus epidermidis
RLVNLKQRYNAILIIDASHSLGLNL

SEQ ID NO: 1812219 - protein, 19 aa, Staphylococcus epidermidis
RLYSDNAVDSFVYIPEEGY

SEQ ID NO: 1812220 - protein, 24 aa, Staphylococcus epidermidis
RMAMSHPDIRISLVSDGKTLISTN

SEQ ID NO: 1812221 - protein, 21 aa, Staphylococcus epidermidis
RMCKPDFMLNVALNKNKEITA

SEQ ID NO: 1812222 - protein, 18 aa, Staphylococcus epidermidis
RMFDELRSELEKKVQQLK

SEQ ID NO: 1812223 - protein, 21 aa, Staphylococcus epidermidis
RMHAKGSGAFGTFTVTNDITK

SEQ ID NO: 1812224 - protein, 24 aa, Staphylococcus epidermidis
RMHGIKAKILILGVIRTEDISKAI

SEQ ID NO: 1812225 - protein, 17 aa, Staphylococcus epidermidis
RMKERKLAHNKRIRNVQ

SEQ ID NO: 1812226 - protein, 23 aa, Staphylococcus epidermidis
RMKRAQKLFGQKSHVFDIRKHEM

SEQ ID NO: 1812227 - protein, 18 aa, Staphylococcus epidermidis
RMNERSFVLIPLNDIASN

SEQ ID NO: 1812228 - protein, 23 aa, Staphylococcus epidermidis
RMNRIAQTINRFGFTIRGIYGEG

SEQ ID NO: 1812229 - protein, 27 aa, Staphylococcus epidermidis
RMRKLCRPETPAIIVTRGLTPPEELVN

SEQ ID NO: 1812230 - protein, 21 aa, Staphylococcus epidermidis
RNAIEKQLVARGFTVKVPPEY

SEQ ID NO: 1812231 - protein, 17 aa, Staphylococcus epidermidis
RNDALVFYSSEDKEKVE

SEQ ID NO: 1812232 - protein, 18 aa, Staphylococcus epidermidis
RNEAWQKLKQLRQAEKDL

SEQ ID NO: 1812233 - protein, 19 aa, Staphylococcus epidermidis
RNEEFDQAIELGRSLGVDV

SEQ ID NO: 1812234 - protein, 20 aa, Staphylococcus epidermidis
RNELKRMQFSLDKFPLHHFE

SEQ ID NO: 1812235 - protein, 24 aa, Staphylococcus epidermidis
RNEREFKLRVCSLNNDKFKEALER

SEQ ID NO: 1812236 - protein, 19 aa, Staphylococcus epidermidis
RNEYGKFFILTGGGSNGKS

SEQ ID NO: 1812237 - protein, 19 aa, Staphylococcus epidermidis
RNGKKYSDMAILYRTNAQS

SEQ ID NO: 1812238 - protein, 18 aa, Staphylococcus epidermidis
RNGKVLAEDVERYKVVAV

SEQ ID NO: 1812239 - protein, 17 aa, Staphylococcus epidermidis
RNIAAELGQYGITANVV

SEQ ID NO: 1812240 - protein, 19 aa, Staphylococcus epidermidis
RNIAAELGQYGITANVVSG

SEQ ID NO: 1812241 - protein, 25 aa, Staphylococcus epidermidis
RNIARKCNRRCVSDGLMYMWADEYE

SEQ ID NO: 1812242 - protein, 20 aa, Staphylococcus epidermidis
RNIDGLIEFNRMFKNSYLFK

SEQ ID NO: 1812243 - protein, 23 aa, Staphylococcus epidermidis
RNIIKDQLLKIVRKLNFNNSYEI

SEQ ID NO: 1812244 - protein, 17 aa, Staphylococcus epidermidis
RNIPEYKFENISIEYLS

SEQ ID NO: 1812245 - protein, 17 aa, Staphylococcus epidermidis
RNIYCSFYLSINSIYMV

SEQ ID NO: 1812246 - protein, 22 aa, Staphylococcus epidermidis
RNKELTWMYDLDMFEDDTKNAY

SEQ ID NO: 1812247 - protein, 23 aa, Staphylococcus epidermidis
RNLDKGVAFGAMFEDTEDLMHQK

SEQ ID NO: 1812248 - protein, 20 aa, Staphylococcus epidermidis
RNLEILKIDHLFTEVIGSDK

SEQ ID NO: 1812249 - protein, 22 aa, Staphylococcus epidermidis
RNLKCNKCGNTYDYYKFSNGHE

SEQ ID NO: 1812250 - protein, 20 aa, Staphylococcus epidermidis
RNLKNAIQFFEICKKHHITI

SEQ ID NO: 1812251 - protein, 26 aa, Staphylococcus epidermidis
RNLKNALKLIKLCQTYHVHILSVHDG

SEQ ID NO: 1812252 - protein, 31 aa, Staphylococcus epidermidis; identical to SEQ ID NO: 1672281

SEQ ID NO: 1812253 - protein, 20 aa, Staphylococcus epidermidis
RNMALEAFKATDCSGLVRAD

SEQ ID NO: 1812254 - protein, 25 aa, Staphylococcus epidermidis
RNPENLPWRELDIDLVIEATGKFNH

SEQ ID NO: 1812255 - protein, 30 aa, Staphylococcus epidermidis
RNPYVRHIAHPTGRIIGRRPGYEPNIEKLM

SEQ ID NO: 1812256 - protein, 24 aa, Staphylococcus epidermidis
RNRNEPLGGIGCHGYLEIDTGLLD

SEQ ID NO: 1812257 - protein, 28 aa, Staphylococcus epidermidis
RNRYWGTPLNVWICNDCNHEYAPSSIKD

SEQ ID NO: 1812258 - protein, 30 aa, Staphylococcus epidermidis
RNTFVPAICYNESMGPIQTCDTCMVEINGD

SEQ ID NO: 1812259 - protein, 19 aa, Staphylococcus epidermidis
RNTSGLVVFAKFGHVHNLF

SEQ ID NO: 1812260 - protein, 22 aa, Staphylococcus epidermidis
RNVHKPSGAKPGFVTYDNQKTL

SEQ ID NO: 1812261 - protein, 24 aa, Staphylococcus epidermidis
RNVHKSVFHGLDLTKAHATFTAMT

SEQ ID NO: 1812262 - protein, 24 aa, Staphylococcus epidermidis
RNVKPEFFIRTVVAQILNLNIPII

SEQ ID NO: 1812263 - protein, 17 aa, Staphylococcus epidermidis
RNYLESMATDFKVNGFF

SEQ ID NO: 1812264 - protein, 22 aa, Staphylococcus epidermidis
RNYVDFGIAFDSQWNFAVLPEE

SEQ ID NO: 1812265 - protein, 18 aa, Staphylococcus epidermidis
RPATMLVQTASKFDSDIQ

SEQ ID NO: 1812266 - protein, 17 aa, Staphylococcus epidermidis
RPDLLVVDSIQTIYHPE

SEQ ID NO: 1812267 - protein, 20 aa, Staphylococcus epidermidis
RPDMPASRIANYIRRDIYEQ

SEQ ID NO: 1812268 - protein, 20 aa, Staphylococcus epidermidis
RPDQIFDIALYRKASVKEGA

SEQ ID NO: 1812269 - protein, 19 aa, Staphylococcus epidermidis
RPDTIFGTTFLVLSPEHSL

SEQ ID NO: 1812270 - protein, 18 aa, Staphylococcus epidermidis
RPEFETITWEVDTYRGSI

SEQ ID NO: 1812271 - protein, 17 aa, Staphylococcus epidermidis
RPELQRMLKDANEGKLD

SEQ ID NO: 1812272 - protein, 27 aa, Staphylococcus epidermidis
RPETEEVMLHFLKLCRNKDGVVDIGTG

SEQ ID NO: 1812273 - protein, 19 aa, Staphylococcus epidermidis
RPEVTEADIYYISKQENDI

SEQ ID NO: 1812274 - protein, 20 aa, Staphylococcus epidermidis
RPGVPEELQGAALYLASDAS

SEQ ID NO: 1812275 - protein, 17 aa, Staphylococcus epidermidis
RPIPGVKGGIHHITGVE

SEQ ID NO: 1812276 - protein, 26 aa, Staphylococcus epidermidis
RPIVEKELIQRIGFVIEPENLFSNLK

SEQ ID NO: 1812277 - protein, 27 aa, Staphylococcus epidermidis
RPIVEKELIQRIGFVIEPENLFSNLKA

SEQ ID NO: 1812278 - protein, 17 aa, Staphylococcus epidermidis
RPLILAQDLLQIYETHT

SEQ ID NO: 1812279 - protein, 19 aa, Staphylococcus epidermidis
RPQDLIFLSDMKTEFEKSV

SEQ ID NO: 1812280 - protein, 20 aa, Staphylococcus epidermidis
RPRRVGWFDSVVLRHSRRVS

SEQ ID NO: 1812281 - protein, 17 aa, Staphylococcus epidermidis
RPSRVSLNNINIWNSSN

SEQ ID NO: 1812282 - protein, 20 aa, Staphylococcus epidermidis
RPSYISNPWLKPDEHQSNFL

SEQ ID NO: 1812283 - protein, 17 aa, Staphylococcus epidermidis
RPTHSSIYEIQRAQQEL

SEQ ID NO: 1812284 - protein, 19 aa, Staphylococcus epidermidis
RPVHIHLPIDVALTEIEVS

SEQ ID NO: 1812285 - protein, 19 aa, Staphylococcus epidermidis
RPVHLHLPIDVALAEIEVS

SEQ ID NO: 1812286 - protein, 17 aa, Staphylococcus epidermidis
RPVTYWVATMPELKQRE

SEQ ID NO: 1812287 - protein, 18 aa, Staphylococcus epidermidis
RQAFYDWQNSKAYAQTHK

SEQ ID NO: 1812288 - protein, 18 aa, Staphylococcus epidermidis
RQFKGTNGSSGFLSGGVV

SEQ ID NO: 1812289 - protein, 30 aa, Staphylococcus epidermidis
RQGKDALLKNGRRLKLYHGYNGNSHIYIKG

SEQ ID NO: 1812290 - protein, 20 aa, Staphylococcus epidermidis
RQHMEKFEGFDFGRGATGFG

SEQ ID NO: 1812291 - protein, 17 aa, Staphylococcus epidermidis
RQILKDHFAMTTLTTVV

SEQ ID NO: 1812292 - protein, 17 aa, Staphylococcus epidermidis
RQLETISYYSLINAYTP

SEQ ID NO: 1812293 - protein, 21 aa, Staphylococcus epidermidis
RQLHYPIKFVFLDFIQSENIQ

SEQ ID NO: 1812294 - protein, 19 aa, Staphylococcus epidermidis
RQLLKESIMNLTEQQIETL

SEQ ID NO: 1812295 - protein, 24 aa, Staphylococcus epidermidis
RQNLEARLSFYNDNEIVDYINSKD

SEQ ID NO: 1812296 - protein, 22 aa, Staphylococcus epidermidis
RQNLEARLSFYNDSEIVDYINS

SEQ ID NO: 1812297 - protein, 20 aa, Staphylococcus epidermidis
RQPIDFKWKDEAVVGVMLAS

SEQ ID NO: 1812298 - protein, 17 aa, Staphylococcus epidermidis
RQPYSMITASRLAKEKH

SEQ ID NO: 1812299 - protein, 18 aa, Staphylococcus epidermidis
RQQFKDNHIEGVDYIFCT

SEQ ID NO: 1812300 - protein, 26 aa, Staphylococcus epidermidis
RQQLNVFRMELLGAKVVAVEEGQGTL

SEQ ID NO: 1812301 - protein, 17 aa, Staphylococcus epidermidis
RQRIDYWLERFAITENR

SEQ ID NO: 1812302 - protein, 22 aa, Staphylococcus epidermidis
RQSEIWLKKQAALHNLDMLAGG

SEQ ID NO: 1812303 - protein, 39 aa, Staphylococcus epidermidis
RQSKVFRSRFRMLVEAQLDLLKSEDWDYLLNYDLDAEQV

SEQ ID NO: 1812304 - protein, 24 aa, Staphylococcus epidermidis
RQVREFCTKIAWIEGGKLKDFGEL

SEQ ID NO: 1812305 - protein, 17 aa, Staphylococcus epidermidis
RQVRRMFEYFGHQVNKL

SEQ ID NO: 1812306 - protein, 17 aa, Staphylococcus epidermidis
RQVTPYIFADFHAETTS

SEQ ID NO: 1812307 - protein, 23 aa, Staphylococcus epidermidis
RQYIKQRMHEISEGLSQAFNVEM

SEQ ID NO: 1812308 - protein, 24 aa, Staphylococcus epidermidis
RRDAMRDKIDWRDELPNLDYSKIY

SEQ ID NO: 1812309 - protein, 18 aa, Staphylococcus epidermidis
RRDLYDSRGFLSCSRTLT

SEQ ID NO: 1812310 - protein, 18 aa, Staphylococcus epidermidis
RRDNLLAFYEQLKVIDPK

SEQ ID NO: 1812311 - protein, 19 aa, Staphylococcus epidermidis
RREAISLGLSGLEIDVFDF

SEQ ID NO: 1812312 - protein, 23 aa, Staphylococcus epidermidis
RREAISLGLSGLEIDVFDFHSNK

SEQ ID NO: 1812313 - protein, 29 aa, Staphylococcus epidermidis
RREAISQGFSGLEIDVFDFHSNKSRHISS

SEQ ID NO: 1812314 - protein, 18 aa, Staphylococcus epidermidis
RRESIFISYILKYHPRFK

SEQ ID NO: 1812315 - protein, 17 aa, Staphylococcus epidermidis
RRFGFNKIINVSFDDTF

SEQ ID NO: 1812316 - protein, 24 aa, Staphylococcus epidermidis
RRGGFCYELNHLFATYLEHKGFHV

SEQ ID NO: 1812317 - protein, 17 aa, Staphylococcus epidermidis
RRGNLKGALKSFEKALL

SEQ ID NO: 1812318 - protein, 17 aa, Staphylococcus epidermidis
RRHEYLEAFNELGGEEK

SEQ ID NO: 1812319 - protein, 18 aa, Staphylococcus epidermidis
RRKMASLFHTSKTAIDDV

SEQ ID NO: 1812320 - protein, 22 aa, Staphylococcus epidermidis
RRKMLIDLLINIGFTVIEPEDP

SEQ ID NO: 1812321 - protein, 25 aa, Staphylococcus epidermidis
RRLFISAKSKVSFDKCAARLEKYVL

SEQ ID NO: 1812322 - protein, 18 aa, Staphylococcus epidermidis
RRLPEEEWRRVYNAHQPL

SEQ ID NO: 1812323 - protein, 17 aa, Staphylococcus epidermidis
RRLSVATALSSKADIVL

SEQ ID NO: 1812324 - protein, 23 aa, Staphylococcus epidermidis
RRMIDTACFKEFRFDNEEESALN

SEQ ID NO: 1812325 - protein, 19 aa, Staphylococcus epidermidis
RRMVGHPKKDIDAYNKRDA

SEQ ID NO: 1812326 - protein, 22 aa, Staphylococcus epidermidis
RRNRSKVRLALKRGTKVERSNR

SEQ ID NO: 1812327 - protein, 18 aa, Staphylococcus epidermidis
RRPVRIYTVRGLRLETVH

SEQ ID NO: 1812328 - protein, 28 aa, Staphylococcus epidermidis
RRRLIKFDKEIDIPYVLNRALQNEKNSY

SEQ ID NO: 1812329 - protein, 19 aa, Staphylococcus epidermidis
RRRVSLMKDAGILFKTGVE

SEQ ID NO: 1812330 - protein, 17 aa, Staphylococcus epidermidis
RRSEPRLKIEAGSVGIA

SEQ ID NO: 1812331 - protein, 17 aa, Staphylococcus epidermidis
RRTRICSDAVKVAQASR

SEQ ID NO: 1812332 - protein, 17 aa, Staphylococcus epidermidis
RRVAKEEGILAGISSGA

SEQ ID NO: 1812333 - protein, 22 aa, Staphylococcus epidermidis
RRVIAIECVIALQAVEYKGVDK

SEQ ID NO: 1812334 - protein, 21 aa, Staphylococcus epidermidis
RRVNEEIWRGIDVRIQEMGID

SEQ ID NO: 1812335 - protein, 19 aa, Staphylococcus epidermidis
RRVNIIPCEYYVEKADTSL

SEQ ID NO: 1812336 - protein, 21 aa, Staphylococcus epidermidis
RRVQDHNFTWAAPIMSKPVKN

SEQ ID NO: 1812337 - protein, 21 aa, Staphylococcus epidermidis
RRWGAPFPVIEIVKRGINKAR

SEQ ID NO: 1812338 - protein, 20 aa, Staphylococcus epidermidis
RRYCDYAIKTGKKSSNINLY

SEQ ID NO: 1812339 - protein, 20 aa, Staphylococcus epidermidis
RRYHEAFKKSGLKYNISYAS

SEQ ID NO: 1812340 - protein, 19 aa, Staphylococcus epidermidis
RRYQLKFFTPSSIGAFGIS

SEQ ID NO: 1812341 - protein, 20 aa, Staphylococcus epidermidis
RSAEEIGLDLNFTIEELIEL

SEQ ID NO: 1812342 - protein, 23 aa, Staphylococcus epidermidis
RSAFYKYRETIFPVDEKMLDHRE

SEQ ID NO: 1812343 - protein, 27 aa, Staphylococcus epidermidis
RSAKLAGRRGLPFVIAQMGQSSKSIDE

SEQ ID NO: 1812344 - protein, 21 aa, Staphylococcus epidermidis
RSDDKELLDLLAKVHNHDVAQ

SEQ ID NO: 1812345 - protein, 26 aa, Staphylococcus epidermidis
RSEIQKMREERQMLGQMINQVHQQQQ

SEQ ID NO: 1812346 - protein, 17 aa, Staphylococcus epidermidis
RSELLRKLVDVQYTRND

SEQ ID NO: 1812347 - protein, 26 aa, Staphylococcus epidermidis
RSERPEWNIIGLIGQVFIRVDETVSA

SEQ ID NO: 1812348 - protein, 21 aa, Staphylococcus epidermidis
RSGEAITGRVLGYKLSFNPLT

SEQ ID NO: 1812349 - protein, 20 aa, Staphylococcus epidermidis
RSGEDITVFCYGLMVNYCLQ

SEQ ID NO: 1812350 - protein, 18 aa, Staphylococcus epidermidis
RSGLGGFQGRALKKDDVI

SEQ ID NO: 1812351 - protein, 25 aa, Staphylococcus epidermidis
RSGLSFKKFVLFTGYEVDANEQELI

SEQ ID NO: 1812352 - protein, 25 aa, Staphylococcus epidermidis
RSHQQRFLIVFSDGEPSAFNYSQDG

SEQ ID NO: 1812353 - protein, 17 aa, Staphylococcus epidermidis
RSIDTAMIYGNEETVGQ

SEQ ID NO: 1812354 - protein, 19 aa, Staphylococcus epidermidis
RSKVDGIVLMATHITEAHI

SEQ ID NO: 1812355 - protein, 35 aa, Staphylococcus epidermidis
RSLESSFNIARKMGYFDIPKDLLIPINEVDNYPKN

SEQ ID NO: 1812356 - protein, 25 aa, Staphylococcus epidermidis
RSLIDGSDFTTGWIFFINQEGEHEL

SEQ ID NO: 1812357 - protein, 18 aa, Staphylococcus epidermidis
RSLKLAGYQHLTICLEDD

SEQ ID NO: 1812358 - protein, 19 aa, Staphylococcus epidermidis
RSLLNEYREGILVGTACDE

SEQ ID NO: 1812359 - protein, 19 aa, Staphylococcus epidermidis
RSLLYSAIILHDLGKVREL

SEQ ID NO: 1812360 - protein, 30 aa, Staphylococcus epidermidis; identical to SEQ ID NO: 1660161

SEQ ID NO: 1812361 - protein, 28 aa, Staphylococcus epidermidis
RSNINLTLNAKKEWRNIMLSTGEASISN

SEQ ID NO: 1812362 - protein, 21 aa, Staphylococcus epidermidis
RSPQYSFKNQMMVSSQYENSN

SEQ ID NO: 1812363 - protein, 21 aa, Staphylococcus epidermidis
RSRLMPINRAYNVEKLMEAIQ

SEQ ID NO: 1812364 - protein, 18 aa, Staphylococcus epidermidis
RSRVDSLQKNVLFEKMEI

SEQ ID NO: 1812365 - protein, 24 aa, Staphylococcus epidermidis
RSSVEALELTHLIVEEAYKAGASD

SEQ ID NO: 1812366 - protein, 27 aa, Staphylococcus epidermidis
RSTFMPHLDYDISFMIQEYIEDKANVY

SEQ ID NO: 1812367 - protein, 24 aa, Staphylococcus epidermidis
RSTNHRVIVTGGVLYHNNYVLNGF

SEQ ID NO: 1812368 - protein, 19 aa, Staphylococcus epidermidis
RSTVKTLLNPVKFDFSLTV

SEQ ID NO: 1812369 - protein, 21 aa, Staphylococcus epidermidis
RSVALAKRLGEYLDEIFDYNV

SEQ ID NO: 1812370 - protein, 18 aa, Staphylococcus epidermidis
RSVENFKFEGDITSSAKL

SEQ ID NO: 1812371 - protein, 19 aa, Staphylococcus epidermidis
RSVRFPGLISHVKEPGGGI

SEQ ID NO: 1812372 - protein, 19 aa, Staphylococcus epidermidis
RSYCPGKFDLSIDGKKFAG

SEQ ID NO: 1812373 - protein, 19 aa, Staphylococcus epidermidis
RSYDAVFPLLHGPNGEDGT

SEQ ID NO: 1812374 - protein, 19 aa, Staphylococcus epidermidis
RSYMKSEMEPFVDKFIQNK

SEQ ID NO: 1812375 - protein, 20 aa, Staphylococcus epidermidis
RSYYKGIFIKCHLKNTAHSV

SEQ ID NO: 1812376 - protein, 17 aa, Staphylococcus epidermidis
RTAFEFRFEELFSKEEW

SEQ ID NO: 1812377 - protein, 23 aa, Staphylococcus epidermidis
RTAKHLKSMLLLHGLSSDETTYI

SEQ ID NO: 1812378 - protein, 23 aa, Staphylococcus epidermidis
RTAPWLNRLGFENVKEVLLDKDR

SEQ ID NO: 1812379 - protein, 22 aa, Staphylococcus epidermidis
RTDLQMSLDVITRVGVAVVTAA

SEQ ID NO: 1812380 - protein, 17 aa, Staphylococcus epidermidis
RTDRGVHAYQQFFHFDT

SEQ ID NO: 1812381 - protein, 20 aa, Staphylococcus epidermidis
RTEIKYSYTHMAFSINDNEF

SEQ ID NO: 1812382 - protein, 20 aa, Staphylococcus epidermidis
RTEIPFLIECVQSAINAGAT

SEQ ID NO: 1812383 - protein, 20 aa, Staphylococcus epidermidis
RTELDKCLDYLREGDILVIY

SEQ ID NO: 1812384 - protein, 31 aa, Staphylococcus epidermidis
RTFSKAFGIAGLRLGVIIGHEATIRLIQRIE

SEQ ID NO: 1812385 - protein, 20 aa, Staphylococcus epidermidis
RTFSKAYGLAGMRVGYVIAP

SEQ ID NO: 1812386 - protein, 22 aa, Staphylococcus epidermidis
RTFYNSMAWRDKRSEVMQRDHF

SEQ ID NO: 1812387 - protein, 25 aa, Staphylococcus epidermidis
RTGMLSLRLNKAYSVAKFLENINVC

SEQ ID NO: 1812388 - protein, 24 aa, Staphylococcus epidermidis
RTGMLSLRLNQAYSVAKFLENLDI

SEQ ID NO: 1812389 - protein, 24 aa, Staphylococcus epidermidis
RTHRIGQERPCFYYYMLTLGTYEW

SEQ ID NO: 1812390 - protein, 21 aa, Staphylococcus epidermidis
RTIDAPSLCFSIFTERNKVVT

SEQ ID NO: 1812391 - protein, 17 aa, Staphylococcus epidermidis
RTIILEIMGKHSNLILV

SEQ ID NO: 1812392 - protein, 23 aa, Staphylococcus epidermidis
RTKPKRIKLKWSSQLAEDLKRIR

SEQ ID NO: 1812393 - protein, 18 aa, Staphylococcus epidermidis
RTKSLLTRIRFLDKEMGI

SEQ ID NO: 1812394 - protein, 21 aa, Staphylococcus epidermidis
RTKYWILKLLEMHCIQKTDEV

SEQ ID NO: 1812395 - protein, 21 aa, Staphylococcus epidermidis
RTLGRLKPLLNEGTVTVGNSC

SEQ ID NO: 1812396 - protein, 20 aa, Staphylococcus epidermidis
RTLNNLPIILDDQIQAEAKH

SEQ ID NO: 1812397 - protein, 17 aa, Staphylococcus epidermidis
RTLQRLSHVIGKIETNH

SEQ ID NO: 1812398 - protein, 24 aa, Staphylococcus epidermidis
RTLRKEVLGGLGGFGATFDLSQLN

SEQ ID NO: 1812399 - protein, 21 aa, Staphylococcus epidermidis
RTNDIDVTKEWYLCKFSNRTL

SEQ ID NO: 1812400 - protein, 25 aa, Staphylococcus epidermidis
RTQLILEIFALRARSREGKLHVELA

SEQ ID NO: 1812401 - protein, 28 aa, Staphylococcus epidermidis
RTQRRVAPFPKHYLNAIQDYAHKQEKIE

SEQ ID NO: 1812402 - protein, 19 aa, Staphylococcus epidermidis
RTSSDIGMARGFRAPLKFY

SEQ ID NO: 1812403 - protein, 24 aa, Staphylococcus epidermidis
RTTENRGLIPYTVFIDPPLSRVGL

SEQ ID NO: 1812404 - protein, 17 aa, Staphylococcus epidermidis
RTTRWAARCLKAHQRPE

SEQ ID NO: 1812405 - protein, 17 aa, Staphylococcus epidermidis
RTVKETLEGAGLDQAIT

SEQ ID NO: 1812406 - protein, 19 aa, Staphylococcus epidermidis
RTVYRGETYIDMKLTTSLV

SEQ ID NO: 1812407 - protein, 21 aa, Staphylococcus epidermidis
RTWNSEEFFSLIKEFELPTQN

SEQ ID NO: 1812408 - protein, 17 aa, Staphylococcus epidermidis
RVAEAHSSIIVNEKIYR

SEQ ID NO: 1812409 - protein, 19 aa, Staphylococcus epidermidis
RVDELLSMVNLEPEKFKNR

SEQ ID NO: 1812410 - protein, 20 aa, Staphylococcus epidermidis
RVDLKTGVPTLEGLADSHLG

SEQ ID NO: 1812411 - protein, 26 aa, Staphylococcus epidermidis
RVDSSIKKRLGQMALDKDTSIKSIVD

SEQ ID NO: 1812412 - protein, 19 aa, Staphylococcus epidermidis
RVEKFLNDSIRMMWFSQIQ

SEQ ID NO: 1812413 - protein, 17 aa, Staphylococcus epidermidis
RVELSEKQVRKIVQHLE

SEQ ID NO: 1812414 - protein, 22 aa, Staphylococcus epidermidis
RVKFEKVFADHFLKLYDETKNR

SEQ ID NO: 1812415 - protein, 20 aa, Staphylococcus epidermidis
RVKLYNAYEFLKPKNERYRK

SEQ ID NO: 1812416 - protein, 19 aa, Staphylococcus epidermidis
RVKNAKFKPYFDNMEILEQ

SEQ ID NO: 1812417 - protein, 17 aa, Staphylococcus epidermidis
RVKTRKLLEALILVGAF

SEQ ID NO: 1812418 - protein, 19 aa, Staphylococcus epidermidis
RVLASCCGKSRAFYFQNDA

SEQ ID NO: 1812419 - protein, 18 aa, Staphylococcus epidermidis
RVLDYPFRYEAFEQVNFD

SEQ ID NO: 1812420 - protein, 17 aa, Staphylococcus epidermidis
RVLNRRHFAGYGVNVIA

SEQ ID NO: 1812421 - protein, 20 aa, Staphylococcus epidermidis
RVLYEPHLLLSIAASVGKPV

SEQ ID NO: 1812422 - protein, 24 aa, Staphylococcus epidermidis
RVNELKESFMWGLNQFSDKSSVID

SEQ ID NO: 1812423 - protein, 24 aa, Staphylococcus epidermidis
RVNENKKKYGFEINTEDRKKNKSD

SEQ ID NO: 1812424 - protein, 21 aa, Staphylococcus epidermidis
RVNVPVIVKEVGFGMSKETFK

SEQ ID NO: 1812425 - protein, 24 aa, Staphylococcus epidermidis
RVPSESGIRYYVNRLLEQTSHQSQ

SEQ ID NO: 1812426 - protein, 22 aa, Staphylococcus epidermidis
RVTDHRIGLTLQKLGQIMEGHL

SEQ ID NO: 1812427 - protein, 21 aa, Staphylococcus epidermidis
RVTDHRIGLTLQKLNQIMEGH

SEQ ID NO: 1812428 - protein, 21 aa, Staphylococcus epidermidis
RVTFPNDYKQFLLGNNGGFFN

SEQ ID NO: 1812429 - protein, 24 aa, Staphylococcus epidermidis
RVTRGSEFDFVFIYNVDEESQVED

SEQ ID NO: 1812430 - protein, 18 aa, Staphylococcus epidermidis
RVTRKLCNHYEIKTPLKS

SEQ ID NO: 1812431 - protein, 17 aa, Staphylococcus epidermidis
RVVKGVQFKGLRDIGNP

SEQ ID NO: 1812432 - protein, 18 aa, Staphylococcus epidermidis
RVYAVLCPSWNIDHYNKA

SEQ ID NO: 1812433 - protein, 17 aa, Staphylococcus epidermidis
RWFEVSKKLEGLPRHTS

SEQ ID NO: 1812434 - protein, 18 aa, Staphylococcus epidermidis
RWIENGATIYVCGDESKM

SEQ ID NO: 1812435 - protein, 18 aa, Staphylococcus epidermidis
RWIYKTMNEIRFFEEKVH

SEQ ID NO: 1812436 - protein, 20 aa, Staphylococcus epidermidis
RYAKEGKFAEGSMLPKIEAA

SEQ ID NO: 1812437 - protein, 20 aa, Staphylococcus epidermidis
RYAKEQGYRTIVAGIDASNM

SEQ ID NO: 1812438 - protein, 18 aa, Staphylococcus epidermidis
RYDEHLIIIFKEAELSHK

SEQ ID NO: 1812439 - protein, 20 aa, Staphylococcus epidermidis
RYDFLKTLLYEINKRYNQFL

SEQ ID NO: 1812440 - protein, 18 aa, Staphylococcus epidermidis
RYDLMLVQTDRHYGKTLV

SEQ ID NO: 1812441 - protein, 20 aa, Staphylococcus epidermidis
RYDPNQCILCGRCVEACQDV

SEQ ID NO: 1812442 - protein, 23 aa, Staphylococcus epidermidis
RYEDLNFKKSCIHLNDTKNKYSK

SEQ ID NO: 1812443 - protein, 21 aa, Staphylococcus epidermidis
RYEVHHLKEYAGISEMLQLLH

SEQ ID NO: 1812444 - protein, 20 aa, Staphylococcus epidermidis
RYGCALAVDVLQQLKDENID

SEQ ID NO: 1812445 - protein, 20 aa, Staphylococcus epidermidis
RYGEFGSFYIGHILNIEDFK

SEQ ID NO: 1812446 - protein, 27 aa, Staphylococcus epidermidis
RYHHLRLCGGFQFSSHKSDDEWREYGL

SEQ ID NO: 1812447 - protein, 17 aa, Staphylococcus epidermidis
RYHIKKKYIAKLKGYLM

SEQ ID NO: 1812448 - protein, 17 aa, Staphylococcus epidermidis
RYHPIERVGIYVPGGKA

SEQ ID NO: 1812449 - protein, 25 aa, Staphylococcus epidermidis
RYIGIYNPRFNQIYKYDMTQSDPEM

SEQ ID NO: 1812450 - protein, 20 aa, Staphylococcus epidermidis
RYIHKKAKTYSLGMKQKLGI

SEQ ID NO: 1812451 - protein, 33 aa, Staphylococcus epidermidis
RYISQRSNYEFNRLQYQIIYILSKILDKHPLPK

SEQ ID NO: 1812452 - protein, 20 aa, Staphylococcus epidermidis
RYKIIKIIIEKLVSNLDEDI

SEQ ID NO: 1812453 - protein, 17 aa, Staphylococcus epidermidis
RYKIPKKYYQVESLPYT

SEQ ID NO: 1812454 - protein, 18 aa, Staphylococcus epidermidis
RYLGELGLSNLEEGNSPS

SEQ ID NO: 1812455 - protein, 20 aa, Staphylococcus epidermidis
RYLTPHGKWNIHSTYQDNER

SEQ ID NO: 1812456 - protein, 17 aa, Staphylococcus epidermidis
RYNMVEFQEEMKYKRSA

SEQ ID NO: 1812457 - protein, 20 aa, Staphylococcus epidermidis
RYNVIEAVKAVFGFTSIYEK

SEQ ID NO: 1812458 - protein, 21 aa, Staphylococcus epidermidis
RYPIRALMMSHMFVEVDDEVH

SEQ ID NO: 1812459 - protein, 19 aa, Staphylococcus epidermidis
RYPSIPFYLQVGNPYLEDD

SEQ ID NO: 1812460 - protein, 24 aa, Staphylococcus epidermidis
RYQLEHLDRIRLSFFTYHRSDTDI

SEQ ID NO: 1812461 - protein, 25 aa, Staphylococcus epidermidis
RYRHFAGSYAVQWKMINYAIEHGID

SEQ ID NO: 1812462 - protein, 18 aa, Staphylococcus epidermidis
RYRVKRDAQDIAELAKSL

SEQ ID NO: 1812463 - protein, 19 aa, Staphylococcus epidermidis
RYSEEIQGPIIWVEDTLIA

SEQ ID NO: 1812464 - protein, 22 aa, Staphylococcus epidermidis
RYSIENGHSFTGNYVVNNEQRD

SEQ ID NO: 1812465 - protein, 25 aa, Staphylococcus epidermidis
RYSIIALNIVEIFTHPDMVLDIDKE

SEQ ID NO: 1812466 - protein, 27 aa, Staphylococcus epidermidis
RYSSEIFRSAFWMDEPRILEIGYPRND

SEQ ID NO: 1812467 - protein, 21 aa, Staphylococcus epidermidis
RYTHEGQIEFMGRIDKQVKVN

SEQ ID NO: 1812468 - protein, 23 aa, Staphylococcus epidermidis
RYTYLYNKRYLKIQMSASSRGKS

SEQ ID NO: 1812469 - protein, 19 aa, Staphylococcus epidermidis
RYVERYLLDGKVPPLPLSI

SEQ ID NO: 1812470 - protein, 19 aa, Staphylococcus epidermidis
RYVLKDGKYGTLVINEIEE

SEQ ID NO: 1812471 - protein, 35 aa, Staphylococcus epidermidis
RYYDSVLLSTKFKAPRWLVTPIKNYSVRKHKEISY

SEQ ID NO: 1812472 - protein, 19 aa, Staphylococcus epidermidis
RYYIQRFLARSFGFEVDDM

SEQ ID NO: 1812473 - protein, 18 aa, Staphylococcus epidermidis
SAASGVFVNGHVSIEDTR

SEQ ID NO: 1812474 - protein, 25 aa, Staphylococcus epidermidis
SAASSCYIISLAATLERAGYTDIQI

SEQ ID NO: 1812475 - protein, 21 aa, Staphylococcus epidermidis
SADFRRGEAIFELSDDQIEKA

SEQ ID NO: 1812476 - protein, 31 aa, Staphylococcus epidermidis
SADGLHAGFKRKKLDFGWIVSEVPANVAGVF

SEQ ID NO: 1812477 - protein, 26 aa, Staphylococcus epidermidis
SAETLIKEGYRLVPLNIMNPDNSIAY

SEQ ID NO: 1812478 - protein, 19 aa, Staphylococcus epidermidis
SAFDIIGPVMMGPSSSHTA

SEQ ID NO: 1812479 - protein, 25 aa, Staphylococcus epidermidis
SAGRLCKDYQQIWGLSQDVQVSPFI

SEQ ID NO: 1812480 - protein, 23 aa, Staphylococcus epidermidis
SAIIAEHCLFDLDAPIMRLAAPD

SEQ ID NO: 1812481 - protein, 17 aa, Staphylococcus epidermidis
SAIKRNGALIVNKQPVT

SEQ ID NO: 1812482 - protein, 29 aa, Staphylococcus epidermidis
SAIMAAKLSNCYPIIAVDIFDSRLDLAME

SEQ ID NO: 1812483 - protein, 18 aa, Staphylococcus epidermidis
SAISTLGHYELLTINDAG

SEQ ID NO: 1812484 - protein, 30 aa, Staphylococcus epidermidis
SAKAWDNRYGCVLAIEILELLKDTELDVDL

SEQ ID NO: 1812485 - protein, 24 aa, Staphylococcus epidermidis
SAKCVKQVEVIRAQRLLNGRATTS

SEQ ID NO: 1812486 - protein, 24 aa, Staphylococcus epidermidis
SAKENINCRCKLLYYIDEDELPTT

SEQ ID NO: 1812487 - protein, 25 aa, Staphylococcus epidermidis
SAKESLRLRTLFPYIKEASENHKKR

SEQ ID NO: 1812488 - protein, 19 aa, Staphylococcus epidermidis
SAKGVGGCNTILKEIEERA

SEQ ID NO: 1812489 - protein, 20 aa, Staphylococcus epidermidis
SAKNSAGKHWGSMSSTIASK

SEQ ID NO: 1812490 - protein, 24 aa, Staphylococcus epidermidis
SALALEMIHTYSLIHDDLPAMDDD

SEQ ID NO: 1812491 - protein, 19 aa, Staphylococcus epidermidis
SALKKYPALNTSFNEEAGE

SEQ ID NO: 1812492 - protein, 17 aa, Staphylococcus epidermidis
SALNLIKGGGGALFREK

SEQ ID NO: 1812493 - protein, 24 aa, Staphylococcus epidermidis
SALQHAASVAAMFLTTEAVVATIP

SEQ ID NO: 1812494 - protein, 28 aa, Staphylococcus epidermidis
SALRQLPTYIRKNFDSIKVLAITLYGEH

SEQ ID NO: 1812495 - protein, 17 aa, Staphylococcus epidermidis
SARETAARVAVGAVSKI

SEQ ID NO: 1812496 - protein, 21 aa, Staphylococcus epidermidis
SARLHPWLLQIYKKRGYEIYA

SEQ ID NO: 1812497 - protein, 19 aa, Staphylococcus epidermidis
SARRHARKNGVDLSEVSGK

SEQ ID NO: 1812498 - protein, 21 aa, Staphylococcus epidermidis
SASRERIFISPLARNMAEDKG

SEQ ID NO: 1812499 - protein, 25 aa, Staphylococcus epidermidis
SASSRFKAPQFVFADFIEEFTFNTT

SEQ ID NO: 1812500 - protein, 25 aa, Staphylococcus epidermidis
SATNFVHLNLGYAIVPRFYYQSYFA

SEQ ID NO: 1812501 - protein, 17 aa, Staphylococcus epidermidis
SAVPLEAQIVFVGDEDQ

SEQ ID NO: 1812502 - protein, 21 aa, Staphylococcus epidermidis
SAYAFIKRLIKQFGKPQKVIT

SEQ ID NO: 1812503 - protein, 21 aa, Staphylococcus epidermidis
SAYAFIKRLIKQFGKPQKVVT

SEQ ID NO: 1812504 - protein, 22 aa, Staphylococcus epidermidis
SAYAFIKRLIKQFGKPQMIITD

SEQ ID NO: 1812505 - protein, 17 aa, Staphylococcus epidermidis
SAYKELHDIHGYKKARI

SEQ ID NO: 1812506 - protein, 19 aa, Staphylococcus epidermidis
SCDILRKVMLENKKAIQWE

SEQ ID NO: 1812507 - protein, 25 aa, Staphylococcus epidermidis
SCGDCTICVDRCPTGALVGNGQLNS

SEQ ID NO: 1812508 - protein, 25 aa, Staphylococcus epidermidis
SCGDIAVSVYSGWLAYSTFDHEWVK

SEQ ID NO: 1812509 - protein, 24 aa, Staphylococcus epidermidis
SCHLAIGSAYGFNVKGGTEMTTEE

SEQ ID NO: 1812510 - protein, 20 aa, Staphylococcus epidermidis
SCKAYIEAHAKYVSENQEKE

SEQ ID NO: 1812511 - protein, 17 aa, Staphylococcus epidermidis
SCSKMAKAFKIGRSRAE

SEQ ID NO: 1812512 - protein, 27 aa, Staphylococcus epidermidis
SCVNAPTSKDTFEWLQPLLKRKFPEHH

SEQ ID NO: 1812513 - protein, 17 aa, Staphylococcus epidermidis
SCYKKVATSYVHTATQF

SEQ ID NO: 1812514 - protein, 26 aa, Staphylococcus epidermidis
SDAKPTGVTSLCIGGGQGIATLVSKY

SEQ ID NO: 1812515 - protein, 18 aa, Staphylococcus epidermidis
SDAVGDWAVLNALINTAA

SEQ ID NO: 1812516 - protein, 19 aa, Staphylococcus epidermidis
SDDQLKEFYSYATNHNLEV

SEQ ID NO: 1812517 - protein, 28 aa, Staphylococcus epidermidis
SDDYRYFPEPDIVPLYVDEDWKARVRQT

SEQ ID NO: 1812518 - protein, 29 aa, Staphylococcus epidermidis
SDDYRYFPEPDIVPLYVDEEWKERVRQTI

SEQ ID NO: 1812519 - protein, 23 aa, Staphylococcus epidermidis
SDESRGSSGINILWPDTDNEYFK

SEQ ID NO: 1812520 - protein, 24 aa, Staphylococcus epidermidis
SDFDKLRFVHHSIPNIDVNQVDLT

SEQ ID NO: 1812521 - protein, 27 aa, Staphylococcus epidermidis
SDFFTMVKWDISGTLNYMKSREFCLVS

SEQ ID NO: 1812522 - protein, 18 aa, Staphylococcus epidermidis
SDFYSFSSGSVFKNIFNG

SEQ ID NO: 1812523 - protein, 29 aa, Staphylococcus epidermidis
SDGEAFAKFFKLMLHQGINLAPSKFEAWF

SEQ ID NO: 1812524 - protein, 21 aa, Staphylococcus epidermidis
SDGKLKPAILKKVDDYVSHVT

SEQ ID NO: 1812525 - protein, 22 aa, Staphylococcus epidermidis
SDHLNELILYLAPKLIGGSGKH

SEQ ID NO: 1812526 - protein, 20 aa, Staphylococcus epidermidis
SDIEGVLKYIEKWTDKRESL

SEQ ID NO: 1812527 - protein, 18 aa, Staphylococcus epidermidis
SDIEGVLNYIEKWTSKRE

SEQ ID NO: 1812528 - protein, 25 aa, Staphylococcus epidermidis
SDIFDYKDLDTIIAEKLAQTTSTSS

SEQ ID NO: 1812529 - protein, 18 aa, Staphylococcus epidermidis
SDIFSFNNPKGMCDTCSG

SEQ ID NO: 1812530 - protein, 17 aa, Staphylococcus epidermidis
SDIILSYGQTDENEMRM

SEQ ID NO: 1812531 - protein, 19 aa, Staphylococcus epidermidis
SDIQRAFIFGFEKKDQSEA

SEQ ID NO: 1812532 - protein, 25 aa, Staphylococcus epidermidis
SDISYSVCGIPYYIGGNVSDIDELT

SEQ ID NO: 1812533 - protein, 20 aa, Staphylococcus epidermidis
SDIVKFRTRLGLENYAKEGK

SEQ ID NO: 1812534 - protein, 24 aa, Staphylococcus epidermidis
SDIYCFDEPFVGIDIYSEQLIMNK

SEQ ID NO: 1812535 - protein, 20 aa, Staphylococcus epidermidis
SDKTAFFLNGYVNEYDDTDK

SEQ ID NO: 1812536 - protein, 21 aa, Staphylococcus epidermidis
SDLAHRFAVGRGRDRTKINHF

SEQ ID NO: 1812537 - protein, 18 aa, Staphylococcus epidermidis
SDLILYVTYFNHSFTDND

SEQ ID NO: 1812538 - protein, 29 aa, Staphylococcus epidermidis
SDLIPELQGRFPIRVELESLSVDDFVRIL

SEQ ID NO: 1812539 - protein, 23 aa, Staphylococcus epidermidis
SDLRAGACLITAGLIAEGVTTIF

SEQ ID NO: 1812540 - protein, 23 aa, Staphylococcus epidermidis
SDMKGGMSSLFYVLERLKQEGRR

SEQ ID NO: 1812541 - protein, 18 aa, Staphylococcus epidermidis
SDMKTEFEKSVTAPAGNQ

SEQ ID NO: 1812542 - protein, 28 aa, Staphylococcus epidermidis
SDMYLHPDLDTWVIFPWTAGQGKVARLI

SEQ ID NO: 1812543 - protein, 17 aa, Staphylococcus epidermidis
SDNEFDNRINLLTKELV

SEQ ID NO: 1812544 - protein, 28 aa, Staphylococcus epidermidis
SDNGEPCNECAICKGITQGTNNDVIEID

SEQ ID NO: 1812545 - protein, 24 aa, Staphylococcus epidermidis
SDNNIPEFNHYYAIGKQTADTLKE

SEQ ID NO: 1812546 - protein, 21 aa, Staphylococcus epidermidis
SDNYSTPAWIAGEKYDTAPTV

SEQ ID NO: 1812547 - protein, 20 aa, Staphylococcus epidermidis
SDRIILRMATFEMLHSDTPE

SEQ ID NO: 1812548 - protein, 24 aa, Staphylococcus epidermidis
SDRINRLFDITGLKDLMHVNEGTE

SEQ ID NO: 1812549 - protein, 20 aa, Staphylococcus epidermidis
SDRLYDMIFIDAAKAQSKKF

SEQ ID NO: 1812550 - protein, 17 aa, Staphylococcus epidermidis
SDSLALLKMQRHVIWLD

SEQ ID NO: 1812551 - protein, 25 aa, Staphylococcus epidermidis
SDVKCLINHDFSYVIGRTQAGTLEL

SEQ ID NO: 1812552 - protein, 19 aa, Staphylococcus epidermidis
SDVTSHCYFELETDRLDKK

SEQ ID NO: 1812553 - protein, 22 aa, Staphylococcus epidermidis
SDYFAFEACEYRRHFLSYHPDY

SEQ ID NO: 1812554 - protein, 27 aa, Staphylococcus epidermidis
SDYYPKFGFKKASNWNIEAPFDVPKDT

SEQ ID NO: 1812555 - protein, 17 aa, Staphylococcus epidermidis
SEACKKEGIHLTIPSPV

SEQ ID NO: 1812556 - protein, 21 aa, Staphylococcus epidermidis
SEALLKVVIKDVAKRAAAKQT

SEQ ID NO: 1812557 - protein, 28 aa, Staphylococcus epidermidis
SEALLSRKRLLLLTVDSIEFILVKGSDV

SEQ ID NO: 1812558 - protein, 22 aa, Staphylococcus epidermidis
SEAQHIVFICGHYEGYDERIRE

SEQ ID NO: 1812559 - protein, 23 aa, Staphylococcus epidermidis
SEDCGYCGQSVKMKQKQRYALVD

SEQ ID NO: 1812560 - protein, 25 aa, Staphylococcus epidermidis
SEDIKRKMVRNLCLSILTFDKDGDM

SEQ ID NO: 1812561 - protein, 18 aa, Staphylococcus epidermidis
SEDKAFFFNQFSKVETII

SEQ ID NO: 1812562 - protein, 21 aa, Staphylococcus epidermidis
SEDSYRTSIIQAIGRTLGVQT

SEQ ID NO: 1812563 - protein, 18 aa, Staphylococcus epidermidis
SEDVVNWTFLGEIQTDLS

SEQ ID NO: 1812564 - protein, 21 aa, Staphylococcus epidermidis
SEDYYRTLIIQAIGRALNVAT

SEQ ID NO: 1812565 - protein, 24 aa, Staphylococcus epidermidis
SEEIPHAIGVNVDRMIKEDEDRVR

SEQ ID NO: 1812566 - protein, 23 aa, Staphylococcus epidermidis
SEELGAKGIRVNCVAPGPFWSPL

SEQ ID NO: 1812567 - protein, 25 aa, Staphylococcus epidermidis
SEEMAELYNFLGLSVGLNLNSKSTE

SEQ ID NO: 1812568 - protein, 18 aa, Staphylococcus epidermidis
SEEMRLIYVALTRAKEQL

SEQ ID NO: 1812569 - protein, 27 aa, Staphylococcus epidermidis
SEETARQCAIVWGVNPVVKEGRKNTDA

SEQ ID NO: 1812570 - protein, 20 aa, Staphylococcus epidermidis
SEEVALVMMVLRLNTLLKGH

SEQ ID NO: 1812571 - protein, 23 aa, Staphylococcus epidermidis
SEFDLKLKAGDPLSPELQLKATA

SEQ ID NO: 1812572 - protein, 17 aa, Staphylococcus epidermidis
SEFGLQGNRLFYLAMAP

SEQ ID NO: 1812573 - protein, 19 aa, Staphylococcus epidermidis
SEFPQFFERAPFAREGEDP

SEQ ID NO: 1812574 - protein, 23 aa, Staphylococcus epidermidis
SEGLLKGYLYLRVDAERHSAEIK

SEQ ID NO: 1812575 - protein, 19 aa, Staphylococcus epidermidis
SEGLSLNAIIFYKNYQKNH

SEQ ID NO: 1812576 - protein, 17 aa, Staphylococcus epidermidis
SEGVGLGHQFLRHVERT

SEQ ID NO: 1812577 - protein, 22 aa, Staphylococcus epidermidis
SEGYKRHFSILKNKDFYISTSI

SEQ ID NO: 1812578 - protein, 18 aa, Staphylococcus epidermidis
SEGYRTDLQMSLDVITRV

SEQ ID NO: 1812579 - protein, 20 aa, Staphylococcus epidermidis
SEHCSYKHSKPFLKQFPTTG

SEQ ID NO: 1812580 - protein, 19 aa, Staphylococcus epidermidis
SEHQSYCVLIASPKTETGI

SEQ ID NO: 1812581 - protein, 25 aa, Staphylococcus epidermidis
SEICQEWLYHMGVPQDELVELAQTE

SEQ ID NO: 1812582 - protein, 26 aa, Staphylococcus epidermidis
SEICQEWLYHMGVPQEEIVELAQSEC

SEQ ID NO: 1812583 - protein, 24 aa, Staphylococcus epidermidis
SEIDLEKGFECTAKFRYRQKDTKV

SEQ ID NO: 1812584 - protein, 19 aa, Staphylococcus epidermidis
SEIEKRLNQKKAFQVEFGQ

SEQ ID NO: 1812585 - protein, 26 aa, Staphylococcus epidermidis
SEIHGRIFISLAVKFSKARLIDNIII

SEQ ID NO: 1812586 - protein, 20 aa, Staphylococcus epidermidis
SEIKRVIAHLPNFESDTDTF

SEQ ID NO: 1812587 - protein, 23 aa, Staphylococcus epidermidis
SEIKYWAELKDVFDTLNVEMPIV

SEQ ID NO: 1812588 - protein, 25 aa, Staphylococcus epidermidis
SEIKYWAELKEVFQLLKVEMPIVLP

SEQ ID NO: 1812589 - protein, 23 aa, Staphylococcus epidermidis
SEIKYWAELKGVFDTLNVEMPIV

SEQ ID NO: 1812590 - protein, 17 aa, Staphylococcus epidermidis
SEILRLFSSDIDVLITG

SEQ ID NO: 1812591 - protein, 20 aa, Staphylococcus epidermidis
SEINRILSLNNQFDIIFTSG

SEQ ID NO: 1812592 - protein, 17 aa, Staphylococcus epidermidis
SEIQSIIKQCLNLPQTR

SEQ ID NO: 1812593 - protein, 22 aa, Staphylococcus epidermidis
SEIRKKDIGFIFQDYNILHTLT

SEQ ID NO: 1812594 - protein, 17 aa, Staphylococcus epidermidis
SEIRVKELIERFPNNIV

SEQ ID NO: 1812595 - protein, 21 aa, Staphylococcus epidermidis
SEITIGLKDNGTFIYDGDEPL

SEQ ID NO: 1812596 - protein, 22 aa, Staphylococcus epidermidis
SEKECLEAEILVIAGDISHHNS

SEQ ID NO: 1812597 - protein, 23 aa, Staphylococcus epidermidis
SEKFGRQCICIAIDSFYDKDRED

SEQ ID NO: 1812598 - protein, 26 aa, Staphylococcus epidermidis
SELFEREMNELIALLNQLKDSTKYPI

SEQ ID NO: 1812599 - protein, 17 aa, Staphylococcus epidermidis
SELKTRIIDCLETAHTR

SEQ ID NO: 1812600 - protein, 22 aa, Staphylococcus epidermidis
SELPYHFDVKKANHIIKFLEML

SEQ ID NO: 1812601 - protein, 20 aa, Staphylococcus epidermidis
SELPYLQWLEECKIDNHFEE

SEQ ID NO: 1812602 - protein, 17 aa, Staphylococcus epidermidis
SELTMYYLNLVSVSRLK

SEQ ID NO: 1812603 - protein, 20 aa, Staphylococcus epidermidis
SELTYLTFVYKVAAMDFIFK

SEQ ID NO: 1812604 - protein, 20 aa, Staphylococcus epidermidis
SELYGAYVNSFVSKFKDRHV

SEQ ID NO: 1812605 - protein, 23 aa, Staphylococcus epidermidis
SENEINVPIFLKLTSDMELEGFK

SEQ ID NO: 1812606 - protein, 28 aa, Staphylococcus epidermidis
SENHACPLCGFSIGELEPRMFSFNSPFG

SEQ ID NO: 1812607 - protein, 26 aa, Staphylococcus epidermidis
SENKHFRLGISVSKKLGNAVTRNRIK

SEQ ID NO: 1812608 - protein, 18 aa, Staphylococcus epidermidis
SEPFEVIGKIIPRYENEN

SEQ ID NO: 1812609 - protein, 19 aa, Staphylococcus epidermidis
SEPRLKIEAGSVGIANNQT

SEQ ID NO: 1812610 - protein, 19 aa, Staphylococcus epidermidis
SEQEFLELLVRVFCDCFKF

SEQ ID NO: 1812611 - protein, 17 aa, Staphylococcus epidermidis
SEQLAQWVQENKIKTQV

SEQ ID NO: 1812612 - protein, 23 aa, Staphylococcus epidermidis
SEQLKRVGASLFNPQVKASKQDY

SEQ ID NO: 1812613 - protein, 18 aa, Staphylococcus epidermidis
SEQTRLKILPIIDNPNEE

SEQ ID NO: 1812614 - protein, 19 aa, Staphylococcus epidermidis
SERFIHLMTQYGAHVEKID

SEQ ID NO: 1812615 - protein, 17 aa, Staphylococcus epidermidis
SERHLGYAIKKEIIEEL

SEQ ID NO: 1812616 - protein, 18 aa, Staphylococcus epidermidis
SERLLKESLKTFLSADTD

SEQ ID NO: 1812617 - protein, 24 aa, Staphylococcus epidermidis
SERSYELLQDINIDEIINYKTEEV

SEQ ID NO: 1812618 - protein, 21 aa, Staphylococcus epidermidis
SERYGAVYLVNLFSNIKTPEN

SEQ ID NO: 1812619 - protein, 23 aa, Staphylococcus epidermidis
SESDKFKHVWILNNKDILEDYPI

SEQ ID NO: 1812620 - protein, 21 aa, Staphylococcus epidermidis
SETAKYYALIHHNKFEETLNA

SEQ ID NO: 1812621 - protein, 21 aa, Staphylococcus epidermidis
SETHFKFRIISGGNSSMLPQT

SEQ ID NO: 1812622 - protein, 20 aa, Staphylococcus epidermidis
SETIGKLLGYISDYLYTDLN

SEQ ID NO: 1812623 - protein, 23 aa, Staphylococcus epidermidis
SETLPEYMIPVHFMKVDRIPITM

SEQ ID NO: 1812624 - protein, 19 aa, Staphylococcus epidermidis
SEVKSGFMTTLHAYTNDQS

SEQ ID NO: 1812625 - protein, 19 aa, Staphylococcus epidermidis
SEVSELFKKDNKALKSNNQ

SEQ ID NO: 1812626 - protein, 17 aa, Staphylococcus epidermidis
SEWEAFVSYSEKVNQGK

SEQ ID NO: 1812627 - protein, 23 aa, Staphylococcus epidermidis
SEWNAKNLFTGWSDVKLSEQGIE

SEQ ID NO: 1812628 - protein, 30 aa, Staphylococcus epidermidis
SEYDDCLLFFRLGDFYEMFFEDAKEASRVL

SEQ ID NO: 1812629 - protein, 24 aa, Staphylococcus epidermidis
SEYKMFCYHFKKYLHMSPSDYNKQ

SEQ ID NO: 1812630 - protein, 22 aa, Staphylococcus epidermidis
SEYMGGVKFDLLSVENLDRIRA

SEQ ID NO: 1812631 - protein, 26 aa, Staphylococcus epidermidis
SEYSIPYYAGLSFRTLVPELPNEAPH

SEQ ID NO: 1812632 - protein, 20 aa, Staphylococcus epidermidis
SFAPYLTMAEGLKLAALTFD

SEQ ID NO: 1812633 - protein, 30 aa, Staphylococcus epidermidis; identical to SEQ ID NO: 1662271

SEQ ID NO: 1812634 - protein, 19 aa, Staphylococcus epidermidis
SFDNIRNAVDFGYATDPLA

SEQ ID NO: 1812635 - protein, 29 aa, Staphylococcus epidermidis
SFDQPIIWLCGGLDRGNEFDELIPYMENV

SEQ ID NO: 1812636 - protein, 17 aa, Staphylococcus epidermidis
SFETSLVKSSSFKSKMA

SEQ ID NO: 1812637 - protein, 25 aa, Staphylococcus epidermidis
SFEVAEKKLGLNLISFETSTSSVKK

SEQ ID NO: 1812638 - protein, 27 aa, Staphylococcus epidermidis
SFGGKVAGELFIFDIVDAFIEAEYKPT

SEQ ID NO: 1812639 - protein, 18 aa, Staphylococcus epidermidis
SFHILKVDGTMILLWRNG

SEQ ID NO: 1812640 - protein, 19 aa, Staphylococcus epidermidis
SFIEITLRGLEFANTDEIK

SEQ ID NO: 1812641 - protein, 19 aa, Staphylococcus epidermidis
SFKSLQKGVQMVHESLLRA

SEQ ID NO: 1812642 - protein, 19 aa, Staphylococcus epidermidis
SFKTPVHFGKKRLSDGEMT

SEQ ID NO: 1812643 - protein, 27 aa, Staphylococcus epidermidis
SFLRKQSACNIIFRTAIVKAHHIRFNE

SEQ ID NO: 1812644 - protein, 21 aa, Staphylococcus epidermidis
SFNAGEVVGLIGPSGTGKTTL

SEQ ID NO: 1812645 - protein, 28 aa, Staphylococcus epidermidis
SFSAYEFKKRAEACIEDIINRGKLPIIA

SEQ ID NO: 1812646 - protein, 19 aa, Staphylococcus epidermidis
SFSGLKSAVINKLHNLLQK

SEQ ID NO: 1812647 - protein, 19 aa, Staphylococcus epidermidis
SFSGQMHGLIILDKQGKPL

SEQ ID NO: 1812648 - protein, 20 aa, Staphylococcus epidermidis
SFSKVRGIFKPDKFEPSYIL

SEQ ID NO: 1812649 - protein, 24 aa, Staphylococcus epidermidis
SFTAGIRSTEDFQFDGDITSSNNL

SEQ ID NO: 1812650 - protein, 21 aa, Staphylococcus epidermidis
SFTEKGILIWIDQEKVKYRAP

SEQ ID NO: 1812651 - protein, 23 aa, Staphylococcus epidermidis
SFYEMSDEPFIYHYNTDEVSATI

SEQ ID NO: 1812652 - protein, 19 aa, Staphylococcus epidermidis
SGAAVWGDLFGDIKGQVNA

SEQ ID NO: 1812653 - protein, 20 aa, Staphylococcus epidermidis
SGAEHRKAQNYAEVKLKLDN

SEQ ID NO: 1812654 - protein, 22 aa, Staphylococcus epidermidis
SGAGLSLIRHWVEDENRISQEA

SEQ ID NO: 1812655 - protein, 21 aa, Staphylococcus epidermidis
SGAKIAFYVAQWPSARLNHWL

SEQ ID NO: 1812656 - protein, 18 aa, Staphylococcus epidermidis
SGARPAGVICEIMNDDGT

SEQ ID NO: 1812657 - protein, 17 aa, Staphylococcus epidermidis
SGAYILSKRQLETEKSY

SEQ ID NO: 1812658 - protein, 23 aa, Staphylococcus epidermidis
SGDLDPALIPFIMEKTGKTADEV

SEQ ID NO: 1812659 - protein, 18 aa, Staphylococcus epidermidis
SGFTRLLNNIFISRGDTR

SEQ ID NO: 1812660 - protein, 18 aa, Staphylococcus epidermidis
SGGIMLPNHAPLIVAEQF

SEQ ID NO: 1812661 - protein, 29 aa, Staphylococcus epidermidis
SGGQRQRVWIAMALAQRTDIIFLDEPTTY

SEQ ID NO: 1812662 - protein, 17 aa, Staphylococcus epidermidis
SGGTYLTTGIKMPNNSR

SEQ ID NO: 1812663 - protein, 21 aa, Staphylococcus epidermidis
SGHIINLASVSGFEPTKTNAV

SEQ ID NO: 1812664 - protein, 18 aa, Staphylococcus epidermidis
SGIGRAVAILYAKEGANV

SEQ ID NO: 1812665 - protein, 18 aa, Staphylococcus epidermidis
SGIGRSVAILYAKEGANV

SEQ ID NO: 1812666 - protein, 17 aa, Staphylococcus epidermidis
SGIVKRDVVAIISDQTY

SEQ ID NO: 1812667 - protein, 25 aa, Staphylococcus epidermidis
SGKCKVLCCYRLNRLHRNLKNAIQF

SEQ ID NO: 1812668 - protein, 18 aa, Staphylococcus epidermidis
SGKQRPWREKKIDNVSYA

SEQ ID NO: 1812669 - protein, 17 aa, Staphylococcus epidermidis
SGLPDFLVANVVEDYRM

SEQ ID NO: 1812670 - protein, 19 aa, Staphylococcus epidermidis
SGLPSFTYTFLGFLPRKEK

SEQ ID NO: 1812671 - protein, 18 aa, Staphylococcus epidermidis
SGLQEYLDDLGFNLVGYG

SEQ ID NO: 1812672 - protein, 36 aa, Staphylococcus epidermidis
SGMAAIQLVCNIFKPGDEVLVAFDLYGGTFRLFDFY

SEQ ID NO: 1812673 - protein, 20 aa, Staphylococcus epidermidis
SGMTCTGCEKHVESALEKIG

SEQ ID NO: 1812674 - protein, 23 aa, Staphylococcus epidermidis
SGNVRRFIQRAGIDDTMEITQDN

SEQ ID NO: 1812675 - protein, 20 aa, Staphylococcus epidermidis
SGPVAIQLARLCYLHGEHIV

SEQ ID NO: 1812676 - protein, 23 aa, Staphylococcus epidermidis
SGQKCSACSRAIVHKDVHDEVLK

SEQ ID NO: 1812677 - protein, 19 aa, Staphylococcus epidermidis
SGRELHKGLEIGTQYDKWM

SEQ ID NO: 1812678 - protein, 20 aa, Staphylococcus epidermidis
SGSATLKFKVGDAAYSEPVT

SEQ ID NO: 1812679 - protein, 28 aa, Staphylococcus epidermidis
SGSKKFARREVKNLPTSYTYSSDTYISD

SEQ ID NO: 1812680 - protein, 18 aa, Staphylococcus epidermidis
SGTIPGVLFKLEKTHDLT

SEQ ID NO: 1812681 - protein, 21 aa, Staphylococcus epidermidis
SGTSYSWKPLTDQVIVSSLKQ

SEQ ID NO: 1812682 - protein, 26 aa, Staphylococcus epidermidis
SGVAEPLAVVDACFTPVLAPFITIRS

SEQ ID NO: 1812683 - protein, 28 aa, Staphylococcus epidermidis
SGVDIKEVFLKLPIIGTEVYDESNEIEF

SEQ ID NO: 1812684 - protein, 18 aa, Staphylococcus epidermidis
SGVKLIRKGDINMNLHFV

SEQ ID NO: 1812685 - protein, 20 aa, Staphylococcus epidermidis
SGVSDLPMNNAIEFKSPKQY

SEQ ID NO: 1812686 - protein, 20 aa, Staphylococcus epidermidis
SGYRSYHVIIEYPIETLNGQ

SEQ ID NO: 1812687 - protein, 26 aa, Staphylococcus epidermidis
SGYTKDYPGVFAFIGSNSKYDLHHPK

SEQ ID NO: 1812688 - protein, 17 aa, Staphylococcus epidermidis
SHAGGSASRFLPWMKQM

SEQ ID NO: 1812689 - protein, 19 aa, Staphylococcus epidermidis
SHEREILVNSASFLAAGVC

SEQ ID NO: 1812690 - protein, 26 aa, Staphylococcus epidermidis
SHFCHDFLKKKGYDIELAFEAGLLSR

SEQ ID NO: 1812691 - protein, 26 aa, Staphylococcus epidermidis
SHFKQRIIHIPVLYGGDFGPDLSEVA

SEQ ID NO: 1812692 - protein, 19 aa, Staphylococcus epidermidis
SHGKEILKEYDYVNYRLFD

SEQ ID NO: 1812693 - protein, 17 aa, Staphylococcus epidermidis
SHGLRLNERTKYELQNF

SEQ ID NO: 1812694 - protein, 23 aa, Staphylococcus epidermidis
SHGYIPGNMKVMLSQNLQSRFAV

SEQ ID NO: 1812695 - protein, 24 aa, Staphylococcus epidermidis
SHIDEAYNMITFVHSIDEGIKDAD

SEQ ID NO: 1812696 - protein, 29 aa, Staphylococcus epidermidis
SHIDTGVGFLDHMLTLFTFHSGLTLNIVA

SEQ ID NO: 1812697 - protein, 33 aa, Staphylococcus epidermidis
SHILGRRVNPHIFKASCVTYLLEVKKVDIKHVS

SEQ ID NO: 1812698 - protein, 17 aa, Staphylococcus epidermidis
SHIPYPHQYWLAKLKSK

SEQ ID NO: 1812699 - protein, 18 aa, Staphylococcus epidermidis
SHIPYPHQYWLAKLKSKE

SEQ ID NO: 1812700 - protein, 22 aa, Staphylococcus epidermidis
SHISQAISTLGHYDLLTINDAG

SEQ ID NO: 1812701 - protein, 22 aa, Staphylococcus epidermidis
SHKRFGGVVPEVASRHHVEGMT

SEQ ID NO: 1812702 - protein, 17 aa, Staphylococcus epidermidis
SHKVVKDAMSIIRNIMK

SEQ ID NO: 1812703 - protein, 17 aa, Staphylococcus epidermidis
SHLIRLSSGHSFIEKII

SEQ ID NO: 1812704 - protein, 21 aa, Staphylococcus epidermidis
SHLVPYLKVLDQLTLVGKEAG

SEQ ID NO: 1812705 - protein, 25 aa, Staphylococcus epidermidis
SHPANCLMARIGKRISLDQQQAFDD

SEQ ID NO: 1812706 - protein, 21 aa, Staphylococcus epidermidis
SHPYLLKLQDLYREFRDSMLD

SEQ ID NO: 1812707 - protein, 22 aa, Staphylococcus epidermidis
SHQLRFLKNLRLVKFRREGTTL

SEQ ID NO: 1812708 - protein, 21 aa, Staphylococcus epidermidis
SHRKLFPSIFHLFQQDNLDEH

SEQ ID NO: 1812709 - protein, 17 aa, Staphylococcus epidermidis
SHSFLLPLMQKIDVDVQ

SEQ ID NO: 1812710 - protein, 25 aa, Staphylococcus epidermidis
SHSSLPFLGQNAIKPLLEFIQNIDQ

SEQ ID NO: 1812711 - protein, 26 aa, Staphylococcus epidermidis
SHVSELKQRIPLILEVSSNQYQSNTQ

SEQ ID NO: 1812712 - protein, 20 aa, Staphylococcus epidermidis
SHYKHLFAILELAKKQGVDK

SEQ ID NO: 1812713 - protein, 20 aa, Staphylococcus epidermidis
SHYRLYGIFLLNQLNGKEIL

SEQ ID NO: 1812714 - protein, 17 aa, Staphylococcus epidermidis
SIASGVDIKEVFLKLPI

SEQ ID NO: 1812715 - protein, 25 aa, Staphylococcus epidermidis
SIDEIKMLFLQGIHKKIGYEGSKII

SEQ ID NO: 1812716 - protein, 18 aa, Staphylococcus epidermidis
SIDFSWIPNMGKAWDDFK

SEQ ID NO: 1812717 - protein, 20 aa, Staphylococcus epidermidis
SIDFTSCERDPMGGYAIKGY

SEQ ID NO: 1812718 - protein, 26 aa, Staphylococcus epidermidis
SIDGLYQFLFKFIFDVDERYIKLYVQ

SEQ ID NO: 1812719 - protein, 18 aa, Staphylococcus epidermidis
SIDKSVMATITFQNLFKL

SEQ ID NO: 1812720 - protein, 22 aa, Staphylococcus epidermidis
SIDPLHIVLWFDRMRETYGLEK

SEQ ID NO: 1812721 - protein, 21 aa, Staphylococcus epidermidis
SIDVDEDFLLVKREIFSSGKS

SEQ ID NO: 1812722 - protein, 20 aa, Staphylococcus epidermidis
SIEGKEIKKVIAVPQKLVNI

SEQ ID NO: 1812723 - protein, 18 aa, Staphylococcus epidermidis
SIEGYVFINNGKQITNSS

SEQ ID NO: 1812724 - protein, 29 aa, Staphylococcus epidermidis
SIENRPILQEALNFVRIGDRFVVESIDRL

SEQ ID NO: 1812725 - protein, 25 aa, Staphylococcus epidermidis
SIENRPILQEALNFVRMGDRFIVES

SEQ ID NO: 1812726 - protein, 26 aa, Staphylococcus epidermidis
SIENRPILQEALNFVRMGDRFVVESI

SEQ ID NO: 1812727 - protein, 19 aa, Staphylococcus epidermidis
SIEVSDKAKKWLGEEAYEP

SEQ ID NO: 1812728 - protein, 26 aa, Staphylococcus epidermidis
SIEYLRFSYYLTIEQFKLLQFIYQFT

SEQ ID NO: 1812729 - protein, 18 aa, Staphylococcus epidermidis
SIFENKKLKDLGIDLEDF

SEQ ID NO: 1812730 - protein, 17 aa, Staphylococcus epidermidis
SIFTVPVDLIFLKGKEM

SEQ ID NO: 1812731 - protein, 17 aa, Staphylococcus epidermidis
SIFTVPVDLIFMNGKEM

SEQ ID NO: 1812732 - protein, 22 aa, Staphylococcus epidermidis
SIGCIPCTAPVFDSNDSRAGRW

SEQ ID NO: 1812733 - protein, 24 aa, Staphylococcus epidermidis
SIGIYSYELYNFFDVDTIIRVGSC

SEQ ID NO: 1812734 - protein, 23 aa, Staphylococcus epidermidis
SIGVKCPKCNEGDVVERKSKKNR

SEQ ID NO: 1812735 - protein, 18 aa, Staphylococcus epidermidis
SIIDGCRLSKAKIIRVNH

SEQ ID NO: 1812736 - protein, 18 aa, Staphylococcus epidermidis
SIIIKIFTEKGITSKDKL

SEQ ID NO: 1812737 - protein, 17 aa, Staphylococcus epidermidis
SIIKMLGTDQFKRIRIG

SEQ ID NO: 1812738 - protein, 19 aa, Staphylococcus epidermidis
SIKDVENFIDLLSKIYDES

SEQ ID NO: 1812739 - protein, 20 aa, Staphylococcus epidermidis
SIKVHSLKGIISLGPIIKTL

SEQ ID NO: 1812740 - protein, 21 aa, Staphylococcus epidermidis
SILEMYDIILAGVEVENELSN

SEQ ID NO: 1812741 - protein, 20 aa, Staphylococcus epidermidis
SILGGEPFCNLNITLRIARA

SEQ ID NO: 1812742 - protein, 22 aa, Staphylococcus epidermidis
SILKAIRLIGILDEAKILDALN

SEQ ID NO: 1812743 - protein, 29 aa, Staphylococcus epidermidis
SILKAKRIILLAFGPKKKEAISKLLNEQV

SEQ ID NO: 1812744 - protein, 26 aa, Staphylococcus epidermidis
SILNGEFKAGSILLPTPTEPVYLANR

SEQ ID NO: 1812745 - protein, 17 aa, Staphylococcus epidermidis
SINDCYAILGLVHTLWK

SEQ ID NO: 1812746 - protein, 23 aa, Staphylococcus epidermidis
SINKEGYVQYEFVTDDLTDLLAI

SEQ ID NO: 1812747 - protein, 18 aa, Staphylococcus epidermidis
SINVPMDLLPYLFFQFSS

SEQ ID NO: 1812748 - protein, 23 aa, Staphylococcus epidermidis
SIPKDRYLGMRKIDNEPKLFENL

SEQ ID NO: 1812749 - protein, 20 aa, Staphylococcus epidermidis
SIPMAIKYYDTFQRLKNEGV

SEQ ID NO: 1812750 - protein, 25 aa, Staphylococcus epidermidis
SIRKNDEIILLEGFMDVIKSDYAGL

SEQ ID NO: 1812751 - protein, 30 aa, Staphylococcus epidermidis
SISAHKFGGPKGVGLLLVKEHTPIAYNQLG

SEQ ID NO: 1812752 - protein, 29 aa, Staphylococcus epidermidis
SISAHKFGGPKGVGLLLVKEYTPIAYNQL

SEQ ID NO: 1812753 - protein, 26 aa, Staphylococcus epidermidis
SISDLELIGIGGFSPLTGFMNKADYT

SEQ ID NO: 1812754 - protein, 24 aa, Staphylococcus epidermidis
SISGYPFVWWFATKPAYDGQGYGS

SEQ ID NO: 1812755 - protein, 24 aa, Staphylococcus epidermidis
SISLRYEMLKARLKYSQDAIFVSE

SEQ ID NO: 1812756 - protein, 18 aa, Staphylococcus epidermidis
SITEGTIAEWLKNVGDSV

SEQ ID NO: 1812757 - protein, 26 aa, Staphylococcus epidermidis
SITKRLGFKKGHKFEEPLVEFFYKKD

SEQ ID NO: 1812758 - protein, 21 aa, Staphylococcus epidermidis
SITNSKCLVLFTSYKMMHMVQ

SEQ ID NO: 1812759 - protein, 22 aa, Staphylococcus epidermidis
SITPYEGGIAFAAKPLIEDNFI

SEQ ID NO: 1812760 - protein, 17 aa, Staphylococcus epidermidis
SITRKKEVVQALNNKNY

SEQ ID NO: 1812761 - protein, 24 aa, Staphylococcus epidermidis
SIVGRLLEHSRIYYFHNNGDERIY

SEQ ID NO: 1812762 - protein, 24 aa, Staphylococcus epidermidis
SIVGRLLEHSRIYYFHNNGEAHIY

SEQ ID NO: 1812763 - protein, 22 aa, Staphylococcus epidermidis
SIYSLRYDEMQQWLIDHGQQKF

SEQ ID NO: 1812764 - protein, 23 aa, Staphylococcus epidermidis
SIYSLRYDEMQQWLIDHGQQKFR

SEQ ID NO: 1812765 - protein, 24 aa, Staphylococcus epidermidis
SIYTTELTPHFSFSEKIILISNKE

SEQ ID NO: 1812766 - protein, 21 aa, Staphylococcus epidermidis
SKADQVFLCEIFGSIRENTGD

SEQ ID NO: 1812767 - protein, 18 aa, Staphylococcus epidermidis
SKAYEEWLRVLKPHGHLL

SEQ ID NO: 1812768 - protein, 18 aa, Staphylococcus epidermidis
SKDAISILENLSIDVDED

SEQ ID NO: 1812769 - protein, 19 aa, Staphylococcus epidermidis
SKDGYKIFVHESERKEEPR

SEQ ID NO: 1812770 - protein, 26 aa, Staphylococcus epidermidis
SKDKRIKLGVIPSFSLYKLHEKNYIN

SEQ ID NO: 1812771 - protein, 23 aa, Staphylococcus epidermidis
SKDLEVDFIFKARKPMGKAFKKA

SEQ ID NO: 1812772 - protein, 23 aa, Staphylococcus epidermidis
SKDLFKNCYKALINKKETNLVEE

SEQ ID NO: 1812773 - protein, 28 aa, Staphylococcus epidermidis
SKDLKKYGFKFLGPVTVFSFLEAAGLYD

SEQ ID NO: 1812774 - protein, 17 aa, Staphylococcus epidermidis
SKDMSIGVITNDIYTKE

SEQ ID NO: 1812775 - protein, 24 aa, Staphylococcus epidermidis
SKETFKSLVEIGVQYVDVSGRGGT

SEQ ID NO: 1812776 - protein, 18 aa, Staphylococcus epidermidis
SKETLDYFIDAMIQIANE

SEQ ID NO: 1812777 - protein, 18 aa, Staphylococcus epidermidis
SKEWKDFIESAYKYYTTI

SEQ ID NO: 1812778 - protein, 25 aa, Staphylococcus epidermidis
SKFGLSIKHGLALEAVNKVKTSKHL

SEQ ID NO: 1812779 - protein, 19 aa, Staphylococcus epidermidis
SKGDLVVWGSSTLSSFSNW

SEQ ID NO: 1812780 - protein, 18 aa, Staphylococcus epidermidis
SKGGQLADFVRYEVGEGM

SEQ ID NO: 1812781 - protein, 36 aa, Staphylococcus epidermidis
SKGIYKFRFPILEAIKEVYEYTSIFEKMRFKGSSYT

SEQ ID NO: 1812782 - protein, 18 aa, Staphylococcus epidermidis
SKGIYKFRYNVIEAVKAV

SEQ ID NO: 1812783 - protein, 21 aa, Staphylococcus epidermidis
SKGKYLFELKIDLENLYKELG

SEQ ID NO: 1812784 - protein, 18 aa, Staphylococcus epidermidis
SKGRPSISTFSPQSTTQD

SEQ ID NO: 1812785 - protein, 18 aa, Staphylococcus epidermidis
SKGSLAGVDGRIQSRSYE

SEQ ID NO: 1812786 - protein, 19 aa, Staphylococcus epidermidis
SKGSLAGVDGRIQSRSYEN

SEQ ID NO: 1812787 - protein, 21 aa, Staphylococcus epidermidis
SKHAVKVILEAAIKAGAPKDC

SEQ ID NO: 1812788 - protein, 19 aa, Staphylococcus epidermidis
SKHGIALDEVNEFLNELKD

SEQ ID NO: 1812789 - protein, 17 aa, Staphylococcus epidermidis
SKHPIRVDIAGSVDSIY

SEQ ID NO: 1812790 - protein, 25 aa, Staphylococcus epidermidis
SKHVPFRTAHEIVGKIVLDCIHQGI

SEQ ID NO: 1812791 - protein, 24 aa, Staphylococcus epidermidis
SKIGKDDFSSFCELKELNAVLMDK

SEQ ID NO: 1812792 - protein, 19 aa, Staphylococcus epidermidis
SKIKIIRPINDLLKKFHKC

SEQ ID NO: 1812793 - protein, 17 aa, Staphylococcus epidermidis
SKILNLMGYEYNSSNER

SEQ ID NO: 1812794 - protein, 22 aa, Staphylococcus epidermidis
SKKFGEEAFEVVIGAMKHNQQE

SEQ ID NO: 1812795 - protein, 28 aa, Staphylococcus epidermidis
SKKGVKLLWASCREVINVIQADEIGADI

SEQ ID NO: 1812796 - protein, 19 aa, Staphylococcus epidermidis
SKKIAHTMSHYYSQEHQII

SEQ ID NO: 1812797 - protein, 23 aa, Staphylococcus epidermidis
SKKLSKYNMCVAYTRNYVKKQTR

SEQ ID NO: 1812798 - protein, 22 aa, Staphylococcus epidermidis
SKKSGKLFIDRCGQEMLERTSV

SEQ ID NO: 1812799 - protein, 27 aa, Staphylococcus epidermidis
SKLAAKRKLSVFLYSVNDFTDFNATTQ

SEQ ID NO: 1812800 - protein, 29 aa, Staphylococcus epidermidis
SKLESAKRFKRWVTSEVLPTLRKTGTYQI

SEQ ID NO: 1812801 - protein, 18 aa, Staphylococcus epidermidis
SKLGLYRRFEKRQEIYNL

SEQ ID NO: 1812802 - protein, 18 aa, Staphylococcus epidermidis
SKLKRLFRRTKASINEVF

SEQ ID NO: 1812803 - protein, 22 aa, Staphylococcus epidermidis
SKLLENQQILALESNKKIQKLE

SEQ ID NO: 1812804 - protein, 20 aa, Staphylococcus epidermidis
SKLLENQQVLALESNKKIQK

SEQ ID NO: 1812805 - protein, 22 aa, Staphylococcus epidermidis
SKLPNSINFIAWLQHLQDSGMT

SEQ ID NO: 1812806 - protein, 19 aa, Staphylococcus epidermidis
SKLPRPRIQRNTFVQPRNN

SEQ ID NO: 1812807 - protein, 23 aa, Staphylococcus epidermidis
SKMAKAFKIGRSRAEKDVKSGSF

SEQ ID NO: 1812808 - protein, 20 aa, Staphylococcus epidermidis
SKMIKEGVCQLDIKLDTGRT

SEQ ID NO: 1812809 - protein, 21 aa, Staphylococcus epidermidis
SKMIKEGVCQLNIKLDTGRTH

SEQ ID NO: 1812810 - protein, 17 aa, Staphylococcus epidermidis
SKMTGIKERHWADENQD

SEQ ID NO: 1812811 - protein, 19 aa, Staphylococcus epidermidis
SKNIGIGVGSKIYDTKITN

SEQ ID NO: 1812812 - protein, 23 aa, Staphylococcus epidermidis
SKNIKLTDLFIYKQLPMLIEDRQ

SEQ ID NO: 1812813 - protein, 26 aa, Staphylococcus epidermidis
SKNIPFRTAHEIVGKIVLNCIHKGIY

SEQ ID NO: 1812814 - protein, 18 aa, Staphylococcus epidermidis
SKNLREFGELISKNLKED

SEQ ID NO: 1812815 - protein, 23 aa, Staphylococcus epidermidis
SKNRINLILIPLIAKHFIVEKKE

SEQ ID NO: 1812816 - protein, 18 aa, Staphylococcus epidermidis
SKNTFIINNEFRMCNGGI

SEQ ID NO: 1812817 - protein, 18 aa, Staphylococcus epidermidis
SKNYILFFIDKYKIKTPF

SEQ ID NO: 1812818 - protein, 17 aa, Staphylococcus epidermidis
SKPLRRVFHFDNQPTKL

SEQ ID NO: 1812819 - protein, 24 aa, Staphylococcus epidermidis
SKQKRSRNLLDFADYEHFALQILT

SEQ ID NO: 1812820 - protein, 20 aa, Staphylococcus epidermidis
SKQLCFLFYVSSKEIIKKYT

SEQ ID NO: 1812821 - protein, 21 aa, Staphylococcus epidermidis
SKQPLEYPSCGSVFQRPPGHF

SEQ ID NO: 1812822 - protein, 22 aa, Staphylococcus epidermidis
SKQRNVFGGGRFNFLNDTCELS

SEQ ID NO: 1812823 - protein, 21 aa, Staphylococcus epidermidis
SKRAMKILLKQGHDVINVRDG

SEQ ID NO: 1812824 - protein, 20 aa, Staphylococcus epidermidis
SKRLTGNKITFYSSGNKVTM

SEQ ID NO: 1812825 - protein, 19 aa, Staphylococcus epidermidis
SKRSLVLTDAGKIFFKKCQ

SEQ ID NO: 1812826 - protein, 20 aa, Staphylococcus epidermidis
SKSLAIAVASIISRYAFVKH

SEQ ID NO: 1812827 - protein, 19 aa, Staphylococcus epidermidis
SKSLARFISTIRSFHQFAL

SEQ ID NO: 1812828 - protein, 25 aa, Staphylococcus epidermidis
SKSLFPSCRIAYIVLPEKVMNTYKQ

SEQ ID NO: 1812829 - protein, 21 aa, Staphylococcus epidermidis
SKSSLSKGLSFIRKGSTNTPI

SEQ ID NO: 1812830 - protein, 25 aa, Staphylococcus epidermidis
SKSVFRSTSKWFGNAFKSLKGNMGN

SEQ ID NO: 1812831 - protein, 23 aa, Staphylococcus epidermidis
SKSVYKGTSKWFGNAYSSLKSWT

SEQ ID NO: 1812832 - protein, 23 aa, Staphylococcus epidermidis
SKTKELFSNIIGLQYTDKNENAL

SEQ ID NO: 1812833 - protein, 23 aa, Staphylococcus epidermidis
SKTKRSNYEFDMEQFESISTLVD

SEQ ID NO: 1812834 - protein, 18 aa, Staphylococcus epidermidis
SKTLLRAGEINHLSKDNP

SEQ ID NO: 1812835 - protein, 17 aa, Staphylococcus epidermidis
SKVDGIVLMATHITEAH

SEQ ID NO: 1812836 - protein, 21 aa, Staphylococcus epidermidis
SKVIFPLQIFISAHCRHAPFI

SEQ ID NO: 1812837 - protein, 22 aa, Staphylococcus epidermidis
SKYAGLRFDEDVVFCEEHTFIV

SEQ ID NO: 1812838 - protein, 22 aa, Staphylococcus epidermidis
SLAPKGKTGLYILMPTPELKTG

SEQ ID NO: 1812839 - protein, 25 aa, Staphylococcus epidermidis
SLASRIPYGEALSFAKVNKVNEAEK

SEQ ID NO: 1812840 - protein, 18 aa, Staphylococcus epidermidis
SLAVKFGLTIEDLTETLA

SEQ ID NO: 1812841 - protein, 19 aa, Staphylococcus epidermidis
SLDDFRILQSQFFGNGTRT

SEQ ID NO: 1812842 - protein, 21 aa, Staphylococcus epidermidis
SLDQMLPCLKNVHVAANEYKG

SEQ ID NO: 1812843 - protein, 24 aa, Staphylococcus epidermidis
SLEGFDGVLIPGGFSFGDYLRSGA

SEQ ID NO: 1812844 - protein, 18 aa, Staphylococcus epidermidis
SLELKGGLDHFLDSRRHS

SEQ ID NO: 1812845 - protein, 23 aa, Staphylococcus epidermidis
SLEQNVFLLTEFIQKGRKNKAVQ

SEQ ID NO: 1812846 - protein, 19 aa, Staphylococcus epidermidis
SLFRKSSEVLSHLEDIANR

SEQ ID NO: 1812847 - protein, 29 aa, Staphylococcus epidermidis
SLGGLFTLRLAEHFNLERIAVMSAPHKKR

SEQ ID NO: 1812848 - protein, 21 aa, Staphylococcus epidermidis
SLGLEPWHFVVVQNKELREKL

SEQ ID NO: 1812849 - protein, 25 aa, Staphylococcus epidermidis
SLGLGISCVPEYALSPSDSFKKLFL

SEQ ID NO: 1812850 - protein, 32 aa, Staphylococcus epidermidis
SLGMKQRLGIALALLCGPDILVLDEPINGLDA

SEQ ID NO: 1812851 - protein, 18 aa, Staphylococcus epidermidis
SLGNLVIAGMTNITNDFG

SEQ ID NO: 1812852 - protein, 17 aa, Staphylococcus epidermidis
SLGQTFIVELYLYDYDY

SEQ ID NO: 1812853 - protein, 18 aa, Staphylococcus epidermidis
SLGRSYDAVFPLLHGPNG

SEQ ID NO: 1812854 - protein, 17 aa, Staphylococcus epidermidis
SLIKKLKMRNHVFLLGH

SEQ ID NO: 1812855 - protein, 18 aa, Staphylococcus epidermidis
SLIKLAIDQHIPYTVLRD

SEQ ID NO: 1812856 - protein, 34 aa, Staphylococcus epidermidis
SLIPQSLKKDWGFFFMPKFNFVINVANENRIENL

SEQ ID NO: 1812857 - protein, 22 aa, Staphylococcus epidermidis
SLISTDFIEDFSVFDGQTIRIK

SEQ ID NO: 1812858 - protein, 23 aa, Staphylococcus epidermidis
SLKEGDCNLKFKAYLLENNIIDE

SEQ ID NO: 1812859 - protein, 19 aa, Staphylococcus epidermidis
SLKIFSLKGNEPLAQEVAD

SEQ ID NO: 1812860 - protein, 20 aa, Staphylococcus epidermidis
SLKKEGANVILIDTTEKDFV

SEQ ID NO: 1812861 - protein, 20 aa, Staphylococcus epidermidis
SLKQLEGFMGNDIRETSVDF

SEQ ID NO: 1812862 - protein, 17 aa, Staphylococcus epidermidis
SLKQLKYLAKIVPDHIE

SEQ ID NO: 1812863 - protein, 22 aa, Staphylococcus epidermidis
SLKVANGLQVERLLRQNEEIKK

SEQ ID NO: 1812864 - protein, 18 aa, Staphylococcus epidermidis
SLLAPRIETMFANHHIVF

SEQ ID NO: 1812865 - protein, 24 aa, Staphylococcus epidermidis
SLLEDRLLRCIDIILHVKNSTKLN

SEQ ID NO: 1812866 - protein, 27 aa, Staphylococcus epidermidis
SLLESPRLGAINVHASLLPKYRGGAPI

SEQ ID NO: 1812867 - protein, 23 aa, Staphylococcus epidermidis
SLLKEYNGSIIFVSHDRKFIEKV

SEQ ID NO: 1812868 - protein, 19 aa, Staphylococcus epidermidis
SLLKQARHSIQDAIDAAES

SEQ ID NO: 1812869 - protein, 20 aa, Staphylococcus epidermidis
SLLNDLKIASPILENHLDDI

SEQ ID NO: 1812870 - protein, 22 aa, Staphylococcus epidermidis
SLLQGNHHWRNVVPQVAHNLYK

SEQ ID NO: 1812871 - protein, 27 aa, Staphylococcus epidermidis
SLLTIIYLRKPWRIESLLKKIDDLFKN

SEQ ID NO: 1812872 - protein, 27 aa, Staphylococcus epidermidis
SLLTIIYLRKPWRIESLLKKINDLFKN

SEQ ID NO: 1812873 - protein, 24 aa, Staphylococcus epidermidis
SLNDFKYAELSSMDSHIYEVLTSR

SEQ ID NO: 1812874 - protein, 20 aa, Staphylococcus epidermidis
SLNLTTKFKLLVPKKSKLTF

SEQ ID NO: 1812875 - protein, 25 aa, Staphylococcus epidermidis
SLNPEVDRLTLSCRMEINARGEVVK

SEQ ID NO: 1812876 - protein, 26 aa, Staphylococcus epidermidis
SLNPPHLKAMIPWEGLNDMYREIAFH

SEQ ID NO: 1812877 - protein, 19 aa, Staphylococcus epidermidis
SLNRHKTEIINIIDQNLYE

SEQ ID NO: 1812878 - protein, 18 aa, Staphylococcus epidermidis
SLPIYKPTLPPMVFGTRD

SEQ ID NO: 1812879 - protein, 20 aa, Staphylococcus epidermidis
SLREPLLFYRQLIPQNIKNI

SEQ ID NO: 1812880 - protein, 25 aa, Staphylococcus epidermidis
SLREPLLFYRQLIRQNIKNIILNYL

SEQ ID NO: 1812881 - protein, 18 aa, Staphylococcus epidermidis
SLRHTHCSYLLAKGISIQ

SEQ ID NO: 1812882 - protein, 18 aa, Staphylococcus epidermidis
SLRQNRVGLYIKNDLDSI

SEQ ID NO: 1812883 - protein, 19 aa, Staphylococcus epidermidis
SLRYDEMQQWLIDHGQQKF

SEQ ID NO: 1812884 - protein, 19 aa, Staphylococcus epidermidis
SLSAYEVVNEWSYEALVKI

SEQ ID NO: 1812885 - protein, 26 aa, Staphylococcus epidermidis
SLSDFESLCFHVPFTKMGKKALDSII

SEQ ID NO: 1812886 - protein, 20 aa, Staphylococcus epidermidis
SLSGKELKEGFKDVPQVTLS

SEQ ID NO: 1812887 - protein, 31 aa, Staphylococcus epidermidis
SLSKEKRVSVKRAFIGSFLFGGRYSSSKFKI

SEQ ID NO: 1812888 - protein, 22 aa, Staphylococcus epidermidis
SLSLYACIYALFTGRTFIGQKV

SEQ ID NO: 1812889 - protein, 17 aa, Staphylococcus epidermidis
SLSMKRFNLEKLNQYLD

SEQ ID NO: 1812890 - protein, 18 aa, Staphylococcus epidermidis
SLTANYDRFMTWRSKDGK

SEQ ID NO: 1812891 - protein, 18 aa, Staphylococcus epidermidis
SLTAPLLNKIMLDVYERF

SEQ ID NO: 1812892 - protein, 19 aa, Staphylococcus epidermidis
SLTKKEWDKEITSKLIFEL

SEQ ID NO: 1812893 - protein, 18 aa, Staphylococcus epidermidis
SLTNRFEQLEGYQYESKI

SEQ ID NO: 1812894 - protein, 28 aa, Staphylococcus epidermidis
SLVIPCSRPNLTPGFFMFVHTNNGLHMN

SEQ ID NO: 1812895 - protein, 25 aa, Staphylococcus epidermidis
SLVKEIRLKDGLVYRKMIIETEEIA

SEQ ID NO: 1812896 - protein, 26 aa, Staphylococcus epidermidis
SLVSEEGFAMPMLLALSHIHQLLIRE

SEQ ID NO: 1812897 - protein, 18 aa, Staphylococcus epidermidis
SLVYAHKGSMDFRITSKG

SEQ ID NO: 1812898 - protein, 22 aa, Staphylococcus epidermidis
SLYRMSPRTFAYMNELEYPDLL

SEQ ID NO: 1812899 - protein, 31 aa, Staphylococcus epidermidis
SMAKEMRKEPSIPHNFTFHLLFSNNKLKIND

SEQ ID NO: 1812900 - protein, 32 aa, Staphylococcus epidermidis
SMAKEMRKEPSIPHNFTFNLLFSNNKLKINDP

SEQ ID NO: 1812901 - protein, 17 aa, Staphylococcus epidermidis
SMCKHLSIQLSENEGDI

SEQ ID NO: 1812902 - protein, 20 aa, Staphylococcus epidermidis
SMEHILRAAMDIDQTTQQFI

SEQ ID NO: 1812903 - protein, 23 aa, Staphylococcus epidermidis
SMKDWKTNANLPFHNNTTNLKID

SEQ ID NO: 1812904 - protein, 23 aa, Staphylococcus epidermidis
SMLAEDKRLFVVSSKKTDVLIRN

SEQ ID NO: 1812905 - protein, 21 aa, Staphylococcus epidermidis
SMLFRGVHYEICCKDRKGYEW

SEQ ID NO: 1812906 - protein, 20 aa, Staphylococcus epidermidis
SMLNQLRGYIVYRSNEMIMT

SEQ ID NO: 1812907 - protein, 22 aa, Staphylococcus epidermidis
SMLQLIKYKGLMTYDNKELKKI

SEQ ID NO: 1812908 - protein, 26 aa, Staphylococcus epidermidis
SMNRISKELGIGMGTLYRHFKDKSDL

SEQ ID NO: 1812909 - protein, 17 aa, Staphylococcus epidermidis
SMVANWFPSQATLYRIK

SEQ ID NO: 1812910 - protein, 17 aa, Staphylococcus epidermidis
SMYCKRYFKTKPNSKIN

SEQ ID NO: 1812911 - protein, 19 aa, Staphylococcus epidermidis
SNAMADIKIFGGANRPKKV

SEQ ID NO: 1812912 - protein, 17 aa, Staphylococcus epidermidis
SNAWSKEEMESIVVELP

SEQ ID NO: 1812913 - protein, 24 aa, Staphylococcus epidermidis
SNDTFCVLNHLFVNEGHEEMFEDK

SEQ ID NO: 1812914 - protein, 24 aa, Staphylococcus epidermidis
SNDTFCVLNHLFVNEGNEEVFESR

SEQ ID NO: 1812915 - protein, 17 aa, Staphylococcus epidermidis
SNEIIVVTVSGRGDKDM

SEQ ID NO: 1812916 - protein, 19 aa, Staphylococcus epidermidis
SNELEIAKRAILDNHPYET

SEQ ID NO: 1812917 - protein, 22 aa, Staphylococcus epidermidis
SNELFLDFLKEQPFGQSINLKK

SEQ ID NO: 1812918 - protein, 17 aa, Staphylococcus epidermidis
SNFERFSEHLAQSGIEF

SEQ ID NO: 1812919 - protein, 36 aa, Staphylococcus epidermidis
SNFKMNILIGPLVKLWKIGFKDALKPKEEDIQRALL

SEQ ID NO: 1812920 - protein, 17 aa, Staphylococcus epidermidis
SNGHEFRHGCDCELIEI

SEQ ID NO: 1812921 - protein, 18 aa, Staphylococcus epidermidis
SNGHEFRHGCDCTMIQAG

SEQ ID NO: 1812922 - protein, 18 aa, Staphylococcus epidermidis
SNGKWQFESGLVVDDSIK

SEQ ID NO: 1812923 - protein, 19 aa, Staphylococcus epidermidis
SNHDLKKFNIILSNYSDSE

SEQ ID NO: 1812924 - protein, 21 aa, Staphylococcus epidermidis
SNHDLKKFNIMLSNYSESEQR

SEQ ID NO: 1812925 - protein, 18 aa, Staphylococcus epidermidis
SNHKANGVFFSLDGKSVS

SEQ ID NO: 1812926 - protein, 22 aa, Staphylococcus epidermidis
SNIATNCYDTAEIIREINDADL

SEQ ID NO: 1812927 - protein, 18 aa, Staphylococcus epidermidis
SNIGKLYIDEQTFVPCTP

SEQ ID NO: 1812928 - protein, 19 aa, Staphylococcus epidermidis
SNIINCSRINLANRAYHEE

SEQ ID NO: 1812929 - protein, 18 aa, Staphylococcus epidermidis
SNILKRNANYIGIDNSIY

SEQ ID NO: 1812930 - protein, 18 aa, Staphylococcus epidermidis
SNISSQYSIYVSKIKNSI

SEQ ID NO: 1812931 - protein, 25 aa, Staphylococcus epidermidis
SNKPKPRYLIGFAAKPLVFLHAILP

SEQ ID NO: 1812932 - protein, 20 aa, Staphylococcus epidermidis
SNLIESRLDIVAFKEGQICI

SEQ ID NO: 1812933 - protein, 18 aa, Staphylococcus epidermidis
SNLSFELVGAVPVLIKRN

SEQ ID NO: 1812934 - protein, 26 aa, Staphylococcus epidermidis
SNLWQLAKDTYQEWYLGKELFNKVEE

SEQ ID NO: 1812935 - protein, 18 aa, Staphylococcus epidermidis
SNLYELAEYVQLSEEYIA

SEQ ID NO: 1812936 - protein, 19 aa, Staphylococcus epidermidis
SNNDWGCPITIRAPFGGGV

SEQ ID NO: 1812937 - protein, 23 aa, Staphylococcus epidermidis
SNNGRIIVISSIWGETGASMESI

SEQ ID NO: 1812938 - protein, 24 aa, Staphylococcus epidermidis
SNNGTCAFLHFSRTEGTQYPAIAV

SEQ ID NO: 1812939 - protein, 21 aa, Staphylococcus epidermidis
SNNKELIWKDLKLDKDKRKVT

SEQ ID NO: 1812940 - protein, 23 aa, Staphylococcus epidermidis
SNPDTKKVRGMERQLVVDFYADQ

SEQ ID NO: 1812941 - protein, 26 aa, Staphylococcus epidermidis
SNPLFKITDIRAVARIAKQNNLRLAV

SEQ ID NO: 1812942 - protein, 24 aa, Staphylococcus epidermidis
SNQALRLVLERAKTYSVPNHIIDR

SEQ ID NO: 1812943 - protein, 17 aa, Staphylococcus epidermidis
SNQLFKVQLTEEVLTKD

SEQ ID NO: 1812944 - protein, 18 aa, Staphylococcus epidermidis
SNRHLLEKDLLYLNKPDS

SEQ ID NO: 1812945 - protein, 23 aa, Staphylococcus epidermidis
SNSFNISTTVAFIVASAGVPVVK

SEQ ID NO: 1812946 - protein, 18 aa, Staphylococcus epidermidis
SNSGFKRKSDAKHHAEMV

SEQ ID NO: 1812947 - protein, 24 aa, Staphylococcus epidermidis
SNTLCIRPGVVVTYDRNYVSNELL

SEQ ID NO: 1812948 - protein, 23 aa, Staphylococcus epidermidis
SNTSSFSGIKCHTAKTSDNGLSQ

SEQ ID NO: 1812949 - protein, 37 aa, Staphylococcus epidermidis
SNVRSNCGIGFKGFWDNDAGFNYEFFHSVDPDLPKIV

SEQ ID NO: 1812950 - protein, 20 aa, Staphylococcus epidermidis
SNWLSMGPKVKEFESMWAKE

SEQ ID NO: 1812951 - protein, 26 aa, Staphylococcus epidermidis
SNYILKYVFANGISRDIIYPLLEEMN

SEQ ID NO: 1812952 - protein, 17 aa, Staphylococcus epidermidis
SNYKIKFDYDVIPEKSV

SEQ ID NO: 1812953 - protein, 19 aa, Staphylococcus epidermidis
SPDKSRLDGIGYMENYTHL

SEQ ID NO: 1812954 - protein, 20 aa, Staphylococcus epidermidis
SPDVYPGMEKQLLDTLDKHD

SEQ ID NO: 1812955 - protein, 17 aa, Staphylococcus epidermidis
SPEFTYLNHSFKSSEVP

SEQ ID NO: 1812956 - protein, 23 aa, Staphylococcus epidermidis
SPGKEIHPTYSLEEFVESLEKPR

SEQ ID NO: 1812957 - protein, 22 aa, Staphylococcus epidermidis
SPHPSPLSAFRGFFGSKPYSRT

SEQ ID NO: 1812958 - protein, 18 aa, Staphylococcus epidermidis
SPIDKRILDILKEKVNNN

SEQ ID NO: 1812959 - protein, 18 aa, Staphylococcus epidermidis
SPIIGRDIANWLISGIKP

SEQ ID NO: 1812960 - protein, 31 aa, Staphylococcus epidermidis
SPIKAARSGIVTFKGWTGGGNTLSIFDGKNT

SEQ ID NO: 1812961 - protein, 19 aa, Staphylococcus epidermidis
SPIPINYDLIPKCVYTNPE

SEQ ID NO: 1812962 - protein, 19 aa, Staphylococcus epidermidis
SPKLDDLFEKFAIEMGEDV

SEQ ID NO: 1812963 - protein, 27 aa, Staphylococcus epidermidis
SPLRLQKTLYFLFAYYGASYGQLSKSK

SEQ ID NO: 1812964 - protein, 26 aa, Staphylococcus epidermidis
SPMLLKNSRFGFKMGNQALEDSMVSD

SEQ ID NO: 1812965 - protein, 19 aa, Staphylococcus epidermidis
SPNHFHSGFELIYMLDGEM

SEQ ID NO: 1812966 - protein, 17 aa, Staphylococcus epidermidis
SPNRARISSTSGKIDKA

SEQ ID NO: 1812967 - protein, 25 aa, Staphylococcus epidermidis
SPRALEEVIYFASYVVVDPGPTGLE

SEQ ID NO: 1812968 - protein, 19 aa, Staphylococcus epidermidis
SPREYWRLQEMPDELYKHV

SEQ ID NO: 1812969 - protein, 24 aa, Staphylococcus epidermidis
SPSVKMIIVPGSMRVRKQAVEEGL

SEQ ID NO: 1812970 - protein, 24 aa, Staphylococcus epidermidis
SPVKADAISLCQKPHLGVPSEQEI

SEQ ID NO: 1812971 - protein, 19 aa, Staphylococcus epidermidis
SPYEKAWMVKVEMNDESQL

SEQ ID NO: 1812972 - protein, 19 aa, Staphylococcus epidermidis
SQEILLSFLERNHIQHRTN

SEQ ID NO: 1812973 - protein, 22 aa, Staphylococcus epidermidis
SQEKRWLSLHLQGYKQYEIAQI

SEQ ID NO: 1812974 - protein, 23 aa, Staphylococcus epidermidis
SQELEKLILFIGERPIINKDDID

SEQ ID NO: 1812975 - protein, 23 aa, Staphylococcus epidermidis
SQELEKLMLFLGDRPTINKDDVN

SEQ ID NO: 1812976 - protein, 24 aa, Staphylococcus epidermidis
SQFDNLKWLGLDWDESIDKDKGYG

SEQ ID NO: 1812977 - protein, 17 aa, Staphylococcus epidermidis
SQFNIHVTDEWIIQIAY

SEQ ID NO: 1812978 - protein, 23 aa, Staphylococcus epidermidis
SQFRLNDIGFIFQSSHLIPYLTV

SEQ ID NO: 1812979 - protein, 17 aa, Staphylococcus epidermidis
SQFSSYVEKKMIKAIKH

SEQ ID NO: 1812980 - protein, 25 aa, Staphylococcus epidermidis
SQGLLEGFKNLGFETYFAVPRSKEE

SEQ ID NO: 1812981 - protein, 20 aa, Staphylococcus epidermidis
SQHAGLSWLTILKKKDAYEE

SEQ ID NO: 1812982 - protein, 31 aa, Staphylococcus epidermidis
SQILGLQNPEIWDSRISKFGTPESQILDPND

SEQ ID NO: 1812983 - protein, 19 aa, Staphylococcus epidermidis
SQISFQIAFSGFDVALYET

SEQ ID NO: 1812984 - protein, 26 aa, Staphylococcus epidermidis
SQKLLTQVRFQIPYGKNIALVGANGV

SEQ ID NO: 1812985 - protein, 27 aa, Staphylococcus epidermidis
SQLEKRKAKELKLDHDVLDGSKALSEK

SEQ ID NO: 1812986 - protein, 18 aa, Staphylococcus epidermidis
SQLLHRSLKLAGYQHLTI

SEQ ID NO: 1812987 - protein, 25 aa, Staphylococcus epidermidis
SQLQLFSRLKLALTEENPSAPEFDQ

SEQ ID NO: 1812988 - protein, 26 aa, Staphylococcus epidermidis
SQNKLSFKYIDRILLNWKKNNVKTVD

SEQ ID NO: 1812989 - protein, 27 aa, Staphylococcus epidermidis
SQNKLSFKYIDRILLNWKKNNVKTVDD

SEQ ID NO: 1812990 - protein, 26 aa, Staphylococcus epidermidis
SQNLGLQNPEIWDSRNSKFGTPESQI

SEQ ID NO: 1812991 - protein, 27 aa, Staphylococcus epidermidis
SQQLIDWLKAQSRPFLFSTSLAPGDTK

SEQ ID NO: 1812992 - protein, 25 aa, Staphylococcus epidermidis
SQQTRLANMIQNFGILSLKDDYIEV

SEQ ID NO: 1812993 - protein, 27 aa, Staphylococcus epidermidis
SQREFKIYMLIVERFLESLMKPYEYEG

SEQ ID NO: 1812994 - protein, 17 aa, Staphylococcus epidermidis
SQRTVETLAEFSGVPVW

SEQ ID NO: 1812995 - protein, 23 aa, Staphylococcus epidermidis
SQSAKKRQEDVLSNQKNTDIAME

SEQ ID NO: 1812996 - protein, 27 aa, Staphylococcus epidermidis
SQSLTFAELERILGFSNGQIRRWEKTK

SEQ ID NO: 1812997 - protein, 17 aa, Staphylococcus epidermidis
SQVAEIINNAKQLDNAM

SEQ ID NO: 1812998 - protein, 19 aa, Staphylococcus epidermidis
SQVFNVYKLKEQAFEEFYP

SEQ ID NO: 1812999 - protein, 18 aa, Staphylococcus epidermidis
SQVRWMGVLDLEGKTPTS

SEQ ID NO: 1813000 - protein, 20 aa, Staphylococcus epidermidis
SQYARPKLANQLNKYNDVTK

SEQ ID NO: 1813001 - protein, 20 aa, Staphylococcus epidermidis
SQYFKRKYDFFYSEEEIIVT

SEQ ID NO: 1813002 - protein, 19 aa, Staphylococcus epidermidis
SQYHQCPVILGSATPSLES

SEQ ID NO: 1813003 - protein, 21 aa, Staphylococcus epidermidis
SRARLRLVDYRGKASASMIYD

SEQ ID NO: 1813004 - protein, 21 aa, Staphylococcus epidermidis
SRFGHSLGVYEIVRRMIDESF

SEQ ID NO: 1813005 - protein, 19 aa, Staphylococcus epidermidis
SRFKREFDLTKSFDTNPLF

SEQ ID NO: 1813006 - protein, 19 aa, Staphylococcus epidermidis
SRFNNWSLNINKINLSHAE

SEQ ID NO: 1813007 - protein, 24 aa, Staphylococcus epidermidis
SRGSLKIKSKDPFEKPSIVFNYLS

SEQ ID NO: 1813008 - protein, 18 aa, Staphylococcus epidermidis
SRGVIVLTDPDFPGDKIR

SEQ ID NO: 1813009 - protein, 23 aa, Staphylococcus epidermidis
SRIKSKLTPFSLEISKSSGREQH

SEQ ID NO: 1813010 - protein, 19 aa, Staphylococcus epidermidis
SRIPENAHWSAFGIGKMQL

SEQ ID NO: 1813011 - protein, 25 aa, Staphylococcus epidermidis
SRITCAIASCIFDYLNENNIHNYKD

SEQ ID NO: 1813012 - protein, 17 aa, Staphylococcus epidermidis
SRIYPVGRLDYDTSGVL

SEQ ID NO: 1813013 - protein, 19 aa, Staphylococcus epidermidis
SRKEIKAMTHKEVSDLISE

SEQ ID NO: 1813014 - protein, 18 aa, Staphylococcus epidermidis
SRKGLKEGDQGIDDLRNS

SEQ ID NO: 1813015 - protein, 17 aa, Staphylococcus epidermidis
SRKTFAIISHPDAGKTT

SEQ ID NO: 1813016 - protein, 22 aa, Staphylococcus epidermidis
SRLATEKHVDWIVEAVIKAKHQ

SEQ ID NO: 1813017 - protein, 19 aa, Staphylococcus epidermidis
SRLDIVAFKEGQICIPTIG

SEQ ID NO: 1813018 - protein, 21 aa, Staphylococcus epidermidis
SRLKDGILAIDLLRRPEMTYD

SEQ ID NO: 1813019 - protein, 19 aa, Staphylococcus epidermidis
SRLNFTIIKPSFFMDNFLR

SEQ ID NO: 1813020 - protein, 20 aa, Staphylococcus epidermidis
SRLPVPNVHKNKFVAPRNNI

SEQ ID NO: 1813021 - protein, 17 aa, Staphylococcus epidermidis
SRNDVAFVYPKGQSEPI

SEQ ID NO: 1813022 - protein, 24 aa, Staphylococcus epidermidis
SRNEGFGMVILEAMAQDNIVISFK

SEQ ID NO: 1813023 - protein, 17 aa, Staphylococcus epidermidis
SRPESEVNYIMNLPVNF

SEQ ID NO: 1813024 - protein, 28 aa, Staphylococcus epidermidis
SRPNGWFLHIPSCYLGIAQAARDYAVDF

SEQ ID NO: 1813025 - protein, 25 aa, Staphylococcus epidermidis
SRPVKIGLATLVDRGHRELPIRADF

SEQ ID NO: 1813026 - protein, 18 aa, Staphylococcus epidermidis
SRQFKETMGLKVNENATP

SEQ ID NO: 1813027 - protein, 24 aa, Staphylococcus epidermidis
SRQLSLFFKYELNHLLENYQITAI

SEQ ID NO: 1813028 - protein, 20 aa, Staphylococcus epidermidis
SRTLKFPSNLEVAKNILEDD

SEQ ID NO: 1813029 - protein, 19 aa, Staphylococcus epidermidis
SRTPMQWNDSMNGGFTKGT

SEQ ID NO: 1813030 - protein, 21 aa, Staphylococcus epidermidis
SRVKESPVHFECEYVQTVRIP

SEQ ID NO: 1813031 - protein, 18 aa, Staphylococcus epidermidis
SRVKPGAEGLIFHPYLAG

SEQ ID NO: 1813032 - protein, 23 aa, Staphylococcus epidermidis
SRVYLAVGGGFKLDNWLNSTSTD

SEQ ID NO: 1813033 - protein, 24 aa, Staphylococcus epidermidis
SRVYLAVGGGFKLEKWLHSASTDF

SEQ ID NO: 1813034 - protein, 17 aa, Staphylococcus epidermidis
SRYNCYYENIHINQNIF

SEQ ID NO: 1813035 - protein, 22 aa, Staphylococcus epidermidis
SRYQMYWQIYFHPVSRGGEVLL

SEQ ID NO: 1813036 - protein, 17 aa, Staphylococcus epidermidis
SRYYTNWDTIEKQVNHR

SEQ ID NO: 1813037 - protein, 17 aa, Staphylococcus epidermidis
SRYYTNWNTIEKQVNHR

SEQ ID NO: 1813038 - protein, 20 aa, Staphylococcus epidermidis
SSAEWEVMNIIWMKKYASAN

SEQ ID NO: 1813039 - protein, 20 aa, Staphylococcus epidermidis
SSALEAVIGFLYLDHQQTRL

SEQ ID NO: 1813040 - protein, 29 aa, Staphylococcus epidermidis
SSDDPKFKRWVIGSILSRTYYHNMVTHLL

SEQ ID NO: 1813041 - protein, 17 aa, Staphylococcus epidermidis
SSEILIKAAKIGVGIIL

SEQ ID NO: 1813042 - protein, 30 aa, Staphylococcus epidermidis
SSFKSYLFIRLKFYLIDLFRQKDTTLNICS

SEQ ID NO: 1813043 - protein, 20 aa, Staphylococcus epidermidis
SSFTAGIRSVENFKFEGDIT

SEQ ID NO: 1813044 - protein, 25 aa, Staphylococcus epidermidis
SSFVYRRKLPFNADRFKEWFDHLPS

SEQ ID NO: 1813045 - protein, 23 aa, Staphylococcus epidermidis
SSGLGKVKWPREFFIGTDGYVRE

SEQ ID NO: 1813046 - protein, 18 aa, Staphylococcus epidermidis
SSGTLTFEPGATVVNEIK

SEQ ID NO: 1813047 - protein, 18 aa, Staphylococcus epidermidis
SSHCDISKHIAHTMSDYY

SEQ ID NO: 1813048 - protein, 23 aa, Staphylococcus epidermidis
SSHGLTLGRLRGVEFDVAIFSNL

SEQ ID NO: 1813049 - protein, 22 aa, Staphylococcus epidermidis
SSHPILKKEIAPVTEFDENLSL

SEQ ID NO: 1813050 - protein, 26 aa, Staphylococcus epidermidis
SSHSFKFHGVVAMQLFLNDEFKLPSK

SEQ ID NO: 1813051 - protein, 25 aa, Staphylococcus epidermidis
SSHSSMPFLGENAIKPLLEFIQNID

SEQ ID NO: 1813052 - protein, 29 aa, Staphylococcus epidermidis
SSIGEYFGKTCLDFSFIDVTARHIVKLAA

SEQ ID NO: 1813053 - protein, 18 aa, Staphylococcus epidermidis
SSIKNKFPKGWKIVENKP

SEQ ID NO: 1813054 - protein, 25 aa, Staphylococcus epidermidis
SSIKPEYIKEFSIYRQAKRFEGKQY

SEQ ID NO: 1813055 - protein, 24 aa, Staphylococcus epidermidis
SSKAFIRFENFNELFQFVFNEYYD

SEQ ID NO: 1813056 - protein, 26 aa, Staphylococcus epidermidis
SSKDSICCVIDIPIHLYMRITGHHIL

SEQ ID NO: 1813057 - protein, 18 aa, Staphylococcus epidermidis
SSKFKRGLDEIVNDASKI

SEQ ID NO: 1813058 - protein, 26 aa, Staphylococcus epidermidis
SSKGKLTGNIYIEFAGYYEKDQKSNP

SEQ ID NO: 1813059 - protein, 23 aa, Staphylococcus epidermidis
SSKGLEFPFVIYSGLSKKYNESD

SEQ ID NO: 1813060 - protein, 18 aa, Staphylococcus epidermidis
SSKLWRQIVNDVKKDFPE

SEQ ID NO: 1813061 - protein, 21 aa, Staphylococcus epidermidis
SSLGLEPWHFVVVQSETLRDK

SEQ ID NO: 1813062 - protein, 23 aa, Staphylococcus epidermidis
SSMEGRKILILADVLELGTNSQQ

SEQ ID NO: 1813063 - protein, 18 aa, Staphylococcus epidermidis
SSMMVAHIMNLGRNDVVL

SEQ ID NO: 1813064 - protein, 27 aa, Staphylococcus epidermidis
SSNDPHIWLDPVLDRVFAKEIKDKLIQ

SEQ ID NO: 1813065 - protein, 19 aa, Staphylococcus epidermidis
SSNERWLRNAISKLIDDYS

SEQ ID NO: 1813066 - protein, 24 aa, Staphylococcus epidermidis
SSQFHILMGMGFKKYVDTLKISKS

SEQ ID NO: 1813067 - protein, 18 aa, Staphylococcus epidermidis
SSQGRKSTSTGFGSSVNS

SEQ ID NO: 1813068 - protein, 24 aa, Staphylococcus epidermidis
SSQLYDVHIGFWIDNLSRDVVEPV

SEQ ID NO: 1813069 - protein, 20 aa, Staphylococcus epidermidis
SSQVRWMGVLDLEGKTPASL

SEQ ID NO: 1813070 - protein, 25 aa, Staphylococcus epidermidis
SSRREAIKGKIDWQDTLPDAHFSKI

SEQ ID NO: 1813071 - protein, 18 aa, Staphylococcus epidermidis
SSSGTESGLRIDLSQNFR

SEQ ID NO: 1813072 - protein, 18 aa, Staphylococcus epidermidis
SSSIVFLIDYYIKNENKK

SEQ ID NO: 1813073 - protein, 19 aa, Staphylococcus epidermidis
SSSIVFLIDYYIKNENKKE

SEQ ID NO: 1813074 - protein, 24 aa, Staphylococcus epidermidis
SSTLRPSDFEAYTGRPKKFAALHF

SEQ ID NO: 1813075 - protein, 21 aa, Staphylococcus epidermidis
SSTLSSFSNWVGIRNKTTSYL

SEQ ID NO: 1813076 - protein, 24 aa, Staphylococcus epidermidis
SSTSGKIDKARFVHKTSEELIKWQ

SEQ ID NO: 1813077 - protein, 26 aa, Staphylococcus epidermidis
SSVELYKILSRFGFNRETKLRFPNLL

SEQ ID NO: 1813078 - protein, 17 aa, Staphylococcus epidermidis
SSYIRIAIKDNNEALNF

SEQ ID NO: 1813079 - protein, 26 aa, Staphylococcus epidermidis
STDFIDVGAIILMDYEIDSVDSMIEK

SEQ ID NO: 1813080 - protein, 22 aa, Staphylococcus epidermidis
STFVKDLFEKVIRHVGEDYLTV

SEQ ID NO: 1813081 - protein, 26 aa, Staphylococcus epidermidis
STHSFRHTHCALLIEAGVHIKEIQER

SEQ ID NO: 1813082 - protein, 22 aa, Staphylococcus epidermidis
STIASKSKHIFGSVKTWFGKTS

SEQ ID NO: 1813083 - protein, 21 aa, Staphylococcus epidermidis
STIPVKGVRKAIAQNMVTSVT

SEQ ID NO: 1813084 - protein, 22 aa, Staphylococcus epidermidis
STLEYRMIEALVQHAKKVTVLL

SEQ ID NO: 1813085 - protein, 19 aa, Staphylococcus epidermidis
STLGYEKINNWAFNETDET

SEQ ID NO: 1813086 - protein, 18 aa, Staphylococcus epidermidis
STLKWIKNHQSFNFPKFI

SEQ ID NO: 1813087 - protein, 17 aa, Staphylococcus epidermidis
STLRSWKTDQADAHKLA

SEQ ID NO: 1813088 - protein, 22 aa, Staphylococcus epidermidis
STMIRQHLNPVIFVINNDGYTV

SEQ ID NO: 1813089 - protein, 24 aa, Staphylococcus epidermidis
STPSFIEMCLLLPNLNEEQYGSLN

SEQ ID NO: 1813090 - protein, 26 aa, Staphylococcus epidermidis
STQAKVWNFFKSKGLSDHAVAGIMGN

SEQ ID NO: 1813091 - protein, 23 aa, Staphylococcus epidermidis
STQKLCRDLLDLIGHSSQPEEIY

SEQ ID NO: 1813092 - protein, 19 aa, Staphylococcus epidermidis
STSPGFTYLNHGFKSSEVP

SEQ ID NO: 1813093 - protein, 22 aa, Staphylococcus epidermidis
STSQVAKAFGLPVSKLGIETVN

SEQ ID NO: 1813094 - protein, 19 aa, Staphylococcus epidermidis
STTMRVDSSIKKRLGQMAL

SEQ ID NO: 1813095 - protein, 34 aa, Staphylococcus epidermidis
STVIYQKRFYKSWSKWERVGSDVVDTGWIDLQLV

SEQ ID NO: 1813096 - protein, 29 aa, Staphylococcus epidermidis
STVIYQKRFYKTWSGWERVGSDVVDTGWI

SEQ ID NO: 1813097 - protein, 22 aa, Staphylococcus epidermidis
STVPRPIGWISTVSKDGKDNLA

SEQ ID NO: 1813098 - protein, 24 aa, Staphylococcus epidermidis
STVSELLTAYGFRIVDADIASREA

SEQ ID NO: 1813099 - protein, 22 aa, Staphylococcus epidermidis
STYKIYFGFANRTAYEDFKASN

SEQ ID NO: 1813100 - protein, 19 aa, Staphylococcus epidermidis
STYYGHIWLVDKGATQMTM

SEQ ID NO: 1813101 - protein, 27 aa, Staphylococcus epidermidis
SVDADIFAPCALGGILNDDTIPQLKVK

SEQ ID NO: 1813102 - protein, 17 aa, Staphylococcus epidermidis
SVDLPFAQKRWCASNGL

SEQ ID NO: 1813103 - protein, 26 aa, Staphylococcus epidermidis
SVEAGKFADLVMWEPAFFGVKPELIV

SEQ ID NO: 1813104 - protein, 17 aa, Staphylococcus epidermidis
SVEDVPKVFDIERNSFS

SEQ ID NO: 1813105 - protein, 18 aa, Staphylococcus epidermidis
SVEEFSPSIAREIYEMYE

SEQ ID NO: 1813106 - protein, 30 aa, Staphylococcus epidermidis
SVEKDIYSQMAWDGFQPFKIEKINQISSDI

SEQ ID NO: 1813107 - protein, 19 aa, Staphylococcus epidermidis
SVFDMLEIVENITLESVNE

SEQ ID NO: 1813108 - protein, 17 aa, Staphylococcus epidermidis
SVFKEEIFGPVLAIATY

SEQ ID NO: 1813109 - protein, 22 aa, Staphylococcus epidermidis
SVFPELNHLIGHTLMVTDGTSL

SEQ ID NO: 1813110 - protein, 22 aa, Staphylococcus epidermidis
SVGNLYGIMVFEGSMTLDEMRQ

SEQ ID NO: 1813111 - protein, 17 aa, Staphylococcus epidermidis
SVGPGQLFKDLIDSKTI

SEQ ID NO: 1813112 - protein, 29 aa, Staphylococcus epidermidis
SVGTTKKGLNWLFNHACERIPELKHSRIL

SEQ ID NO: 1813113 - protein, 25 aa, Staphylococcus epidermidis
SVIELTEGTGIFVTVLRSFSHFSHQ

SEQ ID NO: 1813114 - protein, 23 aa, Staphylococcus epidermidis
SVIHIRKRYSLLLNISYKDITKL

SEQ ID NO: 1813115 - protein, 18 aa, Staphylococcus epidermidis
SVIQKICNRVAVMENGEV

SEQ ID NO: 1813116 - protein, 27 aa, Staphylococcus epidermidis
SVKAQPPFFYPLDKLISISTMIEEAGY

SEQ ID NO: 1813117 - protein, 22 aa, Staphylococcus epidermidis
SVKDLPDYIQIWPGHGAGSPCG

SEQ ID NO: 1813118 - protein, 20 aa, Staphylococcus epidermidis
SVLNLRTLKLVIADFKNLYD

SEQ ID NO: 1813119 - protein, 17 aa, Staphylococcus epidermidis
SVLSYVLDKIMKMLHPF

SEQ ID NO: 1813120 - protein, 24 aa, Staphylococcus epidermidis
SVLTGRLSGNIGYVASKVAQEARP

SEQ ID NO: 1813121 - protein, 17 aa, Staphylococcus epidermidis
SVMKGRKILILADVLEL

SEQ ID NO: 1813122 - protein, 21 aa, Staphylococcus epidermidis
SVMPGFDFYFIPTVMNSNDTR

SEQ ID NO: 1813123 - protein, 25 aa, Staphylococcus epidermidis
SVNIEPKLDMSLRLSQLPNDIRNIL

SEQ ID NO: 1813124 - protein, 17 aa, Staphylococcus epidermidis
SVNLARFDGIRYGYHSK

SEQ ID NO: 1813125 - protein, 18 aa, Staphylococcus epidermidis
SVNQFCFDEQFIKKTISI

SEQ ID NO: 1813126 - protein, 23 aa, Staphylococcus epidermidis
SVPTEVIAALGISNGDNLKFNVK

SEQ ID NO: 1813127 - protein, 20 aa, Staphylococcus epidermidis
SVSKAFRKAKEVIGLNDNNI

SEQ ID NO: 1813128 - protein, 17 aa, Staphylococcus epidermidis
SVTCPPDIFTKLLQTIA

SEQ ID NO: 1813129 - protein, 23 aa, Staphylococcus epidermidis
SVTEIPHGWMMIEADATNLVKTR

SEQ ID NO: 1813130 - protein, 17 aa, Staphylococcus epidermidis
SVTGISFSNNFGPKSKD

SEQ ID NO: 1813131 - protein, 17 aa, Staphylococcus epidermidis
SWETMLKEAHFNPLVML

SEQ ID NO: 1813132 - protein, 18 aa, Staphylococcus epidermidis
SWFKKGNKLIFSGFRRGG

SEQ ID NO: 1813133 - protein, 20 aa, Staphylococcus epidermidis
SWMQIMLKFYQLCPRTLEKF

SEQ ID NO: 1813134 - protein, 17 aa, Staphylococcus epidermidis
SWNGLIINYLSRCESHS

SEQ ID NO: 1813135 - protein, 18 aa, Staphylococcus epidermidis
SYAMPILLALSHVHQLLI

SEQ ID NO: 1813136 - protein, 25 aa, Staphylococcus epidermidis
SYCGPGRRKTFAFVNNRPLAALTED

SEQ ID NO: 1813137 - protein, 24 aa, Staphylococcus epidermidis
SYDRLEGFNSLQWPVDKDGKDTPL

SEQ ID NO: 1813138 - protein, 24 aa, Staphylococcus epidermidis
SYDRLEGFNSLQWPVNKDGKDTPI

SEQ ID NO: 1813139 - protein, 22 aa, Staphylococcus epidermidis
SYDVAYRMLHQLDLTAQDIGSV

SEQ ID NO: 1813140 - protein, 27 aa, Staphylococcus epidermidis
SYDVIPKFEVGGAYTPIEIVNENGYSL

SEQ ID NO: 1813141 - protein, 23 aa, Staphylococcus epidermidis
SYEALVKIFYRYGEEKFSKQIAR

SEQ ID NO: 1813142 - protein, 17 aa, Staphylococcus epidermidis
SYEKMDWFRRGFSDMGK

SEQ ID NO: 1813143 - protein, 23 aa, Staphylococcus epidermidis
SYFKNVHIYEVTWGEAVKVDEFI

SEQ ID NO: 1813144 - protein, 21 aa, Staphylococcus epidermidis
SYGKKSWFHPAPHCIVKDVTF

SEQ ID NO: 1813145 - protein, 26 aa, Staphylococcus epidermidis
SYGLIPEFIGRVPIVANLETLDIAAL

SEQ ID NO: 1813146 - protein, 33 aa, Staphylococcus epidermidis
SYGRTFKATEEMRIAILPIGYADGYLRAMQGAY

SEQ ID NO: 1813147 - protein, 18 aa, Staphylococcus epidermidis
SYHPDYAIMTNIDFDHPD

SEQ ID NO: 1813148 - protein, 21 aa, Staphylococcus epidermidis
SYIEDFSYFMSPFKRDNNRNV

SEQ ID NO: 1813149 - protein, 19 aa, Staphylococcus epidermidis
SYIEGLSILGGEPFCNLSI

SEQ ID NO: 1813150 - protein, 22 aa, Staphylococcus epidermidis
SYISSYFIPYVSWSIKKAIKEN

SEQ ID NO: 1813151 - protein, 29 aa, Staphylococcus epidermidis
SYKDRNRVSSLMFRYEVYEDYETVGDASE

SEQ ID NO: 1813152 - protein, 21 aa, Staphylococcus epidermidis
SYKKKHIFDSLDMQFQPHKIT

SEQ ID NO: 1813153 - protein, 31 aa, Staphylococcus epidermidis
SYKMPKKMRRLALRSALSFKVQEKGFTVVDT

SEQ ID NO: 1813154 - protein, 19 aa, Staphylococcus epidermidis
SYLAIFILIVAGGRFVEVQ

SEQ ID NO: 1813155 - protein, 23 aa, Staphylococcus epidermidis
SYLHKFCNPSELIIDTEIDIPEK

SEQ ID NO: 1813156 - protein, 21 aa, Staphylococcus epidermidis
SYLKVHYPHYFYANILSNVIG

SEQ ID NO: 1813157 - protein, 24 aa, Staphylococcus epidermidis
SYLNFNVNKWKRYAASSRKDPNIT

SEQ ID NO: 1813158 - protein, 20 aa, Staphylococcus epidermidis
SYLSVPRGDTGYFFNTAYLP

SEQ ID NO: 1813159 - protein, 21 aa, Staphylococcus epidermidis
SYLVGCQRTGEAIIIDPVRDL

SEQ ID NO: 1813160 - protein, 20 aa, Staphylococcus epidermidis
SYMCMAAAMGEEVTLNNIVP

SEQ ID NO: 1813161 - protein, 23 aa, Staphylococcus epidermidis
SYMDFTDIIPISALEGMNVDHFI

SEQ ID NO: 1813162 - protein, 24 aa, Staphylococcus epidermidis
SYQGLPSRIAWLGYGERAKMGLAL

SEQ ID NO: 1813163 - protein, 23 aa, Staphylococcus epidermidis
SYRRGEAVFELPDDIEVESAIKA

SEQ ID NO: 1813164 - protein, 33 aa, Staphylococcus epidermidis
SYTELYKTLPFDFLSDVVYQWERFANKFKDFGT

SEQ ID NO: 1813165 - protein, 25 aa, Staphylococcus epidermidis
SYTEWIKFYLSEMGVEIKEVIFNTL

SEQ ID NO: 1813166 - protein, 26 aa, Staphylococcus epidermidis
SYTFKSTRLESSVYFPPYKGKFKYIK

SEQ ID NO: 1813167 - protein, 25 aa, Staphylococcus epidermidis
SYVALEQEYAWAFLNELFYLIELYL

SEQ ID NO: 1813168 - protein, 25 aa, Staphylococcus epidermidis
SYVSKYYKGCLEFQKNQPLASYMVD

SEQ ID NO: 1813169 - protein, 18 aa, Staphylococcus epidermidis
SYYDYILEIYDYVHQILP

SEQ ID NO: 1813170 - protein, 19 aa, Staphylococcus epidermidis
SYYEGYRLGSDDLTIGEIV

SEQ ID NO: 1813171 - protein, 18 aa, Staphylococcus epidermidis
TAAARAFVHKPTIIFADE

SEQ ID NO: 1813172 - protein, 23 aa, Staphylococcus epidermidis
TAALHLACLCCEFTYGDEVIVPA

SEQ ID NO: 1813173 - protein, 25 aa, Staphylococcus epidermidis
TADHKPVVYCLDKIAKQYLTCLDYQ

SEQ ID NO: 1813174 - protein, 23 aa, Staphylococcus epidermidis
TADLTIGLILSVARRIVEGDELS

SEQ ID NO: 1813175 - protein, 19 aa, Staphylococcus epidermidis
TADVALREQVAFRDDALRL

SEQ ID NO: 1813176 - protein, 24 aa, Staphylococcus epidermidis
TAEKIKHQYGHAFYDSASEQDVFS

SEQ ID NO: 1813177 - protein, 17 aa, Staphylococcus epidermidis
TAELPRDEVQTVSTKTP

SEQ ID NO: 1813178 - protein, 21 aa, Staphylococcus epidermidis
TAEWCPDCKVIEPDLPKLEKK

SEQ ID NO: 1813179 - protein, 22 aa, Staphylococcus epidermidis
TAFAYKAAHPDIYVSMSTHDVE

SEQ ID NO: 1813180 - protein, 27 aa, Staphylococcus epidermidis
TAFDGRGNYTLGIKEQLIFPEIDYDKV

SEQ ID NO: 1813181 - protein, 27 aa, Staphylococcus epidermidis
TAFEQFALAVGETFAKSGMLDGIRMVT

SEQ ID NO: 1813182 - protein, 17 aa, Staphylococcus epidermidis
TAGDCLSDLGFKGALPE

SEQ ID NO: 1813183 - protein, 18 aa, Staphylococcus epidermidis
TAGFDMYDLDLAKKHGIV

SEQ ID NO: 1813184 - protein, 18 aa, Staphylococcus epidermidis
TAGFDMYDLELAKKHGII

SEQ ID NO: 1813185 - protein, 18 aa, Staphylococcus epidermidis
TAGPLYYRAEPVGCSATI

SEQ ID NO: 1813186 - protein, 18 aa, Staphylococcus epidermidis
TAGQCTWYAFDKRAQDGH

SEQ ID NO: 1813187 - protein, 18 aa, Staphylococcus epidermidis
TAIEDIIFAPTIDYKCVT

SEQ ID NO: 1813188 - protein, 18 aa, Staphylococcus epidermidis
TAIIACINRLLKTIHYLV

SEQ ID NO: 1813189 - protein, 28 aa, Staphylococcus epidermidis
TAINAKLGLGIGVLTGIAKREELHEADV

SEQ ID NO: 1813190 - protein, 18 aa, Staphylococcus epidermidis
TAKLMIKAFEKFENLPLD

SEQ ID NO: 1813191 - protein, 23 aa, Staphylococcus epidermidis
TAKRYGLRSGVGLAAPQINEPKR

SEQ ID NO: 1813192 - protein, 18 aa, Staphylococcus epidermidis
TALMLFVTRCKAMADKGE

SEQ ID NO: 1813193 - protein, 21 aa, Staphylococcus epidermidis
TALSAHDSWALAKHLKTLPVR

SEQ ID NO: 1813194 - protein, 17 aa, Staphylococcus epidermidis
TALSIGWHLSVIGQLYE

SEQ ID NO: 1813195 - protein, 29 aa, Staphylococcus epidermidis
TAMKLEGLVTRRGIHAGGVIIFNDEAYKN

SEQ ID NO: 1813196 - protein, 24 aa, Staphylococcus epidermidis
TAMYISRLVKPIGIKVTRLAQGLS

SEQ ID NO: 1813197 - protein, 21 aa, Staphylococcus epidermidis
TANALKLKKFFNSSVPVHRGA

SEQ ID NO: 1813198 - protein, 24 aa, Staphylococcus epidermidis
TANALKLKRFFNSDVPVHRGASRP

SEQ ID NO: 1813199 - protein, 17 aa, Staphylococcus epidermidis
TAQRADTFLPYMKDALK

SEQ ID NO: 1813200 - protein, 31 aa, Staphylococcus epidermidis
TARIDEYVVLRFGWLYGPGTWYGKDGMIYNQ

SEQ ID NO: 1813201 - protein, 25 aa, Staphylococcus epidermidis
TASERLKFGEVYANCEAEEVVNGYH

SEQ ID NO: 1813202 - protein, 21 aa, Staphylococcus epidermidis
TASLCKINLLTGRTHQIRVHF

SEQ ID NO: 1813203 - protein, 20 aa, Staphylococcus epidermidis
TASNYFFWYSVPTSTEGTMF

SEQ ID NO: 1813204 - protein, 20 aa, Staphylococcus epidermidis
TAVQYDLPMTIFVLNNKQLS

SEQ ID NO: 1813205 - protein, 25 aa, Staphylococcus epidermidis
TCGCAAGLARPAAVAVAEQNEAKPT

SEQ ID NO: 1813206 - protein, 25 aa, Staphylococcus epidermidis
TCHNEELKESYGIAPEEKVLIHVSN

SEQ ID NO: 1813207 - protein, 25 aa, Staphylococcus epidermidis
TCMPCKNLKGILPVMNFEFEYKDVF

SEQ ID NO: 1813208 - protein, 17 aa, Staphylococcus epidermidis
TCNKIAILDKGSLVYKG

SEQ ID NO: 1813209 - protein, 21 aa, Staphylococcus epidermidis
TCTTEACEFRDHIEDFNQLDV

SEQ ID NO: 1813210 - protein, 24 aa, Staphylococcus epidermidis
TDAIKRQAEKFVHYTPAYMYHEPL

SEQ ID NO: 1813211 - protein, 23 aa, Staphylococcus epidermidis
TDDARLTIEVMKKAAEKGAEIIN

SEQ ID NO: 1813212 - protein, 23 aa, Staphylococcus epidermidis
TDDARLTIEVMKKAAENGAEIIN

SEQ ID NO: 1813213 - protein, 27 aa, Staphylococcus epidermidis
TDDRIDFFPGRFENTFNRWMEEIRDWT

SEQ ID NO: 1813214 - protein, 18 aa, Staphylococcus epidermidis
TDEGFSLDDFKRVIDNKV

SEQ ID NO: 1813215 - protein, 24 aa, Staphylococcus epidermidis
TDEKYFGGSFERLTELTIETKLPV

SEQ ID NO: 1813216 - protein, 17 aa, Staphylococcus epidermidis
TDELFADFREFGNKNLY

SEQ ID NO: 1813217 - protein, 42 aa, Staphylococcus epidermidis
TDFKELPVDPVVADVFKFKGREMPKYEIVNIAGTVIAKNAPK

SEQ ID NO: 1813218 - protein, 23 aa, Staphylococcus epidermidis
TDFNLGPEPEFFLFKLDEKGEPT

SEQ ID NO: 1813219 - protein, 25 aa, Staphylococcus epidermidis
TDFNRPGHLFPLIAKDNGVLERNGH

SEQ ID NO: 1813220 - protein, 21 aa, Staphylococcus epidermidis
TDFPYTIRIVSEVLESNGSSS

SEQ ID NO: 1813221 - protein, 25 aa, Staphylococcus epidermidis
TDFQARRANIRFKRDAASKPELVHT

SEQ ID NO: 1813222 - protein, 24 aa, Staphylococcus epidermidis
TDFQARRANIRFKRDNSAKPELAH

SEQ ID NO: 1813223 - protein, 30 aa, Staphylococcus epidermidis
TDGRFLNVGENLWGLRDWYSVDDIEEKIAP

SEQ ID NO: 1813224 - protein, 31 aa, Staphylococcus epidermidis
TDIEYKFPFGWGELWGIASRTDFDLRQHSEH

SEQ ID NO: 1813225 - protein, 19 aa, Staphylococcus epidermidis
TDIKVVLNGAGAAGIAIVK

SEQ ID NO: 1813226 - protein, 17 aa, Staphylococcus epidermidis
TDILRKRMAELNEVNPM

SEQ ID NO: 1813227 - protein, 19 aa, Staphylococcus epidermidis
TDIRIAFSCVEKEDIPHVF

SEQ ID NO: 1813228 - protein, 19 aa, Staphylococcus epidermidis
TDIYKGLRIAGCTMTSKPN

SEQ ID NO: 1813229 - protein, 17 aa, Staphylococcus epidermidis
TDKGQFTERIFGLENRQ

SEQ ID NO: 1813230 - protein, 33 aa, Staphylococcus epidermidis
TDKRVSPDLFVKRTHFYDFLLLNSDGLTDYVRD

SEQ ID NO: 1813231 - protein, 23 aa, Staphylococcus epidermidis
TDLAINRWYNWETEQWEDKGKAE

SEQ ID NO: 1813232 - protein, 23 aa, Staphylococcus epidermidis
TDLKSEIVEYPWIQHIHTLIKMC

SEQ ID NO: 1813233 - protein, 22 aa, Staphylococcus epidermidis
TDLKVPYICLNGAEVRDETFNI

SEQ ID NO: 1813234 - protein, 19 aa, Staphylococcus epidermidis
TDLQMQLFFERSEQDEKNE

SEQ ID NO: 1813235 - protein, 17 aa, Staphylococcus epidermidis
TDLYKGDYETLVDSIKD

SEQ ID NO: 1813236 - protein, 17 aa, Staphylococcus epidermidis
TDMPHMVIYTFNEPQNW

SEQ ID NO: 1813237 - protein, 21 aa, Staphylococcus epidermidis
TDMTPRLDLFSSDGSIFTNEP

SEQ ID NO: 1813238 - protein, 22 aa, Staphylococcus epidermidis
TDMTPRLDLFSSDGSIFTNEPL

SEQ ID NO: 1813239 - protein, 17 aa, Staphylococcus epidermidis
TDNFSIIDCCLYNDKKD

SEQ ID NO: 1813240 - protein, 25 aa, Staphylococcus epidermidis
TDPATLPEASWRGTKSKKHNNIINY

SEQ ID NO: 1813241 - protein, 23 aa, Staphylococcus epidermidis
TDPEYWKKLFKRYEDWINNFNAC

SEQ ID NO: 1813242 - protein, 18 aa, Staphylococcus epidermidis
TDPKTGTTTTAFLNKDTG

SEQ ID NO: 1813243 - protein, 19 aa, Staphylococcus epidermidis
TDPMKFLPEDGSLELTSGW

SEQ ID NO: 1813244 - protein, 25 aa, Staphylococcus epidermidis
TDQEWRDVRYLYDYSEEELADLARK

SEQ ID NO: 1813245 - protein, 18 aa, Staphylococcus epidermidis
TDQLPRIDYFVAGVGSGG

SEQ ID NO: 1813246 - protein, 19 aa, Staphylococcus epidermidis
TDRGLLVPVVKHADRKSIF

SEQ ID NO: 1813247 - protein, 27 aa, Staphylococcus epidermidis
TDRPSFTRFDFKLTGEEWKKFKANCHS

SEQ ID NO: 1813248 - protein, 21 aa, Staphylococcus epidermidis
TDRVFLFAPFYTEEVEKDVQR

SEQ ID NO: 1813249 - protein, 25 aa, Staphylococcus epidermidis
TDSELKRFKGVYELLYEEELGLQAT

SEQ ID NO: 1813250 - protein, 18 aa, Staphylococcus epidermidis
TDSGLRIDLSQNFRSRQE

SEQ ID NO: 1813251 - protein, 29 aa, Staphylococcus epidermidis
TDTGFKIATLVREYISAIVNIRINDMYFA

SEQ ID NO: 1813252 - protein, 20 aa, Staphylococcus epidermidis
TDTKLLTWVTMNLKDNLNIS

SEQ ID NO: 1813253 - protein, 19 aa, Staphylococcus epidermidis
TDVITRTSYLLAESVYEFS

SEQ ID NO: 1813254 - protein, 18 aa, Staphylococcus epidermidis
TDVLFKYVENIMNNKKSE

SEQ ID NO: 1813255 - protein, 19 aa, Staphylococcus epidermidis
TDVPLDLYLSVLGMPGQTA

SEQ ID NO: 1813256 - protein, 20 aa, Staphylococcus epidermidis
TDWARLTARLAESFVNDIAQ

SEQ ID NO: 1813257 - protein, 17 aa, Staphylococcus epidermidis
TDYKLKSSYMDKQLILE

SEQ ID NO: 1813258 - protein, 18 aa, Staphylococcus epidermidis
TDYKSINVLIYFKDITEP

SEQ ID NO: 1813259 - protein, 18 aa, Staphylococcus epidermidis
TDYSSIFFDYLVTNKPII

SEQ ID NO: 1813260 - protein, 18 aa, Staphylococcus epidermidis
TDYVLSYDVIPKFEVGGA

SEQ ID NO: 1813261 - protein, 26 aa, Staphylococcus epidermidis
TEAEKARLRVQLDMLDRESMDIEERY

SEQ ID NO: 1813262 - protein, 17 aa, Staphylococcus epidermidis
TEAELLTGISINNESDM

SEQ ID NO: 1813263 - protein, 22 aa, Staphylococcus epidermidis
TEAKAYRLGEISAETQFALDHF

SEQ ID NO: 1813264 - protein, 25 aa, Staphylococcus epidermidis
TEAKAYRLGEISAETQFALDHFNVE

SEQ ID NO: 1813265 - protein, 22 aa, Staphylococcus epidermidis
TEAKAYRLGEVSAETQYALDYF

SEQ ID NO: 1813266 - protein, 25 aa, Staphylococcus epidermidis
TEAKRKGLEDLADWFSQSKLDSKIE

SEQ ID NO: 1813267 - protein, 27 aa, Staphylococcus epidermidis
TEAKRKGLEPLAQWLIQGKLDKKIEDK

SEQ ID NO: 1813268 - protein, 18 aa, Staphylococcus epidermidis
TEANFELKEENSTAFHQK

SEQ ID NO: 1813269 - protein, 23 aa, Staphylococcus epidermidis
TEAQWDAMLLGWKVVSSVKSNAV

SEQ ID NO: 1813270 - protein, 17 aa, Staphylococcus epidermidis
TEAWLKLLDETSPIDML

SEQ ID NO: 1813271 - protein, 21 aa, Staphylococcus epidermidis
TEDVYDFWRPTGHKYPLVAGA

SEQ ID NO: 1813272 - protein, 20 aa, Staphylococcus epidermidis
TEEAIKHLIFDALDATMEVL

SEQ ID NO: 1813273 - protein, 27 aa, Staphylococcus epidermidis
TEEFFARSRFDLMPNKIEPFTAENLEK

SEQ ID NO: 1813274 - protein, 18 aa, Staphylococcus epidermidis
TEEIMPIYDAAMKYKEDG

SEQ ID NO: 1813275 - protein, 21 aa, Staphylococcus epidermidis
TEEMPALGFAPDAEFPAIHGE

SEQ ID NO: 1813276 - protein, 23 aa, Staphylococcus epidermidis
TEEPLKFKVRLLFDEHKFTLNNI

SEQ ID NO: 1813277 - protein, 18 aa, Staphylococcus epidermidis
TEEVDGYNAIQVGFEDKQ

SEQ ID NO: 1813278 - protein, 17 aa, Staphylococcus epidermidis
TEFKVSKDIASWKTLSD

SEQ ID NO: 1813279 - protein, 20 aa, Staphylococcus epidermidis
TEGARGYIVFGHPLKIDKVA

SEQ ID NO: 1813280 - protein, 22 aa, Staphylococcus epidermidis
TEGCICCAMKSDVSQQLHELYL

SEQ ID NO: 1813281 - protein, 23 aa, Staphylococcus epidermidis
TEGHAGQSLAAYAPRGLTIHHTG

SEQ ID NO: 1813282 - protein, 25 aa, Staphylococcus epidermidis
TEHFGISVMVGFGYRAEEPAHGKVR

SEQ ID NO: 1813283 - protein, 24 aa, Staphylococcus epidermidis
TEHFREIGYNIFRVRYIDKEEDYV

SEQ ID NO: 1813284 - protein, 22 aa, Staphylococcus epidermidis
TEHSIAMILAMARNIPQAHQSL

SEQ ID NO: 1813285 - protein, 17 aa, Staphylococcus epidermidis
TEIEGHPEFSGKTIVLT

SEQ ID NO: 1813286 - protein, 23 aa, Staphylococcus epidermidis
TEIEIIKTVLLKAKTSFNNTIDS

SEQ ID NO: 1813287 - protein, 22 aa, Staphylococcus epidermidis
TEIEVSKPFKAEVEPQKDVQSY

SEQ ID NO: 1813288 - protein, 29 aa, Staphylococcus epidermidis
TEIKMPLLSPEKFERSWHKLIQNHDILQT

SEQ ID NO: 1813289 - protein, 27 aa, Staphylococcus epidermidis
TEINEALKYVVECGANVVGLNCHHGPH

SEQ ID NO: 1813290 - protein, 21 aa, Staphylococcus epidermidis
TEIPRVINAAIQQRRPVHIHL

SEQ ID NO: 1813291 - protein, 23 aa, Staphylococcus epidermidis
TEITHDWLNFGYEFVSSRSVSIP

SEQ ID NO: 1813292 - protein, 21 aa, Staphylococcus epidermidis
TEIYDYIRLLYARVGKPYCPY

SEQ ID NO: 1813293 - protein, 17 aa, Staphylococcus epidermidis
TEIYFKDDAYKLAIGTP

SEQ ID NO: 1813294 - protein, 20 aa, Staphylococcus epidermidis
TEIYSMMLGALRLLINGSDF

SEQ ID NO: 1813295 - protein, 31 aa, Staphylococcus epidermidis
TEKALSVKVFYCLKGKCEITINVQKHTLKKD

SEQ ID NO: 1813296 - protein, 25 aa, Staphylococcus epidermidis
TEKDLKRTPSFSVNRPGEETGITFA

SEQ ID NO: 1813297 - protein, 25 aa, Staphylococcus epidermidis
TEKFKTTMVTFKFMAPLDYETITSR

SEQ ID NO: 1813298 - protein, 21 aa, Staphylococcus epidermidis
TEKKGPSVLGVIEYNVQGQTK

SEQ ID NO: 1813299 - protein, 26 aa, Staphylococcus epidermidis
TEKVNHIFEVLGISLFECYDMTEKLY

SEQ ID NO: 1813300 - protein, 21 aa, Staphylococcus epidermidis
TEKWYFPLQSFQKFIVPFVFL

SEQ ID NO: 1813301 - protein, 23 aa, Staphylococcus epidermidis
TEKYSVLRALKAIERSNVVLVVI

SEQ ID NO: 1813302 - protein, 20 aa, Staphylococcus epidermidis
TELDTYYLLNRAIASNADIP

SEQ ID NO: 1813303 - protein, 23 aa, Staphylococcus epidermidis
TELEIKFSKKLREAVPSLEKIRF

SEQ ID NO: 1813304 - protein, 24 aa, Staphylococcus epidermidis
TELPQNITICSGLIKADKYEWMIQ

SEQ ID NO: 1813305 - protein, 23 aa, Staphylococcus epidermidis
TELQHAREALHGEQKLQEAKDQA

SEQ ID NO: 1813306 - protein, 19 aa, Staphylococcus epidermidis
TELTKALADKGNYDYYSFE

SEQ ID NO: 1813307 - protein, 22 aa, Staphylococcus epidermidis
TELYVKPILELKKHINIKAMNH

SEQ ID NO: 1813308 - protein, 23 aa, Staphylococcus epidermidis
TEMIKYKVPRAFVEISPELAQSR

SEQ ID NO: 1813309 - protein, 20 aa, Staphylococcus epidermidis
TEMRTALETLRKVIHIQPTS

SEQ ID NO: 1813310 - protein, 25 aa, Staphylococcus epidermidis
TENINAIELFKGMDFQIEGELKDKL

SEQ ID NO: 1813311 - protein, 20 aa, Staphylococcus epidermidis
TERRIYITAPYPSNHGEGYP

SEQ ID NO: 1813312 - protein, 19 aa, Staphylococcus epidermidis
TESLLGFKTIHTNEEGHQE

SEQ ID NO: 1813313 - protein, 24 aa, Staphylococcus epidermidis
TESPRIRLYIALNECISADDYRKY

SEQ ID NO: 1813314 - protein, 31 aa, Staphylococcus epidermidis
TESQDWAGMLLRMYQRYCEQNGFKVETVDYL

SEQ ID NO: 1813315 - protein, 23 aa, Staphylococcus epidermidis
TESQDWASMLLRMYQRYGEQKGF

SEQ ID NO: 1813316 - protein, 18 aa, Staphylococcus epidermidis
TESSKWVHDRSSALGEET

SEQ ID NO: 1813317 - protein, 20 aa, Staphylococcus epidermidis
TETHNTCIIGTSRSGKGESA

SEQ ID NO: 1813318 - protein, 18 aa, Staphylococcus epidermidis
TETLKFLFDDLIVTGISS

SEQ ID NO: 1813319 - protein, 19 aa, Staphylococcus epidermidis
TETQLFYGGGITSLGQAQE

SEQ ID NO: 1813320 - protein, 29 aa, Staphylococcus epidermidis
TEVGKKKLKRWLMKYDFKDLVYATDKAFA

SEQ ID NO: 1813321 - protein, 22 aa, Staphylococcus epidermidis
TEVHVASEFVYNMPLLSEKPLF

SEQ ID NO: 1813322 - protein, 24 aa, Staphylococcus epidermidis
TEVPACNEVQCGWAASHSLEGAKE

SEQ ID NO: 1813323 - protein, 18 aa, Staphylococcus epidermidis
TEYCQFQGYEVVNEYTDR

SEQ ID NO: 1813324 - protein, 17 aa, Staphylococcus epidermidis
TEYFVEAGLKPQPNGWI

SEQ ID NO: 1813325 - protein, 17 aa, Staphylococcus epidermidis
TEYIAPAVITWINQFSK

SEQ ID NO: 1813326 - protein, 21 aa, Staphylococcus epidermidis
TEYPILLATSRKRFIKEMIGT

SEQ ID NO: 1813327 - protein, 18 aa, Staphylococcus epidermidis
TEYTRWFMQSGSTRPSKW

SEQ ID NO: 1813328 - protein, 17 aa, Staphylococcus epidermidis
TFAAEHLEFCKENNLKG

SEQ ID NO: 1813329 - protein, 19 aa, Staphylococcus epidermidis
TFAEEAVKAIPDASISFEV

SEQ ID NO: 1813330 - protein, 21 aa, Staphylococcus epidermidis
TFAEMAVKVAQYLDIDTISFG

SEQ ID NO: 1813331 - protein, 19 aa, Staphylococcus epidermidis
TFAKSGMLDGIRMVTQLLT

SEQ ID NO: 1813332 - protein, 20 aa, Staphylococcus epidermidis
TFECPVGESIAIIGESGSGK

SEQ ID NO: 1813333 - protein, 18 aa, Staphylococcus epidermidis
TFEYKDARNYLSYLYSNN

SEQ ID NO: 1813334 - protein, 24 aa, Staphylococcus epidermidis
TFEYTESAVAKVRYVDANTGKDII

SEQ ID NO: 1813335 - protein, 19 aa, Staphylococcus epidermidis
TFHTVVPCATLIIDENTHN

SEQ ID NO: 1813336 - protein, 23 aa, Staphylococcus epidermidis
TFIDVLKMKGFNVGEPEDPLKLI

SEQ ID NO: 1813337 - protein, 25 aa, Staphylococcus epidermidis
TFIEEIKSALSIGDTCPICGNEIQS

SEQ ID NO: 1813338 - protein, 20 aa, Staphylococcus epidermidis
TFIELIRYALDINPMSRNAN

SEQ ID NO: 1813339 - protein, 30 aa, Staphylococcus epidermidis
TFIGAGIISIEFASIMIKSGVEVNVIHHSN

SEQ ID NO: 1813340 - protein, 30 aa, Staphylococcus epidermidis
TFIGAGIISIEFASIMIKSGVEVNVIHHTN

SEQ ID NO: 1813341 - protein, 26 aa, Staphylococcus epidermidis
TFIGAGIISIEFASIMVKSGVEVNVI

SEQ ID NO: 1813342 - protein, 18 aa, Staphylococcus epidermidis
TFIGQKVFNAEALIDNII

SEQ ID NO: 1813343 - protein, 24 aa, Staphylococcus epidermidis
TFINILELLALEYAKDKGYQLYNF

SEQ ID NO: 1813344 - protein, 18 aa, Staphylococcus epidermidis
TFKGPKGPTGYMIPTVIE

SEQ ID NO: 1813345 - protein, 30 aa, Staphylococcus epidermidis
TFKNKRGQEVTEFIVEMDLNYTWINADKPE

SEQ ID NO: 1813346 - protein, 23 aa, Staphylococcus epidermidis
TFNDAWKKMGILGIEMESAGLYL

SEQ ID NO: 1813347 - protein, 23 aa, Staphylococcus epidermidis
TFNDSWKKMGILGIEMESAGLYL

SEQ ID NO: 1813348 - protein, 18 aa, Staphylococcus epidermidis
TFNHSFDAFKNWFNDHTE

SEQ ID NO: 1813349 - protein, 19 aa, Staphylococcus epidermidis
TFPEHEWGFNGIFDKTNGG

SEQ ID NO: 1813350 - protein, 17 aa, Staphylococcus epidermidis
TFPLFGMAVGEPAEDEN

SEQ ID NO: 1813351 - protein, 17 aa, Staphylococcus epidermidis
TFPLFGMAVGEPSDEEN

SEQ ID NO: 1813352 - protein, 18 aa, Staphylococcus epidermidis
TFPRKGLNVSNERLTELS

SEQ ID NO: 1813353 - protein, 26 aa, Staphylococcus epidermidis
TFPSLLQWTESLWQYVPSSTNKNQLI

SEQ ID NO: 1813354 - protein, 18 aa, Staphylococcus epidermidis
TFSRTQAFLDEFASSLSK

SEQ ID NO: 1813355 - protein, 17 aa, Staphylococcus epidermidis
TFTKSGTSYSWKPLTDQ

SEQ ID NO: 1813356 - protein, 18 aa, Staphylococcus epidermidis
TFTYPLIGNYGINRDDFE

SEQ ID NO: 1813357 - protein, 20 aa, Staphylococcus epidermidis
TFVPGKIVKIFDELILALEN

SEQ ID NO: 1813358 - protein, 21 aa, Staphylococcus epidermidis
TFYHPSNMVLFVVGDVDPQSI

SEQ ID NO: 1813359 - protein, 19 aa, Staphylococcus epidermidis
TFYYTFSDMYTLKDVRETL

SEQ ID NO: 1813360 - protein, 17 aa, Staphylococcus epidermidis
TGALLTFAVMAAVDIAQ

SEQ ID NO: 1813361 - protein, 17 aa, Staphylococcus epidermidis
TGAVAWVSGLRRAQSPT

SEQ ID NO: 1813362 - protein, 19 aa, Staphylococcus epidermidis
TGAVKLAIERLIKPELNHL

SEQ ID NO: 1813363 - protein, 21 aa, Staphylococcus epidermidis
TGDTPVIVNIGEWYEGDEEDK

SEQ ID NO: 1813364 - protein, 19 aa, Staphylococcus epidermidis
TGEEWKKFKANCHSFNVTP

SEQ ID NO: 1813365 - protein, 18 aa, Staphylococcus epidermidis
TGEFSNKLLSYFVSSKSL

SEQ ID NO: 1813366 - protein, 27 aa, Staphylococcus epidermidis
TGEPVYCALMKGTFSLDSMEFKTKGEK

SEQ ID NO: 1813367 - protein, 19 aa, Staphylococcus epidermidis
TGESCAINGVLPPIISIVA

SEQ ID NO: 1813368 - protein, 19 aa, Staphylococcus epidermidis
TGFGTGGWQLAALNICSKA

SEQ ID NO: 1813369 - protein, 19 aa, Staphylococcus epidermidis
TGGVMLGKDVKFEASAEFS

SEQ ID NO: 1813370 - protein, 19 aa, Staphylococcus epidermidis
TGGVMLGKNVKFEASAEFS

SEQ ID NO: 1813371 - protein, 20 aa, Staphylococcus epidermidis
TGHAYLAYAGYYGDKATVLD

SEQ ID NO: 1813372 - protein, 21 aa, Staphylococcus epidermidis
TGHTRFPIVNKDFKLVGIVTS

SEQ ID NO: 1813373 - protein, 18 aa, Staphylococcus epidermidis
TGIGRTGKLFAYEHYDII

SEQ ID NO: 1813374 - protein, 17 aa, Staphylococcus epidermidis
TGIGRTGKLYAHEHYQL

SEQ ID NO: 1813375 - protein, 22 aa, Staphylococcus epidermidis
TGKSHIAYAIAKAIKNEGHSVA

SEQ ID NO: 1813376 - protein, 18 aa, Staphylococcus epidermidis
TGLIRHLVVRTGHHTNEM

SEQ ID NO: 1813377 - protein, 19 aa, Staphylococcus epidermidis
TGLPMKRVDDIKTYIKHDV

SEQ ID NO: 1813378 - protein, 20 aa, Staphylococcus epidermidis
TGMAWEAGVLAGLNDSNIDV

SEQ ID NO: 1813379 - protein, 30 aa, Staphylococcus epidermidis
TGMFPKWKGIPATFALKLITVILGKRRRVK

SEQ ID NO: 1813380 - protein, 31 aa, Staphylococcus epidermidis
TGMFPKWKGVPIRLAMKIVTFIFGKRRRLKW

SEQ ID NO: 1813381 - protein, 22 aa, Staphylococcus epidermidis
TGMGRIGMKDIYEYKEVVDLIN

SEQ ID NO: 1813382 - protein, 22 aa, Staphylococcus epidermidis
TGNFLLAMGLKHLSEISDTRVH

SEQ ID NO: 1813383 - protein, 19 aa, Staphylococcus epidermidis
TGRGSIQMRSRAEIEERGG

SEQ ID NO: 1813384 - protein, 20 aa, Staphylococcus epidermidis
TGRGSIQMRSRAEIEERGGG

SEQ ID NO: 1813385 - protein, 21 aa, Staphylococcus epidermidis
TGRMLPGTKLQSGLHQAIEAK

SEQ ID NO: 1813386 - protein, 22 aa, Staphylococcus epidermidis
TGSCSWKVFVKNGVITWENQQT

SEQ ID NO: 1813387 - protein, 24 aa, Staphylococcus epidermidis
TGSDLSVVLLDFGKKQNIVRELNM

SEQ ID NO: 1813388 - protein, 25 aa, Staphylococcus epidermidis
TGSGKSYFLYFLIFQLVIKNADVYV

SEQ ID NO: 1813389 - protein, 17 aa, Staphylococcus epidermidis
TGVCGPEPDETLIKANQ

SEQ ID NO: 1813390 - protein, 17 aa, Staphylococcus epidermidis
TGVKVTSISPGMVESPM

SEQ ID NO: 1813391 - protein, 21 aa, Staphylococcus epidermidis
TGVNPKPIFEIIQKANMSKLG

SEQ ID NO: 1813392 - protein, 18 aa, Staphylococcus epidermidis
TGVSLGGLFTLRLAEQFD

SEQ ID NO: 1813393 - protein, 25 aa, Staphylococcus epidermidis
TGVTFAFQGCEHINRAVTIDRANFN

SEQ ID NO: 1813394 - protein, 26 aa, Staphylococcus epidermidis
TGWSGASLFMSCLYRATNNEKWLHLS

SEQ ID NO: 1813395 - protein, 19 aa, Staphylococcus epidermidis
THAHEKWGLNCDYDNNKAR

SEQ ID NO: 1813396 - protein, 19 aa, Staphylococcus epidermidis
THASMLIHEGLNIYYISKR

SEQ ID NO: 1813397 - protein, 17 aa, Staphylococcus epidermidis
THDIELLNACADEIISL

SEQ ID NO: 1813398 - protein, 20 aa, Staphylococcus epidermidis
THERGMKLILDLVVNHTSDE

SEQ ID NO: 1813399 - protein, 19 aa, Staphylococcus epidermidis
THFDAFINLFVENRSKFIY

SEQ ID NO: 1813400 - protein, 19 aa, Staphylococcus epidermidis
THFPQIEYECCAIEDVDFP

SEQ ID NO: 1813401 - protein, 25 aa, Staphylococcus epidermidis
THGYDFPMWFIRPFYAKETTKNKVK

SEQ ID NO: 1813402 - protein, 17 aa, Staphylococcus epidermidis
THHSRYLLLTNNYSHDP

SEQ ID NO: 1813403 - protein, 18 aa, Staphylococcus epidermidis
THILKFARKLSDMKQPVW

SEQ ID NO: 1813404 - protein, 18 aa, Staphylococcus epidermidis
THLENGLVWSILITLPVT

SEQ ID NO: 1813405 - protein, 18 aa, Staphylococcus epidermidis
THLFQLSNNEAWECEALE

SEQ ID NO: 1813406 - protein, 17 aa, Staphylococcus epidermidis
THLKEVFLDEPFEENQS

SEQ ID NO: 1813407 - protein, 23 aa, Staphylococcus epidermidis
THLKKRLTEQLFLVAEEDEEIIG

SEQ ID NO: 1813408 - protein, 20 aa, Staphylococcus epidermidis
THLKSTYAKNMFRLLKQYKH

SEQ ID NO: 1813409 - protein, 22 aa, Staphylococcus epidermidis
THNGGKLKIHYELYQDEQKMGS

SEQ ID NO: 1813410 - protein, 23 aa, Staphylococcus epidermidis
THPIEWQLQYLLLRRDFKSYEAC

SEQ ID NO: 1813411 - protein, 19 aa, Staphylococcus epidermidis
THPRYRIKKKYVAKLKGYL

SEQ ID NO: 1813412 - protein, 27 aa, Staphylococcus epidermidis
THPSKLPLDKRMHAIRQRLGNVEWTDN

SEQ ID NO: 1813413 - protein, 25 aa, Staphylococcus epidermidis
THSFRHTHCALLIEAGVHIKEIQER

SEQ ID NO: 1813414 - protein, 25 aa, Staphylococcus epidermidis
THTAKMMAVKHFERDGVKTENKSYS

SEQ ID NO: 1813415 - protein, 25 aa, Staphylococcus epidermidis
THTVTGLPQGLKFDASTNSIVGTPT

SEQ ID NO: 1813416 - protein, 28 aa, Staphylococcus epidermidis
THVDAIAGTSVDDWTKFNLDKPATQNTA

SEQ ID NO: 1813417 - protein, 27 aa, Staphylococcus epidermidis
TIAEYSVSIALQLVRKFPAIERRVQDH

SEQ ID NO: 1813418 - protein, 20 aa, Staphylococcus epidermidis
TIAGEVDATVNIDKQLNNLK

SEQ ID NO: 1813419 - protein, 25 aa, Staphylococcus epidermidis
TIARDLRELNIFRLPADAKQFEYKI

SEQ ID NO: 1813420 - protein, 28 aa, Staphylococcus epidermidis
TIASYRIHKGFHMLKFEGINNINDIEHL

SEQ ID NO: 1813421 - protein, 22 aa, Staphylococcus epidermidis
TIDFKQSLMGGGFQINNPNAIA

SEQ ID NO: 1813422 - protein, 21 aa, Staphylococcus epidermidis
TIDHLHLKYGKGIVSKATSYT

SEQ ID NO: 1813423 - protein, 17 aa, Staphylococcus epidermidis
TIDHVFYAALSVNTELG

SEQ ID NO: 1813424 - protein, 19 aa, Staphylococcus epidermidis
TIDMLRKGVIGIERNSDIP

SEQ ID NO: 1813425 - protein, 19 aa, Staphylococcus epidermidis
TIDNLKLRYEHVGYPGQPL

SEQ ID NO: 1813426 - protein, 25 aa, Staphylococcus epidermidis
TIDPIKFNLLFERFLNPERVTMPDI

SEQ ID NO: 1813427 - protein, 28 aa, Staphylococcus epidermidis
TIDSGFYKTPKYSVGDYVWEDTNKDGIQ

SEQ ID NO: 1813428 - protein, 34 aa, Staphylococcus epidermidis
TIEAIDIAMEFRKEFHKDVVIDLVGYRRYGHNEM

SEQ ID NO: 1813429 - protein, 20 aa, Staphylococcus epidermidis
TIEFYRKELQERSKLLENQQ

SEQ ID NO: 1813430 - protein, 22 aa, Staphylococcus epidermidis
TIELSRITGIILDNAIEASEAL

SEQ ID NO: 1813431 - protein, 25 aa, Staphylococcus epidermidis
TIENRPMMYLALSYDHRIIDGKEAV

SEQ ID NO: 1813432 - protein, 24 aa, Staphylococcus epidermidis
TIEQLKLLIFILHFTENHKEELSL

SEQ ID NO: 1813433 - protein, 18 aa, Staphylococcus epidermidis
TIEQSLREPLLFYRQLIP

SEQ ID NO: 1813434 - protein, 19 aa, Staphylococcus epidermidis
TIFCTFWGLNALKKIQSQR

SEQ ID NO: 1813435 - protein, 18 aa, Staphylococcus epidermidis
TIGLFIRVILGYDEGSKY

SEQ ID NO: 1813436 - protein, 32 aa, Staphylococcus epidermidis
TIKAELGDNLFVLLCIANSLNIDMTESFNDTM

SEQ ID NO: 1813437 - protein, 26 aa, Staphylococcus epidermidis
TIKEFTELGSGFKIAMRDLNIRGAGN

SEQ ID NO: 1813438 - protein, 22 aa, Staphylococcus epidermidis
TILSAKELLYLLTQAAVGDETE

SEQ ID NO: 1813439 - protein, 17 aa, Staphylococcus epidermidis
TINASDFLMYYANETEK

SEQ ID NO: 1813440 - protein, 29 aa, Staphylococcus epidermidis
TINHKMQWDKPHAYCLVSVIDGEGKILID

SEQ ID NO: 1813441 - protein, 17 aa, Staphylococcus epidermidis
TINVSRPYGERVSELSI

SEQ ID NO: 1813442 - protein, 26 aa, Staphylococcus epidermidis
TIPEDIKYIPEKEVKTVQDLSELVQK

SEQ ID NO: 1813443 - protein, 31 aa, Staphylococcus epidermidis
TIPMDSWNRLSLRNTDTYIALLLGYYDATKK

SEQ ID NO: 1813444 - protein, 19 aa, Staphylococcus epidermidis
TIPTTFEFTDIAGIVKGAS

SEQ ID NO: 1813445 - protein, 19 aa, Staphylococcus epidermidis
TIQYQRFIRHIQFLIYRLT

SEQ ID NO: 1813446 - protein, 25 aa, Staphylococcus epidermidis
TIRIAPRKVRLVLDLIRGKKAGEAI

SEQ ID NO: 1813447 - protein, 25 aa, Staphylococcus epidermidis
TIRIAPRKVRLVLDLIRGKNAAEAI

SEQ ID NO: 1813448 - protein, 24 aa, Staphylococcus epidermidis
TISIFLRELIKIYMISKLTNQNLL

SEQ ID NO: 1813449 - protein, 18 aa, Staphylococcus epidermidis
TISRWKHNDKFREGFKGY

SEQ ID NO: 1813450 - protein, 19 aa, Staphylococcus epidermidis
TITCTNCGYTEFYKESANR

SEQ ID NO: 1813451 - protein, 20 aa, Staphylococcus epidermidis
TITNGGIFGSMMSTPIINGS

SEQ ID NO: 1813452 - protein, 24 aa, Staphylococcus epidermidis
TIVNNAKRLNISFEKENGINYIKD

SEQ ID NO: 1813453 - protein, 25 aa, Staphylococcus epidermidis
TIVNNAKRLNISFEKENGINYINDN

SEQ ID NO: 1813454 - protein, 17 aa, Staphylococcus epidermidis
TIVPFHLQNEIKKRGAI

SEQ ID NO: 1813455 - protein, 26 aa, Staphylococcus epidermidis
TIYKNYPIRFSVMGHVHFRKKLVENN

SEQ ID NO: 1813456 - protein, 17 aa, Staphylococcus epidermidis
TIYRNRYLFAIKENMGN

SEQ ID NO: 1813457 - protein, 22 aa, Staphylococcus epidermidis
TIYYRYFIEETMLYNIHLFMYK

SEQ ID NO: 1813458 - protein, 19 aa, Staphylococcus epidermidis
TKALIRYVYEVYDINRIEI

SEQ ID NO: 1813459 - protein, 20 aa, Staphylococcus epidermidis
TKDFAPLVVLGGHGSESHNN

SEQ ID NO: 1813460 - protein, 21 aa, Staphylococcus epidermidis
TKDRIWKKIVINKIFNQTRCL

SEQ ID NO: 1813461 - protein, 18 aa, Staphylococcus epidermidis
TKEIVRFISTHPDEDHIH

SEQ ID NO: 1813462 - protein, 21 aa, Staphylococcus epidermidis
TKFLIAGGLDIKHLKQLNQIE

SEQ ID NO: 1813463 - protein, 21 aa, Staphylococcus epidermidis
TKFLLPLMMKQGGSIINTASF

SEQ ID NO: 1813464 - protein, 17 aa, Staphylococcus epidermidis
TKGDVHLVGVKDDQEDV

SEQ ID NO: 1813465 - protein, 18 aa, Staphylococcus epidermidis
TKGHKLKKSAAKTTALVG

SEQ ID NO: 1813466 - protein, 24 aa, Staphylococcus epidermidis
TKGMVRREVVRIVTPGTVMDQSGM

SEQ ID NO: 1813467 - protein, 19 aa, Staphylococcus epidermidis
TKGNFGGLEIKAHSNANAA

SEQ ID NO: 1813468 - protein, 19 aa, Staphylococcus epidermidis
TKGNFGGLEIKAHSNASAA

SEQ ID NO: 1813469 - protein, 18 aa, Staphylococcus epidermidis
TKGYKGSTTFTSLKVSGC

SEQ ID NO: 1813470 - protein, 18 aa, Staphylococcus epidermidis
TKHGINFQEMAFKEEKQC

SEQ ID NO: 1813471 - protein, 17 aa, Staphylococcus epidermidis
TKIELFDALRAWLDQED

SEQ ID NO: 1813472 - protein, 25 aa, Staphylococcus epidermidis
TKIEVTESAIGRQLINTQNHDLWQE

SEQ ID NO: 1813473 - protein, 21 aa, Staphylococcus epidermidis
TKILRYLCHTVGYDNEEFYEI

SEQ ID NO: 1813474 - protein, 17 aa, Staphylococcus epidermidis
TKIRKQIRLKRTKIKKY

SEQ ID NO: 1813475 - protein, 23 aa, Staphylococcus epidermidis
TKISWKQDQSFMINTDGEQLDLT

SEQ ID NO: 1813476 - protein, 20 aa, Staphylococcus epidermidis
TKKDAATLFSAFEDTVIEAI

SEQ ID NO: 1813477 - protein, 19 aa, Staphylococcus epidermidis
TKKDRKALSDAVNSLGEPL

SEQ ID NO: 1813478 - protein, 18 aa, Staphylococcus epidermidis
TKKGFSFTKNRFINKEKD

SEQ ID NO: 1813479 - protein, 18 aa, Staphylococcus epidermidis
TKKKLWWGKFKYPTNPNA

SEQ ID NO: 1813480 - protein, 26 aa, Staphylococcus epidermidis
TKKPVIFRATPQWFASISKVRQDILD

SEQ ID NO: 1813481 - protein, 24 aa, Staphylococcus epidermidis
TKKRIRYYSCSNFRNKGSKVCSAN

SEQ ID NO: 1813482 - protein, 21 aa, Staphylococcus epidermidis
TKKSYKYALEHSAHIDKYIVL

SEQ ID NO: 1813483 - protein, 21 aa, Staphylococcus epidermidis
TKLAETLSHVMKLPMHQVNCS

SEQ ID NO: 1813484 - protein, 18 aa, Staphylococcus epidermidis
TKLDDIEAYYARIEADIH

SEQ ID NO: 1813485 - protein, 24 aa, Staphylococcus epidermidis
TKLIKVPIMNARPFKPSNEKKKPY

SEQ ID NO: 1813486 - protein, 23 aa, Staphylococcus epidermidis
TKLKRGDDAILIRYQPYNSTVIY

SEQ ID NO: 1813487 - protein, 21 aa, Staphylococcus epidermidis
TKLQAVCAVCGSPSSRTQRLI

SEQ ID NO: 1813488 - protein, 21 aa, Staphylococcus epidermidis
TKLRFPNLLKNATKNTITAYL

SEQ ID NO: 1813489 - protein, 22 aa, Staphylococcus epidermidis
TKLSMVTAYDFPSAKQAQQADI

SEQ ID NO: 1813490 - protein, 31 aa, Staphylococcus epidermidis
TKLVVISHIFWKTGEVIPIKKVINLAHSKGI

SEQ ID NO: 1813491 - protein, 22 aa, Staphylococcus epidermidis
TKMGGKILKPLAIGSAIMDNYK

SEQ ID NO: 1813492 - protein, 18 aa, Staphylococcus epidermidis
TKMGIPVVSHLGLTPQSV

SEQ ID NO: 1813493 - protein, 19 aa, Staphylococcus epidermidis
TKNAMLPIALEKEAREHLA

SEQ ID NO: 1813494 - protein, 25 aa, Staphylococcus epidermidis
TKNDLIEQIIMEWCENNESGLLEKF

SEQ ID NO: 1813495 - protein, 18 aa, Staphylococcus epidermidis
TKNLEDFYDKEGFRDQEF

SEQ ID NO: 1813496 - protein, 18 aa, Staphylococcus epidermidis
TKNLEDFYDKEGYRDEEF

SEQ ID NO: 1813497 - protein, 18 aa, Staphylococcus epidermidis
TKNLENFYDKEGYRDEEF

SEQ ID NO: 1813498 - protein, 23 aa, Staphylococcus epidermidis
TKNLKTRVMQALKEVHLEEHYDK

SEQ ID NO: 1813499 - protein, 17 aa, Staphylococcus epidermidis
TKNVLVFHNSHIDGDNI

SEQ ID NO: 1813500 - protein, 26 aa, Staphylococcus epidermidis
TKPTFKKERTVYLPNAFHPLLNKETV

SEQ ID NO: 1813501 - protein, 26 aa, Staphylococcus epidermidis
TKQKVNMIQCLLKKADIYILDEPFSG

SEQ ID NO: 1813502 - protein, 19 aa, Staphylococcus epidermidis
TKQLMIFKQFVEFQNENAV

SEQ ID NO: 1813503 - protein, 23 aa, Staphylococcus epidermidis
TKQPVDEIVHYGGEEIKPGHKDE

SEQ ID NO: 1813504 - protein, 21 aa, Staphylococcus epidermidis
TKQSIKIVNCEDFIEFYNPGN

SEQ ID NO: 1813505 - protein, 17 aa, Staphylococcus epidermidis
TKRIMSWIENQTGAFKN

SEQ ID NO: 1813506 - protein, 22 aa, Staphylococcus epidermidis
TKRKIKGLKHEFGKNQSYVHYY

SEQ ID NO: 1813507 - protein, 21 aa, Staphylococcus epidermidis
TKRQAGKELVDFKELALEGVF

SEQ ID NO: 1813508 - protein, 18 aa, Staphylococcus epidermidis
TKSALGTYVKYSDQSDKI

SEQ ID NO: 1813509 - protein, 29 aa, Staphylococcus epidermidis
TKSETFVIISFKHKVILIGGTEYAGEMKK

SEQ ID NO: 1813510 - protein, 19 aa, Staphylococcus epidermidis
TKSIAGFDIESFNVSHDAI

SEQ ID NO: 1813511 - protein, 20 aa, Staphylococcus epidermidis
TKTGALLNFSVMAAVDIAQV

SEQ ID NO: 1813512 - protein, 20 aa, Staphylococcus epidermidis
TKWNCKYHIVFAPKYRRQVI

SEQ ID NO: 1813513 - protein, 22 aa, Staphylococcus epidermidis
TKYAGLRFDEDVVFCEEHTFIV

SEQ ID NO: 1813514 - protein, 26 aa, Staphylococcus epidermidis
TKYARASAVALGLKGDTCIAGGGSDG

SEQ ID NO: 1813515 - protein, 22 aa, Staphylococcus epidermidis
TKYKRNGDAVLIQYQPYNSTVI

SEQ ID NO: 1813516 - protein, 17 aa, Staphylococcus epidermidis
TKYKYKNLIKEISPVDL

SEQ ID NO: 1813517 - protein, 19 aa, Staphylococcus epidermidis
TKYVVHFEWGYNNISLPQA

SEQ ID NO: 1813518 - protein, 18 aa, Staphylococcus epidermidis
TLAPGWNEILIRGHNISN

SEQ ID NO: 1813519 - protein, 18 aa, Staphylococcus epidermidis
TLAQYSGVPVWNGLTDED

SEQ ID NO: 1813520 - protein, 20 aa, Staphylococcus epidermidis
TLCGGGRYNGLLQLLDGPSE

SEQ ID NO: 1813521 - protein, 26 aa, Staphylococcus epidermidis
TLCQLWKEISQLIGPIETINGTKISS

SEQ ID NO: 1813522 - protein, 28 aa, Staphylococcus epidermidis
TLEAFNYHKVHLFKEWKTEKDIINYLLG

SEQ ID NO: 1813523 - protein, 23 aa, Staphylococcus epidermidis
TLEEMFDAIILCTGSQNARDLPL

SEQ ID NO: 1813524 - protein, 17 aa, Staphylococcus epidermidis
TLEGAGLDQAITYSLVS

SEQ ID NO: 1813525 - protein, 22 aa, Staphylococcus epidermidis
TLEKLLYNTFDLIFLDINLMDE

SEQ ID NO: 1813526 - protein, 25 aa, Staphylococcus epidermidis
TLENYRKGGSRVRAFYGNNTREYKY

SEQ ID NO: 1813527 - protein, 19 aa, Staphylococcus epidermidis
TLFYFKDSIIIGAVDIRHQ

SEQ ID NO: 1813528 - protein, 19 aa, Staphylococcus epidermidis
TLGTYEWKNYQTLVDGKDY

SEQ ID NO: 1813529 - protein, 29 aa, Staphylococcus epidermidis
TLGYPFIVKTRFGGYDGKGQILVKQESDI

SEQ ID NO: 1813530 - protein, 18 aa, Staphylococcus epidermidis
TLHSKGVYRLKVTLNKEG

SEQ ID NO: 1813531 - protein, 20 aa, Staphylococcus epidermidis
TLHWQYGHVLTVFEEALSMG

SEQ ID NO: 1813532 - protein, 18 aa, Staphylococcus epidermidis
TLIARGLVEAKDVDHSRS

SEQ ID NO: 1813533 - protein, 19 aa, Staphylococcus epidermidis
TLIEKCWESENFIDDNTLA

SEQ ID NO: 1813534 - protein, 22 aa, Staphylococcus epidermidis
TLIEMKDQFKGKIVIIHQPAEE

SEQ ID NO: 1813535 - protein, 19 aa, Staphylococcus epidermidis
TLIQILLKYIENHTSSIEG

SEQ ID NO: 1813536 - protein, 25 aa, Staphylococcus epidermidis
TLIRTILARMHFFRDDVYKPINVLS

SEQ ID NO: 1813537 - protein, 26 aa, Staphylococcus epidermidis
TLKAISPRTTLPILTGIKIDAKDNEV

SEQ ID NO: 1813538 - protein, 24 aa, Staphylococcus epidermidis
TLKDLRSDANIGLRSVTNKDAQFK

SEQ ID NO: 1813539 - protein, 18 aa, Staphylococcus epidermidis
TLKGERPLTYYLTDKPQE

SEQ ID NO: 1813540 - protein, 23 aa, Staphylococcus epidermidis
TLKGIECIYALYKKNRRSEETCG

SEQ ID NO: 1813541 - protein, 23 aa, Staphylococcus epidermidis
TLKGIECIYGLYKKTVGLFRSTD

SEQ ID NO: 1813542 - protein, 18 aa, Staphylococcus epidermidis
TLKGVAWFWHTTFNHQTE

SEQ ID NO: 1813543 - protein, 18 aa, Staphylococcus epidermidis
TLKGVAWFWHTTYSHTTE

SEQ ID NO: 1813544 - protein, 18 aa, Staphylococcus epidermidis
TLKIGAIFVPLSKEHPLT

SEQ ID NO: 1813545 - protein, 22 aa, Staphylococcus epidermidis
TLKKRHCHAFSKNFKSLAKDDW

SEQ ID NO: 1813546 - protein, 21 aa, Staphylococcus epidermidis
TLKRIRMHITQGIMSGEGYSK

SEQ ID NO: 1813547 - protein, 24 aa, Staphylococcus epidermidis
TLLEKRPVAYFTLFTSSMQVPLEH

SEQ ID NO: 1813548 - protein, 31 aa, Staphylococcus epidermidis
TLLELLDYAYSFGFEFQSFMAASKFYDTYAL

SEQ ID NO: 1813549 - protein, 22 aa, Staphylococcus epidermidis
TLLERFKYAQSINVNAHPIIVG

SEQ ID NO: 1813550 - protein, 25 aa, Staphylococcus epidermidis
TLLKSSAGGTEFPKLAKELPEKLNK

SEQ ID NO: 1813551 - protein, 22 aa, Staphylococcus epidermidis
TLLNPVKFDFSLTVDGETKEGN

SEQ ID NO: 1813552 - protein, 27 aa, Staphylococcus epidermidis
TLMNHAISFLKERGYSVATIKHNGHIG

SEQ ID NO: 1813553 - protein, 29 aa, Staphylococcus epidermidis
TLMNHAISFLKERGYSVVTIKHHGHIGEE

SEQ ID NO: 1813554 - protein, 18 aa, Staphylococcus epidermidis
TLNQLVDYYCQWLDETKG

SEQ ID NO: 1813555 - protein, 24 aa, Staphylococcus epidermidis
TLNRLLENQQILALESNKKIQKLE

SEQ ID NO: 1813556 - protein, 24 aa, Staphylococcus epidermidis
TLNRLLENQQILTLESNKKIQKLE

SEQ ID NO: 1813557 - protein, 25 aa, Staphylococcus epidermidis
TLNSLYKLTGVQAYVDVYKEEVKVI

SEQ ID NO: 1813558 - protein, 24 aa, Staphylococcus epidermidis
TLNYPETCPHGGVIPRDHQYKELY

SEQ ID NO: 1813559 - protein, 17 aa, Staphylococcus epidermidis
TLQEMAPLFKWLNSSFN

SEQ ID NO: 1813560 - protein, 23 aa, Staphylococcus epidermidis
TLQRLNERVELVKPKSEYIDLGT

SEQ ID NO: 1813561 - protein, 20 aa, Staphylococcus epidermidis
TLQTPFEMIHRAYLESTAYG

SEQ ID NO: 1813562 - protein, 21 aa, Staphylococcus epidermidis
TLRMNYLFDFYQSLLTQKQRN

SEQ ID NO: 1813563 - protein, 24 aa, Staphylococcus epidermidis
TLSAIKLNGALLLNGSPVTVRQVM

SEQ ID NO: 1813564 - protein, 22 aa, Staphylococcus epidermidis
TLSALKYQTGFSKFVPQRFETG

SEQ ID NO: 1813565 - protein, 17 aa, Staphylococcus epidermidis
TLSEKEGRVDVLINNAG

SEQ ID NO: 1813566 - protein, 24 aa, Staphylococcus epidermidis
TLSGGQFQRVWIAKALILEPEILI

SEQ ID NO: 1813567 - protein, 24 aa, Staphylococcus epidermidis
TLSGGQFQRVWIAKALIVEPQVLI

SEQ ID NO: 1813568 - protein, 18 aa, Staphylococcus epidermidis
TLTSFKASQLLSQEENIK

SEQ ID NO: 1813569 - protein, 19 aa, Staphylococcus epidermidis
TLVDELLKQSGIFRENEHV

SEQ ID NO: 1813570 - protein, 18 aa, Staphylococcus epidermidis
TLVMKDGVCVAFFTLHEG

SEQ ID NO: 1813571 - protein, 24 aa, Staphylococcus epidermidis
TLVRLHKDYQFHIGAKTEMSSKLL

SEQ ID NO: 1813572 - protein, 25 aa, Staphylococcus epidermidis
TLWKKAKPGEISWDSPFGEGRPGWH

SEQ ID NO: 1813573 - protein, 18 aa, Staphylococcus epidermidis
TLWKSGKCKDFLVHRLVA

SEQ ID NO: 1813574 - protein, 22 aa, Staphylococcus epidermidis
TMAEGLKLAALTFDKDISKLSC

SEQ ID NO: 1813575 - protein, 18 aa, Staphylococcus epidermidis
TMEDALFNFQWLAATQGV

SEQ ID NO: 1813576 - protein, 27 aa, Staphylococcus epidermidis
TMETMFPRRVDLGLGRAPGTDMMTASA

SEQ ID NO: 1813577 - protein, 21 aa, Staphylococcus epidermidis
TMFSNFRIIDAITSPKELLTT

SEQ ID NO: 1813578 - protein, 23 aa, Staphylococcus epidermidis
TMGEGYPVVLIHTAYDNYSVFND

SEQ ID NO: 1813579 - protein, 25 aa, Staphylococcus epidermidis
TMILKPIFRDYLLKLAQENQIAYQY

SEQ ID NO: 1813580 - protein, 22 aa, Staphylococcus epidermidis
TMILKPQFRDYLLQLAESNDIA

SEQ ID NO: 1813581 - protein, 19 aa, Staphylococcus epidermidis
TMKALRDAIKDNQQVLQSS

SEQ ID NO: 1813582 - protein, 23 aa, Staphylococcus epidermidis
TMKSISIPLQYLIAAALEVTDVN

SEQ ID NO: 1813583 - protein, 23 aa, Staphylococcus epidermidis
TMKVRCKYPVWVNNQITASDEKE

SEQ ID NO: 1813584 - protein, 18 aa, Staphylococcus epidermidis
TMMKELKNSFRPEFLNRV

SEQ ID NO: 1813585 - protein, 17 aa, Staphylococcus epidermidis
TMPELKQREILMAREEI

SEQ ID NO: 1813586 - protein, 23 aa, Staphylococcus epidermidis
TMRKEVLGGLGGFGATFDLSQLN

SEQ ID NO: 1813587 - protein, 27 aa, Staphylococcus epidermidis
TMRNQDCLYMINTFYPYIETVKKFIQF

SEQ ID NO: 1813588 - protein, 20 aa, Staphylococcus epidermidis
TMTDVYRYLVGLLEKNQLDV

SEQ ID NO: 1813589 - protein, 19 aa, Staphylococcus epidermidis
TMTDYCYRNYKMYLQEAIV

SEQ ID NO: 1813590 - protein, 26 aa, Staphylococcus epidermidis
TMVHLSRFAEEIIFWSTDEAKFITLS

SEQ ID NO: 1813591 - protein, 20 aa, Staphylococcus epidermidis
TNCLPVFKILMKKQSLHFRV

SEQ ID NO: 1813592 - protein, 17 aa, Staphylococcus epidermidis
TNDGRFEYEIGQMSSSF

SEQ ID NO: 1813593 - protein, 23 aa, Staphylococcus epidermidis
TNDKETFGVWVKRWENDKPVPEP

SEQ ID NO: 1813594 - protein, 17 aa, Staphylococcus epidermidis
TNEEYQLLLSKSEEEIE

SEQ ID NO: 1813595 - protein, 28 aa, Staphylococcus epidermidis
TNEIKKILIMPTWRDWLNSTYAFDNSDY

SEQ ID NO: 1813596 - protein, 17 aa, Staphylococcus epidermidis
TNEKLKSILNISSPNKL

SEQ ID NO: 1813597 - protein, 18 aa, Staphylococcus epidermidis
TNFNEIFDGIFISEQTGY

SEQ ID NO: 1813598 - protein, 18 aa, Staphylococcus epidermidis
TNGSSGFLSGGVVAGTNG

SEQ ID NO: 1813599 - protein, 17 aa, Staphylococcus epidermidis
TNHLDFESINWLINYVK

SEQ ID NO: 1813600 - protein, 23 aa, Staphylococcus epidermidis
TNIVPSYRAILIYFDNSEINGAE

SEQ ID NO: 1813601 - protein, 21 aa, Staphylococcus epidermidis
TNKFYKFAIYGKFGTGKTTFL

SEQ ID NO: 1813602 - protein, 33 aa, Staphylococcus epidermidis
TNKGRYLFIPVHKLADIRWKELGQHVSQIVPID

SEQ ID NO: 1813603 - protein, 29 aa, Staphylococcus epidermidis
TNKNIRSNCGIGFKGFWDEVNGFNYDFFE

SEQ ID NO: 1813604 - protein, 23 aa, Staphylococcus epidermidis
TNKYARGVAVYGDIKDDTDEKGN

SEQ ID NO: 1813605 - protein, 17 aa, Staphylococcus epidermidis
TNKYFKSIFNILHDYFS

SEQ ID NO: 1813606 - protein, 27 aa, Staphylococcus epidermidis
TNLFKYQLIFCFDGLDFFRFGRIQRIY

SEQ ID NO: 1813607 - protein, 31 aa, Staphylococcus epidermidis
TNLTQFGYMWECPDYFRLGNKDVILMCPQGV

SEQ ID NO: 1813608 - protein, 29 aa, Staphylococcus epidermidis
TNMIFKYAYDMKLIRIMPSEGIKRPKKKV

SEQ ID NO: 1813609 - protein, 24 aa, Staphylococcus epidermidis
TNMIPSYRAILIYFDKSGINGTEL

SEQ ID NO: 1813610 - protein, 17 aa, Staphylococcus epidermidis
TNNEKWLHLSRKMLNKE

SEQ ID NO: 1813611 - protein, 18 aa, Staphylococcus epidermidis
TNNNGWLTKLKRGDDAIL

SEQ ID NO: 1813612 - protein, 24 aa, Staphylococcus epidermidis
TNPPIRAGKDIVHRIFEEAYEKLK

SEQ ID NO: 1813613 - protein, 17 aa, Staphylococcus epidermidis
TNPYYIWLSEVMLQQTQ

SEQ ID NO: 1813614 - protein, 17 aa, Staphylococcus epidermidis
TNQKLIHRSIRIIQDVC

SEQ ID NO: 1813615 - protein, 24 aa, Staphylococcus epidermidis
TNQRFVMKDGLRWYKTGDKGRFWR

SEQ ID NO: 1813616 - protein, 26 aa, Staphylococcus epidermidis
TNRDLRFIEDFSIKISDVMTKDDLIT

SEQ ID NO: 1813617 - protein, 18 aa, Staphylococcus epidermidis
TNRLPKFQPGFYINGKIY

SEQ ID NO: 1813618 - protein, 20 aa, Staphylococcus epidermidis
TNSAFLIYLIAKESPNHDER

SEQ ID NO: 1813619 - protein, 23 aa, Staphylococcus epidermidis
TNSHPWISMTVKRRIGYLKEQLQ

SEQ ID NO: 1813620 - protein, 23 aa, Staphylococcus epidermidis
TNSSAFPLKSFKNVIKKTLADAG

SEQ ID NO: 1813621 - protein, 21 aa, Staphylococcus epidermidis
TNSTWSSWQLMNAQPTFSDTG

SEQ ID NO: 1813622 - protein, 17 aa, Staphylococcus epidermidis
TNTLKGVAWFWHTTFNH

SEQ ID NO: 1813623 - protein, 18 aa, Staphylococcus epidermidis
TNVIRLLPPLTITNEQIE

SEQ ID NO: 1813624 - protein, 26 aa, Staphylococcus epidermidis
TNYKEGLMTFKRLLSLNEIEKDDKGI

SEQ ID NO: 1813625 - protein, 25 aa, Staphylococcus epidermidis
TNYLKDAILKFGFYTNHQHVVINAD

SEQ ID NO: 1813626 - protein, 25 aa, Staphylococcus epidermidis
TNYLKDTILKFGFYTNHQHVVINAE

SEQ ID NO: 1813627 - protein, 32 aa, Staphylococcus epidermidis
TPAMPLDVCGSMTQGMIGYWLETEINRALSEI

SEQ ID NO: 1813628 - protein, 23 aa, Staphylococcus epidermidis
TPDGRSKFGYINVYNQGSSAGWA

SEQ ID NO: 1813629 - protein, 22 aa, Staphylococcus epidermidis
TPDSWYFSKRLLYGKLDEIKEG

SEQ ID NO: 1813630 - protein, 17 aa, Staphylococcus epidermidis
TPEKDILLFERLSQPGE

SEQ ID NO: 1813631 - protein, 17 aa, Staphylococcus epidermidis
TPELKTGQINWKDESII

SEQ ID NO: 1813632 - protein, 25 aa, Staphylococcus epidermidis
TPFEPYELIEWFVFQSYDRESLRCL

SEQ ID NO: 1813633 - protein, 36 aa, Staphylococcus epidermidis
TPFPRISYDDAIEFLKKEGFNDIEWGEDFGAPHETA

SEQ ID NO: 1813634 - protein, 26 aa, Staphylococcus epidermidis
TPFPRISYDDAIEFLKQEGFDDIEWG

SEQ ID NO: 1813635 - protein, 26 aa, Staphylococcus epidermidis
TPFTIESKATLSFRTMDLIHKPYHVK

SEQ ID NO: 1813636 - protein, 26 aa, Staphylococcus epidermidis
TPFTLESKATLSFRTMDLIHKPYHVK

SEQ ID NO: 1813637 - protein, 20 aa, Staphylococcus epidermidis
TPGHPEFRHTDGVEVTTGPL

SEQ ID NO: 1813638 - protein, 24 aa, Staphylococcus epidermidis
TPGHSPGSLSYVFDEFAVVGDTLF

SEQ ID NO: 1813639 - protein, 25 aa, Staphylococcus epidermidis
TPGHTPESISFLLTDEGGGSSVPMG

SEQ ID NO: 1813640 - protein, 20 aa, Staphylococcus epidermidis
TPHRIFDFFNAFIGTHDFDA

SEQ ID NO: 1813641 - protein, 20 aa, Staphylococcus epidermidis
TPHRIFDFFNAFIGTHDFDT

SEQ ID NO: 1813642 - protein, 20 aa, Staphylococcus epidermidis
TPHRIFDFFNAFIGTRDFDT

SEQ ID NO: 1813643 - protein, 21 aa, Staphylococcus epidermidis
TPIKNIVCDSLVSAQAQYDML

SEQ ID NO: 1813644 - protein, 22 aa, Staphylococcus epidermidis
TPIPRAECNPFKEVANSKGYTL

SEQ ID NO: 1813645 - protein, 34 aa, Staphylococcus epidermidis
TPKQLMIYEAFGWEPPRFGHMALIVNEERKKLSK

SEQ ID NO: 1813646 - protein, 20 aa, Staphylococcus epidermidis
TPKSLPFIDFDHERILSSDD

SEQ ID NO: 1813647 - protein, 23 aa, Staphylococcus epidermidis
TPKSPLCLFCPVQENCEAFHEGT

SEQ ID NO: 1813648 - protein, 28 aa, Staphylococcus epidermidis
TPKTRGIIGEAFFKKAKPNLQIINVARG

SEQ ID NO: 1813649 - protein, 23 aa, Staphylococcus epidermidis
TPKTRGIVGSSFFNKAKKNLQII

SEQ ID NO: 1813650 - protein, 25 aa, Staphylococcus epidermidis
TPKVKEIFKGIYIPTKEDWQRLARE

SEQ ID NO: 1813651 - protein, 18 aa, Staphylococcus epidermidis
TPKYHKLSEAERNWLNQQ

SEQ ID NO: 1813652 - protein, 20 aa, Staphylococcus epidermidis
TPLDAVKCLALGAKAIGMSR

SEQ ID NO: 1813653 - protein, 20 aa, Staphylococcus epidermidis
TPLDTMLSAFGKRDDINSGG

SEQ ID NO: 1813654 - protein, 30 aa, Staphylococcus epidermidis
TPLFEKGLEMLKELIWNPLIEDEQFNEKYV

SEQ ID NO: 1813655 - protein, 18 aa, Staphylococcus epidermidis
TPLGKLAAWINQDEDFPI

SEQ ID NO: 1813656 - protein, 18 aa, Staphylococcus epidermidis
TPLGKLAAWINQDEDFPM

SEQ ID NO: 1813657 - protein, 17 aa, Staphylococcus epidermidis
TPMGARRLKQWVDRPLI

SEQ ID NO: 1813658 - protein, 20 aa, Staphylococcus epidermidis
TPNYRKHWQVIFDLDNDQKL

SEQ ID NO: 1813659 - protein, 20 aa, Staphylococcus epidermidis
TPNYRKHWQVIFDLDNKQKL

SEQ ID NO: 1813660 - protein, 25 aa, Staphylococcus epidermidis
TPPCMYYYKCGGCQLQHMTYQAQLD

SEQ ID NO: 1813661 - protein, 25 aa, Staphylococcus epidermidis
TPQDIQAGYNFGAKGIGLVRTEHMF

SEQ ID NO: 1813662 - protein, 28 aa, Staphylococcus epidermidis
TPQMVLRFKRRFGDDVAVLHSGLSNGER

SEQ ID NO: 1813663 - protein, 25 aa, Staphylococcus epidermidis
TPQYAIELWSKCVNELVEKNVSFSA

SEQ ID NO: 1813664 - protein, 18 aa, Staphylococcus epidermidis
TPRLLMRGAGDPKGSSVG

SEQ ID NO: 1813665 - protein, 23 aa, Staphylococcus epidermidis
TPSFIEMCLLLPNLNEQQYSSLK

SEQ ID NO: 1813666 - protein, 18 aa, Staphylococcus epidermidis
TPSSLTPRDVYFNIAKDQ

SEQ ID NO: 1813667 - protein, 22 aa, Staphylococcus epidermidis
TPTEMCGLKVIAIEDFETGKKT

SEQ ID NO: 1813668 - protein, 18 aa, Staphylococcus epidermidis
TPTMEEFINALYEGINQT

SEQ ID NO: 1813669 - protein, 22 aa, Staphylococcus epidermidis
TPVPPYDTGDMWTQGASGDILV

SEQ ID NO: 1813670 - protein, 23 aa, Staphylococcus epidermidis
TQALLSLPFDYMFFTGSEKVGKI

SEQ ID NO: 1813671 - protein, 23 aa, Staphylococcus epidermidis
TQDECPPCTFVKNYLSEHDIEYT

SEQ ID NO: 1813672 - protein, 24 aa, Staphylococcus epidermidis
TQEPWTSCEFDFTNDGKLNVSFDY

SEQ ID NO: 1813673 - protein, 23 aa, Staphylococcus epidermidis
TQFSTSKFKGYLKYINDEKSNKA

SEQ ID NO: 1813674 - protein, 19 aa, Staphylococcus epidermidis
TQGRVGWNLVTSMTDAEAQ

SEQ ID NO: 1813675 - protein, 17 aa, Staphylococcus epidermidis
TQIEKGKDFIFDATVTV

SEQ ID NO: 1813676 - protein, 17 aa, Staphylococcus epidermidis
TQIHLDFPSVGATQNII

SEQ ID NO: 1813677 - protein, 25 aa, Staphylococcus epidermidis
TQKSPRWAIAYKFPAEEVVTKLLDI

SEQ ID NO: 1813678 - protein, 17 aa, Staphylococcus epidermidis
TQLEVGDNIIIYNKKKE

SEQ ID NO: 1813679 - protein, 19 aa, Staphylococcus epidermidis
TQLKAKRALVGNNDTFLIL

SEQ ID NO: 1813680 - protein, 23 aa, Staphylococcus epidermidis
TQLLERFLFPSATHGKKVYKLSG

SEQ ID NO: 1813681 - protein, 18 aa, Staphylococcus epidermidis
TQLLERFLFPSSTHGKKI

SEQ ID NO: 1813682 - protein, 19 aa, Staphylococcus epidermidis
TQLLFQFLFSQGRLEEARA

SEQ ID NO: 1813683 - protein, 19 aa, Staphylococcus epidermidis
TQLLFQFLFSQGRLTDARA

SEQ ID NO: 1813684 - protein, 18 aa, Staphylococcus epidermidis
TQPFTGQGIHYFKVNGLT

SEQ ID NO: 1813685 - protein, 23 aa, Staphylococcus epidermidis
TQQSFTRYGCSYVPMDEALARTV

SEQ ID NO: 1813686 - protein, 24 aa, Staphylococcus epidermidis
TQSFPTLEVFDWLQKQGNISTNEM

SEQ ID NO: 1813687 - protein, 24 aa, Staphylococcus epidermidis
TQSFPTLKVFDWLQQQAKISTDEM

SEQ ID NO: 1813688 - protein, 20 aa, Staphylococcus epidermidis
TQTFSCIQLLIQTLSHKRKE

SEQ ID NO: 1813689 - protein, 21 aa, Staphylococcus epidermidis
TQTKFFKGNKIIAIGQISDLG

SEQ ID NO: 1813690 - protein, 23 aa, Staphylococcus epidermidis
TQTLIHLPFDYMFFTGSEKVGKV

SEQ ID NO: 1813691 - protein, 23 aa, Staphylococcus epidermidis
TQTLRLPKFKTMKVNVENQLSQQ

SEQ ID NO: 1813692 - protein, 17 aa, Staphylococcus epidermidis
TQVGAEFLQRFNGGMGI

SEQ ID NO: 1813693 - protein, 21 aa, Staphylococcus epidermidis
TQVQLAFCIDVRSEPFRRHLE

SEQ ID NO: 1813694 - protein, 18 aa, Staphylococcus epidermidis
TRAATLAVNGLKLAFRGL

SEQ ID NO: 1813695 - protein, 18 aa, Staphylococcus epidermidis
TRALLDQYGFNFKKSLGQ

SEQ ID NO: 1813696 - protein, 24 aa, Staphylococcus epidermidis
TRALRFYKRLDFVTIDSSIDKTNH

SEQ ID NO: 1813697 - protein, 22 aa, Staphylococcus epidermidis
TRARQKVTFSYSLMGNSGDEKE

SEQ ID NO: 1813698 - protein, 20 aa, Staphylococcus epidermidis
TRASLKIQEGCNNFCTFCII

SEQ ID NO: 1813699 - protein, 17 aa, Staphylococcus epidermidis
TRELAMQVAEQLREFSK

SEQ ID NO: 1813700 - protein, 21 aa, Staphylococcus epidermidis
TRELKTLLSSTKIELILENNI

SEQ ID NO: 1813701 - protein, 24 aa, Staphylococcus epidermidis
TRELSRLYVYAHYKGLKSLYYTRN

SEQ ID NO: 1813702 - protein, 23 aa, Staphylococcus epidermidis
TREYIPVLMFSPKINEYHELSQD

SEQ ID NO: 1813703 - protein, 17 aa, Staphylococcus epidermidis
TREYLYYVCKGEDFRNS

SEQ ID NO: 1813704 - protein, 25 aa, Staphylococcus epidermidis
TRGLESIGLSVYWLISDMVIKKNIM

SEQ ID NO: 1813705 - protein, 31 aa, Staphylococcus epidermidis
TRHELSFPADLYFEGSDQYRGWFNSSITTAV

SEQ ID NO: 1813706 - protein, 18 aa, Staphylococcus epidermidis
TRIAKGIILPSIIPNKKQ

SEQ ID NO: 1813707 - protein, 19 aa, Staphylococcus epidermidis
TRIHLKPTQLVGGYAQISY

SEQ ID NO: 1813708 - protein, 20 aa, Staphylococcus epidermidis
TRIRILHLLFYKEYSVNGIA

SEQ ID NO: 1813709 - protein, 21 aa, Staphylococcus epidermidis
TRISKIYAQLGVKKIRITGGE

SEQ ID NO: 1813710 - protein, 17 aa, Staphylococcus epidermidis
TRISRIYAELGVKKIRI

SEQ ID NO: 1813711 - protein, 25 aa, Staphylococcus epidermidis
TRITRHFYFPPVMADITKWSDQHHK

SEQ ID NO: 1813712 - protein, 17 aa, Staphylococcus epidermidis
TRKAEVLYEELAHHKLT

SEQ ID NO: 1813713 - protein, 20 aa, Staphylococcus epidermidis
TRKDMDALTEFVNIYGAKGL

SEQ ID NO: 1813714 - protein, 20 aa, Staphylococcus epidermidis
TRKRTMVFEGVVPNVNRRYH

SEQ ID NO: 1813715 - protein, 19 aa, Staphylococcus epidermidis
TRLAQSMDFLKENEYERHH

SEQ ID NO: 1813716 - protein, 22 aa, Staphylococcus epidermidis
TRLGHVKGYFIYPYQEELKNSN

SEQ ID NO: 1813717 - protein, 18 aa, Staphylococcus epidermidis
TRLKTMGKLAMLMLEDLN

SEQ ID NO: 1813718 - protein, 17 aa, Staphylococcus epidermidis
TRLLNEWEMSSDELMAF

SEQ ID NO: 1813719 - protein, 20 aa, Staphylococcus epidermidis
TRLLNRCELNNWSYELYKEI

SEQ ID NO: 1813720 - protein, 17 aa, Staphylococcus epidermidis
TRLNLSLSTNDVITDKI

SEQ ID NO: 1813721 - protein, 20 aa, Staphylococcus epidermidis
TRLSNELLLNLDAKYTDFIA

SEQ ID NO: 1813722 - protein, 22 aa, Staphylococcus epidermidis
TRLVEMVRPQLSSVIQPLYDIG

SEQ ID NO: 1813723 - protein, 23 aa, Staphylococcus epidermidis
TRNINRIILMFSLTNDLKITING

SEQ ID NO: 1813724 - protein, 18 aa, Staphylococcus epidermidis
TRPDVERVINKAKPLNQS

SEQ ID NO: 1813725 - protein, 22 aa, Staphylococcus epidermidis
TRPEAIKMAPLIKTLEKDSNLE

SEQ ID NO: 1813726 - protein, 22 aa, Staphylococcus epidermidis
TRPEAIKMAPLVKALEKDPELE

SEQ ID NO: 1813727 - protein, 22 aa, Staphylococcus epidermidis
TRPTPNHILVPLLIEELNHVPR

SEQ ID NO: 1813728 - protein, 18 aa, Staphylococcus epidermidis
TRQSIARDLSKLGANANQ

SEQ ID NO: 1813729 - protein, 25 aa, Staphylococcus epidermidis
TRQVGEPFIDFVICSSESYSKDVLQ

SEQ ID NO: 1813730 - protein, 23 aa, Staphylococcus epidermidis
TRSEVKQLLKKGAVKVNQNKVKS

SEQ ID NO: 1813731 - protein, 25 aa, Staphylococcus epidermidis
TRSKLRKALPEQFVYIIEELLYKSN

SEQ ID NO: 1813732 - protein, 34 aa, Staphylococcus epidermidis
TRSPRIYNFWYRPRKARCMFNIDIRDTMKLAPPG

SEQ ID NO: 1813733 - protein, 21 aa, Staphylococcus epidermidis
TRTEIPFLIDCVQTAVDAGAT

SEQ ID NO: 1813734 - protein, 17 aa, Staphylococcus epidermidis
TRTTDWGIDGYALSFNY

SEQ ID NO: 1813735 - protein, 23 aa, Staphylococcus epidermidis
TRTYNNLVNLEWIYKERPQDDER

SEQ ID NO: 1813736 - protein, 18 aa, Staphylococcus epidermidis
TRVILMCPQGRPFTQEIA

SEQ ID NO: 1813737 - protein, 21 aa, Staphylococcus epidermidis
TRYRSGSCSILKKALENKIQE

SEQ ID NO: 1813738 - protein, 17 aa, Staphylococcus epidermidis
TSAKRWLDHYFNGDDPM

SEQ ID NO: 1813739 - protein, 20 aa, Staphylococcus epidermidis
TSDNNCLVVLPLNKAISEST

SEQ ID NO: 1813740 - protein, 23 aa, Staphylococcus epidermidis
TSEIKLRKFLKVIQKAIHYINHH

SEQ ID NO: 1813741 - protein, 22 aa, Staphylococcus epidermidis
TSENLDLFFSYRVEKGQTGRML

SEQ ID NO: 1813742 - protein, 22 aa, Staphylococcus epidermidis
TSENLELFFSYRVEKGNTGRML

SEQ ID NO: 1813743 - protein, 30 aa, Staphylococcus epidermidis; identical to SEQ ID NO: 1746614

SEQ ID NO: 1813744 - protein, 18 aa, Staphylococcus epidermidis
TSFGFKHGIQMDADLVFD

SEQ ID NO: 1813745 - protein, 22 aa, Staphylococcus epidermidis
TSFPEGWHEWVAAAKAKPVYGA

SEQ ID NO: 1813746 - protein, 20 aa, Staphylococcus epidermidis
TSHAKTLFSTHYHELTSLDQ

SEQ ID NO: 1813747 - protein, 21 aa, Staphylococcus epidermidis
TSHAKTLFSTHYHELTSLDQM

SEQ ID NO: 1813748 - protein, 18 aa, Staphylococcus epidermidis
TSHAQYGKQFKIIKRYNE

SEQ ID NO: 1813749 - protein, 17 aa, Staphylococcus epidermidis
TSHELNQLINITTHILN

SEQ ID NO: 1813750 - protein, 17 aa, Staphylococcus epidermidis
TSIHMLLDYLFEMINPY

SEQ ID NO: 1813751 - protein, 17 aa, Staphylococcus epidermidis
TSIIQAIGRTLGVQTPM

SEQ ID NO: 1813752 - protein, 17 aa, Staphylococcus epidermidis
TSKEVRHVLNFKDKNGC

SEQ ID NO: 1813753 - protein, 31 aa, Staphylococcus epidermidis; identical to SEQ ID NO: 1673378

SEQ ID NO: 1813754 - protein, 21 aa, Staphylococcus epidermidis
TSKPKIKSVVNFITDDLISCH

SEQ ID NO: 1813755 - protein, 17 aa, Staphylococcus epidermidis
TSKRWLLKTYSFESNDV

SEQ ID NO: 1813756 - protein, 38 aa, Staphylococcus epidermidis
TSLFKLKSPLWTLAKDIYQEWYLGKALFNQVEYKKDIQ

SEQ ID NO: 1813757 - protein, 25 aa, Staphylococcus epidermidis
TSLGGKFGIGPMFSKVFESLFSIEG

SEQ ID NO: 1813758 - protein, 25 aa, Staphylococcus epidermidis
TSLKNYRIYFEPLIKKNDKEFKEGV

SEQ ID NO: 1813759 - protein, 24 aa, Staphylococcus epidermidis
TSLVRRLNLLANRNITKETHASFL

SEQ ID NO: 1813760 - protein, 21 aa, Staphylococcus epidermidis
TSNETIEFDALIDFELDMLYR

SEQ ID NO: 1813761 - protein, 26 aa, Staphylococcus epidermidis
TSPRSIYCGTIGVLLPDGRMIFNIPI

SEQ ID NO: 1813762 - protein, 20 aa, Staphylococcus epidermidis
TSQPPIGRFIEKYEELAKED

SEQ ID NO: 1813763 - protein, 20 aa, Staphylococcus epidermidis
TSRFYQYWLDHVDQDLADAK

SEQ ID NO: 1813764 - protein, 18 aa, Staphylococcus epidermidis
TSRLKVEIGQSVERGEVL

SEQ ID NO: 1813765 - protein, 21 aa, Staphylococcus epidermidis
TSSDLILYVSYFNHSFTDNDK

SEQ ID NO: 1813766 - protein, 30 aa, Staphylococcus epidermidis
TSSGRTPSELGFRYYVNRLLEQTSHQNQNK

SEQ ID NO: 1813767 - protein, 20 aa, Staphylococcus epidermidis
TSTPVLRPLLTLDKEDIIKK

SEQ ID NO: 1813768 - protein, 25 aa, Staphylococcus epidermidis
TSTRRIMMRVADAFVHKIGAHAIVN

SEQ ID NO: 1813769 - protein, 18 aa, Staphylococcus epidermidis
TSVCNGVPTPGFSASINY

SEQ ID NO: 1813770 - protein, 26 aa, Staphylococcus epidermidis
TSVKIKPPFYYPLNKIISIGTMIKEA

SEQ ID NO: 1813771 - protein, 23 aa, Staphylococcus epidermidis
TSVRMNTKWTQKGRLFIYELLKD

SEQ ID NO: 1813772 - protein, 17 aa, Staphylococcus epidermidis
TSYPSKEAIGLLEETIE

SEQ ID NO: 1813773 - protein, 22 aa, Staphylococcus epidermidis
TTADMLGMLGFRLQPTSDGLII

SEQ ID NO: 1813774 - protein, 20 aa, Staphylococcus epidermidis
TTAKALVNIENFNGTKAEAD

SEQ ID NO: 1813775 - protein, 25 aa, Staphylococcus epidermidis
TTASRKETIEWTKSMGADIVLNYKE

SEQ ID NO: 1813776 - protein, 24 aa, Staphylococcus epidermidis
TTCKKAAKFLDEYGVSYEPIDIVQ

SEQ ID NO: 1813777 - protein, 17 aa, Staphylococcus epidermidis
TTCKVCGFDFKAKYGDL

SEQ ID NO: 1813778 - protein, 32 aa, Staphylococcus epidermidis
TTDIEYRFPFGWGELWGIASRTDFDLQKHSEH

SEQ ID NO: 1813779 - protein, 25 aa, Staphylococcus epidermidis
TTDTLWDFKVSKQLPQKNQTLQLAI

SEQ ID NO: 1813780 - protein, 19 aa, Staphylococcus epidermidis
TTEACEFRDHIEDFNQLDV

SEQ ID NO: 1813781 - protein, 33 aa, Staphylococcus epidermidis
TTELAYTIAHRGNYNYFSFKGMRSEGNNELHVT

SEQ ID NO: 1813782 - protein, 22 aa, Staphylococcus epidermidis
TTEVPLKATIKYISELVEELEI

SEQ ID NO: 1813783 - protein, 23 aa, Staphylococcus epidermidis
TTGIPKERLISFAHEVAKAESVA

SEQ ID NO: 1813784 - protein, 21 aa, Staphylococcus epidermidis
TTHSFIRYYLTRPLETGKTYT

SEQ ID NO: 1813785 - protein, 24 aa, Staphylococcus epidermidis
TTIDFKQSLMGGGFQIDNPNAIAS

SEQ ID NO: 1813786 - protein, 19 aa, Staphylococcus epidermidis
TTIGEFGIQLLEGAPSEIK

SEQ ID NO: 1813787 - protein, 18 aa, Staphylococcus epidermidis
TTIIRLIMDLIQSESGTI

SEQ ID NO: 1813788 - protein, 17 aa, Staphylococcus epidermidis
TTISGKIYTEFKTFENG

SEQ ID NO: 1813789 - protein, 19 aa, Staphylococcus epidermidis
TTKGFWQQKFADFIRYEEQ

SEQ ID NO: 1813790 - protein, 17 aa, Staphylococcus epidermidis
TTKQLIELSQWFDENSI

SEQ ID NO: 1813791 - protein, 21 aa, Staphylococcus epidermidis
TTLEGFIWAHYEPQMSVVQIE

SEQ ID NO: 1813792 - protein, 18 aa, Staphylococcus epidermidis
TTLQTCIEFIARTLSQTN

SEQ ID NO: 1813793 - protein, 23 aa, Staphylococcus epidermidis
TTLRRLMDLYGFKEVLQNSDLPM

SEQ ID NO: 1813794 - protein, 22 aa, Staphylococcus epidermidis
TTLSNKGYRVLLATTDPTKEIN

SEQ ID NO: 1813795 - protein, 20 aa, Staphylococcus epidermidis
TTLVCAIVYDKKVVVANVGD

SEQ ID NO: 1813796 - protein, 24 aa, Staphylococcus epidermidis
TTNRFSIMMHELLKTSSIGEYFGK

SEQ ID NO: 1813797 - protein, 17 aa, Staphylococcus epidermidis
TTPEHIRYIKSAVQGLT

SEQ ID NO: 1813798 - protein, 20 aa, Staphylococcus epidermidis
TTPPGIAITGVIVIGTGVTL

SEQ ID NO: 1813799 - protein, 23 aa, Staphylococcus epidermidis
TTSKRIVKMLKDSGANQVHVRIA

SEQ ID NO: 1813800 - protein, 18 aa, Staphylococcus epidermidis
TTSLLAYTNHIHVVSPTI

SEQ ID NO: 1813801 - protein, 25 aa, Staphylococcus epidermidis
TTTAVCGLARCKKADIDAVYEATKL

SEQ ID NO: 1813802 - protein, 17 aa, Staphylococcus epidermidis
TTTGRPRRVGWFDSVVL

SEQ ID NO: 1813803 - protein, 18 aa, Staphylococcus epidermidis
TTTIKCLMGMESLNEGYA

SEQ ID NO: 1813804 - protein, 20 aa, Staphylococcus epidermidis
TTTLRLKECGAILGIELLDH

SEQ ID NO: 1813805 - protein, 24 aa, Staphylococcus epidermidis
TTTVTGLPSGLSFDQTTNTITGTP

SEQ ID NO: 1813806 - protein, 19 aa, Staphylococcus epidermidis
TTVIRLIMDLIQSKNGQIS

SEQ ID NO: 1813807 - protein, 24 aa, Staphylococcus epidermidis
TTVKVEAKLPVFGDILKVLGATDI

SEQ ID NO: 1813808 - protein, 18 aa, Staphylococcus epidermidis
TVEAGVRKGAYVVFETEK

SEQ ID NO: 1813809 - protein, 17 aa, Staphylococcus epidermidis
TVEDWKQWYDMQILHEY

SEQ ID NO: 1813810 - protein, 19 aa, Staphylococcus epidermidis
TVEEWSIKDILDFQKPHTY

SEQ ID NO: 1813811 - protein, 22 aa, Staphylococcus epidermidis
TVGKGGLLLTLAKISAYYNMGL

SEQ ID NO: 1813812 - protein, 21 aa, Staphylococcus epidermidis
TVGLELLDKGIARTGYEVLNL

SEQ ID NO: 1813813 - protein, 23 aa, Staphylococcus epidermidis
TVGLELLGKGIARTGYEVLDENS

SEQ ID NO: 1813814 - protein, 27 aa, Staphylococcus epidermidis
TVIASCWIYKKGDAIPSTIPIGKPLAN

SEQ ID NO: 1813815 - protein, 26 aa, Staphylococcus epidermidis
TVKDIEYYMGIPIERSFRLMSPTPLD

SEQ ID NO: 1813816 - protein, 22 aa, Staphylococcus epidermidis
TVKGAYKTYAYVVSYKPTNGNE

SEQ ID NO: 1813817 - protein, 23 aa, Staphylococcus epidermidis
TVKGAYKTYAYVVSYKPTNGNEK

SEQ ID NO: 1813818 - protein, 24 aa, Staphylococcus epidermidis
TVKKYWGSLIIKGQIGYNTEIRPN

SEQ ID NO: 1813819 - protein, 28 aa, Staphylococcus epidermidis
TVKRPEVVEKIKVARSFGDLSENSEYDA

SEQ ID NO: 1813820 - protein, 27 aa, Staphylococcus epidermidis
TVLDCTQFPFRIARPGSVTKEMIEKVL

SEQ ID NO: 1813821 - protein, 17 aa, Staphylococcus epidermidis
TVLETGSDFGLAFDGDG

SEQ ID NO: 1813822 - protein, 19 aa, Staphylococcus epidermidis
TVLIKSVYRLTGLKTGSNL

SEQ ID NO: 1813823 - protein, 22 aa, Staphylococcus epidermidis
TVLRGFKPYYIEHGAFSGALGA

SEQ ID NO: 1813824 - protein, 23 aa, Staphylococcus epidermidis
TVPSKAWLKEAIKNIPEDNEKKL

SEQ ID NO: 1813825 - protein, 30 aa, Staphylococcus epidermidis
TVQSIPMAIKYYKVFKEMREAGLHNLNVST

SEQ ID NO: 1813826 - protein, 33 aa, Staphylococcus epidermidis
TVRGLRLETVHGFKYKILYAMEKLAMFCATDVI

SEQ ID NO: 1813827 - protein, 22 aa, Staphylococcus epidermidis
TVSLWKEWYNLKIVNETATSTD

SEQ ID NO: 1813828 - protein, 20 aa, Staphylococcus epidermidis
TVSLWKEWYNMKIVNETATS

SEQ ID NO: 1813829 - protein, 24 aa, Staphylococcus epidermidis
TVSPGLRIGWIVADKNVINHLSDL

SEQ ID NO: 1813830 - protein, 25 aa, Staphylococcus epidermidis
TVTRLKGGDPFVFGRGGEEAEELAN

SEQ ID NO: 1813831 - protein, 22 aa, Staphylococcus epidermidis
TVVAGTKYRGEFEERLKKVMEE

SEQ ID NO: 1813832 - protein, 18 aa, Staphylococcus epidermidis
TVVDELLLIDVLRNQIIR

SEQ ID NO: 1813833 - protein, 39 aa, Staphylococcus epidermidis
TVVDYNYMIGMSFNQLEAFKEALPFLMTAAEKDENNDAE

SEQ ID NO: 1813834 - protein, 17 aa, Staphylococcus epidermidis
TVVYRVIQEAVLNSLKY

SEQ ID NO: 1813835 - protein, 18 aa, Staphylococcus epidermidis
TVYEWPDIAHELTKARKD

SEQ ID NO: 1813836 - protein, 23 aa, Staphylococcus epidermidis
TVYKGLEMFINFQPDTIIALGGG

SEQ ID NO: 1813837 - protein, 19 aa, Staphylococcus epidermidis
TVYKNKPFIRIKDGLPQLN

SEQ ID NO: 1813838 - protein, 28 aa, Staphylococcus epidermidis
TVYNIPFLWRLTSELNVAQLKRALNQLI

SEQ ID NO: 1813839 - protein, 26 aa, Staphylococcus epidermidis
TWKQHKVKLVFFLAMSKKDLNINRKI

SEQ ID NO: 1813840 - protein, 17 aa, Staphylococcus epidermidis
TYAKYYGDLKVKDHQIL

SEQ ID NO: 1813841 - protein, 25 aa, Staphylococcus epidermidis
TYCGECKNCLDGNAGACENFVALNL

SEQ ID NO: 1813842 - protein, 23 aa, Staphylococcus epidermidis
TYDIFQVYSPQIWEEIIGMQDVL

SEQ ID NO: 1813843 - protein, 20 aa, Staphylococcus epidermidis
TYDKNGVYCAVWINDNQYAL

SEQ ID NO: 1813844 - protein, 24 aa, Staphylococcus epidermidis
TYDLSVPIYLPLKTLIPLIIDSLG

SEQ ID NO: 1813845 - protein, 26 aa, Staphylococcus epidermidis
TYDYDLRSAYPFQMQCMRMIDFDKPP

SEQ ID NO: 1813846 - protein, 17 aa, Staphylococcus epidermidis
TYEEAYAVLNLVHAKLE

SEQ ID NO: 1813847 - protein, 17 aa, Staphylococcus epidermidis
TYEHVKLAVTRAVIQLN

SEQ ID NO: 1813848 - protein, 24 aa, Staphylococcus epidermidis
TYFKKGESIVVVIKGNEIIKGNSS

SEQ ID NO: 1813849 - protein, 23 aa, Staphylococcus epidermidis
TYGDLACFSFYPNKNITTGEGGV

SEQ ID NO: 1813850 - protein, 17 aa, Staphylococcus epidermidis
TYHLQFFTPSSIGAFGA

SEQ ID NO: 1813851 - protein, 17 aa, Staphylococcus epidermidis
TYIALLLGYYDATKKYD

SEQ ID NO: 1813852 - protein, 24 aa, Staphylococcus epidermidis
TYIHYVLMCDGVDLAMKQRVEDFV

SEQ ID NO: 1813853 - protein, 17 aa, Staphylococcus epidermidis
TYIKALNRMVELVPSVK

SEQ ID NO: 1813854 - protein, 20 aa, Staphylococcus epidermidis
TYIKHLITINVKNYKKETIE

SEQ ID NO: 1813855 - protein, 18 aa, Staphylococcus epidermidis
TYKADFKDRKAIEHIDID

SEQ ID NO: 1813856 - protein, 29 aa, Staphylococcus epidermidis
TYKIMTMFEPYFRDYKLIFINSPSRGKST

SEQ ID NO: 1813857 - protein, 20 aa, Staphylococcus epidermidis
TYLFCVAYCELLGIDLTVNL

SEQ ID NO: 1813858 - protein, 19 aa, Staphylococcus epidermidis
TYLPESFVIAGNVGTPEGV

SEQ ID NO: 1813859 - protein, 18 aa, Staphylococcus epidermidis
TYLQKGIVFLMIRFKTLD

SEQ ID NO: 1813860 - protein, 24 aa, Staphylococcus epidermidis
TYLVKSKRQGQSMIYSIDDRHVST

SEQ ID NO: 1813861 - protein, 34 aa, Staphylococcus epidermidis
TYNFKHAIIATGSRPIEIPNFEFGERVIDSTGAL

SEQ ID NO: 1813862 - protein, 19 aa, Staphylococcus epidermidis
TYNIAWSMVASAHIFVDDK

SEQ ID NO: 1813863 - protein, 26 aa, Staphylococcus epidermidis
TYPGRFKCLALLPMPHVKETIKEIEY

SEQ ID NO: 1813864 - protein, 23 aa, Staphylococcus epidermidis
TYQFKSVCINPSHVAYAAQKLKE

SEQ ID NO: 1813865 - protein, 26 aa, Staphylococcus epidermidis
TYRKETDCVPCFRYRDYSNDYMDDPN

SEQ ID NO: 1813866 - protein, 25 aa, Staphylococcus epidermidis
TYSLGMKQKLGIAIAFLNQPQLIIL

SEQ ID NO: 1813867 - protein, 26 aa, Staphylococcus epidermidis
TYSLGMKQKLGIAIAFLNSPKLIILD

SEQ ID NO: 1813868 - protein, 23 aa, Staphylococcus epidermidis
TYVTEGKNEWAFETKDKSFVAQI

SEQ ID NO: 1813869 - protein, 17 aa, Staphylococcus epidermidis
TYWNCLCDCGNKVTVRS

SEQ ID NO: 1813870 - protein, 17 aa, Staphylococcus epidermidis
TYYEVIQQLHIHPLLTV

SEQ ID NO: 1813871 - protein, 18 aa, Staphylococcus epidermidis
TYYEYTLRIETINNEMRK

SEQ ID NO: 1813872 - protein, 22 aa, Staphylococcus epidermidis
VAALKTGYVKVNFHNGNEYVAV

SEQ ID NO: 1813873 - protein, 19 aa, Staphylococcus epidermidis
VADGVVIGSEIVKRLAEND

SEQ ID NO: 1813874 - protein, 24 aa, Staphylococcus epidermidis
VADLKVEGALAMILKDAIKPNLVQ

SEQ ID NO: 1813875 - protein, 20 aa, Staphylococcus epidermidis
VADVKISGDFTIENDPEDSI

SEQ ID NO: 1813876 - protein, 20 aa, Staphylococcus epidermidis
VAEAIRYLAGKGFSKQLITV

SEQ ID NO: 1813877 - protein, 31 aa, Staphylococcus epidermidis
VAEGPGSYTGLRIGVTVAKTLAYALQTRLYG

SEQ ID NO: 1813878 - protein, 31 aa, Staphylococcus epidermidis
VAEKLNLKFDYRAGKINGLHPGRTAIVSLNG

SEQ ID NO: 1813879 - protein, 26 aa, Staphylococcus epidermidis
VAETEVINVFPIRFVVDKDNEVSDPK

SEQ ID NO: 1813880 - protein, 28 aa, Staphylococcus epidermidis
VAFDKLGYRIGYGGGYYDRFLSQHRSNT

SEQ ID NO: 1813881 - protein, 26 aa, Staphylococcus epidermidis
VAFIMSLIRQPECLVVDEPTSALDKE

SEQ ID NO: 1813882 - protein, 23 aa, Staphylococcus epidermidis
VAFVRASYDFMGIPLDDETLIKE

SEQ ID NO: 1813883 - protein, 26 aa, Staphylococcus epidermidis
VAGKGRSGFVANSFAMRLNQLGEDAF

SEQ ID NO: 1813884 - protein, 24 aa, Staphylococcus epidermidis
VAGNVLRFQPPLVITYEQLDQALD

SEQ ID NO: 1813885 - protein, 23 aa, Staphylococcus epidermidis
VAGRMSAQVGAEFLQRFNGGMGI

SEQ ID NO: 1813886 - protein, 20 aa, Staphylococcus epidermidis
VAIKEQFRGYGLGQLLLKYV

SEQ ID NO: 1813887 - protein, 26 aa, Staphylococcus epidermidis
VAKLKESFSGYGLNLFSHPNLFNAVH

SEQ ID NO: 1813888 - protein, 26 aa, Staphylococcus epidermidis
VAKRAAAKQTRWFPVIGQAVSASISY

SEQ ID NO: 1813889 - protein, 18 aa, Staphylococcus epidermidis
VAKTYSVHLLYWEYHDFY

SEQ ID NO: 1813890 - protein, 19 aa, Staphylococcus epidermidis
VAKTYSVHLLYWEYHDFYI

SEQ ID NO: 1813891 - protein, 18 aa, Staphylococcus epidermidis
VALDGGFDCPNRDGTVAH

SEQ ID NO: 1813892 - protein, 24 aa, Staphylococcus epidermidis
VALEHLQKLLPIPVIGVIEPGART

SEQ ID NO: 1813893 - protein, 25 aa, Staphylococcus epidermidis
VALLAELCSVSLFPINQLKEVTTQS

SEQ ID NO: 1813894 - protein, 17 aa, Staphylococcus epidermidis
VALSTDERVLWVTETTT

SEQ ID NO: 1813895 - protein, 18 aa, Staphylococcus epidermidis
VAMAKIIKVFKLKPNCHC

SEQ ID NO: 1813896 - protein, 18 aa, Staphylococcus epidermidis
VANCLESKNYISIVKGLV

SEQ ID NO: 1813897 - protein, 21 aa, Staphylococcus epidermidis
VANFRKQHLGFIFQDYSVLPT

SEQ ID NO: 1813898 - protein, 30 aa, Staphylococcus epidermidis
VAPLKYKQVLPCQFCNYKSVCHVDGLIDSK

SEQ ID NO: 1813899 - protein, 22 aa, Staphylococcus epidermidis
VAQHVYKNLGFQYGGKRKNYYG

SEQ ID NO: 1813900 - protein, 27 aa, Staphylococcus epidermidis
VAQWPNSRLDHWLSLLKARAIENDIFI

SEQ ID NO: 1813901 - protein, 27 aa, Staphylococcus epidermidis
VAQWPSARLNHWLSLLKARAIENDMYV

SEQ ID NO: 1813902 - protein, 20 aa, Staphylococcus epidermidis
VARTDYIRKLGFSYASMEEQ

SEQ ID NO: 1813903 - protein, 22 aa, Staphylococcus epidermidis
VARVKAILRRSKFVSEIEKEDT

SEQ ID NO: 1813904 - protein, 28 aa, Staphylococcus epidermidis
VASCAHMMIWEGIELLPVTNNNKKAVGV

SEQ ID NO: 1813905 - protein, 23 aa, Staphylococcus epidermidis
VASEIMAILCLSRSIKDLKDKIS

SEQ ID NO: 1813906 - protein, 17 aa, Staphylococcus epidermidis
VATKIKGMIAAEVSDER

SEQ ID NO: 1813907 - protein, 28 aa, Staphylococcus epidermidis
VATRLGHVKGYFIYPYQEVMKDSNVKLF

SEQ ID NO: 1813908 - protein, 17 aa, Staphylococcus epidermidis
VATSYVHTATQFFNKEG

SEQ ID NO: 1813909 - protein, 19 aa, Staphylococcus epidermidis
VAVALELIHMATLVHDDVI

SEQ ID NO: 1813910 - protein, 21 aa, Staphylococcus epidermidis
VAVGYYLRYALSYRDISEILR

SEQ ID NO: 1813911 - protein, 22 aa, Staphylococcus epidermidis
VAYSDRAKKRFADVETPRFYLD

SEQ ID NO: 1813912 - protein, 18 aa, Staphylococcus epidermidis
VCELLHLYQSFYQTFISF

SEQ ID NO: 1813913 - protein, 18 aa, Staphylococcus epidermidis
VCENCSFTKAAQELNYVQ

SEQ ID NO: 1813914 - protein, 20 aa, Staphylococcus epidermidis
VCGYQSIWVEGYEQHCSHIL

SEQ ID NO: 1813915 - protein, 24 aa, Staphylococcus epidermidis
VCISDPKLSFDAMTIVGNLNRDNA

SEQ ID NO: 1813916 - protein, 22 aa, Staphylococcus epidermidis
VCKDKRFEKYFCDPNYKYFRHS

SEQ ID NO: 1813917 - protein, 25 aa, Staphylococcus epidermidis
VCREVRKKFEMPIIMLTAKDSEIDK

SEQ ID NO: 1813918 - protein, 19 aa, Staphylococcus epidermidis
VCTCPERIFVHEDVHDDFL

SEQ ID NO: 1813919 - protein, 19 aa, Staphylococcus epidermidis
VCTCPERIFVHKDVHDTFV

SEQ ID NO: 1813920 - protein, 18 aa, Staphylococcus epidermidis
VDAFSCNYRDKAIILKAA

SEQ ID NO: 1813921 - protein, 18 aa, Staphylococcus epidermidis
VDALRDIGLEPGPKYQEV

SEQ ID NO: 1813922 - protein, 26 aa, Staphylococcus epidermidis
VDAMISRSEFYTAYTPYQPEISQGEL

SEQ ID NO: 1813923 - protein, 25 aa, Staphylococcus epidermidis
VDAVKKLNVDYVFHPSVDEMYPEEL

SEQ ID NO: 1813924 - protein, 19 aa, Staphylococcus epidermidis
VDDDFRILPYLSSGGAGLA

SEQ ID NO: 1813925 - protein, 23 aa, Staphylococcus epidermidis
VDDEECIICVPLDEKAWHVIYDT

SEQ ID NO: 1813926 - protein, 24 aa, Staphylococcus epidermidis
VDDGLSGPIARFFEDANVETLKQL

SEQ ID NO: 1813927 - protein, 24 aa, Staphylococcus epidermidis
VDDYPFGGGQGMVLKPEPVFNAMQ

SEQ ID NO: 1813928 - protein, 25 aa, Staphylococcus epidermidis
VDEADLMIDLGLIEDVDYIAARLDD

SEQ ID NO: 1813929 - protein, 26 aa, Staphylococcus epidermidis
VDEAVDRACYLLERYASGTVLKDRVS

SEQ ID NO: 1813930 - protein, 21 aa, Staphylococcus epidermidis
VDEAVDRACYLLETYASGTVL

SEQ ID NO: 1813931 - protein, 18 aa, Staphylococcus epidermidis
VDEGINLNAYVSFLETVP

SEQ ID NO: 1813932 - protein, 18 aa, Staphylococcus epidermidis
VDEHIAPINFFGHVHERG

SEQ ID NO: 1813933 - protein, 22 aa, Staphylococcus epidermidis
VDEIKLEFMIKGNELEITKRAI

SEQ ID NO: 1813934 - protein, 20 aa, Staphylococcus epidermidis
VDEIKLEFMISENEKQITEQ

SEQ ID NO: 1813935 - protein, 22 aa, Staphylococcus epidermidis
VDEIKLIKSVLLKAKTSFNNSI

SEQ ID NO: 1813936 - protein, 19 aa, Staphylococcus epidermidis
VDEILILPHVFGEDARMES

SEQ ID NO: 1813937 - protein, 19 aa, Staphylococcus epidermidis
VDELTSALLSKGYKAEGLH

SEQ ID NO: 1813938 - protein, 20 aa, Staphylococcus epidermidis
VDEVEFIKVIREVGRNGVID

SEQ ID NO: 1813939 - protein, 19 aa, Staphylococcus epidermidis
VDFVKQRGLQSFLEKLLYP

SEQ ID NO: 1813940 - protein, 22 aa, Staphylococcus epidermidis
VDFYYRWLEITKLDIINDTSYK

SEQ ID NO: 1813941 - protein, 20 aa, Staphylococcus epidermidis
VDGFHPINIGKLYIDEQTFV

SEQ ID NO: 1813942 - protein, 30 aa, Staphylococcus epidermidis
VDGYYGAQCWDLPNYIFNRYWRFRTTGNAI

SEQ ID NO: 1813943 - protein, 17 aa, Staphylococcus epidermidis
VDHHLFESISLNKEDLR

SEQ ID NO: 1813944 - protein, 19 aa, Staphylococcus epidermidis
VDIAGPGFINFYLDNHYLT

SEQ ID NO: 1813945 - protein, 17 aa, Staphylococcus epidermidis
VDIETLKATQSDIIETI

SEQ ID NO: 1813946 - protein, 18 aa, Staphylococcus epidermidis
VDIFDSRLDLAMELGATH

SEQ ID NO: 1813947 - protein, 23 aa, Staphylococcus epidermidis
VDILDLLSAKGISLYIINLNKNL

SEQ ID NO: 1813948 - protein, 34 aa, Staphylococcus epidermidis
VDISCFKCKGKGCNVCKHTGWIEILGAGMVHPNV

SEQ ID NO: 1813949 - protein, 17 aa, Staphylococcus epidermidis
VDISITYVVAQIEAGAE

SEQ ID NO: 1813950 - protein, 28 aa, Staphylococcus epidermidis
VDKAELGGVCLNRGCIPSKALISASERV

SEQ ID NO: 1813951 - protein, 24 aa, Staphylococcus epidermidis
VDKHGKRILIGWMGLPDIDYPTDS

SEQ ID NO: 1813952 - protein, 28 aa, Staphylococcus epidermidis
VDKYRGESALNYRLTAATFFIKMNQKTV

SEQ ID NO: 1813953 - protein, 17 aa, Staphylococcus epidermidis
VDLDFPGYAIGGLSVGE

SEQ ID NO: 1813954 - protein, 17 aa, Staphylococcus epidermidis
VDLDTESLLGFKTIHTN

SEQ ID NO: 1813955 - protein, 17 aa, Staphylococcus epidermidis
VDLKPGVVGTVLSAQKL

SEQ ID NO: 1813956 - protein, 26 aa, Staphylococcus epidermidis
VDLLAKRLKQEYGLKFESCATKYLKI

SEQ ID NO: 1813957 - protein, 23 aa, Staphylococcus epidermidis
VDLLNLGGGFGIKYVEEDVSFPI

SEQ ID NO: 1813958 - protein, 20 aa, Staphylococcus epidermidis
VDMFESYTSAISNYESIVSQ

SEQ ID NO: 1813959 - protein, 21 aa, Staphylococcus epidermidis
VDMHSFRLFDYVMLGHLHHPF

SEQ ID NO: 1813960 - protein, 17 aa, Staphylococcus epidermidis
VDMRLHRVIYNVIEEIE

SEQ ID NO: 1813961 - protein, 17 aa, Staphylococcus epidermidis
VDNMKIGAVNLLKGTSN

SEQ ID NO: 1813962 - protein, 18 aa, Staphylococcus epidermidis
VDNPEMWEKANPMFSKPM

SEQ ID NO: 1813963 - protein, 26 aa, Staphylococcus epidermidis
VDNVFPTKHAVGLKADNGLELLVHIG

SEQ ID NO: 1813964 - protein, 21 aa, Staphylococcus epidermidis
VDPAFRTGCKLAVVNPFGTFI

SEQ ID NO: 1813965 - protein, 20 aa, Staphylococcus epidermidis
VDPDAKFIIWTTTPWTIPSN

SEQ ID NO: 1813966 - protein, 24 aa, Staphylococcus epidermidis
VDPRLTELPLYLSSDIGNQKSTST

SEQ ID NO: 1813967 - protein, 24 aa, Staphylococcus epidermidis
VDQMLQVVKGHFGKVDIVVNSAGQ

SEQ ID NO: 1813968 - protein, 18 aa, Staphylococcus epidermidis
VDQNFKAVKVIKANLNQL

SEQ ID NO: 1813969 - protein, 17 aa, Staphylococcus epidermidis
VDRIFKRDAELIDYRID

SEQ ID NO: 1813970 - protein, 24 aa, Staphylococcus epidermidis
VDRVPDSWMTIPYGKPLPNQLYRI

SEQ ID NO: 1813971 - protein, 21 aa, Staphylococcus epidermidis
VDRYLAAFVYMFYRHTNNALT

SEQ ID NO: 1813972 - protein, 24 aa, Staphylococcus epidermidis
VDTNLKKRLSQMALDQDTSIKAIV

SEQ ID NO: 1813973 - protein, 17 aa, Staphylococcus epidermidis
VDTPAIFMDHAEGSKIY

SEQ ID NO: 1813974 - protein, 17 aa, Staphylococcus epidermidis
VDTWVAFAPNKRGYKML

SEQ ID NO: 1813975 - protein, 17 aa, Staphylococcus epidermidis
VDVDGYYGAQCWDLPNY

SEQ ID NO: 1813976 - protein, 17 aa, Staphylococcus epidermidis
VDVFDFEGSFINAIKRI

SEQ ID NO: 1813977 - protein, 20 aa, Staphylococcus epidermidis
VDVGQRGFVPASLISTDFIE

SEQ ID NO: 1813978 - protein, 23 aa, Staphylococcus epidermidis
VDYDFTGKIAVSFDELIEFKKKV

SEQ ID NO: 1813979 - protein, 22 aa, Staphylococcus epidermidis
VDYKKSKPCMYVGTEKSTVLNL

SEQ ID NO: 1813980 - protein, 23 aa, Staphylococcus epidermidis
VDYLKVKALMMIPKSKKDIKRIV

SEQ ID NO: 1813981 - protein, 19 aa, Staphylococcus epidermidis
VDYNCALAIDEVERSFFRK

SEQ ID NO: 1813982 - protein, 26 aa, Staphylococcus epidermidis
VDYNHVQSALNFKFMKRINEVGIPVV

SEQ ID NO: 1813983 - protein, 18 aa, Staphylococcus epidermidis
VEAAKIPVIHTLPAKTIL

SEQ ID NO: 1813984 - protein, 17 aa, Staphylococcus epidermidis
VEAAKQYRCVVRLKGGD

SEQ ID NO: 1813985 - protein, 22 aa, Staphylococcus epidermidis
VEACNFKPSTAYDVVGGVINQL

SEQ ID NO: 1813986 - protein, 24 aa, Staphylococcus epidermidis
VEADRLRFDFSHFGPMSQEEIDQV

SEQ ID NO: 1813987 - protein, 19 aa, Staphylococcus epidermidis
VEAMQGYLMKSLKSEFAEM

SEQ ID NO: 1813988 - protein, 20 aa, Staphylococcus epidermidis
VEAMQGYLMQSIKTELEELH

SEQ ID NO: 1813989 - protein, 21 aa, Staphylococcus epidermidis
VEAVKDLGERVNIQVDIGQNQ

SEQ ID NO: 1813990 - protein, 17 aa, Staphylococcus epidermidis
VEDFKDSLNELGLAKEG

SEQ ID NO: 1813991 - protein, 24 aa, Staphylococcus epidermidis
VEDGLSGPIARFFEDANVETLKEL

SEQ ID NO: 1813992 - protein, 19 aa, Staphylococcus epidermidis
VEDIDEWIGLLDQLEEKVK

SEQ ID NO: 1813993 - protein, 19 aa, Staphylococcus epidermidis
VEEAKRILAGLDIEPLTPA

SEQ ID NO: 1813994 - protein, 27 aa, Staphylococcus epidermidis
VEEAPFLRIDLNEMVGALPKQLTKRKL

SEQ ID NO: 1813995 - protein, 30 aa, Staphylococcus epidermidis
VEEFFRALIINARLTVHIDLLRGGNTHHEI

SEQ ID NO: 1813996 - protein, 28 aa, Staphylococcus epidermidis
VEEFKRCIKELGFKGALIMGHPKNGFLD

SEQ ID NO: 1813997 - protein, 25 aa, Staphylococcus epidermidis
VEEGMMLCEYLKVKPELLKFMLKVF

SEQ ID NO: 1813998 - protein, 32 aa, Staphylococcus epidermidis
VEEIKVLFLEGLYKRIGFKDSNIIFYFMPHLY

SEQ ID NO: 1813999 - protein, 21 aa, Staphylococcus epidermidis
VEEQKVIILYALIQSKHAIKQ

SEQ ID NO: 1814000 - protein, 17 aa, Staphylococcus epidermidis
VEFLKSRVASLQKNVLF

SEQ ID NO: 1814001 - protein, 19 aa, Staphylococcus epidermidis
VEFNPLLQMNKGVKLTTTI

SEQ ID NO: 1814002 - protein, 20 aa, Staphylococcus epidermidis
VEFVLEGYLIRKDFFSYTRV

SEQ ID NO: 1814003 - protein, 25 aa, Staphylococcus epidermidis
VEGFKNEHFDKIVVYKDDKELEKLS

SEQ ID NO: 1814004 - protein, 17 aa, Staphylococcus epidermidis
VEGGKAFFAIKAPNMTS

SEQ ID NO: 1814005 - protein, 17 aa, Staphylococcus epidermidis
VEGMSCEHCRNAVESAL

SEQ ID NO: 1814006 - protein, 24 aa, Staphylococcus epidermidis
VEHEADFGFGQCFKHTDNTISKLA

SEQ ID NO: 1814007 - protein, 22 aa, Staphylococcus epidermidis
VEHKVKHIWQHVDRVLLMNYEG

SEQ ID NO: 1814008 - protein, 21 aa, Staphylococcus epidermidis
VEIAPAVQGLVHISEIDHKHI

SEQ ID NO: 1814009 - protein, 23 aa, Staphylococcus epidermidis
VEIAPSVQGLVHISEIDHKHIGS

SEQ ID NO: 1814010 - protein, 23 aa, Staphylococcus epidermidis
VEIKAEDGITFAVEKNTTVKVSG

SEQ ID NO: 1814011 - protein, 22 aa, Staphylococcus epidermidis
VEIKNKIGFVYSETYFNDKWTA

SEQ ID NO: 1814012 - protein, 18 aa, Staphylococcus epidermidis
VEKFPYVVKNSMEGFVFE

SEQ ID NO: 1814013 - protein, 17 aa, Staphylococcus epidermidis
VEKGEFVAIMGPSGSGK

SEQ ID NO: 1814014 - protein, 17 aa, Staphylococcus epidermidis
VEKGMTESSKWVHDRSS

SEQ ID NO: 1814015 - protein, 20 aa, Staphylococcus epidermidis
VEKIIERFKNPNLSDEVTRV

SEQ ID NO: 1814016 - protein, 23 aa, Staphylococcus epidermidis
VEKIKYVGALFLGHYSPEVIGDY

SEQ ID NO: 1814017 - protein, 20 aa, Staphylococcus epidermidis
VELTGSYKLLHCHHNEHKIV

SEQ ID NO: 1814018 - protein, 19 aa, Staphylococcus epidermidis
VEMIEPYKGRIYDPCCGSG

SEQ ID NO: 1814019 - protein, 29 aa, Staphylococcus epidermidis
VEMPIVLPRLRISYMYERTEKLLSQYDLT

SEQ ID NO: 1814020 - protein, 29 aa, Staphylococcus epidermidis
VEMPIVMPRLRITYLYARTKKLLKQYNLS

SEQ ID NO: 1814021 - protein, 22 aa, Staphylococcus epidermidis
VENIEFKMLCMGFKRKEIKELM

SEQ ID NO: 1814022 - protein, 23 aa, Staphylococcus epidermidis
VENLCPFSRDGQMRFLDDNQGGG

SEQ ID NO: 1814023 - protein, 17 aa, Staphylococcus epidermidis
VEPKLKQVFALTQAKFL

SEQ ID NO: 1814024 - protein, 21 aa, Staphylococcus epidermidis
VEQLLKYGIKTLMIGGQVKET

SEQ ID NO: 1814025 - protein, 25 aa, Staphylococcus epidermidis
VERIMSRAKFSFRLTAIDKAILGIG

SEQ ID NO: 1814026 - protein, 18 aa, Staphylococcus epidermidis
VERKLLVEGIIPIEDEDD

SEQ ID NO: 1814027 - protein, 23 aa, Staphylococcus epidermidis
VERLPVELAQFIRLDYQDTTQES

SEQ ID NO: 1814028 - protein, 21 aa, Staphylococcus epidermidis
VERRSKYIIFYIAYHDEDRIL

SEQ ID NO: 1814029 - protein, 20 aa, Staphylococcus epidermidis
VESGRIGIPNKGEWTHKPLR

SEQ ID NO: 1814030 - protein, 20 aa, Staphylococcus epidermidis
VESGRYVFEKVLSQKQLKSK

SEQ ID NO: 1814031 - protein, 20 aa, Staphylococcus epidermidis
VESMAGMDIAVFYLDPTKNS

SEQ ID NO: 1814032 - protein, 18 aa, Staphylococcus epidermidis
VETLAEFSGVPVWNGLTD

SEQ ID NO: 1814033 - protein, 23 aa, Staphylococcus epidermidis
VETPRFYLDLNKYIKSQEQNSTP

SEQ ID NO: 1814034 - protein, 24 aa, Staphylococcus epidermidis
VEVSEINGGLFIKKKEESIEDEIT

SEQ ID NO: 1814035 - protein, 21 aa, Staphylococcus epidermidis
VEYAEFCFKEFTEVNYWTTFN

SEQ ID NO: 1814036 - protein, 18 aa, Staphylococcus epidermidis
VFCYGLMVNYCLQAADIL

SEQ ID NO: 1814037 - protein, 20 aa, Staphylococcus epidermidis
VFDDARLYSKQALVAYFIRQ

SEQ ID NO: 1814038 - protein, 20 aa, Staphylococcus epidermidis
VFDRGGYLYHGRVKALADAA

SEQ ID NO: 1814039 - protein, 18 aa, Staphylococcus epidermidis
VFDRGGYLYHGRVKALAE

SEQ ID NO: 1814040 - protein, 24 aa, Staphylococcus epidermidis
VFDTWKEFITYALNNDNFYFRELI

SEQ ID NO: 1814041 - protein, 24 aa, Staphylococcus epidermidis
VFEHEFDNGLKLFVIPKPGFQKTY

SEQ ID NO: 1814042 - protein, 24 aa, Staphylococcus epidermidis
VFEHELDNGLKLFIIPKPGFQKTF

SEQ ID NO: 1814043 - protein, 21 aa, Staphylococcus epidermidis
VFEKDGKLYAILGAQTNNEQG

SEQ ID NO: 1814044 - protein, 18 aa, Staphylococcus epidermidis
VFEQIKWAIEEQKVSHLF

SEQ ID NO: 1814045 - protein, 23 aa, Staphylococcus epidermidis
VFFKGFKQYNDLVLDLAEELVEA

SEQ ID NO: 1814046 - protein, 18 aa, Staphylococcus epidermidis
VFFLNGFQMKGVIEDFDK

SEQ ID NO: 1814047 - protein, 37 aa, Staphylococcus epidermidis
VFFTNEIYKKLSLEAKVAYSILRDRLELSLQNDWVDS

SEQ ID NO: 1814048 - protein, 21 aa, Staphylococcus epidermidis
VFGIPGAKIDYLFDALEDDGP

SEQ ID NO: 1814049 - protein, 17 aa, Staphylococcus epidermidis
VFGKLSYIGSTVKTLMN

SEQ ID NO: 1814050 - protein, 23 aa, Staphylococcus epidermidis
VFKEKSVLFKDIFNSTNEKLHQQ

SEQ ID NO: 1814051 - protein, 18 aa, Staphylococcus epidermidis
VFKLKPNCHCTSKYLNNF

SEQ ID NO: 1814052 - protein, 21 aa, Staphylococcus epidermidis
VFKSVGLAIVDIIVAQYFYKK

SEQ ID NO: 1814053 - protein, 19 aa, Staphylococcus epidermidis
VFLGIPYAKPFNKISRFQH

SEQ ID NO: 1814054 - protein, 25 aa, Staphylococcus epidermidis
VFMNELKINLLDFRKQMDYLEAIGL

SEQ ID NO: 1814055 - protein, 25 aa, Staphylococcus epidermidis
VFNGLKRVVNFIENFGFTNEDITYL

SEQ ID NO: 1814056 - protein, 26 aa, Staphylococcus epidermidis
VFNKFKEVYQIFSDVLGVPLKGKEAD

SEQ ID NO: 1814057 - protein, 25 aa, Staphylococcus epidermidis
VFNNIKRLNIETVKQDNTSFIKNDV

SEQ ID NO: 1814058 - protein, 25 aa, Staphylococcus epidermidis
VFNVAKAMRTGRIWVNTYNQFPAGA

SEQ ID NO: 1814059 - protein, 19 aa, Staphylococcus epidermidis
VFPELKVTIVDSLNKRIQF

SEQ ID NO: 1814060 - protein, 23 aa, Staphylococcus epidermidis
VFQGEALLFLLGLTNSMAGFEKL

SEQ ID NO: 1814061 - protein, 23 aa, Staphylococcus epidermidis
VFRRGEKVIPHFAHKVKGSRPCY

SEQ ID NO: 1814062 - protein, 24 aa, Staphylococcus epidermidis
VFRSMRTQQCLSRQQAYRIIHQAA

SEQ ID NO: 1814063 - protein, 21 aa, Staphylococcus epidermidis
VFTSFDAWLPYLSELDSMPAT

SEQ ID NO: 1814064 - protein, 22 aa, Staphylococcus epidermidis
VFYIPNCDKITPGMILAAVRTN

SEQ ID NO: 1814065 - protein, 22 aa, Staphylococcus epidermidis
VGCITRPFPTGVRITIGFPEQN

SEQ ID NO: 1814066 - protein, 23 aa, Staphylococcus epidermidis
VGDRQLVKVAAWYDNEMSYTSQL

SEQ ID NO: 1814067 - protein, 24 aa, Staphylococcus epidermidis
VGDTCPICGNEIHSLGEHIDFELI

SEQ ID NO: 1814068 - protein, 18 aa, Staphylococcus epidermidis
VGDTFPRKGLNVSNERLT

SEQ ID NO: 1814069 - protein, 23 aa, Staphylococcus epidermidis
VGERFKYHRHFFVPDNVGHDGFL

SEQ ID NO: 1814070 - protein, 17 aa, Staphylococcus epidermidis
VGESIAIIGESGSGKST

SEQ ID NO: 1814071 - protein, 17 aa, Staphylococcus epidermidis
VGFFYPEIAMYFKNPSR

SEQ ID NO: 1814072 - protein, 17 aa, Staphylococcus epidermidis
VGIDLARLSLEKAETLK

SEQ ID NO: 1814073 - protein, 18 aa, Staphylococcus epidermidis
VGITRSVIVNALRKLESA

SEQ ID NO: 1814074 - protein, 18 aa, Staphylococcus epidermidis
VGKNGLVSVWSHYFLSDY

SEQ ID NO: 1814075 - protein, 19 aa, Staphylococcus epidermidis
VGKPYCPYHDIEIESQTVQ

SEQ ID NO: 1814076 - protein, 18 aa, Staphylococcus epidermidis
VGKSTLFNAITKAGALAA

SEQ ID NO: 1814077 - protein, 27 aa, Staphylococcus epidermidis
VGLKSDCLYCYPHMLSGGEAQRVAIAR

SEQ ID NO: 1814078 - protein, 36 aa, Staphylococcus epidermidis
VGLYIKNDLDSIILIHACWLARVEIAMINTRLTEQE

SEQ ID NO: 1814079 - protein, 19 aa, Staphylococcus epidermidis
VGNLGRALLTYNFSIHDEM

SEQ ID NO: 1814080 - protein, 26 aa, Staphylococcus epidermidis
VGNPSLLNRVGKLIASIYMNEELDAV

SEQ ID NO: 1814081 - protein, 19 aa, Staphylococcus epidermidis
VGNQANYIAELEVTNEMLL

SEQ ID NO: 1814082 - protein, 19 aa, Staphylococcus epidermidis
VGNVNFISRLLEGHYPDTT

SEQ ID NO: 1814083 - protein, 18 aa, Staphylococcus epidermidis
VGPGQVFKDLIDSEIIPR

SEQ ID NO: 1814084 - protein, 19 aa, Staphylococcus epidermidis
VGPGQVFKDLIDSEIIPRV

SEQ ID NO: 1814085 - protein, 29 aa, Staphylococcus epidermidis
VGQIAKIKGCKVVGIAGGDKKVNYLTDEL

SEQ ID NO: 1814086 - protein, 25 aa, Staphylococcus epidermidis
VGQIAKLKGCRVVGIAGGDEKVNYL

SEQ ID NO: 1814087 - protein, 21 aa, Staphylococcus epidermidis
VGREEAVLIFVNRLNEGLYCI

SEQ ID NO: 1814088 - protein, 17 aa, Staphylococcus epidermidis
VGRELREMMPFIKSKSI

SEQ ID NO: 1814089 - protein, 23 aa, Staphylococcus epidermidis
VGRGGGSIEDLWNFNEEDVVKTI

SEQ ID NO: 1814090 - protein, 23 aa, Staphylococcus epidermidis
VGRGGGSIEDLWNFNEEEVVKAI

SEQ ID NO: 1814091 - protein, 24 aa, Staphylococcus epidermidis
VGRGMTVNRMFWRARRRESIFISY

SEQ ID NO: 1814092 - protein, 21 aa, Staphylococcus epidermidis
VGRQHKGLGWVLSYDENEVID

SEQ ID NO: 1814093 - protein, 19 aa, Staphylococcus epidermidis
VGSFCGLDQYAISGRFSGR

SEQ ID NO: 1814094 - protein, 23 aa, Staphylococcus epidermidis
VGSIVKFDVAFGLENHAVPHDEM

SEQ ID NO: 1814095 - protein, 23 aa, Staphylococcus epidermidis
VGTKLKLAIDYNKHDTIGIDAVA

SEQ ID NO: 1814096 - protein, 18 aa, Staphylococcus epidermidis
VGVARPGTTLSTTDEGEL

SEQ ID NO: 1814097 - protein, 19 aa, Staphylococcus epidermidis
VGVPRGRGKIERFFQTVNQ

SEQ ID NO: 1814098 - protein, 20 aa, Staphylococcus epidermidis
VGVQISDIFPHLKGICDKEI

SEQ ID NO: 1814099 - protein, 19 aa, Staphylococcus epidermidis
VGYKFGRWLDLSFYQYDLS

SEQ ID NO: 1814100 - protein, 20 aa, Staphylococcus epidermidis
VGYKFNRWLDLSFYQYDLSD

SEQ ID NO: 1814101 - protein, 21 aa, Staphylococcus epidermidis
VHDTIPWPNYVNYAASKGGMK

SEQ ID NO: 1814102 - protein, 18 aa, Staphylococcus epidermidis
VHHIWEWENGENEPKMED

SEQ ID NO: 1814103 - protein, 18 aa, Staphylococcus epidermidis
VHHTIKNATSFGIDVNDF

SEQ ID NO: 1814104 - protein, 19 aa, Staphylococcus epidermidis
VHHTLNLKVVIFNEEDYEF

SEQ ID NO: 1814105 - protein, 26 aa, Staphylococcus epidermidis
VHLNLPLEWLKGKIVVDSLGLHSNNQ

SEQ ID NO: 1814106 - protein, 18 aa, Staphylococcus epidermidis
VHMASLRKKLNYTQDPNT

SEQ ID NO: 1814107 - protein, 17 aa, Staphylococcus epidermidis
VHQCNKHRYQLLLNYTG

SEQ ID NO: 1814108 - protein, 21 aa, Staphylococcus epidermidis
VHQLFRFKQHFDTIFIDEVDA

SEQ ID NO: 1814109 - protein, 18 aa, Staphylococcus epidermidis
VHSDGIHFQGFRYSNTNL

SEQ ID NO: 1814110 - protein, 17 aa, Staphylococcus epidermidis
VHSHYKHLFAILELAKK

SEQ ID NO: 1814111 - protein, 27 aa, Staphylococcus epidermidis
VHVERKSAMERYVFSGDVIYSCGHVSQ

SEQ ID NO: 1814112 - protein, 17 aa, Staphylococcus epidermidis
VHVTDCELLLDTFKSKY

SEQ ID NO: 1814113 - protein, 19 aa, Staphylococcus epidermidis
VHYSHYGRMCPIETPEGPN

SEQ ID NO: 1814114 - protein, 20 aa, Staphylococcus epidermidis
VHYSHYGRMCPIETPEGPNI

SEQ ID NO: 1814115 - protein, 26 aa, Staphylococcus epidermidis
VIAAELRLGIVNGEIESHIQLSENQV

SEQ ID NO: 1814116 - protein, 27 aa, Staphylococcus epidermidis
VIAEKGGYNYFSFKGIRSKGNNELHVT

SEQ ID NO: 1814117 - protein, 17 aa, Staphylococcus epidermidis
VIANMAVGFDNIDISLA

SEQ ID NO: 1814118 - protein, 17 aa, Staphylococcus epidermidis
VIARAGVGVDNIDIDAA

SEQ ID NO: 1814119 - protein, 24 aa, Staphylococcus epidermidis
VIDGEFQFDAAILPSVAEKKAPGA

SEQ ID NO: 1814120 - protein, 24 aa, Staphylococcus epidermidis
VIDLIPEYSHLGIFPVGRLDKDTE

SEQ ID NO: 1814121 - protein, 17 aa, Staphylococcus epidermidis
VIDRAQVILNAFEQKPS

SEQ ID NO: 1814122 - protein, 25 aa, Staphylococcus epidermidis
VIEGFTVRIVEKFKTKKMLKIIINE

SEQ ID NO: 1814123 - protein, 25 aa, Staphylococcus epidermidis
VIEIAARPAGGFITSHLIRLSSGHS

SEQ ID NO: 1814124 - protein, 18 aa, Staphylococcus epidermidis
VIEIKSCHYAASKWYEEN

SEQ ID NO: 1814125 - protein, 24 aa, Staphylococcus epidermidis
VIEIPGSELVRGRGGPRCMSQPLF

SEQ ID NO: 1814126 - protein, 18 aa, Staphylococcus epidermidis
VIEQCVHHTLNLKVVIFN

SEQ ID NO: 1814127 - protein, 27 aa, Staphylococcus epidermidis
VIEQSKCKRAIILPNNKNILMASEQAA

SEQ ID NO: 1814128 - protein, 26 aa, Staphylococcus epidermidis
VIEQSKCKRAIILPNNKNIMMASEQA

SEQ ID NO: 1814129 - protein, 19 aa, Staphylococcus epidermidis
VIFNTRYLKNNIEQVEKID

SEQ ID NO: 1814130 - protein, 24 aa, Staphylococcus epidermidis
VIGLPANLFFGTSIPTSILVFKKC

SEQ ID NO: 1814131 - protein, 19 aa, Staphylococcus epidermidis
VIHASKSYVGQLLEDVGFK

SEQ ID NO: 1814132 - protein, 19 aa, Staphylococcus epidermidis
VIHPMSGSLKSMFEQQGID

SEQ ID NO: 1814133 - protein, 24 aa, Staphylococcus epidermidis
VIHPREIFKTAILSNANSIMLGHN

SEQ ID NO: 1814134 - protein, 17 aa, Staphylococcus epidermidis
VIHTYDANHRWSVQYEA

SEQ ID NO: 1814135 - protein, 17 aa, Staphylococcus epidermidis
VIIPGIMEHIERAGVHS

SEQ ID NO: 1814136 - protein, 19 aa, Staphylococcus epidermidis
VIIVTTFKRPGYFEKAVAN

SEQ ID NO: 1814137 - protein, 24 aa, Staphylococcus epidermidis
VIKGLCRKEILFAIDHFNQIVRHE

SEQ ID NO: 1814138 - protein, 17 aa, Staphylococcus epidermidis
VIKKLQLWIKAILKKTD

SEQ ID NO: 1814139 - protein, 22 aa, Staphylococcus epidermidis
VIKNCPIEYDIPDLNLDNPVKD

SEQ ID NO: 1814140 - protein, 30 aa, Staphylococcus epidermidis
VILEAAIKAGAPKDCIQWIEIPSIEATKQL

SEQ ID NO: 1814141 - protein, 21 aa, Staphylococcus epidermidis
VILEYGESAPKIFRKVTDLVK

SEQ ID NO: 1814142 - protein, 20 aa, Staphylococcus epidermidis
VINFERLRNYFFIKKPKRMK

SEQ ID NO: 1814143 - protein, 19 aa, Staphylococcus epidermidis
VINFSSRFANVTSEAFIQE

SEQ ID NO: 1814144 - protein, 19 aa, Staphylococcus epidermidis
VISGKEYFYVPSVHKGGFT

SEQ ID NO: 1814145 - protein, 25 aa, Staphylococcus epidermidis
VISKSELLEKVWGYDYYEDANTVNV

SEQ ID NO: 1814146 - protein, 24 aa, Staphylococcus epidermidis
VITMYPHLDGVLSLDLTTVLILNQ

SEQ ID NO: 1814147 - protein, 17 aa, Staphylococcus epidermidis
VITRPANDPALFDATVK

SEQ ID NO: 1814148 - protein, 17 aa, Staphylococcus epidermidis
VITRPANDPALFNATVK

SEQ ID NO: 1814149 - protein, 18 aa, Staphylococcus epidermidis
VITRVGVAVVTAARYGAV

SEQ ID NO: 1814150 - protein, 19 aa, Staphylococcus epidermidis
VITTMAITLAREYHTENVV

SEQ ID NO: 1814151 - protein, 33 aa, Staphylococcus epidermidis
VITTYDLLYRAGLDLDVDFVIRVGKPVISKKLN

SEQ ID NO: 1814152 - protein, 20 aa, Staphylococcus epidermidis
VKAFGKGNVHVHMTAGTYVI

SEQ ID NO: 1814153 - protein, 21 aa, Staphylococcus epidermidis
VKAGDLIKHMAPVVGGKGGGR

SEQ ID NO: 1814154 - protein, 25 aa, Staphylococcus epidermidis
VKAIYQCATPIISAVGHETDFTLSD

SEQ ID NO: 1814155 - protein, 23 aa, Staphylococcus epidermidis
VKAKGTGVVHLRAIHKRWSRAEM

SEQ ID NO: 1814156 - protein, 19 aa, Staphylococcus epidermidis
VKALSMWMTLKCGIVDLPY

SEQ ID NO: 1814157 - protein, 19 aa, Staphylococcus epidermidis
VKASGGVRNLEDFNKMIEA

SEQ ID NO: 1814158 - protein, 25 aa, Staphylococcus epidermidis
VKATDLRAAAALILAGLVADGTTQV

SEQ ID NO: 1814159 - protein, 17 aa, Staphylococcus epidermidis
VKAVLGVIGEEGEAIDK

SEQ ID NO: 1814160 - protein, 17 aa, Staphylococcus epidermidis
VKDASALVSLLSTNVDK

SEQ ID NO: 1814161 - protein, 24 aa, Staphylococcus epidermidis
VKDGEIIAAPVLALSLSFDHRQID

SEQ ID NO: 1814162 - protein, 20 aa, Staphylococcus epidermidis
VKDILNRFFNNEAFQDKDVI

SEQ ID NO: 1814163 - protein, 18 aa, Staphylococcus epidermidis
VKDKQRLTFKFNTGNQTN

SEQ ID NO: 1814164 - protein, 25 aa, Staphylococcus epidermidis
VKDLPNIKSYLFDDIGSLDVSSEVP

SEQ ID NO: 1814165 - protein, 21 aa, Staphylococcus epidermidis
VKDNEILAGFLYLTDLEEVPT

SEQ ID NO: 1814166 - protein, 21 aa, Staphylococcus epidermidis
VKDNIKPGGTIVYSTCTIEQM

SEQ ID NO: 1814167 - protein, 21 aa, Staphylococcus epidermidis
VKDQKVIDWLWETQDKTFFDS

SEQ ID NO: 1814168 - protein, 25 aa, Staphylococcus epidermidis
VKEGRITKRTFAWEQFLNVVSELET

SEQ ID NO: 1814169 - protein, 18 aa, Staphylococcus epidermidis
VKEHPLLNAIGVTNMGAV

SEQ ID NO: 1814170 - protein, 19 aa, Staphylococcus epidermidis
VKEKFRIIYYDGEAALALL

SEQ ID NO: 1814171 - protein, 26 aa, Staphylococcus epidermidis
VKELKRKARAFDEIVEIYNDVDNFSD

SEQ ID NO: 1814172 - protein, 21 aa, Staphylococcus epidermidis
VKELNRLLGKVIDAFTEAKEK

SEQ ID NO: 1814173 - protein, 26 aa, Staphylococcus epidermidis
VKESEGRIILFIDEIHMLVGAGKTEG

SEQ ID NO: 1814174 - protein, 19 aa, Staphylococcus epidermidis
VKFADNWLAPHPGTDAAVA

SEQ ID NO: 1814175 - protein, 24 aa, Staphylococcus epidermidis
VKFKNCAFDNVAIRNASMPQKLID

SEQ ID NO: 1814176 - protein, 17 aa, Staphylococcus epidermidis
VKFYLVENTYVFDHYKD

SEQ ID NO: 1814177 - protein, 18 aa, Staphylococcus epidermidis
VKGCKLILDEAKLIKEGE

SEQ ID NO: 1814178 - protein, 19 aa, Staphylococcus epidermidis
VKGDKEYLIPYIEDVVKDI

SEQ ID NO: 1814179 - protein, 19 aa, Staphylococcus epidermidis
VKGILDMKGGFADSVTNAF

SEQ ID NO: 1814180 - protein, 18 aa, Staphylococcus epidermidis
VKGLFIVPLNGFKKWLTP

SEQ ID NO: 1814181 - protein, 20 aa, Staphylococcus epidermidis
VKGQLGQDIPLVINGEKIDK

SEQ ID NO: 1814182 - protein, 20 aa, Staphylococcus epidermidis
VKGTLYVLQAALPYLLNQSS

SEQ ID NO: 1814183 - protein, 26 aa, Staphylococcus epidermidis
VKGYFIWSLMDVFSWSNGYEKRYGLF

SEQ ID NO: 1814184 - protein, 21 aa, Staphylococcus epidermidis
VKIDLYRPVPNFKNISQVKAL

SEQ ID NO: 1814185 - protein, 17 aa, Staphylococcus epidermidis
VKIISLIAMTASDARIM

SEQ ID NO: 1814186 - protein, 31 aa, Staphylococcus epidermidis
VKILNEMKVDWKKRIHIIIGTDEESDWKCTD

SEQ ID NO: 1814187 - protein, 31 aa, Staphylococcus epidermidis
VKIPSFTGEIVFKIKGPLPFLQLTHFLLKFG

SEQ ID NO: 1814188 - protein, 17 aa, Staphylococcus epidermidis
VKIQKELAAKKGIVMDG

SEQ ID NO: 1814189 - protein, 28 aa, Staphylococcus epidermidis
VKISGKFKKMHVRMMPAQEPPYTRLIDS

SEQ ID NO: 1814190 - protein, 19 aa, Staphylococcus epidermidis
VKITRRIGSRVIYLYPQVL

SEQ ID NO: 1814191 - protein, 24 aa, Staphylococcus epidermidis
VKKPHINWDNVIFFTLQQNPSTPA

SEQ ID NO: 1814192 - protein, 29 aa, Staphylococcus epidermidis
VKLDPGYDRQIICTQSFYQKLDTLKDGNG

SEQ ID NO: 1814193 - protein, 19 aa, Staphylococcus epidermidis
VKLEPKPVLDTVNQDLEAQ

SEQ ID NO: 1814194 - protein, 26 aa, Staphylococcus epidermidis
VKLSKRCISKSIKLSVHCHNDLGLAV

SEQ ID NO: 1814195 - protein, 18 aa, Staphylococcus epidermidis
VKLTEYHPLVSQPIEVEF

SEQ ID NO: 1814196 - protein, 25 aa, Staphylococcus epidermidis
VKLVQRLSKASGHLGMVGGQTLDMQ

SEQ ID NO: 1814197 - protein, 21 aa, Staphylococcus epidermidis
VKLYYNGPMFRYERKQKGRYR

SEQ ID NO: 1814198 - protein, 17 aa, Staphylococcus epidermidis
VKMKAVLHNEAIKNVLQ

SEQ ID NO: 1814199 - protein, 20 aa, Staphylococcus epidermidis
VKNGVPSEVSINWKDLMNFK

SEQ ID NO: 1814200 - protein, 25 aa, Staphylococcus epidermidis
VKNVAKFKKTMSVVFECHIYTLRQV

SEQ ID NO: 1814201 - protein, 21 aa, Staphylococcus epidermidis
VKPHPFINLLNYILLESSGAD

SEQ ID NO: 1814202 - protein, 17 aa, Staphylococcus epidermidis
VKPKAVIAVNLYGQSSK

SEQ ID NO: 1814203 - protein, 24 aa, Staphylococcus epidermidis
VKPKREALEMAERVDLDLVVVAPN

SEQ ID NO: 1814204 - protein, 23 aa, Staphylococcus epidermidis
VKPSELTPHVAIVIRDIIEDTFD

SEQ ID NO: 1814205 - protein, 17 aa, Staphylococcus epidermidis
VKQAPFFELYREGDTES

SEQ ID NO: 1814206 - protein, 24 aa, Staphylococcus epidermidis
VKQKGADIARLWVSSTDYLADVRI

SEQ ID NO: 1814207 - protein, 24 aa, Staphylococcus epidermidis
VKQKGADIARLWVSSTDYLSDVRI

SEQ ID NO: 1814208 - protein, 26 aa, Staphylococcus epidermidis
VKQLRKRYDIPIKRAPKLILKGDGDL

SEQ ID NO: 1814209 - protein, 23 aa, Staphylococcus epidermidis
VKRIGGELTSFVHLGTGNYNDKT

SEQ ID NO: 1814210 - protein, 26 aa, Staphylococcus epidermidis
VKRPEVVEKIKVARSFGDLSENSEYD

SEQ ID NO: 1814211 - protein, 17 aa, Staphylococcus epidermidis
VKSAILFASIFSKEATT

SEQ ID NO: 1814212 - protein, 23 aa, Staphylococcus epidermidis
VKSDLDAAFSYKDGAKVMSLLEP

SEQ ID NO: 1814213 - protein, 24 aa, Staphylococcus epidermidis
VKSGNATIARWSVTTSGDLRLDGV

SEQ ID NO: 1814214 - protein, 17 aa, Staphylococcus epidermidis
VKTKNGQMLVCQDPSCK

SEQ ID NO: 1814215 - protein, 18 aa, Staphylococcus epidermidis
VKTMIFKIDGEFIMFLVR

SEQ ID NO: 1814216 - protein, 18 aa, Staphylococcus epidermidis
VKTMIFKIDGEFIMLLVR

SEQ ID NO: 1814217 - protein, 18 aa, Staphylococcus epidermidis
VKTMIFKVDGEFIMVLIR

SEQ ID NO: 1814218 - protein, 19 aa, Staphylococcus epidermidis
VKTTICGTDLHIIKGDTPE

SEQ ID NO: 1814219 - protein, 17 aa, Staphylococcus epidermidis
VKVHPFIYEEAKKDCDL

SEQ ID NO: 1814220 - protein, 27 aa, Staphylococcus epidermidis
VKVISKENPNEFVIMVGGVIAMTRDNG

SEQ ID NO: 1814221 - protein, 18 aa, Staphylococcus epidermidis
VKVKREDAVWDLPMVFAE

SEQ ID NO: 1814222 - protein, 24 aa, Staphylococcus epidermidis
VKVLARGPVFKGLLTSNSVNALDQ

SEQ ID NO: 1814223 - protein, 22 aa, Staphylococcus epidermidis
VKVSWTGICGTDLHEYLEGPIF

SEQ ID NO: 1814224 - protein, 26 aa, Staphylococcus epidermidis
VKYAEAFGAKGLRVYNQEELEAAIKE

SEQ ID NO: 1814225 - protein, 19 aa, Staphylococcus epidermidis
VKYRFSPKLLTNNFEKDIK

SEQ ID NO: 1814226 - protein, 20 aa, Staphylococcus epidermidis
VLAGFAGSVADAFTLFEKFE

SEQ ID NO: 1814227 - protein, 24 aa, Staphylococcus epidermidis
VLAKRLEALGVHAVMPLASPIGTG

SEQ ID NO: 1814228 - protein, 18 aa, Staphylococcus epidermidis
VLASLGVNDNDEWLNINA

SEQ ID NO: 1814229 - protein, 23 aa, Staphylococcus epidermidis
VLASRLGGYAIELLKQGETAKGV

SEQ ID NO: 1814230 - protein, 22 aa, Staphylococcus epidermidis
VLASRLGGYAVELLKQGETAKG

SEQ ID NO: 1814231 - protein, 17 aa, Staphylococcus epidermidis
VLCCTPTEYRMMAKLNN

SEQ ID NO: 1814232 - protein, 25 aa, Staphylococcus epidermidis
VLDACSAPGGKACHMAEILSPEGHV

SEQ ID NO: 1814233 - protein, 26 aa, Staphylococcus epidermidis
VLDEAHCLSEWGYDFRPHYALIGQII

SEQ ID NO: 1814234 - protein, 25 aa, Staphylococcus epidermidis
VLDEAHCLSEWGYDFRPHYALVGKI

SEQ ID NO: 1814235 - protein, 22 aa, Staphylococcus epidermidis
VLDKPYVIVCLNTIVSDSDEQA

SEQ ID NO: 1814236 - protein, 22 aa, Staphylococcus epidermidis
VLDSARFRYLISQELNVVPSSV

SEQ ID NO: 1814237 - protein, 27 aa, Staphylococcus epidermidis
VLEAIPSDLAREISQQLTIPVIGIGAG

SEQ ID NO: 1814238 - protein, 20 aa, Staphylococcus epidermidis
VLEALLSYAKEVARDEKSYA

SEQ ID NO: 1814239 - protein, 18 aa, Staphylococcus epidermidis
VLEELGLGAKDIGTTHLK

SEQ ID NO: 1814240 - protein, 22 aa, Staphylococcus epidermidis
VLEENKYVFILKHSETCPISAN

SEQ ID NO: 1814241 - protein, 18 aa, Staphylococcus epidermidis
VLEGSHFLIASGAKPTPL

SEQ ID NO: 1814242 - protein, 25 aa, Staphylococcus epidermidis
VLELKRIKIAELELDHNLDLGSYRL

SEQ ID NO: 1814243 - protein, 31 aa, Staphylococcus epidermidis
VLFLNRRGYASFMLCRDCGYVPQCPNCDISL

SEQ ID NO: 1814244 - protein, 18 aa, Staphylococcus epidermidis
VLFRVGNVNFISRLLEGH

SEQ ID NO: 1814245 - protein, 25 aa, Staphylococcus epidermidis
VLGHSMGSIIARLFVVRYPEFANGL

SEQ ID NO: 1814246 - protein, 18 aa, Staphylococcus epidermidis
VLGLDWRTSIKQADDMGV

SEQ ID NO: 1814247 - protein, 18 aa, Staphylococcus epidermidis
VLGNEIYLVDSLEEVRDN

SEQ ID NO: 1814248 - protein, 22 aa, Staphylococcus epidermidis
VLGRVYEYFIAKFASAEGKNAG

SEQ ID NO: 1814249 - protein, 28 aa, Staphylococcus epidermidis
VLHIPSPLWKVMDFMILDKEEEHRKYER

SEQ ID NO: 1814250 - protein, 19 aa, Staphylococcus epidermidis
VLHYARLTHKAGLDGVVCS

SEQ ID NO: 1814251 - protein, 25 aa, Staphylococcus epidermidis
VLIHGFKGYVALLFQKGAILEEKYH

SEQ ID NO: 1814252 - protein, 26 aa, Staphylococcus epidermidis
VLIHGFKHYVALLFHKGAILEDKYGT

SEQ ID NO: 1814253 - protein, 17 aa, Staphylococcus epidermidis
VLIHVSNFRKVKRIDTI

SEQ ID NO: 1814254 - protein, 17 aa, Staphylococcus epidermidis
VLIKRSGKVDEKILNMS

SEQ ID NO: 1814255 - protein, 22 aa, Staphylococcus epidermidis
VLKNCVLELKALDRDTTKLEKV

SEQ ID NO: 1814256 - protein, 22 aa, Staphylococcus epidermidis
VLKPIYGSGSMDVFIAKNQQDI

SEQ ID NO: 1814257 - protein, 18 aa, Staphylococcus epidermidis
VLLRVGKDALLKNGKSYI

SEQ ID NO: 1814258 - protein, 17 aa, Staphylococcus epidermidis
VLLVYIFNGVEFIPDSY

SEQ ID NO: 1814259 - protein, 18 aa, Staphylococcus epidermidis
VLLYGCGHHQAAWQMDDS

SEQ ID NO: 1814260 - protein, 23 aa, Staphylococcus epidermidis
VLNEFKFTVKDALINSVSAVTKI

SEQ ID NO: 1814261 - protein, 18 aa, Staphylococcus epidermidis
VLNIPKSTYYRWKNKTHK

SEQ ID NO: 1814262 - protein, 18 aa, Staphylococcus epidermidis
VLNKSMGQLQQFINDAQS

SEQ ID NO: 1814263 - protein, 19 aa, Staphylococcus epidermidis
VLNLFSYTGAFSVIAAQNA

SEQ ID NO: 1814264 - protein, 18 aa, Staphylococcus epidermidis
VLNQQFAQYALKVTLRRE

SEQ ID NO: 1814265 - protein, 24 aa, Staphylococcus epidermidis
VLNQRVAALVPKQFIDSQFLSKLI

SEQ ID NO: 1814266 - protein, 25 aa, Staphylococcus epidermidis
VLQDKGVEITSHFYKRMFKQHPELK

SEQ ID NO: 1814267 - protein, 21 aa, Staphylococcus epidermidis
VLQELGLTKVNGGFVVTGGSA

SEQ ID NO: 1814268 - protein, 18 aa, Staphylococcus epidermidis
VLQRCYKSEFSGWESKIK

SEQ ID NO: 1814269 - protein, 19 aa, Staphylococcus epidermidis
VLRMLELCESIPIHMEIYQ

SEQ ID NO: 1814270 - protein, 31 aa, Staphylococcus epidermidis
VLSDRLVFLLQRMMWEVLGFGETSSIKPEYI

SEQ ID NO: 1814271 - protein, 23 aa, Staphylococcus epidermidis
VLSEPYVIVCLNVIVSDTDEHAE

SEQ ID NO: 1814272 - protein, 28 aa, Staphylococcus epidermidis
VLSETLPDYMIPIHFKKIDQIPITINGK

SEQ ID NO: 1814273 - protein, 23 aa, Staphylococcus epidermidis
VLTESGAFGRALVPSGASTGEHE

SEQ ID NO: 1814274 - protein, 24 aa, Staphylococcus epidermidis
VLTYKAMHACKSYGVQRLIVAGGV

SEQ ID NO: 1814275 - protein, 18 aa, Staphylococcus epidermidis
VLVRRLVEENGTEHEGEL

SEQ ID NO: 1814276 - protein, 19 aa, Staphylococcus epidermidis
VLWFDRMRETYGLEKVIAD

SEQ ID NO: 1814277 - protein, 19 aa, Staphylococcus epidermidis
VMAKMGISTVQSYQGAQIF

SEQ ID NO: 1814278 - protein, 19 aa, Staphylococcus epidermidis
VMATITFQNLFKLFDKFAG

SEQ ID NO: 1814279 - protein, 22 aa, Staphylococcus epidermidis
VMEELRLLARSVFVLNENNKVV

SEQ ID NO: 1814280 - protein, 19 aa, Staphylococcus epidermidis
VMEGKAVLFKSFAGINGVP

SEQ ID NO: 1814281 - protein, 25 aa, Staphylococcus epidermidis
VMGRDCGDLALWAGLSVGAETIVVP

SEQ ID NO: 1814282 - protein, 24 aa, Staphylococcus epidermidis
VMHTLGDFLIQYCIEQWGELSPNQ

SEQ ID NO: 1814283 - protein, 24 aa, Staphylococcus epidermidis
VMISRDVIKYGGLKDESNETVNEN

SEQ ID NO: 1814284 - protein, 23 aa, Staphylococcus epidermidis
VMIYDRRKDLIISGGENIYPYQI

SEQ ID NO: 1814285 - protein, 23 aa, Staphylococcus epidermidis
VMKLNCVEEAIIIGQPHHKFGEI

SEQ ID NO: 1814286 - protein, 23 aa, Staphylococcus epidermidis
VMMKEGHGAYLYDVDGNKFIDYL

SEQ ID NO: 1814287 - protein, 22 aa, Staphylococcus epidermidis
VMQELTEYGLIPEDWGGDTIFV

SEQ ID NO: 1814288 - protein, 18 aa, Staphylococcus epidermidis
VMRSIKKLKSMGIVETAL

SEQ ID NO: 1814289 - protein, 26 aa, Staphylococcus epidermidis
VNAEQFRQLFILPQGEFKKFLQSNSK

SEQ ID NO: 1814290 - protein, 22 aa, Staphylococcus epidermidis
VNCVAPGPFWSPLQITGGQPQS

SEQ ID NO: 1814291 - protein, 26 aa, Staphylococcus epidermidis
VNDELQLVIVRDMWLTGFDVPSMHTM

SEQ ID NO: 1814292 - protein, 17 aa, Staphylococcus epidermidis
VNDGKCHNFVKFRLDEF

SEQ ID NO: 1814293 - protein, 21 aa, Staphylococcus epidermidis
VNDIQSGIKLARHLIDSGQAM

SEQ ID NO: 1814294 - protein, 19 aa, Staphylococcus epidermidis
VNEAMKLFSEDCFNVDVLK

SEQ ID NO: 1814295 - protein, 18 aa, Staphylococcus epidermidis
VNEHRFERVSGWRDVKNY

SEQ ID NO: 1814296 - protein, 23 aa, Staphylococcus epidermidis
VNEIKEVKKALSKNAKGVSRKVD

SEQ ID NO: 1814297 - protein, 18 aa, Staphylococcus epidermidis
VNELKDLGADKVVVQDLE

SEQ ID NO: 1814298 - protein, 19 aa, Staphylococcus epidermidis
VNETIRIDWERDHPRVIWD

SEQ ID NO: 1814299 - protein, 22 aa, Staphylococcus epidermidis
VNEVIKRLNYRPNAVARGLASK

SEQ ID NO: 1814300 - protein, 24 aa, Staphylococcus epidermidis
VNFGRFPYSKGRMKKEDYDKVDYA

SEQ ID NO: 1814301 - protein, 21 aa, Staphylococcus epidermidis
VNFKAPKEMIGKLVDVKIDEA

SEQ ID NO: 1814302 - protein, 19 aa, Staphylococcus epidermidis
VNFKNFLNGVKFEESTINA

SEQ ID NO: 1814303 - protein, 25 aa, Staphylococcus epidermidis
VNGDGRIKVYMSYQMDYDEFDKFKG

SEQ ID NO: 1814304 - protein, 19 aa, Staphylococcus epidermidis
VNGETLLFLGTGAIAQKTA

SEQ ID NO: 1814305 - protein, 23 aa, Staphylococcus epidermidis
VNGIDCVKFFLKEEQKNEIVTAP

SEQ ID NO: 1814306 - protein, 25 aa, Staphylococcus epidermidis
VNGILRSIMRSELPQFDEIKDDKKR

SEQ ID NO: 1814307 - protein, 29 aa, Staphylococcus epidermidis
VNGKEADKCFRAELAMAPVKLFDHTLEVI

SEQ ID NO: 1814308 - protein, 18 aa, Staphylococcus epidermidis
VNGLKLAFRGLLAATGVG

SEQ ID NO: 1814309 - protein, 17 aa, Staphylococcus epidermidis
VNGRISVITFHSLEDRL

SEQ ID NO: 1814310 - protein, 19 aa, Staphylococcus epidermidis
VNIDFPLSVMTVVTGVSGS

SEQ ID NO: 1814311 - protein, 20 aa, Staphylococcus epidermidis
VNIEDLFRKIVLNHRGGFCY

SEQ ID NO: 1814312 - protein, 19 aa, Staphylococcus epidermidis
VNIGGVFWGIQAALEQFDK

SEQ ID NO: 1814313 - protein, 25 aa, Staphylococcus epidermidis
VNIKSVVMDLLFEKLDCHLAMPQHA

SEQ ID NO: 1814314 - protein, 18 aa, Staphylococcus epidermidis
VNILPIIAKSFAPYLKEK

SEQ ID NO: 1814315 - protein, 18 aa, Staphylococcus epidermidis
VNINKLFNTHGIKYRELN

SEQ ID NO: 1814316 - protein, 20 aa, Staphylococcus epidermidis
VNIPEGYVGLLTSRSGVSSK

SEQ ID NO: 1814317 - protein, 24 aa, Staphylococcus epidermidis
VNKDNFNEHMNLSGSATYDPKTGI

SEQ ID NO: 1814318 - protein, 30 aa, Staphylococcus epidermidis
VNLERAMSGKGRFGGHFVLGHVDELGTISK

SEQ ID NO: 1814319 - protein, 20 aa, Staphylococcus epidermidis
VNLKSIMGVMSLGVGKDAEI

SEQ ID NO: 1814320 - protein, 20 aa, Staphylococcus epidermidis
VNLPMAISMVKAIKQAVQGT

SEQ ID NO: 1814321 - protein, 23 aa, Staphylococcus epidermidis
VNLRTEKNYHQFIADRTGLKNIN

SEQ ID NO: 1814322 - protein, 22 aa, Staphylococcus epidermidis
VNLRYPEGFKFEDAIERFRSEI

SEQ ID NO: 1814323 - protein, 18 aa, Staphylococcus epidermidis
VNLSYSFPYIACAIDNQP

SEQ ID NO: 1814324 - protein, 18 aa, Staphylococcus epidermidis
VNLYDWKYPFKNCEFDNI

SEQ ID NO: 1814325 - protein, 24 aa, Staphylococcus epidermidis
VNMFSNYVNFQFDLPIADGTEQML

SEQ ID NO: 1814326 - protein, 20 aa, Staphylococcus epidermidis
VNMQPWRIAVVQSDEMKEKV

SEQ ID NO: 1814327 - protein, 20 aa, Staphylococcus epidermidis
VNMQPWRIVVVDSDEGKAKL

SEQ ID NO: 1814328 - protein, 23 aa, Staphylococcus epidermidis
VNNCVTIEPGIYVDGLGGVRIED

SEQ ID NO: 1814329 - protein, 25 aa, Staphylococcus epidermidis
VNNDYCLFYPRWANQKNNNMTHLIN

SEQ ID NO: 1814330 - protein, 17 aa, Staphylococcus epidermidis
VNNLHGLTQAQKDKEHE

SEQ ID NO: 1814331 - protein, 25 aa, Staphylococcus epidermidis
VNPDEVVAMGAAIQGGVITGDVKDV

SEQ ID NO: 1814332 - protein, 17 aa, Staphylococcus epidermidis
VNPDYSKTLNWQKYKLT

SEQ ID NO: 1814333 - protein, 19 aa, Staphylococcus epidermidis
VNPRSSRTVPFLSKITDIQ

SEQ ID NO: 1814334 - protein, 17 aa, Staphylococcus epidermidis
VNQNVHFEVLLVKLAEM

SEQ ID NO: 1814335 - protein, 24 aa, Staphylococcus epidermidis
VNRETWAKHRGLIAAEQILEDITQ

SEQ ID NO: 1814336 - protein, 17 aa, Staphylococcus epidermidis
VNRTFGITIMMITHEMS

SEQ ID NO: 1814337 - protein, 27 aa, Staphylococcus epidermidis
VNSLDFFKPRIGSNIITAPKYDGFLTS

SEQ ID NO: 1814338 - protein, 19 aa, Staphylococcus epidermidis
VNSLELFFPQGKTDIAMAA

SEQ ID NO: 1814339 - protein, 23 aa, Staphylococcus epidermidis
VNTALWLHLEEDYGIKQGNLTDL

SEQ ID NO: 1814340 - protein, 29 aa, Staphylococcus epidermidis
VNTERFKYKFGLPIESVFGQTIENLLGRN

SEQ ID NO: 1814341 - protein, 18 aa, Staphylococcus epidermidis
VNVDLHYDYARLLQDELK

SEQ ID NO: 1814342 - protein, 20 aa, Staphylococcus epidermidis
VNVLKRFKATLIQKNETVEA

SEQ ID NO: 1814343 - protein, 25 aa, Staphylococcus epidermidis
VNVPDHLPQLQALVERRYRKDITAP

SEQ ID NO: 1814344 - protein, 17 aa, Staphylococcus epidermidis
VNVPIIVEKDIYKATAQ

SEQ ID NO: 1814345 - protein, 18 aa, Staphylococcus epidermidis
VNVRICTPKALSPKEAYV

SEQ ID NO: 1814346 - protein, 19 aa, Staphylococcus epidermidis
VNYKTIGVMLFDTQQQFLQ

SEQ ID NO: 1814347 - protein, 18 aa, Staphylococcus epidermidis
VPAGDGWDSDPFDPVVTD

SEQ ID NO: 1814348 - protein, 20 aa, Staphylococcus epidermidis
VPALFKLFLDYIEKLDQRTL

SEQ ID NO: 1814349 - protein, 20 aa, Staphylococcus epidermidis
VPDFCQLIFITTPEVLNTSE

SEQ ID NO: 1814350 - protein, 18 aa, Staphylococcus epidermidis
VPDPLVYAYCYMWNENCK

SEQ ID NO: 1814351 - protein, 32 aa, Staphylococcus epidermidis
VPDTLRVASLLAHTLFDFPSHQLTTYGVTGTN

SEQ ID NO: 1814352 - protein, 29 aa, Staphylococcus epidermidis
VPEFKNKHLRLAIAQAINKKGYVNSVLND

SEQ ID NO: 1814353 - protein, 20 aa, Staphylococcus epidermidis
VPEGVLIRAIEPEDGIEAMK

SEQ ID NO: 1814354 - protein, 19 aa, Staphylococcus epidermidis
VPEHYELYGTEARIDSNGN

SEQ ID NO: 1814355 - protein, 25 aa, Staphylococcus epidermidis
VPEKLWPIQPLRDFWGINRRTEAKL

SEQ ID NO: 1814356 - protein, 19 aa, Staphylococcus epidermidis
VPESIKEDFLTAVKEQFSQ

SEQ ID NO: 1814357 - protein, 17 aa, Staphylococcus epidermidis
VPFVFLFEKEGNFLFYE

SEQ ID NO: 1814358 - protein, 29 aa, Staphylococcus epidermidis
VPFYKEIHKIVKIIGGFFVEENTNVYDIG

SEQ ID NO: 1814359 - protein, 18 aa, Staphylococcus epidermidis
VPGFKFAEFNNFSSFKSL

SEQ ID NO: 1814360 - protein, 23 aa, Staphylococcus epidermidis
VPGHAYIEYNVRTVPEYDNEFVK

SEQ ID NO: 1814361 - protein, 21 aa, Staphylococcus epidermidis
VPGNMKLMFDEYLKRNYSVMI

SEQ ID NO: 1814362 - protein, 17 aa, Staphylococcus epidermidis
VPLAGDRFVVFSDEKQA

SEQ ID NO: 1814363 - protein, 17 aa, Staphylococcus epidermidis
VPLAPMSNKALFKFEHG

SEQ ID NO: 1814364 - protein, 24 aa, Staphylococcus epidermidis
VPLEPGCYLMKDRNAQVIYVGKAK

SEQ ID NO: 1814365 - protein, 26 aa, Staphylococcus epidermidis
VPLNGFKKWLTPVEMWQSHQMTLKVG

SEQ ID NO: 1814366 - protein, 21 aa, Staphylococcus epidermidis
VPMDLLPYLFFQFSRNGKRLY

SEQ ID NO: 1814367 - protein, 19 aa, Staphylococcus epidermidis
VPMKIATLRIETGKGETHT

SEQ ID NO: 1814368 - protein, 21 aa, Staphylococcus epidermidis
VPMVNPWGFANQERENVNNVD

SEQ ID NO: 1814369 - protein, 17 aa, Staphylococcus epidermidis
VPNKLTLTSVDKVFANI

SEQ ID NO: 1814370 - protein, 23 aa, Staphylococcus epidermidis
VPPKPHLRPAFDRGKDKFQNNIK

SEQ ID NO: 1814371 - protein, 17 aa, Staphylococcus epidermidis
VPSKLFLISPLLDATLS

SEQ ID NO: 1814372 - protein, 19 aa, Staphylococcus epidermidis
VPSTVSGVVTELIVNEGET

SEQ ID NO: 1814373 - protein, 23 aa, Staphylococcus epidermidis
VPTLEIFPTISHRCFDDEDFEEV

SEQ ID NO: 1814374 - protein, 25 aa, Staphylococcus epidermidis
VPTSDVPLHLYLSVLGMPGQTAYHG

SEQ ID NO: 1814375 - protein, 22 aa, Staphylococcus epidermidis
VPTVCLRFFNVYGPKQNPNSDY

SEQ ID NO: 1814376 - protein, 18 aa, Staphylococcus epidermidis
VPVDLIFMNGKEMHRQGR

SEQ ID NO: 1814377 - protein, 18 aa, Staphylococcus epidermidis
VPVKACGAQLTIEPNGDV

SEQ ID NO: 1814378 - protein, 18 aa, Staphylococcus epidermidis
VPVSKSPHVFVSSRNEND

SEQ ID NO: 1814379 - protein, 20 aa, Staphylococcus epidermidis
VPYIKSTIEECYRCLEKGIE

SEQ ID NO: 1814380 - protein, 24 aa, Staphylococcus epidermidis
VPYNPHRVAVLDYGALDVMKQLGL

SEQ ID NO: 1814381 - protein, 28 aa, Staphylococcus epidermidis
VQDAPGFKHVYPYMLQFIDQLPVVAHNA

SEQ ID NO: 1814382 - protein, 20 aa, Staphylococcus epidermidis
VQEGMKGLKRQLGVVNSEMK

SEQ ID NO: 1814383 - protein, 18 aa, Staphylococcus epidermidis
VQEILKLSHIQLVGLAFN

SEQ ID NO: 1814384 - protein, 18 aa, Staphylococcus epidermidis
VQEKIRLFNSDEMMGEQA

SEQ ID NO: 1814385 - protein, 23 aa, Staphylococcus epidermidis
VQEVRAWTFRQGMTAPQCAGIIH

SEQ ID NO: 1814386 - protein, 17 aa, Staphylococcus epidermidis
VQGEFKMQIAHAKLAAE

SEQ ID NO: 1814387 - protein, 27 aa, Staphylococcus epidermidis
VQGVGFRFYTERIAREYNIKGTVQNVE

SEQ ID NO: 1814388 - protein, 38 aa, Staphylococcus epidermidis
VQHLEERGYQLSKTEYRGREATDFKEEDIELFRDIADK

SEQ ID NO: 1814389 - protein, 18 aa, Staphylococcus epidermidis
VQHYKPVEHWGGEESLKK

SEQ ID NO: 1814390 - protein, 31 aa, Staphylococcus epidermidis
VQKFTEGFTALPGWVRKSAIALTILTATIGP

SEQ ID NO: 1814391 - protein, 18 aa, Staphylococcus epidermidis
VQKNSVVMYSNIITLSKE

SEQ ID NO: 1814392 - protein, 17 aa, Staphylococcus epidermidis
VQKRLRTMPNNYKQPQR

SEQ ID NO: 1814393 - protein, 23 aa, Staphylococcus epidermidis
VQLAKDRGAYVIGTASERSYELL

SEQ ID NO: 1814394 - protein, 19 aa, Staphylococcus epidermidis
VQLAYAIGVAEPVSISINT

SEQ ID NO: 1814395 - protein, 20 aa, Staphylococcus epidermidis
VQLRRYLHQYPELSFEEKRT

SEQ ID NO: 1814396 - protein, 19 aa, Staphylococcus epidermidis
VQPNAKFPPSLKNMYQELE

SEQ ID NO: 1814397 - protein, 24 aa, Staphylococcus epidermidis
VQTFKPELLEILGRTHKTEDIYKA

SEQ ID NO: 1814398 - protein, 25 aa, Staphylococcus epidermidis
VQTFKPELLKILGRTHKTEDIYDAV

SEQ ID NO: 1814399 - protein, 25 aa, Staphylococcus epidermidis
VQTFKRQIQELGFSYDWDREVNTTD

SEQ ID NO: 1814400 - protein, 18 aa, Staphylococcus epidermidis
VQVRRLLKKYGYPPDLQK

SEQ ID NO: 1814401 - protein, 17 aa, Staphylococcus epidermidis
VQVVTVFGGMPIERQIK

SEQ ID NO: 1814402 - protein, 20 aa, Staphylococcus epidermidis
VQYKQSGQWLLYSNIQDKGY

SEQ ID NO: 1814403 - protein, 17 aa, Staphylococcus epidermidis
VRAGKLFDIPVSGTHAH

SEQ ID NO: 1814404 - protein, 32 aa, Staphylococcus epidermidis
VRESAYRVLGMYPKDVQVLGAIVMHQGNIAEM

SEQ ID NO: 1814405 - protein, 23 aa, Staphylococcus epidermidis
VRGGCSPIGMKHLFKTTIDRSAQ

SEQ ID NO: 1814406 - protein, 17 aa, Staphylococcus epidermidis
VRGKIFYQPNFKTRIVS

SEQ ID NO: 1814407 - protein, 18 aa, Staphylococcus epidermidis
VRHDIHYYNFIKRNAQNI

SEQ ID NO: 1814408 - protein, 21 aa, Staphylococcus epidermidis
VRKASYTLHRRVYVSKLNKAK

SEQ ID NO: 1814409 - protein, 24 aa, Staphylococcus epidermidis
VRKDGAFHEVEWDEALEVIADNFN

SEQ ID NO: 1814410 - protein, 27 aa, Staphylococcus epidermidis
VRKHFDLRPAGIIKMLDLKQPIYKQTA

SEQ ID NO: 1814411 - protein, 18 aa, Staphylococcus epidermidis
VRKICLYLDISADIYFLN

SEQ ID NO: 1814412 - protein, 20 aa, Staphylococcus epidermidis
VRKMTIKYIPSLREQQNKEV

SEQ ID NO: 1814413 - protein, 18 aa, Staphylococcus epidermidis
VRKQERFADFDFKEVRKH

SEQ ID NO: 1814414 - protein, 23 aa, Staphylococcus epidermidis
VRKSIHTPTIFNLVGPLINPFKL

SEQ ID NO: 1814415 - protein, 22 aa, Staphylococcus epidermidis
VRKVALGIAQFFKSRNKEASIV

SEQ ID NO: 1814416 - protein, 25 aa, Staphylococcus epidermidis
VRKVHGCLARCIRDALYDGYLKKDP

SEQ ID NO: 1814417 - protein, 28 aa, Staphylococcus epidermidis
VRLDGATKEFFAWGFRVGFMTFGTENET

SEQ ID NO: 1814418 - protein, 29 aa, Staphylococcus epidermidis
VRLDGATKEFFSWGFRVGFMTFGINHETL

SEQ ID NO: 1814419 - protein, 17 aa, Staphylococcus epidermidis
VRLPLWEDKLECQRTIN

SEQ ID NO: 1814420 - protein, 18 aa, Staphylococcus epidermidis
VRLPLWEDKLECQRTINA

SEQ ID NO: 1814421 - protein, 28 aa, Staphylococcus epidermidis
VRLYKSGKNWIKAGIKEIQLLRVMGLPF

SEQ ID NO: 1814422 - protein, 17 aa, Staphylococcus epidermidis
VRMINKFIHDVESETHF

SEQ ID NO: 1814423 - protein, 27 aa, Staphylococcus epidermidis
VRNHFDLRPAGIIKMLDLKQPIYKQTA

SEQ ID NO: 1814424 - protein, 18 aa, Staphylococcus epidermidis
VRNMFGYTGTYKGKEVSV

SEQ ID NO: 1814425 - protein, 18 aa, Staphylococcus epidermidis
VRNVEEWNNGHLDQAVNI

SEQ ID NO: 1814426 - protein, 19 aa, Staphylococcus epidermidis
VRPFKMKSIFENKKLKDLG

SEQ ID NO: 1814427 - protein, 18 aa, Staphylococcus epidermidis
VRQCIDRGLDYVFFGHIF

SEQ ID NO: 1814428 - protein, 24 aa, Staphylococcus epidermidis
VRQERGITFGLFRLSVGLEDPEEI

SEQ ID NO: 1814429 - protein, 19 aa, Staphylococcus epidermidis
VRQGLEFLLSTVEDLEVVK

SEQ ID NO: 1814430 - protein, 17 aa, Staphylococcus epidermidis
VRRDLSQMMTFKGDPDF

SEQ ID NO: 1814431 - protein, 23 aa, Staphylococcus epidermidis
VRRERGITFGLFRLSVGLENPEE

SEQ ID NO: 1814432 - protein, 21 aa, Staphylococcus epidermidis
VRRLYEGKVLAGFAGSVADAF

SEQ ID NO: 1814433 - protein, 31 aa, Staphylococcus epidermidis
VRSAKLREILHCPGQSLISAEAYRDKLLMKQ

SEQ ID NO: 1814434 - protein, 22 aa, Staphylococcus epidermidis
VRSNCGLGFKSFWEENEGFHYD

SEQ ID NO: 1814435 - protein, 20 aa, Staphylococcus epidermidis
VRTILKRNVRNVPVVDDHNQ

SEQ ID NO: 1814436 - protein, 17 aa, Staphylococcus epidermidis
VRVIVPFGPRTIQGYVM

SEQ ID NO: 1814437 - protein, 17 aa, Staphylococcus epidermidis
VRVPLPNGGEINVKIVD

SEQ ID NO: 1814438 - protein, 18 aa, Staphylococcus epidermidis
VRVYERFSTLDAVSNGRA

SEQ ID NO: 1814439 - protein, 22 aa, Staphylococcus epidermidis
VRYKTMKGFYAPYVPGWDTHGL

SEQ ID NO: 1814440 - protein, 19 aa, Staphylococcus epidermidis
VRYSILCMENLNSDKIEEN

SEQ ID NO: 1814441 - protein, 19 aa, Staphylococcus epidermidis
VRYSILCMENLSSDKIEEN

SEQ ID NO: 1814442 - protein, 24 aa, Staphylococcus epidermidis
VSAKTGEGGKLFGSVSTKQIAEAL

SEQ ID NO: 1814443 - protein, 23 aa, Staphylococcus epidermidis
VSALRLDVVLKDMIRKSRNIAKQ

SEQ ID NO: 1814444 - protein, 24 aa, Staphylococcus epidermidis
VSANEKYDLFVLVVTDIINSDSKI

SEQ ID NO: 1814445 - protein, 17 aa, Staphylococcus epidermidis
VSAYRKAAQSLEIDERP

SEQ ID NO: 1814446 - protein, 23 aa, Staphylococcus epidermidis
VSDKELIILGALTTHRLETQFQN

SEQ ID NO: 1814447 - protein, 23 aa, Staphylococcus epidermidis
VSDMKGGMSSLFYVLEQLHQEGL

SEQ ID NO: 1814448 - protein, 18 aa, Staphylococcus epidermidis
VSDNVIKHAGRMDAKLFL

SEQ ID NO: 1814449 - protein, 23 aa, Staphylococcus epidermidis
VSEGRANLIATIGSGKPVIGISG

SEQ ID NO: 1814450 - protein, 26 aa, Staphylococcus epidermidis
VSEHLWRVEIELKRGMVDYWNDCFGD

SEQ ID NO: 1814451 - protein, 21 aa, Staphylococcus epidermidis
VSEIKLIKSVLLKAKTSFNNS

SEQ ID NO: 1814452 - protein, 24 aa, Staphylococcus epidermidis
VSEINWLQVMSKFKKIIEFKEQVE

SEQ ID NO: 1814453 - protein, 17 aa, Staphylococcus epidermidis
VSELTQFPEIMDGRVKT

SEQ ID NO: 1814454 - protein, 24 aa, Staphylococcus epidermidis
VSEVKRLKSDPSFYGEFLDQSHMC

SEQ ID NO: 1814455 - protein, 31 aa, Staphylococcus epidermidis
VSEYLKQFVKVFLDLGIKVKFYNVVGNHSRV

SEQ ID NO: 1814456 - protein, 27 aa, Staphylococcus epidermidis
VSFDDTFRFLKGHYFFTIKDKNANEKV

SEQ ID NO: 1814457 - protein, 23 aa, Staphylococcus epidermidis
VSGCPFQCKGCYNVQAQNFKYGE

SEQ ID NO: 1814458 - protein, 25 aa, Staphylococcus epidermidis
VSGDFKNHMLVAVTELRTKDEIDTF

SEQ ID NO: 1814459 - protein, 17 aa, Staphylococcus epidermidis
VSGFKALRFLRPLVKGR

SEQ ID NO: 1814460 - protein, 19 aa, Staphylococcus epidermidis
VSGLYQFMISHLIEDHLDI

SEQ ID NO: 1814461 - protein, 18 aa, Staphylococcus epidermidis
VSHLIYLHSAAKITPDAS

SEQ ID NO: 1814462 - protein, 17 aa, Staphylococcus epidermidis
VSIGRLSPEKGFDLLIN

SEQ ID NO: 1814463 - protein, 17 aa, Staphylococcus epidermidis
VSILDGLSIITSQKAMQ

SEQ ID NO: 1814464 - protein, 22 aa, Staphylococcus epidermidis
VSIPKHQLTVFTGRSGSGKSSL

SEQ ID NO: 1814465 - protein, 19 aa, Staphylococcus epidermidis
VSIRFSVNQNVHFEVLLVK

SEQ ID NO: 1814466 - protein, 19 aa, Staphylococcus epidermidis
VSKAFRKAKEVIGLNDNNI

SEQ ID NO: 1814467 - protein, 17 aa, Staphylococcus epidermidis
VSKFAIGAMKLQDILKY

SEQ ID NO: 1814468 - protein, 24 aa, Staphylococcus epidermidis
VSKFKDRHVITISLEVVNEKFLKD

SEQ ID NO: 1814469 - protein, 22 aa, Staphylococcus epidermidis
VSKHECPSCHGKRLNDKVLSCK

SEQ ID NO: 1814470 - protein, 19 aa, Staphylococcus epidermidis
VSKLYKWLKNEYPYKHTDE

SEQ ID NO: 1814471 - protein, 19 aa, Staphylococcus epidermidis
VSKPMKGTMPRGKNVKEDE

SEQ ID NO: 1814472 - protein, 27 aa, Staphylococcus epidermidis
VSLIRLTLSGVFSRAGASYDDIEDSKI

SEQ ID NO: 1814473 - protein, 26 aa, Staphylococcus epidermidis
VSLPKLQLPYLISFLSFHNYAIYQIL

SEQ ID NO: 1814474 - protein, 27 aa, Staphylococcus epidermidis
VSLVSRLIFDFSFYYSKLKHENMSEND

SEQ ID NO: 1814475 - protein, 19 aa, Staphylococcus epidermidis
VSLWTWWKNNNFSHAAQKG

SEQ ID NO: 1814476 - protein, 24 aa, Staphylococcus epidermidis
VSMKRAGADLIITYFAKDICRYLD

SEQ ID NO: 1814477 - protein, 18 aa, Staphylococcus epidermidis
VSNQLIYQTVKYMMLTTE

SEQ ID NO: 1814478 - protein, 17 aa, Staphylococcus epidermidis
VSPHLAFKIERHQQLNH

SEQ ID NO: 1814479 - protein, 24 aa, Staphylococcus epidermidis
VSQSLKGALFTSLLLEKLNMKTSP

SEQ ID NO: 1814480 - protein, 25 aa, Staphylococcus epidermidis
VSRFRIVPLLIFRAMHYIGDIPEIL

SEQ ID NO: 1814481 - protein, 19 aa, Staphylococcus epidermidis
VSRLVKRRTLAKEISDQGR

SEQ ID NO: 1814482 - protein, 17 aa, Staphylococcus epidermidis
VSRTTIYRYLNKLEDKE

SEQ ID NO: 1814483 - protein, 17 aa, Staphylococcus epidermidis
VSRTTIYRYLNKLNNQE

SEQ ID NO: 1814484 - protein, 17 aa, Staphylococcus epidermidis
VSRTTIYRYLNRLNNQE

SEQ ID NO: 1814485 - protein, 28 aa, Staphylococcus epidermidis
VSSCGKCYYCKKGIYAHCENDGGWILGH

SEQ ID NO: 1814486 - protein, 26 aa, Staphylococcus epidermidis
VSSDYLLCKAFGKTATNIEKYTSQGT

SEQ ID NO: 1814487 - protein, 25 aa, Staphylococcus epidermidis
VSSFDASPFLKMIINQSEFNMKIAG

SEQ ID NO: 1814488 - protein, 25 aa, Staphylococcus epidermidis
VSSFEASPFLKMIINQSEFNMKIAG

SEQ ID NO: 1814489 - protein, 26 aa, Staphylococcus epidermidis
VSSHGLSLGRLRGVEFDVAIFSNLTQ

SEQ ID NO: 1814490 - protein, 17 aa, Staphylococcus epidermidis
VSSKYQSIVENLLGNTI

SEQ ID NO: 1814491 - protein, 25 aa, Staphylococcus epidermidis
VSSSDWKVGDKVTHKAWGEGMVSNV

SEQ ID NO: 1814492 - protein, 24 aa, Staphylococcus epidermidis
VSTLRILGAQVGWYIPNRFTEGYG

SEQ ID NO: 1814493 - protein, 25 aa, Staphylococcus epidermidis
VSVATFTLAVNRTFTNAQGEREADF

SEQ ID NO: 1814494 - protein, 22 aa, Staphylococcus epidermidis
VTAARLGWLPSYPQFNKNSLLF

SEQ ID NO: 1814495 - protein, 22 aa, Staphylococcus epidermidis
VTAATFACFGYGWHVDVGIHAI

SEQ ID NO: 1814496 - protein, 19 aa, Staphylococcus epidermidis
VTAEPWVKISDRGLQLEGL

SEQ ID NO: 1814497 - protein, 19 aa, Staphylococcus epidermidis
VTAIFPKLVFSIKKGINFG

SEQ ID NO: 1814498 - protein, 18 aa, Staphylococcus epidermidis
VTALNYYTGEEVTIPLNP

SEQ ID NO: 1814499 - protein, 21 aa, Staphylococcus epidermidis
VTATPVLRPLLTLDKEDIIKK

SEQ ID NO: 1814500 - protein, 22 aa, Staphylococcus epidermidis
VTAYRGSGHLIDYSATKGAIVS

SEQ ID NO: 1814501 - protein, 20 aa, Staphylococcus epidermidis
VTCHKDKPGIVGHTGNLLGN

SEQ ID NO: 1814502 - protein, 29 aa, Staphylococcus epidermidis
VTEPEPSFSTCFGAPFLPLNPTVYADLLG

SEQ ID NO: 1814503 - protein, 24 aa, Staphylococcus epidermidis
VTEPSYRDNVNWGDINQPIDEETF

SEQ ID NO: 1814504 - protein, 24 aa, Staphylococcus epidermidis
VTFFRSQRALGEYVGINVNATIVA

SEQ ID NO: 1814505 - protein, 18 aa, Staphylococcus epidermidis
VTGHALRGLYAKDIPFAN

SEQ ID NO: 1814506 - protein, 18 aa, Staphylococcus epidermidis
VTGIGPKSALAILAASTP

SEQ ID NO: 1814507 - protein, 17 aa, Staphylococcus epidermidis
VTGNCTEIFQYMHVSDI

SEQ ID NO: 1814508 - protein, 29 aa, Staphylococcus epidermidis
VTGYDIIFFWVARMIFQGLEFTDRRPFND

SEQ ID NO: 1814509 - protein, 18 aa, Staphylococcus epidermidis
VTHRDFSSSVAFVTAVNK

SEQ ID NO: 1814510 - protein, 19 aa, Staphylococcus epidermidis
VTHTYDADQRWTIQYEAES

SEQ ID NO: 1814511 - protein, 23 aa, Staphylococcus epidermidis
VTIDHIKYFIATYTQTLVKPLIA

SEQ ID NO: 1814512 - protein, 20 aa, Staphylococcus epidermidis
VTIFCTFWGLNALKKNQSQR

SEQ ID NO: 1814513 - protein, 20 aa, Staphylococcus epidermidis
VTIFCTFWGLNALKKTQSQR

SEQ ID NO: 1814514 - protein, 20 aa, Staphylococcus epidermidis
VTIFFTFWGLNALKKAQSTR

SEQ ID NO: 1814515 - protein, 20 aa, Staphylococcus epidermidis
VTIFFTFWGLNALKKAQTVN

SEQ ID NO: 1814516 - protein, 17 aa, Staphylococcus epidermidis
VTIKWPNDIYIGNKKIC

SEQ ID NO: 1814517 - protein, 20 aa, Staphylococcus epidermidis
VTKEAFKNSFSLQNTLNSPN

SEQ ID NO: 1814518 - protein, 17 aa, Staphylococcus epidermidis
VTLAAGYSLNWLKKTFF

SEQ ID NO: 1814519 - protein, 24 aa, Staphylococcus epidermidis
VTLEPCVMCAGAIVMSRIPRVVYG

SEQ ID NO: 1814520 - protein, 24 aa, Staphylococcus epidermidis
VTLEPCVMCAGTIIMSRIPKVVYG

SEQ ID NO: 1814521 - protein, 18 aa, Staphylococcus epidermidis
VTLGPQFVYVAAYEGGII

SEQ ID NO: 1814522 - protein, 24 aa, Staphylococcus epidermidis
VTLHKDDEVCILYGTKNGLVALPT

SEQ ID NO: 1814523 - protein, 25 aa, Staphylococcus epidermidis
VTLLIKGHNAYGYLKAEKGVHRLVR

SEQ ID NO: 1814524 - protein, 22 aa, Staphylococcus epidermidis
VTLPHLFSDILIYCTERNVMLV

SEQ ID NO: 1814525 - protein, 17 aa, Staphylococcus epidermidis
VTLPYEFTPTLPVNDVY

SEQ ID NO: 1814526 - protein, 17 aa, Staphylococcus epidermidis
VTLRPDGTLYFYNKDSN

SEQ ID NO: 1814527 - protein, 20 aa, Staphylococcus epidermidis
VTMELGGLAPLIVHEDANVD

SEQ ID NO: 1814528 - protein, 25 aa, Staphylococcus epidermidis
VTMGEAEKFWDFMAKVEKENEKSNP

SEQ ID NO: 1814529 - protein, 17 aa, Staphylococcus epidermidis
VTNPKILLCDEATSALD

SEQ ID NO: 1814530 - protein, 24 aa, Staphylococcus epidermidis
VTPDGGKLKIHYELYQNEEKMGSY

SEQ ID NO: 1814531 - protein, 24 aa, Staphylococcus epidermidis
VTPEQCNQLGLALAEKLVPNHQVA

SEQ ID NO: 1814532 - protein, 18 aa, Staphylococcus epidermidis
VTPSMMVFTNFFRDQMDR

SEQ ID NO: 1814533 - protein, 19 aa, Staphylococcus epidermidis
VTQSKGYRVLDIENNQILN

SEQ ID NO: 1814534 - protein, 18 aa, Staphylococcus epidermidis
VTRCKAMADKGELPHNVV

SEQ ID NO: 1814535 - protein, 21 aa, Staphylococcus epidermidis
VTSPYRFFAAYQIYEDDTPAF

SEQ ID NO: 1814536 - protein, 23 aa, Staphylococcus epidermidis
VTSPYRFFAAYQIYEDDTPAFFN

SEQ ID NO: 1814537 - protein, 17 aa, Staphylococcus epidermidis
VTSQLANIFPDLVTGEN

SEQ ID NO: 1814538 - protein, 19 aa, Staphylococcus epidermidis
VTTPEVFDLIAQTTPLKKV

SEQ ID NO: 1814539 - protein, 22 aa, Staphylococcus epidermidis
VTTPRFYLDLNKYLNSQEQNST

SEQ ID NO: 1814540 - protein, 17 aa, Staphylococcus epidermidis
VTVGMAVTNVHGDQLKN

SEQ ID NO: 1814541 - protein, 21 aa, Staphylococcus epidermidis
VTVLHLADWLMEMQLDRKAGE

SEQ ID NO: 1814542 - protein, 22 aa, Staphylococcus epidermidis
VTVYWHHFLRPEVKFEGIDPLV

SEQ ID NO: 1814543 - protein, 17 aa, Staphylococcus epidermidis
VTYGLAIDGEKVTRKEL

SEQ ID NO: 1814544 - protein, 20 aa, Staphylococcus epidermidis
VVAAVGLAQNFSACRALVSE

SEQ ID NO: 1814545 - protein, 23 aa, Staphylococcus epidermidis
VVANLPYYITTPILLNLMQQDIP

SEQ ID NO: 1814546 - protein, 23 aa, Staphylococcus epidermidis
VVANLPYYITTPILLNLMQQDVP

SEQ ID NO: 1814547 - protein, 20 aa, Staphylococcus epidermidis
VVDISGRPYFSFNSKLSAQK

SEQ ID NO: 1814548 - protein, 17 aa, Staphylococcus epidermidis
VVDKGFSLEGVYEVSDD

SEQ ID NO: 1814549 - protein, 22 aa, Staphylococcus epidermidis
VVDRDGRLIGIVSLKIDMHNVE

SEQ ID NO: 1814550 - protein, 18 aa, Staphylococcus epidermidis
VVEFIVKFQKEMRKFMAG

SEQ ID NO: 1814551 - protein, 24 aa, Staphylococcus epidermidis
VVEKIRQNYNFDFIFIDVPPTINS

SEQ ID NO: 1814552 - protein, 36 aa, Staphylococcus epidermidis
VVERPTLKFELFYFDIFKYGTSFITLQVPREEEFSP

SEQ ID NO: 1814553 - protein, 17 aa, Staphylococcus epidermidis
VVETFQGAGVISRELEN

SEQ ID NO: 1814554 - protein, 33 aa, Staphylococcus epidermidis
VVGDSDQSIYGWRGADIQNILSFEEDYPEAKTI

SEQ ID NO: 1814555 - protein, 21 aa, Staphylococcus epidermidis
VVKDAMSIIRNIMKYIQRKYK

SEQ ID NO: 1814556 - protein, 28 aa, Staphylococcus epidermidis
VVKKDFEGISFLNLVDFDALYGHRRDKE

SEQ ID NO: 1814557 - protein, 20 aa, Staphylococcus epidermidis
VVKPLLKYAYDRGIYVQMNS

SEQ ID NO: 1814558 - protein, 17 aa, Staphylococcus epidermidis
VVKRLSKDMSIGVITND

SEQ ID NO: 1814559 - protein, 23 aa, Staphylococcus epidermidis
VVKYGKEILKMGAQSVIISLGGD

SEQ ID NO: 1814560 - protein, 26 aa, Staphylococcus epidermidis
VVLIHGFKDYVALLFQKGAILEDKYH

SEQ ID NO: 1814561 - protein, 20 aa, Staphylococcus epidermidis
VVLKPFRLGGIDRILDAMKI

SEQ ID NO: 1814562 - protein, 19 aa, Staphylococcus epidermidis
VVLPEMWNNGYALEELEDK

SEQ ID NO: 1814563 - protein, 18 aa, Staphylococcus epidermidis
VVLPEMWNNGYALEELKQ

SEQ ID NO: 1814564 - protein, 26 aa, Staphylococcus epidermidis
VVNMIQEVYEDFGFEDYTFRLSYRDP

SEQ ID NO: 1814565 - protein, 24 aa, Staphylococcus epidermidis
VVNSEMKANLSAFGKSEKSMAKYE

SEQ ID NO: 1814566 - protein, 18 aa, Staphylococcus epidermidis
VVPKPLWTRKYQVNDKNQ

SEQ ID NO: 1814567 - protein, 17 aa, Staphylococcus epidermidis
VVPRFNRVYIEPSNPRV

SEQ ID NO: 1814568 - protein, 17 aa, Staphylococcus epidermidis
VVQEFKGNYNGVINDNL

SEQ ID NO: 1814569 - protein, 22 aa, Staphylococcus epidermidis
VVQESELRRCQEDHIEANYTID

SEQ ID NO: 1814570 - protein, 17 aa, Staphylococcus epidermidis
VVQHPRYGKQLKAERFE

SEQ ID NO: 1814571 - protein, 29 aa, Staphylococcus epidermidis
VVRKLKMIGHYIGMSFQIIDDVLDFTSSE

SEQ ID NO: 1814572 - protein, 23 aa, Staphylococcus epidermidis
VVRRYFEYKGYEVIYVSNFTDVD

SEQ ID NO: 1814573 - protein, 23 aa, Staphylococcus epidermidis
VVTRPFGFEGRKRQTQAAAGVES

SEQ ID NO: 1814574 - protein, 18 aa, Staphylococcus epidermidis
VVVGGGYIGSELGTAFAN

SEQ ID NO: 1814575 - protein, 21 aa, Staphylococcus epidermidis
VVVLKPFRLGGIDKVIEAMKI

SEQ ID NO: 1814576 - protein, 21 aa, Staphylococcus epidermidis
VVWLDCDIEIIFKRVKNDPHR

SEQ ID NO: 1814577 - protein, 18 aa, Staphylococcus epidermidis
VWFKLVLNDTSEFHNIKQ

SEQ ID NO: 1814578 - protein, 18 aa, Staphylococcus epidermidis
VWFNEPRGDFYTEQDELV

SEQ ID NO: 1814579 - protein, 24 aa, Staphylococcus epidermidis
VWQERLKLLEPYRVNKELMEKTGN

SEQ ID NO: 1814580 - protein, 22 aa, Staphylococcus epidermidis
VWQERLKLLKPYQVNQTLLEKT

SEQ ID NO: 1814581 - protein, 17 aa, Staphylococcus epidermidis
VYCAVWINDNQYALQKL

SEQ ID NO: 1814582 - protein, 17 aa, Staphylococcus epidermidis
VYECKFLTVATGYYGQH

SEQ ID NO: 1814583 - protein, 21 aa, Staphylococcus epidermidis
VYEHRFERVSGWRDVKNYFNS

SEQ ID NO: 1814584 - protein, 26 aa, Staphylococcus epidermidis
VYGAVNLHWPGSVNVREIFKQYVNCP

SEQ ID NO: 1814585 - protein, 25 aa, Staphylococcus epidermidis
VYGLFIYNKWRGMGTLNSVDVINQH

SEQ ID NO: 1814586 - protein, 30 aa, Staphylococcus epidermidis
VYHDRPSEDWVWRDGFVKMDTLEVNVNDLM

SEQ ID NO: 1814587 - protein, 24 aa, Staphylococcus epidermidis
VYIYKNRFNLEWIYVSLEKKGLEQ

SEQ ID NO: 1814588 - protein, 25 aa, Staphylococcus epidermidis
VYKGIKKHLVYDWIVKFKNTAQKNK

SEQ ID NO: 1814589 - protein, 22 aa, Staphylococcus epidermidis
VYKKAFESYQRYFNQKGSNEIM

SEQ ID NO: 1814590 - protein, 17 aa, Staphylococcus epidermidis
VYKVAAMDFIFKDDPSE

SEQ ID NO: 1814591 - protein, 20 aa, Staphylococcus epidermidis
VYLELWVKVQRDWRNKVNFI

SEQ ID NO: 1814592 - protein, 19 aa, Staphylococcus epidermidis
VYLQQLFTLCQLWKEISQL

SEQ ID NO: 1814593 - protein, 26 aa, Staphylococcus epidermidis
VYLVDRVIPMIPHRLSNGICSLNPEV

SEQ ID NO: 1814594 - protein, 25 aa, Staphylococcus epidermidis
VYMEFMAGGILRIIYAWLKEGQKRS

SEQ ID NO: 1814595 - protein, 23 aa, Staphylococcus epidermidis
VYMPYITAYFMPRAYKDRPLVVP

SEQ ID NO: 1814596 - protein, 18 aa, Staphylococcus epidermidis
VYPDYVFTSFVISEPYIV

SEQ ID NO: 1814597 - protein, 17 aa, Staphylococcus epidermidis
VYPNIIIFVDNCYGEFV

SEQ ID NO: 1814598 - protein, 30 aa, Staphylococcus epidermidis
VYQDRPTDEWQWRDGFVKMDTLEVDANDLI

SEQ ID NO: 1814599 - protein, 18 aa, Staphylococcus epidermidis
VYQHYALSELPFPKKTKF

SEQ ID NO: 1814600 - protein, 23 aa, Staphylococcus epidermidis
VYRKIRNTLRFMLGNINDYNPET

SEQ ID NO: 1814601 - protein, 19 aa, Staphylococcus epidermidis
VYTSYAYYQLCEEKGIIRS

SEQ ID NO: 1814602 - protein, 18 aa, Staphylococcus epidermidis
VYVVYDWTGGTILGKQAL

SEQ ID NO: 1814603 - protein, 18 aa, Staphylococcus epidermidis
VYYEWLAQLCEALETGEI

SEQ ID NO: 1814604 - protein, 23 aa, Staphylococcus epidermidis
WADNYKFPVAVIDEVIKAKKAHA

SEQ ID NO: 1814605 - protein, 17 aa, Staphylococcus epidermidis
WAFKRVWGTYLSEKIGE

SEQ ID NO: 1814606 - protein, 35 aa, Staphylococcus epidermidis
WANEWKNYFHPFKASERFTIVPSWETYEKESNNEL

SEQ ID NO: 1814607 - protein, 27 aa, Staphylococcus epidermidis
WASPIMSRPVKNMTVAIIGTGRIGAAT

SEQ ID NO: 1814608 - protein, 17 aa, Staphylococcus epidermidis
WASTASAHFFVDDEECI

SEQ ID NO: 1814609 - protein, 19 aa, Staphylococcus epidermidis
WCRSTTVPHVGNWRDKFYK

SEQ ID NO: 1814610 - protein, 19 aa, Staphylococcus epidermidis
WDHEIFIKYLNFFQLPYKN

SEQ ID NO: 1814611 - protein, 23 aa, Staphylococcus epidermidis
WDHISYKQAFYIAEHYIDNTCED

SEQ ID NO: 1814612 - protein, 17 aa, Staphylococcus epidermidis
WDIEVYNVTAPLNIQEN

SEQ ID NO: 1814613 - protein, 19 aa, Staphylococcus epidermidis
WDNYPVCMAKTQYSFSDDQ

SEQ ID NO: 1814614 - protein, 24 aa, Staphylococcus epidermidis
WDREQKAYNAIRNFEGPTYASAKE

SEQ ID NO: 1814615 - protein, 27 aa, Staphylococcus epidermidis
WDSPFGEGRPGWHIECSVMAYHELGPT

SEQ ID NO: 1814616 - protein, 19 aa, Staphylococcus epidermidis
WDSQIKKFIFASSAAVYGD

SEQ ID NO: 1814617 - protein, 17 aa, Staphylococcus epidermidis
WEASILSQSIKDLKVAV

SEQ ID NO: 1814618 - protein, 18 aa, Staphylococcus epidermidis
WEDKDGRHFDQLKTVIDQ

SEQ ID NO: 1814619 - protein, 18 aa, Staphylococcus epidermidis
WEEECGYTVRDVHQANDV

SEQ ID NO: 1814620 - protein, 22 aa, Staphylococcus epidermidis
WEESGRWGAYGPELMRLKDRNG

SEQ ID NO: 1814621 - protein, 18 aa, Staphylococcus epidermidis
WEIMGLNIMQPFKVYPDG

SEQ ID NO: 1814622 - protein, 24 aa, Staphylococcus epidermidis
WENSCGSGAASIGVFQQYRTNQAS

SEQ ID NO: 1814623 - protein, 25 aa, Staphylococcus epidermidis
WEQPEYIKSLTFESAVETLKKHLPE

SEQ ID NO: 1814624 - protein, 25 aa, Staphylococcus epidermidis
WEQPEYIKTLTFNSAVQTLKSELPT

SEQ ID NO: 1814625 - protein, 20 aa, Staphylococcus epidermidis
WESWGPYLLSGKDVYGSTVG

SEQ ID NO: 1814626 - protein, 17 aa, Staphylococcus epidermidis
WFGFDEFKEGQEEIIDS

SEQ ID NO: 1814627 - protein, 25 aa, Staphylococcus epidermidis
WFLNPDHMPLIIGIEKGWFKEESLE

SEQ ID NO: 1814628 - protein, 27 aa, Staphylococcus epidermidis
WFLNPDHMPLILGIEKGWFKEESLEIE

SEQ ID NO: 1814629 - protein, 18 aa, Staphylococcus epidermidis
WFMSEFTTDLSLSMAFEK

SEQ ID NO: 1814630 - protein, 18 aa, Staphylococcus epidermidis
WFPVIGQAVSASISYYFM

SEQ ID NO: 1814631 - protein, 17 aa, Staphylococcus epidermidis
WFTASEAVEKGFADSYE

SEQ ID NO: 1814632 - protein, 25 aa, Staphylococcus epidermidis
WFTIAMYELGKWIGRELYYKLTAND

SEQ ID NO: 1814633 - protein, 18 aa, Staphylococcus epidermidis
WFTIAMYELGKWIGREVY

SEQ ID NO: 1814634 - protein, 24 aa, Staphylococcus epidermidis
WFTISVYELGKWLGRELYYKLSAN

SEQ ID NO: 1814635 - protein, 18 aa, Staphylococcus epidermidis
WGAHGGIIFSSKDIKDLI

SEQ ID NO: 1814636 - protein, 17 aa, Staphylococcus epidermidis
WGGDTIFVPLSALSGDG

SEQ ID NO: 1814637 - protein, 20 aa, Staphylococcus epidermidis
WGLNALKKAQTVNVKKKGIA

SEQ ID NO: 1814638 - protein, 18 aa, Staphylococcus epidermidis
WGNETLTWNLKKGPKGGI

SEQ ID NO: 1814639 - protein, 17 aa, Staphylococcus epidermidis
WGRTREFYIDKHSGKSI

SEQ ID NO: 1814640 - protein, 21 aa, Staphylococcus epidermidis
WGTRVCEEIKPQKGDLIIKKN

SEQ ID NO: 1814641 - protein, 30 aa, Staphylococcus epidermidis
WGYAHLQMAPKHWLCIEEDDLVWATAAPGW

SEQ ID NO: 1814642 - protein, 32 aa, Staphylococcus epidermidis
WHDQYPKLAELGLKWYAVPIISNMDLKIGGIT

SEQ ID NO: 1814643 - protein, 18 aa, Staphylococcus epidermidis
WHEGVLGIVASKIVETYA

SEQ ID NO: 1814644 - protein, 17 aa, Staphylococcus epidermidis
WHGVGIKPIERFVDSPG

SEQ ID NO: 1814645 - protein, 17 aa, Staphylococcus epidermidis
WHIHRMLEAAEELPINV

SEQ ID NO: 1814646 - protein, 17 aa, Staphylococcus epidermidis
WHIHRMLEAAEEMPINV

SEQ ID NO: 1814647 - protein, 17 aa, Staphylococcus epidermidis
WHLAHNRIIIPKSQTPQ

SEQ ID NO: 1814648 - protein, 25 aa, Staphylococcus epidermidis
WHPELKKYIEYAGDDILLRRIYKLP

SEQ ID NO: 1814649 - protein, 17 aa, Staphylococcus epidermidis
WHTAGRYWGHMNTETLM

SEQ ID NO: 1814650 - protein, 32 aa, Staphylococcus epidermidis
WIHERSKFGIKPGVKRMEWMLEQFNNPQDKIR

SEQ ID NO: 1814651 - protein, 30 aa, Staphylococcus epidermidis
WIHERSKFGIKPGVKRMEWMLEQLNNPQHK

SEQ ID NO: 1814652 - protein, 26 aa, Staphylococcus epidermidis
WIHPDERSAAFFALGLIKGSGKPVAI

SEQ ID NO: 1814653 - protein, 17 aa, Staphylococcus epidermidis
WIINSKMIVEPKGKDME

SEQ ID NO: 1814654 - protein, 22 aa, Staphylococcus epidermidis
WILHIPSCYLGIAQAARDYAVH

SEQ ID NO: 1814655 - protein, 25 aa, Staphylococcus epidermidis
WIQHIHTLIKMCGEVRGVLIQPSSD

SEQ ID NO: 1814656 - protein, 17 aa, Staphylococcus epidermidis
WIQKFKEVEDIFKERAT

SEQ ID NO: 1814657 - protein, 27 aa, Staphylococcus epidermidis
WKAKSFSIRGGDKMAIIGSNGTGKTTF

SEQ ID NO: 1814658 - protein, 19 aa, Staphylococcus epidermidis
WKDALYIDNDFVFTDYNGY

SEQ ID NO: 1814659 - protein, 19 aa, Staphylococcus epidermidis
WKDEIREAIDQSKATNMDE

SEQ ID NO: 1814660 - protein, 18 aa, Staphylococcus epidermidis
WKDEIREAIDQSQATNID

SEQ ID NO: 1814661 - protein, 18 aa, Staphylococcus epidermidis
WKETEIFFDKLTDLLKFM

SEQ ID NO: 1814662 - protein, 20 aa, Staphylococcus epidermidis
WKHNDKFREGFKGYQAEHLS

SEQ ID NO: 1814663 - protein, 22 aa, Staphylococcus epidermidis
WKKFFKEKAIVTYWKQGYYYQH

SEQ ID NO: 1814664 - protein, 17 aa, Staphylococcus epidermidis
WKKFFKEKAVVTYWKQG

SEQ ID NO: 1814665 - protein, 21 aa, Staphylococcus epidermidis
WKKVHKSTFMYGSKLKFNNNF

SEQ ID NO: 1814666 - protein, 18 aa, Staphylococcus epidermidis
WKRLFELHPMLKARFTEE

SEQ ID NO: 1814667 - protein, 18 aa, Staphylococcus epidermidis
WKRMKEFHQHGIYNDLTL

SEQ ID NO: 1814668 - protein, 20 aa, Staphylococcus epidermidis
WKVSRTTIYRYLNKLNNQEN

SEQ ID NO: 1814669 - protein, 17 aa, Staphylococcus epidermidis
WLANELFNTKAYQDAES

SEQ ID NO: 1814670 - protein, 24 aa, Staphylococcus epidermidis
WLDSKGFPKLVLQMVEHEADFGFG

SEQ ID NO: 1814671 - protein, 17 aa, Staphylococcus epidermidis
WLEEKGYVIDFVQMERI

SEQ ID NO: 1814672 - protein, 19 aa, Staphylococcus epidermidis
WLELWRDVTGISEITQVRV

SEQ ID NO: 1814673 - protein, 19 aa, Staphylococcus epidermidis
WLERTDKRATEWHHFINQL

SEQ ID NO: 1814674 - protein, 17 aa, Staphylococcus epidermidis
WLGYCTNELVQINPQDK

SEQ ID NO: 1814675 - protein, 18 aa, Staphylococcus epidermidis
WLHLSRKMLNKELEKTLF

SEQ ID NO: 1814676 - protein, 17 aa, Staphylococcus epidermidis
WLKLLDETSPIDMLASW

SEQ ID NO: 1814677 - protein, 17 aa, Staphylococcus epidermidis
WLLMKNIKLDIVDMKIS

SEQ ID NO: 1814678 - protein, 18 aa, Staphylococcus epidermidis
WLLQIYKKRGYEIYAEHE

SEQ ID NO: 1814679 - protein, 18 aa, Staphylococcus epidermidis
WLNCGYNRWNHNEPLVGQ

SEQ ID NO: 1814680 - protein, 19 aa, Staphylococcus epidermidis
WLNCGYNRWNHNEPLVGQT

SEQ ID NO: 1814681 - protein, 18 aa, Staphylococcus epidermidis
WLNSSFNDNGFSLSNHHT

SEQ ID NO: 1814682 - protein, 24 aa, Staphylococcus epidermidis
WLQILPEKKRYSITVMFDDKGHPL

SEQ ID NO: 1814683 - protein, 26 aa, Staphylococcus epidermidis
WLQPLLKRKFPEHHFEFTYIDINKDK

SEQ ID NO: 1814684 - protein, 23 aa, Staphylococcus epidermidis
WLRCDIKSLNLLGNVLAKEFAVK

SEQ ID NO: 1814685 - protein, 20 aa, Staphylococcus epidermidis
WLSVLPIYHISGLSVILRSV

SEQ ID NO: 1814686 - protein, 19 aa, Staphylococcus epidermidis
WLTKPIMGKIFMPIVNDAR

SEQ ID NO: 1814687 - protein, 18 aa, Staphylococcus epidermidis
WLVEKGFDEDELFKESIK

SEQ ID NO: 1814688 - protein, 17 aa, Staphylococcus epidermidis
WLVMEVCGGQTESKRQF

SEQ ID NO: 1814689 - protein, 26 aa, Staphylococcus epidermidis
WLVRQRLINFPAMPVKGEWKQESYGY

SEQ ID NO: 1814690 - protein, 19 aa, Staphylococcus epidermidis
WMREYSKAILGLVMPLYSK

SEQ ID NO: 1814691 - protein, 19 aa, Staphylococcus epidermidis
WMRHEEPEIFKQTTMFADL

SEQ ID NO: 1814692 - protein, 18 aa, Staphylococcus epidermidis
WMTLKCGIVDLPYGGGKG

SEQ ID NO: 1814693 - protein, 18 aa, Staphylococcus epidermidis
WMVKIEISDDSQLEELLS

SEQ ID NO: 1814694 - protein, 17 aa, Staphylococcus epidermidis
WNCKYHIVFAPKYRRQV

SEQ ID NO: 1814695 - protein, 22 aa, Staphylococcus epidermidis
WNDCFSDLHILQPDWKTIQRTA

SEQ ID NO: 1814696 - protein, 23 aa, Staphylococcus epidermidis
WNDCFSDLHILQPDWKTIQRTAD

SEQ ID NO: 1814697 - protein, 25 aa, Staphylococcus epidermidis
WNFINKIWNAARFSLMNIGEDFKVE

SEQ ID NO: 1814698 - protein, 24 aa, Staphylococcus epidermidis
WNIVKLPFNVGCLSEYAAVEAIKD

SEQ ID NO: 1814699 - protein, 18 aa, Staphylococcus epidermidis
WNKAESMLKEAVDEMGLP

SEQ ID NO: 1814700 - protein, 25 aa, Staphylococcus epidermidis
WNKSHHQLIFFGRYHCLARKPKCDI

SEQ ID NO: 1814701 - protein, 20 aa, Staphylococcus epidermidis
WNTIETRNGFILQSNKVSNI

SEQ ID NO: 1814702 - protein, 17 aa, Staphylococcus epidermidis
WNYEVHVIDNFEKIMED

SEQ ID NO: 1814703 - protein, 17 aa, Staphylococcus epidermidis
WPHIRVLEQDWIDGGMT

SEQ ID NO: 1814704 - protein, 20 aa, Staphylococcus epidermidis
WPKDTEFVYSPFMVETIIGE

SEQ ID NO: 1814705 - protein, 18 aa, Staphylococcus epidermidis
WPQNLMITAVNAQKAERV

SEQ ID NO: 1814706 - protein, 17 aa, Staphylococcus epidermidis
WPREFFIGTDGYVREGF

SEQ ID NO: 1814707 - protein, 22 aa, Staphylococcus epidermidis
WPVNRNGAYVIHRLAGSKQYKG

SEQ ID NO: 1814708 - protein, 24 aa, Staphylococcus epidermidis
WQNFWKTFASQWLKDLNINEENMR

SEQ ID NO: 1814709 - protein, 20 aa, Staphylococcus epidermidis
WQNIYFKIYINDEGSEAFFF

SEQ ID NO: 1814710 - protein, 18 aa, Staphylococcus epidermidis
WQSSLLLNFFKVEPMEQA

SEQ ID NO: 1814711 - protein, 19 aa, Staphylococcus epidermidis
WQYHDHWLGYCTNELVQIN

SEQ ID NO: 1814712 - protein, 20 aa, Staphylococcus epidermidis
WRIISHANLSIVNFRYENSD

SEQ ID NO: 1814713 - protein, 18 aa, Staphylococcus epidermidis
WRKEETLYSEDEKKENKD

SEQ ID NO: 1814714 - protein, 18 aa, Staphylococcus epidermidis
WRKHVMKDMRVEEGSKAL

SEQ ID NO: 1814715 - protein, 24 aa, Staphylococcus epidermidis
WRLIPEVWGNGIATEGAEAVMDYA

SEQ ID NO: 1814716 - protein, 24 aa, Staphylococcus epidermidis
WRLIPEVWGNGLATEGAEAVMKYA

SEQ ID NO: 1814717 - protein, 19 aa, Staphylococcus epidermidis
WRNSNRCIGRLFWDSLNVE

SEQ ID NO: 1814718 - protein, 20 aa, Staphylococcus epidermidis
WRPTGHKYPLVAGALSKDAY

SEQ ID NO: 1814719 - protein, 19 aa, Staphylococcus epidermidis
WRTMPRNGMTIHYSGMTLE

SEQ ID NO: 1814720 - protein, 20 aa, Staphylococcus epidermidis
WRTSIKQADDMGVKKTLQGN

SEQ ID NO: 1814721 - protein, 20 aa, Staphylococcus epidermidis
WRTSIKQADKMGVNKAIQGN

SEQ ID NO: 1814722 - protein, 19 aa, Staphylococcus epidermidis
WSADPSFLKDERFSDYGKL

SEQ ID NO: 1814723 - protein, 18 aa, Staphylococcus epidermidis
WSAESSFLDDERFSDYGK

SEQ ID NO: 1814724 - protein, 20 aa, Staphylococcus epidermidis
WSEDTARLQVRMNAETPQDI

SEQ ID NO: 1814725 - protein, 18 aa, Staphylococcus epidermidis
WSEEELLKTIDLLHLQNE

SEQ ID NO: 1814726 - protein, 17 aa, Staphylococcus epidermidis
WSIKDILDFQKPHTYCL

SEQ ID NO: 1814727 - protein, 17 aa, Staphylococcus epidermidis
WSKEEMESIVVELPQNR

SEQ ID NO: 1814728 - protein, 17 aa, Staphylococcus epidermidis
WSVELPIEMSKDEIHEE

SEQ ID NO: 1814729 - protein, 20 aa, Staphylococcus epidermidis
WTEKYDIWFSIYSTPSESLT

SEQ ID NO: 1814730 - protein, 20 aa, Staphylococcus epidermidis
WTIDDCYDFYSLPNGNEGTK

SEQ ID NO: 1814731 - protein, 19 aa, Staphylococcus epidermidis
WTIDDSYDFYSLANENEPV

SEQ ID NO: 1814732 - protein, 25 aa, Staphylococcus epidermidis
WTISRQLWWGHQIPAWYHKETNEIY

SEQ ID NO: 1814733 - protein, 20 aa, Staphylococcus epidermidis
WTQKGRLFIYELLKDNDILP

SEQ ID NO: 1814734 - protein, 18 aa, Staphylococcus epidermidis
WTYRRKGLYKTCKHCNEV

SEQ ID NO: 1814735 - protein, 21 aa, Staphylococcus epidermidis
WVGKNVLDPTFNWISDKAKKI

SEQ ID NO: 1814736 - protein, 20 aa, Staphylococcus epidermidis
WVGTLLKMKPVLHFEEDGKI

SEQ ID NO: 1814737 - protein, 18 aa, Staphylococcus epidermidis
WVQEYAPVLYQIWKKKHK

SEQ ID NO: 1814738 - protein, 19 aa, Staphylococcus epidermidis
WVQEYDPIFIKFGRKSIKK

SEQ ID NO: 1814739 - protein, 18 aa, Staphylococcus epidermidis
WWESTSRPFYLKKQYTDF

SEQ ID NO: 1814740 - protein, 23 aa, Staphylococcus epidermidis
WWNEVKDAYHFLENEGYQHISAT

SEQ ID NO: 1814741 - protein, 23 aa, Staphylococcus epidermidis
WYAEEAKRIYGRTIPANSSSKKI

SEQ ID NO: 1814742 - protein, 18 aa, Staphylococcus epidermidis
WYAENRITLINDDPVVKV

SEQ ID NO: 1814743 - protein, 17 aa, Staphylococcus epidermidis
WYAKILYTIYRNRYLFA

SEQ ID NO: 1814744 - protein, 19 aa, Staphylococcus epidermidis
WYEHSLDLFLDHFGEDIMI

SEQ ID NO: 1814745 - protein, 17 aa, Staphylococcus epidermidis
WYNLKIVNETATSTDLK

SEQ ID NO: 1814746 - protein, 24 aa, Staphylococcus epidermidis
WYPQPAPADHPWRTMPRNGMTIHY

SEQ ID NO: 1814747 - protein, 20 aa, Staphylococcus epidermidis
WYYIESSLQLTLPYERNSLY

SEQ ID NO: 1814748 - protein, 19 aa, Staphylococcus epidermidis
YADGYLRAMQGAYVNVNGH

SEQ ID NO: 1814749 - protein, 19 aa, Staphylococcus epidermidis
YADGYLRSMQGAFVNVNGN

SEQ ID NO: 1814750 - protein, 18 aa, Staphylococcus epidermidis
YADRIKVDWDAIERHTEQ

SEQ ID NO: 1814751 - protein, 23 aa, Staphylococcus epidermidis
YAENVKFADHWLAPHPGTDAAIA

SEQ ID NO: 1814752 - protein, 18 aa, Staphylococcus epidermidis
YAESLTFNQMVLMYDQIT

SEQ ID NO: 1814753 - protein, 19 aa, Staphylococcus epidermidis
YAHARICSILKQAKEQGVE

SEQ ID NO: 1814754 - protein, 24 aa, Staphylococcus epidermidis
YAHGEIHLDINFALYGNGTDSLKD

SEQ ID NO: 1814755 - protein, 39 aa, Staphylococcus epidermidis
YAKELNLKSKEIIDELKSMNVEVSNHMQALEDDQIKALD

SEQ ID NO: 1814756 - protein, 18 aa, Staphylococcus epidermidis
YAKEQGYRTIVAGIDASN

SEQ ID NO: 1814757 - protein, 30 aa, Staphylococcus epidermidis
YAKNQFKAQGFEVLDGNSFNEFVVKFDEPI

SEQ ID NO: 1814758 - protein, 20 aa, Staphylococcus epidermidis
YAKQFFEVVQFSPEDATRTE

SEQ ID NO: 1814759 - protein, 20 aa, Staphylococcus epidermidis
YAKQYFEVVQFSPEDATRTE

SEQ ID NO: 1814760 - protein, 22 aa, Staphylococcus epidermidis
YAKRTYGGRMLSVIGHGHGYEN

SEQ ID NO: 1814761 - protein, 19 aa, Staphylococcus epidermidis
YALDYFKVDAPELLSEDLN

SEQ ID NO: 1814762 - protein, 18 aa, Staphylococcus epidermidis
YALEHSAHIDKYIVLTHQ

SEQ ID NO: 1814763 - protein, 25 aa, Staphylococcus epidermidis
YALEKEDFILPGYRDVPQIIWHGLP

SEQ ID NO: 1814764 - protein, 19 aa, Staphylococcus epidermidis
YALKVTLRREHFIKELETL

SEQ ID NO: 1814765 - protein, 17 aa, Staphylococcus epidermidis
YALQYDVDYVFFDYIHL

SEQ ID NO: 1814766 - protein, 24 aa, Staphylococcus epidermidis
YALYPDIFKGVTIGEYEFERSFLM

SEQ ID NO: 1814767 - protein, 17 aa, Staphylococcus epidermidis
YAQKMIDWCSGNQAALI

SEQ ID NO: 1814768 - protein, 26 aa, Staphylococcus epidermidis
YAQMANELFHFPVMYIEYSGEYGDID

SEQ ID NO: 1814769 - protein, 17 aa, Staphylococcus epidermidis
YAQPFNATSRFKHSQLN

SEQ ID NO: 1814770 - protein, 22 aa, Staphylococcus epidermidis
YASKAFTCIQMVKLVQEEDLQL

SEQ ID NO: 1814771 - protein, 22 aa, Staphylococcus epidermidis
YASLIEFAEWMVSLNKAGEGKE

SEQ ID NO: 1814772 - protein, 21 aa, Staphylococcus epidermidis
YASNIKTIFSSGAKLSKEQFD

SEQ ID NO: 1814773 - protein, 29 aa, Staphylococcus epidermidis
YASNTWIYKTMPTMNQWLKDIEVQKKTHL

SEQ ID NO: 1814774 - protein, 22 aa, Staphylococcus epidermidis
YASRNDVAFVYPKGQSEPIVLV

SEQ ID NO: 1814775 - protein, 25 aa, Staphylococcus epidermidis
YASVDIKDLVMITGLSKSTLQNKIV

SEQ ID NO: 1814776 - protein, 24 aa, Staphylococcus epidermidis
YATDFDSSMEWWKELYSDDDAYFE

SEQ ID NO: 1814777 - protein, 21 aa, Staphylococcus epidermidis
YATEIGMLLKSIKLMRKELKN

SEQ ID NO: 1814778 - protein, 18 aa, Staphylococcus epidermidis
YATLCGRDTVQYENRNIS

SEQ ID NO: 1814779 - protein, 17 aa, Staphylococcus epidermidis
YAVLNLVHAKLEFESNF

SEQ ID NO: 1814780 - protein, 25 aa, Staphylococcus epidermidis
YAYECTKDIRVAMNVGSHSNMETTQ

SEQ ID NO: 1814781 - protein, 19 aa, Staphylococcus epidermidis
YCAPEQMYSLKQADKQSDV

SEQ ID NO: 1814782 - protein, 21 aa, Staphylococcus epidermidis
YCGKGSKVLIEGNLKQDRFQD

SEQ ID NO: 1814783 - protein, 18 aa, Staphylococcus epidermidis
YCHHKVIMFGGGGYNIWR

SEQ ID NO: 1814784 - protein, 17 aa, Staphylococcus epidermidis
YCIVINFSSRFANVTSE

SEQ ID NO: 1814785 - protein, 19 aa, Staphylococcus epidermidis
YCKEVLQYPDIVINQKNAI

SEQ ID NO: 1814786 - protein, 17 aa, Staphylococcus epidermidis
YCKRYFKTKPNSKINGV

SEQ ID NO: 1814787 - protein, 17 aa, Staphylococcus epidermidis
YCQVKITRDILEKYQIQ

SEQ ID NO: 1814788 - protein, 20 aa, Staphylococcus epidermidis
YCSFYLSINSIYMVNQVEDF

SEQ ID NO: 1814789 - protein, 19 aa, Staphylococcus epidermidis
YDADQRWTIQYEAESTQKT

SEQ ID NO: 1814790 - protein, 19 aa, Staphylococcus epidermidis
YDAICTIFLEDAGTLFITN

SEQ ID NO: 1814791 - protein, 23 aa, Staphylococcus epidermidis
YDALERHVQFLLENQTQAIIVNG

SEQ ID NO: 1814792 - protein, 18 aa, Staphylococcus epidermidis
YDDSLYFVVDGVSCIGAV

SEQ ID NO: 1814793 - protein, 20 aa, Staphylococcus epidermidis
YDDVMRFGKYHPDYKDIMLE

SEQ ID NO: 1814794 - protein, 28 aa, Staphylococcus epidermidis
YDEAFAIEDARLYIIKQYANGLPLDNKA

SEQ ID NO: 1814795 - protein, 22 aa, Staphylococcus epidermidis
YDEEIQLILNFYRNKTIQDVLN

SEQ ID NO: 1814796 - protein, 23 aa, Staphylococcus epidermidis
YDEIIRLKPEWHSDDDDKGVIKV

SEQ ID NO: 1814797 - protein, 19 aa, Staphylococcus epidermidis
YDETGEWLPQETLDTIKEY

SEQ ID NO: 1814798 - protein, 24 aa, Staphylococcus epidermidis
YDFALFLYEEFHGCYIDNRPHVFT

SEQ ID NO: 1814799 - protein, 20 aa, Staphylococcus epidermidis
YDFRPHYALIGQIISHFKHA

SEQ ID NO: 1814800 - protein, 19 aa, Staphylococcus epidermidis
YDGEQFVVYDLRKADMKNI

SEQ ID NO: 1814801 - protein, 22 aa, Staphylococcus epidermidis
YDHRNDTFFIIDLEKYGLLETI

SEQ ID NO: 1814802 - protein, 24 aa, Staphylococcus epidermidis
YDHSLKNAIKFGIEESDIVTSVSR

SEQ ID NO: 1814803 - protein, 18 aa, Staphylococcus epidermidis
YDIELAYEAGLLSRNEEN

SEQ ID NO: 1814804 - protein, 30 aa, Staphylococcus epidermidis
YDIEWPELMKLLPRRSRTSIKKKLFQLDLH

SEQ ID NO: 1814805 - protein, 17 aa, Staphylococcus epidermidis
YDIGAVGMRLLTKYMNE

SEQ ID NO: 1814806 - protein, 22 aa, Staphylococcus epidermidis
YDIILCPNVLHNSKHALLVLNQ

SEQ ID NO: 1814807 - protein, 22 aa, Staphylococcus epidermidis
YDIMKRLNFDYYFIDIENLETK

SEQ ID NO: 1814808 - protein, 24 aa, Staphylococcus epidermidis
YDIPSNSTGECWAISAHKNGPNVI

SEQ ID NO: 1814809 - protein, 20 aa, Staphylococcus epidermidis
YDIPSNVIKHIGKVNCKLFM

SEQ ID NO: 1814810 - protein, 20 aa, Staphylococcus epidermidis
YDISTALTYFANELSMQSQY

SEQ ID NO: 1814811 - protein, 18 aa, Staphylococcus epidermidis
YDKEGFRDQEFDKGDKGT

SEQ ID NO: 1814812 - protein, 17 aa, Staphylococcus epidermidis
YDKHLIIIFKEAELSHK

SEQ ID NO: 1814813 - protein, 17 aa, Staphylococcus epidermidis
YDKLIPKLKEAFENIKV

SEQ ID NO: 1814814 - protein, 25 aa, Staphylococcus epidermidis
YDLAVPIHMSMKALLPLVLESLDIH

SEQ ID NO: 1814815 - protein, 19 aa, Staphylococcus epidermidis
YDLDLAKKHGIVISNIPSY

SEQ ID NO: 1814816 - protein, 27 aa, Staphylococcus epidermidis
YDLKLKPKLSRHRTKLVKLIDEKIKDL

SEQ ID NO: 1814817 - protein, 17 aa, Staphylococcus epidermidis
YDLKYDMANSVINQIKD

SEQ ID NO: 1814818 - protein, 17 aa, Staphylococcus epidermidis
YDLPTIYTKTLRERSLG

SEQ ID NO: 1814819 - protein, 24 aa, Staphylococcus epidermidis
YDLPTKGKGILFWQEHSKNHVPGN

SEQ ID NO: 1814820 - protein, 17 aa, Staphylococcus epidermidis
YDLVKLVNGKTMFDGGQ

SEQ ID NO: 1814821 - protein, 19 aa, Staphylococcus epidermidis
YDLVPKCVYTYPEVASIGK

SEQ ID NO: 1814822 - protein, 18 aa, Staphylococcus epidermidis
YDLYNILFEMVRNNQSKP

SEQ ID NO: 1814823 - protein, 18 aa, Staphylococcus epidermidis
YDNGHLEPIFILGKNNKQ

SEQ ID NO: 1814824 - protein, 25 aa, Staphylococcus epidermidis
YDNKHGYLYFCGQLDIPLTERGIKS

SEQ ID NO: 1814825 - protein, 18 aa, Staphylococcus epidermidis
YDPCCGSGGMFVQSERFV

SEQ ID NO: 1814826 - protein, 28 aa, Staphylococcus epidermidis
YDPTCGSGSLLLRVGREAKVRNYYGQEY

SEQ ID NO: 1814827 - protein, 26 aa, Staphylococcus epidermidis
YDPTCGSGSLLLRVGRESKVRNYYGQ

SEQ ID NO: 1814828 - protein, 17 aa, Staphylococcus epidermidis
YDQFFIMGGRGVGKNGL

SEQ ID NO: 1814829 - protein, 17 aa, Staphylococcus epidermidis
YDRGPRILRNFPEKLSK

SEQ ID NO: 1814830 - protein, 20 aa, Staphylococcus epidermidis
YDTSTAMGRLFVTLVGAMAE

SEQ ID NO: 1814831 - protein, 17 aa, Staphylococcus epidermidis
YDTTLFIEWIDQAEAII

SEQ ID NO: 1814832 - protein, 19 aa, Staphylococcus epidermidis
YDVAYRMLHQLDLTTQDIG

SEQ ID NO: 1814833 - protein, 18 aa, Staphylococcus epidermidis
YDVTPCGLGARDTLRLEA

SEQ ID NO: 1814834 - protein, 17 aa, Staphylococcus epidermidis
YDVVPSLISELYQTQTS

SEQ ID NO: 1814835 - protein, 19 aa, Staphylococcus epidermidis
YDWKYPFKNCEFDNIDQYN

SEQ ID NO: 1814836 - protein, 25 aa, Staphylococcus epidermidis
YDYIPRLFWPIYYFVQAPIQGLLMR

SEQ ID NO: 1814837 - protein, 17 aa, Staphylococcus epidermidis
YDYIYVSGYSFEPPSDE

SEQ ID NO: 1814838 - protein, 24 aa, Staphylococcus epidermidis
YDYKTGNELVRFFNHYFNKGDIYQ

SEQ ID NO: 1814839 - protein, 18 aa, Staphylococcus epidermidis
YDYPHQRLYRAIAGVGAY

SEQ ID NO: 1814840 - protein, 18 aa, Staphylococcus epidermidis
YEAAKILAKLGANVIVND

SEQ ID NO: 1814841 - protein, 19 aa, Staphylococcus epidermidis
YEAALPLRIIVEAHHYGIS

SEQ ID NO: 1814842 - protein, 17 aa, Staphylococcus epidermidis
YEACKVLLDKGYIVCPY

SEQ ID NO: 1814843 - protein, 29 aa, Staphylococcus epidermidis
YEAGYKIGVLIGEKGCRNVHFFGVSEEDI

SEQ ID NO: 1814844 - protein, 25 aa, Staphylococcus epidermidis
YEAGYKIGVLIGEKVVEMYISLALV

SEQ ID NO: 1814845 - protein, 17 aa, Staphylococcus epidermidis
YEAIVRMEKRYKGPIAF

SEQ ID NO: 1814846 - protein, 18 aa, Staphylococcus epidermidis
YEAKKIILNHLGKTHFLN

SEQ ID NO: 1814847 - protein, 23 aa, Staphylococcus epidermidis
YEAKLYLARIYKALNFNVEIEPY

SEQ ID NO: 1814848 - protein, 29 aa, Staphylococcus epidermidis
YEAKRTKSLLKFKTFHTVDLRCLRVEEHV

SEQ ID NO: 1814849 - protein, 20 aa, Staphylococcus epidermidis
YEDESDFGLLTGKRKDHDAK

SEQ ID NO: 1814850 - protein, 20 aa, Staphylococcus epidermidis
YEDESNFGLLTGKRKDHDAK

SEQ ID NO: 1814851 - protein, 23 aa, Staphylococcus epidermidis
YEDFKASNIFKENFSKDALSQYF

SEQ ID NO: 1814852 - protein, 27 aa, Staphylococcus epidermidis
YEDMKGQLLYRRYELLYQPQDTNTGGG

SEQ ID NO: 1814853 - protein, 25 aa, Staphylococcus epidermidis
YEDTIKVFLQHGVLGRKKVEYDKKY

SEQ ID NO: 1814854 - protein, 19 aa, Staphylococcus epidermidis
YEEAGEIAAALSRSDKDAL

SEQ ID NO: 1814855 - protein, 22 aa, Staphylococcus epidermidis
YEEAGEVASALSRGQMDALKDG

SEQ ID NO: 1814856 - protein, 21 aa, Staphylococcus epidermidis
YEEALISVGLDLPFPLKMNRL

SEQ ID NO: 1814857 - protein, 24 aa, Staphylococcus epidermidis
YEELKAEYLSDVTFLSETDTEVIV

SEQ ID NO: 1814858 - protein, 24 aa, Staphylococcus epidermidis
YEELQKSYDLFSMMESVDKQLEVV

SEQ ID NO: 1814859 - protein, 22 aa, Staphylococcus epidermidis
YEELSFRDVVVFNQEKLKTTNE

SEQ ID NO: 1814860 - protein, 25 aa, Staphylococcus epidermidis
YEELSYGAKLAWRNSNRCIGRLFWD

SEQ ID NO: 1814861 - protein, 19 aa, Staphylococcus epidermidis
YEEMMEMSALGAGVLETRS

SEQ ID NO: 1814862 - protein, 26 aa, Staphylococcus epidermidis
YEFADLMSYKNGWGHIVADGSLANLE

SEQ ID NO: 1814863 - protein, 17 aa, Staphylococcus epidermidis
YEFFEGIAKVTINRPEV

SEQ ID NO: 1814864 - protein, 18 aa, Staphylococcus epidermidis
YEGFGPSGSMLIVDALTN

SEQ ID NO: 1814865 - protein, 17 aa, Staphylococcus epidermidis
YEGVYFWDDGHNFESSN

SEQ ID NO: 1814866 - protein, 17 aa, Staphylococcus epidermidis
YEINKPEFIGFVDLIVK

SEQ ID NO: 1814867 - protein, 20 aa, Staphylococcus epidermidis
YEISKRTVLFLIEKDITVYD

SEQ ID NO: 1814868 - protein, 18 aa, Staphylococcus epidermidis
YEIVFKKNIDTFDINEKK

SEQ ID NO: 1814869 - protein, 23 aa, Staphylococcus epidermidis
YEKEDSRVATFCVATERNYKDEN

SEQ ID NO: 1814870 - protein, 19 aa, Staphylococcus epidermidis
YEKEMALNWGKKNNIEVTT

SEQ ID NO: 1814871 - protein, 20 aa, Staphylococcus epidermidis
YEKGFDLLLESVRLIQDYLR

SEQ ID NO: 1814872 - protein, 17 aa, Staphylococcus epidermidis
YEKICKLAGKDKALPMN

SEQ ID NO: 1814873 - protein, 20 aa, Staphylococcus epidermidis
YEKLNNFILRSLLENNSEKV

SEQ ID NO: 1814874 - protein, 17 aa, Staphylococcus epidermidis
YEKMINKKLKLIDDEQT

SEQ ID NO: 1814875 - protein, 22 aa, Staphylococcus epidermidis
YEKRLGPYTKIELIEVPDEKAP

SEQ ID NO: 1814876 - protein, 21 aa, Staphylococcus epidermidis
YELKEGQLIPDFYRSDDHIQP

SEQ ID NO: 1814877 - protein, 25 aa, Staphylococcus epidermidis
YELSKCMTCGVCLEVCPNVTPNNKF

SEQ ID NO: 1814878 - protein, 22 aa, Staphylococcus epidermidis
YEMFKEMTSFIVENDIREYEDL

SEQ ID NO: 1814879 - protein, 22 aa, Staphylococcus epidermidis
YENIKIVGLMTMAPLTDDASYI

SEQ ID NO: 1814880 - protein, 18 aa, Staphylococcus epidermidis
YENLSFIFDEDVSNINMQ

SEQ ID NO: 1814881 - protein, 17 aa, Staphylococcus epidermidis
YENVPLWHERDISHSSA

SEQ ID NO: 1814882 - protein, 25 aa, Staphylococcus epidermidis
YEPADLKAHRMVNVILDKEAAAGLP

SEQ ID NO: 1814883 - protein, 27 aa, Staphylococcus epidermidis
YEQSRAKWLFLDVFQWSRTDYLIHSQE

SEQ ID NO: 1814884 - protein, 17 aa, Staphylococcus epidermidis
YERCIIDKKVVRLLDSV

SEQ ID NO: 1814885 - protein, 17 aa, Staphylococcus epidermidis
YERYFIQENQLFHHILD

SEQ ID NO: 1814886 - protein, 18 aa, Staphylococcus epidermidis
YESLDYGVIGWNDGGPSA

SEQ ID NO: 1814887 - protein, 18 aa, Staphylococcus epidermidis
YETEPILDVLVGVDNLHD

SEQ ID NO: 1814888 - protein, 20 aa, Staphylococcus epidermidis
YEVLCNISRRLPRIYHHSDE

SEQ ID NO: 1814889 - protein, 20 aa, Staphylococcus epidermidis
YEVVNEWSYEALVKIFYRYG

SEQ ID NO: 1814890 - protein, 19 aa, Staphylococcus epidermidis
YEYGNGSGHVAIIESATQN

SEQ ID NO: 1814891 - protein, 17 aa, Staphylococcus epidermidis
YEYRSFIEITLRGLEFA

SEQ ID NO: 1814892 - protein, 30 aa, Staphylococcus epidermidis
YFDLSKEFDCFRLNILMSLAEMESNNISEQ

SEQ ID NO: 1814893 - protein, 17 aa, Staphylococcus epidermidis
YFEHRFNQNDIVFNDAR

SEQ ID NO: 1814894 - protein, 18 aa, Staphylococcus epidermidis
YFELDGHDVILFCPQGVE

SEQ ID NO: 1814895 - protein, 25 aa, Staphylococcus epidermidis
YFGGIKLGGGGLIRAYSGAVRDVIY

SEQ ID NO: 1814896 - protein, 20 aa, Staphylococcus epidermidis
YFIEMNARIQVEHTVTEMRA

SEQ ID NO: 1814897 - protein, 21 aa, Staphylococcus epidermidis
YFKDVDVVDVFDSEVLSESNK

SEQ ID NO: 1814898 - protein, 27 aa, Staphylococcus epidermidis
YFKEILKRSPFSIGFRDEDGFPKFIET

SEQ ID NO: 1814899 - protein, 17 aa, Staphylococcus epidermidis
YFKNYRHMMMQPQQLAK

SEQ ID NO: 1814900 - protein, 22 aa, Staphylococcus epidermidis
YFKSEKYYTLSINVDGYDLNLN

SEQ ID NO: 1814901 - protein, 18 aa, Staphylococcus epidermidis
YFLCHDILEDAWKSQNTF

SEQ ID NO: 1814902 - protein, 24 aa, Staphylococcus epidermidis
YFLCHDILEEVWKAYPSFSKNDAV

SEQ ID NO: 1814903 - protein, 33 aa, Staphylococcus epidermidis
YFMLKLDPKYCKLVGISDGMYTYAFNLSYFDGN

SEQ ID NO: 1814904 - protein, 20 aa, Staphylococcus epidermidis
YFNRDRFILSAGHGSALLYS

SEQ ID NO: 1814905 - protein, 20 aa, Staphylococcus epidermidis
YFTFKGLKPKNNRTLHVTST

SEQ ID NO: 1814906 - protein, 18 aa, Staphylococcus epidermidis
YFTSLKVIHAIKLLLSTD

SEQ ID NO: 1814907 - protein, 25 aa, Staphylococcus epidermidis
YFTSLSKRTIVYKGWLRSDQIKGLY

SEQ ID NO: 1814908 - protein, 18 aa, Staphylococcus epidermidis
YFYSESHGYVGLAHAGWR

SEQ ID NO: 1814909 - protein, 17 aa, Staphylococcus epidermidis
YGDHYERGFINRKKLKA

SEQ ID NO: 1814910 - protein, 18 aa, Staphylococcus epidermidis
YGDLKFYEAFVLDSEEKL

SEQ ID NO: 1814911 - protein, 18 aa, Staphylococcus epidermidis
YGEFGSFYVGHILNTEDF

SEQ ID NO: 1814912 - protein, 21 aa, Staphylococcus epidermidis
YGEVKRSKMITVQSYDINGNA

SEQ ID NO: 1814913 - protein, 22 aa, Staphylococcus epidermidis
YGEVKRSKMITVQSYDINGNAV

SEQ ID NO: 1814914 - protein, 25 aa, Staphylococcus epidermidis
YGEYFPHRLGHGLGLEEHEYQDVSS

SEQ ID NO: 1814915 - protein, 21 aa, Staphylococcus epidermidis
YGGEVKDCIDYALCVNEEGDL

SEQ ID NO: 1814916 - protein, 25 aa, Staphylococcus epidermidis
YGHFGRTDVLLPWEKLDKVNLLKDA

SEQ ID NO: 1814917 - protein, 26 aa, Staphylococcus epidermidis
YGHFGRTDVLLPWEKLDKVNLLKDAV

SEQ ID NO: 1814918 - protein, 18 aa, Staphylococcus epidermidis
YGIEIAKLIVAARQSVNV

SEQ ID NO: 1814919 - protein, 23 aa, Staphylococcus epidermidis
YGINLRPLLTLAEKYYDGENPAF

SEQ ID NO: 1814920 - protein, 17 aa, Staphylococcus epidermidis
YGKESEELISLIKLAID

SEQ ID NO: 1814921 - protein, 17 aa, Staphylococcus epidermidis
YGKFKGDLAEIVKEFLI

SEQ ID NO: 1814922 - protein, 25 aa, Staphylococcus epidermidis
YGKLDEIKEGLGFNYVLDGMIMDDL

SEQ ID NO: 1814923 - protein, 25 aa, Staphylococcus epidermidis
YGKNIKESPDFGRIVNEKHYNRLNE

SEQ ID NO: 1814924 - protein, 25 aa, Staphylococcus epidermidis
YGKTECWYILDAEPGAEIIYGVDAD

SEQ ID NO: 1814925 - protein, 19 aa, Staphylococcus epidermidis
YGLEPVVALNAFIHDTEAE

SEQ ID NO: 1814926 - protein, 21 aa, Staphylococcus epidermidis
YGMKVAKDLVHISGDTSDYHL

SEQ ID NO: 1814927 - protein, 20 aa, Staphylococcus epidermidis
YGNGIKSLFNYPSQKTDDKH

SEQ ID NO: 1814928 - protein, 34 aa, Staphylococcus epidermidis
YGNRFAMAYIYNRYMFPKIEHFFVKNGIEVNKDL

SEQ ID NO: 1814929 - protein, 22 aa, Staphylococcus epidermidis
YGNRKFWCKGFYVDTVGRNKKV

SEQ ID NO: 1814930 - protein, 17 aa, Staphylococcus epidermidis
YGQREIYEFIDNANRMV

SEQ ID NO: 1814931 - protein, 20 aa, Staphylococcus epidermidis
YGSFRDWPAYLYSIEHSIYV

SEQ ID NO: 1814932 - protein, 22 aa, Staphylococcus epidermidis
YGSRIIGLRAGELVYDGPAYEA

SEQ ID NO: 1814933 - protein, 21 aa, Staphylococcus epidermidis
YGSSVNSEWMIPKIMEVKHEA

SEQ ID NO: 1814934 - protein, 19 aa, Staphylococcus epidermidis
YGTASGRVILVDTSNGEMI

SEQ ID NO: 1814935 - protein, 18 aa, Staphylococcus epidermidis
YGTKMMMFLPQYVQELFP

SEQ ID NO: 1814936 - protein, 19 aa, Staphylococcus epidermidis
YGTQFFKDAVPLFVTGLGD

SEQ ID NO: 1814937 - protein, 22 aa, Staphylococcus epidermidis
YGVDFGTGYALEFTGETIKNLS

SEQ ID NO: 1814938 - protein, 17 aa, Staphylococcus epidermidis
YGVMICYNDTDLAKAIT

SEQ ID NO: 1814939 - protein, 31 aa, Staphylococcus epidermidis
YGYKLKCKCLFPFDANVPFIKSPFKTKRNLS

SEQ ID NO: 1814940 - protein, 21 aa, Staphylococcus epidermidis
YHAQCMDLAIDYVMWLTDNQT

SEQ ID NO: 1814941 - protein, 21 aa, Staphylococcus epidermidis
YHHFGVDWIAPAMREDGSEFD

SEQ ID NO: 1814942 - protein, 17 aa, Staphylococcus epidermidis
YHKAVEMEYRFFSFGDA

SEQ ID NO: 1814943 - protein, 21 aa, Staphylococcus epidermidis
YHLKNKFGQKIFKVALDGGFD

SEQ ID NO: 1814944 - protein, 19 aa, Staphylococcus epidermidis
YHLNVKIVLINNGTLGMVK

SEQ ID NO: 1814945 - protein, 24 aa, Staphylococcus epidermidis
YHLPTLKKGILFWQEQSHGYIPGN

SEQ ID NO: 1814946 - protein, 18 aa, Staphylococcus epidermidis
YHLSFSFPANENIDEVLL

SEQ ID NO: 1814947 - protein, 25 aa, Staphylococcus epidermidis
YHNTYRKLTCVHVNHGLRHQSVEEE

SEQ ID NO: 1814948 - protein, 17 aa, Staphylococcus epidermidis
YHPEARPGPSDSNYLFD

SEQ ID NO: 1814949 - protein, 22 aa, Staphylococcus epidermidis
YHSWFNIVQHFLPSDSHDLLDI

SEQ ID NO: 1814950 - protein, 22 aa, Staphylococcus epidermidis
YHTHARVGIALYGSRPYRKLDT

SEQ ID NO: 1814951 - protein, 25 aa, Staphylococcus epidermidis
YHVAAEILKYFGLSKINLLSNNPKK

SEQ ID NO: 1814952 - protein, 25 aa, Staphylococcus epidermidis
YHVMVDYFGGTAFEIYAQLEVNDGE

SEQ ID NO: 1814953 - protein, 19 aa, Staphylococcus epidermidis
YHVTKRISVLEAMLPSAIK

SEQ ID NO: 1814954 - protein, 17 aa, Staphylococcus epidermidis
YIAELEVTNEMLLSQIQ

SEQ ID NO: 1814955 - protein, 19 aa, Staphylococcus epidermidis
YIAHRNSNEIMYLDLVKII

SEQ ID NO: 1814956 - protein, 18 aa, Staphylococcus epidermidis
YIALEFASMFSNLGSNVT

SEQ ID NO: 1814957 - protein, 19 aa, Staphylococcus epidermidis
YIAMTRARQKVTFSYSLMG

SEQ ID NO: 1814958 - protein, 17 aa, Staphylococcus epidermidis
YIDGFNFENKKAKLYPL

SEQ ID NO: 1814959 - protein, 18 aa, Staphylococcus epidermidis
YIDLFGGDVLENVINFEE

SEQ ID NO: 1814960 - protein, 20 aa, Staphylococcus epidermidis
YIDVYCALKHGVNISKTAKK

SEQ ID NO: 1814961 - protein, 21 aa, Staphylococcus epidermidis
YIDYVLSWGPLILGHKNKQVI

SEQ ID NO: 1814962 - protein, 24 aa, Staphylococcus epidermidis
YIEASCSIQVLYPLLDILNQSLEG

SEQ ID NO: 1814963 - protein, 20 aa, Staphylococcus epidermidis
YIEDVFRAFQSLYNAHYNQD

SEQ ID NO: 1814964 - protein, 24 aa, Staphylococcus epidermidis
YIEETRLKQFVSYYNNHKGLRLRE

SEQ ID NO: 1814965 - protein, 18 aa, Staphylococcus epidermidis
YIELGRYSYGSVLNRDQH

SEQ ID NO: 1814966 - protein, 17 aa, Staphylococcus epidermidis
YIENLGFNAIHQHEKEL

SEQ ID NO: 1814967 - protein, 17 aa, Staphylococcus epidermidis
YIENRLHTLMELYNYKE

SEQ ID NO: 1814968 - protein, 17 aa, Staphylococcus epidermidis
YIERFIKSDSSVEKHMK

SEQ ID NO: 1814969 - protein, 17 aa, Staphylococcus epidermidis
YIETTIKGKKVLFIHYE

SEQ ID NO: 1814970 - protein, 19 aa, Staphylococcus epidermidis
YIEVLYLDIYEKFNEDINN

SEQ ID NO: 1814971 - protein, 18 aa, Staphylococcus epidermidis
YIGNVTINGFPNVEKRPK

SEQ ID NO: 1814972 - protein, 20 aa, Staphylococcus epidermidis
YIGSELGTAFANFGSEVTIL

SEQ ID NO: 1814973 - protein, 24 aa, Staphylococcus epidermidis
YIGSELGTAFANFGSEVTILEGAK

SEQ ID NO: 1814974 - protein, 28 aa, Staphylococcus epidermidis
YIHIPVGVLLPFKSQCFVRHYSKGQVIY

SEQ ID NO: 1814975 - protein, 22 aa, Staphylococcus epidermidis
YIKKSSYIRGIFKNRNIFYRDF

SEQ ID NO: 1814976 - protein, 23 aa, Staphylococcus epidermidis
YIKNEPYGTVLIIGPFNYPVQLV

SEQ ID NO: 1814977 - protein, 21 aa, Staphylococcus epidermidis
YIKRLPVSTYRSQNRGGRGVQ

SEQ ID NO: 1814978 - protein, 19 aa, Staphylococcus epidermidis
YIKSIFHDLRHKKEEIQQF

SEQ ID NO: 1814979 - protein, 18 aa, Staphylococcus epidermidis
YIKSMKKYIEDLGSGGSA

SEQ ID NO: 1814980 - protein, 30 aa, Staphylococcus epidermidis
YIKTPRKIKGLIDRRGKKSGLIHYYNNECH

SEQ ID NO: 1814981 - protein, 18 aa, Staphylococcus epidermidis
YILANPFYIGKIQFAKYK

SEQ ID NO: 1814982 - protein, 27 aa, Staphylococcus epidermidis
YILKCLKNSLKPGGIIIVSELTKTLNI

SEQ ID NO: 1814983 - protein, 18 aa, Staphylococcus epidermidis
YILLQVCCHNPTGMDLTI

SEQ ID NO: 1814984 - protein, 18 aa, Staphylococcus epidermidis
YILNWLVTNSNEFDMEPL

SEQ ID NO: 1814985 - protein, 19 aa, Staphylococcus epidermidis
YIMEFQALNGMRIGELLAI

SEQ ID NO: 1814986 - protein, 19 aa, Staphylococcus epidermidis
YIMENVVNFVKKLIEEVQK

SEQ ID NO: 1814987 - protein, 20 aa, Staphylococcus epidermidis
YINAYRLAEKYANIATNCYD

SEQ ID NO: 1814988 - protein, 24 aa, Staphylococcus epidermidis
YINCNHNLDFALAIRTMLIDENQV

SEQ ID NO: 1814989 - protein, 20 aa, Staphylococcus epidermidis
YINDKEINDFVTYVNRKMEN

SEQ ID NO: 1814990 - protein, 23 aa, Staphylococcus epidermidis
YINHKRFNNAYMQYASTSPFYPL

SEQ ID NO: 1814991 - protein, 17 aa, Staphylococcus epidermidis
YINHSVPKVMGVDYVSH

SEQ ID NO: 1814992 - protein, 17 aa, Staphylococcus epidermidis
YINKKVKKYSLGMKQKL

SEQ ID NO: 1814993 - protein, 17 aa, Staphylococcus epidermidis
YINRSFKENGEWYNMEK

SEQ ID NO: 1814994 - protein, 20 aa, Staphylococcus epidermidis
YIQAEGFAGGELKHGTIALI

SEQ ID NO: 1814995 - protein, 18 aa, Staphylococcus epidermidis
YIRIAIKDNNEALNFNNT

SEQ ID NO: 1814996 - protein, 23 aa, Staphylococcus epidermidis
YISRRRIRHIVGYVPQDIALFEH

SEQ ID NO: 1814997 - protein, 17 aa, Staphylococcus epidermidis
YISTLNLEDEAEFSKLL

SEQ ID NO: 1814998 - protein, 24 aa, Staphylococcus epidermidis
YITPDKVHVMYGGKVVKSGGPELA

SEQ ID NO: 1814999 - protein, 18 aa, Staphylococcus epidermidis
YIVAKRFGVDTSEHTIKY

SEQ ID NO: 1815000 - protein, 17 aa, Staphylococcus epidermidis
YIVKVIRNLISGKSSQD

SEQ ID NO: 1815001 - protein, 25 aa, Staphylococcus epidermidis
YIVLTTEYYWHWDLDNAQLDVFEYK

SEQ ID NO: 1815002 - protein, 20 aa, Staphylococcus epidermidis
YIVNSYPVWFPKEEAEEIIK

SEQ ID NO: 1815003 - protein, 26 aa, Staphylococcus epidermidis
YIVNSYPVWFPKGDAEEIIKDMINLV

SEQ ID NO: 1815004 - protein, 17 aa, Staphylococcus epidermidis
YIVREAGVSKEDIKLIS

SEQ ID NO: 1815005 - protein, 19 aa, Staphylococcus epidermidis
YIVTWALGHLVTNAAPEQY

SEQ ID NO: 1815006 - protein, 18 aa, Staphylococcus epidermidis
YKAADLMFERFNINEGVT

SEQ ID NO: 1815007 - protein, 19 aa, Staphylococcus epidermidis
YKDEEAFKVYIQEWYDNDE

SEQ ID NO: 1815008 - protein, 27 aa, Staphylococcus epidermidis
YKDLVVSVRVGMEMDRSELLRKLVDVQ

SEQ ID NO: 1815009 - protein, 24 aa, Staphylococcus epidermidis
YKEILKLLFQSWFDVCKRTKQEIN

SEQ ID NO: 1815010 - protein, 27 aa, Staphylococcus epidermidis
YKESVIRYKGKYIPKVAINHPIFVEGL

SEQ ID NO: 1815011 - protein, 17 aa, Staphylococcus epidermidis
YKEVPELTDEVANELDS

SEQ ID NO: 1815012 - protein, 17 aa, Staphylococcus epidermidis
YKEWKLEDLPIIPKYMK

SEQ ID NO: 1815013 - protein, 21 aa, Staphylococcus epidermidis
YKFAESLGHSITELFPTEVPI

SEQ ID NO: 1815014 - protein, 17 aa, Staphylococcus epidermidis
YKGEIGVVHALPTKYPY

SEQ ID NO: 1815015 - protein, 17 aa, Staphylococcus epidermidis
YKGSTAFTSLKVSGCDL

SEQ ID NO: 1815016 - protein, 25 aa, Staphylococcus epidermidis
YKHFAYVIKMLPQIIEKLRDNGKKI

SEQ ID NO: 1815017 - protein, 17 aa, Staphylococcus epidermidis
YKIISQGLLEGFKNLGF

SEQ ID NO: 1815018 - protein, 18 aa, Staphylococcus epidermidis
YKILKMIQRQFDVIIDES

SEQ ID NO: 1815019 - protein, 17 aa, Staphylococcus epidermidis
YKIMDKVIEEFNKDMEQ

SEQ ID NO: 1815020 - protein, 29 aa, Staphylococcus epidermidis
YKIMTMFEPYFRDYKLIFINCPSRGKSSD

SEQ ID NO: 1815021 - protein, 28 aa, Staphylococcus epidermidis
YKIMTMFEPYFREYQLIFVNCPSRGKSS

SEQ ID NO: 1815022 - protein, 19 aa, Staphylococcus epidermidis
YKKNRRSLQIYGFSPCHEI

SEQ ID NO: 1815023 - protein, 24 aa, Staphylococcus epidermidis
YKKNRRSLQIYGFSPCHEISIMLA

SEQ ID NO: 1815024 - protein, 17 aa, Staphylococcus epidermidis
YKKRSVLDETFVINMTP

SEQ ID NO: 1815025 - protein, 19 aa, Staphylococcus epidermidis
YKKRSVLEGTFVINMTPFF

SEQ ID NO: 1815026 - protein, 24 aa, Staphylococcus epidermidis
YKKSRKGLSNDIWSTYSAFANTEG

SEQ ID NO: 1815027 - protein, 17 aa, Staphylococcus epidermidis
YKLELIDAIPDDESVTL

SEQ ID NO: 1815028 - protein, 17 aa, Staphylococcus epidermidis
YKLELIDAIPEDENVTL

SEQ ID NO: 1815029 - protein, 24 aa, Staphylococcus epidermidis
YKLFPEGPITMTLIREMRQMWQEM

SEQ ID NO: 1815030 - protein, 20 aa, Staphylococcus epidermidis
YKLGNYAGIHFRNTFSGTVT

SEQ ID NO: 1815031 - protein, 18 aa, Staphylococcus epidermidis
YKMPHAFVEISPELAQDR

SEQ ID NO: 1815032 - protein, 19 aa, Staphylococcus epidermidis
YKNEIVIIDAGIKFPDDNL

SEQ ID NO: 1815033 - protein, 17 aa, Staphylococcus epidermidis
YKNESFMDLLRYSQPIR

SEQ ID NO: 1815034 - protein, 24 aa, Staphylococcus epidermidis
YKNIKEIYFWGFSLSDVDKPYIEK

SEQ ID NO: 1815035 - protein, 22 aa, Staphylococcus epidermidis
YKNKKYRAADIVYETFIGNLKN

SEQ ID NO: 1815036 - protein, 19 aa, Staphylococcus epidermidis
YKNLHIDSVGLRTPSDSGL

SEQ ID NO: 1815037 - protein, 26 aa, Staphylococcus epidermidis
YKNLKAETIVAYAVYLSRYEYSVYKN

SEQ ID NO: 1815038 - protein, 18 aa, Staphylococcus epidermidis
YKNLVRWLEDKNTTKIVY

SEQ ID NO: 1815039 - protein, 26 aa, Staphylococcus epidermidis
YKNNWLGIKTGTDWVGKNVLDPTFNW

SEQ ID NO: 1815040 - protein, 18 aa, Staphylococcus epidermidis
YKNQLPWHLPSDLKHVKK

SEQ ID NO: 1815041 - protein, 26 aa, Staphylococcus epidermidis
YKNTLFKFTNEIIIGRKYNSGIIKDK

SEQ ID NO: 1815042 - protein, 21 aa, Staphylococcus epidermidis
YKNVALGLIFLKYVSDSFEEK

SEQ ID NO: 1815043 - protein, 18 aa, Staphylococcus epidermidis
YKNVAMPLILSKTNKKEI

SEQ ID NO: 1815044 - protein, 21 aa, Staphylococcus epidermidis
YKNVSSIYLDFSLNNSPVHEN

SEQ ID NO: 1815045 - protein, 17 aa, Staphylococcus epidermidis
YKNYCRYCEKVEYYFKD

SEQ ID NO: 1815046 - protein, 18 aa, Staphylococcus epidermidis
YKNYKIIDPSGILSGSPY

SEQ ID NO: 1815047 - protein, 24 aa, Staphylococcus epidermidis
YKNYYDKWLVGFKETKGGRRFALE

SEQ ID NO: 1815048 - protein, 21 aa, Staphylococcus epidermidis
YKPTLPPMVFGTRDKKVKGGQ

SEQ ID NO: 1815049 - protein, 27 aa, Staphylococcus epidermidis
YKRTKGMYEFDQFRLAIDHVQVDPFAP

SEQ ID NO: 1815050 - protein, 23 aa, Staphylococcus epidermidis
YKRYLENQIRDAFGFEGTPIHII

SEQ ID NO: 1815051 - protein, 21 aa, Staphylococcus epidermidis
YKSDIFNTQNWIMTKLTMNSF

SEQ ID NO: 1815052 - protein, 32 aa, Staphylococcus epidermidis
YKSGEYRSLLNYFIDMARFYYVIDPLFSSDSK

SEQ ID NO: 1815053 - protein, 18 aa, Staphylococcus epidermidis
YKSIPRHITTNISEQKFV

SEQ ID NO: 1815054 - protein, 21 aa, Staphylococcus epidermidis
YKSKVTLDFTTKCELPVSIVM

SEQ ID NO: 1815055 - protein, 21 aa, Staphylococcus epidermidis
YKTFDCKWGNETLTWNLKKGP

SEQ ID NO: 1815056 - protein, 18 aa, Staphylococcus epidermidis
YKTLIKEIIVDRTDENEA

SEQ ID NO: 1815057 - protein, 17 aa, Staphylococcus epidermidis
YKTSKNFINKVYKGGFN

SEQ ID NO: 1815058 - protein, 19 aa, Staphylococcus epidermidis
YKVLPDLFYPELISVGNNS

SEQ ID NO: 1815059 - protein, 17 aa, Staphylococcus epidermidis
YKWLQILPEKKRYSITV

SEQ ID NO: 1815060 - protein, 26 aa, Staphylococcus epidermidis
YKYDTRLKNIIFKYIILIEQTLKTNL

SEQ ID NO: 1815061 - protein, 22 aa, Staphylococcus epidermidis
YKYKKFGIVPEYEYEREEIKEI

SEQ ID NO: 1815062 - protein, 23 aa, Staphylococcus epidermidis
YKYKLKTPFIDKIIIDNLKNIKS

SEQ ID NO: 1815063 - protein, 19 aa, Staphylococcus epidermidis
YKYRCIYCEQEFIRIKRVN

SEQ ID NO: 1815064 - protein, 17 aa, Staphylococcus epidermidis
YLAGKGFSKQLITVDAF

SEQ ID NO: 1815065 - protein, 19 aa, Staphylococcus epidermidis
YLDDLGFNLVGYGCTTCIG

SEQ ID NO: 1815066 - protein, 34 aa, Staphylococcus epidermidis
YLDLPKEINPFLGYRAIRLCLAQPEIFRPQLRAL

SEQ ID NO: 1815067 - protein, 21 aa, Staphylococcus epidermidis
YLDNFHFFNSKLLKIRINQSN

SEQ ID NO: 1815068 - protein, 18 aa, Staphylococcus epidermidis
YLEPLRLNLNNYRVMLIH

SEQ ID NO: 1815069 - protein, 19 aa, Staphylococcus epidermidis
YLEPNCYWASDILDTELTI

SEQ ID NO: 1815070 - protein, 24 aa, Staphylococcus epidermidis
YLERISELCGVHISIFSVGPDREQ

SEQ ID NO: 1815071 - protein, 17 aa, Staphylococcus epidermidis
YLFVFVLDYYRHSLVNE

SEQ ID NO: 1815072 - protein, 20 aa, Staphylococcus epidermidis
YLGFSPKQFRSYISKIELNP

SEQ ID NO: 1815073 - protein, 25 aa, Staphylococcus epidermidis
YLHIQKKRIDLFFKENMNNYQNLDL

SEQ ID NO: 1815074 - protein, 18 aa, Staphylococcus epidermidis
YLIEYREFVSHAENRIKR

SEQ ID NO: 1815075 - protein, 17 aa, Staphylococcus epidermidis
YLKANYPNRHYITNVNQ

SEQ ID NO: 1815076 - protein, 21 aa, Staphylococcus epidermidis
YLKNELHFDAGIDYKKDNFPE

SEQ ID NO: 1815077 - protein, 26 aa, Staphylococcus epidermidis
YLKQRHIPMAIATSSYREDILPTFKK

SEQ ID NO: 1815078 - protein, 19 aa, Staphylococcus epidermidis
YLLPKATVVTPNLFEAGQL

SEQ ID NO: 1815079 - protein, 18 aa, Staphylococcus epidermidis
YLMAELALNFLDDNTDKE

SEQ ID NO: 1815080 - protein, 19 aa, Staphylococcus epidermidis
YLNKRNELKRMQFSLDKFP

SEQ ID NO: 1815081 - protein, 17 aa, Staphylococcus epidermidis
YLNLIYYDNLKMMTNDL

SEQ ID NO: 1815082 - protein, 33 aa, Staphylococcus epidermidis
YLNLPEEMNPFLGYRAIRLCLAQQDIFRPQLRA

SEQ ID NO: 1815083 - protein, 23 aa, Staphylococcus epidermidis
YLPEIYKAINADVLFNKAAQRPG

SEQ ID NO: 1815084 - protein, 25 aa, Staphylococcus epidermidis
YLPEIYKSIQAQILFNKVAQRPGSV

SEQ ID NO: 1815085 - protein, 27 aa, Staphylococcus epidermidis
YLPFGHSMLYLSSIMDIYNREIVAYKI

SEQ ID NO: 1815086 - protein, 28 aa, Staphylococcus epidermidis
YLPFGHSMLYLSSIMDIYNREIVAYKID

SEQ ID NO: 1815087 - protein, 26 aa, Staphylococcus epidermidis
YLPFGHSMLYLSSIMDLYNGEIVAYK

SEQ ID NO: 1815088 - protein, 20 aa, Staphylococcus epidermidis
YLPGDSCFRVSSDLMSGTAG

SEQ ID NO: 1815089 - protein, 22 aa, Staphylococcus epidermidis
YLPKYMIPKTLTAIDEIPLTRN

SEQ ID NO: 1815090 - protein, 17 aa, Staphylococcus epidermidis
YLPLLHRYTKLRKELLG

SEQ ID NO: 1815091 - protein, 25 aa, Staphylococcus epidermidis
YLQPDLDTWVIFPWTAGQGKVARLI

SEQ ID NO: 1815092 - protein, 19 aa, Staphylococcus epidermidis
YLRDGEIIFNESRDKLFEK

SEQ ID NO: 1815093 - protein, 22 aa, Staphylococcus epidermidis
YLRPETLFGTKFEGYLNQELQP

SEQ ID NO: 1815094 - protein, 21 aa, Staphylococcus epidermidis
YLRPLYDGLNTVLGREQTERF

SEQ ID NO: 1815095 - protein, 20 aa, Staphylococcus epidermidis
YLRRINRKTALLIQLATEVG

SEQ ID NO: 1815096 - protein, 19 aa, Staphylococcus epidermidis
YLSKYQVMRSIKKLKSMGI

SEQ ID NO: 1815097 - protein, 17 aa, Staphylococcus epidermidis
YLTALSMAEGLNQLVEE

SEQ ID NO: 1815098 - protein, 23 aa, Staphylococcus epidermidis
YLTEGAELFGYIYYADNKTIYIH

SEQ ID NO: 1815099 - protein, 17 aa, Staphylococcus epidermidis
YLTLYAFSTENWSRPES

SEQ ID NO: 1815100 - protein, 24 aa, Staphylococcus epidermidis
YLVFPDNVAIVLGIAEAVGIDHET

SEQ ID NO: 1815101 - protein, 17 aa, Staphylococcus epidermidis
YLVGLMRSVIYQFTEDE

SEQ ID NO: 1815102 - protein, 17 aa, Staphylococcus epidermidis
YLVYLLKFPELHPEDDF

SEQ ID NO: 1815103 - protein, 17 aa, Staphylococcus epidermidis
YLYFLDDDLEIISKNTI

SEQ ID NO: 1815104 - protein, 17 aa, Staphylococcus epidermidis
YLYGDAVVPFEGESRSE

SEQ ID NO: 1815105 - protein, 23 aa, Staphylococcus epidermidis
YLYIRKAYPNPFIKGLDIIIPQA

SEQ ID NO: 1815106 - protein, 17 aa, Staphylococcus epidermidis
YLYTGLFDNDKKLKDYT

SEQ ID NO: 1815107 - protein, 20 aa, Staphylococcus epidermidis
YMDFLGTKGKLEFLIIGYTT

SEQ ID NO: 1815108 - protein, 20 aa, Staphylococcus epidermidis
YMEKAKEAGFKVKIHADEID

SEQ ID NO: 1815109 - protein, 18 aa, Staphylococcus epidermidis
YMFEMTLKVPAEVGLTEY

SEQ ID NO: 1815110 - protein, 27 aa, Staphylococcus epidermidis
YMGVDYSDIMKWNALQLQHSFQRISLF

SEQ ID NO: 1815111 - protein, 24 aa, Staphylococcus epidermidis
YMKDKAATHILKLLSYGVKYINYD

SEQ ID NO: 1815112 - protein, 17 aa, Staphylococcus epidermidis
YMNFGIPAVILANYLRE

SEQ ID NO: 1815113 - protein, 19 aa, Staphylococcus epidermidis
YMPYVTAYFMPRAYKDRPL

SEQ ID NO: 1815114 - protein, 19 aa, Staphylococcus epidermidis
YMTEGSCWCVQAYHNRKLT

SEQ ID NO: 1815115 - protein, 19 aa, Staphylococcus epidermidis
YMYEMTLKVPAEVGLTEYN

SEQ ID NO: 1815116 - protein, 27 aa, Staphylococcus epidermidis
YNAEAYKASYLFSYLAFMNIIKKRIMN

SEQ ID NO: 1815117 - protein, 23 aa, Staphylococcus epidermidis
YNAMTHAICNRCEGYSNEYDIQS

SEQ ID NO: 1815118 - protein, 24 aa, Staphylococcus epidermidis
YNDSSMFGAYGFSFEGEINPEITV

SEQ ID NO: 1815119 - protein, 25 aa, Staphylococcus epidermidis
YNELLPKLKEAFENIKVGDPFDEDT

SEQ ID NO: 1815120 - protein, 24 aa, Staphylococcus epidermidis
YNGEPYAGFVYDVMKDVLYHTKVG

SEQ ID NO: 1815121 - protein, 24 aa, Staphylococcus epidermidis
YNHPSEVAKAFGLQSEQAIYQFDN

SEQ ID NO: 1815122 - protein, 21 aa, Staphylococcus epidermidis
YNIIFKLIIKNNFLDDSTSDL

SEQ ID NO: 1815123 - protein, 19 aa, Staphylococcus epidermidis
YNISTDIIRKVVFESIADE

SEQ ID NO: 1815124 - protein, 19 aa, Staphylococcus epidermidis
YNISYASKAFTCIQMVKLV

SEQ ID NO: 1815125 - protein, 19 aa, Staphylococcus epidermidis
YNISYECPIYNFGDQDDVK

SEQ ID NO: 1815126 - protein, 18 aa, Staphylococcus epidermidis
YNKFCLLDDGKATKRVVE

SEQ ID NO: 1815127 - protein, 21 aa, Staphylococcus epidermidis
YNKHHFKNFIYTPVGFVCEHL

SEQ ID NO: 1815128 - protein, 22 aa, Staphylococcus epidermidis
YNKHYKQDFAIIESTYELSEDE

SEQ ID NO: 1815129 - protein, 20 aa, Staphylococcus epidermidis
YNKIVIQRRGGFCYELNHLF

SEQ ID NO: 1815130 - protein, 24 aa, Staphylococcus epidermidis
YNKNGNFIFDFLNLAKCKDENELD

SEQ ID NO: 1815131 - protein, 24 aa, Staphylococcus epidermidis
YNKNIKISGVFTWSDKDVELVSFL

SEQ ID NO: 1815132 - protein, 17 aa, Staphylococcus epidermidis
YNLFEVIGVTQYDLEKL

SEQ ID NO: 1815133 - protein, 20 aa, Staphylococcus epidermidis
YNLLLEKRKQNFDVSRILGL

SEQ ID NO: 1815134 - protein, 19 aa, Staphylococcus epidermidis
YNLNIPRYVDTFEEEEPID

SEQ ID NO: 1815135 - protein, 25 aa, Staphylococcus epidermidis
YNLNQRFNINFAKTVLKSPRYIYAY

SEQ ID NO: 1815136 - protein, 18 aa, Staphylococcus epidermidis
YNLPNAHIGECWGISAHP

SEQ ID NO: 1815137 - protein, 25 aa, Staphylococcus epidermidis
YNMEKEWRKAIDKGKNVKNIKIKVK

SEQ ID NO: 1815138 - protein, 18 aa, Staphylococcus epidermidis
YNNLQAIIQAIEDVYNNA

SEQ ID NO: 1815139 - protein, 17 aa, Staphylococcus epidermidis
YNNNRIQQKLGYLSPVK

SEQ ID NO: 1815140 - protein, 25 aa, Staphylococcus epidermidis
YNPFSNTLITSWFWSHRPPQVEQAG

SEQ ID NO: 1815141 - protein, 22 aa, Staphylococcus epidermidis
YNRILEDLTIFLSVNNLSFSDV

SEQ ID NO: 1815142 - protein, 20 aa, Staphylococcus epidermidis
YNSGPWKRTIVYKDPVPHNF

SEQ ID NO: 1815143 - protein, 29 aa, Staphylococcus epidermidis
YNSKGACPNCGGKGYIKTELAFMGDFSQT

SEQ ID NO: 1815144 - protein, 17 aa, Staphylococcus epidermidis
YNSLPIKLYENIPDENL

SEQ ID NO: 1815145 - protein, 17 aa, Staphylococcus epidermidis
YNSTVIYQKRFYKTWSG

SEQ ID NO: 1815146 - protein, 30 aa, Staphylococcus epidermidis
YNTEIRPNTLLTREGIILSKLSWIDDTTFI

SEQ ID NO: 1815147 - protein, 19 aa, Staphylococcus epidermidis
YNVFKDEIFGPVLAITTYR

SEQ ID NO: 1815148 - protein, 22 aa, Staphylococcus epidermidis
YNVPDFCQLIFITTPDKLETDN

SEQ ID NO: 1815149 - protein, 18 aa, Staphylococcus epidermidis
YNVPLLMKFEVQGTNNDV

SEQ ID NO: 1815150 - protein, 24 aa, Staphylococcus epidermidis
YNYDEFYQLLLIKMWELILDYDNQ

SEQ ID NO: 1815151 - protein, 23 aa, Staphylococcus epidermidis
YNYDEFYQQMLIKMWQLTLDFDE

SEQ ID NO: 1815152 - protein, 17 aa, Staphylococcus epidermidis
YNYDFVSNVFSDFDEQE

SEQ ID NO: 1815153 - protein, 27 aa, Staphylococcus epidermidis
YNYRAKKYPQFNICKKIYLNLETPPII

SEQ ID NO: 1815154 - protein, 17 aa, Staphylococcus epidermidis
YNYRARKYNKWVHQDYL

SEQ ID NO: 1815155 - protein, 28 aa, Staphylococcus epidermidis
YPDVKLTWICKAPKYTGLEWIEYDELIK

SEQ ID NO: 1815156 - protein, 19 aa, Staphylococcus epidermidis
YPFADGEGYIEIATTRPET

SEQ ID NO: 1815157 - protein, 18 aa, Staphylococcus epidermidis
YPFRYEAFEQVNFDYVRY

SEQ ID NO: 1815158 - protein, 21 aa, Staphylococcus epidermidis
YPGRRYYGGCEYVDVTETVAI

SEQ ID NO: 1815159 - protein, 21 aa, Staphylococcus epidermidis
YPHLEIKWIRGNIDTRLNKLE

SEQ ID NO: 1815160 - protein, 18 aa, Staphylococcus epidermidis
YPIDQMRGLNNEIIEFIK

SEQ ID NO: 1815161 - protein, 18 aa, Staphylococcus epidermidis
YPIISQFRTFFKTTYKER

SEQ ID NO: 1815162 - protein, 18 aa, Staphylococcus epidermidis
YPILKRANAKFNTVAELE

SEQ ID NO: 1815163 - protein, 26 aa, Staphylococcus epidermidis
YPKGEYRLKVTLERDGHLDYIIAPLP

SEQ ID NO: 1815164 - protein, 17 aa, Staphylococcus epidermidis
YPKHNREGYSMVAKQMK

SEQ ID NO: 1815165 - protein, 21 aa, Staphylococcus epidermidis
YPKLTFKSSILQLIKDNNVTA

SEQ ID NO: 1815166 - protein, 17 aa, Staphylococcus epidermidis
YPLEHETKFFAFRDSFD

SEQ ID NO: 1815167 - protein, 18 aa, Staphylococcus epidermidis
YPLIEVGEFELNRNPENY

SEQ ID NO: 1815168 - protein, 26 aa, Staphylococcus epidermidis
YPLIHIPKIGSLIWENSCGSGAASIG

SEQ ID NO: 1815169 - protein, 21 aa, Staphylococcus epidermidis
YPLLNGCVCCDMKSDLVQQIE

SEQ ID NO: 1815170 - protein, 18 aa, Staphylococcus epidermidis
YPLPDNRLLTQLFTELEE

SEQ ID NO: 1815171 - protein, 24 aa, Staphylococcus epidermidis
YPLSREKLSPLLAMVTAKSTRHAL

SEQ ID NO: 1815172 - protein, 25 aa, Staphylococcus epidermidis
YPMNWPIGMGQNFFGIIDRESKTIE

SEQ ID NO: 1815173 - protein, 17 aa, Staphylococcus epidermidis
YPNHLNHGYYFHEILNR

SEQ ID NO: 1815174 - protein, 20 aa, Staphylococcus epidermidis
YPNQFEYVIETALKKDIKII

SEQ ID NO: 1815175 - protein, 18 aa, Staphylococcus epidermidis
YPRIKRIQTLADYFNVPK

SEQ ID NO: 1815176 - protein, 19 aa, Staphylococcus epidermidis
YPRIRIQAENYVRDYYKKS

SEQ ID NO: 1815177 - protein, 26 aa, Staphylococcus epidermidis
YPTDSEGWAHCLTIPRELTIENGKLK

SEQ ID NO: 1815178 - protein, 25 aa, Staphylococcus epidermidis
YPTLLKRVCEVYRINMDKPYKKLTD

SEQ ID NO: 1815179 - protein, 19 aa, Staphylococcus epidermidis
YPTRIKPFYMQPNPDNEDT

SEQ ID NO: 1815180 - protein, 21 aa, Staphylococcus epidermidis
YPVDLSAKCWENKHKRIFEVA

SEQ ID NO: 1815181 - protein, 25 aa, Staphylococcus epidermidis
YPVEVFDKIMAVDMRGTFLVTKFLL

SEQ ID NO: 1815182 - protein, 20 aa, Staphylococcus epidermidis
YPVKEAFSTLTFKDPDTTVA

SEQ ID NO: 1815183 - protein, 18 aa, Staphylococcus epidermidis
YPYIDLIEFFGTSEASFI

SEQ ID NO: 1815184 - protein, 17 aa, Staphylococcus epidermidis
YPYISFIPLNGEVILSL

SEQ ID NO: 1815185 - protein, 19 aa, Staphylococcus epidermidis
YPYQHILLATGFVNQLGAQ

SEQ ID NO: 1815186 - protein, 24 aa, Staphylococcus epidermidis
YPYRYLKRDFGVLGVDMHLHANGI

SEQ ID NO: 1815187 - protein, 27 aa, Staphylococcus epidermidis
YQAPFPSRWLYVVKHLQTLIQERKINQ

SEQ ID NO: 1815188 - protein, 25 aa, Staphylococcus epidermidis
YQDFLQNEIARWIKIQEDIGLDVLV

SEQ ID NO: 1815189 - protein, 18 aa, Staphylococcus epidermidis
YQEARWILIDLANVVVHV

SEQ ID NO: 1815190 - protein, 23 aa, Staphylococcus epidermidis
YQEQYKMIPACNVKAVDTTAAGD

SEQ ID NO: 1815191 - protein, 22 aa, Staphylococcus epidermidis
YQFKMYPQDFVPFFEGTMTIEQ

SEQ ID NO: 1815192 - protein, 17 aa, Staphylococcus epidermidis
YQFKSYKLFNEIIRLII

SEQ ID NO: 1815193 - protein, 25 aa, Staphylococcus epidermidis
YQFLDEAYLLLDFHATIFNESQLTP

SEQ ID NO: 1815194 - protein, 24 aa, Staphylococcus epidermidis
YQFVLEPSYSFSIITSATQHPDEL

SEQ ID NO: 1815195 - protein, 23 aa, Staphylococcus epidermidis
YQGLNKGGAFILVEKVNGEFVQS

SEQ ID NO: 1815196 - protein, 18 aa, Staphylococcus epidermidis
YQLCPRTLEKFCPKLFKN

SEQ ID NO: 1815197 - protein, 17 aa, Staphylococcus epidermidis
YQLIRREAISLGLSGLE

SEQ ID NO: 1815198 - protein, 20 aa, Staphylococcus epidermidis
YQLKIMPNFIKDVSKSPHLL

SEQ ID NO: 1815199 - protein, 18 aa, Staphylococcus epidermidis
YQLLLSKSEEEIEKIYIN

SEQ ID NO: 1815200 - protein, 17 aa, Staphylococcus epidermidis
YQLPKVFFTNEIYKKLS

SEQ ID NO: 1815201 - protein, 17 aa, Staphylococcus epidermidis
YQMTIVFITHDINLVKD

SEQ ID NO: 1815202 - protein, 20 aa, Staphylococcus epidermidis
YQNEIRAIIKQCLNLPQTRL

SEQ ID NO: 1815203 - protein, 25 aa, Staphylococcus epidermidis
YQNKRPDYISAFWNVVNWEKVDELY

SEQ ID NO: 1815204 - protein, 24 aa, Staphylococcus epidermidis
YQNRPLVCVGILKGSVMFMADLIK

SEQ ID NO: 1815205 - protein, 19 aa, Staphylococcus epidermidis
YQPWPTFDESLLVDEEVEI

SEQ ID NO: 1815206 - protein, 20 aa, Staphylococcus epidermidis
YQQCPFKHYASHGLRLNERT

SEQ ID NO: 1815207 - protein, 19 aa, Staphylococcus epidermidis
YQQKGLKVFGLTASPNYIA

SEQ ID NO: 1815208 - protein, 19 aa, Staphylococcus epidermidis
YQREVYRLVDEGESLTAPL

SEQ ID NO: 1815209 - protein, 25 aa, Staphylococcus epidermidis
YQRGMKLSTACDSTLKDAEKKVNKL

SEQ ID NO: 1815210 - protein, 17 aa, Staphylococcus epidermidis
YQRKRLGYMRMLGYKDI

SEQ ID NO: 1815211 - protein, 18 aa, Staphylococcus epidermidis
YQRQTAEFERHFKEQKDK

SEQ ID NO: 1815212 - protein, 25 aa, Staphylococcus epidermidis
YQRSADIFLGVPFNIASYALLTHLI

SEQ ID NO: 1815213 - protein, 17 aa, Staphylococcus epidermidis
YQSKSWLVIANFSKEAV

SEQ ID NO: 1815214 - protein, 19 aa, Staphylococcus epidermidis
YQVAKKIECTYDIHVNRRI

SEQ ID NO: 1815215 - protein, 17 aa, Staphylococcus epidermidis
YRAKYQMEQEAQQEMKE

SEQ ID NO: 1815216 - protein, 21 aa, Staphylococcus epidermidis
YREDCPTCGHHPYYPHLNQEK

SEQ ID NO: 1815217 - protein, 17 aa, Staphylococcus epidermidis
YRFIHRFPTVASLSEAH

SEQ ID NO: 1815218 - protein, 22 aa, Staphylococcus epidermidis
YRFLEFPQETSIEIKQGDFTPI

SEQ ID NO: 1815219 - protein, 18 aa, Staphylococcus epidermidis
YRGSYVMRYLLDGRVPSL

SEQ ID NO: 1815220 - protein, 25 aa, Staphylococcus epidermidis
YRHRLEKRDLLVFPNQYALHNRERI

SEQ ID NO: 1815221 - protein, 17 aa, Staphylococcus epidermidis
YRISLGKDAKTGKYKYI

SEQ ID NO: 1815222 - protein, 19 aa, Staphylococcus epidermidis
YRKIDHFKSLEDFYKNHTY

SEQ ID NO: 1815223 - protein, 22 aa, Staphylococcus epidermidis
YRKIPREYLDSNIPKGRGFVKW

SEQ ID NO: 1815224 - protein, 25 aa, Staphylococcus epidermidis
YRKLGKYPPYYFLINFTISHKEMKK

SEQ ID NO: 1815225 - protein, 24 aa, Staphylococcus epidermidis
YRKLGKYPPYYFLINFTISHTDIK

SEQ ID NO: 1815226 - protein, 25 aa, Staphylococcus epidermidis
YRMDDLRASLGISQFKNMKRNKIHR

SEQ ID NO: 1815227 - protein, 18 aa, Staphylococcus epidermidis
YRMLKAGGNLVFTVEHPV

SEQ ID NO: 1815228 - protein, 25 aa, Staphylococcus epidermidis
YRNGYPDFKGAGLVEQEVDINSFDN

SEQ ID NO: 1815229 - protein, 20 aa, Staphylococcus epidermidis
YRNLHLFKDLGIIESTELEG

SEQ ID NO: 1815230 - protein, 17 aa, Staphylococcus epidermidis
YRRFKMGPKETLNTLQH

SEQ ID NO: 1815231 - protein, 21 aa, Staphylococcus epidermidis
YRTVMPGFKYETPPNQNKINP

SEQ ID NO: 1815232 - protein, 17 aa, Staphylococcus epidermidis
YRVVLMADKDPKLIGHL

SEQ ID NO: 1815233 - protein, 17 aa, Staphylococcus epidermidis
YRWLDAYLAIRDDDQLN

SEQ ID NO: 1815234 - protein, 24 aa, Staphylococcus epidermidis
YRYGRVPFTSTLVVDGRVITGQNP

SEQ ID NO: 1815235 - protein, 19 aa, Staphylococcus epidermidis
YRYKAIALTLDYFFNIQNH

SEQ ID NO: 1815236 - protein, 19 aa, Staphylococcus epidermidis
YRYLVGLLEKNQLDVSHVE

SEQ ID NO: 1815237 - protein, 23 aa, Staphylococcus epidermidis
YRYPNSCTFALSNINLHINKGEV

SEQ ID NO: 1815238 - protein, 26 aa, Staphylococcus epidermidis
YSAINDVLVRFCLKYKYDKYTLKSLR

SEQ ID NO: 1815239 - protein, 17 aa, Staphylococcus epidermidis
YSANWSADPSFLKDERF

SEQ ID NO: 1815240 - protein, 21 aa, Staphylococcus epidermidis
YSDIKYQLGLIGKNENEKLLK

SEQ ID NO: 1815241 - protein, 24 aa, Staphylococcus epidermidis
YSDLKLKAFEAHASQTGPFLKQIA

SEQ ID NO: 1815242 - protein, 27 aa, Staphylococcus epidermidis
YSDLPGWHFKFIIIANMLLNGQSFVEI

SEQ ID NO: 1815243 - protein, 21 aa, Staphylococcus epidermidis
YSESTIDRWFTTALKVLDNQL

SEQ ID NO: 1815244 - protein, 19 aa, Staphylococcus epidermidis
YSFGSTFHTVVPCATLIID

SEQ ID NO: 1815245 - protein, 17 aa, Staphylococcus epidermidis
YSFIKSRIDTQEVITDI

SEQ ID NO: 1815246 - protein, 26 aa, Staphylococcus epidermidis
YSGGMKRRLSLAISFLQNPNILILDE

SEQ ID NO: 1815247 - protein, 27 aa, Staphylococcus epidermidis
YSGLELLRLALNHPRITVASIHATKEI

SEQ ID NO: 1815248 - protein, 18 aa, Staphylococcus epidermidis
YSGQHIYVYAGVLNKNHF

SEQ ID NO: 1815249 - protein, 17 aa, Staphylococcus epidermidis
YSGVPVWNGLTDEDHPT

SEQ ID NO: 1815250 - protein, 18 aa, Staphylococcus epidermidis
YSHFTQMEGNYELKVAEG

SEQ ID NO: 1815251 - protein, 21 aa, Staphylococcus epidermidis
YSHKDVANMIGMNPARFSQKI

SEQ ID NO: 1815252 - protein, 17 aa, Staphylococcus epidermidis
YSIIALNIAEIFTHPDM

SEQ ID NO: 1815253 - protein, 18 aa, Staphylococcus epidermidis
YSIIALNIAEIFTHSDMV

SEQ ID NO: 1815254 - protein, 17 aa, Staphylococcus epidermidis
YSIKATHIMSQWPTHPN

SEQ ID NO: 1815255 - protein, 20 aa, Staphylococcus epidermidis
YSIKIDLPKQFKVNATVKFD

SEQ ID NO: 1815256 - protein, 26 aa, Staphylococcus epidermidis
YSILNGCVCCDLKLDLVNQLEVLINE

SEQ ID NO: 1815257 - protein, 22 aa, Staphylococcus epidermidis
YSKGEPIPSMIPIGQPLANIQV

SEQ ID NO: 1815258 - protein, 30 aa, Staphylococcus epidermidis
YSKNTKELFILNWAKFNWNNSEKVVNRIKQ

SEQ ID NO: 1815259 - protein, 19 aa, Staphylococcus epidermidis
YSLGMKQKLAIAVSLINKP

SEQ ID NO: 1815260 - protein, 24 aa, Staphylococcus epidermidis
YSLLKEMPIQFALGTSQQYGMDAE

SEQ ID NO: 1815261 - protein, 20 aa, Staphylococcus epidermidis
YSLNAGGKRIRPVILLLTLK

SEQ ID NO: 1815262 - protein, 28 aa, Staphylococcus epidermidis
YSLNAGGKRIRPVILLLTLKMLNKDYQQ

SEQ ID NO: 1815263 - protein, 25 aa, Staphylococcus epidermidis
YSMGGRVALYYALYGSVALRGLLLE

SEQ ID NO: 1815264 - protein, 18 aa, Staphylococcus epidermidis
YSMIKGTVDAILFQNNDN

SEQ ID NO: 1815265 - protein, 19 aa, Staphylococcus epidermidis
YSMIKGTVDTILFQNTDNF

SEQ ID NO: 1815266 - protein, 29 aa, Staphylococcus epidermidis
YSMYIQFLYECRQYIKSLKIEPSDKQALL

SEQ ID NO: 1815267 - protein, 26 aa, Staphylococcus epidermidis
YSNIFQRIISFFTMGFKFNQFTIYDN

SEQ ID NO: 1815268 - protein, 17 aa, Staphylococcus epidermidis
YSNSRLGVHSVHPQNPK

SEQ ID NO: 1815269 - protein, 19 aa, Staphylococcus epidermidis
YSPEPFLGNIRVFNPIETL

SEQ ID NO: 1815270 - protein, 17 aa, Staphylococcus epidermidis
YSPRSIAEFTVTQAINI

SEQ ID NO: 1815271 - protein, 17 aa, Staphylococcus epidermidis
YSQLIAKSVQLDFLRSD

SEQ ID NO: 1815272 - protein, 32 aa, Staphylococcus epidermidis
YSQRKIDVEPVFGFMKAILGFTRMSVRGLNKV

SEQ ID NO: 1815273 - protein, 17 aa, Staphylococcus epidermidis
YSRGMERFCCVNQINYI

SEQ ID NO: 1815274 - protein, 17 aa, Staphylococcus epidermidis
YSRIFKRVGINARPVVA

SEQ ID NO: 1815275 - protein, 21 aa, Staphylococcus epidermidis
YSSFISYHIFFETLLRKYNER

SEQ ID NO: 1815276 - protein, 24 aa, Staphylococcus epidermidis
YSSGMRAKLGFSINVTVNPDILVI

SEQ ID NO: 1815277 - protein, 20 aa, Staphylococcus epidermidis
YSTDLANIFYVRQKEQKGLG

SEQ ID NO: 1815278 - protein, 18 aa, Staphylococcus epidermidis
YSTLEWIKNHQSFNLPKF

SEQ ID NO: 1815279 - protein, 17 aa, Staphylococcus epidermidis
YSVMIPDSIEYLTICQR

SEQ ID NO: 1815280 - protein, 17 aa, Staphylococcus epidermidis
YSYIKYRGLEHEMTEEQ

SEQ ID NO: 1815281 - protein, 18 aa, Staphylococcus epidermidis
YSYIPAIFTKEKAMKFRE

SEQ ID NO: 1815282 - protein, 20 aa, Staphylococcus epidermidis
YSYYEFKYHSTVLYGCRCIS

SEQ ID NO: 1815283 - protein, 19 aa, Staphylococcus epidermidis
YTELFKYQVILCFDGLDFL

SEQ ID NO: 1815284 - protein, 24 aa, Staphylococcus epidermidis
YTELRNAPHFIFNGYHTRDFNVKN

SEQ ID NO: 1815285 - protein, 18 aa, Staphylococcus epidermidis
YTFHKIFSIIILSRQLSE

SEQ ID NO: 1815286 - protein, 21 aa, Staphylococcus epidermidis
YTGLELLRLALNHPHITVSSI

SEQ ID NO: 1815287 - protein, 25 aa, Staphylococcus epidermidis
YTGRPKKFAALHFANHVWINNTGEV

SEQ ID NO: 1815288 - protein, 17 aa, Staphylococcus epidermidis
YTHIQRILMTILLNIKS

SEQ ID NO: 1815289 - protein, 17 aa, Staphylococcus epidermidis
YTILQAIDFGHLNRELN

SEQ ID NO: 1815290 - protein, 24 aa, Staphylococcus epidermidis
YTKEGFKFAETVYDLLGNAILKKY

SEQ ID NO: 1815291 - protein, 17 aa, Staphylococcus epidermidis
YTKKNGKGIYRFELNEL

SEQ ID NO: 1815292 - protein, 31 aa, Staphylococcus epidermidis
YTKLSNDAKITWSILRDRLDLSIRNNWVDEN

SEQ ID NO: 1815293 - protein, 18 aa, Staphylococcus epidermidis
YTLLKREKPGLFGSPIKW

SEQ ID NO: 1815294 - protein, 17 aa, Staphylococcus epidermidis
YTMTSTRRIMMRVADAF

SEQ ID NO: 1815295 - protein, 23 aa, Staphylococcus epidermidis
YTPEPKLSFDAMTIVGNLNKNNA

SEQ ID NO: 1815296 - protein, 17 aa, Staphylococcus epidermidis
YTPIEIVNENGYSLKPR

SEQ ID NO: 1815297 - protein, 18 aa, Staphylococcus epidermidis
YTPYSLPITNKNLFKYNG

SEQ ID NO: 1815298 - protein, 19 aa, Staphylococcus epidermidis
YTQHIGGTCHFNYQTEPIL

SEQ ID NO: 1815299 - protein, 24 aa, Staphylococcus epidermidis
YTQKELFEQWFYPEGASVEVYQFN

SEQ ID NO: 1815300 - protein, 22 aa, Staphylococcus epidermidis
YTSALKQFGWFVADSLNNKPLF

SEQ ID NO: 1815301 - protein, 23 aa, Staphylococcus epidermidis
YTYGENGFKEYAVSQFQEADGTR

SEQ ID NO: 1815302 - protein, 17 aa, Staphylococcus epidermidis
YVAAFVYLSYRRSSQPF

SEQ ID NO: 1815303 - protein, 18 aa, Staphylococcus epidermidis
YVAGTSFDPYYLVEQAID

SEQ ID NO: 1815304 - protein, 18 aa, Staphylococcus epidermidis
YVDEDWKARVRQTIPELP

SEQ ID NO: 1815305 - protein, 18 aa, Staphylococcus epidermidis
YVEKGVLYPLSYYDGDWY

SEQ ID NO: 1815306 - protein, 30 aa, Staphylococcus epidermidis
YVFDDARLYSKEEFIAYFIRKLHLSHNDIV

SEQ ID NO: 1815307 - protein, 17 aa, Staphylococcus epidermidis
YVFEKVLSQKQLKSKNV

SEQ ID NO: 1815308 - protein, 18 aa, Staphylococcus epidermidis
YVFTEVALRNKGIKILPF

SEQ ID NO: 1815309 - protein, 19 aa, Staphylococcus epidermidis
YVGLKTGRDGIHGATFASE

SEQ ID NO: 1815310 - protein, 17 aa, Staphylococcus epidermidis
YVHASGYLYHKEKDNQY

SEQ ID NO: 1815311 - protein, 19 aa, Staphylococcus epidermidis
YVKEAYELGKYMAEQGYEL

SEQ ID NO: 1815312 - protein, 23 aa, Staphylococcus epidermidis
YVKGENPYFVSFIGDAPKKNPKV

SEQ ID NO: 1815313 - protein, 19 aa, Staphylococcus epidermidis
YVMLGHLHHPFSINDNTIK

SEQ ID NO: 1815314 - protein, 23 aa, Staphylococcus epidermidis
YVNEHPDRFVGFATLPINEPQAA

SEQ ID NO: 1815315 - protein, 24 aa, Staphylococcus epidermidis
YVPELKIGFEYNGVQHYKPVEHWG

SEQ ID NO: 1815316 - protein, 25 aa, Staphylococcus epidermidis
YVPPAQRDLGMVFQDFALWPHMSVF

SEQ ID NO: 1815317 - protein, 21 aa, Staphylococcus epidermidis
YVQELFPDFNHLYLVVDAENK

SEQ ID NO: 1815318 - protein, 17 aa, Staphylococcus epidermidis
YVRDYALEQNAKPIELD

SEQ ID NO: 1815319 - protein, 18 aa, Staphylococcus epidermidis
YVSLFMKLARPFIITKKS

SEQ ID NO: 1815320 - protein, 33 aa, Staphylococcus epidermidis
YVSRSHPGLLKRLFEQEVPEIYDGTVIVKSVAR

SEQ ID NO: 1815321 - protein, 23 aa, Staphylococcus epidermidis
YVTEFPLTIMVNGEEFATVICSP

SEQ ID NO: 1815322 - protein, 20 aa, Staphylococcus epidermidis
YVVQSFSKFRGKNVLISGGG

SEQ ID NO: 1815323 - protein, 17 aa, Staphylococcus epidermidis
YWGKADEAYIIPMNNSL

SEQ ID NO: 1815324 - protein, 17 aa, Staphylococcus epidermidis
YWKLFLKPFETLEAFNY

SEQ ID NO: 1815325 - protein, 19 aa, Staphylococcus epidermidis
YWNKLRFLQEASNKSELMT

SEQ ID NO: 1815326 - protein, 24 aa, Staphylococcus epidermidis
YWYERSIKLFSEYFGENMLVKNIT

SEQ ID NO: 1815327 - protein, 25 aa, Staphylococcus epidermidis
YWYERSIKLFSEYFGENMLVKNITR

SEQ ID NO: 1815328 - protein, 17 aa, Staphylococcus epidermidis
YYADTGISFVVGESDNP

SEQ ID NO: 1815329 - protein, 18 aa, Staphylococcus epidermidis
YYAVKILNEMKVDWKKRI

SEQ ID NO: 1815330 - protein, 34 aa, Staphylococcus epidermidis
YYAVKILNEMNVDWKKRIHMIIGTDEESDWKCTD

SEQ ID NO: 1815331 - protein, 17 aa, Staphylococcus epidermidis
YYDFPFNLFNVSSTYEK

SEQ ID NO: 1815332 - protein, 19 aa, Staphylococcus epidermidis
YYDGVTFHRVINDFMVQGG

SEQ ID NO: 1815333 - protein, 22 aa, Staphylococcus epidermidis
YYDKIANAIGDYRNVESDVSKN

SEQ ID NO: 1815334 - protein, 20 aa, Staphylococcus epidermidis
YYEEGYINFIELIIHRIDSM

SEQ ID NO: 1815335 - protein, 22 aa, Staphylococcus epidermidis
YYEKMIELIKPLGHIATIVAFN

SEQ ID NO: 1815336 - protein, 19 aa, Staphylococcus epidermidis
YYEVFPFGAQRIVLNRDEQ

SEQ ID NO: 1815337 - protein, 17 aa, Staphylococcus epidermidis
YYGGEVIQGTKIMHGKV

SEQ ID NO: 1815338 - protein, 18 aa, Staphylococcus epidermidis
YYIESSLQLTLPYERNSL

SEQ ID NO: 1815339 - protein, 25 aa, Staphylococcus epidermidis
YYIICAAGSRSARVVQYLEEQDIHA

SEQ ID NO: 1815340 - protein, 20 aa, Staphylococcus epidermidis
YYIIESIEVVQEFKGNYNGV

SEQ ID NO: 1815341 - protein, 18 aa, Staphylococcus epidermidis
YYILLWKLEVLDTYQRRG

SEQ ID NO: 1815342 - protein, 19 aa, Staphylococcus epidermidis
YYKYLSRRIGSIVETTLSA

SEQ ID NO: 1815343 - protein, 26 aa, Staphylococcus epidermidis
YYLASKVERGFVYGFDIQQEAIDNTR

SEQ ID NO: 1815344 - protein, 18 aa, Staphylococcus epidermidis
YYLEQEGYNVIAMGYLFL

SEQ ID NO: 1815345 - protein, 18 aa, Staphylococcus epidermidis
YYNVLKVIVGNAYVDEFD

SEQ ID NO: 1815346 - protein, 18 aa, Staphylococcus epidermidis
YYQQLWNLPEKVQISPYM

SEQ ID NO: 1815347 - protein, 23 aa, Staphylococcus epidermidis
YYQSLEPFSMVFAEEVTGIPQER

SEQ ID NO: 1815348 - protein, 19 aa, Staphylococcus epidermidis
YYREGFITHLMPKKDKSYL

SEQ ID NO: 1815349 - protein, 24 aa, Staphylococcus epidermidis
YYRPEMPNTHPLFIGAIVDEIQSH

SEQ ID NO: 1815350 - protein, 23 aa, Staphylococcus epidermidis
YYVEELRPFIGLDEPVYNYVMKW

SEQ ID NO: 1815351 - protein, 22 aa, Staphylococcus epidermidis
YYYEYKKFGILPEKEYAINKVK

SEQ ID NO: 1815352 - protein, 25 aa, Staphylococcus epidermidis
YYYISHQWFPLGAVHGLKYWFNYKS

SEQ ID NO: 1815353 - protein, 18 aa, Staphylococcus epidermidis
YYYMLTLGTYEWKNYQTL

SEQ ID NO: 1815354 - protein, 19 aa, Staphylococcus epidermidis
RKLLFWVIMNIIRGQHHYD

SEQ ID NO: 1815355 - protein, 20 aa, Staphylococcus epidermidis
GHSMLYLSSIMDIYNGEIVA

SEQ ID NO: 1815356 - protein, 22 aa, Staphylococcus epidermidis
AAIFAGDLMRMYSKYAEANGFK

SEQ ID NO: 1815357 - protein, 20 aa, Staphylococcus epidermidis
AGGCFWCMTKPFDTFDGIEK

SEQ ID NO: 1815358 - protein, 18 aa, Staphylococcus epidermidis
AHTVVWNGPMGVFEFSNF

SEQ ID NO: 1815359 - protein, 24 aa, Staphylococcus epidermidis
AKGRLPDCLVEWSAKRLKEQGANA

SEQ ID NO: 1815360 - protein, 19 aa, Staphylococcus epidermidis
ALYNFIWDEFCDWYIEMSK

SEQ ID NO: 1815361 - protein, 22 aa, Staphylococcus epidermidis
ANIPTRIAFMVSSSVDSRTILD

SEQ ID NO: 1815362 - protein, 19 aa, Staphylococcus epidermidis
ANLLRICARYDNLDIIEDA

SEQ ID NO: 1815363 - protein, 17 aa, Staphylococcus epidermidis
APIGRPSPMSPWGKPTL

SEQ ID NO: 1815364 - protein, 22 aa, Staphylococcus epidermidis
ATAPLVVLGCIMMRVCHNDTCP

SEQ ID NO: 1815365 - protein, 18 aa, Staphylococcus epidermidis
ATQSLKWAVEEMEKRYKL

SEQ ID NO: 1815366 - protein, 23 aa, Staphylococcus epidermidis
AVAEMKLAVGLLVDKKLSHMRIH

SEQ ID NO: 1815367 - protein, 18 aa, Staphylococcus epidermidis
CDKFCTYCIVPFTRGKER

SEQ ID NO: 1815368 - protein, 18 aa, Staphylococcus epidermidis
CINSILMSLLYKNHPEEL

SEQ ID NO: 1815369 - protein, 21 aa, Staphylococcus epidermidis
CPEFTSLCPITGQPDFATIYI

SEQ ID NO: 1815370 - protein, 18 aa, Staphylococcus epidermidis
CYCGCVFAAMKQGIDFKQ

SEQ ID NO: 1815371 - protein, 23 aa, Staphylococcus epidermidis
DGDTRGGAALSIRSVTQKPIKFV

SEQ ID NO: 1815372 - protein, 19 aa, Staphylococcus epidermidis
EALHKLGFDDGMYDLIKEP

SEQ ID NO: 1815373 - protein, 18 aa, Staphylococcus epidermidis
EFTELGSGFKIAMRDLNI

SEQ ID NO: 1815374 - protein, 18 aa, Staphylococcus epidermidis
EGCMPFEVMAERGRKTLL

SEQ ID NO: 1815375 - protein, 19 aa, Staphylococcus epidermidis
EHGIKAIIQPGGSIKDQDS

SEQ ID NO: 1815376 - protein, 18 aa, Staphylococcus epidermidis
EHMIRAALEGVLYNLYTV

SEQ ID NO: 1815377 - protein, 18 aa, Staphylococcus epidermidis
EIRPGIVHRIDKDTSGLL

SEQ ID NO: 1815378 - protein, 20 aa, Staphylococcus epidermidis
EIRRFLPRKVRTFQLQEAQR

SEQ ID NO: 1815379 - protein, 17 aa, Staphylococcus epidermidis
ELACAMSGYQLGVNPFN

SEQ ID NO: 1815380 - protein, 25 aa, Staphylococcus epidermidis
EMEKRYKLFAQYHVRNITAFNKKAP

SEQ ID NO: 1815381 - protein, 20 aa, Staphylococcus epidermidis
EMTVELIAPIAIEDGTRFSI

SEQ ID NO: 1815382 - protein, 17 aa, Staphylococcus epidermidis
ENPRFVEDLIRLIAADL

SEQ ID NO: 1815383 - protein, 20 aa, Staphylococcus epidermidis
EPIIPFIIGDGIGPDIWKAA

SEQ ID NO: 1815384 - protein, 18 aa, Staphylococcus epidermidis
EPKLSLPSARSIIAIAVG

SEQ ID NO: 1815385 - protein, 24 aa, Staphylococcus epidermidis
ESKYCPNCGRLLQYDYIHYNQIGH

SEQ ID NO: 1815386 - protein, 19 aa, Staphylococcus epidermidis
ETLEIYAPLAHRLGINTIK

SEQ ID NO: 1815387 - protein, 22 aa, Staphylococcus epidermidis
EWREPGCSMCLGMNPDQVPEGV

SEQ ID NO: 1815388 - protein, 22 aa, Staphylococcus epidermidis
FFPENRVEYFVSYYDYYQPEAY

SEQ ID NO: 1815389 - protein, 18 aa, Staphylococcus epidermidis
FHKDVVIDLVGYRRYGHN

SEQ ID NO: 1815390 - protein, 18 aa, Staphylococcus epidermidis
FILGETLYNFGLTPQGLE

SEQ ID NO: 1815391 - protein, 21 aa, Staphylococcus epidermidis
FRSRFRMLVEAQLDLLKSEDW

SEQ ID NO: 1815392 - protein, 18 aa, Staphylococcus epidermidis
FVIISFKHKVILIGGTEY

SEQ ID NO: 1815393 - protein, 24 aa, Staphylococcus epidermidis
FYDRKEIKDLLSYLRVIANSNDDI

SEQ ID NO: 1815394 - protein, 17 aa, Staphylococcus epidermidis
GAQKEVIRLIPGLENVD

SEQ ID NO: 1815395 - protein, 20 aa, Staphylococcus epidermidis
GASWRKLNIPGEDRLINKGV

SEQ ID NO: 1815396 - protein, 20 aa, Staphylococcus epidermidis
GFRGEALASISSVAKVTLKT

SEQ ID NO: 1815397 - protein, 19 aa, Staphylococcus epidermidis
GGLYLEKFIENFRHIEIQI

SEQ ID NO: 1815398 - protein, 22 aa, Staphylococcus epidermidis
GKQTEMFARFSTVSGERGAADL

SEQ ID NO: 1815399 - protein, 20 aa, Staphylococcus epidermidis
GKRRLAYEINDFKEGFYNIV

SEQ ID NO: 1815400 - protein, 18 aa, Staphylococcus epidermidis
GTFKWGVTTSLSYFPKDN

SEQ ID NO: 1815401 - protein, 17 aa, Staphylococcus epidermidis
GVALPWAISAALVRPNT

SEQ ID NO: 1815402 - protein, 18 aa, Staphylococcus epidermidis
HHTFFEMLGNFSIGDYFK

SEQ ID NO: 1815403 - protein, 19 aa, Staphylococcus epidermidis
IAPALATGCSLVMKPSEIT

SEQ ID NO: 1815404 - protein, 17 aa, Staphylococcus epidermidis
IDFFPGRFENTFNRWME

SEQ ID NO: 1815405 - protein, 19 aa, Staphylococcus epidermidis
IKYMFPKAHAAAYVLMAVR

SEQ ID NO: 1815406 - protein, 24 aa, Staphylococcus epidermidis
INAFKGVSFGEGFKAAEKPGSEIQ

SEQ ID NO: 1815407 - protein, 19 aa, Staphylococcus epidermidis
IPEHLVWRQPFPGPGLGIR

SEQ ID NO: 1815408 - protein, 17 aa, Staphylococcus epidermidis
IQKEYYVGFVIDRATDK

SEQ ID NO: 1815409 - protein, 17 aa, Staphylococcus epidermidis
IRLEPMSTFPVIRDLQV

SEQ ID NO: 1815410 - protein, 26 aa, Staphylococcus epidermidis
IRTLLLTFFYRFMRPLIEAGYVYIAQ

SEQ ID NO: 1815411 - protein, 25 aa, Staphylococcus epidermidis
IVEKSLRGAAIWDELKDRLHTNAYG

SEQ ID NO: 1815412 - protein, 19 aa, Staphylococcus epidermidis
IVVSIPVFLADSVEVTPVE

SEQ ID NO: 1815413 - protein, 24 aa, Staphylococcus epidermidis
KAAARFGSGWAWLVVNNGQLEIVT

SEQ ID NO: 1815414 - protein, 20 aa, Staphylococcus epidermidis
KCATLAWKALEKGTVEKEGK

SEQ ID NO: 1815415 - protein, 19 aa, Staphylococcus epidermidis
KELEREGFHILAIKDMAGL

SEQ ID NO: 1815416 - protein, 21 aa, Staphylococcus epidermidis
KELFKKLAHVEGFEKYLHKNF

SEQ ID NO: 1815417 - protein, 20 aa, Staphylococcus epidermidis
KELRDTLHFEMLWDTSKIDV

SEQ ID NO: 1815418 - protein, 20 aa, Staphylococcus epidermidis
KEVIAGFDFTFGKFGKGNMT

SEQ ID NO: 1815419 - protein, 23 aa, Staphylococcus epidermidis
KFTEGSFKQWGYDLAHNEFGDKV

SEQ ID NO: 1815420 - protein, 19 aa, Staphylococcus epidermidis
KGLEFPIVFIMGMEESLFP

SEQ ID NO: 1815421 - protein, 22 aa, Staphylococcus epidermidis
KGVAFCPHCDGPLFENKDVAVI

SEQ ID NO: 1815422 - protein, 18 aa, Staphylococcus epidermidis
KHWLPVDLYIGGVEHAVL

SEQ ID NO: 1815423 - protein, 20 aa, Staphylococcus epidermidis
KKGPFAPDFIKVWKERYKKI

SEQ ID NO: 1815424 - protein, 17 aa, Staphylococcus epidermidis
KKLPFGIGQIGKSFRNE

SEQ ID NO: 1815425 - protein, 24 aa, Staphylococcus epidermidis
KMGRYGKFMACSNFPDCRNTKAIV

SEQ ID NO: 1815426 - protein, 18 aa, Staphylococcus epidermidis
KPDLILLTFPTPVMSVLT

SEQ ID NO: 1815427 - protein, 18 aa, Staphylococcus epidermidis
KRIIDFLSGTVYAIGGDI

SEQ ID NO: 1815428 - protein, 17 aa, Staphylococcus epidermidis
KTVKRKYTALVHGNIPH

SEQ ID NO: 1815429 - protein, 23 aa, Staphylococcus epidermidis
LAVSRTSFDWGVRVPSNPKHVVY

SEQ ID NO: 1815430 - protein, 19 aa, Staphylococcus epidermidis
LDPSLPIDLIIDYAHTADG

SEQ ID NO: 1815431 - protein, 19 aa, Staphylococcus epidermidis
LDSCRKIKYMFPKAHAAAY

SEQ ID NO: 1815432 - protein, 24 aa, Staphylococcus epidermidis
LHIGHLLPFLTLRRFQEHGHRPIV

SEQ ID NO: 1815433 - protein, 17 aa, Staphylococcus epidermidis
LKKRGKNAVAITYTGDG

SEQ ID NO: 1815434 - protein, 22 aa, Staphylococcus epidermidis
LKSFKGSIIFTSYDFEFINTIA

SEQ ID NO: 1815435 - protein, 18 aa, Staphylococcus epidermidis
LKYIKSLYTELGKITDIV

SEQ ID NO: 1815436 - protein, 21 aa, Staphylococcus epidermidis
LPESFYRGAHQHIFRAMMHLN

SEQ ID NO: 1815437 - protein, 20 aa, Staphylococcus epidermidis
LPYRRVILCTGDIGFSASKT

SEQ ID NO: 1815438 - protein, 18 aa, Staphylococcus epidermidis
LRFANAMFEPLWNNKYIS

SEQ ID NO: 1815439 - protein, 21 aa, Staphylococcus epidermidis
LRTLLDFRYQRHFKAKKGENG

SEQ ID NO: 1815440 - protein, 20 aa, Staphylococcus epidermidis
LSLNVRRVFFSTFDRSELNE

SEQ ID NO: 1815441 - protein, 20 aa, Staphylococcus epidermidis
LYARFWHKVLYDLGVVPTKE

SEQ ID NO: 1815442 - protein, 19 aa, Staphylococcus epidermidis
LYGDVKFGVGPVIEGGFYY

SEQ ID NO: 1815443 - protein, 21 aa, Staphylococcus epidermidis
LYKDRIPVVIKNTNRPNDKGT

SEQ ID NO: 1815444 - protein, 18 aa, Staphylococcus epidermidis
MALPPCHTMFQFYVQEGK

SEQ ID NO: 1815445 - protein, 23 aa, Staphylococcus epidermidis
MILGAVCTRACRFCAVKTGLPNE

SEQ ID NO: 1815446 - protein, 17 aa, Staphylococcus epidermidis
MMFYTCILDMIKVEESS

SEQ ID NO: 1815447 - protein, 24 aa, Staphylococcus epidermidis
NALSWSSAGALGFKGSKKSTPFAA

SEQ ID NO: 1815448 - protein, 24 aa, Staphylococcus epidermidis
NHPEELRLLLIDPKMVELAPYNDL

SEQ ID NO: 1815449 - protein, 18 aa, Staphylococcus epidermidis
NIEVLRFANAMFEPLWNN

SEQ ID NO: 1815450 - protein, 22 aa, Staphylococcus epidermidis
NKAEKCTFCFPRIEAGMPTVCS

SEQ ID NO: 1815451 - protein, 19 aa, Staphylococcus epidermidis
NPVELRRSIGYVIQQIGLM

SEQ ID NO: 1815452 - protein, 17 aa, Staphylococcus epidermidis
NQAPFSFDLSVMAIYPC

SEQ ID NO: 1815453 - protein, 20 aa, Staphylococcus epidermidis
NRLTGRRICEKCGTTYHLVF

SEQ ID NO: 1815454 - protein, 17 aa, Staphylococcus epidermidis
NVGVPALVVFLNKVDMV

SEQ ID NO: 1815455 - protein, 19 aa, Staphylococcus epidermidis
PEEVRFILKQMGLKEKTID

SEQ ID NO: 1815456 - protein, 18 aa, Staphylococcus epidermidis
PIGSFLFLGPTGVGKTEL

SEQ ID NO: 1815457 - protein, 23 aa, Staphylococcus epidermidis
PQLFKQLLMISGFDKYYQIVKCF

SEQ ID NO: 1815458 - protein, 21 aa, Staphylococcus epidermidis
PRVRFTTSHPWDFTDRMIEVI

SEQ ID NO: 1815459 - protein, 20 aa, Staphylococcus epidermidis
PSVLPARFPNLLVNGAAGIA

SEQ ID NO: 1815460 - protein, 18 aa, Staphylococcus epidermidis
PSVQIGDPFVGKKLMEAT

SEQ ID NO: 1815461 - protein, 19 aa, Staphylococcus epidermidis
PYKVQVMGGIAIHKGDIAE

SEQ ID NO: 1815462 - protein, 18 aa, Staphylococcus epidermidis
QHRLYKLIWERFVASQMA

SEQ ID NO: 1815463 - protein, 17 aa, Staphylococcus epidermidis
QLFAAGYSACFNSALSL

SEQ ID NO: 1815464 - protein, 17 aa, Staphylococcus epidermidis
RAGACLITAGLIAEGVT

SEQ ID NO: 1815465 - protein, 23 aa, Staphylococcus epidermidis
RDGLKSECILLFSERDKGLHEYF

SEQ ID NO: 1815466 - protein, 19 aa, Staphylococcus epidermidis
REKRIVISLTYVYGIGTST

SEQ ID NO: 1815467 - protein, 19 aa, Staphylococcus epidermidis
RKGLRTGIVADRIGGQVND

SEQ ID NO: 1815468 - protein, 19 aa, Staphylococcus epidermidis
RKLSERRIFPAIDIGRSST

SEQ ID NO: 1815469 - protein, 20 aa, Staphylococcus epidermidis
RKPYSVILFDEIEKAHPDVF

SEQ ID NO: 1815470 - protein, 18 aa, Staphylococcus epidermidis
RLDHRGGVGADGITGDGA

SEQ ID NO: 1815471 - protein, 24 aa, Staphylococcus epidermidis
RMQGYNVLHPMGWDAFGLPAEQYA

SEQ ID NO: 1815472 - protein, 23 aa, Staphylococcus epidermidis
RSYNCLKRAGINSVQELADKSEA

SEQ ID NO: 1815473 - protein, 21 aa, Staphylococcus epidermidis
RVFNMIPYKVQVMGGIAIHKG

SEQ ID NO: 1815474 - protein, 32 aa, Staphylococcus epidermidis
SEISDWNKTGWGRIPMSLGFTYSSNTLMMHLQ

SEQ ID NO: 1815475 - protein, 21 aa, Staphylococcus epidermidis
SEPKALIGFAGRRVIEQTINE

SEQ ID NO: 1815476 - protein, 19 aa, Staphylococcus epidermidis
SEVPAHVQAGWMLTTIASI

SEQ ID NO: 1815477 - protein, 18 aa, Staphylococcus epidermidis
SFSLEMWGGATFDVAYNF

SEQ ID NO: 1815478 - protein, 17 aa, Staphylococcus epidermidis
SSFRGLFQFIRFIDELI

SEQ ID NO: 1815479 - protein, 18 aa, Staphylococcus epidermidis
SVVLLDFGKKQNIVRELN

SEQ ID NO: 1815480 - protein, 24 aa, Staphylococcus epidermidis
TESKLTVAMGYRINNEPLLMDIAK

SEQ ID NO: 1815481 - protein, 17 aa, Staphylococcus epidermidis
TFFPPYTFENWEVESSV

SEQ ID NO: 1815482 - protein, 24 aa, Staphylococcus epidermidis
TKGRLQKDLINWFIDDQFKLFYKK

SEQ ID NO: 1815483 - protein, 26 aa, Staphylococcus epidermidis
TLKLFKVCKMRGIPIFTFINKLDRVG

SEQ ID NO: 1815484 - protein, 22 aa, Staphylococcus epidermidis
TPELAFKLGRYGGYVLAHNKGE

SEQ ID NO: 1815485 - protein, 24 aa, Staphylococcus epidermidis
TTLGLRWLVNYARLRGEKTMEDRL

SEQ ID NO: 1815486 - protein, 23 aa, Staphylococcus epidermidis
TYLPRKFKIGIAVPPSNDIDVYS

SEQ ID NO: 1815487 - protein, 18 aa, Staphylococcus epidermidis
VATFTLAVNRTFTNAQGE

SEQ ID NO: 1815488 - protein, 18 aa, Staphylococcus epidermidis
VDVFRIFDSLNWVDQMKV

SEQ ID NO: 1815489 - protein, 23 aa, Staphylococcus epidermidis
VEFYPVLCGTAFKNKGVQLMLNA

SEQ ID NO: 1815490 - protein, 18 aa, Staphylococcus epidermidis
VELTLPLVVRLEGTNVER

SEQ ID NO: 1815491 - protein, 23 aa, Staphylococcus epidermidis
VGKDLSCNVVRTWIHQHTVILGI

SEQ ID NO: 1815492 - protein, 21 aa, Staphylococcus epidermidis
VKMYVCGPTVYNYIHIGNARP

SEQ ID NO: 1815493 - protein, 21 aa, Staphylococcus epidermidis
VRLSQDWKLRHVLIEMHGNNG

SEQ ID NO: 1815494 - protein, 22 aa, Staphylococcus epidermidis
VRMAQDFSYRYPLVDGQGNFGS

SEQ ID NO: 1815495 - protein, 17 aa, Staphylococcus epidermidis
WDGPTMISFCNGDKIGA

SEQ ID NO: 1815496 - protein, 21 aa, Staphylococcus epidermidis
WLEDYLKYFKGAIVIISHDRY

SEQ ID NO: 1815497 - protein, 24 aa, Staphylococcus epidermidis
WNLKLGELAMIWREGCIIRAQFLQ

SEQ ID NO: 1815498 - protein, 19 aa, Staphylococcus epidermidis
YARHGGGCFSGKDPTKVDR

SEQ ID NO: 1815499 - protein, 21 aa, Staphylococcus epidermidis
YASCFNGAFDLILKQNKVRDA

SEQ ID NO: 1815500 - protein, 19 aa, Staphylococcus epidermidis
YDIIFFWVARMIFQGLEFT

SEQ ID NO: 1815501 - protein, 25 aa, Staphylococcus epidermidis
YGILKRPQFFFAYDIDKYDKGLRGF

SEQ ID NO: 1815502 - protein, 22 aa, Staphylococcus epidermidis
YMRIAIELHLKRLIVGGLEKVY

SEQ ID NO: 1815503 - protein, 19 aa, Staphylococcus epidermidis
YQLSLAIGKRGQNARLAAK

SEQ ID NO: 1815504 - protein, 19 aa, Staphylococcus epidermidis
YVLRRLLRRAVRFSQSLGI

SEQ ID NO: 1815505 - protein, 18 aa, Staphylococcus epidermidis
AAELQGRIRAERFIHLMQ

SEQ ID NO: 1815506 - protein, 18 aa, Staphylococcus epidermidis
ACPNCGGKGYIKTELAFM

SEQ ID NO: 1815507 - protein, 21 aa, Staphylococcus epidermidis
AEFLQRFNGGMGILLGGIPGV

SEQ ID NO: 1815508 - protein, 22 aa, Staphylococcus epidermidis
AELLLRVAAIIRRRKEEISAIM

SEQ ID NO: 1815509 - protein, 17 aa, Staphylococcus epidermidis
AEVDIMYGQGISKEGEL

SEQ ID NO: 1815510 - protein, 25 aa, Staphylococcus epidermidis
AGAHGEWTALMIFKAYHEKNGQSHR

SEQ ID NO: 1815511 - protein, 23 aa, Staphylococcus epidermidis
AGAIGLKVHEDWGATPSALSHAL

SEQ ID NO: 1815512 - protein, 18 aa, Staphylococcus epidermidis
AGELFIFDIVDAFIEAEY

SEQ ID NO: 1815513 - protein, 20 aa, Staphylococcus epidermidis
AHLLIWEGIELLPVTDNNKK

SEQ ID NO: 1815514 - protein, 18 aa, Staphylococcus epidermidis
AHPEGYRKALRLMKQAEK

SEQ ID NO: 1815515 - protein, 17 aa, Staphylococcus epidermidis
AKHCDFFSFGTNDLTQL

SEQ ID NO: 1815516 - protein, 18 aa, Staphylococcus epidermidis
AKYRGEFEERLKAVLKEV

SEQ ID NO: 1815517 - protein, 23 aa, Staphylococcus epidermidis
AMINRLNLFKAYHYQAKILLLAW

SEQ ID NO: 1815518 - protein, 20 aa, Staphylococcus epidermidis
ANVIKIYFNEGFIALRPSGT

SEQ ID NO: 1815519 - protein, 20 aa, Staphylococcus epidermidis
APCPYVYAVIGKRAMEDPKL

SEQ ID NO: 1815520 - protein, 17 aa, Staphylococcus epidermidis
AQDGASCVTYIGPNGAG

SEQ ID NO: 1815521 - protein, 24 aa, Staphylococcus epidermidis
AQMAEELYRFPIMYVEYSGTYGDV

SEQ ID NO: 1815522 - protein, 20 aa, Staphylococcus epidermidis
ARKGLPYVFAGHFAPQQMKE

SEQ ID NO: 1815523 - protein, 17 aa, Staphylococcus epidermidis
ARPKPVVQWSDEVVEET

SEQ ID NO: 1815524 - protein, 19 aa, Staphylococcus epidermidis
ASPEFMFPSFYGIDVSTTA

SEQ ID NO: 1815525 - protein, 24 aa, Staphylococcus epidermidis
ATGLRPIAELMFNDFIGFGLDPIL

SEQ ID NO: 1815526 - protein, 20 aa, Staphylococcus epidermidis
AVFEMMNWWFEKGIDGFRVD

SEQ ID NO: 1815527 - protein, 19 aa, Staphylococcus epidermidis
AVHKLPFVCVIINNKYAIS

SEQ ID NO: 1815528 - protein, 19 aa, Staphylococcus epidermidis
AVWDLPMVFAEFGDKDFNP

SEQ ID NO: 1815529 - protein, 18 aa, Staphylococcus epidermidis
AYEILKWAYQTYENDIVY

SEQ ID NO: 1815530 - protein, 17 aa, Staphylococcus epidermidis
AYEMLPVVMEYKAKEVA

SEQ ID NO: 1815531 - protein, 28 aa, Staphylococcus epidermidis
CNIQFKPKRVMDTLELFKIAFPTDKSYQ

SEQ ID NO: 1815532 - protein, 18 aa, Staphylococcus epidermidis
CNYMIGMSFNQLGAFKEA

SEQ ID NO: 1815533 - protein, 27 aa, Staphylococcus epidermidis
CRYEMLKILRFCSGLNLIPTFKIITDR

SEQ ID NO: 1815534 - protein, 19 aa, Staphylococcus epidermidis
CSAGSRILVHNDIKDKFEK

SEQ ID NO: 1815535 - protein, 17 aa, Staphylococcus epidermidis
DCFLELVQIDSETGHEE

SEQ ID NO: 1815536 - protein, 19 aa, Staphylococcus epidermidis
DCPPCAFIKNYLVNKNIKF

SEQ ID NO: 1815537 - protein, 19 aa, Staphylococcus epidermidis
DCVKKLSAMNLDYELGLLI

SEQ ID NO: 1815538 - protein, 17 aa, Staphylococcus epidermidis
DDALRLAHEDLYETKAI

SEQ ID NO: 1815539 - protein, 17 aa, Staphylococcus epidermidis
DEIKMLFLQGIHKKIGY

SEQ ID NO: 1815540 - protein, 19 aa, Staphylococcus epidermidis
DELLRFAIKQVDKASQSNL

SEQ ID NO: 1815541 - protein, 25 aa, Staphylococcus epidermidis
DFESIRWLINYVKQYPHTVLFVTHD

SEQ ID NO: 1815542 - protein, 18 aa, Staphylococcus epidermidis
DGLKGGGYYVEYRTDDAR

SEQ ID NO: 1815543 - protein, 24 aa, Staphylococcus epidermidis
DIKIGDPLIRFDLEYINNNAKSII

SEQ ID NO: 1815544 - protein, 17 aa, Staphylococcus epidermidis
DIPFCIYNQTAVCTGRG

SEQ ID NO: 1815545 - protein, 23 aa, Staphylococcus epidermidis
DIVCAGASAVLFGSVNAIMGLTS

SEQ ID NO: 1815546 - protein, 21 aa, Staphylococcus epidermidis
DKEGWAHCLTIPRVLTIENGK

SEQ ID NO: 1815547 - protein, 23 aa, Staphylococcus epidermidis
DLFTCLRPVRWFKGVPSPVKRPE

SEQ ID NO: 1815548 - protein, 19 aa, Staphylococcus epidermidis
DLRRLGLRVYFNINNALVS

SEQ ID NO: 1815549 - protein, 24 aa, Staphylococcus epidermidis
DNGIKFFGSDGFKLSDDQENEIEQ

SEQ ID NO: 1815550 - protein, 17 aa, Staphylococcus epidermidis
DPFTCPHGRPIIINFSN

SEQ ID NO: 1815551 - protein, 23 aa, Staphylococcus epidermidis
DPMFQFCLGIPWGAENDPETIEY

SEQ ID NO: 1815552 - protein, 19 aa, Staphylococcus epidermidis
DRGDSRFYLSLQDELMVRF

SEQ ID NO: 1815553 - protein, 19 aa, Staphylococcus epidermidis
DRPLVCVGILKGSVMFMAD

SEQ ID NO: 1815554 - protein, 22 aa, Staphylococcus epidermidis
DTKKRIAIQYSLPKWIVDHWVT

SEQ ID NO: 1815555 - protein, 23 aa, Staphylococcus epidermidis
DVDVPRTDWDWMIYPQGLYDQIM

SEQ ID NO: 1815556 - protein, 21 aa, Staphylococcus epidermidis
DVSCFKCKGQGCNVCKHTGWI

SEQ ID NO: 1815557 - protein, 17 aa, Staphylococcus epidermidis
DWALSVTGTSEFRHRTI

SEQ ID NO: 1815558 - protein, 17 aa, Staphylococcus epidermidis
DWSRFTIAVGKLSRTKI

SEQ ID NO: 1815559 - protein, 18 aa, Staphylococcus epidermidis
EAKSWMLKALEPMGEEYL

SEQ ID NO: 1815560 - protein, 19 aa, Staphylococcus epidermidis
EALFNFITLLGWSPEGEEE

SEQ ID NO: 1815561 - protein, 20 aa, Staphylococcus epidermidis
EDRARLVIYPAAMRYAGPRE

SEQ ID NO: 1815562 - protein, 23 aa, Staphylococcus epidermidis
EEMAELYNYLGLTVGLNLNSKST

SEQ ID NO: 1815563 - protein, 17 aa, Staphylococcus epidermidis
EFPEIRDQLLLIGGLSK

SEQ ID NO: 1815564 - protein, 17 aa, Staphylococcus epidermidis
EGIKFIGPHLEHLDMFG

SEQ ID NO: 1815565 - protein, 20 aa, Staphylococcus epidermidis
EHGKHGFAFGSGMAAISAVI

SEQ ID NO: 1815566 - protein, 20 aa, Staphylococcus epidermidis
EIPHAIGVNVDRMIKEDEDR

SEQ ID NO: 1815567 - protein, 24 aa, Staphylococcus epidermidis
EKAKELGCLFAFYGHTHVAKYEQI

SEQ ID NO: 1815568 - protein, 22 aa, Staphylococcus epidermidis
EKKLPSSLFIKIHRATIVNKEH

SEQ ID NO: 1815569 - protein, 25 aa, Staphylococcus epidermidis
EKNAMGWYLDGRVSAVVGTHTHIQT

SEQ ID NO: 1815570 - protein, 21 aa, Staphylococcus epidermidis
EKSLKRTPSFSVNRPGEETGI

SEQ ID NO: 1815571 - protein, 24 aa, Staphylococcus epidermidis
EKTARQCAIVWGVNPVVKEGRKTT

SEQ ID NO: 1815572 - protein, 18 aa, Staphylococcus epidermidis
ELHIYRLPVKANQYEYKL

SEQ ID NO: 1815573 - protein, 23 aa, Staphylococcus epidermidis
ELLKDLELPLARILSEMEEIGIY

SEQ ID NO: 1815574 - protein, 20 aa, Staphylococcus epidermidis
ELQSRLGITFIFVTHDQEEA

SEQ ID NO: 1815575 - protein, 22 aa, Staphylococcus epidermidis
EMKRLGLPVPDGFTITTEACIT

SEQ ID NO: 1815576 - protein, 25 aa, Staphylococcus epidermidis
EMKVDWKKRIHIIIGTDEESDWKCT

SEQ ID NO: 1815577 - protein, 25 aa, Staphylococcus epidermidis
ENHACPICGFSIGELEPRMFSFNSP

SEQ ID NO: 1815578 - protein, 23 aa, Staphylococcus epidermidis
ESAGIIKKLFLLGIMANINQSLD

SEQ ID NO: 1815579 - protein, 23 aa, Staphylococcus epidermidis
ESFKESLRWGAEIFHNLKSILSE

SEQ ID NO: 1815580 - protein, 19 aa, Staphylococcus epidermidis
ESNCGWPSFSKALNDDEIV

SEQ ID NO: 1815581 - protein, 18 aa, Staphylococcus epidermidis
ESNTSWPLAMPVFKMDYA

SEQ ID NO: 1815582 - protein, 21 aa, Staphylococcus epidermidis
ETDRTGLRIAIELKKDANSES

SEQ ID NO: 1815583 - protein, 23 aa, Staphylococcus epidermidis
ETLRRYCFDRAFIGMNGIDVKYG

SEQ ID NO: 1815584 - protein, 18 aa, Staphylococcus epidermidis
EVAFRLGIDTRKNDQQIR

SEQ ID NO: 1815585 - protein, 23 aa, Staphylococcus epidermidis
EVAKCPKNYLAHVLSRYGFNVKK

SEQ ID NO: 1815586 - protein, 24 aa, Staphylococcus epidermidis
EVKEMYRRVNFLFGDLVKVTPSSK

SEQ ID NO: 1815587 - protein, 17 aa, Staphylococcus epidermidis
EVMSIPTLIVFKDGEPV

SEQ ID NO: 1815588 - protein, 17 aa, Staphylococcus epidermidis
EVSRLPKDVKVEIELIG

SEQ ID NO: 1815589 - protein, 17 aa, Staphylococcus epidermidis
FAGSYAVQWKMINYAIE

SEQ ID NO: 1815590 - protein, 19 aa, Staphylococcus epidermidis
FAQFFKLMLNQGINLAPSK

SEQ ID NO: 1815591 - protein, 17 aa, Staphylococcus epidermidis
FAVRIMGDASTRVVEKA

SEQ ID NO: 1815592 - protein, 25 aa, Staphylococcus epidermidis
FAYDCYRRLLQMFGEVVYGIPMTAF

SEQ ID NO: 1815593 - protein, 18 aa, Staphylococcus epidermidis
FDNLKWLGLDWDESVDKD

SEQ ID NO: 1815594 - protein, 25 aa, Staphylococcus epidermidis
FFFEEGKRAVLLLHGFTGNSADVRQ

SEQ ID NO: 1815595 - protein, 17 aa, Staphylococcus epidermidis
FGEMEVWALEAYGAAYT

SEQ ID NO: 1815596 - protein, 18 aa, Staphylococcus epidermidis
FGRIGRLAFRRIQDVEGL

SEQ ID NO: 1815597 - protein, 26 aa, Staphylococcus epidermidis
FGVNGIRISIAWSRIFPKGYGEVNQK

SEQ ID NO: 1815598 - protein, 17 aa, Staphylococcus epidermidis
FIIGDGIGPDIWKAASR

SEQ ID NO: 1815599 - protein, 21 aa, Staphylococcus epidermidis
FKAFLEHALKLGADYVATGHY

SEQ ID NO: 1815600 - protein, 21 aa, Staphylococcus epidermidis
FKGKEIFSALSKYEVKRRGDM

SEQ ID NO: 1815601 - protein, 18 aa, Staphylococcus epidermidis
FKGQHLVHFIPREHIEGR

SEQ ID NO: 1815602 - protein, 19 aa, Staphylococcus epidermidis
FKGQMWLNRLGFVDDEQAY

SEQ ID NO: 1815603 - protein, 19 aa, Staphylococcus epidermidis
FKHEAIEFAWEFLTSDKWM

SEQ ID NO: 1815604 - protein, 23 aa, Staphylococcus epidermidis
FKHYKDRVLVPLAYINFDEYIEE

SEQ ID NO: 1815605 - protein, 18 aa, Staphylococcus epidermidis
FNELMVAIQSPFLIDDDD

SEQ ID NO: 1815606 - protein, 18 aa, Staphylococcus epidermidis
FNIARKMGYFDIPKDLLI

SEQ ID NO: 1815607 - protein, 23 aa, Staphylococcus epidermidis
FNLAPEEFIVWVLGFNKSISELK

SEQ ID NO: 1815608 - protein, 17 aa, Staphylococcus epidermidis
FNRDRFILSAGHGSALL

SEQ ID NO: 1815609 - protein, 21 aa, Staphylococcus epidermidis
FPGVKGEVLVNAFSKQNVMVS

SEQ ID NO: 1815610 - protein, 18 aa, Staphylococcus epidermidis
FRGLFQFIRFIDELIDRK

SEQ ID NO: 1815611 - protein, 24 aa, Staphylococcus epidermidis
FSVFKKPMLFYAFDLEDYIYTRDF

SEQ ID NO: 1815612 - protein, 24 aa, Staphylococcus epidermidis
FTGYEVLNTFTFRITRNADLTIHE

SEQ ID NO: 1815613 - protein, 17 aa, Staphylococcus epidermidis
GAKMAWRNSNRCIGRLF

SEQ ID NO: 1815614 - protein, 17 aa, Staphylococcus epidermidis
GALGLNIGSEISIKQKC

SEQ ID NO: 1815615 - protein, 19 aa, Staphylococcus epidermidis
GASGIEYFTPILNLGETGI

SEQ ID NO: 1815616 - protein, 19 aa, Staphylococcus epidermidis
GCFWCMVKPFTSYPGIKSV

SEQ ID NO: 1815617 - protein, 18 aa, Staphylococcus epidermidis
GDCTICVDRCPTGALVGN

SEQ ID NO: 1815618 - protein, 19 aa, Staphylococcus epidermidis
GDIYRPAAIDQLQTVGKQI

SEQ ID NO: 1815619 - protein, 18 aa, Staphylococcus epidermidis
GDKLPIWIADYVLSTYGT

SEQ ID NO: 1815620 - protein, 18 aa, Staphylococcus epidermidis
GEGIPIILIHGLDGNLAG

SEQ ID NO: 1815621 - protein, 21 aa, Staphylococcus epidermidis
GEPKLGFKEMEEIGASTGLPL

SEQ ID NO: 1815622 - protein, 17 aa, Staphylococcus epidermidis
GFPEARIPLSQAVIELC

SEQ ID NO: 1815623 - protein, 26 aa, Staphylococcus epidermidis
GHIELAAPVSHIWYFKGIPSRMGLLL

SEQ ID NO: 1815624 - protein, 23 aa, Staphylococcus epidermidis
GKDLKIAIVVSRFNDFITTRLLE

SEQ ID NO: 1815625 - protein, 19 aa, Staphylococcus epidermidis
GKEISRIGSTFGKTNRVLI

SEQ ID NO: 1815626 - protein, 20 aa, Staphylococcus epidermidis
GKLGVKVWIYRGEVLPTKNT

SEQ ID NO: 1815627 - protein, 23 aa, Staphylococcus epidermidis
GKSNITDAIKWVLGEQSAKSLRG

SEQ ID NO: 1815628 - protein, 19 aa, Staphylococcus epidermidis
GLECARGLLDQGMEVTVLH

SEQ ID NO: 1815629 - protein, 19 aa, Staphylococcus epidermidis
GLKLGFPAHMSRLTRIASG

SEQ ID NO: 1815630 - protein, 23 aa, Staphylococcus epidermidis
GLKSDCLYCYPHMLSGGEAQRVA

SEQ ID NO: 1815631 - protein, 19 aa, Staphylococcus epidermidis
GLQERVWNPLQIMNDFGID

SEQ ID NO: 1815632 - protein, 18 aa, Staphylococcus epidermidis
GMKKRYATLMGIDEQTPV

SEQ ID NO: 1815633 - protein, 18 aa, Staphylococcus epidermidis
GNMLKPWFVSSIDNPITK

SEQ ID NO: 1815634 - protein, 18 aa, Staphylococcus epidermidis
GNVLRFQPPLVITYKQLD

SEQ ID NO: 1815635 - protein, 18 aa, Staphylococcus epidermidis
GPAALRCSQFVYKEQKNQ

SEQ ID NO: 1815636 - protein, 23 aa, Staphylococcus epidermidis
GQGCNVCKHTGWIEILGAGMVHP

SEQ ID NO: 1815637 - protein, 20 aa, Staphylococcus epidermidis
GREWGDYGIEEFLEVKSIAG

SEQ ID NO: 1815638 - protein, 23 aa, Staphylococcus epidermidis
GTVVRLANFGAFVEIAPSVQGLV

SEQ ID NO: 1815639 - protein, 23 aa, Staphylococcus epidermidis
GWTDIFIYPGFEFKAIDGLITNF

SEQ ID NO: 1815640 - protein, 19 aa, Staphylococcus epidermidis
GYFARPTIFINVDNHMTIA

SEQ ID NO: 1815641 - protein, 21 aa, Staphylococcus epidermidis
HAAGLRYAQYGPFMTFHLAGG

SEQ ID NO: 1815642 - protein, 21 aa, Staphylococcus epidermidis
HAQMKMFLTRLGFGSKMVVTG

SEQ ID NO: 1815643 - protein, 18 aa, Staphylococcus epidermidis
HDAFKLYDTYGFPIELTE

SEQ ID NO: 1815644 - protein, 22 aa, Staphylococcus epidermidis
HFNKLEVPFIYRVHEQPKSDRL

SEQ ID NO: 1815645 - protein, 17 aa, Staphylococcus epidermidis
HGFEVLKAQSFNEFVVK

SEQ ID NO: 1815646 - protein, 19 aa, Staphylococcus epidermidis
HGQALHCCSVEFIHPIYRS

SEQ ID NO: 1815647 - protein, 24 aa, Staphylococcus epidermidis
HGRERSGVCSVQFAERIQEGDTIP

SEQ ID NO: 1815648 - protein, 19 aa, Staphylococcus epidermidis
HLRLCGGFQFSSHKSDDEW

SEQ ID NO: 1815649 - protein, 18 aa, Staphylococcus epidermidis
HSIKLGKIDHIFITHMHG

SEQ ID NO: 1815650 - protein, 24 aa, Staphylococcus epidermidis
HSPERLKAALLFTLEEECIKQGHT

SEQ ID NO: 1815651 - protein, 23 aa, Staphylococcus epidermidis
HVSELKQRIPLILEVTSNQYESH

SEQ ID NO: 1815652 - protein, 20 aa, Staphylococcus epidermidis
HYEVRLPLVPLEEAQCKQVE

SEQ ID NO: 1815653 - protein, 22 aa, Staphylococcus epidermidis
IAACLLTAVPVMKIFKYFYSNR

SEQ ID NO: 1815654 - protein, 17 aa, Staphylococcus epidermidis
IAEAFVRSGAVDIVVVD

SEQ ID NO: 1815655 - protein, 19 aa, Staphylococcus epidermidis
IDLEKGFECTAKFRYRQKD

SEQ ID NO: 1815656 - protein, 22 aa, Staphylococcus epidermidis
IFRPQLRALLRASVYGKLNIMF

SEQ ID NO: 1815657 - protein, 19 aa, Staphylococcus epidermidis
IGRFPICYINIQMDPILVD

SEQ ID NO: 1815658 - protein, 17 aa, Staphylococcus epidermidis
IIIVTTFKRPGYFEKAV

SEQ ID NO: 1815659 - protein, 18 aa, Staphylococcus epidermidis
IIVIEWSKFIKDFLPPNH

SEQ ID NO: 1815660 - protein, 19 aa, Staphylococcus epidermidis
IKAAGGFIIQVMPGATDET

SEQ ID NO: 1815661 - protein, 19 aa, Staphylococcus epidermidis
IKFLFELQDGYTIETVLMR

SEQ ID NO: 1815662 - protein, 19 aa, Staphylococcus epidermidis
ILIGGGMAYTFIKAQGKEI

SEQ ID NO: 1815663 - protein, 18 aa, Staphylococcus epidermidis
IMREKRVDTIFVVGNDEH

SEQ ID NO: 1815664 - protein, 22 aa, Staphylococcus epidermidis
INDLRIGEALLRGIDTTTNHSI

SEQ ID NO: 1815665 - protein, 18 aa, Staphylococcus epidermidis
IPAKARRKGGHPAKRVFQ

SEQ ID NO: 1815666 - protein, 17 aa, Staphylococcus epidermidis
IPDEFVVGYGLDYRELY

SEQ ID NO: 1815667 - protein, 19 aa, Staphylococcus epidermidis
IPEDLFFIISLSGETHQLK

SEQ ID NO: 1815668 - protein, 22 aa, Staphylococcus epidermidis
IPGELIMKVLAFDADLSKIDQV

SEQ ID NO: 1815669 - protein, 23 aa, Staphylococcus epidermidis
IPGSNLPSVIGWRTIDDTNKMIE

SEQ ID NO: 1815670 - protein, 20 aa, Staphylococcus epidermidis
IPRTLAISVFGEMDVSSIKQ

SEQ ID NO: 1815671 - protein, 17 aa, Staphylococcus epidermidis
ISDLMGWTAQGLDTLRI

SEQ ID NO: 1815672 - protein, 22 aa, Staphylococcus epidermidis
ISKSELLEKVWGYDYYEDANTV

SEQ ID NO: 1815673 - protein, 23 aa, Staphylococcus epidermidis
ISPNEFKFGLSFLTRSVALSRFP

SEQ ID NO: 1815674 - protein, 17 aa, Staphylococcus epidermidis
IVIMPIVRQYYRMLQRP

SEQ ID NO: 1815675 - protein, 17 aa, Staphylococcus epidermidis
IYDLITIACQFKSGERP

SEQ ID NO: 1815676 - protein, 19 aa, Staphylococcus epidermidis
KARACGIHMLVATQRPSVN

SEQ ID NO: 1815677 - protein, 23 aa, Staphylococcus epidermidis
KATDLRAAAALILAGLVAEGTTQ

SEQ ID NO: 1815678 - protein, 17 aa, Staphylococcus epidermidis
KCGNVIRPDIVLYGEML

SEQ ID NO: 1815679 - protein, 24 aa, Staphylococcus epidermidis
KDGLKGAHIHLDFPSVGATQNIIM

SEQ ID NO: 1815680 - protein, 19 aa, Staphylococcus epidermidis
KDHFLRISIDKEGGVDLND

SEQ ID NO: 1815681 - protein, 19 aa, Staphylococcus epidermidis
KDIYQEWYLGKALFNQVEY

SEQ ID NO: 1815682 - protein, 20 aa, Staphylococcus epidermidis
KEAAMLAGYFSKAGSSAQIP

SEQ ID NO: 1815683 - protein, 17 aa, Staphylococcus epidermidis
KEFELLWYLASREGEVI

SEQ ID NO: 1815684 - protein, 20 aa, Staphylococcus epidermidis
KEIPPTYSFKDLNVAIAELE

SEQ ID NO: 1815685 - protein, 21 aa, Staphylococcus epidermidis
KELRGAHIFLDMVSVGATINI

SEQ ID NO: 1815686 - protein, 21 aa, Staphylococcus epidermidis
KERLKGIFLTHGHEHAIGAVS

SEQ ID NO: 1815687 - protein, 20 aa, Staphylococcus epidermidis
KFGKSKIWLGVWEHNPKALS

SEQ ID NO: 1815688 - protein, 17 aa, Staphylococcus epidermidis
KFMKYKTFFDNINMPTT

SEQ ID NO: 1815689 - protein, 18 aa, Staphylococcus epidermidis
KGVRLKAYFNEFTYNENL

SEQ ID NO: 1815690 - protein, 20 aa, Staphylococcus epidermidis
KGYFLWSLMDVFSWSNGYEK

SEQ ID NO: 1815691 - protein, 18 aa, Staphylococcus epidermidis
KHEFLRYPYIESFENVDE

SEQ ID NO: 1815692 - protein, 19 aa, Staphylococcus epidermidis
KHLEGGFIKAIRQVGNDRR

SEQ ID NO: 1815693 - protein, 18 aa, Staphylococcus epidermidis
KHPYTWGLLSSMPDLTTS

SEQ ID NO: 1815694 - protein, 19 aa, Staphylococcus epidermidis
KIALFAGIDKCRFKKQVVP

SEQ ID NO: 1815695 - protein, 18 aa, Staphylococcus epidermidis
KIAQFILNYPHKVVNMTS

SEQ ID NO: 1815696 - protein, 20 aa, Staphylococcus epidermidis
KIMKMLHPFMPFVTETIWQS

SEQ ID NO: 1815697 - protein, 18 aa, Staphylococcus epidermidis
KKKFKVDRLSTIEAEISE

SEQ ID NO: 1815698 - protein, 19 aa, Staphylococcus epidermidis
KKRVYDLLETVGLGKEHAN

SEQ ID NO: 1815699 - protein, 21 aa, Staphylococcus epidermidis
KLKAFAPVREWAWSREEEIDY

SEQ ID NO: 1815700 - protein, 19 aa, Staphylococcus epidermidis
KLKVLYEMFGLKMVDNELS

SEQ ID NO: 1815701 - protein, 20 aa, Staphylococcus epidermidis
KLPYTLCYVSRGFVADYNNK

SEQ ID NO: 1815702 - protein, 19 aa, Staphylococcus epidermidis
KLWPIQPLRDFWGINKRTE

SEQ ID NO: 1815703 - protein, 20 aa, Staphylococcus epidermidis
KMNILIGPLVKLWKIGFKDA

SEQ ID NO: 1815704 - protein, 19 aa, Staphylococcus epidermidis
KNHWYEWLRHNLTLEGYDV

SEQ ID NO: 1815705 - protein, 18 aa, Staphylococcus epidermidis
KPDHKVTVFAGQDKEATQ

SEQ ID NO: 1815706 - protein, 20 aa, Staphylococcus epidermidis
KPEEYWSIEGEFRYKKSKFT

SEQ ID NO: 1815707 - protein, 17 aa, Staphylococcus epidermidis
KPIKRLWISSVTKKAIQ

SEQ ID NO: 1815708 - protein, 19 aa, Staphylococcus epidermidis
KQDEIILLEGFMDVIKSDY

SEQ ID NO: 1815709 - protein, 22 aa, Staphylococcus epidermidis
KQLMIYEAFGWEAPRFGHMSLI

SEQ ID NO: 1815710 - protein, 19 aa, Staphylococcus epidermidis
KREDLQWVRSFKLRGAYNA

SEQ ID NO: 1815711 - protein, 24 aa, Staphylococcus epidermidis
KRIAIEMASPLGWHKYVGIEGKVI

SEQ ID NO: 1815712 - protein, 17 aa, Staphylococcus epidermidis
KRLGYYPKTVANISQIS

SEQ ID NO: 1815713 - protein, 20 aa, Staphylococcus epidermidis
KRPPSAWVVLAKPNIGISSP

SEQ ID NO: 1815714 - protein, 19 aa, Staphylococcus epidermidis
KSCVGKEFCRFGTQYTTRL

SEQ ID NO: 1815715 - protein, 17 aa, Staphylococcus epidermidis
KSYRFALNQSKNVYKYI

SEQ ID NO: 1815716 - protein, 19 aa, Staphylococcus epidermidis
KTEYRGREATDFKEDDIEL

SEQ ID NO: 1815717 - protein, 17 aa, Staphylococcus epidermidis
KTFPGYVLVELIMTDES

SEQ ID NO: 1815718 - protein, 21 aa, Staphylococcus epidermidis
KTLLIKKCEAFTNEVIKKDVL

SEQ ID NO: 1815719 - protein, 17 aa, Staphylococcus epidermidis
KTRVVSHVEWLDSKQRL

SEQ ID NO: 1815720 - protein, 18 aa, Staphylococcus epidermidis
KVAKRLNKTIGLLLDTKG

SEQ ID NO: 1815721 - protein, 19 aa, Staphylococcus epidermidis
KYIPYCIEPSLGADRVTLA

SEQ ID NO: 1815722 - protein, 19 aa, Staphylococcus epidermidis
KYLRLYAEFENYKRRIQKE

SEQ ID NO: 1815723 - protein, 18 aa, Staphylococcus epidermidis
KYQEICWFHTLEGIWHPV

SEQ ID NO: 1815724 - protein, 19 aa, Staphylococcus epidermidis
LAEQMGIIFIDEIDKVATN

SEQ ID NO: 1815725 - protein, 17 aa, Staphylococcus epidermidis
LAKRLKQEYGLKFESCA

SEQ ID NO: 1815726 - protein, 18 aa, Staphylococcus epidermidis
LAYNYDISCVHIPKNGEE

SEQ ID NO: 1815727 - protein, 17 aa, Staphylococcus epidermidis
LDVGKCPFHPSSSHNTI

SEQ ID NO: 1815728 - protein, 18 aa, Staphylococcus epidermidis
LEAFNLYGALSMANAGPN

SEQ ID NO: 1815729 - protein, 24 aa, Staphylococcus epidermidis
LEDRLRSRFEWGLIVDITPPDYET

SEQ ID NO: 1815730 - protein, 17 aa, Staphylococcus epidermidis
LEIAEAFVRSGAVDIVV

SEQ ID NO: 1815731 - protein, 17 aa, Staphylococcus epidermidis
LEKESRAKEILAHRIFS

SEQ ID NO: 1815732 - protein, 23 aa, Staphylococcus epidermidis
LEYKIGLDISCMFNDTAQFKSLA

SEQ ID NO: 1815733 - protein, 23 aa, Staphylococcus epidermidis
LGDFKAPMGCRSFLPSWKNDEGQ

SEQ ID NO: 1815734 - protein, 21 aa, Staphylococcus epidermidis
LGFLALHGFLHLLGYDHMNDN

SEQ ID NO: 1815735 - protein, 18 aa, Staphylococcus epidermidis
LGFMPGFPYLGGLDAKLH

SEQ ID NO: 1815736 - protein, 23 aa, Staphylococcus epidermidis
LGLDYLDLFLIHWPCENDQLYIE

SEQ ID NO: 1815737 - protein, 17 aa, Staphylococcus epidermidis
LKALKLFYKMPMPQWGG

SEQ ID NO: 1815738 - protein, 20 aa, Staphylococcus epidermidis
LKAQFKRLWSIRNDQYSDKR

SEQ ID NO: 1815739 - protein, 19 aa, Staphylococcus epidermidis
LKAYGFKFLGPVTVFSFLE

SEQ ID NO: 1815740 - protein, 23 aa, Staphylococcus epidermidis
LKDRYEFIGGLSPLAGTTDRQAE

SEQ ID NO: 1815741 - protein, 18 aa, Staphylococcus epidermidis
LKLAEYGYIGGFDLGEVS

SEQ ID NO: 1815742 - protein, 18 aa, Staphylococcus epidermidis
LKLKNTRAITANRIKKYT

SEQ ID NO: 1815743 - protein, 21 aa, Staphylococcus epidermidis
LKLYAPEFEKVIPLNIMLIEK

SEQ ID NO: 1815744 - protein, 19 aa, Staphylococcus epidermidis
LLESVAFQIGSAIKRIQLT

SEQ ID NO: 1815745 - protein, 23 aa, Staphylococcus epidermidis
LLINGSDFSTGWIFYIDEEGHHD

SEQ ID NO: 1815746 - protein, 17 aa, Staphylococcus epidermidis
LLSHGFVMDGEGKKMSK

SEQ ID NO: 1815747 - protein, 23 aa, Staphylococcus epidermidis
LNDCKYFGLDFVDFEDWVKNINL

SEQ ID NO: 1815748 - protein, 17 aa, Staphylococcus epidermidis
LNKTIGLLLDTKGPEIR

SEQ ID NO: 1815749 - protein, 17 aa, Staphylococcus epidermidis
LNTRIIIVTTFKRPGYF

SEQ ID NO: 1815750 - protein, 19 aa, Staphylococcus epidermidis
LPFPLKMNRLLGFDSTYVT

SEQ ID NO: 1815751 - protein, 17 aa, Staphylococcus epidermidis
LPMVFAEFGDKDFNPKT

SEQ ID NO: 1815752 - protein, 17 aa, Staphylococcus epidermidis
LPYPTKFIFLDFIQSEN

SEQ ID NO: 1815753 - protein, 19 aa, Staphylococcus epidermidis
LQMAPKHWLCIQENDLVWA

SEQ ID NO: 1815754 - protein, 23 aa, Staphylococcus epidermidis
LQNCGLCASSLYALVDGDIVEGN

SEQ ID NO: 1815755 - protein, 19 aa, Staphylococcus epidermidis
LRHKYVWSTPFLMRVEENF

SEQ ID NO: 1815756 - protein, 17 aa, Staphylococcus epidermidis
LRKPDWLKIKLNTNDNY

SEQ ID NO: 1815757 - protein, 20 aa, Staphylococcus epidermidis
LRKRVWRRLAKDLKPQQLHD

SEQ ID NO: 1815758 - protein, 17 aa, Staphylococcus epidermidis
LRMNYLFDFYQSLLTNK

SEQ ID NO: 1815759 - protein, 20 aa, Staphylococcus epidermidis
LRVDELLTMVGLNPEQFKNR

SEQ ID NO: 1815760 - protein, 19 aa, Staphylococcus epidermidis
LRYPARKGAKIAFYVAQWP

SEQ ID NO: 1815761 - protein, 17 aa, Staphylococcus epidermidis
LSAYDSWALAKHLKTLP

SEQ ID NO: 1815762 - protein, 19 aa, Staphylococcus epidermidis
LSKLGLKWYAVPIISNMDL

SEQ ID NO: 1815763 - protein, 19 aa, Staphylococcus epidermidis
LSPDVYLKWYKKSPCTVDI

SEQ ID NO: 1815764 - protein, 19 aa, Staphylococcus epidermidis
LSRCIPMIFLNPAPGQELE

SEQ ID NO: 1815765 - protein, 21 aa, Staphylococcus epidermidis
LSRQGIWKIIKQYGLKANINK

SEQ ID NO: 1815766 - protein, 17 aa, Staphylococcus epidermidis
LTHEFKYQVSRSYMKTF

SEQ ID NO: 1815767 - protein, 20 aa, Staphylococcus epidermidis
LTKVFTRFGIDVDFVDTTKI

SEQ ID NO: 1815768 - protein, 18 aa, Staphylococcus epidermidis
LYFEGVSVFDMLDIVENI

SEQ ID NO: 1815769 - protein, 17 aa, Staphylococcus epidermidis
LYHYWALGHIHQREQLS

SEQ ID NO: 1815770 - protein, 24 aa, Staphylococcus epidermidis
MDEFWPGPISFILPLKQGYLCSKV

SEQ ID NO: 1815771 - protein, 18 aa, Staphylococcus epidermidis
MDELRLLARSVFVLNENN

SEQ ID NO: 1815772 - protein, 20 aa, Staphylococcus epidermidis
MIDLRIETRLSFTESQINFY

SEQ ID NO: 1815773 - protein, 18 aa, Staphylococcus epidermidis
MIRQAAFRLVENIKNDIK

SEQ ID NO: 1815774 - protein, 18 aa, Staphylococcus epidermidis
MISRSEFYTAYTPYQPEI

SEQ ID NO: 1815775 - protein, 18 aa, Staphylococcus epidermidis
MKFIKSFKAVNLHQSIFE

SEQ ID NO: 1815776 - protein, 17 aa, Staphylococcus epidermidis
MKHYFILNFPQRPGALR

SEQ ID NO: 1815777 - protein, 25 aa, Staphylococcus epidermidis
MKILKEKNIRFVVGGMYEFGLSRYF

SEQ ID NO: 1815778 - protein, 17 aa, Staphylococcus epidermidis
MLVKRPLAISGNHLTLG

SEQ ID NO: 1815779 - protein, 18 aa, Staphylococcus epidermidis
MLYRLGALGLNIGSEISI

SEQ ID NO: 1815780 - protein, 17 aa, Staphylococcus epidermidis
MMAALKISTDFERMGDN

SEQ ID NO: 1815781 - protein, 20 aa, Staphylococcus epidermidis
MPRSIYCGTIGLLLPNQRMI

SEQ ID NO: 1815782 - protein, 20 aa, Staphylococcus epidermidis
MSGSGRFGGHFVLGHVDELG

SEQ ID NO: 1815783 - protein, 19 aa, Staphylococcus epidermidis
MVLPARFPNLLINGSTGIS

SEQ ID NO: 1815784 - protein, 17 aa, Staphylococcus epidermidis
MVMHIYESFGLKHLKLV

SEQ ID NO: 1815785 - protein, 20 aa, Staphylococcus epidermidis
NDCPRIRTIPVGSIESLQYP

SEQ ID NO: 1815786 - protein, 19 aa, Staphylococcus epidermidis
NDLPHLVSPVITDVKAATQ

SEQ ID NO: 1815787 - protein, 21 aa, Staphylococcus epidermidis
NEIFDILSIEGIIILVIYHGH

SEQ ID NO: 1815788 - protein, 20 aa, Staphylococcus epidermidis
NELRESIQYFAKVESRTILE

SEQ ID NO: 1815789 - protein, 23 aa, Staphylococcus epidermidis
NFPSNKFNLGFTFQDTPGVDSNV

SEQ ID NO: 1815790 - protein, 22 aa, Staphylococcus epidermidis
NGDIGIIVGIFWAKENALNKDV

SEQ ID NO: 1815791 - protein, 20 aa, Staphylococcus epidermidis
NIPFLWRLSSELNVMQLQRA

SEQ ID NO: 1815792 - protein, 17 aa, Staphylococcus epidermidis
NITAYWQGFVEYHNKKN

SEQ ID NO: 1815793 - protein, 17 aa, Staphylococcus epidermidis
NLEHGKHGFAFGSGMAA

SEQ ID NO: 1815794 - protein, 21 aa, Staphylococcus epidermidis
NMRCSHCAVGYTLQTKDPDPL

SEQ ID NO: 1815795 - protein, 19 aa, Staphylococcus epidermidis
NMSGFRVGFAVGNKKMIQA

SEQ ID NO: 1815796 - protein, 26 aa, Staphylococcus epidermidis
NNVKPNWCPGCGDFSVQAAIQKATAN

SEQ ID NO: 1815797 - protein, 19 aa, Staphylococcus epidermidis
NPSPKWSIARYKGLGEMNA

SEQ ID NO: 1815798 - protein, 18 aa, Staphylococcus epidermidis
NRGAIPYTVFIDPPLSRV

SEQ ID NO: 1815799 - protein, 18 aa, Staphylococcus epidermidis
NRMCKPDFLLNVALNKSK

SEQ ID NO: 1815800 - protein, 20 aa, Staphylococcus epidermidis
NRYGCVLAIEILELLKDVQL

SEQ ID NO: 1815801 - protein, 23 aa, Staphylococcus epidermidis
NSEVKPRVSIVIDHYEDVSTEEV

SEQ ID NO: 1815802 - protein, 25 aa, Staphylococcus epidermidis
NSPFGKGRPGWHIECSVMAYHELGS

SEQ ID NO: 1815803 - protein, 23 aa, Staphylococcus epidermidis
NVELSWHLGVIWRKDAYLNHVTR

SEQ ID NO: 1815804 - protein, 21 aa, Staphylococcus epidermidis
NWPVGMGQNFFGIIDRHSKTI

SEQ ID NO: 1815805 - protein, 24 aa, Staphylococcus epidermidis
NYILKYVFANGISREIIYPLLKEM

SEQ ID NO: 1815806 - protein, 18 aa, Staphylococcus epidermidis
PAPCEQSCVMKINRESVA

SEQ ID NO: 1815807 - protein, 19 aa, Staphylococcus epidermidis
PATNFKEAVQWLYLAYLAA

SEQ ID NO: 1815808 - protein, 23 aa, Staphylococcus epidermidis
PCKNCTRIIPFSSISYLELIDKQ

SEQ ID NO: 1815809 - protein, 21 aa, Staphylococcus epidermidis
PCNECAICKGITQGTNNDVIE

SEQ ID NO: 1815810 - protein, 24 aa, Staphylococcus epidermidis
PDTLRVASLLAHELYEFPSHQLTT

SEQ ID NO: 1815811 - protein, 17 aa, Staphylococcus epidermidis
PDYDFLKTIGIDIHTNE

SEQ ID NO: 1815812 - protein, 18 aa, Staphylococcus epidermidis
PDYINAFWNVVNWEKVNE

SEQ ID NO: 1815813 - protein, 20 aa, Staphylococcus epidermidis
PEFIGRVPIVANLETLDVAA

SEQ ID NO: 1815814 - protein, 17 aa, Staphylococcus epidermidis
PFHPVYILPLVEIVPGK

SEQ ID NO: 1815815 - protein, 20 aa, Staphylococcus epidermidis
PGDEILVAFDLYGGTFRLFD

SEQ ID NO: 1815816 - protein, 20 aa, Staphylococcus epidermidis
PGLTICGGYQFLGHKYITPD

SEQ ID NO: 1815817 - protein, 24 aa, Staphylococcus epidermidis
PGYEAPCYIAWSGKNRSPLVRVPT

SEQ ID NO: 1815818 - protein, 20 aa, Staphylococcus epidermidis
PHLKIKWIRGNIDTRLKKLE

SEQ ID NO: 1815819 - protein, 18 aa, Staphylococcus epidermidis
PIEIPNFEFGKRVIDSTG

SEQ ID NO: 1815820 - protein, 23 aa, Staphylococcus epidermidis
PKKMRRLALRSALSFKVQENSFT

SEQ ID NO: 1815821 - protein, 17 aa, Staphylococcus epidermidis
PNFLKRDKLTISVSTDG

SEQ ID NO: 1815822 - protein, 17 aa, Staphylococcus epidermidis
PQPFEWLNQLAQPYKEE

SEQ ID NO: 1815823 - protein, 18 aa, Staphylococcus epidermidis
PSPLWKVMDFMILDKEEE

SEQ ID NO: 1815824 - protein, 17 aa, Staphylococcus epidermidis
PSVREIGEAVGLASSST

SEQ ID NO: 1815825 - protein, 18 aa, Staphylococcus epidermidis
PTAGLVLGKSGIRRAYET

SEQ ID NO: 1815826 - protein, 20 aa, Staphylococcus epidermidis
PYHYLKRDFGVLGIDMHLHA

SEQ ID NO: 1815827 - protein, 18 aa, Staphylococcus epidermidis
QAIYRRVYEFGVEEKRTL

SEQ ID NO: 1815828 - protein, 21 aa, Staphylococcus epidermidis
QHESFNFFSLFTFHEPVEQVV

SEQ ID NO: 1815829 - protein, 17 aa, Staphylococcus epidermidis
QIKRLKFDYLYIDNARL

SEQ ID NO: 1815830 - protein, 19 aa, Staphylococcus epidermidis
QKFGLRLPGEFNRDAMQEA

SEQ ID NO: 1815831 - protein, 24 aa, Staphylococcus epidermidis
QKYYPNYRYIWSFKNPDKNVVPGS

SEQ ID NO: 1815832 - protein, 19 aa, Staphylococcus epidermidis
QLNVFRMELLGAKVVSVSD

SEQ ID NO: 1815833 - protein, 22 aa, Staphylococcus epidermidis
QMTEMYRLLGIAKYEDRFVVPS

SEQ ID NO: 1815834 - protein, 23 aa, Staphylococcus epidermidis
QNDFLYDRVEVVIATNAFGMGID

SEQ ID NO: 1815835 - protein, 18 aa, Staphylococcus epidermidis
QNEIARWIKIQEDIGLDV

SEQ ID NO: 1815836 - protein, 17 aa, Staphylococcus epidermidis
QNITICSGLIKADKYEW

SEQ ID NO: 1815837 - protein, 23 aa, Staphylococcus epidermidis
QNYKEVAEALGIYNLGNKYPSEI

SEQ ID NO: 1815838 - protein, 21 aa, Staphylococcus epidermidis
QPIIWLCGGLDRGNEFDELIP

SEQ ID NO: 1815839 - protein, 20 aa, Staphylococcus epidermidis
QRALEILNLVGLPRAEKRFK

SEQ ID NO: 1815840 - protein, 21 aa, Staphylococcus epidermidis
QTFKPELLKILGRTHKTEDIY

SEQ ID NO: 1815841 - protein, 25 aa, Staphylococcus epidermidis
QTMKRVAIHFTKLILCNNSNQCELK

SEQ ID NO: 1815842 - protein, 24 aa, Staphylococcus epidermidis
QVLEKFKSLTFISGTLTFNHSFKA

SEQ ID NO: 1815843 - protein, 18 aa, Staphylococcus epidermidis
QWAGSCWYYLRYIDPHNE

SEQ ID NO: 1815844 - protein, 18 aa, Staphylococcus epidermidis
RAEWLFLDVFGWSKTDYL

SEQ ID NO: 1815845 - protein, 20 aa, Staphylococcus epidermidis
RALEEVIYFASYVVVDPGPT

SEQ ID NO: 1815846 - protein, 24 aa, Staphylococcus epidermidis
RARKFGIEVFNVFLSQEPITEDIE

SEQ ID NO: 1815847 - protein, 18 aa, Staphylococcus epidermidis
RATPQWFASINKVRQDIL

SEQ ID NO: 1815848 - protein, 29 aa, Staphylococcus epidermidis
RDVFGYSVSKGWMCVQVFFVRQGNMIKRD

SEQ ID NO: 1815849 - protein, 17 aa, Staphylococcus epidermidis
RELGFLALHGFLHLLGY

SEQ ID NO: 1815850 - protein, 20 aa, Staphylococcus epidermidis
RELQDIIAILGMDELSDEDK

SEQ ID NO: 1815851 - protein, 22 aa, Staphylococcus epidermidis
REREHFTIFPASHFVTREEKMK

SEQ ID NO: 1815852 - protein, 19 aa, Staphylococcus epidermidis
RFYTQRIAHQFNIKGTVQN

SEQ ID NO: 1815853 - protein, 22 aa, Staphylococcus epidermidis
RGIDEYLIRLSVGIEDYNDIEA

SEQ ID NO: 1815854 - protein, 20 aa, Staphylococcus epidermidis
RGYASFMLCRDCGYVPQCPH

SEQ ID NO: 1815855 - protein, 18 aa, Staphylococcus epidermidis
RHKVKCIIFAPEGFAEEK

SEQ ID NO: 1815856 - protein, 17 aa, Staphylococcus epidermidis
RIAVFDLYFRKMPFNSG

SEQ ID NO: 1815857 - protein, 22 aa, Staphylococcus epidermidis
RIRRLLKLYLERESFEIHEARD

SEQ ID NO: 1815858 - protein, 17 aa, Staphylococcus epidermidis
RITSAFVRLQCNIDELH

SEQ ID NO: 1815859 - protein, 17 aa, Staphylococcus epidermidis
RKIPLVLVFEGMDAAGK

SEQ ID NO: 1815860 - protein, 20 aa, Staphylococcus epidermidis
RKKWGEDQVHQWRRSYDVRP

SEQ ID NO: 1815861 - protein, 17 aa, Staphylococcus epidermidis
RKQVLIDHGFRLPSALD

SEQ ID NO: 1815862 - protein, 20 aa, Staphylococcus epidermidis
RKSAKYVGLIPRFSRIFLGD

SEQ ID NO: 1815863 - protein, 18 aa, Staphylococcus epidermidis
RKVAIALRNRYRRSLLKE

SEQ ID NO: 1815864 - protein, 20 aa, Staphylococcus epidermidis
RKYPEVLNQLALLKGKEFEI

SEQ ID NO: 1815865 - protein, 23 aa, Staphylococcus epidermidis
RMERRYKGPIAFEYTHINNNKER

SEQ ID NO: 1815866 - protein, 21 aa, Staphylococcus epidermidis
RMPFIGLQWIFARKGAAASNH

SEQ ID NO: 1815867 - protein, 18 aa, Staphylococcus epidermidis
RMVHELPTFFSSNFNYSE

SEQ ID NO: 1815868 - protein, 20 aa, Staphylococcus epidermidis
RNEGFGMIILEAMVQDNIVI

SEQ ID NO: 1815869 - protein, 17 aa, Staphylococcus epidermidis
RPELSFPADLYFEGSDQ

SEQ ID NO: 1815870 - protein, 20 aa, Staphylococcus epidermidis
RPMMYIALSYDHRIIDGKEA

SEQ ID NO: 1815871 - protein, 17 aa, Staphylococcus epidermidis
RRKEEISAIMVYEAGKP

SEQ ID NO: 1815872 - protein, 17 aa, Staphylococcus epidermidis
RTHFYDYLLLNSDGLTD

SEQ ID NO: 1815873 - protein, 20 aa, Staphylococcus epidermidis
RTIRIPVHMVETINKLIRVQ

SEQ ID NO: 1815874 - protein, 17 aa, Staphylococcus epidermidis
RTYNNLVNLEWIYKERP

SEQ ID NO: 1815875 - protein, 18 aa, Staphylococcus epidermidis
RVKYNSALEKLRNQDDTT

SEQ ID NO: 1815876 - protein, 18 aa, Staphylococcus epidermidis
RYQVEWTKQYDIWFSIYS

SEQ ID NO: 1815877 - protein, 22 aa, Staphylococcus epidermidis
SAYHILDLVFWFGHLSILTKNH

SEQ ID NO: 1815878 - protein, 19 aa, Staphylococcus epidermidis
SEAMIILFSKLFKEKDKAM

SEQ ID NO: 1815879 - protein, 18 aa, Staphylococcus epidermidis
SEGFKVIGYRDVPVDTRA

SEQ ID NO: 1815880 - protein, 18 aa, Staphylococcus epidermidis
SELVKVYPLLNGCVCCDM

SEQ ID NO: 1815881 - protein, 20 aa, Staphylococcus epidermidis
SETKAVVMIGEIGGTAEEEA

SEQ ID NO: 1815882 - protein, 17 aa, Staphylococcus epidermidis
SEVKLGIDLNYILLENF

SEQ ID NO: 1815883 - protein, 22 aa, Staphylococcus epidermidis
SGGKRVRPAFVILSGQFGSNNK

SEQ ID NO: 1815884 - protein, 17 aa, Staphylococcus epidermidis
SGLHLRLDQVPTREPGI

SEQ ID NO: 1815885 - protein, 19 aa, Staphylococcus epidermidis
SGNVRRFISRAGIKDTFEI

SEQ ID NO: 1815886 - protein, 19 aa, Staphylococcus epidermidis
SHEQRFLIVFSDGEPSAFN

SEQ ID NO: 1815887 - protein, 17 aa, Staphylococcus epidermidis
SINWALGLMNEGSQIID

SEQ ID NO: 1815888 - protein, 21 aa, Staphylococcus epidermidis
SKIYYKWLAQLSEALESGEIF

SEQ ID NO: 1815889 - protein, 17 aa, Staphylococcus epidermidis
SLCKEMYDYPYVIFYKG

SEQ ID NO: 1815890 - protein, 19 aa, Staphylococcus epidermidis
SLFKKCYKALINKKETDLI

SEQ ID NO: 1815891 - protein, 17 aa, Staphylococcus epidermidis
SLLPKFKGLDAIGQALE

SEQ ID NO: 1815892 - protein, 18 aa, Staphylococcus epidermidis
SLLPKYRGGAPIHQAIID

SEQ ID NO: 1815893 - protein, 24 aa, Staphylococcus epidermidis
SLQFSVALSTVWKFISRTNKYIDE

SEQ ID NO: 1815894 - protein, 19 aa, Staphylococcus epidermidis
SNYVNFQFDLPIADGSEHT

SEQ ID NO: 1815895 - protein, 19 aa, Staphylococcus epidermidis
SPFHWRLLDKLTLNTLHEV

SEQ ID NO: 1815896 - protein, 17 aa, Staphylococcus epidermidis
SRIGSTFGKTNRVLIDT

SEQ ID NO: 1815897 - protein, 19 aa, Staphylococcus epidermidis
SSLAHRLSKTFGFYEEKEI

SEQ ID NO: 1815898 - protein, 17 aa, Staphylococcus epidermidis
SSMADLGVRVTIIEVAD

SEQ ID NO: 1815899 - protein, 18 aa, Staphylococcus epidermidis
SYDAMAIVEQCRKANLPC

SEQ ID NO: 1815900 - protein, 25 aa, Staphylococcus epidermidis
TAMNRKGYFLYGYRHFSSRIKGGHT

SEQ ID NO: 1815901 - protein, 17 aa, Staphylococcus epidermidis
TDGRMKALVSITLDEAF

SEQ ID NO: 1815902 - protein, 17 aa, Staphylococcus epidermidis
TDRFELFIVGREHANAF

SEQ ID NO: 1815903 - protein, 23 aa, Staphylococcus epidermidis
TDVLVCTVIGFPLGATTTAVKSY

SEQ ID NO: 1815904 - protein, 19 aa, Staphylococcus epidermidis
TEALPNWAAENGYPVTNYE

SEQ ID NO: 1815905 - protein, 17 aa, Staphylococcus epidermidis
TGFDGWAPLFFRGREVS

SEQ ID NO: 1815906 - protein, 18 aa, Staphylococcus epidermidis
TKIKSWVRQLLWMSLYQY

SEQ ID NO: 1815907 - protein, 21 aa, Staphylococcus epidermidis
TLFPQRVDLGLGRAPGTDMMT

SEQ ID NO: 1815908 - protein, 19 aa, Staphylococcus epidermidis
TLKFELFYFDIFRYGTSFV

SEQ ID NO: 1815909 - protein, 18 aa, Staphylococcus epidermidis
TNTFPSWKRAHPNRMLMH

SEQ ID NO: 1815910 - protein, 25 aa, Staphylococcus epidermidis
TSIPLWKNQMAIALTLMRQRNAVSA

SEQ ID NO: 1815911 - protein, 19 aa, Staphylococcus epidermidis
TSLYRPGPMEEIPTYITRR

SEQ ID NO: 1815912 - protein, 20 aa, Staphylococcus epidermidis
TSRIYAKFGKEIYVAAKSGE

SEQ ID NO: 1815913 - protein, 23 aa, Staphylococcus epidermidis
TTDMKGGLMAMVIAMIELKQSNA

SEQ ID NO: 1815914 - protein, 17 aa, Staphylococcus epidermidis
TTPDLSFAVRYLQADAG

SEQ ID NO: 1815915 - protein, 18 aa, Staphylococcus epidermidis
TWAIKFDIYLSIKKKQGI

SEQ ID NO: 1815916 - protein, 17 aa, Staphylococcus epidermidis
VAEPLAVVDACFTPVLA

SEQ ID NO: 1815917 - protein, 21 aa, Staphylococcus epidermidis
VDFRLIEPAAFYHTLQHFTGS

SEQ ID NO: 1815918 - protein, 17 aa, Staphylococcus epidermidis
VDYRLKLKNTRAITANR

SEQ ID NO: 1815919 - protein, 21 aa, Staphylococcus epidermidis
VEKKLPFLFGEDFSFYGQQLA

SEQ ID NO: 1815920 - protein, 23 aa, Staphylococcus epidermidis
VETALKAARRWAYDVKGIEPNKA

SEQ ID NO: 1815921 - protein, 19 aa, Staphylococcus epidermidis
VFLKLPIIGTEVYDESNEI

SEQ ID NO: 1815922 - protein, 20 aa, Staphylococcus epidermidis
VGLIPRFSRIFLGDKEFNKK

SEQ ID NO: 1815923 - protein, 19 aa, Staphylococcus epidermidis
VGVLLPFKSQCFVRHYNKG

SEQ ID NO: 1815924 - protein, 17 aa, Staphylococcus epidermidis
VHKPSGAKPGFVTYDNQ

SEQ ID NO: 1815925 - protein, 18 aa, Staphylococcus epidermidis
VHLSRFAEEIIFWSTDEA

SEQ ID NO: 1815926 - protein, 23 aa, Staphylococcus epidermidis
VKNFRVTKIFGYFGLKREEIEEA

SEQ ID NO: 1815927 - protein, 20 aa, Staphylococcus epidermidis
VKRTCGYLGNPVQRPVIEGR

SEQ ID NO: 1815928 - protein, 18 aa, Staphylococcus epidermidis
VLNKTIPEDLFFIISLSG

SEQ ID NO: 1815929 - protein, 19 aa, Staphylococcus epidermidis
VLRFKRRFGDDVAVLHSGL

SEQ ID NO: 1815930 - protein, 17 aa, Staphylococcus epidermidis
VNFGIVYGISDYGLSQS

SEQ ID NO: 1815931 - protein, 19 aa, Staphylococcus epidermidis
VNGVLPICLGDATKVSDYI

SEQ ID NO: 1815932 - protein, 19 aa, Staphylococcus epidermidis
VPACNEVQCGWAASHSLEG

SEQ ID NO: 1815933 - protein, 21 aa, Staphylococcus epidermidis
VPADQWLRVRAEYLQNRNTNE

SEQ ID NO: 1815934 - protein, 17 aa, Staphylococcus epidermidis
VQPHAKFPPSLRNMYQE

SEQ ID NO: 1815935 - protein, 17 aa, Staphylococcus epidermidis
VRPGAFFLTGCGNKDKG

SEQ ID NO: 1815936 - protein, 22 aa, Staphylococcus epidermidis
VSGGKRPLVCFFSNDLNIHRTK

SEQ ID NO: 1815937 - protein, 22 aa, Staphylococcus epidermidis
VSKSGFGPFAFDEWRYLPDGSD

SEQ ID NO: 1815938 - protein, 23 aa, Staphylococcus epidermidis
VTGFRPVMEIQFLGFVYEVFDEV

SEQ ID NO: 1815939 - protein, 18 aa, Staphylococcus epidermidis
VTTLCPCSKEISEYSAHN

SEQ ID NO: 1815940 - protein, 17 aa, Staphylococcus epidermidis
VVAAICMYALKTAGYQS

SEQ ID NO: 1815941 - protein, 17 aa, Staphylococcus epidermidis
VVEKIKVARSFGDLSEN

SEQ ID NO: 1815942 - protein, 19 aa, Staphylococcus epidermidis
VVIGLRPGRSFNKAKEDGF

SEQ ID NO: 1815943 - protein, 18 aa, Staphylococcus epidermidis
VWMQFRLIKAGIRPINNV

SEQ ID NO: 1815944 - protein, 18 aa, Staphylococcus epidermidis
VYEIFKSTMLKRANENEE

SEQ ID NO: 1815945 - protein, 18 aa, Staphylococcus epidermidis
VYEMRWDIGYVLQQIALF

SEQ ID NO: 1815946 - protein, 18 aa, Staphylococcus epidermidis
WGGATFDVAYNFLKENPW

SEQ ID NO: 1815947 - protein, 19 aa, Staphylococcus epidermidis
WLKDKGVHFDRSFVDMPVG

SEQ ID NO: 1815948 - protein, 21 aa, Staphylococcus epidermidis
WSVHVPRRIKEIGPRIKKVSD

SEQ ID NO: 1815949 - protein, 17 aa, Staphylococcus epidermidis
WWFEKGIDGFRVDAITH

SEQ ID NO: 1815950 - protein, 22 aa, Staphylococcus epidermidis
WWPAETPIEMMLGAILVQNTNW

SEQ ID NO: 1815951 - protein, 25 aa, Staphylococcus epidermidis
YAKKAFKMAIDYAFLVLNMNKVYLY

SEQ ID NO: 1815952 - protein, 22 aa, Staphylococcus epidermidis
YANHIIEAFGMKPYIKKKVNKY

SEQ ID NO: 1815953 - protein, 26 aa, Staphylococcus epidermidis
YDDCLLFFRLGDFYEMFFDDAKEASR

SEQ ID NO: 1815954 - protein, 23 aa, Staphylococcus epidermidis
YDPRKYLGPAREAIKETVKGKIR

SEQ ID NO: 1815955 - protein, 18 aa, Staphylococcus epidermidis
YEESYGFLARPFVRDKDA

SEQ ID NO: 1815956 - protein, 17 aa, Staphylococcus epidermidis
YFFSIANPQPFEWLNQL

SEQ ID NO: 1815957 - protein, 18 aa, Staphylococcus epidermidis
YGAVPIDFAYAIHSEVGN

SEQ ID NO: 1815958 - protein, 18 aa, Staphylococcus epidermidis
YGRIRAMVNDLGKRIKSA

SEQ ID NO: 1815959 - protein, 17 aa, Staphylococcus epidermidis
YHPTWKMILGLFPKEDK

SEQ ID NO: 1815960 - protein, 17 aa, Staphylococcus epidermidis
YKHQIPWIYGGVVQSTY

SEQ ID NO: 1815961 - protein, 19 aa, Staphylococcus epidermidis
YKQSVGFYFDLFEVGDFLK

SEQ ID NO: 1815962 - protein, 18 aa, Staphylococcus epidermidis
YLDGLLFDDIPFLKVAQQ

SEQ ID NO: 1815963 - protein, 18 aa, Staphylococcus epidermidis
YLENQIRNAFGFEGTPIH

SEQ ID NO: 1815964 - protein, 17 aa, Staphylococcus epidermidis
YNKWRGMGTLNSVDVIN

SEQ ID NO: 1815965 - protein, 27 aa, Staphylococcus epidermidis
YRDEKRPRFGLLRGREFLMKDAYSFHS

SEQ ID NO: 1815966 - protein, 19 aa, Staphylococcus epidermidis
YREAFKVNHPLSLGLNTFN

SEQ ID NO: 1815967 - protein, 22 aa, Staphylococcus epidermidis
YRFKSRITVWVLNYLKANQDKL

SEQ ID NO: 1815968 - protein, 18 aa, Staphylococcus epidermidis
YRHFAGSYAVQWKMINYA

SEQ ID NO: 1815969 - protein, 17 aa, Staphylococcus epidermidis
YRLKLKNTRAITANRIK

SEQ ID NO: 1815970 - protein, 21 aa, Staphylococcus epidermidis
YRVGLKLKDGGWVYVQGLTHY

SEQ ID NO: 1815971 - protein, 24 aa, Staphylococcus epidermidis
YSRPRGKFRFPIQVSENEYTQKNE

SEQ ID NO: 1815972 - protein, 18 aa, Staphylococcus epidermidis
YSSAWSFLVPEILQLDEA

SEQ ID NO: 1815973 - protein, 24 aa, Staphylococcus epidermidis
YTMPCARTLVPVDVPLDVSTSEVF

SEQ ID NO: 1815974 - protein, 23 aa, Staphylococcus epidermidis
YTTRLGIRLEKTFEYIDTPHKFK

SEQ ID NO: 1815975 - protein, 26 aa, Staphylococcus epidermidis
YVKKYNCLYLRVDPYLPYQYLNHEGE

SEQ ID NO: 1815976 - protein, 23 aa, Staphylococcus epidermidis
AAELRLGIVSGEIESHIQLSENQ

SEQ ID NO: 1815977 - protein, 21 aa, Staphylococcus epidermidis
AAQRGLPFVIARMGQSETDLH

SEQ ID NO: 1815978 - protein, 19 aa, Staphylococcus epidermidis
ACGTWKLVYQRLQNIERQT

SEQ ID NO: 1815979 - protein, 17 aa, Staphylococcus epidermidis
ADCKLVLENLCHEQVLT

SEQ ID NO: 1815980 - protein, 17 aa, Staphylococcus epidermidis
AEMELRILTQIKEALED

SEQ ID NO: 1815981 - protein, 17 aa, Staphylococcus epidermidis
AESFGAKGLRVTNQEEL

SEQ ID NO: 1815982 - protein, 17 aa, Staphylococcus epidermidis
AHCLSEWGYDFRPHYAL

SEQ ID NO: 1815983 - protein, 18 aa, Staphylococcus epidermidis
AHIHPIFGMTIYLTDGLY

SEQ ID NO: 1815984 - protein, 26 aa, Staphylococcus epidermidis
AIALLFAILKVRSAPFVILDEVEAAL

SEQ ID NO: 1815985 - protein, 18 aa, Staphylococcus epidermidis
AISFLKERGYSVVTIKHH

SEQ ID NO: 1815986 - protein, 24 aa, Staphylococcus epidermidis
AKEGLRLKTLFPYINQASENHKKR

SEQ ID NO: 1815987 - protein, 19 aa, Staphylococcus epidermidis
ALRTRGYRVCIFKPFQTEE

SEQ ID NO: 1815988 - protein, 19 aa, Staphylococcus epidermidis
ALWGARAAFIGGFDSTSNV

SEQ ID NO: 1815989 - protein, 23 aa, Staphylococcus epidermidis
AMIKTAKIVLNWLASERIEVSLL

SEQ ID NO: 1815990 - protein, 18 aa, Staphylococcus epidermidis
AMMFKGNASKLGFEPKEG

SEQ ID NO: 1815991 - protein, 20 aa, Staphylococcus epidermidis
ARAYRLLRVGSFLLSNEGYK

SEQ ID NO: 1815992 - protein, 17 aa, Staphylococcus epidermidis
ARLQLALLMLQRDNVLI

SEQ ID NO: 1815993 - protein, 19 aa, Staphylococcus epidermidis
ARRGELVSCFLLEVDDSLN

SEQ ID NO: 1815994 - protein, 18 aa, Staphylococcus epidermidis
ARRIQFFLSQNFHVAEQF

SEQ ID NO: 1815995 - protein, 17 aa, Staphylococcus epidermidis
ATIKEFRDAKSMLLEEK

SEQ ID NO: 1815996 - protein, 18 aa, Staphylococcus epidermidis
AVVDACFTPVLAPFITLR

SEQ ID NO: 1815997 - protein, 17 aa, Staphylococcus epidermidis
CLHKGCIPTKALLKSAE

SEQ ID NO: 1815998 - protein, 20 aa, Staphylococcus epidermidis
CSAGSRLLVQSSIYDELLPK

SEQ ID NO: 1815999 - protein, 17 aa, Staphylococcus epidermidis
CTPFGSFPVKSPYVGRF

SEQ ID NO: 1816000 - protein, 21 aa, Staphylococcus epidermidis
DEFSHHLGMMFQIKDDLLDVY

SEQ ID NO: 1816001 - protein, 24 aa, Staphylococcus epidermidis
DFEIGFKLYDVFTILYLLDPEAFN

SEQ ID NO: 1816002 - protein, 19 aa, Staphylococcus epidermidis
DFNNLVLVRFFFKSLTAYL

SEQ ID NO: 1816003 - protein, 17 aa, Staphylococcus epidermidis
DFTHWRKIMGVAPISDE

SEQ ID NO: 1816004 - protein, 23 aa, Staphylococcus epidermidis
DGATKEFFSWGFRVGFMTFGIDH

SEQ ID NO: 1816005 - protein, 27 aa, Staphylococcus epidermidis
DIEYKFPFGWGELWGIASRTDYDLRQH

SEQ ID NO: 1816006 - protein, 18 aa, Staphylococcus epidermidis
DLDMLYRMIDIINDTLVS

SEQ ID NO: 1816007 - protein, 21 aa, Staphylococcus epidermidis
DLFIDWIWGESFFKQKLIDYD

SEQ ID NO: 1816008 - protein, 25 aa, Staphylococcus epidermidis
DLPKEMNPFLGYRAIRLCLAQPEIF

SEQ ID NO: 1816009 - protein, 17 aa, Staphylococcus epidermidis
DLVEFDWIEGFDIECRN

SEQ ID NO: 1816010 - protein, 17 aa, Staphylococcus epidermidis
DNGFDFYAPQTFVDADG

SEQ ID NO: 1816011 - protein, 18 aa, Staphylococcus epidermidis
DRALGYGMHGIQVDGNDP

SEQ ID NO: 1816012 - protein, 22 aa, Staphylococcus epidermidis
DRIDVEGPFYFKNLSKEDDFER

SEQ ID NO: 1816013 - protein, 17 aa, Staphylococcus epidermidis
DTLRLEAGLPLHGQDLS

SEQ ID NO: 1816014 - protein, 18 aa, Staphylococcus epidermidis
EAGYKIGVLIGEKGCRNV

SEQ ID NO: 1816015 - protein, 21 aa, Staphylococcus epidermidis
EAIKGKIDWRDTLPDAHFSKI

SEQ ID NO: 1816016 - protein, 22 aa, Staphylococcus epidermidis
EAYRKANTIGFVLSMPHEVNTY

SEQ ID NO: 1816017 - protein, 21 aa, Staphylococcus epidermidis
EDCRRTMDIFKLLGVTIEEQD

SEQ ID NO: 1816018 - protein, 19 aa, Staphylococcus epidermidis
EDTIKWSVNMGADVVLNHK

SEQ ID NO: 1816019 - protein, 17 aa, Staphylococcus epidermidis
EEVKRRIFLGTFALSSG

SEQ ID NO: 1816020 - protein, 19 aa, Staphylococcus epidermidis
EFEFCTPFGSFPVKSPYVG

SEQ ID NO: 1816021 - protein, 25 aa, Staphylococcus epidermidis
EGIKLILKIFEAWQIPIIFVTHSNY

SEQ ID NO: 1816022 - protein, 20 aa, Staphylococcus epidermidis
EGRNCKFIAVKLPYGVQQDA

SEQ ID NO: 1816023 - protein, 19 aa, Staphylococcus epidermidis
EIIPRVNLTEVYRQQDGSS

SEQ ID NO: 1816024 - protein, 25 aa, Staphylococcus epidermidis
EKAHSIRVANDWGITTKDLKIDFTQ

SEQ ID NO: 1816025 - protein, 18 aa, Staphylococcus epidermidis
ENYDALLIPGGFSPDHLR

SEQ ID NO: 1816026 - protein, 19 aa, Staphylococcus epidermidis
EPLCVKIGMELFYQTGPAL

SEQ ID NO: 1816027 - protein, 17 aa, Staphylococcus epidermidis
ERAKAGLFLAMQYPSEI

SEQ ID NO: 1816028 - protein, 25 aa, Staphylococcus epidermidis
ESSALFKKRVKSIVNKAQRVSEETA

SEQ ID NO: 1816029 - protein, 23 aa, Staphylococcus epidermidis
ESTVCILEAMKLFNEIQAETTGE

SEQ ID NO: 1816030 - protein, 25 aa, Staphylococcus epidermidis
ETGSVVLPGRFFVDIIKKLPGKEVK

SEQ ID NO: 1816031 - protein, 19 aa, Staphylococcus epidermidis
EYGATCGFFPVDEESLKYM

SEQ ID NO: 1816032 - protein, 17 aa, Staphylococcus epidermidis
FDAKCIVIPSGETSKSF

SEQ ID NO: 1816033 - protein, 18 aa, Staphylococcus epidermidis
FDHLFWKQFIHNIKTLHS

SEQ ID NO: 1816034 - protein, 19 aa, Staphylococcus epidermidis
FDKVIKYESVFNFDEMIEN

SEQ ID NO: 1816035 - protein, 18 aa, Staphylococcus epidermidis
FDVSRFNADFAYTMDGSQ

SEQ ID NO: 1816036 - protein, 18 aa, Staphylococcus epidermidis
FGATIGRYAGRIENASFK

SEQ ID NO: 1816037 - protein, 19 aa, Staphylococcus epidermidis
FIEDFSIKISDVMTKDNLI

SEQ ID NO: 1816038 - protein, 22 aa, Staphylococcus epidermidis
FKAPRWLVTPIKNYSVKKHKEI

SEQ ID NO: 1816039 - protein, 17 aa, Staphylococcus epidermidis
FKSLGGYEYEDIENRIV

SEQ ID NO: 1816040 - protein, 23 aa, Staphylococcus epidermidis
FKVERLKGVFAWGFRINSSEPEE

SEQ ID NO: 1816041 - protein, 17 aa, Staphylococcus epidermidis
FKVIGYRDVPVDTRAIA

SEQ ID NO: 1816042 - protein, 27 aa, Staphylococcus epidermidis
FLEMKPLYEWLGLSVSLGFVDIPEYEY

SEQ ID NO: 1816043 - protein, 23 aa, Staphylococcus epidermidis
FLNVGENLWGLRDWYSVDDIEEK

SEQ ID NO: 1816044 - protein, 18 aa, Staphylococcus epidermidis
FMAKEGRGLICAPIDKSI

SEQ ID NO: 1816045 - protein, 20 aa, Staphylococcus epidermidis
FNDYGCKILKSFEEAKNKIT

SEQ ID NO: 1816046 - protein, 19 aa, Staphylococcus epidermidis
FRPFPFWKRVHDSFISSDD

SEQ ID NO: 1816047 - protein, 18 aa, Staphylococcus epidermidis
FRTAHEIVGKIVLNCIHK

SEQ ID NO: 1816048 - protein, 20 aa, Staphylococcus epidermidis
FTMVKWDISGTLNYMKPREF

SEQ ID NO: 1816049 - protein, 18 aa, Staphylococcus epidermidis
GDIAVSVYSGWLAYSTFD

SEQ ID NO: 1816050 - protein, 17 aa, Staphylococcus epidermidis
GDTIVVWRLDRLGRNME

SEQ ID NO: 1816051 - protein, 18 aa, Staphylococcus epidermidis
GEIDPVIRFYTWNPATLS

SEQ ID NO: 1816052 - protein, 21 aa, Staphylococcus epidermidis
GFKKKKLDFGWIVSEVPANVA

SEQ ID NO: 1816053 - protein, 19 aa, Staphylococcus epidermidis
GGEKARLQLALLMLQRDNV

SEQ ID NO: 1816054 - protein, 19 aa, Staphylococcus epidermidis
GGFCYELNHLFATYLEHKG

SEQ ID NO: 1816055 - protein, 24 aa, Staphylococcus epidermidis
GGLFTLRLAEHFDLERIAVMSAPH

SEQ ID NO: 1816056 - protein, 23 aa, Staphylococcus epidermidis
GGLRCTACFEMRLEIVAKAALEH

SEQ ID NO: 1816057 - protein, 20 aa, Staphylococcus epidermidis
GHSLRATLVVNRIEERLKKR

SEQ ID NO: 1816058 - protein, 20 aa, Staphylococcus epidermidis
GHTKTIWVWTGFLFEYLKQQ

SEQ ID NO: 1816059 - protein, 20 aa, Staphylococcus epidermidis
GIISIEFASIMIKSGVEVNV

SEQ ID NO: 1816060 - protein, 19 aa, Staphylococcus epidermidis
GITKFRIVPLLIFSAMHYI

SEQ ID NO: 1816061 - protein, 21 aa, Staphylococcus epidermidis
GKAKPGPIISIFGDTKPCENE

SEQ ID NO: 1816062 - protein, 19 aa, Staphylococcus epidermidis
GKMAFRVYPTWEKDLNRVA

SEQ ID NO: 1816063 - protein, 19 aa, Staphylococcus epidermidis
GKNGFGYDPIFFVPELNKT

SEQ ID NO: 1816064 - protein, 18 aa, Staphylococcus epidermidis
GLTIQRYGSTYVLTTKKE

SEQ ID NO: 1816065 - protein, 26 aa, Staphylococcus epidermidis
GMFPKWKGVPIRLAMKLVTFIFGKRR

SEQ ID NO: 1816066 - protein, 17 aa, Staphylococcus epidermidis
GQILRIGHMGKISPFDI

SEQ ID NO: 1816067 - protein, 18 aa, Staphylococcus epidermidis
GRSDYFWDLFIQMPAALM

SEQ ID NO: 1816068 - protein, 21 aa, Staphylococcus epidermidis
GRYGTFAKYFTKNDVPTFAIC

SEQ ID NO: 1816069 - protein, 17 aa, Staphylococcus epidermidis
GSFLAKFLYDLGAKVVG

SEQ ID NO: 1816070 - protein, 18 aa, Staphylococcus epidermidis
GSIIPRPIAFVTTQNLKG

SEQ ID NO: 1816071 - protein, 18 aa, Staphylococcus epidermidis
GTKLKLAIDYGKHDTIGI

SEQ ID NO: 1816072 - protein, 18 aa, Staphylococcus epidermidis
GVASLCIGGGQGIATVVS

SEQ ID NO: 1816073 - protein, 18 aa, Staphylococcus epidermidis
GVSYCAVCDGAFFKNKRL

SEQ ID NO: 1816074 - protein, 17 aa, Staphylococcus epidermidis
GVYRFKRGFNVRIEELI

SEQ ID NO: 1816075 - protein, 18 aa, Staphylococcus epidermidis
GWPSFSKALNDDEIVELV

SEQ ID NO: 1816076 - protein, 19 aa, Staphylococcus epidermidis
HEVKLVFFLAMSKKDLNIN

SEQ ID NO: 1816077 - protein, 23 aa, Staphylococcus epidermidis
HFKQRIIHIPVLYGGDFGPDLSE

SEQ ID NO: 1816078 - protein, 17 aa, Staphylococcus epidermidis
HHWKSWKPLLGDILLQF

SEQ ID NO: 1816079 - protein, 19 aa, Staphylococcus epidermidis
HHYLWRFAKKMPKSGHIEI

SEQ ID NO: 1816080 - protein, 19 aa, Staphylococcus epidermidis
HIAHPTGRIIGRRKGYKAN

SEQ ID NO: 1816081 - protein, 22 aa, Staphylococcus epidermidis
HMPNLWPHLSLIRIPTLILVGE

SEQ ID NO: 1816082 - protein, 19 aa, Staphylococcus epidermidis
HPGLLKRLFEQEVPEIYDG

SEQ ID NO: 1816083 - protein, 19 aa, Staphylococcus epidermidis
HRHVPILGVCLGFQLIIEY

SEQ ID NO: 1816084 - protein, 19 aa, Staphylococcus epidermidis
HYHLPILGTHNMKNAAIAI

SEQ ID NO: 1816085 - protein, 17 aa, Staphylococcus epidermidis
IDHCYRCGYDGDFETTA

SEQ ID NO: 1816086 - protein, 25 aa, Staphylococcus epidermidis
IEKSIWYKLLVNLGINTITAIGQQP

SEQ ID NO: 1816087 - protein, 17 aa, Staphylococcus epidermidis
IFDAVLMTVKYIVRESG

SEQ ID NO: 1816088 - protein, 17 aa, Staphylococcus epidermidis
IHFSQEGYLMWVEDYKY

SEQ ID NO: 1816089 - protein, 17 aa, Staphylococcus epidermidis
IIDEFKSLGGYEYEDIE

SEQ ID NO: 1816090 - protein, 24 aa, Staphylococcus epidermidis
IKALCKRLQISLEEVIVFGDSLND

SEQ ID NO: 1816091 - protein, 21 aa, Staphylococcus epidermidis
IKELKAAVSQPIFNDIEWIIV

SEQ ID NO: 1816092 - protein, 20 aa, Staphylococcus epidermidis
IKESKHIGGFPVSGLFLRCK

SEQ ID NO: 1816093 - protein, 19 aa, Staphylococcus epidermidis
IKKDIGMIFQHFNLLNSKS

SEQ ID NO: 1816094 - protein, 20 aa, Staphylococcus epidermidis
IKMLFLQGIHKKIGYEGSNI

SEQ ID NO: 1816095 - protein, 18 aa, Staphylococcus epidermidis
IKNKIGFVYSEIYFNQKW

SEQ ID NO: 1816096 - protein, 17 aa, Staphylococcus epidermidis
IKTGAPLVYELTDDLVV

SEQ ID NO: 1816097 - protein, 17 aa, Staphylococcus epidermidis
IKYESVFNFDEMIENAV

SEQ ID NO: 1816098 - protein, 17 aa, Staphylococcus epidermidis
IKYWILKILELHCLSYN

SEQ ID NO: 1816099 - protein, 17 aa, Staphylococcus epidermidis
ILGGEPFCNLFITLQLV

SEQ ID NO: 1816100 - protein, 18 aa, Staphylococcus epidermidis
ILNDLGILKKGVFTHDID

SEQ ID NO: 1816101 - protein, 17 aa, Staphylococcus epidermidis
IMCEADWIIDVGPGPGL

SEQ ID NO: 1816102 - protein, 23 aa, Staphylococcus epidermidis
INRAESWLRSNIKEINFQLYNYA

SEQ ID NO: 1816103 - protein, 23 aa, Staphylococcus epidermidis
IPELQGRFPIRVELESLSVEDFV

SEQ ID NO: 1816104 - protein, 17 aa, Staphylococcus epidermidis
IPNCDKITPGMLLAAVR

SEQ ID NO: 1816105 - protein, 18 aa, Staphylococcus epidermidis
IQEGKWKSWGPYLLSGKD

SEQ ID NO: 1816106 - protein, 17 aa, Staphylococcus epidermidis
IRAAGGVARMANPKIVE

SEQ ID NO: 1816107 - protein, 21 aa, Staphylococcus epidermidis
IRSNCGIGFKGFWDNEAGFNY

SEQ ID NO: 1816108 - protein, 17 aa, Staphylococcus epidermidis
ITCKALIGLNAQRLSVS

SEQ ID NO: 1816109 - protein, 24 aa, Staphylococcus epidermidis
ITVNRAGSMIGYFLNEGPVTNFEE

SEQ ID NO: 1816110 - protein, 17 aa, Staphylococcus epidermidis
IYKFRFPILEAIKEVYE

SEQ ID NO: 1816111 - protein, 25 aa, Staphylococcus epidermidis
KALSVKVFYCLKGKCEVTINVQKHI

SEQ ID NO: 1816112 - protein, 24 aa, Staphylococcus epidermidis
KATYKFAGGKGINVSRVLKTLDVD

SEQ ID NO: 1816113 - protein, 22 aa, Staphylococcus epidermidis
KDFEGISFLNLVDFDALYGHRR

SEQ ID NO: 1816114 - protein, 24 aa, Staphylococcus epidermidis
KDPKRPIGSFIFLGPTGVGKTELA

SEQ ID NO: 1816115 - protein, 17 aa, Staphylococcus epidermidis
KDRLNGIIWVFNYFLDE

SEQ ID NO: 1816116 - protein, 18 aa, Staphylococcus epidermidis
KFEKVFADHFLKLYDKTK

SEQ ID NO: 1816117 - protein, 19 aa, Staphylococcus epidermidis
KFGGPKGVGLLLVKEHTPI

SEQ ID NO: 1816118 - protein, 18 aa, Staphylococcus epidermidis
KGAKIAFYVAQWPSSRLD

SEQ ID NO: 1816119 - protein, 23 aa, Staphylococcus epidermidis
KHFDLRPAGIIKMLDLKQPIYRQ

SEQ ID NO: 1816120 - protein, 18 aa, Staphylococcus epidermidis
KICNYCFENGVIIIAVAG

SEQ ID NO: 1816121 - protein, 20 aa, Staphylococcus epidermidis
KIGATVFAGFGPRIVRINDY

SEQ ID NO: 1816122 - protein, 20 aa, Staphylococcus epidermidis
KIIIEYRLHVAFSIDKIEQI

SEQ ID NO: 1816123 - protein, 20 aa, Staphylococcus epidermidis
KKLQVDYVFHPSVDEMYPEE

SEQ ID NO: 1816124 - protein, 20 aa, Staphylococcus epidermidis
KKPANGFVCYMVGRLILENC

SEQ ID NO: 1816125 - protein, 20 aa, Staphylococcus epidermidis
KNANISTCWFNIRQKENHTS

SEQ ID NO: 1816126 - protein, 23 aa, Staphylococcus epidermidis
KQKALELIELVGLKGRESAYPSE

SEQ ID NO: 1816127 - protein, 18 aa, Staphylococcus epidermidis
KQVLPCQFCNYKSVCHVD

SEQ ID NO: 1816128 - protein, 19 aa, Staphylococcus epidermidis
KRHIPMAITTSSYKKNIYP

SEQ ID NO: 1816129 - protein, 17 aa, Staphylococcus epidermidis
KRKGLEDLADWFSQSKL

SEQ ID NO: 1816130 - protein, 21 aa, Staphylococcus epidermidis
KSLAREWSRYGIKVNAIAPGY

SEQ ID NO: 1816131 - protein, 19 aa, Staphylococcus epidermidis
KSSEVPSAIFGTKKRRPIE

SEQ ID NO: 1816132 - protein, 22 aa, Staphylococcus epidermidis
KTNAKRDWYIWADPKPDGSEPN

SEQ ID NO: 1816133 - protein, 18 aa, Staphylococcus epidermidis
LAGPVVACAVILEKNHHY

SEQ ID NO: 1816134 - protein, 19 aa, Staphylococcus epidermidis
LCGRATWSGAVKVYIEEGE

SEQ ID NO: 1816135 - protein, 18 aa, Staphylococcus epidermidis
LDEYICQWIRGLDNIIPR

SEQ ID NO: 1816136 - protein, 19 aa, Staphylococcus epidermidis
LDQLPCWLTYTNGDTHQVI

SEQ ID NO: 1816137 - protein, 25 aa, Staphylococcus epidermidis
LEEMFGVICDFEFKKDYPALYNDPE

SEQ ID NO: 1816138 - protein, 18 aa, Staphylococcus epidermidis
LGYLRYWVAEHHQVYSVV

SEQ ID NO: 1816139 - protein, 21 aa, Staphylococcus epidermidis
LGYRIGYGGGYYDRFLSQHKC

SEQ ID NO: 1816140 - protein, 18 aa, Staphylococcus epidermidis
LHIPSCYLGIAQAARDYA

SEQ ID NO: 1816141 - protein, 18 aa, Staphylococcus epidermidis
LIERGVIEIAPLAYMRGR

SEQ ID NO: 1816142 - protein, 18 aa, Staphylococcus epidermidis
LKEKLTFLSESKMIEVDN

SEQ ID NO: 1816143 - protein, 17 aa, Staphylococcus epidermidis
LKLAIDYGKHDTIGIDA

SEQ ID NO: 1816144 - protein, 18 aa, Staphylococcus epidermidis
LKLFSAFIVKGKKGNPGT

SEQ ID NO: 1816145 - protein, 19 aa, Staphylococcus epidermidis
LKNELRFDAGIDYKKDNFP

SEQ ID NO: 1816146 - protein, 17 aa, Staphylococcus epidermidis
LKQEYGLKFESCATKNL

SEQ ID NO: 1816147 - protein, 18 aa, Staphylococcus epidermidis
LKQPLKRRVPGIELLEEC

SEQ ID NO: 1816148 - protein, 19 aa, Staphylococcus epidermidis
LLEKWLFKYENQFPIYASE

SEQ ID NO: 1816149 - protein, 18 aa, Staphylococcus epidermidis
LLTAYGFKIVDADIASRE

SEQ ID NO: 1816150 - protein, 17 aa, Staphylococcus epidermidis
LRARPKPVVQWSDEVVE

SEQ ID NO: 1816151 - protein, 19 aa, Staphylococcus epidermidis
LRKRIKLVAEQNYGRIKSI

SEQ ID NO: 1816152 - protein, 20 aa, Staphylococcus epidermidis
LRQFFDFITNFGIMIKGTGE

SEQ ID NO: 1816153 - protein, 19 aa, Staphylococcus epidermidis
MCAKLWPQFELFQSFSKKP

SEQ ID NO: 1816154 - protein, 23 aa, Staphylococcus epidermidis
MEHLRLAKYQDLMLISGKQFEVG

SEQ ID NO: 1816155 - protein, 19 aa, Staphylococcus epidermidis
MGGRVALYYAIHGNETLSG

SEQ ID NO: 1816156 - protein, 26 aa, Staphylococcus epidermidis
MIHLSLRAKYLFKYNLDYFIFDGEIV

SEQ ID NO: 1816157 - protein, 22 aa, Staphylococcus epidermidis
MIPRKFEWMEQLPLTSNGKLDR

SEQ ID NO: 1816158 - protein, 18 aa, Staphylococcus epidermidis
MLFRGVHYEICCKDRKGY

SEQ ID NO: 1816159 - protein, 17 aa, Staphylococcus epidermidis
MPQTRFVLKKALEQNLK

SEQ ID NO: 1816160 - protein, 17 aa, Staphylococcus epidermidis
MRFKGTSYTGGFVEGNA

SEQ ID NO: 1816161 - protein, 22 aa, Staphylococcus epidermidis
NDFKYKEHLGVVFDDLRVPDKL

SEQ ID NO: 1816162 - protein, 17 aa, Staphylococcus epidermidis
NDLVFGIGPAGTGKTFL

SEQ ID NO: 1816163 - protein, 19 aa, Staphylococcus epidermidis
NHMLWKGFKPFKITNITQE

SEQ ID NO: 1816164 - protein, 21 aa, Staphylococcus epidermidis
NKEIKSYVIVPAISQEINEFI

SEQ ID NO: 1816165 - protein, 19 aa, Staphylococcus epidermidis
NKLLITIAYRLFMEKHTFT

SEQ ID NO: 1816166 - protein, 24 aa, Staphylococcus epidermidis
NLAEEYQCPVILLSDLQLSLGKQT

SEQ ID NO: 1816167 - protein, 27 aa, Staphylococcus epidermidis
NNKTSECFSFFISYHFNKFDLGIQQLF

SEQ ID NO: 1816168 - protein, 18 aa, Staphylococcus epidermidis
PARAMGMVSVWYKQEDAE

SEQ ID NO: 1816169 - protein, 17 aa, Staphylococcus epidermidis
PCLKCLLQTIPDTGESC

SEQ ID NO: 1816170 - protein, 19 aa, Staphylococcus epidermidis
PEKYYTLSINVDGYDLNLK

SEQ ID NO: 1816171 - protein, 17 aa, Staphylococcus epidermidis
PFPKEWRMHAFFMDALP

SEQ ID NO: 1816172 - protein, 17 aa, Staphylococcus epidermidis
PGFRKGKVPRPIFEQRF

SEQ ID NO: 1816173 - protein, 17 aa, Staphylococcus epidermidis
PGREIYPTYSLEEFVES

SEQ ID NO: 1816174 - protein, 19 aa, Staphylococcus epidermidis
PILGVCLGFQLIIEYFGGN

SEQ ID NO: 1816175 - protein, 25 aa, Staphylococcus epidermidis
PIVMPRLRITYLYARTKKLLKQYNL

SEQ ID NO: 1816176 - protein, 21 aa, Staphylococcus epidermidis
PKDRRAGVITFNLADIHPHDV

SEQ ID NO: 1816177 - protein, 17 aa, Staphylococcus epidermidis
PKGVGLLLVKEHTPIAY

SEQ ID NO: 1816178 - protein, 18 aa, Staphylococcus epidermidis
PKIKVGDTVTEGDIIGYI

SEQ ID NO: 1816179 - protein, 21 aa, Staphylococcus epidermidis
PKPRLPFKHIFHKDQYDANQH

SEQ ID NO: 1816180 - protein, 18 aa, Staphylococcus epidermidis
PLAISGNHLTLGFKENEY

SEQ ID NO: 1816181 - protein, 20 aa, Staphylococcus epidermidis
PMKCLRIIAMFRLINPTKEI

SEQ ID NO: 1816182 - protein, 22 aa, Staphylococcus epidermidis
PNKEFQLLFLLASNPKHIFTRD

SEQ ID NO: 1816183 - protein, 17 aa, Staphylococcus epidermidis
PQLKICACLGLTKEEQA

SEQ ID NO: 1816184 - protein, 19 aa, Staphylococcus epidermidis
PRETMIGSMAYYISHAKNE

SEQ ID NO: 1816185 - protein, 19 aa, Staphylococcus epidermidis
PRLFWPIYYFIQAPIQGLL

SEQ ID NO: 1816186 - protein, 19 aa, Staphylococcus epidermidis
PSSIKAILNQAGFNDEITE

SEQ ID NO: 1816187 - protein, 21 aa, Staphylococcus epidermidis
PYHHPLFLGMGGMHGSYASNM

SEQ ID NO: 1816188 - protein, 21 aa, Staphylococcus epidermidis
PYLEKGNALAFAHGFNIHFSV

SEQ ID NO: 1816189 - protein, 18 aa, Staphylococcus epidermidis
QAKILLLAWNRYLTQTAS

SEQ ID NO: 1816190 - protein, 19 aa, Staphylococcus epidermidis
QAPYKFLLSHGFVMDGEGK

SEQ ID NO: 1816191 - protein, 20 aa, Staphylococcus epidermidis
QDIKAGYNFGSKGIGLVRTE

SEQ ID NO: 1816192 - protein, 18 aa, Staphylococcus epidermidis
QEGYLMWVEDYKYSTIQR

SEQ ID NO: 1816193 - protein, 25 aa, Staphylococcus epidermidis
QIICYDLRFPEILRYPARKGAKIAF

SEQ ID NO: 1816194 - protein, 19 aa, Staphylococcus epidermidis
QPSFSTCFGAPFLPLSPTK

SEQ ID NO: 1816195 - protein, 19 aa, Staphylococcus epidermidis
QRISNFLIWQASYSEFIFN

SEQ ID NO: 1816196 - protein, 18 aa, Staphylococcus epidermidis
QSLEHLLFGLGIRHLGVK

SEQ ID NO: 1816197 - protein, 17 aa, Staphylococcus epidermidis
QTHLKWGAQKEVIRLIP

SEQ ID NO: 1816198 - protein, 19 aa, Staphylococcus epidermidis
RAAPFPKHYLNAIQDYAHK

SEQ ID NO: 1816199 - protein, 17 aa, Staphylococcus epidermidis
REAIPVTVTLDYDQTGK

SEQ ID NO: 1816200 - protein, 20 aa, Staphylococcus epidermidis
REIYPTYSLEEFVESLEKPR

SEQ ID NO: 1816201 - protein, 18 aa, Staphylococcus epidermidis
REPCWKIQAKYAIPNLVQ

SEQ ID NO: 1816202 - protein, 18 aa, Staphylococcus epidermidis
RHFKRRITITDGKISSDE

SEQ ID NO: 1816203 - protein, 21 aa, Staphylococcus epidermidis
RIAPRKVRLVLDLIRGKNAGE

SEQ ID NO: 1816204 - protein, 18 aa, Staphylococcus epidermidis
RIGCTFCASTLGGLKRNL

SEQ ID NO: 1816205 - protein, 17 aa, Staphylococcus epidermidis
RLCKDYQQIWGLSQDVQ

SEQ ID NO: 1816206 - protein, 19 aa, Staphylococcus epidermidis
RLSNELLLHLDAKYSRFIA

SEQ ID NO: 1816207 - protein, 19 aa, Staphylococcus epidermidis
RLTQYIGHLNVVLFAPEDL

SEQ ID NO: 1816208 - protein, 20 aa, Staphylococcus epidermidis
RMILERILPILSERERQIIQ

SEQ ID NO: 1816209 - protein, 23 aa, Staphylococcus epidermidis
RNGPTGTVKLHFMKQYNKFTDID

SEQ ID NO: 1816210 - protein, 17 aa, Staphylococcus epidermidis
RRANIRFKRDAASKPEL

SEQ ID NO: 1816211 - protein, 17 aa, Staphylococcus epidermidis
RREAIKGKIDWRDTLPD

SEQ ID NO: 1816212 - protein, 17 aa, Staphylococcus epidermidis
RRLKQWIDRPLINKQQI

SEQ ID NO: 1816213 - protein, 19 aa, Staphylococcus epidermidis
RRTNLIGAIIPRMNSYAVD

SEQ ID NO: 1816214 - protein, 19 aa, Staphylococcus epidermidis
RSLKFFKYFYTHRGPVMDF

SEQ ID NO: 1816215 - protein, 17 aa, Staphylococcus epidermidis
RVLIDWKRIGRMISIPK

SEQ ID NO: 1816216 - protein, 22 aa, Staphylococcus epidermidis
SASRAYLRPALRRRNLDVETRA

SEQ ID NO: 1816217 - protein, 23 aa, Staphylococcus epidermidis
SCGKCYYCKKGIYAHCENGGGWI

SEQ ID NO: 1816218 - protein, 18 aa, Staphylococcus epidermidis
SDVPLHLYLSVLGMPGQT

SEQ ID NO: 1816219 - protein, 23 aa, Staphylococcus epidermidis
SDWSEVRPEWGLARNAEFIIGKR

SEQ ID NO: 1816220 - protein, 19 aa, Staphylococcus epidermidis
SEHYGLWAFKRVWGTYLSE

SEQ ID NO: 1816221 - protein, 18 aa, Staphylococcus epidermidis
SFDLMFVRWIPRKQNKEA

SEQ ID NO: 1816222 - protein, 17 aa, Staphylococcus epidermidis
SGGFGVRLDAGDGFQGA

SEQ ID NO: 1816223 - protein, 19 aa, Staphylococcus epidermidis
SHYLKVRPGAFFLTGCGNK

SEQ ID NO: 1816224 - protein, 20 aa, Staphylococcus epidermidis
SKIKTVLHGLNFTESDFNKP

SEQ ID NO: 1816225 - protein, 17 aa, Staphylococcus epidermidis
SLWKEWYNLKIVNETAT

SEQ ID NO: 1816226 - protein, 18 aa, Staphylococcus epidermidis
SNELEWLNQLFVAGGLAD

SEQ ID NO: 1816227 - protein, 18 aa, Staphylococcus epidermidis
SPGSLSFVFNDFAVVGDT

SEQ ID NO: 1816228 - protein, 18 aa, Staphylococcus epidermidis
SRFLPGRHYALFNLQGEI

SEQ ID NO: 1816229 - protein, 21 aa, Staphylococcus epidermidis
SRLLKDRIIMLGSQIDDNVAN

SEQ ID NO: 1816230 - protein, 17 aa, Staphylococcus epidermidis
SSIPFLGQNAIKPLLEF

SEQ ID NO: 1816231 - protein, 17 aa, Staphylococcus epidermidis
STKGVSIADNWDMVGMR

SEQ ID NO: 1816232 - protein, 17 aa, Staphylococcus epidermidis
SYAYSMRLTDDFSSINI

SEQ ID NO: 1816233 - protein, 17 aa, Staphylococcus epidermidis
TDIHAVATLAKEHKILL

SEQ ID NO: 1816234 - protein, 22 aa, Staphylococcus epidermidis
TEEYPGVFAFIGSDSKYDLHHP

SEQ ID NO: 1816235 - protein, 21 aa, Staphylococcus epidermidis
TELKRMLCVVMRKDNKKNDIN

SEQ ID NO: 1816236 - protein, 17 aa, Staphylococcus epidermidis
TGRPRTETIIPFQSLGL

SEQ ID NO: 1816237 - protein, 18 aa, Staphylococcus epidermidis
TIFIYGYGASFVVATDLY

SEQ ID NO: 1816238 - protein, 18 aa, Staphylococcus epidermidis
TKDELKEIVTMMVNKLTH

SEQ ID NO: 1816239 - protein, 19 aa, Staphylococcus epidermidis
TLLTIGRFPICYINIQMDP

SEQ ID NO: 1816240 - protein, 19 aa, Staphylococcus epidermidis
TLRLAELFRASTIPAGLIQ

SEQ ID NO: 1816241 - protein, 18 aa, Staphylococcus epidermidis
TRDIKPLNFMTGFSEYKT

SEQ ID NO: 1816242 - protein, 21 aa, Staphylococcus epidermidis
TRFSPFYFKKLWLDAWEETHE

SEQ ID NO: 1816243 - protein, 25 aa, Staphylococcus epidermidis
TSIYNRLGFDFGIVGNHEFNYDLPY

SEQ ID NO: 1816244 - protein, 29 aa, Staphylococcus epidermidis
TSTIIPMCHPLPLTGIDISFKWDSNNDDS

SEQ ID NO: 1816245 - protein, 19 aa, Staphylococcus epidermidis
TTYYNNWLFYYIFAHSFLN

SEQ ID NO: 1816246 - protein, 18 aa, Staphylococcus epidermidis
TYMPLPIFLSHQLAKRLA

SEQ ID NO: 1816247 - protein, 23 aa, Staphylococcus epidermidis
VAEACLKLGVSMINDQWAGLFDS

SEQ ID NO: 1816248 - protein, 20 aa, Staphylococcus epidermidis
VHTYKMKFIKSFKAVNLHQS

SEQ ID NO: 1816249 - protein, 17 aa, Staphylococcus epidermidis
VKEWLRKSARKYGLEAE

SEQ ID NO: 1816250 - protein, 23 aa, Staphylococcus epidermidis
VKLAEALHSIFLEVVIAPQFTEE

SEQ ID NO: 1816251 - protein, 18 aa, Staphylococcus epidermidis
VKRRIFLGTFALSSGYYD

SEQ ID NO: 1816252 - protein, 20 aa, Staphylococcus epidermidis
VLLLTFFFKYMKPLVQAGRV

SEQ ID NO: 1816253 - protein, 18 aa, Staphylococcus epidermidis
VPEARLLVISPYDKSSVA

SEQ ID NO: 1816254 - protein, 19 aa, Staphylococcus epidermidis
VRVGMEMERSELLRKLVDV

SEQ ID NO: 1816255 - protein, 17 aa, Staphylococcus epidermidis
VTYPNKRIEFIIEDAEV

SEQ ID NO: 1816256 - protein, 19 aa, Staphylococcus epidermidis
VVGSWRLEECTLYVTLEPC

SEQ ID NO: 1816257 - protein, 18 aa, Staphylococcus epidermidis
VYEYTSIFEKMRFKGTSY

SEQ ID NO: 1816258 - protein, 20 aa, Staphylococcus epidermidis
WARRVYPELDVESAYIKFID

SEQ ID NO: 1816259 - protein, 19 aa, Staphylococcus epidermidis
WFNVICMFREDGIYYYCNL

SEQ ID NO: 1816260 - protein, 18 aa, Staphylococcus epidermidis
WKPLLGDILLQFLGDPIN

SEQ ID NO: 1816261 - protein, 20 aa, Staphylococcus epidermidis
WKYVEKYGVLGIALDNPLHV

SEQ ID NO: 1816262 - protein, 18 aa, Staphylococcus epidermidis
WLERMGFENVKNVLLNQE

SEQ ID NO: 1816263 - protein, 19 aa, Staphylococcus epidermidis
WNRKAFRGVELYGKTLGVI

SEQ ID NO: 1816264 - protein, 22 aa, Staphylococcus epidermidis
WPSSRLDHWLSLLKARAIENDI

SEQ ID NO: 1816265 - protein, 19 aa, Staphylococcus epidermidis
WSTPFLMRVEENFRPYMHI

SEQ ID NO: 1816266 - protein, 18 aa, Staphylococcus epidermidis
YDIFQIYSPQIWEEIIGM

SEQ ID NO: 1816267 - protein, 17 aa, Staphylococcus epidermidis
YDLFVLVVTDIINSDSK

SEQ ID NO: 1816268 - protein, 17 aa, Staphylococcus epidermidis
YFDIFRYGTSFVTLQVP

SEQ ID NO: 1816269 - protein, 17 aa, Staphylococcus epidermidis
YFHPFRASKQFTIVPSW

SEQ ID NO: 1816270 - protein, 18 aa, Staphylococcus epidermidis
YKLLVEWNKKMNLTSITD

SEQ ID NO: 1816271 - protein, 17 aa, Staphylococcus epidermidis
YLEEFRKGFKQQIENTK

SEQ ID NO: 1816272 - protein, 20 aa, Staphylococcus epidermidis
YLWTILIHRLREWELNDKTY

SEQ ID NO: 1816273 - protein, 17 aa, Staphylococcus epidermidis
YNPLFIYGGVGLGKTHL

SEQ ID NO: 1816274 - protein, 18 aa, Staphylococcus epidermidis
YSRNRWWESTSRPFYLKK

SEQ ID NO: 1816275 - protein, 19 aa, Staphylococcus epidermidis
YSVSIALQLVRKFPTIEKR

SEQ ID NO: 1816276 - protein, 20 aa, Staphylococcus epidermidis
ADVGCGYGPIGLAIGKVSPH

SEQ ID NO: 1816277 - protein, 23 aa, Staphylococcus epidermidis
AGYKPGEDVFLGFDCASSEFYEN

SEQ ID NO: 1816278 - protein, 20 aa, Staphylococcus epidermidis
AKLKGCRVVGIAGGDKKVNY

SEQ ID NO: 1816279 - protein, 18 aa, Staphylococcus epidermidis
AKTLLAYTKHIHVVSPTI

SEQ ID NO: 1816280 - protein, 21 aa, Staphylococcus epidermidis
ANLRLVVSIAKRYVGRGMLFL

SEQ ID NO: 1816281 - protein, 19 aa, Staphylococcus epidermidis
ARIPLSQAVIELCLSPKSN

SEQ ID NO: 1816282 - protein, 18 aa, Staphylococcus epidermidis
DAKKAVVVGGGYIGIEAA

SEQ ID NO: 1816283 - protein, 20 aa, Staphylococcus epidermidis
DAVTRFRQGLGRLIRHEDDK

SEQ ID NO: 1816284 - protein, 23 aa, Staphylococcus epidermidis
DFKGSWNVVCFYPADFSFVCPTE

SEQ ID NO: 1816285 - protein, 18 aa, Staphylococcus epidermidis
DLISRYAGIRVPRNKAIV

SEQ ID NO: 1816286 - protein, 18 aa, Staphylococcus epidermidis
DPELCVLKVIPRSIKLMN

SEQ ID NO: 1816287 - protein, 20 aa, Staphylococcus epidermidis
DPKRDLAIYIDIAERAGQKA

SEQ ID NO: 1816288 - protein, 20 aa, Staphylococcus epidermidis
DSFCVLNHLFVNGGNEEVFE

SEQ ID NO: 1816289 - protein, 24 aa, Staphylococcus epidermidis
DVDMLRMCRYPWKTKQRILSDMGH

SEQ ID NO: 1816290 - protein, 18 aa, Staphylococcus epidermidis
EEPFNFGATIGRYAGRIE

SEQ ID NO: 1816291 - protein, 24 aa, Staphylococcus epidermidis
EGMDTWDFAHCLPYFKKLETTYGA

SEQ ID NO: 1816292 - protein, 20 aa, Staphylococcus epidermidis
ELKTRLSKFLPKEVTQYNVE

SEQ ID NO: 1816293 - protein, 18 aa, Staphylococcus epidermidis
ELLFRIKAVLRRYQINAD

SEQ ID NO: 1816294 - protein, 18 aa, Staphylococcus epidermidis
ENIPLWVDRDCPFNIEGG

SEQ ID NO: 1816295 - protein, 18 aa, Staphylococcus epidermidis
ENYFKPEHINVIKCDLMQ

SEQ ID NO: 1816296 - protein, 23 aa, Staphylococcus epidermidis
EQPEIYICGGTKFLHSIINSLKE

SEQ ID NO: 1816297 - protein, 17 aa, Staphylococcus epidermidis
EQSQCKRAIILPNNKNI

SEQ ID NO: 1816298 - protein, 22 aa, Staphylococcus epidermidis
EQTEVRLVLSFLRTIDNPLQDI

SEQ ID NO: 1816299 - protein, 18 aa, Staphylococcus epidermidis
FEGTIIFVSHDRYFINQL

SEQ ID NO: 1816300 - protein, 19 aa, Staphylococcus epidermidis
FELRKKRMMEIRDDINVHY

SEQ ID NO: 1816301 - protein, 18 aa, Staphylococcus epidermidis
FISWTGKMAETFVLAHEL

SEQ ID NO: 1816302 - protein, 24 aa, Staphylococcus epidermidis
FKFDKAFISCGSFDTSDCYEFDLE

SEQ ID NO: 1816303 - protein, 23 aa, Staphylococcus epidermidis
FKNPKRILGSFFIKHHGYRVRID

SEQ ID NO: 1816304 - protein, 24 aa, Staphylococcus epidermidis
FLNPDHMLLILGIEKGWFKEESLE

SEQ ID NO: 1816305 - protein, 24 aa, Staphylococcus epidermidis
FNDRKRLLPSIAYLEGEYGCSDIC

SEQ ID NO: 1816306 - protein, 21 aa, Staphylococcus epidermidis
FRGDIFGGYILYNLGFIESED

SEQ ID NO: 1816307 - protein, 19 aa, Staphylococcus epidermidis
FYHPEFKKEYVVLAEEGAQ

SEQ ID NO: 1816308 - protein, 17 aa, Staphylococcus epidermidis
GAIKFALTQSYRFSKAA

SEQ ID NO: 1816309 - protein, 17 aa, Staphylococcus epidermidis
GGIPCIFNHQWSNERIH

SEQ ID NO: 1816310 - protein, 21 aa, Staphylococcus epidermidis
GMGRIGRMVLRIALNNKNLNV

SEQ ID NO: 1816311 - protein, 20 aa, Staphylococcus epidermidis
GNELPISAGFFIINPFEVVY

SEQ ID NO: 1816312 - protein, 20 aa, Staphylococcus epidermidis
GVWHPRAWHSAPRPIPLPNQ

SEQ ID NO: 1816313 - protein, 17 aa, Staphylococcus epidermidis
GYGPIGLAIGKVSPHHQ

SEQ ID NO: 1816314 - protein, 18 aa, Staphylococcus epidermidis
HCFGCKKGGNVFQFTQEI

SEQ ID NO: 1816315 - protein, 17 aa, Staphylococcus epidermidis
HLVSPVITDVKAATQSL

SEQ ID NO: 1816316 - protein, 24 aa, Staphylococcus epidermidis
HNCQSFCISVAFITESGLASLKSH

SEQ ID NO: 1816317 - protein, 20 aa, Staphylococcus epidermidis
HPKGSGLGLYGMRERAELVN

SEQ ID NO: 1816318 - protein, 20 aa, Staphylococcus epidermidis
HTPESISFLLTDEGAGAQVP

SEQ ID NO: 1816319 - protein, 17 aa, Staphylococcus epidermidis
IDQHIPYTVLRDNIYTH

SEQ ID NO: 1816320 - protein, 22 aa, Staphylococcus epidermidis
IEPLKSLRVMGKFGDSVTTDHI

SEQ ID NO: 1816321 - protein, 17 aa, Staphylococcus epidermidis
IFNHQWSNERIHQLVKS

SEQ ID NO: 1816322 - protein, 17 aa, Staphylococcus epidermidis
IKNGWKMNDFVGPVDHG

SEQ ID NO: 1816323 - protein, 18 aa, Staphylococcus epidermidis
IKSAMSIGDTCPICGNEI

SEQ ID NO: 1816324 - protein, 18 aa, Staphylococcus epidermidis
INAALKYVVECGANVVGL

SEQ ID NO: 1816325 - protein, 17 aa, Staphylococcus epidermidis
IQFKIKHLMVSQVKGTF

SEQ ID NO: 1816326 - protein, 21 aa, Staphylococcus epidermidis
IQPRMDICFVREKGSGTRFYQ

SEQ ID NO: 1816327 - protein, 18 aa, Staphylococcus epidermidis
ISAGFFIINPFEVVYYAG

SEQ ID NO: 1816328 - protein, 17 aa, Staphylococcus epidermidis
ISLHYTREMVDQAISGK

SEQ ID NO: 1816329 - protein, 18 aa, Staphylococcus epidermidis
ISPTHFVKSWLLDARAPK

SEQ ID NO: 1816330 - protein, 21 aa, Staphylococcus epidermidis
IVLNCIHKGIYLLDVPLSEYQ

SEQ ID NO: 1816331 - protein, 17 aa, Staphylococcus epidermidis
KATLSFRTMDLIHTPYH

SEQ ID NO: 1816332 - protein, 23 aa, Staphylococcus epidermidis
KELPMEYAVEMNRLIKFEMEGSI

SEQ ID NO: 1816333 - protein, 19 aa, Staphylococcus epidermidis
KFTTCGFNNCIFEDVHFYK

SEQ ID NO: 1816334 - protein, 19 aa, Staphylococcus epidermidis
KGLLCVYEGFLKGLKGEKI

SEQ ID NO: 1816335 - protein, 21 aa, Staphylococcus epidermidis
KGVDFLIAGGLDFEKIKRLEI

SEQ ID NO: 1816336 - protein, 21 aa, Staphylococcus epidermidis
KMKELQDFIARFSANASKSKQ

SEQ ID NO: 1816337 - protein, 23 aa, Staphylococcus epidermidis
KNYDIPLYLGRTLSNVKGTWIMS

SEQ ID NO: 1816338 - protein, 21 aa, Staphylococcus epidermidis
KRFALPNAEVMIHQPLGGAQG

SEQ ID NO: 1816339 - protein, 17 aa, Staphylococcus epidermidis
KSIRKFNQWEIDYVSCS

SEQ ID NO: 1816340 - protein, 20 aa, Staphylococcus epidermidis
KSIVGPFAYYIKGFEMLPQM

SEQ ID NO: 1816341 - protein, 17 aa, Staphylococcus epidermidis
KSPMVGTFFLQDSKELT

SEQ ID NO: 1816342 - protein, 17 aa, Staphylococcus epidermidis
KSRPYIANMLRLLQLPK

SEQ ID NO: 1816343 - protein, 18 aa, Staphylococcus epidermidis
KSSGRMVGIISHVSELKQ

SEQ ID NO: 1816344 - protein, 19 aa, Staphylococcus epidermidis
KSTRLESSLFFPPYKGKFK

SEQ ID NO: 1816345 - protein, 19 aa, Staphylococcus epidermidis
KWSKVAFVFPESQRSLIPE

SEQ ID NO: 1816346 - protein, 17 aa, Staphylococcus epidermidis
LGFRGDIFGGYILYNLG

SEQ ID NO: 1816347 - protein, 17 aa, Staphylococcus epidermidis
LGGTCLHKGCIPTKALL

SEQ ID NO: 1816348 - protein, 24 aa, Staphylococcus epidermidis
LGIEEYKPHIAIITNIYSAHLDYH

SEQ ID NO: 1816349 - protein, 18 aa, Staphylococcus epidermidis
LGLNSNWDMLFIVFSIHL

SEQ ID NO: 1816350 - protein, 18 aa, Staphylococcus epidermidis
LHPDLDTWVIFPWTAGQG

SEQ ID NO: 1816351 - protein, 19 aa, Staphylococcus epidermidis
LIHEVFKDYGILLIDAQYP

SEQ ID NO: 1816352 - protein, 17 aa, Staphylococcus epidermidis
LKFDYLYIDNARLKSPY

SEQ ID NO: 1816353 - protein, 19 aa, Staphylococcus epidermidis
LKGGQTIGLFSYGSGSVGE

SEQ ID NO: 1816354 - protein, 18 aa, Staphylococcus epidermidis
LKLKLQFFAEEPGDNAQT

SEQ ID NO: 1816355 - protein, 17 aa, Staphylococcus epidermidis
LKSLKLNGYMVVIDTGV

SEQ ID NO: 1816356 - protein, 20 aa, Staphylococcus epidermidis
LLKNSRFGFKMGNQTLEDSM

SEQ ID NO: 1816357 - protein, 23 aa, Staphylococcus epidermidis
LNAELRPGIDVVLEETQFKQRIK

SEQ ID NO: 1816358 - protein, 18 aa, Staphylococcus epidermidis
LNICEGFSPLIANEIVNR

SEQ ID NO: 1816359 - protein, 17 aa, Staphylococcus epidermidis
LPLIKRLSSKQVRLNVT

SEQ ID NO: 1816360 - protein, 30 aa, Staphylococcus epidermidis
LRVVVDLSLEPKLFLQICCIGAGIPQINKK

SEQ ID NO: 1816361 - protein, 19 aa, Staphylococcus epidermidis
LSKAALEMMIFHIVQQHES

SEQ ID NO: 1816362 - protein, 20 aa, Staphylococcus epidermidis
LSRRRIRHIVGYVPQDIALF

SEQ ID NO: 1816363 - protein, 20 aa, Staphylococcus epidermidis
LTGACPMGPYIVTKDELPAP

SEQ ID NO: 1816364 - protein, 17 aa, Staphylococcus epidermidis
LTKGFPLLTTKKVSFKL

SEQ ID NO: 1816365 - protein, 17 aa, Staphylococcus epidermidis
LTLGHSGLTALFWNHGH

SEQ ID NO: 1816366 - protein, 17 aa, Staphylococcus epidermidis
MDHRHLWLRSKKQHAVM

SEQ ID NO: 1816367 - protein, 33 aa, Staphylococcus epidermidis
MSLVLRPDVPFSMIPKFNLFIALGIRDAIQQFS

SEQ ID NO: 1816368 - protein, 19 aa, Staphylococcus epidermidis
MYKERGFEIKPEIAGLMIS

SEQ ID NO: 1816369 - protein, 19 aa, Staphylococcus epidermidis
NELLQRFKFDKAFISCGSF

SEQ ID NO: 1816370 - protein, 23 aa, Staphylococcus epidermidis
NGILRTVMRTELPSFEDIDDTKK

SEQ ID NO: 1816371 - protein, 23 aa, Staphylococcus epidermidis
NINAIELFKGMGFQIEGELKDKL

SEQ ID NO: 1816372 - protein, 25 aa, Staphylococcus epidermidis
NKKLIIDGTIHWRKEGNNLGFKDTT

SEQ ID NO: 1816373 - protein, 18 aa, Staphylococcus epidermidis
NLLFLSFAGALAYQIHAK

SEQ ID NO: 1816374 - protein, 22 aa, Staphylococcus epidermidis
NPRFKRWVIGSILSRTYYHNMV

SEQ ID NO: 1816375 - protein, 18 aa, Staphylococcus epidermidis
NYYPRPDTGLSISFIEEK

SEQ ID NO: 1816376 - protein, 20 aa, Staphylococcus epidermidis
PEGIAAKVLVSFNITEDKVI

SEQ ID NO: 1816377 - protein, 24 aa, Staphylococcus epidermidis
PETEVINVFPIRFVVDKDNEVSDP

SEQ ID NO: 1816378 - protein, 17 aa, Staphylococcus epidermidis
PETPAIIVTRGLEPPEE

SEQ ID NO: 1816379 - protein, 19 aa, Staphylococcus epidermidis
PFGKCHFALAAKPETSCYK

SEQ ID NO: 1816380 - protein, 17 aa, Staphylococcus epidermidis
PGLTGLEILSYVRKKQL

SEQ ID NO: 1816381 - protein, 23 aa, Staphylococcus epidermidis
PHNKIWLDPGIGFAKTREEENEV

SEQ ID NO: 1816382 - protein, 18 aa, Staphylococcus epidermidis
PIKLRKRVWRRLAKDLKP

SEQ ID NO: 1816383 - protein, 21 aa, Staphylococcus epidermidis
PIKRIANHRVLAMNRGEKEKV

SEQ ID NO: 1816384 - protein, 17 aa, Staphylococcus epidermidis
PIMSRPVKNMTVAIIGT

SEQ ID NO: 1816385 - protein, 17 aa, Staphylococcus epidermidis
PKGMCKTCEGLGYIEDI

SEQ ID NO: 1816386 - protein, 22 aa, Staphylococcus epidermidis
PKLKELWPKAGDYLLVTLRIDS

SEQ ID NO: 1816387 - protein, 26 aa, Staphylococcus epidermidis
PQEMPSRIPIGLPISGTTVYVMQGNR

SEQ ID NO: 1816388 - protein, 20 aa, Staphylococcus epidermidis
PRVLGDIIICTDVAKEQSES

SEQ ID NO: 1816389 - protein, 19 aa, Staphylococcus epidermidis
PVIGICLGMQLLFQHSAEG

SEQ ID NO: 1816390 - protein, 19 aa, Staphylococcus epidermidis
QLRAKLFVDQIVSFVTNSP

SEQ ID NO: 1816391 - protein, 18 aa, Staphylococcus epidermidis
QTLLSLPFDYMFFTGSEK

SEQ ID NO: 1816392 - protein, 22 aa, Staphylococcus epidermidis
QVISLRANHYFNPRKTHNKQGE

SEQ ID NO: 1816393 - protein, 20 aa, Staphylococcus epidermidis
RANHVIKCFLQVNVSGEESK

SEQ ID NO: 1816394 - protein, 17 aa, Staphylococcus epidermidis
RDLFKYIPFDGSIITIS

SEQ ID NO: 1816395 - protein, 23 aa, Staphylococcus epidermidis
RDLKHFRLGISVSKKLGNAVTRN

SEQ ID NO: 1816396 - protein, 20 aa, Staphylococcus epidermidis
RERICDAAIQLMENIKYVNA

SEQ ID NO: 1816397 - protein, 20 aa, Staphylococcus epidermidis
RGFEIKPEIAGLMISAIISD

SEQ ID NO: 1816398 - protein, 20 aa, Staphylococcus epidermidis
RMLQRPILYTGLTRAKQSLV

SEQ ID NO: 1816399 - protein, 17 aa, Staphylococcus epidermidis
RNAGIDFCCGGQESIAS

SEQ ID NO: 1816400 - protein, 19 aa, Staphylococcus epidermidis
RPDTGLSISFIEEKNQLIR

SEQ ID NO: 1816401 - protein, 17 aa, Staphylococcus epidermidis
RVYKYKFGITFPIHAKI

SEQ ID NO: 1816402 - protein, 19 aa, Staphylococcus epidermidis
SELPHNVVFIFQPAEETGG

SEQ ID NO: 1816403 - protein, 19 aa, Staphylococcus epidermidis
SFIEMCLLLPNLNEQQYSS

SEQ ID NO: 1816404 - protein, 20 aa, Staphylococcus epidermidis
SHGLALGRLRGVEFDVAIFS

SEQ ID NO: 1816405 - protein, 17 aa, Staphylococcus epidermidis
SIDSGKVLPIFQHATES

SEQ ID NO: 1816406 - protein, 20 aa, Staphylococcus epidermidis
SVACPGFVPLVEQMRYKDPT

SEQ ID NO: 1816407 - protein, 24 aa, Staphylococcus epidermidis
TCYQFKVPFIVTRAVSDLANGKAD

SEQ ID NO: 1816408 - protein, 23 aa, Staphylococcus epidermidis
TIHRFTRKLGFDGYSDFKSFLKF

SEQ ID NO: 1816409 - protein, 20 aa, Staphylococcus epidermidis
TLDHIKHFIAIYTQTLVTPL

SEQ ID NO: 1816410 - protein, 19 aa, Staphylococcus epidermidis
TNHYWKYVEKYGVLGIALD

SEQ ID NO: 1816411 - protein, 18 aa, Staphylococcus epidermidis
VATRRAKTLLAYTKHIHV

SEQ ID NO: 1816412 - protein, 21 aa, Staphylococcus epidermidis
VEIAIKMAYQYWKNIDAERYA

SEQ ID NO: 1816413 - protein, 17 aa, Staphylococcus epidermidis
VIFIGLICKNAVWHAVV

SEQ ID NO: 1816414 - protein, 19 aa, Staphylococcus epidermidis
VILQAAFELGERINSTSTF

SEQ ID NO: 1816415 - protein, 18 aa, Staphylococcus epidermidis
VQSALNFKFMKRINEAGI

SEQ ID NO: 1816416 - protein, 20 aa, Staphylococcus epidermidis
VVAGRGELHLSILIENMRRE

SEQ ID NO: 1816417 - protein, 22 aa, Staphylococcus epidermidis
VVEGPLWIQVHAFEKGVEVTIS

SEQ ID NO: 1816418 - protein, 18 aa, Staphylococcus epidermidis
WRNECGYTIKPVSETNDV

SEQ ID NO: 1816419 - protein, 19 aa, Staphylococcus epidermidis
YDLLMVMSHVGIFFDEKLC

SEQ ID NO: 1816420 - protein, 19 aa, Staphylococcus epidermidis
YGIGRRISLHYTREMVDQA

SEQ ID NO: 1816421 - protein, 18 aa, Staphylococcus epidermidis
YKIGVLIGEKGCRNVHFF

SEQ ID NO: 1816422 - protein, 17 aa, Staphylococcus epidermidis
YLPVLAIAIGKKAQDAH

SEQ ID NO: 1816423 - protein, 22 aa, Staphylococcus epidermidis
YRIHKGFHMLRFEGINNINEIE

SEQ ID NO: 1816424 - protein, 19 aa, Staphylococcus epidermidis
YRTNLYMTMFRFREHRIVA

SEQ ID NO: 1816425 - protein, 17 aa, Staphylococcus epidermidis
AAEWAIPLLPKEHVTLL

SEQ ID NO: 1816426 - protein, 22 aa, Staphylococcus epidermidis
AGYKPGEDVFLGFDCASSEFYE

SEQ ID NO: 1816427 - protein, 19 aa, Staphylococcus epidermidis
AGYSACFNSALSLILSQNK

SEQ ID NO: 1816428 - protein, 19 aa, Staphylococcus epidermidis
AKHIVFICGHYEGYDERIR

SEQ ID NO: 1816429 - protein, 22 aa, Staphylococcus epidermidis
ANAESKERCQLLINPIRDEILN

SEQ ID NO: 1816430 - protein, 20 aa, Staphylococcus epidermidis
ANLRLVVSIAKRYVGRGMLF

SEQ ID NO: 1816431 - protein, 18 aa, Staphylococcus epidermidis
ANLSPGTRVHFVEVPEED

SEQ ID NO: 1816432 - protein, 17 aa, Staphylococcus epidermidis
APGGKACHMAEILSPEG

SEQ ID NO: 1816433 - protein, 18 aa, Staphylococcus epidermidis
AQVVIRWNIQHDVVVIPK

SEQ ID NO: 1816434 - protein, 18 aa, Staphylococcus epidermidis
ARELKVSNALLYTDSKLI

SEQ ID NO: 1816435 - protein, 20 aa, Staphylococcus epidermidis
ARLTNFGAFIDIGGVDGLVH

SEQ ID NO: 1816436 - protein, 17 aa, Staphylococcus epidermidis
ARYKNWFPNFTLSDLIS

SEQ ID NO: 1816437 - protein, 22 aa, Staphylococcus epidermidis
ASHAQYRLGIRPEDLHLVNDNE

SEQ ID NO: 1816438 - protein, 18 aa, Staphylococcus epidermidis
AYVKISLIGSGMRDMSGV

SEQ ID NO: 1816439 - protein, 17 aa, Staphylococcus epidermidis
CFGCKKGGNVFQFTQEI

SEQ ID NO: 1816440 - protein, 19 aa, Staphylococcus epidermidis
CKPDHPFVYWATFSNAADL

SEQ ID NO: 1816441 - protein, 18 aa, Staphylococcus epidermidis
CMTCGVCLEVCPNVTKNN

SEQ ID NO: 1816442 - protein, 17 aa, Staphylococcus epidermidis
CYLGDFKTTGGIFATTE

SEQ ID NO: 1816443 - protein, 19 aa, Staphylococcus epidermidis
DANLSPGTRVHFVEVPEED

SEQ ID NO: 1816444 - protein, 18 aa, Staphylococcus epidermidis
DARYKNWFPNFTLSDLIS

SEQ ID NO: 1816445 - protein, 21 aa, Staphylococcus epidermidis
DAVTRFRQGLGRLIRHEDDKG

SEQ ID NO: 1816446 - protein, 20 aa, Staphylococcus epidermidis
DIAEINGFWVYHNTKNKQFT

SEQ ID NO: 1816447 - protein, 17 aa, Staphylococcus epidermidis
DLKAHRMVNVILDKEAA

SEQ ID NO: 1816448 - protein, 23 aa, Staphylococcus epidermidis
DMGELRGKIFYKEHYKTRVVSHV

SEQ ID NO: 1816449 - protein, 24 aa, Staphylococcus epidermidis
DMGELRGKIFYKEHYKTRVVSHVE

SEQ ID NO: 1816450 - protein, 17 aa, Staphylococcus epidermidis
DNLICLANEFKEALNKP

SEQ ID NO: 1816451 - protein, 21 aa, Staphylococcus epidermidis
DVDMLRMCRYPWKTKQRILSD

SEQ ID NO: 1816452 - protein, 20 aa, Staphylococcus epidermidis
EAKHIVFICGHYEGYDERIR

SEQ ID NO: 1816453 - protein, 19 aa, Staphylococcus epidermidis
EAYVKISLIGSGMRDMSGV

SEQ ID NO: 1816454 - protein, 17 aa, Staphylococcus epidermidis
EGIAAKVLESFNITEDK

SEQ ID NO: 1816455 - protein, 30 aa, Staphylococcus epidermidis; identical to SEQ ID NO: 1678130

SEQ ID NO: 1816456 - protein, 21 aa, Staphylococcus epidermidis
EQLSNMWLYRHFILHLDQLDS

SEQ ID NO: 1816457 - protein, 17 aa, Staphylococcus epidermidis
ERLKLQLLDEVKSVFNS

SEQ ID NO: 1816458 - protein, 18 aa, Staphylococcus epidermidis
EVIPRNVIHIGFTSGTTG

SEQ ID NO: 1816459 - protein, 21 aa, Staphylococcus epidermidis
EYYLPDVLSLILKDGGKAEVY

SEQ ID NO: 1816460 - protein, 19 aa, Staphylococcus epidermidis
FFGICLGHQLFALSQGATS

SEQ ID NO: 1816461 - protein, 19 aa, Staphylococcus epidermidis
FIVKTRFGGYDGKGQILVR

SEQ ID NO: 1816462 - protein, 18 aa, Staphylococcus epidermidis
FKSYLFIRLKFYLIDLFR

SEQ ID NO: 1816463 - protein, 24 aa, Staphylococcus epidermidis
FLPHCFKFGIKNAIRIYNHNTSKS

SEQ ID NO: 1816464 - protein, 21 aa, Staphylococcus epidermidis
FLRKRYETLKTLPMFDTIEYT

SEQ ID NO: 1816465 - protein, 21 aa, Staphylococcus epidermidis
FLRKRYETLRTLPMFDTIEYT

SEQ ID NO: 1816466 - protein, 21 aa, Staphylococcus epidermidis
FPILLASWKLGPALAAGNTVV

SEQ ID NO: 1816467 - protein, 17 aa, Staphylococcus epidermidis
FSGGFPGDFIAQTLEDS

SEQ ID NO: 1816468 - protein, 17 aa, Staphylococcus epidermidis
FSKDLGYWVDMDSPYIT

SEQ ID NO: 1816469 - protein, 19 aa, Staphylococcus epidermidis
FTRKLGFDGYSDFKSFLKF

SEQ ID NO: 1816470 - protein, 22 aa, Staphylococcus epidermidis
FTSVEIDLFFAMCNKLKEQDTN

SEQ ID NO: 1816471 - protein, 20 aa, Staphylococcus epidermidis
FVLEPSYSFSIITSATQQPD

SEQ ID NO: 1816472 - protein, 21 aa, Staphylococcus epidermidis
FVLEPSYSFSIITSATQQPDL

SEQ ID NO: 1816473 - protein, 17 aa, Staphylococcus epidermidis
GDLFIKSRMDKLCSEIY

SEQ ID NO: 1816474 - protein, 17 aa, Staphylococcus epidermidis
GFLLDGFPRTIDQAESL

SEQ ID NO: 1816475 - protein, 18 aa, Staphylococcus epidermidis
GGVSYIFPSDVEKFKKVN

SEQ ID NO: 1816476 - protein, 17 aa, Staphylococcus epidermidis
GIARPAAAHALHYDKLP

SEQ ID NO: 1816477 - protein, 22 aa, Staphylococcus epidermidis
GKRFALPNAEVMIHQPLGGAQG

SEQ ID NO: 1816478 - protein, 18 aa, Staphylococcus epidermidis
GKVARLTNFGAFIDIGGV

SEQ ID NO: 1816479 - protein, 23 aa, Staphylococcus epidermidis
GKVARLTNFGAFIDIGGVDGLVH

SEQ ID NO: 1816480 - protein, 17 aa, Staphylococcus epidermidis
GLNSNWDMLFIVFSIHL

SEQ ID NO: 1816481 - protein, 17 aa, Staphylococcus epidermidis
GPNIKLPSYQLLEAPEP

SEQ ID NO: 1816482 - protein, 18 aa, Staphylococcus epidermidis
IDLYRPVPNFKNISQVKS

SEQ ID NO: 1816483 - protein, 27 aa, Staphylococcus epidermidis
IFQHFNLLWSRNVLKNVTFPLEIAGVP

SEQ ID NO: 1816484 - protein, 26 aa, Staphylococcus epidermidis
IFQHFNLLWSRSVLKNVTFPLEIAGV

SEQ ID NO: 1816485 - protein, 23 aa, Staphylococcus epidermidis
IFRKLNIEWVYRVLIDWKRIGRM

SEQ ID NO: 1816486 - protein, 18 aa, Staphylococcus epidermidis
IGLLKIDFLGLRNLSIIH

SEQ ID NO: 1816487 - protein, 18 aa, Staphylococcus epidermidis
IHGRIFISLAVKFSKARL

SEQ ID NO: 1816488 - protein, 18 aa, Staphylococcus epidermidis
IKYWAELKGVFDTLNVEM

SEQ ID NO: 1816489 - protein, 18 aa, Staphylococcus epidermidis
INEAGIPIVFVINQIDKH

SEQ ID NO: 1816490 - protein, 22 aa, Staphylococcus epidermidis
INKSRGKWCIKLSTGDKMITDC

SEQ ID NO: 1816491 - protein, 21 aa, Staphylococcus epidermidis
IPETRRSTILSSKKVGDKVHL

SEQ ID NO: 1816492 - protein, 17 aa, Staphylococcus epidermidis
IPLRKAILWNDTRNSIQ

SEQ ID NO: 1816493 - protein, 19 aa, Staphylococcus epidermidis
IPLRKAILWNDTRNSIQCR

SEQ ID NO: 1816494 - protein, 24 aa, Staphylococcus epidermidis
IPTGRGMVKWAPFATLPEQFETIY

SEQ ID NO: 1816495 - protein, 24 aa, Staphylococcus epidermidis
ISTDYLLCKAFGKTATNIEKYTSQ

SEQ ID NO: 1816496 - protein, 23 aa, Staphylococcus epidermidis
ITEYCFVRPIYLFLNQMNSCDTW

SEQ ID NO: 1816497 - protein, 20 aa, Staphylococcus epidermidis
ITHPIEWQLKYLLLRRTLND

SEQ ID NO: 1816498 - protein, 18 aa, Staphylococcus epidermidis
IVELLAFVSFTHCQQEFG

SEQ ID NO: 1816499 - protein, 18 aa, Staphylococcus epidermidis
IWNRVDVFMLPKDYLRYC

SEQ ID NO: 1816500 - protein, 17 aa, Staphylococcus epidermidis
IWSRVDVFMLPKDYLRY

SEQ ID NO: 1816501 - protein, 19 aa, Staphylococcus epidermidis
IYEFLSLRIPMLLIPLGLD

SEQ ID NO: 1816502 - protein, 17 aa, Staphylococcus epidermidis
KAIDIGNAMLKDGYKES

SEQ ID NO: 1816503 - protein, 19 aa, Staphylococcus epidermidis
KEADECFRAELAKAPVKLF

SEQ ID NO: 1816504 - protein, 23 aa, Staphylococcus epidermidis
KEGCAYVKEHAMFKCDQHFDIVI

SEQ ID NO: 1816505 - protein, 20 aa, Staphylococcus epidermidis
KEGLRLSQFYKELMVSTGSL

SEQ ID NO: 1816506 - protein, 23 aa, Staphylococcus epidermidis
KEGLRLSQFYKELMVSTGSLEIE

SEQ ID NO: 1816507 - protein, 17 aa, Staphylococcus epidermidis
KEVDIQRALLCMNPENL

SEQ ID NO: 1816508 - protein, 20 aa, Staphylococcus epidermidis
KEYKQKYLILRIFNVSGKEP

SEQ ID NO: 1816509 - protein, 17 aa, Staphylococcus epidermidis
KGLEDLADWFSQSKLDT

SEQ ID NO: 1816510 - protein, 19 aa, Staphylococcus epidermidis
KGLLCVYEGFLKGLKGEKV

SEQ ID NO: 1816511 - protein, 19 aa, Staphylococcus epidermidis
KGRSGFVANSFAMRLNQLG

SEQ ID NO: 1816512 - protein, 18 aa, Staphylococcus epidermidis
KIKIFPGLVTYVGETHEK

SEQ ID NO: 1816513 - protein, 19 aa, Staphylococcus epidermidis
KIKIFPGLVTYVGETHEKA

SEQ ID NO: 1816514 - protein, 18 aa, Staphylococcus epidermidis
KKAIDIGNAMLKDGYKES

SEQ ID NO: 1816515 - protein, 17 aa, Staphylococcus epidermidis
KKGFLLDGFPRTIDQAE

SEQ ID NO: 1816516 - protein, 19 aa, Staphylococcus epidermidis
KKGFLLDGFPRTIDQAESL

SEQ ID NO: 1816517 - protein, 23 aa, Staphylococcus epidermidis
KMNGREVFKFAVRIMGDASTRVV

SEQ ID NO: 1816518 - protein, 24 aa, Staphylococcus epidermidis
KMNGREVFKFAVRIMGDASTRVVE

SEQ ID NO: 1816519 - protein, 17 aa, Staphylococcus epidermidis
KPGEISWNSPFGKGRPG

SEQ ID NO: 1816520 - protein, 18 aa, Staphylococcus epidermidis
KPGEISWNSPFGKGRPGW

SEQ ID NO: 1816521 - protein, 21 aa, Staphylococcus epidermidis
KPRIRIPLSNEILEEFEKIRR

SEQ ID NO: 1816522 - protein, 17 aa, Staphylococcus epidermidis
KQLCHSYHVPMIVNDDV

SEQ ID NO: 1816523 - protein, 20 aa, Staphylococcus epidermidis
LFIRLKFYLIDLFRQKDNTL

SEQ ID NO: 1816524 - protein, 19 aa, Staphylococcus epidermidis
LFSTLLRLEWDDVPSKILI

SEQ ID NO: 1816525 - protein, 17 aa, Staphylococcus epidermidis
LGFSGGFPGDFIAQTLE

SEQ ID NO: 1816526 - protein, 19 aa, Staphylococcus epidermidis
LIHGFKGYVALLFQKGAIL

SEQ ID NO: 1816527 - protein, 17 aa, Staphylococcus epidermidis
LKGGDPFVFGRGGEEAE

SEQ ID NO: 1816528 - protein, 17 aa, Staphylococcus epidermidis
LKLKFPLDQHSIRKEIT

SEQ ID NO: 1816529 - protein, 22 aa, Staphylococcus epidermidis
LKRLPLYYRFVSILKGKGIDRV

SEQ ID NO: 1816530 - protein, 17 aa, Staphylococcus epidermidis
LKRVVNFIENFGFTNED

SEQ ID NO: 1816531 - protein, 19 aa, Staphylococcus epidermidis
LKRVVNFIENFGFTNEDIT

SEQ ID NO: 1816532 - protein, 18 aa, Staphylococcus epidermidis
LPEYMIPRKFEWMEQLPL

SEQ ID NO: 1816533 - protein, 17 aa, Staphylococcus epidermidis
LREAFQFAAENKVIPKI

SEQ ID NO: 1816534 - protein, 17 aa, Staphylococcus epidermidis
LREAFQFAAENKVIPKV

SEQ ID NO: 1816535 - protein, 17 aa, Staphylococcus epidermidis
LRKAILWNDTRNSIQCR

SEQ ID NO: 1816536 - protein, 17 aa, Staphylococcus epidermidis
LSKTFGFYEEKEIVDEN

SEQ ID NO: 1816537 - protein, 18 aa, Staphylococcus epidermidis
LSQFYKELMVSTGSLEIE

SEQ ID NO: 1816538 - protein, 21 aa, Staphylococcus epidermidis
LSRFPWLSANIEYTVTREPYF

SEQ ID NO: 1816539 - protein, 17 aa, Staphylococcus epidermidis
LSSLNFNQFELVASQCE

SEQ ID NO: 1816540 - protein, 20 aa, Staphylococcus epidermidis
LVHLKQRYNAILIIDASHSL

SEQ ID NO: 1816541 - protein, 18 aa, Staphylococcus epidermidis
MCRYPWKTKQRILSDMGH

SEQ ID NO: 1816542 - protein, 17 aa, Staphylococcus epidermidis
MDRLLCGDVGYGKTEVA

SEQ ID NO: 1816543 - protein, 17 aa, Staphylococcus epidermidis
MEFPEPVIHLSVEPKSK

SEQ ID NO: 1816544 - protein, 22 aa, Staphylococcus epidermidis
MKKSRPSTQLTLICKLHDKIYF

SEQ ID NO: 1816545 - protein, 22 aa, Staphylococcus epidermidis
MKKSRPSTQLTLICKLHDKTYF

SEQ ID NO: 1816546 - protein, 23 aa, Staphylococcus epidermidis
MLNHGIPSFGYRIEAPIMPGTIN

SEQ ID NO: 1816547 - protein, 23 aa, Staphylococcus epidermidis
MLNHGIPSFGYRIEAPITPGTIN

SEQ ID NO: 1816548 - protein, 18 aa, Staphylococcus epidermidis
MPYIDGFEVAQSLKESNI

SEQ ID NO: 1816549 - protein, 18 aa, Staphylococcus epidermidis
MRYMFGGKAKIPLVVRTV

SEQ ID NO: 1816550 - protein, 22 aa, Staphylococcus epidermidis
NMIFQFEHLGLWSTGDTKFDVK

SEQ ID NO: 1816551 - protein, 23 aa, Staphylococcus epidermidis
NMIFQFEHLGLWSTGDTKFDVKS

SEQ ID NO: 1816552 - protein, 18 aa, Staphylococcus epidermidis
NNIKKAWWQKFITQSPYN

SEQ ID NO: 1816553 - protein, 17 aa, Staphylococcus epidermidis
NVIRYAQYLNELSTETQ

SEQ ID NO: 1816554 - protein, 19 aa, Staphylococcus epidermidis
PAQVVIRWNIQHDVVVIPK

SEQ ID NO: 1816555 - protein, 21 aa, Staphylococcus epidermidis
PGFKGICAISYFNNASLEEIK

SEQ ID NO: 1816556 - protein, 20 aa, Staphylococcus epidermidis
PILLASWKLGPALAAGNTVV

SEQ ID NO: 1816557 - protein, 18 aa, Staphylococcus epidermidis
PQLHCLKLKFPLDQHSIR

SEQ ID NO: 1816558 - protein, 20 aa, Staphylococcus epidermidis
PRIRIPLSNEILEEFEKIRR

SEQ ID NO: 1816559 - protein, 19 aa, Staphylococcus epidermidis
PRISYDDAIEFLKKEGFDD

SEQ ID NO: 1816560 - protein, 17 aa, Staphylococcus epidermidis
PRPIGWISTVSKEGKDN

SEQ ID NO: 1816561 - protein, 19 aa, Staphylococcus epidermidis
PVVACAVILEKNHHYIGLD

SEQ ID NO: 1816562 - protein, 20 aa, Staphylococcus epidermidis
PVVACAVILEKNHHYIGLDD

SEQ ID NO: 1816563 - protein, 22 aa, Staphylococcus epidermidis
PWGDLDIDVVLECTGFYTDKEK

SEQ ID NO: 1816564 - protein, 23 aa, Staphylococcus epidermidis
PWGDLDIDVVLECTGFYTDKEKA

SEQ ID NO: 1816565 - protein, 20 aa, Staphylococcus epidermidis
QGRGKIKWQAFATLPQQFEI

SEQ ID NO: 1816566 - protein, 17 aa, Staphylococcus epidermidis
QHIHTLIKMCGLVRGVL

SEQ ID NO: 1816567 - protein, 22 aa, Staphylococcus epidermidis
QKLKGRYSIVVFDHYGKITLDN

SEQ ID NO: 1816568 - protein, 17 aa, Staphylococcus epidermidis
QQIHLILSAYSRMKSLK

SEQ ID NO: 1816569 - protein, 19 aa, Staphylococcus epidermidis
RGALKYIHDIWGYIAPNTK

SEQ ID NO: 1816570 - protein, 18 aa, Staphylococcus epidermidis
RHKQTFLLGGGHDIAYAQ

SEQ ID NO: 1816571 - protein, 18 aa, Staphylococcus epidermidis
RIPLSQAVIELCLSPKSN

SEQ ID NO: 1816572 - protein, 19 aa, Staphylococcus epidermidis
RKLIKVLLDNGWVMTKTGV

SEQ ID NO: 1816573 - protein, 19 aa, Staphylococcus epidermidis
RNGSFKILAEFNALNTDYI

SEQ ID NO: 1816574 - protein, 20 aa, Staphylococcus epidermidis
RQIAELCYLIWRDMELDITK

SEQ ID NO: 1816575 - protein, 19 aa, Staphylococcus epidermidis
SDLISRYAGIRVPRNKAIV

SEQ ID NO: 1816576 - protein, 24 aa, Staphylococcus epidermidis
SELGSRMRLRIIPELTFEYDESIE

SEQ ID NO: 1816577 - protein, 25 aa, Staphylococcus epidermidis
SELGSRMRLRIIPELTFEYDESIEY

SEQ ID NO: 1816578 - protein, 19 aa, Staphylococcus epidermidis
SFKSYLFIRLKFYLIDLFR

SEQ ID NO: 1816579 - protein, 23 aa, Staphylococcus epidermidis
SGDVLKGLIFVSSRGEAYQLANQ

SEQ ID NO: 1816580 - protein, 20 aa, Staphylococcus epidermidis
SGKIKKLLCILKEQVPNCDN

SEQ ID NO: 1816581 - protein, 18 aa, Staphylococcus epidermidis
SIGLILGFLVQRFLEHKK

SEQ ID NO: 1816582 - protein, 19 aa, Staphylococcus epidermidis
SIVGPFAYYIKGFEMLPQM

SEQ ID NO: 1816583 - protein, 19 aa, Staphylococcus epidermidis
SKGGFYFTDFRGYSTQPLG

SEQ ID NO: 1816584 - protein, 22 aa, Staphylococcus epidermidis
SNKELIGVIGLHYLDLVNKTTS

SEQ ID NO: 1816585 - protein, 20 aa, Staphylococcus epidermidis
SRIGEPFVGYSDAYSFNSPK

SEQ ID NO: 1816586 - protein, 17 aa, Staphylococcus epidermidis
SSGRMVGIISHVSELKQ

SEQ ID NO: 1816587 - protein, 17 aa, Staphylococcus epidermidis
TENRGAIPYTVFIDPPL

SEQ ID NO: 1816588 - protein, 17 aa, Staphylococcus epidermidis
TFLKRPPSAWVVLAKPN

SEQ ID NO: 1816589 - protein, 18 aa, Staphylococcus epidermidis
TFLKRPPSAWVVLAKPNI

SEQ ID NO: 1816590 - protein, 19 aa, Staphylococcus epidermidis
TIHRFTRKLGFDGYSDFKS

SEQ ID NO: 1816591 - protein, 25 aa, Staphylococcus epidermidis
TKKEFEIIKLLSLNPQYYFSKEQIY

SEQ ID NO: 1816592 - protein, 23 aa, Staphylococcus epidermidis
TVHLKLPLDWLKGKIIIDSLGLH

SEQ ID NO: 1816593 - protein, 24 aa, Staphylococcus epidermidis
TVHLKLPLDWLKGKIIIDSLGLHS

SEQ ID NO: 1816594 - protein, 19 aa, Staphylococcus epidermidis
VAGRGELHLSILIENMRRE

SEQ ID NO: 1816595 - protein, 25 aa, Staphylococcus epidermidis
VAHYFKRLFSQYGIRSHIDTVTDGR

SEQ ID NO: 1816596 - protein, 17 aa, Staphylococcus epidermidis
VKEAGYELNVWTVNKPA

SEQ ID NO: 1816597 - protein, 24 aa, Staphylococcus epidermidis
VKNLWLRTELKYFYFYHLNNGIWN

SEQ ID NO: 1816598 - protein, 18 aa, Staphylococcus epidermidis
VQSALNFKFMKRINEVGI

SEQ ID NO: 1816599 - protein, 18 aa, Staphylococcus epidermidis
VVAWNFPILLASWKLGPA

SEQ ID NO: 1816600 - protein, 19 aa, Staphylococcus epidermidis
VVAWNFPILLASWKLGPAL

SEQ ID NO: 1816601 - protein, 23 aa, Staphylococcus epidermidis
VVEGPLWIQVHAFEKGVEVTISK

SEQ ID NO: 1816602 - protein, 24 aa, Staphylococcus epidermidis
YHDRPSEDWVWRDGFVKMDTLEVD

SEQ ID NO: 1816603 - protein, 18 aa, Staphylococcus epidermidis
YRSSGGFGVRLDAGDGFQ

SEQ ID NO: 1816604 - protein, 19 aa, Staphylococcus epidermidis
YSRLRSTYCYEVYNENGEL

SEQ ID NO: 1816605 - protein, 22 aa, Staphylococcus epidermidis
YTGLRIGVTVAKTLAYALNTNL

SEQ ID NO: 1816606 - protein, 23 aa, Staphylococcus epidermidis
YTGLRIGVTVAKTLAYALNTNLY

SEQ ID NO: 1816607 - protein, 20 aa, Staphylococcus epidermidis
YYLPDVLSLILKDGGKAEVY

SEQ ID NO: 1816608 - protein, 18 aa, Staphylococcus epidermidis
AAPTVEWEDMGAYTDSYE

SEQ ID NO: 1816609 - protein, 22 aa, Staphylococcus epidermidis
ADVGCGYGPIGLAIGKASPHHQ

SEQ ID NO: 1816610 - protein, 22 aa, Staphylococcus epidermidis
AEQLSNMWLYRHFILHLDQLDS

SEQ ID NO: 1816611 - protein, 21 aa, Staphylococcus epidermidis
AFGEALGAVIVRSKKLDEGEA

SEQ ID NO: 1816612 - protein, 20 aa, Staphylococcus epidermidis
AGYSACFNSALSLILSQNKI

SEQ ID NO: 1816613 - protein, 17 aa, Staphylococcus epidermidis
AIFCSGGPMKAGLSAQG

SEQ ID NO: 1816614 - protein, 17 aa, Staphylococcus epidermidis
AKFKTSALRSWKTDQAD

SEQ ID NO: 1816615 - protein, 19 aa, Staphylococcus epidermidis
ALQQELINLIGFVIEPQDL

SEQ ID NO: 1816616 - protein, 22 aa, Staphylococcus epidermidis
ALSRFPWLSANIEYTVTREPYF

SEQ ID NO: 1816617 - protein, 17 aa, Staphylococcus epidermidis
ALTQSYRFSKAAMLSAP

SEQ ID NO: 1816618 - protein, 18 aa, Staphylococcus epidermidis
ANVIRYAQYLNELSTETQ

SEQ ID NO: 1816619 - protein, 17 aa, Staphylococcus epidermidis
APLSAVFEAQRFIDLDW

SEQ ID NO: 1816620 - protein, 18 aa, Staphylococcus epidermidis
ARELKVSNALLFTDSKLI

SEQ ID NO: 1816621 - protein, 19 aa, Staphylococcus epidermidis
ARRIQFFLSQNFHVAEQFT

SEQ ID NO: 1816622 - protein, 17 aa, Staphylococcus epidermidis
AVARDVGRIMGFDETSL

SEQ ID NO: 1816623 - protein, 19 aa, Staphylococcus epidermidis
AYCPGVAKTEMWDRIDEEM

SEQ ID NO: 1816624 - protein, 17 aa, Staphylococcus epidermidis
CGIPEKFYTDHGSDFTS

SEQ ID NO: 1816625 - protein, 17 aa, Staphylococcus epidermidis
CGIPGSIGGAVFMNAGA

SEQ ID NO: 1816626 - protein, 17 aa, Staphylococcus epidermidis
CLRIIAMFRLINPTKEI

SEQ ID NO: 1816627 - protein, 19 aa, Staphylococcus epidermidis
CMTCGVCLEVCPNVTKNNK

SEQ ID NO: 1816628 - protein, 18 aa, Staphylococcus epidermidis
CYLGDFKTTGGIFATTEK

SEQ ID NO: 1816629 - protein, 22 aa, Staphylococcus epidermidis
CYQFKVPFIVIRAVSDLANGKA

SEQ ID NO: 1816630 - protein, 22 aa, Staphylococcus epidermidis
DACIKYQYIGICYGQPGVGKTL

SEQ ID NO: 1816631 - protein, 22 aa, Staphylococcus epidermidis
DAFARRSRYALDIDFKEEPPWF

SEQ ID NO: 1816632 - protein, 18 aa, Staphylococcus epidermidis
DEKLRVFIEYALEQGKVD

SEQ ID NO: 1816633 - protein, 20 aa, Staphylococcus epidermidis
DEVIPRNVIHIGFTSGTTGL

SEQ ID NO: 1816634 - protein, 19 aa, Staphylococcus epidermidis
DFEGTIIFVSHDRYFINQL

SEQ ID NO: 1816635 - protein, 18 aa, Staphylococcus epidermidis
DKLECQRTINAFIPKAHI

SEQ ID NO: 1816636 - protein, 18 aa, Staphylococcus epidermidis
DKLKELVEYGWLEDENYE

SEQ ID NO: 1816637 - protein, 20 aa, Staphylococcus epidermidis
DKNVKGYAFFKATNGTEEKR

SEQ ID NO: 1816638 - protein, 17 aa, Staphylococcus epidermidis
DPELCVLKVIPRSIKLM

SEQ ID NO: 1816639 - protein, 17 aa, Staphylococcus epidermidis
DVADEFDVQVALHADTL

SEQ ID NO: 1816640 - protein, 17 aa, Staphylococcus epidermidis
EADECFRDELAKAPVKL

SEQ ID NO: 1816641 - protein, 17 aa, Staphylococcus epidermidis
EEMKHYFILNFPQRPGA

SEQ ID NO: 1816642 - protein, 23 aa, Staphylococcus epidermidis
EFARAGDTIVVWRLDRLGRNMED

SEQ ID NO: 1816643 - protein, 25 aa, Staphylococcus epidermidis
EGMDTWDFAHCLPYFKKLETTYGAA

SEQ ID NO: 1816644 - protein, 21 aa, Staphylococcus epidermidis
EKAHSITAIWNFEKQNYYLKD

SEQ ID NO: 1816645 - protein, 22 aa, Staphylococcus epidermidis
EKMKELQDFIARFSANASKSKQ

SEQ ID NO: 1816646 - protein, 19 aa, Staphylococcus epidermidis
ELLFRIKAVLRRYQINADN

SEQ ID NO: 1816647 - protein, 18 aa, Staphylococcus epidermidis
ELLSKFRLKPEMFTDEKL

SEQ ID NO: 1816648 - protein, 17 aa, Staphylococcus epidermidis
ENYFKPEHINVIKCDLM

SEQ ID NO: 1816649 - protein, 21 aa, Staphylococcus epidermidis
EQRRLEFLAGRFTVKEAFSKA

SEQ ID NO: 1816650 - protein, 19 aa, Staphylococcus epidermidis
EQTEVRLVLSFLRTIDNPL

SEQ ID NO: 1816651 - protein, 18 aa, Staphylococcus epidermidis
ERHVQFLLNNNIQAIIVN

SEQ ID NO: 1816652 - protein, 18 aa, Staphylococcus epidermidis
EVRKAIGMDSNFTSIQEK

SEQ ID NO: 1816653 - protein, 17 aa, Staphylococcus epidermidis
EVTNVSGIVLTKLDGTA

SEQ ID NO: 1816654 - protein, 17 aa, Staphylococcus epidermidis
FARSGDTIVVWRLDRLG

SEQ ID NO: 1816655 - protein, 18 aa, Staphylococcus epidermidis
FELRKKRMMEIRDDINVH

SEQ ID NO: 1816656 - protein, 20 aa, Staphylococcus epidermidis
FFGICLGHQLFALSQGATSF

SEQ ID NO: 1816657 - protein, 19 aa, Staphylococcus epidermidis
FIRLKFYLIDLFRQKDNTL

SEQ ID NO: 1816658 - protein, 17 aa, Staphylococcus epidermidis
FISWTGKMAETFVLAHE

SEQ ID NO: 1816659 - protein, 20 aa, Staphylococcus epidermidis
FIVKTRFGGYDGKGQILVRN

SEQ ID NO: 1816660 - protein, 17 aa, Staphylococcus epidermidis
FKKASNWGIKAPFEVPD

SEQ ID NO: 1816661 - protein, 24 aa, Staphylococcus epidermidis
FKNKHLRLAISQAINKKGYVNSVL

SEQ ID NO: 1816662 - protein, 17 aa, Staphylococcus epidermidis
FKRVLPDALIKLEKAGY

SEQ ID NO: 1816663 - protein, 25 aa, Staphylococcus epidermidis
FNDRKRLLPSIAYLEGEYGCSDICF

SEQ ID NO: 1816664 - protein, 17 aa, Staphylococcus epidermidis
FNLFIALGIRDAIQQFS

SEQ ID NO: 1816665 - protein, 18 aa, Staphylococcus epidermidis
FTLNILYPYIETIHITKD

SEQ ID NO: 1816666 - protein, 17 aa, Staphylococcus epidermidis
FVNEIKSAMSIGDTCPI

SEQ ID NO: 1816667 - protein, 18 aa, Staphylococcus epidermidis
FYHPEFKKEYVVLAEEGA

SEQ ID NO: 1816668 - protein, 18 aa, Staphylococcus epidermidis
GAIKFALTQSYRFSKAAM

SEQ ID NO: 1816669 - protein, 17 aa, Staphylococcus epidermidis
GALKYIHDIWGYIAPNT

SEQ ID NO: 1816670 - protein, 21 aa, Staphylococcus epidermidis
GCAYVKDHAMFKCEQRFDIVI

SEQ ID NO: 1816671 - protein, 23 aa, Staphylococcus epidermidis
GDAFARRSRYALDIDFKEEPPWF

SEQ ID NO: 1816672 - protein, 18 aa, Staphylococcus epidermidis
GGVSYIFSSDVEKFKKVN

SEQ ID NO: 1816673 - protein, 20 aa, Staphylococcus epidermidis
GHSMLYLSSIMDIYNREIVA

SEQ ID NO: 1816674 - protein, 20 aa, Staphylococcus epidermidis
GIRGKFGLGKGRLNKFTVSK

SEQ ID NO: 1816675 - protein, 20 aa, Staphylococcus epidermidis
GMGRIGRMVLRIALNNKNLN

SEQ ID NO: 1816676 - protein, 18 aa, Staphylococcus epidermidis
GMKKRLGIAQAILHDPKV

SEQ ID NO: 1816677 - protein, 18 aa, Staphylococcus epidermidis
GMMFKGNASKLGFEPKEG

SEQ ID NO: 1816678 - protein, 23 aa, Staphylococcus epidermidis
GNELPISAGFFIINPFEVVYYAG

SEQ ID NO: 1816679 - protein, 18 aa, Staphylococcus epidermidis
GVGRRISLHYTREMVDQA

SEQ ID NO: 1816680 - protein, 19 aa, Staphylococcus epidermidis
GVSYCAVCDGAFFKNKRLF

SEQ ID NO: 1816681 - protein, 17 aa, Staphylococcus epidermidis
GVTFAFQGCEHINRAVT

SEQ ID NO: 1816682 - protein, 19 aa, Staphylococcus epidermidis
HIPFCYRICTYCDFNKYFI

SEQ ID NO: 1816683 - protein, 17 aa, Staphylococcus epidermidis
HPDLDTWVIFPWTAGQG

SEQ ID NO: 1816684 - protein, 17 aa, Staphylococcus epidermidis
HQAESWDNVGLLIGNDK

SEQ ID NO: 1816685 - protein, 21 aa, Staphylococcus epidermidis
IAKETGCIIIALSQLSRGVES

SEQ ID NO: 1816686 - protein, 25 aa, Staphylococcus epidermidis
IALLFAILKVRSAPFVILDEVEAAL

SEQ ID NO: 1816687 - protein, 18 aa, Staphylococcus epidermidis
IANFKSGKSYVFKPKSLF

SEQ ID NO: 1816688 - protein, 19 aa, Staphylococcus epidermidis
IAVVSLRKDIGWSQMQFAQ

SEQ ID NO: 1816689 - protein, 17 aa, Staphylococcus epidermidis
IDLYRPVPNFKNISQVK

SEQ ID NO: 1816690 - protein, 17 aa, Staphylococcus epidermidis
IEDLRIISCHIGNGASI

SEQ ID NO: 1816691 - protein, 17 aa, Staphylococcus epidermidis
IEFFVLFNHFKIHKTEK

SEQ ID NO: 1816692 - protein, 20 aa, Staphylococcus epidermidis
IELLSRLGIQLNLPDLTFDT

SEQ ID NO: 1816693 - protein, 23 aa, Staphylococcus epidermidis
IEPLKSLRVMGKFGDSVTTDHIS

SEQ ID NO: 1816694 - protein, 24 aa, Staphylococcus epidermidis
IFRKLNIEWVYRVLIDWKRIGRMI

SEQ ID NO: 1816695 - protein, 17 aa, Staphylococcus epidermidis
IGCTFCASTLGGLKRNL

SEQ ID NO: 1816696 - protein, 18 aa, Staphylococcus epidermidis
IGHLYAYQFEKIALIGGN

SEQ ID NO: 1816697 - protein, 17 aa, Staphylococcus epidermidis
IGLILGFLVQRFLEHKK

SEQ ID NO: 1816698 - protein, 17 aa, Staphylococcus epidermidis
IGYKIAQRLGGYDAVGP

SEQ ID NO: 1816699 - protein, 17 aa, Staphylococcus epidermidis
IHGRIFISLAVKFSKAR

SEQ ID NO: 1816700 - protein, 20 aa, Staphylococcus epidermidis
IHTLIKMCGLVRGVLIQPSF

SEQ ID NO: 1816701 - protein, 17 aa, Staphylococcus epidermidis
IKLRKRVWRRLAKDLKP

SEQ ID NO: 1816702 - protein, 18 aa, Staphylococcus epidermidis
IKRYPTRRLRVEDGCLKE

SEQ ID NO: 1816703 - protein, 19 aa, Staphylococcus epidermidis
IKRYPTRRLRVEDGCLKEM

SEQ ID NO: 1816704 - protein, 20 aa, Staphylococcus epidermidis
KAHKNHLWFHTKDIPGSHVV

SEQ ID NO: 1816705 - protein, 22 aa, Staphylococcus epidermidis
KDELRLGMDTQWMNRAGDGYPA

SEQ ID NO: 1816706 - protein, 17 aa, Staphylococcus epidermidis
KDVQILGAIAMHQGNIA

SEQ ID NO: 1816707 - protein, 22 aa, Staphylococcus epidermidis
KDYKPELAFAIGNAIKYISRAN

SEQ ID NO: 1816708 - protein, 19 aa, Staphylococcus epidermidis
KELQAVGLLEQIRTGFNKP

SEQ ID NO: 1816709 - protein, 20 aa, Staphylococcus epidermidis
KFTTCGFNNCIFEDVHFYKN

SEQ ID NO: 1816710 - protein, 19 aa, Staphylococcus epidermidis
KGENVMKGYLYPKYLKDTF

SEQ ID NO: 1816711 - protein, 18 aa, Staphylococcus epidermidis
KGPNIKLPSYQLLEAPEP

SEQ ID NO: 1816712 - protein, 19 aa, Staphylococcus epidermidis
KGTDTGWQTLPLVNGITQA

SEQ ID NO: 1816713 - protein, 23 aa, Staphylococcus epidermidis
KHQCPHCKSEVILKQGMTLIAHF

SEQ ID NO: 1816714 - protein, 17 aa, Staphylococcus epidermidis
KKGTLLWLMDETKTPMG

SEQ ID NO: 1816715 - protein, 20 aa, Staphylococcus epidermidis
KLIKRYQLSYIIDDKFNYAS

SEQ ID NO: 1816716 - protein, 21 aa, Staphylococcus epidermidis
KLKGRYSIVVFDHYGKITLDN

SEQ ID NO: 1816717 - protein, 22 aa, Staphylococcus epidermidis
KLSRYPQLYSRIGFAHEFDNLS

SEQ ID NO: 1816718 - protein, 18 aa, Staphylococcus epidermidis
KLTLGHSGLTALFWNHGH

SEQ ID NO: 1816719 - protein, 23 aa, Staphylococcus epidermidis
KNYDIPLYLGRTLSNMKGTWIMS

SEQ ID NO: 1816720 - protein, 17 aa, Staphylococcus epidermidis
KRIKLKWSTSLIKDLET

SEQ ID NO: 1816721 - protein, 17 aa, Staphylococcus epidermidis
KRYPTRRLRVEDGCLKE

SEQ ID NO: 1816722 - protein, 18 aa, Staphylococcus epidermidis
KSRPYIANMLRLLQLPKN

SEQ ID NO: 1816723 - protein, 17 aa, Staphylococcus epidermidis
KVTRLAEHLGWKGKGSN

SEQ ID NO: 1816724 - protein, 18 aa, Staphylococcus epidermidis
KYARGVAVYGDIKDDTDE

SEQ ID NO: 1816725 - protein, 23 aa, Staphylococcus epidermidis
KYQCPHCKSEVILKQGMTLIAHF

SEQ ID NO: 1816726 - protein, 20 aa, Staphylococcus epidermidis
LERHVKFLLNNNIQAIIVNG

SEQ ID NO: 1816727 - protein, 23 aa, Staphylococcus epidermidis
LGFRGDIFGGYILYNLGFIESED

SEQ ID NO: 1816728 - protein, 19 aa, Staphylococcus epidermidis
LGFSGGFPGDFIAQTLEDS

SEQ ID NO: 1816729 - protein, 18 aa, Staphylococcus epidermidis
LGKTSLALTMMWNIAQRG

SEQ ID NO: 1816730 - protein, 18 aa, Staphylococcus epidermidis
LHGAPGFEDEVRRYMKSE

SEQ ID NO: 1816731 - protein, 18 aa, Staphylococcus epidermidis
LHVLKRFKAMLIQKNETV

SEQ ID NO: 1816732 - protein, 20 aa, Staphylococcus epidermidis
LIHGFKGYVALLFQKGAILE

SEQ ID NO: 1816733 - protein, 17 aa, Staphylococcus epidermidis
LINLIGFVIEPQDLFSH

SEQ ID NO: 1816734 - protein, 24 aa, Staphylococcus epidermidis
LITEYCFVRPIYLFLNKMNSCDTW

SEQ ID NO: 1816735 - protein, 21 aa, Staphylococcus epidermidis
LITHPIEWQLKYLLLRRTLND

SEQ ID NO: 1816736 - protein, 22 aa, Staphylococcus epidermidis
LKEEILKFVDLMKSLGKEVSQQ

SEQ ID NO: 1816737 - protein, 17 aa, Staphylococcus epidermidis
LKFDYLYIDNARLKSSY

SEQ ID NO: 1816738 - protein, 18 aa, Staphylococcus epidermidis
LKGGQTIGLFSYGSGSVG

SEQ ID NO: 1816739 - protein, 24 aa, Staphylococcus epidermidis
LKILLKELERVLGRNTFAERVNKL

SEQ ID NO: 1816740 - protein, 17 aa, Staphylococcus epidermidis
LLFLSFAGALAYQIHAK

SEQ ID NO: 1816741 - protein, 18 aa, Staphylococcus epidermidis
LLGGTCLHKGCIPTKALL

SEQ ID NO: 1816742 - protein, 19 aa, Staphylococcus epidermidis
LLKNSRFGFKMGNQTLEDS

SEQ ID NO: 1816743 - protein, 17 aa, Staphylococcus epidermidis
LLLKYAMNYARFSCDVM

SEQ ID NO: 1816744 - protein, 19 aa, Staphylococcus epidermidis
LLLTFFFKYMKPLVQAGRV

SEQ ID NO: 1816745 - protein, 18 aa, Staphylococcus epidermidis
LNIAEIFTHPDMVLDIDK

SEQ ID NO: 1816746 - protein, 17 aa, Staphylococcus epidermidis
LNICEGFSPLIANEIVN

SEQ ID NO: 1816747 - protein, 17 aa, Staphylococcus epidermidis
LNIETVKQDNTSFIKND

SEQ ID NO: 1816748 - protein, 19 aa, Staphylococcus epidermidis
LPEYMIPRKFEWMEQLPLT

SEQ ID NO: 1816749 - protein, 28 aa, Staphylococcus epidermidis
LPEYMIPRKFEWMERLPLTLNGKLDRKK

SEQ ID NO: 1816750 - protein, 21 aa, Staphylococcus epidermidis
LPKLKELWPQAGDYLLVTLRI

SEQ ID NO: 1816751 - protein, 18 aa, Staphylococcus epidermidis
LSKAALEMMIFHIVQQHE

SEQ ID NO: 1816752 - protein, 20 aa, Staphylococcus epidermidis
LTDSYYCFSYSLKGNSKKVL

SEQ ID NO: 1816753 - protein, 20 aa, Staphylococcus epidermidis
LTGACPMGPYIVTKDELPTP

SEQ ID NO: 1816754 - protein, 23 aa, Staphylococcus epidermidis
MKVSEVLYYLGFLSKINQTDFDK

SEQ ID NO: 1816755 - protein, 19 aa, Staphylococcus epidermidis
MLQRPILYTGLTRAKQSLV

SEQ ID NO: 1816756 - protein, 22 aa, Staphylococcus epidermidis
MYKIWAEFKFNDEVHRFTYNIK

SEQ ID NO: 1816757 - protein, 21 aa, Staphylococcus epidermidis
NAPELKANFNFIKKIDGNSIT

SEQ ID NO: 1816758 - protein, 21 aa, Staphylococcus epidermidis
NAPELKANFNFIKKIDSNSIT

SEQ ID NO: 1816759 - protein, 21 aa, Staphylococcus epidermidis
NELKTRLSKFLPKEVTQYNVE

SEQ ID NO: 1816760 - protein, 18 aa, Staphylococcus epidermidis
NGSFKILAEFNALNTDYI

SEQ ID NO: 1816761 - protein, 20 aa, Staphylococcus epidermidis
NGVLRTVMRTELPSFEDIDD

SEQ ID NO: 1816762 - protein, 17 aa, Staphylococcus epidermidis
NGYAIGLIKSGLSKEGK

SEQ ID NO: 1816763 - protein, 18 aa, Staphylococcus epidermidis
NIIKATHVQYLFKQNNNI

SEQ ID NO: 1816764 - protein, 23 aa, Staphylococcus epidermidis
NLSNDAKITWSILRDRLDLSIRN

SEQ ID NO: 1816765 - protein, 20 aa, Staphylococcus epidermidis
NLWYFRYFIYYLIKENVIPK

SEQ ID NO: 1816766 - protein, 22 aa, Staphylococcus epidermidis
NQIRYVYTFLKYVDGVQVIGNK

SEQ ID NO: 1816767 - protein, 19 aa, Staphylococcus epidermidis
PARAMGMVSVWYKQEDAEL

SEQ ID NO: 1816768 - protein, 23 aa, Staphylococcus epidermidis
PETEVINVFPIRFVVDKDNEVSD

SEQ ID NO: 1816769 - protein, 20 aa, Staphylococcus epidermidis
PEYGATCGFFPVDEESLKYM

SEQ ID NO: 1816770 - protein, 21 aa, Staphylococcus epidermidis
PFFGICLGHQLFALSQGATSF

SEQ ID NO: 1816771 - protein, 17 aa, Staphylococcus epidermidis
PFPFWKRVHDSFISSDD

SEQ ID NO: 1816772 - protein, 22 aa, Staphylococcus epidermidis
PGFKGICAISYFNNASLEEIKQ

SEQ ID NO: 1816773 - protein, 18 aa, Staphylococcus epidermidis
PGLLKRLFEQEVPEIYDG

SEQ ID NO: 1816774 - protein, 19 aa, Staphylococcus epidermidis
PKRDLAIYIDIAERAGQKA

SEQ ID NO: 1816775 - protein, 20 aa, Staphylococcus epidermidis
PRETMIGSMAYYISHAKNEK

SEQ ID NO: 1816776 - protein, 17 aa, Staphylococcus epidermidis
PRSSVCFDAPSWYELVV

SEQ ID NO: 1816777 - protein, 22 aa, Staphylococcus epidermidis
QHIHTLIKMCGLVRGVLIQPSF

SEQ ID NO: 1816778 - protein, 17 aa, Staphylococcus epidermidis
QIQELGFSYDWDREVNT

SEQ ID NO: 1816779 - protein, 18 aa, Staphylococcus epidermidis
QLRLWIWEVKKRDGKHHG

SEQ ID NO: 1816780 - protein, 18 aa, Staphylococcus epidermidis
QPRSSVCFDAPSWYELVV

SEQ ID NO: 1816781 - protein, 18 aa, Staphylococcus epidermidis
QTHLKWGAQKEVIRLIPG

SEQ ID NO: 1816782 - protein, 20 aa, Staphylococcus epidermidis
RANHVIKCFLQVNVSGEKSK

SEQ ID NO: 1816783 - protein, 17 aa, Staphylococcus epidermidis
RFKEVYSIFSDVLGIPL

SEQ ID NO: 1816784 - protein, 17 aa, Staphylococcus epidermidis
RFKEVYSIFSDVLGVPL

SEQ ID NO: 1816785 - protein, 18 aa, Staphylococcus epidermidis
RFKEVYSIFSDVLGVPLK

SEQ ID NO: 1816786 - protein, 24 aa, Staphylococcus epidermidis
RFTATEINLFFAMCNKLKEQDTNT

SEQ ID NO: 1816787 - protein, 17 aa, Staphylococcus epidermidis
RGAIFGLSRGTEKEHFI

SEQ ID NO: 1816788 - protein, 19 aa, Staphylococcus epidermidis
RHKQTFLLGGGHDIAYAQY

SEQ ID NO: 1816789 - protein, 22 aa, Staphylococcus epidermidis
RIHKGFHMLRFEGINNINDIEH

SEQ ID NO: 1816790 - protein, 17 aa, Staphylococcus epidermidis
RIIDCLETAHTRLKLLS

SEQ ID NO: 1816791 - protein, 17 aa, Staphylococcus epidermidis
RKDIGWSQMQFAQKLKV

SEQ ID NO: 1816792 - protein, 24 aa, Staphylococcus epidermidis
RNGPTGTVKLHFMKQYNKFTDIDY

SEQ ID NO: 1816793 - protein, 19 aa, Staphylococcus epidermidis
RPSTSGVLDVEFIDPMKGL

SEQ ID NO: 1816794 - protein, 17 aa, Staphylococcus epidermidis
RYMFGGKAKIPLVVRTV

SEQ ID NO: 1816795 - protein, 17 aa, Staphylococcus epidermidis
SDHNIKIAIVMHLCSTT

SEQ ID NO: 1816796 - protein, 17 aa, Staphylococcus epidermidis
SEFLRKRIVDLNEVNPM

SEQ ID NO: 1816797 - protein, 19 aa, Staphylococcus epidermidis
SFIEMCLLLPNLNEQQYNS

SEQ ID NO: 1816798 - protein, 23 aa, Staphylococcus epidermidis
SIAERLKLAVQFANHFESEEEYS

SEQ ID NO: 1816799 - protein, 18 aa, Staphylococcus epidermidis
SIIKRLSKASGHLGMVGG

SEQ ID NO: 1816800 - protein, 24 aa, Staphylococcus epidermidis
SIIKRLSKASGHWGMVGGQALDME

SEQ ID NO: 1816801 - protein, 18 aa, Staphylococcus epidermidis
SKGGFYFTDFRGYSTQPL

SEQ ID NO: 1816802 - protein, 22 aa, Staphylococcus epidermidis
SLKDSRFPFSIMWIEELAEFKT

SEQ ID NO: 1816803 - protein, 21 aa, Staphylococcus epidermidis
SQRKIDVEPVFGFMKAILGFT

SEQ ID NO: 1816804 - protein, 20 aa, Staphylococcus epidermidis
SRLKALYLSVIDRIDIKKDG

SEQ ID NO: 1816805 - protein, 23 aa, Staphylococcus epidermidis
STDYLLCKAFGKTATNIEKYTSQ

SEQ ID NO: 1816806 - protein, 19 aa, Staphylococcus epidermidis
TMPQTRFVLKKALEQNLKP

SEQ ID NO: 1816807 - protein, 18 aa, Staphylococcus epidermidis
TVMRTELPSFEDIDDTKK

SEQ ID NO: 1816808 - protein, 18 aa, Staphylococcus epidermidis
TYMPLPIFLSHQLAKRLS

SEQ ID NO: 1816809 - protein, 19 aa, Staphylococcus epidermidis
VACPGFVPLVEQMRYKDPT

SEQ ID NO: 1816810 - protein, 17 aa, Staphylococcus epidermidis
VGKQWVLYIENMNRGYT

SEQ ID NO: 1816811 - protein, 19 aa, Staphylococcus epidermidis
VHLKQRYNAILIIDASHSL

SEQ ID NO: 1816812 - protein, 20 aa, Staphylococcus epidermidis
VLNCIHKGIYLLDVPLSEYQ

SEQ ID NO: 1816813 - protein, 18 aa, Staphylococcus epidermidis
VPGFRKGKVPRPIFEQRF

SEQ ID NO: 1816814 - protein, 17 aa, Staphylococcus epidermidis
VPPKLAKLIAYQVNLAL

SEQ ID NO: 1816815 - protein, 18 aa, Staphylococcus epidermidis
VRLVLSFLRTIDNPLQDI

SEQ ID NO: 1816816 - protein, 19 aa, Staphylococcus epidermidis
VTVPQWFLKNVVDSEVLGE

SEQ ID NO: 1816817 - protein, 18 aa, Staphylococcus epidermidis
WFNVICMFREDGIYYYCN

SEQ ID NO: 1816818 - protein, 21 aa, Staphylococcus epidermidis
WSRIGEPFVGYSDAYSFNSPK

SEQ ID NO: 1816819 - protein, 17 aa, Staphylococcus epidermidis
YASGGFIHYCEYPKLNH

SEQ ID NO: 1816820 - protein, 17 aa, Staphylococcus epidermidis
YKGEPKLGFKEMEEIGA

SEQ ID NO: 1816821 - protein, 20 aa, Staphylococcus epidermidis
YKRFMFLALLRRAMIRKLPY

SEQ ID NO: 1816822 - protein, 20 aa, Staphylococcus epidermidis
YPKFEFKKASNWGIKAPFEV

SEQ ID NO: 1816823 - protein, 22 aa, Staphylococcus epidermidis
YQCPHCKSEVILKQGMTLIAHF

SEQ ID NO: 1816824 - protein, 17 aa, Staphylococcus epidermidis
YQLSYIIDDKFNYASNL

SEQ ID NO: 1816825 - protein, 17 aa, Staphylococcus epidermidis
YRSSGGFGVRLDAGDGF

SEQ ID NO: 1816826 - protein, 20 aa, Staphylococcus epidermidis
YRSSGGFGVRLDAGDGFQGA

SEQ ID NO: 1816827 - protein, 18 aa, Staphylococcus epidermidis
YRYARYVDDISFPFNFEE

SEQ ID NO: 1816828 - protein, 20 aa, Staphylococcus epidermidis
AAELRLGIVNGEIESHIQLS

SEQ ID NO: 1816829 - protein, 21 aa, Staphylococcus epidermidis
AAQTLYFLYSMKLLDQSNSYE

SEQ ID NO: 1816830 - protein, 20 aa, Staphylococcus epidermidis
ACLLTAVPVMKFFKYFYSNR

SEQ ID NO: 1816831 - protein, 18 aa, Staphylococcus epidermidis
ADCKLVLENLCHEQVLTS

SEQ ID NO: 1816832 - protein, 22 aa, Staphylococcus epidermidis
ADISLKRSFPFISQLAKEFNVD

SEQ ID NO: 1816833 - protein, 19 aa, Staphylococcus epidermidis
ADLDMVICITEHIPVVDMV

SEQ ID NO: 1816834 - protein, 24 aa, Staphylococcus epidermidis
ADLPNQFNALKWQKFQLTNDDGSI

SEQ ID NO: 1816835 - protein, 18 aa, Staphylococcus epidermidis
ADYWKAYDFNSGYFMALK

SEQ ID NO: 1816836 - protein, 22 aa, Staphylococcus epidermidis
AEAKVKAEKVLKTFKDLNNAQR

SEQ ID NO: 1816837 - protein, 22 aa, Staphylococcus epidermidis
AEAYKASYLFSYLAFMNIIKKR

SEQ ID NO: 1816838 - protein, 18 aa, Staphylococcus epidermidis
AEDKRLFVVSSKKTDVLI

SEQ ID NO: 1816839 - protein, 20 aa, Staphylococcus epidermidis
AEGKALFFVKGQYVAGAGGK

SEQ ID NO: 1816840 - protein, 18 aa, Staphylococcus epidermidis
AEKFWDFMAKVEKENEKS

SEQ ID NO: 1816841 - protein, 23 aa, Staphylococcus epidermidis
AEKGGYNYFSFKGIRSKGNNELH

SEQ ID NO: 1816842 - protein, 17 aa, Staphylococcus epidermidis
AELKVYMIASVEERAER

SEQ ID NO: 1816843 - protein, 22 aa, Staphylococcus epidermidis
AELLLRVAAIIRRRKEEISAVM

SEQ ID NO: 1816844 - protein, 20 aa, Staphylococcus epidermidis
AELPAGVGDYLFERLRLTAH

SEQ ID NO: 1816845 - protein, 18 aa, Staphylococcus epidermidis
AEMELRILTKIKEALEDG

SEQ ID NO: 1816846 - protein, 18 aa, Staphylococcus epidermidis
AEMELRILTQIKEALEDG

SEQ ID NO: 1816847 - protein, 20 aa, Staphylococcus epidermidis
AESKERCQLLINPIRDEILN

SEQ ID NO: 1816848 - protein, 25 aa, Staphylococcus epidermidis
AESKKRFEEMLGWFKYEIRQYTESD

SEQ ID NO: 1816849 - protein, 20 aa, Staphylococcus epidermidis
AESWLRSNIKDINFQLYNYA

SEQ ID NO: 1816850 - protein, 18 aa, Staphylococcus epidermidis
AFAYRLPVYNSFGMTETC

SEQ ID NO: 1816851 - protein, 18 aa, Staphylococcus epidermidis
AFDGRGNYTLGIKEQLIF

SEQ ID NO: 1816852 - protein, 21 aa, Staphylococcus epidermidis
AFDLLEYALKFAFEHYSIHKV

SEQ ID NO: 1816853 - protein, 24 aa, Staphylococcus epidermidis
AFEQFALAVGETFAKSGMLDGIRM

SEQ ID NO: 1816854 - protein, 17 aa, Staphylococcus epidermidis
AGNALAFAHGFNIHFGV

SEQ ID NO: 1816855 - protein, 17 aa, Staphylococcus epidermidis
AGYHLAIATGRPRTETI

SEQ ID NO: 1816856 - protein, 20 aa, Staphylococcus epidermidis
AGYKAGIEYLNFDEQPATIL

SEQ ID NO: 1816857 - protein, 19 aa, Staphylococcus epidermidis
AHCLSEWGYDFRPHYALIG

SEQ ID NO: 1816858 - protein, 17 aa, Staphylococcus epidermidis
AHIHPIFGMTIYLTDGL

SEQ ID NO: 1816859 - protein, 19 aa, Staphylococcus epidermidis
AHNHIKWIGNTNELNASYA

SEQ ID NO: 1816860 - protein, 17 aa, Staphylococcus epidermidis
AHSGFSIETQFMPNDIN

SEQ ID NO: 1816861 - protein, 18 aa, Staphylococcus epidermidis
AIEDARLYIIKQYANGLP

SEQ ID NO: 1816862 - protein, 18 aa, Staphylococcus epidermidis
AIEQAFKIAKAHGVTTIL

SEQ ID NO: 1816863 - protein, 23 aa, Staphylococcus epidermidis
AIKFPSFRPDSWRGKRYLYTGLF

SEQ ID NO: 1816864 - protein, 18 aa, Staphylococcus epidermidis
AIKNGWKMNDFVGPVDHG

SEQ ID NO: 1816865 - protein, 18 aa, Staphylococcus epidermidis
AILEKCIQFVFSLDDDQF

SEQ ID NO: 1816866 - protein, 18 aa, Staphylococcus epidermidis
AIMGRYVLTPEIFDYLET

SEQ ID NO: 1816867 - protein, 23 aa, Staphylococcus epidermidis
AINKSRGKWCIKLSTGDKMITDC

SEQ ID NO: 1816868 - protein, 23 aa, Staphylococcus epidermidis
AINKSRGKWCIKLSTGDKMVTDC

SEQ ID NO: 1816869 - protein, 24 aa, Staphylococcus epidermidis
AIPYEHPLFLGMGGMHGSYASNMA

SEQ ID NO: 1816870 - protein, 18 aa, Staphylococcus epidermidis
AISFLKERGYSVATIKHN

SEQ ID NO: 1816871 - protein, 20 aa, Staphylococcus epidermidis
AISQGFSGLEIDVFDFHSNK

SEQ ID NO: 1816872 - protein, 19 aa, Staphylococcus epidermidis
AIYKRDYLCIIGQTVHEKL

SEQ ID NO: 1816873 - protein, 18 aa, Staphylococcus epidermidis
AKAFKRWITNEVLPSIRK

SEQ ID NO: 1816874 - protein, 17 aa, Staphylococcus epidermidis
AKAGLFLAMQYPSEITG

SEQ ID NO: 1816875 - protein, 19 aa, Staphylococcus epidermidis
AKAKDGASCVTYIGPNGAG

SEQ ID NO: 1816876 - protein, 20 aa, Staphylococcus epidermidis
AKARGAEIYAEIVGYGSTGD

SEQ ID NO: 1816877 - protein, 25 aa, Staphylococcus epidermidis
AKATYKFAGGKGINVSRVLKTLDVD

SEQ ID NO: 1816878 - protein, 17 aa, Staphylococcus epidermidis
AKDVFRKDLKIFNINDE

SEQ ID NO: 1816879 - protein, 23 aa, Staphylococcus epidermidis
AKEGLRLKTLFPYINQASENHKK

SEQ ID NO: 1816880 - protein, 23 aa, Staphylococcus epidermidis
AKEIKSTMVGTFFLQDSKELTDP

SEQ ID NO: 1816881 - protein, 18 aa, Staphylococcus epidermidis
AKFKTSALRSWKTDQADA

SEQ ID NO: 1816882 - protein, 19 aa, Staphylococcus epidermidis
AKFKTSALRSWKTDQADAH

SEQ ID NO: 1816883 - protein, 17 aa, Staphylococcus epidermidis
AKFKTSTLRSWKTDQAD

SEQ ID NO: 1816884 - protein, 22 aa, Staphylococcus epidermidis
AKGYYRRVWRDGKARNRVQVVQ

SEQ ID NO: 1816885 - protein, 18 aa, Staphylococcus epidermidis
AKIAYAILRDRLELSIQN

SEQ ID NO: 1816886 - protein, 24 aa, Staphylococcus epidermidis
AKKAFKMAIDYAFLVLNMNKVYLY

SEQ ID NO: 1816887 - protein, 18 aa, Staphylococcus epidermidis
AKLHPAICFTMLGHHLGL

SEQ ID NO: 1816888 - protein, 19 aa, Staphylococcus epidermidis
AKLKGCRVVGIAGGDEKVN

SEQ ID NO: 1816889 - protein, 19 aa, Staphylococcus epidermidis
AKLKGCRVVGIAGGDKKVN

SEQ ID NO: 1816890 - protein, 21 aa, Staphylococcus epidermidis
AKLKVLYEMFGLKMVDNELSD

SEQ ID NO: 1816891 - protein, 19 aa, Staphylococcus epidermidis
AKLSNCYPIIAVDIFDSRL

SEQ ID NO: 1816892 - protein, 19 aa, Staphylococcus epidermidis
AKNSFKLIYSILAKHQSAS

SEQ ID NO: 1816893 - protein, 19 aa, Staphylococcus epidermidis
AKRFKRWVTSEVLPTLRKT

SEQ ID NO: 1816894 - protein, 20 aa, Staphylococcus epidermidis
AKSFSIRGGDKMAIIGSNGT

SEQ ID NO: 1816895 - protein, 22 aa, Staphylococcus epidermidis
ALELAEQMGIIFIDEIDKVATN

SEQ ID NO: 1816896 - protein, 18 aa, Staphylococcus epidermidis
ALKLKLSPNEVWNAVTVN

SEQ ID NO: 1816897 - protein, 18 aa, Staphylococcus epidermidis
ALKTRGYRVCIFKPFQTE

SEQ ID NO: 1816898 - protein, 19 aa, Staphylococcus epidermidis
ALLRASAYGKLNIMFPMVA

SEQ ID NO: 1816899 - protein, 17 aa, Staphylococcus epidermidis
ALLSLPFDYMFFTGSEK

SEQ ID NO: 1816900 - protein, 23 aa, Staphylococcus epidermidis
ALLSRKRLLLLTVDSIEFILVKG

SEQ ID NO: 1816901 - protein, 17 aa, Staphylococcus epidermidis
ALQLRFILDWNSQSHRP

SEQ ID NO: 1816902 - protein, 19 aa, Staphylococcus epidermidis
ALTAHLGFGNYELRLPLIP

SEQ ID NO: 1816903 - protein, 22 aa, Staphylococcus epidermidis
ALYCLDCLPSQFDTAQLKEIVD

SEQ ID NO: 1816904 - protein, 23 aa, Staphylococcus epidermidis
AMSQEGYHFFGLLYIGAILTKEG

SEQ ID NO: 1816905 - protein, 22 aa, Staphylococcus epidermidis
ANAESKERCQLLIKPIRDEILN

SEQ ID NO: 1816906 - protein, 17 aa, Staphylococcus epidermidis
ANAESKERCQLLINPIR

SEQ ID NO: 1816907 - protein, 19 aa, Staphylococcus epidermidis
ANCLMARIGKRISLDQQQA

SEQ ID NO: 1816908 - protein, 24 aa, Staphylococcus epidermidis
ANDWSEVRPEWGLARNAEFIIGKR

SEQ ID NO: 1816909 - protein, 26 aa, Staphylococcus epidermidis
ANEFKNYILGLIFYRFLSEKVEESSA

SEQ ID NO: 1816910 - protein, 18 aa, Staphylococcus epidermidis
ANFPAGVGDYLFERLRLT

SEQ ID NO: 1816911 - protein, 20 aa, Staphylococcus epidermidis
ANLKRPILFYTYDLDKYKDE

SEQ ID NO: 1816912 - protein, 19 aa, Staphylococcus epidermidis
ANLSPGTRLHFVEIPTNDY

SEQ ID NO: 1816913 - protein, 18 aa, Staphylococcus epidermidis
ANVIRYAQYLNELSEQTQ

SEQ ID NO: 1816914 - protein, 19 aa, Staphylococcus epidermidis
APFESFAGFKSYRLLRPLE

SEQ ID NO: 1816915 - protein, 19 aa, Staphylococcus epidermidis
APFPSRWLYVVKHLQTLIQ

SEQ ID NO: 1816916 - protein, 18 aa, Staphylococcus epidermidis
APNLFKLGGIQKVANQKW

SEQ ID NO: 1816917 - protein, 19 aa, Staphylococcus epidermidis
AQELLNFIGDYTIVTILTV

SEQ ID NO: 1816918 - protein, 18 aa, Staphylococcus epidermidis
AQGFEVLDGNSFNEFVVK

SEQ ID NO: 1816919 - protein, 19 aa, Staphylococcus epidermidis
AQMKMFLTRLGFGSKMVVT

SEQ ID NO: 1816920 - protein, 19 aa, Staphylococcus epidermidis
AQNDFLYDRVDVVVATNAF

SEQ ID NO: 1816921 - protein, 18 aa, Staphylococcus epidermidis
ARAFDEIVEIYNDVDNFS

SEQ ID NO: 1816922 - protein, 21 aa, Staphylococcus epidermidis
ARAYRLLRVGSFLLSNEGYKI

SEQ ID NO: 1816923 - protein, 18 aa, Staphylococcus epidermidis
AREYFKIFFSKLLSSITI

SEQ ID NO: 1816924 - protein, 22 aa, Staphylococcus epidermidis
ARGFTVKVPPEYLGGQNNKNFI

SEQ ID NO: 1816925 - protein, 20 aa, Staphylococcus epidermidis
ARLTNFGAFINIGGVDGLVH

SEQ ID NO: 1816926 - protein, 17 aa, Staphylococcus epidermidis
ARPALAEVAFIGKAPGK

SEQ ID NO: 1816927 - protein, 18 aa, Staphylococcus epidermidis
ARPVWKPMHLQPLYEGYE

SEQ ID NO: 1816928 - protein, 22 aa, Staphylococcus epidermidis
ARRGELVSCFLLEIDDSLNSIN

SEQ ID NO: 1816929 - protein, 20 aa, Staphylococcus epidermidis
ARRGELVSCFLLEVDDSLNS

SEQ ID NO: 1816930 - protein, 18 aa, Staphylococcus epidermidis
ARRLKQWIDRPLINKQQI

SEQ ID NO: 1816931 - protein, 19 aa, Staphylococcus epidermidis
ARRLKQWVDRPLINKNQIN

SEQ ID NO: 1816932 - protein, 17 aa, Staphylococcus epidermidis
ASCWIYKKGDAIPSTIP

SEQ ID NO: 1816933 - protein, 18 aa, Staphylococcus epidermidis
ASGWIAHILEQYRDNRIM

SEQ ID NO: 1816934 - protein, 22 aa, Staphylococcus epidermidis
ASHAQYRLGIRPEDLHLVEDNE

SEQ ID NO: 1816935 - protein, 17 aa, Staphylococcus epidermidis
ASILRKAFHLNFDDVGE

SEQ ID NO: 1816936 - protein, 17 aa, Staphylococcus epidermidis
ASINEVFSRMQSVSSQI

SEQ ID NO: 1816937 - protein, 20 aa, Staphylococcus epidermidis
ASKFKNLCVVGDSDQSIYGW

SEQ ID NO: 1816938 - protein, 20 aa, Staphylococcus epidermidis
ASPEFMFPSFYGIDVSTTAE

SEQ ID NO: 1816939 - protein, 19 aa, Staphylococcus epidermidis
ASTHPGAGVPIVLTSAKIT

SEQ ID NO: 1816940 - protein, 20 aa, Staphylococcus epidermidis
ASWSPRLHFNASLFQIEDDD

SEQ ID NO: 1816941 - protein, 25 aa, Staphylococcus epidermidis
ATATYKFAGGKGINVSRVLKTLDVD

SEQ ID NO: 1816942 - protein, 20 aa, Staphylococcus epidermidis
ATEALPNWAAENGYPVTNYE

SEQ ID NO: 1816943 - protein, 18 aa, Staphylococcus epidermidis
ATIKEFRDAKSILLEEKE

SEQ ID NO: 1816944 - protein, 20 aa, Staphylococcus epidermidis
AVFDMMNWWFEKGIDGFRVD

SEQ ID NO: 1816945 - protein, 24 aa, Staphylococcus epidermidis
AVGIGGLNNAFGFKLDTYHNTSPP

SEQ ID NO: 1816946 - protein, 17 aa, Staphylococcus epidermidis
AVGRDVGRIMGFDETTL

SEQ ID NO: 1816947 - protein, 20 aa, Staphylococcus epidermidis
AVIIQAAFELGERINSTSTF

SEQ ID NO: 1816948 - protein, 20 aa, Staphylococcus epidermidis
AVILQAAFELGERINSTSTL

SEQ ID NO: 1816949 - protein, 24 aa, Staphylococcus epidermidis
AVRDARISYEWYKMVVSIIGDGLT

SEQ ID NO: 1816950 - protein, 18 aa, Staphylococcus epidermidis
AVVDACFTPVLAPFITIR

SEQ ID NO: 1816951 - protein, 19 aa, Staphylococcus epidermidis
AVWDLPMVFAEFGEEDFHP

SEQ ID NO: 1816952 - protein, 18 aa, Staphylococcus epidermidis
AYAPEFEKVIPLNIMLIE

SEQ ID NO: 1816953 - protein, 17 aa, Staphylococcus epidermidis
AYEMLPVVMDYKTKEVA

SEQ ID NO: 1816954 - protein, 20 aa, Staphylococcus epidermidis
AYHILDIVFWFGHLDILTTN

SEQ ID NO: 1816955 - protein, 18 aa, Staphylococcus epidermidis
AYLLLDFHATIFNESQLT

SEQ ID NO: 1816956 - protein, 26 aa, Staphylococcus epidermidis
AYRGAYPIFYWKEFDYIIEKHGGTSP

SEQ ID NO: 1816957 - protein, 17 aa, Staphylococcus epidermidis
AYYKYAHEFSGGQRQRI

SEQ ID NO: 1816958 - protein, 20 aa, Staphylococcus epidermidis
CAAGSRSARVVQYLEEQDIH

SEQ ID NO: 1816959 - protein, 21 aa, Staphylococcus epidermidis
CAHMMIWEGIELLPVTNNNKK

SEQ ID NO: 1816960 - protein, 18 aa, Staphylococcus epidermidis
CCGCGFHSKFLIDKGHHV

SEQ ID NO: 1816961 - protein, 18 aa, Staphylococcus epidermidis
CCQSCRWDYDLLQVDDDG

SEQ ID NO: 1816962 - protein, 20 aa, Staphylococcus epidermidis
CGDIAVSVYSGWLAYSTFDH

SEQ ID NO: 1816963 - protein, 17 aa, Staphylococcus epidermidis
CGMGGPLIASILKEGQE

SEQ ID NO: 1816964 - protein, 24 aa, Staphylococcus epidermidis
CGSGSLLLRVGREADVRFYYGQEY

SEQ ID NO: 1816965 - protein, 23 aa, Staphylococcus epidermidis
CIAADIHPIFGMTLILTDGLYKV

SEQ ID NO: 1816966 - protein, 18 aa, Staphylococcus epidermidis
CIFNHQWSNERIHQLVKS

SEQ ID NO: 1816967 - protein, 21 aa, Staphylococcus epidermidis
CIRNGKVLNCYIPSLRMRTLL

SEQ ID NO: 1816968 - protein, 17 aa, Staphylococcus epidermidis
CIVGSSLVKTAIFGEDP

SEQ ID NO: 1816969 - protein, 17 aa, Staphylococcus epidermidis
CKDYQQIWGLSQDVQVS

SEQ ID NO: 1816970 - protein, 17 aa, Staphylococcus epidermidis
CKECLRSDIDINDDGLC

SEQ ID NO: 1816971 - protein, 17 aa, Staphylococcus epidermidis
CKPDFLLNVALNKSKEI

SEQ ID NO: 1816972 - protein, 19 aa, Staphylococcus epidermidis
CLINHDFSYVIGRTQAGTL

SEQ ID NO: 1816973 - protein, 23 aa, Staphylococcus epidermidis
CQLWKEISQLIGPIETINGTKIS

SEQ ID NO: 1816974 - protein, 19 aa, Staphylococcus epidermidis
CSAGSRILVHNSIKDQFEK

SEQ ID NO: 1816975 - protein, 20 aa, Staphylococcus epidermidis
CSAGSRLLVQSSIYDKLIPK

SEQ ID NO: 1816976 - protein, 20 aa, Staphylococcus epidermidis
CSAGSRLLVQSSIYNELLPK

SEQ ID NO: 1816977 - protein, 17 aa, Staphylococcus epidermidis
CSGRLSGYIKSYGVHAI

SEQ ID NO: 1816978 - protein, 18 aa, Staphylococcus epidermidis
CWYILDAEPGAEIIYGVD

SEQ ID NO: 1816979 - protein, 18 aa, Staphylococcus epidermidis
CYFDRHLLQSSGFVKNII

SEQ ID NO: 1816980 - protein, 18 aa, Staphylococcus epidermidis
CYLGDFKTTGGIFATTEN

SEQ ID NO: 1816981 - protein, 17 aa, Staphylococcus epidermidis
DACSAPGGKACHMAEIL

SEQ ID NO: 1816982 - protein, 24 aa, Staphylococcus epidermidis
DAEGRYGTFAKYFTKNDVPTFAIC

SEQ ID NO: 1816983 - protein, 18 aa, Staphylococcus epidermidis
DAELRGVASSGMICSMKE

SEQ ID NO: 1816984 - protein, 21 aa, Staphylococcus epidermidis
DAFARRSRYALDIDFKEEPPW

SEQ ID NO: 1816985 - protein, 18 aa, Staphylococcus epidermidis
DAIKEWHRILPLIQELPI

SEQ ID NO: 1816986 - protein, 17 aa, Staphylococcus epidermidis
DAIKNKVSFLIDKKSGY

SEQ ID NO: 1816987 - protein, 18 aa, Staphylococcus epidermidis
DARYKNWFPNFTLGDLIS

SEQ ID NO: 1816988 - protein, 20 aa, Staphylococcus epidermidis
DASIKWALGLMNEGSQIIDN

SEQ ID NO: 1816989 - protein, 20 aa, Staphylococcus epidermidis
DCRRTMEIFKLLGVSITENE

SEQ ID NO: 1816990 - protein, 17 aa, Staphylococcus epidermidis
DCTQFPFRIARPGSVTK

SEQ ID NO: 1816991 - protein, 26 aa, Staphylococcus epidermidis
DCVKKLAEMNLEFELGVLLSKKQYWY

SEQ ID NO: 1816992 - protein, 17 aa, Staphylococcus epidermidis
DDALRLAHEDLYETKSI

SEQ ID NO: 1816993 - protein, 22 aa, Staphylococcus epidermidis
DDLKPRYALNVLVEMANQSDLD

SEQ ID NO: 1816994 - protein, 17 aa, Staphylococcus epidermidis
DDTSFFDIVAFGKTAQL

SEQ ID NO: 1816995 - protein, 17 aa, Staphylococcus epidermidis
DEAHCLSEWGYDFRPHY

SEQ ID NO: 1816996 - protein, 19 aa, Staphylococcus epidermidis
DEEIFKYVINYLIAYIKKE

SEQ ID NO: 1816997 - protein, 17 aa, Staphylococcus epidermidis
DEHLIRLSVGIEDYNDI

SEQ ID NO: 1816998 - protein, 19 aa, Staphylococcus epidermidis
DELFKCFAETYAPSMRDSE

SEQ ID NO: 1816999 - protein, 19 aa, Staphylococcus epidermidis
DENIPLWVDRDCPFNIEGG

SEQ ID NO: 1817000 - protein, 19 aa, Staphylococcus epidermidis
DENVPLWLDRDCPFNIEGG

SEQ ID NO: 1817001 - protein, 18 aa, Staphylococcus epidermidis
DERAKAGLFLAMQYPSEI

SEQ ID NO: 1817002 - protein, 19 aa, Staphylococcus epidermidis
DERAKAGLFLAMQYPSEIT

SEQ ID NO: 1817003 - protein, 21 aa, Staphylococcus epidermidis
DETSLRTGVRIVIDVRKDANA

SEQ ID NO: 1817004 - protein, 19 aa, Staphylococcus epidermidis
DEVIPRNVIHIGFTSGTTG

SEQ ID NO: 1817005 - protein, 20 aa, Staphylococcus epidermidis
DEVKRRIFLGTFALSSGYYD

SEQ ID NO: 1817006 - protein, 24 aa, Staphylococcus epidermidis
DFDIGFKLYDVFTILYLLDPEAFN

SEQ ID NO: 1817007 - protein, 19 aa, Staphylococcus epidermidis
DFESLCFHVPFTKMGKKAL

SEQ ID NO: 1817008 - protein, 21 aa, Staphylococcus epidermidis
DFKGSWSVVCFYPADFSFVCP

SEQ ID NO: 1817009 - protein, 28 aa, Staphylococcus epidermidis
DFKSKEIIELISITILVSRLIKEIENVF

SEQ ID NO: 1817010 - protein, 18 aa, Staphylococcus epidermidis
DFLNCAFGLVPTELNNFE

SEQ ID NO: 1817011 - protein, 23 aa, Staphylococcus epidermidis
DGATKEFFSWGFRVGFMTFGINH

SEQ ID NO: 1817012 - protein, 20 aa, Staphylococcus epidermidis
DGRSKFGYINVYNQGSSAGW

SEQ ID NO: 1817013 - protein, 18 aa, Staphylococcus epidermidis
DHQCSISQLFDCDKQQHT

SEQ ID NO: 1817014 - protein, 17 aa, Staphylococcus epidermidis
DIDRFGIQEVIERALEY

SEQ ID NO: 1817015 - protein, 28 aa, Staphylococcus epidermidis
DIEYKFPFGWGELWGIASRTDFDLRQHS

SEQ ID NO: 1817016 - protein, 18 aa, Staphylococcus epidermidis
DIFAPCALGGILNDDTIP

SEQ ID NO: 1817017 - protein, 18 aa, Staphylococcus epidermidis
DIIDEFKSLGGYEYEDIE

SEQ ID NO: 1817018 - protein, 23 aa, Staphylococcus epidermidis
DIIDEFKSLGGYEYEDIETRVVQ

SEQ ID NO: 1817019 - protein, 24 aa, Staphylococcus epidermidis
DIKEFKPDLFISHYPLLMTYSHKL

SEQ ID NO: 1817020 - protein, 27 aa, Staphylococcus epidermidis
DILLRRIYKLPIGFKWENQPNVTLIGD

SEQ ID NO: 1817021 - protein, 24 aa, Staphylococcus epidermidis
DIRMREVISYFATYVFEKGAEVPA

SEQ ID NO: 1817022 - protein, 17 aa, Staphylococcus epidermidis
DKLECQRTINAFIPKAH

SEQ ID NO: 1817023 - protein, 24 aa, Staphylococcus epidermidis
DKLKGRLILMITRFSVYLRKATPE

SEQ ID NO: 1817024 - protein, 21 aa, Staphylococcus epidermidis
DKRIKLGVIPSFSLYKLHEKN

SEQ ID NO: 1817025 - protein, 17 aa, Staphylococcus epidermidis
DKTWSVHVPRRIKEIGP

SEQ ID NO: 1817026 - protein, 17 aa, Staphylococcus epidermidis
DKVSAKRIIDFLSGTVY

SEQ ID NO: 1817027 - protein, 23 aa, Staphylococcus epidermidis
DLCSYLYHKGHRHIIFINESGQY

SEQ ID NO: 1817028 - protein, 22 aa, Staphylococcus epidermidis
DLDPVFMWHLAYAYGQEERDKE

SEQ ID NO: 1817029 - protein, 23 aa, Staphylococcus epidermidis
DLEIPRVLGDIIICTDVAQEQAE

SEQ ID NO: 1817030 - protein, 21 aa, Staphylococcus epidermidis
DLFIDWIWGESFFKQKLIDYY

SEQ ID NO: 1817031 - protein, 23 aa, Staphylococcus epidermidis
DLFTCLRPVRWFQGVPSPVKRPE

SEQ ID NO: 1817032 - protein, 24 aa, Staphylococcus epidermidis
DLKDRYEFIGGLSPLAGTTDRQAE

SEQ ID NO: 1817033 - protein, 23 aa, Staphylococcus epidermidis
DLKGSWNVVCFYPADFSFVCPTE

SEQ ID NO: 1817034 - protein, 21 aa, Staphylococcus epidermidis
DLKKYGFKFLGPVTVFSFLEA

SEQ ID NO: 1817035 - protein, 18 aa, Staphylococcus epidermidis
DLQMSLDVITRVGVAVVT

SEQ ID NO: 1817036 - protein, 19 aa, Staphylococcus epidermidis
DLRRLGLRVYFNIKNALVS

SEQ ID NO: 1817037 - protein, 25 aa, Staphylococcus epidermidis
DLSLEPKLFLQICCIGAGIPQINKK

SEQ ID NO: 1817038 - protein, 23 aa, Staphylococcus epidermidis
DLSRGCSIEDVYNLSIITAAQSL

SEQ ID NO: 1817039 - protein, 23 aa, Staphylococcus epidermidis
DMKGQLLYRRYELLYQPQDTNTG

SEQ ID NO: 1817040 - protein, 17 aa, Staphylococcus epidermidis
DNCTVCHAVLPQIQDLL

SEQ ID NO: 1817041 - protein, 17 aa, Staphylococcus epidermidis
DNGFDFYAPQTFIDADG

SEQ ID NO: 1817042 - protein, 17 aa, Staphylococcus epidermidis
DNGFKLAADIKVTLENI

SEQ ID NO: 1817043 - protein, 24 aa, Staphylococcus epidermidis
DNGIKFFGSDGFKLSDDQENEIET

SEQ ID NO: 1817044 - protein, 22 aa, Staphylococcus epidermidis
DNRYGCVLAIEILELLKDTELD

SEQ ID NO: 1817045 - protein, 19 aa, Staphylococcus epidermidis
DPEKKLAYDNALSKAEQLL

SEQ ID NO: 1817046 - protein, 18 aa, Staphylococcus epidermidis
DPFTCPHGRPIIINFSNY

SEQ ID NO: 1817047 - protein, 22 aa, Staphylococcus epidermidis
DPKFKRWVIGSILSRTYYHNMV

SEQ ID NO: 1817048 - protein, 21 aa, Staphylococcus epidermidis
DPRFKRWVIGSILSRTYYHNM

SEQ ID NO: 1817049 - protein, 22 aa, Staphylococcus epidermidis
DPRFKRWVIGSILSRTYYHNMV

SEQ ID NO: 1817050 - protein, 17 aa, Staphylococcus epidermidis
DQDTKWLSVLPIYHISG

SEQ ID NO: 1817051 - protein, 18 aa, Staphylococcus epidermidis
DQLICNWLNIVDDILPQL

SEQ ID NO: 1817052 - protein, 17 aa, Staphylococcus epidermidis
DQVSAKRIIDFLSGTVY

SEQ ID NO: 1817053 - protein, 17 aa, Staphylococcus epidermidis
DRIRLTFDIEDGIINDA

SEQ ID NO: 1817054 - protein, 22 aa, Staphylococcus epidermidis
DRLDVEGPFYFKNLSKEDDFER

SEQ ID NO: 1817055 - protein, 18 aa, Staphylococcus epidermidis
DSEFKLGMKQAYNATNYK

SEQ ID NO: 1817056 - protein, 21 aa, Staphylococcus epidermidis
DSFCVLNHLFVNGGNEEVFES

SEQ ID NO: 1817057 - protein, 20 aa, Staphylococcus epidermidis
DSICCVIDIPIHLYMRITGH

SEQ ID NO: 1817058 - protein, 20 aa, Staphylococcus epidermidis
DSKGGFYFTDFRGYSTQPLG

SEQ ID NO: 1817059 - protein, 18 aa, Staphylococcus epidermidis
DSMNWNEITEGIGHIPGR

SEQ ID NO: 1817060 - protein, 17 aa, Staphylococcus epidermidis
DSPGGWQIIGRTPLKVF

SEQ ID NO: 1817061 - protein, 23 aa, Staphylococcus epidermidis
DSTVCILEAMKLFNEIQAETSGE

SEQ ID NO: 1817062 - protein, 23 aa, Staphylococcus epidermidis
DSTVCILEAMKLFNEIQAETTGE

SEQ ID NO: 1817063 - protein, 24 aa, Staphylococcus epidermidis
DSVTAYDFVYAWRKVVNPKTASEF

SEQ ID NO: 1817064 - protein, 19 aa, Staphylococcus epidermidis
DSWNRLSLRNTDTYIALLL

SEQ ID NO: 1817065 - protein, 26 aa, Staphylococcus epidermidis
DTGFYRFWIQGIFARWPKNPNIEDLI

SEQ ID NO: 1817066 - protein, 19 aa, Staphylococcus epidermidis
DTGWLPLVLSNGVQPYSTG

SEQ ID NO: 1817067 - protein, 17 aa, Staphylococcus epidermidis
DTLRLEAGLPLHGQDLT

SEQ ID NO: 1817068 - protein, 17 aa, Staphylococcus epidermidis
DVADEFDIQVALHADTL

SEQ ID NO: 1817069 - protein, 18 aa, Staphylococcus epidermidis
DVDFLIAGGLDFEKIKRL

SEQ ID NO: 1817070 - protein, 23 aa, Staphylococcus epidermidis
DVDVPRTDWDWMIYPKGLYDQIM

SEQ ID NO: 1817071 - protein, 24 aa, Staphylococcus epidermidis
DVIPKFEVGGAYTPIEIVNENGYS

SEQ ID NO: 1817072 - protein, 17 aa, Staphylococcus epidermidis
DVSRFNADFAYTMDGSQ

SEQ ID NO: 1817073 - protein, 17 aa, Staphylococcus epidermidis
DYDALLIPGGFSPDHLR

SEQ ID NO: 1817074 - protein, 23 aa, Staphylococcus epidermidis
DYDLRSAYPFQMQCMRMIDFDKP

SEQ ID NO: 1817075 - protein, 17 aa, Staphylococcus epidermidis
DYLFFKFAIHTGVKLTE

SEQ ID NO: 1817076 - protein, 19 aa, Staphylococcus epidermidis
EAAMIAGYFSKAGNSGQIP

SEQ ID NO: 1817077 - protein, 17 aa, Staphylococcus epidermidis
EAFNLYGALSMANAGPN

SEQ ID NO: 1817078 - protein, 20 aa, Staphylococcus epidermidis
EAFWPGPISFILPLKSGYLC

SEQ ID NO: 1817079 - protein, 20 aa, Staphylococcus epidermidis
EALFNFITLLGWSPEGEEEI

SEQ ID NO: 1817080 - protein, 20 aa, Staphylococcus epidermidis
EALKNIITALTWVNLNDSSI

SEQ ID NO: 1817081 - protein, 18 aa, Staphylococcus epidermidis
EAMASFLNSFPMFKDDTR

SEQ ID NO: 1817082 - protein, 17 aa, Staphylococcus epidermidis
EATDFKEEDIELFRDIA

SEQ ID NO: 1817083 - protein, 17 aa, Staphylococcus epidermidis
EAVFRKGDKVLQLVNRP

SEQ ID NO: 1817084 - protein, 18 aa, Staphylococcus epidermidis
EAVPRVGDIVNVIDDLIG

SEQ ID NO: 1817085 - protein, 17 aa, Staphylococcus epidermidis
ECIYALYKKNRRSLQIY

SEQ ID NO: 1817086 - protein, 18 aa, Staphylococcus epidermidis
EDAFKLYDTYGFPVELTE

SEQ ID NO: 1817087 - protein, 23 aa, Staphylococcus epidermidis
EDPRFTDRFELFIVGREHANAFT

SEQ ID NO: 1817088 - protein, 24 aa, Staphylococcus epidermidis
EDQGRYFVRLSFVKTWNKGDEIVN

SEQ ID NO: 1817089 - protein, 22 aa, Staphylococcus epidermidis
EDRLRSRFEWGLIVDITPPDYE

SEQ ID NO: 1817090 - protein, 22 aa, Staphylococcus epidermidis
EDRYLLYLFDWRVIESESKGDN

SEQ ID NO: 1817091 - protein, 18 aa, Staphylococcus epidermidis
EDTIKWSINMGADIVLNH

SEQ ID NO: 1817092 - protein, 19 aa, Staphylococcus epidermidis
EDWNRFTIAVGKLSRTKIF

SEQ ID NO: 1817093 - protein, 17 aa, Staphylococcus epidermidis
EDYCIILGYFVDGAPQL

SEQ ID NO: 1817094 - protein, 19 aa, Staphylococcus epidermidis
EDYDALLIPGGFSPDHLRG

SEQ ID NO: 1817095 - protein, 19 aa, Staphylococcus epidermidis
EEAKSWMLKALEPMGEEYL

SEQ ID NO: 1817096 - protein, 24 aa, Staphylococcus epidermidis
EEAPFLRIDLNEMVGALPKQLTKR

SEQ ID NO: 1817097 - protein, 25 aa, Staphylococcus epidermidis
EEFFARSRFDLMPNKIEPFTAENLE

SEQ ID NO: 1817098 - protein, 18 aa, Staphylococcus epidermidis
EEGFKYLVNKDVTKAQVE

SEQ ID NO: 1817099 - protein, 20 aa, Staphylococcus epidermidis
EEIIEFWKDYGLGTFFEGFM

SEQ ID NO: 1817100 - protein, 20 aa, Staphylococcus epidermidis
EEIIEWKFDYLSELKKQKNA

SEQ ID NO: 1817101 - protein, 21 aa, Staphylococcus epidermidis
EEIILFKGFFARFEFKQINKR

SEQ ID NO: 1817102 - protein, 17 aa, Staphylococcus epidermidis
EEILRFINFAKYNINYI

SEQ ID NO: 1817103 - protein, 23 aa, Staphylococcus epidermidis
EEIPGELIMKILAFDSDLGKIDL

SEQ ID NO: 1817104 - protein, 23 aa, Staphylococcus epidermidis
EEKAHSITAIWNFEKQNYYLKNL

SEQ ID NO: 1817105 - protein, 21 aa, Staphylococcus epidermidis
EEKYLRLYAEFENYKRRIQNE

SEQ ID NO: 1817106 - protein, 23 aa, Staphylococcus epidermidis
EEMAELYNFLGLSVGLNLNSKST

SEQ ID NO: 1817107 - protein, 22 aa, Staphylococcus epidermidis
EENRTLPIFGKYVFSTAAGIHQ

SEQ ID NO: 1817108 - protein, 24 aa, Staphylococcus epidermidis
EEQGRYFVRLSFVKTWNKGDEIVN

SEQ ID NO: 1817109 - protein, 17 aa, Staphylococcus epidermidis
EESYFLFYINRPSIIVG

SEQ ID NO: 1817110 - protein, 24 aa, Staphylococcus epidermidis
EETARQCAIVWGVNPVVKEGRKNT

SEQ ID NO: 1817111 - protein, 24 aa, Staphylococcus epidermidis
EFEFCTPFGSFPVRSPYVGRFNIS

SEQ ID NO: 1817112 - protein, 27 aa, Staphylococcus epidermidis
EFEIPKTWKLIAQMPFGDVREEAKEKE

SEQ ID NO: 1817113 - protein, 19 aa, Staphylococcus epidermidis
EFIKIIKIESVLFEEDLIR

SEQ ID NO: 1817114 - protein, 22 aa, Staphylococcus epidermidis
EFRNYILGLIFYRFLSEKTEEE

SEQ ID NO: 1817115 - protein, 24 aa, Staphylococcus epidermidis
EFRNYILGLIFYRFLSEKTEEEVA

SEQ ID NO: 1817116 - protein, 20 aa, Staphylococcus epidermidis
EFYHPEFKKEYVVLAEEGAQ

SEQ ID NO: 1817117 - protein, 17 aa, Staphylococcus epidermidis
EGELCFGNEPLIRVEAP

SEQ ID NO: 1817118 - protein, 19 aa, Staphylococcus epidermidis
EGFAMPMLLALSHIHQLLI

SEQ ID NO: 1817119 - protein, 27 aa, Staphylococcus epidermidis
EGIKLILKIFEAWKIPIIFVTHSNYEA

SEQ ID NO: 1817120 - protein, 22 aa, Staphylococcus epidermidis
EGLKTRRMVLFMNRNTRTSKGK

SEQ ID NO: 1817121 - protein, 17 aa, Staphylococcus epidermidis
EGLRLSQFYKELMVSTG

SEQ ID NO: 1817122 - protein, 22 aa, Staphylococcus epidermidis
EGSDLPSVIGWRTIEDTERIID

SEQ ID NO: 1817123 - protein, 19 aa, Staphylococcus epidermidis
EGYPVVLIHTAYDNYSVFN

SEQ ID NO: 1817124 - protein, 18 aa, Staphylococcus epidermidis
EHLWRVEIELKRDMVDYW

SEQ ID NO: 1817125 - protein, 18 aa, Staphylococcus epidermidis
EHLWRVEIELKRGMVDYW

SEQ ID NO: 1817126 - protein, 18 aa, Staphylococcus epidermidis
EIGPRGDLALVLDTSENQ

SEQ ID NO: 1817127 - protein, 20 aa, Staphylococcus epidermidis
EIHGRIFISLAVKFSKARLI

SEQ ID NO: 1817128 - protein, 19 aa, Staphylococcus epidermidis
EIIRRLSKVYGIKSISPVI

SEQ ID NO: 1817129 - protein, 21 aa, Staphylococcus epidermidis
EIKEAPDFITVFLGTNDYGLV

SEQ ID NO: 1817130 - protein, 21 aa, Staphylococcus epidermidis
EIKKILIMPTWRDWLNSTYAF

SEQ ID NO: 1817131 - protein, 25 aa, Staphylococcus epidermidis
EIQEIKEFICIYSLSKSESSVLNLR

SEQ ID NO: 1817132 - protein, 19 aa, Staphylococcus epidermidis
EIVELLAFVSFTHCQQEFG

SEQ ID NO: 1817133 - protein, 18 aa, Staphylococcus epidermidis
EIYPCAQDGFDLVYNANA

SEQ ID NO: 1817134 - protein, 24 aa, Staphylococcus epidermidis
EKAHSIRVANDWGITTKDLKIDFT

SEQ ID NO: 1817135 - protein, 17 aa, Staphylococcus epidermidis
EKARLQLVLLMLQRDNV

SEQ ID NO: 1817136 - protein, 21 aa, Staphylococcus epidermidis
EKDLKRTPSFSVNRPGEETGI

SEQ ID NO: 1817137 - protein, 23 aa, Staphylococcus epidermidis
EKFKTTMVTFKFMAPLDYETITS

SEQ ID NO: 1817138 - protein, 21 aa, Staphylococcus epidermidis
EKGYGVAVCYVHPISLFNKGS

SEQ ID NO: 1817139 - protein, 22 aa, Staphylococcus epidermidis
EKIKELQDFIARFSANASKSKQ

SEQ ID NO: 1817140 - protein, 24 aa, Staphylococcus epidermidis
EKLDYLKYLGVDYLWLTPIYESPM

SEQ ID NO: 1817141 - protein, 26 aa, Staphylococcus epidermidis
EKNAMGWYLDGRVSAVVGTHTHIQTS

SEQ ID NO: 1817142 - protein, 24 aa, Staphylococcus epidermidis
EKRAKEPKTDERKKTRQDSSNSKE

SEQ ID NO: 1817143 - protein, 23 aa, Staphylococcus epidermidis
ELANRYVLNEAWKKHALGNYSSW

SEQ ID NO: 1817144 - protein, 18 aa, Staphylococcus epidermidis
ELCVKIGMELFYQTGPEF

SEQ ID NO: 1817145 - protein, 17 aa, Staphylococcus epidermidis
ELDMLYRMIDIINDTLV

SEQ ID NO: 1817146 - protein, 24 aa, Staphylococcus epidermidis
ELFEREMNELIALLNQLKDSTKYP

SEQ ID NO: 1817147 - protein, 23 aa, Staphylococcus epidermidis
ELFKSELKLAIGPIERGGAGGGI

SEQ ID NO: 1817148 - protein, 18 aa, Staphylococcus epidermidis
ELIYHFISFIVAYTLEEN

SEQ ID NO: 1817149 - protein, 18 aa, Staphylococcus epidermidis
ELLFRIKAVLRRYQINAE

SEQ ID NO: 1817150 - protein, 17 aa, Staphylococcus epidermidis
ELQRRALFKNSYNQSTL

SEQ ID NO: 1817151 - protein, 20 aa, Staphylococcus epidermidis
ELVEGLKLVTGFVQDEHATQ

SEQ ID NO: 1817152 - protein, 23 aa, Staphylococcus epidermidis
ELYGYCVGGFIAIETARILIENG

SEQ ID NO: 1817153 - protein, 21 aa, Staphylococcus epidermidis
EMKHRTAFEFHFEDLFTEEEW

SEQ ID NO: 1817154 - protein, 22 aa, Staphylococcus epidermidis
EMKRLGLPVPDGFTITTEACID

SEQ ID NO: 1817155 - protein, 18 aa, Staphylococcus epidermidis
EMTASELIEWGFENNVKN

SEQ ID NO: 1817156 - protein, 17 aa, Staphylococcus epidermidis
ENFKFFVQYGNFKNLEN

SEQ ID NO: 1817157 - protein, 25 aa, Staphylococcus epidermidis
ENHACPLCGFSIGELEPRMFSFNSP

SEQ ID NO: 1817158 - protein, 18 aa, Staphylococcus epidermidis
ENHLKKVSGVGCLVINTI

SEQ ID NO: 1817159 - protein, 19 aa, Staphylococcus epidermidis
ENIEIALKLLKILLKELER

SEQ ID NO: 1817160 - protein, 19 aa, Staphylococcus epidermidis
ENLPGTKWAKLIINSAFSG

SEQ ID NO: 1817161 - protein, 20 aa, Staphylococcus epidermidis
ENRARLVIYPAAMRYAGPRE

SEQ ID NO: 1817162 - protein, 19 aa, Staphylococcus epidermidis
ENYDALLIPGGFSPDHLRG

SEQ ID NO: 1817163 - protein, 18 aa, Staphylococcus epidermidis
EPLCVKIGMELFYQTGPA

SEQ ID NO: 1817164 - protein, 19 aa, Staphylococcus epidermidis
EPLELISLLGNISHIDDKP

SEQ ID NO: 1817165 - protein, 20 aa, Staphylococcus epidermidis
EPPEGIFTPCHFDGEKWIGT

SEQ ID NO: 1817166 - protein, 18 aa, Staphylococcus epidermidis
EPPEGIYTPCHFDGKQWI

SEQ ID NO: 1817167 - protein, 20 aa, Staphylococcus epidermidis
EPRLDDLILMQLIHSPSYSS

SEQ ID NO: 1817168 - protein, 19 aa, Staphylococcus epidermidis
EPYAGFVYDVMKDVLYHTK

SEQ ID NO: 1817169 - protein, 20 aa, Staphylococcus epidermidis
EQRISNFLIWQASYSEFIFN

SEQ ID NO: 1817170 - protein, 17 aa, Staphylococcus epidermidis
EQSKCKRAIILPNNKNI

SEQ ID NO: 1817171 - protein, 18 aa, Staphylococcus epidermidis
EQSKCKRAIILPNNKNIL

SEQ ID NO: 1817172 - protein, 18 aa, Staphylococcus epidermidis
EQSQCKRAIILPNNKNIM

SEQ ID NO: 1817173 - protein, 22 aa, Staphylococcus epidermidis
EQTEVRLVLSFLRTVDNPLQDI

SEQ ID NO: 1817174 - protein, 18 aa, Staphylococcus epidermidis
ERGYQLSKTEYRGREATD

SEQ ID NO: 1817175 - protein, 17 aa, Staphylococcus epidermidis
ERIIPVIPQQGSLGASG

SEQ ID NO: 1817176 - protein, 17 aa, Staphylococcus epidermidis
ERIWGGSALTQFGYDIP

SEQ ID NO: 1817177 - protein, 18 aa, Staphylococcus epidermidis
ERKIPLVLVFEGMDAAGK

SEQ ID NO: 1817178 - protein, 23 aa, Staphylococcus epidermidis
ERLRQFFDFITNFGIMIKGTGED

SEQ ID NO: 1817179 - protein, 18 aa, Staphylococcus epidermidis
ERLVEMRRFILASNHDER

SEQ ID NO: 1817180 - protein, 18 aa, Staphylococcus epidermidis
ESAPHMHLHFIPVNHQGR

SEQ ID NO: 1817181 - protein, 17 aa, Staphylococcus epidermidis
ESFKESLRWGAEIFHNL

SEQ ID NO: 1817182 - protein, 19 aa, Staphylococcus epidermidis
ESKATLSFRTMDLIHKPYH

SEQ ID NO: 1817183 - protein, 19 aa, Staphylococcus epidermidis
ESKEAFDYIAKVVSKQEEG

SEQ ID NO: 1817184 - protein, 25 aa, Staphylococcus epidermidis
ESLQFSVALSTVWKFISRTNKYIDE

SEQ ID NO: 1817185 - protein, 18 aa, Staphylococcus epidermidis
ESMASFLNSFPMFKDDTR

SEQ ID NO: 1817186 - protein, 19 aa, Staphylococcus epidermidis
ESNCGWPSFSKALDDDEIV

SEQ ID NO: 1817187 - protein, 19 aa, Staphylococcus epidermidis
ESNTSWPLAMPVFKMDYAH

SEQ ID NO: 1817188 - protein, 19 aa, Staphylococcus epidermidis
ETDCVPCFRYRDYSNDYMD

SEQ ID NO: 1817189 - protein, 20 aa, Staphylococcus epidermidis
ETDRTGLRIAIELKKDVNSE

SEQ ID NO: 1817190 - protein, 23 aa, Staphylococcus epidermidis
ETEVINVFPIRFVVDKDNEVSDP

SEQ ID NO: 1817191 - protein, 25 aa, Staphylococcus epidermidis
ETGSVVLPGRFFVDIIKKLPGKDVK

SEQ ID NO: 1817192 - protein, 24 aa, Staphylococcus epidermidis
ETHFFKSHESFIIYYLKQLNVDLS

SEQ ID NO: 1817193 - protein, 17 aa, Staphylococcus epidermidis
ETIEWTKSMGADIVLNY

SEQ ID NO: 1817194 - protein, 19 aa, Staphylococcus epidermidis
ETIKHLYNQLDIYKEQSKR

SEQ ID NO: 1817195 - protein, 17 aa, Staphylococcus epidermidis
ETIKQLYNQVAIYKEQS

SEQ ID NO: 1817196 - protein, 23 aa, Staphylococcus epidermidis
ETLRRYCFDRAFIGMNGIDLKYG

SEQ ID NO: 1817197 - protein, 23 aa, Staphylococcus epidermidis
EVAKAESVAICWAMGITQQDIGS

SEQ ID NO: 1817198 - protein, 20 aa, Staphylococcus epidermidis
EVAKCPKNYLANVLNRYGFS

SEQ ID NO: 1817199 - protein, 19 aa, Staphylococcus epidermidis
EVFCTLAYTGMRAGELLAL

SEQ ID NO: 1817200 - protein, 19 aa, Staphylococcus epidermidis
EVKLRLKGYPAIVFQHEID

SEQ ID NO: 1817201 - protein, 19 aa, Staphylococcus epidermidis
EVLKPGGVYYASFADLTNN

SEQ ID NO: 1817202 - protein, 17 aa, Staphylococcus epidermidis
EVLVNAFSKHGVMVSTT

SEQ ID NO: 1817203 - protein, 18 aa, Staphylococcus epidermidis
EVMSIPTLIVFKDGQPVD

SEQ ID NO: 1817204 - protein, 19 aa, Staphylococcus epidermidis
EVSINWKDLMNFKRTFTDD

SEQ ID NO: 1817205 - protein, 17 aa, Staphylococcus epidermidis
EVTRLAEHLGWKGKGSN

SEQ ID NO: 1817206 - protein, 19 aa, Staphylococcus epidermidis
EVVEKIKVARSFGDLSENS

SEQ ID NO: 1817207 - protein, 24 aa, Staphylococcus epidermidis
EWPELMKLLPRRSRTSIKKKLFQL

SEQ ID NO: 1817208 - protein, 27 aa, Staphylococcus epidermidis
EYDDCLLFFRLGDFYEMFFEDAKEASR

SEQ ID NO: 1817209 - protein, 21 aa, Staphylococcus epidermidis
EYFGKTCLDFSFIDVTARHIV

SEQ ID NO: 1817210 - protein, 17 aa, Staphylococcus epidermidis
EYFIFGGLYKIKKIEPE

SEQ ID NO: 1817211 - protein, 19 aa, Staphylococcus epidermidis
EYIDFRYLINLSYHLEKMR

SEQ ID NO: 1817212 - protein, 20 aa, Staphylococcus epidermidis
EYSVSIALQLVRKFPTIEKR

SEQ ID NO: 1817213 - protein, 22 aa, Staphylococcus epidermidis
FAAGYSACFNSALSLILSQNKI

SEQ ID NO: 1817214 - protein, 22 aa, Staphylococcus epidermidis
FAAGYSACFNSALSLILSQNKV

SEQ ID NO: 1817215 - protein, 20 aa, Staphylococcus epidermidis
FAEACILAFSHTKKNKVVVS

SEQ ID NO: 1817216 - protein, 20 aa, Staphylococcus epidermidis
FAKFFKLMLHQGINLAPSKF

SEQ ID NO: 1817217 - protein, 18 aa, Staphylococcus epidermidis
FAKVKGRLIVSCYASNFI

SEQ ID NO: 1817218 - protein, 17 aa, Staphylococcus epidermidis
FANGCNGIFTVIYKNKK

SEQ ID NO: 1817219 - protein, 23 aa, Staphylococcus epidermidis
FAPFSLVVKCGYDGLDLIDAALA

SEQ ID NO: 1817220 - protein, 27 aa, Staphylococcus epidermidis
FAYDCYRRLLQMFGEVVYGIPMLAFDT

SEQ ID NO: 1817221 - protein, 17 aa, Staphylococcus epidermidis
FCTKIAWIEGGKLKDFG

SEQ ID NO: 1817222 - protein, 17 aa, Staphylococcus epidermidis
FDDLDWYAKILYTIYRN

SEQ ID NO: 1817223 - protein, 17 aa, Staphylococcus epidermidis
FDDVISMVANWFPSQAT

SEQ ID NO: 1817224 - protein, 18 aa, Staphylococcus epidermidis
FDDVRTFFNILVLGKMGM

SEQ ID NO: 1817225 - protein, 23 aa, Staphylococcus epidermidis
FDKKVIVTWCVGHLIQLAHMEDY

SEQ ID NO: 1817226 - protein, 17 aa, Staphylococcus epidermidis
FDKLRFVHHSIPNIDVN

SEQ ID NO: 1817227 - protein, 19 aa, Staphylococcus epidermidis
FDKVVKYESVFNFDEMIEN

SEQ ID NO: 1817228 - protein, 20 aa, Staphylococcus epidermidis
FDLSKGFPLLTTKKVSFKLI

SEQ ID NO: 1817229 - protein, 18 aa, Staphylococcus epidermidis
FDNIRNGLDFGYADDPLA

SEQ ID NO: 1817230 - protein, 18 aa, Staphylococcus epidermidis
FDNLKWLGLDWDESIDKD

SEQ ID NO: 1817231 - protein, 17 aa, Staphylococcus epidermidis
FDRFKLNIFISLAELES

SEQ ID NO: 1817232 - protein, 18 aa, Staphylococcus epidermidis
FDTYAKRRVRLLGVDTPE

SEQ ID NO: 1817233 - protein, 23 aa, Staphylococcus epidermidis
FDVSRILGLPAFIDILTILEPNS

SEQ ID NO: 1817234 - protein, 18 aa, Staphylococcus epidermidis
FDYMKRTMLKHGLDEVTS

SEQ ID NO: 1817235 - protein, 23 aa, Staphylococcus epidermidis
FEEGKRAVLLLHGFTGNSADVRQ

SEQ ID NO: 1817236 - protein, 19 aa, Staphylococcus epidermidis
FEEPFNFGATIGRYAGRIE

SEQ ID NO: 1817237 - protein, 19 aa, Staphylococcus epidermidis
FEEPFNFGATVGRYAGRIE

SEQ ID NO: 1817238 - protein, 25 aa, Staphylococcus epidermidis
FEGGHSWKSWKPMLGDILKYFLSDV

SEQ ID NO: 1817239 - protein, 17 aa, Staphylococcus epidermidis
FEIIDPYSLNRQGPDIG

SEQ ID NO: 1817240 - protein, 17 aa, Staphylococcus epidermidis
FEKGLEMLKELIWNPLI

SEQ ID NO: 1817241 - protein, 17 aa, Staphylococcus epidermidis
FELELFKILLNTIEDFP

SEQ ID NO: 1817242 - protein, 17 aa, Staphylococcus epidermidis
FEMIACMVASWKVGASY

SEQ ID NO: 1817243 - protein, 23 aa, Staphylococcus epidermidis
FENKPLYCLMPFSNTIKNKLEYL

SEQ ID NO: 1817244 - protein, 21 aa, Staphylococcus epidermidis
FEPYELIEWFVFQSYDRESLR

SEQ ID NO: 1817245 - protein, 21 aa, Staphylococcus epidermidis
FETRAGTLLRYYTGLLESSRD

SEQ ID NO: 1817246 - protein, 17 aa, Staphylococcus epidermidis
FFDMCHILNLLVNQWEK

SEQ ID NO: 1817247 - protein, 17 aa, Staphylococcus epidermidis
FGATIGRYAGRIANASF

SEQ ID NO: 1817248 - protein, 17 aa, Staphylococcus epidermidis
FGGYDGKGQILIRDDSE

SEQ ID NO: 1817249 - protein, 22 aa, Staphylococcus epidermidis
FGIAGLRLGVIIGHEATIRLIQ

SEQ ID NO: 1817250 - protein, 17 aa, Staphylococcus epidermidis
FGLSIKHGLALNAVNKV

SEQ ID NO: 1817251 - protein, 18 aa, Staphylococcus epidermidis
FGPAWIERFVRLQIEEAF

SEQ ID NO: 1817252 - protein, 17 aa, Staphylococcus epidermidis
FGTIDSWLVWKLSGRTA

SEQ ID NO: 1817253 - protein, 17 aa, Staphylococcus epidermidis
FHKLPLEDRVALFGLEK

SEQ ID NO: 1817254 - protein, 19 aa, Staphylococcus epidermidis
FIEDFSIKISDVMTKDDLI

SEQ ID NO: 1817255 - protein, 19 aa, Staphylococcus epidermidis
FIEDFSIKISDVMTKENLI

SEQ ID NO: 1817256 - protein, 17 aa, Staphylococcus epidermidis
FIEEIKSALSIGDTCPI

SEQ ID NO: 1817257 - protein, 17 aa, Staphylococcus epidermidis
FIGCNTNLIAPVTVGDH

SEQ ID NO: 1817258 - protein, 18 aa, Staphylococcus epidermidis
FIIGDGIGPDIWKAASRV

SEQ ID NO: 1817259 - protein, 18 aa, Staphylococcus epidermidis
FINQIGWYLNFEKDIDLI

SEQ ID NO: 1817260 - protein, 18 aa, Staphylococcus epidermidis
FIQERGFELGLMELYVVE

SEQ ID NO: 1817261 - protein, 19 aa, Staphylococcus epidermidis
FIRLKFYLIDLFRQKDTTL

SEQ ID NO: 1817262 - protein, 19 aa, Staphylococcus epidermidis
FIVKTRFGGYDGKGQILIR

SEQ ID NO: 1817263 - protein, 25 aa, Staphylococcus epidermidis
FIYGHSFGALLAFYVTYQLENEYGI

SEQ ID NO: 1817264 - protein, 18 aa, Staphylococcus epidermidis
FKALRFLRPKTYGRHYII

SEQ ID NO: 1817265 - protein, 23 aa, Staphylococcus epidermidis
FKAPRWLVNPIKNYSLRKHREIS

SEQ ID NO: 1817266 - protein, 22 aa, Staphylococcus epidermidis
FKAPRWLVTPIKNYSVRKHKEI

SEQ ID NO: 1817267 - protein, 18 aa, Staphylococcus epidermidis
FKAYRSRRPIDFVSESYQ

SEQ ID NO: 1817268 - protein, 17 aa, Staphylococcus epidermidis
FKDYGILFIDAQYPELR

SEQ ID NO: 1817269 - protein, 21 aa, Staphylococcus epidermidis
FKESLRWGAEIFHNLKSILSE

SEQ ID NO: 1817270 - protein, 18 aa, Staphylococcus epidermidis
FKEYLNSRFENVNLKVKN

SEQ ID NO: 1817271 - protein, 17 aa, Staphylococcus epidermidis
FKGIIGLVTMKKVREPL

SEQ ID NO: 1817272 - protein, 22 aa, Staphylococcus epidermidis
FKGQDAFEFKPYVKLIFASNEL

SEQ ID NO: 1817273 - protein, 22 aa, Staphylococcus epidermidis
FKGSWNVVCFYPADFSFVCPTE

SEQ ID NO: 1817274 - protein, 17 aa, Staphylococcus epidermidis
FKILAEFNLSNENHVNT

SEQ ID NO: 1817275 - protein, 20 aa, Staphylococcus epidermidis
FKITDIRAVARIAKQNNLRL

SEQ ID NO: 1817276 - protein, 17 aa, Staphylococcus epidermidis
FKLKSPLWTLAKDIYQE

SEQ ID NO: 1817277 - protein, 17 aa, Staphylococcus epidermidis
FKNEHFDKIVVYKDDKE

SEQ ID NO: 1817278 - protein, 22 aa, Staphylococcus epidermidis
FKQGFKGICFRTKDINQVKSTL

SEQ ID NO: 1817279 - protein, 22 aa, Staphylococcus epidermidis
FKQRIIHIPVLYGGDFGPDLSE

SEQ ID NO: 1817280 - protein, 21 aa, Staphylococcus epidermidis
FKRIKNFACVEILPNQQRLLL

SEQ ID NO: 1817281 - protein, 18 aa, Staphylococcus epidermidis
FKSLGGYEYEDIENRIVQ

SEQ ID NO: 1817282 - protein, 20 aa, Staphylococcus epidermidis
FKSRITVWVLNYLKANHDKL

SEQ ID NO: 1817283 - protein, 20 aa, Staphylococcus epidermidis
FKSTRLESSLFFPPYKGKFK

SEQ ID NO: 1817284 - protein, 24 aa, Staphylococcus epidermidis
FKVERLKGVFAWGFRIKSSEPEEG

SEQ ID NO: 1817285 - protein, 22 aa, Staphylococcus epidermidis
FKVERLKGVFAWGFRINSSEPE

SEQ ID NO: 1817286 - protein, 24 aa, Staphylococcus epidermidis
FKYFKDRVLVPLAYIDFNEYLEEL

SEQ ID NO: 1817287 - protein, 17 aa, Staphylococcus epidermidis
FKYVINYLIAYIKKEDD

SEQ ID NO: 1817288 - protein, 17 aa, Staphylococcus epidermidis
FLGQNAIKPLLEFIQNI

SEQ ID NO: 1817289 - protein, 18 aa, Staphylococcus epidermidis
FLIAGGLDFEKIKRLEKY

SEQ ID NO: 1817290 - protein, 17 aa, Staphylococcus epidermidis
FLKSIGIEINTNEYGTA

SEQ ID NO: 1817291 - protein, 17 aa, Staphylococcus epidermidis
FLLSHGFFMDGEGKKMS

SEQ ID NO: 1817292 - protein, 24 aa, Staphylococcus epidermidis
FLNPDHMPLILGIEKGWFKEESLE

SEQ ID NO: 1817293 - protein, 17 aa, Staphylococcus epidermidis
FLYGDKIVPFEGESREE

SEQ ID NO: 1817294 - protein, 22 aa, Staphylococcus epidermidis
FMAKEGRGLICAPIDRSIARRL

SEQ ID NO: 1817295 - protein, 18 aa, Staphylococcus epidermidis
FNELMVGIQSPFLIDEDD

SEQ ID NO: 1817296 - protein, 17 aa, Staphylococcus epidermidis
FNFGATIGRYAGRIANA

SEQ ID NO: 1817297 - protein, 17 aa, Staphylococcus epidermidis
FNFGATIGRYAGRIENA

SEQ ID NO: 1817298 - protein, 24 aa, Staphylococcus epidermidis
FNGDIGVIVGIFWAKENALNKDVL

SEQ ID NO: 1817299 - protein, 19 aa, Staphylococcus epidermidis
FNIARKMGYFDIPKDLLIP

SEQ ID NO: 1817300 - protein, 18 aa, Staphylococcus epidermidis
FNIDLEVYMEFMAGGILR

SEQ ID NO: 1817301 - protein, 18 aa, Staphylococcus epidermidis
FNNCIFESVHFYKDLYKD

SEQ ID NO: 1817302 - protein, 20 aa, Staphylococcus epidermidis
FNNIKRLNIETVKQENTSFI

SEQ ID NO: 1817303 - protein, 18 aa, Staphylococcus epidermidis
FNNLFSVNQFCFDEQFIK

SEQ ID NO: 1817304 - protein, 18 aa, Staphylococcus epidermidis
FNNLVLVRFFFKSLTAYL

SEQ ID NO: 1817305 - protein, 19 aa, Staphylococcus epidermidis
FNVAKAMRTGRIWVNTYNQ

SEQ ID NO: 1817306 - protein, 20 aa, Staphylococcus epidermidis
FPDREDFTLLKLGDNVKFVA

SEQ ID NO: 1817307 - protein, 21 aa, Staphylococcus epidermidis
FPGVKGEVLVNAFSKHGVMVS

SEQ ID NO: 1817308 - protein, 17 aa, Staphylococcus epidermidis
FPHRLGHGLGLEEHEYQ

SEQ ID NO: 1817309 - protein, 21 aa, Staphylococcus epidermidis
FPNHKVKIIPLIAMTTSKERM

SEQ ID NO: 1817310 - protein, 17 aa, Staphylococcus epidermidis
FPRIYWQTACLNVDSDS

SEQ ID NO: 1817311 - protein, 19 aa, Staphylococcus epidermidis
FPTAGLILGKSGIRRAYET

SEQ ID NO: 1817312 - protein, 19 aa, Staphylococcus epidermidis
FPTRDWAHRVYPELDVESA

SEQ ID NO: 1817313 - protein, 18 aa, Staphylococcus epidermidis
FPVWMGATTLFFGAINGA

SEQ ID NO: 1817314 - protein, 17 aa, Staphylococcus epidermidis
FQILELFHQTFPGLERL

SEQ ID NO: 1817315 - protein, 34 aa, Staphylococcus epidermidis
FQKLNIEWVFRLLIDWKRIGRMVSIPKFMLKVAK

SEQ ID NO: 1817316 - protein, 17 aa, Staphylococcus epidermidis
FQLIFLLVSNPKHIFTR

SEQ ID NO: 1817317 - protein, 21 aa, Staphylococcus epidermidis
FQLRAKLFVDQIVSFVNNSPY

SEQ ID NO: 1817318 - protein, 20 aa, Staphylococcus epidermidis
FQLTEVGGWLYGRGVSDMKG

SEQ ID NO: 1817319 - protein, 17 aa, Staphylococcus epidermidis
FQSHIALIQTFDLPMKN

SEQ ID NO: 1817320 - protein, 27 aa, Staphylococcus epidermidis
FRDEKRPRFGLLRGREFIMKDAYSFHA

SEQ ID NO: 1817321 - protein, 18 aa, Staphylococcus epidermidis
FRFTGKVNLGNRYEGYSP

SEQ ID NO: 1817322 - protein, 21 aa, Staphylococcus epidermidis
FRGDIFGGYILYNIGFIESED

SEQ ID NO: 1817323 - protein, 18 aa, Staphylococcus epidermidis
FRGLFQFIRFIDELIDRG

SEQ ID NO: 1817324 - protein, 29 aa, Staphylococcus epidermidis
FRKIVLNHRGGFCYEMNHLFGTYLEEKGF

SEQ ID NO: 1817325 - protein, 19 aa, Staphylococcus epidermidis
FRLTIPFDFKSLGFNDYYI

SEQ ID NO: 1817326 - protein, 18 aa, Staphylococcus epidermidis
FRNAGIDFCCGGQESIAS

SEQ ID NO: 1817327 - protein, 19 aa, Staphylococcus epidermidis
FRNAGIDFCCGGQESIASA

SEQ ID NO: 1817328 - protein, 18 aa, Staphylococcus epidermidis
FRSTSKWFGNAFKSLKGN

SEQ ID NO: 1817329 - protein, 17 aa, Staphylococcus epidermidis
FRVGFAVGNKEMIQALK

SEQ ID NO: 1817330 - protein, 22 aa, Staphylococcus epidermidis
FRVPAEQAVPIWTNKERDELQA

SEQ ID NO: 1817331 - protein, 18 aa, Staphylococcus epidermidis
FSDGQSFLSFLKENEQPD

SEQ ID NO: 1817332 - protein, 17 aa, Staphylococcus epidermidis
FSGGFPGDFITQTLEDS

SEQ ID NO: 1817333 - protein, 18 aa, Staphylococcus epidermidis
FSRGHFKGNQFPEGVNAL

SEQ ID NO: 1817334 - protein, 19 aa, Staphylococcus epidermidis
FSSNGRFGGFLNKDLGIKH

SEQ ID NO: 1817335 - protein, 19 aa, Staphylococcus epidermidis
FSTSKFKGYLKYINDEKSN

SEQ ID NO: 1817336 - protein, 18 aa, Staphylococcus epidermidis
FTGYEVLNTFTFRITRNA

SEQ ID NO: 1817337 - protein, 17 aa, Staphylococcus epidermidis
FTLESKATLSFRTMDLI

SEQ ID NO: 1817338 - protein, 19 aa, Staphylococcus epidermidis
FTLNILYPYIETIHITKDK

SEQ ID NO: 1817339 - protein, 17 aa, Staphylococcus epidermidis
FTLNMLYPYIDEILITK

SEQ ID NO: 1817340 - protein, 20 aa, Staphylococcus epidermidis
FTMVKWDISGTLNYMKSREF

SEQ ID NO: 1817341 - protein, 20 aa, Staphylococcus epidermidis
FTQRISMPFLRSPFVHHIHP

SEQ ID NO: 1817342 - protein, 23 aa, Staphylococcus epidermidis
FTSTEINLFFAMCNKLKEKETNT

SEQ ID NO: 1817343 - protein, 17 aa, Staphylococcus epidermidis
FTVYGPWGRPDMALFKF

SEQ ID NO: 1817344 - protein, 20 aa, Staphylococcus epidermidis
FVLEPSYSFSIITSATQHPD

SEQ ID NO: 1817345 - protein, 18 aa, Staphylococcus epidermidis
FVLLCIANSLGIDMTESF

SEQ ID NO: 1817346 - protein, 18 aa, Staphylococcus epidermidis
FYQKEAFLLLSMDMSGIQ

SEQ ID NO: 1817347 - protein, 18 aa, Staphylococcus epidermidis
FYQLLLIKMWELILDYDN

SEQ ID NO: 1817348 - protein, 19 aa, Staphylococcus epidermidis
FYRKNFKTRVVSFVEWLDK

SEQ ID NO: 1817349 - protein, 17 aa, Staphylococcus epidermidis
GAATIAMLGKAPILTAA

SEQ ID NO: 1817350 - protein, 17 aa, Staphylococcus epidermidis
GAELPKVFHYFKEAHPY

SEQ ID NO: 1817351 - protein, 23 aa, Staphylococcus epidermidis
GAHGEWTALMIFKAYHENNGQGH

SEQ ID NO: 1817352 - protein, 17 aa, Staphylococcus epidermidis
GAKIAFYVAQWPNSRLD

SEQ ID NO: 1817353 - protein, 17 aa, Staphylococcus epidermidis
GATTLFFGAINGAKEML

SEQ ID NO: 1817354 - protein, 20 aa, Staphylococcus epidermidis
GCAYVKDHAMFKCDQRFDIV

SEQ ID NO: 1817355 - protein, 23 aa, Staphylococcus epidermidis
GDAFARRSRYALDIDFREEPPWY

SEQ ID NO: 1817356 - protein, 17 aa, Staphylococcus epidermidis
GDCTICVDRCPTGALVG

SEQ ID NO: 1817357 - protein, 22 aa, Staphylococcus epidermidis
GDEAKEYWLCWVTTERSEQGPY

SEQ ID NO: 1817358 - protein, 17 aa, Staphylococcus epidermidis
GDEVVGLDVAHAESEDE

SEQ ID NO: 1817359 - protein, 20 aa, Staphylococcus epidermidis
GDGRIKVYMSYQMDYDEFDK

SEQ ID NO: 1817360 - protein, 19 aa, Staphylococcus epidermidis
GDIAVSVYSGWLAYSTFDH

SEQ ID NO: 1817361 - protein, 20 aa, Staphylococcus epidermidis
GDIFILAKVLHDWNDKQAIK

SEQ ID NO: 1817362 - protein, 24 aa, Staphylococcus epidermidis
GDIRFTKVKLWLMHTGLNLNGSVF

SEQ ID NO: 1817363 - protein, 21 aa, Staphylococcus epidermidis
GDPLIRFDLEYIKNNAKSVIS

SEQ ID NO: 1817364 - protein, 25 aa, Staphylococcus epidermidis
GDSVTAYDFVYAWRKVVNPKTASEF

SEQ ID NO: 1817365 - protein, 18 aa, Staphylococcus epidermidis
GEAVFRKGDKVLQLVNRP

SEQ ID NO: 1817366 - protein, 24 aa, Staphylococcus epidermidis
GEAVSMEWLFRPLLKMLAEGDPVP

SEQ ID NO: 1817367 - protein, 18 aa, Staphylococcus epidermidis
GEIDPVIRFYTWDPATLS

SEQ ID NO: 1817368 - protein, 18 aa, Staphylococcus epidermidis
GEKARLQLVLLMLQRDNV

SEQ ID NO: 1817369 - protein, 18 aa, Staphylococcus epidermidis
GENILPKEVEAILREYKY

SEQ ID NO: 1817370 - protein, 21 aa, Staphylococcus epidermidis
GEQRISNFLIWQASYSEFIFN

SEQ ID NO: 1817371 - protein, 19 aa, Staphylococcus epidermidis
GFGRIGRLAFRRIQDVEGL

SEQ ID NO: 1817372 - protein, 24 aa, Staphylococcus epidermidis
GFGRIGRLAFRSMLDMENVEVVAI

SEQ ID NO: 1817373 - protein, 18 aa, Staphylococcus epidermidis
GFGYRLNLYMSLIILNNK

SEQ ID NO: 1817374 - protein, 22 aa, Staphylococcus epidermidis
GFKKKKLDFGWIVSEVPANVAG

SEQ ID NO: 1817375 - protein, 20 aa, Staphylococcus epidermidis
GFTALPGWVRKSAIALTILT

SEQ ID NO: 1817376 - protein, 18 aa, Staphylococcus epidermidis
GGFCYELNHLFATYLEHK

SEQ ID NO: 1817377 - protein, 18 aa, Staphylococcus epidermidis
GGIARPAATHALHYDKLP

SEQ ID NO: 1817378 - protein, 17 aa, Staphylococcus epidermidis
GGIPCIFNHQWSNERIY

SEQ ID NO: 1817379 - protein, 24 aa, Staphylococcus epidermidis
GGLFTLRLAEHFNLERIAVMSAPH

SEQ ID NO: 1817380 - protein, 17 aa, Staphylococcus epidermidis
GGMKRRLSLAITLLSNP

SEQ ID NO: 1817381 - protein, 17 aa, Staphylococcus epidermidis
GGNGLKTALTQAGLTVK

SEQ ID NO: 1817382 - protein, 18 aa, Staphylococcus epidermidis
GGYNIWRVVPRAWSHVFL

SEQ ID NO: 1817383 - protein, 17 aa, Staphylococcus epidermidis
GHLFPLIAKDNGVLERN

SEQ ID NO: 1817384 - protein, 17 aa, Staphylococcus epidermidis
GHNEFKMAYINKFNEME

SEQ ID NO: 1817385 - protein, 19 aa, Staphylococcus epidermidis
GHSGEYLKKMHVFLVSLLN

SEQ ID NO: 1817386 - protein, 18 aa, Staphylococcus epidermidis
GHSLRATLVVNRIEAQLK

SEQ ID NO: 1817387 - protein, 21 aa, Staphylococcus epidermidis
GHSLRATLVVNRIEERLKKRL

SEQ ID NO: 1817388 - protein, 19 aa, Staphylococcus epidermidis
GHSMLYLSSIMDIYNGEIV

SEQ ID NO: 1817389 - protein, 20 aa, Staphylococcus epidermidis
GHSMLYLSSIMDLYNGEIVA

SEQ ID NO: 1817390 - protein, 17 aa, Staphylococcus epidermidis
GHVKGYFIYPYQEELKN

SEQ ID NO: 1817391 - protein, 20 aa, Staphylococcus epidermidis
GIEFKERYFRTGSGYTTAIT

SEQ ID NO: 1817392 - protein, 19 aa, Staphylococcus epidermidis
GIGRTNIGISFPVEAPKEY

SEQ ID NO: 1817393 - protein, 19 aa, Staphylococcus epidermidis
GITKFRIVPLLIFSAMHYV

SEQ ID NO: 1817394 - protein, 25 aa, Staphylococcus epidermidis
GKEADKCFRAELAMAPVKLFDHTLE

SEQ ID NO: 1817395 - protein, 21 aa, Staphylococcus epidermidis
GKEISRIGSTFGKTNRVIIDT

SEQ ID NO: 1817396 - protein, 19 aa, Staphylococcus epidermidis
GKFICPRCGGTLTMNTATR

SEQ ID NO: 1817397 - protein, 23 aa, Staphylococcus epidermidis
GKGCNVCKHTGWIEILGAGMVHP

SEQ ID NO: 1817398 - protein, 17 aa, Staphylococcus epidermidis
GKGYAKFAFEKAIIYAF

SEQ ID NO: 1817399 - protein, 18 aa, Staphylococcus epidermidis
GKGYAKFAFEKAINYAFD

SEQ ID NO: 1817400 - protein, 17 aa, Staphylococcus epidermidis
GKLFAYEHYDIIPDIIT

SEQ ID NO: 1817401 - protein, 21 aa, Staphylococcus epidermidis
GKLGVKVWIYRGEVLPTKNTS

SEQ ID NO: 1817402 - protein, 19 aa, Staphylococcus epidermidis
GKLYLYIDFDTMRMEDLFM

SEQ ID NO: 1817403 - protein, 23 aa, Staphylococcus epidermidis
GKNLKIAIVVSRFNDFITGRLLE

SEQ ID NO: 1817404 - protein, 22 aa, Staphylococcus epidermidis
GKRDLPYGRALIIYSDDDIVDN

SEQ ID NO: 1817405 - protein, 17 aa, Staphylococcus epidermidis
GKSNITDAIKWVLGEQS

SEQ ID NO: 1817406 - protein, 18 aa, Staphylococcus epidermidis
GKSYVFKPKSLFVLYDIL

SEQ ID NO: 1817407 - protein, 25 aa, Staphylococcus epidermidis
GKSYVFKPKSLFVLYDILSNNSVYL

SEQ ID NO: 1817408 - protein, 17 aa, Staphylococcus epidermidis
GKTECWYILDAEPGAEI

SEQ ID NO: 1817409 - protein, 19 aa, Staphylococcus epidermidis
GKYKFANGCNGIFTVIYKN

SEQ ID NO: 1817410 - protein, 20 aa, Staphylococcus epidermidis
GLDMILEKIIGIDINNIKEE

SEQ ID NO: 1817411 - protein, 19 aa, Staphylococcus epidermidis
GLELLRLALNHPRITVASI

SEQ ID NO: 1817412 - protein, 17 aa, Staphylococcus epidermidis
GLFIYNKWRGMGTLNSV

SEQ ID NO: 1817413 - protein, 19 aa, Staphylococcus epidermidis
GLFTLRLAEQFDLERIVVM

SEQ ID NO: 1817414 - protein, 20 aa, Staphylococcus epidermidis
GLKTRRMVLFMNRNTRTSKG

SEQ ID NO: 1817415 - protein, 19 aa, Staphylococcus epidermidis
GLMTFKRLLSLNEIEKDDK

SEQ ID NO: 1817416 - protein, 18 aa, Staphylococcus epidermidis
GLRAYAFAPVKNGKPDKK

SEQ ID NO: 1817417 - protein, 22 aa, Staphylococcus epidermidis
GLRCTACFEMRLEIVAKAALEH

SEQ ID NO: 1817418 - protein, 23 aa, Staphylococcus epidermidis
GLYRKRLISYGGLLKEIHKELNL

SEQ ID NO: 1817419 - protein, 20 aa, Staphylococcus epidermidis
GLYRKRMLSYGGLLKQKHKI

SEQ ID NO: 1817420 - protein, 24 aa, Staphylococcus epidermidis
GMETWDFAHCLPYFKKLETTYGAS

SEQ ID NO: 1817421 - protein, 28 aa, Staphylococcus epidermidis
GMFPKWKGVPIRLAMKIVTFIFGKRRRL

SEQ ID NO: 1817422 - protein, 21 aa, Staphylococcus epidermidis
GMGRIGRMVLRIALKNENLNV

SEQ ID NO: 1817423 - protein, 18 aa, Staphylococcus epidermidis
GMVKREVVRIVTPGTVME

SEQ ID NO: 1817424 - protein, 20 aa, Staphylococcus epidermidis
GNELPISAGYFVINPFEVVY

SEQ ID NO: 1817425 - protein, 18 aa, Staphylococcus epidermidis
GNIGRGFIGYILADNNVK

SEQ ID NO: 1817426 - protein, 19 aa, Staphylococcus epidermidis
GNITAYWKGFVEYHDKKKT

SEQ ID NO: 1817427 - protein, 19 aa, Staphylococcus epidermidis
GNMLKPWFVSSIDNPVTKK

SEQ ID NO: 1817428 - protein, 18 aa, Staphylococcus epidermidis
GNVLRFQPPLVITYEQLD

SEQ ID NO: 1817429 - protein, 23 aa, Staphylococcus epidermidis
GNYELRLPLIPLENAERKVLEQA

SEQ ID NO: 1817430 - protein, 19 aa, Staphylococcus epidermidis
GNYTLGIKEQLIFPEIDYD

SEQ ID NO: 1817431 - protein, 18 aa, Staphylococcus epidermidis
GPCLKCLLQTIPDTGESC

SEQ ID NO: 1817432 - protein, 21 aa, Staphylococcus epidermidis
GPDAIRYAGLLARLKRMGHDV

SEQ ID NO: 1817433 - protein, 18 aa, Staphylococcus epidermidis
GPISFILPLKSGYLCETV

SEQ ID NO: 1817434 - protein, 17 aa, Staphylococcus epidermidis
GPVGRYETVLAIIEDKQ

SEQ ID NO: 1817435 - protein, 17 aa, Staphylococcus epidermidis
GQDGYRFNTVWTSGLND

SEQ ID NO: 1817436 - protein, 18 aa, Staphylococcus epidermidis
GQFQRVWIAKALILEPEI

SEQ ID NO: 1817437 - protein, 18 aa, Staphylococcus epidermidis
GQFQRVWIAKALIVEPQV

SEQ ID NO: 1817438 - protein, 18 aa, Staphylococcus epidermidis
GQILRIGHMGKISPFDIL

SEQ ID NO: 1817439 - protein, 17 aa, Staphylococcus epidermidis
GRCPKCLNNKISTDGEC

SEQ ID NO: 1817440 - protein, 17 aa, Staphylococcus epidermidis
GRDCPKCNHYLVDKKKG

SEQ ID NO: 1817441 - protein, 22 aa, Staphylococcus epidermidis
GRDRTGVCSVQFAERIQEGDTV

SEQ ID NO: 1817442 - protein, 18 aa, Staphylococcus epidermidis
GRENLTFFARIYMRDKED

SEQ ID NO: 1817443 - protein, 19 aa, Staphylococcus epidermidis
GREWGDYGIEEFLEVKSIA

SEQ ID NO: 1817444 - protein, 17 aa, Staphylococcus epidermidis
GRLFICYLGDFKTTGGI

SEQ ID NO: 1817445 - protein, 18 aa, Staphylococcus epidermidis
GRMPWKCYEPHHQALHIY

SEQ ID NO: 1817446 - protein, 19 aa, Staphylococcus epidermidis
GRNCKFIAVKLPYGVQQDA

SEQ ID NO: 1817447 - protein, 17 aa, Staphylococcus epidermidis
GRSDYFWDLFIQMPAAL

SEQ ID NO: 1817448 - protein, 19 aa, Staphylococcus epidermidis
GRSDYFWDLFIQMPAALMF

SEQ ID NO: 1817449 - protein, 18 aa, Staphylococcus epidermidis
GRSGFVANSFAMRLNQLD

SEQ ID NO: 1817450 - protein, 25 aa, Staphylococcus epidermidis
GRTPSELGFRYYVNRLLEQTSHQNQ

SEQ ID NO: 1817451 - protein, 20 aa, Staphylococcus epidermidis
GRYGTFAKYFTKNDVPTFAI

SEQ ID NO: 1817452 - protein, 20 aa, Staphylococcus epidermidis
GSDIKHAFNFSTTEKPKDIY

SEQ ID NO: 1817453 - protein, 21 aa, Staphylococcus epidermidis
GSEIAKYFLNKGVHVIQEQPV

SEQ ID NO: 1817454 - protein, 18 aa, Staphylococcus epidermidis
GSFLAKFLYDLGAKVVGI

SEQ ID NO: 1817455 - protein, 19 aa, Staphylococcus epidermidis
GSIIPRPIAFVTTQNLKGD

SEQ ID NO: 1817456 - protein, 17 aa, Staphylococcus epidermidis
GSSREHAAWALKDYGFN

SEQ ID NO: 1817457 - protein, 20 aa, Staphylococcus epidermidis
GSTRPSKWIDFMEDADSIAK

SEQ ID NO: 1817458 - protein, 18 aa, Staphylococcus epidermidis
GTDLAWLSAVTKYIIDNN

SEQ ID NO: 1817459 - protein, 20 aa, Staphylococcus epidermidis
GTKLKLAIDYGKHDTIGIDA

SEQ ID NO: 1817460 - protein, 17 aa, Staphylococcus epidermidis
GTPWLDQKHTVFGQLID

SEQ ID NO: 1817461 - protein, 17 aa, Staphylococcus epidermidis
GTPWLDQKHTVFGQLIE

SEQ ID NO: 1817462 - protein, 22 aa, Staphylococcus epidermidis
GTRFSPFYFKKLWLDAWEETHE

SEQ ID NO: 1817463 - protein, 23 aa, Staphylococcus epidermidis
GTVVRLANFGAFVEIAPAVQGLV

SEQ ID NO: 1817464 - protein, 20 aa, Staphylococcus epidermidis
GVACPGFVPLVEQMRYNDPT

SEQ ID NO: 1817465 - protein, 22 aa, Staphylococcus epidermidis
GVIGLKVHEDWGATPSALSHAL

SEQ ID NO: 1817466 - protein, 25 aa, Staphylococcus epidermidis
GVNGIRISIAWSRIFPKGYGEVNAK

SEQ ID NO: 1817467 - protein, 24 aa, Staphylococcus epidermidis
GVNYLIKVLENWSKDGVDTKEKAI

SEQ ID NO: 1817468 - protein, 17 aa, Staphylococcus epidermidis
GVSYIFPSDIERFKKDN

SEQ ID NO: 1817469 - protein, 17 aa, Staphylococcus epidermidis
GVTSLCIGGGQGIATLV

SEQ ID NO: 1817470 - protein, 19 aa, Staphylococcus epidermidis
GVWHPRAWHSAPRPIPLPN

SEQ ID NO: 1817471 - protein, 17 aa, Staphylococcus epidermidis
GVYRFKRGFNVKIEELI

SEQ ID NO: 1817472 - protein, 17 aa, Staphylococcus epidermidis
GVYRFKRGFNVQIEELI

SEQ ID NO: 1817473 - protein, 19 aa, Staphylococcus epidermidis
GYAISCHRSQGSGFKTLVG

SEQ ID NO: 1817474 - protein, 18 aa, Staphylococcus epidermidis
GYFARPTIFINVDNQMTI

SEQ ID NO: 1817475 - protein, 19 aa, Staphylococcus epidermidis
GYFIWSLMDVFSWSNGYEK

SEQ ID NO: 1817476 - protein, 19 aa, Staphylococcus epidermidis
GYHNYAWDRYYLENVSEDC

SEQ ID NO: 1817477 - protein, 19 aa, Staphylococcus epidermidis
GYHPTWKMVLGLFPKEDKI

SEQ ID NO: 1817478 - protein, 18 aa, Staphylococcus epidermidis
GYIPLHWHNDLQLMVVTH

SEQ ID NO: 1817479 - protein, 18 aa, Staphylococcus epidermidis
GYLPLSWINKWKLYSPVQ

SEQ ID NO: 1817480 - protein, 20 aa, Staphylococcus epidermidis
GYSFNLFELELFKILLNTIE

SEQ ID NO: 1817481 - protein, 24 aa, Staphylococcus epidermidis
GYTKDYPGVFAFIGSNSKYDLHHP

SEQ ID NO: 1817482 - protein, 25 aa, Staphylococcus epidermidis
HAGFKRKKLDFGWIVSEVPANVAGV

SEQ ID NO: 1817483 - protein, 18 aa, Staphylococcus epidermidis
HDIHGYKKARIMRNVGKL

SEQ ID NO: 1817484 - protein, 22 aa, Staphylococcus epidermidis
HDPRLFEGFSMGNPKIQTGNLL

SEQ ID NO: 1817485 - protein, 19 aa, Staphylococcus epidermidis
HEADFGFGQCFKHTDNTIS

SEQ ID NO: 1817486 - protein, 17 aa, Staphylococcus epidermidis
HELGIPIMVLFEGIPAS

SEQ ID NO: 1817487 - protein, 25 aa, Staphylococcus epidermidis
HEVAKADSVAICWAMGITQQDIGSD

SEQ ID NO: 1817488 - protein, 17 aa, Staphylococcus epidermidis
HEYEIITNMGFEDYFLI

SEQ ID NO: 1817489 - protein, 19 aa, Staphylococcus epidermidis
HGKHGFAFGSGMAAISAVI

SEQ ID NO: 1817490 - protein, 20 aa, Staphylococcus epidermidis
HGKNGFGYDPIFFVPELNKT

SEQ ID NO: 1817491 - protein, 20 aa, Staphylococcus epidermidis
HGLKMIYGMEGMLVDDGVPI

SEQ ID NO: 1817492 - protein, 19 aa, Staphylococcus epidermidis
HGNLSLELDVLFGVSSLVT

SEQ ID NO: 1817493 - protein, 21 aa, Staphylococcus epidermidis
HGYDFPMWFIRPFYAKETTKN

SEQ ID NO: 1817494 - protein, 18 aa, Staphylococcus epidermidis
HGYVGLAHAGWRGTYGEI

SEQ ID NO: 1817495 - protein, 18 aa, Staphylococcus epidermidis
HIAHPTGRIIGRRPGYEP

SEQ ID NO: 1817496 - protein, 24 aa, Staphylococcus epidermidis
HIELAAPVSHIWYFKGIPSRMGLL

SEQ ID NO: 1817497 - protein, 19 aa, Staphylococcus epidermidis
HIKYFCNILKYDVSQSEIE

SEQ ID NO: 1817498 - protein, 19 aa, Staphylococcus epidermidis
HILIIKVTRDFFGISSEEN

SEQ ID NO: 1817499 - protein, 17 aa, Staphylococcus epidermidis
HIPFCYRICTYCDFNKY

SEQ ID NO: 1817500 - protein, 23 aa, Staphylococcus epidermidis
HKIWYKLLVNLGINSITAIGHQT

SEQ ID NO: 1817501 - protein, 18 aa, Staphylococcus epidermidis
HKNIMFILAQIQYFSLED

SEQ ID NO: 1817502 - protein, 17 aa, Staphylococcus epidermidis
HKPHIMPVWSIKNRARK

SEQ ID NO: 1817503 - protein, 20 aa, Staphylococcus epidermidis
HKRLDAMIVLSDFNRRYLSG

SEQ ID NO: 1817504 - protein, 18 aa, Staphylococcus epidermidis
HLIEAVAYNVARKNTDVK

SEQ ID NO: 1817505 - protein, 20 aa, Staphylococcus epidermidis
HLPNVLSFASKEHFEVASKA

SEQ ID NO: 1817506 - protein, 24 aa, Staphylococcus epidermidis
HMNAWLKPYRRAFNLEEPVVNVTE

SEQ ID NO: 1817507 - protein, 19 aa, Staphylococcus epidermidis
HPKGSGLGLYGMRERADLV

SEQ ID NO: 1817508 - protein, 19 aa, Staphylococcus epidermidis
HPKGSGLGLYGMRERAELV

SEQ ID NO: 1817509 - protein, 17 aa, Staphylococcus epidermidis
HPLPIPKFKYFKLKSTR

SEQ ID NO: 1817510 - protein, 17 aa, Staphylococcus epidermidis
HPSEVAKAFGLQSEQAI

SEQ ID NO: 1817511 - protein, 23 aa, Staphylococcus epidermidis
HQEAPISLEFYKQFIGGETTGLH

SEQ ID NO: 1817512 - protein, 20 aa, Staphylococcus epidermidis
HQRFAKQYAEAMQKIENVID

SEQ ID NO: 1817513 - protein, 23 aa, Staphylococcus epidermidis
HRKKPANGFVCYMIGRLILENCK

SEQ ID NO: 1817514 - protein, 18 aa, Staphylococcus epidermidis
HSITAIWNFEKQNYFLKN

SEQ ID NO: 1817515 - protein, 17 aa, Staphylococcus epidermidis
HSITAIWNFEKQNYYLK

SEQ ID NO: 1817516 - protein, 20 aa, Staphylococcus epidermidis
HSSLPFLGQNAIKPLLEFIQ

SEQ ID NO: 1817517 - protein, 19 aa, Staphylococcus epidermidis
HTKTIWVWTGFLFEYLKQQ

SEQ ID NO: 1817518 - protein, 20 aa, Staphylococcus epidermidis
HTPESISFLLTDEGGGSSVP

SEQ ID NO: 1817519 - protein, 23 aa, Staphylococcus epidermidis
HVSELKQRIPLILEVSSNQYQSN

SEQ ID NO: 1817520 - protein, 20 aa, Staphylococcus epidermidis
HYHLPILGTHNMKNAAIAIA

SEQ ID NO: 1817521 - protein, 18 aa, Staphylococcus epidermidis
HYLKVRPGAFFLTGCGNE

SEQ ID NO: 1817522 - protein, 18 aa, Staphylococcus epidermidis
HYLKVRPGAFFLTGCGNK

SEQ ID NO: 1817523 - protein, 18 aa, Staphylococcus epidermidis
HYLWRFAKKMPKSGHIEI

SEQ ID NO: 1817524 - protein, 20 aa, Staphylococcus epidermidis
IADVGCGYGPIGLTIAKISP

SEQ ID NO: 1817525 - protein, 19 aa, Staphylococcus epidermidis
IAISDLMGWTAQGLDTLRI

SEQ ID NO: 1817526 - protein, 21 aa, Staphylococcus epidermidis
IAKIKGCKVVGIAGGDKKVNY

SEQ ID NO: 1817527 - protein, 18 aa, Staphylococcus epidermidis
IANSLGIDMTESFNETMD

SEQ ID NO: 1817528 - protein, 18 aa, Staphylococcus epidermidis
IANWKGLDNVIGVNAIKD

SEQ ID NO: 1817529 - protein, 20 aa, Staphylococcus epidermidis
IAPRKVRLVLDLIRGKKAGE

SEQ ID NO: 1817530 - protein, 17 aa, Staphylococcus epidermidis
ICNYCFENGVIIIAVAG

SEQ ID NO: 1817531 - protein, 17 aa, Staphylococcus epidermidis
ICQEWLYHMGVPQEEIV

SEQ ID NO: 1817532 - protein, 21 aa, Staphylococcus epidermidis
ICYDLRFPELLRYPAKSGAKI

SEQ ID NO: 1817533 - protein, 18 aa, Staphylococcus epidermidis
IDELPVIALLCTQASNSC

SEQ ID NO: 1817534 - protein, 17 aa, Staphylococcus epidermidis
IDGLLFRTSMPQKELKQ

SEQ ID NO: 1817535 - protein, 18 aa, Staphylococcus epidermidis
IDHCYRCGYDGDFETTAN

SEQ ID NO: 1817536 - protein, 17 aa, Staphylococcus epidermidis
IDLLIAILKGYKGIKLD

SEQ ID NO: 1817537 - protein, 24 aa, Staphylococcus epidermidis
IDMGELRGKIFYRKNFKTRVVSFV

SEQ ID NO: 1817538 - protein, 19 aa, Staphylococcus epidermidis
IDMIIKYHVPVCCFTFGIP

SEQ ID NO: 1817539 - protein, 17 aa, Staphylococcus epidermidis
IDQWPSFNKALLKEVIK

SEQ ID NO: 1817540 - protein, 21 aa, Staphylococcus epidermidis
IEKGYCLLVGVGKDSTEEDAK

SEQ ID NO: 1817541 - protein, 17 aa, Staphylococcus epidermidis
IEKLDYLKDLGIDVIWL

SEQ ID NO: 1817542 - protein, 19 aa, Staphylococcus epidermidis
IELTRPARALKLWITLQVI

SEQ ID NO: 1817543 - protein, 22 aa, Staphylococcus epidermidis
IEPLKDLRVMGKFGDSVTTDHI

SEQ ID NO: 1817544 - protein, 23 aa, Staphylococcus epidermidis
IEYLRFSYYLTIEQFKLLQFIYQ

SEQ ID NO: 1817545 - protein, 17 aa, Staphylococcus epidermidis
IFGKYVFSTAAGIHQQG

SEQ ID NO: 1817546 - protein, 19 aa, Staphylococcus epidermidis
IFKDLPLYFNVMRYHSLMA

SEQ ID NO: 1817547 - protein, 17 aa, Staphylococcus epidermidis
IFNHQWSNERIYQLVKS

SEQ ID NO: 1817548 - protein, 20 aa, Staphylococcus epidermidis
IFNPRLNRIYTYDMTQADSD

SEQ ID NO: 1817549 - protein, 24 aa, Staphylococcus epidermidis
IFQHFNLLWSRTVLKNITFPLEIA

SEQ ID NO: 1817550 - protein, 25 aa, Staphylococcus epidermidis
IFRKLNIEWVYRVLIDWKRIGRMIS

SEQ ID NO: 1817551 - protein, 18 aa, Staphylococcus epidermidis
IFRSAFWMDEPRILEIGY

SEQ ID NO: 1817552 - protein, 17 aa, Staphylococcus epidermidis
IFTPCHFDGEKWIGTSH

SEQ ID NO: 1817553 - protein, 19 aa, Staphylococcus epidermidis
IGATVFAGFGPRIVRINDY

SEQ ID NO: 1817554 - protein, 20 aa, Staphylococcus epidermidis
IGATVLAGFGPRIVRINNFS

SEQ ID NO: 1817555 - protein, 17 aa, Staphylococcus epidermidis
IGIGRVFRGKMRVGDNV

SEQ ID NO: 1817556 - protein, 17 aa, Staphylococcus epidermidis
IGLLKIDFLGLRNLSII

SEQ ID NO: 1817557 - protein, 20 aa, Staphylococcus epidermidis
IGRYPICYINIQMDPILVDV

SEQ ID NO: 1817558 - protein, 17 aa, Staphylococcus epidermidis
IGTAIGYSSMQFANISK

SEQ ID NO: 1817559 - protein, 21 aa, Staphylococcus epidermidis
IHPREIFKTAILSNANSIMLG

SEQ ID NO: 1817560 - protein, 19 aa, Staphylococcus epidermidis
IHTLIKMCGLVRGVLIQPS

SEQ ID NO: 1817561 - protein, 24 aa, Staphylococcus epidermidis
IICYDLRFPEILRYPARKGAKIAF

SEQ ID NO: 1817562 - protein, 26 aa, Staphylococcus epidermidis
IIGHWGEFVPFFLERMDDILFADHLE

SEQ ID NO: 1817563 - protein, 17 aa, Staphylococcus epidermidis
IISFFTMGFKFNQFTIY

SEQ ID NO: 1817564 - protein, 19 aa, Staphylococcus epidermidis
IISIEFASIMIKSGVEVNV

SEQ ID NO: 1817565 - protein, 17 aa, Staphylococcus epidermidis
IISIEFASIMVKSGVEV

SEQ ID NO: 1817566 - protein, 19 aa, Staphylococcus epidermidis
IKAAGGFIIQVMPGAKDET

SEQ ID NO: 1817567 - protein, 17 aa, Staphylococcus epidermidis
IKAGYDFGSKGIGLVRT

SEQ ID NO: 1817568 - protein, 25 aa, Staphylococcus epidermidis
IKALCKRLQIPLEEVIVFGDSLNDK

SEQ ID NO: 1817569 - protein, 26 aa, Staphylococcus epidermidis
IKDDDLFCGECGHKISRHPQSVRNAE

SEQ ID NO: 1817570 - protein, 18 aa, Staphylococcus epidermidis
IKEGLGFNYVLDGMIMDD

SEQ ID NO: 1817571 - protein, 17 aa, Staphylococcus epidermidis
IKELYKLLHFIADSNMS

SEQ ID NO: 1817572 - protein, 18 aa, Staphylococcus epidermidis
IKERLGLNYQTEVIVNEV

SEQ ID NO: 1817573 - protein, 17 aa, Staphylococcus epidermidis
IKFKLTIEDEIYSINEI

SEQ ID NO: 1817574 - protein, 20 aa, Staphylococcus epidermidis
IKFLFELQDGYTIETVLMRH

SEQ ID NO: 1817575 - protein, 18 aa, Staphylococcus epidermidis
IKGGFTFAILTKDALYGA

SEQ ID NO: 1817576 - protein, 18 aa, Staphylococcus epidermidis
IKGKIDWQDTLPDAHFSK

SEQ ID NO: 1817577 - protein, 17 aa, Staphylococcus epidermidis
IKIAELELDHNLDLGSY

SEQ ID NO: 1817578 - protein, 17 aa, Staphylococcus epidermidis
IKIKVLVDYRFKPKNLK

SEQ ID NO: 1817579 - protein, 17 aa, Staphylococcus epidermidis
IKIYFSLNVEDIESVIK

SEQ ID NO: 1817580 - protein, 18 aa, Staphylococcus epidermidis
IKKDIGMIFQHFNLLNSK

SEQ ID NO: 1817581 - protein, 20 aa, Staphylococcus epidermidis
IKKKFKVDRLSAIEAEISEI

SEQ ID NO: 1817582 - protein, 20 aa, Staphylococcus epidermidis
IKKLYGVNGISIMKLDQSDV

SEQ ID NO: 1817583 - protein, 17 aa, Staphylococcus epidermidis
IKLGDDFFKLGGDSLKA

SEQ ID NO: 1817584 - protein, 24 aa, Staphylococcus epidermidis
IKLQKRSDYGLGIIGELPHTMTLD

SEQ ID NO: 1817585 - protein, 20 aa, Staphylococcus epidermidis
IKMLFLQGIHKKIGYEGSKI

SEQ ID NO: 1817586 - protein, 19 aa, Staphylococcus epidermidis
IKNKIGFVYSEIYFNQKWT

SEQ ID NO: 1817587 - protein, 18 aa, Staphylococcus epidermidis
IKNKVSFLIDKKSGYFYI

SEQ ID NO: 1817588 - protein, 17 aa, Staphylococcus epidermidis
IKPWILPNFESLVNHEK

SEQ ID NO: 1817589 - protein, 17 aa, Staphylococcus epidermidis
IKPWILPNFESLVTHEK

SEQ ID NO: 1817590 - protein, 18 aa, Staphylococcus epidermidis
IKQYSIDSEYNFLSSEDT

SEQ ID NO: 1817591 - protein, 18 aa, Staphylococcus epidermidis
IKTGAPLVYELTDDLDVK

SEQ ID NO: 1817592 - protein, 18 aa, Staphylococcus epidermidis
IKTGAPLVYELTDDLVVK

SEQ ID NO: 1817593 - protein, 18 aa, Staphylococcus epidermidis
IKTGTDWVGKNVLDPTFN

SEQ ID NO: 1817594 - protein, 18 aa, Staphylococcus epidermidis
IKTGTDWVGRNVLDPAFD

SEQ ID NO: 1817595 - protein, 18 aa, Staphylococcus epidermidis
IKVLENWSKDGVDTKEKA

SEQ ID NO: 1817596 - protein, 17 aa, Staphylococcus epidermidis
IKYIRMFDELKRQINAR

SEQ ID NO: 1817597 - protein, 20 aa, Staphylococcus epidermidis
IKYWAELKEVFQLLKVEMPI

SEQ ID NO: 1817598 - protein, 17 aa, Staphylococcus epidermidis
IKYWAELKGVFDTLNVE

SEQ ID NO: 1817599 - protein, 18 aa, Staphylococcus epidermidis
IKYWILKILELHCLSYND

SEQ ID NO: 1817600 - protein, 18 aa, Staphylococcus epidermidis
ILGVCLGFQLIIEYFGGN

SEQ ID NO: 1817601 - protein, 24 aa, Staphylococcus epidermidis
ILHVLKRFKAILIQKNETVEAMQG

SEQ ID NO: 1817602 - protein, 23 aa, Staphylococcus epidermidis
ILHVLKRFKAMLIQKNETIEAMQ

SEQ ID NO: 1817603 - protein, 24 aa, Staphylococcus epidermidis
ILHVLKRFKAVLIQKNETVEAMQG

SEQ ID NO: 1817604 - protein, 17 aa, Staphylococcus epidermidis
ILNDLGILKEGVFTHDI

SEQ ID NO: 1817605 - protein, 17 aa, Staphylococcus epidermidis
ILNDLGILKEGVFTHEI

SEQ ID NO: 1817606 - protein, 24 aa, Staphylococcus epidermidis
ILNGEFKAGSILLPTPTEPVYLAN

SEQ ID NO: 1817607 - protein, 17 aa, Staphylococcus epidermidis
ILQEALNFVRMGDRFIV

SEQ ID NO: 1817608 - protein, 17 aa, Staphylococcus epidermidis
ILVAPGIPFGENGNDYV

SEQ ID NO: 1817609 - protein, 19 aa, Staphylococcus epidermidis
IMCDFKLGCRNSCDPLKIN

SEQ ID NO: 1817610 - protein, 19 aa, Staphylococcus epidermidis
IMKMLHPFMPFVTETIWQS

SEQ ID NO: 1817611 - protein, 20 aa, Staphylococcus epidermidis
IMQRLGRAFALLQVTGEVLN

SEQ ID NO: 1817612 - protein, 22 aa, Staphylococcus epidermidis
IMQRLGRSFALLQVAGEVLNDI

SEQ ID NO: 1817613 - protein, 24 aa, Staphylococcus epidermidis
INDFSYKYGIPWIYGGVVQSTYVE

SEQ ID NO: 1817614 - protein, 19 aa, Staphylococcus epidermidis
INEALKYVVECGANVVGLN

SEQ ID NO: 1817615 - protein, 18 aa, Staphylococcus epidermidis
INGGLFIKKKEESIEDEI

SEQ ID NO: 1817616 - protein, 22 aa, Staphylococcus epidermidis
INKSRGKWCIKLSTGDKMVTDC

SEQ ID NO: 1817617 - protein, 19 aa, Staphylococcus epidermidis
INLEQGFECTAKFRYRQKD

SEQ ID NO: 1817618 - protein, 23 aa, Staphylococcus epidermidis
INLSLRAKYLFDYNLDYFVSNGE

SEQ ID NO: 1817619 - protein, 17 aa, Staphylococcus epidermidis
INNSLARLEMPEVDEEA

SEQ ID NO: 1817620 - protein, 19 aa, Staphylococcus epidermidis
IPAKARRKGGHPAKRVFQA

SEQ ID NO: 1817621 - protein, 19 aa, Staphylococcus epidermidis
IPDEFVVGYGLDYGELYRN

SEQ ID NO: 1817622 - protein, 23 aa, Staphylococcus epidermidis
IPELQGRFPIRVELESLSVDDFV

SEQ ID NO: 1817623 - protein, 22 aa, Staphylococcus epidermidis
IPETRRSTILSSKKVGDKVHLE

SEQ ID NO: 1817624 - protein, 21 aa, Staphylococcus epidermidis
IPETRRSTILSSKKVGNKVHL

SEQ ID NO: 1817625 - protein, 22 aa, Staphylococcus epidermidis
IPETRRSTILSSKKVGNKVHLE

SEQ ID NO: 1817626 - protein, 17 aa, Staphylococcus epidermidis
IPHNFTFNLLFSNNKLK

SEQ ID NO: 1817627 - protein, 18 aa, Staphylococcus epidermidis
IPKRLTVIGSGYIGMELG

SEQ ID NO: 1817628 - protein, 20 aa, Staphylococcus epidermidis
IPMAIKYYKVFKEMREAGLH

SEQ ID NO: 1817629 - protein, 17 aa, Staphylococcus epidermidis
IPMIPHRLSNGICSLNP

SEQ ID NO: 1817630 - protein, 17 aa, Staphylococcus epidermidis
IPNIYFKSNLKAIYDMI

SEQ ID NO: 1817631 - protein, 21 aa, Staphylococcus epidermidis
IPQHILLRFIFVCQQAECSDD

SEQ ID NO: 1817632 - protein, 21 aa, Staphylococcus epidermidis
IPRVLGDIIICRDVAKEQSES

SEQ ID NO: 1817633 - protein, 17 aa, Staphylococcus epidermidis
IPVCGAISSYNHPEDDI

SEQ ID NO: 1817634 - protein, 22 aa, Staphylococcus epidermidis
IPYHHPLFLGMGGMHGSYASNM

SEQ ID NO: 1817635 - protein, 19 aa, Staphylococcus epidermidis
IQFQYGLTLCHLEMFDQAI

SEQ ID NO: 1817636 - protein, 19 aa, Staphylococcus epidermidis
IQIGHTFRTKMINNFRTIL

SEQ ID NO: 1817637 - protein, 19 aa, Staphylococcus epidermidis
IQIIKGIILKAKRSFHDER

SEQ ID NO: 1817638 - protein, 20 aa, Staphylococcus epidermidis
IQIIKGIILKAKRSFHDERA

SEQ ID NO: 1817639 - protein, 17 aa, Staphylococcus epidermidis
IQKSFDLFSMLEDVEKH

SEQ ID NO: 1817640 - protein, 17 aa, Staphylococcus epidermidis
IREGFSYHERRIHNNQM

SEQ ID NO: 1817641 - protein, 17 aa, Staphylococcus epidermidis
IRGGDKMAIIGSNGTGK

SEQ ID NO: 1817642 - protein, 19 aa, Staphylococcus epidermidis
IRHGIRFNIDLEVYMEFMA

SEQ ID NO: 1817643 - protein, 17 aa, Staphylococcus epidermidis
IRMKEFVKDVAKYDEVY

SEQ ID NO: 1817644 - protein, 18 aa, Staphylococcus epidermidis
IRPNTLLTREGIILSKLS

SEQ ID NO: 1817645 - protein, 17 aa, Staphylococcus epidermidis
IRQFNQWGIDYVSCSPF

SEQ ID NO: 1817646 - protein, 23 aa, Staphylococcus epidermidis
IRSNCGIGFKGFWDEVNGFNYDF

SEQ ID NO: 1817647 - protein, 17 aa, Staphylococcus epidermidis
IRTILARMHFFRDDVYK

SEQ ID NO: 1817648 - protein, 21 aa, Staphylococcus epidermidis
IRVFYCLKGNCKMTINLQEFD

SEQ ID NO: 1817649 - protein, 23 aa, Staphylococcus epidermidis
IRYCEKCGQILRPDIVLYGEMLN

SEQ ID NO: 1817650 - protein, 17 aa, Staphylococcus epidermidis
ISAGYFVINPFEVVYYA

SEQ ID NO: 1817651 - protein, 18 aa, Staphylococcus epidermidis
ISDFPWERMLEIDEYLSG

SEQ ID NO: 1817652 - protein, 19 aa, Staphylococcus epidermidis
ISEGAICYTGDILNVERSN

SEQ ID NO: 1817653 - protein, 17 aa, Staphylococcus epidermidis
ISFLNLVDFDALYGHRR

SEQ ID NO: 1817654 - protein, 22 aa, Staphylococcus epidermidis
ISHIFWKTGEVIPIKKVINLAH

SEQ ID NO: 1817655 - protein, 19 aa, Staphylococcus epidermidis
ISKELGIGMGTLYRHFKDK

SEQ ID NO: 1817656 - protein, 23 aa, Staphylococcus epidermidis
ISKSELLEKVWGYDYYEDANTVN

SEQ ID NO: 1817657 - protein, 22 aa, Staphylococcus epidermidis
ISKTGFGPFAFDEWRYLPDGSD

SEQ ID NO: 1817658 - protein, 17 aa, Staphylococcus epidermidis
ISQRSNYEFNRLQYQII

SEQ ID NO: 1817659 - protein, 18 aa, Staphylococcus epidermidis
ISVGIKFLGKLTIPLTIA

SEQ ID NO: 1817660 - protein, 17 aa, Staphylococcus epidermidis
ISYDDAIEFLKKEGFDD

SEQ ID NO: 1817661 - protein, 21 aa, Staphylococcus epidermidis
ITEFPFTDLISFKEIKERLGL

SEQ ID NO: 1817662 - protein, 20 aa, Staphylococcus epidermidis
ITHPIEWQLKYLLLRRTLNE

SEQ ID NO: 1817663 - protein, 17 aa, Staphylococcus epidermidis
ITKEYPSELAFVIGNAT

SEQ ID NO: 1817664 - protein, 19 aa, Staphylococcus epidermidis
ITLKAAFELGERLNATSTI

SEQ ID NO: 1817665 - protein, 17 aa, Staphylococcus epidermidis
ITLRANHYFKPCKTHNK

SEQ ID NO: 1817666 - protein, 17 aa, Staphylococcus epidermidis
ITLREGDEVVGLDVAHA

SEQ ID NO: 1817667 - protein, 20 aa, Staphylococcus epidermidis
ITQRCNEEGYAIKSTISTSE

SEQ ID NO: 1817668 - protein, 24 aa, Staphylococcus epidermidis
ITVNRAGSMIGYFLNEGPVTNFDE

SEQ ID NO: 1817669 - protein, 24 aa, Staphylococcus epidermidis
ITVNRAGSMIGYFLNKGPVTNFDE

SEQ ID NO: 1817670 - protein, 22 aa, Staphylococcus epidermidis
IVCAGASAVLFGSVNAIMGLTS

SEQ ID NO: 1817671 - protein, 18 aa, Staphylococcus epidermidis
IVEKWRKGLIVLSGQSGV

SEQ ID NO: 1817672 - protein, 20 aa, Staphylococcus epidermidis
IVFVNHLGKIIAMNDAASDI

SEQ ID NO: 1817673 - protein, 21 aa, Staphylococcus epidermidis
IVFVNRYGKIIAMNDAAKDIL

SEQ ID NO: 1817674 - protein, 19 aa, Staphylococcus epidermidis
IVKTRFGGYDGKGQILVKQ

SEQ ID NO: 1817675 - protein, 17 aa, Staphylococcus epidermidis
IVVLLKCMAKFGFTASF

SEQ ID NO: 1817676 - protein, 19 aa, Staphylococcus epidermidis
IWLDPVLDRVFAKEIKDKL

SEQ ID NO: 1817677 - protein, 21 aa, Staphylococcus epidermidis
IYKKLSLEAKVAYSILRDRLE

SEQ ID NO: 1817678 - protein, 18 aa, Staphylococcus epidermidis
IYKMPSFLLKDAFDDLDW

SEQ ID NO: 1817679 - protein, 20 aa, Staphylococcus epidermidis
IYKPYIEGFVKMLAPIAPHI

SEQ ID NO: 1817680 - protein, 17 aa, Staphylococcus epidermidis
IYKTMPTMNQWLKDIEV

SEQ ID NO: 1817681 - protein, 23 aa, Staphylococcus epidermidis
IYQKRFYKSWSKWERVGSDVVDT

SEQ ID NO: 1817682 - protein, 22 aa, Staphylococcus epidermidis
IYRKSVENCFNYFIDFLLRNHD

SEQ ID NO: 1817683 - protein, 18 aa, Staphylococcus epidermidis
IYRKSVENCFNYFKTFIL

SEQ ID NO: 1817684 - protein, 23 aa, Staphylococcus epidermidis
IYYFINCVMAFTFEENENEAIME

SEQ ID NO: 1817685 - protein, 19 aa, Staphylococcus epidermidis
KAAELQGRIRAERFIHLMQ

SEQ ID NO: 1817686 - protein, 18 aa, Staphylococcus epidermidis
KAATHILKLLSYGVKYIN

SEQ ID NO: 1817687 - protein, 20 aa, Staphylococcus epidermidis
KAELGGVCLNRGCIPSKALI

SEQ ID NO: 1817688 - protein, 19 aa, Staphylococcus epidermidis
KAFAPVREWAWSREEEIDY

SEQ ID NO: 1817689 - protein, 19 aa, Staphylococcus epidermidis
KAHSITAIWNFEKQNYYLK

SEQ ID NO: 1817690 - protein, 17 aa, Staphylococcus epidermidis
KAKELNKRIEALEEKAA

SEQ ID NO: 1817691 - protein, 18 aa, Staphylococcus epidermidis
KALFAAAFITHFSGQTPH

SEQ ID NO: 1817692 - protein, 25 aa, Staphylococcus epidermidis
KALSVKVFYCLKGKCEITINVQKHT

SEQ ID NO: 1817693 - protein, 24 aa, Staphylococcus epidermidis
KAMLKEFYNAFPLVTNDVINEAIK

SEQ ID NO: 1817694 - protein, 19 aa, Staphylococcus epidermidis
KANELWKSQLGSVLTPPHN

SEQ ID NO: 1817695 - protein, 19 aa, Staphylococcus epidermidis
KAPNLKLAITAGVGSDHVD

SEQ ID NO: 1817696 - protein, 20 aa, Staphylococcus epidermidis
KARACGIHMLVATQRPSVNV

SEQ ID NO: 1817697 - protein, 19 aa, Staphylococcus epidermidis
KARLAEDIPEIKIEIPKDT

SEQ ID NO: 1817698 - protein, 17 aa, Staphylococcus epidermidis
KARVEKSINDWDIHLTD

SEQ ID NO: 1817699 - protein, 20 aa, Staphylococcus epidermidis
KASAKRNWYIWADPKPDGSE

SEQ ID NO: 1817700 - protein, 19 aa, Staphylococcus epidermidis
KASEFDLIVSLGKGETKIP

SEQ ID NO: 1817701 - protein, 18 aa, Staphylococcus epidermidis
KASERFTIVPSWETYEKE

SEQ ID NO: 1817702 - protein, 19 aa, Staphylococcus epidermidis
KASEVPSAIFGTKKRRPIE

SEQ ID NO: 1817703 - protein, 23 aa, Staphylococcus epidermidis
KATDLRAAAALILAGLVADGTTQ

SEQ ID NO: 1817704 - protein, 17 aa, Staphylococcus epidermidis
KATEEMRIAILPIGYAD

SEQ ID NO: 1817705 - protein, 17 aa, Staphylococcus epidermidis
KAVNFGIVYGISDYGLS

SEQ ID NO: 1817706 - protein, 19 aa, Staphylococcus epidermidis
KAVNFGIVYGISDYGLSQS

SEQ ID NO: 1817707 - protein, 18 aa, Staphylococcus epidermidis
KCIPCKEGRPALCENGAI

SEQ ID NO: 1817708 - protein, 19 aa, Staphylococcus epidermidis
KDAYLNFVTRQWIDFISQL

SEQ ID NO: 1817709 - protein, 19 aa, Staphylococcus epidermidis
KDCNVRKAFELASPKHTEG

SEQ ID NO: 1817710 - protein, 17 aa, Staphylococcus epidermidis
KDDEVCILYGTKNGLVA

SEQ ID NO: 1817711 - protein, 25 aa, Staphylococcus epidermidis
KDDKKRIAIKYSIPKWIVDHWVTHH

SEQ ID NO: 1817712 - protein, 20 aa, Staphylococcus epidermidis
KDFEGISFLNLVDFDALYGH

SEQ ID NO: 1817713 - protein, 20 aa, Staphylococcus epidermidis
KDFTGISFLNLVDFDALYGH

SEQ ID NO: 1817714 - protein, 20 aa, Staphylococcus epidermidis
KDIHKAMIFNLTLRPNSRKP

SEQ ID NO: 1817715 - protein, 18 aa, Staphylococcus epidermidis
KDIIEIFLDSGLGKEAFS

SEQ ID NO: 1817716 - protein, 18 aa, Staphylococcus epidermidis
KDIKEPLELISLLGNISH

SEQ ID NO: 1817717 - protein, 17 aa, Staphylococcus epidermidis
KDIKLGDDFFKLGGDSL

SEQ ID NO: 1817718 - protein, 18 aa, Staphylococcus epidermidis
KDLDYEANCDVVTTLFST

SEQ ID NO: 1817719 - protein, 17 aa, Staphylococcus epidermidis
KDMYLRQGYVYQGFKYH

SEQ ID NO: 1817720 - protein, 19 aa, Staphylococcus epidermidis
KDNLICLGNEFKEALNKSL

SEQ ID NO: 1817721 - protein, 23 aa, Staphylococcus epidermidis
KDPKRPIGSFIFLGPTGVGKTEL

SEQ ID NO: 1817722 - protein, 17 aa, Staphylococcus epidermidis
KDRIGSNIVAFPHINKG

SEQ ID NO: 1817723 - protein, 17 aa, Staphylococcus epidermidis
KDRLNGITWVFNYFIDG

SEQ ID NO: 1817724 - protein, 18 aa, Staphylococcus epidermidis
KDSELRSHFDSMPNSASI

SEQ ID NO: 1817725 - protein, 17 aa, Staphylococcus epidermidis
KDTFEWLQPLLKRKFPE

SEQ ID NO: 1817726 - protein, 17 aa, Staphylococcus epidermidis
KDVDLAIQFIKDVRPSA

SEQ ID NO: 1817727 - protein, 18 aa, Staphylococcus epidermidis
KDYCRAHHIELYVKHLDL

SEQ ID NO: 1817728 - protein, 18 aa, Staphylococcus epidermidis
KEALPFLMTAAELDDDRD

SEQ ID NO: 1817729 - protein, 19 aa, Staphylococcus epidermidis
KEEFPHIELHLYGFGAEER

SEQ ID NO: 1817730 - protein, 24 aa, Staphylococcus epidermidis
KEFKGGHQWKSWKPLLGDILLQFL

SEQ ID NO: 1817731 - protein, 27 aa, Staphylococcus epidermidis
KEGCAYVKEHAMFKCDHRFDVVIASNS

SEQ ID NO: 1817732 - protein, 20 aa, Staphylococcus epidermidis
KEHESFNFFSLFTFHEPVEQ

SEQ ID NO: 1817733 - protein, 17 aa, Staphylococcus epidermidis
KEHYKAGGLGDVKVKKY

SEQ ID NO: 1817734 - protein, 24 aa, Staphylococcus epidermidis
KEILKRSPFSIGFRDEDGFPKFIE

SEQ ID NO: 1817735 - protein, 20 aa, Staphylococcus epidermidis
KEITRLAQHLGWKGEGTNFD

SEQ ID NO: 1817736 - protein, 17 aa, Staphylococcus epidermidis
KEIYKFIPTSATKAEKA

SEQ ID NO: 1817737 - protein, 17 aa, Staphylococcus epidermidis
KEKLTFLSDSKMIEVDN

SEQ ID NO: 1817738 - protein, 18 aa, Staphylococcus epidermidis
KEKMFLSHYTYREWDEKE

SEQ ID NO: 1817739 - protein, 23 aa, Staphylococcus epidermidis
KEKQKYRPCVVVSNDFVNQNSPF

SEQ ID NO: 1817740 - protein, 20 aa, Staphylococcus epidermidis
KELFEQWFYPEGASVEVYQF

SEQ ID NO: 1817741 - protein, 20 aa, Staphylococcus epidermidis
KELFILNWAKFNWNNSEKVV

SEQ ID NO: 1817742 - protein, 19 aa, Staphylococcus epidermidis
KELIGVIGLHYLDLVNKTT

SEQ ID NO: 1817743 - protein, 17 aa, Staphylococcus epidermidis
KEPSIPHNFTFHLLFSN

SEQ ID NO: 1817744 - protein, 19 aa, Staphylococcus epidermidis
KESKHIGGFPVSGLFLRCK

SEQ ID NO: 1817745 - protein, 18 aa, Staphylococcus epidermidis
KESLRLRTLFPYIKEASE

SEQ ID NO: 1817746 - protein, 17 aa, Staphylococcus epidermidis
KEYPSELAFVIGNATKY

SEQ ID NO: 1817747 - protein, 18 aa, Staphylococcus epidermidis
KFEKVFADHFLKLYDETK

SEQ ID NO: 1817748 - protein, 18 aa, Staphylococcus epidermidis
KFEKVFAEHFLKLYDETK

SEQ ID NO: 1817749 - protein, 18 aa, Staphylococcus epidermidis
KFFKRMLVEFMEKTNYTC

SEQ ID NO: 1817750 - protein, 19 aa, Staphylococcus epidermidis
KFGGPKGVGLLLVKEYTPI

SEQ ID NO: 1817751 - protein, 20 aa, Staphylococcus epidermidis
KFGLRLPGEFNREMMKEAVQ

SEQ ID NO: 1817752 - protein, 22 aa, Staphylococcus epidermidis
KFKAFLEHALKLGADYVATGHY

SEQ ID NO: 1817753 - protein, 20 aa, Staphylococcus epidermidis
KFKEAMFLKGFNLSDLSRET

SEQ ID NO: 1817754 - protein, 18 aa, Staphylococcus epidermidis
KFKEVYQIFSDVLGVPLK

SEQ ID NO: 1817755 - protein, 18 aa, Staphylococcus epidermidis
KFKNCAFDNVAIRNASMP

SEQ ID NO: 1817756 - protein, 17 aa, Staphylococcus epidermidis
KFLKGRIKFGGAVNSAP

SEQ ID NO: 1817757 - protein, 24 aa, Staphylococcus epidermidis
KFRGIRSNIMFSRAKDEIVSIIVT

SEQ ID NO: 1817758 - protein, 17 aa, Staphylococcus epidermidis
KFTEGFTALPGWVRKSA

SEQ ID NO: 1817759 - protein, 17 aa, Staphylococcus epidermidis
KFYKFAIYGKFGTGKTT

SEQ ID NO: 1817760 - protein, 18 aa, Staphylococcus epidermidis
KGDSLVMIDIAVPRDIEP

SEQ ID NO: 1817761 - protein, 21 aa, Staphylococcus epidermidis
KGELPHNVVFIFQPAEETGGG

SEQ ID NO: 1817762 - protein, 22 aa, Staphylococcus epidermidis
KGEYRLKVTLERDGHLDYIIAP

SEQ ID NO: 1817763 - protein, 17 aa, Staphylococcus epidermidis
KGGRRFALEGGIPDVLN

SEQ ID NO: 1817764 - protein, 21 aa, Staphylococcus epidermidis
KGIKKHLVYDWIVKFKNTAQK

SEQ ID NO: 1817765 - protein, 20 aa, Staphylococcus epidermidis
KGILVFPGFEISTSEKVHIV

SEQ ID NO: 1817766 - protein, 24 aa, Staphylococcus epidermidis
KGIREVIESFKILKDKGYKVKLLI

SEQ ID NO: 1817767 - protein, 22 aa, Staphylococcus epidermidis
KGKAKPGPIISIFGDTKPCENE

SEQ ID NO: 1817768 - protein, 23 aa, Staphylococcus epidermidis
KGKLTGNIYIEFAGYYEKDQKSN

SEQ ID NO: 1817769 - protein, 20 aa, Staphylococcus epidermidis
KGKMAFRVYPTWEKDLNRVA

SEQ ID NO: 1817770 - protein, 28 aa, Staphylococcus epidermidis
KGKRVLDLGCGYGWHCIYAMENGASSVV

SEQ ID NO: 1817771 - protein, 18 aa, Staphylococcus epidermidis
KGLCRKEILFAIDHFNQI

SEQ ID NO: 1817772 - protein, 17 aa, Staphylococcus epidermidis
KGLEDLADWFSQSKLDS

SEQ ID NO: 1817773 - protein, 17 aa, Staphylococcus epidermidis
KGLELLRSLLLNSQMTV

SEQ ID NO: 1817774 - protein, 21 aa, Staphylococcus epidermidis
KGLYRKRMLSYGGLLKQKHKI

SEQ ID NO: 1817775 - protein, 17 aa, Staphylococcus epidermidis
KGMDCRLGISQLPTHGL

SEQ ID NO: 1817776 - protein, 22 aa, Staphylococcus epidermidis
KGPEVPRGLPIIPEAYSPKLKR

SEQ ID NO: 1817777 - protein, 18 aa, Staphylococcus epidermidis
KGPNIKLPSFDLLEEPEP

SEQ ID NO: 1817778 - protein, 17 aa, Staphylococcus epidermidis
KGPNIKLPSYQLLEEPE

SEQ ID NO: 1817779 - protein, 17 aa, Staphylococcus epidermidis
KGSGLGFYGMKERAELV

SEQ ID NO: 1817780 - protein, 17 aa, Staphylococcus epidermidis
KHECPSCHGKRLNDKVL

SEQ ID NO: 1817781 - protein, 19 aa, Staphylococcus epidermidis
KHEFLRYPYIESFENVDEV

SEQ ID NO: 1817782 - protein, 23 aa, Staphylococcus epidermidis
KHFDLRPAGIIKMLDLKQPIYKQ

SEQ ID NO: 1817783 - protein, 20 aa, Staphylococcus epidermidis
KHFRLGISVSKKLGNAVTRN

SEQ ID NO: 1817784 - protein, 17 aa, Staphylococcus epidermidis
KHLEGGFIQNIRQVGND

SEQ ID NO: 1817785 - protein, 17 aa, Staphylococcus epidermidis
KHPKLGGQIIFGANLQI

SEQ ID NO: 1817786 - protein, 20 aa, Staphylococcus epidermidis
KHRLEFLGHTLLEGFDYQVK

SEQ ID NO: 1817787 - protein, 19 aa, Staphylococcus epidermidis
KIALFAGIDKCRFKKQVTP

SEQ ID NO: 1817788 - protein, 20 aa, Staphylococcus epidermidis
KICNDCFKHGVVIIAVAGNV

SEQ ID NO: 1817789 - protein, 19 aa, Staphylococcus epidermidis
KIDLYRPVPNFKNISQVKS

SEQ ID NO: 1817790 - protein, 24 aa, Staphylococcus epidermidis
KIFNEWKIPIIFVTHSNYEAEKMA

SEQ ID NO: 1817791 - protein, 17 aa, Staphylococcus epidermidis
KIGSLIWENSCGSGAAS

SEQ ID NO: 1817792 - protein, 24 aa, Staphylococcus epidermidis
KIIDRFSWEYFYYVTVAKYFILNM

SEQ ID NO: 1817793 - protein, 24 aa, Staphylococcus epidermidis
KINELRIGEALFRGVDTTTNEPIA

SEQ ID NO: 1817794 - protein, 19 aa, Staphylococcus epidermidis
KIVNYWIDFGVDGFRFDVI

SEQ ID NO: 1817795 - protein, 23 aa, Staphylococcus epidermidis
KIYKTCVLEDIFFGYEIEDKDNY

SEQ ID NO: 1817796 - protein, 19 aa, Staphylococcus epidermidis
KKAIDIGNAMLKDGYKEGD

SEQ ID NO: 1817797 - protein, 18 aa, Staphylococcus epidermidis
KKAQRIVHRFSQKWLRKP

SEQ ID NO: 1817798 - protein, 17 aa, Staphylococcus epidermidis
KKDLKTILKNGGLTVGG

SEQ ID NO: 1817799 - protein, 18 aa, Staphylococcus epidermidis
KKELVIQVAREFAQNAID

SEQ ID NO: 1817800 - protein, 17 aa, Staphylococcus epidermidis
KKGFLLDGFPRTIEQAE

SEQ ID NO: 1817801 - protein, 17 aa, Staphylococcus epidermidis
KKIELHGTVTVKGKWNR

SEQ ID NO: 1817802 - protein, 19 aa, Staphylococcus epidermidis
KKIKLGVIPNFSLYKLHEK

SEQ ID NO: 1817803 - protein, 22 aa, Staphylococcus epidermidis
KKINYIRACLRYDGKNQSVNNS

SEQ ID NO: 1817804 - protein, 20 aa, Staphylococcus epidermidis
KKKLKRWLMKYDFKDLVYAT

SEQ ID NO: 1817805 - protein, 17 aa, Staphylococcus epidermidis
KKLGLNLISFETSTSSV

SEQ ID NO: 1817806 - protein, 19 aa, Staphylococcus epidermidis
KKLHLPQGFNIRVDSLLYS

SEQ ID NO: 1817807 - protein, 17 aa, Staphylococcus epidermidis
KKLREARQDFQMIFQDP

SEQ ID NO: 1817808 - protein, 17 aa, Staphylococcus epidermidis
KKLTDVSVYDWVQEVEH

SEQ ID NO: 1817809 - protein, 19 aa, Staphylococcus epidermidis
KKPSLRWDNYYGLTHFIVP

SEQ ID NO: 1817810 - protein, 18 aa, Staphylococcus epidermidis
KKRIDLFFKENMNNYQNL

SEQ ID NO: 1817811 - protein, 20 aa, Staphylococcus epidermidis
KKYFRFAFPIIDENGEKIII

SEQ ID NO: 1817812 - protein, 17 aa, Staphylococcus epidermidis
KKYLERFYYKAATIQTI

SEQ ID NO: 1817813 - protein, 22 aa, Staphylococcus epidermidis
KLAGRRGLPFVIAQMGQSSKSI

SEQ ID NO: 1817814 - protein, 18 aa, Staphylococcus epidermidis
KLEELKQGVLYPYTTNEE

SEQ ID NO: 1817815 - protein, 23 aa, Staphylococcus epidermidis
KLFELEGDLPLFPGHGPYTTVDD

SEQ ID NO: 1817816 - protein, 20 aa, Staphylococcus epidermidis
KLFFKLLFYSGARKGEIRAL

SEQ ID NO: 1817817 - protein, 17 aa, Staphylococcus epidermidis
KLLKTLILLHGLSSDET

SEQ ID NO: 1817818 - protein, 19 aa, Staphylococcus epidermidis
KLNVDYVFHPSVDEMYPEE

SEQ ID NO: 1817819 - protein, 22 aa, Staphylococcus epidermidis
KLSNDAKITWSILRDRLDLSIR

SEQ ID NO: 1817820 - protein, 19 aa, Staphylococcus epidermidis
KLTSCGYTVVFIGHTSVDK

SEQ ID NO: 1817821 - protein, 18 aa, Staphylococcus epidermidis
KLVECFFTGLTRYLKRHK

SEQ ID NO: 1817822 - protein, 26 aa, Staphylococcus epidermidis
KMNGREVFKFAVRIMGDASTRVVDKA

SEQ ID NO: 1817823 - protein, 21 aa, Staphylococcus epidermidis
KNKHLRLAIAQAINKKGYVNS

SEQ ID NO: 1817824 - protein, 19 aa, Staphylococcus epidermidis
KNVFCPSTYPPLHYTFDHI

SEQ ID NO: 1817825 - protein, 23 aa, Staphylococcus epidermidis
KNYDIPLYLGRTLSNLKGTWIMS

SEQ ID NO: 1817826 - protein, 17 aa, Staphylococcus epidermidis
KPALRLSAIMGLNSTFI

SEQ ID NO: 1817827 - protein, 18 aa, Staphylococcus epidermidis
KPDHPFVYWATFSNAADL

SEQ ID NO: 1817828 - protein, 20 aa, Staphylococcus epidermidis
KQESRHEITIEFYRKELQER

SEQ ID NO: 1817829 - protein, 20 aa, Staphylococcus epidermidis
KQGFKGICFRTKDIDQVKST

SEQ ID NO: 1817830 - protein, 19 aa, Staphylococcus epidermidis
KQLLKRGAHVTVLARNIEK

SEQ ID NO: 1817831 - protein, 27 aa, Staphylococcus epidermidis
KQLMIYEAFGWEPPRFGHMALIVNEER

SEQ ID NO: 1817832 - protein, 22 aa, Staphylococcus epidermidis
KQPIIWLCGGLDRGNDFDELIP

SEQ ID NO: 1817833 - protein, 17 aa, Staphylococcus epidermidis
KQSFKKVVIKNCENMQD

SEQ ID NO: 1817834 - protein, 19 aa, Staphylococcus epidermidis
KQWLYSMLHTGNLNNQVKQ

SEQ ID NO: 1817835 - protein, 17 aa, Staphylococcus epidermidis
KRGEGVYLNGPESKKRE

SEQ ID NO: 1817836 - protein, 19 aa, Staphylococcus epidermidis
KRHIPMAIATSSYKKNIYP

SEQ ID NO: 1817837 - protein, 18 aa, Staphylococcus epidermidis
KRIKLKWSTSLIKDLETI

SEQ ID NO: 1817838 - protein, 19 aa, Staphylococcus epidermidis
KRIKLKWSTSLIKDLETIR

SEQ ID NO: 1817839 - protein, 18 aa, Staphylococcus epidermidis
KRKARAFDEIVEIYNDVD

SEQ ID NO: 1817840 - protein, 24 aa, Staphylococcus epidermidis
KRKIDLRFVPGVTFTNPSIATVGL

SEQ ID NO: 1817841 - protein, 20 aa, Staphylococcus epidermidis
KRLKQEYGLKFEPCATKYLK

SEQ ID NO: 1817842 - protein, 20 aa, Staphylococcus epidermidis
KRLLPSIAYLDGEYGFSDIC

SEQ ID NO: 1817843 - protein, 22 aa, Staphylococcus epidermidis
KRMPFIGLQWIFARKGAAASNH

SEQ ID NO: 1817844 - protein, 17 aa, Staphylococcus epidermidis
KRRIFLGTFALSSGYYD

SEQ ID NO: 1817845 - protein, 18 aa, Staphylococcus epidermidis
KRRIKCPYCQSTLTNLTI

SEQ ID NO: 1817846 - protein, 22 aa, Staphylococcus epidermidis
KRTKSLLKFKTFHTVDLRCLRV

SEQ ID NO: 1817847 - protein, 18 aa, Staphylococcus epidermidis
KRVIDFIENFGFSDSDIA

SEQ ID NO: 1817848 - protein, 17 aa, Staphylococcus epidermidis
KRYRIITTYHSKKRNPT

SEQ ID NO: 1817849 - protein, 17 aa, Staphylococcus epidermidis
KSALSIGDTCPICGNEI

SEQ ID NO: 1817850 - protein, 17 aa, Staphylococcus epidermidis
KSERLRQFFDFITNFGI

SEQ ID NO: 1817851 - protein, 19 aa, Staphylococcus epidermidis
KSGKNWIKAGIKEIQLLRV

SEQ ID NO: 1817852 - protein, 17 aa, Staphylococcus epidermidis
KSILVAPGIPFGENGND

SEQ ID NO: 1817853 - protein, 20 aa, Staphylococcus epidermidis
KSKHAQLEWERVPQPTRAEH

SEQ ID NO: 1817854 - protein, 17 aa, Staphylococcus epidermidis
KSKKGTLLWLMDETKTP

SEQ ID NO: 1817855 - protein, 24 aa, Staphylococcus epidermidis
KSKLCPVCNWRRAMKNSYQAQKVI

SEQ ID NO: 1817856 - protein, 20 aa, Staphylococcus epidermidis
KSKLCPVCNWRRSMKNSYQA

SEQ ID NO: 1817857 - protein, 24 aa, Staphylococcus epidermidis
KSLAIKFDIEYVLKECNRIEKEAL

SEQ ID NO: 1817858 - protein, 19 aa, Staphylococcus epidermidis
KSLAWEYISTLNLEDEAEF

SEQ ID NO: 1817859 - protein, 18 aa, Staphylococcus epidermidis
KSMNVEVSNHMQALEDDQ

SEQ ID NO: 1817860 - protein, 17 aa, Staphylococcus epidermidis
KSPRWAIAYKFPAEEVV

SEQ ID NO: 1817861 - protein, 21 aa, Staphylococcus epidermidis
KSRGFKVLVPPAYLGGQNDKN

SEQ ID NO: 1817862 - protein, 19 aa, Staphylococcus epidermidis
KSSARGMFDKGWLFVDDED

SEQ ID NO: 1817863 - protein, 17 aa, Staphylococcus epidermidis
KTFPGYVLVELVMTDES

SEQ ID NO: 1817864 - protein, 20 aa, Staphylococcus epidermidis
KTKIKGWMRQLLWMSIYQYV

SEQ ID NO: 1817865 - protein, 19 aa, Staphylococcus epidermidis
KTKNPRLAKEVLLSLPNDF

SEQ ID NO: 1817866 - protein, 17 aa, Staphylococcus epidermidis
KTPKYSVGDYVWEDTNK

SEQ ID NO: 1817867 - protein, 19 aa, Staphylococcus epidermidis
KTQMLEWILPYYKGLSKEG

SEQ ID NO: 1817868 - protein, 18 aa, Staphylococcus epidermidis
KTRVVSFVEWLDKKQRLR

SEQ ID NO: 1817869 - protein, 19 aa, Staphylococcus epidermidis
KTSESFKAFIYYIEQHKKV

SEQ ID NO: 1817870 - protein, 19 aa, Staphylococcus epidermidis
KTTGNAIAMAWYRYPRGFK

SEQ ID NO: 1817871 - protein, 17 aa, Staphylococcus epidermidis
KTWDFKEPHFKTMKDIK

SEQ ID NO: 1817872 - protein, 19 aa, Staphylococcus epidermidis
KVFLQHGVLGRKKVEYDKK

SEQ ID NO: 1817873 - protein, 25 aa, Staphylococcus epidermidis
KVISKENPNEFVIMVGGVIAMTRDN

SEQ ID NO: 1817874 - protein, 18 aa, Staphylococcus epidermidis
KVTRLGAILDEFLEADKY

SEQ ID NO: 1817875 - protein, 19 aa, Staphylococcus epidermidis
KVWNFFKSKGLSDHAVAGI

SEQ ID NO: 1817876 - protein, 18 aa, Staphylococcus epidermidis
KWSKVAFVFPESQRSLIP

SEQ ID NO: 1817877 - protein, 22 aa, Staphylococcus epidermidis
KYAEAFGAKGLRVYNQEELEAA

SEQ ID NO: 1817878 - protein, 19 aa, Staphylococcus epidermidis
KYCNLSFLAKILYSILSKL

SEQ ID NO: 1817879 - protein, 18 aa, Staphylococcus epidermidis
KYDLFVLVVTDIINSDSK

SEQ ID NO: 1817880 - protein, 17 aa, Staphylococcus epidermidis
KYGKDITELIGYQSKLA

SEQ ID NO: 1817881 - protein, 18 aa, Staphylococcus epidermidis
KYGQWNAVIFDIGRGHTR

SEQ ID NO: 1817882 - protein, 22 aa, Staphylococcus epidermidis
KYIDLRLNTRMAFTDSQINVYK

SEQ ID NO: 1817883 - protein, 18 aa, Staphylococcus epidermidis
KYLYIVTMFNGFNTLIGF

SEQ ID NO: 1817884 - protein, 17 aa, Staphylococcus epidermidis
KYMPSKIAFIFQTMDIE

SEQ ID NO: 1817885 - protein, 19 aa, Staphylococcus epidermidis
KYYLILGCLPKYKGYLNLS

SEQ ID NO: 1817886 - protein, 17 aa, Staphylococcus epidermidis
LAAFNVHFDNWFSETSL

SEQ ID NO: 1817887 - protein, 22 aa, Staphylococcus epidermidis
LAAQRGLPFVIARMGQSETDLH

SEQ ID NO: 1817888 - protein, 22 aa, Staphylococcus epidermidis
LAEEYQCPVIILSDLQLSLGKQ

SEQ ID NO: 1817889 - protein, 23 aa, Staphylococcus epidermidis
LAEEYQCPVILLSDLQLSLGKQT

SEQ ID NO: 1817890 - protein, 18 aa, Staphylococcus epidermidis
LAEHLGWKGKGSNFDILP

SEQ ID NO: 1817891 - protein, 17 aa, Staphylococcus epidermidis
LAGPVVACAVILEKNHH

SEQ ID NO: 1817892 - protein, 18 aa, Staphylococcus epidermidis
LAGPVVACAVILNKDHHY

SEQ ID NO: 1817893 - protein, 18 aa, Staphylococcus epidermidis
LAKEILLSLPNDFDREVQ

SEQ ID NO: 1817894 - protein, 20 aa, Staphylococcus epidermidis
LAKEKHVYWIAKAVVKAKKE

SEQ ID NO: 1817895 - protein, 23 aa, Staphylococcus epidermidis
LAKRLGFKEGLKFIESSTVGVDP

SEQ ID NO: 1817896 - protein, 17 aa, Staphylococcus epidermidis
LAKRLKQEYGLKFEPCA

SEQ ID NO: 1817897 - protein, 17 aa, Staphylococcus epidermidis
LAQHLGWKGEGTNFDIL

SEQ ID NO: 1817898 - protein, 17 aa, Staphylococcus epidermidis
LASFYVACELFKQIQQY

SEQ ID NO: 1817899 - protein, 19 aa, Staphylococcus epidermidis
LASSFSFPVLDLYNESNLR

SEQ ID NO: 1817900 - protein, 27 aa, Staphylococcus epidermidis
LCKNRFCPVCAWRKARKDALGLSLMMQ

SEQ ID NO: 1817901 - protein, 21 aa, Staphylococcus epidermidis
LDACGLNGIHITNCSFEGFLD

SEQ ID NO: 1817902 - protein, 22 aa, Staphylococcus epidermidis
LDEFSHHLGMMFQIKDDLLDVY

SEQ ID NO: 1817903 - protein, 17 aa, Staphylococcus epidermidis
LDESLIRPFYEQQNDIE

SEQ ID NO: 1817904 - protein, 18 aa, Staphylococcus epidermidis
LDEYICQWIRGLDDIIPR

SEQ ID NO: 1817905 - protein, 22 aa, Staphylococcus epidermidis
LDFFKPRIGSNIITAPKYDGFL

SEQ ID NO: 1817906 - protein, 24 aa, Staphylococcus epidermidis
LDGATKEFFAWGFRVGFMTFGTEN

SEQ ID NO: 1817907 - protein, 26 aa, Staphylococcus epidermidis
LDLPKEINPFLGYRAIRLCLAQPEIF

SEQ ID NO: 1817908 - protein, 18 aa, Staphylococcus epidermidis
LDLYFKYNLRKYGSMKIT

SEQ ID NO: 1817909 - protein, 20 aa, Staphylococcus epidermidis
LDNQNRWLGYYGFNVSSEWM

SEQ ID NO: 1817910 - protein, 19 aa, Staphylococcus epidermidis
LDQLPCWLTYTNGETHKVI

SEQ ID NO: 1817911 - protein, 19 aa, Staphylococcus epidermidis
LDRGFDFYAPQTFVDKHGK

SEQ ID NO: 1817912 - protein, 18 aa, Staphylococcus epidermidis
LDTLMFPALIGRTVHIAS

SEQ ID NO: 1817913 - protein, 19 aa, Staphylococcus epidermidis
LDVADEFDIQIALHADTLN

SEQ ID NO: 1817914 - protein, 24 aa, Staphylococcus epidermidis
LDVMVEPFFEWVIEKDAWYGEELN

SEQ ID NO: 1817915 - protein, 17 aa, Staphylococcus epidermidis
LDYDISFMIQEYIEDKA

SEQ ID NO: 1817916 - protein, 20 aa, Staphylococcus epidermidis
LDYIDLFLIHWPCEKDGLFI

SEQ ID NO: 1817917 - protein, 17 aa, Staphylococcus epidermidis
LEAKVAYSILRDRLELS

SEQ ID NO: 1817918 - protein, 21 aa, Staphylococcus epidermidis
LEDRLLRCIDIILHVKNSTKL

SEQ ID NO: 1817919 - protein, 19 aa, Staphylococcus epidermidis
LEIAEAFVRSGAVDIVVVD

SEQ ID NO: 1817920 - protein, 17 aa, Staphylococcus epidermidis
LEILKKLEIHNVCVVVT

SEQ ID NO: 1817921 - protein, 19 aa, Staphylococcus epidermidis
LEKKLPMALFHEGIGTIEE

SEQ ID NO: 1817922 - protein, 17 aa, Staphylococcus epidermidis
LEKRPVAYFTLFTSSMQ

SEQ ID NO: 1817923 - protein, 24 aa, Staphylococcus epidermidis
LELKEVPQRLAVIGSGYIAAELGQ

SEQ ID NO: 1817924 - protein, 17 aa, Staphylococcus epidermidis
LELKRIKIANLELDQSL

SEQ ID NO: 1817925 - protein, 26 aa, Staphylococcus epidermidis
LELLDYAYSFGFEFQSFMAASKFYDT

SEQ ID NO: 1817926 - protein, 17 aa, Staphylococcus epidermidis
LELLRSLLLNSQMTVDE

SEQ ID NO: 1817927 - protein, 18 aa, Staphylococcus epidermidis
LEMLKELIWNPLIEDEQF

SEQ ID NO: 1817928 - protein, 19 aa, Staphylococcus epidermidis
LERFLKYYLLYSEYNNYSI

SEQ ID NO: 1817929 - protein, 17 aa, Staphylococcus epidermidis
LERMGFENVKNVLLNQE

SEQ ID NO: 1817930 - protein, 17 aa, Staphylococcus epidermidis
LFHDFEMHFYRYVFPYY

SEQ ID NO: 1817931 - protein, 18 aa, Staphylococcus epidermidis
LFIDWTWGEEYFRQKLID

SEQ ID NO: 1817932 - protein, 19 aa, Staphylococcus epidermidis
LFKRVLPDVLIKLEKAGYE

SEQ ID NO: 1817933 - protein, 17 aa, Staphylococcus epidermidis
LFSCSTLIYPQPLNKKQ

SEQ ID NO: 1817934 - protein, 19 aa, Staphylococcus epidermidis
LGCRNSCDPLKINGTFRKW

SEQ ID NO: 1817935 - protein, 23 aa, Staphylococcus epidermidis
LGDFKAPMGCRSFLPSWKDAEGH

SEQ ID NO: 1817936 - protein, 21 aa, Staphylococcus epidermidis
LGDGWPVVTSEWLRAWRDLLF

SEQ ID NO: 1817937 - protein, 18 aa, Staphylococcus epidermidis
LGEVFRRYTIENFRELKY

SEQ ID NO: 1817938 - protein, 21 aa, Staphylococcus epidermidis
LGFLALHGFLHLLGYDHMTED

SEQ ID NO: 1817939 - protein, 18 aa, Staphylococcus epidermidis
LGFPEARIPLSQAVIELC

SEQ ID NO: 1817940 - protein, 17 aa, Staphylococcus epidermidis
LGFRGDIFGGYILYNIG

SEQ ID NO: 1817941 - protein, 17 aa, Staphylococcus epidermidis
LGFSGGFPGDFITQTLE

SEQ ID NO: 1817942 - protein, 20 aa, Staphylococcus epidermidis
LGGLPCFLNHQWSESTVKQL

SEQ ID NO: 1817943 - protein, 18 aa, Staphylococcus epidermidis
LGKDRMTAIFPKLVFSIK

SEQ ID NO: 1817944 - protein, 20 aa, Staphylococcus epidermidis
LGLECARGLLDQGMEVTVLH

SEQ ID NO: 1817945 - protein, 17 aa, Staphylococcus epidermidis
LGLGIGVLTGIAKREEL

SEQ ID NO: 1817946 - protein, 19 aa, Staphylococcus epidermidis
LGMKQRLGIALALLCGPDI

SEQ ID NO: 1817947 - protein, 17 aa, Staphylococcus epidermidis
LGTVWINDFHPYFAQAP

SEQ ID NO: 1817948 - protein, 21 aa, Staphylococcus epidermidis
LGYRIGYGGGYYDRFLSQHRS

SEQ ID NO: 1817949 - protein, 17 aa, Staphylococcus epidermidis
LIDGSDFTTGWIFFINQ

SEQ ID NO: 1817950 - protein, 20 aa, Staphylococcus epidermidis
LIDLLENFALERGVYGKRWL

SEQ ID NO: 1817951 - protein, 20 aa, Staphylococcus epidermidis
LIHEVFKDYGILFIDAQYPE

SEQ ID NO: 1817952 - protein, 19 aa, Staphylococcus epidermidis
LIHGFKDYVALLFQKGAIL

SEQ ID NO: 1817953 - protein, 19 aa, Staphylococcus epidermidis
LIHGFKHYVALLFHKGAIL

SEQ ID NO: 1817954 - protein, 17 aa, Staphylococcus epidermidis
LIIKFFLCLDKKEQLKR

SEQ ID NO: 1817955 - protein, 19 aa, Staphylococcus epidermidis
LIKEGYRLVPLNIMNPDNS

SEQ ID NO: 1817956 - protein, 23 aa, Staphylococcus epidermidis
LIKENKIWLGVHLGRGVSGFIVP

SEQ ID NO: 1817957 - protein, 17 aa, Staphylococcus epidermidis
LILEELEHTLSHVDDTD

SEQ ID NO: 1817958 - protein, 24 aa, Staphylococcus epidermidis
LIPELQGRFPIRVELESLSVEDFV

SEQ ID NO: 1817959 - protein, 22 aa, Staphylococcus epidermidis
LIPETRKSTILSGKKVGDAVHL

SEQ ID NO: 1817960 - protein, 17 aa, Staphylococcus epidermidis
LIPKFNLFIALGIRDAI

SEQ ID NO: 1817961 - protein, 18 aa, Staphylococcus epidermidis
LIQRIGFVIEPENLFSNL

SEQ ID NO: 1817962 - protein, 17 aa, Staphylococcus epidermidis
LISRINIVTDWYEKNVI

SEQ ID NO: 1817963 - protein, 21 aa, Staphylococcus epidermidis
LKADLIREFLDSVIPHLEEGT

SEQ ID NO: 1817964 - protein, 17 aa, Staphylococcus epidermidis
LKADLIRSFLDKVVPSL

SEQ ID NO: 1817965 - protein, 18 aa, Staphylococcus epidermidis
LKAGVLSYAYGIASSEEI

SEQ ID NO: 1817966 - protein, 17 aa, Staphylococcus epidermidis
LKALYLAVIDRIDIRKD

SEQ ID NO: 1817967 - protein, 22 aa, Staphylococcus epidermidis
LKCKCLFPFDANVPFIKSPFKT

SEQ ID NO: 1817968 - protein, 24 aa, Staphylococcus epidermidis
LKDDLKELISLVGREEAVLIFVNR

SEQ ID NO: 1817969 - protein, 25 aa, Staphylococcus epidermidis
LKDPKRPIGSFIFLGPTGVGKTELA

SEQ ID NO: 1817970 - protein, 19 aa, Staphylococcus epidermidis
LKDQKRLLPSIAYLDGEYG

SEQ ID NO: 1817971 - protein, 17 aa, Staphylococcus epidermidis
LKELWPQAGDYLLVTLR

SEQ ID NO: 1817972 - protein, 21 aa, Staphylococcus epidermidis
LKESFSGYGLNLFSHPNLFNA

SEQ ID NO: 1817973 - protein, 17 aa, Staphylococcus epidermidis
LKFELFYFDIFKYGTSF

SEQ ID NO: 1817974 - protein, 20 aa, Staphylococcus epidermidis
LKGRYSIVVLDDFGSVTLDN

SEQ ID NO: 1817975 - protein, 19 aa, Staphylococcus epidermidis
LKKRLKVGDIMKLPTVEQL

SEQ ID NO: 1817976 - protein, 23 aa, Staphylococcus epidermidis
LKKSFIGESFLAVFNKLLETPLF

SEQ ID NO: 1817977 - protein, 17 aa, Staphylococcus epidermidis
LKLFSAFIVKGKKVIQE

SEQ ID NO: 1817978 - protein, 20 aa, Staphylococcus epidermidis
LKLGIITPFLGHTNRWNEQN

SEQ ID NO: 1817979 - protein, 21 aa, Staphylococcus epidermidis
LKLLNDLAMIFLKAAHEEIQK

SEQ ID NO: 1817980 - protein, 20 aa, Staphylococcus epidermidis
LKLQFDHAIQVAHDVLNKKD

SEQ ID NO: 1817981 - protein, 18 aa, Staphylococcus epidermidis
LKNYRIYFEPLIKKNDKE

SEQ ID NO: 1817982 - protein, 17 aa, Staphylococcus epidermidis
LKPFILLVVEKKEEGLK

SEQ ID NO: 1817983 - protein, 17 aa, Staphylococcus epidermidis
LKPGETIHFEWISVEEA

SEQ ID NO: 1817984 - protein, 17 aa, Staphylococcus epidermidis
LKQEYGLKFESCATKYL

SEQ ID NO: 1817985 - protein, 21 aa, Staphylococcus epidermidis
LKQFVKVFLDLGIKVKFYNVV

SEQ ID NO: 1817986 - protein, 17 aa, Staphylococcus epidermidis
LKQGVLYPYTTNEEYNN

SEQ ID NO: 1817987 - protein, 19 aa, Staphylococcus epidermidis
LKQPLKRRVPGIELLEECL

SEQ ID NO: 1817988 - protein, 17 aa, Staphylococcus epidermidis
LKRDFIDKICLESMEGG

SEQ ID NO: 1817989 - protein, 20 aa, Staphylococcus epidermidis
LKREDLQWVRSFKLRGAYNA

SEQ ID NO: 1817990 - protein, 21 aa, Staphylococcus epidermidis
LKRLIMPSIEREIRGDLTQKA

SEQ ID NO: 1817991 - protein, 22 aa, Staphylococcus epidermidis
LKRLPLYYRFVSTLKSKGIDRV

SEQ ID NO: 1817992 - protein, 18 aa, Staphylococcus epidermidis
LKSIFGVRDMFFISENGA

SEQ ID NO: 1817993 - protein, 18 aa, Staphylococcus epidermidis
LKSKKGTLLWLMDETKTP

SEQ ID NO: 1817994 - protein, 17 aa, Staphylococcus epidermidis
LKSKWSRIEALAGAKPR

SEQ ID NO: 1817995 - protein, 17 aa, Staphylococcus epidermidis
LKSLLSVESGGIVFTTM

SEQ ID NO: 1817996 - protein, 20 aa, Staphylococcus epidermidis
LKSRVQSLICSKMPTNELDN

SEQ ID NO: 1817997 - protein, 17 aa, Staphylococcus epidermidis
LKVYMIASVEERAERRQ

SEQ ID NO: 1817998 - protein, 20 aa, Staphylococcus epidermidis
LLAKWLFKYENQFPIYASEI

SEQ ID NO: 1817999 - protein, 24 aa, Staphylococcus epidermidis
LLESPRLGAINVHASLLPKYRGGA

SEQ ID NO: 1818000 - protein, 19 aa, Staphylococcus epidermidis
LLESVAFQIGSAIKRILLT

SEQ ID NO: 1818001 - protein, 18 aa, Staphylococcus epidermidis
LLGGTCLHKGCIPTKSLL

SEQ ID NO: 1818002 - protein, 19 aa, Staphylococcus epidermidis
LLIPELVKFFKRGQYPMDK

SEQ ID NO: 1818003 - protein, 19 aa, Staphylococcus epidermidis
LLKDRIIMLGSQIDDNVAN

SEQ ID NO: 1818004 - protein, 20 aa, Staphylococcus epidermidis
LLKNSRFGFKMGNQALEDSM

SEQ ID NO: 1818005 - protein, 20 aa, Staphylococcus epidermidis
LLKYLKLKLSDFIQLHTGEQ

SEQ ID NO: 1818006 - protein, 17 aa, Staphylococcus epidermidis
LLLNLGIEEVIIAIDKE

SEQ ID NO: 1818007 - protein, 17 aa, Staphylococcus epidermidis
LLSKIAITFSEEENVDR

SEQ ID NO: 1818008 - protein, 18 aa, Staphylococcus epidermidis
LLSLPGWAGMMYYRAEKN

SEQ ID NO: 1818009 - protein, 18 aa, Staphylococcus epidermidis
LLSQRLDADFSKLSNKIE

SEQ ID NO: 1818010 - protein, 23 aa, Staphylococcus epidermidis
LLYRAGLDLDVDFVIRVGKPVIS

SEQ ID NO: 1818011 - protein, 17 aa, Staphylococcus epidermidis
LLYRAGLNLEVDYVIRV

SEQ ID NO: 1818012 - protein, 20 aa, Staphylococcus epidermidis
LMCAKLWPQFELFQSFSKKP

SEQ ID NO: 1818013 - protein, 18 aa, Staphylococcus epidermidis
LMKIKGFGKKTFEKLKEH

SEQ ID NO: 1818014 - protein, 17 aa, Staphylococcus epidermidis
LMLHQGINLAPSKFEAW

SEQ ID NO: 1818015 - protein, 22 aa, Staphylococcus epidermidis
LNAELRPGIDVVLEETQFKQRI

SEQ ID NO: 1818016 - protein, 21 aa, Staphylococcus epidermidis
LNAKLRPGIDVVLEETQFKQR

SEQ ID NO: 1818017 - protein, 18 aa, Staphylococcus epidermidis
LNDFKYAELSSMDSHIYE

SEQ ID NO: 1818018 - protein, 19 aa, Staphylococcus epidermidis
LNEAMKALRSEISKKDQVK

SEQ ID NO: 1818019 - protein, 19 aa, Staphylococcus epidermidis
LNFGETIKWFSILKPKDKQ

SEQ ID NO: 1818020 - protein, 20 aa, Staphylococcus epidermidis
LNGIYKLIFKLPVNKSDQHK

SEQ ID NO: 1818021 - protein, 19 aa, Staphylococcus epidermidis
LNGRLKLQLLDEVKSVYNS

SEQ ID NO: 1818022 - protein, 17 aa, Staphylococcus epidermidis
LNHKRLDAMIVLSDFNR

SEQ ID NO: 1818023 - protein, 24 aa, Staphylococcus epidermidis
LNLAPEEFIVWVLGFIKNVDELKQ

SEQ ID NO: 1818024 - protein, 17 aa, Staphylococcus epidermidis
LNLGYRFPSYYGKSNYY

SEQ ID NO: 1818025 - protein, 18 aa, Staphylococcus epidermidis
LNLGYRFPTYYGKQNYYA

SEQ ID NO: 1818026 - protein, 21 aa, Staphylococcus epidermidis
LNLPLEWLKGKIVVDSLGLHS

SEQ ID NO: 1818027 - protein, 22 aa, Staphylococcus epidermidis
LNPDHMPLIIGIEKGWFKEESL

SEQ ID NO: 1818028 - protein, 18 aa, Staphylococcus epidermidis
LNQLPCWLTYTNGDTHQV

SEQ ID NO: 1818029 - protein, 24 aa, Staphylococcus epidermidis
LNSEMKPRVSIVVDHYEDVSTEEV

SEQ ID NO: 1818030 - protein, 24 aa, Staphylococcus epidermidis
LNSRLKVSIYFYFAPPKSWTKNQK

SEQ ID NO: 1818031 - protein, 17 aa, Staphylococcus epidermidis
LNTRLDSNRSFRFTGKV

SEQ ID NO: 1818032 - protein, 22 aa, Staphylococcus epidermidis
LNVGENLWGLRDWYSVDDIEEK

SEQ ID NO: 1818033 - protein, 20 aa, Staphylococcus epidermidis
LNYKSCEGFFLSYEVPHIGH

SEQ ID NO: 1818034 - protein, 20 aa, Staphylococcus epidermidis
LPDEVLRLKGYVQFRDHPNA

SEQ ID NO: 1818035 - protein, 20 aa, Staphylococcus epidermidis
LPFGKCHFALAAKPETSCYK

SEQ ID NO: 1818036 - protein, 18 aa, Staphylococcus epidermidis
LPGSVSFAPFSLVVKCGY

SEQ ID NO: 1818037 - protein, 17 aa, Staphylococcus epidermidis
LPIDLIIDYAHTADGMN

SEQ ID NO: 1818038 - protein, 18 aa, Staphylococcus epidermidis
LPLIKRLSSKQVRLNVTA

SEQ ID NO: 1818039 - protein, 21 aa, Staphylococcus epidermidis
LPLTEAFLFSRGHFKGNQFPE

SEQ ID NO: 1818040 - protein, 17 aa, Staphylococcus epidermidis
LPLVLSNGVQPYSTGYT

SEQ ID NO: 1818041 - protein, 17 aa, Staphylococcus epidermidis
LPLYFNVMRYHSLMADP

SEQ ID NO: 1818042 - protein, 17 aa, Staphylococcus epidermidis
LPMVFAEFGEEDFHPKT

SEQ ID NO: 1818043 - protein, 18 aa, Staphylococcus epidermidis
LPNNHKWLGIGLRVVPKP

SEQ ID NO: 1818044 - protein, 19 aa, Staphylococcus epidermidis
LPPVEAFKGPVGRYETVLA

SEQ ID NO: 1818045 - protein, 18 aa, Staphylococcus epidermidis
LPQGLKFDASTNSIVGTP

SEQ ID NO: 1818046 - protein, 18 aa, Staphylococcus epidermidis
LPQRIVFVGGGYISFEFA

SEQ ID NO: 1818047 - protein, 18 aa, Staphylococcus epidermidis
LPRPFFILAPMEDVTDIV

SEQ ID NO: 1818048 - protein, 17 aa, Staphylococcus epidermidis
LPTEINSMFGLESGHIN

SEQ ID NO: 1818049 - protein, 18 aa, Staphylococcus epidermidis
LPVDPVVADVFKFKGREM

SEQ ID NO: 1818050 - protein, 21 aa, Staphylococcus epidermidis
LPVIPEFADYTLIGGNGSIIS

SEQ ID NO: 1818051 - protein, 19 aa, Staphylococcus epidermidis
LQAIYRRVYEFGVEEKRTL

SEQ ID NO: 1818052 - protein, 21 aa, Staphylococcus epidermidis
LQARIRVALRVSRKIDTEQNN

SEQ ID NO: 1818053 - protein, 18 aa, Staphylococcus epidermidis
LQDVPGFKALRFLRPKTY

SEQ ID NO: 1818054 - protein, 23 aa, Staphylococcus epidermidis
LQIKLELDSLVTLHEQIFKSLSK

SEQ ID NO: 1818055 - protein, 19 aa, Staphylococcus epidermidis
LQLFSRLKLALTEENPSAP

SEQ ID NO: 1818056 - protein, 17 aa, Staphylococcus epidermidis
LQLMSDFSSRLYGKQSE

SEQ ID NO: 1818057 - protein, 19 aa, Staphylococcus epidermidis
LQMAPKHWLCIEEDDLVWA

SEQ ID NO: 1818058 - protein, 19 aa, Staphylococcus epidermidis
LQNEIARWIKIQEDIGLDV

SEQ ID NO: 1818059 - protein, 25 aa, Staphylococcus epidermidis
LQNPEIWDSRISKFGTPESQILDPN

SEQ ID NO: 1818060 - protein, 18 aa, Staphylococcus epidermidis
LQNPEIWDSRNSKFGTPE

SEQ ID NO: 1818061 - protein, 18 aa, Staphylococcus epidermidis
LQRPILYTGLTRAKQSLV

SEQ ID NO: 1818062 - protein, 18 aa, Staphylococcus epidermidis
LRANHYFKPCKTHNKQGE

SEQ ID NO: 1818063 - protein, 19 aa, Staphylococcus epidermidis
LRARIRVALRMSRSTETIQ

SEQ ID NO: 1818064 - protein, 17 aa, Staphylococcus epidermidis
LRATLVVNRIEAQLKKR

SEQ ID NO: 1818065 - protein, 20 aa, Staphylococcus epidermidis
LRCTACFEMRLEIVAQAAVK

SEQ ID NO: 1818066 - protein, 18 aa, Staphylococcus epidermidis
LRELNIFRLPADAKQFEY

SEQ ID NO: 1818067 - protein, 21 aa, Staphylococcus epidermidis
LRERICDAAIQLMENIKYVNA

SEQ ID NO: 1818068 - protein, 17 aa, Staphylococcus epidermidis
LRFDLSKGFPLLTTKKV

SEQ ID NO: 1818069 - protein, 19 aa, Staphylococcus epidermidis
LRKALPEQFVYIIEELLYK

SEQ ID NO: 1818070 - protein, 17 aa, Staphylococcus epidermidis
LRKPDWLKIKLNTNENY

SEQ ID NO: 1818071 - protein, 19 aa, Staphylococcus epidermidis
LRKRIGFMIENPEFISHFS

SEQ ID NO: 1818072 - protein, 18 aa, Staphylococcus epidermidis
LRKSLFVNHKSSRKSREN

SEQ ID NO: 1818073 - protein, 19 aa, Staphylococcus epidermidis
LRLAEQFDLERIVVMSAPH

SEQ ID NO: 1818074 - protein, 17 aa, Staphylococcus epidermidis
LRLKADLIREFLDSVIP

SEQ ID NO: 1818075 - protein, 17 aa, Staphylococcus epidermidis
LRMNYLFDFYQSLLTQK

SEQ ID NO: 1818076 - protein, 17 aa, Staphylococcus epidermidis
LRNYGCVFMKTEEVFDL

SEQ ID NO: 1818077 - protein, 17 aa, Staphylococcus epidermidis
LRPSSLDDLGIEAAFNS

SEQ ID NO: 1818078 - protein, 19 aa, Staphylococcus epidermidis
LRQFFDFITNFGIMIKGTG

SEQ ID NO: 1818079 - protein, 18 aa, Staphylococcus epidermidis
LRSAVDLPIHLHTHDTSG

SEQ ID NO: 1818080 - protein, 19 aa, Staphylococcus epidermidis
LRSKYDWSTKFLIKVEDNF

SEQ ID NO: 1818081 - protein, 20 aa, Staphylococcus epidermidis
LRVVVDLSLEPKLFLQICCI

SEQ ID NO: 1818082 - protein, 19 aa, Staphylococcus epidermidis
LRWRLLYIANPDYRVKPPF

SEQ ID NO: 1818083 - protein, 17 aa, Staphylococcus epidermidis
LRYLGPLGCGFMTGSGA

SEQ ID NO: 1818084 - protein, 18 aa, Staphylococcus epidermidis
LRYRWEYMGEAIGSGVVP

SEQ ID NO: 1818085 - protein, 23 aa, Staphylococcus epidermidis
LSEDCILCTYTLFNTTNNTITNR

SEQ ID NO: 1818086 - protein, 25 aa, Staphylococcus epidermidis
LSGKASKGASGWFGRLGGSLLTTID

SEQ ID NO: 1818087 - protein, 19 aa, Staphylococcus epidermidis
LSKEELKEIVTMMVNKLTA

SEQ ID NO: 1818088 - protein, 17 aa, Staphylococcus epidermidis
LSLAVAFSHHAELFILD

SEQ ID NO: 1818089 - protein, 17 aa, Staphylococcus epidermidis
LSQFYKELMVSTGSLEI

SEQ ID NO: 1818090 - protein, 21 aa, Staphylococcus epidermidis
LSQLLGIQIHYIFTGHVHHHF

SEQ ID NO: 1818091 - protein, 21 aa, Staphylococcus epidermidis
LSQNMPIFFSANMSYGIHALT

SEQ ID NO: 1818092 - protein, 20 aa, Staphylococcus epidermidis
LSRFPWLSANIEYTVTREPY

SEQ ID NO: 1818093 - protein, 19 aa, Staphylococcus epidermidis
LSRRRIRHIVGYVPQDIAL

SEQ ID NO: 1818094 - protein, 18 aa, Staphylococcus epidermidis
LSYLCLVENDLTYFNPQK

SEQ ID NO: 1818095 - protein, 19 aa, Staphylococcus epidermidis
LTDKRVSPLYGELKGLPPV

SEQ ID NO: 1818096 - protein, 18 aa, Staphylococcus epidermidis
LTENITWADNRASRYADL

SEQ ID NO: 1818097 - protein, 19 aa, Staphylococcus epidermidis
LTGACPMGPYIVTKDELPA

SEQ ID NO: 1818098 - protein, 17 aa, Staphylococcus epidermidis
LTHKAIHACKTYHVNRL

SEQ ID NO: 1818099 - protein, 17 aa, Staphylococcus epidermidis
LTIGRFPICYINIQMDP

SEQ ID NO: 1818100 - protein, 17 aa, Staphylococcus epidermidis
LTIGRYPICYINIQMDP

SEQ ID NO: 1818101 - protein, 17 aa, Staphylococcus epidermidis
LTIQRYGSTYVLTTKKE

SEQ ID NO: 1818102 - protein, 17 aa, Staphylococcus epidermidis
LTLSGVFSRAGASYDDI

SEQ ID NO: 1818103 - protein, 18 aa, Staphylococcus epidermidis
LTQYIGHLNVVLFAPEDL

SEQ ID NO: 1818104 - protein, 19 aa, Staphylococcus epidermidis
LTSELRKSLFVNHKSSRKS

SEQ ID NO: 1818105 - protein, 21 aa, Staphylococcus epidermidis
LTTEYYWHWDLDNAQLDVFEY

SEQ ID NO: 1818106 - protein, 18 aa, Staphylococcus epidermidis
LVEGLKLVTAFVQDENAT

SEQ ID NO: 1818107 - protein, 18 aa, Staphylococcus epidermidis
LVGISDGMYTYAFNLSYF

SEQ ID NO: 1818108 - protein, 22 aa, Staphylococcus epidermidis
LVGKEFLEKWAGVPTEVHVASE

SEQ ID NO: 1818109 - protein, 17 aa, Staphylococcus epidermidis
LVLRLGGEYTVKRVRRT

SEQ ID NO: 1818110 - protein, 17 aa, Staphylococcus epidermidis
LWGARAAFIGGFDSTSN

SEQ ID NO: 1818111 - protein, 17 aa, Staphylococcus epidermidis
LWSVLIDKLNEWNLHND

SEQ ID NO: 1818112 - protein, 18 aa, Staphylococcus epidermidis
LYFEGVSVFDMLEIVENI

SEQ ID NO: 1818113 - protein, 17 aa, Staphylococcus epidermidis
LYHFYFDYWATIVGIDI

SEQ ID NO: 1818114 - protein, 18 aa, Staphylococcus epidermidis
LYKRIGFKDSNIIFYFMP

SEQ ID NO: 1818115 - protein, 24 aa, Staphylococcus epidermidis
LYLDTATGVAYRFLKKGTTSPTYY

SEQ ID NO: 1818116 - protein, 18 aa, Staphylococcus epidermidis
LYNQLDIYKEQSKRDKEQ

SEQ ID NO: 1818117 - protein, 19 aa, Staphylococcus epidermidis
LYPEYAFNMARYVDDNQDN

SEQ ID NO: 1818118 - protein, 22 aa, Staphylococcus epidermidis
LYPQCFNTAYKILKMIQRQFDV

SEQ ID NO: 1818119 - protein, 18 aa, Staphylococcus epidermidis
LYQFLFKFIFDVDERYIK

SEQ ID NO: 1818120 - protein, 17 aa, Staphylococcus epidermidis
MAAQCLIQAIGGEGHVY

SEQ ID NO: 1818121 - protein, 17 aa, Staphylococcus epidermidis
MAKKDFRLILVGGDCPK

SEQ ID NO: 1818122 - protein, 18 aa, Staphylococcus epidermidis
MDRLLCGDVGYGKTEVAV

SEQ ID NO: 1818123 - protein, 21 aa, Staphylococcus epidermidis
MEFMAGGILRIIYAWLKEGQK

SEQ ID NO: 1818124 - protein, 23 aa, Staphylococcus epidermidis
MEHLRLAKYQDMMLISGKQFEVG

SEQ ID NO: 1818125 - protein, 18 aa, Staphylococcus epidermidis
MEKEWRKAIDKGKNVKNI

SEQ ID NO: 1818126 - protein, 21 aa, Staphylococcus epidermidis
MELYYRVALHLNNDKTSYCYK

SEQ ID NO: 1818127 - protein, 25 aa, Staphylococcus epidermidis
METMFPRRVDLGLGRAPGTDMMTAS

SEQ ID NO: 1818128 - protein, 21 aa, Staphylococcus epidermidis
MFKNYWFYKFVIPIYNEPNIE

SEQ ID NO: 1818129 - protein, 18 aa, Staphylococcus epidermidis
MHVLLCVENAYFRKKENY

SEQ ID NO: 1818130 - protein, 17 aa, Staphylococcus epidermidis
MHVLLCVENSYFKNKAN

SEQ ID NO: 1818131 - protein, 18 aa, Staphylococcus epidermidis
MIEHFGIKQEETLVIGDS

SEQ ID NO: 1818132 - protein, 21 aa, Staphylococcus epidermidis
MIFETFSFYGACLLGDDVTPA

SEQ ID NO: 1818133 - protein, 19 aa, Staphylococcus epidermidis
MILERILPILSERERQIIQ

SEQ ID NO: 1818134 - protein, 18 aa, Staphylococcus epidermidis
MIQCLLKKADIYILDEPF

SEQ ID NO: 1818135 - protein, 18 aa, Staphylococcus epidermidis
MIRQAAFRLVENIKHDIK

SEQ ID NO: 1818136 - protein, 17 aa, Staphylococcus epidermidis
MKCLRIIAMFRLINPTK

SEQ ID NO: 1818137 - protein, 17 aa, Staphylococcus epidermidis
MKDLRILASELRNDIQG

SEQ ID NO: 1818138 - protein, 17 aa, Staphylococcus epidermidis
MKKRLGIAQAILHDPKV

SEQ ID NO: 1818139 - protein, 23 aa, Staphylococcus epidermidis
MKLAREYGRPVLMVKRIGEYFKG

SEQ ID NO: 1818140 - protein, 17 aa, Staphylococcus epidermidis
MKPGDIIQFEWITVEEA

SEQ ID NO: 1818141 - protein, 21 aa, Staphylococcus epidermidis
MKRFEEFQSHIALIQTFDLPM

SEQ ID NO: 1818142 - protein, 21 aa, Staphylococcus epidermidis
MKRHKQTFLLGGGHDIAYAQY

SEQ ID NO: 1818143 - protein, 17 aa, Staphylococcus epidermidis
MKSTIALLHKFEVETIF

SEQ ID NO: 1818144 - protein, 19 aa, Staphylococcus epidermidis
MKSWYERFGFGKKTGGMFD

SEQ ID NO: 1818145 - protein, 23 aa, Staphylococcus epidermidis
MKVSEVLYYLGFLSKINQKDFDK

SEQ ID NO: 1818146 - protein, 20 aa, Staphylococcus epidermidis
MKYLSTWQGWSLVNPDYSKT

SEQ ID NO: 1818147 - protein, 22 aa, Staphylococcus epidermidis
MKYYMVGSTYRFKKSDVDEFME

SEQ ID NO: 1818148 - protein, 18 aa, Staphylococcus epidermidis
MLFRGVHYEICCIDRKGY

SEQ ID NO: 1818149 - protein, 20 aa, Staphylococcus epidermidis
MLGFMPGFPYLGGLDKKLHT

SEQ ID NO: 1818150 - protein, 17 aa, Staphylococcus epidermidis
MLQRMMIALALALKPKL

SEQ ID NO: 1818151 - protein, 17 aa, Staphylococcus epidermidis
MLVKRPLAISGEKITLG

SEQ ID NO: 1818152 - protein, 19 aa, Staphylococcus epidermidis
MMMAALKISTDFERMGDNA

SEQ ID NO: 1818153 - protein, 18 aa, Staphylococcus epidermidis
MNNHITFRFDRLNKEMNN

SEQ ID NO: 1818154 - protein, 24 aa, Staphylococcus epidermidis
MNVDWKKRIHMIIGTDEESDWKCT

SEQ ID NO: 1818155 - protein, 20 aa, Staphylococcus epidermidis
MNWWFEKGIDGFRVDAITHI

SEQ ID NO: 1818156 - protein, 17 aa, Staphylococcus epidermidis
MPARIPIGQPINGTTVY

SEQ ID NO: 1818157 - protein, 19 aa, Staphylococcus epidermidis
MPIEVVYGFAQLKRGAALA

SEQ ID NO: 1818158 - protein, 26 aa, Staphylococcus epidermidis
MPIVLPRLRISYMYERTEKLLSQYDL

SEQ ID NO: 1818159 - protein, 27 aa, Staphylococcus epidermidis
MPIVMPRLRITYLYARTKKLLKQYNLS

SEQ ID NO: 1818160 - protein, 18 aa, Staphylococcus epidermidis
MPNLWPHLSSIRIPTLII

SEQ ID NO: 1818161 - protein, 19 aa, Staphylococcus epidermidis
MPYRAKRHYSIVEGDKQHL

SEQ ID NO: 1818162 - protein, 18 aa, Staphylococcus epidermidis
MRCSHCAVGYTLQTKDPD

SEQ ID NO: 1818163 - protein, 18 aa, Staphylococcus epidermidis
MRIIDCLETAHTRLKLLS

SEQ ID NO: 1818164 - protein, 19 aa, Staphylococcus epidermidis
MRNQDCLYMINTFYPYIET

SEQ ID NO: 1818165 - protein, 24 aa, Staphylococcus epidermidis
MRPKFNLYFMFNWLENFQLKWNKY

SEQ ID NO: 1818166 - protein, 17 aa, Staphylococcus epidermidis
MSDEPFIYHYNTDEVSA

SEQ ID NO: 1818167 - protein, 19 aa, Staphylococcus epidermidis
MSGMQKWFHGLTVDSKKAW

SEQ ID NO: 1818168 - protein, 31 aa, Staphylococcus epidermidis
MSLVLRPDVPFSMIPKFNLFIALGIRDAIQQ

SEQ ID NO: 1818169 - protein, 23 aa, Staphylococcus epidermidis
MSRVRRYPLPLALEVSNVESVMP

SEQ ID NO: 1818170 - protein, 17 aa, Staphylococcus epidermidis
MTCGVCLEVCPNVTKNN

SEQ ID NO: 1818171 - protein, 17 aa, Staphylococcus epidermidis
MTCGVCLEVCPNVTPNN

SEQ ID NO: 1818172 - protein, 21 aa, Staphylococcus epidermidis
MTLCKLKSLFDYLNIELTTMD

SEQ ID NO: 1818173 - protein, 20 aa, Staphylococcus epidermidis
MTLPELIEWVSITQKKLKVE

SEQ ID NO: 1818174 - protein, 17 aa, Staphylococcus epidermidis
MTTACLLFFGKYNAISD

SEQ ID NO: 1818175 - protein, 19 aa, Staphylococcus epidermidis
MVLNKTVPKDLFFIISLSG

SEQ ID NO: 1818176 - protein, 17 aa, Staphylococcus epidermidis
MVRREVVRIITPGTVMD

SEQ ID NO: 1818177 - protein, 17 aa, Staphylococcus epidermidis
MWFIRPFYAKETTKNKV

SEQ ID NO: 1818178 - protein, 24 aa, Staphylococcus epidermidis
MYKERGFEIKPEIAGLMISAIISD

SEQ ID NO: 1818179 - protein, 25 aa, Staphylococcus epidermidis
MYKERGFEIKPEIAGLMISAIISDS

SEQ ID NO: 1818180 - protein, 25 aa, Staphylococcus epidermidis
MYKERGFEIKPHIAGLMISAIISDS

SEQ ID NO: 1818181 - protein, 17 aa, Staphylococcus epidermidis
NAALKYVVECGANVVGL

SEQ ID NO: 1818182 - protein, 19 aa, Staphylococcus epidermidis
NAARIMAYLTKFWKINYKN

SEQ ID NO: 1818183 - protein, 19 aa, Staphylococcus epidermidis
NAIELFKGMDFQIEGELKD

SEQ ID NO: 1818184 - protein, 18 aa, Staphylococcus epidermidis
NAKKEWRNILISTGESSI

SEQ ID NO: 1818185 - protein, 18 aa, Staphylococcus epidermidis
NALLESWKIFSLEDKADF

SEQ ID NO: 1818186 - protein, 18 aa, Staphylococcus epidermidis
NAMKRNDLVFGIGPAGTG

SEQ ID NO: 1818187 - protein, 18 aa, Staphylococcus epidermidis
NANISTCWFNIRQKENHT

SEQ ID NO: 1818188 - protein, 22 aa, Staphylococcus epidermidis
NAYPEWEVMKLKDILSERKEYA

SEQ ID NO: 1818189 - protein, 21 aa, Staphylococcus epidermidis
NCGICSSGLYALVDGDIVEGD

SEQ ID NO: 1818190 - protein, 21 aa, Staphylococcus epidermidis
NCLYLRVDPYLPYQYLNHDGE

SEQ ID NO: 1818191 - protein, 20 aa, Staphylococcus epidermidis
NCPYRNFLFSWYYKKYDKEP

SEQ ID NO: 1818192 - protein, 19 aa, Staphylococcus epidermidis
NDIKRFDLVLVYKLDRLTR

SEQ ID NO: 1818193 - protein, 19 aa, Staphylococcus epidermidis
NDLDSIILIHACWLARVEI

SEQ ID NO: 1818194 - protein, 23 aa, Staphylococcus epidermidis
NDLLPVDALKMWSQKFNEPPNLS

SEQ ID NO: 1818195 - protein, 21 aa, Staphylococcus epidermidis
NDLPHLVSPVITDVKAATQSL

SEQ ID NO: 1818196 - protein, 17 aa, Staphylococcus epidermidis
NDPHIWLDPVLDRVFAK

SEQ ID NO: 1818197 - protein, 22 aa, Staphylococcus epidermidis
NDTFCVLNHLFVNEGNEEVFES

SEQ ID NO: 1818198 - protein, 17 aa, Staphylococcus epidermidis
NEAGIPIIFVINQIDKH

SEQ ID NO: 1818199 - protein, 25 aa, Staphylococcus epidermidis
NEFKNYILGLIFYRFLSEKVEETSG

SEQ ID NO: 1818200 - protein, 18 aa, Staphylococcus epidermidis
NEGFGMVILEAMAQDNIV

SEQ ID NO: 1818201 - protein, 20 aa, Staphylococcus epidermidis
NEITEGIGHIPGRHFTLSTE

SEQ ID NO: 1818202 - protein, 17 aa, Staphylococcus epidermidis
NESIWRKELEGISKIAK

SEQ ID NO: 1818203 - protein, 23 aa, Staphylococcus epidermidis
NFREEIKDILSLVEEIIERTKNA

SEQ ID NO: 1818204 - protein, 22 aa, Staphylococcus epidermidis
NFVYLYHCFEFSNNIVKAKDNE

SEQ ID NO: 1818205 - protein, 18 aa, Staphylococcus epidermidis
NGRMPLVGIGSVFTPDDA

SEQ ID NO: 1818206 - protein, 18 aa, Staphylococcus epidermidis
NGTCAFLHFSRTEGTQYP

SEQ ID NO: 1818207 - protein, 17 aa, Staphylococcus epidermidis
NGVELRNRFVLAPLTHI

SEQ ID NO: 1818208 - protein, 24 aa, Staphylococcus epidermidis
NGVLCGRATWAGAVQVYIEQGEEA

SEQ ID NO: 1818209 - protein, 18 aa, Staphylococcus epidermidis
NGYPDFKGAGLVEQEVDI

SEQ ID NO: 1818210 - protein, 23 aa, Staphylococcus epidermidis
NHFDLRPAGIIKMLDLKQPIYKQ

SEQ ID NO: 1818211 - protein, 25 aa, Staphylococcus epidermidis
NHIPPWILIIPLNFGETIKWFSILK

SEQ ID NO: 1818212 - protein, 22 aa, Staphylococcus epidermidis
NHIRLKFCLIDILTTHRPIEDI

SEQ ID NO: 1818213 - protein, 18 aa, Staphylococcus epidermidis
NHWYEWLKHNLTLEGYHV

SEQ ID NO: 1818214 - protein, 18 aa, Staphylococcus epidermidis
NHYWKYVEKYGVLGIALD

SEQ ID NO: 1818215 - protein, 17 aa, Staphylococcus epidermidis
NIEIALKLLKILLKELE

SEQ ID NO: 1818216 - protein, 17 aa, Staphylococcus epidermidis
NIFKRNRLTIGVSTEGA

SEQ ID NO: 1818217 - protein, 17 aa, Staphylococcus epidermidis
NIHVIPLSLTIDGKSYT

SEQ ID NO: 1818218 - protein, 24 aa, Staphylococcus epidermidis
NIKLDMDGRIPINVWTGESIARSG

SEQ ID NO: 1818219 - protein, 20 aa, Staphylococcus epidermidis
NIKSYAIGVGPEYTDLNIKN

SEQ ID NO: 1818220 - protein, 22 aa, Staphylococcus epidermidis
NINAIELFKGMGFQIEGELKDK

SEQ ID NO: 1818221 - protein, 25 aa, Staphylococcus epidermidis
NIPAGRGMVKWAPFATLPEQFETIH

SEQ ID NO: 1818222 - protein, 23 aa, Staphylococcus epidermidis
NIPELRKRIKLVAEQNYGQIKSI

SEQ ID NO: 1818223 - protein, 20 aa, Staphylococcus epidermidis
NIPFLWRLTSELNVAQLKRA

SEQ ID NO: 1818224 - protein, 20 aa, Staphylococcus epidermidis
NKEIKSYVIVPAISQEINEF

SEQ ID NO: 1818225 - protein, 17 aa, Staphylococcus epidermidis
NKGKVVLVTAMSPTPAG

SEQ ID NO: 1818226 - protein, 17 aa, Staphylococcus epidermidis
NKHGYLYFCGQLDVPLT

SEQ ID NO: 1818227 - protein, 19 aa, Staphylococcus epidermidis
NKLGFTFVIKGTFKERVAV

SEQ ID NO: 1818228 - protein, 18 aa, Staphylococcus epidermidis
NKVKEFIDHLPFELTDAQ

SEQ ID NO: 1818229 - protein, 28 aa, Staphylococcus epidermidis
NLCKNRFCPVCAWRKARKDALGLSLMMQ

SEQ ID NO: 1818230 - protein, 22 aa, Staphylococcus epidermidis
NLKAETIVAYAVYLSRYEYSVY

SEQ ID NO: 1818231 - protein, 18 aa, Staphylococcus epidermidis
NLLFLSFAGALAYQINAK

SEQ ID NO: 1818232 - protein, 22 aa, Staphylococcus epidermidis
NLLNRHKMGILFQKTEFPKYIK

SEQ ID NO: 1818233 - protein, 25 aa, Staphylococcus epidermidis
NLPEEMNPFLGYRAIRLCLAQQDIF

SEQ ID NO: 1818234 - protein, 19 aa, Staphylococcus epidermidis
NMFEIRLSKIWEKLLNKSP

SEQ ID NO: 1818235 - protein, 22 aa, Staphylococcus epidermidis
NMIFQFEHLGLWSTGDTQFDVK

SEQ ID NO: 1818236 - protein, 19 aa, Staphylococcus epidermidis
NMSGFRVGFAVGNKEMIQA

SEQ ID NO: 1818237 - protein, 17 aa, Staphylococcus epidermidis
NNDLKAGVLSYAYGIAS

SEQ ID NO: 1818238 - protein, 17 aa, Staphylococcus epidermidis
NNDYCLFYPRWANQKNN

SEQ ID NO: 1818239 - protein, 22 aa, Staphylococcus epidermidis
NNELGIGVGKGFYDYTNGVPYE

SEQ ID NO: 1818240 - protein, 17 aa, Staphylococcus epidermidis
NNGRIIVISSIWGETGA

SEQ ID NO: 1818241 - protein, 18 aa, Staphylococcus epidermidis
NNGYKYWVDLGWKETDKK

SEQ ID NO: 1818242 - protein, 17 aa, Staphylococcus epidermidis
NNIKKAWWQKFITQSPY

SEQ ID NO: 1818243 - protein, 17 aa, Staphylococcus epidermidis
NNIKRLNIETVKQDNTS

SEQ ID NO: 1818244 - protein, 18 aa, Staphylococcus epidermidis
NNIKRLNIETVKQDNTSF

SEQ ID NO: 1818245 - protein, 18 aa, Staphylococcus epidermidis
NNIPEFNHYYAIGKQTAD

SEQ ID NO: 1818246 - protein, 24 aa, Staphylococcus epidermidis
NNKTSECFSFFISYHYNKFDLGVQ

SEQ ID NO: 1818247 - protein, 24 aa, Staphylococcus epidermidis
NNPKGMCDTCSGLGYVEDIDLNEL

SEQ ID NO: 1818248 - protein, 18 aa, Staphylococcus epidermidis
NNSFSFTGGYVFIHEYEI

SEQ ID NO: 1818249 - protein, 26 aa, Staphylococcus epidermidis
NNVKPNWCPGCGDFSVQAAIQKAAAN

SEQ ID NO: 1818250 - protein, 23 aa, Staphylococcus epidermidis
NNYKEVTEALGIYDLGNKYPSEI

SEQ ID NO: 1818251 - protein, 18 aa, Staphylococcus epidermidis
NPDGAYGFQCFDVANQYW

SEQ ID NO: 1818252 - protein, 18 aa, Staphylococcus epidermidis
NPFPKEWRMHAFFMDALP

SEQ ID NO: 1818253 - protein, 19 aa, Staphylococcus epidermidis
NPNPFEWLNQLSHPYRDEE

SEQ ID NO: 1818254 - protein, 23 aa, Staphylococcus epidermidis
NPPHLKAMIPWEGLNDMYREIAF

SEQ ID NO: 1818255 - protein, 19 aa, Staphylococcus epidermidis
NPVQLRRVVSVLSDQHYIT

SEQ ID NO: 1818256 - protein, 19 aa, Staphylococcus epidermidis
NPYQWPSFDIKYLDLPKKQ

SEQ ID NO: 1818257 - protein, 19 aa, Staphylococcus epidermidis
NQHLPGWGLDALKFLIEER

SEQ ID NO: 1818258 - protein, 24 aa, Staphylococcus epidermidis
NQLFKEYLRFVSILKPKIFIIENV

SEQ ID NO: 1818259 - protein, 22 aa, Staphylococcus epidermidis
NRAESWLRSNIKEINFQLYNYA

SEQ ID NO: 1818260 - protein, 19 aa, Staphylococcus epidermidis
NRPLVCVGILKGSVMFMAD

SEQ ID NO: 1818261 - protein, 22 aa, Staphylococcus epidermidis
NRPRGKFRFPMQVSEETSAQYE

SEQ ID NO: 1818262 - protein, 24 aa, Staphylococcus epidermidis
NSALFKKRVKSIVNKAQRVSEETA

SEQ ID NO: 1818263 - protein, 26 aa, Staphylococcus epidermidis
NSFPEWQKHFPFWSVMTIKRAVYSLE

SEQ ID NO: 1818264 - protein, 18 aa, Staphylococcus epidermidis
NSGGTTFSLSMTASTGGA

SEQ ID NO: 1818265 - protein, 20 aa, Staphylococcus epidermidis
NSLYKLTGVQAYVDVYKEEV

SEQ ID NO: 1818266 - protein, 25 aa, Staphylococcus epidermidis
NTERFKYKFGLPIESVFGQTIENLL

SEQ ID NO: 1818267 - protein, 17 aa, Staphylococcus epidermidis
NTLFKFTNEIIIGRKYN

SEQ ID NO: 1818268 - protein, 22 aa, Staphylococcus epidermidis
NVIFIGLLCKYGQWNAVIFDIG

SEQ ID NO: 1818269 - protein, 18 aa, Staphylococcus epidermidis
NVLKWVHQYIEHFGGDPN

SEQ ID NO: 1818270 - protein, 20 aa, Staphylococcus epidermidis
NVRIIFRRGPLLASLKECYK

SEQ ID NO: 1818271 - protein, 18 aa, Staphylococcus epidermidis
NVVDFGAFVDIGVKQDGL

SEQ ID NO: 1818272 - protein, 17 aa, Staphylococcus epidermidis
NWPVCGIPEKFYTDHGS

SEQ ID NO: 1818273 - protein, 18 aa, Staphylococcus epidermidis
NYGTLGLAFIKQYESKKD

SEQ ID NO: 1818274 - protein, 23 aa, Staphylococcus epidermidis
NYIKEQYKGIGIMYKNHQWYFVV

SEQ ID NO: 1818275 - protein, 19 aa, Staphylococcus epidermidis
NYVDFGIAFDSQWNFAVLP

SEQ ID NO: 1818276 - protein, 17 aa, Staphylococcus epidermidis
NYVNFQFDLPIADGTEQ

SEQ ID NO: 1818277 - protein, 17 aa, Staphylococcus epidermidis
NYYPRPDTGLSISFIEE

SEQ ID NO: 1818278 - protein, 23 aa, Staphylococcus epidermidis
NYYPRPDTGLSRSFIDNKNQLIH

SEQ ID NO: 1818279 - protein, 22 aa, Staphylococcus epidermidis
PAALMFPSGNPFYDWRYQTEEE

SEQ ID NO: 1818280 - protein, 17 aa, Staphylococcus epidermidis
PACNEVQCGWAASHSLE

SEQ ID NO: 1818281 - protein, 19 aa, Staphylococcus epidermidis
PCNECEICRGITQGTNSDV

SEQ ID NO: 1818282 - protein, 18 aa, Staphylococcus epidermidis
PDFFELQAGIAYGENNSI

SEQ ID NO: 1818283 - protein, 17 aa, Staphylococcus epidermidis
PDTGLSISFIEEKNQLI

SEQ ID NO: 1818284 - protein, 18 aa, Staphylococcus epidermidis
PDTGLSISFIEEKNQLIR

SEQ ID NO: 1818285 - protein, 25 aa, Staphylococcus epidermidis
PDTLRVASLLAHTLFDFPSHQLTTY

SEQ ID NO: 1818286 - protein, 24 aa, Staphylococcus epidermidis
PDVKRKLSEAKYLNGKMEELKAIV

SEQ ID NO: 1818287 - protein, 18 aa, Staphylococcus epidermidis
PDVLRFFMISVHYRSPIN

SEQ ID NO: 1818288 - protein, 17 aa, Staphylococcus epidermidis
PDYIKTLTFNSAVHILK

SEQ ID NO: 1818289 - protein, 17 aa, Staphylococcus epidermidis
PDYIKTLTFNSAVHTLK

SEQ ID NO: 1818290 - protein, 19 aa, Staphylococcus epidermidis
PEEYWTIEGEFRYKKSKFN

SEQ ID NO: 1818291 - protein, 20 aa, Staphylococcus epidermidis
PEFIGRVPIVANLETLDIAA

SEQ ID NO: 1818292 - protein, 24 aa, Staphylococcus epidermidis
PEHIVKLKLTYKWINADNPQEVLE

SEQ ID NO: 1818293 - protein, 19 aa, Staphylococcus epidermidis
PELFWSIELSKELDTDQLY

SEQ ID NO: 1818294 - protein, 18 aa, Staphylococcus epidermidis
PENGFVCYMVGRLILENC

SEQ ID NO: 1818295 - protein, 20 aa, Staphylococcus epidermidis
PEYIKTLTFNSAVQTLKSEL

SEQ ID NO: 1818296 - protein, 17 aa, Staphylococcus epidermidis
PFCYRICTYCDFNKYFI

SEQ ID NO: 1818297 - protein, 18 aa, Staphylococcus epidermidis
PFFYPLDKLISISTMIEE

SEQ ID NO: 1818298 - protein, 23 aa, Staphylococcus epidermidis
PFGEGRPGWHIECSVMAYHELGP

SEQ ID NO: 1818299 - protein, 19 aa, Staphylococcus epidermidis
PFGKCHFALAAKPETSRYK

SEQ ID NO: 1818300 - protein, 20 aa, Staphylococcus epidermidis
PFRTAHEIVGKIVLNCIHKG

SEQ ID NO: 1818301 - protein, 19 aa, Staphylococcus epidermidis
PGDEVLVAFDLYGGTFRLF

SEQ ID NO: 1818302 - protein, 17 aa, Staphylococcus epidermidis
PGHNRWHPDIPAAFSVE

SEQ ID NO: 1818303 - protein, 22 aa, Staphylococcus epidermidis
PGHPPESISFLLTDEGGGSSIP

SEQ ID NO: 1818304 - protein, 20 aa, Staphylococcus epidermidis
PGLTICGGYQFLGTKYITPD

SEQ ID NO: 1818305 - protein, 17 aa, Staphylococcus epidermidis
PGSLSYVFDEFAVVGDT

SEQ ID NO: 1818306 - protein, 20 aa, Staphylococcus epidermidis
PGTDLVWLGAVTKYIIDNDL

SEQ ID NO: 1818307 - protein, 24 aa, Staphylococcus epidermidis
PGYEAPCYIAWSGKNRSPLVRVPS

SEQ ID NO: 1818308 - protein, 18 aa, Staphylococcus epidermidis
PHIFKASCVTYLLEVKKV

SEQ ID NO: 1818309 - protein, 17 aa, Staphylococcus epidermidis
PHIMPVWSIKNRARKVR

SEQ ID NO: 1818310 - protein, 17 aa, Staphylococcus epidermidis
PHIMPVWSIKSRARKVR

SEQ ID NO: 1818311 - protein, 21 aa, Staphylococcus epidermidis
PHLEKGNALAFAHGFNIHFSV

SEQ ID NO: 1818312 - protein, 24 aa, Staphylococcus epidermidis
PHMLSGGMLQRLMIALALALKPKL

SEQ ID NO: 1818313 - protein, 23 aa, Staphylococcus epidermidis
PHNKIWLDPGIGFAKTREEGNEV

SEQ ID NO: 1818314 - protein, 22 aa, Staphylococcus epidermidis
PHNKIWLDPGIGFPKTREEENE

SEQ ID NO: 1818315 - protein, 20 aa, Staphylococcus epidermidis
PHYRSQMFFKSFLTDNKSDI

SEQ ID NO: 1818316 - protein, 17 aa, Staphylococcus epidermidis
PIDFKWKDEAVVGVMLA

SEQ ID NO: 1818317 - protein, 18 aa, Staphylococcus epidermidis
PIEIPNFEFGERVIDSTG

SEQ ID NO: 1818318 - protein, 18 aa, Staphylococcus epidermidis
PIGRCWLVQASKLKWIFK

SEQ ID NO: 1818319 - protein, 19 aa, Staphylococcus epidermidis
PILQEALNFVRIGDRFVVE

SEQ ID NO: 1818320 - protein, 18 aa, Staphylococcus epidermidis
PILQEALNFVRMGDRFVV

SEQ ID NO: 1818321 - protein, 21 aa, Staphylococcus epidermidis
PIPRTLAISVFGEMDVSSIKQ

SEQ ID NO: 1818322 - protein, 21 aa, Staphylococcus epidermidis
PIVEKELIQRIGFVIEPENLF

SEQ ID NO: 1818323 - protein, 24 aa, Staphylococcus epidermidis
PIVEKELIQRIGFVIEPENLFSNL

SEQ ID NO: 1818324 - protein, 21 aa, Staphylococcus epidermidis
PKDRRAGVITFNLEDIHPHDV

SEQ ID NO: 1818325 - protein, 21 aa, Staphylococcus epidermidis
PKDRRAGVITFNLSDIHPHDV

SEQ ID NO: 1818326 - protein, 18 aa, Staphylococcus epidermidis
PKGMCKTCEGLGYIEDIN

SEQ ID NO: 1818327 - protein, 17 aa, Staphylococcus epidermidis
PKIKVGDTVTEGDVIGY

SEQ ID NO: 1818328 - protein, 23 aa, Staphylococcus epidermidis
PKKMRRLALRSALSFKVQEKGFT

SEQ ID NO: 1818329 - protein, 17 aa, Staphylococcus epidermidis
PKKWNILTINDFADDLI

SEQ ID NO: 1818330 - protein, 17 aa, Staphylococcus epidermidis
PKLKELWPQAGDYLLVT

SEQ ID NO: 1818331 - protein, 17 aa, Staphylococcus epidermidis
PKLSFDAMTIVGNLNKN

SEQ ID NO: 1818332 - protein, 21 aa, Staphylococcus epidermidis
PKPRLPFEHIFHKNSYDASND

SEQ ID NO: 1818333 - protein, 21 aa, Staphylococcus epidermidis
PKPRLPFKHIFHKDQYDANHH

SEQ ID NO: 1818334 - protein, 20 aa, Staphylococcus epidermidis
PKRIKLKWSTSIIKDLETIR

SEQ ID NO: 1818335 - protein, 18 aa, Staphylococcus epidermidis
PLEDRVALFGLEKSEDGI

SEQ ID NO: 1818336 - protein, 18 aa, Staphylococcus epidermidis
PLHREIEAMYAISNQHQT

SEQ ID NO: 1818337 - protein, 22 aa, Staphylococcus epidermidis
PLKNCTRIIPFSSISYLDVLDR

SEQ ID NO: 1818338 - protein, 17 aa, Staphylococcus epidermidis
PLKRGAATIAMLGKAPI

SEQ ID NO: 1818339 - protein, 21 aa, Staphylococcus epidermidis
PLRREAVVLLGMIEDEDILPY

SEQ ID NO: 1818340 - protein, 17 aa, Staphylococcus epidermidis
PLVNRITHEIAFVRYHG

SEQ ID NO: 1818341 - protein, 23 aa, Staphylococcus epidermidis
PMIKTAKIVLNWLASERIEVSLL

SEQ ID NO: 1818342 - protein, 18 aa, Staphylococcus epidermidis
PMKCLRIIAMFRLINPTK

SEQ ID NO: 1818343 - protein, 17 aa, Staphylococcus epidermidis
PMMYLALSYDHRIIDGK

SEQ ID NO: 1818344 - protein, 18 aa, Staphylococcus epidermidis
PNIECLRQADIVMSPELI

SEQ ID NO: 1818345 - protein, 19 aa, Staphylococcus epidermidis
PNKEFQLIFLLVSNPKHIF

SEQ ID NO: 1818346 - protein, 21 aa, Staphylococcus epidermidis
PNKEFQLLFLLASNPKHIFTR

SEQ ID NO: 1818347 - protein, 19 aa, Staphylococcus epidermidis
PNYCGRVINQYGQFDNMFP

SEQ ID NO: 1818348 - protein, 22 aa, Staphylococcus epidermidis
PPGFKGICAISYFNNASLEEIK

SEQ ID NO: 1818349 - protein, 17 aa, Staphylococcus epidermidis
PPILIIHGGKDWQVGIH

SEQ ID NO: 1818350 - protein, 26 aa, Staphylococcus epidermidis
PQEMPSRIPIGLPISGTTVYVMQGDR

SEQ ID NO: 1818351 - protein, 26 aa, Staphylococcus epidermidis
PQEMPSRIPIGLPISGTTVYVMQGER

SEQ ID NO: 1818352 - protein, 23 aa, Staphylococcus epidermidis
PQGKIWLDPGVGFAKTREEENEV

SEQ ID NO: 1818353 - protein, 22 aa, Staphylococcus epidermidis
PQHPRCPYSIMTASRLASEKHV

SEQ ID NO: 1818354 - protein, 18 aa, Staphylococcus epidermidis
PQLKICACLGLTKEEQAK

SEQ ID NO: 1818355 - protein, 28 aa, Staphylococcus epidermidis
PQSLKKDWGFFFMPKFNFVINVANENRI

SEQ ID NO: 1818356 - protein, 22 aa, Staphylococcus epidermidis
PQYAIELWSKCVNELVEKNVSF

SEQ ID NO: 1818357 - protein, 19 aa, Staphylococcus epidermidis
PRIRLYIALNECISADDYR

SEQ ID NO: 1818358 - protein, 17 aa, Staphylococcus epidermidis
PRISYDDAIEFLKKEGF

SEQ ID NO: 1818359 - protein, 20 aa, Staphylococcus epidermidis
PRISYDDAIEFLKKEGFDDI

SEQ ID NO: 1818360 - protein, 20 aa, Staphylococcus epidermidis
PRISYDDAIEFLKKEGFNDI

SEQ ID NO: 1818361 - protein, 20 aa, Staphylococcus epidermidis
PRISYDDAIEFLKQEGFDDI

SEQ ID NO: 1818362 - protein, 19 aa, Staphylococcus epidermidis
PRLFEGFSMGNPKIQTGNL

SEQ ID NO: 1818363 - protein, 19 aa, Staphylococcus epidermidis
PRLFWPIYYFVQAPIQGLL

SEQ ID NO: 1818364 - protein, 20 aa, Staphylococcus epidermidis
PRLTELPLYLSSDIGNQKST

SEQ ID NO: 1818365 - protein, 17 aa, Staphylococcus epidermidis
PRPIGWISTVSKDGKDN

SEQ ID NO: 1818366 - protein, 17 aa, Staphylococcus epidermidis
PRPIGWISTVSKKGKDN

SEQ ID NO: 1818367 - protein, 19 aa, Staphylococcus epidermidis
PRSIYCGTIGVLLPDGRMI

SEQ ID NO: 1818368 - protein, 20 aa, Staphylococcus epidermidis
PRVLGDIIICTDVAKEQAES

SEQ ID NO: 1818369 - protein, 19 aa, Staphylococcus epidermidis
PSDQWLRVRAEYLQNRNSN

SEQ ID NO: 1818370 - protein, 18 aa, Staphylococcus epidermidis
PSFSTCFGAPFLPLNPTV

SEQ ID NO: 1818371 - protein, 24 aa, Staphylococcus epidermidis
PSKLPLDKRMHAIRQRLGNVEWTD

SEQ ID NO: 1818372 - protein, 20 aa, Staphylococcus epidermidis
PSSIKAILNQAGFNDEITEE

SEQ ID NO: 1818373 - protein, 17 aa, Staphylococcus epidermidis
PSSLDDLGIEAAFNSYF

SEQ ID NO: 1818374 - protein, 23 aa, Staphylococcus epidermidis
PTGLWLSELVHFYDAFKHTNVDI

SEQ ID NO: 1818375 - protein, 18 aa, Staphylococcus epidermidis
PTHVAVCWDMGQQTFRNE

SEQ ID NO: 1818376 - protein, 18 aa, Staphylococcus epidermidis
PTPKWSISRYKGLGEMNA

SEQ ID NO: 1818377 - protein, 21 aa, Staphylococcus epidermidis
PVEHPPRILGFDAAGIVEQVG

SEQ ID NO: 1818378 - protein, 18 aa, Staphylococcus epidermidis
PVLQEALNFVRMGDRFIV

SEQ ID NO: 1818379 - protein, 23 aa, Staphylococcus epidermidis
PWGDLDIDVVLECTGFYTDKDKA

SEQ ID NO: 1818380 - protein, 17 aa, Staphylococcus epidermidis
PYIEGFVKMLAPIAPHI

SEQ ID NO: 1818381 - protein, 23 aa, Staphylococcus epidermidis
QALKDFAERLGVNYSYDDAELLK

SEQ ID NO: 1818382 - protein, 20 aa, Staphylococcus epidermidis
QAPYKFLLSHGFFMDGEGKK

SEQ ID NO: 1818383 - protein, 20 aa, Staphylococcus epidermidis
QAPYKFLLSHGFVMDGEGKK

SEQ ID NO: 1818384 - protein, 19 aa, Staphylococcus epidermidis
QCNQLGLALAEKFAPNHQV

SEQ ID NO: 1818385 - protein, 18 aa, Staphylococcus epidermidis
QDGLLFKGIHKLFNGIHS

SEQ ID NO: 1818386 - protein, 17 aa, Staphylococcus epidermidis
QDIKAGYDFGSKGIGLV

SEQ ID NO: 1818387 - protein, 17 aa, Staphylococcus epidermidis
QDKGVEITSHFYKRMFK

SEQ ID NO: 1818388 - protein, 18 aa, Staphylococcus epidermidis
QEGIEFVEFLISPNKGEP

SEQ ID NO: 1818389 - protein, 17 aa, Staphylococcus epidermidis
QEYAWAFLNELFYLIEL

SEQ ID NO: 1818390 - protein, 22 aa, Staphylococcus epidermidis
QFETRAAALLRYYTGLLESSKK

SEQ ID NO: 1818391 - protein, 22 aa, Staphylococcus epidermidis
QFETRAGTLLRYYTGLLESSRE

SEQ ID NO: 1818392 - protein, 19 aa, Staphylococcus epidermidis
QFFKEGLILFTYLHLANEE

SEQ ID NO: 1818393 - protein, 17 aa, Staphylococcus epidermidis
QGFSLAGKFGRTFIDDP

SEQ ID NO: 1818394 - protein, 18 aa, Staphylococcus epidermidis
QGFSLAGKFGRTFIDDPR

SEQ ID NO: 1818395 - protein, 17 aa, Staphylococcus epidermidis
QGYEAIFVLCDTDYFEN

SEQ ID NO: 1818396 - protein, 25 aa, Staphylococcus epidermidis
QHFTLSMLYRYIDEIHISKNKSLVG

SEQ ID NO: 1818397 - protein, 20 aa, Staphylococcus epidermidis
QHKVKLVFFLAMSKKDLNIN

SEQ ID NO: 1818398 - protein, 18 aa, Staphylococcus epidermidis
QHLLKLLSNEGVQWIVLA

SEQ ID NO: 1818399 - protein, 20 aa, Staphylococcus epidermidis
QIAELCYFIWRDMELDITKE

SEQ ID NO: 1818400 - protein, 17 aa, Staphylococcus epidermidis
QIKELFYDLEITNLQDL

SEQ ID NO: 1818401 - protein, 21 aa, Staphylococcus epidermidis
QKALELIELVGLKGRESAYPS

SEQ ID NO: 1818402 - protein, 20 aa, Staphylococcus epidermidis
QKALELVELVGLKGRESAYP

SEQ ID NO: 1818403 - protein, 22 aa, Staphylococcus epidermidis
QKARSGDTLIVYKLDRISRKYD

SEQ ID NO: 1818404 - protein, 20 aa, Staphylococcus epidermidis
QKEIYSCFAGMYEPTQKDVQ

SEQ ID NO: 1818405 - protein, 22 aa, Staphylococcus epidermidis
QKEMRKFMAGVIFATQSPQELI

SEQ ID NO: 1818406 - protein, 21 aa, Staphylococcus epidermidis
QKIVRWRAAMFVFDEGNENQL

SEQ ID NO: 1818407 - protein, 23 aa, Staphylococcus epidermidis
QKYYPNYRYVWSLKNPDKSVIPG

SEQ ID NO: 1818408 - protein, 17 aa, Staphylococcus epidermidis
QLEAFKEALPFLMTAAE

SEQ ID NO: 1818409 - protein, 23 aa, Staphylococcus epidermidis
QLFKEYLRFVSILKPKIFIIENV

SEQ ID NO: 1818410 - protein, 18 aa, Staphylococcus epidermidis
QLHRLRTKWDIHIIDIFN

SEQ ID NO: 1818411 - protein, 18 aa, Staphylococcus epidermidis
QLKLARLSRRTHELGIPI

SEQ ID NO: 1818412 - protein, 19 aa, Staphylococcus epidermidis
QLNVFRMELLGAKVVAVEE

SEQ ID NO: 1818413 - protein, 18 aa, Staphylococcus epidermidis
QLRLKADLIRSFLDKVVP

SEQ ID NO: 1818414 - protein, 17 aa, Staphylococcus epidermidis
QLWEGWLKSWGLKDIHL

SEQ ID NO: 1818415 - protein, 23 aa, Staphylococcus epidermidis
QMANELFHFPVMYIEYSGEYGDI

SEQ ID NO: 1818416 - protein, 23 aa, Staphylococcus epidermidis
QMLKFGLPRLVKYLNMNIEKEQQ

SEQ ID NO: 1818417 - protein, 17 aa, Staphylococcus epidermidis
QNKRPDYISAFWNVVNW

SEQ ID NO: 1818418 - protein, 17 aa, Staphylococcus epidermidis
QNPEIWDSRNSKFGTPE

SEQ ID NO: 1818419 - protein, 19 aa, Staphylococcus epidermidis
QNYKRVVGVVSRDKDKMNK

SEQ ID NO: 1818420 - protein, 21 aa, Staphylococcus epidermidis
QPEYIKSLTFESAVETLKKHL

SEQ ID NO: 1818421 - protein, 19 aa, Staphylococcus epidermidis
QPSFSTCFGAPFLPLNPTK

SEQ ID NO: 1818422 - protein, 22 aa, Staphylococcus epidermidis
QQLRLKAGLIRSFLDKVVPSLK

SEQ ID NO: 1818423 - protein, 17 aa, Staphylococcus epidermidis
QQRVCIARCLAIEPDVI

SEQ ID NO: 1818424 - protein, 17 aa, Staphylococcus epidermidis
QRFNINFAKTVLKSPRY

SEQ ID NO: 1818425 - protein, 18 aa, Staphylococcus epidermidis
QRGEVQGVYALRQQIAHY

SEQ ID NO: 1818426 - protein, 19 aa, Staphylococcus epidermidis
QRHIPMAIATSSYREDILP

SEQ ID NO: 1818427 - protein, 21 aa, Staphylococcus epidermidis
QRKTLRPDGIFYYVKDKLLRI

SEQ ID NO: 1818428 - protein, 21 aa, Staphylococcus epidermidis
QRLINFPAMPVKGEWKQESYG

SEQ ID NO: 1818429 - protein, 24 aa, Staphylococcus epidermidis
QRWWPAESPIEMMLGAILVQNTNW

SEQ ID NO: 1818430 - protein, 19 aa, Staphylococcus epidermidis
QSKVFRSRFRMLVEAQLDL

SEQ ID NO: 1818431 - protein, 24 aa, Staphylococcus epidermidis
QSRAKWLFLDVFQWSRTDYLIHSQ

SEQ ID NO: 1818432 - protein, 18 aa, Staphylococcus epidermidis
QSYKRVVGVVSRDKDKMN

SEQ ID NO: 1818433 - protein, 18 aa, Staphylococcus epidermidis
QTDGRMKALVSITLDEAF

SEQ ID NO: 1818434 - protein, 19 aa, Staphylococcus epidermidis
QTLLSLPFDYIFFTGSEKV

SEQ ID NO: 1818435 - protein, 26 aa, Staphylococcus epidermidis
QVTKRFAGICAISFFMNASLEDIKEL

SEQ ID NO: 1818436 - protein, 20 aa, Staphylococcus epidermidis
QVVIRCIFVYLGQLTKEEAL

SEQ ID NO: 1818437 - protein, 18 aa, Staphylococcus epidermidis
QWAGSCWYYLRYIDPDNE

SEQ ID NO: 1818438 - protein, 19 aa, Staphylococcus epidermidis
QWDMIKFALNNNIPRYNFY

SEQ ID NO: 1818439 - protein, 18 aa, Staphylococcus epidermidis
QYLEEFRKGFKQQIENTK

SEQ ID NO: 1818440 - protein, 25 aa, Staphylococcus epidermidis
RAASAWRPEVIKALKMNGLPASSAY

SEQ ID NO: 1818441 - protein, 18 aa, Staphylococcus epidermidis
RAGATVAHIHVRDPETGG

SEQ ID NO: 1818442 - protein, 18 aa, Staphylococcus epidermidis
RAGGLHQFMNWDGPILTD

SEQ ID NO: 1818443 - protein, 19 aa, Staphylococcus epidermidis
RALEEVIYFASYVVVDPGP

SEQ ID NO: 1818444 - protein, 17 aa, Staphylococcus epidermidis
RALGYGMHGEHVDGNDP

SEQ ID NO: 1818445 - protein, 20 aa, Staphylococcus epidermidis
RALRFYKRLDFVTIDSSIDK

SEQ ID NO: 1818446 - protein, 25 aa, Staphylococcus epidermidis
RAMSGKGRFGGHFVLGHVDELGTIS

SEQ ID NO: 1818447 - protein, 17 aa, Staphylococcus epidermidis
RAYRSPARLQLFEHVMA

SEQ ID NO: 1818448 - protein, 17 aa, Staphylococcus epidermidis
RAYSKRHKKLFENLGET

SEQ ID NO: 1818449 - protein, 18 aa, Staphylococcus epidermidis
RCDLKFSLHENILEIKYS

SEQ ID NO: 1818450 - protein, 17 aa, Staphylococcus epidermidis
RCDYCMPKEIFGDDYTF

SEQ ID NO: 1818451 - protein, 19 aa, Staphylococcus epidermidis
RCIKELGFKGALIMGHPKN

SEQ ID NO: 1818452 - protein, 17 aa, Staphylococcus epidermidis
RCSWCDSAFTWDGSAKE

SEQ ID NO: 1818453 - protein, 27 aa, Staphylococcus epidermidis
RDCMEMKPLYEWLGLTASLGFIDIPDY

SEQ ID NO: 1818454 - protein, 20 aa, Staphylococcus epidermidis
RDDLKLGLELTVVALNPYDL

SEQ ID NO: 1818455 - protein, 17 aa, Staphylococcus epidermidis
RDFIDKICLESMEGGCD

SEQ ID NO: 1818456 - protein, 20 aa, Staphylococcus epidermidis
RDIAEINGFWAYQNTRNKEF

SEQ ID NO: 1818457 - protein, 26 aa, Staphylococcus epidermidis
RDIIKRMYFFSIANPNPFEWLNQLSH

SEQ ID NO: 1818458 - protein, 22 aa, Staphylococcus epidermidis
RDLKHFRLGISVSKKLGNAVTR

SEQ ID NO: 1818459 - protein, 17 aa, Staphylococcus epidermidis
RDLRELNIFRLPADAKQ

SEQ ID NO: 1818460 - protein, 17 aa, Staphylococcus epidermidis
RDLRFIEDFSIKISDVM

SEQ ID NO: 1818461 - protein, 30 aa, Staphylococcus epidermidis
RDVFGYSVSKGWMCVQVFFIRQGNMIKRDA

SEQ ID NO: 1818462 - protein, 19 aa, Staphylococcus epidermidis
REAMIRSQILGLIDNYDYE

SEQ ID NO: 1818463 - protein, 18 aa, Staphylococcus epidermidis
REHFAIFPASHFVTREEK

SEQ ID NO: 1818464 - protein, 19 aa, Staphylococcus epidermidis
REKVIEMLKFVGLANKKNQ

SEQ ID NO: 1818465 - protein, 21 aa, Staphylococcus epidermidis
RELQDIIAILGMDELSDEDKQ

SEQ ID NO: 1818466 - protein, 21 aa, Staphylococcus epidermidis
RELQSRLGITFIFVTHDQEEA

SEQ ID NO: 1818467 - protein, 17 aa, Staphylococcus epidermidis
RENYGTLGLAFIKQYES

SEQ ID NO: 1818468 - protein, 24 aa, Staphylococcus epidermidis
REQPEIYICGGTKFLHSIINSLKE

SEQ ID NO: 1818469 - protein, 17 aa, Staphylococcus epidermidis
RERICDAAIQLMKNIKY

SEQ ID NO: 1818470 - protein, 20 aa, Staphylococcus epidermidis
RERICEAAIQLMENIKYVNA

SEQ ID NO: 1818471 - protein, 17 aa, Staphylococcus epidermidis
RFDLKCYLTLLDVLDSH

SEQ ID NO: 1818472 - protein, 17 aa, Staphylococcus epidermidis
RFEAYGWNYILVKDGND

SEQ ID NO: 1818473 - protein, 19 aa, Staphylococcus epidermidis
RFLEFPQETSIEIKQGDFT

SEQ ID NO: 1818474 - protein, 23 aa, Staphylococcus epidermidis
RFTSTEVDLFFTLCNKLKEQDTR

SEQ ID NO: 1818475 - protein, 18 aa, Staphylococcus epidermidis
RGALKYIHDIWGYIAPNT

SEQ ID NO: 1818476 - protein, 18 aa, Staphylococcus epidermidis
RGDSRFYLSLQDELMVRF

SEQ ID NO: 1818477 - protein, 18 aa, Staphylococcus epidermidis
RGGIPCIFNHQWSNERIH

SEQ ID NO: 1818478 - protein, 17 aa, Staphylococcus epidermidis
RGHFYLRELAASESEIK

SEQ ID NO: 1818479 - protein, 17 aa, Staphylococcus epidermidis
RGLSCYDDLMIYYVKSL

SEQ ID NO: 1818480 - protein, 17 aa, Staphylococcus epidermidis
RGLSILERLACRFENLS

SEQ ID NO: 1818481 - protein, 19 aa, Staphylococcus epidermidis
RGSEFDFVFIYNVDEESQV

SEQ ID NO: 1818482 - protein, 20 aa, Staphylococcus epidermidis
RGYASFMLCRDCGYVPQCPN

SEQ ID NO: 1818483 - protein, 19 aa, Staphylococcus epidermidis
RHFKRRITITDGKISSDEE

SEQ ID NO: 1818484 - protein, 17 aa, Staphylococcus epidermidis
RHGYKRFTKAYISMSRK

SEQ ID NO: 1818485 - protein, 21 aa, Staphylococcus epidermidis
RHHLRLCGGFQFSSHKSDDEW

SEQ ID NO: 1818486 - protein, 20 aa, Staphylococcus epidermidis
RHIAHPTGRIIGRRKGYKAN

SEQ ID NO: 1818487 - protein, 18 aa, Staphylococcus epidermidis
RHRLLELFLIEILHYNWE

SEQ ID NO: 1818488 - protein, 17 aa, Staphylococcus epidermidis
RHVPILGVCLGFQLIIE

SEQ ID NO: 1818489 - protein, 18 aa, Staphylococcus epidermidis
RIAIFDLYFRSMPFNSGY

SEQ ID NO: 1818490 - protein, 18 aa, Staphylococcus epidermidis
RIAKYPIFTILYEKVEYD

SEQ ID NO: 1818491 - protein, 18 aa, Staphylococcus epidermidis
RIANHRVLAMNRGEKEKV

SEQ ID NO: 1818492 - protein, 21 aa, Staphylococcus epidermidis
RIAPRKVRLVLDLIRGKNAAE

SEQ ID NO: 1818493 - protein, 24 aa, Staphylococcus epidermidis
RIDEYVVLRFGWLYGPGTWYGKDG

SEQ ID NO: 1818494 - protein, 20 aa, Staphylococcus epidermidis
RIHKGFHMLKFEGINNINDI

SEQ ID NO: 1818495 - protein, 21 aa, Staphylococcus epidermidis
RIKEFELLWYLASRENDVISK

SEQ ID NO: 1818496 - protein, 18 aa, Staphylococcus epidermidis
RIKLGVIPSFSLYKLHEK

SEQ ID NO: 1818497 - protein, 18 aa, Staphylococcus epidermidis
RIRPVILLLTLKMLNKDY

SEQ ID NO: 1818498 - protein, 23 aa, Staphylococcus epidermidis
RIRRLLKLYLERESFEIHEASNG

SEQ ID NO: 1818499 - protein, 18 aa, Staphylococcus epidermidis
RITSAFVRLQCNIDELHV

SEQ ID NO: 1818500 - protein, 18 aa, Staphylococcus epidermidis
RKAKELKLDHDVLDGSKA

SEQ ID NO: 1818501 - protein, 17 aa, Staphylococcus epidermidis
RKDLKIFNINDEKGVIN

SEQ ID NO: 1818502 - protein, 19 aa, Staphylococcus epidermidis
RKEPSIPHNFTFNLLFSNN

SEQ ID NO: 1818503 - protein, 19 aa, Staphylococcus epidermidis
RKGLPYVFAGHFAPQQMKE

SEQ ID NO: 1818504 - protein, 25 aa, Staphylococcus epidermidis
RKMIRMPVVLIISPRYNWLSSDAKI

SEQ ID NO: 1818505 - protein, 18 aa, Staphylococcus epidermidis
RKRIKLVAEQNYGRIKSI

SEQ ID NO: 1818506 - protein, 17 aa, Staphylococcus epidermidis
RKSYACLSYALNELGYD

SEQ ID NO: 1818507 - protein, 18 aa, Staphylococcus epidermidis
RKVAIALRNRYRRSLLDE

SEQ ID NO: 1818508 - protein, 18 aa, Staphylococcus epidermidis
RLAKEVLLSLPNDFDREV

SEQ ID NO: 1818509 - protein, 19 aa, Staphylococcus epidermidis
RLANMIQNFGILSLKDDYI

SEQ ID NO: 1818510 - protein, 18 aa, Staphylococcus epidermidis
RLCKDYQQIWGLSQDVQV

SEQ ID NO: 1818511 - protein, 22 aa, Staphylococcus epidermidis
RLDYPILCANIFENGKPFTGQG

SEQ ID NO: 1818512 - protein, 18 aa, Staphylococcus epidermidis
RLEALGVHAVMPLASPIG

SEQ ID NO: 1818513 - protein, 17 aa, Staphylococcus epidermidis
RLESYIMFELTRIKGAT

SEQ ID NO: 1818514 - protein, 17 aa, Staphylococcus epidermidis
RLKDGLVYRKMIIETEE

SEQ ID NO: 1818515 - protein, 18 aa, Staphylococcus epidermidis
RLKGGDPFVFGRGGEEAE

SEQ ID NO: 1818516 - protein, 18 aa, Staphylococcus epidermidis
RLKLTVINELAWHNLFAH

SEQ ID NO: 1818517 - protein, 20 aa, Staphylococcus epidermidis
RLLKDRIIMLGSQIDDNVAN

SEQ ID NO: 1818518 - protein, 18 aa, Staphylococcus epidermidis
RLNIETVKQENTSFIKED

SEQ ID NO: 1818519 - protein, 19 aa, Staphylococcus epidermidis
RLPESLNFISWLQHLQENG

SEQ ID NO: 1818520 - protein, 18 aa, Staphylococcus epidermidis
RLQKTLYFLFAYYGASYG

SEQ ID NO: 1818521 - protein, 19 aa, Staphylococcus epidermidis
RLQYQIIYILSKILDKHPL

SEQ ID NO: 1818522 - protein, 17 aa, Staphylococcus epidermidis
RLSEVKLGIDLNYITLN

SEQ ID NO: 1818523 - protein, 19 aa, Staphylococcus epidermidis
RLSNELLLHLDAKYSQFIA

SEQ ID NO: 1818524 - protein, 23 aa, Staphylococcus epidermidis
RMDDLRASLGISQFKNMKRNKIH

SEQ ID NO: 1818525 - protein, 19 aa, Staphylococcus epidermidis
RMILERILPILSDRERQII

SEQ ID NO: 1818526 - protein, 18 aa, Staphylococcus epidermidis
RMNTKWTQKGRLFIYELL

SEQ ID NO: 1818527 - protein, 18 aa, Staphylococcus epidermidis
RMVHELPTFFSSNFDYSE

SEQ ID NO: 1818528 - protein, 25 aa, Staphylococcus epidermidis
RNAKWFKERFNIDIYTKYEVNQIND

SEQ ID NO: 1818529 - protein, 21 aa, Staphylococcus epidermidis
RNEPLGGIGCHGYLEIDTGLL

SEQ ID NO: 1818530 - protein, 21 aa, Staphylococcus epidermidis
RNGSFKILAEFNALNTDYIQI

SEQ ID NO: 1818531 - protein, 21 aa, Staphylococcus epidermidis
RNNFYRFIPDNVVPVIPSSLV

SEQ ID NO: 1818532 - protein, 20 aa, Staphylococcus epidermidis
RPARALKLWITLQVIGEDEI

SEQ ID NO: 1818533 - protein, 17 aa, Staphylococcus epidermidis
RPDCLIGVCGCMSQEES

SEQ ID NO: 1818534 - protein, 20 aa, Staphylococcus epidermidis
RPDYISAFWNVVNWEKVDEL

SEQ ID NO: 1818535 - protein, 20 aa, Staphylococcus epidermidis
RPIMEEWLFNTVAFIGGPSE

SEQ ID NO: 1818536 - protein, 23 aa, Staphylococcus epidermidis
RPKKVMDTLELFKIAFPTDKSYQ

SEQ ID NO: 1818537 - protein, 19 aa, Staphylococcus epidermidis
RPLAISGNHLTLGFKENEY

SEQ ID NO: 1818538 - protein, 20 aa, Staphylococcus epidermidis
RPQDGFEVIKEFQITTEHLE

SEQ ID NO: 1818539 - protein, 19 aa, Staphylococcus epidermidis
RPQLRALLRASAYGKLNIM

SEQ ID NO: 1818540 - protein, 21 aa, Staphylococcus epidermidis
RQIAELCYFIWRDMELDITKE

SEQ ID NO: 1818541 - protein, 20 aa, Staphylococcus epidermidis
RQLITFKYLLPFRMPIKEIE

SEQ ID NO: 1818542 - protein, 24 aa, Staphylococcus epidermidis
RRDNEFWKSIAFGVSTGNRNQTLT

SEQ ID NO: 1818543 - protein, 17 aa, Staphylococcus epidermidis
RREAIKGKIDWQDTLPD

SEQ ID NO: 1818544 - protein, 18 aa, Staphylococcus epidermidis
RRGPLLASLKECYKVDFV

SEQ ID NO: 1818545 - protein, 19 aa, Staphylococcus epidermidis
RSGDTIVVWRLDRLGRNME

SEQ ID NO: 1818546 - protein, 17 aa, Staphylococcus epidermidis
RSLHIVVSIPVFLADSV

SEQ ID NO: 1818547 - protein, 19 aa, Staphylococcus epidermidis
RSLKFFKYFYTHRGPVMDY

SEQ ID NO: 1818548 - protein, 19 aa, Staphylococcus epidermidis
RSLKFFKYFYTHRGPVMNF

SEQ ID NO: 1818549 - protein, 20 aa, Staphylococcus epidermidis
RSTKGVSIADNWDMVGMRAT

SEQ ID NO: 1818550 - protein, 20 aa, Staphylococcus epidermidis
RSYRLLRVGSFLLSKDGYKI

SEQ ID NO: 1818551 - protein, 21 aa, Staphylococcus epidermidis
RTFYNSMAWRDKRSEVMQRDH

SEQ ID NO: 1818552 - protein, 18 aa, Staphylococcus epidermidis
RTHFYDFLLLNSDGLTDY

SEQ ID NO: 1818553 - protein, 21 aa, Staphylococcus epidermidis
RTIRIPVHMVETINKLIRVQR

SEQ ID NO: 1818554 - protein, 20 aa, Staphylococcus epidermidis
RTVMPGFEYEAPPSQNKLNP

SEQ ID NO: 1818555 - protein, 18 aa, Staphylococcus epidermidis
RTYNNLVNLEWIYKERPQ

SEQ ID NO: 1818556 - protein, 23 aa, Staphylococcus epidermidis
RVAIEMASPLGWHKYVGTEGKVI

SEQ ID NO: 1818557 - protein, 19 aa, Staphylococcus epidermidis
RVAPFPKHYLNAIQDYAHK

SEQ ID NO: 1818558 - protein, 40 aa, Staphylococcus epidermidis
RVKLYKSGKSWVKASINEIELLKTMGLPFLSKNEIQENVT

SEQ ID NO: 1818559 - protein, 19 aa, Staphylococcus epidermidis
RVLGGLSYRESHFALELLS

SEQ ID NO: 1818560 - protein, 25 aa, Staphylococcus epidermidis
RVQDAYSLRCIPQIHGASFQVFNYV

SEQ ID NO: 1818561 - protein, 20 aa, Staphylococcus epidermidis
RVVSMPNWFAFEQQSDEYKE

SEQ ID NO: 1818562 - protein, 20 aa, Staphylococcus epidermidis
RWLGYYGFNVSSEWMIPKIM

SEQ ID NO: 1818563 - protein, 18 aa, Staphylococcus epidermidis
RYGIPSVILGVGYENIHT

SEQ ID NO: 1818564 - protein, 19 aa, Staphylococcus epidermidis
RYLENQIRDAFGFEGTPIH

SEQ ID NO: 1818565 - protein, 18 aa, Staphylococcus epidermidis
RYLINLSYHLEKMRGLKK

SEQ ID NO: 1818566 - protein, 20 aa, Staphylococcus epidermidis
RYPFELSGGMAQRVAFIMSL

SEQ ID NO: 1818567 - protein, 24 aa, Staphylococcus epidermidis
RYRHFAGSYAIQWKMINYALEHGI

SEQ ID NO: 1818568 - protein, 21 aa, Staphylococcus epidermidis
SASRAYLRPALRRRNLDVETR

SEQ ID NO: 1818569 - protein, 24 aa, Staphylococcus epidermidis
SCGKCYYCKKGIYAHCENGGGWIL

SEQ ID NO: 1818570 - protein, 18 aa, Staphylococcus epidermidis
SDFTTGWIFFINQEGEHE

SEQ ID NO: 1818571 - protein, 23 aa, Staphylococcus epidermidis
SDLPGWHFKFIIIANMLLNGQSF

SEQ ID NO: 1818572 - protein, 19 aa, Staphylococcus epidermidis
SDRALGYGMHGIQVDGNDP

SEQ ID NO: 1818573 - protein, 22 aa, Staphylococcus epidermidis
SDRFPGFQLDYFKKTNYLDTDW

SEQ ID NO: 1818574 - protein, 22 aa, Staphylococcus epidermidis
SDYLLCKAFGKTATNIEKYTSQ

SEQ ID NO: 1818575 - protein, 19 aa, Staphylococcus epidermidis
SEELIKWQKYMESISDSIE

SEQ ID NO: 1818576 - protein, 17 aa, Staphylococcus epidermidis
SEFLRKRIVDLNEVNSM

SEQ ID NO: 1818577 - protein, 18 aa, Staphylococcus epidermidis
SEGYRPGDFESITVTVDA

SEQ ID NO: 1818578 - protein, 19 aa, Staphylococcus epidermidis
SEHLWRVEIELKRDMVDYW

SEQ ID NO: 1818579 - protein, 20 aa, Staphylococcus epidermidis
SEHYGLWSFKRVWGTYLSEK

SEQ ID NO: 1818580 - protein, 20 aa, Staphylococcus epidermidis
SEIIPRVNLTEVYRQQDGSS

SEQ ID NO: 1818581 - protein, 24 aa, Staphylococcus epidermidis
SELGSRMRLRIIPDLTFEYDESIE

SEQ ID NO: 1818582 - protein, 17 aa, Staphylococcus epidermidis
SELNSIVQLEETFSHEI

SEQ ID NO: 1818583 - protein, 17 aa, Staphylococcus epidermidis
SELRKGRQAYVICPLIE

SEQ ID NO: 1818584 - protein, 18 aa, Staphylococcus epidermidis
SEQFFKTLGFEINKNPDM

SEQ ID NO: 1818585 - protein, 23 aa, Staphylococcus epidermidis
SEQPEIYICGGTKFLHSIINSLK

SEQ ID NO: 1818586 - protein, 20 aa, Staphylococcus epidermidis
SETIFIYGYGASFVVATDLY

SEQ ID NO: 1818587 - protein, 23 aa, Staphylococcus epidermidis
SEVLESFYIIGIPTEYTRWFMQS

SEQ ID NO: 1818588 - protein, 27 aa, Staphylococcus epidermidis
SFANLRTFSRFTVLNTMAAPTTTSTTT

SEQ ID NO: 1818589 - protein, 17 aa, Staphylococcus epidermidis
SFEHLLFGLGIRHLGVK

SEQ ID NO: 1818590 - protein, 18 aa, Staphylococcus epidermidis
SFELMFVKWVPREQNKEA

SEQ ID NO: 1818591 - protein, 19 aa, Staphylococcus epidermidis
SFIEMCLLLPNLNEEQYGS

SEQ ID NO: 1818592 - protein, 19 aa, Staphylococcus epidermidis
SFLLKDAFDDLDWYAKILY

SEQ ID NO: 1818593 - protein, 22 aa, Staphylococcus epidermidis
SGDALKGLIFVSSREEAYQLAN

SEQ ID NO: 1818594 - protein, 22 aa, Staphylococcus epidermidis
SGGKRVRPVFVILSSQFGDSKD

SEQ ID NO: 1818595 - protein, 24 aa, Staphylococcus epidermidis
SGGMKRRLSLAISFLQNPNILILD

SEQ ID NO: 1818596 - protein, 21 aa, Staphylococcus epidermidis
SGLSFKKFVLFTGYEVDANEQ

SEQ ID NO: 1818597 - protein, 21 aa, Staphylococcus epidermidis
SGLSFKKFVLFTGYEVNVDTQ

SEQ ID NO: 1818598 - protein, 19 aa, Staphylococcus epidermidis
SGNVRRFIQRAGIDDTMEI

SEQ ID NO: 1818599 - protein, 20 aa, Staphylococcus epidermidis
SGPAALRCSQFVYKEQKNQK

SEQ ID NO: 1818600 - protein, 23 aa, Staphylococcus epidermidis
SGWTDIFIYPGFEYKAIDGLITN

SEQ ID NO: 1818601 - protein, 21 aa, Staphylococcus epidermidis
SGYRIGYGGGYYDKFLNQYKT

SEQ ID NO: 1818602 - protein, 19 aa, Staphylococcus epidermidis
SHGLALGRLRGVEFDVAIF

SEQ ID NO: 1818603 - protein, 20 aa, Staphylococcus epidermidis
SHGLSLGRLRGVEFDVAIFS

SEQ ID NO: 1818604 - protein, 23 aa, Staphylococcus epidermidis
SHSFKFHGVVAMQLFLNDEFKLP

SEQ ID NO: 1818605 - protein, 17 aa, Staphylococcus epidermidis
SIADNWDMVGMRATESH

SEQ ID NO: 1818606 - protein, 22 aa, Staphylococcus epidermidis
SIEIAIKMAYQYWKNIDAKRYA

SEQ ID NO: 1818607 - protein, 18 aa, Staphylococcus epidermidis
SIGLILGFLVQRFLEHKE

SEQ ID NO: 1818608 - protein, 25 aa, Staphylococcus epidermidis
SIIKRLSKASGHWGMVGGQALDMES

SEQ ID NO: 1818609 - protein, 19 aa, Staphylococcus epidermidis
SIKDGGLFKKGFNTQLDEY

SEQ ID NO: 1818610 - protein, 24 aa, Staphylococcus epidermidis
SIKNFRVTKIFGYFGLKREEIEEA

SEQ ID NO: 1818611 - protein, 20 aa, Staphylococcus epidermidis
SITCKALLGLNPERFRVSGD

SEQ ID NO: 1818612 - protein, 18 aa, Staphylococcus epidermidis
SIYNRLGFDFGTVGNHEF

SEQ ID NO: 1818613 - protein, 18 aa, Staphylococcus epidermidis
SKATLSFRTMDLIHKPYH

SEQ ID NO: 1818614 - protein, 18 aa, Staphylococcus epidermidis
SKECFKLSAILSKLRIEY

SEQ ID NO: 1818615 - protein, 24 aa, Staphylococcus epidermidis
SKEFDCFRLNILMSLAEMESNNIS

SEQ ID NO: 1818616 - protein, 18 aa, Staphylococcus epidermidis
SKGGFYFTDFRGYSTKPL

SEQ ID NO: 1818617 - protein, 18 aa, Staphylococcus epidermidis
SKGHLPYLIELGAIEISP

SEQ ID NO: 1818618 - protein, 17 aa, Staphylococcus epidermidis
SKHIGGFPVSGLFLRCK

SEQ ID NO: 1818619 - protein, 17 aa, Staphylococcus epidermidis
SKIAFIFQTMDIEHILK

SEQ ID NO: 1818620 - protein, 19 aa, Staphylococcus epidermidis
SKIKTVLHGLNFTENDFDK

SEQ ID NO: 1818621 - protein, 20 aa, Staphylococcus epidermidis
SKIKTVLHGLNFTENDFNKP

SEQ ID NO: 1818622 - protein, 23 aa, Staphylococcus epidermidis
SKKIPRLICNFSKRISDTDISIT

SEQ ID NO: 1818623 - protein, 26 aa, Staphylococcus epidermidis
SKKRFDILKLTAFGAIPKDMLDLGPK

SEQ ID NO: 1818624 - protein, 19 aa, Staphylococcus epidermidis
SKLCPVCNWRRAMKNSYQA

SEQ ID NO: 1818625 - protein, 21 aa, Staphylococcus epidermidis
SKTEYRGREATDFKEEDIELF

SEQ ID NO: 1818626 - protein, 17 aa, Staphylococcus epidermidis
SKVFRSRFRMLVEAQLD

SEQ ID NO: 1818627 - protein, 17 aa, Staphylococcus epidermidis
SLEHLLFGLGIRHLGVK

SEQ ID NO: 1818628 - protein, 19 aa, Staphylococcus epidermidis
SLFPSCRIAYIVLPEKVMN

SEQ ID NO: 1818629 - protein, 17 aa, Staphylococcus epidermidis
SLQIYGFSSCHEIRHMS

SEQ ID NO: 1818630 - protein, 17 aa, Staphylococcus epidermidis
SLSEIYKLLGVVDKDEV

SEQ ID NO: 1818631 - protein, 24 aa, Staphylococcus epidermidis
SLVSRLIFDFSFYYSKLKHENMSE

SEQ ID NO: 1818632 - protein, 20 aa, Staphylococcus epidermidis
SMGGRVALYYAIHGNETLSG

SEQ ID NO: 1818633 - protein, 21 aa, Staphylococcus epidermidis
SNCKALRAVYPAGVPIGHPAY

SEQ ID NO: 1818634 - protein, 19 aa, Staphylococcus epidermidis
SNELEWLNQLFVAGGLADL

SEQ ID NO: 1818635 - protein, 17 aa, Staphylococcus epidermidis
SNIISVFHFLKSSINTI

SEQ ID NO: 1818636 - protein, 26 aa, Staphylococcus epidermidis
SNIPKGRGFVKWLAFKTIPEQYQQIE

SEQ ID NO: 1818637 - protein, 21 aa, Staphylococcus epidermidis
SNITDAIKWVLGEQSAKSLRG

SEQ ID NO: 1818638 - protein, 20 aa, Staphylococcus epidermidis
SNLIRLIFDEGFIAIRPSGT

SEQ ID NO: 1818639 - protein, 19 aa, Staphylococcus epidermidis
SNSTGECWAISAHKNGPNV

SEQ ID NO: 1818640 - protein, 26 aa, Staphylococcus epidermidis
SNVPKGRGFVKWLAFKTIPEQYQQIE

SEQ ID NO: 1818641 - protein, 22 aa, Staphylococcus epidermidis
SPERLKAGLLYILEEECIKQGH

SEQ ID NO: 1818642 - protein, 20 aa, Staphylococcus epidermidis
SPFHWRLLDKLALNTLNEVV

SEQ ID NO: 1818643 - protein, 18 aa, Staphylococcus epidermidis
SPGLRIGWIVADKNVINH

SEQ ID NO: 1818644 - protein, 23 aa, Staphylococcus epidermidis
SPNEIARLITLEWLDHKQTFKPK

SEQ ID NO: 1818645 - protein, 17 aa, Staphylococcus epidermidis
SPTHFVKSWLLDARAPK

SEQ ID NO: 1818646 - protein, 20 aa, Staphylococcus epidermidis
SQIKRLKFDYLYIDNAQLTS

SEQ ID NO: 1818647 - protein, 18 aa, Staphylococcus epidermidis
SQIMNWLPYVKTLAERNK

SEQ ID NO: 1818648 - protein, 24 aa, Staphylococcus epidermidis
SQSEWLKRAEIFIDGFHNFSTLEY

SEQ ID NO: 1818649 - protein, 21 aa, Staphylococcus epidermidis
SQTLFKRWFVDFEFPDENGNP

SEQ ID NO: 1818650 - protein, 18 aa, Staphylococcus epidermidis
SQYYVYAFIKLFKEKYNN

SEQ ID NO: 1818651 - protein, 18 aa, Staphylococcus epidermidis
SRFKNCNFNEGIFKNIKA

SEQ ID NO: 1818652 - protein, 17 aa, Staphylococcus epidermidis
SRFLPGRHYALFNLQGE

SEQ ID NO: 1818653 - protein, 23 aa, Staphylococcus epidermidis
SRFRIVPLLIFRAMHYIGDIPEI

SEQ ID NO: 1818654 - protein, 18 aa, Staphylococcus epidermidis
SRIGEPFVGYSDIFSFNN

SEQ ID NO: 1818655 - protein, 19 aa, Staphylococcus epidermidis
SRIYAKFGKEIYVAAKSGE

SEQ ID NO: 1818656 - protein, 20 aa, Staphylococcus epidermidis
SRLKALYLSVIDRINIRKDG

SEQ ID NO: 1818657 - protein, 19 aa, Staphylococcus epidermidis
SRPAPYFKYDAHDDNFIRL

SEQ ID NO: 1818658 - protein, 21 aa, Staphylococcus epidermidis
SRRFLDRVWRLIVTEDGTLNN

SEQ ID NO: 1818659 - protein, 24 aa, Staphylococcus epidermidis
SSCGKCYYCKKGIYAHCENDGGWI

SEQ ID NO: 1818660 - protein, 20 aa, Staphylococcus epidermidis
SSDVPLHLYLSVLGMPGQTA

SEQ ID NO: 1818661 - protein, 23 aa, Staphylococcus epidermidis
SSDYLLCKAFGKTATNIEKYTSQ

SEQ ID NO: 1818662 - protein, 21 aa, Staphylococcus epidermidis
SSGIIKKLFLLGIMANINQSL

SEQ ID NO: 1818663 - protein, 17 aa, Staphylococcus epidermidis
SSPILRNHLDDIIMNTK

SEQ ID NO: 1818664 - protein, 24 aa, Staphylococcus epidermidis
SSPRLLCIAGGFTRYDEHAVKQIN

SEQ ID NO: 1818665 - protein, 28 aa, Staphylococcus epidermidis
STINRKMCALKEFIKYLSSYGYDIDINI

SEQ ID NO: 1818666 - protein, 18 aa, Staphylococcus epidermidis
STRLESSLFFPPYKGKFK

SEQ ID NO: 1818667 - protein, 18 aa, Staphylococcus epidermidis
STRLESSVYFPPYKGKFK

SEQ ID NO: 1818668 - protein, 23 aa, Staphylococcus epidermidis
STVSELLTAYGFRIVDADIASRE

SEQ ID NO: 1818669 - protein, 20 aa, Staphylococcus epidermidis
STWIKHLIGLVNLKKAQFTI

SEQ ID NO: 1818670 - protein, 20 aa, Staphylococcus epidermidis
SVHVPRRIKEIGPRIKKVSD

SEQ ID NO: 1818671 - protein, 21 aa, Staphylococcus epidermidis
SVIRYKGKYIPKVAINHPIFV

SEQ ID NO: 1818672 - protein, 18 aa, Staphylococcus epidermidis
SVNSEWMIPKILEMKHEA

SEQ ID NO: 1818673 - protein, 23 aa, Staphylococcus epidermidis
SYDPRLFEGFSMGNPKIQTGNLL

SEQ ID NO: 1818674 - protein, 19 aa, Staphylococcus epidermidis
SYPELKLGIITPFLGHTNR

SEQ ID NO: 1818675 - protein, 23 aa, Staphylococcus epidermidis
SYQKLRSGMTMKEIAERQNVKIN

SEQ ID NO: 1818676 - protein, 18 aa, Staphylococcus epidermidis
SYRAILIYFDKSGINGTE

SEQ ID NO: 1818677 - protein, 17 aa, Staphylococcus epidermidis
SYRAILIYFDNTKIKGN

SEQ ID NO: 1818678 - protein, 18 aa, Staphylococcus epidermidis
SYSYLIFVQETWSMLHEN

SEQ ID NO: 1818679 - protein, 18 aa, Staphylococcus epidermidis
SYVLPILGIHNMKNAAIA

SEQ ID NO: 1818680 - protein, 26 aa, Staphylococcus epidermidis
TAKFEGLIHRFRRSFLLNDNFEKKRF

SEQ ID NO: 1818681 - protein, 22 aa, Staphylococcus epidermidis
TALDEWLFLRFDSVNTHIHKEY

SEQ ID NO: 1818682 - protein, 24 aa, Staphylococcus epidermidis
TALGFAGGFPGEFISKTLEDSQIQ

SEQ ID NO: 1818683 - protein, 26 aa, Staphylococcus epidermidis
TAMNRKGYFLYGYRHFSSRIKGGHTN

SEQ ID NO: 1818684 - protein, 23 aa, Staphylococcus epidermidis
TANAESKERCQLLIKPIRDEILN

SEQ ID NO: 1818685 - protein, 24 aa, Staphylococcus epidermidis
TARKFGIEVFNVFLSQEPITEDIE

SEQ ID NO: 1818686 - protein, 18 aa, Staphylococcus epidermidis
TCEFEFKKDYPALYNDPD

SEQ ID NO: 1818687 - protein, 20 aa, Staphylococcus epidermidis
TCEGILWNKWDDAVEILQSK

SEQ ID NO: 1818688 - protein, 25 aa, Staphylococcus epidermidis
TCGSGSLLLRVGREADVRFYYGQEY

SEQ ID NO: 1818689 - protein, 22 aa, Staphylococcus epidermidis
TCGSGSLLLRVGREAKVRNYYG

SEQ ID NO: 1818690 - protein, 21 aa, Staphylococcus epidermidis
TCGSGSLLLRVGRESKVRNYY

SEQ ID NO: 1818691 - protein, 25 aa, Staphylococcus epidermidis
TCYQFKVPFIVTRAVSDLANGEAEI

SEQ ID NO: 1818692 - protein, 22 aa, Staphylococcus epidermidis
TDIEIVELLAFISFTHCQQEFG

SEQ ID NO: 1818693 - protein, 28 aa, Staphylococcus epidermidis
TDIEYRFPFGWGELWGIASRTDFDLQKH

SEQ ID NO: 1818694 - protein, 17 aa, Staphylococcus epidermidis
TDIHAVATLAKEHKLLL

SEQ ID NO: 1818695 - protein, 19 aa, Staphylococcus epidermidis
TDIPFCIYNKTAVCTGRGE

SEQ ID NO: 1818696 - protein, 21 aa, Staphylococcus epidermidis
TDIYNRLGFSFGTIGNHEFNY

SEQ ID NO: 1818697 - protein, 23 aa, Staphylococcus epidermidis
TDLEIVELLAFVSFTHCQQEFGA

SEQ ID NO: 1818698 - protein, 25 aa, Staphylococcus epidermidis
TDLRLITLYIMEAFKVLGREEMLED

SEQ ID NO: 1818699 - protein, 21 aa, Staphylococcus epidermidis
TDSEGWAHCLTIPRELTIENG

SEQ ID NO: 1818700 - protein, 22 aa, Staphylococcus epidermidis
TDVLVCTVIGFPLGATTTNAKI

SEQ ID NO: 1818701 - protein, 17 aa, Staphylococcus epidermidis
TECWYILDAEPGAEIIY

SEQ ID NO: 1818702 - protein, 22 aa, Staphylococcus epidermidis
TEEYPGVFAFIGSDSKFDLHHP

SEQ ID NO: 1818703 - protein, 20 aa, Staphylococcus epidermidis
TEIDILFSLCNKLKEQDIKE

SEQ ID NO: 1818704 - protein, 20 aa, Staphylococcus epidermidis
TEIIPSYRAILIYFDNTKIK

SEQ ID NO: 1818705 - protein, 18 aa, Staphylococcus epidermidis
TEILWKMHFGLYPTPIKR

SEQ ID NO: 1818706 - protein, 19 aa, Staphylococcus epidermidis
TEINSMFGLESGHINISMS

SEQ ID NO: 1818707 - protein, 23 aa, Staphylococcus epidermidis
TEIYICGGTHFLKSIIEALKELN

SEQ ID NO: 1818708 - protein, 22 aa, Staphylococcus epidermidis
TEMIKFKYPRLFENIHKALHMV

SEQ ID NO: 1818709 - protein, 17 aa, Staphylococcus epidermidis
TEPSYRDNVNWGDINQP

SEQ ID NO: 1818710 - protein, 18 aa, Staphylococcus epidermidis
TESFRRLFKYKKVSKNLI

SEQ ID NO: 1818711 - protein, 18 aa, Staphylococcus epidermidis
TEVLNFLNSYKFSTSQVA

SEQ ID NO: 1818712 - protein, 18 aa, Staphylococcus epidermidis
TEVVKDFKDGIVTEAEKT

SEQ ID NO: 1818713 - protein, 20 aa, Staphylococcus epidermidis
TFCVLNHLFVNEGHEEMFED

SEQ ID NO: 1818714 - protein, 19 aa, Staphylococcus epidermidis
TFMPHLDYDISFMIQEYIE

SEQ ID NO: 1818715 - protein, 19 aa, Staphylococcus epidermidis
TFRFLKGHYFFTIKDKNAN

SEQ ID NO: 1818716 - protein, 24 aa, Staphylococcus epidermidis
TFRVPAEQAIPIWTNKERDELQAF

SEQ ID NO: 1818717 - protein, 19 aa, Staphylococcus epidermidis
TGIGFALSIERLLLALEEE

SEQ ID NO: 1818718 - protein, 18 aa, Staphylococcus epidermidis
TGIKEMIEHFGIKQEETL

SEQ ID NO: 1818719 - protein, 17 aa, Staphylococcus epidermidis
TGRPRTETIIPFESLGL

SEQ ID NO: 1818720 - protein, 24 aa, Staphylococcus epidermidis
TGSVVLPGRFFVDIIKKLPGKEVK

SEQ ID NO: 1818721 - protein, 17 aa, Staphylococcus epidermidis
TGYRPVMEIQFLGFVFE

SEQ ID NO: 1818722 - protein, 19 aa, Staphylococcus epidermidis
THELGIPVMILFEGVPASG

SEQ ID NO: 1818723 - protein, 20 aa, Staphylococcus epidermidis
TICNCPKCSNGRIKKLLSKN

SEQ ID NO: 1818724 - protein, 17 aa, Staphylococcus epidermidis
TIFIYGYGASFVVATDL

SEQ ID NO: 1818725 - protein, 22 aa, Staphylococcus epidermidis
TIIYLRKPWRIESLLKKIDDLF

SEQ ID NO: 1818726 - protein, 22 aa, Staphylococcus epidermidis
TIIYLRKPWRIESLLKKINDLF

SEQ ID NO: 1818727 - protein, 17 aa, Staphylococcus epidermidis
TKDELKEIVTMMVNKLT

SEQ ID NO: 1818728 - protein, 18 aa, Staphylococcus epidermidis
TKGMYEFDQFRLAIDHVQ

SEQ ID NO: 1818729 - protein, 21 aa, Staphylococcus epidermidis
TKKGLNWLFNHACERIPELKH

SEQ ID NO: 1818730 - protein, 18 aa, Staphylococcus epidermidis
TKRLGFKKGHKFEEPLVE

SEQ ID NO: 1818731 - protein, 17 aa, Staphylococcus epidermidis
TKSGYAYTFTKSGTSYS

SEQ ID NO: 1818732 - protein, 18 aa, Staphylococcus epidermidis
TKVFTRFGVEVDFVDTTH

SEQ ID NO: 1818733 - protein, 20 aa, Staphylococcus epidermidis
TLDHIKHFIAIYTQILVTPL

SEQ ID NO: 1818734 - protein, 17 aa, Staphylococcus epidermidis
TLLTIGRFPICYINIQM

SEQ ID NO: 1818735 - protein, 22 aa, Staphylococcus epidermidis
TLMCAKLWPEFEIYKSFVKETL

SEQ ID NO: 1818736 - protein, 20 aa, Staphylococcus epidermidis
TLPYLKWRINETLNTQKYVM

SEQ ID NO: 1818737 - protein, 19 aa, Staphylococcus epidermidis
TLRLAELFRASTIPAGLFQ

SEQ ID NO: 1818738 - protein, 19 aa, Staphylococcus epidermidis
TLSDISMKVYSEFNINQDE

SEQ ID NO: 1818739 - protein, 24 aa, Staphylococcus epidermidis
TNHYWKYVEKYGVLGIALDNPLHV

SEQ ID NO: 1818740 - protein, 18 aa, Staphylococcus epidermidis
TNIGISFPVEAPKEYLAF

SEQ ID NO: 1818741 - protein, 17 aa, Staphylococcus epidermidis
TNTFPSWKRAHPNRMLM

SEQ ID NO: 1818742 - protein, 19 aa, Staphylococcus epidermidis
TPLIYCEKLSKKLDIELYV

SEQ ID NO: 1818743 - protein, 18 aa, Staphylococcus epidermidis
TPWNFPAAMITRKMAPAL

SEQ ID NO: 1818744 - protein, 25 aa, Staphylococcus epidermidis
TRERRGENGFGYDPVFFVPDKDRTM

SEQ ID NO: 1818745 - protein, 17 aa, Staphylococcus epidermidis
TRKELKSLLSVESGGIV

SEQ ID NO: 1818746 - protein, 22 aa, Staphylococcus epidermidis
TRLDSNRSFRFTGKVNLGNRYE

SEQ ID NO: 1818747 - protein, 20 aa, Staphylococcus epidermidis
TRLKGGDPFVFGRGGEEAEE

SEQ ID NO: 1818748 - protein, 19 aa, Staphylococcus epidermidis
TRVELGIALGKGERVNIGV

SEQ ID NO: 1818749 - protein, 23 aa, Staphylococcus epidermidis
TSDMKGGLAALVISLIELKEEDA

SEQ ID NO: 1818750 - protein, 23 aa, Staphylococcus epidermidis
TSEPRIKMGILESTSQWIAKVTQ

SEQ ID NO: 1818751 - protein, 18 aa, Staphylococcus epidermidis
TSGSMRWNLNANSLDYFD

SEQ ID NO: 1818752 - protein, 26 aa, Staphylococcus epidermidis
TSIPLWKNQMAIALTLMRQRNAVSAQ

SEQ ID NO: 1818753 - protein, 19 aa, Staphylococcus epidermidis
TSLYRPGPMEEISTYITRR

SEQ ID NO: 1818754 - protein, 17 aa, Staphylococcus epidermidis
TSQFYPTQFIKFEEATI

SEQ ID NO: 1818755 - protein, 22 aa, Staphylococcus epidermidis
TSTIIPMCHPLPLTGIDVQFEW

SEQ ID NO: 1818756 - protein, 32 aa, Staphylococcus epidermidis
TSTIIPMCHPLPLTGIDVSFKWGSNNDDSYRL

SEQ ID NO: 1818757 - protein, 20 aa, Staphylococcus epidermidis
TTKALSIRVFYCLKGNCKMT

SEQ ID NO: 1818758 - protein, 19 aa, Staphylococcus epidermidis
TTSEAIKWQAQHSKATAWS

SEQ ID NO: 1818759 - protein, 17 aa, Staphylococcus epidermidis
TVCLRFFNVYGPKQNPN

SEQ ID NO: 1818760 - protein, 17 aa, Staphylococcus epidermidis
TVGFLLAKLSWHERHHL

SEQ ID NO: 1818761 - protein, 24 aa, Staphylococcus epidermidis
TVHGFKYKILYAMEKLAMFCATDV

SEQ ID NO: 1818762 - protein, 19 aa, Staphylococcus epidermidis
TVRLAELFRASTIPAGLIQ

SEQ ID NO: 1818763 - protein, 19 aa, Staphylococcus epidermidis
TVTGLPQGLKFDASTNSIV

SEQ ID NO: 1818764 - protein, 24 aa, Staphylococcus epidermidis
TYDLEWLPQLFVMGGLADLELGPF

SEQ ID NO: 1818765 - protein, 20 aa, Staphylococcus epidermidis
TYRKLTCVHVNHGLRHQSVE

SEQ ID NO: 1818766 - protein, 25 aa, Staphylococcus epidermidis
TYTMPCARTLVPVEVPLDVTTSEVF

SEQ ID NO: 1818767 - protein, 23 aa, Staphylococcus epidermidis
VAEACLKLGASIINDQWAGLYDP

SEQ ID NO: 1818768 - protein, 22 aa, Staphylococcus epidermidis
VAEACLKLGVSMINDQWAGLFD

SEQ ID NO: 1818769 - protein, 18 aa, Staphylococcus epidermidis
VAEVDIMYGQGISKEGEL

SEQ ID NO: 1818770 - protein, 23 aa, Staphylococcus epidermidis
VAFPHINKGLFIPFLDQHSIANY

SEQ ID NO: 1818771 - protein, 21 aa, Staphylococcus epidermidis
VAGDIYRPAAIDQLQTVGKQI

SEQ ID NO: 1818772 - protein, 19 aa, Staphylococcus epidermidis
VALEQEYAWAFLNELFYLI

SEQ ID NO: 1818773 - protein, 17 aa, Staphylococcus epidermidis
VALYYAIHGNETLSGLL

SEQ ID NO: 1818774 - protein, 17 aa, Staphylococcus epidermidis
VAMAFGFFDGMHRGHDK

SEQ ID NO: 1818775 - protein, 18 aa, Staphylococcus epidermidis
VAMGYGFSTTSYFIQVFK

SEQ ID NO: 1818776 - protein, 19 aa, Staphylococcus epidermidis
VATIKEFRDAKAILLEEKK

SEQ ID NO: 1818777 - protein, 20 aa, Staphylococcus epidermidis
VAVNFAKLILCDENHQCELK

SEQ ID NO: 1818778 - protein, 25 aa, Staphylococcus epidermidis
VAWNFPTLLASWKLGPALAAGNTVV

SEQ ID NO: 1818779 - protein, 17 aa, Staphylococcus epidermidis
VCGIPYYIGGNVSDIDE

SEQ ID NO: 1818780 - protein, 24 aa, Staphylococcus epidermidis
VDIKEVFLKLPIIGTEVYDESNEI

SEQ ID NO: 1818781 - protein, 17 aa, Staphylococcus epidermidis
VDLSLNVRRVFFSTFDR

SEQ ID NO: 1818782 - protein, 18 aa, Staphylococcus epidermidis
VDQLKFFINERIIPVIPQ

SEQ ID NO: 1818783 - protein, 21 aa, Staphylococcus epidermidis
VEIAIKMAYQYWKNIDAKQYA

SEQ ID NO: 1818784 - protein, 17 aa, Staphylococcus epidermidis
VEITSHFYKRMFKQHPE

SEQ ID NO: 1818785 - protein, 18 aa, Staphylococcus epidermidis
VELRNRFVLAPLTHISSN

SEQ ID NO: 1818786 - protein, 17 aa, Staphylococcus epidermidis
VEMRRFILASNHDERVE

SEQ ID NO: 1818787 - protein, 23 aa, Staphylococcus epidermidis
VETTLKAARRWAYDVKGIEPNKA

SEQ ID NO: 1818788 - protein, 19 aa, Staphylococcus epidermidis
VEVAFRLGIDTRKNDQQIR

SEQ ID NO: 1818789 - protein, 19 aa, Staphylococcus epidermidis
VEVARLPKDVKVEIELIGK

SEQ ID NO: 1818790 - protein, 19 aa, Staphylococcus epidermidis
VFISWTGKMAETFVLAHEL

SEQ ID NO: 1818791 - protein, 21 aa, Staphylococcus epidermidis
VFKPKSLFVLYDILSNNSVYL

SEQ ID NO: 1818792 - protein, 19 aa, Staphylococcus epidermidis
VFLDLGIKVKFYNVVGNHS

SEQ ID NO: 1818793 - protein, 17 aa, Staphylococcus epidermidis
VGIAISDLMGWTAQGLD

SEQ ID NO: 1818794 - protein, 18 aa, Staphylococcus epidermidis
VGLKLRDGGWVYVQGLTH

SEQ ID NO: 1818795 - protein, 19 aa, Staphylococcus epidermidis
VGPGPRKALDYMYQIAERD

SEQ ID NO: 1818796 - protein, 19 aa, Staphylococcus epidermidis
VGVLLPFKSQCFVRHYSKG

SEQ ID NO: 1818797 - protein, 17 aa, Staphylococcus epidermidis
VHLSRFAEEIIFWSTDE

SEQ ID NO: 1818798 - protein, 19 aa, Staphylococcus epidermidis
VHTYKMKFIKSFKAVNLHQ

SEQ ID NO: 1818799 - protein, 17 aa, Staphylococcus epidermidis
VIDYCLWISDNQFRIRG

SEQ ID NO: 1818800 - protein, 17 aa, Staphylococcus epidermidis
VIGSWRLEDCTLYVTLE

SEQ ID NO: 1818801 - protein, 17 aa, Staphylococcus epidermidis
VILSQLFRGFCKNIENE

SEQ ID NO: 1818802 - protein, 25 aa, Staphylococcus epidermidis
VIPCSRPNLTPGFFMFVHTNNGLHM

SEQ ID NO: 1818803 - protein, 21 aa, Staphylococcus epidermidis
VISLRANHYFNPRKTYNKQGE

SEQ ID NO: 1818804 - protein, 20 aa, Staphylococcus epidermidis
VKCPKCGAAMEASNTTNTLK

SEQ ID NO: 1818805 - protein, 24 aa, Staphylococcus epidermidis
VKDMYRRVNFLFGDIVKVTPSSKV

SEQ ID NO: 1818806 - protein, 25 aa, Staphylococcus epidermidis
VKDNKIEMVLSWKLNRISRSMRDVF

SEQ ID NO: 1818807 - protein, 17 aa, Staphylococcus epidermidis
VKEIICERLGIDSKLIS

SEQ ID NO: 1818808 - protein, 22 aa, Staphylococcus epidermidis
VKFRLDEFGNLPAIKDFEQILT

SEQ ID NO: 1818809 - protein, 17 aa, Staphylococcus epidermidis
VKFTHEFMFARPVNRTP

SEQ ID NO: 1818810 - protein, 18 aa, Staphylococcus epidermidis
VKGLLILADLEFSHIAPF

SEQ ID NO: 1818811 - protein, 17 aa, Staphylococcus epidermidis
VKGYFIYPYQEVMKDSN

SEQ ID NO: 1818812 - protein, 19 aa, Staphylococcus epidermidis
VKIYDVFTILYLLSPQAFN

SEQ ID NO: 1818813 - protein, 23 aa, Staphylococcus epidermidis
VKLAEALHSIFLEVIIAPQFTEE

SEQ ID NO: 1818814 - protein, 20 aa, Staphylococcus epidermidis
VKQRIATHVLPDFEEVTTSL

SEQ ID NO: 1818815 - protein, 18 aa, Staphylococcus epidermidis
VKRTCGYLGNPVQRPVIE

SEQ ID NO: 1818816 - protein, 17 aa, Staphylococcus epidermidis
VKSGPWLKDVLRQIELA

SEQ ID NO: 1818817 - protein, 17 aa, Staphylococcus epidermidis
VKYESVFNFDEMIENAV

SEQ ID NO: 1818818 - protein, 20 aa, Staphylococcus epidermidis
VLCGRATWSGAVKVYIEEGE

SEQ ID NO: 1818819 - protein, 18 aa, Staphylococcus epidermidis
VLFLEGLYKRIGFKDSNI

SEQ ID NO: 1818820 - protein, 18 aa, Staphylococcus epidermidis
VLKEMFISMIYKNVSSIY

SEQ ID NO: 1818821 - protein, 19 aa, Staphylococcus epidermidis
VLNTFTFRITRNADLTIHE

SEQ ID NO: 1818822 - protein, 17 aa, Staphylococcus epidermidis
VLQEALNFVRMGDRFIV

SEQ ID NO: 1818823 - protein, 20 aa, Staphylococcus epidermidis
VLRFKRRFGDDVAVLHSGLS

SEQ ID NO: 1818824 - protein, 19 aa, Staphylococcus epidermidis
VNGVLPICLGHATRISDYV

SEQ ID NO: 1818825 - protein, 17 aa, Staphylococcus epidermidis
VNYLIKVLENWSKDGVD

SEQ ID NO: 1818826 - protein, 17 aa, Staphylococcus epidermidis
VPALLGAYILEGSKAGA

SEQ ID NO: 1818827 - protein, 18 aa, Staphylococcus epidermidis
VPEARLLVISPYDKTSVA

SEQ ID NO: 1818828 - protein, 18 aa, Staphylococcus epidermidis
VPEARLLVISPYDKTSVD

SEQ ID NO: 1818829 - protein, 18 aa, Staphylococcus epidermidis
VPELKIGFEYNGVQHYKP

SEQ ID NO: 1818830 - protein, 23 aa, Staphylococcus epidermidis
VPVCGFPWIHWVVANVSVNSDTI

SEQ ID NO: 1818831 - protein, 24 aa, Staphylococcus epidermidis
VQEGLRVYWYYDLIDNEIKIVCID

SEQ ID NO: 1818832 - protein, 25 aa, Staphylococcus epidermidis
VQFKELKFYLAFKRIKNFACVEILP

SEQ ID NO: 1818833 - protein, 18 aa, Staphylococcus epidermidis
VREIKGLITTKFLQAQEK

SEQ ID NO: 1818834 - protein, 25 aa, Staphylococcus epidermidis
VRMEKRYKGPIAFEYTHINNSKERV

SEQ ID NO: 1818835 - protein, 23 aa, Staphylococcus epidermidis
VRSNCGIGFKGFWDNDAGFNYEF

SEQ ID NO: 1818836 - protein, 19 aa, Staphylococcus epidermidis
VRVGMEMDRSELLRKLVDV

SEQ ID NO: 1818837 - protein, 18 aa, Staphylococcus epidermidis
VRVGMEMERSELLRKLVD

SEQ ID NO: 1818838 - protein, 23 aa, Staphylococcus epidermidis
VRYPEFANGLILTGTGMFPKWKG

SEQ ID NO: 1818839 - protein, 25 aa, Staphylococcus epidermidis
VSELIQFIFRGCIRNGKVLNCYIPS

SEQ ID NO: 1818840 - protein, 22 aa, Staphylococcus epidermidis
VTYPDKRIEFIIKDAEVAAVLT

SEQ ID NO: 1818841 - protein, 18 aa, Staphylococcus epidermidis
VVGSWRLEECTLYVTLEP

SEQ ID NO: 1818842 - protein, 17 aa, Staphylococcus epidermidis
VVKNSMEGFVFEYGLIQ

SEQ ID NO: 1818843 - protein, 18 aa, Staphylococcus epidermidis
VVMDLLFEKLDCHLAMPQ

SEQ ID NO: 1818844 - protein, 19 aa, Staphylococcus epidermidis
VYEMRWDIGYVLQQIALFP

SEQ ID NO: 1818845 - protein, 18 aa, Staphylococcus epidermidis
VYEYTSIFEKMRFKGSSY

SEQ ID NO: 1818846 - protein, 20 aa, Staphylococcus epidermidis
VYFDLYYKAAFMVDLYEYNN

SEQ ID NO: 1818847 - protein, 22 aa, Staphylococcus epidermidis
VYHRRLRFTLAHEYGHYIMEHD

SEQ ID NO: 1818848 - protein, 20 aa, Staphylococcus epidermidis
WAHRVYPELDVESAYIKFID

SEQ ID NO: 1818849 - protein, 19 aa, Staphylococcus epidermidis
WDFDGVYGAQCFDLANQYW

SEQ ID NO: 1818850 - protein, 18 aa, Staphylococcus epidermidis
WDLPNYIFNRYWRFRTTG

SEQ ID NO: 1818851 - protein, 17 aa, Staphylococcus epidermidis
WDSSFSLTDEWIKEYKQ

SEQ ID NO: 1818852 - protein, 17 aa, Staphylococcus epidermidis
WERMLEIDEYLSGISTV

SEQ ID NO: 1818853 - protein, 18 aa, Staphylococcus epidermidis
WFAVLRIAKQMFIPIGSV

SEQ ID NO: 1818854 - protein, 24 aa, Staphylococcus epidermidis
WFLNPDHLPLILGMEKGWFSEQNL

SEQ ID NO: 1818855 - protein, 18 aa, Staphylococcus epidermidis
WFYKMMPSMNQWLEDINV

SEQ ID NO: 1818856 - protein, 19 aa, Staphylococcus epidermidis
WGGATFDVAYNFLKENPWE

SEQ ID NO: 1818857 - protein, 19 aa, Staphylococcus epidermidis
WIVPHCGALLPVIAQRVAM

SEQ ID NO: 1818858 - protein, 18 aa, Staphylococcus epidermidis
WKDKSSIIMSAFIEQSQY

SEQ ID NO: 1818859 - protein, 18 aa, Staphylococcus epidermidis
WKIPIIFVTHSNYEAQQM

SEQ ID NO: 1818860 - protein, 18 aa, Staphylococcus epidermidis
WKPLLGDILLQFLSNQIN

SEQ ID NO: 1818861 - protein, 17 aa, Staphylococcus epidermidis
WLLHIPSCYLGIAQAAR

SEQ ID NO: 1818862 - protein, 18 aa, Staphylococcus epidermidis
WLMHTGLNLNGSVFNKDV

SEQ ID NO: 1818863 - protein, 17 aa, Staphylococcus epidermidis
WLQEKVYNWDEFKKNIL

SEQ ID NO: 1818864 - protein, 17 aa, Staphylococcus epidermidis
WLRKVINSLVYDYAYPI

SEQ ID NO: 1818865 - protein, 19 aa, Staphylococcus epidermidis
WMKSHWAYDSMRSFTRQML

SEQ ID NO: 1818866 - protein, 34 aa, Staphylococcus epidermidis
WMSLVLRPDVPFSMIPKFNLFIALGIRDAIQQFS

SEQ ID NO: 1818867 - protein, 25 aa, Staphylococcus epidermidis
WMSLVLRPNVPFALIPKFNLFIALG

SEQ ID NO: 1818868 - protein, 18 aa, Staphylococcus epidermidis
WNIIGLIGQVFIRVDETV

SEQ ID NO: 1818869 - protein, 20 aa, Staphylococcus epidermidis
WNRKAFRGIELYGKTLGVIG

SEQ ID NO: 1818870 - protein, 19 aa, Staphylococcus epidermidis
WNRKAFRGVELYGKTLGII

SEQ ID NO: 1818871 - protein, 19 aa, Staphylococcus epidermidis
WPHLSCQWLQQWYHLLFEK

SEQ ID NO: 1818872 - protein, 18 aa, Staphylococcus epidermidis
WPHLSSIRIPTLIIVGEK

SEQ ID NO: 1818873 - protein, 20 aa, Staphylococcus epidermidis
WPIGMGQNFFGIIDRESKTI

SEQ ID NO: 1818874 - protein, 17 aa, Staphylococcus epidermidis
WPIQPLRDFWGINRRTE

SEQ ID NO: 1818875 - protein, 22 aa, Staphylococcus epidermidis
WPNSRLDHWLSLLKARAIENDI

SEQ ID NO: 1818876 - protein, 22 aa, Staphylococcus epidermidis
WPSARLNHWLSLLKARAIENDM

SEQ ID NO: 1818877 - protein, 17 aa, Staphylococcus epidermidis
WPSFSKALNDDEIVELV

SEQ ID NO: 1818878 - protein, 17 aa, Staphylococcus epidermidis
WRNECGYTIKPVSETND

SEQ ID NO: 1818879 - protein, 20 aa, Staphylococcus epidermidis
WSGASLFMSCLYRATNNEKW

SEQ ID NO: 1818880 - protein, 17 aa, Staphylococcus epidermidis
WSINMGADIVLNHRKDL

SEQ ID NO: 1818881 - protein, 19 aa, Staphylococcus epidermidis
WSTKFLIKVEDNFKPYVEI

SEQ ID NO: 1818882 - protein, 19 aa, Staphylococcus epidermidis
WSTPFLMRVEENFRPYMNI

SEQ ID NO: 1818883 - protein, 17 aa, Staphylococcus epidermidis
YAELSSMDSHIYEVLTS

SEQ ID NO: 1818884 - protein, 17 aa, Staphylococcus epidermidis
YAFIKRLIKQFGKPQKV

SEQ ID NO: 1818885 - protein, 24 aa, Staphylococcus epidermidis
YAIKKEIIEELGFDFSHSHNPYNE

SEQ ID NO: 1818886 - protein, 20 aa, Staphylococcus epidermidis
YAKELNLKSKEIIDELKSMN

SEQ ID NO: 1818887 - protein, 21 aa, Staphylococcus epidermidis
YARASAVALGLKGDTCIAGGG

SEQ ID NO: 1818888 - protein, 25 aa, Staphylococcus epidermidis
YASDWSEIRPEWGLAKNAEFIIGKR

SEQ ID NO: 1818889 - protein, 19 aa, Staphylococcus epidermidis
YCFDEPFVGIDIYSEQLIM

SEQ ID NO: 1818890 - protein, 17 aa, Staphylococcus epidermidis
YCIILGYFVDGAPQLSY

SEQ ID NO: 1818891 - protein, 20 aa, Staphylococcus epidermidis
YCLFYPRWANQKNNNMTHLI

SEQ ID NO: 1818892 - protein, 18 aa, Staphylococcus epidermidis
YDIAGLRMMCQFVDDIDV

SEQ ID NO: 1818893 - protein, 17 aa, Staphylococcus epidermidis
YDILSWVQDPVFKNNPG

SEQ ID NO: 1818894 - protein, 22 aa, Staphylococcus epidermidis
YDIYRLLKYLYYFDNVKDYQEF

SEQ ID NO: 1818895 - protein, 18 aa, Staphylococcus epidermidis
YDPDQCILCGRCVEACQD

SEQ ID NO: 1818896 - protein, 23 aa, Staphylococcus epidermidis
YDPRKYLGPAREAIKETVKGKIK

SEQ ID NO: 1818897 - protein, 17 aa, Staphylococcus epidermidis
YDPRLFEGFSMGNPKIQ

SEQ ID NO: 1818898 - protein, 18 aa, Staphylococcus epidermidis
YDRQIICTQSFYQKLDTL

SEQ ID NO: 1818899 - protein, 18 aa, Staphylococcus epidermidis
YDRVDVVVATNAFGMGID

SEQ ID NO: 1818900 - protein, 23 aa, Staphylococcus epidermidis
YDSKELFKLIALESQHAGLSWLT

SEQ ID NO: 1818901 - protein, 17 aa, Staphylococcus epidermidis
YDVVPSLISELYQTQTS

SEQ ID NO: 1818902 - protein, 17 aa, Staphylococcus epidermidis
YEIYQIWCANNGYHHMN

SEQ ID NO: 1818903 - protein, 17 aa, Staphylococcus epidermidis
YEPSMQYFNEWWKQLYG

SEQ ID NO: 1818904 - protein, 21 aa, Staphylococcus epidermidis
YETWHGVLLYSRWPMLEQQTI

SEQ ID NO: 1818905 - protein, 19 aa, Staphylococcus epidermidis
YFDIFKYGTSFITLQVPRE

SEQ ID NO: 1818906 - protein, 18 aa, Staphylococcus epidermidis
YFDIFRYGTSFVTLQVPR

SEQ ID NO: 1818907 - protein, 19 aa, Staphylococcus epidermidis
YFDRLFSQYGIRSHIDTVT

SEQ ID NO: 1818908 - protein, 17 aa, Staphylococcus epidermidis
YFGKSYIEFEDWVQNIN

SEQ ID NO: 1818909 - protein, 18 aa, Staphylococcus epidermidis
YFHPFRASKQFTIVPSWE

SEQ ID NO: 1818910 - protein, 18 aa, Staphylococcus epidermidis
YFKYNLKKYTAMKITKVE

SEQ ID NO: 1818911 - protein, 19 aa, Staphylococcus epidermidis
YFTSTWPSKLVYIAKPQLE

SEQ ID NO: 1818912 - protein, 18 aa, Staphylococcus epidermidis
YGDDIKALFNYPSQATDE

SEQ ID NO: 1818913 - protein, 21 aa, Staphylococcus epidermidis
YGELYTRYGAILNKVYSKTDS

SEQ ID NO: 1818914 - protein, 19 aa, Staphylococcus epidermidis
YGVGRRISLHYTRQMVNQA

SEQ ID NO: 1818915 - protein, 17 aa, Staphylococcus epidermidis
YGVKIYDVFTILYLLSP

SEQ ID NO: 1818916 - protein, 24 aa, Staphylococcus epidermidis
YHDRPSEDWVWRDGFVKMDTLEVN

SEQ ID NO: 1818917 - protein, 17 aa, Staphylococcus epidermidis
YHFISFIVAYTLEENET

SEQ ID NO: 1818918 - protein, 21 aa, Staphylococcus epidermidis
YHPDYEFLKSIGIEINTNEYG

SEQ ID NO: 1818919 - protein, 19 aa, Staphylococcus epidermidis
YHVPVCCFTFGIPDHETIQ

SEQ ID NO: 1818920 - protein, 17 aa, Staphylococcus epidermidis
YHYSARIVLLAWNRYLT

SEQ ID NO: 1818921 - protein, 17 aa, Staphylococcus epidermidis
YIDWSFLLEYMKYVNKF

SEQ ID NO: 1818922 - protein, 18 aa, Staphylococcus epidermidis
YIKFCIKPLLKKIEDELN

SEQ ID NO: 1818923 - protein, 22 aa, Staphylococcus epidermidis
YIKSGNEPIIFAGSRSGMPIPA

SEQ ID NO: 1818924 - protein, 17 aa, Staphylococcus epidermidis
YIMNLPVNFLKTFLPEL

SEQ ID NO: 1818925 - protein, 17 aa, Staphylococcus epidermidis
YINSFRYFRNMYKRFYY

SEQ ID NO: 1818926 - protein, 18 aa, Staphylococcus epidermidis
YIPNCDKITPGMLLAAVR

SEQ ID NO: 1818927 - protein, 22 aa, Staphylococcus epidermidis
YIQFLYECRQYIKSLKIEPSDK

SEQ ID NO: 1818928 - protein, 18 aa, Staphylococcus epidermidis
YIRKEVGVVFQFPESQLF

SEQ ID NO: 1818929 - protein, 25 aa, Staphylococcus epidermidis
YKEIHKIVKIIGGFFVEENTNVYDI

SEQ ID NO: 1818930 - protein, 23 aa, Staphylococcus epidermidis
YKGEPKLGFKEMEEIGASTGLPL

SEQ ID NO: 1818931 - protein, 19 aa, Staphylococcus epidermidis
YKIGVLIGEKGCRNVHFFG

SEQ ID NO: 1818932 - protein, 17 aa, Staphylococcus epidermidis
YKLAILISLMNSVFEFE

SEQ ID NO: 1818933 - protein, 17 aa, Staphylococcus epidermidis
YKLKCKCLFPFDANVPF

SEQ ID NO: 1818934 - protein, 17 aa, Staphylococcus epidermidis
YKLYFKKKIFGEIKDIP

SEQ ID NO: 1818935 - protein, 20 aa, Staphylococcus epidermidis
YKPELAFAIGNAIKYISRAN

SEQ ID NO: 1818936 - protein, 22 aa, Staphylococcus epidermidis
YKPKNMFFHIAVSPINLITSDN

SEQ ID NO: 1818937 - protein, 19 aa, Staphylococcus epidermidis
YKQVLPCQFCNYKSVCHVD

SEQ ID NO: 1818938 - protein, 17 aa, Staphylococcus epidermidis
YKTVCNFEYTFDGTYRN

SEQ ID NO: 1818939 - protein, 19 aa, Staphylococcus epidermidis
YKYARGVAVYGDIKDGAND

SEQ ID NO: 1818940 - protein, 24 aa, Staphylococcus epidermidis
YLAEMKEHYKAGGLGDVKVKKYLN

SEQ ID NO: 1818941 - protein, 17 aa, Staphylococcus epidermidis
YLDGLLFDDIPYLKVAQ

SEQ ID NO: 1818942 - protein, 17 aa, Staphylococcus epidermidis
YLGPLGCGFMTGSGAVF

SEQ ID NO: 1818943 - protein, 21 aa, Staphylococcus epidermidis
YLKEFSNLYALLVPKVPTMED

SEQ ID NO: 1818944 - protein, 19 aa, Staphylococcus epidermidis
YLWTILIHRLQKWELNDKT

SEQ ID NO: 1818945 - protein, 18 aa, Staphylococcus epidermidis
YMGAYRLQWEMIKFAKEH

SEQ ID NO: 1818946 - protein, 18 aa, Staphylococcus epidermidis
YMGPYAMHWHMINYCFDN

SEQ ID NO: 1818947 - protein, 19 aa, Staphylococcus epidermidis
YMGPYAMHWHMINYCFDNG

SEQ ID NO: 1818948 - protein, 17 aa, Staphylococcus epidermidis
YMIELLEPLPFLEKISK

SEQ ID NO: 1818949 - protein, 18 aa, Staphylococcus epidermidis
YMIGMSFNQLEAFKEALP

SEQ ID NO: 1818950 - protein, 24 aa, Staphylococcus epidermidis
YMLSLKLSDFIYVFRMFSLGIADY

SEQ ID NO: 1818951 - protein, 25 aa, Staphylococcus epidermidis
YMTIFKFRGHRIVAFNGGRFLIHEM

SEQ ID NO: 1818952 - protein, 19 aa, Staphylococcus epidermidis
YMVFKSWYRKLGITSEEQY

SEQ ID NO: 1818953 - protein, 22 aa, Staphylococcus epidermidis
YNELLRRYDFVLIDTPPVNTVT

SEQ ID NO: 1818954 - protein, 17 aa, Staphylococcus epidermidis
YPDWSIKKIEDISKVNK

SEQ ID NO: 1818955 - protein, 17 aa, Staphylococcus epidermidis
YPFGGGQGMVLKPEPVF

SEQ ID NO: 1818956 - protein, 19 aa, Staphylococcus epidermidis
YPIRFSVMGHVHFRKKLVE

SEQ ID NO: 1818957 - protein, 18 aa, Staphylococcus epidermidis
YPKFGFKKASNWNIEAPF

SEQ ID NO: 1818958 - protein, 25 aa, Staphylococcus epidermidis
YPKLAELGLKWYAVPIISNMDLKIG

SEQ ID NO: 1818959 - protein, 18 aa, Staphylococcus epidermidis
YPKWIFKKFEEIFKVVPS

SEQ ID NO: 1818960 - protein, 17 aa, Staphylococcus epidermidis
YPNIKWIVPHCGALLPV

SEQ ID NO: 1818961 - protein, 17 aa, Staphylococcus epidermidis
YPNSCTFALSNINLHIN

SEQ ID NO: 1818962 - protein, 18 aa, Staphylococcus epidermidis
YPSELAFVIGNATKYISR

SEQ ID NO: 1818963 - protein, 19 aa, Staphylococcus epidermidis
YQAKILLLAWNRYLTQTAS

SEQ ID NO: 1818964 - protein, 24 aa, Staphylococcus epidermidis
YQDRPTDEWQWRDGFVKMDTLEVD

SEQ ID NO: 1818965 - protein, 19 aa, Staphylococcus epidermidis
YQKRFYKTWSGWERVGSDV

SEQ ID NO: 1818966 - protein, 17 aa, Staphylococcus epidermidis
YQVKRKPNQIAVIDQHR

SEQ ID NO: 1818967 - protein, 17 aa, Staphylococcus epidermidis
YRFGDGINEQGVAISNH

SEQ ID NO: 1818968 - protein, 19 aa, Staphylococcus epidermidis
YRISYKFIQSIQELSGIPT

SEQ ID NO: 1818969 - protein, 19 aa, Staphylococcus epidermidis
YRLNLYMSLIILNNKEMLF

SEQ ID NO: 1818970 - protein, 20 aa, Staphylococcus epidermidis
YRPVMEIQFLGFVFEVFDEV

SEQ ID NO: 1818971 - protein, 22 aa, Staphylococcus epidermidis
YRRWKDKASIIMDMFVEQSHKI

SEQ ID NO: 1818972 - protein, 20 aa, Staphylococcus epidermidis
YRTNLYMTMFRFREHRIVAF

SEQ ID NO: 1818973 - protein, 19 aa, Staphylococcus epidermidis
YRVLIDWKRIGRMISIPKF

SEQ ID NO: 1818974 - protein, 22 aa, Staphylococcus epidermidis
YSDHIIDAFGMRPYIKKKVKKY

SEQ ID NO: 1818975 - protein, 18 aa, Staphylococcus epidermidis
YSNIKFILAHAGGTLPYL

SEQ ID NO: 1818976 - protein, 17 aa, Staphylococcus epidermidis
YSQMAWDGFQPFKIEKI

SEQ ID NO: 1818977 - protein, 18 aa, Staphylococcus epidermidis
YSSAWSFLVPEILQIDES

SEQ ID NO: 1818978 - protein, 17 aa, Staphylococcus epidermidis
YSSRPAPYFKYDAHDDN

SEQ ID NO: 1818979 - protein, 20 aa, Staphylococcus epidermidis
YSVSIALQLVRKFPAIERRV

SEQ ID NO: 1818980 - protein, 22 aa, Staphylococcus epidermidis
YTGLRIGVTVAKTLAYALQTRL

SEQ ID NO: 1818981 - protein, 20 aa, Staphylococcus epidermidis
YTVKSVYRWYLQGLGYKKIS

SEQ ID NO: 1818982 - protein, 17 aa, Staphylococcus epidermidis
YVINYLIAYIKKEDDQE

SEQ ID NO: 1818983 - protein, 18 aa, Staphylococcus epidermidis
YVKELRPLTGLDEPVYNY

SEQ ID NO: 1818984 - protein, 18 aa, Staphylococcus epidermidis
YVPYCIEPSLGADRVTLA

SEQ ID NO: 1818985 - protein, 23 aa, Staphylococcus epidermidis
YVQMKWRCPIIFYTCIRENDENY

SEQ ID NO: 1818986 - protein, 24 aa, Staphylococcus epidermidis
YVSGGKRPLICFFSNDLNIHRTKT

SEQ ID NO: 1818987 - protein, 17 aa, Staphylococcus epidermidis
YWGSLIIKGQIGYNTEI

SEQ ID NO: 1818988 - protein, 19 aa, Staphylococcus epidermidis
YWRDECGYTIKPVSETNDV

SEQ ID NO: 1818989 - protein, 17 aa, Staphylococcus epidermidis
YYDKWLVGFKETKGGRR

SEQ ID NO: 1818990 - protein, 25 aa, Staphylococcus epidermidis
YYDRPSEDWLWRDGFVKMDTLEVDV

SEQ ID NO: 1818991 - protein, 27 aa, Staphylococcus epidermidis
YYDRPSEDWLWRDGFVKMDTLEVDVND

SEQ ID NO: 1818992 - protein, 17 aa, Staphylococcus epidermidis
YYITVSWQRLREGKNIK

SEQ ID NO: 1818993 - protein, 19 aa, Staphylococcus epidermidis
YYKGCLEFQKNQPLASYMV

SEQ ID NO: 1818994 - protein, 19 aa, Staphylococcus epidermidis
YYLPDVLSLILEDGGKAEI

SEQ ID NO: 1818995 - protein, 18 aa, Staphylococcus epidermidis
YYMGIPIERSFRLMSPTP

SEQ ID NO: 1818996 - protein, 18 aa, Staphylococcus epidermidis
YYPALMIEYDYLSRNVPN

SEQ ID NO: 1818997 - protein, 24 aa, Staphylococcus epidermidis
YYREVPILGVCLGFQVIVEHFGGQ

SEQ ID NO: 1818998 - protein, 18 aa, Staphylococcus epidermidis
RLLKTIHYLVMNHKLYDY

SEQ ID NO: 1818999 - protein, 24 aa, Staphylococcus epidermidis
IHELIFFELRERVRFHLEIENEQN

SEQ ID NO: 1819000 - protein, 24 aa, Staphylococcus epidermidis
RGNKKARKLLFWVIMNIIRGQHHY

SEQ ID NO: 1819001 - protein, 25 aa, Staphylococcus epidermidis
QNRLKFQILELLHQTFPGLERLFSS

SEQ ID NO: 1819002 - protein, 24 aa, Staphylococcus epidermidis
NRLKFQILELLHQTFPGLERLFSS

SEQ ID NO: 1819003 - protein, 19 aa, Staphylococcus epidermidis
TDNLLQRQFKASCPMEVLT

SEQ ID NO: 1819004 - protein, 19 aa, Staphylococcus epidermidis
KDIELDILKKYKALERKWY

SEQ ID NO: 1819005 - protein, 19 aa, Staphylococcus epidermidis
KGKWSYLYRAIDAEGHTLD

SEQ ID NO: 1819006 - protein, 27 aa, Staphylococcus epidermidis
KNRTQVETWWRWYRNEESYRFSQHVGK

SEQ ID NO: 1819007 - protein, 20 aa, Staphylococcus epidermidis
VQEYAPILYQIWKKKHKKAY

SEQ ID NO: 1819008 - protein, 18 aa, Staphylococcus epidermidis
YAFIKRLIKQFGKPQKVI

SEQ ID NO: 1819009 - protein, 23 aa, Staphylococcus epidermidis
SIKLILEVLNIPKSTYYRWKNKT

SEQ ID NO: 1819010 - protein, 30 aa, Staphylococcus epidermidis
VLTTDITYLPFGHSMLYLSSIMDIYNGEIV

SEQ ID NO: 1819011 - protein, 27 aa, Staphylococcus epidermidis
AADLLGQPLYKYLGGFNGKQLPVPMMN

SEQ ID NO: 1819012 - protein, 24 aa, Staphylococcus epidermidis
AAGTLYNIVGFQTHLKWGAQKEVI

SEQ ID NO: 1819013 - protein, 19 aa, Staphylococcus epidermidis
AAMAHGRVFSFGPTFRAEK

SEQ ID NO: 1819014 - protein, 26 aa, Staphylococcus epidermidis
AAYRELSLLLRRPPGREAYPGDVFYL

SEQ ID NO: 1819015 - protein, 28 aa, Staphylococcus epidermidis
ADEEYHLRKDQFTVPFVCGCRNLGEAAR

SEQ ID NO: 1819016 - protein, 23 aa, Staphylococcus epidermidis
ADKFKLTVLVDMFGRETPVEVEF

SEQ ID NO: 1819017 - protein, 24 aa, Staphylococcus epidermidis
ADSIPINFLHPIKGTKFGGLDLLS

SEQ ID NO: 1819018 - protein, 25 aa, Staphylococcus epidermidis
AELPKVFHYFKEAHPYFNQNVVIIG

SEQ ID NO: 1819019 - protein, 25 aa, Staphylococcus epidermidis
AEPYIRRRAIRHLEKKRVVIFAAGI

SEQ ID NO: 1819020 - protein, 21 aa, Staphylococcus epidermidis
AFKMAIDYAFLVLNMNKVYLY

SEQ ID NO: 1819021 - protein, 22 aa, Staphylococcus epidermidis
AGLKAIVVIPEGKIALGKLSQA

SEQ ID NO: 1819022 - protein, 24 aa, Staphylococcus epidermidis
AHSDVFNVLLQILDEGRLTDSKGR

SEQ ID NO: 1819023 - protein, 30 aa, Staphylococcus epidermidis
AIEYDAIVPTQLWPTLETKAIKNLYTAGQI

SEQ ID NO: 1819024 - protein, 22 aa, Staphylococcus epidermidis
AIFAGDLMRMYSKYAEANGFKT

SEQ ID NO: 1819025 - protein, 19 aa, Staphylococcus epidermidis
AISSPLLETSIVGAQGVLM

SEQ ID NO: 1819026 - protein, 42 aa, Staphylococcus epidermidis; identical to SEQ ID NO: 1679526

SEQ ID NO: 1819027 - protein, 26 aa, Staphylococcus epidermidis
AKTLMLTINLDNIAFMPCNPSVGGPA

SEQ ID NO: 1819028 - protein, 26 aa, Staphylococcus epidermidis
ALAPYKAAVLPLSKKLSSEAIKIFEQ

SEQ ID NO: 1819029 - protein, 18 aa, Staphylococcus epidermidis
ALEIVDGLLLNPLVGETK

SEQ ID NO: 1819030 - protein, 27 aa, Staphylococcus epidermidis
ALVTGYDIIFFWVARMIFQGLEFTDRR

SEQ ID NO: 1819031 - protein, 27 aa, Staphylococcus epidermidis
AMNRKGYFLYGYRHFSSRIKGGHTNNK

SEQ ID NO: 1819032 - protein, 17 aa, Staphylococcus epidermidis
AMVFGQMNEPPGARMRV

SEQ ID NO: 1819033 - protein, 25 aa, Staphylococcus epidermidis
APGFGDRRKAMLEDLAILTGAQVIT

SEQ ID NO: 1819034 - protein, 25 aa, Staphylococcus epidermidis
APIAFQEFMILPVGAESFKESLRWG

SEQ ID NO: 1819035 - protein, 21 aa, Staphylococcus epidermidis
APQCAGIIHTDFERGFIRAEV

SEQ ID NO: 1819036 - protein, 23 aa, Staphylococcus epidermidis
AQAILDMRLRRLTGLERDKIESE

SEQ ID NO: 1819037 - protein, 22 aa, Staphylococcus epidermidis
AQTLANVYLALDNDLELLPVVN

SEQ ID NO: 1819038 - protein, 30 aa, Staphylococcus epidermidis
ARRTYAFTELFMFELRMQWLNRLEKTSDEA

SEQ ID NO: 1819039 - protein, 18 aa, Staphylococcus epidermidis
ASRILGMGDVLSLIEKAQ

SEQ ID NO: 1819040 - protein, 19 aa, Staphylococcus epidermidis
ATIHRFTRKLGFDGYSDFK

SEQ ID NO: 1819041 - protein, 20 aa, Staphylococcus epidermidis
AVCTRACRFCAVKTGLPNEL

SEQ ID NO: 1819042 - protein, 26 aa, Staphylococcus epidermidis
AVRKNLNIIQLIWNDGRYNMVEFQEE

SEQ ID NO: 1819043 - protein, 24 aa, Staphylococcus epidermidis
CYTNYTIPPYYDSMVAKLIVHEPT

SEQ ID NO: 1819044 - protein, 17 aa, Staphylococcus epidermidis
DAIEAALITAYKKNYDS

SEQ ID NO: 1819045 - protein, 17 aa, Staphylococcus epidermidis
DDEDKEMFLEDLGIEEP

SEQ ID NO: 1819046 - protein, 24 aa, Staphylococcus epidermidis
DDERRLLLLNQELERFRATLFRQT

SEQ ID NO: 1819047 - protein, 20 aa, Staphylococcus epidermidis
DDIHNVFMYFAGLADKDGGE

SEQ ID NO: 1819048 - protein, 24 aa, Staphylococcus epidermidis
DDKQGVIRLFLKYGQNNERVITGL

SEQ ID NO: 1819049 - protein, 22 aa, Staphylococcus epidermidis
DEPLNRLFNTSPVFSQIPGPNH

SEQ ID NO: 1819050 - protein, 17 aa, Staphylococcus epidermidis
DFEKDYPYYASGGFIHY

SEQ ID NO: 1819051 - protein, 21 aa, Staphylococcus epidermidis
DGLLVPFVRDCDKKNFAEIEQ

SEQ ID NO: 1819052 - protein, 23 aa, Staphylococcus epidermidis
DGRTWITREPAIVYFHSEYWFNV

SEQ ID NO: 1819053 - protein, 17 aa, Staphylococcus epidermidis
DIDYLLDRRDSFGTVTN

SEQ ID NO: 1819054 - protein, 20 aa, Staphylococcus epidermidis
DILTIGQYLQPSRKHLKVEK

SEQ ID NO: 1819055 - protein, 30 aa, Staphylococcus epidermidis
DKMIAELERPYILVTDKKISSFQDILPLLE

SEQ ID NO: 1819056 - protein, 30 aa, Staphylococcus epidermidis
DLVGNNTPVFFFRDPKLFISLNRAVKRDPR

SEQ ID NO: 1819057 - protein, 23 aa, Staphylococcus epidermidis
DMRLAAYIVGIKRTAEAARYRGW

SEQ ID NO: 1819058 - protein, 18 aa, Staphylococcus epidermidis
DNLKRMKAWIPIDGTYDL

SEQ ID NO: 1819059 - protein, 25 aa, Staphylococcus epidermidis
DNMPDKLCLYYHIGQCMGPCVYDVD

SEQ ID NO: 1819060 - protein, 21 aa, Staphylococcus epidermidis
DNPIYYAQYAHARICSILKQA

SEQ ID NO: 1819061 - protein, 24 aa, Staphylococcus epidermidis
DNTPNLLAVLKEVGVVDSGGKGLL

SEQ ID NO: 1819062 - protein, 17 aa, Staphylococcus epidermidis
DPYRGVISSIRIIDGVV

SEQ ID NO: 1819063 - protein, 21 aa, Staphylococcus epidermidis
DQISKLLFESTKRRPMIIPVI

SEQ ID NO: 1819064 - protein, 29 aa, Staphylococcus epidermidis
DQNIAYQYATIRNILYSKGYTTEMLINYE

SEQ ID NO: 1819065 - protein, 21 aa, Staphylococcus epidermidis
DQVIIDYLVSEFKKENGVDLS

SEQ ID NO: 1819066 - protein, 17 aa, Staphylococcus epidermidis
DRLIKFLGGIRDMKSMP

SEQ ID NO: 1819067 - protein, 27 aa, Staphylococcus epidermidis
DSEEAVLQMNLLGHDFFIFTDRETDGT

SEQ ID NO: 1819068 - protein, 18 aa, Staphylococcus epidermidis
DSVILLEQIRTLDKKRLK

SEQ ID NO: 1819069 - protein, 25 aa, Staphylococcus epidermidis
DTIQRGGTFLFSARCPQFKEEDVRK

SEQ ID NO: 1819070 - protein, 17 aa, Staphylococcus epidermidis
DVAFQYNDQYSESILSF

SEQ ID NO: 1819071 - protein, 19 aa, Staphylococcus epidermidis
EANVKYLALDLGEDNIRVN

SEQ ID NO: 1819072 - protein, 25 aa, Staphylococcus epidermidis
EAPLKALIFDSEYDPYRGVISSIRI

SEQ ID NO: 1819073 - protein, 35 aa, Staphylococcus epidermidis
EATLTARLIDRPIRPLFPKGYRHDVQIMNIVLSAD

SEQ ID NO: 1819074 - protein, 22 aa, Staphylococcus epidermidis
EDEIRRFLPRKVRTFQLQEAQR

SEQ ID NO: 1819075 - protein, 24 aa, Staphylococcus epidermidis
EDGIFIAVVTLDPKNRRIAAGPEI

SEQ ID NO: 1819076 - protein, 26 aa, Staphylococcus epidermidis
EDMGFTDFNLGPEPEFFLFKLDEKGE

SEQ ID NO: 1819077 - protein, 24 aa, Staphylococcus epidermidis
EEDMFEIIAGERRFRALQSLHKPQ

SEQ ID NO: 1819078 - protein, 25 aa, Staphylococcus epidermidis
EEIHQAGNVILFIDELHTLVGAGGA

SEQ ID NO: 1819079 - protein, 20 aa, Staphylococcus epidermidis
EFDFIIFDTAPTGHTLRMLE

SEQ ID NO: 1819080 - protein, 20 aa, Staphylococcus epidermidis
EFKPYYLTKALQKLKDLNLL

SEQ ID NO: 1819081 - protein, 29 aa, Staphylococcus epidermidis
EGCNNFCTFCIIPWARGLMRSRDPEKVVE

SEQ ID NO: 1819082 - protein, 36 aa, Staphylococcus epidermidis
EGEFYALPQSPQLFKQLLMISGFDKYYQIVKCFRDE

SEQ ID NO: 1819083 - protein, 22 aa, Staphylococcus epidermidis
EGQYIAYFQAFTNTHAPVEVLK

SEQ ID NO: 1819084 - protein, 25 aa, Staphylococcus epidermidis
EGTMPQTRFVLKKALEQNLKPVVVV

SEQ ID NO: 1819085 - protein, 21 aa, Staphylococcus epidermidis
EGTRPLLIEVQALVTPTTFNN

SEQ ID NO: 1819086 - protein, 22 aa, Staphylococcus epidermidis
EHFERFLYENPSVGRIIVEKGI

SEQ ID NO: 1819087 - protein, 21 aa, Staphylococcus epidermidis
EHMLFYFAYKTFITTADEIIE

SEQ ID NO: 1819088 - protein, 25 aa, Staphylococcus epidermidis
EHVASALIKWFNTNYHYIVPEWDNV

SEQ ID NO: 1819089 - protein, 23 aa, Staphylococcus epidermidis
EKKLKIILSLIKEDELCVCDISL

SEQ ID NO: 1819090 - protein, 25 aa, Staphylococcus epidermidis
EKNVAPLELALSSGATFVAQGFSSD

SEQ ID NO: 1819091 - protein, 24 aa, Staphylococcus epidermidis
EKQKLRYLYGMTERQFRNTFDIAG

SEQ ID NO: 1819092 - protein, 23 aa, Staphylococcus epidermidis
EKVQLIGFGNFEVRERAARKGRN

SEQ ID NO: 1819093 - protein, 19 aa, Staphylococcus epidermidis
ELDSLWQLRNLFTDSTDFT

SEQ ID NO: 1819094 - protein, 28 aa, Staphylococcus epidermidis
ELGDDYVILLRMHYLISNALDLSGYENF

SEQ ID NO: 1819095 - protein, 20 aa, Staphylococcus epidermidis
ELIASFSRALASDLRASQSQ

SEQ ID NO: 1819096 - protein, 21 aa, Staphylococcus epidermidis
ELIRRLRRGIYAKQKVVVFKP

SEQ ID NO: 1819097 - protein, 34 aa, Staphylococcus epidermidis
ELPNLIEIQTKSYDWFLKEGLLEMFRDISPIEDF

SEQ ID NO: 1819098 - protein, 26 aa, Staphylococcus epidermidis
ENAKSLLYSRFFDPKRYDLASVGRYK

SEQ ID NO: 1819099 - protein, 25 aa, Staphylococcus epidermidis
ENGYRSLHIVVSIPVFLADSVEVTP

SEQ ID NO: 1819100 - protein, 19 aa, Staphylococcus epidermidis
ENHFFGRVGLFRNQVGDEL

SEQ ID NO: 1819101 - protein, 23 aa, Staphylococcus epidermidis
ENHRKLFIAIAKDVRVILVKLAD

SEQ ID NO: 1819102 - protein, 19 aa, Staphylococcus epidermidis
EPEFFLFKLDEKGEPTLEL

SEQ ID NO: 1819103 - protein, 17 aa, Staphylococcus epidermidis
EQNLNIKRLMEISSYRG

SEQ ID NO: 1819104 - protein, 25 aa, Staphylococcus epidermidis
EQRISNFLIWQASYSEFIFNEKLWP

SEQ ID NO: 1819105 - protein, 24 aa, Staphylococcus epidermidis
ERAGQFYVNQRWLGGILTNYKTIS

SEQ ID NO: 1819106 - protein, 23 aa, Staphylococcus epidermidis
ERKLTEMGIYPAVDPLASTSRAL

SEQ ID NO: 1819107 - protein, 29 aa, Staphylococcus epidermidis
ERLERLRKAIPNVLFQMLLRASNAVGYKN

SEQ ID NO: 1819108 - protein, 25 aa, Staphylococcus epidermidis
ESKSLKLYLFSFRNHGDFHEDCMNI

SEQ ID NO: 1819109 - protein, 24 aa, Staphylococcus epidermidis
ESLLDKTIFELDLSALVAGAKYRG

SEQ ID NO: 1819110 - protein, 26 aa, Staphylococcus epidermidis
ESRSDLEILLYDRGPRILRNFPEKLS

SEQ ID NO: 1819111 - protein, 29 aa, Staphylococcus epidermidis
ESSELHDLAFLLLVYPLSEYEGALDSAYY

SEQ ID NO: 1819112 - protein, 23 aa, Staphylococcus epidermidis
ETIDPVVGLSPYQARRIAFNINI

SEQ ID NO: 1819113 - protein, 24 aa, Staphylococcus epidermidis
ETTPGGRALKFYSSVRLEVRRAEQ

SEQ ID NO: 1819114 - protein, 21 aa, Staphylococcus epidermidis
EVEHVFATQTLWQTKPKNLKI

SEQ ID NO: 1819115 - protein, 25 aa, Staphylococcus epidermidis
EVEKRFMHHYNFPNFSVGETGPVRA

SEQ ID NO: 1819116 - protein, 24 aa, Staphylococcus epidermidis
EVFQGRQYKVYRGMGSLGAMEKGS

SEQ ID NO: 1819117 - protein, 18 aa, Staphylococcus epidermidis
EVIQAIHELPFDKGLDRV

SEQ ID NO: 1819118 - protein, 24 aa, Staphylococcus epidermidis
EVMGRDCGDLALWAGLSVGAETIV

SEQ ID NO: 1819119 - protein, 23 aa, Staphylococcus epidermidis
EVMLLRHMILAHHGKMEFGSPKL

SEQ ID NO: 1819120 - protein, 28 aa, Staphylococcus epidermidis
FADKAAARFGSGWAWLVVNNGQLEIVTT

SEQ ID NO: 1819121 - protein, 18 aa, Staphylococcus epidermidis
FDLILKQNKVRDAEPEVT

SEQ ID NO: 1819122 - protein, 20 aa, Staphylococcus epidermidis
FDNRISVGVMYMLKLAHMVD

SEQ ID NO: 1819123 - protein, 23 aa, Staphylococcus epidermidis
FDRKNYFYPDNPKAYQISQFDQP

SEQ ID NO: 1819124 - protein, 25 aa, Staphylococcus epidermidis
FEDEFSLEAFNLYGALSMANAGPNT

SEQ ID NO: 1819125 - protein, 25 aa, Staphylococcus epidermidis
FERNYERYQFLNWATKAFDNYNAVP

SEQ ID NO: 1819126 - protein, 26 aa, Staphylococcus epidermidis
FGEKLQGFLVTKFGWVQSYGSRAVKP

SEQ ID NO: 1819127 - protein, 29 aa, Staphylococcus epidermidis
FGGETYKLHLVPSGIFYKDKLAVIGNGVV

SEQ ID NO: 1819128 - protein, 33 aa, Staphylococcus epidermidis
FIEQYRDLGYLPEALFNFITLLGWSPEGEEEIF

SEQ ID NO: 1819129 - protein, 25 aa, Staphylococcus epidermidis
FKIVTGFIEPHFFAGFSGGPKGIMP

SEQ ID NO: 1819130 - protein, 19 aa, Staphylococcus epidermidis
FKYHRHFFVPDNVGHDGFL

SEQ ID NO: 1819131 - protein, 27 aa, Staphylococcus epidermidis
FNLDHTKVVAPFIRLAGTMEGLNGDVI

SEQ ID NO: 1819132 - protein, 18 aa, Staphylococcus epidermidis
FPLTVNYEEKMYAAGKIP

SEQ ID NO: 1819133 - protein, 24 aa, Staphylococcus epidermidis
FQPMNANFGLLPSLEKRIKDKKER

SEQ ID NO: 1819134 - protein, 17 aa, Staphylococcus epidermidis
FSKGLLMGARGNSGVIL

SEQ ID NO: 1819135 - protein, 21 aa, Staphylococcus epidermidis
FTCPHGRPIIINFSNYELEKL

SEQ ID NO: 1819136 - protein, 17 aa, Staphylococcus epidermidis
FVNPIEMDYIRQIEDVN

SEQ ID NO: 1819137 - protein, 22 aa, Staphylococcus epidermidis
GAKSIRFMCLIAAPEGVEKMQE

SEQ ID NO: 1819138 - protein, 18 aa, Staphylococcus epidermidis
GATWLRTSDFKDDKDRVL

SEQ ID NO: 1819139 - protein, 19 aa, Staphylococcus epidermidis
GAYILSKRQLETEKSYEYL

SEQ ID NO: 1819140 - protein, 22 aa, Staphylococcus epidermidis
GDAITIFSKLKPQIPTCRVIFT

SEQ ID NO: 1819141 - protein, 18 aa, Staphylococcus epidermidis
GDDCNTLYLYEKELAARS

SEQ ID NO: 1819142 - protein, 20 aa, Staphylococcus epidermidis
GDFSLYDHILDTSLLFNIIP

SEQ ID NO: 1819143 - protein, 27 aa, Staphylococcus epidermidis
GDGIIKIEMHFLPDVYVPCEVCDGKRY

SEQ ID NO: 1819144 - protein, 23 aa, Staphylococcus epidermidis
GDMHYDVMSAFQKSIRGSDVNAA

SEQ ID NO: 1819145 - protein, 20 aa, Staphylococcus epidermidis
GEFAVLLMAGGQGTRLGYKG

SEQ ID NO: 1819146 - protein, 21 aa, Staphylococcus epidermidis
GEIAIRIFRAAAELNISTVAI

SEQ ID NO: 1819147 - protein, 27 aa, Staphylococcus epidermidis
GEVGRALYNFIWDEFCDWYIEMSKIPM

SEQ ID NO: 1819148 - protein, 17 aa, Staphylococcus epidermidis
GFDCASSEFYENGVYDY

SEQ ID NO: 1819149 - protein, 20 aa, Staphylococcus epidermidis
GFGRIGRLAFRRIQDVEGLE

SEQ ID NO: 1819150 - protein, 28 aa, Staphylococcus epidermidis
GGEQKRLYLLRLLVHKPNVLLLDEPTND

SEQ ID NO: 1819151 - protein, 34 aa, Staphylococcus epidermidis
GGLDLLSPMKCLRIIAMFRLINPTKEIRIAGGRE

SEQ ID NO: 1819152 - protein, 27 aa, Staphylococcus epidermidis
GIDHNRLSLLMAVLEKKENYLLQQQDA

SEQ ID NO: 1819153 - protein, 18 aa, Staphylococcus epidermidis
GIEEPGLDRLIRTTYDLL

SEQ ID NO: 1819154 - protein, 23 aa, Staphylococcus epidermidis
GKATNPEQLFAAGYASCFNGAFD

SEQ ID NO: 1819155 - protein, 18 aa, Staphylococcus epidermidis
GKGKTVVTVLPSNGERYL

SEQ ID NO: 1819156 - protein, 18 aa, Staphylococcus epidermidis
GLAFVCAAKGYKAVFTMP

SEQ ID NO: 1819157 - protein, 28 aa, Staphylococcus epidermidis
GLDRLIRTTYDLLGLSTYFTAGVQEVRA

SEQ ID NO: 1819158 - protein, 17 aa, Staphylococcus epidermidis
GLELFHPERMASRILGM

SEQ ID NO: 1819159 - protein, 17 aa, Staphylococcus epidermidis
GLGLERTVAWISGVEHV

SEQ ID NO: 1819160 - protein, 18 aa, Staphylococcus epidermidis
GLIGFTRNIAAELGQYGI

SEQ ID NO: 1819161 - protein, 25 aa, Staphylococcus epidermidis
GLQARLMSQALRKLSGAISKSNTTA

SEQ ID NO: 1819162 - protein, 20 aa, Staphylococcus epidermidis
GMVFQQPNPFPKSIYDNITY

SEQ ID NO: 1819163 - protein, 19 aa, Staphylococcus epidermidis
GPCKMIAPVLEELAGDYDG

SEQ ID NO: 1819164 - protein, 27 aa, Staphylococcus epidermidis
GQRQRVWIAMALAQRTDIIFLDEPTTY

SEQ ID NO: 1819165 - protein, 27 aa, Staphylococcus epidermidis
GRLQKDLINWFIDDQFKLFYKKQDLSK

SEQ ID NO: 1819166 - protein, 21 aa, Staphylococcus epidermidis
GRPRGVLRKFEMSRIAFREHA

SEQ ID NO: 1819167 - protein, 17 aa, Staphylococcus epidermidis
GRRLNVFYTTQVAIEPP

SEQ ID NO: 1819168 - protein, 24 aa, Staphylococcus epidermidis
GRRRHLLNYLRSKDIQRYRELIKS

SEQ ID NO: 1819169 - protein, 25 aa, Staphylococcus epidermidis
GRSSRIGYAYFLHPANKVLNETAEE

SEQ ID NO: 1819170 - protein, 23 aa, Staphylococcus epidermidis
GRYSVLTAVGLLPIATAGINIES

SEQ ID NO: 1819171 - protein, 20 aa, Staphylococcus epidermidis
GSGSVFMKPAAPGTGVIAGG

SEQ ID NO: 1819172 - protein, 24 aa, Staphylococcus epidermidis
GSVELDIIFKSEGPKRLLAQFAPI

SEQ ID NO: 1819173 - protein, 20 aa, Staphylococcus epidermidis
GTLLQAFHQYSHMLSKVAFV

SEQ ID NO: 1819174 - protein, 21 aa, Staphylococcus epidermidis
GTREQFLREKILNGLVRSCEK

SEQ ID NO: 1819175 - protein, 27 aa, Staphylococcus epidermidis
GTVNTEHMLFIGAGAFHVSKPSDLIPE

SEQ ID NO: 1819176 - protein, 23 aa, Staphylococcus epidermidis
GVDVFRIFDSLNWVDQMKVANEA

SEQ ID NO: 1819177 - protein, 32 aa, Staphylococcus epidermidis
GVELTWMRQPHYYMGLYSYTYSAGLTIGTVVS

SEQ ID NO: 1819178 - protein, 30 aa, Staphylococcus epidermidis; identical to SEQ ID NO: 1682250

SEQ ID NO: 1819179 - protein, 17 aa, Staphylococcus epidermidis
GVKINDPVRMYLKEIGR

SEQ ID NO: 1819180 - protein, 25 aa, Staphylococcus epidermidis
GVLAGYPLIDVKAKLFDGSYHDVDS

SEQ ID NO: 1819181 - protein, 29 aa, Staphylococcus epidermidis
GVLGPQDSYLLIRGIKTLGLRMEQINRNV

SEQ ID NO: 1819182 - protein, 21 aa, Staphylococcus epidermidis
GVLTDILPSIDNIERALQIEG

SEQ ID NO: 1819183 - protein, 21 aa, Staphylococcus epidermidis
GYPVVVRPSYVLGGRAMEIVD

SEQ ID NO: 1819184 - protein, 17 aa, Staphylococcus epidermidis
HAAAYVLMAVRIAYFKV

SEQ ID NO: 1819185 - protein, 29 aa, Staphylococcus epidermidis
HAVENFIMSRYQMYWQIYFHPVSRGGEVL

SEQ ID NO: 1819186 - protein, 26 aa, Staphylococcus epidermidis
HDVDMLRMCRYPWKTKQRILSDMGHV

SEQ ID NO: 1819187 - protein, 18 aa, Staphylococcus epidermidis
HLLQTVWGYDYFGDVRTV

SEQ ID NO: 1819188 - protein, 19 aa, Staphylococcus epidermidis
HLNHSLFWELLSPNSEEKG

SEQ ID NO: 1819189 - protein, 30 aa, Staphylococcus epidermidis
HPGFPTDMQSQMMALLLTANGHKVITETVF

SEQ ID NO: 1819190 - protein, 23 aa, Staphylococcus epidermidis
HVQRQMLETIPGLEKADMMRAGY

SEQ ID NO: 1819191 - protein, 25 aa, Staphylococcus epidermidis
IAYPRQIAMYLSRELTDFSLPKIGE

SEQ ID NO: 1819192 - protein, 19 aa, Staphylococcus epidermidis
IFITEKVANYIGYLCSIIS

SEQ ID NO: 1819193 - protein, 26 aa, Staphylococcus epidermidis
IGCRDDIMVYLMYAGLEPSMAFKTME

SEQ ID NO: 1819194 - protein, 17 aa, Staphylococcus epidermidis
IGGPTMLRAAAKNFKHV

SEQ ID NO: 1819195 - protein, 24 aa, Staphylococcus epidermidis
IGIDRLVMLLTDSPSIRDVLLFPY

SEQ ID NO: 1819196 - protein, 25 aa, Staphylococcus epidermidis
IHGANHYLIHQFVSPYYNRRNDVWA

SEQ ID NO: 1819197 - protein, 17 aa, Staphylococcus epidermidis
IIINFSNYELEKLFKRV

SEQ ID NO: 1819198 - protein, 25 aa, Staphylococcus epidermidis
IIKDSIADIFLQQILTRPAEHDVVA

SEQ ID NO: 1819199 - protein, 25 aa, Staphylococcus epidermidis
IIVVPDYMDIYDFTPIQFPADDQSA

SEQ ID NO: 1819200 - protein, 24 aa, Staphylococcus epidermidis
ILDTSLLFNIIPERFQGREVNDDL

SEQ ID NO: 1819201 - protein, 18 aa, Staphylococcus epidermidis
ILVKGNVPGPKKGLVEIT

SEQ ID NO: 1819202 - protein, 27 aa, Staphylococcus epidermidis
IPREKRIVISLTYVYGIGTSTANKIVE

SEQ ID NO: 1819203 - protein, 30 aa, Staphylococcus epidermidis
IQNREKAMKVLKARLYDMKLQEEQQKYASQ

SEQ ID NO: 1819204 - protein, 21 aa, Staphylococcus epidermidis
ISMPGMMDTILNLGLNDDNVK

SEQ ID NO: 1819205 - protein, 25 aa, Staphylococcus epidermidis
ISSGAAIYAAIQKAKELGKGKTVVT

SEQ ID NO: 1819206 - protein, 24 aa, Staphylococcus epidermidis
ISTGLIVPSKFFDLAKEGKDFYMF

SEQ ID NO: 1819207 - protein, 25 aa, Staphylococcus epidermidis
ISVKAKSFTLLSKSLRPLPDKFHGL

SEQ ID NO: 1819208 - protein, 27 aa, Staphylococcus epidermidis
ITDGQIFLQSDLFFSGVRPAINAGQSV

SEQ ID NO: 1819209 - protein, 18 aa, Staphylococcus epidermidis
ITIKDIVIYPDAYSIKKR

SEQ ID NO: 1819210 - protein, 27 aa, Staphylococcus epidermidis
IVEKMVEGRLRKYLQEICAVDQNFVKN

SEQ ID NO: 1819211 - protein, 27 aa, Staphylococcus epidermidis
KAAVDTLIVIPNDRLLDIVDKSTPMME

SEQ ID NO: 1819212 - protein, 23 aa, Staphylococcus epidermidis
KAHPDVFNILLQVLDDGHLTDTK

SEQ ID NO: 1819213 - protein, 24 aa, Staphylococcus epidermidis
KAKQDFLLPHLENGKIVLIGATTS

SEQ ID NO: 1819214 - protein, 18 aa, Staphylococcus epidermidis
KALVEKLKTLIPRQQFEV

SEQ ID NO: 1819215 - protein, 38 aa, Staphylococcus epidermidis
KAVEKFDFSKGFKFSTYATWWIRQAITRAIADQARTIR

SEQ ID NO: 1819216 - protein, 19 aa, Staphylococcus epidermidis
KDIRIIPLGGVGEIAKNMY

SEQ ID NO: 1819217 - protein, 17 aa, Staphylococcus epidermidis
KDLIRKCNKLGKPVITA

SEQ ID NO: 1819218 - protein, 21 aa, Staphylococcus epidermidis
KEVELTLPLVVRLEGTNVERG

SEQ ID NO: 1819219 - protein, 25 aa, Staphylococcus epidermidis
KGDMITLDFGAYYRGYCSDITRTFA

SEQ ID NO: 1819220 - protein, 22 aa, Staphylococcus epidermidis
KIQTDGRMKALVSITLDEAFVI

SEQ ID NO: 1819221 - protein, 17 aa, Staphylococcus epidermidis
KKAFKMAIDYAFLVLNM

SEQ ID NO: 1819222 - protein, 24 aa, Staphylococcus epidermidis
KKFGAFVELPEGKSGLVHISEVAD

SEQ ID NO: 1819223 - protein, 20 aa, Staphylococcus epidermidis
KLHHNFVGTEHILLGLIREN

SEQ ID NO: 1819224 - protein, 20 aa, Staphylococcus epidermidis
KLMVDMAHIAGLVAAGLHPN

SEQ ID NO: 1819225 - protein, 19 aa, Staphylococcus epidermidis
KLPGIGPKTAQRLAFHTLD

SEQ ID NO: 1819226 - protein, 23 aa, Staphylococcus epidermidis
KLVDFWATWCGPCKMIAPVLEEL

SEQ ID NO: 1819227 - protein, 20 aa, Staphylococcus epidermidis
KLVHGGLRYLKQLQVGVVAE

SEQ ID NO: 1819228 - protein, 17 aa, Staphylococcus epidermidis
KMALWYTEMKRNLKRFK

SEQ ID NO: 1819229 - protein, 35 aa, Staphylococcus epidermidis
KNHPEELRLLLIDPKMVELAPYNDLPHLVSPVITD

SEQ ID NO: 1819230 - protein, 29 aa, Staphylococcus epidermidis
KNLPSEESYFLFYINRPSIIVGKNQNTIE

SEQ ID NO: 1819231 - protein, 24 aa, Staphylococcus epidermidis
KNRDATYAAPLRVKVRLIIKETGE

SEQ ID NO: 1819232 - protein, 22 aa, Staphylococcus epidermidis
KNSIDCHLGNRIVLKANGGRKK

SEQ ID NO: 1819233 - protein, 18 aa, Staphylococcus epidermidis
KPPTVVMMVGLQGAGKTT

SEQ ID NO: 1819234 - protein, 29 aa, Staphylococcus epidermidis
KQFSEQIYNGLWFSPLTDSLKLFIDSTQQ

SEQ ID NO: 1819235 - protein, 26 aa, Staphylococcus epidermidis
KRGGKVWIKIFPHTPYTKKPLEVRMG

SEQ ID NO: 1819236 - protein, 27 aa, Staphylococcus epidermidis
KRNEILQLMMLEPKFAILDEIDSGLDI

SEQ ID NO: 1819237 - protein, 20 aa, Staphylococcus epidermidis
KTIIRGLRAVSDFEYELRLT

SEQ ID NO: 1819238 - protein, 18 aa, Staphylococcus epidermidis
KTLEQEFDFIIFDTAPTG

SEQ ID NO: 1819239 - protein, 29 aa, Staphylococcus epidermidis
KTMASITFQNYFRMYNKLAGMTGTAKTEE

SEQ ID NO: 1819240 - protein, 24 aa, Staphylococcus epidermidis
KTNIPFLINVMRNDKFRSGDYTTK

SEQ ID NO: 1819241 - protein, 24 aa, Staphylococcus epidermidis
KTTLTEKLLYFSGAIREAGTVKGK

SEQ ID NO: 1819242 - protein, 26 aa, Staphylococcus epidermidis
KTTPEKSLLQPLPKRAGRNNQGKLTV

SEQ ID NO: 1819243 - protein, 26 aa, Staphylococcus epidermidis
KVMVSDYQFDPLKNQITHIDFLAINM

SEQ ID NO: 1819244 - protein, 26 aa, Staphylococcus epidermidis
KVNLKSIMGVMSLGVGKDAEITIYAD

SEQ ID NO: 1819245 - protein, 24 aa, Staphylococcus epidermidis
KWVNQAQLLTSKKMLYIANVGEDE

SEQ ID NO: 1819246 - protein, 24 aa, Staphylococcus epidermidis
KYDLSYIALDGDIGCMVNGAGLAM

SEQ ID NO: 1819247 - protein, 21 aa, Staphylococcus epidermidis
KYKVYIIDEVHMLTTGAFNAL

SEQ ID NO: 1819248 - protein, 26 aa, Staphylococcus epidermidis
LDEETFGYVVYFFELACAMSGYQLGV

SEQ ID NO: 1819249 - protein, 26 aa, Staphylococcus epidermidis
LDKCFYKYYGLNKLINLLIKEKPDLI

SEQ ID NO: 1819250 - protein, 23 aa, Staphylococcus epidermidis
LEEFFEMYSWAQIGIHQKPIGVF

SEQ ID NO: 1819251 - protein, 25 aa, Staphylococcus epidermidis
LEGALTRLLAYSKLQGKPITTELTA

SEQ ID NO: 1819252 - protein, 20 aa, Staphylococcus epidermidis
LEIYAPLAHRLGINTIKWEL

SEQ ID NO: 1819253 - protein, 26 aa, Staphylococcus epidermidis
LFFTNKGRVYKLKGYEVPELSRQSKG

SEQ ID NO: 1819254 - protein, 19 aa, Staphylococcus epidermidis
LFQFCDSQFPTGAFSHSFG

SEQ ID NO: 1819255 - protein, 26 aa, Staphylococcus epidermidis
LGELAMIWREGCIIRAQFLQKIKDAY

SEQ ID NO: 1819256 - protein, 28 aa, Staphylococcus epidermidis
LGGEMLSFYDWYADLPPASPQIWGEQTD

SEQ ID NO: 1819257 - protein, 29 aa, Staphylococcus epidermidis
LGLIDESKLNFLWVTDWPLLEYDEDAKRY

SEQ ID NO: 1819258 - protein, 27 aa, Staphylococcus epidermidis
LGQKKFYALDMFPYPSGAGLHVGHPEG

SEQ ID NO: 1819259 - protein, 20 aa, Staphylococcus epidermidis
LGQQVIMKQTARKVRRLYEG

SEQ ID NO: 1819260 - protein, 27 aa, Staphylococcus epidermidis
LGRDRKFQAILPLRGKVINTEKARLED

SEQ ID NO: 1819261 - protein, 19 aa, Staphylococcus epidermidis
LHGMALRVPTKNVSLVDLV

SEQ ID NO: 1819262 - protein, 19 aa, Staphylococcus epidermidis
LHLKHRLFNQKLAEPIVNS

SEQ ID NO: 1819263 - protein, 20 aa, Staphylococcus epidermidis
LHYLARLIEAGDLPTIVRRL

SEQ ID NO: 1819264 - protein, 18 aa, Staphylococcus epidermidis
LIEQPDLLLLDEPTNHLD

SEQ ID NO: 1819265 - protein, 19 aa, Staphylococcus epidermidis
LIEVQALVTPTTFNNPRRM

SEQ ID NO: 1819266 - protein, 19 aa, Staphylococcus epidermidis
LILVLDFGSQYNQLITRRI

SEQ ID NO: 1819267 - protein, 25 aa, Staphylococcus epidermidis
LINTTQEVLLPESFYRGAHQHIFRA

SEQ ID NO: 1819268 - protein, 25 aa, Staphylococcus epidermidis
LIQIDTTNILFILGGAFDGIDEVIK

SEQ ID NO: 1819269 - protein, 18 aa, Staphylococcus epidermidis
LKVVIPSGPYDAKGLLIS

SEQ ID NO: 1819270 - protein, 22 aa, Staphylococcus epidermidis
LLDRIYPFRKCDNMPDKLCLYY

SEQ ID NO: 1819271 - protein, 17 aa, Staphylococcus epidermidis
LLGLIRENEGVAARVFA

SEQ ID NO: 1819272 - protein, 20 aa, Staphylococcus epidermidis
LNNLIARYRKVDEDFFEALE

SEQ ID NO: 1819273 - protein, 20 aa, Staphylococcus epidermidis
LNQAPFSFDLSVMAIYPCLT

SEQ ID NO: 1819274 - protein, 19 aa, Staphylococcus epidermidis
LPEVEGKLHGMALRVPTKN

SEQ ID NO: 1819275 - protein, 18 aa, Staphylococcus epidermidis
LQIFYSFIILKNNEVYFN

SEQ ID NO: 1819276 - protein, 22 aa, Staphylococcus epidermidis
LRDTLHFEMLWDTSKIDVIIRK

SEQ ID NO: 1819277 - protein, 18 aa, Staphylococcus epidermidis
LREKILNGLVRSCEKRPV

SEQ ID NO: 1819278 - protein, 19 aa, Staphylococcus epidermidis
LREPALGPTFGIKGGATGG

SEQ ID NO: 1819279 - protein, 25 aa, Staphylococcus epidermidis
LRKNHPKTLFVWRSNLISSSAKGQE

SEQ ID NO: 1819280 - protein, 25 aa, Staphylococcus epidermidis
LSDTMYVVPPSRLISEIPYVMKQLE

SEQ ID NO: 1819281 - protein, 24 aa, Staphylococcus epidermidis
LSRDGQVFYLYNKVQSIYEKREQL

SEQ ID NO: 1819282 - protein, 25 aa, Staphylococcus epidermidis
LTNIVLNRMRGTFTAVAVKAPGFGD

SEQ ID NO: 1819283 - protein, 25 aa, Staphylococcus epidermidis
LTPKEYELLIYLAKTPNKVFDREQL

SEQ ID NO: 1819284 - protein, 38 aa, Staphylococcus epidermidis; identical to SEQ ID NO: 1680532

SEQ ID NO: 1819285 - protein, 19 aa, Staphylococcus epidermidis
LVMKPSEITPLTTIRVFEL

SEQ ID NO: 1819286 - protein, 32 aa, Staphylococcus epidermidis; identical to SEQ ID NO: 1680534

SEQ ID NO: 1819287 - protein, 18 aa, Staphylococcus epidermidis
LYEKQLDLFLDPFDEEVI

SEQ ID NO: 1819288 - protein, 22 aa, Staphylococcus epidermidis
LYPAMEDFFLDIIIGKGDEARS

SEQ ID NO: 1819289 - protein, 17 aa, Staphylococcus epidermidis
LYRSVIMDHYKNPRNKG

SEQ ID NO: 1819290 - protein, 23 aa, Staphylococcus epidermidis
MAQDFSYRYPLVDGQGNFGSMDG

SEQ ID NO: 1819291 - protein, 23 aa, Staphylococcus epidermidis
MEKHAVSRLIGAPPGYVGHDEGG

SEQ ID NO: 1819292 - protein, 24 aa, Staphylococcus epidermidis
MGALTVGVVTRPFGFEGRKRQTQA

SEQ ID NO: 1819293 - protein, 30 aa, Staphylococcus epidermidis
MIADPEKLKHWLPVDLYIGGVEHAVLHLLY

SEQ ID NO: 1819294 - protein, 20 aa, Staphylococcus epidermidis
MIVMGFIEPFTKELPMEYAV

SEQ ID NO: 1819295 - protein, 47 aa, Staphylococcus epidermidis
MKRQSKVFRSRFRMLVEAQLDLLKSEDWDYLLNYDLDAEQVTLEDIH

SEQ ID NO: 1819296 - protein, 23 aa, Staphylococcus epidermidis
MLNAVIDYLPSPLDVKPIIGHRA

SEQ ID NO: 1819297 - protein, 28 aa, Staphylococcus epidermidis
MNFGVINILLQFVMLKEDMKLPKSYIFE

SEQ ID NO: 1819298 - protein, 18 aa, Staphylococcus epidermidis
MNIGQVLELHLGMAAKNL

SEQ ID NO: 1819299 - protein, 36 aa, Staphylococcus epidermidis; identical to SEQ ID NO: 1679643

SEQ ID NO: 1819300 - protein, 19 aa, Staphylococcus epidermidis
MSMTRGYGIINHTFEEFRP

SEQ ID NO: 1819301 - protein, 25 aa, Staphylococcus epidermidis
MVYKPTDFLVRRSGKLYFNIQDVLD

SEQ ID NO: 1819302 - protein, 19 aa, Staphylococcus epidermidis
MYPHLDGVLSLDLTTVLIL

SEQ ID NO: 1819303 - protein, 19 aa, Staphylococcus epidermidis
NAGSFLAKFLYDLGAKVVG

SEQ ID NO: 1819304 - protein, 19 aa, Staphylococcus epidermidis
NAITFLLQNIQPHQNLIVD

SEQ ID NO: 1819305 - protein, 34 aa, Staphylococcus epidermidis; identical to SEQ ID NO: 1679646

SEQ ID NO: 1819306 - protein, 24 aa, Staphylococcus epidermidis
NASSILYPILKRPDEKRVTERAYE

SEQ ID NO: 1819307 - protein, 23 aa, Staphylococcus epidermidis
NAVNQIVGYLLSGDPAYIPRQNE

SEQ ID NO: 1819308 - protein, 18 aa, Staphylococcus epidermidis
NDPELGKYWASLGDVFVN

SEQ ID NO: 1819309 - protein, 24 aa, Staphylococcus epidermidis
NDYLDKILPEAYALVREGSKRVFN

SEQ ID NO: 1819310 - protein, 26 aa, Staphylococcus epidermidis
NEEEDFVVEGPLWIQVHAFEKGVEVT

SEQ ID NO: 1819311 - protein, 24 aa, Staphylococcus epidermidis
NEPPGARMRVALSGLTMAEYFRDE

SEQ ID NO: 1819312 - protein, 25 aa, Staphylococcus epidermidis
NEREPSVLPARFPNLLVNGAAGIAV

SEQ ID NO: 1819313 - protein, 25 aa, Staphylococcus epidermidis
NEVKSLLQMLLLHAIPEPVISDKKA

SEQ ID NO: 1819314 - protein, 24 aa, Staphylococcus epidermidis
NGMKSIIKMLGTDQFKRIRIGVGR

SEQ ID NO: 1819315 - protein, 20 aa, Staphylococcus epidermidis
NIPLNVFSIMEEGNIKRAVM

SEQ ID NO: 1819316 - protein, 24 aa, Staphylococcus epidermidis
NKEAQLILQAMLVSLQTIEEEYNE

SEQ ID NO: 1819317 - protein, 24 aa, Staphylococcus epidermidis
NKVAPPFRVAEVDIMYGQGISKEG

SEQ ID NO: 1819318 - protein, 17 aa, Staphylococcus epidermidis
NLTKYLVSQLMLSNEER

SEQ ID NO: 1819319 - protein, 18 aa, Staphylococcus epidermidis
NLTQMIIVTLAEKTPYLE

SEQ ID NO: 1819320 - protein, 20 aa, Staphylococcus epidermidis
NLTYPVLIDQYQTAGLFSFS

SEQ ID NO: 1819321 - protein, 24 aa, Staphylococcus epidermidis
NNKFIISSWLGTMGCGLPGAMAAK

SEQ ID NO: 1819322 - protein, 21 aa, Staphylococcus epidermidis
NPFLSDFYDDIEKWSFQTEMF

SEQ ID NO: 1819323 - protein, 26 aa, Staphylococcus epidermidis
NRIAQTINRFGFTIRGIYGEGSQVYG

SEQ ID NO: 1819324 - protein, 29 aa, Staphylococcus epidermidis
NSEFQVIEYPLLELIVRYNDNGYETRYLA

SEQ ID NO: 1819325 - protein, 25 aa, Staphylococcus epidermidis
NTLDISAVPILKQGTHLPVMVDVTH

SEQ ID NO: 1819326 - protein, 20 aa, Staphylococcus epidermidis
NVPLIGFTGAPFTLASYMIE

SEQ ID NO: 1819327 - protein, 18 aa, Staphylococcus epidermidis
PAVEVILTVLHAGGKFGG

SEQ ID NO: 1819328 - protein, 17 aa, Staphylococcus epidermidis
PCLITIFGATGDLSHRK

SEQ ID NO: 1819329 - protein, 25 aa, Staphylococcus epidermidis
PDFATIYISYIPNIKMVESKSLKLY

SEQ ID NO: 1819330 - protein, 20 aa, Staphylococcus epidermidis
PEARIPLSQAVIELCLSPKS

SEQ ID NO: 1819331 - protein, 26 aa, Staphylococcus epidermidis
PENRVEYFVSYYDYYQPEAYVPSTDT

SEQ ID NO: 1819332 - protein, 18 aa, Staphylococcus epidermidis
PGRREIGHGALGERALRY

SEQ ID NO: 1819333 - protein, 23 aa, Staphylococcus epidermidis
PGVNQLVRVYIVQKRKIHVGDKM

SEQ ID NO: 1819334 - protein, 18 aa, Staphylococcus epidermidis
PIPEMYYLDVASPGAERP

SEQ ID NO: 1819335 - protein, 18 aa, Staphylococcus epidermidis
PKADIVLLGISRTSKTPL

SEQ ID NO: 1819336 - protein, 22 aa, Staphylococcus epidermidis
PKHVVYVWIDALVNYISSLGYL

SEQ ID NO: 1819337 - protein, 24 aa, Staphylococcus epidermidis
PLEEQSLINFLTDLSLVADIDEAD

SEQ ID NO: 1819338 - protein, 26 aa, Staphylococcus epidermidis
PLGSTPYTLLDYFGDDWLVMIDESHV

SEQ ID NO: 1819339 - protein, 21 aa, Staphylococcus epidermidis
PMAHGSHFHRAPGSVGMASDA

SEQ ID NO: 1819340 - protein, 23 aa, Staphylococcus epidermidis
PQDAALMMELGADGVFVGSGIFK

SEQ ID NO: 1819341 - protein, 20 aa, Staphylococcus epidermidis
PQFFFAYDIDKYDKGLRGFY

SEQ ID NO: 1819342 - protein, 17 aa, Staphylococcus epidermidis
PREVLIDAIEAALITAY

SEQ ID NO: 1819343 - protein, 31 aa, Staphylococcus epidermidis
PSHDGLVSMLLSVLQAPVRNFAYAVKAVGEQ

SEQ ID NO: 1819344 - protein, 22 aa, Staphylococcus epidermidis
PSKLKSIVGPFAYYIKGFEMLP

SEQ ID NO: 1819345 - protein, 21 aa, Staphylococcus epidermidis
PTGHTLRMLELPSAWTDYLNT

SEQ ID NO: 1819346 - protein, 29 aa, Staphylococcus epidermidis
PTNGLDIPAISWLEDFLINFENTVIVVSH

SEQ ID NO: 1819347 - protein, 23 aa, Staphylococcus epidermidis
PVNFGANLGLMLDLYDDYLQDPS

SEQ ID NO: 1819348 - protein, 25 aa, Staphylococcus epidermidis
PVNLHLMELLIMIDACKRASAANIN

SEQ ID NO: 1819349 - protein, 18 aa, Staphylococcus epidermidis
QALLEIYERLRPGEPPTV

SEQ ID NO: 1819350 - protein, 26 aa, Staphylococcus epidermidis
QDNPGLLRRPIILDDKRLQVGYNEDE

SEQ ID NO: 1819351 - protein, 25 aa, Staphylococcus epidermidis
QEHGLDMIVIDYLQLIQGSGSRFSD

SEQ ID NO: 1819352 - protein, 20 aa, Staphylococcus epidermidis
QGRDYFVKFNCPEFTSLCPI

SEQ ID NO: 1819353 - protein, 17 aa, Staphylococcus epidermidis
QIIFIDTPGIHKPKHKL

SEQ ID NO: 1819354 - protein, 23 aa, Staphylococcus epidermidis
QKEYYVGFVIDRATDKVTLMASE

SEQ ID NO: 1819355 - protein, 25 aa, Staphylococcus epidermidis
QNPLDFGIDIVLHSATKYIGGHSDV

SEQ ID NO: 1819356 - protein, 18 aa, Staphylococcus epidermidis
QPIVVRPIEEDMFEIIAG

SEQ ID NO: 1819357 - protein, 19 aa, Staphylococcus epidermidis
QQQGLDLQTYYQISGQNEE

SEQ ID NO: 1819358 - protein, 25 aa, Staphylococcus epidermidis
QRSADIFLGVPFNIASYALLTHLVA

SEQ ID NO: 1819359 - protein, 17 aa, Staphylococcus epidermidis
QSHLLGLSLIGVNEILA

SEQ ID NO: 1819360 - protein, 20 aa, Staphylococcus epidermidis
QSIVTLLKYNLETAGYIVEV

SEQ ID NO: 1819361 - protein, 19 aa, Staphylococcus epidermidis
QSSTLTTLILKELGVKKVT

SEQ ID NO: 1819362 - protein, 22 aa, Staphylococcus epidermidis
QVDYLEELIGKYPIITIEDGMD

SEQ ID NO: 1819363 - protein, 20 aa, Staphylococcus epidermidis
QVVVHINGGKFNGIIPISQL

SEQ ID NO: 1819364 - protein, 30 aa, Staphylococcus epidermidis; identical to SEQ ID NO: 1679991

SEQ ID NO: 1819365 - protein, 23 aa, Staphylococcus epidermidis
RANIGHNWWVVNQSLVTLNQRDD

SEQ ID NO: 1819366 - protein, 29 aa, Staphylococcus epidermidis
RDEEGQDVLLFIDNIFRFTQAGSEVSALL

SEQ ID NO: 1819367 - protein, 28 aa, Staphylococcus epidermidis
REGSKRVFNMIPYKVQVMGGIAIHKGDI

SEQ ID NO: 1819368 - protein, 19 aa, Staphylococcus epidermidis
RESFLDYAMSVIVSRALPD

SEQ ID NO: 1819369 - protein, 21 aa, Staphylococcus epidermidis
REVHHVACLLGYGANAVVPYL

SEQ ID NO: 1819370 - protein, 19 aa, Staphylococcus epidermidis
RFANAMFEPLWNNKYISNI

SEQ ID NO: 1819371 - protein, 25 aa, Staphylococcus epidermidis
RFSTNTFPSWKRAHPNRMLMHNGEI

SEQ ID NO: 1819372 - protein, 30 aa, Staphylococcus epidermidis
RGERMYEFLDKLIAVSLPRVRDFQGVSKTA

SEQ ID NO: 1819373 - protein, 22 aa, Staphylococcus epidermidis
RGTAQRILYSAFDLVEQRSGRD

SEQ ID NO: 1819374 - protein, 18 aa, Staphylococcus epidermidis
RGYQKGRFSFNVKGGRCE

SEQ ID NO: 1819375 - protein, 22 aa, Staphylococcus epidermidis
RHGTMPLTMFITKKGKQVKVNH

SEQ ID NO: 1819376 - protein, 30 aa, Staphylococcus epidermidis
RIAYFKVHHPLYYYAAYFTIRASDFDLITM

SEQ ID NO: 1819377 - protein, 22 aa, Staphylococcus epidermidis
RKIKYMFPKAHAAAYVLMAVRI

SEQ ID NO: 1819378 - protein, 19 aa, Staphylococcus epidermidis
RLGFPEARIPLSQAVIELC

SEQ ID NO: 1819379 - protein, 20 aa, Staphylococcus epidermidis
RLNVFYTTQVAIEPPTFVVF

SEQ ID NO: 1819380 - protein, 23 aa, Staphylococcus epidermidis
RMVQLRRYLHQYPELSFEEKRTH

SEQ ID NO: 1819381 - protein, 24 aa, Staphylococcus epidermidis
RNFEGRIHPLVKANYLASPQLVVA

SEQ ID NO: 1819382 - protein, 23 aa, Staphylococcus epidermidis
RNPEPLFFEIYEMSLETIIQFDH

SEQ ID NO: 1819383 - protein, 17 aa, Staphylococcus epidermidis
RPIIINFSNYELEKLFK

SEQ ID NO: 1819384 - protein, 18 aa, Staphylococcus epidermidis
RQGICDLSSVIGCRDDIM

SEQ ID NO: 1819385 - protein, 30 aa, Staphylococcus epidermidis
RRGNWSLQQLVDYFTIKPATIFNLNYGKLH

SEQ ID NO: 1819386 - protein, 25 aa, Staphylococcus epidermidis
RTTGHLMSMLVTLKGLPLAYNKDMQ

SEQ ID NO: 1819387 - protein, 30 aa, Staphylococcus epidermidis
RVANEKVRFARFRPFPFWKRVHDSFISSDD

SEQ ID NO: 1819388 - protein, 19 aa, Staphylococcus epidermidis
RVITGLKRISKPGLRVYAK

SEQ ID NO: 1819389 - protein, 21 aa, Staphylococcus epidermidis
RVNEFGFIETPYRKVDLDTNS

SEQ ID NO: 1819390 - protein, 35 aa, Staphylococcus epidermidis
RVSSVFLETFLFYSGFYYPLYLAGQGKMTTSGEII

SEQ ID NO: 1819391 - protein, 18 aa, Staphylococcus epidermidis
RWYAVHTYSGYENKVKKN

SEQ ID NO: 1819392 - protein, 21 aa, Staphylococcus epidermidis
RYGTFAKYFTKNDVPTFAICH

SEQ ID NO: 1819393 - protein, 20 aa, Staphylococcus epidermidis
RYVSDRFLPDKAIDLIDEAS

SEQ ID NO: 1819394 - protein, 24 aa, Staphylococcus epidermidis
SAAFFIVAALITPGSDITIHNVGI

SEQ ID NO: 1819395 - protein, 23 aa, Staphylococcus epidermidis
SAANINIVVPYYGYARQDRKARS

SEQ ID NO: 1819396 - protein, 30 aa, Staphylococcus epidermidis; identical to SEQ ID NO: 1680703

SEQ ID NO: 1819397 - protein, 21 aa, Staphylococcus epidermidis
SARSIIAIAVGYPNKLKGAPK

SEQ ID NO: 1819398 - protein, 24 aa, Staphylococcus epidermidis
SDNKTLGRFQLTDIPPAPRGVPQI

SEQ ID NO: 1819399 - protein, 24 aa, Staphylococcus epidermidis
SDRYITDRFLPDKAIDLVDQACAT

SEQ ID NO: 1819400 - protein, 19 aa, Staphylococcus epidermidis
SECILLFSERDKGLHEYFI

SEQ ID NO: 1819401 - protein, 23 aa, Staphylococcus epidermidis
SEHPKVRMMSFTGSGPTGSKIME

SEQ ID NO: 1819402 - protein, 24 aa, Staphylococcus epidermidis
SEKIMIRLHDLGFGPKLSMAIYQF

SEQ ID NO: 1819403 - protein, 26 aa, Staphylococcus epidermidis
SERVSYLYQPYNPSILRLVKQVIEAS

SEQ ID NO: 1819404 - protein, 23 aa, Staphylococcus epidermidis
SGKIRMNYIRILPGDKVTVEMSP

SEQ ID NO: 1819405 - protein, 24 aa, Staphylococcus epidermidis
SGKTLLAQTLAKTLNVPFAIADAT

SEQ ID NO: 1819406 - protein, 23 aa, Staphylococcus epidermidis
SGSAAIYTARKGLRTGIVADRIG

SEQ ID NO: 1819407 - protein, 28 aa, Staphylococcus epidermidis
SHEYLKQHNIHVIPLSLTIDGKSYTDQV

SEQ ID NO: 1819408 - protein, 19 aa, Staphylococcus epidermidis
SISDKLYFEPLTEEDVMNI

SEQ ID NO: 1819409 - protein, 26 aa, Staphylococcus epidermidis
SKFGHQLRFDLTKGFPLLTTKKVSFK

SEQ ID NO: 1819410 - protein, 23 aa, Staphylococcus epidermidis
SKHFEISFYLTTHSIPEAYGVIV

SEQ ID NO: 1819411 - protein, 23 aa, Staphylococcus epidermidis
SKRFEPRMFIGAISNLKNELKTP

SEQ ID NO: 1819412 - protein, 25 aa, Staphylococcus epidermidis
SKTRRHLIEFWMIEPEMAFTNHAES

SEQ ID NO: 1819413 - protein, 23 aa, Staphylococcus epidermidis
SLARFISTIRSFHQFALREKYAA

SEQ ID NO: 1819414 - protein, 32 aa, Staphylococcus epidermidis
SLGKSQSFIANKLRLLKLAPNVIKRLREGKIT

SEQ ID NO: 1819415 - protein, 29 aa, Staphylococcus epidermidis
SLLFEEMKHYFILNFPQRPGALREFVNDV

SEQ ID NO: 1819416 - protein, 32 aa, Staphylococcus epidermidis
SLQPSLDVKRMPFIGLQWIFARKGAAASNHFE

SEQ ID NO: 1819417 - protein, 38 aa, Staphylococcus epidermidis
SLRASYYMMGAMLGRFKKCVIGLPGGCPLGPRPIDQHI

SEQ ID NO: 1819418 - protein, 24 aa, Staphylococcus epidermidis
SMIRTDLEIPPFIQALTSIEEEML

SEQ ID NO: 1819419 - protein, 21 aa, Staphylococcus epidermidis
SNLLNGVTVDYYGAPTPVQQL

SEQ ID NO: 1819420 - protein, 24 aa, Staphylococcus epidermidis
SPSKDNLAMLYREGFHICKGELFG

SEQ ID NO: 1819421 - protein, 22 aa, Staphylococcus epidermidis
SQERRNLLKAYGAELVLTPGSE

SEQ ID NO: 1819422 - protein, 33 aa, Staphylococcus epidermidis
SQGDQQLMLRLIQPKYFLPIHGEYRMLKAHGET

SEQ ID NO: 1819423 - protein, 25 aa, Staphylococcus epidermidis
SSEPLSHLRVIVRSLLGIAVPTQIA

SEQ ID NO: 1819424 - protein, 24 aa, Staphylococcus epidermidis
SSKEELFNLRFQLATGQLEETARI

SEQ ID NO: 1819425 - protein, 25 aa, Staphylococcus epidermidis
STDMHPFIHPFNPAIDPLWESRSDW

SEQ ID NO: 1819426 - protein, 25 aa, Staphylococcus epidermidis
STGQLLFHLFAAFAEFERNLILERS

SEQ ID NO: 1819427 - protein, 23 aa, Staphylococcus epidermidis
SVALLAQDYYYKDQSHLTFEERL

SEQ ID NO: 1819428 - protein, 26 aa, Staphylococcus epidermidis
SVVDNTFMTPYYQNPLDFGIDIVLHS

SEQ ID NO: 1819429 - protein, 18 aa, Staphylococcus epidermidis
SVVLLDFGKKQNIVRELN

SEQ ID NO: 1819430 - protein, 23 aa, Staphylococcus epidermidis
SYCAVCDGAFFKNKRLFVIGGGD

SEQ ID NO: 1819431 - protein, 18 aa, Staphylococcus epidermidis
TAEERLLHAIFGEKAREV

SEQ ID NO: 1819432 - protein, 21 aa, Staphylococcus epidermidis
TATFMILGAVCTRACRFCAVK

SEQ ID NO: 1819433 - protein, 21 aa, Staphylococcus epidermidis
TATMPTYLNALAGRGVHVITV

SEQ ID NO: 1819434 - protein, 19 aa, Staphylococcus epidermidis
TAYIFIKMVQQMKELGVNN

SEQ ID NO: 1819435 - protein, 19 aa, Staphylococcus epidermidis
TCLGKVIGGGLPVGAFGGK

SEQ ID NO: 1819436 - protein, 24 aa, Staphylococcus epidermidis
TEFLMDHRHLWLRSKKQHAVMKIR

SEQ ID NO: 1819437 - protein, 27 aa, Staphylococcus epidermidis
TEKVRRKPYSVILFDEIEKAHPDVFNI

SEQ ID NO: 1819438 - protein, 30 aa, Staphylococcus epidermidis; identical to SEQ ID NO: 1680760

SEQ ID NO: 1819439 - protein, 21 aa, Staphylococcus epidermidis
TFHSMCVRILRRDADRIGIER

SEQ ID NO: 1819440 - protein, 26 aa, Staphylococcus epidermidis
TGIKVVDLLAPYIKGGKIGLFGGAGV

SEQ ID NO: 1819441 - protein, 21 aa, Staphylococcus epidermidis
TGPVTILNWSFERVDVPRKVV

SEQ ID NO: 1819442 - protein, 24 aa, Staphylococcus epidermidis
TGVEMFRKLLDYAEAGDNIGALLR

SEQ ID NO: 1819443 - protein, 18 aa, Staphylococcus epidermidis
THQSIDNASLLRSSTKYS

SEQ ID NO: 1819444 - protein, 24 aa, Staphylococcus epidermidis
TIKEYLIAVKGPLTTPIGGGIRSL

SEQ ID NO: 1819445 - protein, 19 aa, Staphylococcus epidermidis
TIRIAPRKVRLVLDLIRGK

SEQ ID NO: 1819446 - protein, 21 aa, Staphylococcus epidermidis
TMERFVAFLTEETKGAFPTWL

SEQ ID NO: 1819447 - protein, 17 aa, Staphylococcus epidermidis
TMFITKKGKQVKVNHLE

SEQ ID NO: 1819448 - protein, 20 aa, Staphylococcus epidermidis
TPQQLINIRPVIASIKEFFG

SEQ ID NO: 1819449 - protein, 29 aa, Staphylococcus epidermidis
TRIMDLVTPIGLGQRGLIVAPPKAGKTSL

SEQ ID NO: 1819450 - protein, 22 aa, Staphylococcus epidermidis
TRLARAYNLVIPPSGRTLSGGL

SEQ ID NO: 1819451 - protein, 30 aa, Staphylococcus epidermidis
TSHSELTYLTFVYKVAAMDFIFKDDPSELK

SEQ ID NO: 1819452 - protein, 24 aa, Staphylococcus epidermidis
TSKTPLSMYLANKGYKIANIPLVP

SEQ ID NO: 1819453 - protein, 32 aa, Staphylococcus epidermidis; identical to SEQ ID NO: 1681603

SEQ ID NO: 1819454 - protein, 27 aa, Staphylococcus epidermidis
TTTGRPRRVGWFDSVVLRHSRRVSGIT

SEQ ID NO: 1819455 - protein, 24 aa, Staphylococcus epidermidis
TTTTERILYYTGRIHKIGETHEGA

SEQ ID NO: 1819456 - protein, 26 aa, Staphylococcus epidermidis
TVERARRIQFFLSQNFHVAEQFTGQK

SEQ ID NO: 1819457 - protein, 19 aa, Staphylococcus epidermidis
TVVTVLPSNGERYLSTPLY

SEQ ID NO: 1819458 - protein, 25 aa, Staphylococcus epidermidis
VAGAKYRGEFEERLKAVLKEVKESE

SEQ ID NO: 1819459 - protein, 49 aa, Staphylococcus epidermidis
VDGAHIRTLLLTFFYRFMRPLIEAGYVYIAQPPLYKLTQGKQKYYVFND

SEQ ID NO: 1819460 - protein, 25 aa, Staphylococcus epidermidis
VDKIYGTHLWSGYPSGTIYSRPGAI

SEQ ID NO: 1819461 - protein, 26 aa, Staphylococcus epidermidis
VDQLEQPIRLEPMSTFPVIRDLQVDR

SEQ ID NO: 1819462 - protein, 17 aa, Staphylococcus epidermidis
VFPLLHGPNGEDGTIQG

SEQ ID NO: 1819463 - protein, 18 aa, Staphylococcus epidermidis
VFQEINQIIVKPLDEIYA

SEQ ID NO: 1819464 - protein, 22 aa, Staphylococcus epidermidis
VGKIIFNEIIPDSFAYINEPSQ

SEQ ID NO: 1819465 - protein, 23 aa, Staphylococcus epidermidis
VGKSTLFNAITKAGALAANYPFA

SEQ ID NO: 1819466 - protein, 22 aa, Staphylococcus epidermidis
VGKTEIARRMAKIVGAPFIKVE

SEQ ID NO: 1819467 - protein, 24 aa, Staphylococcus epidermidis
VGYDTMSQIRWLSVLNLKDKSEDQ

SEQ ID NO: 1819468 - protein, 26 aa, Staphylococcus epidermidis
VIEGNSGLFVAMPSKRTPDGEFRDIA

SEQ ID NO: 1819469 - protein, 18 aa, Staphylococcus epidermidis
VIKMGRYGKFMACSNFPD

SEQ ID NO: 1819470 - protein, 19 aa, Staphylococcus epidermidis
VILTVLHAGGKFGGGGYKV

SEQ ID NO: 1819471 - protein, 20 aa, Staphylococcus epidermidis
VKPPVIYGDVKWTAPLTVKE

SEQ ID NO: 1819472 - protein, 25 aa, Staphylococcus epidermidis
VNNKDWLGQISLISFLRDYGKHVGV

SEQ ID NO: 1819473 - protein, 24 aa, Staphylococcus epidermidis
VNQYAVFQYPPYDITLSTKISDVI

SEQ ID NO: 1819474 - protein, 29 aa, Staphylococcus epidermidis
VNYAEERVMRPLHFAIIDEVDSILIDEAR

SEQ ID NO: 1819475 - protein, 23 aa, Staphylococcus epidermidis
VPNATFMMIYDADRFGLSTLHQL

SEQ ID NO: 1819476 - protein, 23 aa, Staphylococcus epidermidis
VQEAQTRHYTWPTASAAMGRTMT

SEQ ID NO: 1819477 - protein, 35 aa, Staphylococcus epidermidis
VRALGIELGIPEHLVWRQPFPGPGLGIRVLGEITE

SEQ ID NO: 1819478 - protein, 26 aa, Staphylococcus epidermidis
VRIASPEFMFPSFYGIDVSTTAELIS

SEQ ID NO: 1819479 - protein, 26 aa, Staphylococcus epidermidis
VRPERRTTLGLRWLVNYARLRGEKTM

SEQ ID NO: 1819480 - protein, 19 aa, Staphylococcus epidermidis
VSALKNGYYADTGISFVVG

SEQ ID NO: 1819481 - protein, 29 aa, Staphylococcus epidermidis
VSFKLVATELLWFIKGDTNIQYLLKYNNN

SEQ ID NO: 1819482 - protein, 17 aa, Staphylococcus epidermidis
VSQLLFLQAQDSEKDIY

SEQ ID NO: 1819483 - protein, 21 aa, Staphylococcus epidermidis
VSVATFTLAVNRTFTNAQGER

SEQ ID NO: 1819484 - protein, 24 aa, Staphylococcus epidermidis
VTDKEKILVLGSGPIRIGQGVEFD

SEQ ID NO: 1819485 - protein, 17 aa, Staphylococcus epidermidis
VVDSIQTIYHPEISSAP

SEQ ID NO: 1819486 - protein, 19 aa, Staphylococcus epidermidis
VVEILGREPNFTEVGIFSV

SEQ ID NO: 1819487 - protein, 26 aa, Staphylococcus epidermidis
VYEDRSFTFITKTPPAPVLLKKAAGV

SEQ ID NO: 1819488 - protein, 25 aa, Staphylococcus epidermidis
VYLVDRVIPMIPHRLSNGICSLNPE

SEQ ID NO: 1819489 - protein, 30 aa, Staphylococcus epidermidis
VYVRIDRTRKLPLTVLLRALGFSTDQEIVD

SEQ ID NO: 1819490 - protein, 18 aa, Staphylococcus epidermidis
WAPLFFRGREVSGKTIGI

SEQ ID NO: 1819491 - protein, 19 aa, Staphylococcus epidermidis
WLNCGYNRWNHNEPLVGQT

SEQ ID NO: 1819492 - protein, 17 aa, Staphylococcus epidermidis
WLVMIDESHVTLPQIRG

SEQ ID NO: 1819493 - protein, 24 aa, Staphylococcus epidermidis
WNPKMKKYIFTERNGIYIIDLQKT

SEQ ID NO: 1819494 - protein, 30 aa, Staphylococcus epidermidis; identical to SEQ ID NO: 1701024

SEQ ID NO: 1819495 - protein, 29 aa, Staphylococcus epidermidis
YAAFEPTLDYVISKIPRFPFDKFEKGERE

SEQ ID NO: 1819496 - protein, 25 aa, Staphylococcus epidermidis
YANDLLTTPVNLAGLPGISVPCGQS

SEQ ID NO: 1819497 - protein, 17 aa, Staphylococcus epidermidis
YARVNEFGFIETPYRKV

SEQ ID NO: 1819498 - protein, 20 aa, Staphylococcus epidermidis
YATISFLNWFLDEQVEEEST

SEQ ID NO: 1819499 - protein, 31 aa, Staphylococcus epidermidis
YEETKHLNTPFFIGIMPIASYNNALFLHNEV

SEQ ID NO: 1819500 - protein, 21 aa, Staphylococcus epidermidis
YEPSMQYFNEWWKQLYGESEG

SEQ ID NO: 1819501 - protein, 17 aa, Staphylococcus epidermidis
YGDVKWTAPLTVKETVY

SEQ ID NO: 1819502 - protein, 20 aa, Staphylococcus epidermidis
YGFNIIIAGSFSDIFYMNCT

SEQ ID NO: 1819503 - protein, 19 aa, Staphylococcus epidermidis
YGRVSRFGLVAFASSLDQI

SEQ ID NO: 1819504 - protein, 30 aa, Staphylococcus epidermidis; identical to SEQ ID NO: 1681631

SEQ ID NO: 1819505 - protein, 21 aa, Staphylococcus epidermidis
YHKVIFLDTTTNFKFLSGSTK

SEQ ID NO: 1819506 - protein, 23 aa, Staphylococcus epidermidis
YKHSKPFLKQFPTTGEHVLMGPG

SEQ ID NO: 1819507 - protein, 18 aa, Staphylococcus epidermidis
YLEHMKLYRSFREEVPEE

SEQ ID NO: 1819508 - protein, 19 aa, Staphylococcus epidermidis
YLISQRLVKKSLDDGYLVG

SEQ ID NO: 1819509 - protein, 26 aa, Staphylococcus epidermidis
YLKAEKGVHRLVRISPFDSSGRRHTS

SEQ ID NO: 1819510 - protein, 17 aa, Staphylococcus epidermidis
YLKIKSEYDDCLLFFRL

SEQ ID NO: 1819511 - protein, 17 aa, Staphylococcus epidermidis
YMKIGLASPEKIRSWSY

SEQ ID NO: 1819512 - protein, 24 aa, Staphylococcus epidermidis
YRKMLEFYHPEFKKEYVVLAEEGA

SEQ ID NO: 1819513 - protein, 21 aa, Staphylococcus epidermidis
YRYGNRKFWCKGFYVDTVGRN

SEQ ID NO: 1819514 - protein, 17 aa, Staphylococcus epidermidis
YSKYFEQVYQPPSLKEA

SEQ ID NO: 1819515 - protein, 25 aa, Staphylococcus epidermidis
YSSVMFDYGILKRPQFFFAYDIDKY

SEQ ID NO: 1819516 - protein, 26 aa, Staphylococcus epidermidis
YSYYLDLRRYGSVPHSGFGLGLERTV

SEQ ID NO: 1819517 - protein, 24 aa, Staphylococcus epidermidis
YTGQIITFTYPLIGNYGINRDDFE

SEQ ID NO: 1819518 - protein, 27 aa, Staphylococcus epidermidis
YTRVLNEGLPLPDLIIVDGGKGHMNGV

SEQ ID NO: 1819519 - protein, 18 aa, Staphylococcus epidermidis
YVMLGAGLVAKKAVEKGL

SEQ ID NO: 1819520 - protein, 24 aa, Staphylococcus epidermidis
AADPAPLLYIAPYSGVTMGEEFMF

SEQ ID NO: 1819521 - protein, 24 aa, Staphylococcus epidermidis
AAGLFAASFLNKNISRLGSLAAIS

SEQ ID NO: 1819522 - protein, 20 aa, Staphylococcus epidermidis
AAKRKLSVFLYSVNDLTEFN

SEQ ID NO: 1819523 - protein, 40 aa, Staphylococcus epidermidis
AAVDLKVILEYGESAPKIFRKVTDLVKEQVKYITGLEVVE

SEQ ID NO: 1819524 - protein, 22 aa, Staphylococcus epidermidis
ACEYRRHFLSYHPDYAIMTNID

SEQ ID NO: 1819525 - protein, 29 aa, Staphylococcus epidermidis
ACLLTAVPVMKIFKYFYSNRGPVIDYNNK

SEQ ID NO: 1819526 - protein, 30 aa, Staphylococcus epidermidis
ADAAWITTPLNIFYFTGYRSEPHERLFALL

SEQ ID NO: 1819527 - protein, 17 aa, Staphylococcus epidermidis
ADKGLIYKGKKPVYWSP

SEQ ID NO: 1819528 - protein, 23 aa, Staphylococcus epidermidis
ADKMKSWYERFGFGKKTGGMFDG

SEQ ID NO: 1819529 - protein, 23 aa, Staphylococcus epidermidis
ADQALLQRLDLMKFQLEELTEAS

SEQ ID NO: 1819530 - protein, 19 aa, Staphylococcus epidermidis
ADRILHLIKVQMDNLTLPS

SEQ ID NO: 1819531 - protein, 20 aa, Staphylococcus epidermidis
ADYALTPDIAIVDPQFVLSV

SEQ ID NO: 1819532 - protein, 26 aa, Staphylococcus epidermidis
AEAERLVIHGFLDPVVRELPIDDVKR

SEQ ID NO: 1819533 - protein, 23 aa, Staphylococcus epidermidis
AEEFGFATAPLVVLGCIMMRVCH

SEQ ID NO: 1819534 - protein, 19 aa, Staphylococcus epidermidis
AEELVIIEKPMRAYSEHSD

SEQ ID NO: 1819535 - protein, 27 aa, Staphylococcus epidermidis
AEIDNLIWYFSELFKNELKIAMGPIER

SEQ ID NO: 1819536 - protein, 23 aa, Staphylococcus epidermidis
AEKISDFLSLIGGYQALLKFEDV

SEQ ID NO: 1819537 - protein, 35 aa, Staphylococcus epidermidis; identical to SEQ ID NO: 1679734

SEQ ID NO: 1819538 - protein, 17 aa, Staphylococcus epidermidis
AESGIGGLALGLAVTGF

SEQ ID NO: 1819539 - protein, 37 aa, Staphylococcus epidermidis
AETVINAHWFDGVFYIPNCDKITPGMLLAAVRTNVPA

SEQ ID NO: 1819540 - protein, 28 aa, Staphylococcus epidermidis
AEYLQVDAPYYIEYLDYFATSKGEKDTS

SEQ ID NO: 1819541 - protein, 18 aa, Staphylococcus epidermidis
AFEHDFPYELTPDQSKSI

SEQ ID NO: 1819542 - protein, 18 aa, Staphylococcus epidermidis
AFKHRKRPATAKPVLLGI

SEQ ID NO: 1819543 - protein, 32 aa, Staphylococcus epidermidis
AFKVMTDPYVGKLTFFRVYSGTLSSGSYVKNS

SEQ ID NO: 1819544 - protein, 22 aa, Staphylococcus epidermidis
AGASKIFVFDLSEERLAKAKSV

SEQ ID NO: 1819545 - protein, 18 aa, Staphylococcus epidermidis
AGFHIHFANDDRDFGGHI

SEQ ID NO: 1819546 - protein, 20 aa, Staphylococcus epidermidis
AGKMSEWFEKEQPIYIEIGS

SEQ ID NO: 1819547 - protein, 23 aa, Staphylococcus epidermidis
AGLVTPWNFPTNQTSLKLAAAFA

SEQ ID NO: 1819548 - protein, 26 aa, Staphylococcus epidermidis
AGYQNIPIMSYGIKYASSFFGPFRDA

SEQ ID NO: 1819549 - protein, 19 aa, Staphylococcus epidermidis
AHNISFDLNFIKKAFEKCN

SEQ ID NO: 1819550 - protein, 23 aa, Staphylococcus epidermidis
AHTNIALIKYWGKADETYIIPMN

SEQ ID NO: 1819551 - protein, 18 aa, Staphylococcus epidermidis
AIDYWKDDIAAVLVEPIV

SEQ ID NO: 1819552 - protein, 17 aa, Staphylococcus epidermidis
AIGQALLAKRMGKTKLV

SEQ ID NO: 1819553 - protein, 26 aa, Staphylococcus epidermidis
AIMASFHFDVPCLFAKKAKPSTLKDG

SEQ ID NO: 1819554 - protein, 18 aa, Staphylococcus epidermidis
AIPGTPPDLLHPPIGDAF

SEQ ID NO: 1819555 - protein, 24 aa, Staphylococcus epidermidis
AIPSDLAREISQQLTIPVIGIGAG

SEQ ID NO: 1819556 - protein, 17 aa, Staphylococcus epidermidis
AIVIISHDRYFLDKIVT

SEQ ID NO: 1819557 - protein, 23 aa, Staphylococcus epidermidis
AKAEHLLQYAQLGNIYAQKIRGI

SEQ ID NO: 1819558 - protein, 19 aa, Staphylococcus epidermidis
AKEQGYCAIFVNNHPQYFE

SEQ ID NO: 1819559 - protein, 17 aa, Staphylococcus epidermidis
AKIPLVVRTVHGAGASA

SEQ ID NO: 1819560 - protein, 17 aa, Staphylococcus epidermidis
AKKIGYPVIIKATAGGG

SEQ ID NO: 1819561 - protein, 23 aa, Staphylococcus epidermidis
AKRLLDFGVHPPTIYFPLNVEEG

SEQ ID NO: 1819562 - protein, 20 aa, Staphylococcus epidermidis
AKTFLNKLYGGDMKSLVLNF

SEQ ID NO: 1819563 - protein, 23 aa, Staphylococcus epidermidis
AKVFFSSIGFENLAFEKNASKIG

SEQ ID NO: 1819564 - protein, 27 aa, Staphylococcus epidermidis
AKWGERSGLTLFLPHAFEGQGPEHSSA

SEQ ID NO: 1819565 - protein, 25 aa, Staphylococcus epidermidis
ALAAKDIRIEAPIPGTSLVGIEVPN

SEQ ID NO: 1819566 - protein, 21 aa, Staphylococcus epidermidis
ALGFGYRTGFLGMLHMEIIQE

SEQ ID NO: 1819567 - protein, 32 aa, Staphylococcus epidermidis
ALNEFYGLELSNLYIYKLAVIANMKLQSLSSC

SEQ ID NO: 1819568 - protein, 20 aa, Staphylococcus epidermidis
ALSMWMTLKCGIVNLPYGGG

SEQ ID NO: 1819569 - protein, 20 aa, Staphylococcus epidermidis
ALVKALQTWNIDHLYGIPGD

SEQ ID NO: 1819570 - protein, 27 aa, Staphylococcus epidermidis
AMDNKNVKRLIFVAAPGIYDELPEPFN

SEQ ID NO: 1819571 - protein, 38 aa, Staphylococcus epidermidis
AMINRLNLFKAYHYQAKILLLAWNRYLTQTASQYINSE

SEQ ID NO: 1819572 - protein, 26 aa, Staphylococcus epidermidis
ANALETLRRYCFDRAFIGMNGIDVKY

SEQ ID NO: 1819573 - protein, 30 aa, Staphylococcus epidermidis
ANGLKCVMIAKLPFMNKHNIKYWLMDSEFT

SEQ ID NO: 1819574 - protein, 18 aa, Staphylococcus epidermidis
ANHKPVVYCLDKIAKTYL

SEQ ID NO: 1819575 - protein, 25 aa, Staphylococcus epidermidis
APAVLGIYPHTVFELAKRVIPSEKV

SEQ ID NO: 1819576 - protein, 23 aa, Staphylococcus epidermidis
APHEALLCLDATTGQNALSQARS

SEQ ID NO: 1819577 - protein, 22 aa, Staphylococcus epidermidis
APVLALSLSFDHRQIDGATGQN

SEQ ID NO: 1819578 - protein, 24 aa, Staphylococcus epidermidis
AQANSLCVALIHKPIVLTHESQVE

SEQ ID NO: 1819579 - protein, 24 aa, Staphylococcus epidermidis
AQRLKLIRHLNSSLSDLVYIIDEP

SEQ ID NO: 1819580 - protein, 23 aa, Staphylococcus epidermidis
AQYQRILKQKNNYLKQLQIGQKT

SEQ ID NO: 1819581 - protein, 20 aa, Staphylococcus epidermidis
AQYVWHPFTQMGVYAKNDNI

SEQ ID NO: 1819582 - protein, 18 aa, Staphylococcus epidermidis
ARENNLKIIASCPFAKNV

SEQ ID NO: 1819583 - protein, 24 aa, Staphylococcus epidermidis
ARLTNFGAFIDIGGVDGLVHVSEL

SEQ ID NO: 1819584 - protein, 20 aa, Staphylococcus epidermidis
ARRIYSLIKRIFNVEVEILV

SEQ ID NO: 1819585 - protein, 21 aa, Staphylococcus epidermidis
ARTVMHFHPALAPYKAAVLPL

SEQ ID NO: 1819586 - protein, 28 aa, Staphylococcus epidermidis
ASDNTTMPAFWFDPIINLSAIAQVTSHI

SEQ ID NO: 1819587 - protein, 17 aa, Staphylococcus epidermidis
ASNATIHRFTRKLGFDG

SEQ ID NO: 1819588 - protein, 44 aa, Staphylococcus epidermidis
ASQKSMYLLWKVNPKDTVYNIPFLWRLSSELNVMQLQRALSKLI

SEQ ID NO: 1819589 - protein, 19 aa, Staphylococcus epidermidis
ASSILLDPEYGLPASDARN

SEQ ID NO: 1819590 - protein, 24 aa, Staphylococcus epidermidis
ATAKQLFIPLTVGGGIQNLDDITQ

SEQ ID NO: 1819591 - protein, 19 aa, Staphylococcus epidermidis
ATEYRFFLKGLSSHVADKE

SEQ ID NO: 1819592 - protein, 26 aa, Staphylococcus epidermidis
ATGIRIGFLLGPEYLIEKLTFMHAYN

SEQ ID NO: 1819593 - protein, 23 aa, Staphylococcus epidermidis
ATGKSEIIAFKKSFHGRTYGAMS

SEQ ID NO: 1819594 - protein, 25 aa, Staphylococcus epidermidis
ATGSKAFVLPIPGSNLPSVIGWRTI

SEQ ID NO: 1819595 - protein, 31 aa, Staphylococcus epidermidis
ATGVVNLVNFYYPKLTFKSSILQLIKDNQVT

SEQ ID NO: 1819596 - protein, 25 aa, Staphylococcus epidermidis
ATLQDRRKAFQFAYLSLLQEENIQA

SEQ ID NO: 1819597 - protein, 19 aa, Staphylococcus epidermidis
ATPDMMGEVGKLGRVLGPK

SEQ ID NO: 1819598 - protein, 22 aa, Staphylococcus epidermidis
AVDIMFDVLQRCYKSEFKSWEP

SEQ ID NO: 1819599 - protein, 23 aa, Staphylococcus epidermidis
AVDRELPYHLAIKQLKQLDENFG

SEQ ID NO: 1819600 - protein, 24 aa, Staphylococcus epidermidis
AVLPLYDTFYDGKIKHILARHEQG

SEQ ID NO: 1819601 - protein, 26 aa, Staphylococcus epidermidis
AVQYNLPMTIFVLNNKQLSFIKYEQQ

SEQ ID NO: 1819602 - protein, 18 aa, Staphylococcus epidermidis
AVRRNPYSVILLDEVEKA

SEQ ID NO: 1819603 - protein, 21 aa, Staphylococcus epidermidis
AVSVYSGWLAYSTFDHDWVKQ

SEQ ID NO: 1819604 - protein, 20 aa, Staphylococcus epidermidis
AVVAVPLWLENSMYGVLLLG

SEQ ID NO: 1819605 - protein, 18 aa, Staphylococcus epidermidis
AVVLVLEAIPSDLAREIS

SEQ ID NO: 1819606 - protein, 18 aa, Staphylococcus epidermidis
AYEMGVSKAFKPIMENTL

SEQ ID NO: 1819607 - protein, 21 aa, Staphylococcus epidermidis
AYGINLRPLLTLAEKYYDAEN

SEQ ID NO: 1819608 - protein, 24 aa, Staphylococcus epidermidis
AYNHQLLIMGYKEVVHNQDFVAIE

SEQ ID NO: 1819609 - protein, 18 aa, Staphylococcus epidermidis
AYPIDYIENIVTPSKAAH

SEQ ID NO: 1819610 - protein, 22 aa, Staphylococcus epidermidis
AYVPLSEMFGYATSLRSNTQGR

SEQ ID NO: 1819611 - protein, 17 aa, Staphylococcus epidermidis
CCSTFLGDFEPVSIKMA

SEQ ID NO: 1819612 - protein, 32 aa, Staphylococcus epidermidis
CDKIMVVANLPYYITTPILLNLMQQDVPIDGF

SEQ ID NO: 1819613 - protein, 23 aa, Staphylococcus epidermidis
CDKKALYRTLSVSLTQFIKESDR

SEQ ID NO: 1819614 - protein, 17 aa, Staphylococcus epidermidis
CFNCDHHIALTAYKRIE

SEQ ID NO: 1819615 - protein, 20 aa, Staphylococcus epidermidis
CFNGAFDLILKQNKVRDAEP

SEQ ID NO: 1819616 - protein, 22 aa, Staphylococcus epidermidis
CGTTYHLVFNPPKVDGICDIDG

SEQ ID NO: 1819617 - protein, 26 aa, Staphylococcus epidermidis
CKEMYDYPYVIFYKGNPQFFNHSHSL

SEQ ID NO: 1819618 - protein, 25 aa, Staphylococcus epidermidis
CTEHRLPFILFSASGGARMQEGIIS

SEQ ID NO: 1819619 - protein, 21 aa, Staphylococcus epidermidis
DAARYFLTMRSPDSHFDFDLE

SEQ ID NO: 1819620 - protein, 32 aa, Staphylococcus epidermidis
DADLLIMAGTNYPYVNYLPKKNIKAIQIDTNE

SEQ ID NO: 1819621 - protein, 32 aa, Staphylococcus epidermidis
DAEKDLVETVLPYRPLFIKPNKDELEVMFNTT

SEQ ID NO: 1819622 - protein, 25 aa, Staphylococcus epidermidis
DAFGAYLHMGGRIGVLTVVEGTTDE

SEQ ID NO: 1819623 - protein, 22 aa, Staphylococcus epidermidis
DAKIVIQGFGNAGSFLAKFLYD

SEQ ID NO: 1819624 - protein, 17 aa, Staphylococcus epidermidis
DALELFIELTGVNYNIV

SEQ ID NO: 1819625 - protein, 23 aa, Staphylococcus epidermidis
DARYKNWFPNFTLSDLISDNTAT

SEQ ID NO: 1819626 - protein, 23 aa, Staphylococcus epidermidis
DATGYINHLLQLIGPSISQQQGY

SEQ ID NO: 1819627 - protein, 18 aa, Staphylococcus epidermidis
DAYLTQFPGIGKKTARQI

SEQ ID NO: 1819628 - protein, 22 aa, Staphylococcus epidermidis
DAYYGLFYEEVYQQSIFTALTQ

SEQ ID NO: 1819629 - protein, 26 aa, Staphylococcus epidermidis
DDAKKGFLLDGFPRTIDQAESLSQIM

SEQ ID NO: 1819630 - protein, 23 aa, Staphylococcus epidermidis
DDDKLYVPVIKNADEKSIKGIAR

SEQ ID NO: 1819631 - protein, 22 aa, Staphylococcus epidermidis
DDDLFHIRTLGFRGEALASISS

SEQ ID NO: 1819632 - protein, 17 aa, Staphylococcus epidermidis
DDIIVFHKLTKDELKEI

SEQ ID NO: 1819633 - protein, 24 aa, Staphylococcus epidermidis
DDIKFLLDAIYIDEAAFIGHEMGA

SEQ ID NO: 1819634 - protein, 24 aa, Staphylococcus epidermidis
DDNPDYTPFINYVNDVFLQEGDLQ

SEQ ID NO: 1819635 - protein, 24 aa, Staphylococcus epidermidis
DDTTFVVINSTCGCAAGLARPAAV

SEQ ID NO: 1819636 - protein, 27 aa, Staphylococcus epidermidis
DDTTLEPMVLPARFPNLLINGSTGISS

SEQ ID NO: 1819637 - protein, 21 aa, Staphylococcus epidermidis
DDWTFPPFELTDKDGKLFGRG

SEQ ID NO: 1819638 - protein, 17 aa, Staphylococcus epidermidis
DDYRKMFEPITTAQAYI

SEQ ID NO: 1819639 - protein, 22 aa, Staphylococcus epidermidis
DEDIDIFFASNQVLFRVGNINF

SEQ ID NO: 1819640 - protein, 27 aa, Staphylococcus epidermidis
DEDVIKFLKYFTFLEKEEINRLEQSKN

SEQ ID NO: 1819641 - protein, 27 aa, Staphylococcus epidermidis
DEGKIEWLLPFLSNSGPTIIYVSSKKR

SEQ ID NO: 1819642 - protein, 17 aa, Staphylococcus epidermidis
DEKTLYRVAYQFETQYN

SEQ ID NO: 1819643 - protein, 27 aa, Staphylococcus epidermidis
DEKVKGLYLYGPFGTGKSFILGAIANQ

SEQ ID NO: 1819644 - protein, 26 aa, Staphylococcus epidermidis
DESTKQYYFHLFSKKQPDLNWENPDV

SEQ ID NO: 1819645 - protein, 23 aa, Staphylococcus epidermidis
DFDSNLIFVGLANTLLISEAELV

SEQ ID NO: 1819646 - protein, 18 aa, Staphylococcus epidermidis
DFDVVVATPDMMGEVGKL

SEQ ID NO: 1819647 - protein, 20 aa, Staphylococcus epidermidis
DFETIFRLSQDRPTIVRLLD

SEQ ID NO: 1819648 - protein, 23 aa, Staphylococcus epidermidis
DFSTGWIFYIDEEGHHDLVSSVD

SEQ ID NO: 1819649 - protein, 31 aa, Staphylococcus epidermidis
DGDAFAQFFKLMLNQGINLAPSKFEAWFLTT

SEQ ID NO: 1819650 - protein, 25 aa, Staphylococcus epidermidis
DGDDIYYNLDISFSQAALGDEIKIP

SEQ ID NO: 1819651 - protein, 25 aa, Staphylococcus epidermidis
DGFIVFNGIRIINTKDLVLPGEHNL

SEQ ID NO: 1819652 - protein, 24 aa, Staphylococcus epidermidis
DGFLLNFNDWAPNLYHFLNLKQFR

SEQ ID NO: 1819653 - protein, 28 aa, Staphylococcus epidermidis
DGIHERIAVFDLYFRKMPFNSGYAVFNG

SEQ ID NO: 1819654 - protein, 19 aa, Staphylococcus epidermidis
DGIYIDVFCSLKHGVNISK

SEQ ID NO: 1819655 - protein, 23 aa, Staphylococcus epidermidis
DGKFQGDTFFPPYTFENWEVESS

SEQ ID NO: 1819656 - protein, 28 aa, Staphylococcus epidermidis
DGLNVPNEPIIPFIIGDGIGPDIWKAAS

SEQ ID NO: 1819657 - protein, 20 aa, Staphylococcus epidermidis
DGNKYIDYLQAYGPIITGHA

SEQ ID NO: 1819658 - protein, 17 aa, Staphylococcus epidermidis
DGPDRIAGFTPIPAMSM

SEQ ID NO: 1819659 - protein, 21 aa, Staphylococcus epidermidis
DGQYLVGKFPPGIKYDFEKVF

SEQ ID NO: 1819660 - protein, 26 aa, Staphylococcus epidermidis
DGRFLNVGENLWGLRDWYSVDDIEEK

SEQ ID NO: 1819661 - protein, 17 aa, Staphylococcus epidermidis
DGRYIEVIGISIGGGTI

SEQ ID NO: 1819662 - protein, 19 aa, Staphylococcus epidermidis
DGRYLLFQPNDGGLSQIGP

SEQ ID NO: 1819663 - protein, 26 aa, Staphylococcus epidermidis
DGWYSLHLFYAVDWTTFRLIAEDDRE

SEQ ID NO: 1819664 - protein, 30 aa, Staphylococcus epidermidis
DHDGTKLGFMSFFTKAAVAALKKYPEVNAE

SEQ ID NO: 1819665 - protein, 24 aa, Staphylococcus epidermidis
DHHSRRGLLKMVGRRRHLLNYLRS

SEQ ID NO: 1819666 - protein, 25 aa, Staphylococcus epidermidis
DHLSRTTGFDGWAPLFFRGREVSGK

SEQ ID NO: 1819667 - protein, 21 aa, Staphylococcus epidermidis
DHRDPLPVLRIDEPTLEMTFK

SEQ ID NO: 1819668 - protein, 24 aa, Staphylococcus epidermidis
DHRLSPDVYLKWYKKSPCTVDIQK

SEQ ID NO: 1819669 - protein, 25 aa, Staphylococcus epidermidis
DHTREYIPLLMFSPKIKDYHELSQD

SEQ ID NO: 1819670 - protein, 17 aa, Staphylococcus epidermidis
DIAPIFGLNKRQGKQLL

SEQ ID NO: 1819671 - protein, 17 aa, Staphylococcus epidermidis
DIEVSIMDFDRDEWATP

SEQ ID NO: 1819672 - protein, 23 aa, Staphylococcus epidermidis
DIGMLLYNYVPQNKWSQWFKTYG

SEQ ID NO: 1819673 - protein, 30 aa, Staphylococcus epidermidis
DIHDQKVLHIPSPLWKVMDFMILDKEEEHR

SEQ ID NO: 1819674 - protein, 20 aa, Staphylococcus epidermidis
DIKRVIAHLPNFESDTDTFV

SEQ ID NO: 1819675 - protein, 19 aa, Staphylococcus epidermidis
DILFEVMNQCRCTSKENME

SEQ ID NO: 1819676 - protein, 18 aa, Staphylococcus epidermidis
DIPTVELIIRRCKENGLM

SEQ ID NO: 1819677 - protein, 27 aa, Staphylococcus epidermidis
DIRDENTWMLFGTLPIYPCLNDEYDQH

SEQ ID NO: 1819678 - protein, 24 aa, Staphylococcus epidermidis
DISNYVLLEYGQPLHMFDQEQIGS

SEQ ID NO: 1819679 - protein, 24 aa, Staphylococcus epidermidis
DIVSIGARPINLLNSLRFGELTVK

SEQ ID NO: 1819680 - protein, 27 aa, Staphylococcus epidermidis
DKDFVIHTPLMWLDKAQTWALSDKLGV

SEQ ID NO: 1819681 - protein, 32 aa, Staphylococcus epidermidis
DKEADLILFGHNHRLHMFDDKSTVYFNPGSVG

SEQ ID NO: 1819682 - protein, 25 aa, Staphylococcus epidermidis
DKFEVENIFDLALLTILKGHIAVEG

SEQ ID NO: 1819683 - protein, 24 aa, Staphylococcus epidermidis
DKNNPLLEKLNFISIFSSNLDEFF

SEQ ID NO: 1819684 - protein, 18 aa, Staphylococcus epidermidis
DLALKQEVDFIIIAGDLF

SEQ ID NO: 1819685 - protein, 18 aa, Staphylococcus epidermidis
DLDSLKLAFEKYGDDIAG

SEQ ID NO: 1819686 - protein, 18 aa, Staphylococcus epidermidis
DLELFTNNQLVGAGLPLW

SEQ ID NO: 1819687 - protein, 22 aa, Staphylococcus epidermidis
DLERFIDVLAAKAKKYQYTLMM

SEQ ID NO: 1819688 - protein, 18 aa, Staphylococcus epidermidis
DLNFIKKAFEKCNIQFKP

SEQ ID NO: 1819689 - protein, 30 aa, Staphylococcus epidermidis
DLSRRFINRDLFKYIPFDGSIITISELQEL

SEQ ID NO: 1819690 - protein, 18 aa, Staphylococcus epidermidis
DLVEFDWIEGFDIECRNE

SEQ ID NO: 1819691 - protein, 23 aa, Staphylococcus epidermidis
DLVLTNALIIDYDKIVKADIGIK

SEQ ID NO: 1819692 - protein, 17 aa, Staphylococcus epidermidis
DMELGQISAVYLNDLAQ

SEQ ID NO: 1819693 - protein, 26 aa, Staphylococcus epidermidis
DMETTKWLEDYLKYFKGAIVIISHDR

SEQ ID NO: 1819694 - protein, 21 aa, Staphylococcus epidermidis
DMITKQFYDIGIAVSTDDGLL

SEQ ID NO: 1819695 - protein, 33 aa, Staphylococcus epidermidis
DMKAFLTRDQHRLYKLIWERFVASQMAPAILDT

SEQ ID NO: 1819696 - protein, 20 aa, Staphylococcus epidermidis
DMTNMFWRQNISQMWVETEF

SEQ ID NO: 1819697 - protein, 29 aa, Staphylococcus epidermidis
DNDIYYLDGPLDLTFLFGLVDHLSHKLKY

SEQ ID NO: 1819698 - protein, 27 aa, Staphylococcus epidermidis
DNEEKYLRLYAEFENYKRRIQKENQIN

SEQ ID NO: 1819699 - protein, 28 aa, Staphylococcus epidermidis
DNIFQGEALLFLLGLTNSMAGFEKLVPD

SEQ ID NO: 1819700 - protein, 23 aa, Staphylococcus epidermidis
DNPNIIIEMILINSKKLVFNAIS

SEQ ID NO: 1819701 - protein, 20 aa, Staphylococcus epidermidis
DPDPLPMDIIYRRLDEIPNL

SEQ ID NO: 1819702 - protein, 18 aa, Staphylococcus epidermidis
DPLRTRKLLLHKKEIQKL

SEQ ID NO: 1819703 - protein, 20 aa, Staphylococcus epidermidis
DPSFKQLISYCLLENEKGEI

SEQ ID NO: 1819704 - protein, 22 aa, Staphylococcus epidermidis
DQFNKFLYERDIDGYYLIVQQE

SEQ ID NO: 1819705 - protein, 27 aa, Staphylococcus epidermidis
DQGWHDMKIVPYAPFEISPAAQGLHYG

SEQ ID NO: 1819706 - protein, 21 aa, Staphylococcus epidermidis
DQLYDLIVTKIREAFKDKILI

SEQ ID NO: 1819707 - protein, 23 aa, Staphylococcus epidermidis
DQMDGKLFGIPMGIKDNIITKDV

SEQ ID NO: 1819708 - protein, 26 aa, Staphylococcus epidermidis
DQMSEFERMILLRSIDTHWTDHIDTM

SEQ ID NO: 1819709 - protein, 18 aa, Staphylococcus epidermidis
DRAIRIQAKIASLVTAFA

SEQ ID NO: 1819710 - protein, 28 aa, Staphylococcus epidermidis
DRKEGIHYKNLLGSYLHGPILPKNHEIT

SEQ ID NO: 1819711 - protein, 17 aa, Staphylococcus epidermidis
DRLGAKLVFTYRKERSR

SEQ ID NO: 1819712 - protein, 25 aa, Staphylococcus epidermidis
DRQLVKVAAWYDNEMSYTAQLVRTL

SEQ ID NO: 1819713 - protein, 24 aa, Staphylococcus epidermidis
DRVDHRYVYVNLGRIEAVLSEAER

SEQ ID NO: 1819714 - protein, 25 aa, Staphylococcus epidermidis
DRVDIILPAISVFKTLFKKIDATQF

SEQ ID NO: 1819715 - protein, 18 aa, Staphylococcus epidermidis
DSEDIFEIVWSKIEKAYA

SEQ ID NO: 1819716 - protein, 26 aa, Staphylococcus epidermidis
DSHNEWVNMLGVVPVIRALREKAMNI

SEQ ID NO: 1819717 - protein, 18 aa, Staphylococcus epidermidis
DSHYPFKELPFYEIGWRL

SEQ ID NO: 1819718 - protein, 31 aa, Staphylococcus epidermidis
DSTGHILNIYFPFIDVETMLTLLDLAHVYVS

SEQ ID NO: 1819719 - protein, 24 aa, Staphylococcus epidermidis
DSVQFIALELIRPNPYQPRKTFEE

SEQ ID NO: 1819720 - protein, 21 aa, Staphylococcus epidermidis
DTAPAFFQGTPGYEEQMFGEE

SEQ ID NO: 1819721 - protein, 26 aa, Staphylococcus epidermidis
DTEVMIVWSPPWNKDMMSRYAKIALG

SEQ ID NO: 1819722 - protein, 20 aa, Staphylococcus epidermidis
DTGFYPLGSCTMKYNPKINE

SEQ ID NO: 1819723 - protein, 27 aa, Staphylococcus epidermidis
DTIENRPMMYIALSYDHRIIDGKEAVG

SEQ ID NO: 1819724 - protein, 26 aa, Staphylococcus epidermidis
DTLEMRPLIVMSPKSLLRNKTVAKPI

SEQ ID NO: 1819725 - protein, 25 aa, Staphylococcus epidermidis
DTNAIIVYTLIKPEIKKYMISKVNE

SEQ ID NO: 1819726 - protein, 22 aa, Staphylococcus epidermidis
DTNGFVKLITLKEDDTLIGAQV

SEQ ID NO: 1819727 - protein, 22 aa, Staphylococcus epidermidis
DTSVAVQWLIDKGYDVVACCLD

SEQ ID NO: 1819728 - protein, 18 aa, Staphylococcus epidermidis
DTTQLLLDYIHHTQKRDL

SEQ ID NO: 1819729 - protein, 24 aa, Staphylococcus epidermidis
DTYCGIGTIGLYMAPLAKHVYGVE

SEQ ID NO: 1819730 - protein, 25 aa, Staphylococcus epidermidis
DTYNDWLVIGYTPVQLFFPEQQNFT

SEQ ID NO: 1819731 - protein, 38 aa, Staphylococcus epidermidis
DVALDMIRGILGKIPFFGICLGHQLFALSQGATSFKMK

SEQ ID NO: 1819732 - protein, 28 aa, Staphylococcus epidermidis
DVDYPNLMFHFLPIAVRYDGQKAPVAHG

SEQ ID NO: 1819733 - protein, 18 aa, Staphylococcus epidermidis
DVGNLYLNRGCTAAVVGY

SEQ ID NO: 1819734 - protein, 17 aa, Staphylococcus epidermidis
DVHLGIATSLDEGLMVP

SEQ ID NO: 1819735 - protein, 25 aa, Staphylococcus epidermidis
DVMAHLTMEFFTKGLVPITSLSFGY

SEQ ID NO: 1819736 - protein, 21 aa, Staphylococcus epidermidis
DVQELWDHRKKFKEIAAEQGT

SEQ ID NO: 1819737 - protein, 26 aa, Staphylococcus epidermidis
DVQGIKIHLLHLLKGTPMVKQYEKGM

SEQ ID NO: 1819738 - protein, 24 aa, Staphylococcus epidermidis
DVVIGDFPIGYYPLDERSREMKLG

SEQ ID NO: 1819739 - protein, 19 aa, Staphylococcus epidermidis
DVYDDCEFIVAIRSMLIKE

SEQ ID NO: 1819740 - protein, 17 aa, Staphylococcus epidermidis
DWFQLASNKEKRMVQLR

SEQ ID NO: 1819741 - protein, 55 aa, Staphylococcus epidermidis
DYKLTLENYVLIYYLEKIIFQANQRLSFMSGNRYQLIRREAISLGLSGLEIDVFD

SEQ ID NO: 1819742 - protein, 27 aa, Staphylococcus epidermidis
DYLENLGIDVIWLSPMYPSPNDDNGYD

SEQ ID NO: 1819743 - protein, 20 aa, Staphylococcus epidermidis
DYLINAINYMFPTVNVKDED

SEQ ID NO: 1819744 - protein, 18 aa, Staphylococcus epidermidis
DYNAEIKTILSKLGIHDT

SEQ ID NO: 1819745 - protein, 25 aa, Staphylococcus epidermidis
DYSSFISYHIFFETLLRKYNEYKEN

SEQ ID NO: 1819746 - protein, 27 aa, Staphylococcus epidermidis
DYTKDELELFLYQEPMTLKNPPKEWRK

SEQ ID NO: 1819747 - protein, 19 aa, Staphylococcus epidermidis
DYVLPDAVTRFRQGLGRLI

SEQ ID NO: 1819748 - protein, 23 aa, Staphylococcus epidermidis
EAAKDVAMHIAAINPKYVSSEQV

SEQ ID NO: 1819749 - protein, 21 aa, Staphylococcus epidermidis
EAAPKMLPMFSDDLVSYAVKY

SEQ ID NO: 1819750 - protein, 19 aa, Staphylococcus epidermidis
EAFLKAKGGKLTDFVRYEV

SEQ ID NO: 1819751 - protein, 17 aa, Staphylococcus epidermidis
EAIGVAGLVTPWNFPTN

SEQ ID NO: 1819752 - protein, 26 aa, Staphylococcus epidermidis
EAILEELGLPYRRVILCTGDIGFSAS

SEQ ID NO: 1819753 - protein, 27 aa, Staphylococcus epidermidis
EAKDFANIFFMIMNYYSIERSMEIAKE

SEQ ID NO: 1819754 - protein, 24 aa, Staphylococcus epidermidis
EAMVLRPMNCPHHMMIYKNKPHSY

SEQ ID NO: 1819755 - protein, 25 aa, Staphylococcus epidermidis
EAQAEAIVMLQLYRLTNTDIEALKK

SEQ ID NO: 1819756 - protein, 31 aa, Staphylococcus epidermidis
EARAHQLVIKYSSAWSFLVPEILQLDEATIQ

SEQ ID NO: 1819757 - protein, 23 aa, Staphylococcus epidermidis
EARGFIIGCPVAYSMGIGFAPVR

SEQ ID NO: 1819758 - protein, 28 aa, Staphylococcus epidermidis
EARKSPHAFVNLLNYILLEKSGADIACT

SEQ ID NO: 1819759 - protein, 24 aa, Staphylococcus epidermidis
EAVKPQVHVFIATSPIHLEHKLKM

SEQ ID NO: 1819760 - protein, 20 aa, Staphylococcus epidermidis
EAVLNYARLTKKAGLDGVVC

SEQ ID NO: 1819761 - protein, 19 aa, Staphylococcus epidermidis
EDALRIIRGLRFQSQLNFQ

SEQ ID NO: 1819762 - protein, 24 aa, Staphylococcus epidermidis
EDDEMDDIFIPPTKINRALDGDTV

SEQ ID NO: 1819763 - protein, 26 aa, Staphylococcus epidermidis
EDFELTLFELQYPKKFVTIQHQHVLG

SEQ ID NO: 1819764 - protein, 18 aa, Staphylococcus epidermidis
EDFLLVKREIFSSGKSIC

SEQ ID NO: 1819765 - protein, 28 aa, Staphylococcus epidermidis
EDIAKESLILYINAYRLAEKYANIATNC

SEQ ID NO: 1819766 - protein, 26 aa, Staphylococcus epidermidis
EDIPGELIMKVLAFDADLSKIDQVGQ

SEQ ID NO: 1819767 - protein, 26 aa, Staphylococcus epidermidis
EDRLRSRFEWGLIVDITPPDYETRMA

SEQ ID NO: 1819768 - protein, 24 aa, Staphylococcus epidermidis
EDTKQRFEAYGWNYILVENGNDLD

SEQ ID NO: 1819769 - protein, 18 aa, Staphylococcus epidermidis
EDVFLGFDCASSEFYENG

SEQ ID NO: 1819770 - protein, 25 aa, Staphylococcus epidermidis
EEDLDPIFMWHLAYAYGQEERDKEA

SEQ ID NO: 1819771 - protein, 27 aa, Staphylococcus epidermidis
EEFDLVTLRKSIIRWCQLILSNKAMAL

SEQ ID NO: 1819772 - protein, 18 aa, Staphylococcus epidermidis
EEGRYGTFAKYFTKNDVP

SEQ ID NO: 1819773 - protein, 18 aa, Staphylococcus epidermidis
EEHGAISAPIHDENFPGQ

SEQ ID NO: 1819774 - protein, 24 aa, Staphylococcus epidermidis
EEIEWQNYWKTFASEWLTDLNISE

SEQ ID NO: 1819775 - protein, 24 aa, Staphylococcus epidermidis
EEMAELYNYLGLTVGLNLNSKSTE

SEQ ID NO: 1819776 - protein, 50 aa, Staphylococcus epidermidis
EENAPVIWRGPMLGKMLTNFFTEVQWGELDYLLLDLPPGTGDVALDVHSM

SEQ ID NO: 1819777 - protein, 23 aa, Staphylococcus epidermidis
EEQHVVVLDWLNGNRSILSNSHL

SEQ ID NO: 1819778 - protein, 27 aa, Staphylococcus epidermidis
EEQIKQGHLFLLLAKEGWHEGVLGIVA

SEQ ID NO: 1819779 - protein, 18 aa, Staphylococcus epidermidis
EERTKIQLLAPVISHRKG

SEQ ID NO: 1819780 - protein, 22 aa, Staphylococcus epidermidis
EERYLLFILEQSGINDEMTAHH

SEQ ID NO: 1819781 - protein, 25 aa, Staphylococcus epidermidis
EETPFAAIILAEIFDKVGVPKGVFN

SEQ ID NO: 1819782 - protein, 19 aa, Staphylococcus epidermidis
EEYATFIRQQWAKLGLGLD

SEQ ID NO: 1819783 - protein, 22 aa, Staphylococcus epidermidis
EFIHPIYRSHYLINVDYKQLIK

SEQ ID NO: 1819784 - protein, 22 aa, Staphylococcus epidermidis
EFKMLCMGFKRKEIKKLMPEII

SEQ ID NO: 1819785 - protein, 24 aa, Staphylococcus epidermidis
EGAALAMSILDYVRRLGSLVMATT

SEQ ID NO: 1819786 - protein, 25 aa, Staphylococcus epidermidis
EGAARYMSGFYTVVKMVEGLMHDLN

SEQ ID NO: 1819787 - protein, 18 aa, Staphylococcus epidermidis
EGAKNAVLPVLTASLLAS

SEQ ID NO: 1819788 - protein, 17 aa, Staphylococcus epidermidis
EGCMPFEVMAERGRKTL

SEQ ID NO: 1819789 - protein, 23 aa, Staphylococcus epidermidis
EGDSFTFDKVLFVGGDSVKVGAP

SEQ ID NO: 1819790 - protein, 21 aa, Staphylococcus epidermidis
EGDTLIPPFISVPGLGENVAQ

SEQ ID NO: 1819791 - protein, 36 aa, Staphylococcus epidermidis
EGELLFGDTVAVFGAGPIGLLTIVAAKAAGASKIFV

SEQ ID NO: 1819792 - protein, 25 aa, Staphylococcus epidermidis
EGELPEERLFRKYAHKIRNWEDDKQ

SEQ ID NO: 1819793 - protein, 26 aa, Staphylococcus epidermidis
EGFVPTTTLFYFKDSIIIGAVDIRHQ

SEQ ID NO: 1819794 - protein, 26 aa, Staphylococcus epidermidis
EGIFKKPVITPIKPYKNFYPAEEYHQ

SEQ ID NO: 1819795 - protein, 24 aa, Staphylococcus epidermidis
EGKQYIVTWALGHLVTNATPEQYN

SEQ ID NO: 1819796 - protein, 38 aa, Staphylococcus epidermidis
EGLKNLFKIVSASLVKYYYRTPRIPRSLLNEYREGILI

SEQ ID NO: 1819797 - protein, 18 aa, Staphylococcus epidermidis
EGLRLKTLFPYINQASEN

SEQ ID NO: 1819798 - protein, 18 aa, Staphylococcus epidermidis
EGLSIKASKFPYAANGRA

SEQ ID NO: 1819799 - protein, 25 aa, Staphylococcus epidermidis
EGMLLCEYLNIKPEILTFMLKVFKE

SEQ ID NO: 1819800 - protein, 19 aa, Staphylococcus epidermidis
EGMNFAAVHKLPFVCVIIN

SEQ ID NO: 1819801 - protein, 35 aa, Staphylococcus epidermidis
EGNFHEGLNFASILDLPVLFICENNQFAEGTTHDY

SEQ ID NO: 1819802 - protein, 26 aa, Staphylococcus epidermidis
EGQTHFVTELYVETIKFMSPKNKNNE

SEQ ID NO: 1819803 - protein, 27 aa, Staphylococcus epidermidis
EHDIHVILTDTFALNKPAQGLFEKFGF

SEQ ID NO: 1819804 - protein, 26 aa, Staphylococcus epidermidis
EHIQTIEHWFNYTYQLTLTHEFKYQV

SEQ ID NO: 1819805 - protein, 28 aa, Staphylococcus epidermidis
EHNKLAMVLVQFPPWFDCNVQNINYILY

SEQ ID NO: 1819806 - protein, 39 aa, Staphylococcus epidermidis
EHNRYFYKPIGTGVTIPPWNFPFAIMAGTTLAPVVAGNT

SEQ ID NO: 1819807 - protein, 24 aa, Staphylococcus epidermidis
EHPKFFHQLFKLLEDVRIFEHIRQ

SEQ ID NO: 1819808 - protein, 17 aa, Staphylococcus epidermidis
EHSRYDLMLVQTDRHYG

SEQ ID NO: 1819809 - protein, 19 aa, Staphylococcus epidermidis
EIFNNLLSKQVDGIIFLGG

SEQ ID NO: 1819810 - protein, 33 aa, Staphylococcus epidermidis
EIGCQSYCGPGRRKTFAFVNNRPLAALTEEELM

SEQ ID NO: 1819811 - protein, 23 aa, Staphylococcus epidermidis
EIGTLMHTVMQHLPFREQRLTKD

SEQ ID NO: 1819812 - protein, 22 aa, Staphylococcus epidermidis
EIMEQALVLDVPLKVDSNYGAT

SEQ ID NO: 1819813 - protein, 17 aa, Staphylococcus epidermidis
EIQKMREERQMLGQMIN

SEQ ID NO: 1819814 - protein, 24 aa, Staphylococcus epidermidis
EISQQVLYIIKHMSYRAGKNNHVK

SEQ ID NO: 1819815 - protein, 25 aa, Staphylococcus epidermidis
EIVGFILEPLIQGATGLFVHPHGFL

SEQ ID NO: 1819816 - protein, 24 aa, Staphylococcus epidermidis
EKAKELGCLFAFYGHTHVAKYEQI

SEQ ID NO: 1819817 - protein, 23 aa, Staphylococcus epidermidis
EKDFKNEAFYIMATKNGMIKKSS

SEQ ID NO: 1819818 - protein, 24 aa, Staphylococcus epidermidis
EKFKSLTFISGTLTFNHSFKAFQN

SEQ ID NO: 1819819 - protein, 23 aa, Staphylococcus epidermidis
EKGLDGSRRFLDRVWRLIITDEN

SEQ ID NO: 1819820 - protein, 25 aa, Staphylococcus epidermidis
EKGNIYLGGPIKLLNRPKHDAFSNY

SEQ ID NO: 1819821 - protein, 22 aa, Staphylococcus epidermidis
EKIYKQLLREGVDFMTMGNHTY

SEQ ID NO: 1819822 - protein, 17 aa, Staphylococcus epidermidis
EKNTLLERFKYAQSINV

SEQ ID NO: 1819823 - protein, 24 aa, Staphylococcus epidermidis
EKQTLFFGGLARIDYVSGGKRPLV

SEQ ID NO: 1819824 - protein, 24 aa, Staphylococcus epidermidis
EKRPDLLEQYPLTEKDREILETYK

SEQ ID NO: 1819825 - protein, 24 aa, Staphylococcus epidermidis
EKSQAFDFIIEGDTLIPPFISVPG

SEQ ID NO: 1819826 - protein, 18 aa, Staphylococcus epidermidis
EKTLVSAKRWIRYIHEVE

SEQ ID NO: 1819827 - protein, 21 aa, Staphylococcus epidermidis
EKVATPFPRISYDDAIEFLKK

SEQ ID NO: 1819828 - protein, 25 aa, Staphylococcus epidermidis
EKYGAFVELFPGKDALLHISQISQE

SEQ ID NO: 1819829 - protein, 39 aa, Staphylococcus epidermidis
ELADMYQVLLVLPLWHEGDKFPFKLLIEKIREINVPKKC

SEQ ID NO: 1819830 - protein, 25 aa, Staphylococcus epidermidis
ELDIRAQYGINIIAIKRAKEFIVSP

SEQ ID NO: 1819831 - protein, 26 aa, Staphylococcus epidermidis
ELEREGFHILAIKDMAGLLKPKAAYE

SEQ ID NO: 1819832 - protein, 20 aa, Staphylococcus epidermidis
ELERFRATLFRQTMFAEFEH

SEQ ID NO: 1819833 - protein, 25 aa, Staphylococcus epidermidis
ELETQLFAELPLEQPTWNPNDFSPS

SEQ ID NO: 1819834 - protein, 24 aa, Staphylococcus epidermidis
ELHEFLIHLTGVLETGYFLDIADQ

SEQ ID NO: 1819835 - protein, 28 aa, Staphylococcus epidermidis
ELHNMTKIDYFFLNKFQNIIDIEHELKN

SEQ ID NO: 1819836 - protein, 24 aa, Staphylococcus epidermidis
ELLKPTVMMNLLGRDLDLLENEFS

SEQ ID NO: 1819837 - protein, 19 aa, Staphylococcus epidermidis
ELQGRFPIRVELESLSVED

SEQ ID NO: 1819838 - protein, 19 aa, Staphylococcus epidermidis
ELQQCGHYVMIATGRPYRA

SEQ ID NO: 1819839 - protein, 24 aa, Staphylococcus epidermidis
ELTPKEFELLLYLIERQGRVITRE

SEQ ID NO: 1819840 - protein, 25 aa, Staphylococcus epidermidis
EMGIDIDTLVKFNLKKDQILEPSDM

SEQ ID NO: 1819841 - protein, 22 aa, Staphylococcus epidermidis
EMRRSIGMIFQHFNLVKRSTVL

SEQ ID NO: 1819842 - protein, 22 aa, Staphylococcus epidermidis
ENCKRLGYYPKTVANISQISFI

SEQ ID NO: 1819843 - protein, 24 aa, Staphylococcus epidermidis
ENCVAQLIELPFTSTAKELGTALM

SEQ ID NO: 1819844 - protein, 22 aa, Staphylococcus epidermidis
ENERIKIRYLPCPCKIKHDEER

SEQ ID NO: 1819845 - protein, 26 aa, Staphylococcus epidermidis
ENIFAIGDIVPGLPLAHKASYEGKVA

SEQ ID NO: 1819846 - protein, 23 aa, Staphylococcus epidermidis
ENKDELLRFAIKQVDKASQSNLI

SEQ ID NO: 1819847 - protein, 23 aa, Staphylococcus epidermidis
ENKIQQLLVHLILIIKHSQPEEE

SEQ ID NO: 1819848 - protein, 17 aa, Staphylococcus epidermidis
ENNQPMEWGWKQFTDQI

SEQ ID NO: 1819849 - protein, 22 aa, Staphylococcus epidermidis
ENNYACILLDLMLPEMDGIEVA

SEQ ID NO: 1819850 - protein, 25 aa, Staphylococcus epidermidis
ENRLHTLMELYNYKEIRTPIFESTE

SEQ ID NO: 1819851 - protein, 29 aa, Staphylococcus epidermidis
ENRYLTEDIAYGLVLWSSLGRVIDVPTPN

SEQ ID NO: 1819852 - protein, 18 aa, Staphylococcus epidermidis
ENSRFNVDLFLRNAHRIP

SEQ ID NO: 1819853 - protein, 18 aa, Staphylococcus epidermidis
ENVLTSRKLSRHIEDKFA

SEQ ID NO: 1819854 - protein, 21 aa, Staphylococcus epidermidis
EPAYSFMIRVRVPGGKATPEQ

SEQ ID NO: 1819855 - protein, 19 aa, Staphylococcus epidermidis
EPFNQWNKEQFGEKLNRYR

SEQ ID NO: 1819856 - protein, 31 aa, Staphylococcus epidermidis
EPTNHLDFESIRWLINYVKQYPHTVLFVTHD

SEQ ID NO: 1819857 - protein, 33 aa, Staphylococcus epidermidis; identical to SEQ ID NO: 1680269

SEQ ID NO: 1819858 - protein, 25 aa, Staphylococcus epidermidis
EQEFKLSVLPTLTPLGIDAYHPFPK

SEQ ID NO: 1819859 - protein, 24 aa, Staphylococcus epidermidis
EQIDTIINEAKAYQFKSVCVNPTH

SEQ ID NO: 1819860 - protein, 23 aa, Staphylococcus epidermidis
EQLSFLHFYPRQQIHLILSAYSR

SEQ ID NO: 1819861 - protein, 17 aa, Staphylococcus epidermidis
EQNGKVLRLYLNNQQTF

SEQ ID NO: 1819862 - protein, 23 aa, Staphylococcus epidermidis
EQRKMMLESIRYVDLVIPEEGWG

SEQ ID NO: 1819863 - protein, 23 aa, Staphylococcus epidermidis
EQRQTMLFSATMPKAIQELVQQF

SEQ ID NO: 1819864 - protein, 25 aa, Staphylococcus epidermidis
EQSATHWTKPLYLQWKKALSEVGIG

SEQ ID NO: 1819865 - protein, 24 aa, Staphylococcus epidermidis
EQTETFLRGFLGRMLFSGEEVKKK

SEQ ID NO: 1819866 - protein, 27 aa, Staphylococcus epidermidis
EQYDELVIVPLFLFDGRLVNKVKRLLG

SEQ ID NO: 1819867 - protein, 18 aa, Staphylococcus epidermidis
ERDIFFHHPYESFEPIVD

SEQ ID NO: 1819868 - protein, 23 aa, Staphylococcus epidermidis
ERFTDRFELFIVGREHANAFTEL

SEQ ID NO: 1819869 - protein, 30 aa, Staphylococcus epidermidis
ERHGKNGFGYDPIFFVPELNKTMAEITNDE

SEQ ID NO: 1819870 - protein, 24 aa, Staphylococcus epidermidis
ERKRAIIAPLYFKPQPEDFELTLF

SEQ ID NO: 1819871 - protein, 24 aa, Staphylococcus epidermidis
ERMIDFQIVGMPLPKKTSSQRPAR

SEQ ID NO: 1819872 - protein, 26 aa, Staphylococcus epidermidis
ERVTVYWHHFLRPEVKFDGIDPLVKQ

SEQ ID NO: 1819873 - protein, 20 aa, Staphylococcus epidermidis
ESLTFDDVLLIPAASDVLPS

SEQ ID NO: 1819874 - protein, 19 aa, Staphylococcus epidermidis
ESQLTPFLQQLNIAYTHSL

SEQ ID NO: 1819875 - protein, 18 aa, Staphylococcus epidermidis
ESYVFTEVALRNKGIKIL

SEQ ID NO: 1819876 - protein, 25 aa, Staphylococcus epidermidis
ETEKYGFQTLKERLPVWIKQSKRAI

SEQ ID NO: 1819877 - protein, 29 aa, Staphylococcus epidermidis
ETFETNVYPVFWTVQKALEYLQPGGSITT

SEQ ID NO: 1819878 - protein, 30 aa, Staphylococcus epidermidis
ETLEKLLYNTFDLIFLDINLMDESGIDLAQ

SEQ ID NO: 1819879 - protein, 24 aa, Staphylococcus epidermidis
ETNPSLIISFYPKFAVHPDHEATA

SEQ ID NO: 1819880 - protein, 23 aa, Staphylococcus epidermidis
ETNVLTFAVRRMNLYDRNLPNPL

SEQ ID NO: 1819881 - protein, 22 aa, Staphylococcus epidermidis
ETQTRNLFDLVISTETHAEEKP

SEQ ID NO: 1819882 - protein, 24 aa, Staphylococcus epidermidis
ETTDTFFDLEKLPKQLAVIGGGVI

SEQ ID NO: 1819883 - protein, 24 aa, Staphylococcus epidermidis
ETYEKNILFATLDPKTRQIQVNEG

SEQ ID NO: 1819884 - protein, 23 aa, Staphylococcus epidermidis
EVFKKQIALAKRVQLPIIIHNRE

SEQ ID NO: 1819885 - protein, 17 aa, Staphylococcus epidermidis
EVGLLPRAHGSGLFTRG

SEQ ID NO: 1819886 - protein, 21 aa, Staphylococcus epidermidis
EVHLLTRVLSYINHKNIPVSF

SEQ ID NO: 1819887 - protein, 29 aa, Staphylococcus epidermidis
EVIRSNWHINAMLRLFKTNVLTSQFKRSS

SEQ ID NO: 1819888 - protein, 23 aa, Staphylococcus epidermidis
EVITKLLDIELSIGRTGVVTPTA

SEQ ID NO: 1819889 - protein, 23 aa, Staphylococcus epidermidis
EVLDPSLPIDLIIDYAHTADGMN

SEQ ID NO: 1819890 - protein, 27 aa, Staphylococcus epidermidis
EVQEIIDHFIMKLRIVKFARTPEYNEL

SEQ ID NO: 1819891 - protein, 24 aa, Staphylococcus epidermidis
EVQFQYGLVLCQLEMFDEAIKQLN

SEQ ID NO: 1819892 - protein, 25 aa, Staphylococcus epidermidis
EWREYGLNHFVLPKVLISNEGTRTY

SEQ ID NO: 1819893 - protein, 24 aa, Staphylococcus epidermidis
EYERILIEIDRLYNYPELRLSVDT

SEQ ID NO: 1819894 - protein, 32 aa, Staphylococcus epidermidis
EYIMEMLKNVKTPIFLVLNKIDLVHPDTLMPK

SEQ ID NO: 1819895 - protein, 26 aa, Staphylococcus epidermidis
EYMNLDPFYHKLNQLLKHQYLKHEEQ

SEQ ID NO: 1819896 - protein, 17 aa, Staphylococcus epidermidis
EYNKYIKVRHILNPSLK

SEQ ID NO: 1819897 - protein, 23 aa, Staphylococcus epidermidis
EYRDCYVMGLLKRNWVNKNDDDL

SEQ ID NO: 1819898 - protein, 26 aa, Staphylococcus epidermidis
FAAVHKLPFVCVIINNKYAISVPDSL

SEQ ID NO: 1819899 - protein, 29 aa, Staphylococcus epidermidis
FAKLIHHRYPNIPFYLQVGNPYLDDNVDQ

SEQ ID NO: 1819900 - protein, 21 aa, Staphylococcus epidermidis
FAKLIQYQTYEFTLFKDGRMN

SEQ ID NO: 1819901 - protein, 29 aa, Staphylococcus epidermidis
FAKREVYQHYALSALPFPDKTKFETKGES

SEQ ID NO: 1819902 - protein, 41 aa, Staphylococcus epidermidis
FAPNKRGYKMLPHFQIGLFRNQLFIMFGIMHEGRNKEEKVK

SEQ ID NO: 1819903 - protein, 21 aa, Staphylococcus epidermidis
FDHTLEVIQQLKLNHSLYIVT

SEQ ID NO: 1819904 - protein, 17 aa, Staphylococcus epidermidis
FDLSVMAIYPCLTSGGT

SEQ ID NO: 1819905 - protein, 24 aa, Staphylococcus epidermidis
FDTVYRNLHLFKDLGIIESTELDG

SEQ ID NO: 1819906 - protein, 18 aa, Staphylococcus epidermidis
FEEGKRAVLLLHGFTGNS

SEQ ID NO: 1819907 - protein, 18 aa, Staphylococcus epidermidis
FELLAMVTYADRLKGIIK

SEQ ID NO: 1819908 - protein, 20 aa, Staphylococcus epidermidis
FELPYMQLVVITERELFKTR

SEQ ID NO: 1819909 - protein, 17 aa, Staphylococcus epidermidis
FEQVYQPPSLKEAKKRG

SEQ ID NO: 1819910 - protein, 26 aa, Staphylococcus epidermidis
FGITYSQYLVLLTLWEENPQTLNSIG

SEQ ID NO: 1819911 - protein, 17 aa, Staphylococcus epidermidis
FGKLKSKHAVVIGAGEM

SEQ ID NO: 1819912 - protein, 27 aa, Staphylococcus epidermidis
FGNVSLLDTPTFLFGMRNGETVEIEID

SEQ ID NO: 1819913 - protein, 25 aa, Staphylococcus epidermidis
FGSEKYIKTFRKCKYVFINGNSWDK

SEQ ID NO: 1819914 - protein, 24 aa, Staphylococcus epidermidis
FGVFHDEALQPLYKDRIPVVIKNT

SEQ ID NO: 1819915 - protein, 23 aa, Staphylococcus epidermidis
FHKAMPIIIHGDAAYPGQGINFE

SEQ ID NO: 1819916 - protein, 20 aa, Staphylococcus epidermidis
FHKNQRDMPWRETTNPYYIW

SEQ ID NO: 1819917 - protein, 19 aa, Staphylococcus epidermidis
FHNFKKFTMPIVQALQSMG

SEQ ID NO: 1819918 - protein, 26 aa, Staphylococcus epidermidis
FIAHKLKHLLDEGLEWVLIQGQMGIE

SEQ ID NO: 1819919 - protein, 27 aa, Staphylococcus epidermidis
FIEHPNTTIFLITPKYDKPGLLASVLN

SEQ ID NO: 1819920 - protein, 18 aa, Staphylococcus epidermidis
FIEILSQSQWIKKAEVFI

SEQ ID NO: 1819921 - protein, 18 aa, Staphylococcus epidermidis
FIEKPFNLSLTVAKIQAL

SEQ ID NO: 1819922 - protein, 17 aa, Staphylococcus epidermidis
FIKSFKAVNLHQSIFEN

SEQ ID NO: 1819923 - protein, 20 aa, Staphylococcus epidermidis
FILGETLYNFGLTPQGLEVF

SEQ ID NO: 1819924 - protein, 22 aa, Staphylococcus epidermidis
FKDFKHFMKKKQGLLLFSGPTG

SEQ ID NO: 1819925 - protein, 27 aa, Staphylococcus epidermidis
FKEQVGYPLIVRPAFTMGGTGGGICHN

SEQ ID NO: 1819926 - protein, 20 aa, Staphylococcus epidermidis
FKHEAIEFAWEFLTSDKWMG

SEQ ID NO: 1819927 - protein, 31 aa, Staphylococcus epidermidis
FKPKRVMDTLELFKIAFPTDKSYQLSALAES

SEQ ID NO: 1819928 - protein, 28 aa, Staphylococcus epidermidis
FKTTTITFKFMAPLNYKTITSRSILSKV

SEQ ID NO: 1819929 - protein, 18 aa, Staphylococcus epidermidis
FLGNIIAEVFNRFSITDT

SEQ ID NO: 1819930 - protein, 17 aa, Staphylococcus epidermidis
FLNGKKPIQHRSSYGLG

SEQ ID NO: 1819931 - protein, 18 aa, Staphylococcus epidermidis
FLPYTITTVWGLGYKFER

SEQ ID NO: 1819932 - protein, 17 aa, Staphylococcus epidermidis
FMGAINEAIDQSMEKDE

SEQ ID NO: 1819933 - protein, 33 aa, Staphylococcus epidermidis
FMTQYLMNHPNKLIPLTYFVKKFKQAKSSISED

SEQ ID NO: 1819934 - protein, 17 aa, Staphylococcus epidermidis
FPNLLINGSTGISSGYA

SEQ ID NO: 1819935 - protein, 17 aa, Staphylococcus epidermidis
FQGTPGYEEQMFGEEQS

SEQ ID NO: 1819936 - protein, 18 aa, Staphylococcus epidermidis
FQNEYWNHFEKGIYVDKL

SEQ ID NO: 1819937 - protein, 24 aa, Staphylococcus epidermidis
FQQKNLKVFGLTASPNYIANIRRN

SEQ ID NO: 1819938 - protein, 17 aa, Staphylococcus epidermidis
FQRLRRIKQLGTLYLSF

SEQ ID NO: 1819939 - protein, 34 aa, Staphylococcus epidermidis
FRDIAILYRDESYAYLFESILPSYDIPFNIDTKK

SEQ ID NO: 1819940 - protein, 26 aa, Staphylococcus epidermidis
FREAGLFHVAYLLPTRSDLADFLYHA

SEQ ID NO: 1819941 - protein, 19 aa, Staphylococcus epidermidis
FRQNGSTSMLLLAKDLTHG

SEQ ID NO: 1819942 - protein, 32 aa, Staphylococcus epidermidis
FTAYSMYPNLWKNMGLSYPDLIAKLIDLAKER

SEQ ID NO: 1819943 - protein, 27 aa, Staphylococcus epidermidis
FTTTADFLYAVLNYPIYAKGDASKVDI

SEQ ID NO: 1819944 - protein, 27 aa, Staphylococcus epidermidis
FTYFDRFRNRIMFPLKNGQGRIVGYSG

SEQ ID NO: 1819945 - protein, 18 aa, Staphylococcus epidermidis
FVLFHDDYYLKDQIIENC

SEQ ID NO: 1819946 - protein, 26 aa, Staphylococcus epidermidis
FVSMMGYSPGFPYLTGMNKKLHVNHT

SEQ ID NO: 1819947 - protein, 25 aa, Staphylococcus epidermidis
FYDNSLEFLALFEKLSLEMNDIVNV

SEQ ID NO: 1819948 - protein, 18 aa, Staphylococcus epidermidis
FYLIREDVLPESVIKTLK

SEQ ID NO: 1819949 - protein, 23 aa, Staphylococcus epidermidis
GAAGYYLYQAGLRGDLALNGQNN

SEQ ID NO: 1819950 - protein, 29 aa, Staphylococcus epidermidis
GADREIRLRPSYFPFTEPSVEVDVSCFKC

SEQ ID NO: 1819951 - protein, 18 aa, Staphylococcus epidermidis
GAFGIPLIEKVVGQQGVQ

SEQ ID NO: 1819952 - protein, 24 aa, Staphylococcus epidermidis
GAGHALYLLNQLNDKGRLIAIDQD

SEQ ID NO: 1819953 - protein, 28 aa, Staphylococcus epidermidis
GALGERALRYIIPDTQDFPYTIRIVSEV

SEQ ID NO: 1819954 - protein, 18 aa, Staphylococcus epidermidis
GANKFKTIVGKDAFIGCN

SEQ ID NO: 1819955 - protein, 27 aa, Staphylococcus epidermidis
GANVKGYFLWSLMDVFSWSNGYEKRYG

SEQ ID NO: 1819956 - protein, 23 aa, Staphylococcus epidermidis
GAQHALDLLGLSTLSLLDTFSCK

SEQ ID NO: 1819957 - protein, 29 aa, Staphylococcus epidermidis
GAQILSKYPHLKIKWIRGNIDTRLKKLET

SEQ ID NO: 1819958 - protein, 17 aa, Staphylococcus epidermidis
GAQLLIDYLSHNDLSQI

SEQ ID NO: 1819959 - protein, 23 aa, Staphylococcus epidermidis
GARRLHTILEKMLEDLSFEAPSM

SEQ ID NO: 1819960 - protein, 28 aa, Staphylococcus epidermidis
GASGIEYFTPILNLGETGILGVGALTKE

SEQ ID NO: 1819961 - protein, 20 aa, Staphylococcus epidermidis
GATFLSYLKNNERPDIVLLD

SEQ ID NO: 1819962 - protein, 18 aa, Staphylococcus epidermidis
GCFWCMVKPFTSYPGIKS

SEQ ID NO: 1819963 - protein, 27 aa, Staphylococcus epidermidis
GCMEELKMMLNIMKPEYFVPVQGEFKM

SEQ ID NO: 1819964 - protein, 26 aa, Staphylococcus epidermidis
GCPKCRPAINYYLNMVYPFEHRDEKD

SEQ ID NO: 1819965 - protein, 23 aa, Staphylococcus epidermidis
GDDLQYTMTITFEEAVFGTKKEI

SEQ ID NO: 1819966 - protein, 24 aa, Staphylococcus epidermidis
GDDQFNIWKMADLGDIIGVEGVMF

SEQ ID NO: 1819967 - protein, 26 aa, Staphylococcus epidermidis
GDISSPYYRDLAFVTYMGISPLDTML

SEQ ID NO: 1819968 - protein, 27 aa, Staphylococcus epidermidis
GDLLFGTIDSWLVWKLSGRTAHITDYT

SEQ ID NO: 1819969 - protein, 27 aa, Staphylococcus epidermidis
GDRGDSRFYLSLQDELMVRFGSERLQK

SEQ ID NO: 1819970 - protein, 18 aa, Staphylococcus epidermidis
GDRVSIAWMYAACGNCEY

SEQ ID NO: 1819971 - protein, 26 aa, Staphylococcus epidermidis
GDVKDVVLLDVTPLSLGIEIMGGRMN

SEQ ID NO: 1819972 - protein, 18 aa, Staphylococcus epidermidis
GDYLADKGVVPFLKVDKG

SEQ ID NO: 1819973 - protein, 20 aa, Staphylococcus epidermidis
GEIMPIYDAAMKYKEDGTGL

SEQ ID NO: 1819974 - protein, 27 aa, Staphylococcus epidermidis
GEMTNQLLSQLRFSKMFFSSNGVKDGL

SEQ ID NO: 1819975 - protein, 17 aa, Staphylococcus epidermidis
GFEDKQAYKKGSKSNKY

SEQ ID NO: 1819976 - protein, 40 aa, Staphylococcus epidermidis
GFGEEVKRRIFLGTFALSSGYYDAYYKKSQKVRTLIKNDF

SEQ ID NO: 1819977 - protein, 19 aa, Staphylococcus epidermidis
GFIDEKYQKLAPLYDTKES

SEQ ID NO: 1819978 - protein, 28 aa, Staphylococcus epidermidis
GFNKSEAMIILFSKLFKEKDKAMKWYQS

SEQ ID NO: 1819979 - protein, 27 aa, Staphylococcus epidermidis
GFRGDIFGGYILYNLGFIESEDRYFIG

SEQ ID NO: 1819980 - protein, 24 aa, Staphylococcus epidermidis
GGPHGDLYVVFRVKPSNTFERDGD

SEQ ID NO: 1819981 - protein, 22 aa, Staphylococcus epidermidis
GGQWFTPVINHPEVAILGIGRI

SEQ ID NO: 1819982 - protein, 32 aa, Staphylococcus epidermidis
GGRHTPFFTNYRPQFYFRTTDVTGVVNLPEGT

SEQ ID NO: 1819983 - protein, 26 aa, Staphylococcus epidermidis
GGTYRALTKVFTRFGIDVDFVDTTKI

SEQ ID NO: 1819984 - protein, 35 aa, Staphylococcus epidermidis
GGVEHAVLHLLYARFWHKVLYDLGVVPTKEPFQKL

SEQ ID NO: 1819985 - protein, 33 aa, Staphylococcus epidermidis
GHAAPPEEILKSSPFVWFKDVLDGYDYLVDQGY

SEQ ID NO: 1819986 - protein, 24 aa, Staphylococcus epidermidis
GHIADRLMEALWRESLHIVNDGIA

SEQ ID NO: 1819987 - protein, 38 aa, Staphylococcus epidermidis
GHIELAAPVSHIWYFKGIPSRMGLLLDMSPRALEEVIY

SEQ ID NO: 1819988 - protein, 23 aa, Staphylococcus epidermidis
GHRTAHYPFFKINFARLASYCEE

SEQ ID NO: 1819989 - protein, 31 aa, Staphylococcus epidermidis
GIAIDAYGAGSFIVATKIKGMIAAEVSDERS

SEQ ID NO: 1819990 - protein, 24 aa, Staphylococcus epidermidis
GIAMGHIGMRYSLPSREIIADAAE

SEQ ID NO: 1819991 - protein, 23 aa, Staphylococcus epidermidis
GIDDLLEMIGLVAEVQELKANPN

SEQ ID NO: 1819992 - protein, 18 aa, Staphylococcus epidermidis
GIEGLDEFLTGPTAIATS

SEQ ID NO: 1819993 - protein, 26 aa, Staphylococcus epidermidis
GIENYSVHLTLRPLGSTPYTLLDYFG

SEQ ID NO: 1819994 - protein, 18 aa, Staphylococcus epidermidis
GIGLYRTEFLYMGRDQMP

SEQ ID NO: 1819995 - protein, 18 aa, Staphylococcus epidermidis
GIIVADPLIIETCKKVAP

SEQ ID NO: 1819996 - protein, 30 aa, Staphylococcus epidermidis
GIKIIDRTQLILEIFALRARSREGKLQVEL

SEQ ID NO: 1819997 - protein, 29 aa, Staphylococcus epidermidis
GIKSLKISFNKVFGYFIEITRANLNNFQP

SEQ ID NO: 1819998 - protein, 25 aa, Staphylococcus epidermidis
GIKYASSFFGPFRDAADSAPSFGDR

SEQ ID NO: 1819999 - protein, 27 aa, Staphylococcus epidermidis
GIPNTFVPARNLLFLSFAGALAYQIHA

SEQ ID NO: 1820000 - protein, 30 aa, Staphylococcus epidermidis
GIVGSETAFPLLYTHFVRRGNWSLQQLVDY

SEQ ID NO: 1820001 - protein, 26 aa, Staphylococcus epidermidis
GIYSYELYHFFDVDTIIRVGSCGALQ

SEQ ID NO: 1820002 - protein, 24 aa, Staphylococcus epidermidis
GKGFSLDHHPKGSGLGLYGMRERA

SEQ ID NO: 1820003 - protein, 18 aa, Staphylococcus epidermidis
GKGRRANLYGLFNKAVEF

SEQ ID NO: 1820004 - protein, 20 aa, Staphylococcus epidermidis
GKKILFIHYEIENDKMSAPI

SEQ ID NO: 1820005 - protein, 24 aa, Staphylococcus epidermidis
GKKVKLNMILNAKSGICAEDCGYC

SEQ ID NO: 1820006 - protein, 18 aa, Staphylococcus epidermidis
GKQLLAYLGAPKHLYEKV

SEQ ID NO: 1820007 - protein, 19 aa, Staphylococcus epidermidis
GKQVAFLVPTTILAQQHYE

SEQ ID NO: 1820008 - protein, 20 aa, Staphylococcus epidermidis
GKSQRVLVFAKGDKITEAEE

SEQ ID NO: 1820009 - protein, 23 aa, Staphylococcus epidermidis
GKSTLIRMFNNLESPTSGEIIID

SEQ ID NO: 1820010 - protein, 29 aa, Staphylococcus epidermidis
GKSVCINSILMSLLYKNHPEELRLLLIDP

SEQ ID NO: 1820011 - protein, 18 aa, Staphylococcus epidermidis
GKTLLMLSGGIDSPVAGI

SEQ ID NO: 1820012 - protein, 19 aa, Staphylococcus epidermidis
GKYFGPYPNAYSAQETKKL

SEQ ID NO: 1820013 - protein, 33 aa, Staphylococcus epidermidis
GKYLVIQTYFERVHLKFLSSLPVGGLGLDLVHD

SEQ ID NO: 1820014 - protein, 24 aa, Staphylococcus epidermidis
GLDTLKEIIWNPLIKDRCFDHTYV

SEQ ID NO: 1820015 - protein, 25 aa, Staphylococcus epidermidis
GLDYLDLFLIHWPCENDQLYIESYK

SEQ ID NO: 1820016 - protein, 25 aa, Staphylococcus epidermidis
GLERDIWQYFTVLPGIQSVGVMGDY

SEQ ID NO: 1820017 - protein, 36 aa, Staphylococcus epidermidis
GLHPYAATFFVFSDYLKPALRLSSIMGLNSTFIFTH

SEQ ID NO: 1820018 - protein, 24 aa, Staphylococcus epidermidis
GLKPVQRRILFAMYSSGNTYDKNF

SEQ ID NO: 1820019 - protein, 27 aa, Staphylococcus epidermidis
GLKVEGLYPYHIYTYIINELMGQPIEK

SEQ ID NO: 1820020 - protein, 28 aa, Staphylococcus epidermidis
GLNFEYTALLYDFTFKRFDNLTDFKYAE

SEQ ID NO: 1820021 - protein, 17 aa, Staphylococcus epidermidis
GLRLSQFYKELMVSTGS

SEQ ID NO: 1820022 - protein, 23 aa, Staphylococcus epidermidis
GLRVGVIRDWEAKWYAEKDFASL

SEQ ID NO: 1820023 - protein, 22 aa, Staphylococcus epidermidis
GLTHYIFMNELKINLLDFREQM

SEQ ID NO: 1820024 - protein, 20 aa, Staphylococcus epidermidis
GLVPVILQHAQTDSVLMLGY

SEQ ID NO: 1820025 - protein, 26 aa, Staphylococcus epidermidis
GMDTWDFAHCLPYFKKLETTYGAAPY

SEQ ID NO: 1820026 - protein, 18 aa, Staphylococcus epidermidis
GMEVTVLHLADWLMEMQL

SEQ ID NO: 1820027 - protein, 18 aa, Staphylococcus epidermidis
GMGKGRTFLIKTYGCQMN

SEQ ID NO: 1820028 - protein, 23 aa, Staphylococcus epidermidis
GMGRIGRMVLRIALNNKNLNVKA

SEQ ID NO: 1820029 - protein, 28 aa, Staphylococcus epidermidis
GMKQKVMIICAFIVDPELYIIDEPFLGL

SEQ ID NO: 1820030 - protein, 19 aa, Staphylococcus epidermidis
GMRAKLGFSINITVNPDIL

SEQ ID NO: 1820031 - protein, 29 aa, Staphylococcus epidermidis
GMSRQHHRFLFFINKLPGITIKELLITLE

SEQ ID NO: 1820032 - protein, 26 aa, Staphylococcus epidermidis
GMTCMFQSKRMLLGNYYTFQERQMKI

SEQ ID NO: 1820033 - protein, 27 aa, Staphylococcus epidermidis
GNIAVPLDLPALFKGYFKDEARTKAAS

SEQ ID NO: 1820034 - protein, 29 aa, Staphylococcus epidermidis
GNLGYITAVLLKKLYPTTKIIVFGKTLYK

SEQ ID NO: 1820035 - protein, 24 aa, Staphylococcus epidermidis
GNSKYLFNYFVKHNPMIESYFITD

SEQ ID NO: 1820036 - protein, 25 aa, Staphylococcus epidermidis
GNTNDRYKLIILRKGRGLAGMVMKT

SEQ ID NO: 1820037 - protein, 24 aa, Staphylococcus epidermidis
GPKLSMAIYQFYMGDTLNVLDKNP

SEQ ID NO: 1820038 - protein, 24 aa, Staphylococcus epidermidis
GPVNNGGVVLRWLRDEILASEVET

SEQ ID NO: 1820039 - protein, 22 aa, Staphylococcus epidermidis
GQGLLLLKNIQNIEPIVHGGGQ

SEQ ID NO: 1820040 - protein, 17 aa, Staphylococcus epidermidis
GQIFVVDITLKVDLSYA

SEQ ID NO: 1820041 - protein, 18 aa, Staphylococcus epidermidis
GQTLLPEVLSLYNSQFPN

SEQ ID NO: 1820042 - protein, 20 aa, Staphylococcus epidermidis
GRIIGDYRRVALYGVDFLME

SEQ ID NO: 1820043 - protein, 27 aa, Staphylococcus epidermidis
GRILNIHPSLLPKFKGLDAIGQALESG

SEQ ID NO: 1820044 - protein, 27 aa, Staphylococcus epidermidis
GRKTDERLWLLNRAGKIPFVVSGQGQE

SEQ ID NO: 1820045 - protein, 22 aa, Staphylococcus epidermidis
GRRFRFTALVVVGDKNGRVGFG

SEQ ID NO: 1820046 - protein, 24 aa, Staphylococcus epidermidis
GRTDKPILLKRGLSATIEEFIYAA

SEQ ID NO: 1820047 - protein, 26 aa, Staphylococcus epidermidis
GSDDYRYFPEPDIVPLYVDEDWKARV

SEQ ID NO: 1820048 - protein, 17 aa, Staphylococcus epidermidis
GSDIESYVFTEVALRNK

SEQ ID NO: 1820049 - protein, 39 aa, Staphylococcus epidermidis
GSEFPIVIMPIVRQYYRMLQRPILYTGLTRAKQSLVLLG

SEQ ID NO: 1820050 - protein, 25 aa, Staphylococcus epidermidis
GSGKTMIFDAIVYALYGMASTKTRK

SEQ ID NO: 1820051 - protein, 29 aa, Staphylococcus epidermidis
GSLAAFYYAVVAPYKRHPMIKLMNAMQYD

SEQ ID NO: 1820052 - protein, 23 aa, Staphylococcus epidermidis
GTAVIVSIFGHPVEFNPLLQMNK

SEQ ID NO: 1820053 - protein, 26 aa, Staphylococcus epidermidis
GTGKSHAFLLPLIQLIESDIQEPQAI

SEQ ID NO: 1820054 - protein, 18 aa, Staphylococcus epidermidis
GTILDAKASEHASRMTAM

SEQ ID NO: 1820055 - protein, 36 aa, Staphylococcus epidermidis
GTRILFVAATAPFTPFYRALDWIVTDPLAAIKDEIN

SEQ ID NO: 1820056 - protein, 26 aa, Staphylococcus epidermidis
GTTRALLNNMVLGVSQGYEKTLELVG

SEQ ID NO: 1820057 - protein, 26 aa, Staphylococcus epidermidis
GTVKNFRVTKIFGYFGLKREEIEEAQ

SEQ ID NO: 1820058 - protein, 25 aa, Staphylococcus epidermidis
GVCLNVGCIPSKALLHASHRFVEAQ

SEQ ID NO: 1820059 - protein, 27 aa, Staphylococcus epidermidis
GVCNGFQILTEIGLLPGALLHNDSHLF

SEQ ID NO: 1820060 - protein, 25 aa, Staphylococcus epidermidis
GVDFRLIEPAAFYHTLQHFTGSKDH

SEQ ID NO: 1820061 - protein, 25 aa, Staphylococcus epidermidis
GVGPLTITMVLNNTLLAEKLRRGLT

SEQ ID NO: 1820062 - protein, 23 aa, Staphylococcus epidermidis
GVGPVIEGGFYYDFDMDDKVSSD

SEQ ID NO: 1820063 - protein, 22 aa, Staphylococcus epidermidis
GVKTALWLQTTPLLKNRNKEWR

SEQ ID NO: 1820064 - protein, 23 aa, Staphylococcus epidermidis
GVNYYRPEMPNTHPLFIGAIVDE

SEQ ID NO: 1820065 - protein, 23 aa, Staphylococcus epidermidis
GVTLAAGYSLNWLKQTFFENESF

SEQ ID NO: 1820066 - protein, 18 aa, Staphylococcus epidermidis
HCGYFATTKKLMRKVPGR

SEQ ID NO: 1820067 - protein, 33 aa, Staphylococcus epidermidis
HDIKIDKRKMDLPHGIHALGYTNVPVKLDKEVE

SEQ ID NO: 1820068 - protein, 26 aa, Staphylococcus epidermidis
HDKQVKILARGPVFKGLLTSKSVDVI

SEQ ID NO: 1820069 - protein, 29 aa, Staphylococcus epidermidis
HDTTIANVVLAFYLTRPSLDVVIPGAKRA

SEQ ID NO: 1820070 - protein, 19 aa, Staphylococcus epidermidis
HDVYLKHFYDSIAPSFYYD

SEQ ID NO: 1820071 - protein, 23 aa, Staphylococcus epidermidis
HEVDSLYVFTKAASSLTGDEATI

SEQ ID NO: 1820072 - protein, 18 aa, Staphylococcus epidermidis
HEYLEGPIFISTDQPDPL

SEQ ID NO: 1820073 - protein, 28 aa, Staphylococcus epidermidis
HFIAEKDFFTFFRNFFTKKWEREIDTNM

SEQ ID NO: 1820074 - protein, 23 aa, Staphylococcus epidermidis
HFKQRIIHIPVLYGGDFGPDLSE

SEQ ID NO: 1820075 - protein, 26 aa, Staphylococcus epidermidis
HGQDHLMTTLLLKDLMKHLIELYKKG

SEQ ID NO: 1820076 - protein, 22 aa, Staphylococcus epidermidis
HHIQSPFLYMKALIDSIKLEIR

SEQ ID NO: 1820077 - protein, 20 aa, Staphylococcus epidermidis
HHYLILAQDTEEACLIMNTI

SEQ ID NO: 1820078 - protein, 18 aa, Staphylococcus epidermidis
HIAGLVAAGLHPNPVEYA

SEQ ID NO: 1820079 - protein, 17 aa, Staphylococcus epidermidis
HIDFIDRQIIQECLGHL

SEQ ID NO: 1820080 - protein, 25 aa, Staphylococcus epidermidis
HKHLDAIIVLSDYNRRYLSDFTGTS

SEQ ID NO: 1820081 - protein, 17 aa, Staphylococcus epidermidis
HKMLGPTGIGVLYGKRE

SEQ ID NO: 1820082 - protein, 24 aa, Staphylococcus epidermidis
HKYPDESELLIYFIEGLMSENQTD

SEQ ID NO: 1820083 - protein, 17 aa, Staphylococcus epidermidis
HLALPRKQEFIATLNRY

SEQ ID NO: 1820084 - protein, 22 aa, Staphylococcus epidermidis
HLESRFLPGRHYALFNLQGEID

SEQ ID NO: 1820085 - protein, 25 aa, Staphylococcus epidermidis
HLMNLKELFLVQLQERAIPFELNGS

SEQ ID NO: 1820086 - protein, 23 aa, Staphylococcus epidermidis
HLNGIMFYDYIDANEPLKPHEEA

SEQ ID NO: 1820087 - protein, 20 aa, Staphylococcus epidermidis
HLRADFDQRFQCNCGKSGCI

SEQ ID NO: 1820088 - protein, 24 aa, Staphylococcus epidermidis
HLVRRTFVEGSAVPALFGVQQDAT

SEQ ID NO: 1820089 - protein, 28 aa, Staphylococcus epidermidis
HMTIRENIVLVPKLLKWSKEKKDEKAKE

SEQ ID NO: 1820090 - protein, 25 aa, Staphylococcus epidermidis
HNEPSWMTELRKKALKLTETLEMPK

SEQ ID NO: 1820091 - protein, 30 aa, Staphylococcus epidermidis
HNITEDQMIDFLFTSALFGRVVANNASVAG

SEQ ID NO: 1820092 - protein, 24 aa, Staphylococcus epidermidis
HNKKNTQLPQMFGFQAEGASPIVQ

SEQ ID NO: 1820093 - protein, 23 aa, Staphylococcus epidermidis
HNKPHIMPVWSIKSRARKVRDQD

SEQ ID NO: 1820094 - protein, 27 aa, Staphylococcus epidermidis
HPDNPFDLTKVWYKKDYPLIEVGEFEL

SEQ ID NO: 1820095 - protein, 17 aa, Staphylococcus epidermidis
HPERMASRILGMGDVLS

SEQ ID NO: 1820096 - protein, 18 aa, Staphylococcus epidermidis
HQLLLVQVRHRDKYYFPG

SEQ ID NO: 1820097 - protein, 25 aa, Staphylococcus epidermidis
HQMMRVILIEQIYRAFKIMRGEAYH

SEQ ID NO: 1820098 - protein, 25 aa, Staphylococcus epidermidis
HRLTALHTALVNGGIFVYVPKNTVV

SEQ ID NO: 1820099 - protein, 25 aa, Staphylococcus epidermidis
HSGSMPMELFLRLKKYVQSGRLVIH

SEQ ID NO: 1820100 - protein, 27 aa, Staphylococcus epidermidis
HSHPASIALAYRLKGNQSCYLITDAMR

SEQ ID NO: 1820101 - protein, 24 aa, Staphylococcus epidermidis
HSHYKHLFAILELAKKQGIDKVYV

SEQ ID NO: 1820102 - protein, 24 aa, Staphylococcus epidermidis
HSQSLYNMFAAIPGVKVVVPSNPY

SEQ ID NO: 1820103 - protein, 17 aa, Staphylococcus epidermidis
HVHPLMFPSEQEGYRVI

SEQ ID NO: 1820104 - protein, 20 aa, Staphylococcus epidermidis
HVLTGLEFACGIPGSIGGAV

SEQ ID NO: 1820105 - protein, 23 aa, Staphylococcus epidermidis
HVMNLLMHVDQVSYVRFASVYKE

SEQ ID NO: 1820106 - protein, 27 aa, Staphylococcus epidermidis
HVTTPEWMLLPMHKGGTFGKFSTSIGL

SEQ ID NO: 1820107 - protein, 22 aa, Staphylococcus epidermidis
HYLTPNLWEQFNQGFYPLPRKD

SEQ ID NO: 1820108 - protein, 19 aa, Staphylococcus epidermidis
HYRRGVNLAIQYLSYKKRT

SEQ ID NO: 1820109 - protein, 19 aa, Staphylococcus epidermidis
HYVMIATGRPYRASQMYYH

SEQ ID NO: 1820110 - protein, 18 aa, Staphylococcus epidermidis
IAIVKLLHAYGVNNMIMC

SEQ ID NO: 1820111 - protein, 17 aa, Staphylococcus epidermidis
IAKNLDEFSHHLGMMFQ

SEQ ID NO: 1820112 - protein, 28 aa, Staphylococcus epidermidis
IAKRRNNMQWFKLPPKVYFEENSVMYLT

SEQ ID NO: 1820113 - protein, 32 aa, Staphylococcus epidermidis
IANRRSFIDKLKFPYFLGKSKYILVDDYHPMI

SEQ ID NO: 1820114 - protein, 26 aa, Staphylococcus epidermidis
IARKHNLHATFMPKPLFGVNGSGMHF

SEQ ID NO: 1820115 - protein, 17 aa, Staphylococcus epidermidis
IAVTPSEKTARQCAIVW

SEQ ID NO: 1820116 - protein, 20 aa, Staphylococcus epidermidis
IDCTQFPFRIARPGSITQDM

SEQ ID NO: 1820117 - protein, 18 aa, Staphylococcus epidermidis
IDDWQKVIDINLTGAFVG

SEQ ID NO: 1820118 - protein, 30 aa, Staphylococcus epidermidis
IDEMSMVDTWLFHQFLSAVPLEAQIVFVGD

SEQ ID NO: 1820119 - protein, 29 aa, Staphylococcus epidermidis
IDGNEYIDYVLSWGPLILGHKNQQVISKL

SEQ ID NO: 1820120 - protein, 24 aa, Staphylococcus epidermidis
IDILNPYLCIIFCNSRENADELAD

SEQ ID NO: 1820121 - protein, 18 aa, Staphylococcus epidermidis
IDKDKLLDLIQKYKHMHP

SEQ ID NO: 1820122 - protein, 22 aa, Staphylococcus epidermidis
IDNDGYFWFEGRRDDIIISSGY

SEQ ID NO: 1820123 - protein, 21 aa, Staphylococcus epidermidis
IDQHDIFGVIGYSGAGKSTLV

SEQ ID NO: 1820124 - protein, 30 aa, Staphylococcus epidermidis
IDTVHEYFNGLYIITPFQKVDYSLELAAYS

SEQ ID NO: 1820125 - protein, 28 aa, Staphylococcus epidermidis
IDTYQWLQALLLRKFPQHHFEFTYIDIR

SEQ ID NO: 1820126 - protein, 25 aa, Staphylococcus epidermidis
IDVHDTFIKLLQHPTIASKHHLYEQ

SEQ ID NO: 1820127 - protein, 19 aa, Staphylococcus epidermidis
IDYRLLTHKMHHATTIYLY

SEQ ID NO: 1820128 - protein, 23 aa, Staphylococcus epidermidis
IEAIKNSKFPVLLAGMRSSSQAE

SEQ ID NO: 1820129 - protein, 17 aa, Staphylococcus epidermidis
IEARYFEALGDTSYEMP

SEQ ID NO: 1820130 - protein, 20 aa, Staphylococcus epidermidis
IEDLRIISCHIGNGASIAAI

SEQ ID NO: 1820131 - protein, 22 aa, Staphylococcus epidermidis
IEEAFVVKQILQHLAAKHGINF

SEQ ID NO: 1820132 - protein, 29 aa, Staphylococcus epidermidis
IEFAWEFLTSDKWMGMEPEKLYVTIHPED

SEQ ID NO: 1820133 - protein, 19 aa, Staphylococcus epidermidis
IEFYLIPTKGSAKVDKTLE

SEQ ID NO: 1820134 - protein, 24 aa, Staphylococcus epidermidis
IEGIEFVEFLISPNRGEPLKSLNK

SEQ ID NO: 1820135 - protein, 18 aa, Staphylococcus epidermidis
IELICDRAVFLRDGKFVQ

SEQ ID NO: 1820136 - protein, 19 aa, Staphylococcus epidermidis
IELNPFITDYELCEKFDVS

SEQ ID NO: 1820137 - protein, 24 aa, Staphylococcus epidermidis
IENIQPFLYHFYDMSVGICHNGNL

SEQ ID NO: 1820138 - protein, 24 aa, Staphylococcus epidermidis
IEPKTMMSKLVPGLFLCGEVLDIH

SEQ ID NO: 1820139 - protein, 17 aa, Staphylococcus epidermidis
IEQGLTPEGILNEILGE

SEQ ID NO: 1820140 - protein, 23 aa, Staphylococcus epidermidis
IERIKEIVPIWKKEIWEDGAEWQ

SEQ ID NO: 1820141 - protein, 24 aa, Staphylococcus epidermidis
IERLARRIFKDPLSTFKKVVAIEI

SEQ ID NO: 1820142 - protein, 24 aa, Staphylococcus epidermidis
IETKSYLLDIQKRGYYVVLASGRP

SEQ ID NO: 1820143 - protein, 18 aa, Staphylococcus epidermidis
IETLMSQFNLIDNRPESL

SEQ ID NO: 1820144 - protein, 22 aa, Staphylococcus epidermidis
IEVEYDICIFATGSKAFVLPIP

SEQ ID NO: 1820145 - protein, 17 aa, Staphylococcus epidermidis
IFGDREMFFISENGAVI

SEQ ID NO: 1820146 - protein, 31 aa, Staphylococcus epidermidis
IGGLALGLAVTGFRPVMEIQFLGFVYEVFDE

SEQ ID NO: 1820147 - protein, 28 aa, Staphylococcus epidermidis
IGLLKIDFLGLRNLSIIHQIILQVKKDL

SEQ ID NO: 1820148 - protein, 19 aa, Staphylococcus epidermidis
IGMPLEELIEILTMIYEED

SEQ ID NO: 1820149 - protein, 28 aa, Staphylococcus epidermidis
IGRAIVKRLLFEGYEVFLHYHSAQYSDL

SEQ ID NO: 1820150 - protein, 30 aa, Staphylococcus epidermidis
IHNVCVVVTRYFGGIKLGAGGLIRAYSGAV

SEQ ID NO: 1820151 - protein, 24 aa, Staphylococcus epidermidis
IHTVEKFLMYKDFDEIIIATPQKW

SEQ ID NO: 1820152 - protein, 19 aa, Staphylococcus epidermidis
IHVINLLKDDVKVGFIALE

SEQ ID NO: 1820153 - protein, 28 aa, Staphylococcus epidermidis
IICKPHPFTQLLHDAIRLAYNYDISCVH

SEQ ID NO: 1820154 - protein, 19 aa, Staphylococcus epidermidis
IIDAIGQLIGMRASSDYVR

SEQ ID NO: 1820155 - protein, 24 aa, Staphylococcus epidermidis
IIDVDMYIIVSYGVKISEVASNLQ

SEQ ID NO: 1820156 - protein, 26 aa, Staphylococcus epidermidis
IIEINCHGGILTINRILELTMTYGAR

SEQ ID NO: 1820157 - protein, 20 aa, Staphylococcus epidermidis
IIENLPKVRDGHIKAWVNIM

SEQ ID NO: 1820158 - protein, 23 aa, Staphylococcus epidermidis
IIGNGFSVIYLISQRLVKKSLDD

SEQ ID NO: 1820159 - protein, 33 aa, Staphylococcus epidermidis
IIKDFIVRYKTMQGFYAPYVPGWDTHGLPIEQA

SEQ ID NO: 1820160 - protein, 26 aa, Staphylococcus epidermidis
IINDQPLFKFAPLTTGDTGLLTQWTM

SEQ ID NO: 1820161 - protein, 17 aa, Staphylococcus epidermidis
IIPGLYAYEAGQPAVGD

SEQ ID NO: 1820162 - protein, 20 aa, Staphylococcus epidermidis
IIPMIDYFKNKNIEVRFIEF

SEQ ID NO: 1820163 - protein, 24 aa, Staphylococcus epidermidis
IIQPHPMALNYIYYDIYTQMIEMT

SEQ ID NO: 1820164 - protein, 17 aa, Staphylococcus epidermidis
IIVFHKLTKDELKEIVT

SEQ ID NO: 1820165 - protein, 18 aa, Staphylococcus epidermidis
IKEPIRFLQVRIPVRMDD

SEQ ID NO: 1820166 - protein, 30 aa, Staphylococcus epidermidis
IKEVKLLNEFAINGLYPDLTIYLDVDAEIG

SEQ ID NO: 1820167 - protein, 18 aa, Staphylococcus epidermidis
IKLKRGPATNPLFKSFFN

SEQ ID NO: 1820168 - protein, 18 aa, Staphylococcus epidermidis
IKMLFLQGIHKKIGYEGS

SEQ ID NO: 1820169 - protein, 17 aa, Staphylococcus epidermidis
IKNGYIFKIGKAGNPDI

SEQ ID NO: 1820170 - protein, 21 aa, Staphylococcus epidermidis
IKSFRSIIERISGEEYDKVEI

SEQ ID NO: 1820171 - protein, 17 aa, Staphylococcus epidermidis
IKSNRLKGLSLKDVNLS

SEQ ID NO: 1820172 - protein, 21 aa, Staphylococcus epidermidis
IKVTAWMPLMRNKGLLDDPVI

SEQ ID NO: 1820173 - protein, 29 aa, Staphylococcus epidermidis
ILEGYHTLLTIGRFPICYINIQMDPILVD

SEQ ID NO: 1820174 - protein, 17 aa, Staphylococcus epidermidis
ILKASCKAYIDAHAKYI

SEQ ID NO: 1820175 - protein, 17 aa, Staphylococcus epidermidis
ILLQVLLHSSIGKKEGY

SEQ ID NO: 1820176 - protein, 18 aa, Staphylococcus epidermidis
ILPGGESTTLRRLMDLYG

SEQ ID NO: 1820177 - protein, 19 aa, Staphylococcus epidermidis
ILPQDSAKWRYIENRLHTL

SEQ ID NO: 1820178 - protein, 20 aa, Staphylococcus epidermidis
ILSERLQESAFLLKDLKITL

SEQ ID NO: 1820179 - protein, 19 aa, Staphylococcus epidermidis
IMDYIAPVGTIYQAGTLSG

SEQ ID NO: 1820180 - protein, 22 aa, Staphylococcus epidermidis
IMKEEIFGPILPIITYDNFDEV

SEQ ID NO: 1820181 - protein, 26 aa, Staphylococcus epidermidis
INAAKALAFAYDKPIIPVHHIAGHIY

SEQ ID NO: 1820182 - protein, 27 aa, Staphylococcus epidermidis
INFLHDIQVDRIIFGDPAVVMYVKQHE

SEQ ID NO: 1820183 - protein, 18 aa, Staphylococcus epidermidis
INPNLQGQLFKLLEFSNM

SEQ ID NO: 1820184 - protein, 23 aa, Staphylococcus epidermidis
IPGNGKFLYSPFSVFDNLSIINF

SEQ ID NO: 1820185 - protein, 18 aa, Staphylococcus epidermidis
IPHGRTNAILLPHVIRYN

SEQ ID NO: 1820186 - protein, 17 aa, Staphylococcus epidermidis
IPKVHLKRVSKSGFGPF

SEQ ID NO: 1820187 - protein, 25 aa, Staphylococcus epidermidis
IPMDQKFIFNPYETKSLAGFDIESF

SEQ ID NO: 1820188 - protein, 17 aa, Staphylococcus epidermidis
IPVIREQHDSFKGIDAV

SEQ ID NO: 1820189 - protein, 18 aa, Staphylococcus epidermidis
IQAQVVNLLLKLQRERDI

SEQ ID NO: 1820190 - protein, 26 aa, Staphylococcus epidermidis
IQEGDTIPIYLKRNPNFKFPQDESTP

SEQ ID NO: 1820191 - protein, 36 aa, Staphylococcus epidermidis
IQIHTQQPYLIYMLGFMPGFPYLGGLDAKLHTPRRS

SEQ ID NO: 1820192 - protein, 19 aa, Staphylococcus epidermidis
IQLLAPVISHRKGSHEKLI

SEQ ID NO: 1820193 - protein, 18 aa, Staphylococcus epidermidis
IQQGWFDFDVVVATPDMM

SEQ ID NO: 1820194 - protein, 24 aa, Staphylococcus epidermidis
IQTWAIKFDIYLSIKKKQGIMIDA

SEQ ID NO: 1820195 - protein, 26 aa, Staphylococcus epidermidis
IRANNHLIILVMVFSSGHVENIHFVS

SEQ ID NO: 1820196 - protein, 20 aa, Staphylococcus epidermidis
IREGGIRGIVLSLLSLNHIE

SEQ ID NO: 1820197 - protein, 18 aa, Staphylococcus epidermidis
IRLIPGLENVDIVRYGVM

SEQ ID NO: 1820198 - protein, 26 aa, Staphylococcus epidermidis
IRLKSKKGTLLWLMDETKTPMGARRL

SEQ ID NO: 1820199 - protein, 31 aa, Staphylococcus epidermidis
ISDITRPTPNHILVPLLIEELNHVPRENFVI

SEQ ID NO: 1820200 - protein, 20 aa, Staphylococcus epidermidis
ISKRFSSIQDYILEYCNFGC

SEQ ID NO: 1820201 - protein, 18 aa, Staphylococcus epidermidis
ISLDWECLIISKTDMLLD

SEQ ID NO: 1820202 - protein, 30 aa, Staphylococcus epidermidis
ISSKPPILLTPLFPTYFFPTHSDRQEENIW

SEQ ID NO: 1820203 - protein, 27 aa, Staphylococcus epidermidis
ITGQKADLLLWFLRPEMKELNQIENEF

SEQ ID NO: 1820204 - protein, 22 aa, Staphylococcus epidermidis
ITKLTKPLIENAAIFFDNEELS

SEQ ID NO: 1820205 - protein, 24 aa, Staphylococcus epidermidis
ITNYFKPIEKLLEALSLDVNPIPI

SEQ ID NO: 1820206 - protein, 24 aa, Staphylococcus epidermidis
IVAQAPVRLFASGMSDGLATLIEV

SEQ ID NO: 1820207 - protein, 26 aa, Staphylococcus epidermidis
IVASMSYFFNLLNGIGYTDDIDHLGN

SEQ ID NO: 1820208 - protein, 17 aa, Staphylococcus epidermidis
IVDIGYLDTFIEGIKPL

SEQ ID NO: 1820209 - protein, 25 aa, Staphylococcus epidermidis
IVDKILTQLNMRLLDQHISIEVTEE

SEQ ID NO: 1820210 - protein, 24 aa, Staphylococcus epidermidis
IVGPGNQYVAYAKKFVFGQVGIDQ

SEQ ID NO: 1820211 - protein, 17 aa, Staphylococcus epidermidis
IVHEHRHLLKGNVVFIF

SEQ ID NO: 1820212 - protein, 19 aa, Staphylococcus epidermidis
IVITHRKGTMEFSDRLYGV

SEQ ID NO: 1820213 - protein, 19 aa, Staphylococcus epidermidis
IVKQYPMVPGIDLAGTIEE

SEQ ID NO: 1820214 - protein, 20 aa, Staphylococcus epidermidis
IVPWQQLAKRKNATLKFIPM

SEQ ID NO: 1820215 - protein, 25 aa, Staphylococcus epidermidis
IVQIIYEAILKLQNPARKDDMTILI

SEQ ID NO: 1820216 - protein, 17 aa, Staphylococcus epidermidis
IVTIFPDGSDRYMSKQI

SEQ ID NO: 1820217 - protein, 25 aa, Staphylococcus epidermidis
IVVGIAFIIELKYLNGIDKIKDYDV

SEQ ID NO: 1820218 - protein, 17 aa, Staphylococcus epidermidis
IWQLFKDANYERVEFET

SEQ ID NO: 1820219 - protein, 20 aa, Staphylococcus epidermidis
IYAHVMHTHLLINFVTRTEG

SEQ ID NO: 1820220 - protein, 24 aa, Staphylococcus epidermidis
IYKSIQAQILFNKVAQRPGSVTTV

SEQ ID NO: 1820221 - protein, 17 aa, Staphylococcus epidermidis
IYNYPTHQTFFSSSDKL

SEQ ID NO: 1820222 - protein, 26 aa, Staphylococcus epidermidis
IYTGSLYLSLISLLETRDLKGGQTIG

SEQ ID NO: 1820223 - protein, 24 aa, Staphylococcus epidermidis
KAAMLLIPEPWLYNESNDKKVRSF

SEQ ID NO: 1820224 - protein, 26 aa, Staphylococcus epidermidis
KADQYFDRILLLNQSLQFLGPTKEAL

SEQ ID NO: 1820225 - protein, 24 aa, Staphylococcus epidermidis
KAIDYLREKGIAKAAKKADRIAAE

SEQ ID NO: 1820226 - protein, 26 aa, Staphylococcus epidermidis
KALFAAAFISHFSGDIPHIHFDIAGP

SEQ ID NO: 1820227 - protein, 18 aa, Staphylococcus epidermidis
KAMGFLVGQIMKASKGQA

SEQ ID NO: 1820228 - protein, 23 aa, Staphylococcus epidermidis
KANPFTRLIRAKATLTKAGMTVI

SEQ ID NO: 1820229 - protein, 19 aa, Staphylococcus epidermidis
KAPEIGLATVYRTLELLAE

SEQ ID NO: 1820230 - protein, 19 aa, Staphylococcus epidermidis
KAQFKRLWSIRNDQYSDKR

SEQ ID NO: 1820231 - protein, 25 aa, Staphylococcus epidermidis
KCPKNYLAHVLSRYGFNVKKEKKLM

SEQ ID NO: 1820232 - protein, 25 aa, Staphylococcus epidermidis
KDDDTLVLVGFGGGLTWGAIVIKWG

SEQ ID NO: 1820233 - protein, 24 aa, Staphylococcus epidermidis
KDDEVIWLYQYFTDVKIAPTTYTV

SEQ ID NO: 1820234 - protein, 18 aa, Staphylococcus epidermidis
KDFFNRDRFILSAGHGSA

SEQ ID NO: 1820235 - protein, 17 aa, Staphylococcus epidermidis
KDKCEVIYLNRTEGIST

SEQ ID NO: 1820236 - protein, 23 aa, Staphylococcus epidermidis
KDLKIAIVVSRFNDFITTRLLEG

SEQ ID NO: 1820237 - protein, 21 aa, Staphylococcus epidermidis
KDLRRLGLRVYFNINNALVSL

SEQ ID NO: 1820238 - protein, 23 aa, Staphylococcus epidermidis
KDNSDLIYISQKGKFDAVVEDVV

SEQ ID NO: 1820239 - protein, 28 aa, Staphylococcus epidermidis
KDRAELLLRVAAIIRRRKEEISAIMVYE

SEQ ID NO: 1820240 - protein, 23 aa, Staphylococcus epidermidis
KDRPLVCVGILKGSVMFMADLIK

SEQ ID NO: 1820241 - protein, 36 aa, Staphylococcus epidermidis
KDRVKLALLASFKNKSLLKFYCKETQWFSNKEIDTI

SEQ ID NO: 1820242 - protein, 29 aa, Staphylococcus epidermidis
KDSEDYYKFKQMLLYIMTDLAKSIARDGE

SEQ ID NO: 1820243 - protein, 18 aa, Staphylococcus epidermidis
KEAMMLVPEIALTPQMVL

SEQ ID NO: 1820244 - protein, 26 aa, Staphylococcus epidermidis
KEFNKNDTYYIVCAAGSRSAKVVSYL

SEQ ID NO: 1820245 - protein, 23 aa, Staphylococcus epidermidis
KEIAKKIAILPQSPEVPDGLTVG

SEQ ID NO: 1820246 - protein, 17 aa, Staphylococcus epidermidis
KEIKGTRILFVAATAPF

SEQ ID NO: 1820247 - protein, 18 aa, Staphylococcus epidermidis
KEMFLEDLGIEEPGLDRL

SEQ ID NO: 1820248 - protein, 28 aa, Staphylococcus epidermidis
KEPIYGNTYLPRKFKIGIAVPPSNDIDV

SEQ ID NO: 1820249 - protein, 24 aa, Staphylococcus epidermidis
KESDLVIGAVLIPGAKAPNLVTED

SEQ ID NO: 1820250 - protein, 26 aa, Staphylococcus epidermidis
KESEGRIILFIDEIHMLVGAGKTDGA

SEQ ID NO: 1820251 - protein, 24 aa, Staphylococcus epidermidis
KESILSVILPQYVESLIYGTILDA

SEQ ID NO: 1820252 - protein, 26 aa, Staphylococcus epidermidis
KESVKGSLKRLGLNHLDLYQLHGGTI

SEQ ID NO: 1820253 - protein, 20 aa, Staphylococcus epidermidis
KEYFDLNCYLTLLDVLDSHH

SEQ ID NO: 1820254 - protein, 23 aa, Staphylococcus epidermidis
KFEILPYHQLGVHKWKNLGIPYQ

SEQ ID NO: 1820255 - protein, 17 aa, Staphylococcus epidermidis
KFLHVHLVKNQKLINKI

SEQ ID NO: 1820256 - protein, 21 aa, Staphylococcus epidermidis
KFVPNISIGIPILDAVRQQSH

SEQ ID NO: 1820257 - protein, 25 aa, Staphylococcus epidermidis
KFVTNDHLIFFNIAASMGSIRFMNV

SEQ ID NO: 1820258 - protein, 22 aa, Staphylococcus epidermidis
KFYNDHFVIQYFSGLIGGKGRR

SEQ ID NO: 1820259 - protein, 21 aa, Staphylococcus epidermidis
KGDVALFFGLSGTGKTTLSAD

SEQ ID NO: 1820260 - protein, 18 aa, Staphylococcus epidermidis
KGFGRRKMDLTPNEIYNL

SEQ ID NO: 1820261 - protein, 26 aa, Staphylococcus epidermidis
KGFYHAWQRLVKHDPLFTKKQRLTLA

SEQ ID NO: 1820262 - protein, 24 aa, Staphylococcus epidermidis
KGHDAFKLYDTYGFPIELTEELAT

SEQ ID NO: 1820263 - protein, 38 aa, Staphylococcus epidermidis
KGIEPQTLKLFKVCKMRGIPIFTFINKLDRVGKEPFEL

SEQ ID NO: 1820264 - protein, 26 aa, Staphylococcus epidermidis
KGIRDKVIIELLYATGIRVSELINIK

SEQ ID NO: 1820265 - protein, 17 aa, Staphylococcus epidermidis
KGIYLLDVPLSEYQEHH

SEQ ID NO: 1820266 - protein, 25 aa, Staphylococcus epidermidis
KGKSKIPRYFLLAETEAFEPGKNYT

SEQ ID NO: 1820267 - protein, 17 aa, Staphylococcus epidermidis
KGLGVLARKYKLPIYAN

SEQ ID NO: 1820268 - protein, 20 aa, Staphylococcus epidermidis
KGLIYKGKKPVYWSPSSESS

SEQ ID NO: 1820269 - protein, 25 aa, Staphylococcus epidermidis
KGLNIKGLINIQFVIAHDGVYVLEV

SEQ ID NO: 1820270 - protein, 23 aa, Staphylococcus epidermidis
KGRIKEVYADDLSLLDGGRNSYA

SEQ ID NO: 1820271 - protein, 31 aa, Staphylococcus epidermidis
KGSIVGFFTPELFHGIGSAGFHIHFANDDRD

SEQ ID NO: 1820272 - protein, 25 aa, Staphylococcus epidermidis
KGSNFDILPLIYQLPNDTIKIHELP

SEQ ID NO: 1820273 - protein, 18 aa, Staphylococcus epidermidis
KGYPHAIGHVRYATSGNK

SEQ ID NO: 1820274 - protein, 21 aa, Staphylococcus epidermidis
KHCDFFSFGTNDLTQLTFGFS

SEQ ID NO: 1820275 - protein, 25 aa, Staphylococcus epidermidis
KHFYDSIAPSFYYDFNGQLSLCDIG

SEQ ID NO: 1820276 - protein, 20 aa, Staphylococcus epidermidis
KHGIKMIYGMEGMLVDDGVP

SEQ ID NO: 1820277 - protein, 24 aa, Staphylococcus epidermidis
KHVEVMVRQMLRKVRIIEAGDTKL

SEQ ID NO: 1820278 - protein, 18 aa, Staphylococcus epidermidis
KHYSPETPLTIVKDLNKK

SEQ ID NO: 1820279 - protein, 24 aa, Staphylococcus epidermidis
KIAKFYDFIEVQPPALYQDLMDRE

SEQ ID NO: 1820280 - protein, 21 aa, Staphylococcus epidermidis
KIIFTRTFSAPINKVFDAYTK

SEQ ID NO: 1820281 - protein, 21 aa, Staphylococcus epidermidis
KIILGNTYHLWLQPGNDIIKH

SEQ ID NO: 1820282 - protein, 30 aa, Staphylococcus epidermidis
KIKSEYDDCLLFFRLGDFYEMFFDDAKEAS

SEQ ID NO: 1820283 - protein, 28 aa, Staphylococcus epidermidis
KIVDLAEQLITFIPHSLLTLDNVKYNER

SEQ ID NO: 1820284 - protein, 25 aa, Staphylococcus epidermidis
KIYRDKLDYILKRLKPYNTQIKIEG

SEQ ID NO: 1820285 - protein, 28 aa, Staphylococcus epidermidis
KKANDKLVKLLVPSLKKKAAQGNNPLEN

SEQ ID NO: 1820286 - protein, 20 aa, Staphylococcus epidermidis
KKEHMVYPGMVYISHPTEYG

SEQ ID NO: 1820287 - protein, 25 aa, Staphylococcus epidermidis
KKEQIVLFLNRRGYASFMLCRDCGY

SEQ ID NO: 1820288 - protein, 17 aa, Staphylococcus epidermidis
KKHNCLYVLVDPYVLEN

SEQ ID NO: 1820289 - protein, 20 aa, Staphylococcus epidermidis
KKIVLARRRLVKFDKKINIP

SEQ ID NO: 1820290 - protein, 19 aa, Staphylococcus epidermidis
KKLMPEIIEFSELGEFIYQ

SEQ ID NO: 1820291 - protein, 27 aa, Staphylococcus epidermidis
KKLVKKTFPGYVLVELIMTDESWYVVR

SEQ ID NO: 1820292 - protein, 26 aa, Staphylococcus epidermidis
KKQFDQIFDLLAIRIIVNSINDCYAT

SEQ ID NO: 1820293 - protein, 26 aa, Staphylococcus epidermidis
KKQLNHISSYYKFKQPSLLYDQQIQK

SEQ ID NO: 1820294 - protein, 31 aa, Staphylococcus epidermidis
KKRHAKRRLTYHTYLALYKQILKDDGEIHFK

SEQ ID NO: 1820295 - protein, 18 aa, Staphylococcus epidermidis
KKSKFTAKFLHYKNKPYK

SEQ ID NO: 1820296 - protein, 41 aa, Staphylococcus epidermidis
KLAIEYKMAFPLHPEFRTMPMVWYCPPLSPIMSYFEGENAG

SEQ ID NO: 1820297 - protein, 17 aa, Staphylococcus epidermidis
KLDIEVSIMDFDRDEWA

SEQ ID NO: 1820298 - protein, 28 aa, Staphylococcus epidermidis
KLGIDLNYILLENFKFNELMVAIQSPFL

SEQ ID NO: 1820299 - protein, 18 aa, Staphylococcus epidermidis
KLINLKEALIHYLEHQKT

SEQ ID NO: 1820300 - protein, 20 aa, Staphylococcus epidermidis
KLKNLYFLQENAKQSIASMS

SEQ ID NO: 1820301 - protein, 32 aa, Staphylococcus epidermidis
KLNVESAGIIKKLFLLGIMANINQSLDEETLE

SEQ ID NO: 1820302 - protein, 20 aa, Staphylococcus epidermidis
KLPFIEFQADPIYINQIKQW

SEQ ID NO: 1820303 - protein, 19 aa, Staphylococcus epidermidis
KLQELIDLGIDPFGHRFNR

SEQ ID NO: 1820304 - protein, 26 aa, Staphylococcus epidermidis
KLQQLDLPMFGTCAGLIVLAKNVENE

SEQ ID NO: 1820305 - protein, 18 aa, Staphylococcus epidermidis
KLQQQLGKTFIFVTHDMD

SEQ ID NO: 1820306 - protein, 25 aa, Staphylococcus epidermidis
KLRQEPLDHVLLFGPPGLGKTTLSN

SEQ ID NO: 1820307 - protein, 20 aa, Staphylococcus epidermidis
KLRRPDLTFATLDHNVPTID

SEQ ID NO: 1820308 - protein, 20 aa, Staphylococcus epidermidis
KLSFKYIDRILLNWKKNNVK

SEQ ID NO: 1820309 - protein, 27 aa, Staphylococcus epidermidis
KMFHPVHTYKMKFIKSFKAVNLHQSIF

SEQ ID NO: 1820310 - protein, 24 aa, Staphylococcus epidermidis
KMRQQSNVPILFLSSRDNPMDQVM

SEQ ID NO: 1820311 - protein, 25 aa, Staphylococcus epidermidis
KNAVKYFYPYLKNVKVKKVAVIGDK

SEQ ID NO: 1820312 - protein, 21 aa, Staphylococcus epidermidis
KNHQLLLSIHPSFSRLQLTTK

SEQ ID NO: 1820313 - protein, 19 aa, Staphylococcus epidermidis
KNIDNPHKDLRRARSCNES

SEQ ID NO: 1820314 - protein, 22 aa, Staphylococcus epidermidis
KNIDVREFIQLNYSLYEGDDEF

SEQ ID NO: 1820315 - protein, 17 aa, Staphylococcus epidermidis
KNLYASEYIWNSIKDNK

SEQ ID NO: 1820316 - protein, 23 aa, Staphylococcus epidermidis
KNLYILGVSERIGRLFDITGLKD

SEQ ID NO: 1820317 - protein, 21 aa, Staphylococcus epidermidis
KNRIFYGCSRYPECDFISWDK

SEQ ID NO: 1820318 - protein, 29 aa, Staphylococcus epidermidis
KNRTWTFQISLPHFLSHEDYLLFTHAIEE

SEQ ID NO: 1820319 - protein, 19 aa, Staphylococcus epidermidis
KNVPLIKYSIDQMIKTKEG

SEQ ID NO: 1820320 - protein, 17 aa, Staphylococcus epidermidis
KPIIPVHHIAGHIYANH

SEQ ID NO: 1820321 - protein, 18 aa, Staphylococcus epidermidis
KPINKPMYNIYRTLKKLK

SEQ ID NO: 1820322 - protein, 17 aa, Staphylococcus epidermidis
KPKMEGRQMFIMLAPIN

SEQ ID NO: 1820323 - protein, 26 aa, Staphylococcus epidermidis
KPYHYENYSKVYPKFILGFGGIKKEE

SEQ ID NO: 1820324 - protein, 21 aa, Staphylococcus epidermidis
KQEVDFIIIAGDLFDSENRTL

SEQ ID NO: 1820325 - protein, 19 aa, Staphylococcus epidermidis
KQILGVDPAFRTGCKLAVV

SEQ ID NO: 1820326 - protein, 21 aa, Staphylococcus epidermidis
KQRHFWLQQFENQVPILNMPT

SEQ ID NO: 1820327 - protein, 23 aa, Staphylococcus epidermidis
KQRNILNLVCAWTKRLNLSDDEV

SEQ ID NO: 1820328 - protein, 25 aa, Staphylococcus epidermidis
KQYPHTVLFVTHDRYFLNEVSTRII

SEQ ID NO: 1820329 - protein, 32 aa, Staphylococcus epidermidis
KRGIFTIGDLAKYPYHYLKRDFGVLGIDMHLH

SEQ ID NO: 1820330 - protein, 18 aa, Staphylococcus epidermidis
KRIKQIILVSPTLGSHML

SEQ ID NO: 1820331 - protein, 30 aa, Staphylococcus epidermidis
KRMEGYQEARWILIDLANVVVHVFHKDERS

SEQ ID NO: 1820332 - protein, 17 aa, Staphylococcus epidermidis
KRSIAFGVAKVLDRLGA

SEQ ID NO: 1820333 - protein, 25 aa, Staphylococcus epidermidis
KSEKTEVTIFFLNGFQMKGVVENYD

SEQ ID NO: 1820334 - protein, 27 aa, Staphylococcus epidermidis
KSELGSRMRLRIIPELTFEYDESIEYG

SEQ ID NO: 1820335 - protein, 26 aa, Staphylococcus epidermidis
KSLQLLDTPGILWPKFEDEEVGKKLS

SEQ ID NO: 1820336 - protein, 24 aa, Staphylococcus epidermidis
KSQKLIVQTVPKSKLDFLANAPHQ

SEQ ID NO: 1820337 - protein, 21 aa, Staphylococcus epidermidis
KSTHPLLQSDVYFVHSYQAEM

SEQ ID NO: 1820338 - protein, 24 aa, Staphylococcus epidermidis
KSTLINILGFIDRGYEGEYFFNNE

SEQ ID NO: 1820339 - protein, 22 aa, Staphylococcus epidermidis
KSWMLKALEPMGEEYLNVVKEG

SEQ ID NO: 1820340 - protein, 18 aa, Staphylococcus epidermidis
KSYIFEIASNWKKIGISN

SEQ ID NO: 1820341 - protein, 17 aa, Staphylococcus epidermidis
KTGAFGIPLIEKVVGQQ

SEQ ID NO: 1820342 - protein, 32 aa, Staphylococcus epidermidis
KTRLSLAQMLLKEPDLLLLDEPTNHLDMETTK

SEQ ID NO: 1820343 - protein, 26 aa, Staphylococcus epidermidis
KTSIATMIHLIYRKLNKNSAYLGTNG

SEQ ID NO: 1820344 - protein, 41 aa, Staphylococcus epidermidis
KTTTAGKLALLMRKKYNKKPLLVAGDIYRPAAIDQLQTVGK

SEQ ID NO: 1820345 - protein, 20 aa, Staphylococcus epidermidis
KTVIISTGASWRKLNIPGED

SEQ ID NO: 1820346 - protein, 21 aa, Staphylococcus epidermidis
KVDADRLLDFKDRLATELKQA

SEQ ID NO: 1820347 - protein, 27 aa, Staphylococcus epidermidis
KVDSDAQFIIWTTTPWTIPSNVAITVH

SEQ ID NO: 1820348 - protein, 27 aa, Staphylococcus epidermidis
KVEEYVDIVEIGTPIVINEGLPAVQHL

SEQ ID NO: 1820349 - protein, 17 aa, Staphylococcus epidermidis
KVFVRNALSPSQVLEVI

SEQ ID NO: 1820350 - protein, 17 aa, Staphylococcus epidermidis
KVIDINLTGAFVGSREA

SEQ ID NO: 1820351 - protein, 17 aa, Staphylococcus epidermidis
KVLKSHMIIFKPSQPIT

SEQ ID NO: 1820352 - protein, 20 aa, Staphylococcus epidermidis
KVLQFYVKYGGEFQLKQGFS

SEQ ID NO: 1820353 - protein, 22 aa, Staphylococcus epidermidis
KVNIMIGLLSRPKILILDEPTE

SEQ ID NO: 1820354 - protein, 29 aa, Staphylococcus epidermidis
KVNYKLRDWLFSRQRYWGEPIPIIHWEDG

SEQ ID NO: 1820355 - protein, 19 aa, Staphylococcus epidermidis
KVRGLNEFYYAIPERYKMS

SEQ ID NO: 1820356 - protein, 41 aa, Staphylococcus epidermidis
KVRQRVMELLLLLDEKIYYSYRMDNLIVSYLIQAHLKKNNK

SEQ ID NO: 1820357 - protein, 19 aa, Staphylococcus epidermidis
KVYIEPLTHDFIARIIRKE

SEQ ID NO: 1820358 - protein, 28 aa, Staphylococcus epidermidis
KYNCNVYLKREDLQWVRSFKLRGAYNAI

SEQ ID NO: 1820359 - protein, 21 aa, Staphylococcus epidermidis
KYTIAKFYKLYMERSNAGQPE

SEQ ID NO: 1820360 - protein, 31 aa, Staphylococcus epidermidis
KYVNKFVRIFNFPFYFRGEVYDPFETLTLSE

SEQ ID NO: 1820361 - protein, 26 aa, Staphylococcus epidermidis
LAEEYQCPVILLSDLQLSLGKQTVKT

SEQ ID NO: 1820362 - protein, 23 aa, Staphylococcus epidermidis
LAGDRFVVFGDEKQARRIGEARH

SEQ ID NO: 1820363 - protein, 21 aa, Staphylococcus epidermidis
LALNQSRHYKLESLFNIINAC

SEQ ID NO: 1820364 - protein, 25 aa, Staphylococcus epidermidis
LASYINIPVGVLLPFKSQCFVRHYN

SEQ ID NO: 1820365 - protein, 19 aa, Staphylococcus epidermidis
LCERFNIYTQRISMPYLRS

SEQ ID NO: 1820366 - protein, 18 aa, Staphylococcus epidermidis
LCIEIETELNPQSLLKCC

SEQ ID NO: 1820367 - protein, 25 aa, Staphylococcus epidermidis
LCRYEMLKILRFCSGLNLIPTFKII

SEQ ID NO: 1820368 - protein, 23 aa, Staphylococcus epidermidis
LDALLIAEPSFPSLVYAHKGSMD

SEQ ID NO: 1820369 - protein, 27 aa, Staphylococcus epidermidis
LDEVDATIIRLAVDGLWLSEIFGISAI

SEQ ID NO: 1820370 - protein, 25 aa, Staphylococcus epidermidis
LDFGKIKLYVGNYDFWYQSSQLAQK

SEQ ID NO: 1820371 - protein, 19 aa, Staphylococcus epidermidis
LDGLIKDLRRLGLRVYFNI

SEQ ID NO: 1820372 - protein, 30 aa, Staphylococcus epidermidis
LDKALSKPYDLYILDLMLPNINGLEICRQI

SEQ ID NO: 1820373 - protein, 19 aa, Staphylococcus epidermidis
LDKIYEFKAAKKTIFFVSH

SEQ ID NO: 1820374 - protein, 22 aa, Staphylococcus epidermidis
LDLLVSLDFRMTATPLYSDIVL

SEQ ID NO: 1820375 - protein, 26 aa, Staphylococcus epidermidis
LDMDFRGEPFKPMPKLLAVSEHITKL

SEQ ID NO: 1820376 - protein, 18 aa, Staphylococcus epidermidis
LDNHPYETPVFDFIKMNK

SEQ ID NO: 1820377 - protein, 32 aa, Staphylococcus epidermidis
LDSGGAERLLGYGDMLYLGSGMNKPIRVQGTF

SEQ ID NO: 1820378 - protein, 35 aa, Staphylococcus epidermidis
LDTQKQLYYLSKNLKYDLYHILFEMVRNYQTKPPN

SEQ ID NO: 1820379 - protein, 20 aa, Staphylococcus epidermidis
LECPSIISQVKFYHVPEGIE

SEQ ID NO: 1820380 - protein, 19 aa, Staphylococcus epidermidis
LEDQVTLFKQFKEIADKKK

SEQ ID NO: 1820381 - protein, 24 aa, Staphylococcus epidermidis
LEGKNIALLFEKTSTRTRAAFTVA

SEQ ID NO: 1820382 - protein, 26 aa, Staphylococcus epidermidis
LEHGYHVIMDIPLLYENELQDTVDEV

SEQ ID NO: 1820383 - protein, 25 aa, Staphylococcus epidermidis
LEKIRKALYMSKICSYAQGFAQMRK

SEQ ID NO: 1820384 - protein, 17 aa, Staphylococcus epidermidis
LENLFGGAIPNFGQNQD

SEQ ID NO: 1820385 - protein, 18 aa, Staphylococcus epidermidis
LENSMYGVLLLGQRNHQP

SEQ ID NO: 1820386 - protein, 30 aa, Staphylococcus epidermidis
LEPNDPIIHFALAELLYYDGQYLRATREYE

SEQ ID NO: 1820387 - protein, 25 aa, Staphylococcus epidermidis
LEQKDGIFYIIADANIKALAMNTTE

SEQ ID NO: 1820388 - protein, 17 aa, Staphylococcus epidermidis
LEQLLKNYYETTNEKIV

SEQ ID NO: 1820389 - protein, 42 aa, Staphylococcus epidermidis
LESEDFILPGYRDVPQIIWHGLPLTDAFLFSRGHFKGNQFPE

SEQ ID NO: 1820390 - protein, 17 aa, Staphylococcus epidermidis
LESKTVIISTGASWRKL

SEQ ID NO: 1820391 - protein, 19 aa, Staphylococcus epidermidis
LEYGCLQNCGLCASSLYAL

SEQ ID NO: 1820392 - protein, 29 aa, Staphylococcus epidermidis
LFAQMFTIDILYYRYIALNYQSSLDFITQ

SEQ ID NO: 1820393 - protein, 19 aa, Staphylococcus epidermidis
LFKAYRYKKPIDFISENYQ

SEQ ID NO: 1820394 - protein, 25 aa, Staphylococcus epidermidis
LFKGQHLVHFIPREHIEGRDINDIA

SEQ ID NO: 1820395 - protein, 17 aa, Staphylococcus epidermidis
LFKLDPERAHGLTINAL

SEQ ID NO: 1820396 - protein, 17 aa, Staphylococcus epidermidis
LFPLNNLFQDKVPNEMC

SEQ ID NO: 1820397 - protein, 20 aa, Staphylococcus epidermidis
LFYATFTKYNDNVDAEIVFE

SEQ ID NO: 1820398 - protein, 23 aa, Staphylococcus epidermidis
LGAQPPFTYLVQESYDAMAIVEQ

SEQ ID NO: 1820399 - protein, 34 aa, Staphylococcus epidermidis
LGDAVFYATQFKPQLILDFATLTGAAIVALGDDK

SEQ ID NO: 1820400 - protein, 17 aa, Staphylococcus epidermidis
LGFITSAVDRELPYHLA

SEQ ID NO: 1820401 - protein, 23 aa, Staphylococcus epidermidis
LGGLIILNLLEKTELPIEGILLF

SEQ ID NO: 1820402 - protein, 27 aa, Staphylococcus epidermidis
LGIDTTIPFHLRLLNNHIFRSGEFNTK

SEQ ID NO: 1820403 - protein, 24 aa, Staphylococcus epidermidis
LGINEPFMYKLVDIVADIMEPYYP

SEQ ID NO: 1820404 - protein, 28 aa, Staphylococcus epidermidis
LGTQIANPYRRNILLIGDGSLQLTVQSL

SEQ ID NO: 1820405 - protein, 30 aa, Staphylococcus epidermidis
LGTVDMYTFGRYFPLLKGLSTDYIMPEFLR

SEQ ID NO: 1820406 - protein, 26 aa, Staphylococcus epidermidis
LGVLARKYKLPIYANENTWKAIEKKD

SEQ ID NO: 1820407 - protein, 17 aa, Staphylococcus epidermidis
LGVLDAAECVPTFNVSP

SEQ ID NO: 1820408 - protein, 31 aa, Staphylococcus epidermidis
LHAPQIQGFFDIPIDHLMGVPILAQHFENDP

SEQ ID NO: 1820409 - protein, 17 aa, Staphylococcus epidermidis
LHLLEQNSKLSLSEIGK

SEQ ID NO: 1820410 - protein, 18 aa, Staphylococcus epidermidis
LHMIDHLNGIQFTKRAHH

SEQ ID NO: 1820411 - protein, 27 aa, Staphylococcus epidermidis
LIAERSLEMIIGMLGILKAGAGYIPID

SEQ ID NO: 1820412 - protein, 17 aa, Staphylococcus epidermidis
LIAVDGSHEAEWAFNKA

SEQ ID NO: 1820413 - protein, 31 aa, Staphylococcus epidermidis
LIEAGDLPTIVRRLLVISYEDVGLASPNAGQ

SEQ ID NO: 1820414 - protein, 19 aa, Staphylococcus epidermidis
LIELAKIFQEVLPKGVVNV

SEQ ID NO: 1820415 - protein, 23 aa, Staphylococcus epidermidis
LIELLEYYPFDEITIKMICAYSG

SEQ ID NO: 1820416 - protein, 19 aa, Staphylococcus epidermidis
LIFALPGSTGAIKLAIEKL

SEQ ID NO: 1820417 - protein, 23 aa, Staphylococcus epidermidis
LIKDVADIFYLKEEDLLPLERMG

SEQ ID NO: 1820418 - protein, 19 aa, Staphylococcus epidermidis
LIKYSNWLNQLFHGIEHRM

SEQ ID NO: 1820419 - protein, 25 aa, Staphylococcus epidermidis
LIQYDYLVEDLLKELGIPYSHEDRK

SEQ ID NO: 1820420 - protein, 22 aa, Staphylococcus epidermidis
LIRLIAADLVEFDWIEGFDIEC

SEQ ID NO: 1820421 - protein, 28 aa, Staphylococcus epidermidis
LITIIDDTYIPIFELIEKLHQLNQPYVF

SEQ ID NO: 1820422 - protein, 18 aa, Staphylococcus epidermidis
LITKAELDSLWQLRNLFT

SEQ ID NO: 1820423 - protein, 24 aa, Staphylococcus epidermidis
LKEIYGMISQYDYVLIAYEEQAKH

SEQ ID NO: 1820424 - protein, 19 aa, Staphylococcus epidermidis
LKELKALDFGFYKGEKFKG

SEQ ID NO: 1820425 - protein, 25 aa, Staphylococcus epidermidis
LKGLDSLLSIVQMPGGIPVATTAIG

SEQ ID NO: 1820426 - protein, 24 aa, Staphylococcus epidermidis
LKKVIDTRAIYKLGGIGLAFKKGK

SEQ ID NO: 1820427 - protein, 17 aa, Staphylococcus epidermidis
LKMIINQSEFNMKIAGD

SEQ ID NO: 1820428 - protein, 24 aa, Staphylococcus epidermidis
LKNHVVFLGFDFGYRGNSKYLFNY

SEQ ID NO: 1820429 - protein, 25 aa, Staphylococcus epidermidis
LKNNHIYYQIYTNRGIYTEDPKRDL

SEQ ID NO: 1820430 - protein, 18 aa, Staphylococcus epidermidis
LKRLLDLGAPGIIVQNEK

SEQ ID NO: 1820431 - protein, 17 aa, Staphylococcus epidermidis
LKRYTYTETGGEADFYL

SEQ ID NO: 1820432 - protein, 18 aa, Staphylococcus epidermidis
LKVEKYYTPLEFGKMRKI

SEQ ID NO: 1820433 - protein, 27 aa, Staphylococcus epidermidis
LKVINELAWHNLFARNMFIRPESIDEA

SEQ ID NO: 1820434 - protein, 20 aa, Staphylococcus epidermidis
LKWRGLIYQQTDEEGIEELL

SEQ ID NO: 1820435 - protein, 18 aa, Staphylococcus epidermidis
LLDLIQKYKHMHPQDIVQ

SEQ ID NO: 1820436 - protein, 22 aa, Staphylococcus epidermidis
LLEPEIIFIVQEDLPYDADLET

SEQ ID NO: 1820437 - protein, 22 aa, Staphylococcus epidermidis
LLNEIMLNTYKAFFGDTVEMTD

SEQ ID NO: 1820438 - protein, 17 aa, Staphylococcus epidermidis
LLSEYENKLYQAYRYNE

SEQ ID NO: 1820439 - protein, 23 aa, Staphylococcus epidermidis
LLVEALQQEDVDFIFGYPGGAVL

SEQ ID NO: 1820440 - protein, 25 aa, Staphylococcus epidermidis
LMITHYQRLLNYITPDKVHVMYGGK

SEQ ID NO: 1820441 - protein, 28 aa, Staphylococcus epidermidis
LMPKTEMPPFREFAWVQDKFGVSFQLAL

SEQ ID NO: 1820442 - protein, 18 aa, Staphylococcus epidermidis
LNIIHYMHDKYSYERLEM

SEQ ID NO: 1820443 - protein, 25 aa, Staphylococcus epidermidis
LNKKFNMITIFCDSLNYLETLNDVK

SEQ ID NO: 1820444 - protein, 26 aa, Staphylococcus epidermidis
LNLPQTRLRKLLKKMDYYIKFEDSNH

SEQ ID NO: 1820445 - protein, 25 aa, Staphylococcus epidermidis
LNSFDQPIIWLCGGLDRGNEFDELI

SEQ ID NO: 1820446 - protein, 19 aa, Staphylococcus epidermidis
LNTLTIFRVFIIDSQALTR

SEQ ID NO: 1820447 - protein, 32 aa, Staphylococcus epidermidis
LPEDYTNLFKYQLIFCFDGLDFFRFGRIQRIY

SEQ ID NO: 1820448 - protein, 23 aa, Staphylococcus epidermidis
LPILNGVLDYRRQLTNPYTGEVI

SEQ ID NO: 1820449 - protein, 18 aa, Staphylococcus epidermidis
LPYIVKRLDNNGSVALIG

SEQ ID NO: 1820450 - protein, 20 aa, Staphylococcus epidermidis
LQFQIALLDYNDYVGRIGVG

SEQ ID NO: 1820451 - protein, 18 aa, Staphylococcus epidermidis
LQMDEAFVCYIAMTRSQQ

SEQ ID NO: 1820452 - protein, 23 aa, Staphylococcus epidermidis
LQQYLDDLGFNLVGYGCTTCIGN

SEQ ID NO: 1820453 - protein, 18 aa, Staphylococcus epidermidis
LQSTNLVPFLTIEQQFKL

SEQ ID NO: 1820454 - protein, 20 aa, Staphylococcus epidermidis
LQYTLGDDFIAAKPTGICPC

SEQ ID NO: 1820455 - protein, 17 aa, Staphylococcus epidermidis
LREAIPVTVTLDYDQTG

SEQ ID NO: 1820456 - protein, 24 aa, Staphylococcus epidermidis
LRGGIIDIYPLIGTPVRIELFDTE

SEQ ID NO: 1820457 - protein, 20 aa, Staphylococcus epidermidis
LRLKGYPAIVFQHEIDHLNG

SEQ ID NO: 1820458 - protein, 25 aa, Staphylococcus epidermidis
LSAYDSWALAKHLKTLPVRFKQSVH

SEQ ID NO: 1820459 - protein, 23 aa, Staphylococcus epidermidis
LSIASHLLGVQRIKALDIDEMAV

SEQ ID NO: 1820460 - protein, 27 aa, Staphylococcus epidermidis
LSMIYVDTGAMYRAITYKYLQNGKPEN

SEQ ID NO: 1820461 - protein, 20 aa, Staphylococcus epidermidis
LSRTKIFIDDTPGIRINDLR

SEQ ID NO: 1820462 - protein, 31 aa, Staphylococcus epidermidis
LSSDDILRLNTLPQRLAIIGGGVIGLEFASL

SEQ ID NO: 1820463 - protein, 26 aa, Staphylococcus epidermidis
LSTAQLDFLLPERFDLTYIGQDGEQH

SEQ ID NO: 1820464 - protein, 30 aa, Staphylococcus epidermidis
LSVEDFVRILTEPKLSLVKQYEALLQTEEV

SEQ ID NO: 1820465 - protein, 26 aa, Staphylococcus epidermidis
LTDDDMLAHLLKYDTMQGRFTGEVEV

SEQ ID NO: 1820466 - protein, 25 aa, Staphylococcus epidermidis
LTEEDLKKIYKWMDLGRKTDERLWL

SEQ ID NO: 1820467 - protein, 18 aa, Staphylococcus epidermidis
LTESIRLKSKKGTLLWLM

SEQ ID NO: 1820468 - protein, 18 aa, Staphylococcus epidermidis
LTFNQLILMYDQITEAHK

SEQ ID NO: 1820469 - protein, 24 aa, Staphylococcus epidermidis
LTKEALELILPKVQFNLLNSSAYY

SEQ ID NO: 1820470 - protein, 24 aa, Staphylococcus epidermidis
LTNFNLLYKVIQPQLVKAAYIVGI

SEQ ID NO: 1820471 - protein, 20 aa, Staphylococcus epidermidis
LTNFYRDEIIQPGVLPELFT

SEQ ID NO: 1820472 - protein, 23 aa, Staphylococcus epidermidis
LTQYIGHLNVVLFAPEDLNIVKG

SEQ ID NO: 1820473 - protein, 19 aa, Staphylococcus epidermidis
LTTLILKELGVKKVTAKAQ

SEQ ID NO: 1820474 - protein, 19 aa, Staphylococcus epidermidis
LTYEEAIGEAAFYGPKLDV

SEQ ID NO: 1820475 - protein, 23 aa, Staphylococcus epidermidis
LVDNFRTLQDVLAKAKPASAKGT

SEQ ID NO: 1820476 - protein, 19 aa, Staphylococcus epidermidis
LVGPLRNAGLIRSVRGAKG

SEQ ID NO: 1820477 - protein, 29 aa, Staphylococcus epidermidis
LVMKQLFEHRGLPQLPYISFLRSEYEKYE

SEQ ID NO: 1820478 - protein, 17 aa, Staphylococcus epidermidis
LVQFIAPIKTIITDMIY

SEQ ID NO: 1820479 - protein, 17 aa, Staphylococcus epidermidis
LVQVPLPKQVSEQKVLE

SEQ ID NO: 1820480 - protein, 23 aa, Staphylococcus epidermidis
LVTHPKILLCDEATSALDPATTS

SEQ ID NO: 1820481 - protein, 33 aa, Staphylococcus epidermidis
LVWATAAPGWQKWVWSPFLSVLGMGATAFVYNG

SEQ ID NO: 1820482 - protein, 19 aa, Staphylococcus epidermidis
LWINSGVATLKKYFDGRET

SEQ ID NO: 1820483 - protein, 20 aa, Staphylococcus epidermidis
LYVHPPLFMNQFSLKAVFEG

SEQ ID NO: 1820484 - protein, 24 aa, Staphylococcus epidermidis
MAAISAVIMLLDKGDHLVLNSDVY

SEQ ID NO: 1820485 - protein, 31 aa, Staphylococcus epidermidis
MACVSESIHLLPFNVFFVPARGGLGENVVYQ

SEQ ID NO: 1820486 - protein, 24 aa, Staphylococcus epidermidis
MADDPIIFAMANPNPEINPNEAKQ

SEQ ID NO: 1820487 - protein, 18 aa, Staphylococcus epidermidis
MADLIKRIDTHLSIDFMD

SEQ ID NO: 1820488 - protein, 26 aa, Staphylococcus epidermidis
MAGDQTAVPLLLGLGLDEFSMSATSI

SEQ ID NO: 1820489 - protein, 25 aa, Staphylococcus epidermidis
MCNDYNIFRQCYCGCVFAAMKQGID

SEQ ID NO: 1820490 - protein, 27 aa, Staphylococcus epidermidis
MDAAKAIWMFFEHPETSFFGAKQKFLD

SEQ ID NO: 1820491 - protein, 19 aa, Staphylococcus epidermidis
MDAGNMLKPMLARGELHCI

SEQ ID NO: 1820492 - protein, 17 aa, Staphylococcus epidermidis
MDRFIERDTLRNHLNQV

SEQ ID NO: 1820493 - protein, 22 aa, Staphylococcus epidermidis
MESLLLSARHFLWSTARGYQSY

SEQ ID NO: 1820494 - protein, 23 aa, Staphylococcus epidermidis
MGFEDYFLIVSDLIHFAKTHEVM

SEQ ID NO: 1820495 - protein, 24 aa, Staphylococcus epidermidis
MGKDLTLEKALYKGLTGSGFEVKD

SEQ ID NO: 1820496 - protein, 25 aa, Staphylococcus epidermidis
MGMNNWNIAQLRIFWQYCAIVRKEA

SEQ ID NO: 1820497 - protein, 19 aa, Staphylococcus epidermidis
MIETPRACLIANDLAKHCD

SEQ ID NO: 1820498 - protein, 26 aa, Staphylococcus epidermidis
MIGEDFSHYLKVRPGAFFLTGCGNKD

SEQ ID NO: 1820499 - protein, 18 aa, Staphylococcus epidermidis
MITAKQYIQSGDYKHILV

SEQ ID NO: 1820500 - protein, 34 aa, Staphylococcus epidermidis
MKEEPIKLLALITSNYRLYYQCKILSQKGYSGQQ

SEQ ID NO: 1820501 - protein, 23 aa, Staphylococcus epidermidis
MKERSFVLIPLNDIATKQIEPIS

SEQ ID NO: 1820502 - protein, 24 aa, Staphylococcus epidermidis
MKMDYYAKRNLELTESIRLKSKKG

SEQ ID NO: 1820503 - protein, 27 aa, Staphylococcus epidermidis
MNKIEPLFDDALPYYKQFIQEVGQFLE

SEQ ID NO: 1820504 - protein, 25 aa, Staphylococcus epidermidis
MNMGFIDDMRFIMDKIPAEQRQTML

SEQ ID NO: 1820505 - protein, 17 aa, Staphylococcus epidermidis
MPLMRNKGLLDDPVITD

SEQ ID NO: 1820506 - protein, 17 aa, Staphylococcus epidermidis
MPNAYVKSIFEIDIEKL

SEQ ID NO: 1820507 - protein, 28 aa, Staphylococcus epidermidis
MPRAIVTYELYIAALKLGIAIVPSSEML

SEQ ID NO: 1820508 - protein, 34 aa, Staphylococcus epidermidis
MQYTFTTAIDRQLFYQFILRMPDNVLRLKGYVQF

SEQ ID NO: 1820509 - protein, 26 aa, Staphylococcus epidermidis
MRHMLKQFGPALKKPWTKLIAPELTD

SEQ ID NO: 1820510 - protein, 24 aa, Staphylococcus epidermidis
MRIKEFELLWYLASREGEVISKSE

SEQ ID NO: 1820511 - protein, 26 aa, Staphylococcus epidermidis
MRNDIYDFYSLGFGDPYPISGSHGLG

SEQ ID NO: 1820512 - protein, 25 aa, Staphylococcus epidermidis
MRTGRIWINTYNQIPAGAPFGGYKK

SEQ ID NO: 1820513 - protein, 29 aa, Staphylococcus epidermidis
MSEAGLFHIGILLPTLTTLADLLVHLSDF

SEQ ID NO: 1820514 - protein, 35 aa, Staphylococcus epidermidis
MSLVLRPDVPFSMIPKFNLFIALGIRDAIQQFSNE

SEQ ID NO: 1820515 - protein, 17 aa, Staphylococcus epidermidis
MSNIKGYPHAIGHVRYA

SEQ ID NO: 1820516 - protein, 18 aa, Staphylococcus epidermidis
MTEMYRLLGIAKYEDRFV

SEQ ID NO: 1820517 - protein, 19 aa, Staphylococcus epidermidis
MTGPVIGFLAEYDALPGLG

SEQ ID NO: 1820518 - protein, 18 aa, Staphylococcus epidermidis
MVLLHKYTRQDDIAIGSV

SEQ ID NO: 1820519 - protein, 31 aa, Staphylococcus epidermidis
MVMEDGPERFWPADLVLLSIGFVGTETTVPH

SEQ ID NO: 1820520 - protein, 17 aa, Staphylococcus epidermidis
MVRLSQDWKLRHVLIEM

SEQ ID NO: 1820521 - protein, 17 aa, Staphylococcus epidermidis
MYFNAFARENAAFTIAA

SEQ ID NO: 1820522 - protein, 22 aa, Staphylococcus epidermidis
MYRRVNFLFGDLVKVTPSSKVV

SEQ ID NO: 1820523 - protein, 26 aa, Staphylococcus epidermidis
NAFDLKIEKAPFYATPRKPAIHHTMG

SEQ ID NO: 1820524 - protein, 22 aa, Staphylococcus epidermidis
NAKPPVARIMDYGKYKFEQQKK

SEQ ID NO: 1820525 - protein, 22 aa, Staphylococcus epidermidis
NALNQFHRLYPNVTYEVIEGGG

SEQ ID NO: 1820526 - protein, 17 aa, Staphylococcus epidermidis
NAMGWYLDGRVSAVVGT

SEQ ID NO: 1820527 - protein, 25 aa, Staphylococcus epidermidis
NCLMEVLGLALPYNGTALAVSDQRR

SEQ ID NO: 1820528 - protein, 25 aa, Staphylococcus epidermidis
NDAKRKVAIALRNRYRRSLLKEEEK

SEQ ID NO: 1820529 - protein, 26 aa, Staphylococcus epidermidis
NDEAIILVSLPFNASWLNQRYSEIMQ

SEQ ID NO: 1820530 - protein, 23 aa, Staphylococcus epidermidis
NDNQYALQKLRQNKWMTLYEAHL

SEQ ID NO: 1820531 - protein, 24 aa, Staphylococcus epidermidis
NDSNQLFNYLKQKRKDILDNAYIM

SEQ ID NO: 1820532 - protein, 24 aa, Staphylococcus epidermidis
NDSYSQLLEFAYPTDKTNIYLNDY

SEQ ID NO: 1820533 - protein, 23 aa, Staphylococcus epidermidis
NDVNIGSYILLDDGLVELQVKEI

SEQ ID NO: 1820534 - protein, 21 aa, Staphylococcus epidermidis
NDVPTFAICHGPLVLVDTDDL

SEQ ID NO: 1820535 - protein, 27 aa, Staphylococcus epidermidis
NEEEKEMFLSLIKVTGIGPKSALAILA

SEQ ID NO: 1820536 - protein, 17 aa, Staphylococcus epidermidis
NEFLKKGSSNYPIEILK

SEQ ID NO: 1820537 - protein, 22 aa, Staphylococcus epidermidis
NENQFVFIEDLNLQYVQNDEMP

SEQ ID NO: 1820538 - protein, 18 aa, Staphylococcus epidermidis
NEVSTRIIELDRGKLKTY

SEQ ID NO: 1820539 - protein, 17 aa, Staphylococcus epidermidis
NFFNYLSGYSTKPEYNK

SEQ ID NO: 1820540 - protein, 23 aa, Staphylococcus epidermidis
NFSQKLLIEIKKPSQYPNIENMI

SEQ ID NO: 1820541 - protein, 22 aa, Staphylococcus epidermidis
NFTTIIKHHGALLAKGRLTGVQ

SEQ ID NO: 1820542 - protein, 34 aa, Staphylococcus epidermidis
NGEKSLLFGPFAGFSPKFLKNGSYLDLVKSVKPN

SEQ ID NO: 1820543 - protein, 26 aa, Staphylococcus epidermidis
NGFAIYESILEDLPFVMKQGGHVVFE

SEQ ID NO: 1820544 - protein, 25 aa, Staphylococcus epidermidis
NGKQTLLFGPYANIGPKFLKFGSNL

SEQ ID NO: 1820545 - protein, 23 aa, Staphylococcus epidermidis
NGQTPFVTLGFGLGTDQLSRKIQ

SEQ ID NO: 1820546 - protein, 24 aa, Staphylococcus epidermidis
NGRPKHIYSIYRKMIKQKKQFDQI

SEQ ID NO: 1820547 - protein, 23 aa, Staphylococcus epidermidis
NHDDISIIEPLRNGSFKILAEFN

SEQ ID NO: 1820548 - protein, 24 aa, Staphylococcus epidermidis
NHEHYVFVIPVNETLDMKKAAHVV

SEQ ID NO: 1820549 - protein, 26 aa, Staphylococcus epidermidis
NHFGQLHRKIYFSSRTYHKILEEYFD

SEQ ID NO: 1820550 - protein, 24 aa, Staphylococcus epidermidis
NHHFSELHVFPYSPRIGTPAARMD

SEQ ID NO: 1820551 - protein, 17 aa, Staphylococcus epidermidis
NHLISPTSGDLYLNDQS

SEQ ID NO: 1820552 - protein, 18 aa, Staphylococcus epidermidis
NHMLQMVALLAMEAPISL

SEQ ID NO: 1820553 - protein, 23 aa, Staphylococcus epidermidis
NHYDLPVFITNYPTKIKPFYMQP

SEQ ID NO: 1820554 - protein, 17 aa, Staphylococcus epidermidis
NIDNVLVKVLDPLFAGF

SEQ ID NO: 1820555 - protein, 25 aa, Staphylococcus epidermidis
NIDTYPMNWPVGMGQNFFGIIDRHS

SEQ ID NO: 1820556 - protein, 30 aa, Staphylococcus epidermidis
NIIKLVNDKLTYPVFVKPANLGSSVGISKC

SEQ ID NO: 1820557 - protein, 22 aa, Staphylococcus epidermidis
NIKDIFQLRPFGTDFNSPLFMV

SEQ ID NO: 1820558 - protein, 23 aa, Staphylococcus epidermidis
NIMAAMIAVWSKGTNLNEIINAV

SEQ ID NO: 1820559 - protein, 27 aa, Staphylococcus epidermidis
NISSVHDTIPWPNYVHYAASKGGLKLM

SEQ ID NO: 1820560 - protein, 35 aa, Staphylococcus epidermidis
NKKKIEEIIFKLADKGIAILWITHSDDQSMRHFKR

SEQ ID NO: 1820561 - protein, 18 aa, Staphylococcus epidermidis
NKKLYKTFKNDKLLAQFY

SEQ ID NO: 1820562 - protein, 26 aa, Staphylococcus epidermidis
NKKQELNDALYYFNVPAEVKNVTEGP

SEQ ID NO: 1820563 - protein, 32 aa, Staphylococcus epidermidis
NKLINLLIKEKPDLILLTFPTPVMSVLTEQFN

SEQ ID NO: 1820564 - protein, 26 aa, Staphylococcus epidermidis
NKQLLDIRVVITRPANDPALFNATVK

SEQ ID NO: 1820565 - protein, 32 aa, Staphylococcus epidermidis; identical to SEQ ID NO: 1682127

SEQ ID NO: 1820566 - protein, 21 aa, Staphylococcus epidermidis
NKVYWLNEEYYGFGAGASGYV

SEQ ID NO: 1820567 - protein, 21 aa, Staphylococcus epidermidis
NLDEFSHHLGMMFQIKDDLLD

SEQ ID NO: 1820568 - protein, 20 aa, Staphylococcus epidermidis
NLDPALIPFIMEKTGKTADE

SEQ ID NO: 1820569 - protein, 33 aa, Staphylococcus epidermidis
NLDYELGLLISKKKYWHKLPNFKKIAKVADYAN

SEQ ID NO: 1820570 - protein, 22 aa, Staphylococcus epidermidis
NLKHHILDMSLLSQLTPNALTQ

SEQ ID NO: 1820571 - protein, 23 aa, Staphylococcus epidermidis
NLKHLKKERPDCLIGVCGCMSQE

SEQ ID NO: 1820572 - protein, 21 aa, Staphylococcus epidermidis
NLKIIASCPFAKNVLEKDDHA

SEQ ID NO: 1820573 - protein, 23 aa, Staphylococcus epidermidis
NLPDYTFPLFGMAVGEPSDEENG

SEQ ID NO: 1820574 - protein, 26 aa, Staphylococcus epidermidis
NMALTNCDLLINLGSRFDDRLASKPD

SEQ ID NO: 1820575 - protein, 25 aa, Staphylococcus epidermidis
NNDIYSRPRGKFRFPIQVSENEYTQ

SEQ ID NO: 1820576 - protein, 27 aa, Staphylococcus epidermidis
NNENLQNLLLDPYFKNIVMEYQDALRE

SEQ ID NO: 1820577 - protein, 18 aa, Staphylococcus epidermidis
NNRELSWLDFNYRVLQES

SEQ ID NO: 1820578 - protein, 18 aa, Staphylococcus epidermidis
NNVDILKRISNLEKAVFG

SEQ ID NO: 1820579 - protein, 25 aa, Staphylococcus epidermidis
NPANLMGIRAFRKLLPEIPHVAVFD

SEQ ID NO: 1820580 - protein, 28 aa, Staphylococcus epidermidis
NPGNTEAMIQYLLPKATVVTPNLFEAGQ

SEQ ID NO: 1820581 - protein, 36 aa, Staphylococcus epidermidis
NPYLDKFYHNFERWSFHLQIYFLAERFKEQKRMFEY

SEQ ID NO: 1820582 - protein, 27 aa, Staphylococcus epidermidis
NQEDRKLIGILTNRDLRFIEDFSIKIS

SEQ ID NO: 1820583 - protein, 24 aa, Staphylococcus epidermidis
NQGNQFIVQLLGVNAEQFRQLFIL

SEQ ID NO: 1820584 - protein, 25 aa, Staphylococcus epidermidis
NQNHLPVVIYFYGGSFLQGHGTAEL

SEQ ID NO: 1820585 - protein, 26 aa, Staphylococcus epidermidis
NQPIKLYYNGPMFRYERKQKGRYRQF

SEQ ID NO: 1820586 - protein, 26 aa, Staphylococcus epidermidis
NQPMEWGWKQFTDQIALKRLSKPEDV

SEQ ID NO: 1820587 - protein, 21 aa, Staphylococcus epidermidis
NQYMGPYAMHWHMINYCFDNG

SEQ ID NO: 1820588 - protein, 23 aa, Staphylococcus epidermidis
NRAARIIDQLEQLGYISGANGSK

SEQ ID NO: 1820589 - protein, 21 aa, Staphylococcus epidermidis
NRDLRFIEDFSIKISDVMTKD

SEQ ID NO: 1820590 - protein, 25 aa, Staphylococcus epidermidis
NRRTIFYNTLFDENASCHLAIGSAY

SEQ ID NO: 1820591 - protein, 24 aa, Staphylococcus epidermidis
NSIGTFYPFIQDDVKLYGVEAAGK

SEQ ID NO: 1820592 - protein, 26 aa, Staphylococcus epidermidis
NSILKEKQFFVIENLAHSMSKEAKTI

SEQ ID NO: 1820593 - protein, 24 aa, Staphylococcus epidermidis
NSLQEMYQGFFLAPHVVSQSLKGA

SEQ ID NO: 1820594 - protein, 26 aa, Staphylococcus epidermidis
NSPETPIFQKRRILYNLNKARKFIRK

SEQ ID NO: 1820595 - protein, 25 aa, Staphylococcus epidermidis
NSSFRGLFQFIRFIDELIDRKKDFG

SEQ ID NO: 1820596 - protein, 21 aa, Staphylococcus epidermidis
NSVLFEAINLQRASLRQGTHA

SEQ ID NO: 1820597 - protein, 32 aa, Staphylococcus epidermidis
NSYLNGSRGALKYIHDIWGYIAPNTKKEQQPK

SEQ ID NO: 1820598 - protein, 24 aa, Staphylococcus epidermidis
NTDRPLALCAALLHDLGHGPFSHS

SEQ ID NO: 1820599 - protein, 21 aa, Staphylococcus epidermidis
NTILENVSIPLIYNGLSNKAR

SEQ ID NO: 1820600 - protein, 26 aa, Staphylococcus epidermidis
NTLQPSPFHWRLLDKLTLNTLHEVVL

SEQ ID NO: 1820601 - protein, 23 aa, Staphylococcus epidermidis
NTTVGPFAQLRPGSNLGSEVKVG

SEQ ID NO: 1820602 - protein, 26 aa, Staphylococcus epidermidis
NTVASCAHLLIWEGIELLPVTDNNKK

SEQ ID NO: 1820603 - protein, 18 aa, Staphylococcus epidermidis
NVGDAIVVGNTYGRIRAM

SEQ ID NO: 1820604 - protein, 28 aa, Staphylococcus epidermidis
NVGGASGPLYGFGFIKMASAVNDEIDHD

SEQ ID NO: 1820605 - protein, 25 aa, Staphylococcus epidermidis
NVNQNMFVTMFYGLYEEMNHLLYCS

SEQ ID NO: 1820606 - protein, 24 aa, Staphylococcus epidermidis
NVQYYTDIVFKHALKRKLIQTADS

SEQ ID NO: 1820607 - protein, 27 aa, Staphylococcus epidermidis
NYGFAYLLDDGQSYSYLIFVQETWSML

SEQ ID NO: 1820608 - protein, 17 aa, Staphylococcus epidermidis
NYLERIDYRLLTHKMHH

SEQ ID NO: 1820609 - protein, 24 aa, Staphylococcus epidermidis
PASDVIELPYGAVPIDFAYAIHSE

SEQ ID NO: 1820610 - protein, 30 aa, Staphylococcus epidermidis
PATNFKEAVQWLYLAYLAAIKEQNGAAMSL

SEQ ID NO: 1820611 - protein, 24 aa, Staphylococcus epidermidis
PCVTYNKVNTYDWFKEHLTSIDDI

SEQ ID NO: 1820612 - protein, 30 aa, Staphylococcus epidermidis
PDITINQLMKYIKGPDFPTGGIIQGIEGIK

SEQ ID NO: 1820613 - protein, 27 aa, Staphylococcus epidermidis
PDMEEELKILLIPKDPNDDKDVIVEIR

SEQ ID NO: 1820614 - protein, 19 aa, Staphylococcus epidermidis
PDPFPTMVRDFQSVIGNEI

SEQ ID NO: 1820615 - protein, 17 aa, Staphylococcus epidermidis
PDRIAGFTPIPAMSMIS

SEQ ID NO: 1820616 - protein, 34 aa, Staphylococcus epidermidis
PEATIFLMNPVYDFDLVKRYDIHMTLPSLNYYYK

SEQ ID NO: 1820617 - protein, 27 aa, Staphylococcus epidermidis
PEDRARLVIYPAAMRYAGPREAILHAT

SEQ ID NO: 1820618 - protein, 26 aa, Staphylococcus epidermidis
PEDWGGDTIFVPLSALSGDGIDDLLE

SEQ ID NO: 1820619 - protein, 25 aa, Staphylococcus epidermidis
PEEFIQPLPHISFVMGPTNVNFLRK

SEQ ID NO: 1820620 - protein, 26 aa, Staphylococcus epidermidis
PEFINRLFEIEGVKSIFYVLDFISID

SEQ ID NO: 1820621 - protein, 25 aa, Staphylococcus epidermidis
PEIAGLMISAIISDSLLFKSPTCTK

SEQ ID NO: 1820622 - protein, 23 aa, Staphylococcus epidermidis
PEKQSRLKRLFKRTKASINEVFS

SEQ ID NO: 1820623 - protein, 19 aa, Staphylococcus epidermidis
PENMEVLIGWTGSPASSPH

SEQ ID NO: 1820624 - protein, 26 aa, Staphylococcus epidermidis
PEPNLTVLWSTRLPENFKIYCAKMSI

SEQ ID NO: 1820625 - protein, 29 aa, Staphylococcus epidermidis
PERLVVAHPFHPVYILPLVEIVPGKQTSE

SEQ ID NO: 1820626 - protein, 21 aa, Staphylococcus epidermidis
PFQMIKRYHYGLTDTLLLEKG

SEQ ID NO: 1820627 - protein, 20 aa, Staphylococcus epidermidis
PGEISWNSPFGKGRPGWHIE

SEQ ID NO: 1820628 - protein, 17 aa, Staphylococcus epidermidis
PGGLLMYGIPNMKLDKD

SEQ ID NO: 1820629 - protein, 18 aa, Staphylococcus epidermidis
PGHPLDNQLLIKLIENFE

SEQ ID NO: 1820630 - protein, 27 aa, Staphylococcus epidermidis
PGIRFEDTMFLLNTLAEYEPDYFHISA

SEQ ID NO: 1820631 - protein, 17 aa, Staphylococcus epidermidis
PGKLLLVDFLQNKVVEN

SEQ ID NO: 1820632 - protein, 44 aa, Staphylococcus epidermidis
PIAELMFNDFIGFGLDPILNQGAKMRYMFGGKAKIPLVVRTVHG

SEQ ID NO: 1820633 - protein, 17 aa, Staphylococcus epidermidis
PIDIMLNPLGVPSRMNI

SEQ ID NO: 1820634 - protein, 17 aa, Staphylococcus epidermidis
PIKTIITDMIYTINTDY

SEQ ID NO: 1820635 - protein, 18 aa, Staphylococcus epidermidis
PILYQIWKKKHKKAYYKW

SEQ ID NO: 1820636 - protein, 25 aa, Staphylococcus epidermidis
PIQVGSHFHFFEANKALEFDREKAY

SEQ ID NO: 1820637 - protein, 20 aa, Staphylococcus epidermidis
PIVIMAEFILSAQKIISRTI

SEQ ID NO: 1820638 - protein, 20 aa, Staphylococcus epidermidis
PKIGAYHFTTIKPNLGVVST

SEQ ID NO: 1820639 - protein, 23 aa, Staphylococcus epidermidis
PKLSKLGLKWYAVPIISNMDLKI

SEQ ID NO: 1820640 - protein, 20 aa, Staphylococcus epidermidis
PKNKLIVMTGLSGSGKSSLA

SEQ ID NO: 1820641 - protein, 27 aa, Staphylococcus epidermidis
PKSDRLRQFFDFITNFGIMIKGTGEDI

SEQ ID NO: 1820642 - protein, 29 aa, Staphylococcus epidermidis
PLEDVLSGAVAWISGLRRAQSPTRAHTNF

SEQ ID NO: 1820643 - protein, 33 aa, Staphylococcus epidermidis
PLESEYKFFKEELILFTYLHLANEQKLTQALVD

SEQ ID NO: 1820644 - protein, 20 aa, Staphylococcus epidermidis
PLMKKILDRMLEYNEITRIY

SEQ ID NO: 1820645 - protein, 25 aa, Staphylococcus epidermidis
PLQVYNVMHHFYIPKVITGGATSTP

SEQ ID NO: 1820646 - protein, 27 aa, Staphylococcus epidermidis
PLRQQVIDYLTYFQTSSPSYLIMSSLE

SEQ ID NO: 1820647 - protein, 19 aa, Staphylococcus epidermidis
PLTMIGLDLAREALFTHHF

SEQ ID NO: 1820648 - protein, 17 aa, Staphylococcus epidermidis
PLVLPKHHTCLITPVNH

SEQ ID NO: 1820649 - protein, 19 aa, Staphylococcus epidermidis
PLVVRLEGTNVERGKAILN

SEQ ID NO: 1820650 - protein, 24 aa, Staphylococcus epidermidis
PLYSDIVLPAATWYEKHDLSSTDM

SEQ ID NO: 1820651 - protein, 22 aa, Staphylococcus epidermidis
PMGCQTGFYVSFINHDDYDDVL

SEQ ID NO: 1820652 - protein, 28 aa, Staphylococcus epidermidis
PMILYGHMSPYMIVGMIGAIKSGCGYVP

SEQ ID NO: 1820653 - protein, 23 aa, Staphylococcus epidermidis
PNDRRYHPLEKLGRYLMDSFVNI

SEQ ID NO: 1820654 - protein, 35 aa, Staphylococcus epidermidis
PNEFKFGLSFLTRSVALSRFPWLSANIEYTVTREP

SEQ ID NO: 1820655 - protein, 26 aa, Staphylococcus epidermidis
PNGKIIQLWHGTPIKKLFLDSKEPHQ

SEQ ID NO: 1820656 - protein, 24 aa, Staphylococcus epidermidis
PPKLIEHLLEIRGLGIINVMTLFG

SEQ ID NO: 1820657 - protein, 25 aa, Staphylococcus epidermidis
PPRLQNGTSWFYFATDQWKYEESNV

SEQ ID NO: 1820658 - protein, 18 aa, Staphylococcus epidermidis
PPTIYFPLNVEEGMMIEP

SEQ ID NO: 1820659 - protein, 18 aa, Staphylococcus epidermidis
PQIKVVMLTSFIEDKEVY

SEQ ID NO: 1820660 - protein, 25 aa, Staphylococcus epidermidis
PQLKDSHILKKWSGVRPYTEKEMPV

SEQ ID NO: 1820661 - protein, 21 aa, Staphylococcus epidermidis
PQLLYIDLHLIHEVTSPQAFE

SEQ ID NO: 1820662 - protein, 20 aa, Staphylococcus epidermidis
PSLVIFANKIKLNELILLGK

SEQ ID NO: 1820663 - protein, 33 aa, Staphylococcus epidermidis
PSPTGYLHIGNARTALFNYLFAKHYNGDFVVRI

SEQ ID NO: 1820664 - protein, 21 aa, Staphylococcus epidermidis
PSVLEVMRYLEREKGFKLKYV

SEQ ID NO: 1820665 - protein, 19 aa, Staphylococcus epidermidis
PTQFRHFQTVKFGDLSQLD

SEQ ID NO: 1820666 - protein, 25 aa, Staphylococcus epidermidis
PTSGKELFKRVLPDALIKLEKAGYE

SEQ ID NO: 1820667 - protein, 23 aa, Staphylococcus epidermidis
PTTKIIVFGKTLYKLSRFSFVDE

SEQ ID NO: 1820668 - protein, 26 aa, Staphylococcus epidermidis
PVDKMDLDIPRLVLDGIEVVGSLVGT

SEQ ID NO: 1820669 - protein, 24 aa, Staphylococcus epidermidis
PVHDYQFLTFNVIGSPFGSSSKLN

SEQ ID NO: 1820670 - protein, 25 aa, Staphylococcus epidermidis
PVNNFILNGITRRVIKWIAEDEQIP

SEQ ID NO: 1820671 - protein, 32 aa, Staphylococcus epidermidis
PYGTVLIIGPFNYPVQLVFEPLIGAIAAGNTA

SEQ ID NO: 1820672 - protein, 20 aa, Staphylococcus epidermidis
PYSNSIWLFDVGEGTQHQIL

SEQ ID NO: 1820673 - protein, 19 aa, Staphylococcus epidermidis
PYYAGVTACYLLVNKSIRR

SEQ ID NO: 1820674 - protein, 23 aa, Staphylococcus epidermidis
QAAKHMYLVYQNPELQFITNSVY

SEQ ID NO: 1820675 - protein, 23 aa, Staphylococcus epidermidis
QAKAQNLFARWRKEETLYSEDEK

SEQ ID NO: 1820676 - protein, 28 aa, Staphylococcus epidermidis
QAKGSTYYGIALALLRISKALLNNENSI

SEQ ID NO: 1820677 - protein, 25 aa, Staphylococcus epidermidis
QALINRIEAWALNHHIRRIEATVVT

SEQ ID NO: 1820678 - protein, 18 aa, Staphylococcus epidermidis
QALLRRIKLLDEEFKIPS

SEQ ID NO: 1820679 - protein, 17 aa, Staphylococcus epidermidis
QALLRRTYDLSIARDEI

SEQ ID NO: 1820680 - protein, 30 aa, Staphylococcus epidermidis
QANTQLFVYGLFIYNKWRGMGTLNSVDVIN

SEQ ID NO: 1820681 - protein, 25 aa, Staphylococcus epidermidis
QARRILDRLVGYNISPVLWKKVKKG

SEQ ID NO: 1820682 - protein, 24 aa, Staphylococcus epidermidis
QCRKANLPCYFTMDAGPNVKVLVE

SEQ ID NO: 1820683 - protein, 24 aa, Staphylococcus epidermidis
QDDERLFFIGEAIRRGTSLEELHN

SEQ ID NO: 1820684 - protein, 25 aa, Staphylococcus epidermidis
QDKIKIGATVFAGFGPRIVRINDYS

SEQ ID NO: 1820685 - protein, 19 aa, Staphylococcus epidermidis
QDMVLGNYYLTLERKDAVN

SEQ ID NO: 1820686 - protein, 24 aa, Staphylococcus epidermidis
QDNERMLTLFRGGPVVWISNEDAA

SEQ ID NO: 1820687 - protein, 20 aa, Staphylococcus epidermidis
QDTLVLRYLTPHGKWNIHST

SEQ ID NO: 1820688 - protein, 23 aa, Staphylococcus epidermidis
QEALAYATRYGYLYMNQFETKDN

SEQ ID NO: 1820689 - protein, 23 aa, Staphylococcus epidermidis
QEINLMQFIKKLDKQMDFLDIDK

SEQ ID NO: 1820690 - protein, 17 aa, Staphylococcus epidermidis
QETKKLLDRIYPFRKCD

SEQ ID NO: 1820691 - protein, 20 aa, Staphylococcus epidermidis
QFDETFMMYLPRLCEHCLNP

SEQ ID NO: 1820692 - protein, 20 aa, Staphylococcus epidermidis
QFDNLKWLGLDWDESVDKDK

SEQ ID NO: 1820693 - protein, 29 aa, Staphylococcus epidermidis
QFENMYEWLSNFKLFKVPKTLITRNPKYI

SEQ ID NO: 1820694 - protein, 25 aa, Staphylococcus epidermidis
QFGPVVPGFKFAIFNDFNSFKSLTS

SEQ ID NO: 1820695 - protein, 22 aa, Staphylococcus epidermidis
QFGTLETLFPQRVDLGLGRAPG

SEQ ID NO: 1820696 - protein, 30 aa, Staphylococcus epidermidis
QFKRSSYLIDLLENFVLERGIYGKRWLDED

SEQ ID NO: 1820697 - protein, 17 aa, Staphylococcus epidermidis
QFLMVSYINNHVNALYT

SEQ ID NO: 1820698 - protein, 27 aa, Staphylococcus epidermidis
QFRKNGLPYIMHPIQVAGILTEMRLDG

SEQ ID NO: 1820699 - protein, 17 aa, Staphylococcus epidermidis
QFYFVDYKTDAFNRRKG

SEQ ID NO: 1820700 - protein, 24 aa, Staphylococcus epidermidis
QGANAVKFLLYYDVDDTEEINIQK

SEQ ID NO: 1820701 - protein, 25 aa, Staphylococcus epidermidis
QGDQALIRGAKILALMGLELIENKP

SEQ ID NO: 1820702 - protein, 21 aa, Staphylococcus epidermidis
QGEGRVIGRKTMFVRTAGCDY

SEQ ID NO: 1820703 - protein, 17 aa, Staphylococcus epidermidis
QGILNISLIFKGQTETT

SEQ ID NO: 1820704 - protein, 27 aa, Staphylococcus epidermidis
QGMIKSDFFIINKTDLAPYVGASLDQM

SEQ ID NO: 1820705 - protein, 21 aa, Staphylococcus epidermidis
QHSGLMYYTIGQRHGLGIGGD

SEQ ID NO: 1820706 - protein, 31 aa, Staphylococcus epidermidis
QIDEQGYIYFTPIGGWWNQVMLSQKVTITTE

SEQ ID NO: 1820707 - protein, 18 aa, Staphylococcus epidermidis
QIIQPHPALLEAIGESAD

SEQ ID NO: 1820708 - protein, 28 aa, Staphylococcus epidermidis
QILTSSDLILYVTYFNHSFTDNDKAFIE

SEQ ID NO: 1820709 - protein, 26 aa, Staphylococcus epidermidis
QILYQNMGPQYWWPAETPIEMMLGAI

SEQ ID NO: 1820710 - protein, 26 aa, Staphylococcus epidermidis
QKEDALDFTLWKKAKPGEISWNSPFG

SEQ ID NO: 1820711 - protein, 38 aa, Staphylococcus epidermidis
QKGIVFLMIRFKSLDEVYLLPYSKFEKYWQRYINNIKK

SEQ ID NO: 1820712 - protein, 28 aa, Staphylococcus epidermidis
QKGVQMVHESLLRALKDNGLEEILAEGK

SEQ ID NO: 1820713 - protein, 26 aa, Staphylococcus epidermidis
QKKNKERFNLFLDGEFEMGIDIDTLV

SEQ ID NO: 1820714 - protein, 31 aa, Staphylococcus epidermidis
QKLIPDLIDKMYRRFYILSTISQNQPVGRRS

SEQ ID NO: 1820715 - protein, 20 aa, Staphylococcus epidermidis
QKYDIPIIAQLTASNTNYLV

SEQ ID NO: 1820716 - protein, 26 aa, Staphylococcus epidermidis
QLEDYNQIELLKDLELPLARILSEME

SEQ ID NO: 1820717 - protein, 29 aa, Staphylococcus epidermidis
QLGVVLFETLQLPVIKKTKTGYSTAVDVL

SEQ ID NO: 1820718 - protein, 20 aa, Staphylococcus epidermidis
QLIEGLIHFVSRQAMNIDGL

SEQ ID NO: 1820719 - protein, 18 aa, Staphylococcus epidermidis
QLMNEMSLRLVDFKVEFG

SEQ ID NO: 1820720 - protein, 19 aa, Staphylococcus epidermidis
QLSRQIAIQTAPQIRMIQN

SEQ ID NO: 1820721 - protein, 22 aa, Staphylococcus epidermidis
QLTIEQLKLLIFILHFTENHKE

SEQ ID NO: 1820722 - protein, 18 aa, Staphylococcus epidermidis
QNCGLCASSLYALVDGDI

SEQ ID NO: 1820723 - protein, 23 aa, Staphylococcus epidermidis
QNDYCLFLNIWKPSSNQNHLPVV

SEQ ID NO: 1820724 - protein, 23 aa, Staphylococcus epidermidis
QNKIRVEFKFKETLKPLTTDYLK

SEQ ID NO: 1820725 - protein, 23 aa, Staphylococcus epidermidis
QNKVKVIAWYDNEWGYSNRVVEV

SEQ ID NO: 1820726 - protein, 25 aa, Staphylococcus epidermidis
QNMKAFNYIPFFKSFEMSHLHIDEP

SEQ ID NO: 1820727 - protein, 22 aa, Staphylococcus epidermidis
QPDLLLLDEPTNHLDFESIRWL

SEQ ID NO: 1820728 - protein, 30 aa, Staphylococcus epidermidis
QPELAYFEVLHEMKLIVDLMYEGGMENVRY

SEQ ID NO: 1820729 - protein, 31 aa, Staphylococcus epidermidis
QPPTAYQFFNDPMLSVFLFSEVDKKRYQALK

SEQ ID NO: 1820730 - protein, 26 aa, Staphylococcus epidermidis
QPSANSLYYALNGFPRNLRTDIDGLE

SEQ ID NO: 1820731 - protein, 29 aa, Staphylococcus epidermidis
QPTEDDVLMYNYLKHFDIPTLVICTKEDK

SEQ ID NO: 1820732 - protein, 25 aa, Staphylococcus epidermidis
QQEKQKALYKQELAWMRAGAKARTT

SEQ ID NO: 1820733 - protein, 28 aa, Staphylococcus epidermidis
QQGVPIEHYIYFLIRSVKYDYLRKVKAN

SEQ ID NO: 1820734 - protein, 23 aa, Staphylococcus epidermidis
QQPERGKIYDRNGKVLAEDVERY

SEQ ID NO: 1820735 - protein, 21 aa, Staphylococcus epidermidis
QRDFSFYRKPSADMLYQPENI

SEQ ID NO: 1820736 - protein, 18 aa, Staphylococcus epidermidis
QRIGIRMADLLEKETFER

SEQ ID NO: 1820737 - protein, 28 aa, Staphylococcus epidermidis
QRMREIQFALYERKIPLVLVFEGMDAAG

SEQ ID NO: 1820738 - protein, 24 aa, Staphylococcus epidermidis
QRSFSHIELPKHAYLSCYPNASLL

SEQ ID NO: 1820739 - protein, 20 aa, Staphylococcus epidermidis
QRVAIARAIINDPKFIIADE

SEQ ID NO: 1820740 - protein, 17 aa, Staphylococcus epidermidis
QSDVYFVHSYQAEMSEY

SEQ ID NO: 1820741 - protein, 21 aa, Staphylococcus epidermidis
QSIALNLEPYSNSIWLFDVGE

SEQ ID NO: 1820742 - protein, 25 aa, Staphylococcus epidermidis
QTDTPLYLFPTKSYIKKEPYGTVLI

SEQ ID NO: 1820743 - protein, 24 aa, Staphylococcus epidermidis
QTESTLLIGFLKDTEPRMGSMGKG

SEQ ID NO: 1820744 - protein, 26 aa, Staphylococcus epidermidis
QTIDDPILLDLIRNENILVTPHIAFF

SEQ ID NO: 1820745 - protein, 20 aa, Staphylococcus epidermidis
QTIKFKGFMTLYVEAKDDKE

SEQ ID NO: 1820746 - protein, 29 aa, Staphylococcus epidermidis
QTLQRDRHAYYIATLALIATSMEKFAVEI

SEQ ID NO: 1820747 - protein, 27 aa, Staphylococcus epidermidis
QTMPEQAYLYSLPYHYYEDYGIRKYGF

SEQ ID NO: 1820748 - protein, 20 aa, Staphylococcus epidermidis
QTPQFIIKDIAIDQLQILDY

SEQ ID NO: 1820749 - protein, 22 aa, Staphylococcus epidermidis
QTQVEFLSDYYFYLLEIGQKEK

SEQ ID NO: 1820750 - protein, 39 aa, Staphylococcus epidermidis
QTTRSVLSYVLDKIMKMLHPFMPFVTETIWQSLPHHGET

SEQ ID NO: 1820751 - protein, 25 aa, Staphylococcus epidermidis
QVDYIDLYYIHFPDDDTPKDKAVAA

SEQ ID NO: 1820752 - protein, 19 aa, Staphylococcus epidermidis
QVILLLDEIHRLDKAKQDF

SEQ ID NO: 1820753 - protein, 32 aa, Staphylococcus epidermidis
QVPLFNGRHELLDSVFLWQSGNKYRVSAHDAD

SEQ ID NO: 1820754 - protein, 26 aa, Staphylococcus epidermidis
QVSAKRIIDFLSGTVYAIGGDIQRVG

SEQ ID NO: 1820755 - protein, 17 aa, Staphylococcus epidermidis
QWILQPLAEHHYLTWND

SEQ ID NO: 1820756 - protein, 20 aa, Staphylococcus epidermidis
QWVRSFKLRGAYNAISVLSN

SEQ ID NO: 1820757 - protein, 19 aa, Staphylococcus epidermidis
QYVDDLAERILAIGGNPIG

SEQ ID NO: 1820758 - protein, 22 aa, Staphylococcus epidermidis
RAAAALILAGLVAEGTTQVTEL

SEQ ID NO: 1820759 - protein, 27 aa, Staphylococcus epidermidis
RAAAKQTKWFPFVGQAVSASISYYFMS

SEQ ID NO: 1820760 - protein, 28 aa, Staphylococcus epidermidis
RADGVPAGLLTYPPLMAADIVIYNTNIV

SEQ ID NO: 1820761 - protein, 28 aa, Staphylococcus epidermidis
RADRDLLQAQLYLLTHGELPFTQKDILF

SEQ ID NO: 1820762 - protein, 26 aa, Staphylococcus epidermidis
RAGHHCAQPLMKWLGVSSTARASFYV

SEQ ID NO: 1820763 - protein, 23 aa, Staphylococcus epidermidis
RAKAGLFLAMQYPSEITGVTNAD

SEQ ID NO: 1820764 - protein, 21 aa, Staphylococcus epidermidis
RAPQWRGGGVVFGPTPRSYAY

SEQ ID NO: 1820765 - protein, 23 aa, Staphylococcus epidermidis
RAQEIDAALWGARAAFIGGFDST

SEQ ID NO: 1820766 - protein, 23 aa, Staphylococcus epidermidis
RAVLGRFLFVQEDVKKIINDLSG

SEQ ID NO: 1820767 - protein, 19 aa, Staphylococcus epidermidis
RDEIIQPGVLPELFTAQTA

SEQ ID NO: 1820768 - protein, 17 aa, Staphylococcus epidermidis
RDIDGYYLIVQQERKLS

SEQ ID NO: 1820769 - protein, 17 aa, Staphylococcus epidermidis
RDLKAPIRMHRLLQGDV

SEQ ID NO: 1820770 - protein, 18 aa, Staphylococcus epidermidis
REGLTVLEYFISTHGARK

SEQ ID NO: 1820771 - protein, 22 aa, Staphylococcus epidermidis
REHLGGFPISGQFLRCTNPDII

SEQ ID NO: 1820772 - protein, 25 aa, Staphylococcus epidermidis
RELSRLYVYAHHKGLKSLYYTRNKL

SEQ ID NO: 1820773 - protein, 23 aa, Staphylococcus epidermidis
RENYEALLIYYKDSLDNPVVDGA

SEQ ID NO: 1820774 - protein, 23 aa, Staphylococcus epidermidis
REPGVFGAAWLNQGLHTEMIVDG

SEQ ID NO: 1820775 - protein, 38 aa, Staphylococcus epidermidis
RFAYDCYRRLLQMFGEVVYGIPMTAFDTYFNDFKTKHR

SEQ ID NO: 1820776 - protein, 21 aa, Staphylococcus epidermidis
RFNVDLFLRNAHRIPDYASNR

SEQ ID NO: 1820777 - protein, 25 aa, Staphylococcus epidermidis
RGPATNPLFKSFFNAGVEAGYHKTA

SEQ ID NO: 1820778 - protein, 24 aa, Staphylococcus epidermidis
RHKELPAFSVQYHPEARPGPSDSN

SEQ ID NO: 1820779 - protein, 18 aa, Staphylococcus epidermidis
RHLLKGNVVFIFQYGEEI

SEQ ID NO: 1820780 - protein, 22 aa, Staphylococcus epidermidis
RIDEIMHFIDGPLYMEIAQADN

SEQ ID NO: 1820781 - protein, 24 aa, Staphylococcus epidermidis
RIDEPTLEMTFKVNNSPFAGREGD

SEQ ID NO: 1820782 - protein, 19 aa, Staphylococcus epidermidis
RIDTIRKVAKRLNKTIGLL

SEQ ID NO: 1820783 - protein, 18 aa, Staphylococcus epidermidis
RIGRLFDITGLKDLMHVN

SEQ ID NO: 1820784 - protein, 17 aa, Staphylococcus epidermidis
RIHTPSQMGIRKPEFSS

SEQ ID NO: 1820785 - protein, 18 aa, Staphylococcus epidermidis
RIIRIEGNFWDIGEGPSG

SEQ ID NO: 1820786 - protein, 21 aa, Staphylococcus epidermidis
RIKRYIAKYTINPAITHGISD

SEQ ID NO: 1820787 - protein, 20 aa, Staphylococcus epidermidis
RIKYWILKILELHCLSYNDV

SEQ ID NO: 1820788 - protein, 17 aa, Staphylococcus epidermidis
RISLSIKDTLPTPFENI

SEQ ID NO: 1820789 - protein, 23 aa, Staphylococcus epidermidis
RKLDVDIPVYYYGFKETDDIYAK

SEQ ID NO: 1820790 - protein, 22 aa, Staphylococcus epidermidis
RKMRLHDFRWEASILSQSIKDL

SEQ ID NO: 1820791 - protein, 20 aa, Staphylococcus epidermidis
RKQEFIATLNRYRRLKIKQR

SEQ ID NO: 1820792 - protein, 22 aa, Staphylococcus epidermidis
RKRGQFINMDYLDDIRVNIVYE

SEQ ID NO: 1820793 - protein, 17 aa, Staphylococcus epidermidis
RKYLLEFFGEHPQSPKQ

SEQ ID NO: 1820794 - protein, 17 aa, Staphylococcus epidermidis
RKYTMAHFSERLTKLHQ

SEQ ID NO: 1820795 - protein, 28 aa, Staphylococcus epidermidis
RLGIRLEKTFEYIDTPHKFKMGVSGCPR

SEQ ID NO: 1820796 - protein, 17 aa, Staphylococcus epidermidis
RLHTNPMRILDCKIDRD

SEQ ID NO: 1820797 - protein, 17 aa, Staphylococcus epidermidis
RLLKGVVSGIGGYGNCI

SEQ ID NO: 1820798 - protein, 18 aa, Staphylococcus epidermidis
RLREGKITERHARAVLVL

SEQ ID NO: 1820799 - protein, 29 aa, Staphylococcus epidermidis
RLSQDRPTIVRLLDPPLHEFLPSSEEDIN

SEQ ID NO: 1820800 - protein, 17 aa, Staphylococcus epidermidis
RLVDLPEEYLDRYPSEL

SEQ ID NO: 1820801 - protein, 17 aa, Staphylococcus epidermidis
RLYEMFMGPLDAAIAWS

SEQ ID NO: 1820802 - protein, 18 aa, Staphylococcus epidermidis
RLYGIFLLHQLNGKEILM

SEQ ID NO: 1820803 - protein, 17 aa, Staphylococcus epidermidis
RMLELPSAWTDYLNTTS

SEQ ID NO: 1820804 - protein, 34 aa, Staphylococcus epidermidis
RNDDQFRSIIKQLYFFSIANPQPFEWLNQLAQPY

SEQ ID NO: 1820805 - protein, 24 aa, Staphylococcus epidermidis
RNLENVITFVPILSMSNKEIKKMV

SEQ ID NO: 1820806 - protein, 26 aa, Staphylococcus epidermidis
RNYGLVMDELRLLARSVFVLNENNKV

SEQ ID NO: 1820807 - protein, 25 aa, Staphylococcus epidermidis
RPAAAHALHYDKLPQRLVTVFAGQD

SEQ ID NO: 1820808 - protein, 30 aa, Staphylococcus epidermidis
RPEDLQSYGLIPEFIGRVPIVANLETLDVA

SEQ ID NO: 1820809 - protein, 17 aa, Staphylococcus epidermidis
RPFLDKTLERKAVWDKW

SEQ ID NO: 1820810 - protein, 23 aa, Staphylococcus epidermidis
RPKDLIGKRLQYPGAPGPGGIAM

SEQ ID NO: 1820811 - protein, 20 aa, Staphylococcus epidermidis
RPQQLYLAEIILDQLMHSDK

SEQ ID NO: 1820812 - protein, 25 aa, Staphylococcus epidermidis
RQELLGLDDLKMYDLYTPLVKDVKF

SEQ ID NO: 1820813 - protein, 21 aa, Staphylococcus epidermidis
RQGIWKIIKQYGLKANINKTL

SEQ ID NO: 1820814 - protein, 17 aa, Staphylococcus epidermidis
RQIIQECLGHLIDMGQS

SEQ ID NO: 1820815 - protein, 25 aa, Staphylococcus epidermidis
RQRAYIAMTIAQDTDYILLDEPLNN

SEQ ID NO: 1820816 - protein, 19 aa, Staphylococcus epidermidis
RRAKLYYLRSLRGKAARIQ

SEQ ID NO: 1820817 - protein, 23 aa, Staphylococcus epidermidis
RRANLYGLFNKAVEFENSSFRGL

SEQ ID NO: 1820818 - protein, 26 aa, Staphylococcus epidermidis
RRQRKRDFRKLWITRINAAARQHDIS

SEQ ID NO: 1820819 - protein, 24 aa, Staphylococcus epidermidis
RRREKIIRIFPNQTSANRLIGAVL

SEQ ID NO: 1820820 - protein, 26 aa, Staphylococcus epidermidis
RSEPHERLFALLIPSNEEPVLFCPKM

SEQ ID NO: 1820821 - protein, 22 aa, Staphylococcus epidermidis
RSIRIDLPPFTLVGATTRAGSL

SEQ ID NO: 1820822 - protein, 19 aa, Staphylococcus epidermidis
RSLQQIDRSLFWVNPDCGL

SEQ ID NO: 1820823 - protein, 36 aa, Staphylococcus epidermidis
RSNKHYISIFINGRYIKNFVLNKAILEGYHTLLTIG

SEQ ID NO: 1820824 - protein, 22 aa, Staphylococcus epidermidis
RSPKEAYAYLEKLRSIIQYTGV

SEQ ID NO: 1820825 - protein, 27 aa, Staphylococcus epidermidis
RSSHQYKLLIILSPSGAYYGGDTLKST

SEQ ID NO: 1820826 - protein, 20 aa, Staphylococcus epidermidis
RTIHAIPLKIKEPLNFEVRG

SEQ ID NO: 1820827 - protein, 25 aa, Staphylococcus epidermidis
RTLAMNFWATIEHTLRYKYDGAYPD

SEQ ID NO: 1820828 - protein, 29 aa, Staphylococcus epidermidis
RTREIGYSIIPLKLYLKHGQCKVLLGVAR

SEQ ID NO: 1820829 - protein, 33 aa, Staphylococcus epidermidis
RTYGNAETFYPMPFLSPETMWYYKSAFNTDQMK

SEQ ID NO: 1820830 - protein, 37 aa, Staphylococcus epidermidis; identical to SEQ ID NO: 1680698

SEQ ID NO: 1820831 - protein, 25 aa, Staphylococcus epidermidis
RVDPEQLYYLMSRGISRAEAERLVI

SEQ ID NO: 1820832 - protein, 25 aa, Staphylococcus epidermidis
RVENEFNFKILDHRLTFHGVCSECQ

SEQ ID NO: 1820833 - protein, 18 aa, Staphylococcus epidermidis
RVGPIKLHLVPFTEIQKQ

SEQ ID NO: 1820834 - protein, 18 aa, Staphylococcus epidermidis
RVGYKTVDGKKVRIAKKS

SEQ ID NO: 1820835 - protein, 24 aa, Staphylococcus epidermidis
RVIGYQNQLPWHLPNDLKHVKQLT

SEQ ID NO: 1820836 - protein, 23 aa, Staphylococcus epidermidis
RVINRNNRLKRLLDLGAPGIIVQ

SEQ ID NO: 1820837 - protein, 19 aa, Staphylococcus epidermidis
RVTKILRYLCQTVGYDHDE

SEQ ID NO: 1820838 - protein, 27 aa, Staphylococcus epidermidis
RVYLAVGGGFKLEKWLHSASTDFNVEI

SEQ ID NO: 1820839 - protein, 30 aa, Staphylococcus epidermidis
RWMEEIRDWTISRQLWWGHQIPAWYHKDTG

SEQ ID NO: 1820840 - protein, 17 aa, Staphylococcus epidermidis
RYGYLYMNQFETKDNPG

SEQ ID NO: 1820841 - protein, 17 aa, Staphylococcus epidermidis
RYIEVIGISIGGGTIKL

SEQ ID NO: 1820842 - protein, 24 aa, Staphylococcus epidermidis
SARLHPWLLNIYEKRGYEIYAKHE

SEQ ID NO: 1820843 - protein, 27 aa, Staphylococcus epidermidis
SATDFYCSLLNGYPLVIATSVERTNTD

SEQ ID NO: 1820844 - protein, 24 aa, Staphylococcus epidermidis
SATKGAIVSFTRSLATTLMEKGIR

SEQ ID NO: 1820845 - protein, 23 aa, Staphylococcus epidermidis
SDAGLLYISYITNPTTGGVSASF

SEQ ID NO: 1820846 - protein, 23 aa, Staphylococcus epidermidis
SDETTHIYLLLKGNIMRENFNLN

SEQ ID NO: 1820847 - protein, 24 aa, Staphylococcus epidermidis
SDKKVIMYAPTWRDDEFVSKGKYL

SEQ ID NO: 1820848 - protein, 19 aa, Staphylococcus epidermidis
SDLDYTIIRPGWLTDKNEN

SEQ ID NO: 1820849 - protein, 27 aa, Staphylococcus epidermidis
SDLKVEGALTLILKDAIKPNLVQTIEG

SEQ ID NO: 1820850 - protein, 30 aa, Staphylococcus epidermidis; identical to SEQ ID NO: 1680709

SEQ ID NO: 1820851 - protein, 24 aa, Staphylococcus epidermidis
SDVDVFLVAPKGPGHLVRRTFVEG

SEQ ID NO: 1820852 - protein, 29 aa, Staphylococcus epidermidis
SEAHSTLRQSLLPHLIDAVSYNVARKNTN

SEQ ID NO: 1820853 - protein, 29 aa, Staphylococcus epidermidis
SEIQRLIQFLLIELSYLKKPKLDVNKDFY

SEQ ID NO: 1820854 - protein, 27 aa, Staphylococcus epidermidis
SEKDPKLLPFQGYILQNFDLNDKGFCK

SEQ ID NO: 1820855 - protein, 23 aa, Staphylococcus epidermidis
SEKKPRIRIPLSNEILEEFEKIR

SEQ ID NO: 1820856 - protein, 28 aa, Staphylococcus epidermidis
SEKTARQCAIVWGVNPVVKEGRKTTDAL

SEQ ID NO: 1820857 - protein, 21 aa, Staphylococcus epidermidis
SENLIFLNLYNHQLLNNNEID

SEQ ID NO: 1820858 - protein, 28 aa, Staphylococcus epidermidis
SEQLKGTDVLVCTVIGFPLGATTTAVKS

SEQ ID NO: 1820859 - protein, 24 aa, Staphylococcus epidermidis
SETAQVRVLPYAAITKRQAGTELV

SEQ ID NO: 1820860 - protein, 21 aa, Staphylococcus epidermidis
SEYENKLYQAYRYNEKLKSRI

SEQ ID NO: 1820861 - protein, 18 aa, Staphylococcus epidermidis
SFDKLLGHLPSVQEKWNA

SEQ ID NO: 1820862 - protein, 22 aa, Staphylococcus epidermidis
SFDMGFIDTGYERLGFGPSTNG

SEQ ID NO: 1820863 - protein, 19 aa, Staphylococcus epidermidis
SFDTLLVATGRQPNTQVAK

SEQ ID NO: 1820864 - protein, 20 aa, Staphylococcus epidermidis
SFINAIQRIVGNKKIILVAN

SEQ ID NO: 1820865 - protein, 20 aa, Staphylococcus epidermidis
SFKAILRCDPDVILIGEIRD

SEQ ID NO: 1820866 - protein, 23 aa, Staphylococcus epidermidis
SGAKIVEFGGWAMPVQFSSIKEE

SEQ ID NO: 1820867 - protein, 25 aa, Staphylococcus epidermidis
SGDKLPIWIADYVLSTYGTGAVMAV

SEQ ID NO: 1820868 - protein, 28 aa, Staphylococcus epidermidis
SGEKIPRGLALDYIYGYTIINDITDRTA

SEQ ID NO: 1820869 - protein, 26 aa, Staphylococcus epidermidis
SGGEPLLQMPFLEQLFKELKANGVHT

SEQ ID NO: 1820870 - protein, 27 aa, Staphylococcus epidermidis
SGGHLTNPFILLNWSDTVSDLYTLVHE

SEQ ID NO: 1820871 - protein, 26 aa, Staphylococcus epidermidis
SGGKRPLVCFFSNDLNIHRTKTEKAN

SEQ ID NO: 1820872 - protein, 21 aa, Staphylococcus epidermidis
SGIFAFNNRVLFEKLEQVKND

SEQ ID NO: 1820873 - protein, 18 aa, Staphylococcus epidermidis
SGIHFAMDYLTEQTQYLN

SEQ ID NO: 1820874 - protein, 23 aa, Staphylococcus epidermidis
SGIYSYLPLATRVLNNISKIIRE

SEQ ID NO: 1820875 - protein, 33 aa, Staphylococcus epidermidis
SGNNPSWMILDVLPIIPPEIRPMVQLDGGRFAT

SEQ ID NO: 1820876 - protein, 24 aa, Staphylococcus epidermidis
SGRQWYSWIHIDDLIRGILFTINH

SEQ ID NO: 1820877 - protein, 26 aa, Staphylococcus epidermidis
SGVSQTQISLPFISAGENGPLHLEIS

SEQ ID NO: 1820878 - protein, 26 aa, Staphylococcus epidermidis
SHDAIDPQFYIFHNNYKKFTMITDTG

SEQ ID NO: 1820879 - protein, 17 aa, Staphylococcus epidermidis
SHFIIGYRFSPEEIEEP

SEQ ID NO: 1820880 - protein, 26 aa, Staphylococcus epidermidis
SHQMDMIFTHFGISGPAALRCSQFVY

SEQ ID NO: 1820881 - protein, 24 aa, Staphylococcus epidermidis
SHQNVPKIYFTSHMDTVVPGKNIQ

SEQ ID NO: 1820882 - protein, 22 aa, Staphylococcus epidermidis
SHTPVWFMRQAGRSQPEYRKLK

SEQ ID NO: 1820883 - protein, 21 aa, Staphylococcus epidermidis
SIDLEAFFTRNLNSYHFNQLP

SEQ ID NO: 1820884 - protein, 23 aa, Staphylococcus epidermidis
SIGAMALFGEKYGDIVRVVNMAP

SEQ ID NO: 1820885 - protein, 26 aa, Staphylococcus epidermidis
SIGELEPRMFSFNSPFGACPTCDGLG

SEQ ID NO: 1820886 - protein, 29 aa, Staphylococcus epidermidis
SIGRVKPFYGNFGIYLRAYTYIRSMGANG

SEQ ID NO: 1820887 - protein, 22 aa, Staphylococcus epidermidis
SIKNVVKPLLKYAKHRGIYVQM

SEQ ID NO: 1820888 - protein, 18 aa, Staphylococcus epidermidis
SILKFLEEPPDNTIAILL

SEQ ID NO: 1820889 - protein, 23 aa, Staphylococcus epidermidis
SIPLIASSIMSKKIAAGADAIVL

SEQ ID NO: 1820890 - protein, 24 aa, Staphylococcus epidermidis
SISLDLMYHLPQQTIDDFKDSLER

SEQ ID NO: 1820891 - protein, 27 aa, Staphylococcus epidermidis
SISVTQLLERFLFPSATHGKKVYKLSG

SEQ ID NO: 1820892 - protein, 22 aa, Staphylococcus epidermidis
SKDFPLMAKIVDAAAPLSIHVH

SEQ ID NO: 1820893 - protein, 20 aa, Staphylococcus epidermidis
SKDPDFIQGYFYLQSLFENE

SEQ ID NO: 1820894 - protein, 39 aa, Staphylococcus epidermidis
SKMKEEPQWMLDFRLKALKLFYKMPMPQWGGDLSELDFD

SEQ ID NO: 1820895 - protein, 21 aa, Staphylococcus epidermidis
SKQLCFLFYVSSKEIIKKYTD

SEQ ID NO: 1820896 - protein, 27 aa, Staphylococcus epidermidis
SKSLYPSCRIAYIVLPQNLMHKYNNQK

SEQ ID NO: 1820897 - protein, 34 aa, Staphylococcus epidermidis
SLDAILLHTRPIKIGLAALVDRGHRELPIRADFV

SEQ ID NO: 1820898 - protein, 18 aa, Staphylococcus epidermidis
SLDILGLEKSEVAMVGDL

SEQ ID NO: 1820899 - protein, 28 aa, Staphylococcus epidermidis
SLGVNAGLFLLKFLASLNLNKSAKDFVE

SEQ ID NO: 1820900 - protein, 21 aa, Staphylococcus epidermidis
SLIQRHFQIGYNRAARIIDQL

SEQ ID NO: 1820901 - protein, 21 aa, Staphylococcus epidermidis
SLNDQILELLSKRGELAQKIG

SEQ ID NO: 1820902 - protein, 19 aa, Staphylococcus epidermidis
SLSIKDTLPTPFENIKGKF

SEQ ID NO: 1820903 - protein, 23 aa, Staphylococcus epidermidis
SLSNELEWLNQLFVAGGLADLEL

SEQ ID NO: 1820904 - protein, 19 aa, Staphylococcus epidermidis
SLYVEIYPLDISFNDPFTK

SEQ ID NO: 1820905 - protein, 24 aa, Staphylococcus epidermidis
SNDPVLYFEHKKAYRFLKEEVPET

SEQ ID NO: 1820906 - protein, 26 aa, Staphylococcus epidermidis
SNGMQTLGVALPWAISAALVRPNTQV

SEQ ID NO: 1820907 - protein, 18 aa, Staphylococcus epidermidis
SNIAYYAHKGSMSCVVTA

SEQ ID NO: 1820908 - protein, 27 aa, Staphylococcus epidermidis
SNLSTQFHLLLGMGFKKYIDTLKISKS

SEQ ID NO: 1820909 - protein, 23 aa, Staphylococcus epidermidis
SNNDWNCPLTIRAPFGGGVHGGL

SEQ ID NO: 1820910 - protein, 23 aa, Staphylococcus epidermidis
SNRHKVKCIIFAPEGFAEEKISI

SEQ ID NO: 1820911 - protein, 20 aa, Staphylococcus epidermidis
SNVRYVIHYNMPGDLESYYQ

SEQ ID NO: 1820912 - protein, 23 aa, Staphylococcus epidermidis
SPDKILGAILFEQTMDREVEGKY

SEQ ID NO: 1820913 - protein, 20 aa, Staphylococcus epidermidis
SPKPRLPFKHIFHKDQYDAN

SEQ ID NO: 1820914 - protein, 20 aa, Staphylococcus epidermidis
SPLCNYLVSKLKSSLPLTSI

SEQ ID NO: 1820915 - protein, 17 aa, Staphylococcus epidermidis
SPQIIIGAQYIQTAGVA

SEQ ID NO: 1820916 - protein, 21 aa, Staphylococcus epidermidis
SPYDFQGLGVEGLKILKNVKD

SEQ ID NO: 1820917 - protein, 18 aa, Staphylococcus epidermidis
SQFIGRKVSEALLKVVIK

SEQ ID NO: 1820918 - protein, 18 aa, Staphylococcus epidermidis
SQLSRFFTGIEIHPGAKI

SEQ ID NO: 1820919 - protein, 20 aa, Staphylococcus epidermidis
SQPFIPPIDGLDQVNYETTD

SEQ ID NO: 1820920 - protein, 26 aa, Staphylococcus epidermidis
SQREFKIYMLIAERFLENLMNPYLYE

SEQ ID NO: 1820921 - protein, 23 aa, Staphylococcus epidermidis
SRAEYRLLLRHDNADLRLTDMGY

SEQ ID NO: 1820922 - protein, 33 aa, Staphylococcus epidermidis
SRENYFAFGAFAQNLMLLLYEAGIGTCWKSPQY

SEQ ID NO: 1820923 - protein, 19 aa, Staphylococcus epidermidis
SRGTPRIANRLLKRVRDFQ

SEQ ID NO: 1820924 - protein, 17 aa, Staphylococcus epidermidis
SRIPIGLPISGTTVYVM

SEQ ID NO: 1820925 - protein, 17 aa, Staphylococcus epidermidis
SRIYLNFSDPWPKKRHA

SEQ ID NO: 1820926 - protein, 24 aa, Staphylococcus epidermidis
SRTQAILPLRGKILNVEKARLDRI

SEQ ID NO: 1820927 - protein, 23 aa, Staphylococcus epidermidis
SSEDIDLFVPHQANIRIMESARE

SEQ ID NO: 1820928 - protein, 17 aa, Staphylococcus epidermidis
SSGALAGSILKMNEGLK

SEQ ID NO: 1820929 - protein, 23 aa, Staphylococcus epidermidis
SSGTIPGVIFKLEKTHNITEDQM

SEQ ID NO: 1820930 - protein, 22 aa, Staphylococcus epidermidis
SSLAFDTIYAEGQRRYVESLSA

SEQ ID NO: 1820931 - protein, 18 aa, Staphylococcus epidermidis
SSPSYALFKGQHLVHFIP

SEQ ID NO: 1820932 - protein, 23 aa, Staphylococcus epidermidis
SSRLEILDLLSCGELCACDLLQH

SEQ ID NO: 1820933 - protein, 26 aa, Staphylococcus epidermidis
SSSLPSYHLYFIQVSLQHVIEDTYRR

SEQ ID NO: 1820934 - protein, 27 aa, Staphylococcus epidermidis
SSWEKIGVRLVDQLLETFPVHDKEAAH

SEQ ID NO: 1820935 - protein, 23 aa, Staphylococcus epidermidis
SSYDTFLVANIINKAMFNQKIRK

SEQ ID NO: 1820936 - protein, 19 aa, Staphylococcus epidermidis
SSYFGYHAIHRFKNDFENK

SEQ ID NO: 1820937 - protein, 17 aa, Staphylococcus epidermidis
STFLDIYAERDLQNGDI

SEQ ID NO: 1820938 - protein, 22 aa, Staphylococcus epidermidis
STIGEKLSIRRFSIRTKTDNDA

SEQ ID NO: 1820939 - protein, 29 aa, Staphylococcus epidermidis
SVDDDQYWQYPPFKLTNKDEWLYGRGVSD

SEQ ID NO: 1820940 - protein, 18 aa, Staphylococcus epidermidis
SVDISYPLDQFNLDTVNR

SEQ ID NO: 1820941 - protein, 26 aa, Staphylococcus epidermidis
SVGKATKFLLALYNVFIEKDCSIVEI

SEQ ID NO: 1820942 - protein, 22 aa, Staphylococcus epidermidis
SVIKTIEALMRKGYNYDKIKSK

SEQ ID NO: 1820943 - protein, 29 aa, Staphylococcus epidermidis
SVKPISGYPFVWWFATRPTYDGQGYGSQL

SEQ ID NO: 1820944 - protein, 27 aa, Staphylococcus epidermidis
SVMDSGFDGFFLIAANPVDILTRYVKE

SEQ ID NO: 1820945 - protein, 19 aa, Staphylococcus epidermidis
SVVEKLITLGKKGDLASRR

SEQ ID NO: 1820946 - protein, 29 aa, Staphylococcus epidermidis
TADSLHIGHLLPFLTLRRFQEHGHRPIVL

SEQ ID NO: 1820947 - protein, 26 aa, Staphylococcus epidermidis
TADVMYHLFVLLHSLDIPFSEVEQVL

SEQ ID NO: 1820948 - protein, 26 aa, Staphylococcus epidermidis
TAGPLYYRAEPVGCSATILYKMYKER

SEQ ID NO: 1820949 - protein, 28 aa, Staphylococcus epidermidis
TAPYHDSKLPLEIYVELVYSIQQEMVYK

SEQ ID NO: 1820950 - protein, 19 aa, Staphylococcus epidermidis
TAVCNPIVNSYKRLVPGYE

SEQ ID NO: 1820951 - protein, 47 aa, Staphylococcus epidermidis
TDGAHIQVLLLTFFFKYMKPLVQAGRVFIALPPLYKLEKGKGKNKKV

SEQ ID NO: 1820952 - protein, 22 aa, Staphylococcus epidermidis
TDQKVLVFDLGGGTFDVSILEL

SEQ ID NO: 1820953 - protein, 18 aa, Staphylococcus epidermidis
TDQRLKIIKLSNKGKKYI

SEQ ID NO: 1820954 - protein, 23 aa, Staphylococcus epidermidis
TEDIRWLRCDIKSLNLLGNVLAK

SEQ ID NO: 1820955 - protein, 28 aa, Staphylococcus epidermidis
TEDISTDLVWYLWTGKYSSLFGKRAMTT

SEQ ID NO: 1820956 - protein, 18 aa, Staphylococcus epidermidis
TEEEAAKQVLIKRAKENK

SEQ ID NO: 1820957 - protein, 19 aa, Staphylococcus epidermidis
TEHSVAMLLAMARNIPQAH

SEQ ID NO: 1820958 - protein, 29 aa, Staphylococcus epidermidis
TELQPENLHQLLRKLPPREYSISSSYKAT

SEQ ID NO: 1820959 - protein, 24 aa, Staphylococcus epidermidis
TEPGYKSILIAVNRFVTATIEASN

SEQ ID NO: 1820960 - protein, 22 aa, Staphylococcus epidermidis
TEQKFLDLFNKHELDSAVIGEV

SEQ ID NO: 1820961 - protein, 22 aa, Staphylococcus epidermidis
TEQQLEYLLLASGSEVNLAVEA

SEQ ID NO: 1820962 - protein, 26 aa, Staphylococcus epidermidis
TESLLLELNLIKQYQPRYNILLKDDK

SEQ ID NO: 1820963 - protein, 25 aa, Staphylococcus epidermidis
TFGQPAIAIPFNAGKIKVLIESLDE

SEQ ID NO: 1820964 - protein, 21 aa, Staphylococcus epidermidis
TFIRQQWAKLGLGLDYSRERF

SEQ ID NO: 1820965 - protein, 19 aa, Staphylococcus epidermidis
TFLDTPGHAAFTTMRARGA

SEQ ID NO: 1820966 - protein, 35 aa, Staphylococcus epidermidis
TFVSGKLTIDNFRWAGVPFYIRTGKRMKSKTIQVV

SEQ ID NO: 1820967 - protein, 25 aa, Staphylococcus epidermidis
TGAEPLYFLDYIATNKVVPSTIEQI

SEQ ID NO: 1820968 - protein, 27 aa, Staphylococcus epidermidis
TGGEPLLRRNLYKLVEQLNLIDGIEDI

SEQ ID NO: 1820969 - protein, 20 aa, Staphylococcus epidermidis
TGLIKANIPTRIAFMVSSSV

SEQ ID NO: 1820970 - protein, 19 aa, Staphylococcus epidermidis
TGMRIIKINDIKLAIINLQ

SEQ ID NO: 1820971 - protein, 18 aa, Staphylococcus epidermidis
TGRKDIMLPTAKAALAVG

SEQ ID NO: 1820972 - protein, 28 aa, Staphylococcus epidermidis
TGSVVLPGRFFVDIIKKLPGKEVKLSTN

SEQ ID NO: 1820973 - protein, 22 aa, Staphylococcus epidermidis
THAQMKMFLTRLGFGSKMVVTG

SEQ ID NO: 1820974 - protein, 24 aa, Staphylococcus epidermidis
TIDPEIYNLGIPVLGICYGMQLTT

SEQ ID NO: 1820975 - protein, 29 aa, Staphylococcus epidermidis
TIEDLCGNAYLFRFPPKAFKHAAHFPGNM

SEQ ID NO: 1820976 - protein, 19 aa, Staphylococcus epidermidis
TIISGPALVAQWINLQYYA

SEQ ID NO: 1820977 - protein, 22 aa, Staphylococcus epidermidis
TINHFGTLDIIINNAGFENSIP

SEQ ID NO: 1820978 - protein, 25 aa, Staphylococcus epidermidis
TINYEVLCNLSRRLPRIYYYDNNEE

SEQ ID NO: 1820979 - protein, 24 aa, Staphylococcus epidermidis
TITNYLRRINRKTALLIQLSTQVG

SEQ ID NO: 1820980 - protein, 19 aa, Staphylococcus epidermidis
TIVVWRLDRLGRNMEDLIT

SEQ ID NO: 1820981 - protein, 27 aa, Staphylococcus epidermidis
TKAHELKPDLILMDLLMDDMDGVEATT

SEQ ID NO: 1820982 - protein, 24 aa, Staphylococcus epidermidis
TKDLVLLGIKTRGAFLAHRIQDKI

SEQ ID NO: 1820983 - protein, 23 aa, Staphylococcus epidermidis
TKGKVIYISTFSKSLYPSCRIAY

SEQ ID NO: 1820984 - protein, 26 aa, Staphylococcus epidermidis
TKIYLDQIHQRLFLEQSLITERIKKY

SEQ ID NO: 1820985 - protein, 41 aa, Staphylococcus epidermidis
TKTVYTDLLFLYLEHAFLSQNFFNIPSIHPAFDDILVHMYQ

SEQ ID NO: 1820986 - protein, 21 aa, Staphylococcus epidermidis
TLDLLKRLKYMNEEFNTTILM

SEQ ID NO: 1820987 - protein, 18 aa, Staphylococcus epidermidis
TLIVFKDGEPVDKVVGFQ

SEQ ID NO: 1820988 - protein, 22 aa, Staphylococcus epidermidis
TLIYIDEKPKRLLTVGLGNLKI

SEQ ID NO: 1820989 - protein, 17 aa, Staphylococcus epidermidis
TLRLYEMFMGPLDAAIA

SEQ ID NO: 1820990 - protein, 20 aa, Staphylococcus epidermidis
TLTKSKQWLDSLKFLVRCIE

SEQ ID NO: 1820991 - protein, 25 aa, Staphylococcus epidermidis
TLVEGRAIRLHPLVTTAYNADFDGD

SEQ ID NO: 1820992 - protein, 33 aa, Staphylococcus epidermidis
TLVERGPRRVSPFFVPMLIPDMATGQVSIDLGA

SEQ ID NO: 1820993 - protein, 24 aa, Staphylococcus epidermidis
TMEELLTIYEWPEKLLNKELKKLT

SEQ ID NO: 1820994 - protein, 24 aa, Staphylococcus epidermidis
TNKAQYTLVKLLANKFKNLCVVGD

SEQ ID NO: 1820995 - protein, 24 aa, Staphylococcus epidermidis
TNKQWDLLNLLEEELQSLGLKTDM

SEQ ID NO: 1820996 - protein, 27 aa, Staphylococcus epidermidis
TNNQLVGAGLPLWLPNGATIRREIERY

SEQ ID NO: 1820997 - protein, 27 aa, Staphylococcus epidermidis
TNRFSIVMHDLLKMPFIGESISKAKVE

SEQ ID NO: 1820998 - protein, 17 aa, Staphylococcus epidermidis
TPGMLLAAVRTNVPAIF

SEQ ID NO: 1820999 - protein, 24 aa, Staphylococcus epidermidis
TPSNPLLRVTDIKASAKIAKKYDL

SEQ ID NO: 1821000 - protein, 35 aa, Staphylococcus epidermidis
TQDTVLVFTNKGRYLFIPVHKLADIRWKELGQHIS

SEQ ID NO: 1821001 - protein, 33 aa, Staphylococcus epidermidis
TQSLKWAVEEMEKRYKLFAQYHVRNITAFNKKA

SEQ ID NO: 1821002 - protein, 26 aa, Staphylococcus epidermidis
TRCQDGILLFWPIEGSMHFQQFMKER

SEQ ID NO: 1821003 - protein, 24 aa, Staphylococcus epidermidis
TRGQAPYKFLLSHGFVMDGEGKKM

SEQ ID NO: 1821004 - protein, 17 aa, Staphylococcus epidermidis
TRNFLLRNLTETKLLNA

SEQ ID NO: 1821005 - protein, 23 aa, Staphylococcus epidermidis
TSAQFECNCSHEKFLNAIKGLGE

SEQ ID NO: 1821006 - protein, 24 aa, Staphylococcus epidermidis
TSENLDLFFSYRVEKGQTGRMLAF

SEQ ID NO: 1821007 - protein, 28 aa, Staphylococcus epidermidis
TSFAYTRRLPFHAKRFHQWLEQMPENIV

SEQ ID NO: 1821008 - protein, 18 aa, Staphylococcus epidermidis
TSFIQKATKMGIPVVSHL

SEQ ID NO: 1821009 - protein, 26 aa, Staphylococcus epidermidis
TSHTTKFDLAYPIYINAMTGGSDWTK

SEQ ID NO: 1821010 - protein, 17 aa, Staphylococcus epidermidis
TSKHLIIKSPHPSPLSA

SEQ ID NO: 1821011 - protein, 35 aa, Staphylococcus epidermidis
TSQPTLPLFKQIYSLYFKFVMPIFGKMFAKSKEEY

SEQ ID NO: 1821012 - protein, 26 aa, Staphylococcus epidermidis
TSVETILPILSIVDYVLVMTVNPGFG

SEQ ID NO: 1821013 - protein, 26 aa, Staphylococcus epidermidis
TTDNGLTRLIFMVPARGMIGYTTEFM

SEQ ID NO: 1821014 - protein, 18 aa, Staphylococcus epidermidis
TTGKPWFHVNPNYTEINV

SEQ ID NO: 1821015 - protein, 22 aa, Staphylococcus epidermidis
TTGLPKAFYRNEHSWIVSFKEN

SEQ ID NO: 1821016 - protein, 25 aa, Staphylococcus epidermidis
TTGTIFNHLFKQAITFAKKAHSETD

SEQ ID NO: 1821017 - protein, 25 aa, Staphylococcus epidermidis
TTLRRLMDLYGFKEKLQQLDLPMFG

SEQ ID NO: 1821018 - protein, 23 aa, Staphylococcus epidermidis
TTPEVFDLIAQTTPLRKVTSPQD

SEQ ID NO: 1821019 - protein, 22 aa, Staphylococcus epidermidis
TTRIKQAFFKIKGETRNCIAIL

SEQ ID NO: 1821020 - protein, 25 aa, Staphylococcus epidermidis
TTRQAFQFHGILKRNLKQSMKNINH

SEQ ID NO: 1821021 - protein, 29 aa, Staphylococcus epidermidis
TVAYTKLHNFHWYVKGPNFFSLHTKFEEL

SEQ ID NO: 1821022 - protein, 19 aa, Staphylococcus epidermidis
TVCILEAMKLFNEIQAETT

SEQ ID NO: 1821023 - protein, 35 aa, Staphylococcus epidermidis
TVGLGNLKILSYQRLLKVWGQLFQYLKDVHVTDCE

SEQ ID NO: 1821024 - protein, 28 aa, Staphylococcus epidermidis
TVILGCTHYPLLYQPIYEYFSGTKTVIS

SEQ ID NO: 1821025 - protein, 17 aa, Staphylococcus epidermidis
TVKENIMLPLSVQKLDK

SEQ ID NO: 1821026 - protein, 26 aa, Staphylococcus epidermidis
TVKENIVLVPKLLKWSQEKKDEKAKE

SEQ ID NO: 1821027 - protein, 31 aa, Staphylococcus epidermidis
TVTLKTLGLIIVMAQSGLLIPTLDGSQLSIF

SEQ ID NO: 1821028 - protein, 20 aa, Staphylococcus epidermidis
TVYPLLRRLVKSGELSTYYQ

SEQ ID NO: 1821029 - protein, 17 aa, Staphylococcus epidermidis
TWVAFAPNKRGYKMLPH

SEQ ID NO: 1821030 - protein, 32 aa, Staphylococcus epidermidis
TYDADGVFIYIGMKPLTAPFKNLGITNDAGYI

SEQ ID NO: 1821031 - protein, 25 aa, Staphylococcus epidermidis
TYNERMEEEMFLGLRMNQGVSKSRF

SEQ ID NO: 1821032 - protein, 23 aa, Staphylococcus epidermidis
VAEADVWLRENPLEFEWGGTSMI

SEQ ID NO: 1821033 - protein, 21 aa, Staphylococcus epidermidis
VAGELFIFDIVDAFIEAEYKP

SEQ ID NO: 1821034 - protein, 32 aa, Staphylococcus epidermidis
VAMGYRINNEPLLMDIAKTPHALIAGATGSGK

SEQ ID NO: 1821035 - protein, 18 aa, Staphylococcus epidermidis
VANYIGYLCSIISVTSNP

SEQ ID NO: 1821036 - protein, 18 aa, Staphylococcus epidermidis
VAPGPIYSPLIPATFDEE

SEQ ID NO: 1821037 - protein, 25 aa, Staphylococcus epidermidis
VARRRKARGLKLNHPEALALISDEL

SEQ ID NO: 1821038 - protein, 26 aa, Staphylococcus epidermidis
VATSGWTDIFIYPGFEFKAIDGLITN

SEQ ID NO: 1821039 - protein, 28 aa, Staphylococcus epidermidis
VATVTEIYDYIRLLYARVGKPYCPYHGI

SEQ ID NO: 1821040 - protein, 25 aa, Staphylococcus epidermidis
VDEEVLINVLKDRLIRHAYLDVFEK

SEQ ID NO: 1821041 - protein, 17 aa, Staphylococcus epidermidis
VDEGFIYSKPRSGYFVS

SEQ ID NO: 1821042 - protein, 26 aa, Staphylococcus epidermidis
VDEGLRTLLDFRYQRHFKAKKGENGQ

SEQ ID NO: 1821043 - protein, 25 aa, Staphylococcus epidermidis
VDIKTLVYPGFATDLQQPITPLLFM

SEQ ID NO: 1821044 - protein, 28 aa, Staphylococcus epidermidis
VDPDVLRFFMISVHYRSPINYNLELVGA

SEQ ID NO: 1821045 - protein, 18 aa, Staphylococcus epidermidis
VDRLLVVTFTNLSAREMK

SEQ ID NO: 1821046 - protein, 22 aa, Staphylococcus epidermidis
VDVYIRYLRNKLKPFNKEKSIE

SEQ ID NO: 1821047 - protein, 26 aa, Staphylococcus epidermidis
VDYCRDKNFLVLTYDNGYIIHDSSHE

SEQ ID NO: 1821048 - protein, 29 aa, Staphylococcus epidermidis
VEAGKLADLVMWEPEFFGAKPDLVVKGGM

SEQ ID NO: 1821049 - protein, 25 aa, Staphylococcus epidermidis
VEAYKQNMFALLGKPGFEDKKKELE

SEQ ID NO: 1821050 - protein, 28 aa, Staphylococcus epidermidis
VEETLIQPTFIYGHPIEISPLAKKNPND

SEQ ID NO: 1821051 - protein, 18 aa, Staphylococcus epidermidis
VEGSFIASVGIKSNMSMD

SEQ ID NO: 1821052 - protein, 19 aa, Staphylococcus epidermidis
VEHLPSHLSPLLKKLLLKS

SEQ ID NO: 1821053 - protein, 25 aa, Staphylococcus epidermidis
VELLDNVNYFGTMLVYTGKAEGLVS

SEQ ID NO: 1821054 - protein, 29 aa, Staphylococcus epidermidis
VEQHQVTDFMFFASAIMVLLHKYTRQDDI

SEQ ID NO: 1821055 - protein, 19 aa, Staphylococcus epidermidis
VERLDKILNFPKTCPHGGV

SEQ ID NO: 1821056 - protein, 30 aa, Staphylococcus epidermidis
VERPTLKFELFYFDIFRYGTSFVTLQVPRE

SEQ ID NO: 1821057 - protein, 24 aa, Staphylococcus epidermidis
VESVWNFINKIWNAARFSLMNIGE

SEQ ID NO: 1821058 - protein, 26 aa, Staphylococcus epidermidis
VETAYKAVMKPVEGTILTVAKDAAKA

SEQ ID NO: 1821059 - protein, 20 aa, Staphylococcus epidermidis
VFIVSRRGKILGSCLNELLK

SEQ ID NO: 1821060 - protein, 32 aa, Staphylococcus epidermidis
VFQMELSNKLTKYQPIPNLSIANFDPIAAADD

SEQ ID NO: 1821061 - protein, 22 aa, Staphylococcus epidermidis
VFQNYNLFPHKSALENVMEGLI

SEQ ID NO: 1821062 - protein, 17 aa, Staphylococcus epidermidis
VGAVSKILLEQLDIHLY

SEQ ID NO: 1821063 - protein, 32 aa, Staphylococcus epidermidis
VGLEQGLIHALHYYSKMLGLDLKVTINGLIDL

SEQ ID NO: 1821064 - protein, 26 aa, Staphylococcus epidermidis
VGNKKPIKRLWISSVTKKAIQEGFKQ

SEQ ID NO: 1821065 - protein, 29 aa, Staphylococcus epidermidis
VGVHGLPVQLDIDKLWIKNINVTTGLVSG

SEQ ID NO: 1821066 - protein, 33 aa, Staphylococcus epidermidis; identical to SEQ ID NO: 1681615

SEQ ID NO: 1821067 - protein, 31 aa, Staphylococcus epidermidis
VHDVTIGPSPVWMQFRLIKAGIRPINNVVDI

SEQ ID NO: 1821068 - protein, 29 aa, Staphylococcus epidermidis
VHFDRSFVDMPVGALWRRGHKPMKAQGLE

SEQ ID NO: 1821069 - protein, 26 aa, Staphylococcus epidermidis
VHKDGRLFICYLGDFKTTGGIFATTE

SEQ ID NO: 1821070 - protein, 18 aa, Staphylococcus epidermidis
VHRLDDAYFKKIDAIEFA

SEQ ID NO: 1821071 - protein, 29 aa, Staphylococcus epidermidis
VHSDIQFKIKHLMVSQVKGTFKQFDVQLD

SEQ ID NO: 1821072 - protein, 17 aa, Staphylococcus epidermidis
VIAGWTGIPLTKINETE

SEQ ID NO: 1821073 - protein, 24 aa, Staphylococcus epidermidis
VIGAPTQVKIYTTIKGKTAHASTP

SEQ ID NO: 1821074 - protein, 24 aa, Staphylococcus epidermidis
VIGEQKFGLRLPGEFNRDAMQEAV

SEQ ID NO: 1821075 - protein, 22 aa, Staphylococcus epidermidis
VIGPLLHYRMVHELPTFFSSNF

SEQ ID NO: 1821076 - protein, 17 aa, Staphylococcus epidermidis
VIYHGNYATWFEVARTD

SEQ ID NO: 1821077 - protein, 23 aa, Staphylococcus epidermidis
VKDYRYYIKPAMNKLISGIKAYY

SEQ ID NO: 1821078 - protein, 18 aa, Staphylococcus epidermidis
VKGILNFTPRRIKTPQDV

SEQ ID NO: 1821079 - protein, 25 aa, Staphylococcus epidermidis
VKKYNCLYLRVDPYLPYQYLNHEGE

SEQ ID NO: 1821080 - protein, 20 aa, Staphylococcus epidermidis
VKMEAPIVEGSFIASVGIKS

SEQ ID NO: 1821081 - protein, 17 aa, Staphylococcus epidermidis
VKNAIIPGLYAYEAGQP

SEQ ID NO: 1821082 - protein, 24 aa, Staphylococcus epidermidis
VKNTPESWYYSKRLMYSQLENIKN

SEQ ID NO: 1821083 - protein, 25 aa, Staphylococcus epidermidis
VKQTNSYDLAFEELEKEKDFLQVIV

SEQ ID NO: 1821084 - protein, 27 aa, Staphylococcus epidermidis
VKTVHLKLPLDWLKGKIIIDSLGLHSN

SEQ ID NO: 1821085 - protein, 20 aa, Staphylococcus epidermidis
VLEGLEFMGVYWDPKKNESL

SEQ ID NO: 1821086 - protein, 24 aa, Staphylococcus epidermidis
VLESVYWLKDKGVHFDRSFVDMPV

SEQ ID NO: 1821087 - protein, 18 aa, Staphylococcus epidermidis
VLGFHNYPTLKVGEFAIK

SEQ ID NO: 1821088 - protein, 26 aa, Staphylococcus epidermidis
VLGNPLNAIHWLIKKLHTHGKQLKKG

SEQ ID NO: 1821089 - protein, 19 aa, Staphylococcus epidermidis
VLHPNQILDWILIEDENLN

SEQ ID NO: 1821090 - protein, 26 aa, Staphylococcus epidermidis
VLKVNDLYVLNFVGLGLIVQNAENVQ

SEQ ID NO: 1821091 - protein, 18 aa, Staphylococcus epidermidis
VLMTCNPLNFASQTVMKK

SEQ ID NO: 1821092 - protein, 21 aa, Staphylococcus epidermidis
VLNCIHKGIYLLDVPLSEYQE

SEQ ID NO: 1821093 - protein, 28 aa, Staphylococcus epidermidis
VLNDKPESLFNYFKQLFAQVTNPPIDAY

SEQ ID NO: 1821094 - protein, 25 aa, Staphylococcus epidermidis
VLNKTIPEDLFFIISLSGETHQLKE

SEQ ID NO: 1821095 - protein, 26 aa, Staphylococcus epidermidis
VLNTFTLFNINLSWIESRPLKTQLGM

SEQ ID NO: 1821096 - protein, 19 aa, Staphylococcus epidermidis
VLRFQPPLVITYKQLDKAL

SEQ ID NO: 1821097 - protein, 28 aa, Staphylococcus epidermidis
VNAEQFRQLFILPQGEFKKFLQSNSKDK

SEQ ID NO: 1821098 - protein, 24 aa, Staphylococcus epidermidis
VNDGDAVIFYNFRPDRAAQLSEIF

SEQ ID NO: 1821099 - protein, 29 aa, Staphylococcus epidermidis
VNERDVRDYLPFESLILDLNQPFDVTETK

SEQ ID NO: 1821100 - protein, 25 aa, Staphylococcus epidermidis
VNIADKILIGGGMAYTFIKAQGKEI

SEQ ID NO: 1821101 - protein, 17 aa, Staphylococcus epidermidis
VNPFRIEGQKTGAFEIV

SEQ ID NO: 1821102 - protein, 25 aa, Staphylococcus epidermidis
VNQSVHFEVLLVKLAEMIKTQPQTV

SEQ ID NO: 1821103 - protein, 24 aa, Staphylococcus epidermidis
VNRLINDMIYFVRDTIMNKTSNES

SEQ ID NO: 1821104 - protein, 22 aa, Staphylococcus epidermidis
VNYIMNLPVNFLKTFLPELIEK

SEQ ID NO: 1821105 - protein, 17 aa, Staphylococcus epidermidis
VPAYFNDGERQATKDAG

SEQ ID NO: 1821106 - protein, 26 aa, Staphylococcus epidermidis
VPEEDMPYLPDGRPIDIMLNPLGVPS

SEQ ID NO: 1821107 - protein, 26 aa, Staphylococcus epidermidis
VPETEVINVFPIRFVVDKDNEVSDPK

SEQ ID NO: 1821108 - protein, 25 aa, Staphylococcus epidermidis
VPGEGYYAVGLFFSKEKVRDSIHEE

SEQ ID NO: 1821109 - protein, 24 aa, Staphylococcus epidermidis
VPRGLPVIPEAYTPKLKRVNRKPI

SEQ ID NO: 1821110 - protein, 19 aa, Staphylococcus epidermidis
VPSAIFGTKKRRPIENGVI

SEQ ID NO: 1821111 - protein, 23 aa, Staphylococcus epidermidis
VQEVRAWTFKQGMTAPQCAGIIH

SEQ ID NO: 1821112 - protein, 17 aa, Staphylococcus epidermidis
VQIPSLIPRFLTLNEGT

SEQ ID NO: 1821113 - protein, 19 aa, Staphylococcus epidermidis
VQLPDGSLPLLTPMSEVAG

SEQ ID NO: 1821114 - protein, 18 aa, Staphylococcus epidermidis
VRITHLPTGVIATSSEKS

SEQ ID NO: 1821115 - protein, 18 aa, Staphylococcus epidermidis
VRKKYEMPIIMLTAKDSE

SEQ ID NO: 1821116 - protein, 22 aa, Staphylococcus epidermidis
VRVISMPNWYAFEQQSSEYKES

SEQ ID NO: 1821117 - protein, 23 aa, Staphylococcus epidermidis
VSAASSCYIISLAATLEKSGFTN

SEQ ID NO: 1821118 - protein, 22 aa, Staphylococcus epidermidis
VSAKRWIRYIHEVEEPDFLIVI

SEQ ID NO: 1821119 - protein, 18 aa, Staphylococcus epidermidis
VSEKVRIHTPSQMGIRKP

SEQ ID NO: 1821120 - protein, 22 aa, Staphylococcus epidermidis
VSELREMIGDMPLIQTSMLKQE

SEQ ID NO: 1821121 - protein, 24 aa, Staphylococcus epidermidis
VSFHSLWHQYTNAIIYYYMVDKQS

SEQ ID NO: 1821122 - protein, 23 aa, Staphylococcus epidermidis
VSGARFVYLTKDGALLERALMNY

SEQ ID NO: 1821123 - protein, 25 aa, Staphylococcus epidermidis
VSHDRYFLNKVVQEYWFIHDGKIEK

SEQ ID NO: 1821124 - protein, 35 aa, Staphylococcus epidermidis
VSKMRASILVMGPLLARLGHAIVALPGGCAIGTRP

SEQ ID NO: 1821125 - protein, 30 aa, Staphylococcus epidermidis
VSPDLFIKRTHFYDYLLLNSDGLTDYVRDY

SEQ ID NO: 1821126 - protein, 26 aa, Staphylococcus epidermidis
VSRTSGIFFMIKGDEQYIFGDCAINP

SEQ ID NO: 1821127 - protein, 25 aa, Staphylococcus epidermidis
VTAARMGWLPSYPQFNKNSLLFGEE

SEQ ID NO: 1821128 - protein, 25 aa, Staphylococcus epidermidis
VTACYLLVNKSIRRGYKSMPEHVNM

SEQ ID NO: 1821129 - protein, 28 aa, Staphylococcus epidermidis
VTAITGSGPAFLYHVFEQYVKAGTELGL

SEQ ID NO: 1821130 - protein, 25 aa, Staphylococcus epidermidis
VTEQDIISYVLYPKVYKQYIQTKEQ

SEQ ID NO: 1821131 - protein, 20 aa, Staphylococcus epidermidis
VTFDDCDIFFIGGGSDREQA

SEQ ID NO: 1821132 - protein, 23 aa, Staphylococcus epidermidis
VTGTYTMPCARTLVPVDVPLDVS

SEQ ID NO: 1821133 - protein, 19 aa, Staphylococcus epidermidis
VTPGPWHIHRMLEAAEEMP

SEQ ID NO: 1821134 - protein, 22 aa, Staphylococcus epidermidis
VTTQVGCRIGCTFCASTLGGLK

SEQ ID NO: 1821135 - protein, 40 aa, Staphylococcus epidermidis
VTVDVGSHYIWMARKYRSYNPRHLLFSNGMQTLGVALPWA

SEQ ID NO: 1821136 - protein, 17 aa, Staphylococcus epidermidis
VTYMGISPLDTMLSAFG

SEQ ID NO: 1821137 - protein, 25 aa, Staphylococcus epidermidis
VVEYSIKNALYYFENLKLSDQDKSI

SEQ ID NO: 1821138 - protein, 32 aa, Staphylococcus epidermidis
VVGAVVAWNFPILLASWKLGPALAAGNTVVIQ

SEQ ID NO: 1821139 - protein, 26 aa, Staphylococcus epidermidis
VVGVNVGGVFWGIQAAIEQFDKLGHG

SEQ ID NO: 1821140 - protein, 24 aa, Staphylococcus epidermidis
VVHKHYWNIGIAADTDKGLLVPVV

SEQ ID NO: 1821141 - protein, 18 aa, Staphylococcus epidermidis
VVLALKEYGAMNARYEQG

SEQ ID NO: 1821142 - protein, 24 aa, Staphylococcus epidermidis
VVLIHACWLAHIEIAMINTRLTRH

SEQ ID NO: 1821143 - protein, 26 aa, Staphylococcus epidermidis
VVTNDDFTHWRKIMGVAPISDEEREN

SEQ ID NO: 1821144 - protein, 22 aa, Staphylococcus epidermidis
VYIKGYDDLKFYESFILQSHEK

SEQ ID NO: 1821145 - protein, 23 aa, Staphylococcus epidermidis
VYVNGHFENVTFPESFKVFGSEH

SEQ ID NO: 1821146 - protein, 26 aa, Staphylococcus epidermidis
WENEWKNYFHPFRASKQFTIVPSWES

SEQ ID NO: 1821147 - protein, 26 aa, Staphylococcus epidermidis
WFNSDTIYRSILNLVLLCGCQGVNGG

SEQ ID NO: 1821148 - protein, 30 aa, Staphylococcus epidermidis
WIQDEDVLDTWFSSALWPFSTLGWPDTNAD

SEQ ID NO: 1821149 - protein, 21 aa, Staphylococcus epidermidis
WKRVLDMNDRALRHVNVGLGG

SEQ ID NO: 1821150 - protein, 27 aa, Staphylococcus epidermidis
WNKSHHQLIFFGRYHCLARKPKCEICP

SEQ ID NO: 1821151 - protein, 17 aa, Staphylococcus epidermidis
WPGTITTIVHRIGPLQI

SEQ ID NO: 1821152 - protein, 28 aa, Staphylococcus epidermidis
WRYQDVPEKLWPIQPLRDFWGINKRTEK

SEQ ID NO: 1821153 - protein, 19 aa, Staphylococcus epidermidis
WSHLIAHKLYKNRRYVAAR

SEQ ID NO: 1821154 - protein, 26 aa, Staphylococcus epidermidis
WSRIPHFYMNYYVYQYATGYSAAQSL

SEQ ID NO: 1821155 - protein, 27 aa, Staphylococcus epidermidis
WSRRSTIFPNFIGHTFAVYDGRKHVPV

SEQ ID NO: 1821156 - protein, 17 aa, Staphylococcus epidermidis
WTTFNEIGPIGDGQYLV

SEQ ID NO: 1821157 - protein, 28 aa, Staphylococcus epidermidis
YAAENNITFVPYFPLASGILAGKYDENQ

SEQ ID NO: 1821158 - protein, 32 aa, Staphylococcus epidermidis
YALNVRQFIRLTRYFIDILRQSNNGRIIVISS

SEQ ID NO: 1821159 - protein, 23 aa, Staphylococcus epidermidis
YANNFLLKNKYAVEATPGNLKQL

SEQ ID NO: 1821160 - protein, 20 aa, Staphylococcus epidermidis
YAQMAEELYRFPIMYVEYSG

SEQ ID NO: 1821161 - protein, 25 aa, Staphylococcus epidermidis
YATLGLVHTLWKPMPGRFKDYIAMP

SEQ ID NO: 1821162 - protein, 17 aa, Staphylococcus epidermidis
YAVFNDLAKVLAKSFQV

SEQ ID NO: 1821163 - protein, 17 aa, Staphylococcus epidermidis
YCGTIGLLLPNQRMIFN

SEQ ID NO: 1821164 - protein, 27 aa, Staphylococcus epidermidis
YCINSAAIQFIPYDKLEELGYGDLIKH

SEQ ID NO: 1821165 - protein, 17 aa, Staphylococcus epidermidis
YDAAMKYKEDGTGLVVL

SEQ ID NO: 1821166 - protein, 20 aa, Staphylococcus epidermidis
YDAFPRDFNITESDNYLICA

SEQ ID NO: 1821167 - protein, 20 aa, Staphylococcus epidermidis
YDFDILVVALGFVSETFGID

SEQ ID NO: 1821168 - protein, 20 aa, Staphylococcus epidermidis
YDLMLVQTDRHYGKTLVLNM

SEQ ID NO: 1821169 - protein, 30 aa, Staphylococcus epidermidis
YDLTEKRMILERILPILSERERQIIQCTFI

SEQ ID NO: 1821170 - protein, 23 aa, Staphylococcus epidermidis
YDTPDNILRYPANDFVRDFIGQN

SEQ ID NO: 1821171 - protein, 23 aa, Staphylococcus epidermidis
YEEMNHLLYCSSAGHEPGYIYRA

SEQ ID NO: 1821172 - protein, 24 aa, Staphylococcus epidermidis
YELFNAMVMTPYFPKPDVLIYLEC

SEQ ID NO: 1821173 - protein, 23 aa, Staphylococcus epidermidis
YEMRWDIGYVLQQIALFPHMTIK

SEQ ID NO: 1821174 - protein, 26 aa, Staphylococcus epidermidis
YEQRMPKIVIVIDELADLMMMAPQDV

SEQ ID NO: 1821175 - protein, 20 aa, Staphylococcus epidermidis
YERMLTQVKQNWPYAEQMGL

SEQ ID NO: 1821176 - protein, 20 aa, Staphylococcus epidermidis
YEVMSIPTLIVFKDGEPVDK

SEQ ID NO: 1821177 - protein, 18 aa, Staphylococcus epidermidis
YFCNDDVYKLPIGTPAMA

SEQ ID NO: 1821178 - protein, 17 aa, Staphylococcus epidermidis
YFHLLRAQAASLDTLEM

SEQ ID NO: 1821179 - protein, 19 aa, Staphylococcus epidermidis
YFKGAIVIISHDRYFLDKI

SEQ ID NO: 1821180 - protein, 30 aa, Staphylococcus epidermidis
YGAYKQIKDLYEFNLFKLRIDHIQADPFAP

SEQ ID NO: 1821181 - protein, 21 aa, Staphylococcus epidermidis
YGCDKFCTYCIVPFTRGKERS

SEQ ID NO: 1821182 - protein, 24 aa, Staphylococcus epidermidis
YGKTECWYILDAQPGAEIIYGVNA

SEQ ID NO: 1821183 - protein, 24 aa, Staphylococcus epidermidis
YGLQMQMMTYMDIVLQNKERLGLT

SEQ ID NO: 1821184 - protein, 29 aa, Staphylococcus epidermidis
YGLSNIVVHAPYIINIANTTKPEVFNLGV

SEQ ID NO: 1821185 - protein, 27 aa, Staphylococcus epidermidis
YGMSKEEILILLTLLEKGSMTLKEMDK

SEQ ID NO: 1821186 - protein, 19 aa, Staphylococcus epidermidis
YGRFPHQKGFGRLTAEDKK

SEQ ID NO: 1821187 - protein, 22 aa, Staphylococcus epidermidis
YGVPRIVFVNKMDKLGANFEYS

SEQ ID NO: 1821188 - protein, 20 aa, Staphylococcus epidermidis
YHEEENAMVTDLDDLKELGK

SEQ ID NO: 1821189 - protein, 18 aa, Staphylococcus epidermidis
YHPDYDFLKTIGIDIHTN

SEQ ID NO: 1821190 - protein, 17 aa, Staphylococcus epidermidis
YHQAYKQGVPQFDLKEI

SEQ ID NO: 1821191 - protein, 21 aa, Staphylococcus epidermidis
YHYYEDYGIRKYGFHGTSHKY

SEQ ID NO: 1821192 - protein, 18 aa, Staphylococcus epidermidis
YIDAERLYYYSLERKALV

SEQ ID NO: 1821193 - protein, 20 aa, Staphylococcus epidermidis
YIDEQTFVPCTPLGIMEILK

SEQ ID NO: 1821194 - protein, 19 aa, Staphylococcus epidermidis
YIESHLLSLPGWAGIMYHR

SEQ ID NO: 1821195 - protein, 36 aa, Staphylococcus epidermidis
YIKDKKALFIVYANPLSLGLLTPPGTFGADIVVGDT

SEQ ID NO: 1821196 - protein, 32 aa, Staphylococcus epidermidis
YIRTLATDIGLKLGFPAHMSRLTRIASGGFQL

SEQ ID NO: 1821197 - protein, 17 aa, Staphylococcus epidermidis
YIVMDNQIYGLTKGQTS

SEQ ID NO: 1821198 - protein, 26 aa, Staphylococcus epidermidis
YKDARNYLAFLYSNQLKRTTVSRKIS

SEQ ID NO: 1821199 - protein, 17 aa, Staphylococcus epidermidis
YKGPLQDTIYQLMGGVR

SEQ ID NO: 1821200 - protein, 22 aa, Staphylococcus epidermidis
YKIPTFVLGVGLGGLIILNLLE

SEQ ID NO: 1821201 - protein, 17 aa, Staphylococcus epidermidis
YKYVTIDDPETFAAEHL

SEQ ID NO: 1821202 - protein, 34 aa, Staphylococcus epidermidis
YLHQHQCLYVKLDPYWLYQVYDKDINPLTEKNDA

SEQ ID NO: 1821203 - protein, 19 aa, Staphylococcus epidermidis
YLRSLAHNIDPTFQIGKGG

SEQ ID NO: 1821204 - protein, 18 aa, Staphylococcus epidermidis
YLSTQWFVKMKPLAQRAL

SEQ ID NO: 1821205 - protein, 20 aa, Staphylococcus epidermidis
YMQKPFYTNVLIAKLQAIYR

SEQ ID NO: 1821206 - protein, 31 aa, Staphylococcus epidermidis
YNAILKYVELGVLYPLSYYDGDWYGKNQVNS

SEQ ID NO: 1821207 - protein, 24 aa, Staphylococcus epidermidis
YNNEIGMPLTLLELDEDTEISILE

SEQ ID NO: 1821208 - protein, 25 aa, Staphylococcus epidermidis
YNNIEVYGVYQGYQGLLDDDIHKLE

SEQ ID NO: 1821209 - protein, 27 aa, Staphylococcus epidermidis
YNNKELVHFFFNELSKYVKKYNCLYLR

SEQ ID NO: 1821210 - protein, 17 aa, Staphylococcus epidermidis
YNPLIQQLLEEDKAYKC

SEQ ID NO: 1821211 - protein, 19 aa, Staphylococcus epidermidis
YNRRYLSDFTGTSGALIIT

SEQ ID NO: 1821212 - protein, 26 aa, Staphylococcus epidermidis
YPFKELPFYEIGWRLIPEVWGNGLAT

SEQ ID NO: 1821213 - protein, 26 aa, Staphylococcus epidermidis
YQEQPGYKLMFNTLRAMYSKHPIRVD

SEQ ID NO: 1821214 - protein, 17 aa, Staphylococcus epidermidis
YQLLVDEGFIYSKPRSG

SEQ ID NO: 1821215 - protein, 27 aa, Staphylococcus epidermidis
YQNKRPDYINAFWNVVNWEKVNELYNA

SEQ ID NO: 1821216 - protein, 20 aa, Staphylococcus epidermidis
YQVEWTKQYDIWFSIYSTPS

SEQ ID NO: 1821217 - protein, 25 aa, Staphylococcus epidermidis
YREMAKEGVFLPPSQFEGTFLSTAH

SEQ ID NO: 1821218 - protein, 19 aa, Staphylococcus epidermidis
YSHATVINGFVFTSGQIPL

SEQ ID NO: 1821219 - protein, 25 aa, Staphylococcus epidermidis
YSQQEIPIYLDDLIIIFTDGVTEAR

SEQ ID NO: 1821220 - protein, 31 aa, Staphylococcus epidermidis
YSSLIYEFSVFKKPMLFYAFDLEDYIYTRDF

SEQ ID NO: 1821221 - protein, 22 aa, Staphylococcus epidermidis
YSSNIAMVLTKIAKRNPREIAQ

SEQ ID NO: 1821222 - protein, 17 aa, Staphylococcus epidermidis
YSTRIMDLVTPIGLGQR

SEQ ID NO: 1821223 - protein, 23 aa, Staphylococcus epidermidis
YTAKKLNLKAVIFMPVTTPRQKI

SEQ ID NO: 1821224 - protein, 25 aa, Staphylococcus epidermidis
YTEDVYDFWRPTGHQYPLVAGALSK

SEQ ID NO: 1821225 - protein, 19 aa, Staphylococcus epidermidis
YTIVIPPPNVTGKLHLGHA

SEQ ID NO: 1821226 - protein, 19 aa, Staphylococcus epidermidis
YTRILKVGPRRGDGAESVI

SEQ ID NO: 1821227 - protein, 26 aa, Staphylococcus epidermidis
YTRLDKQLIAIYRYHFNVSKDNALKK

SEQ ID NO: 1821228 - protein, 19 aa, Staphylococcus epidermidis
YVDHPQTHFPLNDQGKLDV

SEQ ID NO: 1821229 - protein, 19 aa, Staphylococcus epidermidis
YVGRIGVGRVFRGKMRVGD

SEQ ID NO: 1821230 - protein, 19 aa, Staphylococcus epidermidis
YVIMGIANKRSIAFGVAKV

SEQ ID NO: 1821231 - protein, 18 aa, Staphylococcus epidermidis
YYLKQFIAHKLKHLLDEG

SEQ ID NO: 1821232 - protein, 23 aa, Staphylococcus epidermidis
YYPNYRYIWSFKNPDKNVVPGSA

SEQ ID NO: 1821233 - protein, 20 aa, Staphylococcus epidermidis
YYTPLEFGKMRKIAMEKGFK

SEQ ID NO: 1821234 - protein, 23 aa, Staphylococcus epidermidis
AADSYLKLRFIQKSILKAIDSEW

SEQ ID NO: 1821235 - protein, 23 aa, Staphylococcus epidermidis
AAFGQLLPESLLNAPKLGAINVH

SEQ ID NO: 1821236 - protein, 17 aa, Staphylococcus epidermidis
AAHPNTIIFLTADAFGV

SEQ ID NO: 1821237 - protein, 24 aa, Staphylococcus epidermidis
AANMTFALSFQHYTMRNERAPLYN

SEQ ID NO: 1821238 - protein, 26 aa, Staphylococcus epidermidis
ADAKPLPLKLSPPNYLPNWNTISAKV

SEQ ID NO: 1821239 - protein, 20 aa, Staphylococcus epidermidis
ADDDLAERLGFISNSTGGVL

SEQ ID NO: 1821240 - protein, 24 aa, Staphylococcus epidermidis
ADDNYKWLQILPDKKRYSMTVMFD

SEQ ID NO: 1821241 - protein, 19 aa, Staphylococcus epidermidis
ADFLILGTPNYHGSFSGIL

SEQ ID NO: 1821242 - protein, 18 aa, Staphylococcus epidermidis
ADTVLFAVGVEPATEWLK

SEQ ID NO: 1821243 - protein, 35 aa, Staphylococcus epidermidis
ADVFIKLEQEIYNHMLWKGFKPFKITNITQETSDI

SEQ ID NO: 1821244 - protein, 18 aa, Staphylococcus epidermidis
AEAYGIKGFLIDSPDKLE

SEQ ID NO: 1821245 - protein, 23 aa, Staphylococcus epidermidis
AEERHQFMIQYLKQFMSEWNFNK

SEQ ID NO: 1821246 - protein, 24 aa, Staphylococcus epidermidis
AEHGIDYCIVINFSSRFANVTSDD

SEQ ID NO: 1821247 - protein, 28 aa, Staphylococcus epidermidis
AENAQFEEIIFLLWNYRLPNENELSELK

SEQ ID NO: 1821248 - protein, 28 aa, Staphylococcus epidermidis
AEQLSNMWLYRHFILHLDQLDSSFTSQV

SEQ ID NO: 1821249 - protein, 24 aa, Staphylococcus epidermidis
AESYLLHHSIDYDKIIRADIDRFV

SEQ ID NO: 1821250 - protein, 25 aa, Staphylococcus epidermidis
AEVIERLRPFLLRDGGDCTLVDVED

SEQ ID NO: 1821251 - protein, 19 aa, Staphylococcus epidermidis
AEYEYIEMMPLLMNENNEL

SEQ ID NO: 1821252 - protein, 27 aa, Staphylococcus epidermidis
AFHLSNRTLYLLNILQQLPISKMNHLN

SEQ ID NO: 1821253 - protein, 17 aa, Staphylococcus epidermidis
AFLASDKAKYITGQTIH

SEQ ID NO: 1821254 - protein, 26 aa, Staphylococcus epidermidis
AGSDQQWIPVYKSWRLNERHYGGLQG

SEQ ID NO: 1821255 - protein, 20 aa, Staphylococcus epidermidis
AGTCDSTLIFALPGSTGAIK

SEQ ID NO: 1821256 - protein, 41 aa, Staphylococcus epidermidis
AGVTMLTKSLAREWSRYGIKVNAIAPGYMRTIETEKILNDN

SEQ ID NO: 1821257 - protein, 27 aa, Staphylococcus epidermidis
AGVYAKDIILYLINQYGVDFGTGYALE

SEQ ID NO: 1821258 - protein, 25 aa, Staphylococcus epidermidis
AHIHPIFGMTIYLTDGLYTIETVVL

SEQ ID NO: 1821259 - protein, 22 aa, Staphylococcus epidermidis
AHPTGRIIGRRKGYKANIEKLM

SEQ ID NO: 1821260 - protein, 24 aa, Staphylococcus epidermidis
AHYLYEHDAIARKILIASQPGNPL

SEQ ID NO: 1821261 - protein, 25 aa, Staphylococcus epidermidis
AIHQEYLLYVRYTAILIDPFSNPDD

SEQ ID NO: 1821262 - protein, 27 aa, Staphylococcus epidermidis
AIIVIEWSKFIKDFLPPNHLTINISVK

SEQ ID NO: 1821263 - protein, 27 aa, Staphylococcus epidermidis
AKDPQKHALFPKYDFFRADTDYADIAK

SEQ ID NO: 1821264 - protein, 24 aa, Staphylococcus epidermidis
AKKQHIYYEVFPFESNRISLKEDE

SEQ ID NO: 1821265 - protein, 21 aa, Staphylococcus epidermidis
AKPILKKIQNKGFKAYFVGGS

SEQ ID NO: 1821266 - protein, 23 aa, Staphylococcus epidermidis
AKQLKDHLSKMIGINSVDIDYQM

SEQ ID NO: 1821267 - protein, 27 aa, Staphylococcus epidermidis
AKREIQFDVIFLDPPYNKGLINEAISR

SEQ ID NO: 1821268 - protein, 19 aa, Staphylococcus epidermidis
AKRMGLIILTAGKNVIRLL

SEQ ID NO: 1821269 - protein, 20 aa, Staphylococcus epidermidis
AKYTKIRRPVELVYQETYTT

SEQ ID NO: 1821270 - protein, 25 aa, Staphylococcus epidermidis
ALDAYYTPIFMKKSRPSTQLTLICK

SEQ ID NO: 1821271 - protein, 26 aa, Staphylococcus epidermidis
ALDELKFIYFKMQKLNPEYLKLAVMP

SEQ ID NO: 1821272 - protein, 20 aa, Staphylococcus epidermidis
ALDILESGPIWGFDTSVHGS

SEQ ID NO: 1821273 - protein, 24 aa, Staphylococcus epidermidis
ALSKNHCYYLTNGSCWCVQAYQNH

SEQ ID NO: 1821274 - protein, 18 aa, Staphylococcus epidermidis
ALTHGLSLVADLFVDTDD

SEQ ID NO: 1821275 - protein, 20 aa, Staphylococcus epidermidis
AMALAISNLLGLVCDPVAGL

SEQ ID NO: 1821276 - protein, 19 aa, Staphylococcus epidermidis
ANGFVCYMVGRLILENCKN

SEQ ID NO: 1821277 - protein, 31 aa, Staphylococcus epidermidis
ANILISMDLPKNLVSLMLEYLRFAEYSHTIT

SEQ ID NO: 1821278 - protein, 17 aa, Staphylococcus epidermidis
ANLDLNITKARAQVVKA

SEQ ID NO: 1821279 - protein, 19 aa, Staphylococcus epidermidis
APFILIADPRIEGGAFYLG

SEQ ID NO: 1821280 - protein, 30 aa, Staphylococcus epidermidis
APQIFRKLNIEWVYRVLIDWKRIGRMISIP

SEQ ID NO: 1821281 - protein, 21 aa, Staphylococcus epidermidis
APSIMGIGPVEAIHKALKRSN

SEQ ID NO: 1821282 - protein, 20 aa, Staphylococcus epidermidis
AQMKPGDIIQFKWITVEEAS

SEQ ID NO: 1821283 - protein, 17 aa, Staphylococcus epidermidis
AQQEALAYATRYGYLYM

SEQ ID NO: 1821284 - protein, 25 aa, Staphylococcus epidermidis
AQTYNFKHAIIATGSRPIEIPNFEF

SEQ ID NO: 1821285 - protein, 23 aa, Staphylococcus epidermidis
AQVRRYFPSLLSYRRSEIDMENM

SEQ ID NO: 1821286 - protein, 31 aa, Staphylococcus epidermidis
AQYSFLQLMNYMFKQEPYRYIATGQLEQIPQ

SEQ ID NO: 1821287 - protein, 19 aa, Staphylococcus epidermidis
ASALVGALFIANYFGNIQL

SEQ ID NO: 1821288 - protein, 24 aa, Staphylococcus epidermidis
ASCKAYIDAHAKYISEYELKEGIR

SEQ ID NO: 1821289 - protein, 34 aa, Staphylococcus epidermidis
ASFSWYEYSPLRVKYPYIRGKLLDLWTEALEEQK

SEQ ID NO: 1821290 - protein, 18 aa, Staphylococcus epidermidis
ASHSIVYYGMKKFAHDFE

SEQ ID NO: 1821291 - protein, 29 aa, Staphylococcus epidermidis
ASRTLMFNIYDLKWDDELLELLNIPKQML

SEQ ID NO: 1821292 - protein, 17 aa, Staphylococcus epidermidis
ASYLPKPMVIKDNDRYK

SEQ ID NO: 1821293 - protein, 24 aa, Staphylococcus epidermidis
ATADLTIGLILSVARRIVEGDHLS

SEQ ID NO: 1821294 - protein, 23 aa, Staphylococcus epidermidis
ATIKKWVTLIQTLPKIQSKQSLI

SEQ ID NO: 1821295 - protein, 26 aa, Staphylococcus epidermidis
ATLSPLDSYLLQRGLKTLHLRIERSQ

SEQ ID NO: 1821296 - protein, 27 aa, Staphylococcus epidermidis
AVVDACFTPVLAPFITLRSMVGIIDAS

SEQ ID NO: 1821297 - protein, 18 aa, Staphylococcus epidermidis
AYKAADLMFERFNINEGV

SEQ ID NO: 1821298 - protein, 18 aa, Staphylococcus epidermidis
CCSVEFIHPIYRSHYLIN

SEQ ID NO: 1821299 - protein, 22 aa, Staphylococcus epidermidis
CGDTPLITYQTLQSLIEHHEST

SEQ ID NO: 1821300 - protein, 19 aa, Staphylococcus epidermidis
CGRKNIILADYLIDDNPKQ

SEQ ID NO: 1821301 - protein, 20 aa, Staphylococcus epidermidis
CIDAAIFNLGYLPKGNKEIV

SEQ ID NO: 1821302 - protein, 18 aa, Staphylococcus epidermidis
CLTVIDFTDSSFSVQVIK

SEQ ID NO: 1821303 - protein, 25 aa, Staphylococcus epidermidis
CNTLDELLMLNAIHVPLHTGKIEEM

SEQ ID NO: 1821304 - protein, 20 aa, Staphylococcus epidermidis
CNYPVGVVEDQIYYFNEDNI

SEQ ID NO: 1821305 - protein, 19 aa, Staphylococcus epidermidis
CPTCQMTLKDIAHVGKLGC

SEQ ID NO: 1821306 - protein, 26 aa, Staphylococcus epidermidis
CVMCAGTIIMSRIPKVVYGATDPKGG

SEQ ID NO: 1821307 - protein, 17 aa, Staphylococcus epidermidis
CYIVPKQPNRFLIGATS

SEQ ID NO: 1821308 - protein, 17 aa, Staphylococcus epidermidis
DAELLINDLITDSIPQL

SEQ ID NO: 1821309 - protein, 23 aa, Staphylococcus epidermidis
DAEQFIQYILSNDTNLLTNDKAM

SEQ ID NO: 1821310 - protein, 24 aa, Staphylococcus epidermidis
DAFIQQINAWHLENKKIIIVHGGG

SEQ ID NO: 1821311 - protein, 21 aa, Staphylococcus epidermidis
DAIVVGNTYGRIRAMVNDLGK

SEQ ID NO: 1821312 - protein, 21 aa, Staphylococcus epidermidis
DAMISYFNGIAQLRQHIKKGQ

SEQ ID NO: 1821313 - protein, 25 aa, Staphylococcus epidermidis
DAQKLKAYQTVYSKGFKPYMEASQK

SEQ ID NO: 1821314 - protein, 19 aa, Staphylococcus epidermidis
DCHLDDETFIYLITGPNMS

SEQ ID NO: 1821315 - protein, 26 aa, Staphylococcus epidermidis
DDQLKEVVIAYEPIWAIGTGKSSTSE

SEQ ID NO: 1821316 - protein, 24 aa, Staphylococcus epidermidis
DDVNFKLYLGLKHISPYIEEAVEQ

SEQ ID NO: 1821317 - protein, 30 aa, Staphylococcus epidermidis
DEEFKLLFTDIDFLPPVTPPNNVIAFGRNY

SEQ ID NO: 1821318 - protein, 25 aa, Staphylococcus epidermidis
DEEIKFKLIKVKKNFAIGKLIEVIS

SEQ ID NO: 1821319 - protein, 25 aa, Staphylococcus epidermidis
DEFEDLLYMIDNKYYYSIHFDDSVS

SEQ ID NO: 1821320 - protein, 25 aa, Staphylococcus epidermidis
DEIERLHYLVDNNFYFNVFEKYSEA

SEQ ID NO: 1821321 - protein, 17 aa, Staphylococcus epidermidis
DEILAYDQLKQFLSTLD

SEQ ID NO: 1821322 - protein, 18 aa, Staphylococcus epidermidis
DEKYRTWEWNYGSNPKYN

SEQ ID NO: 1821323 - protein, 19 aa, Staphylococcus epidermidis
DFITYLKQLNVPVTAVFTQ

SEQ ID NO: 1821324 - protein, 22 aa, Staphylococcus epidermidis
DFLGINYYMSDWMRGFEGESEI

SEQ ID NO: 1821325 - protein, 23 aa, Staphylococcus epidermidis
DGEKLLQYALQRESIEQELWQNL

SEQ ID NO: 1821326 - protein, 24 aa, Staphylococcus epidermidis
DGKHPIRVILSKKGQLDFNQQIFK

SEQ ID NO: 1821327 - protein, 20 aa, Staphylococcus epidermidis
DGMAFLSGVVSRKKQVVPQI

SEQ ID NO: 1821328 - protein, 19 aa, Staphylococcus epidermidis
DGSLPLLTPMSEVAGRMST

SEQ ID NO: 1821329 - protein, 24 aa, Staphylococcus epidermidis
DGSQLSFMGLPTPNIFTGCGNFHG

SEQ ID NO: 1821330 - protein, 17 aa, Staphylococcus epidermidis
DHFFLIHRATQGVTAQG

SEQ ID NO: 1821331 - protein, 23 aa, Staphylococcus epidermidis
DHQAILHFAQHNAIDWVIIGPEQ

SEQ ID NO: 1821332 - protein, 24 aa, Staphylococcus epidermidis
DIAYAQYLATRKVYPESSIGVINI

SEQ ID NO: 1821333 - protein, 17 aa, Staphylococcus epidermidis
DIELDILKKYKALERKW

SEQ ID NO: 1821334 - protein, 18 aa, Staphylococcus epidermidis
DIEPFLMSYDKLIDFCKK

SEQ ID NO: 1821335 - protein, 21 aa, Staphylococcus epidermidis
DIGIKYLTLYAFSTENWSRPE

SEQ ID NO: 1821336 - protein, 20 aa, Staphylococcus epidermidis
DIIKVDEPLKRYTYTETGGE

SEQ ID NO: 1821337 - protein, 18 aa, Staphylococcus epidermidis
DIIQFKWITVEEASKKLK

SEQ ID NO: 1821338 - protein, 17 aa, Staphylococcus epidermidis
DIPRVRFTTSHPWDFTD

SEQ ID NO: 1821339 - protein, 24 aa, Staphylococcus epidermidis
DISEIYEFVMSKDSFSPSEVTAIA

SEQ ID NO: 1821340 - protein, 27 aa, Staphylococcus epidermidis
DKKVRSFYEFYSYLMEPWDGPTMISFC

SEQ ID NO: 1821341 - protein, 23 aa, Staphylococcus epidermidis
DKNTSRIYAKFGKEIYVAAKSGE

SEQ ID NO: 1821342 - protein, 32 aa, Staphylococcus epidermidis
DKVKVLMDEFWPGPISFILPLKQGYLCSKVTG

SEQ ID NO: 1821343 - protein, 24 aa, Staphylococcus epidermidis
DLKDQMLEQIPLKRFGEDTDIANT

SEQ ID NO: 1821344 - protein, 27 aa, Staphylococcus epidermidis
DLKEKVDPYLRPLYDGLNTVLGREQTQ

SEQ ID NO: 1821345 - protein, 17 aa, Staphylococcus epidermidis
DLKHFRLGISVSKKLGN

SEQ ID NO: 1821346 - protein, 27 aa, Staphylococcus epidermidis
DLLKAIEKLGFPFIVKTRFGGYDGKGQ

SEQ ID NO: 1821347 - protein, 22 aa, Staphylococcus epidermidis
DLNQRLYHYWALGHIHQREQLS

SEQ ID NO: 1821348 - protein, 19 aa, Staphylococcus epidermidis
DLPIVIKKDGLAAGKGVII

SEQ ID NO: 1821349 - protein, 19 aa, Staphylococcus epidermidis
DLRKLAQMKPGDIIQFKWI

SEQ ID NO: 1821350 - protein, 22 aa, Staphylococcus epidermidis
DLSHRKLFPSIFHLYQQDNLDE

SEQ ID NO: 1821351 - protein, 19 aa, Staphylococcus epidermidis
DLVVVPGVAFDKLGYRIGY

SEQ ID NO: 1821352 - protein, 27 aa, Staphylococcus epidermidis
DLYKEHQFKHFIYTPVGFVCEHLEVLY

SEQ ID NO: 1821353 - protein, 19 aa, Staphylococcus epidermidis
DMHSFRLFDYVMLGHLHHP

SEQ ID NO: 1821354 - protein, 26 aa, Staphylococcus epidermidis
DMLNEYYYLPQKLYEDIYADSFEDLK

SEQ ID NO: 1821355 - protein, 27 aa, Staphylococcus epidermidis
DMPWRETTNPYYIWLSEVMLQQTQVNT

SEQ ID NO: 1821356 - protein, 25 aa, Staphylococcus epidermidis
DNELSDFLPLMLQFLQVADFKNDSR

SEQ ID NO: 1821357 - protein, 19 aa, Staphylococcus epidermidis
DNKNLAYKAADLMFERFNI

SEQ ID NO: 1821358 - protein, 21 aa, Staphylococcus epidermidis
DPELYIIDEPFLGLDPLGIQS

SEQ ID NO: 1821359 - protein, 20 aa, Staphylococcus epidermidis
DPLFNEALKLYDDKLDIGLD

SEQ ID NO: 1821360 - protein, 24 aa, Staphylococcus epidermidis
DPTAKYIIDPLKKQLEALEYIGLS

SEQ ID NO: 1821361 - protein, 29 aa, Staphylococcus epidermidis
DQQEIKSPMVGTFFLQDSKELTEPKIKVG

SEQ ID NO: 1821362 - protein, 23 aa, Staphylococcus epidermidis
DQRRKMLIDLLVNMGFTVIEPED

SEQ ID NO: 1821363 - protein, 23 aa, Staphylococcus epidermidis
DRVTPPCIYYAKCGGCQLQHMTY

SEQ ID NO: 1821364 - protein, 22 aa, Staphylococcus epidermidis
DSATLPIFDQIFTRIGAADDLV

SEQ ID NO: 1821365 - protein, 22 aa, Staphylococcus epidermidis
DSLHAYFKPEILNRMDDIVLFK

SEQ ID NO: 1821366 - protein, 21 aa, Staphylococcus epidermidis
DSLKRIDISPLGAAALSGTTH

SEQ ID NO: 1821367 - protein, 19 aa, Staphylococcus epidermidis
DSLPLVVFTGQVATPGIGK

SEQ ID NO: 1821368 - protein, 25 aa, Staphylococcus epidermidis
DSREFLSMQSLPDSITFIGAGIISI

SEQ ID NO: 1821369 - protein, 23 aa, Staphylococcus epidermidis
DSSSPHTYYLIANSMINGFSHKD

SEQ ID NO: 1821370 - protein, 19 aa, Staphylococcus epidermidis
DTAPKRFIREFRNVNVDEY

SEQ ID NO: 1821371 - protein, 28 aa, Staphylococcus epidermidis
DTEFEKHMYAIHMLTSLVSSHQSRSTIE

SEQ ID NO: 1821372 - protein, 26 aa, Staphylococcus epidermidis
DVDTLSPTYKLLMGVPGRSNAFDISK

SEQ ID NO: 1821373 - protein, 24 aa, Staphylococcus epidermidis
DVIGKTVILPIVGRELPILADEYV

SEQ ID NO: 1821374 - protein, 34 aa, Staphylococcus epidermidis
DVNIKGTLHVLQATLPYLLKQSSGHIINLASVSG

SEQ ID NO: 1821375 - protein, 22 aa, Staphylococcus epidermidis
DVPLLSLIQPGDTFKFVYTKEN

SEQ ID NO: 1821376 - protein, 26 aa, Staphylococcus epidermidis
DVPRTDWDWMIYPQGLYDQIMRVVKD

SEQ ID NO: 1821377 - protein, 25 aa, Staphylococcus epidermidis
DVQPINVIVERLLDQLYKEIEKKPL

SEQ ID NO: 1821378 - protein, 25 aa, Staphylococcus epidermidis
DVTPTHLLIDAMTLDIDIPQTSIIK

SEQ ID NO: 1821379 - protein, 26 aa, Staphylococcus epidermidis
DVYEPFLIQRGFLERTPRGRKATALA

SEQ ID NO: 1821380 - protein, 18 aa, Staphylococcus epidermidis
DWKSLYEKSLNHDFAEVF

SEQ ID NO: 1821381 - protein, 20 aa, Staphylococcus epidermidis
DYAFLVLNMNKVYLYVDIKN

SEQ ID NO: 1821382 - protein, 24 aa, Staphylococcus epidermidis
DYISQFKAGYFSPLANLARMTEEV

SEQ ID NO: 1821383 - protein, 22 aa, Staphylococcus epidermidis
DYNVQFIFNLNEKSIREIYRNI

SEQ ID NO: 1821384 - protein, 32 aa, Staphylococcus epidermidis
DYSINVPMDLLPYLFFQFSSNGKRLYSDNAVD

SEQ ID NO: 1821385 - protein, 32 aa, Staphylococcus epidermidis
DYVESFIQHMKKIMTMLDAPNIERLRQADIVM

SEQ ID NO: 1821386 - protein, 24 aa, Staphylococcus epidermidis
DYVLNQPLYHLVEKVKPRLTKAKI

SEQ ID NO: 1821387 - protein, 18 aa, Staphylococcus epidermidis
EACGTWKLVYQRLQNIER

SEQ ID NO: 1821388 - protein, 24 aa, Staphylococcus epidermidis
EADFINCVVFRRQAENVNNYLSKG

SEQ ID NO: 1821389 - protein, 30 aa, Staphylococcus epidermidis
EADVILYDRLVNKEILNYASPSTKFFYCGK

SEQ ID NO: 1821390 - protein, 27 aa, Staphylococcus epidermidis
EAQLFSTQLLFQFLFSQGRLEEARTYI

SEQ ID NO: 1821391 - protein, 17 aa, Staphylococcus epidermidis
EARSIRIDLPPFTLVGA

SEQ ID NO: 1821392 - protein, 34 aa, Staphylococcus epidermidis
EATPFIKEAIQDSLKRLILPSIEREIRGDLTQNA

SEQ ID NO: 1821393 - protein, 24 aa, Staphylococcus epidermidis
EDAQQPIQVFRIGEGGLGGEIHLF

SEQ ID NO: 1821394 - protein, 25 aa, Staphylococcus epidermidis
EDEADILYIGFISTKGAIGEGAERL

SEQ ID NO: 1821395 - protein, 24 aa, Staphylococcus epidermidis
EDINKLIYMIKEAKKPLILAGAGI

SEQ ID NO: 1821396 - protein, 21 aa, Staphylococcus epidermidis
EDIPFFLEVLTYDDNIPDNKS

SEQ ID NO: 1821397 - protein, 18 aa, Staphylococcus epidermidis
EDIRHFYTNDVRFLDQFK

SEQ ID NO: 1821398 - protein, 21 aa, Staphylococcus epidermidis
EDRIRRLLKLYLERESFEIHE

SEQ ID NO: 1821399 - protein, 24 aa, Staphylococcus epidermidis
EEDVVKTIFNCQTPIISAVGHETD

SEQ ID NO: 1821400 - protein, 23 aa, Staphylococcus epidermidis
EEFKSHLLKLFKETDVAVMSGSL

SEQ ID NO: 1821401 - protein, 22 aa, Staphylococcus epidermidis
EEINTLFFKRLFEAALEERQYY

SEQ ID NO: 1821402 - protein, 28 aa, Staphylococcus epidermidis
EEKRNHQSLLVKFLKPVQNEWSGMTVYY

SEQ ID NO: 1821403 - protein, 19 aa, Staphylococcus epidermidis
EELYRFPIMYVEYSGTYGD

SEQ ID NO: 1821404 - protein, 23 aa, Staphylococcus epidermidis
EENGKFNMIFQFEHLGLWSTGDT

SEQ ID NO: 1821405 - protein, 23 aa, Staphylococcus epidermidis
EFCTPFGSFPVKSPYVGRFNISN

SEQ ID NO: 1821406 - protein, 18 aa, Staphylococcus epidermidis
EFTNIYAMLIPKMSSMED

SEQ ID NO: 1821407 - protein, 20 aa, Staphylococcus epidermidis
EGITCLPEIMIPLVSTVEEF

SEQ ID NO: 1821408 - protein, 24 aa, Staphylococcus epidermidis
EGKPFYDKLISFITSAPVFAMVVE

SEQ ID NO: 1821409 - protein, 27 aa, Staphylococcus epidermidis
EGLKELLEKWLFKYENQFPIYASEINT

SEQ ID NO: 1821410 - protein, 19 aa, Staphylococcus epidermidis
EGLNFNREGQLFLLDVFEG

SEQ ID NO: 1821411 - protein, 21 aa, Staphylococcus epidermidis
EGQILFQNLPVDSQNKREVRK

SEQ ID NO: 1821412 - protein, 18 aa, Staphylococcus epidermidis
EGQRRYVESLSAYARQFL

SEQ ID NO: 1821413 - protein, 24 aa, Staphylococcus epidermidis
EGQSLDLHRLLDTNKVYLKDIFES

SEQ ID NO: 1821414 - protein, 23 aa, Staphylococcus epidermidis
EGRNCKFIAVKLPYGVQQDAHEV

SEQ ID NO: 1821415 - protein, 23 aa, Staphylococcus epidermidis
EGSIYEGFLEYARNFKKYEGKDQ

SEQ ID NO: 1821416 - protein, 22 aa, Staphylococcus epidermidis
EGVFFHERKALSHFEKRYATPS

SEQ ID NO: 1821417 - protein, 26 aa, Staphylococcus epidermidis
EGVYMVPAFVGLGTPYWDSEARGAIF

SEQ ID NO: 1821418 - protein, 24 aa, Staphylococcus epidermidis
EHFNKLEVPFIYRVHEQPKSDRLR

SEQ ID NO: 1821419 - protein, 29 aa, Staphylococcus epidermidis
EHMFDCSPIPINYDLIPKCVYTNPEIASI

SEQ ID NO: 1821420 - protein, 24 aa, Staphylococcus epidermidis
EICIPTIGFYTLSTFPFIEKALNS

SEQ ID NO: 1821421 - protein, 25 aa, Staphylococcus epidermidis
EIFDILSIEGIIILVIYHGHEEGKV

SEQ ID NO: 1821422 - protein, 17 aa, Staphylococcus epidermidis
EIFHRHVPILGVCLGFQ

SEQ ID NO: 1821423 - protein, 18 aa, Staphylococcus epidermidis
EIFNIVLTSQKKAIEQIK

SEQ ID NO: 1821424 - protein, 17 aa, Staphylococcus epidermidis
EIINFKAIVRFDSLVEL

SEQ ID NO: 1821425 - protein, 23 aa, Staphylococcus epidermidis
EIKLLSKEIGFPVVLKAASGGGG

SEQ ID NO: 1821426 - protein, 28 aa, Staphylococcus epidermidis
EIKVQDVMFLLLYALKDLGANLNMDPIT

SEQ ID NO: 1821427 - protein, 18 aa, Staphylococcus epidermidis
EILLLDESLSALDLKLRT

SEQ ID NO: 1821428 - protein, 19 aa, Staphylococcus epidermidis
EILLSFLERNHIQYRTNLY

SEQ ID NO: 1821429 - protein, 24 aa, Staphylococcus epidermidis
EILNRMDDIVLFKPLSVNDMSMIV

SEQ ID NO: 1821430 - protein, 20 aa, Staphylococcus epidermidis
EINDFKEGFYNIVRIKTDNN

SEQ ID NO: 1821431 - protein, 18 aa, Staphylococcus epidermidis
EIVMKLSSGKVIKGMGIP

SEQ ID NO: 1821432 - protein, 27 aa, Staphylococcus epidermidis
EKARLQLALLMLQRDNVLILDEPTNHL

SEQ ID NO: 1821433 - protein, 23 aa, Staphylococcus epidermidis
EKKGYDIELAFEAGLLSRNEENF

SEQ ID NO: 1821434 - protein, 20 aa, Staphylococcus epidermidis
EKKPLIVMVNGMGGTPLSEL

SEQ ID NO: 1821435 - protein, 21 aa, Staphylococcus epidermidis
EKLRKILKSYGIRILEVPLKT

SEQ ID NO: 1821436 - protein, 33 aa, Staphylococcus epidermidis
EKLRRHMSFLMRKGKLYLPYNGNLLIHGCIPVD

SEQ ID NO: 1821437 - protein, 26 aa, Staphylococcus epidermidis
EKMENRLRYQYGKPSKLLAKSFELQN

SEQ ID NO: 1821438 - protein, 17 aa, Staphylococcus epidermidis
EKNLIKYSNWLNQLFHG

SEQ ID NO: 1821439 - protein, 23 aa, Staphylococcus epidermidis
EKNLKLFSAFIVKGKKGNPGTII

SEQ ID NO: 1821440 - protein, 26 aa, Staphylococcus epidermidis
EKTELPIEGILLFSPMLELKRDYKGR

SEQ ID NO: 1821441 - protein, 25 aa, Staphylococcus epidermidis
EKTGLLLDPYFAGTKVKWILDHVEG

SEQ ID NO: 1821442 - protein, 20 aa, Staphylococcus epidermidis
EKWPSFLEKELVDGIFTVAD

SEQ ID NO: 1821443 - protein, 26 aa, Staphylococcus epidermidis
ELEKEKDFLQVIVKDEDSQLPTDQNV

SEQ ID NO: 1821444 - protein, 25 aa, Staphylococcus epidermidis
ELESNLTALSFKYLTSHDAMGSIIV

SEQ ID NO: 1821445 - protein, 20 aa, Staphylococcus epidermidis
ELFKNQWAGKFLKSLNAFPV

SEQ ID NO: 1821446 - protein, 17 aa, Staphylococcus epidermidis
ELGIPIMVLFEGIPASG

SEQ ID NO: 1821447 - protein, 24 aa, Staphylococcus epidermidis
ELGKQKIILLPGPPKEMQPMAKNE

SEQ ID NO: 1821448 - protein, 17 aa, Staphylococcus epidermidis
ELKHWIKNTLNNNYKDI

SEQ ID NO: 1821449 - protein, 30 aa, Staphylococcus epidermidis
ELKSRLPEYMIPRKFEWMEQLPLTSNGKLD

SEQ ID NO: 1821450 - protein, 26 aa, Staphylococcus epidermidis
ELLRAIKQPRYLYGDAVVPFGGESRS

SEQ ID NO: 1821451 - protein, 18 aa, Staphylococcus epidermidis
ELQQKLGKTFIFVTHDMD

SEQ ID NO: 1821452 - protein, 25 aa, Staphylococcus epidermidis
ELTPELAFKLGRYGGYVLAHNKGEK

SEQ ID NO: 1821453 - protein, 23 aa, Staphylococcus epidermidis
EMMKVIHFFNKIENYYEASVKGD

SEQ ID NO: 1821454 - protein, 27 aa, Staphylococcus epidermidis
EMRLMWQEMMMILKKLKVPSVNLLKFM

SEQ ID NO: 1821455 - protein, 21 aa, Staphylococcus epidermidis
EMSLRLVDFKVEFGKTNGGKI

SEQ ID NO: 1821456 - protein, 24 aa, Staphylococcus epidermidis
ENADQYYLYLYDWRVIESESNESD

SEQ ID NO: 1821457 - protein, 25 aa, Staphylococcus epidermidis
ENAKPLKTMLLLHGLSSDTSSYMRY

SEQ ID NO: 1821458 - protein, 29 aa, Staphylococcus epidermidis
ENIDFLREGGLGLFLIESLMDEVTVYKES

SEQ ID NO: 1821459 - protein, 23 aa, Staphylococcus epidermidis
ENKQEFIHYFHPGDLKPPLNVYF

SEQ ID NO: 1821460 - protein, 25 aa, Staphylococcus epidermidis
ENNVPDWYLDSCRKIKYMFPKAHAA

SEQ ID NO: 1821461 - protein, 23 aa, Staphylococcus epidermidis
EQIRYLLFNIQMNVEQWLNLSSK

SEQ ID NO: 1821462 - protein, 24 aa, Staphylococcus epidermidis
EQNRYLVMPALSDELNIVGLKTVS

SEQ ID NO: 1821463 - protein, 25 aa, Staphylococcus epidermidis
ERELGFLALHGFLHLLGYDHMNDND

SEQ ID NO: 1821464 - protein, 21 aa, Staphylococcus epidermidis
ERSAAFFALGLIKGSEKPVAI

SEQ ID NO: 1821465 - protein, 25 aa, Staphylococcus epidermidis
ERSYYIKPYFSNQIFKIKLTEDLLS

SEQ ID NO: 1821466 - protein, 19 aa, Staphylococcus epidermidis
ESDGQFYFVDYKTDAFNRR

SEQ ID NO: 1821467 - protein, 20 aa, Staphylococcus epidermidis
ESIAIKYFGKAFKHEVYYNK

SEQ ID NO: 1821468 - protein, 21 aa, Staphylococcus epidermidis
ESRIYPVGRLDYDTSGVLLLT

SEQ ID NO: 1821469 - protein, 27 aa, Staphylococcus epidermidis
ESRPNGWLLHIPSCYLGIAQAARDYAV

SEQ ID NO: 1821470 - protein, 27 aa, Staphylococcus epidermidis
ESTRAEWLFLDVFGWSKTDYLIHKDEQ

SEQ ID NO: 1821471 - protein, 25 aa, Staphylococcus epidermidis
ESVMPGFDFYFIPTVMNSKDTKYHN

SEQ ID NO: 1821472 - protein, 19 aa, Staphylococcus epidermidis
ETFKLGIVLSYLKQYRASQ

SEQ ID NO: 1821473 - protein, 25 aa, Staphylococcus epidermidis
ETGKEDFYFMKLNQFYDDIVEYHSL

SEQ ID NO: 1821474 - protein, 23 aa, Staphylococcus epidermidis
ETHLSNGLVWSIPITLPVTESEA

SEQ ID NO: 1821475 - protein, 20 aa, Staphylococcus epidermidis
ETVCYLWLRFEHDESFNDFK

SEQ ID NO: 1821476 - protein, 17 aa, Staphylococcus epidermidis
ETWTTFFEYLKERGLQG

SEQ ID NO: 1821477 - protein, 21 aa, Staphylococcus epidermidis
EVDKNIKIYAPLTGEYVKIED

SEQ ID NO: 1821478 - protein, 20 aa, Staphylococcus epidermidis
EVFKFAVRIMGDASTRVVEK

SEQ ID NO: 1821479 - protein, 29 aa, Staphylococcus epidermidis
EVIGNPLLDKFMKDLIIQILAMVSEQERN

SEQ ID NO: 1821480 - protein, 25 aa, Staphylococcus epidermidis
EVIKQLKIFHLKILVTYRTSVQGGK

SEQ ID NO: 1821481 - protein, 23 aa, Staphylococcus epidermidis
EVKGILDMKGGFTDSFTNAFSNG

SEQ ID NO: 1821482 - protein, 21 aa, Staphylococcus epidermidis
EVLPITFIEGNIAKTGAYITQ

SEQ ID NO: 1821483 - protein, 25 aa, Staphylococcus epidermidis
EVTQLILDKFAIKPFYLENKESTEI

SEQ ID NO: 1821484 - protein, 27 aa, Staphylococcus epidermidis
EYDLGHFRGAIRPDITRFRDLPEWVRN

SEQ ID NO: 1821485 - protein, 30 aa, Staphylococcus epidermidis
EYMDDKYPFYLDPMPNLYFTRDPQASIGRG

SEQ ID NO: 1821486 - protein, 23 aa, Staphylococcus epidermidis
FAELCEACQLKFIGPSYQSIQKM

SEQ ID NO: 1821487 - protein, 20 aa, Staphylococcus epidermidis
FAFGMGPDRIAMLKYGIEDI

SEQ ID NO: 1821488 - protein, 17 aa, Staphylococcus epidermidis
FDALPIKEETELPYASK

SEQ ID NO: 1821489 - protein, 19 aa, Staphylococcus epidermidis
FDASPFLKMIINQSEFNMK

SEQ ID NO: 1821490 - protein, 26 aa, Staphylococcus epidermidis
FDEGDIVVGMLPWRKINTVNSEYVNK

SEQ ID NO: 1821491 - protein, 24 aa, Staphylococcus epidermidis
FDLGDIFHSVLKYISDRIYGDFKN

SEQ ID NO: 1821492 - protein, 26 aa, Staphylococcus epidermidis
FDLHDYTFDIHLIPETRRSTILSSKK

SEQ ID NO: 1821493 - protein, 26 aa, Staphylococcus epidermidis
FDSIGTLNIWYITTIQRLIDLITYCS

SEQ ID NO: 1821494 - protein, 20 aa, Staphylococcus epidermidis
FDSSMAWWKELYSDDDAYFD

SEQ ID NO: 1821495 - protein, 17 aa, Staphylococcus epidermidis
FEDKRYHTWNYHLKNKF

SEQ ID NO: 1821496 - protein, 33 aa, Staphylococcus epidermidis
FENYLRTIQVQPGDFYFIPAGTIHSIGAGIMAY

SEQ ID NO: 1821497 - protein, 29 aa, Staphylococcus epidermidis
FEQNTVWLSVLPIYHISGLSVILRAVIEG

SEQ ID NO: 1821498 - protein, 24 aa, Staphylococcus epidermidis
FESNTSWPLAMPVFKMDYAHKEYE

SEQ ID NO: 1821499 - protein, 25 aa, Staphylococcus epidermidis
FFDKLTDLLKFMIPGYKKEGKSQLV

SEQ ID NO: 1821500 - protein, 23 aa, Staphylococcus epidermidis
FGESLPVYKPTLPPMVFGARDKK

SEQ ID NO: 1821501 - protein, 19 aa, Staphylococcus epidermidis
FGMFIELPNTIEGMVHIAN

SEQ ID NO: 1821502 - protein, 19 aa, Staphylococcus epidermidis
FHHDALYSDYLIASDYSFV

SEQ ID NO: 1821503 - protein, 24 aa, Staphylococcus epidermidis
FHPSVDEMYPEELGIHLKVGHLAQ

SEQ ID NO: 1821504 - protein, 26 aa, Staphylococcus epidermidis
FIADECRLWITVHYLPNESYESVVNE

SEQ ID NO: 1821505 - protein, 18 aa, Staphylococcus epidermidis
FIFKDDPSELKMRIIDCL

SEQ ID NO: 1821506 - protein, 17 aa, Staphylococcus epidermidis
FIHLMSQYGTHVEKNDA

SEQ ID NO: 1821507 - protein, 19 aa, Staphylococcus epidermidis
FIKKHQLNFDLLVDKDYQL

SEQ ID NO: 1821508 - protein, 26 aa, Staphylococcus epidermidis
FKDENIPLWVDRDCPFNIEGGDELVL

SEQ ID NO: 1821509 - protein, 21 aa, Staphylococcus epidermidis
FKDILINEYIYFASKNKKLIR

SEQ ID NO: 1821510 - protein, 23 aa, Staphylococcus epidermidis
FKEDDIELFTDIANKVKQTNSYD

SEQ ID NO: 1821511 - protein, 25 aa, Staphylococcus epidermidis
FKGSWNVVCFYPADFSFVCPTELED

SEQ ID NO: 1821512 - protein, 26 aa, Staphylococcus epidermidis
FKHWIQTNHYWKYVEKYGVLGIALDN

SEQ ID NO: 1821513 - protein, 53 aa, Staphylococcus epidermidis
FKKVVKQINVPGFRKGKVPRPIFEQRFGVEALYQDAVDILLPEAYGEAIEETE

SEQ ID NO: 1821514 - protein, 19 aa, Staphylococcus epidermidis
FKNYRHMMIQPQQLAKQIV

SEQ ID NO: 1821515 - protein, 18 aa, Staphylococcus epidermidis
FKQYVNCPVYVDNDANVA

SEQ ID NO: 1821516 - protein, 17 aa, Staphylococcus epidermidis
FLEDLLVDGYIKELKRY

SEQ ID NO: 1821517 - protein, 28 aa, Staphylococcus epidermidis
FLENLMNPYLYEVLTIHAQLKDYNFVLK

SEQ ID NO: 1821518 - protein, 17 aa, Staphylococcus epidermidis
FLTLLDFSRQEVEFLLT

SEQ ID NO: 1821519 - protein, 17 aa, Staphylococcus epidermidis
FMGAGDIQKLLKAYFEK

SEQ ID NO: 1821520 - protein, 26 aa, Staphylococcus epidermidis
FNDLTPDEIFPYAPPQGVEELRDLWQ

SEQ ID NO: 1821521 - protein, 26 aa, Staphylococcus epidermidis
FNGDIGIIVGIFWAKENALNKDVLVV

SEQ ID NO: 1821522 - protein, 23 aa, Staphylococcus epidermidis
FNGPLDLLLHLIQKYEIDIYDIP

SEQ ID NO: 1821523 - protein, 22 aa, Staphylococcus epidermidis
FNKDQFDIVNHYTYVLASDGDL

SEQ ID NO: 1821524 - protein, 17 aa, Staphylococcus epidermidis
FNSLYDVSGLGLDLFAG

SEQ ID NO: 1821525 - protein, 19 aa, Staphylococcus epidermidis
FPNISVATIYNNLRVFKDI

SEQ ID NO: 1821526 - protein, 26 aa, Staphylococcus epidermidis
FQDILPLLEQVVQASRPILIVADEVE

SEQ ID NO: 1821527 - protein, 30 aa, Staphylococcus epidermidis
FQDYALFPHLNVFDNIAYGLKLKKLSKSEI

SEQ ID NO: 1821528 - protein, 32 aa, Staphylococcus epidermidis
FSFETTEFILDQLPCWLTYTNGDTHQVIDDNL

SEQ ID NO: 1821529 - protein, 23 aa, Staphylococcus epidermidis
FSHDELFNFLKRVPSDIPVLIDE

SEQ ID NO: 1821530 - protein, 26 aa, Staphylococcus epidermidis
FSTCFGAPFLPLSPTKYADLLGNLID

SEQ ID NO: 1821531 - protein, 17 aa, Staphylococcus epidermidis
FTAMYQNIDEQRGISAF

SEQ ID NO: 1821532 - protein, 18 aa, Staphylococcus epidermidis
FTEVGIFSVMWSEHCSYK

SEQ ID NO: 1821533 - protein, 17 aa, Staphylococcus epidermidis
FTLDDFLEQLDQVKNLG

SEQ ID NO: 1821534 - protein, 19 aa, Staphylococcus epidermidis
FTMIELYEAYADYHDIMDL

SEQ ID NO: 1821535 - protein, 24 aa, Staphylococcus epidermidis
FTSYTELYRTLPFDFLSEIVYQWE

SEQ ID NO: 1821536 - protein, 22 aa, Staphylococcus epidermidis
FTVAIPNYTSLTPMLEQLNRSF

SEQ ID NO: 1821537 - protein, 20 aa, Staphylococcus epidermidis
FVLGSVSHKVAKRATIPVLI

SEQ ID NO: 1821538 - protein, 18 aa, Staphylococcus epidermidis
FVVLLLNSKNIVTKQAWV

SEQ ID NO: 1821539 - protein, 17 aa, Staphylococcus epidermidis
FYAENIEHRRWGAPFPV

SEQ ID NO: 1821540 - protein, 17 aa, Staphylococcus epidermidis
FYKYRETIFPVDEKILD

SEQ ID NO: 1821541 - protein, 28 aa, Staphylococcus epidermidis
GADIHCDQLIILTAIDYVYINYHTDQQQ

SEQ ID NO: 1821542 - protein, 23 aa, Staphylococcus epidermidis
GAEFLQRFNGGMGILLGGIPGVP

SEQ ID NO: 1821543 - protein, 25 aa, Staphylococcus epidermidis
GAGNDFLGWLDLPVDYDKEEFSRIV

SEQ ID NO: 1821544 - protein, 18 aa, Staphylococcus epidermidis
GAIHKRWSRLELGQFILG

SEQ ID NO: 1821545 - protein, 22 aa, Staphylococcus epidermidis
GALAGSILKMNEGLKNLIQFTG

SEQ ID NO: 1821546 - protein, 23 aa, Staphylococcus epidermidis
GDAELFLVKLEPKPVLDTVNQDL

SEQ ID NO: 1821547 - protein, 28 aa, Staphylococcus epidermidis
GDDILIPGPIYAGYIPLVETLGGNPVYI

SEQ ID NO: 1821548 - protein, 24 aa, Staphylococcus epidermidis
GDDVENILLRLIQAADFDIDKAEK

SEQ ID NO: 1821549 - protein, 24 aa, Staphylococcus epidermidis
GELNYELFPIPDKPFFTARLVQQK

SEQ ID NO: 1821550 - protein, 21 aa, Staphylococcus epidermidis
GENLIIFEVYQPKLDERKKLT

SEQ ID NO: 1821551 - protein, 26 aa, Staphylococcus epidermidis
GEPDEVWQERLKLLKPYQVNQALLEK

SEQ ID NO: 1821552 - protein, 24 aa, Staphylococcus epidermidis
GEQFEEWIAKKILLPTPFTVESKA

SEQ ID NO: 1821553 - protein, 18 aa, Staphylococcus epidermidis
GFAFLRPEDDEMDDIFIP

SEQ ID NO: 1821554 - protein, 19 aa, Staphylococcus epidermidis
GFEDIFSSFFGGGSRQRDP

SEQ ID NO: 1821555 - protein, 28 aa, Staphylococcus epidermidis
GGIVLAIRNELHIPVKYVGLGEKMDDLQ

SEQ ID NO: 1821556 - protein, 26 aa, Staphylococcus epidermidis
GGMLQRMMIALALALKPKLIIADEPT

SEQ ID NO: 1821557 - protein, 28 aa, Staphylococcus epidermidis
GHDAHTAYMLILGETLIEMKDQLRGNVV

SEQ ID NO: 1821558 - protein, 25 aa, Staphylococcus epidermidis
GHTKTIWVWTGFLFEYLKQQDDARK

SEQ ID NO: 1821559 - protein, 19 aa, Staphylococcus epidermidis
GHTYLPRTIVIETTQNLLN

SEQ ID NO: 1821560 - protein, 20 aa, Staphylococcus epidermidis
GIFVYVPKNTVVEHPIQYVV

SEQ ID NO: 1821561 - protein, 17 aa, Staphylococcus epidermidis
GIHYFKVNDLTIGTIGL

SEQ ID NO: 1821562 - protein, 21 aa, Staphylococcus epidermidis
GKPMINVFKAIRKLIDEYQDL

SEQ ID NO: 1821563 - protein, 21 aa, Staphylococcus epidermidis
GKVKPGCTVAIVGAGPVGLAA

SEQ ID NO: 1821564 - protein, 26 aa, Staphylococcus epidermidis
GLNSNWDMLFIVFSIHLIDKAKQLKP

SEQ ID NO: 1821565 - protein, 32 aa, Staphylococcus epidermidis
GLNTDAIQYPPIPSVLYSLPRLSQIGVTVSEA

SEQ ID NO: 1821566 - protein, 19 aa, Staphylococcus epidermidis
GMVCPFPLIEAQKKMNELN

SEQ ID NO: 1821567 - protein, 25 aa, Staphylococcus epidermidis
GMVKQWQDKFFNKRFSHSVFNDQPD

SEQ ID NO: 1821568 - protein, 22 aa, Staphylococcus epidermidis
GNMRIMSRILPHSIPEGYHLTL

SEQ ID NO: 1821569 - protein, 27 aa, Staphylococcus epidermidis
GNSLSFRAFYALPLLSNHAGIHTNAVY

SEQ ID NO: 1821570 - protein, 34 aa, Staphylococcus epidermidis
GQKYNINKLLDLPFGKCHFALAAKPETSCYKKVA

SEQ ID NO: 1821571 - protein, 17 aa, Staphylococcus epidermidis
GQRGFVPASLISTDFIE

SEQ ID NO: 1821572 - protein, 26 aa, Staphylococcus epidermidis
GQTATYSYDKLFLSPGGKPVTPPVDG

SEQ ID NO: 1821573 - protein, 25 aa, Staphylococcus epidermidis
GQYELTYLVEYFIQTNYPNQPFYNK

SEQ ID NO: 1821574 - protein, 25 aa, Staphylococcus epidermidis
GRGQLFINLAIDQAIKFGKSKIWLG

SEQ ID NO: 1821575 - protein, 23 aa, Staphylococcus epidermidis
GRGYRRVVPSPQPISIIELESIK

SEQ ID NO: 1821576 - protein, 30 aa, Staphylococcus epidermidis
GRVGYHPTWKMILGLFPKEDKVKALDALER

SEQ ID NO: 1821577 - protein, 19 aa, Staphylococcus epidermidis
GTAKGGIVLAIRNELHIPV

SEQ ID NO: 1821578 - protein, 24 aa, Staphylococcus epidermidis
GTENLPQIVGLTKALELAITNQDV

SEQ ID NO: 1821579 - protein, 24 aa, Staphylococcus epidermidis
GTGKTFLAVVYAAKQLRKGSVKRI

SEQ ID NO: 1821580 - protein, 28 aa, Staphylococcus epidermidis
GTSVKVKPPFYYPLNKIISIGTMIKEAG

SEQ ID NO: 1821581 - protein, 27 aa, Staphylococcus epidermidis
GTVSDIYASVRLLWSRIGEPFVGYSDA

SEQ ID NO: 1821582 - protein, 28 aa, Staphylococcus epidermidis
GVAKRAQSFGMKILAFDPYLTEDKAKSL

SEQ ID NO: 1821583 - protein, 19 aa, Staphylococcus epidermidis
GVCLGFQLIIEYFGGNIIH

SEQ ID NO: 1821584 - protein, 24 aa, Staphylococcus epidermidis
GVDIKDVFLKLPIIGTEVYDESNE

SEQ ID NO: 1821585 - protein, 24 aa, Staphylococcus epidermidis
GVFKDIPAYELGATVIRQILEHSQ

SEQ ID NO: 1821586 - protein, 20 aa, Staphylococcus epidermidis
GVVKVDRYPIFIPNALIDEE

SEQ ID NO: 1821587 - protein, 28 aa, Staphylococcus epidermidis
GYFNLAPEEFIVWVLGFNKSISELKQKV

SEQ ID NO: 1821588 - protein, 22 aa, Staphylococcus epidermidis
GYGAIKFALTQSYRFSKAAMLS

SEQ ID NO: 1821589 - protein, 24 aa, Staphylococcus epidermidis
GYGYGDLFVNIKVVTPTKLNDRQK

SEQ ID NO: 1821590 - protein, 25 aa, Staphylococcus epidermidis
GYINCNHHLDFALAIRTMIIDEEKV

SEQ ID NO: 1821591 - protein, 30 aa, Staphylococcus epidermidis
HAELPSLDIDVWIVSIYLAHHFISQSSDVT

SEQ ID NO: 1821592 - protein, 21 aa, Staphylococcus epidermidis
HDLAVLMIVGEGMNQVVGTAS

SEQ ID NO: 1821593 - protein, 17 aa, Staphylococcus epidermidis
HDRYFLDKIVTQVYDVA

SEQ ID NO: 1821594 - protein, 26 aa, Staphylococcus epidermidis
HDWRTKKPVIFRATPQWFASINKVRQ

SEQ ID NO: 1821595 - protein, 20 aa, Staphylococcus epidermidis
HEAPNHVMNYFDPKDKTLLK

SEQ ID NO: 1821596 - protein, 28 aa, Staphylococcus epidermidis
HEFDNGLKLFIIPKPGFQKTYVTYTTQF

SEQ ID NO: 1821597 - protein, 26 aa, Staphylococcus epidermidis
HEVEEPDFLIVIYHGGLNKISSANKR

SEQ ID NO: 1821598 - protein, 20 aa, Staphylococcus epidermidis
HFPNTLHWQYGHVLTIFEQA

SEQ ID NO: 1821599 - protein, 24 aa, Staphylococcus epidermidis
HGILQPIVLRQTVQGYYIVVGERR

SEQ ID NO: 1821600 - protein, 30 aa, Staphylococcus epidermidis
HGNELPISAGFFIINPFEVVYYAGGTSNRY

SEQ ID NO: 1821601 - protein, 17 aa, Staphylococcus epidermidis
HGPAIEYTLVGPNIEFL

SEQ ID NO: 1821602 - protein, 27 aa, Staphylococcus epidermidis
HGYGTKMMMFLPEYVQALFPDFTHLYL

SEQ ID NO: 1821603 - protein, 25 aa, Staphylococcus epidermidis
HHPHSIFVRHLLITQPQSFGRATMT

SEQ ID NO: 1821604 - protein, 22 aa, Staphylococcus epidermidis
HIEIFDRSWYGRVLVERVEGFA

SEQ ID NO: 1821605 - protein, 18 aa, Staphylococcus epidermidis
HIPFCYRICTYCDFNKYF

SEQ ID NO: 1821606 - protein, 26 aa, Staphylococcus epidermidis
HIQYRTNLYMTMFRFREHRIVAFSGG

SEQ ID NO: 1821607 - protein, 32 aa, Staphylococcus epidermidis
HISSYGLILEPKTQFYNLYRKGHLKLPNEDLG

SEQ ID NO: 1821608 - protein, 21 aa, Staphylococcus epidermidis
HKIDRLILPTVFHDSADMIAK

SEQ ID NO: 1821609 - protein, 29 aa, Staphylococcus epidermidis
HKKVIENVMLAPLLLHKDSKDQLKEKALY

SEQ ID NO: 1821610 - protein, 17 aa, Staphylococcus epidermidis
HKYCELHDLLGRQYPEL

SEQ ID NO: 1821611 - protein, 24 aa, Staphylococcus epidermidis
HLDEGFDLNYLYPDARYSIENGHS

SEQ ID NO: 1821612 - protein, 32 aa, Staphylococcus epidermidis
HLHIDEPITFELWIAILIVQQPKDIQLSTLKI

SEQ ID NO: 1821613 - protein, 21 aa, Staphylococcus epidermidis
HLKEVFLEEPFGVNQSAYSIT

SEQ ID NO: 1821614 - protein, 23 aa, Staphylococcus epidermidis
HLTLEELYLLGLLIISDNKTTFK

SEQ ID NO: 1821615 - protein, 18 aa, Staphylococcus epidermidis
HLYYMYTGNHRDQHWNRI

SEQ ID NO: 1821616 - protein, 18 aa, Staphylococcus epidermidis
HMIIFKPSQPITWKQHEV

SEQ ID NO: 1821617 - protein, 23 aa, Staphylococcus epidermidis
HNHIRGLSPWPVAYTTMNEKNLK

SEQ ID NO: 1821618 - protein, 22 aa, Staphylococcus epidermidis
HPIEWQLKYLLLRRTLNDNELC

SEQ ID NO: 1821619 - protein, 18 aa, Staphylococcus epidermidis
HPLIQHKLSYIRDARTGT

SEQ ID NO: 1821620 - protein, 19 aa, Staphylococcus epidermidis
HPYETPVFDFIKMNKESEY

SEQ ID NO: 1821621 - protein, 34 aa, Staphylococcus epidermidis
HQFDYLFKHVPVKPGDFFYVPAGTVHAIGSGILI

SEQ ID NO: 1821622 - protein, 18 aa, Staphylococcus epidermidis
HQGHPGHLALPRKQEFIA

SEQ ID NO: 1821623 - protein, 17 aa, Staphylococcus epidermidis
HQLLIREGLRMETSLIA

SEQ ID NO: 1821624 - protein, 20 aa, Staphylococcus epidermidis
HRKRPATAKPVLLGITKASL

SEQ ID NO: 1821625 - protein, 26 aa, Staphylococcus epidermidis
HSDLDFDFIYWLVTGVKDHQIVLDET

SEQ ID NO: 1821626 - protein, 30 aa, Staphylococcus epidermidis
HSDSIINRYTFLTALLTQIIHRFDQFLHQT

SEQ ID NO: 1821627 - protein, 18 aa, Staphylococcus epidermidis
HSHLVDIIHKPFIQLKQL

SEQ ID NO: 1821628 - protein, 30 aa, Staphylococcus epidermidis
HSMNIPHDLFTPIFAVSRTSGWIAHILEQY

SEQ ID NO: 1821629 - protein, 18 aa, Staphylococcus epidermidis
HTWNYHLKNKFGQKIFKV

SEQ ID NO: 1821630 - protein, 18 aa, Staphylococcus epidermidis
HVMNYFDPKDKTLLKEGQ

SEQ ID NO: 1821631 - protein, 26 aa, Staphylococcus epidermidis
HVTATPVLRPLLTLDKEDIIKKAKEL

SEQ ID NO: 1821632 - protein, 20 aa, Staphylococcus epidermidis
HWIYKTMNEIRFFEEKVHKI

SEQ ID NO: 1821633 - protein, 17 aa, Staphylococcus epidermidis
IAAPKKNRIISAGRLEY

SEQ ID NO: 1821634 - protein, 25 aa, Staphylococcus epidermidis
IADNERTLYDWASKQTYIALANMMT

SEQ ID NO: 1821635 - protein, 29 aa, Staphylococcus epidermidis
IADQILKEIISRLSFLNNVGLEYLTLDRS

SEQ ID NO: 1821636 - protein, 24 aa, Staphylococcus epidermidis
IAKSLLPHDSIASRGLFAVEGQAI

SEQ ID NO: 1821637 - protein, 20 aa, Staphylococcus epidermidis
IALGLDRLVMLLTNRTNLRD

SEQ ID NO: 1821638 - protein, 19 aa, Staphylococcus epidermidis
IANELYKIVRPTLTVANRT

SEQ ID NO: 1821639 - protein, 18 aa, Staphylococcus epidermidis
IASDLQFVTNMYGSPGFS

SEQ ID NO: 1821640 - protein, 24 aa, Staphylococcus epidermidis
IDAIFNDRKRLLPSIAYLEGEYGC

SEQ ID NO: 1821641 - protein, 22 aa, Staphylococcus epidermidis
IDELPLGIYRFLEKESKVYART

SEQ ID NO: 1821642 - protein, 23 aa, Staphylococcus epidermidis
IDNNYTPLIIKPSTIKGINYQME

SEQ ID NO: 1821643 - protein, 21 aa, Staphylococcus epidermidis
IDNQKYIFDYSACNYPVGVVE

SEQ ID NO: 1821644 - protein, 25 aa, Staphylococcus epidermidis
IDQINWVGFYLIENNELILGPFQGH

SEQ ID NO: 1821645 - protein, 31 aa, Staphylococcus epidermidis
IDRTFIEHCINLKWIGWFATGVNNLPLNYIK

SEQ ID NO: 1821646 - protein, 18 aa, Staphylococcus epidermidis
IEAAFGVEIFIRTKKQLI

SEQ ID NO: 1821647 - protein, 17 aa, Staphylococcus epidermidis
IEAILAVRDIEKIHIAS

SEQ ID NO: 1821648 - protein, 17 aa, Staphylococcus epidermidis
IEEAGYGDYFPHRLGHG

SEQ ID NO: 1821649 - protein, 20 aa, Staphylococcus epidermidis
IEETLTMPFFSNKKAIVVKN

SEQ ID NO: 1821650 - protein, 23 aa, Staphylococcus epidermidis
IEHPPQHFIALAAIGTIADLVSL

SEQ ID NO: 1821651 - protein, 21 aa, Staphylococcus epidermidis
IEILLSLHHLLKQNGLTTANH

SEQ ID NO: 1821652 - protein, 17 aa, Staphylococcus epidermidis
IELIHPHNKYHHLRLCG

SEQ ID NO: 1821653 - protein, 26 aa, Staphylococcus epidermidis
IEQEDKIYILFYKPTQVITSVSDDRG

SEQ ID NO: 1821654 - protein, 25 aa, Staphylococcus epidermidis
IEVPHVDIILTIPPYELRTEDSRRV

SEQ ID NO: 1821655 - protein, 20 aa, Staphylococcus epidermidis
IEYTLVGPNIEFLTDNTFAI

SEQ ID NO: 1821656 - protein, 18 aa, Staphylococcus epidermidis
IFDYSACNYPVGVVEDQI

SEQ ID NO: 1821657 - protein, 17 aa, Staphylococcus epidermidis
IGGCIALEQLGINTLYC

SEQ ID NO: 1821658 - protein, 19 aa, Staphylococcus epidermidis
IGIFLTDNGDLYAIGNICP

SEQ ID NO: 1821659 - protein, 19 aa, Staphylococcus epidermidis
IGISNKNMLYRLGALGLNI

SEQ ID NO: 1821660 - protein, 25 aa, Staphylococcus epidermidis
IGKDARYRRNILGRKLHIGHSNGKQ

SEQ ID NO: 1821661 - protein, 24 aa, Staphylococcus epidermidis
IGKDIKGLKIALPKEYLGEGVSEE

SEQ ID NO: 1821662 - protein, 26 aa, Staphylococcus epidermidis
IGLLLPNQRMIFNIPIRTIEYNHEEA

SEQ ID NO: 1821663 - protein, 20 aa, Staphylococcus epidermidis
IGLQLIGKPFDEKTLYRVAY

SEQ ID NO: 1821664 - protein, 24 aa, Staphylococcus epidermidis
IGMINLCFEIFDDRIKIVISDQGE

SEQ ID NO: 1821665 - protein, 18 aa, Staphylococcus epidermidis
IGVERSRKALSEADLILF

SEQ ID NO: 1821666 - protein, 19 aa, Staphylococcus epidermidis
IHEGEIVKWFIKAGDTIEE

SEQ ID NO: 1821667 - protein, 18 aa, Staphylococcus epidermidis
IHELSQIIQPHPALLEAI

SEQ ID NO: 1821668 - protein, 19 aa, Staphylococcus epidermidis
IHRTCEVLIIIDPQYANNG

SEQ ID NO: 1821669 - protein, 19 aa, Staphylococcus epidermidis
IIEGHLFLNGKKPIQHRSS

SEQ ID NO: 1821670 - protein, 17 aa, Staphylococcus epidermidis
IIELRIDQWPSFNKALL

SEQ ID NO: 1821671 - protein, 21 aa, Staphylococcus epidermidis
IIERIKTLSTPYYLTGKNFRN

SEQ ID NO: 1821672 - protein, 17 aa, Staphylococcus epidermidis
IIHKPFIQLKQLHFNEK

SEQ ID NO: 1821673 - protein, 18 aa, Staphylococcus epidermidis
IIIVIRQNRKNHQLLLSI

SEQ ID NO: 1821674 - protein, 17 aa, Staphylococcus epidermidis
IIKFEADWCPDCKAMDM

SEQ ID NO: 1821675 - protein, 17 aa, Staphylococcus epidermidis
IIPVHHIAGHIYANHLE

SEQ ID NO: 1821676 - protein, 25 aa, Staphylococcus epidermidis
IIQQYPIQVVVLKPFRLGGIDRMLN

SEQ ID NO: 1821677 - protein, 20 aa, Staphylococcus epidermidis
IIQRLSKVYGIKSISPVIKI

SEQ ID NO: 1821678 - protein, 24 aa, Staphylococcus epidermidis
IITPKKQYLITDFRYIDQATEQAQ

SEQ ID NO: 1821679 - protein, 26 aa, Staphylococcus epidermidis
IIWVEDTLIALQQLAKAYLNHVNPKV

SEQ ID NO: 1821680 - protein, 37 aa, Staphylococcus epidermidis
IKDELTIYDRLSFPIYKKLLIYMKFQSGLDVSTQHRA

SEQ ID NO: 1821681 - protein, 18 aa, Staphylococcus epidermidis
IKFGKSKIWLGVWEHNPK

SEQ ID NO: 1821682 - protein, 18 aa, Staphylococcus epidermidis
IKLLLNYTDTYISGYDIA

SEQ ID NO: 1821683 - protein, 22 aa, Staphylococcus epidermidis
IKQFIKAYVKSHSFIQTLVLGI

SEQ ID NO: 1821684 - protein, 26 aa, Staphylococcus epidermidis
ILEQSFDLMFVRWIPRKQNKEANQLA

SEQ ID NO: 1821685 - protein, 17 aa, Staphylococcus epidermidis
ILKPRLVPLLQMSNKKF

SEQ ID NO: 1821686 - protein, 23 aa, Staphylococcus epidermidis
ILVDDYHPMIYKLQFRENQEIVQ

SEQ ID NO: 1821687 - protein, 18 aa, Staphylococcus epidermidis
IMKIKPIGTLRDGKLELV

SEQ ID NO: 1821688 - protein, 21 aa, Staphylococcus epidermidis
IMQEEIFGPVVGFIKVKDFDE

SEQ ID NO: 1821689 - protein, 20 aa, Staphylococcus epidermidis
IMRLHYEGILQERLDELGEM

SEQ ID NO: 1821690 - protein, 22 aa, Staphylococcus epidermidis
INNIRLRKLRKILNQINALSEE

SEQ ID NO: 1821691 - protein, 18 aa, Staphylococcus epidermidis
INQLGISILPATIAQLLN

SEQ ID NO: 1821692 - protein, 31 aa, Staphylococcus epidermidis
INTMLLEKMLSRDIIPIITSLGVNEQGEYLN

SEQ ID NO: 1821693 - protein, 18 aa, Staphylococcus epidermidis
IPFRIRKPLPNMTFHQVE

SEQ ID NO: 1821694 - protein, 17 aa, Staphylococcus epidermidis
IPHISTGDMFRKAIKDE

SEQ ID NO: 1821695 - protein, 22 aa, Staphylococcus epidermidis
IQPYLKDTFEKMGLHVIEDEAS

SEQ ID NO: 1821696 - protein, 18 aa, Staphylococcus epidermidis
IRDGRMQRLIAPEKEPIT

SEQ ID NO: 1821697 - protein, 29 aa, Staphylococcus epidermidis
IRNRTQVKTWWRWYRNGESYRFSQQVGKQ

SEQ ID NO: 1821698 - protein, 23 aa, Staphylococcus epidermidis
IRQKYLDFFVEKGHMIEPSAPLV

SEQ ID NO: 1821699 - protein, 25 aa, Staphylococcus epidermidis
IRVHMKYIGYPLVGDPKYGPKKTLD

SEQ ID NO: 1821700 - protein, 32 aa, Staphylococcus epidermidis
IRYYDSVLLSTKFKAPRWLVTPIKNYSVKKHK

SEQ ID NO: 1821701 - protein, 19 aa, Staphylococcus epidermidis
ISEALLALQALGYSKRELT

SEQ ID NO: 1821702 - protein, 31 aa, Staphylococcus epidermidis
ISFAHHIMTYFWMLERDKGRFMDSLKRIDIS

SEQ ID NO: 1821703 - protein, 19 aa, Staphylococcus epidermidis
ISMPYLRSPFVHHIHPKPF

SEQ ID NO: 1821704 - protein, 24 aa, Staphylococcus epidermidis
ISTDYLLCKAFGKTATNIEKYTSQ

SEQ ID NO: 1821705 - protein, 18 aa, Staphylococcus epidermidis
ITIGVPLRYMHSNVSVLN

SEQ ID NO: 1821706 - protein, 22 aa, Staphylococcus epidermidis
ITKDNLLMRMKEQEWDDVIDTN

SEQ ID NO: 1821707 - protein, 18 aa, Staphylococcus epidermidis
IVGEVVKMREKINWFVEQ

SEQ ID NO: 1821708 - protein, 33 aa, Staphylococcus epidermidis
IVPEDFTNSYLKRIFSYLYDYYSKNDYYTISDM

SEQ ID NO: 1821709 - protein, 17 aa, Staphylococcus epidermidis
IVVDMPIGTVGLSDEED

SEQ ID NO: 1821710 - protein, 17 aa, Staphylococcus epidermidis
IVWLAQYNDVACLLSQA

SEQ ID NO: 1821711 - protein, 39 aa, Staphylococcus epidermidis
KAGANVTVLYRGEQYPKAIKPWILPNFESLVNHEKITME

SEQ ID NO: 1821712 - protein, 20 aa, Staphylococcus epidermidis
KAHAIFNHGMTPIICVGESD

SEQ ID NO: 1821713 - protein, 24 aa, Staphylococcus epidermidis
KALNPKLKAFAPVREWAWSREEEI

SEQ ID NO: 1821714 - protein, 26 aa, Staphylococcus epidermidis
KAQHVVNFMYFIAEELREILASLGLE

SEQ ID NO: 1821715 - protein, 23 aa, Staphylococcus epidermidis
KAQPIIESAIDNGITYFDTADIY

SEQ ID NO: 1821716 - protein, 27 aa, Staphylococcus epidermidis
KAVIDSLSYYQFYILKLVVGEQRIKKA

SEQ ID NO: 1821717 - protein, 18 aa, Staphylococcus epidermidis
KAVITVPAYFNDGERQAT

SEQ ID NO: 1821718 - protein, 27 aa, Staphylococcus epidermidis
KDAILDIETLFPYLTINHFGSSVDKIK

SEQ ID NO: 1821719 - protein, 33 aa, Staphylococcus epidermidis
KDFEGTIIFVSHDRYFINQLANKVFDLNINGGQ

SEQ ID NO: 1821720 - protein, 23 aa, Staphylococcus epidermidis
KDIGMIFQHFNLLNSKSVYKNVA

SEQ ID NO: 1821721 - protein, 25 aa, Staphylococcus epidermidis
KDKAFQLLLELGFSRNVMSSSPFQM

SEQ ID NO: 1821722 - protein, 25 aa, Staphylococcus epidermidis
KDNVKRALIPLSGYHVKGKRDRMYI

SEQ ID NO: 1821723 - protein, 21 aa, Staphylococcus epidermidis
KDVLFTILDSPIKYTQHIGGT

SEQ ID NO: 1821724 - protein, 23 aa, Staphylococcus epidermidis
KEEHLDFVIIDTAGRLHIDEALM

SEQ ID NO: 1821725 - protein, 18 aa, Staphylococcus epidermidis
KEIGAFLKRLFYKQQDAN

SEQ ID NO: 1821726 - protein, 17 aa, Staphylococcus epidermidis
KEILNDLGILKKGVFTH

SEQ ID NO: 1821727 - protein, 17 aa, Staphylococcus epidermidis
KEKTEYSRLSLNNLNRL

SEQ ID NO: 1821728 - protein, 19 aa, Staphylococcus epidermidis
KENFGYLKGINLTYVGNGR

SEQ ID NO: 1821729 - protein, 24 aa, Staphylococcus epidermidis
KENKLLITIAYRLFMEKHTFTIKE

SEQ ID NO: 1821730 - protein, 22 aa, Staphylococcus epidermidis
KERGFEIKPEIAGLMISAIISD

SEQ ID NO: 1821731 - protein, 23 aa, Staphylococcus epidermidis
KESLELIHKYDLPEPSRAQAFHI

SEQ ID NO: 1821732 - protein, 24 aa, Staphylococcus epidermidis
KESNLEFFQFKEKIKELVSAEFLN

SEQ ID NO: 1821733 - protein, 19 aa, Staphylococcus epidermidis
KETALGYANKFKRKLHPYE

SEQ ID NO: 1821734 - protein, 17 aa, Staphylococcus epidermidis
KFGGPKGVGLLLVKEHT

SEQ ID NO: 1821735 - protein, 23 aa, Staphylococcus epidermidis
KFNRPIFTFIDTKGAYPGKAAEE

SEQ ID NO: 1821736 - protein, 30 aa, Staphylococcus epidermidis
KFRYDLNERFIITRGLDKCLFGYTLEEWQQ

SEQ ID NO: 1821737 - protein, 26 aa, Staphylococcus epidermidis
KGCDETFLTTLLKLNPKRIVYISCNP

SEQ ID NO: 1821738 - protein, 18 aa, Staphylococcus epidermidis
KGEILIYERLSGGGEERL

SEQ ID NO: 1821739 - protein, 18 aa, Staphylococcus epidermidis
KGGLFYHFKSKDELIKEL

SEQ ID NO: 1821740 - protein, 19 aa, Staphylococcus epidermidis
KGIFKFTDINLAREAKNRL

SEQ ID NO: 1821741 - protein, 17 aa, Staphylococcus epidermidis
KGKYWQHLANGPETLCI

SEQ ID NO: 1821742 - protein, 30 aa, Staphylococcus epidermidis
KGQLAAYLTPRLQPWDFAGGLLILNEVGGI

SEQ ID NO: 1821743 - protein, 32 aa, Staphylococcus epidermidis
KGWMRHWDEYQFGYFILIMRDNHEVVGIAGFE

SEQ ID NO: 1821744 - protein, 18 aa, Staphylococcus epidermidis
KHFRLGISVSKKLGNAVT

SEQ ID NO: 1821745 - protein, 18 aa, Staphylococcus epidermidis
KHPKLKNLYFLQENAKQS

SEQ ID NO: 1821746 - protein, 20 aa, Staphylococcus epidermidis
KHTVRLLHAIEIERLNLGRK

SEQ ID NO: 1821747 - protein, 33 aa, Staphylococcus epidermidis
KIAFYVAQWPSSRLDHWLSLLKARAIENDIFIV

SEQ ID NO: 1821748 - protein, 18 aa, Staphylococcus epidermidis
KIDDQSMQALFKSTGMTL

SEQ ID NO: 1821749 - protein, 17 aa, Staphylococcus epidermidis
KIDWKSLYEKSLNHDFA

SEQ ID NO: 1821750 - protein, 24 aa, Staphylococcus epidermidis
KIEPLKHIIDIPKRVFEALDIVPN

SEQ ID NO: 1821751 - protein, 30 aa, Staphylococcus epidermidis
KIIKKLNQINKPLKAILLTHAHYDHIGALD

SEQ ID NO: 1821752 - protein, 18 aa, Staphylococcus epidermidis
KKCQMLLQLNAYLELREE

SEQ ID NO: 1821753 - protein, 19 aa, Staphylococcus epidermidis
KLGYLRYWVAEHHQVYSVV

SEQ ID NO: 1821754 - protein, 20 aa, Staphylococcus epidermidis
KLHLDDLHNSQISLMATSGS

SEQ ID NO: 1821755 - protein, 30 aa, Staphylococcus epidermidis
KLLSSEEVQWIVLAGYMRLVGQDLLQAYEG

SEQ ID NO: 1821756 - protein, 19 aa, Staphylococcus epidermidis
KLLVEIYANVLNKRVVVID

SEQ ID NO: 1821757 - protein, 23 aa, Staphylococcus epidermidis
KLSSSQILIFGAGALGSHIVDQL

SEQ ID NO: 1821758 - protein, 19 aa, Staphylococcus epidermidis
KLTKMSIDELGPVNLNAIE

SEQ ID NO: 1821759 - protein, 27 aa, Staphylococcus epidermidis
KLVKHYRKLIESLAYRYSKGQSHHEDL

SEQ ID NO: 1821760 - protein, 18 aa, Staphylococcus epidermidis
KLYALRDVTGTVNSIPLI

SEQ ID NO: 1821761 - protein, 19 aa, Staphylococcus epidermidis
KMAFRVYPTWEKDLNRVAH

SEQ ID NO: 1821762 - protein, 29 aa, Staphylococcus epidermidis
KNEGIKLILKIFEAWQIPIIFVTHSNYEA

SEQ ID NO: 1821763 - protein, 21 aa, Staphylococcus epidermidis
KNKNFILLTAHRRENIGKPMI

SEQ ID NO: 1821764 - protein, 24 aa, Staphylococcus epidermidis
KNLIGAFYRPKAVIYDLDFLETLP

SEQ ID NO: 1821765 - protein, 20 aa, Staphylococcus epidermidis
KNMLYRLGALGLNIGSEISI

SEQ ID NO: 1821766 - protein, 17 aa, Staphylococcus epidermidis
KNSETIFIYGYGASFVV

SEQ ID NO: 1821767 - protein, 35 aa, Staphylococcus epidermidis
KNTSTIIPMCHPLPLTGIDISFKWDSNNDDSYRLN

SEQ ID NO: 1821768 - protein, 18 aa, Staphylococcus epidermidis
KPCIDYPGFYTHVSITHT

SEQ ID NO: 1821769 - protein, 22 aa, Staphylococcus epidermidis
KPENFDYLINNTKLELTYDEVK

SEQ ID NO: 1821770 - protein, 18 aa, Staphylococcus epidermidis
KPHHILSYVIRMFNQLRG

SEQ ID NO: 1821771 - protein, 20 aa, Staphylococcus epidermidis
KPIGLFYTKEEANRIQQEKG

SEQ ID NO: 1821772 - protein, 21 aa, Staphylococcus epidermidis
KQHEVKLVFFLAMSKKDLNIN

SEQ ID NO: 1821773 - protein, 25 aa, Staphylococcus epidermidis
KQLDTASHFVLIFARKNVTAHTDYV

SEQ ID NO: 1821774 - protein, 27 aa, Staphylococcus epidermidis
KQNFIEYILFNYRFKSRITVWVLNYLK

SEQ ID NO: 1821775 - protein, 24 aa, Staphylococcus epidermidis
KQQEDYCIIIGYFIDGEPKLSYIY

SEQ ID NO: 1821776 - protein, 28 aa, Staphylococcus epidermidis
KQRFGGSRPFNVLMTPSDKKRMMDQNHK

SEQ ID NO: 1821777 - protein, 18 aa, Staphylococcus epidermidis
KQSPFKGKIIGYLDTENP

SEQ ID NO: 1821778 - protein, 20 aa, Staphylococcus epidermidis
KQTYQFLKTIKKADFENATD

SEQ ID NO: 1821779 - protein, 26 aa, Staphylococcus epidermidis
KQVSKIPLSLTFDHQILDGAGAADFL

SEQ ID NO: 1821780 - protein, 20 aa, Staphylococcus epidermidis
KRELFEQWFHPQDASVTVYD

SEQ ID NO: 1821781 - protein, 18 aa, Staphylococcus epidermidis
KRVINRAIPDAPHEALLC

SEQ ID NO: 1821782 - protein, 22 aa, Staphylococcus epidermidis
KSDVNVFPIALGTNAVGGHNLY

SEQ ID NO: 1821783 - protein, 26 aa, Staphylococcus epidermidis
KSIKKRGHDIFLDLKLHDIPNTVSKA

SEQ ID NO: 1821784 - protein, 30 aa, Staphylococcus epidermidis
KSKEQSLEHLLFGLGIRHLGVKASQVLAER

SEQ ID NO: 1821785 - protein, 19 aa, Staphylococcus epidermidis
KSRITVWVLNYLKANQDKL

SEQ ID NO: 1821786 - protein, 24 aa, Staphylococcus epidermidis
KSRQDEINYFKPEKYYTLSINVDG

SEQ ID NO: 1821787 - protein, 25 aa, Staphylococcus epidermidis
KSSLVNEILYKALAQKINKSKVKPG

SEQ ID NO: 1821788 - protein, 22 aa, Staphylococcus epidermidis
KSTLLKALSRLLSIKEGKINLD

SEQ ID NO: 1821789 - protein, 21 aa, Staphylococcus epidermidis
KSTLLRCMNLLDVPSKGKVIF

SEQ ID NO: 1821790 - protein, 22 aa, Staphylococcus epidermidis
KSYNQFLKYGHQTKLAIYGADE

SEQ ID NO: 1821791 - protein, 21 aa, Staphylococcus epidermidis
KTEKLVFIADYIEPGRKTPGV

SEQ ID NO: 1821792 - protein, 21 aa, Staphylococcus epidermidis
KTGAGFIVALTGAIMTMPGLP

SEQ ID NO: 1821793 - protein, 26 aa, Staphylococcus epidermidis
KTIYEISKRTVLFLIEKDITVYGATI

SEQ ID NO: 1821794 - protein, 23 aa, Staphylococcus epidermidis
KTPKDDIFKFEKELKRLGINATI

SEQ ID NO: 1821795 - protein, 26 aa, Staphylococcus epidermidis
KTTLMNHAISFLKERGYSVVTIKHHG

SEQ ID NO: 1821796 - protein, 35 aa, Staphylococcus epidermidis
KTYPITHMSLVPQTLKWLMDAGLTQPFSLEKILLG

SEQ ID NO: 1821797 - protein, 24 aa, Staphylococcus epidermidis
KVQKEIFLLSEILAGKNDYKLTLE

SEQ ID NO: 1821798 - protein, 17 aa, Staphylococcus epidermidis
KVSLELGGKSPYIVLDD

SEQ ID NO: 1821799 - protein, 19 aa, Staphylococcus epidermidis
KWFLQDFEVLINGQRETRR

SEQ ID NO: 1821800 - protein, 18 aa, Staphylococcus epidermidis
KYVLMTYYNILSAYGEEL

SEQ ID NO: 1821801 - protein, 23 aa, Staphylococcus epidermidis
LADDIRAKFLPKLNFAIIDEVDS

SEQ ID NO: 1821802 - protein, 22 aa, Staphylococcus epidermidis
LAGGIFTTDIHRALNVAKAMRT

SEQ ID NO: 1821803 - protein, 18 aa, Staphylococcus epidermidis
LAIIDRDAFEMGKKVIVQ

SEQ ID NO: 1821804 - protein, 18 aa, Staphylococcus epidermidis
LANITVPVNIMYGEEDDP

SEQ ID NO: 1821805 - protein, 39 aa, Staphylococcus epidermidis
LAQGEKGLFIVPLNGFKKWLTPVDLWKDHQMTLKVGQDI

SEQ ID NO: 1821806 - protein, 18 aa, Staphylococcus epidermidis
LAYEINDFKEGFYNIVRI

SEQ ID NO: 1821807 - protein, 17 aa, Staphylococcus epidermidis
LCYQLPTYILEKPTLII

SEQ ID NO: 1821808 - protein, 22 aa, Staphylococcus epidermidis
LDALAALGIQIGTDIPFCIYNQ

SEQ ID NO: 1821809 - protein, 24 aa, Staphylococcus epidermidis
LDDETKFYINPTGRFVIGGPQGDA

SEQ ID NO: 1821810 - protein, 24 aa, Staphylococcus epidermidis
LDIRKRTYKITKPKNAKFICIPTT

SEQ ID NO: 1821811 - protein, 17 aa, Staphylococcus epidermidis
LDKGFIPRLDYHYQRIS

SEQ ID NO: 1821812 - protein, 18 aa, Staphylococcus epidermidis
LDKGFTGHIIRRGSADAD

SEQ ID NO: 1821813 - protein, 24 aa, Staphylococcus epidermidis
LDVTEIDSPYYWYKNINFQHDLDS

SEQ ID NO: 1821814 - protein, 28 aa, Staphylococcus epidermidis
LEGTNYLKDTILKFGFYTNHQHVVINAE

SEQ ID NO: 1821815 - protein, 23 aa, Staphylococcus epidermidis
LEKFDNAVILFMGAGDIQKLLKA

SEQ ID NO: 1821816 - protein, 19 aa, Staphylococcus epidermidis
LEQEHFVVLLLNSKNIVTK

SEQ ID NO: 1821817 - protein, 23 aa, Staphylococcus epidermidis
LETPYLDMAYTFLYAYHLEYTQP

SEQ ID NO: 1821818 - protein, 18 aa, Staphylococcus epidermidis
LEVPFEAIEQAFKIARKQ

SEQ ID NO: 1821819 - protein, 22 aa, Staphylococcus epidermidis
LEVTLELKLLADVGLVGFPSVG

SEQ ID NO: 1821820 - protein, 18 aa, Staphylococcus epidermidis
LFKQLIMDELRKYKGNLK

SEQ ID NO: 1821821 - protein, 23 aa, Staphylococcus epidermidis
LGAKRVLPLAVSGPFHSSMMKVI

SEQ ID NO: 1821822 - protein, 20 aa, Staphylococcus epidermidis
LGAQVGWYIPNRFTEGYGPN

SEQ ID NO: 1821823 - protein, 23 aa, Staphylococcus epidermidis
LGAVPYHHPLFLGMGGMHGSYAS

SEQ ID NO: 1821824 - protein, 18 aa, Staphylococcus epidermidis
LGHLPSVQEKWNALEDIL

SEQ ID NO: 1821825 - protein, 19 aa, Staphylococcus epidermidis
LGIEAAFKSYFKQFEENYG

SEQ ID NO: 1821826 - protein, 26 aa, Staphylococcus epidermidis
LGLDYLDLYLMHWPGTNEAVMIDTWR

SEQ ID NO: 1821827 - protein, 18 aa, Staphylococcus epidermidis
LGPIFDKDIKIYADNYLQ

SEQ ID NO: 1821828 - protein, 18 aa, Staphylococcus epidermidis
LGQMRDAFFLAQNTGTTG

SEQ ID NO: 1821829 - protein, 20 aa, Staphylococcus epidermidis
LGYANKFKRKLHPYEGKQYE

SEQ ID NO: 1821830 - protein, 19 aa, Staphylococcus epidermidis
LHQVQGLGPVIIKVNELSV

SEQ ID NO: 1821831 - protein, 24 aa, Staphylococcus epidermidis
LHYTTGYFASPKLGYRRIFNIKEK

SEQ ID NO: 1821832 - protein, 18 aa, Staphylococcus epidermidis
LIEILDQSSLTEINIEDN

SEQ ID NO: 1821833 - protein, 18 aa, Staphylococcus epidermidis
LIHLCKEITFCESFQYSI

SEQ ID NO: 1821834 - protein, 34 aa, Staphylococcus epidermidis
LIRSADVILFDRLVNPFILQYASSQTKVINVGKK

SEQ ID NO: 1821835 - protein, 19 aa, Staphylococcus epidermidis
LIRSVKWTDIIFKNVSFKN

SEQ ID NO: 1821836 - protein, 24 aa, Staphylococcus epidermidis
LKDLDITFTLLRPTVEADLEKMIS

SEQ ID NO: 1821837 - protein, 24 aa, Staphylococcus epidermidis
LKDYNFVLKEIIPKQLGYKALKDQ

SEQ ID NO: 1821838 - protein, 28 aa, Staphylococcus epidermidis
LKGKDENFPFLMFGPGNGPHQINECVEK

SEQ ID NO: 1821839 - protein, 24 aa, Staphylococcus epidermidis
LKNKNIALLFEKDSTRTRCAFEVA

SEQ ID NO: 1821840 - protein, 25 aa, Staphylococcus epidermidis
LKNYNVPDFCQLIFITTPEVLNTSE

SEQ ID NO: 1821841 - protein, 19 aa, Staphylococcus epidermidis
LKQTLIIEIARFVPSMKLK

SEQ ID NO: 1821842 - protein, 23 aa, Staphylococcus epidermidis
LLELDILRFSLGKPVKIYAAQLI

SEQ ID NO: 1821843 - protein, 17 aa, Staphylococcus epidermidis
LLESIYTLALAKSHRTS

SEQ ID NO: 1821844 - protein, 17 aa, Staphylococcus epidermidis
LLGFNLQPTHDGLIIHP

SEQ ID NO: 1821845 - protein, 17 aa, Staphylococcus epidermidis
LLGLLRLHLSLFEKYDK

SEQ ID NO: 1821846 - protein, 17 aa, Staphylococcus epidermidis
LLINFVTRTEGIPEGVL

SEQ ID NO: 1821847 - protein, 28 aa, Staphylococcus epidermidis
LLKEKDALLKLDFITHSYPHDWRTKKPV

SEQ ID NO: 1821848 - protein, 25 aa, Staphylococcus epidermidis
LLNRAPTLHRLGIQAFEPTLVEGRA

SEQ ID NO: 1821849 - protein, 21 aa, Staphylococcus epidermidis
LLSGSIIPRPIAFVTTQNLKG

SEQ ID NO: 1821850 - protein, 17 aa, Staphylococcus epidermidis
LLVPIFDARREAVYAGV

SEQ ID NO: 1821851 - protein, 25 aa, Staphylococcus epidermidis
LMEAREIFLVITGANKRDMVEKLYR

SEQ ID NO: 1821852 - protein, 18 aa, Staphylococcus epidermidis
LNDKFGIINGLMTTVHAI

SEQ ID NO: 1821853 - protein, 19 aa, Staphylococcus epidermidis
LNDLGILKKGVFTHDIDPD

SEQ ID NO: 1821854 - protein, 26 aa, Staphylococcus epidermidis
LNEQQYLFMNGPAPQLMKRAMKMSYI

SEQ ID NO: 1821855 - protein, 18 aa, Staphylococcus epidermidis
LNIDVELRLLKYKHRDKV

SEQ ID NO: 1821856 - protein, 27 aa, Staphylococcus epidermidis
LNIKTDMPHFVMFTFNDPQVWNNDFNI

SEQ ID NO: 1821857 - protein, 27 aa, Staphylococcus epidermidis
LNLDNVELTKYLFFTGKGGVGKTTISS

SEQ ID NO: 1821858 - protein, 19 aa, Staphylococcus epidermidis
LNNHLLSLKVARKSALKRY

SEQ ID NO: 1821859 - protein, 17 aa, Staphylococcus epidermidis
LNTGIGLGMPTFDSPVN

SEQ ID NO: 1821860 - protein, 27 aa, Staphylococcus epidermidis
LNTYVDWSFVLEYMKYVNKFVRIFNFP

SEQ ID NO: 1821861 - protein, 20 aa, Staphylococcus epidermidis
LPASTIANYIRRDIYEVTRL

SEQ ID NO: 1821862 - protein, 17 aa, Staphylococcus epidermidis
LPILGVCLGAQALTCYY

SEQ ID NO: 1821863 - protein, 26 aa, Staphylococcus epidermidis
LPKLQLPYLISFLSFHNYAIYQILLP

SEQ ID NO: 1821864 - protein, 18 aa, Staphylococcus epidermidis
LPMAISMVRAIKNAVDQT

SEQ ID NO: 1821865 - protein, 27 aa, Staphylococcus epidermidis
LPQNDPAIVDLLISTLGWSPETQVLIN

SEQ ID NO: 1821866 - protein, 18 aa, Staphylococcus epidermidis
LPSERFIHLMSQYGTHVE

SEQ ID NO: 1821867 - protein, 26 aa, Staphylococcus epidermidis
LPSFTYTFLGFLPRKEKEKIEVLEDR

SEQ ID NO: 1821868 - protein, 17 aa, Staphylococcus epidermidis
LPYIAMWTDENVAESYL

SEQ ID NO: 1821869 - protein, 28 aa, Staphylococcus epidermidis
LQDVPGFKALRFLRPVVKGRHYIIITLW

SEQ ID NO: 1821870 - protein, 28 aa, Staphylococcus epidermidis
LQENIEKSIWYKLLVNLGINTITAIGQQ

SEQ ID NO: 1821871 - protein, 25 aa, Staphylococcus epidermidis
LQQRRPVHIHLPIDVALTEIEISNP

SEQ ID NO: 1821872 - protein, 20 aa, Staphylococcus epidermidis
LQRLNIIRSLLAQPDILVCD

SEQ ID NO: 1821873 - protein, 17 aa, Staphylococcus epidermidis
LRALFRGKAQHVVNFMY

SEQ ID NO: 1821874 - protein, 21 aa, Staphylococcus epidermidis
LRELHIYRLPVKANQYEYKLL

SEQ ID NO: 1821875 - protein, 19 aa, Staphylococcus epidermidis
LRELQSRLGITFIFVTHDQ

SEQ ID NO: 1821876 - protein, 19 aa, Staphylococcus epidermidis
LRGEIILGNLKYSSGPNHQ

SEQ ID NO: 1821877 - protein, 17 aa, Staphylococcus epidermidis
LSGVVSRKKQVVPQITE

SEQ ID NO: 1821878 - protein, 20 aa, Staphylococcus epidermidis
LSHIQLVGLAFNFMCFKSEA

SEQ ID NO: 1821879 - protein, 17 aa, Staphylococcus epidermidis
LSKLRIEYNKYIKVRHI

SEQ ID NO: 1821880 - protein, 30 aa, Staphylococcus epidermidis
LSKSRFIYLSPEYILQPHNFKYIAHINFGL

SEQ ID NO: 1821881 - protein, 22 aa, Staphylococcus epidermidis
LSNELLLHLDAKYSRFIATKSP

SEQ ID NO: 1821882 - protein, 22 aa, Staphylococcus epidermidis
LSNVELLAILLNTGRKGFSSID

SEQ ID NO: 1821883 - protein, 19 aa, Staphylococcus epidermidis
LSQMHVSRLQRTAIKKLQE

SEQ ID NO: 1821884 - protein, 24 aa, Staphylococcus epidermidis
LSREDLFITSKLWLTDFGRQNVED

SEQ ID NO: 1821885 - protein, 19 aa, Staphylococcus epidermidis
LSVYHEMTFFVSQQNGLYQ

SEQ ID NO: 1821886 - protein, 17 aa, Staphylococcus epidermidis
LTALFWNHGHLASELEP

SEQ ID NO: 1821887 - protein, 26 aa, Staphylococcus epidermidis
LTATMPLYLNALTGKGAYLITTNDYL

SEQ ID NO: 1821888 - protein, 28 aa, Staphylococcus epidermidis
LTEARSLKFFKYFYTHRGPVMDFNNLVL

SEQ ID NO: 1821889 - protein, 22 aa, Staphylococcus epidermidis
LTISVDLPFAQKRWCASSGLDN

SEQ ID NO: 1821890 - protein, 18 aa, Staphylococcus epidermidis
LTMGFIDDLLYPDDQVRA

SEQ ID NO: 1821891 - protein, 27 aa, Staphylococcus epidermidis
LTPNEIYNLVIYQLGALSGFCKINHVK

SEQ ID NO: 1821892 - protein, 20 aa, Staphylococcus epidermidis
LTQPFSLEKILLGGAKLSPQ

SEQ ID NO: 1821893 - protein, 18 aa, Staphylococcus epidermidis
LTTQYIPHWEQPDYIKTL

SEQ ID NO: 1821894 - protein, 17 aa, Staphylococcus epidermidis
LVDMHIGDSISVNGACL

SEQ ID NO: 1821895 - protein, 18 aa, Staphylococcus epidermidis
LVEQLMSKTVKRKYTALV

SEQ ID NO: 1821896 - protein, 24 aa, Staphylococcus epidermidis
LVNTQEPLTLIAIGPLTNIAILLT

SEQ ID NO: 1821897 - protein, 17 aa, Staphylococcus epidermidis
LVRPQIISGTHAITLAL

SEQ ID NO: 1821898 - protein, 19 aa, Staphylococcus epidermidis
LYHHDIVYTTNGRLGFDYL

SEQ ID NO: 1821899 - protein, 18 aa, Staphylococcus epidermidis
LYMAPLAKHVYGVEVVPQ

SEQ ID NO: 1821900 - protein, 19 aa, Staphylococcus epidermidis
LYNLFQHYKSEDFEIGFKL

SEQ ID NO: 1821901 - protein, 20 aa, Staphylococcus epidermidis
LYQTEWQEWLEDGTLSKLDV

SEQ ID NO: 1821902 - protein, 19 aa, Staphylococcus epidermidis
MALELFKPFVMKELVQREI

SEQ ID NO: 1821903 - protein, 18 aa, Staphylococcus epidermidis
MALIGVIELLKQAKNRKL

SEQ ID NO: 1821904 - protein, 26 aa, Staphylococcus epidermidis
MALKLTFQMLFIMLREFNQLEIEFIV

SEQ ID NO: 1821905 - protein, 18 aa, Staphylococcus epidermidis
MAQSHLLALRSTCKRLSV

SEQ ID NO: 1821906 - protein, 22 aa, Staphylococcus epidermidis
MASPLGWHKYVGIEGKVIGINS

SEQ ID NO: 1821907 - protein, 29 aa, Staphylococcus epidermidis
MDADLVFDVRFLPNPYYVEELRPFTGLDE

SEQ ID NO: 1821908 - protein, 23 aa, Staphylococcus epidermidis
MEKHAVSRLVGAPPGYVGHDDGG

SEQ ID NO: 1821909 - protein, 18 aa, Staphylococcus epidermidis
MELIQSYLKEHSNIPYVI

SEQ ID NO: 1821910 - protein, 25 aa, Staphylococcus epidermidis
MHPNFEYPFKYLCGAGVAYKLAQGL

SEQ ID NO: 1821911 - protein, 18 aa, Staphylococcus epidermidis
MHTDPMKFLPEDGSLELT

SEQ ID NO: 1821912 - protein, 17 aa, Staphylococcus epidermidis
MHVKPHGALYQMGARNK

SEQ ID NO: 1821913 - protein, 25 aa, Staphylococcus epidermidis
MITGEPIQYIVGFQSFYGYQYKVNQ

SEQ ID NO: 1821914 - protein, 18 aa, Staphylococcus epidermidis
MITYRLLKHYDDLQSMLS

SEQ ID NO: 1821915 - protein, 18 aa, Staphylococcus epidermidis
MLEYLRFAEYSHTITIHK

SEQ ID NO: 1821916 - protein, 19 aa, Staphylococcus epidermidis
MLLQLNAYLELREEAIILL

SEQ ID NO: 1821917 - protein, 18 aa, Staphylococcus epidermidis
MMPKLYDMIKIKSLIQQK

SEQ ID NO: 1821918 - protein, 28 aa, Staphylococcus epidermidis
MNLPNKEFQLLFLLASNPKHIFTRDDII

SEQ ID NO: 1821919 - protein, 24 aa, Staphylococcus epidermidis
MNNHSILMYPIDIESLYTIDNWID

SEQ ID NO: 1821920 - protein, 25 aa, Staphylococcus epidermidis
MPIQVIYGFAQLKRGAALANHELGK

SEQ ID NO: 1821921 - protein, 18 aa, Staphylococcus epidermidis
MQDVYYLEQISHFDREVI

SEQ ID NO: 1821922 - protein, 18 aa, Staphylococcus epidermidis
MQYYRETGVYAERTAPWL

SEQ ID NO: 1821923 - protein, 18 aa, Staphylococcus epidermidis
MTGHLLGATGGIEAIFSA

SEQ ID NO: 1821924 - protein, 19 aa, Staphylococcus epidermidis
MTVELIAPIAIEDGTRFSI

SEQ ID NO: 1821925 - protein, 29 aa, Staphylococcus epidermidis
MTVNRMFWRARRRESIFISYILKHHPRFK

SEQ ID NO: 1821926 - protein, 27 aa, Staphylococcus epidermidis
MVEDVITYFINYLFTGYEVLNTFTFRI

SEQ ID NO: 1821927 - protein, 18 aa, Staphylococcus epidermidis
MYAAMKQAAKVKKPIVAH

SEQ ID NO: 1821928 - protein, 23 aa, Staphylococcus epidermidis
NDIIKIIIEYRLHVAFSIDKIEQ

SEQ ID NO: 1821929 - protein, 24 aa, Staphylococcus epidermidis
NDKSYIGLIDRLHPTPALGGYPKE

SEQ ID NO: 1821930 - protein, 23 aa, Staphylococcus epidermidis
NDLPIIYDALINIVGHQLLERLK

SEQ ID NO: 1821931 - protein, 17 aa, Staphylococcus epidermidis
NDRTILVSIMFVNNEIG

SEQ ID NO: 1821932 - protein, 24 aa, Staphylococcus epidermidis
NDVMGIPSILIFQNGKKLAHLHSA

SEQ ID NO: 1821933 - protein, 24 aa, Staphylococcus epidermidis
NDYEKLYLTYLVQGLTLNKLDFIH

SEQ ID NO: 1821934 - protein, 18 aa, Staphylococcus epidermidis
NDYNGIQMVLLKNLGKPV

SEQ ID NO: 1821935 - protein, 25 aa, Staphylococcus epidermidis
NEELGITILINLHFVDLAKEYGSRI

SEQ ID NO: 1821936 - protein, 22 aa, Staphylococcus epidermidis
NEESMFVLYLYPQSLIICLSLH

SEQ ID NO: 1821937 - protein, 24 aa, Staphylococcus epidermidis
NEGIFKGLPSYFNVMRYHSLMADP

SEQ ID NO: 1821938 - protein, 20 aa, Staphylococcus epidermidis
NEKIVFVNRQGKIIAMNDAA

SEQ ID NO: 1821939 - protein, 23 aa, Staphylococcus epidermidis
NEKYDLFVLVVTDIINSDSKILV

SEQ ID NO: 1821940 - protein, 18 aa, Staphylococcus epidermidis
NELKPLCLNSNFVAIEET

SEQ ID NO: 1821941 - protein, 26 aa, Staphylococcus epidermidis
NELQLKTLYISVDPYMRGRMTNADSY

SEQ ID NO: 1821942 - protein, 17 aa, Staphylococcus epidermidis
NEYQGELIFLHKVKDGA

SEQ ID NO: 1821943 - protein, 31 aa, Staphylococcus epidermidis
NFELNVFKPVIMHNTLQSIYLLADGMNTFNK

SEQ ID NO: 1821944 - protein, 22 aa, Staphylococcus epidermidis
NFGCPYFVVRRLSPNEFIEEID

SEQ ID NO: 1821945 - protein, 19 aa, Staphylococcus epidermidis
NFMPSPGKITQYLAPGGFG

SEQ ID NO: 1821946 - protein, 22 aa, Staphylococcus epidermidis
NFNGAFVHHPKANDFKVIHEVL

SEQ ID NO: 1821947 - protein, 28 aa, Staphylococcus epidermidis
NFRKQHLGFIFQDYSVLPTLTVKENIML

SEQ ID NO: 1821948 - protein, 24 aa, Staphylococcus epidermidis
NFTDYKLFLDSEQIQLPILNELIN

SEQ ID NO: 1821949 - protein, 17 aa, Staphylococcus epidermidis
NGAILPRKSGVSDLPMN

SEQ ID NO: 1821950 - protein, 30 aa, Staphylococcus epidermidis
NGDRLGWIEGINNWNFTLFIQNGRVKDTED

SEQ ID NO: 1821951 - protein, 27 aa, Staphylococcus epidermidis
NGELDNHFPLVIWQTGSGTQSNMNVNE

SEQ ID NO: 1821952 - protein, 17 aa, Staphylococcus epidermidis
NGFIYSSGVGYFKSISE

SEQ ID NO: 1821953 - protein, 24 aa, Staphylococcus epidermidis
NGFKTTFGLIFNHLSWMTNQNQIE

SEQ ID NO: 1821954 - protein, 25 aa, Staphylococcus epidermidis
NGGHHWKSWKPLLGDILLQFLGDPI

SEQ ID NO: 1821955 - protein, 47 aa, Staphylococcus epidermidis
NGLIYYEGYYYISHQWFPLGAVHGLKYWFNYKSKDLLHFEPQGTLLK

SEQ ID NO: 1821956 - protein, 31 aa, Staphylococcus epidermidis; identical to SEQ ID NO: 1682271

SEQ ID NO: 1821957 - protein, 19 aa, Staphylococcus epidermidis
NGYKLLNITIKQIEERAFP

SEQ ID NO: 1821958 - protein, 24 aa, Staphylococcus epidermidis
NHTETLFAHFNIPISIQGKTIQTI

SEQ ID NO: 1821959 - protein, 30 aa, Staphylococcus epidermidis
NIEHRRWGAPFPVIEIVKRGINKARGIKHV

SEQ ID NO: 1821960 - protein, 24 aa, Staphylococcus epidermidis
NIKKAWWQKFITQSPYNVGIDAAI

SEQ ID NO: 1821961 - protein, 17 aa, Staphylococcus epidermidis
NIMAVPAVFLDGQEFGN

SEQ ID NO: 1821962 - protein, 23 aa, Staphylococcus epidermidis
NINYILYVRKQLTDIPMSIEFRH

SEQ ID NO: 1821963 - protein, 18 aa, Staphylococcus epidermidis
NIPYVLNRALENEKNSYI

SEQ ID NO: 1821964 - protein, 18 aa, Staphylococcus epidermidis
NIQHYINYMKKLKYPLSI

SEQ ID NO: 1821965 - protein, 22 aa, Staphylococcus epidermidis
NKKFKMERITHYPSIKVPSSQT

SEQ ID NO: 1821966 - protein, 33 aa, Staphylococcus epidermidis; identical to SEQ ID NO: 1681196

SEQ ID NO: 1821967 - protein, 26 aa, Staphylococcus epidermidis
NKPNSRYMVFYNDDLNLYTKTNINSL

SEQ ID NO: 1821968 - protein, 21 aa, Staphylococcus epidermidis
NKRIQFLNHLAAELGLEDVSF

SEQ ID NO: 1821969 - protein, 23 aa, Staphylococcus epidermidis
NLEYLKGVIWVIDPIDGTLNFVH

SEQ ID NO: 1821970 - protein, 24 aa, Staphylococcus epidermidis
NLNDYRVMLIHPWQYDHTIGEQFE

SEQ ID NO: 1821971 - protein, 39 aa, Staphylococcus epidermidis
NLNSYHFNQLPLFNFKIYQFLDDAYLLLDFHATIFNESQ

SEQ ID NO: 1821972 - protein, 25 aa, Staphylococcus epidermidis
NLRHKYVWSTPFLMRVEENFRPYMH

SEQ ID NO: 1821973 - protein, 30 aa, Staphylococcus epidermidis
NLRQKMGMVFQNFNLFPHKKVIENVMLAPL

SEQ ID NO: 1821974 - protein, 26 aa, Staphylococcus epidermidis
NLVKLNILQEKFGPFLLRECNNIFQK

SEQ ID NO: 1821975 - protein, 27 aa, Staphylococcus epidermidis
NLVPDYLDGLLFDDIPFLKVAQQEHDH

SEQ ID NO: 1821976 - protein, 17 aa, Staphylococcus epidermidis
NMIIFYKNYQKNQLLKS

SEQ ID NO: 1821977 - protein, 19 aa, Staphylococcus epidermidis
NNATLPYAQLLANKGYREA

SEQ ID NO: 1821978 - protein, 26 aa, Staphylococcus epidermidis
NNFETTVFPFILRGASIIGIDSVFTP

SEQ ID NO: 1821979 - protein, 21 aa, Staphylococcus epidermidis
NPFGMVLSLALCLRESLNQND

SEQ ID NO: 1821980 - protein, 22 aa, Staphylococcus epidermidis
NPKPRMYRLLEDDALINRMGFN

SEQ ID NO: 1821981 - protein, 26 aa, Staphylococcus epidermidis
NPLTSQIKRLYPFVFNTLYDSIRQLS

SEQ ID NO: 1821982 - protein, 22 aa, Staphylococcus epidermidis
NQIDYFELLSFLKNLADKYAVE

SEQ ID NO: 1821983 - protein, 20 aa, Staphylococcus epidermidis
NQLDKWYKINELKKLVTFIV

SEQ ID NO: 1821984 - protein, 25 aa, Staphylococcus epidermidis
NQLPRYIEMTIKGKKILFIHYEIEN

SEQ ID NO: 1821985 - protein, 26 aa, Staphylococcus epidermidis
NQPSWMQIMLKFYQLCPRTLEKLCPN

SEQ ID NO: 1821986 - protein, 22 aa, Staphylococcus epidermidis
NQSLMLVTALNPHIGYEKAAQI

SEQ ID NO: 1821987 - protein, 26 aa, Staphylococcus epidermidis
NRGAIPYTVFIDPPLSRVGLIASEAK

SEQ ID NO: 1821988 - protein, 26 aa, Staphylococcus epidermidis
NRKAFRGVELYGKTLGVIGAGRIGLG

SEQ ID NO: 1821989 - protein, 26 aa, Staphylococcus epidermidis
NRLELIHQWINGRMPLIGIGSVFTAE

SEQ ID NO: 1821990 - protein, 19 aa, Staphylococcus epidermidis
NRMCKPDFLLNVALNKSKE

SEQ ID NO: 1821991 - protein, 33 aa, Staphylococcus epidermidis
NRPEHGLLKLRKSLNLFANIRPTFVTKGASHLS

SEQ ID NO: 1821992 - protein, 24 aa, Staphylococcus epidermidis
NRSSIVTILALHGGGIEPATTELA

SEQ ID NO: 1821993 - protein, 25 aa, Staphylococcus epidermidis
NRSTFYRYFQDKYELLYTLPDFITQ

SEQ ID NO: 1821994 - protein, 24 aa, Staphylococcus epidermidis
NSDNKMLQRIYGTAFFDKKDLKAH

SEQ ID NO: 1821995 - protein, 27 aa, Staphylococcus epidermidis
NSKNHWYEWLRHNLTLEGYDVSLFNLE

SEQ ID NO: 1821996 - protein, 25 aa, Staphylococcus epidermidis
NTINAPMVGTFYKSPSPDEEAYVQV

SEQ ID NO: 1821997 - protein, 21 aa, Staphylococcus epidermidis
NTVITSCWIYEKGDAIPSTIP

SEQ ID NO: 1821998 - protein, 17 aa, Staphylococcus epidermidis
NVIRPDIVLYGEMLNQK

SEQ ID NO: 1821999 - protein, 28 aa, Staphylococcus epidermidis
NVSWQRCQVHFLRNIFTTIPKKNSKSFR

SEQ ID NO: 1822000 - protein, 23 aa, Staphylococcus epidermidis
PADKPLQGYKKMNPMVFCGLFPI

SEQ ID NO: 1822001 - protein, 26 aa, Staphylococcus epidermidis
PAEAEALSHRLLLKAGLIKQSTSGIY

SEQ ID NO: 1822002 - protein, 28 aa, Staphylococcus epidermidis
PALNGSILPGITRKSIIQLAEDLGYEVE

SEQ ID NO: 1822003 - protein, 18 aa, Staphylococcus epidermidis
PAQYTLVTCNPPYFKMNQ

SEQ ID NO: 1822004 - protein, 21 aa, Staphylococcus epidermidis
PATEWLKDKIDLGKKGIININ

SEQ ID NO: 1822005 - protein, 24 aa, Staphylococcus epidermidis
PDDKRIMQDIFIPKGQNLGAVDGH

SEQ ID NO: 1822006 - protein, 17 aa, Staphylococcus epidermidis
PDDSFILETLLFTDIIT

SEQ ID NO: 1822007 - protein, 28 aa, Staphylococcus epidermidis
PDKDSEHYGLWAFKRVWGTYLSEKIGEF

SEQ ID NO: 1822008 - protein, 27 aa, Staphylococcus epidermidis
PEGIYLSGALLMFAGNKSYYLYGASSN

SEQ ID NO: 1822009 - protein, 24 aa, Staphylococcus epidermidis
PERPTTLDYIPYIFDSFIELHGDR

SEQ ID NO: 1822010 - protein, 25 aa, Staphylococcus epidermidis
PEYDSTFVKDLFEKVIRHVGEDYLT

SEQ ID NO: 1822011 - protein, 18 aa, Staphylococcus epidermidis
PFIKKMHHAGLFASISVG

SEQ ID NO: 1822012 - protein, 17 aa, Staphylococcus epidermidis
PFREPLTPDLDRVDLLT

SEQ ID NO: 1822013 - protein, 24 aa, Staphylococcus epidermidis
PGAEGLIFHPYLAGERAPLWNADA

SEQ ID NO: 1822014 - protein, 17 aa, Staphylococcus epidermidis
PGLIRFKLQVIPKKISF

SEQ ID NO: 1822015 - protein, 25 aa, Staphylococcus epidermidis
PHRGPIHFNLPFREPLTPDLDRVDL

SEQ ID NO: 1822016 - protein, 17 aa, Staphylococcus epidermidis
PIDIEEFKKIILKTIFG

SEQ ID NO: 1822017 - protein, 27 aa, Staphylococcus epidermidis
PIVMPRLRITYLYARTKKLLKQYNLSI

SEQ ID NO: 1822018 - protein, 18 aa, Staphylococcus epidermidis
PKEIFGDDYTFLPKNELL

SEQ ID NO: 1822019 - protein, 19 aa, Staphylococcus epidermidis
PKGKKIVAILTGNGLKDPD

SEQ ID NO: 1822020 - protein, 26 aa, Staphylococcus epidermidis
PKSAARERIFISPLARNMAEDKGLDI

SEQ ID NO: 1822021 - protein, 18 aa, Staphylococcus epidermidis
PKSVTPFDIHLITINPKK

SEQ ID NO: 1822022 - protein, 24 aa, Staphylococcus epidermidis
PLCVKIGMELFYQTGPALIKSIKK

SEQ ID NO: 1822023 - protein, 28 aa, Staphylococcus epidermidis
PLDEIVKTMIFKIDGEFIMFLVRGHHEL

SEQ ID NO: 1822024 - protein, 25 aa, Staphylococcus epidermidis
PLINKYIKMQSAQLAKIPLIGVGSI

SEQ ID NO: 1822025 - protein, 30 aa, Staphylococcus epidermidis
PLPVEHQVLIIFALTKGYLDDIPVQDINRF

SEQ ID NO: 1822026 - protein, 31 aa, Staphylococcus epidermidis
PNHSKFLGIGLRLIPKPLRDLGYRLFANNRD

SEQ ID NO: 1822027 - protein, 25 aa, Staphylococcus epidermidis
PPSVKKEHWGFDDPAGKPWSEFQRV

SEQ ID NO: 1822028 - protein, 24 aa, Staphylococcus epidermidis
PQNFKHLYELKQPLEAKIETIVKE

SEQ ID NO: 1822029 - protein, 28 aa, Staphylococcus epidermidis
PQPPSEDFAFYALERPSTFIYSGAAPED

SEQ ID NO: 1822030 - protein, 27 aa, Staphylococcus epidermidis
PRVKFEKVFADHFLKLYDKTKNRQFDE

SEQ ID NO: 1822031 - protein, 28 aa, Staphylococcus epidermidis
PSDETVLRFITFKLIPLLNQTHGKKKPI

SEQ ID NO: 1822032 - protein, 21 aa, Staphylococcus epidermidis
PSIDYIIFTDGFEISGLNRAK

SEQ ID NO: 1822033 - protein, 31 aa, Staphylococcus epidermidis
PTSFHDKYEWLLEYFPFLDPQHFVFCGRKNI

SEQ ID NO: 1822034 - protein, 21 aa, Staphylococcus epidermidis
PVTIISVFRGADSPYFELHSA

SEQ ID NO: 1822035 - protein, 18 aa, Staphylococcus epidermidis
PVYNSFGMTETCSQFLTA

SEQ ID NO: 1822036 - protein, 20 aa, Staphylococcus epidermidis
PYNDIRMWDYKSLPSVFGGD

SEQ ID NO: 1822037 - protein, 18 aa, Staphylococcus epidermidis
PYQHVFQAVVYISGQKVN

SEQ ID NO: 1822038 - protein, 20 aa, Staphylococcus epidermidis
PYRQHLIPEFNQVRKLSRQH

SEQ ID NO: 1822039 - protein, 17 aa, Staphylococcus epidermidis
QALFPDFTHLYLVVDAE

SEQ ID NO: 1822040 - protein, 20 aa, Staphylococcus epidermidis
QARDFYLKLGYSPFGKVFLE

SEQ ID NO: 1822041 - protein, 23 aa, Staphylococcus epidermidis
QDIQRIEHMIRNALIIEDNGDNN

SEQ ID NO: 1822042 - protein, 25 aa, Staphylococcus epidermidis
QDVKLTVTTLLAKAVVLALKEYGAM

SEQ ID NO: 1822043 - protein, 23 aa, Staphylococcus epidermidis
QDVMDTLKPIWYTDAELLINDLI

SEQ ID NO: 1822044 - protein, 22 aa, Staphylococcus epidermidis
QEIFFLMDLHYENDKFHPESKL

SEQ ID NO: 1822045 - protein, 30 aa, Staphylococcus epidermidis
QEKDRLLPGGYLFLSDLVGNPSLLNKVGKL

SEQ ID NO: 1822046 - protein, 25 aa, Staphylococcus epidermidis
QEKNYQALHYISEGTDLIVGLPKGH

SEQ ID NO: 1822047 - protein, 25 aa, Staphylococcus epidermidis
QEMALLPEYGLNVKIVLINNGTLGM

SEQ ID NO: 1822048 - protein, 18 aa, Staphylococcus epidermidis
QEVANGLIKIITYAPEVD

SEQ ID NO: 1822049 - protein, 26 aa, Staphylococcus epidermidis
QEVPRKLFLLSPLLDATLTNPNITKT

SEQ ID NO: 1822050 - protein, 24 aa, Staphylococcus epidermidis
QFKTQDRVLIIFGPEGGLSDSEIS

SEQ ID NO: 1822051 - protein, 35 aa, Staphylococcus epidermidis
QFNGQTFLETFLAPTKLYVKPILELKKHIDIKAMS

SEQ ID NO: 1822052 - protein, 29 aa, Staphylococcus epidermidis
QFTGDTIEHLWRVTSLNQAITLGIDDIKG

SEQ ID NO: 1822053 - protein, 27 aa, Staphylococcus epidermidis
QHKNGHKSAVIWFTGLSGSGKSTVSVA

SEQ ID NO: 1822054 - protein, 17 aa, Staphylococcus epidermidis
QHYFLCHDILEDAWKSQ

SEQ ID NO: 1822055 - protein, 26 aa, Staphylococcus epidermidis
QIEIDIAFTSLLTRALETTQYILAGS

SEQ ID NO: 1822056 - protein, 26 aa, Staphylococcus epidermidis
QIHLNQYDYLIKRYLLNIERENDISM

SEQ ID NO: 1822057 - protein, 17 aa, Staphylococcus epidermidis
QIIGSMIVLYKESEENK

SEQ ID NO: 1822058 - protein, 18 aa, Staphylococcus epidermidis
QIKALKRGPQIVVGTPGR

SEQ ID NO: 1822059 - protein, 29 aa, Staphylococcus epidermidis
QINELLHTLSPNQQVWLSGYLMANQQSNT

SEQ ID NO: 1822060 - protein, 17 aa, Staphylococcus epidermidis
QIRSYVFHPYSMIKDHR

SEQ ID NO: 1822061 - protein, 24 aa, Staphylococcus epidermidis
QKHVYAIGDLIKGYQLAHAASAHG

SEQ ID NO: 1822062 - protein, 28 aa, Staphylococcus epidermidis
QLDHSKIYYKWLAQLSEALESGEIFNYF

SEQ ID NO: 1822063 - protein, 19 aa, Staphylococcus epidermidis
QLDYLLPRLHGHGKSLSRL

SEQ ID NO: 1822064 - protein, 21 aa, Staphylococcus epidermidis
QLKINLRDFFPFIEIKEVNEM

SEQ ID NO: 1822065 - protein, 18 aa, Staphylococcus epidermidis
QLLYGFINEEEKEMFLSL

SEQ ID NO: 1822066 - protein, 23 aa, Staphylococcus epidermidis
QLNQCANLLAYRLRLNHQIEPND

SEQ ID NO: 1822067 - protein, 24 aa, Staphylococcus epidermidis
QLNQPYVFVGFHIEKIKHLLDSDI

SEQ ID NO: 1822068 - protein, 26 aa, Staphylococcus epidermidis
QLNTRIIIVTTFKRPGYFEKAVANDV

SEQ ID NO: 1822069 - protein, 23 aa, Staphylococcus epidermidis
QLPDIQYYPISSGKLRRYLSFEN

SEQ ID NO: 1822070 - protein, 24 aa, Staphylococcus epidermidis
QLQYYLEQFTYLHQLVLEDSRHIV

SEQ ID NO: 1822071 - protein, 29 aa, Staphylococcus epidermidis
QLSSVIQPLYDIGAVGMRLLTKYMNDEEI

SEQ ID NO: 1822072 - protein, 24 aa, Staphylococcus epidermidis
QLYDTYIGLWIDGLDEIEIREIVN

SEQ ID NO: 1822073 - protein, 18 aa, Staphylococcus epidermidis
QMELEFFCKPGEEIEWQN

SEQ ID NO: 1822074 - protein, 27 aa, Staphylococcus epidermidis
QNDILGIPSFLIFKEGQLLGSYIGKER

SEQ ID NO: 1822075 - protein, 17 aa, Staphylococcus epidermidis
QNVFLLTEYIQKGNKNK

SEQ ID NO: 1822076 - protein, 18 aa, Staphylococcus epidermidis
QPLTFPLMSLIVSGGHTE

SEQ ID NO: 1822077 - protein, 21 aa, Staphylococcus epidermidis
QQFQTFINLLKTFTFTVDGTL

SEQ ID NO: 1822078 - protein, 25 aa, Staphylococcus epidermidis
QRERDITLLFIAHDLSMVKYISDRI

SEQ ID NO: 1822079 - protein, 23 aa, Staphylococcus epidermidis
QSFPTLEVFNWLQKQGNISTNEM

SEQ ID NO: 1822080 - protein, 29 aa, Staphylococcus epidermidis
QSKFNQIYFARVPILDGLSIITSQKAMQS

SEQ ID NO: 1822081 - protein, 21 aa, Staphylococcus epidermidis
QSLLKAYPYMLSGGMLQRMMI

SEQ ID NO: 1822082 - protein, 23 aa, Staphylococcus epidermidis
QSTAILTGNFLLAMGLKHLSEIS

SEQ ID NO: 1822083 - protein, 24 aa, Staphylococcus epidermidis
QSVIQKVFTLPQNFTIVALTATAT

SEQ ID NO: 1822084 - protein, 28 aa, Staphylococcus epidermidis
QSVVPLKILQDAYGLKRVAYTTYQAVSG

SEQ ID NO: 1822085 - protein, 23 aa, Staphylococcus epidermidis
QTALKYLLPTIGVLGFGHCYHYP

SEQ ID NO: 1822086 - protein, 23 aa, Staphylococcus epidermidis
QTKLRRQYLEEFRKGFKQQIENT

SEQ ID NO: 1822087 - protein, 20 aa, Staphylococcus epidermidis
QTLIKRKYPDYLFTSQIIKE

SEQ ID NO: 1822088 - protein, 24 aa, Staphylococcus epidermidis
QTMNRPRILTLEEALQFINDDELV

SEQ ID NO: 1822089 - protein, 21 aa, Staphylococcus epidermidis
QTYDVFLLGYSMGGRVALYYA

SEQ ID NO: 1822090 - protein, 23 aa, Staphylococcus epidermidis
QVASMSDHHLLISKASNADRTTT

SEQ ID NO: 1822091 - protein, 18 aa, Staphylococcus epidermidis
QVKSLMKDYLTPVSDDIV

SEQ ID NO: 1822092 - protein, 17 aa, Staphylococcus epidermidis
QVLAPMYKGNAGIKRLN

SEQ ID NO: 1822093 - protein, 22 aa, Staphylococcus epidermidis
QVLPMEDINLHFNGDFHAITTA

SEQ ID NO: 1822094 - protein, 20 aa, Staphylococcus epidermidis
QVVNLFHRKGPFENTVIKET

SEQ ID NO: 1822095 - protein, 18 aa, Staphylococcus epidermidis
QYLKLPKKDLHQLNMSKE

SEQ ID NO: 1822096 - protein, 18 aa, Staphylococcus epidermidis
RADFDALPIKEETELPYA

SEQ ID NO: 1822097 - protein, 17 aa, Staphylococcus epidermidis
RAELYEMLTEREMEILL

SEQ ID NO: 1822098 - protein, 25 aa, Staphylococcus epidermidis
RAMHKPHETWAPKLILRAVLGQMST

SEQ ID NO: 1822099 - protein, 32 aa, Staphylococcus epidermidis; identical to SEQ ID NO: 1688711

SEQ ID NO: 1822100 - protein, 25 aa, Staphylococcus epidermidis
RAWHSAPRPIPLPNQTKNLLFHFDD

SEQ ID NO: 1822101 - protein, 17 aa, Staphylococcus epidermidis
RDMMDVKIYVDTDADLR

SEQ ID NO: 1822102 - protein, 25 aa, Staphylococcus epidermidis
RDNLQLFVVIGQLNQLIKGGRISKT

SEQ ID NO: 1822103 - protein, 26 aa, Staphylococcus epidermidis
RDQDAATHLPYIYLSAGVSAELFQDT

SEQ ID NO: 1822104 - protein, 26 aa, Staphylococcus epidermidis
RDVTGKWSWLAPPLSPTLTSNYHHGY

SEQ ID NO: 1822105 - protein, 24 aa, Staphylococcus epidermidis
REIMEKFQHWLQEPSLHDTIQDAI

SEQ ID NO: 1822106 - protein, 26 aa, Staphylococcus epidermidis
RELLDSYFDLIINYFKQINNIDEIHF

SEQ ID NO: 1822107 - protein, 29 aa, Staphylococcus epidermidis
REQHIDLIDMVVVNLYPFQQTVAQPDVTE

SEQ ID NO: 1822108 - protein, 23 aa, Staphylococcus epidermidis
RFDLSFDRKFEAFLVPTVIGEIK

SEQ ID NO: 1822109 - protein, 24 aa, Staphylococcus epidermidis
RGERLKFYKEHFTDWTYFQIKLVI

SEQ ID NO: 1822110 - protein, 20 aa, Staphylococcus epidermidis
RGLFIGIELHESARPYCEAL

SEQ ID NO: 1822111 - protein, 18 aa, Staphylococcus epidermidis
RGLGSSASALVGALFIAN

SEQ ID NO: 1822112 - protein, 21 aa, Staphylococcus epidermidis
RGRKTLLFGPMKPVGLEDPKT

SEQ ID NO: 1822113 - protein, 18 aa, Staphylococcus epidermidis
RHIRKEVGIVFQFPESQL

SEQ ID NO: 1822114 - protein, 31 aa, Staphylococcus epidermidis
RIKDGTMILKPLFRDYLLKLAEENQIAYQYY

SEQ ID NO: 1822115 - protein, 25 aa, Staphylococcus epidermidis
RIVGNKKIILVANKIDLLPKQINHR

SEQ ID NO: 1822116 - protein, 23 aa, Staphylococcus epidermidis
RIVQALPTIEYIIEQGGKLVLFS

SEQ ID NO: 1822117 - protein, 17 aa, Staphylococcus epidermidis
RKIKFVKVLKQTLIIEI

SEQ ID NO: 1822118 - protein, 26 aa, Staphylococcus epidermidis
RKKDTYFVTHGFGSIAALKFLEETHH

SEQ ID NO: 1822119 - protein, 17 aa, Staphylococcus epidermidis
RKYDVLLICDEVAVGFG

SEQ ID NO: 1822120 - protein, 27 aa, Staphylococcus epidermidis
RLIERGVIEIAPLAYMRGRTLDDAFVI

SEQ ID NO: 1822121 - protein, 27 aa, Staphylococcus epidermidis
RLKNHFEIPFNQYCKHEFVLSGTLQKQ

SEQ ID NO: 1822122 - protein, 28 aa, Staphylococcus epidermidis
RLTGVQFLELFTDDLYFDISRHAIKMAE

SEQ ID NO: 1822123 - protein, 19 aa, Staphylococcus epidermidis
RNAFDLTIAVLLSAQCTDN

SEQ ID NO: 1822124 - protein, 18 aa, Staphylococcus epidermidis
RPDLPASTIANYIRRDIY

SEQ ID NO: 1822125 - protein, 31 aa, Staphylococcus epidermidis; identical to SEQ ID NO: 1680689

SEQ ID NO: 1822126 - protein, 21 aa, Staphylococcus epidermidis
RPQDLIFLSDMKKEFEKSVTA

SEQ ID NO: 1822127 - protein, 17 aa, Staphylococcus epidermidis
RPQIISGTHAITLALQS

SEQ ID NO: 1822128 - protein, 24 aa, Staphylococcus epidermidis
RQLEAMLIVMNKDAILIVSGTGEV

SEQ ID NO: 1822129 - protein, 25 aa, Staphylococcus epidermidis
RQNPSPYMYYINKDVPIVIGSSPES

SEQ ID NO: 1822130 - protein, 17 aa, Staphylococcus epidermidis
RQTAAYGHFGRTDVLLP

SEQ ID NO: 1822131 - protein, 17 aa, Staphylococcus epidermidis
RSKLRKALPEQYVYIIE

SEQ ID NO: 1822132 - protein, 24 aa, Staphylococcus epidermidis
RSRAQIFELYPLDQDDIRLALDRA

SEQ ID NO: 1822133 - protein, 20 aa, Staphylococcus epidermidis
RSYYNLEKLYQDAPIKEYGQ

SEQ ID NO: 1822134 - protein, 21 aa, Staphylococcus epidermidis
RTLVSLLHQLSDAKPTGVASL

SEQ ID NO: 1822135 - protein, 24 aa, Staphylococcus epidermidis
RTNAILLPHVIRYNAKDPQKHALF

SEQ ID NO: 1822136 - protein, 19 aa, Staphylococcus epidermidis
RVSPKLPILKKGRQYQFQF

SEQ ID NO: 1822137 - protein, 18 aa, Staphylococcus epidermidis
RWSRLELGQFILGGKRYS

SEQ ID NO: 1822138 - protein, 18 aa, Staphylococcus epidermidis
RYFLDKIVTQVYDVALGN

SEQ ID NO: 1822139 - protein, 19 aa, Staphylococcus epidermidis
RYQINQQRFTLVFINNIEI

SEQ ID NO: 1822140 - protein, 25 aa, Staphylococcus epidermidis
RYSYKMKHLYYLRISTLPLSLGNES

SEQ ID NO: 1822141 - protein, 19 aa, Staphylococcus epidermidis
SAVDLVVELPLIGSLSSSD

SEQ ID NO: 1822142 - protein, 19 aa, Staphylococcus epidermidis
SDIPLARGLGSSASALVGA

SEQ ID NO: 1822143 - protein, 24 aa, Staphylococcus epidermidis
SEEMRLIYVALTRAKEQLILVGRV

SEQ ID NO: 1822144 - protein, 18 aa, Staphylococcus epidermidis
SEFPQFFERAPFAREGED

SEQ ID NO: 1822145 - protein, 25 aa, Staphylococcus epidermidis
SELSYAANFLYMLRGELPTEVEVEA

SEQ ID NO: 1822146 - protein, 27 aa, Staphylococcus epidermidis
SENDLTVISIFVNPLQFGPNEDFDAYP

SEQ ID NO: 1822147 - protein, 26 aa, Staphylococcus epidermidis
SENLRNLLLQPPMKGKQILGVDPAFR

SEQ ID NO: 1822148 - protein, 24 aa, Staphylococcus epidermidis
SERIVQHIKYYFNLTNDRPNHFEF

SEQ ID NO: 1822149 - protein, 18 aa, Staphylococcus epidermidis
SETQSIDLYFTSLSHRTI

SEQ ID NO: 1822150 - protein, 31 aa, Staphylococcus epidermidis
SFDALLEQHAVAYFTLFTSSMQVPLQHIIKF

SEQ ID NO: 1822151 - protein, 18 aa, Staphylococcus epidermidis
SFLGAELLKKTLPSIIDN

SEQ ID NO: 1822152 - protein, 18 aa, Staphylococcus epidermidis
SFQTEMFFLCNRYKQIRD

SEQ ID NO: 1822153 - protein, 21 aa, Staphylococcus epidermidis
SFYVPKYYVDMAKLAEARQVD

SEQ ID NO: 1822154 - protein, 18 aa, Staphylococcus epidermidis
SGAFMKTLDDAEALAHAM

SEQ ID NO: 1822155 - protein, 24 aa, Staphylococcus epidermidis
SGYRSYHVIIKYPIETLSGQKHIL

SEQ ID NO: 1822156 - protein, 17 aa, Staphylococcus epidermidis
SHSFIQTLVLGISGGQD

SEQ ID NO: 1822157 - protein, 21 aa, Staphylococcus epidermidis
SHSSIPFLGQNAIKPLLEFIQ

SEQ ID NO: 1822158 - protein, 32 aa, Staphylococcus epidermidis
SIDLYFTSLSHRTIVYKGWLRSDQIKGLYLDL

SEQ ID NO: 1822159 - protein, 24 aa, Staphylococcus epidermidis
SIGVDLLVIRHSQNSYYEELDQLN

SEQ ID NO: 1822160 - protein, 21 aa, Staphylococcus epidermidis
SIHYIATVVSVYRKVIDAYAE

SEQ ID NO: 1822161 - protein, 17 aa, Staphylococcus epidermidis
SIISRYAFVKHMDHISK

SEQ ID NO: 1822162 - protein, 18 aa, Staphylococcus epidermidis
SIQDYILEYCNFGCPYFV

SEQ ID NO: 1822163 - protein, 19 aa, Staphylococcus epidermidis
SIQNGVIVTIFPDGSDRYM

SEQ ID NO: 1822164 - protein, 23 aa, Staphylococcus epidermidis
SIQRLMGIIISENLVECVKMSEE

SEQ ID NO: 1822165 - protein, 24 aa, Staphylococcus epidermidis
SIRYYNNHLVLVKYNEKSICKLKY

SEQ ID NO: 1822166 - protein, 39 aa, Staphylococcus epidermidis
SKGFKPYMEASQKNQFPWVVAAFPTRDWARRVYPELDVE

SEQ ID NO: 1822167 - protein, 22 aa, Staphylococcus epidermidis
SKIKEFKLLSTAGAYWRGNSDN

SEQ ID NO: 1822168 - protein, 25 aa, Staphylococcus epidermidis
SKLPDSINFIAWLQHLQDSGITDDL

SEQ ID NO: 1822169 - protein, 32 aa, Staphylococcus epidermidis
SLGHRKNILNTHFDYLGVGVYFNDRRQPFWTE

SEQ ID NO: 1822170 - protein, 28 aa, Staphylococcus epidermidis
SLKGALFTSLLLEKINMKTSPKYNVYRT

SEQ ID NO: 1822171 - protein, 26 aa, Staphylococcus epidermidis
SLNDDQLVMLKLTIPTEANLYKDLAD

SEQ ID NO: 1822172 - protein, 25 aa, Staphylococcus epidermidis
SLSGHKFNGLKGQGLLLLKNIQNIE

SEQ ID NO: 1822173 - protein, 21 aa, Staphylococcus epidermidis
SLTELQILKLLFQNENKYVSR

SEQ ID NO: 1822174 - protein, 29 aa, Staphylococcus epidermidis
SNGKQLLKKLNAFGYTEDDVRKALFEEEE

SEQ ID NO: 1822175 - protein, 27 aa, Staphylococcus epidermidis
SNHVTLPQLFSDILIYCTERNVMLVDL

SEQ ID NO: 1822176 - protein, 20 aa, Staphylococcus epidermidis
SPEFTYLNHSFKSSEVPSAI

SEQ ID NO: 1822177 - protein, 18 aa, Staphylococcus epidermidis
SPELFFQKGDYKGKSNMI

SEQ ID NO: 1822178 - protein, 20 aa, Staphylococcus epidermidis
SPLCLFCPIQEHCEAFHMGT

SEQ ID NO: 1822179 - protein, 20 aa, Staphylococcus epidermidis
SPQSLPFIKFDHKQILSSDD

SEQ ID NO: 1822180 - protein, 19 aa, Staphylococcus epidermidis
SQEHQIILDFYKDKNITDV

SEQ ID NO: 1822181 - protein, 25 aa, Staphylococcus epidermidis
SQPIFNDIEWIIVSLGSEGAFAKHN

SEQ ID NO: 1822182 - protein, 21 aa, Staphylococcus epidermidis
SQSPMLLKNSRFGFKMGNQTL

SEQ ID NO: 1822183 - protein, 24 aa, Staphylococcus epidermidis
SRLDDLILMQLIHSPSYSSYVQDL

SEQ ID NO: 1822184 - protein, 25 aa, Staphylococcus epidermidis
SRRKIKRELYDTRGFLSCVRVLSTD

SEQ ID NO: 1822185 - protein, 24 aa, Staphylococcus epidermidis
SSEWYQENLGFKSIFKFKNEQNQI

SEQ ID NO: 1822186 - protein, 31 aa, Staphylococcus epidermidis
SSFKSYLFIRLKFYLIDLFRQKDNTLNICSI

SEQ ID NO: 1822187 - protein, 22 aa, Staphylococcus epidermidis
SSHIHVVIACYYGLGISTLLAE

SEQ ID NO: 1822188 - protein, 20 aa, Staphylococcus epidermidis
STINPKFLNVESLIQYIQSA

SEQ ID NO: 1822189 - protein, 24 aa, Staphylococcus epidermidis
STKYPILSQAIILSPLLTNTYLSY

SEQ ID NO: 1822190 - protein, 24 aa, Staphylococcus epidermidis
STLLKVILGLLPIQKGEIIVDGKP

SEQ ID NO: 1822191 - protein, 28 aa, Staphylococcus epidermidis
STVVVVPDYQLSLAIGKRGQNARLAAKL

SEQ ID NO: 1822192 - protein, 20 aa, Staphylococcus epidermidis
SVNGACLTVIDFTDSSFSVQ

SEQ ID NO: 1822193 - protein, 19 aa, Staphylococcus epidermidis
SYDLYYDGQQFYQLTTDMF

SEQ ID NO: 1822194 - protein, 21 aa, Staphylococcus epidermidis
SYGIRILEVPLKTGLVAEIGQ

SEQ ID NO: 1822195 - protein, 20 aa, Staphylococcus epidermidis
SYIQFHLNQQPRPKVKKIKN

SEQ ID NO: 1822196 - protein, 19 aa, Staphylococcus epidermidis
SYSYLIFVQETWSMLHENR

SEQ ID NO: 1822197 - protein, 18 aa, Staphylococcus epidermidis
SYVALYVTYEAAPFFNKE

SEQ ID NO: 1822198 - protein, 19 aa, Staphylococcus epidermidis
TAGDIIRLLEGPITFVESI

SEQ ID NO: 1822199 - protein, 25 aa, Staphylococcus epidermidis
TAGKNVIRLLPPLTITKKQLEKGIE

SEQ ID NO: 1822200 - protein, 18 aa, Staphylococcus epidermidis
TAMTRVFNEYARRINELK

SEQ ID NO: 1822201 - protein, 29 aa, Staphylococcus epidermidis
TAYENGIYRQLNLKRMVRPVRNIRNLTKA

SEQ ID NO: 1822202 - protein, 26 aa, Staphylococcus epidermidis
TDDVRNEFQFLDYAQIAFVSAKEGLR

SEQ ID NO: 1822203 - protein, 18 aa, Staphylococcus epidermidis
TDEGTIILKFFLCLDKDE

SEQ ID NO: 1822204 - protein, 29 aa, Staphylococcus epidermidis
TDETDTYMPLPIFLSHQLAKRLADVRKDE

SEQ ID NO: 1822205 - protein, 24 aa, Staphylococcus epidermidis
TDIEYKFPFGWGELWGIASRTDYD

SEQ ID NO: 1822206 - protein, 25 aa, Staphylococcus epidermidis
TDLMKIANDIRWLASGPRAGLAEIS

SEQ ID NO: 1822207 - protein, 27 aa, Staphylococcus epidermidis
TDQKKLYKFFLLIAKYIKRKEAFYRAT

SEQ ID NO: 1822208 - protein, 25 aa, Staphylococcus epidermidis
TDVELKHHYLWRFAKKMPKSGHIEI

SEQ ID NO: 1822209 - protein, 27 aa, Staphylococcus epidermidis
TEFEIITTMMFLYFGEINPVDFVIIEA

SEQ ID NO: 1822210 - protein, 29 aa, Staphylococcus epidermidis
TENISYEEWLKEINLSLNGAFSVAQTVGR

SEQ ID NO: 1822211 - protein, 22 aa, Staphylococcus epidermidis
TEQFMYTSNLLFYTVDYNHVQS

SEQ ID NO: 1822212 - protein, 24 aa, Staphylococcus epidermidis
TFEEPLVEFFYKKDELNDPLITDD

SEQ ID NO: 1822213 - protein, 23 aa, Staphylococcus epidermidis
TFIAKGVIYPHPPISKVEAAEKE

SEQ ID NO: 1822214 - protein, 26 aa, Staphylococcus epidermidis
TFIRELIFREFYYVLMTNYPETAHVA

SEQ ID NO: 1822215 - protein, 18 aa, Staphylococcus epidermidis
TFLKLYNKVLDYLNQKEE

SEQ ID NO: 1822216 - protein, 19 aa, Staphylococcus epidermidis
TFLNLIEVLGTSASDFFKE

SEQ ID NO: 1822217 - protein, 19 aa, Staphylococcus epidermidis
TFNHPIIQILKENTLNQLK

SEQ ID NO: 1822218 - protein, 19 aa, Staphylococcus epidermidis
TFVIGPGNRFPHAASLAVA

SEQ ID NO: 1822219 - protein, 24 aa, Staphylococcus epidermidis
TGAQAWVGTLLKMKPVLRFEEDGK

SEQ ID NO: 1822220 - protein, 18 aa, Staphylococcus epidermidis
TGVYAERTAPWLERMGFE

SEQ ID NO: 1822221 - protein, 32 aa, Staphylococcus epidermidis
THENSYAMPILLALSHVHQLLIREGLRMETSL

SEQ ID NO: 1822222 - protein, 17 aa, Staphylococcus epidermidis
THMTHQFPNKLYLSVDA

SEQ ID NO: 1822223 - protein, 25 aa, Staphylococcus epidermidis
THPQFVVPTPHRIFDFFNAFIGTHD

SEQ ID NO: 1822224 - protein, 26 aa, Staphylococcus epidermidis
THSETFVIISFKHKVILIGGTEYAGE

SEQ ID NO: 1822225 - protein, 23 aa, Staphylococcus epidermidis
TIADNFNVELPKYGKSYLKEMGV

SEQ ID NO: 1822226 - protein, 22 aa, Staphylococcus epidermidis
TIDCSIILVEGFKEANYDKIIV

SEQ ID NO: 1822227 - protein, 31 aa, Staphylococcus epidermidis
TIHQQQFLNAYYRIFPSYTGVGLAFESMEEI

SEQ ID NO: 1822228 - protein, 25 aa, Staphylococcus epidermidis
TIKGRKTILYFYPRDNTPTCTTEAC

SEQ ID NO: 1822229 - protein, 21 aa, Staphylococcus epidermidis
TILVSTLRLLGAQVGWYIPNR

SEQ ID NO: 1822230 - protein, 17 aa, Staphylococcus epidermidis
TINLPMAISMVRAIKNA

SEQ ID NO: 1822231 - protein, 26 aa, Staphylococcus epidermidis
TISVDNGIWKVIDFQHVKPGKGSAFV

SEQ ID NO: 1822232 - protein, 24 aa, Staphylococcus epidermidis
TKGAFPTWLAPMQVEIIPVNIDLH

SEQ ID NO: 1822233 - protein, 25 aa, Staphylococcus epidermidis
TLAKDIYQEWYLGKALFNQVEYKKD

SEQ ID NO: 1822234 - protein, 18 aa, Staphylococcus epidermidis
TLDPVYKEIIRLIYREEI

SEQ ID NO: 1822235 - protein, 17 aa, Staphylococcus epidermidis
TLKMINRLIPLSEGYIY

SEQ ID NO: 1822236 - protein, 18 aa, Staphylococcus epidermidis
TLMPAIIELKKAYEDAKS

SEQ ID NO: 1822237 - protein, 33 aa, Staphylococcus epidermidis
TLPKANVIKIYFNEGFIALRPSGTEPKIKLYVS

SEQ ID NO: 1822238 - protein, 22 aa, Staphylococcus epidermidis
TLSHNNYIKRLPVSTYRSQNRG

SEQ ID NO: 1822239 - protein, 37 aa, Staphylococcus epidermidis
TLSSNFKMNILIGPLVKLWKIGFKDALKPKEVDIQRA

SEQ ID NO: 1822240 - protein, 18 aa, Staphylococcus epidermidis
TMIRQNLNPVIFVINNDG

SEQ ID NO: 1822241 - protein, 17 aa, Staphylococcus epidermidis
TMKRVAIHFTKLILCNN

SEQ ID NO: 1822242 - protein, 17 aa, Staphylococcus epidermidis
TMTQAHKDLIFSMYGRQ

SEQ ID NO: 1822243 - protein, 23 aa, Staphylococcus epidermidis
TNAKRDWYIWADPKPDGSEPNNW

SEQ ID NO: 1822244 - protein, 27 aa, Staphylococcus epidermidis
TNEVQNLLIPLTFHFSKDEQMIIDQYK

SEQ ID NO: 1822245 - protein, 26 aa, Staphylococcus epidermidis
TNKGDMTFKLFPDIAPKTVENFVTHS

SEQ ID NO: 1822246 - protein, 18 aa, Staphylococcus epidermidis
TNTSYAPWYIVPADHKKT

SEQ ID NO: 1822247 - protein, 20 aa, Staphylococcus epidermidis
TNVIDLAYPGVLPVVNRRAV

SEQ ID NO: 1822248 - protein, 28 aa, Staphylococcus epidermidis
TPAQIVLRWHLAHNRIIIPKSQTPKRIK

SEQ ID NO: 1822249 - protein, 26 aa, Staphylococcus epidermidis
TPENEVLLVKQFRKPADQPLLEIPAG

SEQ ID NO: 1822250 - protein, 17 aa, Staphylococcus epidermidis
TQFGYMWECPDYFRLGN

SEQ ID NO: 1822251 - protein, 23 aa, Staphylococcus epidermidis
TQIAHMIIRYFEDGPIRAHEVSY

SEQ ID NO: 1822252 - protein, 30 aa, Staphylococcus epidermidis
TQVNTVIDYYYRFIHRFPTIQSLSEANEDE

SEQ ID NO: 1822253 - protein, 17 aa, Staphylococcus epidermidis
TQYLIEKGAKTFSLIGG

SEQ ID NO: 1822254 - protein, 17 aa, Staphylococcus epidermidis
TRKKLIHLCKEITFCES

SEQ ID NO: 1822255 - protein, 24 aa, Staphylococcus epidermidis
TRKLDSLVLIDIAVPRDIEPGIDA

SEQ ID NO: 1822256 - protein, 26 aa, Staphylococcus epidermidis
TRKQNLLLNIFRYQINQQRFTLVFIN

SEQ ID NO: 1822257 - protein, 23 aa, Staphylococcus epidermidis
TRLKAEVFCPISHLYYQLTMSQN

SEQ ID NO: 1822258 - protein, 25 aa, Staphylococcus epidermidis
TRQLINDFAYKHQIPWIYGGVVQST

SEQ ID NO: 1822259 - protein, 20 aa, Staphylococcus epidermidis
TRYYLMRELPFGSDGVFTPE

SEQ ID NO: 1822260 - protein, 23 aa, Staphylococcus epidermidis
TSECFSFFISYHFNKFDLGIQQL

SEQ ID NO: 1822261 - protein, 17 aa, Staphylococcus epidermidis
TSLFKLKSALWTLAKDI

SEQ ID NO: 1822262 - protein, 34 aa, Staphylococcus epidermidis
TSNQNFQRIRKGPNIKLPSYQLLEAPEPHEKDQD

SEQ ID NO: 1822263 - protein, 27 aa, Staphylococcus epidermidis
TTGESTLPLIKRLSSKQVRLNVTAVYT

SEQ ID NO: 1822264 - protein, 26 aa, Staphylococcus epidermidis
TTNGRLGFDYLIDNLADDIRAKFLPK

SEQ ID NO: 1822265 - protein, 25 aa, Staphylococcus epidermidis
TVEDTFPFIKHQLITQPKESLHSIY

SEQ ID NO: 1822266 - protein, 18 aa, Staphylococcus epidermidis
TVIQAIGLIQWYEEQKRY

SEQ ID NO: 1822267 - protein, 18 aa, Staphylococcus epidermidis
TVKENIMLPLSVQKFHKY

SEQ ID NO: 1822268 - protein, 24 aa, Staphylococcus epidermidis
TYYNHVHVYDVNWGEAVIVDDFIT

SEQ ID NO: 1822269 - protein, 32 aa, Staphylococcus epidermidis
VAIDFSNPELLFPLLEEQFNLPLVIATTGEKE

SEQ ID NO: 1822270 - protein, 17 aa, Staphylococcus epidermidis
VANSIVSQLLFLQAQDS

SEQ ID NO: 1822271 - protein, 17 aa, Staphylococcus epidermidis
VAQVIKKYQLQAQFIIV

SEQ ID NO: 1822272 - protein, 20 aa, Staphylococcus epidermidis
VATKAGVIGLTKTAARELAS

SEQ ID NO: 1822273 - protein, 25 aa, Staphylococcus epidermidis
VCHKYQIPWVYGAAVGSKGSVYGID

SEQ ID NO: 1822274 - protein, 33 aa, Staphylococcus epidermidis
VDHSRSHHLITTDLFLNVFGIENLDALPTTEED

SEQ ID NO: 1822275 - protein, 18 aa, Staphylococcus epidermidis
VDYLKVKALMMIPKNKKD

SEQ ID NO: 1822276 - protein, 27 aa, Staphylococcus epidermidis
VEAGETIYFILRETPFYAVSGGQVADK

SEQ ID NO: 1822277 - protein, 34 aa, Staphylococcus epidermidis
VEAVRKHFDLRPAGIIKMLDLKQPIYRQTAAYGH

SEQ ID NO: 1822278 - protein, 20 aa, Staphylococcus epidermidis
VEHAIIPDRIEAGTLLIAGA

SEQ ID NO: 1822279 - protein, 25 aa, Staphylococcus epidermidis
VESLDYFLAHLKNWNYSYAYSMRLT

SEQ ID NO: 1822280 - protein, 22 aa, Staphylococcus epidermidis
VFKSFQNLYNKYYKQDFAIIES

SEQ ID NO: 1822281 - protein, 23 aa, Staphylococcus epidermidis
VGMTPLVSMFKKAASLNVPTQMI

SEQ ID NO: 1822282 - protein, 21 aa, Staphylococcus epidermidis
VGVMADLHFAPTYNAAQNLVK

SEQ ID NO: 1822283 - protein, 20 aa, Staphylococcus epidermidis
VIAGFDFTFGKFGKGNMTVL

SEQ ID NO: 1822284 - protein, 17 aa, Staphylococcus epidermidis
VIGLTKTAARELASRGI

SEQ ID NO: 1822285 - protein, 24 aa, Staphylococcus epidermidis
VIHLMSRVRRYPLPLVLEVSNVES

SEQ ID NO: 1822286 - protein, 17 aa, Staphylococcus epidermidis
VIKLVKANDVKKFKYKD

SEQ ID NO: 1822287 - protein, 22 aa, Staphylococcus epidermidis
VINKLNFYVSLGGPVTFKNAKQ

SEQ ID NO: 1822288 - protein, 28 aa, Staphylococcus epidermidis
VIREREHFTIFPASHFVTREEKMKVAIE

SEQ ID NO: 1822289 - protein, 24 aa, Staphylococcus epidermidis
VISRHFKIRNALRAALKALELELL

SEQ ID NO: 1822290 - protein, 22 aa, Staphylococcus epidermidis
VITQDYGLASLLIDKVHTVMHH

SEQ ID NO: 1822291 - protein, 17 aa, Staphylococcus epidermidis
VKAFRQCGFEIDKVVFE

SEQ ID NO: 1822292 - protein, 23 aa, Staphylococcus epidermidis
VKELLFRIKAVLRRYQINADNEL

SEQ ID NO: 1822293 - protein, 17 aa, Staphylococcus epidermidis
VKEPFIFVDSSTQKVLA

SEQ ID NO: 1822294 - protein, 19 aa, Staphylococcus epidermidis
VKFEMPYEEAKSWMLKALE

SEQ ID NO: 1822295 - protein, 26 aa, Staphylococcus epidermidis
VKGGLQFTYISLDDYRIIKSHLFGDG

SEQ ID NO: 1822296 - protein, 35 aa, Staphylococcus epidermidis
VKIQKFPYYNPYSNTLIASWFWSHRPKHIEQAGLK

SEQ ID NO: 1822297 - protein, 18 aa, Staphylococcus epidermidis
VKPIGIKVTRLAQGLSVG

SEQ ID NO: 1822298 - protein, 18 aa, Staphylococcus epidermidis
VLNMLSIEALTVGQITEK

SEQ ID NO: 1822299 - protein, 24 aa, Staphylococcus epidermidis
VLTAYKLMEILEEAGLPQGVVNFV

SEQ ID NO: 1822300 - protein, 31 aa, Staphylococcus epidermidis
VMDFNNLVLVRFFFKSLTAYLKKHNCLYVLV

SEQ ID NO: 1822301 - protein, 19 aa, Staphylococcus epidermidis
VMIGILYQFIVANHLFETN

SEQ ID NO: 1822302 - protein, 18 aa, Staphylococcus epidermidis
VPEPFYLSDQTLVTQIIC

SEQ ID NO: 1822303 - protein, 18 aa, Staphylococcus epidermidis
VPGNMKVMLSPNLQSRFA

SEQ ID NO: 1822304 - protein, 17 aa, Staphylococcus epidermidis
VQNIEVLRFANAMFEPL

SEQ ID NO: 1822305 - protein, 33 aa, Staphylococcus epidermidis; identical to SEQ ID NO: 1700889

SEQ ID NO: 1822306 - protein, 21 aa, Staphylococcus epidermidis
VSDMKGGMSSLFYVLEQLHQA

SEQ ID NO: 1822307 - protein, 23 aa, Staphylococcus epidermidis
VSILKMQLLIWITETNTGDIQEL

SEQ ID NO: 1822308 - protein, 24 aa, Staphylococcus epidermidis
VSQQLHELYLKYQPDIIFIECSGV

SEQ ID NO: 1822309 - protein, 17 aa, Staphylococcus epidermidis
VSRLVKRRTLAKEISDQ

SEQ ID NO: 1822310 - protein, 24 aa, Staphylococcus epidermidis
VSSDFFTMVKWDISGTLNYMKPRE

SEQ ID NO: 1822311 - protein, 17 aa, Staphylococcus epidermidis
VSWKYHDNNIVLGNVVE

SEQ ID NO: 1822312 - protein, 25 aa, Staphylococcus epidermidis
VTAIFPKLVFSIKKGVNFSPEDPNY

SEQ ID NO: 1822313 - protein, 25 aa, Staphylococcus epidermidis
VTEYDIHRMLPHPINIVRVRLTGKQ

SEQ ID NO: 1822314 - protein, 19 aa, Staphylococcus epidermidis
VTQSLLQKGYKFETIQLVM

SEQ ID NO: 1822315 - protein, 23 aa, Staphylococcus epidermidis
VVAAICMYALKTAGYQSALMVPT

SEQ ID NO: 1822316 - protein, 26 aa, Staphylococcus epidermidis
VVANEDTLLILQKYQHVEVALKIDNE

SEQ ID NO: 1822317 - protein, 20 aa, Staphylococcus epidermidis
VVNLLLKLQRERDITLLFIA

SEQ ID NO: 1822318 - protein, 22 aa, Staphylococcus epidermidis
VYGTNWYTYYSNDYNQFLMVSY

SEQ ID NO: 1822319 - protein, 19 aa, Staphylococcus epidermidis
VYVYKLFPEGPITMTLIHE

SEQ ID NO: 1822320 - protein, 21 aa, Staphylococcus epidermidis
WDRYYLENVSIDRLKTILSNH

SEQ ID NO: 1822321 - protein, 18 aa, Staphylococcus epidermidis
WECLIISKTDMLLDGVPK

SEQ ID NO: 1822322 - protein, 24 aa, Staphylococcus epidermidis
WEKDLSMIFVVINNQSKKVSSRSG

SEQ ID NO: 1822323 - protein, 24 aa, Staphylococcus epidermidis
WKRIGRMISIPKFMLKVAIQKYKM

SEQ ID NO: 1822324 - protein, 23 aa, Staphylococcus epidermidis
WNSDTFFSLIKAFELPTNNQIKT

SEQ ID NO: 1822325 - protein, 18 aa, Staphylococcus epidermidis
WQGFVEYHNKKNTQLPQM

SEQ ID NO: 1822326 - protein, 20 aa, Staphylococcus epidermidis
WTTFFEYLKERGLQGTELVI

SEQ ID NO: 1822327 - protein, 22 aa, Staphylococcus epidermidis
YADGEKRYIIAPKGLQVGQTVE

SEQ ID NO: 1822328 - protein, 25 aa, Staphylococcus epidermidis
YAERTAPWLERMGFENVKNVLLNQE

SEQ ID NO: 1822329 - protein, 26 aa, Staphylococcus epidermidis
YANHIIEAFGMKPYIKKKVNKYSMGM

SEQ ID NO: 1822330 - protein, 19 aa, Staphylococcus epidermidis
YAQYGIRINNISPGAIVTE

SEQ ID NO: 1822331 - protein, 18 aa, Staphylococcus epidermidis
YATDFDSSMAWWKELYSD

SEQ ID NO: 1822332 - protein, 24 aa, Staphylococcus epidermidis
YCPNCGRLLQYDYIHYNQIGHYHC

SEQ ID NO: 1822333 - protein, 25 aa, Staphylococcus epidermidis
YDEKHQPILYSLNYIKSSLVKFTIT

SEQ ID NO: 1822334 - protein, 20 aa, Staphylococcus epidermidis
YDGFYWCRKMRQQSNVPILF

SEQ ID NO: 1822335 - protein, 18 aa, Staphylococcus epidermidis
YDKETILTVVNRLRQWIP

SEQ ID NO: 1822336 - protein, 17 aa, Staphylococcus epidermidis
YDKLVELLGDFKAPMGC

SEQ ID NO: 1822337 - protein, 18 aa, Staphylococcus epidermidis
YDLGVKTALWLQTTPLLK

SEQ ID NO: 1822338 - protein, 32 aa, Staphylococcus epidermidis
YDMLFEHGIFVSYLRYPTVSQPTLRISLSYFH

SEQ ID NO: 1822339 - protein, 22 aa, Staphylococcus epidermidis
YEALLTEYGVWHPRAWHSAPRP

SEQ ID NO: 1822340 - protein, 17 aa, Staphylococcus epidermidis
YEAMTERDEAEYVVKEI

SEQ ID NO: 1822341 - protein, 25 aa, Staphylococcus epidermidis
YEDYSFHIVGYINGVPMATARIRPL

SEQ ID NO: 1822342 - protein, 19 aa, Staphylococcus epidermidis
YEEQIYRNLLKDVGYHSVK

SEQ ID NO: 1822343 - protein, 18 aa, Staphylococcus epidermidis
YEFDLKLINEKRPHILDA

SEQ ID NO: 1822344 - protein, 22 aa, Staphylococcus epidermidis
YEGDMFYRDQLLSKIKQAAKHM

SEQ ID NO: 1822345 - protein, 20 aa, Staphylococcus epidermidis
YEIIVLSNRKAEDNKKFVLG

SEQ ID NO: 1822346 - protein, 19 aa, Staphylococcus epidermidis
YEIKHFMTIQLLSDMAGIS

SEQ ID NO: 1822347 - protein, 17 aa, Staphylococcus epidermidis
YEIPLSEVVFDFFDQLK

SEQ ID NO: 1822348 - protein, 26 aa, Staphylococcus epidermidis
YEMLTEREMEILLLIAKGYSNQEIAS

SEQ ID NO: 1822349 - protein, 20 aa, Staphylococcus epidermidis
YENDYVYAFLDISQVSKGHT

SEQ ID NO: 1822350 - protein, 20 aa, Staphylococcus epidermidis
YEPGSTFKTYGLAAAIQEGK

SEQ ID NO: 1822351 - protein, 20 aa, Staphylococcus epidermidis
YEQHLLKLLSSEEVQWIVLA

SEQ ID NO: 1822352 - protein, 18 aa, Staphylococcus epidermidis
YFNVMRYHSLMADPSTIP

SEQ ID NO: 1822353 - protein, 26 aa, Staphylococcus epidermidis
YFPNSNDYILLWKLEVLDTYQRRGYA

SEQ ID NO: 1822354 - protein, 20 aa, Staphylococcus epidermidis
YGDYFPHRLGHGLGLEEHEY

SEQ ID NO: 1822355 - protein, 27 aa, Staphylococcus epidermidis
YGHFGRTDVLLPWEKLDKVNVLKDAVE

SEQ ID NO: 1822356 - protein, 18 aa, Staphylococcus epidermidis
YHTKDKDVLAVDHVDLNI

SEQ ID NO: 1822357 - protein, 31 aa, Staphylococcus epidermidis
YIATTYYNNWLFYYIFAHSFLNQHEKKNSVD

SEQ ID NO: 1822358 - protein, 20 aa, Staphylococcus epidermidis
YKHVLFMRGRDWANQIKERM

SEQ ID NO: 1822359 - protein, 29 aa, Staphylococcus epidermidis
YKNERHLAALSFLTFVALDSDGKPTSVPD

SEQ ID NO: 1822360 - protein, 22 aa, Staphylococcus epidermidis
YKPYIEGFVKMLSPIAPHIGEE

SEQ ID NO: 1822361 - protein, 24 aa, Staphylococcus epidermidis
YKSRDAMQFIKKDSPPILIIHGGK

SEQ ID NO: 1822362 - protein, 32 aa, Staphylococcus epidermidis
YLAKRDFLEMKPLYEWLGLSVSLGFVDIPEYE

SEQ ID NO: 1822363 - protein, 17 aa, Staphylococcus epidermidis
YLKDRNFNIEFITKLEG

SEQ ID NO: 1822364 - protein, 27 aa, Staphylococcus epidermidis
YLKEHSNIPYVIDPVMLAKSGDSLMDE

SEQ ID NO: 1822365 - protein, 17 aa, Staphylococcus epidermidis
YLPNWNTISAKVLEKTK

SEQ ID NO: 1822366 - protein, 21 aa, Staphylococcus epidermidis
YMKKLKYPLSIIKQLHFEDTY

SEQ ID NO: 1822367 - protein, 28 aa, Staphylococcus epidermidis
YMNSLYDKPLPENYFLQNADDYLQILEQ

SEQ ID NO: 1822368 - protein, 26 aa, Staphylococcus epidermidis
YNERNNLRLIYHALRNPYLSPDRKKK

SEQ ID NO: 1822369 - protein, 20 aa, Staphylococcus epidermidis
YNIAYTLYNDLKDPEIPIRL

SEQ ID NO: 1822370 - protein, 18 aa, Staphylococcus epidermidis
YPCKNCTRIIPFSSISYL

SEQ ID NO: 1822371 - protein, 22 aa, Staphylococcus epidermidis
YPKSADIFRNAGIDFCCGGQES

SEQ ID NO: 1822372 - protein, 18 aa, Staphylococcus epidermidis
YPLSIIKQLHFEDTYHFM

SEQ ID NO: 1822373 - protein, 25 aa, Staphylococcus epidermidis
YQIPQSQHFLPSQANFVFVKTSRSQ

SEQ ID NO: 1822374 - protein, 39 aa, Staphylococcus epidermidis
YQQQYFDLVRMIHLSLRAKYLFKYNLDYFIFDGEIVLID

SEQ ID NO: 1822375 - protein, 25 aa, Staphylococcus epidermidis
YRASQNLLYPLYKKGKFVSIQMYNA

SEQ ID NO: 1822376 - protein, 21 aa, Staphylococcus epidermidis
YSERQGGYTRILKVGPRRGDG

SEQ ID NO: 1822377 - protein, 18 aa, Staphylococcus epidermidis
YSGFAFGMGPDRIAMLKY

SEQ ID NO: 1822378 - protein, 24 aa, Staphylococcus epidermidis
YSIDDIHVSTLLKQAIHHAKHPSE

SEQ ID NO: 1822379 - protein, 41 aa, Staphylococcus epidermidis
YSLTIITNCLPVFNILIKKQTLHFRVYLLGGEMRDLTEAFV

SEQ ID NO: 1822380 - protein, 17 aa, Staphylococcus epidermidis
YSRIFKRVGINARPVVA

SEQ ID NO: 1822381 - protein, 20 aa, Staphylococcus epidermidis
YVFGDGIYEYIRAYDGKLFT

SEQ ID NO: 1822382 - protein, 28 aa, Staphylococcus epidermidis
YVISGHYRNGILLSPIIGRDIANWLLSG

SEQ ID NO: 1822383 - protein, 29 aa, Staphylococcus epidermidis
YYAVNFEEQYWDKVFTYFLDEYKKGRTPN

SEQ ID NO: 1822384 - protein, 30 aa, Staphylococcus epidermidis
AAKAQSMKFFQLYTPLLKKGGIVVTDNVLY

SEQ ID NO: 1822385 - protein, 20 aa, Staphylococcus epidermidis
AALALLRLYHQDHNDKWLEV

SEQ ID NO: 1822386 - protein, 26 aa, Staphylococcus epidermidis
AASSYQKIFNYFKPNFLLGMTATPER

SEQ ID NO: 1822387 - protein, 24 aa, Staphylococcus epidermidis
AAVQIHHLLGIQPFARCFEMKEAC

SEQ ID NO: 1822388 - protein, 28 aa, Staphylococcus epidermidis
AEGFEGYFMMKRMNAPFILIADPRIEGG

SEQ ID NO: 1822389 - protein, 20 aa, Staphylococcus epidermidis
AFVGALYLDQGLDSVWTFAE

SEQ ID NO: 1822390 - protein, 24 aa, Staphylococcus epidermidis
AGASIILLIVNILSDDQLKELYSY

SEQ ID NO: 1822391 - protein, 25 aa, Staphylococcus epidermidis
AGGMGTALIAFLNAELRPGIDVVLE

SEQ ID NO: 1822392 - protein, 27 aa, Staphylococcus epidermidis
AGRDVTIFCTFWGLNALKKIQSQRIKK

SEQ ID NO: 1822393 - protein, 31 aa, Staphylococcus epidermidis
AHLVENIRFATILLQPFLTHAPREIFKQLNI

SEQ ID NO: 1822394 - protein, 23 aa, Staphylococcus epidermidis
AIDWVIIGPEQPLIDGLADLLRN

SEQ ID NO: 1822395 - protein, 20 aa, Staphylococcus epidermidis
AILGMHSIITRPIAVDKDTI

SEQ ID NO: 1822396 - protein, 17 aa, Staphylococcus epidermidis
AINEIFDILSIEGIIIL

SEQ ID NO: 1822397 - protein, 31 aa, Staphylococcus epidermidis
AITVPQDRLKLRKQIRQLAAIYLATGIDPDK

SEQ ID NO: 1822398 - protein, 18 aa, Staphylococcus epidermidis
AKPLLKVFRLENELKVFP

SEQ ID NO: 1822399 - protein, 17 aa, Staphylococcus epidermidis
AKYQNIIENLLGNTIIV

SEQ ID NO: 1822400 - protein, 23 aa, Staphylococcus epidermidis
ALEILNLVGLPRAEKRFKAYPHQ

SEQ ID NO: 1822401 - protein, 18 aa, Staphylococcus epidermidis
ALEQLGINTLYCSAIPTG

SEQ ID NO: 1822402 - protein, 17 aa, Staphylococcus epidermidis
ALFILGETLYNFGLTPQ

SEQ ID NO: 1822403 - protein, 19 aa, Staphylococcus epidermidis
ALILVKQGIQPIFSVGDFD

SEQ ID NO: 1822404 - protein, 17 aa, Staphylococcus epidermidis
ALLIFDEVMTGFRVGYN

SEQ ID NO: 1822405 - protein, 31 aa, Staphylococcus epidermidis
ALRQELDLFTCLRPVRWFKGVPSPVKRPEDV

SEQ ID NO: 1822406 - protein, 20 aa, Staphylococcus epidermidis
ALSFIVHRDFAYERGKALVE

SEQ ID NO: 1822407 - protein, 21 aa, Staphylococcus epidermidis
ALTEFVNIYGAKGLAWVKVVD

SEQ ID NO: 1822408 - protein, 28 aa, Staphylococcus epidermidis
AMAQEGHDFFGLLYIGAILTKDGPKVIE

SEQ ID NO: 1822409 - protein, 17 aa, Staphylococcus epidermidis
AMFEFKQNVQIFGKSII

SEQ ID NO: 1822410 - protein, 23 aa, Staphylococcus epidermidis
AMHLVKFKKGINVKLFIGGTDLE

SEQ ID NO: 1822411 - protein, 18 aa, Staphylococcus epidermidis
AMLAGYFSKAGSSAQIPV

SEQ ID NO: 1822412 - protein, 22 aa, Staphylococcus epidermidis
ANVLGVVAIFTYGLAKADKTFN

SEQ ID NO: 1822413 - protein, 38 aa, Staphylococcus epidermidis
APTFEEALKESLRLIKGGFTFAILTKDALYGAVDPNAI

SEQ ID NO: 1822414 - protein, 41 aa, Staphylococcus epidermidis
ARNIFFEKALKVLRPIYLEQSPVPTFYIVNVGGGYLDGDRY

SEQ ID NO: 1822415 - protein, 24 aa, Staphylococcus epidermidis
ATISMGYIGLYEAATLFYGPNWEH

SEQ ID NO: 1822416 - protein, 17 aa, Staphylococcus epidermidis
ATKMGIPVVSHLGLTPQ

SEQ ID NO: 1822417 - protein, 21 aa, Staphylococcus epidermidis
AVMLITPYYNKTNQRGLIQHF

SEQ ID NO: 1822418 - protein, 35 aa, Staphylococcus epidermidis
AYDLALYKDNTFIGQPLWGSIGYTLPATLGTQIAN

SEQ ID NO: 1822419 - protein, 26 aa, Staphylococcus epidermidis
AYKMPKKMRRLALRSALSFKVQENSF

SEQ ID NO: 1822420 - protein, 17 aa, Staphylococcus epidermidis
AYRLLRVGSFLLSNEGY

SEQ ID NO: 1822421 - protein, 17 aa, Staphylococcus epidermidis
CLQNCGLCASSLYALVD

SEQ ID NO: 1822422 - protein, 31 aa, Staphylococcus epidermidis
DADDIRFGIKENVDFIAASFVRRPSDVLDIR

SEQ ID NO: 1822423 - protein, 25 aa, Staphylococcus epidermidis
DAKLNLFDYVAKIEHLPLGGVIYTD

SEQ ID NO: 1822424 - protein, 18 aa, Staphylococcus epidermidis
DDLESRIYPVGRLDYDTS

SEQ ID NO: 1822425 - protein, 22 aa, Staphylococcus epidermidis
DEASLLYQAFLKVKDKYDDVMR

SEQ ID NO: 1822426 - protein, 25 aa, Staphylococcus epidermidis
DECKIGIMPGYIHKKGHVGVVSRSG

SEQ ID NO: 1822427 - protein, 25 aa, Staphylococcus epidermidis
DEEIRNTIRILSRKTKNNPVLIGEP

SEQ ID NO: 1822428 - protein, 17 aa, Staphylococcus epidermidis
DEELFFIVSVDTPMITS

SEQ ID NO: 1822429 - protein, 19 aa, Staphylococcus epidermidis
DEFDLFLDLYRETEARTGF

SEQ ID NO: 1822430 - protein, 22 aa, Staphylococcus epidermidis
DELFQYIDRLIDKQLIDEDAKE

SEQ ID NO: 1822431 - protein, 18 aa, Staphylococcus epidermidis
DELIIRFGQKLVTVKVTG

SEQ ID NO: 1822432 - protein, 21 aa, Staphylococcus epidermidis
DELKNRRATLVNLQRIDQVSA

SEQ ID NO: 1822433 - protein, 19 aa, Staphylococcus epidermidis
DELLYITGSPYDTLLEVIG

SEQ ID NO: 1822434 - protein, 23 aa, Staphylococcus epidermidis
DELNIFELFNYNIAYEIRLQEAL

SEQ ID NO: 1822435 - protein, 25 aa, Staphylococcus epidermidis
DEVKDISYIIKLFNYIIKNQIVDDA

SEQ ID NO: 1822436 - protein, 17 aa, Staphylococcus epidermidis
DEVWDFPFITRQLDEVL

SEQ ID NO: 1822437 - protein, 25 aa, Staphylococcus epidermidis
DFASLLHEDLKIRKFIDNELKEASV

SEQ ID NO: 1822438 - protein, 32 aa, Staphylococcus epidermidis
DFDEIIIATPQKWINYMLDLLNNYQLDDKKIK

SEQ ID NO: 1822439 - protein, 28 aa, Staphylococcus epidermidis
DFKEEPPWFKISPTHFVKSWLLDARAPK

SEQ ID NO: 1822440 - protein, 29 aa, Staphylococcus epidermidis
DFPNQINNVLAFPGIFRGALDVEATHINE

SEQ ID NO: 1822441 - protein, 21 aa, Staphylococcus epidermidis
DFQQWIQWLKENQVNILKGRP

SEQ ID NO: 1822442 - protein, 22 aa, Staphylococcus epidermidis
DFTYNYMHLINEIYIDNQLVVF

SEQ ID NO: 1822443 - protein, 19 aa, Staphylococcus epidermidis
DFYSYVRTFSEYYAPFNNK

SEQ ID NO: 1822444 - protein, 21 aa, Staphylococcus epidermidis
DGATKEFFSWGFRVGFMTFGI

SEQ ID NO: 1822445 - protein, 26 aa, Staphylococcus epidermidis
DGDPMFQFCLGIPWGAENDPETIEYL

SEQ ID NO: 1822446 - protein, 17 aa, Staphylococcus epidermidis
DGKAREVIKRQSLRQLI

SEQ ID NO: 1822447 - protein, 20 aa, Staphylococcus epidermidis
DGVLLVIKNYAGDVMNFEMA

SEQ ID NO: 1822448 - protein, 19 aa, Staphylococcus epidermidis
DIATVLLNRQRQLLLTVDN

SEQ ID NO: 1822449 - protein, 18 aa, Staphylococcus epidermidis
DIFIMSGGKLCGVGIPGE

SEQ ID NO: 1822450 - protein, 27 aa, Staphylococcus epidermidis
DIKTTDLLIRLYEKVLNKLNYESKKQE

SEQ ID NO: 1822451 - protein, 21 aa, Staphylococcus epidermidis
DILCCYRLNRLHRNLKNALKL

SEQ ID NO: 1822452 - protein, 17 aa, Staphylococcus epidermidis
DILFSAIKGKPIHSMIN

SEQ ID NO: 1822453 - protein, 17 aa, Staphylococcus epidermidis
DILHMHYAVPHAVCGIL

SEQ ID NO: 1822454 - protein, 27 aa, Staphylococcus epidermidis
DKAKIEDGLWFIQGRIDFQIKLNGYRM

SEQ ID NO: 1822455 - protein, 20 aa, Staphylococcus epidermidis
DLSNRLIHMRKRRGEIDFDI

SEQ ID NO: 1822456 - protein, 23 aa, Staphylococcus epidermidis
DNQHPLFHFLTNAAKGMINEKIK

SEQ ID NO: 1822457 - protein, 25 aa, Staphylococcus epidermidis
DNQKNLWLHVKLDTGMGRIGMKDID

SEQ ID NO: 1822458 - protein, 20 aa, Staphylococcus epidermidis
DPGVDILSIIYQHGIEIEFP

SEQ ID NO: 1822459 - protein, 24 aa, Staphylococcus epidermidis
DQHVREYIVLKLQSKPHRLHQVSK

SEQ ID NO: 1822460 - protein, 28 aa, Staphylococcus epidermidis
DRARLKDIIDLFLDSGLGKEAFSIISQG

SEQ ID NO: 1822461 - protein, 22 aa, Staphylococcus epidermidis
DRETLTLDYVPSLKLSNYEANQ

SEQ ID NO: 1822462 - protein, 20 aa, Staphylococcus epidermidis
DRKEFEALLREIAVPQPQGK

SEQ ID NO: 1822463 - protein, 24 aa, Staphylococcus epidermidis
DRLKCYLEPLRLNLNDYRVMLIHP

SEQ ID NO: 1822464 - protein, 24 aa, Staphylococcus epidermidis
DSPTNQQFFILSNDKIEELKQKVK

SEQ ID NO: 1822465 - protein, 25 aa, Staphylococcus epidermidis
DSTYPYISFIPLNDKTILTLQGFKY

SEQ ID NO: 1822466 - protein, 18 aa, Staphylococcus epidermidis
DTDYILLDEPLNNLDMKH

SEQ ID NO: 1822467 - protein, 17 aa, Staphylococcus epidermidis
DVIRRRVSLMKDAGVLF

SEQ ID NO: 1822468 - protein, 24 aa, Staphylococcus epidermidis
DVKKRHILPGFIDIHIHGGYGEDA

SEQ ID NO: 1822469 - protein, 20 aa, Staphylococcus epidermidis
DVKLHFIGSLQSRKVKDIIN

SEQ ID NO: 1822470 - protein, 24 aa, Staphylococcus epidermidis
DVNPIPIKVLTAYLGYGHYEVRLP

SEQ ID NO: 1822471 - protein, 26 aa, Staphylococcus epidermidis
DWYNASYIMMWGSNVPLTRTPDAHFM

SEQ ID NO: 1822472 - protein, 21 aa, Staphylococcus epidermidis
DYEGWWLFEDWPQKIVEQSEF

SEQ ID NO: 1822473 - protein, 17 aa, Staphylococcus epidermidis
DYPILSSVLEIFHRHVP

SEQ ID NO: 1822474 - protein, 22 aa, Staphylococcus epidermidis
DYQPQELVIIGGGYIALEFASM

SEQ ID NO: 1822475 - protein, 29 aa, Staphylococcus epidermidis
EALISVGLDLPFPLKMNRLLGFDSTYVTY

SEQ ID NO: 1822476 - protein, 17 aa, Staphylococcus epidermidis
EARFNIAILEKGNFLGT

SEQ ID NO: 1822477 - protein, 18 aa, Staphylococcus epidermidis
EATKLGFKRAIIPQTNIG

SEQ ID NO: 1822478 - protein, 26 aa, Staphylococcus epidermidis
EATTNSAFLIYLIAKESPNHDERMSL

SEQ ID NO: 1822479 - protein, 24 aa, Staphylococcus epidermidis
EAVDRACYLLERYASGTVLKDRVS

SEQ ID NO: 1822480 - protein, 24 aa, Staphylococcus epidermidis
EDAKALFQLNKNILLKGPTGSGKT

SEQ ID NO: 1822481 - protein, 19 aa, Staphylococcus epidermidis
EEAIKHLIFDALDATMEVL

SEQ ID NO: 1822482 - protein, 18 aa, Staphylococcus epidermidis
EEAYEPQFGARPLKRFVQ

SEQ ID NO: 1822483 - protein, 22 aa, Staphylococcus epidermidis
EEFFRALVINARLTVHIDLLRG

SEQ ID NO: 1822484 - protein, 38 aa, Staphylococcus epidermidis; identical to SEQ ID NO: 1683849

SEQ ID NO: 1822485 - protein, 19 aa, Staphylococcus epidermidis
EFFGTMKPFILKPKDDDSV

SEQ ID NO: 1822486 - protein, 27 aa, Staphylococcus epidermidis
EFPKYIKVCELLHLYQSFYQTFISFHQ

SEQ ID NO: 1822487 - protein, 30 aa, Staphylococcus epidermidis
EFSTQLLDRYLVIAHSYHLKPRILITKHDL

SEQ ID NO: 1822488 - protein, 38 aa, Staphylococcus epidermidis
EFVDKYYFEIKDKYLKDLPFISGFIGTCSFDLVRHEFK

SEQ ID NO: 1822489 - protein, 23 aa, Staphylococcus epidermidis
EGIPIILIHGLDGNLAGFKDLKN

SEQ ID NO: 1822490 - protein, 24 aa, Staphylococcus epidermidis
EGQSLYIRPFVFATEGVLGVRSSH

SEQ ID NO: 1822491 - protein, 25 aa, Staphylococcus epidermidis
EGRIQYFNQYLSRRRIRHIVGYVPQ

SEQ ID NO: 1822492 - protein, 23 aa, Staphylococcus epidermidis
EGVDALLFETYYDLDELTRIVTA

SEQ ID NO: 1822493 - protein, 25 aa, Staphylococcus epidermidis
EGYSKFKTLLQHFNLQHQKPLNKVQ

SEQ ID NO: 1822494 - protein, 18 aa, Staphylococcus epidermidis
EHFFARNDDLDIIRDRSD

SEQ ID NO: 1822495 - protein, 17 aa, Staphylococcus epidermidis
EHILLGLIRENEGVAAR

SEQ ID NO: 1822496 - protein, 24 aa, Staphylococcus epidermidis
EHLAKIKQLVNIPIIASGGGGNAQ

SEQ ID NO: 1822497 - protein, 17 aa, Staphylococcus epidermidis
EHTVEAKRLKNNPIRTF

SEQ ID NO: 1822498 - protein, 24 aa, Staphylococcus epidermidis
EIAKELLAFYAKYATDTGLTIQEV

SEQ ID NO: 1822499 - protein, 18 aa, Staphylococcus epidermidis
EIAMYFKNPKRILGSFFI

SEQ ID NO: 1822500 - protein, 30 aa, Staphylococcus epidermidis
EIGFKLYDVFTILYLLDPEAFNVKEAYTQI

SEQ ID NO: 1822501 - protein, 22 aa, Staphylococcus epidermidis
EIHGANTYLLQQFFSPHSNRRQ

SEQ ID NO: 1822502 - protein, 35 aa, Staphylococcus epidermidis
EKIQSSILTSIPLWKNQMAIALTLMRQRNAVSAQR

SEQ ID NO: 1822503 - protein, 25 aa, Staphylococcus epidermidis
EKPHPKVLDPLFNAFDVKPEKVAIV

SEQ ID NO: 1822504 - protein, 36 aa, Staphylococcus epidermidis
EKRMQLLHDALVYRIQRLQDAIPDNAPILYKSGAFK

SEQ ID NO: 1822505 - protein, 26 aa, Staphylococcus epidermidis
EKVENTLIPYFRKIEKRALFNQEKVL

SEQ ID NO: 1822506 - protein, 17 aa, Staphylococcus epidermidis
EKVVKRLAKKMSIGVIT

SEQ ID NO: 1822507 - protein, 24 aa, Staphylococcus epidermidis
EKYRKIDVLLIDDIQFIQNKEQTQ

SEQ ID NO: 1822508 - protein, 26 aa, Staphylococcus epidermidis
ELAGIPHNKIWLDPGIGFAKTREEEN

SEQ ID NO: 1822509 - protein, 18 aa, Staphylococcus epidermidis
ELAKNYDIPLYLGRTLSN

SEQ ID NO: 1822510 - protein, 17 aa, Staphylococcus epidermidis
ELENHFFGRVGLFRNQV

SEQ ID NO: 1822511 - protein, 20 aa, Staphylococcus epidermidis
ELERHWGVMKKSPGMPPGAN

SEQ ID NO: 1822512 - protein, 28 aa, Staphylococcus epidermidis
ELKMIQESKVLITYFTRLQSLKKDKDEL

SEQ ID NO: 1822513 - protein, 26 aa, Staphylococcus epidermidis
ELKYNVKIFEFKSPYLKLTRDGEKLL

SEQ ID NO: 1822514 - protein, 17 aa, Staphylococcus epidermidis
ELLCQYYYVKFGVDTRS

SEQ ID NO: 1822515 - protein, 20 aa, Staphylococcus epidermidis
ELPHNVVFIFQPAEETGGGA

SEQ ID NO: 1822516 - protein, 23 aa, Staphylococcus epidermidis
ELRGAHIFLDMVSVGATINIMLA

SEQ ID NO: 1822517 - protein, 18 aa, Staphylococcus epidermidis
ELRLLKYKHRDKVLAETS

SEQ ID NO: 1822518 - protein, 17 aa, Staphylococcus epidermidis
ELVLTLGSQMVVLAEQA

SEQ ID NO: 1822519 - protein, 20 aa, Staphylococcus epidermidis
EMYDLRLMLESFAFSKLSGT

SEQ ID NO: 1822520 - protein, 24 aa, Staphylococcus epidermidis
ENDEILEYYGLKVLVDRNDAPVLN

SEQ ID NO: 1822521 - protein, 17 aa, Staphylococcus epidermidis
ENKLTFSDEVVEKIAGI

SEQ ID NO: 1822522 - protein, 19 aa, Staphylococcus epidermidis
ENMSLPLKWEFPGGKIENG

SEQ ID NO: 1822523 - protein, 24 aa, Staphylococcus epidermidis
ENSKWASVTFYIRTEKRMKKIYPN

SEQ ID NO: 1822524 - protein, 26 aa, Staphylococcus epidermidis
ENVIFIGLICKNAVWHAVVFEIGRGY

SEQ ID NO: 1822525 - protein, 19 aa, Staphylococcus epidermidis
EPFIFVDSSTQKVLAIYIV

SEQ ID NO: 1822526 - protein, 24 aa, Staphylococcus epidermidis
EPKLDWHLSNLRNYAFLTPQKSTN

SEQ ID NO: 1822527 - protein, 18 aa, Staphylococcus epidermidis
EPVPPLPPAKNFKGPIGR

SEQ ID NO: 1822528 - protein, 19 aa, Staphylococcus epidermidis
EQDIDYLMKFPNIIHNRKK

SEQ ID NO: 1822529 - protein, 17 aa, Staphylococcus epidermidis
EQQERITLYLKYNTKKP

SEQ ID NO: 1822530 - protein, 25 aa, Staphylococcus epidermidis
EQRVEDIFFEVFDVLQELGLTKVNG

SEQ ID NO: 1822531 - protein, 17 aa, Staphylococcus epidermidis
ERKWYVIDAEGQTLGRL

SEQ ID NO: 1822532 - protein, 17 aa, Staphylococcus epidermidis
ERRIIRLLLNDYKPKEI

SEQ ID NO: 1822533 - protein, 23 aa, Staphylococcus epidermidis
ERVAIIKWYRGLGYGKNLIHAIE

SEQ ID NO: 1822534 - protein, 23 aa, Staphylococcus epidermidis
ERYAPKDLFAVVMDAKTGEILAY

SEQ ID NO: 1822535 - protein, 22 aa, Staphylococcus epidermidis
ESGSIFGVIGFSGAGKSTLIRM

SEQ ID NO: 1822536 - protein, 28 aa, Staphylococcus epidermidis
ESNDLRYQFLQKYWNTLPQKGNINIYFR

SEQ ID NO: 1822537 - protein, 26 aa, Staphylococcus epidermidis
ESQIEDDYLLTLKKDYLAYYESLKND

SEQ ID NO: 1822538 - protein, 19 aa, Staphylococcus epidermidis
ETAINSKIMLLTGGPGTGK

SEQ ID NO: 1822539 - protein, 17 aa, Staphylococcus epidermidis
ETKMLYVETPSNPLLRV

SEQ ID NO: 1822540 - protein, 21 aa, Staphylococcus epidermidis
ETYVLYRKFYEDTNIIEFEDV

SEQ ID NO: 1822541 - protein, 24 aa, Staphylococcus epidermidis
EVERIILQMYAEIAKELLAFYAKY

SEQ ID NO: 1822542 - protein, 18 aa, Staphylococcus epidermidis
EVLKQIKDNGRLPVVNFA

SEQ ID NO: 1822543 - protein, 28 aa, Staphylococcus epidermidis
EWFLNPDHMLLILGIEKGWFKEESLEIE

SEQ ID NO: 1822544 - protein, 21 aa, Staphylococcus epidermidis
EYKDQRFIILGFPCNQFGGQE

SEQ ID NO: 1822545 - protein, 18 aa, Staphylococcus epidermidis
EYLIPYIEDVVKDIDIET

SEQ ID NO: 1822546 - protein, 24 aa, Staphylococcus epidermidis
EYQPQNFLDFIKTYSIHLSSSRLV

SEQ ID NO: 1822547 - protein, 20 aa, Staphylococcus epidermidis
EYVTVLLREVGLKSDCLYCY

SEQ ID NO: 1822548 - protein, 26 aa, Staphylococcus epidermidis
FALGGNRLFYLAMAPQFFGVISDYLK

SEQ ID NO: 1822549 - protein, 25 aa, Staphylococcus epidermidis
FDDEEYLFHVLKSGAKGYILKNSPD

SEQ ID NO: 1822550 - protein, 19 aa, Staphylococcus epidermidis
FDDILVHMYQYLPNIFQNQ

SEQ ID NO: 1822551 - protein, 26 aa, Staphylococcus epidermidis
FDLYGGTFRLFDFYEKQYGLKFKYVD

SEQ ID NO: 1822552 - protein, 19 aa, Staphylococcus epidermidis
FEDFIYYIGNNKKIFKHLL

SEQ ID NO: 1822553 - protein, 41 aa, Staphylococcus epidermidis
FEQTEVRLVLSFLRTIDNPLQDIYLVGLMRSVIYQFTEEEL

SEQ ID NO: 1822554 - protein, 17 aa, Staphylococcus epidermidis
FEYDGEEFIFKDLINPI

SEQ ID NO: 1822555 - protein, 26 aa, Staphylococcus epidermidis
FEYKHILLATGFYNQLLTQPLIKNLI

SEQ ID NO: 1822556 - protein, 19 aa, Staphylococcus epidermidis
FIEMCLLLPNLNEQQYSSL

SEQ ID NO: 1822557 - protein, 18 aa, Staphylococcus epidermidis
FINCNGGIRFLGVKDGKN

SEQ ID NO: 1822558 - protein, 18 aa, Staphylococcus epidermidis
FIQTNYPNQPFYNKAMCV

SEQ ID NO: 1822559 - protein, 19 aa, Staphylococcus epidermidis
FKAIFKNQHVIGISELIED

SEQ ID NO: 1822560 - protein, 17 aa, Staphylococcus epidermidis
FKKVSLELGGKSPYIVL

SEQ ID NO: 1822561 - protein, 17 aa, Staphylococcus epidermidis
FKNDKVDFIWSHTLKTI

SEQ ID NO: 1822562 - protein, 27 aa, Staphylococcus epidermidis
FKSAYHILDLVFWFGHLSILTKNHYSV

SEQ ID NO: 1822563 - protein, 18 aa, Staphylococcus epidermidis
FLNEQFERLRKEQIFVYI

SEQ ID NO: 1822564 - protein, 25 aa, Staphylococcus epidermidis
FNDYTLREIFQYLKLPKKDLHQLNM

SEQ ID NO: 1822565 - protein, 19 aa, Staphylococcus epidermidis
FPEHLTLRDIVRAIELGIQ

SEQ ID NO: 1822566 - protein, 18 aa, Staphylococcus epidermidis
FRGQVNVVIYTQGAQGAT

SEQ ID NO: 1822567 - protein, 26 aa, Staphylococcus epidermidis
FRVGYNCAQGYFGVTPDLTCLGKVIG

SEQ ID NO: 1822568 - protein, 19 aa, Staphylococcus epidermidis
FSMYYDYKEPIKRIANHRV

SEQ ID NO: 1822569 - protein, 18 aa, Staphylococcus epidermidis
FVEVAKIISLALNNYDND

SEQ ID NO: 1822570 - protein, 22 aa, Staphylococcus epidermidis
FVHSKGGIYIWLHTPPGYDSEA

SEQ ID NO: 1822571 - protein, 17 aa, Staphylococcus epidermidis
FVKIPIVTTTGESTLPL

SEQ ID NO: 1822572 - protein, 42 aa, Staphylococcus epidermidis
GAIQFLYVAPERFENTFFLNLLRKIEIPLIAFDEAHCISKWG

SEQ ID NO: 1822573 - protein, 32 aa, Staphylococcus epidermidis
GAKQVRKKFPDALFIFLAPPSLDDLKERLVGR

SEQ ID NO: 1822574 - protein, 33 aa, Staphylococcus epidermidis
GAYCASPYITHSYVFISWTGKMAETFVLAHELG

SEQ ID NO: 1822575 - protein, 35 aa, Staphylococcus epidermidis
GEETGITFAGIPLGHEFNSLVLAILQVSGRAPKEK

SEQ ID NO: 1822576 - protein, 19 aa, Staphylococcus epidermidis
GESSQFDNLKWLGLDWDES

SEQ ID NO: 1822577 - protein, 22 aa, Staphylococcus epidermidis
GEVEAFFPSKVPLINFRMNNRN

SEQ ID NO: 1822578 - protein, 33 aa, Staphylococcus epidermidis
GFDYVVTGSGFLYNMVRVLVAFLIEVGKGKREP

SEQ ID NO: 1822579 - protein, 19 aa, Staphylococcus epidermidis
GFLARPFVRDKDAIQIVPL

SEQ ID NO: 1822580 - protein, 69 aa, Staphylococcus epidermidis
GGDKELPYLDLPKEMNPFLGYRAIRLCLAQPEIFRPQLRALLRASVYGKLNIMFPMVATIKEFRDAKSM

SEQ ID NO: 1822581 - protein, 24 aa, Staphylococcus epidermidis
GGFKSYRLLKPTEGSTYKIYFGFA

SEQ ID NO: 1822582 - protein, 25 aa, Staphylococcus epidermidis
GGGAKSRFWLQLQADIFNVQIKRLK

SEQ ID NO: 1822583 - protein, 18 aa, Staphylococcus epidermidis
GGKFNGIIPISQLSTHHI

SEQ ID NO: 1822584 - protein, 30 aa, Staphylococcus epidermidis
GGQQAGLFGGPLYTFHKIFSIITLSRQLSE

SEQ ID NO: 1822585 - protein, 23 aa, Staphylococcus epidermidis
GHTTALMLFVKRCKALYDKSELP

SEQ ID NO: 1822586 - protein, 33 aa, Staphylococcus epidermidis
GIDSVFTPIKLRKRVWRRLAKDLKPQQLHDIKH

SEQ ID NO: 1822587 - protein, 22 aa, Staphylococcus epidermidis
GIHPEWLYCAKANLVLEPAYTG

SEQ ID NO: 1822588 - protein, 24 aa, Staphylococcus epidermidis
GKESEELISLIKLAIDQHIPYTVL

SEQ ID NO: 1822589 - protein, 27 aa, Staphylococcus epidermidis
GKRIRPVILLLTLKMLNKDYQQGLNSA

SEQ ID NO: 1822590 - protein, 19 aa, Staphylococcus epidermidis
GKSYDAVFPLLHGPNGEDG

SEQ ID NO: 1822591 - protein, 23 aa, Staphylococcus epidermidis
GKTTLLRMINALEIPTEGTVYVN

SEQ ID NO: 1822592 - protein, 19 aa, Staphylococcus epidermidis
GLEDNIYLRKGVKATNEAL

SEQ ID NO: 1822593 - protein, 24 aa, Staphylococcus epidermidis
GLKRIGLNVIWIIKDVPLKYKYVK

SEQ ID NO: 1822594 - protein, 21 aa, Staphylococcus epidermidis
GLKVPEFVKTSLAPGSKVVTG

SEQ ID NO: 1822595 - protein, 23 aa, Staphylococcus epidermidis
GLSIKHGLALNAVNKVKATKHLQ

SEQ ID NO: 1822596 - protein, 19 aa, Staphylococcus epidermidis
GMINEKIKWNFTKFLIDRE

SEQ ID NO: 1822597 - protein, 19 aa, Staphylococcus epidermidis
GNLMMRYVMKKKNVDDLPS

SEQ ID NO: 1822598 - protein, 22 aa, Staphylococcus epidermidis
GNSGVILSQLFRGFCKNIEEEK

SEQ ID NO: 1822599 - protein, 19 aa, Staphylococcus epidermidis
GNVVFIFQYGEEIMPGGSQ

SEQ ID NO: 1822600 - protein, 20 aa, Staphylococcus epidermidis
GPDFPTAGLVLGKSGIRRAY

SEQ ID NO: 1822601 - protein, 17 aa, Staphylococcus epidermidis
GPTIIEVKTIIGFGSPN

SEQ ID NO: 1822602 - protein, 22 aa, Staphylococcus epidermidis
GSDLLIKTFLKEHPPGPSKTIA

SEQ ID NO: 1822603 - protein, 17 aa, Staphylococcus epidermidis
GSPMVIKMGRYGKFMAC

SEQ ID NO: 1822604 - protein, 23 aa, Staphylococcus epidermidis
GSTYKIYFGFANRTAYEDFKASD

SEQ ID NO: 1822605 - protein, 23 aa, Staphylococcus epidermidis
GTEHLLLGLMKEPEGIAAKVLVS

SEQ ID NO: 1822606 - protein, 24 aa, Staphylococcus epidermidis
GTEPKIKLYVSLSCDHFDVVAQKM

SEQ ID NO: 1822607 - protein, 20 aa, Staphylococcus epidermidis
GTGNLLVLKTLPGNAQSIGA

SEQ ID NO: 1822608 - protein, 24 aa, Staphylococcus epidermidis
GTGQSFDWKLLKKIKGVDFLIAGG

SEQ ID NO: 1822609 - protein, 17 aa, Staphylococcus epidermidis
GVLGDFHQLYPNITYNL

SEQ ID NO: 1822610 - protein, 23 aa, Staphylococcus epidermidis
GYDPEYGARPLIRAIQKTVEDNL

SEQ ID NO: 1822611 - protein, 18 aa, Staphylococcus epidermidis
GYFIEPTIFSGLQSADRI

SEQ ID NO: 1822612 - protein, 20 aa, Staphylococcus epidermidis
GYKQDILNDKMLVVANSDRS

SEQ ID NO: 1822613 - protein, 21 aa, Staphylococcus epidermidis
GYTLNVPLFVNEGDTLVINTS

SEQ ID NO: 1822614 - protein, 24 aa, Staphylococcus epidermidis
HALTKILETAVPLLQDFDIELTEA

SEQ ID NO: 1822615 - protein, 27 aa, Staphylococcus epidermidis
HDTETFIKWLHLFINEQLTYSDGIAMR

SEQ ID NO: 1822616 - protein, 25 aa, Staphylococcus epidermidis
HEINEKVIMLITRQQPIAKDLRMMM

SEQ ID NO: 1822617 - protein, 18 aa, Staphylococcus epidermidis
HERLLIADKKPNIVHQWI

SEQ ID NO: 1822618 - protein, 33 aa, Staphylococcus epidermidis
HFDPAKTSILMLMDYLFEMINPYSLNQQGQDKG

SEQ ID NO: 1822619 - protein, 19 aa, Staphylococcus epidermidis
HGIDLKKANALLLEEAGVP

SEQ ID NO: 1822620 - protein, 21 aa, Staphylococcus epidermidis
HIKHYYQQPKFIKYWTEKINE

SEQ ID NO: 1822621 - protein, 28 aa, Staphylococcus epidermidis
HLGFQFDHLFWKQFIHNIKTLHSKGVFR

SEQ ID NO: 1822622 - protein, 17 aa, Staphylococcus epidermidis
HLPILTDLFKEINEKCD

SEQ ID NO: 1822623 - protein, 17 aa, Staphylococcus epidermidis
HLPQGFNIRVDSLLYTG

SEQ ID NO: 1822624 - protein, 24 aa, Staphylococcus epidermidis
HLYTLIKHCNEFLYRRDDYRIPSD

SEQ ID NO: 1822625 - protein, 17 aa, Staphylococcus epidermidis
HMAMFEFKQNVQIFGKS

SEQ ID NO: 1822626 - protein, 17 aa, Staphylococcus epidermidis
HMFKLDPAKSISDENLE

SEQ ID NO: 1822627 - protein, 18 aa, Staphylococcus epidermidis
HRLDLNAEIVRKYPKVKL

SEQ ID NO: 1822628 - protein, 27 aa, Staphylococcus epidermidis
HYSGTLVNGLMYQIKDLSGINGEIRPG

SEQ ID NO: 1822629 - protein, 19 aa, Staphylococcus epidermidis
IALANMMTSAALLGIDSCP

SEQ ID NO: 1822630 - protein, 24 aa, Staphylococcus epidermidis
IANEVKLPVILYNVPSRTNMTIEP

SEQ ID NO: 1822631 - protein, 21 aa, Staphylococcus epidermidis
IARFRREMMGFVFQDFNVLNT

SEQ ID NO: 1822632 - protein, 29 aa, Staphylococcus epidermidis
IDENEILESLRPLLLRYSKERLDGEHFGD

SEQ ID NO: 1822633 - protein, 19 aa, Staphylococcus epidermidis
IDFLNLKIEKVKAPIQTLV

SEQ ID NO: 1822634 - protein, 17 aa, Staphylococcus epidermidis
IDFNDFDIPRVLGDIII

SEQ ID NO: 1822635 - protein, 25 aa, Staphylococcus epidermidis
IDKTYGLIFSQRVLLALINKGMVRE

SEQ ID NO: 1822636 - protein, 26 aa, Staphylococcus epidermidis
IDLIPEYAHLNIFPVGRLDKDTEGLL

SEQ ID NO: 1822637 - protein, 18 aa, Staphylococcus epidermidis
IELSGVQFFTLPFATVSE

SEQ ID NO: 1822638 - protein, 26 aa, Staphylococcus epidermidis
IEQLATQLVFMRDGRIILKESKEVLL

SEQ ID NO: 1822639 - protein, 21 aa, Staphylococcus epidermidis
IETLHPYLYEKTARKPMILPV

SEQ ID NO: 1822640 - protein, 27 aa, Staphylococcus epidermidis
IEYDVALFSYHKLLEIFFSVIDPLDDG

SEQ ID NO: 1822641 - protein, 17 aa, Staphylococcus epidermidis
IFASRTLIDQLRANRFE

SEQ ID NO: 1822642 - protein, 17 aa, Staphylococcus epidermidis
IFDLLVEYDGELPFWDK

SEQ ID NO: 1822643 - protein, 18 aa, Staphylococcus epidermidis
IFSLYDFLQDSINFEKKH

SEQ ID NO: 1822644 - protein, 24 aa, Staphylococcus epidermidis
IFSRFKNYYEFLIKNKIIENELSI

SEQ ID NO: 1822645 - protein, 17 aa, Staphylococcus epidermidis
IFYIADHDDDRILVSHL

SEQ ID NO: 1822646 - protein, 17 aa, Staphylococcus epidermidis
IGDLSFYHDMNGLLMAK

SEQ ID NO: 1822647 - protein, 30 aa, Staphylococcus epidermidis
IGGVPFLLKQINVPIYGGPLALGLIRNKLE

SEQ ID NO: 1822648 - protein, 19 aa, Staphylococcus epidermidis
IGMLLKSIKLMRKELKNWS

SEQ ID NO: 1822649 - protein, 25 aa, Staphylococcus epidermidis
IGQLYEQHMWSLSMLDSFAKEVVHG

SEQ ID NO: 1822650 - protein, 18 aa, Staphylococcus epidermidis
IHFQFASYMSASKFYKDY

SEQ ID NO: 1822651 - protein, 18 aa, Staphylococcus epidermidis
IHLIRANNHLIILVMVFS

SEQ ID NO: 1822652 - protein, 25 aa, Staphylococcus epidermidis
IICSRNYLEELTLGFLASEGIFLKR

SEQ ID NO: 1822653 - protein, 17 aa, Staphylococcus epidermidis
IIHNKFILDATYLGKYS

SEQ ID NO: 1822654 - protein, 20 aa, Staphylococcus epidermidis
IINEPTAAALAYGLDKTETD

SEQ ID NO: 1822655 - protein, 19 aa, Staphylococcus epidermidis
IIQFLIQQFTQQFNNRLEV

SEQ ID NO: 1822656 - protein, 23 aa, Staphylococcus epidermidis
IKDIYRVYKYKFGITFPIHAKIN

SEQ ID NO: 1822657 - protein, 27 aa, Staphylococcus epidermidis
IKEYENIQIIGLMTMAPLTDDLSYIRN

SEQ ID NO: 1822658 - protein, 24 aa, Staphylococcus epidermidis
IKGVDFLIAGGLDFEKIKRLEIYS

SEQ ID NO: 1822659 - protein, 17 aa, Staphylococcus epidermidis
IKKEFSISFEEFAVLTY

SEQ ID NO: 1822660 - protein, 17 aa, Staphylococcus epidermidis
IKKTAMVFGQMNEPPGA

SEQ ID NO: 1822661 - protein, 18 aa, Staphylococcus epidermidis
IKNILRYTQKKYNITDKS

SEQ ID NO: 1822662 - protein, 17 aa, Staphylococcus epidermidis
ILRNFPEKLSKYISNWF

SEQ ID NO: 1822663 - protein, 17 aa, Staphylococcus epidermidis
ILVAFDLYGGTFRLFDF

SEQ ID NO: 1822664 - protein, 21 aa, Staphylococcus epidermidis
IMQIAFTPLRELGIDWPSVHA

SEQ ID NO: 1822665 - protein, 24 aa, Staphylococcus epidermidis
INLETPIEIQVLPKAIQLLTATEQ

SEQ ID NO: 1822666 - protein, 20 aa, Staphylococcus epidermidis
INNEYRFQILVKYKSEPQLH

SEQ ID NO: 1822667 - protein, 18 aa, Staphylococcus epidermidis
IQIGEKLTRGLGAGANPE

SEQ ID NO: 1822668 - protein, 19 aa, Staphylococcus epidermidis
IQKKWIRKFKKIESEFKAR

SEQ ID NO: 1822669 - protein, 17 aa, Staphylococcus epidermidis
IQLIRNIKKLNSKIRII

SEQ ID NO: 1822670 - protein, 22 aa, Staphylococcus epidermidis
IRDLLPVIPEFADDTLIGGNGS

SEQ ID NO: 1822671 - protein, 32 aa, Staphylococcus epidermidis
IRKSIATPTIFNLIGPLINPFKLTYQVMGVYE

SEQ ID NO: 1822672 - protein, 27 aa, Staphylococcus epidermidis
IRVNCVAPGPFWSPLQIVGGQPQSAIP

SEQ ID NO: 1822673 - protein, 24 aa, Staphylococcus epidermidis
ITENVAMAFGFFDGMHRGHDKVFQ

SEQ ID NO: 1822674 - protein, 27 aa, Staphylococcus epidermidis
ITKKEFINFPVLFDDEGKFRNKQIINY

SEQ ID NO: 1822675 - protein, 25 aa, Staphylococcus epidermidis
ITLDHIKHFIAIYTQTLVTPLIAYI

SEQ ID NO: 1822676 - protein, 17 aa, Staphylococcus epidermidis
IYGPPKDRRAGVITFNL

SEQ ID NO: 1822677 - protein, 17 aa, Staphylococcus epidermidis
IYIYEKVIAGAGGLPVG

SEQ ID NO: 1822678 - protein, 17 aa, Staphylococcus epidermidis
IYKTMPTMNQWLKDIEV

SEQ ID NO: 1822679 - protein, 19 aa, Staphylococcus epidermidis
KACVVLDMHIGHLKSIMEL

SEQ ID NO: 1822680 - protein, 19 aa, Staphylococcus epidermidis
KADISFEEFLDKAALSSSE

SEQ ID NO: 1822681 - protein, 19 aa, Staphylococcus epidermidis
KARYSTVIILDGLEDPHNL

SEQ ID NO: 1822682 - protein, 24 aa, Staphylococcus epidermidis
KDAIQIVPLMIKYAAELKNKGRML

SEQ ID NO: 1822683 - protein, 27 aa, Staphylococcus epidermidis
KDEPAFINVLEILALEYAKNKGYELYN

SEQ ID NO: 1822684 - protein, 25 aa, Staphylococcus epidermidis
KDMTSFDSWLPYLNQMNDAPAARSM

SEQ ID NO: 1822685 - protein, 22 aa, Staphylococcus epidermidis
KDRNFNIEFITKLEGAHLEYEK

SEQ ID NO: 1822686 - protein, 24 aa, Staphylococcus epidermidis
KDWSRSQLQDWIKEGLVKVNGKVI

SEQ ID NO: 1822687 - protein, 22 aa, Staphylococcus epidermidis
KEKELRFLKFFHQQKYNVVDFN

SEQ ID NO: 1822688 - protein, 26 aa, Staphylococcus epidermidis
KELEKWEIYFKNEGFYPVAVDAKHGK

SEQ ID NO: 1822689 - protein, 33 aa, Staphylococcus epidermidis
KEMNYRKLGKYPPYYFLINFTISHTDIKKVMMA

SEQ ID NO: 1822690 - protein, 28 aa, Staphylococcus epidermidis
KETFMTNIFGMMFLSQAAVPYLSEGDTI

SEQ ID NO: 1822691 - protein, 25 aa, Staphylococcus epidermidis
KETKYHAKLLLQVHDELIFEIPKSE

SEQ ID NO: 1822692 - protein, 26 aa, Staphylococcus epidermidis
KEYKKDKVIIILNYPNNPTGYTPNKK

SEQ ID NO: 1822693 - protein, 25 aa, Staphylococcus epidermidis
KFHGEVAMHLFLNDDFILPSKIDIC

SEQ ID NO: 1822694 - protein, 19 aa, Staphylococcus epidermidis
KFYIADFEFPKALAKEEIA

SEQ ID NO: 1822695 - protein, 19 aa, Staphylococcus epidermidis
KGIGLYKAVILQAAFELGE

SEQ ID NO: 1822696 - protein, 23 aa, Staphylococcus epidermidis
KGLLCVYEGFLKGLKGEKIEAQA

SEQ ID NO: 1822697 - protein, 17 aa, Staphylococcus epidermidis
KIALGKIFYNPDMPLIQ

SEQ ID NO: 1822698 - protein, 24 aa, Staphylococcus epidermidis
KKDEKLFDKLQLDKSSYLSKLKEK

SEQ ID NO: 1822699 - protein, 27 aa, Staphylococcus epidermidis
KKGHQIRWRLLYIANPDYTVKPPFFIE

SEQ ID NO: 1822700 - protein, 35 aa, Staphylococcus epidermidis
KKGIAKLFDFMLPNSPIKMPISKMNMFGVGNLMMR

SEQ ID NO: 1822701 - protein, 18 aa, Staphylococcus epidermidis
KKLHYKIEHLSPLTKKEF

SEQ ID NO: 1822702 - protein, 24 aa, Staphylococcus epidermidis
KKLSINDLLKIKGIGLYKAVILQA

SEQ ID NO: 1822703 - protein, 19 aa, Staphylococcus epidermidis
KKQLINATSIYLEAIYALC

SEQ ID NO: 1822704 - protein, 18 aa, Staphylococcus epidermidis
KLAQLRPAFKKDGSVTAG

SEQ ID NO: 1822705 - protein, 42 aa, Staphylococcus epidermidis
KLENIIAPFYDRWDHEIFIKYLKFFQLPYKNKIKTFSTGMKM

SEQ ID NO: 1822706 - protein, 23 aa, Staphylococcus epidermidis
KLLTQVRFQIPYGKNIALVGANG

SEQ ID NO: 1822707 - protein, 20 aa, Staphylococcus epidermidis
KMMLKVVLYAYTQSVFSGRK

SEQ ID NO: 1822708 - protein, 21 aa, Staphylococcus epidermidis
KNFIQKCIGYLTLGLKLNQYE

SEQ ID NO: 1822709 - protein, 36 aa, Staphylococcus epidermidis
KNTQIENIYDWLSDFKLLSIPKTRFKKKTLYSEKDR

SEQ ID NO: 1822710 - protein, 19 aa, Staphylococcus epidermidis
KPRGLFRKKKFSPVVGDIV

SEQ ID NO: 1822711 - protein, 17 aa, Staphylococcus epidermidis
KPVIREKMSRRKKTAAK

SEQ ID NO: 1822712 - protein, 17 aa, Staphylococcus epidermidis
KQDEIILLEGFMDVIKS

SEQ ID NO: 1822713 - protein, 20 aa, Staphylococcus epidermidis
KQERHILNTKAYYNKKYNSS

SEQ ID NO: 1822714 - protein, 25 aa, Staphylococcus epidermidis
KQKYSFQELPQFTPEIFMKVSAKNV

SEQ ID NO: 1822715 - protein, 17 aa, Staphylococcus epidermidis
KQQAYIELGTRFSPFYF

SEQ ID NO: 1822716 - protein, 32 aa, Staphylococcus epidermidis
KQTLDIIKRHRLLELFLIEILQYNWEEVHQEA

SEQ ID NO: 1822717 - protein, 20 aa, Staphylococcus epidermidis
KRFIREFRNVNVDEYEVGQE

SEQ ID NO: 1822718 - protein, 21 aa, Staphylococcus epidermidis
KRFYDVGVSGIHRLLSNIHDI

SEQ ID NO: 1822719 - protein, 21 aa, Staphylococcus epidermidis
KRILGSFFIKHHGYRVRIDDI

SEQ ID NO: 1822720 - protein, 17 aa, Staphylococcus epidermidis
KRMKWYTVIQAIGLIQW

SEQ ID NO: 1822721 - protein, 20 aa, Staphylococcus epidermidis
KRVITPLSPISTFAARNPWE

SEQ ID NO: 1822722 - protein, 22 aa, Staphylococcus epidermidis
KSIPQGISALFQYDLESSLEDN

SEQ ID NO: 1822723 - protein, 23 aa, Staphylococcus epidermidis
KSLEMSRPLQRYYRDIRAGLHNP

SEQ ID NO: 1822724 - protein, 17 aa, Staphylococcus epidermidis
KSLLQYVSGLTSTIAQN

SEQ ID NO: 1822725 - protein, 21 aa, Staphylococcus epidermidis
KSLLTRIRFLDKEMGIHNKIL

SEQ ID NO: 1822726 - protein, 24 aa, Staphylococcus epidermidis
KSNYILKYVFANGISREIIYPLLK

SEQ ID NO: 1822727 - protein, 20 aa, Staphylococcus epidermidis
KTAINAHLGLAIGVLTGVAK

SEQ ID NO: 1822728 - protein, 24 aa, Staphylococcus epidermidis
KTFNKAHIPFYTLSDYNELIEVAK

SEQ ID NO: 1822729 - protein, 17 aa, Staphylococcus epidermidis
KTLLAYTKHIHVVSPTI

SEQ ID NO: 1822730 - protein, 20 aa, Staphylococcus epidermidis
KTYDLEVWLPSYNDYKEISS

SEQ ID NO: 1822731 - protein, 27 aa, Staphylococcus epidermidis
KVAKRLNKTIGLLLDTKGPEIRTHNMK

SEQ ID NO: 1822732 - protein, 17 aa, Staphylococcus epidermidis
KVARLICDVFKTDGTPF

SEQ ID NO: 1822733 - protein, 17 aa, Staphylococcus epidermidis
KVPLMMKFEVQGTNKDI

SEQ ID NO: 1822734 - protein, 19 aa, Staphylococcus epidermidis
KYWQAYDFNSGYFMSLKLN

SEQ ID NO: 1822735 - protein, 20 aa, Staphylococcus epidermidis
LAARKGLPYVFAGHFAPQQM

SEQ ID NO: 1822736 - protein, 20 aa, Staphylococcus epidermidis
LAKQVLLIDRIQDPGNLGTL

SEQ ID NO: 1822737 - protein, 21 aa, Staphylococcus epidermidis
LAKVSPLVHRASIGGVLNVGE

SEQ ID NO: 1822738 - protein, 20 aa, Staphylococcus epidermidis
LALIIRQKPTIYDYGCTVVT

SEQ ID NO: 1822739 - protein, 24 aa, Staphylococcus epidermidis
LASDGMLVKRPLAISGNHLTLGFK

SEQ ID NO: 1822740 - protein, 24 aa, Staphylococcus epidermidis
LDEYICQWIRGLDNIIPRLVEKME

SEQ ID NO: 1822741 - protein, 17 aa, Staphylococcus epidermidis
LDFIISTSEPKKVQQQL

SEQ ID NO: 1822742 - protein, 24 aa, Staphylococcus epidermidis
LDHSYDWLIFSSKNAVKYFYPYLK

SEQ ID NO: 1822743 - protein, 22 aa, Staphylococcus epidermidis
LDKNPYQLVYDIKGIGFNKADQ

SEQ ID NO: 1822744 - protein, 26 aa, Staphylococcus epidermidis
LEELDLKELVLPLIVLDYSKEAAQNS

SEQ ID NO: 1822745 - protein, 26 aa, Staphylococcus epidermidis
LEFGSPKAIIPKKLARDVGADLIMSG

SEQ ID NO: 1822746 - protein, 23 aa, Staphylococcus epidermidis
LEFPIVFIMGMEESLFPHIRAIK

SEQ ID NO: 1822747 - protein, 17 aa, Staphylococcus epidermidis
LEGYKQDILNDKMLVVA

SEQ ID NO: 1822748 - protein, 23 aa, Staphylococcus epidermidis
LENDALCFYDIGSAGMNLDTALE

SEQ ID NO: 1822749 - protein, 18 aa, Staphylococcus epidermidis
LEYIGLSYLTLNRVTTTL

SEQ ID NO: 1822750 - protein, 17 aa, Staphylococcus epidermidis
LEYLLDIDWFTEEELSV

SEQ ID NO: 1822751 - protein, 27 aa, Staphylococcus epidermidis
LFKEHQLLYILIMHAFANTYVSKRQTN

SEQ ID NO: 1822752 - protein, 18 aa, Staphylococcus epidermidis
LFKYYFEHRFKQNDIVFN

SEQ ID NO: 1822753 - protein, 20 aa, Staphylococcus epidermidis
LGAPYEVLKQIKDNGRLPVV

SEQ ID NO: 1822754 - protein, 23 aa, Staphylococcus epidermidis
LGEEYSFFVYPNRSGDLFATQNM

SEQ ID NO: 1822755 - protein, 17 aa, Staphylococcus epidermidis
LGISILPATIAQLLNDD

SEQ ID NO: 1822756 - protein, 18 aa, Staphylococcus epidermidis
LGKDIQYKDLGLLIVDEE

SEQ ID NO: 1822757 - protein, 17 aa, Staphylococcus epidermidis
LGYRRIFNIKEKGTRHG

SEQ ID NO: 1822758 - protein, 18 aa, Staphylococcus epidermidis
LHDKMNHLPILTDLFKEI

SEQ ID NO: 1822759 - protein, 26 aa, Staphylococcus epidermidis
LHDNKESFINFYHERLLIADKKPNIV

SEQ ID NO: 1822760 - protein, 18 aa, Staphylococcus epidermidis
LHWQYGHVLTIFEQALSL

SEQ ID NO: 1822761 - protein, 17 aa, Staphylococcus epidermidis
LIAGLISIGAEVMRLGV

SEQ ID NO: 1822762 - protein, 29 aa, Staphylococcus epidermidis
LIEEALKFKPITLNPWGISDLELIGIGGF

SEQ ID NO: 1822763 - protein, 44 aa, Staphylococcus epidermidis
LILTGTGMFPKWKGVPIRLAMKLVTFIFGKRRRLKWVNQLLNKT

SEQ ID NO: 1822764 - protein, 18 aa, Staphylococcus epidermidis
LISSFNVVLVKLAEEIMP

SEQ ID NO: 1822765 - protein, 20 aa, Staphylococcus epidermidis
LKAARRWAYDVKGIEPNKAE

SEQ ID NO: 1822766 - protein, 18 aa, Staphylococcus epidermidis
LKDRLMHQLGDALIQYAI

SEQ ID NO: 1822767 - protein, 23 aa, Staphylococcus epidermidis
LKESRWMNLIRKNKYLFNKCKTY

SEQ ID NO: 1822768 - protein, 22 aa, Staphylococcus epidermidis
LKLKLQFFAEEPGDNAQTSEGQ

SEQ ID NO: 1822769 - protein, 22 aa, Staphylococcus epidermidis
LKPYTIAKHYADDYLRTSDLNY

SEQ ID NO: 1822770 - protein, 19 aa, Staphylococcus epidermidis
LLKKPNYLRRDITKEIQKF

SEQ ID NO: 1822771 - protein, 17 aa, Staphylococcus epidermidis
LLLKKHGKNLYQAGLRR

SEQ ID NO: 1822772 - protein, 18 aa, Staphylococcus epidermidis
LLLTVDNIEMILVKGSDV

SEQ ID NO: 1822773 - protein, 18 aa, Staphylococcus epidermidis
LLMVMSHVGIFFDEKLCQ

SEQ ID NO: 1822774 - protein, 19 aa, Staphylococcus epidermidis
LLNPLTLAYMGDAVLDQHV

SEQ ID NO: 1822775 - protein, 17 aa, Staphylococcus epidermidis
LLQYVSGLTSTIAQNII

SEQ ID NO: 1822776 - protein, 25 aa, Staphylococcus epidermidis
LMDKDEVIFSELLRFAGIGESKLET

SEQ ID NO: 1822777 - protein, 17 aa, Staphylococcus epidermidis
LMSKLVPAFPNLQLHLF

SEQ ID NO: 1822778 - protein, 29 aa, Staphylococcus epidermidis
LMTEDIKAQLLDWILPYYKNLSREGMKDI

SEQ ID NO: 1822779 - protein, 23 aa, Staphylococcus epidermidis
LNVNWMNYKIKYLKPINIDEEVQ

SEQ ID NO: 1822780 - protein, 22 aa, Staphylococcus epidermidis
LPLTSIYNRLGFDFGIVGNHEF

SEQ ID NO: 1822781 - protein, 21 aa, Staphylococcus epidermidis
LPRPFFILAPMEDVTDIVFRH

SEQ ID NO: 1822782 - protein, 22 aa, Staphylococcus epidermidis
LQESAFLLKDLKITLTDLRSGK

SEQ ID NO: 1822783 - protein, 19 aa, Staphylococcus epidermidis
LQPFNPESYVYGLFADMIE

SEQ ID NO: 1822784 - protein, 20 aa, Staphylococcus epidermidis
LRKPDWLKIKLNTNDNYTGL

SEQ ID NO: 1822785 - protein, 20 aa, Staphylococcus epidermidis
LSKRLHFIRDKRLLQISLKK

SEQ ID NO: 1822786 - protein, 17 aa, Staphylococcus epidermidis
LSLILSQNKISDANPEV

SEQ ID NO: 1822787 - protein, 22 aa, Staphylococcus epidermidis
LSPNDLFTWSSGIKSPIYCDNR

SEQ ID NO: 1822788 - protein, 23 aa, Staphylococcus epidermidis
LTGLEILSYVRKKQLNTRIIIVT

SEQ ID NO: 1822789 - protein, 26 aa, Staphylococcus epidermidis
LTLIDRMPFHGLKPEFYALAAGTKSD

SEQ ID NO: 1822790 - protein, 18 aa, Staphylococcus epidermidis
LTLPMKTSFFIPANDISR

SEQ ID NO: 1822791 - protein, 30 aa, Staphylococcus epidermidis
LVAESVMGQIDFLIAKARYARTIKGTKPTF

SEQ ID NO: 1822792 - protein, 18 aa, Staphylococcus epidermidis
LVEYDGELPFWDKSSPDA

SEQ ID NO: 1822793 - protein, 18 aa, Staphylococcus epidermidis
LVPAFPNLQLHLFGFGKE

SEQ ID NO: 1822794 - protein, 22 aa, Staphylococcus epidermidis
LYDDLFQFLVKIKDIYKTKLGS

SEQ ID NO: 1822795 - protein, 17 aa, Staphylococcus epidermidis
LYEKFGFKSTEPYSKGM

SEQ ID NO: 1822796 - protein, 17 aa, Staphylococcus epidermidis
MAGPSHVLPTNQTARFT

SEQ ID NO: 1822797 - protein, 22 aa, Staphylococcus epidermidis
MEDEMVYIYKKSIQPRMDICFV

SEQ ID NO: 1822798 - protein, 18 aa, Staphylococcus epidermidis
MESRGMVLYMNRNTRKTT

SEQ ID NO: 1822799 - protein, 17 aa, Staphylococcus epidermidis
MGDIMGDVTARRGRVDG

SEQ ID NO: 1822800 - protein, 26 aa, Staphylococcus epidermidis
MGEVGKLGRVLGPKGLMPNPKTGTVT

SEQ ID NO: 1822801 - protein, 20 aa, Staphylococcus epidermidis
MGGPLIAKILNDGKDKLVNH

SEQ ID NO: 1822802 - protein, 28 aa, Staphylococcus epidermidis
MIPCKPDHPFVYWATFSNAADLLDSGVN

SEQ ID NO: 1822803 - protein, 33 aa, Staphylococcus epidermidis
MIQAQSAFFNKGNMLKPWFVSSIDNPITKKNYY

SEQ ID NO: 1822804 - protein, 29 aa, Staphylococcus epidermidis
MKETATYFLDLGISAVLITLGEQGTYCAY

SEQ ID NO: 1822805 - protein, 19 aa, Staphylococcus epidermidis
MKQRLCLAICLITKPKVAV

SEQ ID NO: 1822806 - protein, 24 aa, Staphylococcus epidermidis
MNNVKFIKPVYPGNTLYVIAEITN

SEQ ID NO: 1822807 - protein, 32 aa, Staphylococcus epidermidis
MTSICKKWYINSFKYFRNTYKRFYYSRPNELD

SEQ ID NO: 1822808 - protein, 20 aa, Staphylococcus epidermidis
NAFNGFLHKNNFKGKEIFSA

SEQ ID NO: 1822809 - protein, 27 aa, Staphylococcus epidermidis
NDNAQGEYYLPDVLSLILKDGGKAEVY

SEQ ID NO: 1822810 - protein, 22 aa, Staphylococcus epidermidis
NDNYVFTRLKTMGKLAMLMLED

SEQ ID NO: 1822811 - protein, 24 aa, Staphylococcus epidermidis
NEEFGRWQIGQNDKLLLIGSGAYP

SEQ ID NO: 1822812 - protein, 42 aa, Staphylococcus epidermidis
NEKDGRQAIQYLKQRGLGRATFLPLNVIQPRHVAADIKDVAR

SEQ ID NO: 1822813 - protein, 18 aa, Staphylococcus epidermidis
NEMAHRGFRLQPISLEKS

SEQ ID NO: 1822814 - protein, 43 aa, Staphylococcus epidermidis
NETIQIINKPIGVTAGIVPWNAPILVLMRKVIPAIVTGCSVVI

SEQ ID NO: 1822815 - protein, 18 aa, Staphylococcus epidermidis
NEYISARAYRLLRVGSFL

SEQ ID NO: 1822816 - protein, 21 aa, Staphylococcus epidermidis
NFDLTGRLALYTSLPVIASGG

SEQ ID NO: 1822817 - protein, 26 aa, Staphylococcus epidermidis
NFEKKHIDWINYWQNICNYTLKFVEN

SEQ ID NO: 1822818 - protein, 23 aa, Staphylococcus epidermidis
NFYNIDEQLIFVDVPGYGYAKVS

SEQ ID NO: 1822819 - protein, 29 aa, Staphylococcus epidermidis
NGETSKDYLWTILIHRLREWELNDKTYFN

SEQ ID NO: 1822820 - protein, 21 aa, Staphylococcus epidermidis
NHAPFANYWMHNGFINIDNEK

SEQ ID NO: 1822821 - protein, 25 aa, Staphylococcus epidermidis
NHIAVKCVFFNQPYLKKKLELNSIV

SEQ ID NO: 1822822 - protein, 18 aa, Staphylococcus epidermidis
NHNLKALEAVWDYAYDKV

SEQ ID NO: 1822823 - protein, 22 aa, Staphylococcus epidermidis
NHYETEAIWQLFKDANYERVEF

SEQ ID NO: 1822824 - protein, 19 aa, Staphylococcus epidermidis
NIIPDFTHARFYTRATSRK

SEQ ID NO: 1822825 - protein, 26 aa, Staphylococcus epidermidis
NLEIVEKKLPFLFGEDFSFYGQQLAP

SEQ ID NO: 1822826 - protein, 22 aa, Staphylococcus epidermidis
NLINGGTLAIYMGVKRLGQIIK

SEQ ID NO: 1822827 - protein, 24 aa, Staphylococcus epidermidis
NLNKTYFNTFYRYNNDDLKNLENG

SEQ ID NO: 1822828 - protein, 23 aa, Staphylococcus epidermidis
NLRKLGFDIVRFKTGTPPRVNAR

SEQ ID NO: 1822829 - protein, 20 aa, Staphylococcus epidermidis
NMFGVGNLMMRYVMKKKNVD

SEQ ID NO: 1822830 - protein, 18 aa, Staphylococcus epidermidis
NMFGYTGTYKGKEVSVMG

SEQ ID NO: 1822831 - protein, 17 aa, Staphylococcus epidermidis
NNGGRIIYIGAGTSGRL

SEQ ID NO: 1822832 - protein, 27 aa, Staphylococcus epidermidis
NNTSDLPIGVIPVDSLYSPVERVNYTV

SEQ ID NO: 1822833 - protein, 22 aa, Staphylococcus epidermidis
NPKQCKHEFLRYPYIESFENVD

SEQ ID NO: 1822834 - protein, 18 aa, Staphylococcus epidermidis
NPSPKWSIARYKGLGEMN

SEQ ID NO: 1822835 - protein, 18 aa, Staphylococcus epidermidis
NQITHIDFLAINMSEERT

SEQ ID NO: 1822836 - protein, 18 aa, Staphylococcus epidermidis
NQLSKITSLPVLCKDFII

SEQ ID NO: 1822837 - protein, 26 aa, Staphylococcus epidermidis
NQMQKPPVFFLKDGKAREVIKRQSLR

SEQ ID NO: 1822838 - protein, 21 aa, Staphylococcus epidermidis
NRFKEVYSIFSDVLGVPLKSK

SEQ ID NO: 1822839 - protein, 21 aa, Staphylococcus epidermidis
NRKMLNLTGKVDTIFLHCLPA

SEQ ID NO: 1822840 - protein, 19 aa, Staphylococcus epidermidis
NRLIPLSEGYIYFKDKPIS

SEQ ID NO: 1822841 - protein, 24 aa, Staphylococcus epidermidis
NTPKQLMIYEAFGWEAPRFGHMSL

SEQ ID NO: 1822842 - protein, 26 aa, Staphylococcus epidermidis
NTSLSILDFTFFKKTIGKTYGLPLIQ

SEQ ID NO: 1822843 - protein, 18 aa, Staphylococcus epidermidis
NTVRNMFGYTGTYKGKEV

SEQ ID NO: 1822844 - protein, 22 aa, Staphylococcus epidermidis
NVAILDIEIPGLTGLEILSYVR

SEQ ID NO: 1822845 - protein, 34 aa, Staphylococcus epidermidis
NVDYQLIVLNFSPYLRTFLHRYDLYESHYWSVFD

SEQ ID NO: 1822846 - protein, 35 aa, Staphylococcus epidermidis
NVGYLIEHPKLYGNKTGLFNLKLFAQVLGDGFDKE

SEQ ID NO: 1822847 - protein, 18 aa, Staphylococcus epidermidis
NVNVDFPLSVLTVVTGVS

SEQ ID NO: 1822848 - protein, 17 aa, Staphylococcus epidermidis
NVTKEHWGFDDPAGKDW

SEQ ID NO: 1822849 - protein, 18 aa, Staphylococcus epidermidis
NVVLVKLAEEIMPQYNRA

SEQ ID NO: 1822850 - protein, 22 aa, Staphylococcus epidermidis
NYIDFGIALDQYWNLSFLPEEI

SEQ ID NO: 1822851 - protein, 17 aa, Staphylococcus epidermidis
PAFDDILVHMYQYLPNI

SEQ ID NO: 1822852 - protein, 28 aa, Staphylococcus epidermidis
PANEGRGYVLRRLLRRAVRFSQSLGINE

SEQ ID NO: 1822853 - protein, 22 aa, Staphylococcus epidermidis
PENYDALLIPGGFSPDHLRGDE

SEQ ID NO: 1822854 - protein, 20 aa, Staphylococcus epidermidis
PEPIIMSKSLDILGLEKSEV

SEQ ID NO: 1822855 - protein, 17 aa, Staphylococcus epidermidis
PEYMVPVHFMKVDRIPI

SEQ ID NO: 1822856 - protein, 19 aa, Staphylococcus epidermidis
PGHFAPIADYNLVAKAKKA

SEQ ID NO: 1822857 - protein, 25 aa, Staphylococcus epidermidis
PGVAFDKLGYRIGYGGGYYDRFLSQ

SEQ ID NO: 1822858 - protein, 22 aa, Staphylococcus epidermidis
PIQLKADVPLYLIVIGKHLKQI

SEQ ID NO: 1822859 - protein, 19 aa, Staphylococcus epidermidis
PIYIEYHDYYWGQPIYDSK

SEQ ID NO: 1822860 - protein, 20 aa, Staphylococcus epidermidis
PLANVDIFIMSGGKLCGVGI

SEQ ID NO: 1822861 - protein, 25 aa, Staphylococcus epidermidis
PLDDIMKMIPGMNKMKGLDKLNMSD

SEQ ID NO: 1822862 - protein, 17 aa, Staphylococcus epidermidis
PLKYRKMYGQFGGNITH

SEQ ID NO: 1822863 - protein, 20 aa, Staphylococcus epidermidis
PLNHEGLLKYGANLQQKMSH

SEQ ID NO: 1822864 - protein, 17 aa, Staphylococcus epidermidis
PLNVYFSGYRTAEGFEG

SEQ ID NO: 1822865 - protein, 22 aa, Staphylococcus epidermidis
PLSEGYIYFKDKPISDYPVYEM

SEQ ID NO: 1822866 - protein, 27 aa, Staphylococcus epidermidis
PPELSEQFPYIRQLLDAYHIKRYELDN

SEQ ID NO: 1822867 - protein, 30 aa, Staphylococcus epidermidis
PSEETTLLTLRLAELFRASTIPAGLIQIVP

SEQ ID NO: 1822868 - protein, 29 aa, Staphylococcus epidermidis
PTFKEDRTIYLPNAFHPLLDKDTVVANTI

SEQ ID NO: 1822869 - protein, 28 aa, Staphylococcus epidermidis
PTSDVPLHLYLSVLGMPGQTAYHGLLDI

SEQ ID NO: 1822870 - protein, 22 aa, Staphylococcus epidermidis
PVELRRSIGYVIQQIGLMPHMT

SEQ ID NO: 1822871 - protein, 25 aa, Staphylococcus epidermidis
PVIGICLGMQLLFQHSAEGDVSGLE

SEQ ID NO: 1822872 - protein, 26 aa, Staphylococcus epidermidis
PWEDLPKLKELWPKAGDYLLVTLRID

SEQ ID NO: 1822873 - protein, 30 aa, Staphylococcus epidermidis
PYKVFTSFYRKWRPYLMIRDEYDYHLEDIS

SEQ ID NO: 1822874 - protein, 25 aa, Staphylococcus epidermidis
PYSNFKVGAYLKTKDGRCFYGANVE

SEQ ID NO: 1822875 - protein, 18 aa, Staphylococcus epidermidis
PYVFAGHFAPQQMKEALQ

SEQ ID NO: 1822876 - protein, 24 aa, Staphylococcus epidermidis
QALVAYFIRQLLLNSEDIIIIDRA

SEQ ID NO: 1822877 - protein, 32 aa, Staphylococcus epidermidis
QATNHQYLKVFWNHLKPVMESLILISMRQRMA

SEQ ID NO: 1822878 - protein, 21 aa, Staphylococcus epidermidis
QAVFEMMNWWFEKGIDGFRVD

SEQ ID NO: 1822879 - protein, 32 aa, Staphylococcus epidermidis
QAYIELGTRFSPFYFKKLWLDAWEETHERRLV

SEQ ID NO: 1822880 - protein, 25 aa, Staphylococcus epidermidis
QCNQHRYQLLLNYTGLKIDGEISAL

SEQ ID NO: 1822881 - protein, 25 aa, Staphylococcus epidermidis
QDPLGDPIVLIAPTQSTFQLEQAFV

SEQ ID NO: 1822882 - protein, 26 aa, Staphylococcus epidermidis
QDQPYHSWFNIVEHFLPSDSHDLLDI

SEQ ID NO: 1822883 - protein, 17 aa, Staphylococcus epidermidis
QESFHIADNERTLYDWA

SEQ ID NO: 1822884 - protein, 29 aa, Staphylococcus epidermidis
QFLQSKHLNELILYIAPKLIGGSGKHQFY

SEQ ID NO: 1822885 - protein, 20 aa, Staphylococcus epidermidis
QFVILGHYQLIDALLEKNHQ

SEQ ID NO: 1822886 - protein, 24 aa, Staphylococcus epidermidis
QHPDRKIKIFPGLVTYVGETHEKA

SEQ ID NO: 1822887 - protein, 19 aa, Staphylococcus epidermidis
QHTLLMETSALIPANDISR

SEQ ID NO: 1822888 - protein, 28 aa, Staphylococcus epidermidis
QIICYDLRFPEILRYPARKGAKIAFYVA

SEQ ID NO: 1822889 - protein, 25 aa, Staphylococcus epidermidis
QIKRLKFDYLYIDNARLKSPYLLDN

SEQ ID NO: 1822890 - protein, 26 aa, Staphylococcus epidermidis
QKFRAKQIFEWLYQKRVNTIDEMTNL

SEQ ID NO: 1822891 - protein, 22 aa, Staphylococcus epidermidis
QKSILINMIKCVEACGVDVLDV

SEQ ID NO: 1822892 - protein, 25 aa, Staphylococcus epidermidis
QKTQLLKWHIELPKVVKLQKDIEKK

SEQ ID NO: 1822893 - protein, 19 aa, Staphylococcus epidermidis
QLSYIFITHDIQAATYICD

SEQ ID NO: 1822894 - protein, 17 aa, Staphylococcus epidermidis
QLTCIFVDHGLLRKGEG

SEQ ID NO: 1822895 - protein, 27 aa, Staphylococcus epidermidis
QMIEIDVEPYYILSKKHQLLTIIDNTF

SEQ ID NO: 1822896 - protein, 17 aa, Staphylococcus epidermidis
QNVAQLVEDLRSEIQKM

SEQ ID NO: 1822897 - protein, 19 aa, Staphylococcus epidermidis
QQIALFPHMTIKENIAQVP

SEQ ID NO: 1822898 - protein, 25 aa, Staphylococcus epidermidis
QQRKIRRDFYDTRGFLSCSRILTSQ

SEQ ID NO: 1822899 - protein, 19 aa, Staphylococcus epidermidis
QRIAIARALIARPKLLLAD

SEQ ID NO: 1822900 - protein, 23 aa, Staphylococcus epidermidis
QSIFGGIIALNRTVDVKLAEALH

SEQ ID NO: 1822901 - protein, 24 aa, Staphylococcus epidermidis
QSPNNILGISYLKAMQQFAPHMSA

SEQ ID NO: 1822902 - protein, 26 aa, Staphylococcus epidermidis
QSQCKRAIILPNNKNIMMASEQAASI

SEQ ID NO: 1822903 - protein, 17 aa, Staphylococcus epidermidis
QVAPISLEFYKQFIGGE

SEQ ID NO: 1822904 - protein, 30 aa, Staphylococcus epidermidis
QVDSLFYNTPARLKYIKSLYTELGKITDIV

SEQ ID NO: 1822905 - protein, 30 aa, Staphylococcus epidermidis
QVHTGRYYIQRFLARSFGFEVDDIKDMSEV

SEQ ID NO: 1822906 - protein, 23 aa, Staphylococcus epidermidis
QVSEYIMTFILHDYKKMKTSYRN

SEQ ID NO: 1822907 - protein, 24 aa, Staphylococcus epidermidis
QYQPRYNILLKDDKSYPFIKITKE

SEQ ID NO: 1822908 - protein, 25 aa, Staphylococcus epidermidis
QYSSLKQFFFCGEILPHKTAKALVE

SEQ ID NO: 1822909 - protein, 19 aa, Staphylococcus epidermidis
RDEKRPRFGLLRGREFLMK

SEQ ID NO: 1822910 - protein, 23 aa, Staphylococcus epidermidis
REGQLFLLDVFEGNIFKVNPATK

SEQ ID NO: 1822911 - protein, 29 aa, Staphylococcus epidermidis
REKGAMTNVLFMTATPIPRTLAISVFGEM

SEQ ID NO: 1822912 - protein, 25 aa, Staphylococcus epidermidis
RELTKDPKYLIGRIIARPYVGEPGN

SEQ ID NO: 1822913 - protein, 21 aa, Staphylococcus epidermidis
REQLLKEVWHYEFYGDLRTVD

SEQ ID NO: 1822914 - protein, 22 aa, Staphylococcus epidermidis
REQQNLTIVLITHEMHVIRRIC

SEQ ID NO: 1822915 - protein, 28 aa, Staphylococcus epidermidis
RFKGIIASGMHTLSISFKLWVEEGKYGE

SEQ ID NO: 1822916 - protein, 28 aa, Staphylococcus epidermidis
RGEIDPVIRFYTWNPATLSIGYFQRLQK

SEQ ID NO: 1822917 - protein, 17 aa, Staphylococcus epidermidis
RGFVPASLISTDFIEDF

SEQ ID NO: 1822918 - protein, 27 aa, Staphylococcus epidermidis
RGHMTNELLQRFKFDKAFISCGSFDTS

SEQ ID NO: 1822919 - protein, 24 aa, Staphylococcus epidermidis
RGMGTTLVCAIIYDKQVVVANVGD

SEQ ID NO: 1822920 - protein, 17 aa, Staphylococcus epidermidis
RGYGIINHTFEEFRPRV

SEQ ID NO: 1822921 - protein, 17 aa, Staphylococcus epidermidis
RHPVDVCFVPIGDNFTM

SEQ ID NO: 1822922 - protein, 17 aa, Staphylococcus epidermidis
RILAERVGPIKLHLVPF

SEQ ID NO: 1822923 - protein, 17 aa, Staphylococcus epidermidis
RKKQLNTRIIIVTTFKR

SEQ ID NO: 1822924 - protein, 20 aa, Staphylococcus epidermidis
RLMHQLGDALIQYAIEQCAG

SEQ ID NO: 1822925 - protein, 33 aa, Staphylococcus epidermidis
RMVVSQFLTKDLFIDWIWGESFFKQKLIDYDAA

SEQ ID NO: 1822926 - protein, 17 aa, Staphylococcus epidermidis
RNDFTPSILTAIKIARI

SEQ ID NO: 1822927 - protein, 29 aa, Staphylococcus epidermidis
RNHSFPTPPVKPVIMAFTKSYDRPYEELE

SEQ ID NO: 1822928 - protein, 17 aa, Staphylococcus epidermidis
RQLTTSSAMLIIFGDLQ

SEQ ID NO: 1822929 - protein, 32 aa, Staphylococcus epidermidis
RQQQLEAFIPRMKKWDYILTSSDINTTLLESA

SEQ ID NO: 1822930 - protein, 22 aa, Staphylococcus epidermidis
RQTYEELFPYDIPTIYTKTLRE

SEQ ID NO: 1822931 - protein, 19 aa, Staphylococcus epidermidis
RQVRRMFEYFGHQVNKLTR

SEQ ID NO: 1822932 - protein, 25 aa, Staphylococcus epidermidis
RRERGITFGLFRLSVGLENPEELIA

SEQ ID NO: 1822933 - protein, 18 aa, Staphylococcus epidermidis
RSEIIKIHKQMKATTIYV

SEQ ID NO: 1822934 - protein, 23 aa, Staphylococcus epidermidis
RSQTKYPHFIKQLQDRKPYQLSA

SEQ ID NO: 1822935 - protein, 17 aa, Staphylococcus epidermidis
RTILVSIMFVNNEIGTV

SEQ ID NO: 1822936 - protein, 18 aa, Staphylococcus epidermidis
RTISMINKYFHGELPAYQ

SEQ ID NO: 1822937 - protein, 24 aa, Staphylococcus epidermidis
RTKLSLAVLFSTKANMLILDEPTN

SEQ ID NO: 1822938 - protein, 35 aa, Staphylococcus epidermidis
RVEAPLIQAQLIETILLNIINFQTLIATKASRIRQ

SEQ ID NO: 1822939 - protein, 22 aa, Staphylococcus epidermidis
RWGPRTLDIDILLFGDQIIEQD

SEQ ID NO: 1822940 - protein, 19 aa, Staphylococcus epidermidis
SASNYFHLLRAQAASLDTL

SEQ ID NO: 1822941 - protein, 18 aa, Staphylococcus epidermidis
SDPFKILSKRELEILPLI

SEQ ID NO: 1822942 - protein, 25 aa, Staphylococcus epidermidis
SEEYDTPIVPVFWIAGEDHDFEEVN

SEQ ID NO: 1822943 - protein, 20 aa, Staphylococcus epidermidis
SEIYDYIKKIVQTKGYPPSV

SEQ ID NO: 1822944 - protein, 18 aa, Staphylococcus epidermidis
SELKQRIPLILEVTSNQY

SEQ ID NO: 1822945 - protein, 26 aa, Staphylococcus epidermidis
SEMLEAIFFGHEEIKRLVAFQQEIID

SEQ ID NO: 1822946 - protein, 18 aa, Staphylococcus epidermidis
SEQLTSLMQQYPKLHIHL

SEQ ID NO: 1822947 - protein, 21 aa, Staphylococcus epidermidis
SEVPAHVQAGWMLTTIASIGE

SEQ ID NO: 1822948 - protein, 18 aa, Staphylococcus epidermidis
SFGFNSRQLTTSSAMLII

SEQ ID NO: 1822949 - protein, 19 aa, Staphylococcus epidermidis
SFRPEFLNRVDDIIVFHKL

SEQ ID NO: 1822950 - protein, 17 aa, Staphylococcus epidermidis
SGIRYYVNRLLEQTSHQ

SEQ ID NO: 1822951 - protein, 31 aa, Staphylococcus epidermidis
SGYLARIVGHKKAREIWYLCRQYNAQEALDM

SEQ ID NO: 1822952 - protein, 24 aa, Staphylococcus epidermidis
SHQTKIQLFEYLRGWLDHEDIDYR

SEQ ID NO: 1822953 - protein, 30 aa, Staphylococcus epidermidis
SICDIYPLLNRSLLYSAIILHDLGKVRELS

SEQ ID NO: 1822954 - protein, 24 aa, Staphylococcus epidermidis
SIDHSYFNVTYLSTLYTGDLESSL

SEQ ID NO: 1822955 - protein, 25 aa, Staphylococcus epidermidis
SIKPQLTLRTLGRLKPLLNEGTVTV

SEQ ID NO: 1822956 - protein, 22 aa, Staphylococcus epidermidis
SKAFTTLINSDIPFYQTTTSEI

SEQ ID NO: 1822957 - protein, 18 aa, Staphylococcus epidermidis
SKIDIPRVRFTTSHPWDF

SEQ ID NO: 1822958 - protein, 17 aa, Staphylococcus epidermidis
SKITSLPVLCKDFIIDK

SEQ ID NO: 1822959 - protein, 21 aa, Staphylococcus epidermidis
SKRHVSLKQLKYLAKIVPDHI

SEQ ID NO: 1822960 - protein, 25 aa, Staphylococcus epidermidis
SLEESLDLYQRGMKLSANCDSTLKE

SEQ ID NO: 1822961 - protein, 23 aa, Staphylococcus epidermidis
SLHNELFPIEYGLKGLKSFQVKD

SEQ ID NO: 1822962 - protein, 23 aa, Staphylococcus epidermidis
SLKSHFYDLSKKGVKGRIITSNY

SEQ ID NO: 1822963 - protein, 17 aa, Staphylococcus epidermidis
SNGDLIIITAGVPTGEK

SEQ ID NO: 1822964 - protein, 18 aa, Staphylococcus epidermidis
SNILCPFHYFGVTDYIQN

SEQ ID NO: 1822965 - protein, 17 aa, Staphylococcus epidermidis
SNIWFEKEAKELLPEGF

SEQ ID NO: 1822966 - protein, 18 aa, Staphylococcus epidermidis
SNRDYLAEFLPFVEHTKK

SEQ ID NO: 1822967 - protein, 24 aa, Staphylococcus epidermidis
SNYREHVVFILWGRPAQQKERFID

SEQ ID NO: 1822968 - protein, 20 aa, Staphylococcus epidermidis
SPEFVNESPYEKAWMVKIEI

SEQ ID NO: 1822969 - protein, 30 aa, Staphylococcus epidermidis
SPSQMLKFGLPRLTQYFRSNLKLEQQRLKK

SEQ ID NO: 1822970 - protein, 18 aa, Staphylococcus epidermidis
SQYFKRKYNFLYSEEEII

SEQ ID NO: 1822971 - protein, 18 aa, Staphylococcus epidermidis
SRLKDGILAIDLLRRPEM

SEQ ID NO: 1822972 - protein, 19 aa, Staphylococcus epidermidis
SSKLAHLLQDSKKPMILYG

SEQ ID NO: 1822973 - protein, 25 aa, Staphylococcus epidermidis
SSTIVYLPEFIRTLKGGFKDGSFEK

SEQ ID NO: 1822974 - protein, 23 aa, Staphylococcus epidermidis
STIVGLGPRILRAETAPLYALSA

SEQ ID NO: 1822975 - protein, 21 aa, Staphylococcus epidermidis
STVWSTRYLNLSVNNKFIISS

SEQ ID NO: 1822976 - protein, 22 aa, Staphylococcus epidermidis
SVFHIHFHLIPRYENDIDGFGY

SEQ ID NO: 1822977 - protein, 19 aa, Staphylococcus epidermidis
SVLLAPWDVIESRLKDILN

SEQ ID NO: 1822978 - protein, 17 aa, Staphylococcus epidermidis
SVPLQYLIAAALEVTDV

SEQ ID NO: 1822979 - protein, 23 aa, Staphylococcus epidermidis
SVPYYAGLSFRTLVPKQPDLSPH

SEQ ID NO: 1822980 - protein, 17 aa, Staphylococcus epidermidis
TDADLRILRRLTRDTKE

SEQ ID NO: 1822981 - protein, 22 aa, Staphylococcus epidermidis
TDAIKWVLGEQSAKSLRGAKME

SEQ ID NO: 1822982 - protein, 23 aa, Staphylococcus epidermidis
TDIEIVELLAFVSFTHCQQEFGA

SEQ ID NO: 1822983 - protein, 17 aa, Staphylococcus epidermidis
TDKVGLVTCMYVNNIMG

SEQ ID NO: 1822984 - protein, 19 aa, Staphylococcus epidermidis
TDWTYFQIKLVIVGIERGD

SEQ ID NO: 1822985 - protein, 30 aa, Staphylococcus epidermidis
TEDSRKAIYLLPPQPLKYASNTWIYKTMPT

SEQ ID NO: 1822986 - protein, 18 aa, Staphylococcus epidermidis
TEEKLNVPLIGFTGAPFT

SEQ ID NO: 1822987 - protein, 20 aa, Staphylococcus epidermidis
TEIYSMMQGALRLLINGSDF

SEQ ID NO: 1822988 - protein, 21 aa, Staphylococcus epidermidis
TERDILLVPDVLASAGGVTVS

SEQ ID NO: 1822989 - protein, 25 aa, Staphylococcus epidermidis
TESQDWVSMLLRMYQRYCEQNGFKV

SEQ ID NO: 1822990 - protein, 20 aa, Staphylococcus epidermidis
TFTHEFMFSRPLHHTDDVIK

SEQ ID NO: 1822991 - protein, 40 aa, Staphylococcus epidermidis
TGALMSAGLFIVGRIKGVARPALVVTLPTTDGKGFVFLDV

SEQ ID NO: 1822992 - protein, 30 aa, Staphylococcus epidermidis
TGHMPNLWPHLSLIRIPTLILVGEKDKKFV

SEQ ID NO: 1822993 - protein, 24 aa, Staphylococcus epidermidis
TGKVDTIFLHCLPAFHDTQTEYGQ

SEQ ID NO: 1822994 - protein, 25 aa, Staphylococcus epidermidis
TGWGRIPMSLGFTYSSNTLMMHLQD

SEQ ID NO: 1822995 - protein, 31 aa, Staphylococcus epidermidis
THMMHVTISYPLPDNQLLTQLFTALEEESVN

SEQ ID NO: 1822996 - protein, 19 aa, Staphylococcus epidermidis
TIDLCLDVLVLPNGEYELV

SEQ ID NO: 1822997 - protein, 24 aa, Staphylococcus epidermidis
TIDPLKYNLLFERFLNPERVTMPD

SEQ ID NO: 1822998 - protein, 26 aa, Staphylococcus epidermidis
TIEKRVQAHNFTWASPIMSRPVKNMT

SEQ ID NO: 1822999 - protein, 21 aa, Staphylococcus epidermidis
TILQDLYQRGIGKLLVEAGPN

SEQ ID NO: 1823000 - protein, 33 aa, Staphylococcus epidermidis
TKKYDNPFTPPMFARVFRKHLEGGFIKAIRQVG

SEQ ID NO: 1823001 - protein, 21 aa, Staphylococcus epidermidis
TKRMYPDILNYDKLVELLGDF

SEQ ID NO: 1823002 - protein, 21 aa, Staphylococcus epidermidis
TKTKKLFQRFNKNDYQKVTKV

SEQ ID NO: 1823003 - protein, 31 aa, Staphylococcus epidermidis; identical to SEQ ID NO: 1690557

SEQ ID NO: 1823004 - protein, 21 aa, Staphylococcus epidermidis
TLLKQLNHLISPTSGDLYLND

SEQ ID NO: 1823005 - protein, 25 aa, Staphylococcus epidermidis
TMNEMLMANYLFNSSNNPRFKRWVI

SEQ ID NO: 1823006 - protein, 21 aa, Staphylococcus epidermidis
TMNMGLTMRSIAPSVTFSTGH

SEQ ID NO: 1823007 - protein, 23 aa, Staphylococcus epidermidis
TMRDIINNYPFPNTFKVIELSGK

SEQ ID NO: 1823008 - protein, 23 aa, Staphylococcus epidermidis
TMTDVYHYLVNLLIKNKVDVSQV

SEQ ID NO: 1823009 - protein, 22 aa, Staphylococcus epidermidis
TNLVPFLTIEQQFKLLGKYKKD

SEQ ID NO: 1823010 - protein, 28 aa, Staphylococcus epidermidis
TNPEDFHRPGHLFPLIAKENGVLTRNGH

SEQ ID NO: 1823011 - protein, 23 aa, Staphylococcus epidermidis
TNQAEKWYEHASKEELETLKNKH

SEQ ID NO: 1823012 - protein, 21 aa, Staphylococcus epidermidis
TNRQLVYFKYNIKEDIYTEDE

SEQ ID NO: 1823013 - protein, 21 aa, Staphylococcus epidermidis
TPKVTSLYKKGGTIYAHVMHT

SEQ ID NO: 1823014 - protein, 33 aa, Staphylococcus epidermidis
TRAPEMYIDKVKYVGALFLGHFSPEVIGDYMAG

SEQ ID NO: 1823015 - protein, 19 aa, Staphylococcus epidermidis
TRLESDLMQLIIDLENCQP

SEQ ID NO: 1823016 - protein, 23 aa, Staphylococcus epidermidis
TSEQLELLRILYNYDRLSQYDLT

SEQ ID NO: 1823017 - protein, 17 aa, Staphylococcus epidermidis
TSFAKLIQYQTYEFTLF

SEQ ID NO: 1823018 - protein, 18 aa, Staphylococcus epidermidis
TSIFYPKMFEANPELLNM

SEQ ID NO: 1823019 - protein, 23 aa, Staphylococcus epidermidis
TSKNLMCLFRKINQKHQTILMVT

SEQ ID NO: 1823020 - protein, 25 aa, Staphylococcus epidermidis
TSMFYNFKLMKNNVLPSLLLPELSG

SEQ ID NO: 1823021 - protein, 27 aa, Staphylococcus epidermidis
TSSYKKNIYPIFKQLGLDTYIDVVVGR

SEQ ID NO: 1823022 - protein, 18 aa, Staphylococcus epidermidis
TTELSFYNLLPDEEKKGR

SEQ ID NO: 1823023 - protein, 20 aa, Staphylococcus epidermidis
TVEAKRLKNNPIRTFMCDDC

SEQ ID NO: 1823024 - protein, 18 aa, Staphylococcus epidermidis
TVEILSHNPYIVALKDAT

SEQ ID NO: 1823025 - protein, 25 aa, Staphylococcus epidermidis
TVTPQGFFAIIKKPTYDKTLAKQVL

SEQ ID NO: 1823026 - protein, 19 aa, Staphylococcus epidermidis
TVVISKTNRQFKIVKSLIL

SEQ ID NO: 1823027 - protein, 23 aa, Staphylococcus epidermidis
TVVNKLFNIVQPDYAYFGKKDAQ

SEQ ID NO: 1823028 - protein, 17 aa, Staphylococcus epidermidis
TVYHSMNIPHDLFTPIF

SEQ ID NO: 1823029 - protein, 25 aa, Staphylococcus epidermidis
TVYKGLEMFINFQPNTIIALGGGSA

SEQ ID NO: 1823030 - protein, 20 aa, Staphylococcus epidermidis
TYDFTRTHYPIYGKKVGEKV

SEQ ID NO: 1823031 - protein, 27 aa, Staphylococcus epidermidis
TYFDNVTLYILAAQKKKKEILTETIPQ

SEQ ID NO: 1823032 - protein, 25 aa, Staphylococcus epidermidis
TYGKLGVKVWIYRGEVLPTKNTSEG

SEQ ID NO: 1823033 - protein, 20 aa, Staphylococcus epidermidis
TYPQLGRLIGFIPKEKVVDV

SEQ ID NO: 1823034 - protein, 23 aa, Staphylococcus epidermidis
TYSKIYEHYFKNQSPFKQTNFYI

SEQ ID NO: 1823035 - protein, 18 aa, Staphylococcus epidermidis
VCNYLDDVYVIEKMLLRQ

SEQ ID NO: 1823036 - protein, 26 aa, Staphylococcus epidermidis
VDVSGKWFFDRYSPVTNIKAVGHADV

SEQ ID NO: 1823037 - protein, 19 aa, Staphylococcus epidermidis
VEDVFVFDHYKDELYIIAS

SEQ ID NO: 1823038 - protein, 24 aa, Staphylococcus epidermidis
VEDVSTIIMNIKKLALKIYSEEDK

SEQ ID NO: 1823039 - protein, 18 aa, Staphylococcus epidermidis
VEKIIPSLQAGKIVLCDR

SEQ ID NO: 1823040 - protein, 22 aa, Staphylococcus epidermidis
VEPERLRFDFSHFGPMTQEEIN

SEQ ID NO: 1823041 - protein, 17 aa, Staphylococcus epidermidis
VEVGDVIIIMTYAQLNE

SEQ ID NO: 1823042 - protein, 20 aa, Staphylococcus epidermidis
VEVRNRFVLAPLTHTSSNDD

SEQ ID NO: 1823043 - protein, 25 aa, Staphylococcus epidermidis
VFKDEIFGPVLAITTYRDFEQVIED

SEQ ID NO: 1823044 - protein, 17 aa, Staphylococcus epidermidis
VFKELEFIYDEKGLIKI

SEQ ID NO: 1823045 - protein, 25 aa, Staphylococcus epidermidis
VGFLDHMLTLFTFHSGLTLSIEATG

SEQ ID NO: 1823046 - protein, 24 aa, Staphylococcus epidermidis
VGGRLPGGIKIKRAKLRGERSEGM

SEQ ID NO: 1823047 - protein, 29 aa, Staphylococcus epidermidis
VGPSMISQLRLYIHDFPIVAIGGINETNV

SEQ ID NO: 1823048 - protein, 29 aa, Staphylococcus epidermidis
VGQHQMWTAQFYPFKNYGQWVTSGGLGTM

SEQ ID NO: 1823049 - protein, 20 aa, Staphylococcus epidermidis
VGYKFDRWLDLSFYQYDLSD

SEQ ID NO: 1823050 - protein, 24 aa, Staphylococcus epidermidis
VIERIRGVIPVYAIPVGYSSFEMN

SEQ ID NO: 1823051 - protein, 26 aa, Staphylococcus epidermidis
VIGQGALPVGLLPRIIVDDKEYVVPM

SEQ ID NO: 1823052 - protein, 25 aa, Staphylococcus epidermidis
VIKHRDLIRMLLMKQDAFLTENNKI

SEQ ID NO: 1823053 - protein, 18 aa, Staphylococcus epidermidis
VILFAPTFRGNGHRTAHY

SEQ ID NO: 1823054 - protein, 25 aa, Staphylococcus epidermidis
VKGENPYFVSFIGDAPKKKPKVIVY

SEQ ID NO: 1823055 - protein, 24 aa, Staphylococcus epidermidis
VKINNVIPIYVIPAGYIDTNESHH

SEQ ID NO: 1823056 - protein, 20 aa, Staphylococcus epidermidis
VKNLGPLDDIMKMIPGMNKM

SEQ ID NO: 1823057 - protein, 24 aa, Staphylococcus epidermidis
VKNQKVIDWLWETQDKTFFNSKED

SEQ ID NO: 1823058 - protein, 17 aa, Staphylococcus epidermidis
VKPPFFIEWDNNKKQNL

SEQ ID NO: 1823059 - protein, 29 aa, Staphylococcus epidermidis
VKSILKAKRIILLAFGPKKKEAISKLLNE

SEQ ID NO: 1823060 - protein, 20 aa, Staphylococcus epidermidis
VLFKMHPFVRNKLNIPAIYS

SEQ ID NO: 1823061 - protein, 18 aa, Staphylococcus epidermidis
VLLALINKGMVREEAYDK

SEQ ID NO: 1823062 - protein, 17 aa, Staphylococcus epidermidis
VLVPWEDLPKLKELWPK

SEQ ID NO: 1823063 - protein, 25 aa, Staphylococcus epidermidis
VNHQCFDYILTNPPIRAGKDIVHRI

SEQ ID NO: 1823064 - protein, 24 aa, Staphylococcus epidermidis
VNLDGIFVQIGLVPNTSWLQNAVE

SEQ ID NO: 1823065 - protein, 19 aa, Staphylococcus epidermidis
VPMGLFSGDFIFVGDIGRP

SEQ ID NO: 1823066 - protein, 26 aa, Staphylococcus epidermidis
VPTLMCAKLWPQFELFQSFSKKPIIL

SEQ ID NO: 1823067 - protein, 29 aa, Staphylococcus epidermidis
VQDAPGFKHVYPYMLKFIDQLPVVAHNAA

SEQ ID NO: 1823068 - protein, 38 aa, Staphylococcus epidermidis
VQEEPKNQGAWLFVYPYLKALVANKYDLTYHGRIQRAA

SEQ ID NO: 1823069 - protein, 19 aa, Staphylococcus epidermidis
VQEYWFIHDGKIEKIIGSF

SEQ ID NO: 1823070 - protein, 19 aa, Staphylococcus epidermidis
VQVRHRDKYYFPGGKIDEG

SEQ ID NO: 1823071 - protein, 17 aa, Staphylococcus epidermidis
VSAKEGLRLKTLFPYIN

SEQ ID NO: 1823072 - protein, 23 aa, Staphylococcus epidermidis
VSDIVYNPYKTPILIEAEQRGNP

SEQ ID NO: 1823073 - protein, 23 aa, Staphylococcus epidermidis
VSEEQLFYLMSRGISEEEATEMI

SEQ ID NO: 1823074 - protein, 28 aa, Staphylococcus epidermidis
VSQFPARIKCATLAWKALEKGTVEKEGK

SEQ ID NO: 1823075 - protein, 20 aa, Staphylococcus epidermidis
VSTPSFIEMCLLLPNLNEQQ

SEQ ID NO: 1823076 - protein, 25 aa, Staphylococcus epidermidis
VTIAPFGATIPYYFTGHEGPDSCCI

SEQ ID NO: 1823077 - protein, 17 aa, Staphylococcus epidermidis
VVGKFVEFFGPGVQHLP

SEQ ID NO: 1823078 - protein, 17 aa, Staphylococcus epidermidis
VVKSELFRNEEFELALK

SEQ ID NO: 1823079 - protein, 17 aa, Staphylococcus epidermidis
VYNYIHIGNARPAINYD

SEQ ID NO: 1823080 - protein, 20 aa, Staphylococcus epidermidis
WADKRQYLGVDFLGTSYAAV

SEQ ID NO: 1823081 - protein, 21 aa, Staphylococcus epidermidis
WEQPDYIKTLTFNSAVHILKS

SEQ ID NO: 1823082 - protein, 30 aa, Staphylococcus epidermidis
WNTLPQKGNINIYFRSWYSHFLDYKENKIK

SEQ ID NO: 1823083 - protein, 29 aa, Staphylococcus epidermidis
WRKSAKYVGLIPRFSRIFLGDKEFNKKRY

SEQ ID NO: 1823084 - protein, 25 aa, Staphylococcus epidermidis
YAKKGRHTVYIPKGTYYIRKALVIY

SEQ ID NO: 1823085 - protein, 34 aa, Staphylococcus epidermidis
YAQVYRAKLLRQLPYPTKFIFLDFIQSENIQTLT

SEQ ID NO: 1823086 - protein, 25 aa, Staphylococcus epidermidis
YATATELALYPLISNHLIRVDSIIV

SEQ ID NO: 1823087 - protein, 17 aa, Staphylococcus epidermidis
YCDRFIILDKGEIVAFG

SEQ ID NO: 1823088 - protein, 22 aa, Staphylococcus epidermidis
YDEYDKGYILNWLVANSNEFDM

SEQ ID NO: 1823089 - protein, 21 aa, Staphylococcus epidermidis
YEAAKLLLKLGANVKVNDGKD

SEQ ID NO: 1823090 - protein, 24 aa, Staphylococcus epidermidis
YEGKSYFFESYTEWIKFYLSEMGI

SEQ ID NO: 1823091 - protein, 19 aa, Staphylococcus epidermidis
YEPQFGARPLKRFVQRQIE

SEQ ID NO: 1823092 - protein, 18 aa, Staphylococcus epidermidis
YHENILEWIKIANEYKIP

SEQ ID NO: 1823093 - protein, 18 aa, Staphylococcus epidermidis
YIHLEYYTFELDGLGKRI

SEQ ID NO: 1823094 - protein, 23 aa, Staphylococcus epidermidis
YIKNQHLFLVGRESDRIIVGGIN

SEQ ID NO: 1823095 - protein, 18 aa, Staphylococcus epidermidis
YIPHWEQPDYIKTLTFNS

SEQ ID NO: 1823096 - protein, 17 aa, Staphylococcus epidermidis
YKDLLIVADTCLCEYTD

SEQ ID NO: 1823097 - protein, 25 aa, Staphylococcus epidermidis
YKNEVLIEPFLLEDILDILKHVSSK

SEQ ID NO: 1823098 - protein, 20 aa, Staphylococcus epidermidis
YLQDAHDFCPYSKATRGNID

SEQ ID NO: 1823099 - protein, 19 aa, Staphylococcus epidermidis
YLQSPYFIPDQSYINALKM

SEQ ID NO: 1823100 - protein, 26 aa, Staphylococcus epidermidis
YNKDEFELIRLFGKRGRGLYNKARGI

SEQ ID NO: 1823101 - protein, 20 aa, Staphylococcus epidermidis
YNNLLDERGPIDIQILGIGE

SEQ ID NO: 1823102 - protein, 17 aa, Staphylococcus epidermidis
YNTLIEDGYFITSGIIE

SEQ ID NO: 1823103 - protein, 34 aa, Staphylococcus epidermidis
YQLGYMADHFYPDLLLGFIHVPLIPEQTINHSQQ

SEQ ID NO: 1823104 - protein, 25 aa, Staphylococcus epidermidis
YRIHKGFHMLRFEGINNINEIEHLK

SEQ ID NO: 1823105 - protein, 24 aa, Staphylococcus epidermidis
YSKIAYIMSYLKVHYPHYFYANIL

SEQ ID NO: 1823106 - protein, 22 aa, Staphylococcus epidermidis
YTIQTLHHPINKQNLLRARRTY

SEQ ID NO: 1823107 - protein, 26 aa, Staphylococcus epidermidis
YVLDNGYLFVFVLDYYRHHLVDEVAA

SEQ ID NO: 1823108 - protein, 19 aa, Staphylococcus epidermidis
YVSDMLVFKGKFKMYYTSE

SEQ ID NO: 1823109 - protein, 27 aa, Staphylococcus epidermidis
YVSRSHPGLLKRLFEQEVPEIYDGTVI

SEQ ID NO: 1823110 - protein, 20 aa, Staphylococcus epidermidis
YWNLSFLPEEINTNAFIKPV

SEQ ID NO: 1823111 - protein, 22 aa, Staphylococcus epidermidis
YWQYHDHWLGYCTNELVQLCPQ

SEQ ID NO: 1823112 - protein, 25 aa, Staphylococcus epidermidis
AAAVQIHHLLGIQPFARCFEMKEAC

SEQ ID NO: 1823113 - protein, 32 aa, Staphylococcus epidermidis
AAVPPLTHFVTNSTYFLWDVLTTAYVGSPNLV

SEQ ID NO: 1823114 - protein, 33 aa, Staphylococcus epidermidis
AAVPPLTHFVTNSTYFLWDVLTTAYVGSPNLVE

SEQ ID NO: 1823115 - protein, 20 aa, Staphylococcus epidermidis
ADCVPVYFYSEPHGYIGLAH

SEQ ID NO: 1823116 - protein, 26 aa, Staphylococcus epidermidis
AEYQRVGFFYPEIAMYFKNPKRILGS

SEQ ID NO: 1823117 - protein, 25 aa, Staphylococcus epidermidis
AFATARFYIRVLTRFFQNISKNKET

SEQ ID NO: 1823118 - protein, 19 aa, Staphylococcus epidermidis
AFNINIPKESVGKATKFLL

SEQ ID NO: 1823119 - protein, 17 aa, Staphylococcus epidermidis
AGDIVLHKGMRINSGVI

SEQ ID NO: 1823120 - protein, 18 aa, Staphylococcus epidermidis
AGKKLAIVPILRAGLGMT

SEQ ID NO: 1823121 - protein, 27 aa, Staphylococcus epidermidis
AGKSTLINLLLEQDILPSSPIPTTSNT

SEQ ID NO: 1823122 - protein, 26 aa, Staphylococcus epidermidis
AGKSTLINLLLEQDILPSSPVPTTSN

SEQ ID NO: 1823123 - protein, 33 aa, Staphylococcus epidermidis
AGSNAIYEFLSLRIPMLLIPLGLDQSRGDQIDN

SEQ ID NO: 1823124 - protein, 33 aa, Staphylococcus epidermidis
AGSNAIYEFLTLRIPMLLIPLGLDQSRGDQIDN

SEQ ID NO: 1823125 - protein, 37 aa, Staphylococcus epidermidis
AHLRLNDIGFIFQASHLVPYLKVLDQLTLIGKETGMS

SEQ ID NO: 1823126 - protein, 24 aa, Staphylococcus epidermidis
AHQVVIRCFFVYFKMITKEEALTT

SEQ ID NO: 1823127 - protein, 27 aa, Staphylococcus epidermidis
AHVAMIEAVRITLHNALALVGVTAPES

SEQ ID NO: 1823128 - protein, 19 aa, Staphylococcus epidermidis
AIFSALSIRDSKVAPTIHA

SEQ ID NO: 1823129 - protein, 26 aa, Staphylococcus epidermidis
AIGAMQFDDILKYIGKHTLLIVGNRE

SEQ ID NO: 1823130 - protein, 18 aa, Staphylococcus epidermidis
AINIVRHFNHIQRKMRLH

SEQ ID NO: 1823131 - protein, 27 aa, Staphylococcus epidermidis
AISKAFRGYGLGQLLLKYAMNYARFSC

SEQ ID NO: 1823132 - protein, 19 aa, Staphylococcus epidermidis
AKNNINVPIFLKLTSDMEL

SEQ ID NO: 1823133 - protein, 22 aa, Staphylococcus epidermidis
AKRELEFVLMALNIRKVTVQRA

SEQ ID NO: 1823134 - protein, 17 aa, Staphylococcus epidermidis
ALHSIFLEVVIAPQFTE

SEQ ID NO: 1823135 - protein, 31 aa, Staphylococcus epidermidis
ALNFKFMKRINEAGIPIVFVINQIDKHNEEE

SEQ ID NO: 1823136 - protein, 31 aa, Staphylococcus epidermidis
AMFADLKTYVLFQLYERFVIDYSLGSATGMM

SEQ ID NO: 1823137 - protein, 25 aa, Staphylococcus epidermidis
APYQDIRFLIYPQDLPKHEKKNSSQ

SEQ ID NO: 1823138 - protein, 43 aa, Staphylococcus epidermidis
AQFKKNEGYNLTFFAFFVKAVAEALKANPLLNSTWQGDEIVIH

SEQ ID NO: 1823139 - protein, 23 aa, Staphylococcus epidermidis
AQILEIENLLDRKPKALSGGQRQ

SEQ ID NO: 1823140 - protein, 17 aa, Staphylococcus epidermidis
ARAIINDPKFIIADEPT

SEQ ID NO: 1823141 - protein, 18 aa, Staphylococcus epidermidis
ARAIINDPKFIIADEPTG

SEQ ID NO: 1823142 - protein, 22 aa, Staphylococcus epidermidis
ARELIRLIQQLRKKKNLPINQR

SEQ ID NO: 1823143 - protein, 20 aa, Staphylococcus epidermidis
ASVILNNLYKQTPLQTSFGV

SEQ ID NO: 1823144 - protein, 19 aa, Staphylococcus epidermidis
AVAEMKLAVGLLVDKKLSH

SEQ ID NO: 1823145 - protein, 17 aa, Staphylococcus epidermidis
AVERLYPFPEEEIKEVL

SEQ ID NO: 1823146 - protein, 19 aa, Staphylococcus epidermidis
AYAFIKRLIKQFGKPQKVV

SEQ ID NO: 1823147 - protein, 27 aa, Staphylococcus epidermidis
AYVAMIEAVRITLHNALALVGVTAPES

SEQ ID NO: 1823148 - protein, 20 aa, Staphylococcus epidermidis
CAYQEQYKMIPACNVKAIDT

SEQ ID NO: 1823149 - protein, 17 aa, Staphylococcus epidermidis
CYADCVPVYFYSEPHGY

SEQ ID NO: 1823150 - protein, 30 aa, Staphylococcus epidermidis
DADDIRFGIKENVDFIAASFVRRPSDVLDI

SEQ ID NO: 1823151 - protein, 24 aa, Staphylococcus epidermidis
DADKNCPILPPSVKKEHWGFDDPA

SEQ ID NO: 1823152 - protein, 17 aa, Staphylococcus epidermidis
DALRRFKRSVSKSGTIQ

SEQ ID NO: 1823153 - protein, 21 aa, Staphylococcus epidermidis
DCRRTMDIFKLLGVTIEEQDN

SEQ ID NO: 1823154 - protein, 24 aa, Staphylococcus epidermidis
DDDYYYYIDPLWSRLSKFVIFPSI

SEQ ID NO: 1823155 - protein, 28 aa, Staphylococcus epidermidis
DDSATVTHWFINFYNLIMEERFGRVTHA

SEQ ID NO: 1823156 - protein, 23 aa, Staphylococcus epidermidis
DDTWGQVPILYYVTNQDINQNEL

SEQ ID NO: 1823157 - protein, 26 aa, Staphylococcus epidermidis
DEEIRNTIRILSRKTKNNPVLIGEPG

SEQ ID NO: 1823158 - protein, 29 aa, Staphylococcus epidermidis
DEEMTIAILPIGYADGYLRSMQGAFVNVN

SEQ ID NO: 1823159 - protein, 25 aa, Staphylococcus epidermidis
DEKRLNYAGFYRLHHSYKKKVVMAR

SEQ ID NO: 1823160 - protein, 27 aa, Staphylococcus epidermidis
DELVATEYPVLLATSRKRYIKEMMNQD

SEQ ID NO: 1823161 - protein, 22 aa, Staphylococcus epidermidis
DFDKYVDLILRKVNLIDYKNKK

SEQ ID NO: 1823162 - protein, 22 aa, Staphylococcus epidermidis
DFEDAYMYFLKKQQGGLNHASI

SEQ ID NO: 1823163 - protein, 26 aa, Staphylococcus epidermidis
DFYGIAEHPFVPHFTIAQGLTSQEFE

SEQ ID NO: 1823164 - protein, 24 aa, Staphylococcus epidermidis
DGKDALISSLKRKVNSLEKEKKML

SEQ ID NO: 1823165 - protein, 26 aa, Staphylococcus epidermidis
DGPGLRYILFTQGCLLRCLYCHNPDT

SEQ ID NO: 1823166 - protein, 27 aa, Staphylococcus epidermidis
DGPGLRYILFTQGCLLRCLYCHNPDTW

SEQ ID NO: 1823167 - protein, 23 aa, Staphylococcus epidermidis
DGTKKRIRYYSCSNFRNKGSKVC

SEQ ID NO: 1823168 - protein, 21 aa, Staphylococcus epidermidis
DIAGLRIMCQFVDDIDIVVDI

SEQ ID NO: 1823169 - protein, 24 aa, Staphylococcus epidermidis
DIDVKQWFVGDYMTALDMQGFSIT

SEQ ID NO: 1823170 - protein, 24 aa, Staphylococcus epidermidis
DIEKKYNMLFPKLATNEEEFVKLY

SEQ ID NO: 1823171 - protein, 24 aa, Staphylococcus epidermidis
DIESTWAGIRPLILEKGKDPSEIS

SEQ ID NO: 1823172 - protein, 23 aa, Staphylococcus epidermidis
DIGKAFARRLQGFDARIIYHNRK

SEQ ID NO: 1823173 - protein, 25 aa, Staphylococcus epidermidis
DIGKTYVTKYLYKALRTRGYRVCIF

SEQ ID NO: 1823174 - protein, 52 aa, Staphylococcus epidermidis
DIIVQPPGKKLQHLSLLSGGERALSAIALLFAILKVRSAPFVILDEVEAALD

SEQ ID NO: 1823175 - protein, 54 aa, Staphylococcus epidermidis
DIIVQPPGKKLQHLSLLSGGERALSAIALLFAILKVRSAPFVILDEVEAALDEA

SEQ ID NO: 1823176 - protein, 26 aa, Staphylococcus epidermidis
DIKSIRPIARLGYYDYTVVDEIFEMK

SEQ ID NO: 1823177 - protein, 24 aa, Staphylococcus epidermidis
DINTLEKHWFNWLTENNIPIKRRS

SEQ ID NO: 1823178 - protein, 32 aa, Staphylococcus epidermidis
DIPRLNVLDLQRLIRVIPKPVIAMVRGYAIGG

SEQ ID NO: 1823179 - protein, 19 aa, Staphylococcus epidermidis
DKCGFLVNFRDLKKLVHEQ

SEQ ID NO: 1823180 - protein, 33 aa, Staphylococcus epidermidis
DKGFTVINIKKYLMNRLVGFTRKILGVLEEFNI

SEQ ID NO: 1823181 - protein, 19 aa, Staphylococcus epidermidis
DKIIGYVGLWLVVDQAQIT

SEQ ID NO: 1823182 - protein, 34 aa, Staphylococcus epidermidis
DKQTIQYQRFIRHIQFLIYRLTKGEYLEAQENFI

SEQ ID NO: 1823183 - protein, 21 aa, Staphylococcus epidermidis
DKRTHFFLRMLIDNQEVVATN

SEQ ID NO: 1823184 - protein, 22 aa, Staphylococcus epidermidis
DKRTHFFLRMLIDNQEVVATNE

SEQ ID NO: 1823185 - protein, 17 aa, Staphylococcus epidermidis
DLDILHMHYAVPHAVCG

SEQ ID NO: 1823186 - protein, 21 aa, Staphylococcus epidermidis
DLEMTFFYELVFGEETEFYQQ

SEQ ID NO: 1823187 - protein, 31 aa, Staphylococcus epidermidis
DLFNDFEMHFYRYVFPYYDTLYTLEKLSKHH

SEQ ID NO: 1823188 - protein, 23 aa, Staphylococcus epidermidis
DLGNITFPNFLKRDKLTISVSTD

SEQ ID NO: 1823189 - protein, 27 aa, Staphylococcus epidermidis
DLHKDLIPVVWIAFKTGLRISDVLTLQ

SEQ ID NO: 1823190 - protein, 17 aa, Staphylococcus epidermidis
DLILLNFANPDMVGHSG

SEQ ID NO: 1823191 - protein, 17 aa, Staphylococcus epidermidis
DLLVYYKGSPIAEEYQA

SEQ ID NO: 1823192 - protein, 23 aa, Staphylococcus epidermidis
DMRKGAYLIKYIRRIDLSGVHPQ

SEQ ID NO: 1823193 - protein, 27 aa, Staphylococcus epidermidis
DMVRNDTRILFAGLRCALKDMNIELSA

SEQ ID NO: 1823194 - protein, 21 aa, Staphylococcus epidermidis
DMYLRQGYVYQGFKYHILKEN

SEQ ID NO: 1823195 - protein, 21 aa, Staphylococcus epidermidis
DNFVDFIRWMKTPFEYENVLS

SEQ ID NO: 1823196 - protein, 23 aa, Staphylococcus epidermidis
DNHSAYVFIKRLIKQFGKSQKVI

SEQ ID NO: 1823197 - protein, 24 aa, Staphylococcus epidermidis
DPEDIEMLQDLVLAATNEAMNKAD

SEQ ID NO: 1823198 - protein, 20 aa, Staphylococcus epidermidis
DQAFDRLKLNIFISLAELES

SEQ ID NO: 1823199 - protein, 29 aa, Staphylococcus epidermidis
DQILTYSTIYDLPILADPLSQLRKEKHPN

SEQ ID NO: 1823200 - protein, 25 aa, Staphylococcus epidermidis
DQTRGWFYSLLVISTILKGKSSYKR

SEQ ID NO: 1823201 - protein, 17 aa, Staphylococcus epidermidis
DRFCRLDKEKFGFIPDV

SEQ ID NO: 1823202 - protein, 19 aa, Staphylococcus epidermidis
DRHSFLVEKLRLLIQQLKQ

SEQ ID NO: 1823203 - protein, 22 aa, Staphylococcus epidermidis
DRKQIPFDELVLFSSARSAGKK

SEQ ID NO: 1823204 - protein, 27 aa, Staphylococcus epidermidis
DSATVTHWFINFYHLIMEERFGRVTHA

SEQ ID NO: 1823205 - protein, 23 aa, Staphylococcus epidermidis
DSFYHFNPNWHIVGITYDSIEKI

SEQ ID NO: 1823206 - protein, 22 aa, Staphylococcus epidermidis
DSIGLILGFLVQRFLEHKKEMH

SEQ ID NO: 1823207 - protein, 21 aa, Staphylococcus epidermidis
DSLKRYLLEETFELFEAIDNE

SEQ ID NO: 1823208 - protein, 18 aa, Staphylococcus epidermidis
DTDADLRILRRLTRDTKE

SEQ ID NO: 1823209 - protein, 25 aa, Staphylococcus epidermidis
DTTEKIELFKKLEFKQLLADIDTSS

SEQ ID NO: 1823210 - protein, 19 aa, Staphylococcus epidermidis
DVINIFQYLNRQGVTIIMA

SEQ ID NO: 1823211 - protein, 24 aa, Staphylococcus epidermidis
DVYDFPRVWLEKDSYDFSFSGLKS

SEQ ID NO: 1823212 - protein, 18 aa, Staphylococcus epidermidis
DWDYVKPDVYILGKALGG

SEQ ID NO: 1823213 - protein, 23 aa, Staphylococcus epidermidis
DYRKIPRKYLNPKIPQGRGKIKW

SEQ ID NO: 1823214 - protein, 19 aa, Staphylococcus epidermidis
DYSSTIFDYIHLNKPVFIL

SEQ ID NO: 1823215 - protein, 20 aa, Staphylococcus epidermidis
DYTYFFNGVKHILKAKDKEL

SEQ ID NO: 1823216 - protein, 39 aa, Staphylococcus epidermidis
EAIKGKIDWRDTLPDAHFSKIYLFSPNLDKITDFRNQLV

SEQ ID NO: 1823217 - protein, 21 aa, Staphylococcus epidermidis
EALDYMYNLGKRDGFSTHDVD

SEQ ID NO: 1823218 - protein, 19 aa, Staphylococcus epidermidis
EAPCYIAWSGKNRSPLVRV

SEQ ID NO: 1823219 - protein, 31 aa, Staphylococcus epidermidis
EAQENFISMIKTMYPRSFNTAYKILKMIQRE

SEQ ID NO: 1823220 - protein, 17 aa, Staphylococcus epidermidis
EATAYIFIKMVQQMKEL

SEQ ID NO: 1823221 - protein, 23 aa, Staphylococcus epidermidis
EAYHAPIRLLIVIQAPDAYIQRL

SEQ ID NO: 1823222 - protein, 24 aa, Staphylococcus epidermidis
ECKIGIMPGYIHKKGHVGVVSRSG

SEQ ID NO: 1823223 - protein, 28 aa, Staphylococcus epidermidis
EEAHASHIMIQKSQLSYLLADSSKRDAH

SEQ ID NO: 1823224 - protein, 22 aa, Staphylococcus epidermidis
EEAYEPQFGARPLKRFVQRQIE

SEQ ID NO: 1823225 - protein, 21 aa, Staphylococcus epidermidis
EEQIIPVMKKLNQIHVIINAK

SEQ ID NO: 1823226 - protein, 18 aa, Staphylococcus epidermidis
EFCTKIAWIEGGKLKEFG

SEQ ID NO: 1823227 - protein, 19 aa, Staphylococcus epidermidis
EFCTKIAWIEGGKLKEFGE

SEQ ID NO: 1823228 - protein, 18 aa, Staphylococcus epidermidis
EFFGTMKPFILKPKDDDS

SEQ ID NO: 1823229 - protein, 24 aa, Staphylococcus epidermidis
EFNYYLSEYVGRETPLTFAESYTK

SEQ ID NO: 1823230 - protein, 26 aa, Staphylococcus epidermidis
EGEEAKAYWLCWVTTERSEEGPYYAG

SEQ ID NO: 1823231 - protein, 26 aa, Staphylococcus epidermidis
EGEEAKAYWLCWVTTERSEQGPYYAG

SEQ ID NO: 1823232 - protein, 20 aa, Staphylococcus epidermidis
EGFLLAQEISSYSLTLVAHE

SEQ ID NO: 1823233 - protein, 21 aa, Staphylococcus epidermidis
EGLIKLDGLPLNQLKNKDIAR

SEQ ID NO: 1823234 - protein, 24 aa, Staphylococcus epidermidis
EGYDPEYGARPLIRAIQKTVEDNL

SEQ ID NO: 1823235 - protein, 22 aa, Staphylococcus epidermidis
EGYINFIELIVHRIDSINYEIE

SEQ ID NO: 1823236 - protein, 17 aa, Staphylococcus epidermidis
EGYRLGSDDLSIGEIVF

SEQ ID NO: 1823237 - protein, 19 aa, Staphylococcus epidermidis
EIALKLLKILLKELMKKHI

SEQ ID NO: 1823238 - protein, 24 aa, Staphylococcus epidermidis
EIHGDNLFRHSLTLERVQKIVELA

SEQ ID NO: 1823239 - protein, 17 aa, Staphylococcus epidermidis
EIKLEDQVTLFKQFKEI

SEQ ID NO: 1823240 - protein, 26 aa, Staphylococcus epidermidis
EIWNRVDVFMLPKDYLRYCLTQTIHM

SEQ ID NO: 1823241 - protein, 26 aa, Staphylococcus epidermidis
EIWSRVDVFMLPKDYLRYCLTQTIHM

SEQ ID NO: 1823242 - protein, 20 aa, Staphylococcus epidermidis
EKDIQFVYADELLHQVSPPI

SEQ ID NO: 1823243 - protein, 21 aa, Staphylococcus epidermidis
EKDIQFVYADELLHQVSPPIK

SEQ ID NO: 1823244 - protein, 17 aa, Staphylococcus epidermidis
EKEIGIFLTDNGDLYAI

SEQ ID NO: 1823245 - protein, 19 aa, Staphylococcus epidermidis
EKLLPGCQFHKMGWAMGVV

SEQ ID NO: 1823246 - protein, 17 aa, Staphylococcus epidermidis
ELAKKYLKNRLITGDIA

SEQ ID NO: 1823247 - protein, 23 aa, Staphylococcus epidermidis
ELDEAVVLYYLKKWIHENDTILS

SEQ ID NO: 1823248 - protein, 17 aa, Staphylococcus epidermidis
ELLGDFKAPMGCRSFLP

SEQ ID NO: 1823249 - protein, 18 aa, Staphylococcus epidermidis
ELLGDFKAPMGCRSFLPS

SEQ ID NO: 1823250 - protein, 22 aa, Staphylococcus epidermidis
ELRKHLINNYSIGIIALNSTDI

SEQ ID NO: 1823251 - protein, 24 aa, Staphylococcus epidermidis
EMGYTQKSPRWAIAYKFPAEEVIT

SEQ ID NO: 1823252 - protein, 25 aa, Staphylococcus epidermidis
EMGYTQKSPRWAIAYKFPAEEVITK

SEQ ID NO: 1823253 - protein, 19 aa, Staphylococcus epidermidis
EMNLVPLRKFTSVEIDLFF

SEQ ID NO: 1823254 - protein, 25 aa, Staphylococcus epidermidis
EMTQKMATIRFTEPALIALTGGNFK

SEQ ID NO: 1823255 - protein, 17 aa, Staphylococcus epidermidis
ENGNIDFLNLKIEKVKA

SEQ ID NO: 1823256 - protein, 24 aa, Staphylococcus epidermidis
ENKPYPLYLLLDKEYQLIEPVMKF

SEQ ID NO: 1823257 - protein, 17 aa, Staphylococcus epidermidis
ENPWERLERLRKAIPNV

SEQ ID NO: 1823258 - protein, 28 aa, Staphylococcus epidermidis
EPEAYPYPIYNNVLPHIDVFLENGYTKE

SEQ ID NO: 1823259 - protein, 24 aa, Staphylococcus epidermidis
EPIQPNHPILKLPNAVVLPHIGSA

SEQ ID NO: 1823260 - protein, 29 aa, Staphylococcus epidermidis
EQASLIFLDSVVLPLMDAFHISEKTMQEN

SEQ ID NO: 1823261 - protein, 17 aa, Staphylococcus epidermidis
ERHLPNYTLLSHLHPST

SEQ ID NO: 1823262 - protein, 30 aa, Staphylococcus epidermidis
ERSRKALSEADLILFVLNNNEPLTEDDQTL

SEQ ID NO: 1823263 - protein, 27 aa, Staphylococcus epidermidis
ESEMLEAIFFGHEEIKRLVAFQQEIID

SEQ ID NO: 1823264 - protein, 24 aa, Staphylococcus epidermidis
ESIPLDLQILLWHMVEKKDNQPHT

SEQ ID NO: 1823265 - protein, 29 aa, Staphylococcus epidermidis
ETHLRVMPLFEENYYMYVPKSHPLAMTVH

SEQ ID NO: 1823266 - protein, 35 aa, Staphylococcus epidermidis
EVIFNTLSTPFLAIYHLPTLKKGILFWQEQSQGYV

SEQ ID NO: 1823267 - protein, 20 aa, Staphylococcus epidermidis
EVVKMREKINWFVEQATVQN

SEQ ID NO: 1823268 - protein, 26 aa, Staphylococcus epidermidis
EVVPWQYPPKREFIYGEWLRGEFENG

SEQ ID NO: 1823269 - protein, 27 aa, Staphylococcus epidermidis
EVVSYIDKVYIMLNKPKGYISATEDEL

SEQ ID NO: 1823270 - protein, 27 aa, Staphylococcus epidermidis
EVVSYIDKVYIMLNKPKGYISATEDEV

SEQ ID NO: 1823271 - protein, 24 aa, Staphylococcus epidermidis
EYFNHQFMELFPNQPLSNTPIKNI

SEQ ID NO: 1823272 - protein, 26 aa, Staphylococcus epidermidis
EYKKDIDKTIFPGIQGGPLEHVIAAK

SEQ ID NO: 1823273 - protein, 17 aa, Staphylococcus epidermidis
EYVFGIPGAKIDYLFNA

SEQ ID NO: 1823274 - protein, 17 aa, Staphylococcus epidermidis
FANFINQFEWHNANYPV

SEQ ID NO: 1823275 - protein, 24 aa, Staphylococcus epidermidis
FASLLHEDLKIRKFIDNELKEASV

SEQ ID NO: 1823276 - protein, 28 aa, Staphylococcus epidermidis
FATDLQQPITPLLFMTEGPSFVTDTIYP

SEQ ID NO: 1823277 - protein, 26 aa, Staphylococcus epidermidis
FCGNATMSYIHYLKERLLIQHQQFQL

SEQ ID NO: 1823278 - protein, 26 aa, Staphylococcus epidermidis
FDINQVDIFIGRIPVLIRSSPVKYDK

SEQ ID NO: 1823279 - protein, 27 aa, Staphylococcus epidermidis
FDLKENRLFYLAMSPKFFGVATNHLKE

SEQ ID NO: 1823280 - protein, 24 aa, Staphylococcus epidermidis
FEFTTKGFWQQKFADFIRYEEQIE

SEQ ID NO: 1823281 - protein, 19 aa, Staphylococcus epidermidis
FEGAQKYLSYLKSTVDVNF

SEQ ID NO: 1823282 - protein, 24 aa, Staphylococcus epidermidis
FEKNYFYYVTQFAKLNIRLFNEAY

SEQ ID NO: 1823283 - protein, 24 aa, Staphylococcus epidermidis
FEKQSIYSLRYDEMQQWLIDHGQQ

SEQ ID NO: 1823284 - protein, 25 aa, Staphylococcus epidermidis
FERYEKMMDWLAGVYINSLNIIHYM

SEQ ID NO: 1823285 - protein, 18 aa, Staphylococcus epidermidis
FFNHAYLVKKLNSKIKIV

SEQ ID NO: 1823286 - protein, 27 aa, Staphylococcus epidermidis
FFNSFIGIYRPYIKLTQPILDQHQIHT

SEQ ID NO: 1823287 - protein, 18 aa, Staphylococcus epidermidis
FFSWGFRVGFMTFGIDHE

SEQ ID NO: 1823288 - protein, 17 aa, Staphylococcus epidermidis
FINLAAGGKLTQVSYET

SEQ ID NO: 1823289 - protein, 17 aa, Staphylococcus epidermidis
FISLKEGYFGKPLKYQS

SEQ ID NO: 1823290 - protein, 24 aa, Staphylococcus epidermidis
FKERHHLKMITIKSLVAFRKAVEL

SEQ ID NO: 1823291 - protein, 25 aa, Staphylococcus epidermidis
FKERHHLKMITIKSLVAFRKAVELN

SEQ ID NO: 1823292 - protein, 17 aa, Staphylococcus epidermidis
FKGICAISYFNNASLEE

SEQ ID NO: 1823293 - protein, 34 aa, Staphylococcus epidermidis
FKLFESTFFDHQLLRRLVSFMYEKPSTLIDYFQK

SEQ ID NO: 1823294 - protein, 17 aa, Staphylococcus epidermidis
FLEIPFDVYPQDAIMPL

SEQ ID NO: 1823295 - protein, 22 aa, Staphylococcus epidermidis
FLEIPFDVYPQDAIMPLPLEEA

SEQ ID NO: 1823296 - protein, 19 aa, Staphylococcus epidermidis
FLTGRELLIANRFPVIVHE

SEQ ID NO: 1823297 - protein, 19 aa, Staphylococcus epidermidis
FMTNGCYIVPKQPNRFLIG

SEQ ID NO: 1823298 - protein, 17 aa, Staphylococcus epidermidis
FNIKEGEFFVLIGPSGC

SEQ ID NO: 1823299 - protein, 17 aa, Staphylococcus epidermidis
FNNLTSLFIPKINEDTL

SEQ ID NO: 1823300 - protein, 25 aa, Staphylococcus epidermidis
FPDTKILILTMFDDEEYLFHVLKSG

SEQ ID NO: 1823301 - protein, 30 aa, Staphylococcus epidermidis
FQQDKQFIYPLIHIPAIDSLIWENSCGSGA

SEQ ID NO: 1823302 - protein, 25 aa, Staphylococcus epidermidis
FRVGYNCAQGYFGVTPDLTCLGKVI

SEQ ID NO: 1823303 - protein, 17 aa, Staphylococcus epidermidis
FSFFNVVNHTPPMIAIA

SEQ ID NO: 1823304 - protein, 20 aa, Staphylococcus epidermidis
FSTDALLLGYLTEVRKNDKV

SEQ ID NO: 1823305 - protein, 17 aa, Staphylococcus epidermidis
FTGPLTDLAKAIKYDNS

SEQ ID NO: 1823306 - protein, 17 aa, Staphylococcus epidermidis
FVDLYNKGIIYRGERII

SEQ ID NO: 1823307 - protein, 18 aa, Staphylococcus epidermidis
FVDLYNKGIIYRGERIIN

SEQ ID NO: 1823308 - protein, 17 aa, Staphylococcus epidermidis
FYELVFGEETEFYQQLL

SEQ ID NO: 1823309 - protein, 21 aa, Staphylococcus epidermidis
FYHDMNGLLMAKLNELHINIV

SEQ ID NO: 1823310 - protein, 23 aa, Staphylococcus epidermidis
FYHDMNGLLMAKLNELHINIVLV

SEQ ID NO: 1823311 - protein, 32 aa, Staphylococcus epidermidis
GAKQVRKKFPDALFIFLAPPSLDDLRERLVGR

SEQ ID NO: 1823312 - protein, 23 aa, Staphylococcus epidermidis
GARGYIVFGHPLKINKVAQSYST

SEQ ID NO: 1823313 - protein, 21 aa, Staphylococcus epidermidis
GDANVFVFPSLEAGNIGYKIA

SEQ ID NO: 1823314 - protein, 19 aa, Staphylococcus epidermidis
GEQFFKDNFSLNVKATNVV

SEQ ID NO: 1823315 - protein, 20 aa, Staphylococcus epidermidis
GEQFFKDNFSLNVKATNVVG

SEQ ID NO: 1823316 - protein, 18 aa, Staphylococcus epidermidis
GESSQFDNLKWLGLDWDE

SEQ ID NO: 1823317 - protein, 17 aa, Staphylococcus epidermidis
GEYDLLMVMSHVGIFFD

SEQ ID NO: 1823318 - protein, 18 aa, Staphylococcus epidermidis
GFKNLGFETYFAIPRSKE

SEQ ID NO: 1823319 - protein, 22 aa, Staphylococcus epidermidis
GFKTISSERLMIGQIVFDDVED

SEQ ID NO: 1823320 - protein, 19 aa, Staphylococcus epidermidis
GGKFNGIIPISQLSTHHIE

SEQ ID NO: 1823321 - protein, 17 aa, Staphylococcus epidermidis
GGNPLACAVSIAAIDVI

SEQ ID NO: 1823322 - protein, 23 aa, Staphylococcus epidermidis
GGRLPGGVKIKRAKLRGERSEGM

SEQ ID NO: 1823323 - protein, 24 aa, Staphylococcus epidermidis
GGVDDLVSLFLLLQMENIELVGVS

SEQ ID NO: 1823324 - protein, 29 aa, Staphylococcus epidermidis
GGVPFLLKQINVPIYGGPLALGLIRNKLE

SEQ ID NO: 1823325 - protein, 19 aa, Staphylococcus epidermidis
GHPGLPMGAAPMAYTLWTR

SEQ ID NO: 1823326 - protein, 32 aa, Staphylococcus epidermidis
GHPGLPMGAAPMAYTLWTRHLNFNPQSKDFFN

SEQ ID NO: 1823327 - protein, 22 aa, Staphylococcus epidermidis
GIDALQLRFILDWNSQSHRPQF

SEQ ID NO: 1823328 - protein, 20 aa, Staphylococcus epidermidis
GIGFALSIERLLMALDEEGI

SEQ ID NO: 1823329 - protein, 21 aa, Staphylococcus epidermidis
GIGFALSIERLLMALDEEGIS

SEQ ID NO: 1823330 - protein, 19 aa, Staphylococcus epidermidis
GIIIGFNVRPDAGAKRAAE

SEQ ID NO: 1823331 - protein, 17 aa, Staphylococcus epidermidis
GIPGAKIDYLFNALEDD

SEQ ID NO: 1823332 - protein, 24 aa, Staphylococcus epidermidis
GKEPQFYFIDPYANYSEFKDVDDL

SEQ ID NO: 1823333 - protein, 21 aa, Staphylococcus epidermidis
GKIEADLYFDKAGSIPREDVA

SEQ ID NO: 1823334 - protein, 20 aa, Staphylococcus epidermidis
GKINIAHGIYPIPAPATAEI

SEQ ID NO: 1823335 - protein, 19 aa, Staphylococcus epidermidis
GKLFATDWDYVKPDVYILG

SEQ ID NO: 1823336 - protein, 21 aa, Staphylococcus epidermidis
GKNVWFGVREFAMGAAINGMA

SEQ ID NO: 1823337 - protein, 20 aa, Staphylococcus epidermidis
GKRPMDRVMKPLLKMNANIS

SEQ ID NO: 1823338 - protein, 24 aa, Staphylococcus epidermidis
GLEELSHYWSVVRPYYADFESDIK

SEQ ID NO: 1823339 - protein, 17 aa, Staphylococcus epidermidis
GLLLEIQNKLDIEVSIM

SEQ ID NO: 1823340 - protein, 17 aa, Staphylococcus epidermidis
GLLMAKLNELHINIVLV

SEQ ID NO: 1823341 - protein, 21 aa, Staphylococcus epidermidis
GMDWLLRHAYHRVPQLKDSHI

SEQ ID NO: 1823342 - protein, 19 aa, Staphylococcus epidermidis
GMVLYMNRNTRKTTGHFYT

SEQ ID NO: 1823343 - protein, 33 aa, Staphylococcus epidermidis
GQIKGVGQLLFKKIPKLPYTLCYVSRGFVADYN

SEQ ID NO: 1823344 - protein, 17 aa, Staphylococcus epidermidis
GRMRYLGVLLYDADRVQ

SEQ ID NO: 1823345 - protein, 19 aa, Staphylococcus epidermidis
GRVRLIFQPAEELGHGAFE

SEQ ID NO: 1823346 - protein, 22 aa, Staphylococcus epidermidis
GSCWYYLRYIDPHNEKMIADPE

SEQ ID NO: 1823347 - protein, 23 aa, Staphylococcus epidermidis
GSCWYYLRYIDPHNEKMIADPEK

SEQ ID NO: 1823348 - protein, 19 aa, Staphylococcus epidermidis
GSTYLLKRYKGKVLIIVNT

SEQ ID NO: 1823349 - protein, 20 aa, Staphylococcus epidermidis
GTEHILLGLIRENEGVAARV

SEQ ID NO: 1823350 - protein, 22 aa, Staphylococcus epidermidis
GTQMFFYYRSFVEKERRLTTLE

SEQ ID NO: 1823351 - protein, 38 aa, Staphylococcus epidermidis
GTRLIMVHLYDYIPRLFWPIYYFIQAPIQGLLMRGFEI

SEQ ID NO: 1823352 - protein, 25 aa, Staphylococcus epidermidis
GTSGLQLFDYKFGQTGIHGTEIDNY

SEQ ID NO: 1823353 - protein, 23 aa, Staphylococcus epidermidis
GVDDLVSLFLLLQMENIELVGVS

SEQ ID NO: 1823354 - protein, 22 aa, Staphylococcus epidermidis
GVKQWFVGDYMTALDMQGFSIT

SEQ ID NO: 1823355 - protein, 18 aa, Staphylococcus epidermidis
GVMLFQQDKQFIYPLIHI

SEQ ID NO: 1823356 - protein, 34 aa, Staphylococcus epidermidis
GVNVIAILEIYFPTSNIYLYAPITGMHAFDRIDV

SEQ ID NO: 1823357 - protein, 18 aa, Staphylococcus epidermidis
GYAKKAFKMAIDYAFLVL

SEQ ID NO: 1823358 - protein, 26 aa, Staphylococcus epidermidis
GYDSDRYLPVLAIAIGKKAQDAHDSV

SEQ ID NO: 1823359 - protein, 17 aa, Staphylococcus epidermidis
GYEAPCYIAWSGKNRSP

SEQ ID NO: 1823360 - protein, 21 aa, Staphylococcus epidermidis
GYEAPCYIAWSGKNRSPLVRV

SEQ ID NO: 1823361 - protein, 17 aa, Staphylococcus epidermidis
GYEESYGFLARPFVRDK

SEQ ID NO: 1823362 - protein, 30 aa, Staphylococcus epidermidis; identical to SEQ ID NO: 1680362

SEQ ID NO: 1823363 - protein, 20 aa, Staphylococcus epidermidis
HANDDFIIGYRLSPEEAESP

SEQ ID NO: 1823364 - protein, 22 aa, Staphylococcus epidermidis
HDSLKRYLLEETFELFEAIDNE

SEQ ID NO: 1823365 - protein, 25 aa, Staphylococcus epidermidis
HEQRRLEFLAGRFTVKEAFSKALGT

SEQ ID NO: 1823366 - protein, 21 aa, Staphylococcus epidermidis
HFKSLRRFFKIYVRGIRGASE

SEQ ID NO: 1823367 - protein, 22 aa, Staphylococcus epidermidis
HFKSLRRFFKIYVRGIRGASEL

SEQ ID NO: 1823368 - protein, 19 aa, Staphylococcus epidermidis
HFVKSWLLDARAPKVTPPS

SEQ ID NO: 1823369 - protein, 33 aa, Staphylococcus epidermidis
HGEKVAYGILVQLVLENAPTEKFMKYKTFFDNI

SEQ ID NO: 1823370 - protein, 17 aa, Staphylococcus epidermidis
HGPSHPYLLKLQDLYRE

SEQ ID NO: 1823371 - protein, 30 aa, Staphylococcus epidermidis
HIFITHMHGDHIFGLPGLLTSRSFQGGENK

SEQ ID NO: 1823372 - protein, 20 aa, Staphylococcus epidermidis
HIIKLARSNAIPIIYHVYAP

SEQ ID NO: 1823373 - protein, 24 aa, Staphylococcus epidermidis
HLEERGYHLSKTEYRGREATDFKE

SEQ ID NO: 1823374 - protein, 17 aa, Staphylococcus epidermidis
HLPILGTHNMKNAAIAI

SEQ ID NO: 1823375 - protein, 20 aa, Staphylococcus epidermidis
HMHDAYYNIIFSEVINKFNE

SEQ ID NO: 1823376 - protein, 21 aa, Staphylococcus epidermidis
HMHDAYYNIIFSEVINKFNEV

SEQ ID NO: 1823377 - protein, 17 aa, Staphylococcus epidermidis
HPYLLKLQDLYREFRDS

SEQ ID NO: 1823378 - protein, 26 aa, Staphylococcus epidermidis
HQDILANLIGYPRDEWVFPIQTHDSR

SEQ ID NO: 1823379 - protein, 26 aa, Staphylococcus epidermidis
HRSNLVMMGVLPLQFQQGESAEALGL

SEQ ID NO: 1823380 - protein, 17 aa, Staphylococcus epidermidis
HSGLTALFWNHGHLASE

SEQ ID NO: 1823381 - protein, 17 aa, Staphylococcus epidermidis
HSIFLEVVIAPQFTEEA

SEQ ID NO: 1823382 - protein, 32 aa, Staphylococcus epidermidis; identical to SEQ ID NO: 1686123

SEQ ID NO: 1823383 - protein, 26 aa, Staphylococcus epidermidis
HTKRDKLILMLMYEGGLRIGEVLSLR

SEQ ID NO: 1823384 - protein, 22 aa, Staphylococcus epidermidis
HTTWELGVVWKKDKRLSHATNK

SEQ ID NO: 1823385 - protein, 20 aa, Staphylococcus epidermidis
IAFNINIPKESVGKATKFLL

SEQ ID NO: 1823386 - protein, 20 aa, Staphylococcus epidermidis
IAGLRIMCQFVDDIDIVVDI

SEQ ID NO: 1823387 - protein, 19 aa, Staphylococcus epidermidis
IDELSICSDYLFVKIKGRN

SEQ ID NO: 1823388 - protein, 18 aa, Staphylococcus epidermidis
IDNTFLTPYLSTPLEEGA

SEQ ID NO: 1823389 - protein, 33 aa, Staphylococcus epidermidis
IDNYNGHLLIQWYSKGIYKFRFPILEAIKEVYE

SEQ ID NO: 1823390 - protein, 19 aa, Staphylococcus epidermidis
IDRGALILVKQGIQPIFSV

SEQ ID NO: 1823391 - protein, 22 aa, Staphylococcus epidermidis
IDVFSPSTYPPLSYSFDHLIIN

SEQ ID NO: 1823392 - protein, 18 aa, Staphylococcus epidermidis
IEFDVMLASYIIDPSRSI

SEQ ID NO: 1823393 - protein, 17 aa, Staphylococcus epidermidis
IEMAAASGLALLSKDER

SEQ ID NO: 1823394 - protein, 17 aa, Staphylococcus epidermidis
IENPNVILPHRIEYRGT

SEQ ID NO: 1823395 - protein, 41 aa, Staphylococcus epidermidis
IEQSLREPLLFYRQLIPQNIKNIILNYLIEFNLSTDLITKF

SEQ ID NO: 1823396 - protein, 20 aa, Staphylococcus epidermidis
IEREYFYHGVKTIFTKEKET

SEQ ID NO: 1823397 - protein, 23 aa, Staphylococcus epidermidis
IESTWAGIRPLILEKGKDPSEIS

SEQ ID NO: 1823398 - protein, 29 aa, Staphylococcus epidermidis
IFITHMHGDHIFGLPGLLTSRSFQGGENK

SEQ ID NO: 1823399 - protein, 17 aa, Staphylococcus epidermidis
IFLKIKRNRYKDINGSY

SEQ ID NO: 1823400 - protein, 17 aa, Staphylococcus epidermidis
IFSALSIRDSKVAPTIH

SEQ ID NO: 1823401 - protein, 25 aa, Staphylococcus epidermidis
IGAMQFDDILKYIGKHTLLIVGNRE

SEQ ID NO: 1823402 - protein, 17 aa, Staphylococcus epidermidis
IGFGKAGKTLAAHAASH

SEQ ID NO: 1823403 - protein, 20 aa, Staphylococcus epidermidis
IGINPNWLSKPILSDIFSSI

SEQ ID NO: 1823404 - protein, 24 aa, Staphylococcus epidermidis
IGNLYQKLELLKKKLKKEGYFNQS

SEQ ID NO: 1823405 - protein, 24 aa, Staphylococcus epidermidis
IGQNPFYHDILENKGWSFKKYANA

SEQ ID NO: 1823406 - protein, 24 aa, Staphylococcus epidermidis
IGTEHLLLGLMKEPEGIAAKVLES

SEQ ID NO: 1823407 - protein, 19 aa, Staphylococcus epidermidis
IHFQFASYMSASKFYKDYA

SEQ ID NO: 1823408 - protein, 20 aa, Staphylococcus epidermidis
IHGRIFISLAVKFSKARLID

SEQ ID NO: 1823409 - protein, 31 aa, Staphylococcus epidermidis
IHINEQFQLSKQFWAYLIREGHIESPDKFIQ

SEQ ID NO: 1823410 - protein, 17 aa, Staphylococcus epidermidis
IIRLLEGPITFVESIDS

SEQ ID NO: 1823411 - protein, 22 aa, Staphylococcus epidermidis
IKAYCYHLKLLYEFMEQRGVIL

SEQ ID NO: 1823412 - protein, 24 aa, Staphylococcus epidermidis
IKDVVEQQFEFAKKIIAKGLVPII

SEQ ID NO: 1823413 - protein, 25 aa, Staphylococcus epidermidis
IKDVVEQQFEFAKKIIAKGLVPIIE

SEQ ID NO: 1823414 - protein, 17 aa, Staphylococcus epidermidis
IKEHDLFIIISGSGSTE

SEQ ID NO: 1823415 - protein, 18 aa, Staphylococcus epidermidis
IKKTAMVFGQMNEPPGAR

SEQ ID NO: 1823416 - protein, 18 aa, Staphylococcus epidermidis
IKLGIITPFLGHTQRWND

SEQ ID NO: 1823417 - protein, 28 aa, Staphylococcus epidermidis
IKQGITKFRIVPLLIFSAMHYISDIPQI

SEQ ID NO: 1823418 - protein, 18 aa, Staphylococcus epidermidis
ILISNHSVPYYAGLSFRT

SEQ ID NO: 1823419 - protein, 18 aa, Staphylococcus epidermidis
ILNYFNQLNYFDDDCIEA

SEQ ID NO: 1823420 - protein, 17 aa, Staphylococcus epidermidis
ILQYQFINQKNNAPFIC

SEQ ID NO: 1823421 - protein, 23 aa, Staphylococcus epidermidis
ILSSVLMLEHLGWQKAADKITDS

SEQ ID NO: 1823422 - protein, 17 aa, Staphylococcus epidermidis
INHWFNSDTIYRSILNL

SEQ ID NO: 1823423 - protein, 17 aa, Staphylococcus epidermidis
INIKGKWNYLYRAIDAE

SEQ ID NO: 1823424 - protein, 17 aa, Staphylococcus epidermidis
INQVVMLRPTKSSIIFI

SEQ ID NO: 1823425 - protein, 40 aa, Staphylococcus epidermidis
INRLKLFKDNLVPNKLIFTSWSPRLYMHAHSLNIDSKDIF

SEQ ID NO: 1823426 - protein, 26 aa, Staphylococcus epidermidis
IPVVDMVKVKRYLQGRKTRLVGPNCP

SEQ ID NO: 1823427 - protein, 19 aa, Staphylococcus epidermidis
IQIGEKLTRGLGAGANPEI

SEQ ID NO: 1823428 - protein, 29 aa, Staphylococcus epidermidis
IQPTEAQWEAMLLGWKVVSAVKSNAVILS

SEQ ID NO: 1823429 - protein, 23 aa, Staphylococcus epidermidis
IQTDILKFSFPKHINYKIYGNIP

SEQ ID NO: 1823430 - protein, 27 aa, Staphylococcus epidermidis
IRDVATKAWYNTYLNIYAASTVNELLA

SEQ ID NO: 1823431 - protein, 23 aa, Staphylococcus epidermidis
ISKTKGLIGNIMKIKPIGTLRDG

SEQ ID NO: 1823432 - protein, 26 aa, Staphylococcus epidermidis
ITEYCFVRPIYLFLNQMNSCDTWLAR

SEQ ID NO: 1823433 - protein, 24 aa, Staphylococcus epidermidis
ITSEQLELLRILYNYDRLSQYDLT

SEQ ID NO: 1823434 - protein, 17 aa, Staphylococcus epidermidis
IVDTPLLQIELNSMLQS

SEQ ID NO: 1823435 - protein, 18 aa, Staphylococcus epidermidis
IVIKFYRALQKFDYQQGV

SEQ ID NO: 1823436 - protein, 18 aa, Staphylococcus epidermidis
IYLLKRKDFIQMDNNALF

SEQ ID NO: 1823437 - protein, 17 aa, Staphylococcus epidermidis
IYVHCQSGIRSSIAIGI

SEQ ID NO: 1823438 - protein, 28 aa, Staphylococcus epidermidis
IYVSRSHPGLLKRLFEQEVPEIYDGTVI

SEQ ID NO: 1823439 - protein, 18 aa, Staphylococcus epidermidis
KAGDIVLHKGMRINSGVI

SEQ ID NO: 1823440 - protein, 18 aa, Staphylococcus epidermidis
KAIVRFDSLVELDYYRHG

SEQ ID NO: 1823441 - protein, 25 aa, Staphylococcus epidermidis
KAKALGLQPIAVLDSFGASGVAPSI

SEQ ID NO: 1823442 - protein, 20 aa, Staphylococcus epidermidis
KAKNNINVPIFLKLTSDMEL

SEQ ID NO: 1823443 - protein, 23 aa, Staphylococcus epidermidis
KASYPSTVLMTATLAQVAGVNEI

SEQ ID NO: 1823444 - protein, 24 aa, Staphylococcus epidermidis
KASYPSTVLMTATLAQVAGVNEIT

SEQ ID NO: 1823445 - protein, 18 aa, Staphylococcus epidermidis
KAVEMEYRFFSFGDAMLI

SEQ ID NO: 1823446 - protein, 30 aa, Staphylococcus epidermidis
KDFESRIQAWSYPFVIKPGDDLPTAGGYGV

SEQ ID NO: 1823447 - protein, 17 aa, Staphylococcus epidermidis
KDFNLPVHVIGIDIVRE

SEQ ID NO: 1823448 - protein, 24 aa, Staphylococcus epidermidis
KDGDFFLKYYQWKMKKEHIVPISK

SEQ ID NO: 1823449 - protein, 28 aa, Staphylococcus epidermidis
KDQIVGKVSLRYWPFSEFKSNFNPNNTK

SEQ ID NO: 1823450 - protein, 20 aa, Staphylococcus epidermidis
KDVVGNKKALASFQDKFNEY

SEQ ID NO: 1823451 - protein, 29 aa, Staphylococcus epidermidis
KEILTTQKYLDYLGLSRFITDSLGVCIKN

SEQ ID NO: 1823452 - protein, 19 aa, Staphylococcus epidermidis
KEMSKDLDFIISTSEPKKV

SEQ ID NO: 1823453 - protein, 22 aa, Staphylococcus epidermidis
KETHDTVIRFAPPLVITKEELD

SEQ ID NO: 1823454 - protein, 23 aa, Staphylococcus epidermidis
KETHDTVIRFAPPLVITKEELDM

SEQ ID NO: 1823455 - protein, 17 aa, Staphylococcus epidermidis
KETVGNATDNKELEKDG

SEQ ID NO: 1823456 - protein, 22 aa, Staphylococcus epidermidis
KFGVYVIFDEKKPVFVGQTGGY

SEQ ID NO: 1823457 - protein, 23 aa, Staphylococcus epidermidis
KGIFSVMNYLLPMQDIMSMHCSA

SEQ ID NO: 1823458 - protein, 34 aa, Staphylococcus epidermidis; identical to SEQ ID NO: 1684371

SEQ ID NO: 1823459 - protein, 19 aa, Staphylococcus epidermidis
KGKWNYLYRAIDAEGHTLD

SEQ ID NO: 1823460 - protein, 22 aa, Staphylococcus epidermidis
KGLKVPEFVKTSLAPGSKVVTG

SEQ ID NO: 1823461 - protein, 25 aa, Staphylococcus epidermidis
KGTNLLTGIIHCPQCGAPMAASNTT

SEQ ID NO: 1823462 - protein, 21 aa, Staphylococcus epidermidis
KGYDLLLESIRLIQEDLRQLN

SEQ ID NO: 1823463 - protein, 20 aa, Staphylococcus epidermidis
KHIEIRYYESFAKTHQGHGT

SEQ ID NO: 1823464 - protein, 21 aa, Staphylococcus epidermidis
KHIEIRYYESFAKTHQGHGTD

SEQ ID NO: 1823465 - protein, 21 aa, Staphylococcus epidermidis
KHLFDLINTHLKIHQVAPISL

SEQ ID NO: 1823466 - protein, 18 aa, Staphylococcus epidermidis
KHLIIKSPHPSPLSAFRG

SEQ ID NO: 1823467 - protein, 17 aa, Staphylococcus epidermidis
KIDIPRVRFTTSHPWDF

SEQ ID NO: 1823468 - protein, 22 aa, Staphylococcus epidermidis
KIDLIILDIKMPYIDGFEVAQS

SEQ ID NO: 1823469 - protein, 18 aa, Staphylococcus epidermidis
KIKKLLCILKEQVPNCDN

SEQ ID NO: 1823470 - protein, 17 aa, Staphylococcus epidermidis
KILIYSEDYPKIPRAKP

SEQ ID NO: 1823471 - protein, 18 aa, Staphylococcus epidermidis
KINQFGMNLYQPYTVYPA

SEQ ID NO: 1823472 - protein, 23 aa, Staphylococcus epidermidis
KIRQMIGYLPQDFDFYPNMKVSE

SEQ ID NO: 1823473 - protein, 22 aa, Staphylococcus epidermidis
KISKLPYSIRVLLESVLRQEDD

SEQ ID NO: 1823474 - protein, 23 aa, Staphylococcus epidermidis
KKDIGFIFQDYNILNTLTVKENI

SEQ ID NO: 1823475 - protein, 24 aa, Staphylococcus epidermidis
KKDIGFIFQDYNILNTLTVKENIM

SEQ ID NO: 1823476 - protein, 17 aa, Staphylococcus epidermidis
KLCRPETPAIIVTRGLE

SEQ ID NO: 1823477 - protein, 17 aa, Staphylococcus epidermidis
KLLCILKEQVPNCDNQF

SEQ ID NO: 1823478 - protein, 18 aa, Staphylococcus epidermidis
KLNIPAIYSKYFLDISNY

SEQ ID NO: 1823479 - protein, 17 aa, Staphylococcus epidermidis
KLNLMPLDQLKQVTGYV

SEQ ID NO: 1823480 - protein, 24 aa, Staphylococcus epidermidis
KLSYIYDYPHQRLYRAIAGIGAYE

SEQ ID NO: 1823481 - protein, 18 aa, Staphylococcus epidermidis
KLTCLNPVQLRRVLAYLT

SEQ ID NO: 1823482 - protein, 17 aa, Staphylococcus epidermidis
KLTIGVMPQGPLTIPYV

SEQ ID NO: 1823483 - protein, 20 aa, Staphylococcus epidermidis
KLYTPTYKGDMLPGCMRQSL

SEQ ID NO: 1823484 - protein, 20 aa, Staphylococcus epidermidis
KNAVLPVLTASLLASEGHSK

SEQ ID NO: 1823485 - protein, 19 aa, Staphylococcus epidermidis
KNAYFKGMFNETCPTFDEI

SEQ ID NO: 1823486 - protein, 30 aa, Staphylococcus epidermidis; identical to SEQ ID NO: 1692722

SEQ ID NO: 1823487 - protein, 18 aa, Staphylococcus epidermidis
KNNDELLYITGSPYDTLL

SEQ ID NO: 1823488 - protein, 18 aa, Staphylococcus epidermidis
KPVIREKMSRRKKTAAKK

SEQ ID NO: 1823489 - protein, 23 aa, Staphylococcus epidermidis
KQEGYIRAYGISSIRPNVIDYYL

SEQ ID NO: 1823490 - protein, 24 aa, Staphylococcus epidermidis
KQEGYIRAYGISSIRPNVIDYYLK

SEQ ID NO: 1823491 - protein, 21 aa, Staphylococcus epidermidis
KQMQFFGARANLAKALLYAIN

SEQ ID NO: 1823492 - protein, 31 aa, Staphylococcus epidermidis
KQWIKDYSKALLGLVIPLYSKYGISLEAHLQ

SEQ ID NO: 1823493 - protein, 25 aa, Staphylococcus epidermidis
KQYQPRYNILLKDDKSYPFIKITKE

SEQ ID NO: 1823494 - protein, 27 aa, Staphylococcus epidermidis
KRARRDIEMLLGSKVYLELWVKVQRDW

SEQ ID NO: 1823495 - protein, 26 aa, Staphylococcus epidermidis
KRDDEGKYFYYLGKAKYIKGTEKQDY

SEQ ID NO: 1823496 - protein, 18 aa, Staphylococcus epidermidis
KRGDKTYLILNEEDILAI

SEQ ID NO: 1823497 - protein, 27 aa, Staphylococcus epidermidis
KRIEFYKLYVFMIHLFAIGTDFYDKVK

SEQ ID NO: 1823498 - protein, 32 aa, Staphylococcus epidermidis
KRQKVSMIFQHFNLLWSRSVLKNVTFPLEIAG

SEQ ID NO: 1823499 - protein, 21 aa, Staphylococcus epidermidis
KSILINMIKCVEACGVDVLDV

SEQ ID NO: 1823500 - protein, 21 aa, Staphylococcus epidermidis
KSVLIDLGLIIGKDARYRRNI

SEQ ID NO: 1823501 - protein, 17 aa, Staphylococcus epidermidis
KTFLNKLYGGDMKSLVL

SEQ ID NO: 1823502 - protein, 26 aa, Staphylococcus epidermidis
KTGWGRIPMSLGFTYSSNTLMMHLQD

SEQ ID NO: 1823503 - protein, 23 aa, Staphylococcus epidermidis
KTIRTLITRLYKKEIIKRYKSEN

SEQ ID NO: 1823504 - protein, 24 aa, Staphylococcus epidermidis
KTIRTLITRLYKKEIIKRYKSENI

SEQ ID NO: 1823505 - protein, 26 aa, Staphylococcus epidermidis
KTITPLRYVLPFNEQNRYLVMPALSD

SEQ ID NO: 1823506 - protein, 26 aa, Staphylococcus epidermidis
KTYAYALKNFFVYLESKKICYKEVSF

SEQ ID NO: 1823507 - protein, 17 aa, Staphylococcus epidermidis
KVHLESDVLFKYVENIM

SEQ ID NO: 1823508 - protein, 18 aa, Staphylococcus epidermidis
KVHLESDVLFKYVENIMN

SEQ ID NO: 1823509 - protein, 23 aa, Staphylococcus epidermidis
KVIFCEADEWKQFYQQNHSLITE

SEQ ID NO: 1823510 - protein, 18 aa, Staphylococcus epidermidis
KVLVDYRLKLKNTRAITA

SEQ ID NO: 1823511 - protein, 24 aa, Staphylococcus epidermidis
KVSEEQLFYLMSRGISEEEATEMI

SEQ ID NO: 1823512 - protein, 19 aa, Staphylococcus epidermidis
KWNIIRPPFNVTRISEYAA

SEQ ID NO: 1823513 - protein, 19 aa, Staphylococcus epidermidis
KYPDYLFTSQIIKEPYIVD

SEQ ID NO: 1823514 - protein, 18 aa, Staphylococcus epidermidis
KYPIYGLQYHPESILSEY

SEQ ID NO: 1823515 - protein, 24 aa, Staphylococcus epidermidis
LAIESRAMFPQLSKSLLDETGIDI

SEQ ID NO: 1823516 - protein, 17 aa, Staphylococcus epidermidis
LASHAQYRLGIRPEDLH

SEQ ID NO: 1823517 - protein, 17 aa, Staphylococcus epidermidis
LCILKEQVPNCDNQFLE

SEQ ID NO: 1823518 - protein, 17 aa, Staphylococcus epidermidis
LDKGYFARPTIFINVDN

SEQ ID NO: 1823519 - protein, 23 aa, Staphylococcus epidermidis
LDRKQIPFDELVLFSSARSAGKK

SEQ ID NO: 1823520 - protein, 18 aa, Staphylococcus epidermidis
LDSARFRYLISKELGVTS

SEQ ID NO: 1823521 - protein, 26 aa, Staphylococcus epidermidis
LDVFKDTKAWLREYFKGNYPEIKVPL

SEQ ID NO: 1823522 - protein, 30 aa, Staphylococcus epidermidis
LEAGRSDYFWDLFIQMPAALMFPSGNRFYD

SEQ ID NO: 1823523 - protein, 34 aa, Staphylococcus epidermidis
LEAGRSDYFWDLFIQMPAALMFPSGNRFYDWEYQ

SEQ ID NO: 1823524 - protein, 19 aa, Staphylococcus epidermidis
LEALNYYVRRFMITVPFEN

SEQ ID NO: 1823525 - protein, 23 aa, Staphylococcus epidermidis
LEELSHYWSVVRPYYADFESDIK

SEQ ID NO: 1823526 - protein, 21 aa, Staphylococcus epidermidis
LEGVLYNLYTVYLALIEVMNE

SEQ ID NO: 1823527 - protein, 23 aa, Staphylococcus epidermidis
LEKTKLIYLTYPNNPTGSTATQD

SEQ ID NO: 1823528 - protein, 19 aa, Staphylococcus epidermidis
LFIEGSYIYYLGSFIDSDS

SEQ ID NO: 1823529 - protein, 17 aa, Staphylococcus epidermidis
LFIPKINEDTLLYQDFD

SEQ ID NO: 1823530 - protein, 30 aa, Staphylococcus epidermidis
LFNDFEMHFYRYVFPYYDTLYTLEKLSKHH

SEQ ID NO: 1823531 - protein, 17 aa, Staphylococcus epidermidis
LGANAILGVSIAVARAA

SEQ ID NO: 1823532 - protein, 17 aa, Staphylococcus epidermidis
LGKDIQYKDLGLLIVDE

SEQ ID NO: 1823533 - protein, 21 aa, Staphylococcus epidermidis
LGQPSYFPIPEVIGVRLTHSL

SEQ ID NO: 1823534 - protein, 17 aa, Staphylococcus epidermidis
LGRAIGYKYPHNYENGH

SEQ ID NO: 1823535 - protein, 18 aa, Staphylococcus epidermidis
LIEHNLSIMCEADWIIDV

SEQ ID NO: 1823536 - protein, 21 aa, Staphylococcus epidermidis
LIGKRFFIMSRKNIKNQASQN

SEQ ID NO: 1823537 - protein, 21 aa, Staphylococcus epidermidis
LIIISYKLFKNKEQLFYVAYE

SEQ ID NO: 1823538 - protein, 20 aa, Staphylococcus epidermidis
LIMLAIPELFWSIELSKELD

SEQ ID NO: 1823539 - protein, 26 aa, Staphylococcus epidermidis
LIQLKHSISEIPHIKALLNELGAQTT

SEQ ID NO: 1823540 - protein, 18 aa, Staphylococcus epidermidis
LKCFSLGAKDYLPKPFYM

SEQ ID NO: 1823541 - protein, 19 aa, Staphylococcus epidermidis
LKELWPQAGDYLLVTLRID

SEQ ID NO: 1823542 - protein, 22 aa, Staphylococcus epidermidis
LKESNIPIIFLTAKDNLDTRLK

SEQ ID NO: 1823543 - protein, 22 aa, Staphylococcus epidermidis
LKVHYPHYFYANILSNVIGSEK

SEQ ID NO: 1823544 - protein, 21 aa, Staphylococcus epidermidis
LLIEGALNILSPGGTLLLCTN

SEQ ID NO: 1823545 - protein, 20 aa, Staphylococcus epidermidis
LLIITRETFFNHAYLVKKLN

SEQ ID NO: 1823546 - protein, 17 aa, Staphylococcus epidermidis
LLQIELNSMLQSLPKQL

SEQ ID NO: 1823547 - protein, 28 aa, Staphylococcus epidermidis
LLTYKIMTMFEPYFRDYKLIFINCPSRG

SEQ ID NO: 1823548 - protein, 18 aa, Staphylococcus epidermidis
LMMQQFYQRALKGETTKF

SEQ ID NO: 1823549 - protein, 18 aa, Staphylococcus epidermidis
LMMQQFYQRALKGQTTKF

SEQ ID NO: 1823550 - protein, 17 aa, Staphylococcus epidermidis
LMQLIIDLENCQPIHFN

SEQ ID NO: 1823551 - protein, 31 aa, Staphylococcus epidermidis; identical to SEQ ID NO: 1684091

SEQ ID NO: 1823552 - protein, 29 aa, Staphylococcus epidermidis
LNDLIFHIQKLFLLIFQLPEHLARQEYSL

SEQ ID NO: 1823553 - protein, 17 aa, Staphylococcus epidermidis
LNHGIPSFGYRIEAPIT

SEQ ID NO: 1823554 - protein, 19 aa, Staphylococcus epidermidis
LNLSFLPNYYSIIKDELNI

SEQ ID NO: 1823555 - protein, 24 aa, Staphylococcus epidermidis
LNPVELRRSIGYVIQQIGLMPHMT

SEQ ID NO: 1823556 - protein, 30 aa, Staphylococcus epidermidis
LNYNPILEGFTLPKMLWVQQHEPEIWNRVD

SEQ ID NO: 1823557 - protein, 30 aa, Staphylococcus epidermidis
LNYNPILEGFTLPKMLWVQQHEPEIWSRVD

SEQ ID NO: 1823558 - protein, 28 aa, Staphylococcus epidermidis
LPMGAAPMAYTLWTRHLNFNPQSKDFFN

SEQ ID NO: 1823559 - protein, 22 aa, Staphylococcus epidermidis
LPRPFFILAPMEDVTNIVFRHV

SEQ ID NO: 1823560 - protein, 18 aa, Staphylococcus epidermidis
LPVLCKDFIIDKIQIDVA

SEQ ID NO: 1823561 - protein, 23 aa, Staphylococcus epidermidis
LQNYHLMMVHPWQIKHILQSDYR

SEQ ID NO: 1823562 - protein, 31 aa, Staphylococcus epidermidis; identical to SEQ ID NO: 1697869

SEQ ID NO: 1823563 - protein, 17 aa, Staphylococcus epidermidis
LRMNYLFDFYQSLLTNK

SEQ ID NO: 1823564 - protein, 19 aa, Staphylococcus epidermidis
LSFIVHRDFAYERGKALVE

SEQ ID NO: 1823565 - protein, 18 aa, Staphylococcus epidermidis
LSHQHDLPVWNKPALCSL

SEQ ID NO: 1823566 - protein, 17 aa, Staphylococcus epidermidis
LSIVNVRYRSFYEHIWV

SEQ ID NO: 1823567 - protein, 18 aa, Staphylococcus epidermidis
LSKDLKAYGFKFLGPVTV

SEQ ID NO: 1823568 - protein, 19 aa, Staphylococcus epidermidis
LSKDLKAYGFKFLGPVTVF

SEQ ID NO: 1823569 - protein, 24 aa, Staphylococcus epidermidis
LSKELRQILKDHFAMTTLTTVVKQ

SEQ ID NO: 1823570 - protein, 27 aa, Staphylococcus epidermidis
LSRLVAPFVPFISEKIHYNLTGKSVHL

SEQ ID NO: 1823571 - protein, 17 aa, Staphylococcus epidermidis
LTCLNPVQLRRVLAYLT

SEQ ID NO: 1823572 - protein, 19 aa, Staphylococcus epidermidis
LTLGHSGLTALFWNHGHLA

SEQ ID NO: 1823573 - protein, 21 aa, Staphylococcus epidermidis
LTLGHSGLTALFWNHGHLASE

SEQ ID NO: 1823574 - protein, 18 aa, Staphylococcus epidermidis
LTLICKLHDKTYFEQLIL

SEQ ID NO: 1823575 - protein, 18 aa, Staphylococcus epidermidis
LTNLLKLKDSIILHLKEL

SEQ ID NO: 1823576 - protein, 30 aa, Staphylococcus epidermidis; identical to SEQ ID NO: 1697951

SEQ ID NO: 1823577 - protein, 23 aa, Staphylococcus epidermidis
LVHEQFDHYLLNDLPAFKDKSPS

SEQ ID NO: 1823578 - protein, 19 aa, Staphylococcus epidermidis
LYEGFSMGNPKIQTGNLLE

SEQ ID NO: 1823579 - protein, 27 aa, Staphylococcus epidermidis
LYNKDEFELIRLFGKRGRGLYNKARGI

SEQ ID NO: 1823580 - protein, 17 aa, Staphylococcus epidermidis
MAFALRAIDADSIPINF

SEQ ID NO: 1823581 - protein, 18 aa, Staphylococcus epidermidis
MDPKVAMLSFSTKGSAKS

SEQ ID NO: 1823582 - protein, 30 aa, Staphylococcus epidermidis
MFADLKTYVLFQLYERFVIDYSLGSATGMM

SEQ ID NO: 1823583 - protein, 18 aa, Staphylococcus epidermidis
MGDIMGDVTARRGRVDGM

SEQ ID NO: 1823584 - protein, 17 aa, Staphylococcus epidermidis
MGWYLDGRVSAVVGTHT

SEQ ID NO: 1823585 - protein, 18 aa, Staphylococcus epidermidis
MGWYLDGRVSAVVGTHTH

SEQ ID NO: 1823586 - protein, 18 aa, Staphylococcus epidermidis
MHKIAKSVQLLFNVECEV

SEQ ID NO: 1823587 - protein, 24 aa, Staphylococcus epidermidis
MIDETLFTVWQGFDYCIDMSQSPF

SEQ ID NO: 1823588 - protein, 18 aa, Staphylococcus epidermidis
MIIVTLAEKTPYLESKRL

SEQ ID NO: 1823589 - protein, 19 aa, Staphylococcus epidermidis
MIIVTLAEKTPYLESKRLV

SEQ ID NO: 1823590 - protein, 18 aa, Staphylococcus epidermidis
MIIYLPQEGRGIGLINKL

SEQ ID NO: 1823591 - protein, 19 aa, Staphylococcus epidermidis
MKIGKQMQFFGARANLAKA

SEQ ID NO: 1823592 - protein, 25 aa, Staphylococcus epidermidis
MKIGKQMQFFGARANLAKALLYAIN

SEQ ID NO: 1823593 - protein, 18 aa, Staphylococcus epidermidis
MKQKLGIAIAFLNQPQLI

SEQ ID NO: 1823594 - protein, 18 aa, Staphylococcus epidermidis
MKYKTFFDNINMPTTLEG

SEQ ID NO: 1823595 - protein, 19 aa, Staphylococcus epidermidis
MLKPMLARGELHCIGATTL

SEQ ID NO: 1823596 - protein, 30 aa, Staphylococcus epidermidis
MMNEVIGNPLLDKFMKDLIVQILAMVSEQE

SEQ ID NO: 1823597 - protein, 20 aa, Staphylococcus epidermidis
MNGYLYPKYLKDTFDNDGYF

SEQ ID NO: 1823598 - protein, 19 aa, Staphylococcus epidermidis
MNMTYIVMDNQIYGLTKGQ

SEQ ID NO: 1823599 - protein, 20 aa, Staphylococcus epidermidis
MNNRYFINLAAGGKLTQVSY

SEQ ID NO: 1823600 - protein, 22 aa, Staphylococcus epidermidis
MNNRYFINLAAGGKLTQVSYET

SEQ ID NO: 1823601 - protein, 17 aa, Staphylococcus epidermidis
MNPVELRRSIGYVIQQI

SEQ ID NO: 1823602 - protein, 23 aa, Staphylococcus epidermidis
MNYSDIYSLFKRLKHKTSINVHP

SEQ ID NO: 1823603 - protein, 19 aa, Staphylococcus epidermidis
MPAALMFPSGNRFYDWEYQ

SEQ ID NO: 1823604 - protein, 25 aa, Staphylococcus epidermidis
MRVQVRRLLKKYGYPPDLQKMAVEQ

SEQ ID NO: 1823605 - protein, 17 aa, Staphylococcus epidermidis
MTEFFDFVFEHIGENNR

SEQ ID NO: 1823606 - protein, 24 aa, Staphylococcus epidermidis
MTQKMATIRFTEPALIALTGGNFK

SEQ ID NO: 1823607 - protein, 28 aa, Staphylococcus epidermidis
MVKQLYSPVQFIQSTKWLINQGVDHFIE

SEQ ID NO: 1823608 - protein, 24 aa, Staphylococcus epidermidis
NAAKQRALTLSSELNKYITSNEFN

SEQ ID NO: 1823609 - protein, 20 aa, Staphylococcus epidermidis
NADRIGVWIGSGIGGMETFE

SEQ ID NO: 1823610 - protein, 19 aa, Staphylococcus epidermidis
NATAPYSIFIRGAKYRFEP

SEQ ID NO: 1823611 - protein, 18 aa, Staphylococcus epidermidis
NAYFKGMFNETCPTFDEI

SEQ ID NO: 1823612 - protein, 25 aa, Staphylococcus epidermidis
NDDRRIDLAVTKSLPRFIDVLETVL

SEQ ID NO: 1823613 - protein, 22 aa, Staphylococcus epidermidis
NDLKNIFTDYDKVIFSVGSGGS

SEQ ID NO: 1823614 - protein, 25 aa, Staphylococcus epidermidis
NDNEGLVVFPLNKAISESALNIIKD

SEQ ID NO: 1823615 - protein, 24 aa, Staphylococcus epidermidis
NEDYSMYIQFLYESRQYIKSLKIE

SEQ ID NO: 1823616 - protein, 19 aa, Staphylococcus epidermidis
NEFLIAGFNYEGQLAATIE

SEQ ID NO: 1823617 - protein, 24 aa, Staphylococcus epidermidis
NEHQIPYVDYMSELISIIKQHTHA

SEQ ID NO: 1823618 - protein, 18 aa, Staphylococcus epidermidis
NEKNADRIGVWIGSGIGG

SEQ ID NO: 1823619 - protein, 23 aa, Staphylococcus epidermidis
NFKGFRNTYFKQLVKRYCKLRLN

SEQ ID NO: 1823620 - protein, 23 aa, Staphylococcus epidermidis
NFKIRYLINEVCHKYQIPWVYGA

SEQ ID NO: 1823621 - protein, 20 aa, Staphylococcus epidermidis
NFLTGRELLIANRFPVIVHE

SEQ ID NO: 1823622 - protein, 24 aa, Staphylococcus epidermidis
NFNEKFDFIVSRTTFHHLDDIASV

SEQ ID NO: 1823623 - protein, 17 aa, Staphylococcus epidermidis
NGHFVIATIHQLLRFKQ

SEQ ID NO: 1823624 - protein, 20 aa, Staphylococcus epidermidis
NGIIIGFNVRPDAGAKRAAE

SEQ ID NO: 1823625 - protein, 26 aa, Staphylococcus epidermidis
NGKSRAIPIFVFMNDSFEQLTVWRPR

SEQ ID NO: 1823626 - protein, 20 aa, Staphylococcus epidermidis
NGRVRLIFQPAEELGHGAFE

SEQ ID NO: 1823627 - protein, 22 aa, Staphylococcus epidermidis
NHAPFANYWMHNGFINIDNEKM

SEQ ID NO: 1823628 - protein, 23 aa, Staphylococcus epidermidis
NIDIEPGYFYTLLGPSGCGKTTI

SEQ ID NO: 1823629 - protein, 19 aa, Staphylococcus epidermidis
NIEFDVMLASYIIDPSRSI

SEQ ID NO: 1823630 - protein, 27 aa, Staphylococcus epidermidis
NIGEYHGIFNEPIACSKINSGLFSQML

SEQ ID NO: 1823631 - protein, 20 aa, Staphylococcus epidermidis
NILEWIKIANEYKIPTFVLG

SEQ ID NO: 1823632 - protein, 21 aa, Staphylococcus epidermidis
NILEWIKIANEYKIPTFVLGV

SEQ ID NO: 1823633 - protein, 23 aa, Staphylococcus epidermidis
NIQKAVAEMKLAVGLLVDKKLSH

SEQ ID NO: 1823634 - protein, 26 aa, Staphylococcus epidermidis
NIVTTYLDRDILLPAIGQGALGIECR

SEQ ID NO: 1823635 - protein, 26 aa, Staphylococcus epidermidis
NKAKAIQALLLWLNEHHFDYSSIAKL

SEQ ID NO: 1823636 - protein, 17 aa, Staphylococcus epidermidis
NKKFVLGSVSHKVAKRA

SEQ ID NO: 1823637 - protein, 26 aa, Staphylococcus epidermidis
NKQQQLMQLINDLAMIFMKAGYEELQ

SEQ ID NO: 1823638 - protein, 17 aa, Staphylococcus epidermidis
NKRQPLHVYYFGKKFLA

SEQ ID NO: 1823639 - protein, 26 aa, Staphylococcus epidermidis
NKYGADSLRWALISDSAPWNNKRFSE

SEQ ID NO: 1823640 - protein, 22 aa, Staphylococcus epidermidis
NLESAYEFYVEKLGFEHISNFP

SEQ ID NO: 1823641 - protein, 29 aa, Staphylococcus epidermidis
NLIKTVHKYLPLLHRYTKLRQELLGLDDL

SEQ ID NO: 1823642 - protein, 31 aa, Staphylococcus epidermidis
NLIKTVHKYLPLLHRYTKLRQELLGLDDLKM

SEQ ID NO: 1823643 - protein, 18 aa, Staphylococcus epidermidis
NLPINQRIDIYIGVTGEL

SEQ ID NO: 1823644 - protein, 17 aa, Staphylococcus epidermidis
NLSHERIEFRHCTEKIE

SEQ ID NO: 1823645 - protein, 18 aa, Staphylococcus epidermidis
NMFFDDMNQLYLNKVSIL

SEQ ID NO: 1823646 - protein, 20 aa, Staphylococcus epidermidis
NMLKPMLARGELHCIGATTL

SEQ ID NO: 1823647 - protein, 17 aa, Staphylococcus epidermidis
NMTYIVMDNQIYGLTKG

SEQ ID NO: 1823648 - protein, 23 aa, Staphylococcus epidermidis
NNGRFSPVVFKLASEHDIDLTQV

SEQ ID NO: 1823649 - protein, 22 aa, Staphylococcus epidermidis
NNINHAYFIPAGNKYIMRHMKV

SEQ ID NO: 1823650 - protein, 26 aa, Staphylococcus epidermidis
NNIRDKFLIQLLYETGLRIGEVLSLR

SEQ ID NO: 1823651 - protein, 23 aa, Staphylococcus epidermidis
NNPNNYIFAIYKGKRKGMPFTQH

SEQ ID NO: 1823652 - protein, 26 aa, Staphylococcus epidermidis
NNTSDLPIGVIPVDSLYSPVERVNYT

SEQ ID NO: 1823653 - protein, 18 aa, Staphylococcus epidermidis
NPGIPYTVSIIKEATNRG

SEQ ID NO: 1823654 - protein, 21 aa, Staphylococcus epidermidis
NPKQCKHEFLRYPYIESFENV

SEQ ID NO: 1823655 - protein, 17 aa, Staphylococcus epidermidis
NPKVAMLSFSTKGSAKS

SEQ ID NO: 1823656 - protein, 25 aa, Staphylococcus epidermidis
NPSSEILSSVLMLEHLGWQEAADKI

SEQ ID NO: 1823657 - protein, 17 aa, Staphylococcus epidermidis
NQHGIDLKKANALLLEE

SEQ ID NO: 1823658 - protein, 18 aa, Staphylococcus epidermidis
NQLLIKLIENFENLPILG

SEQ ID NO: 1823659 - protein, 21 aa, Staphylococcus epidermidis
NSAPLLFKTISKLKKHFKGYG

SEQ ID NO: 1823660 - protein, 26 aa, Staphylococcus epidermidis
NSSNNPRFKRWVIGSILSRTYYHNMV

SEQ ID NO: 1823661 - protein, 28 aa, Staphylococcus epidermidis
NSTLFQNAMFDSNLIRSVKWTDIIFKNV

SEQ ID NO: 1823662 - protein, 17 aa, Staphylococcus epidermidis
NTEGHYYLLTKFGKQTY

SEQ ID NO: 1823663 - protein, 41 aa, Staphylococcus epidermidis
NTGALMSAGLFIVGRIKGVARPALVVTLPTTDGKGFVFLDV

SEQ ID NO: 1823664 - protein, 25 aa, Staphylococcus epidermidis
NVETFSNLLNKIVQSNVERALRQDS

SEQ ID NO: 1823665 - protein, 25 aa, Staphylococcus epidermidis
NVNFLRKRYETLKTLPMFDTIEYTE

SEQ ID NO: 1823666 - protein, 23 aa, Staphylococcus epidermidis
NVPLTAPPDGLYLEKIYLSPEEL

SEQ ID NO: 1823667 - protein, 24 aa, Staphylococcus epidermidis
NVPLTAPPDGLYLEKIYLSPEELI

SEQ ID NO: 1823668 - protein, 24 aa, Staphylococcus epidermidis
PALRNRWVRFERVKNLWLRTELKY

SEQ ID NO: 1823669 - protein, 27 aa, Staphylococcus epidermidis
PARFHRSPLPIPKFKYFKLKSTRKQNL

SEQ ID NO: 1823670 - protein, 26 aa, Staphylococcus epidermidis
PDAYGSQLGLKYYLQKKFPNKQIYAV

SEQ ID NO: 1823671 - protein, 20 aa, Staphylococcus epidermidis
PDIKLGIITPFIGHTQRWND

SEQ ID NO: 1823672 - protein, 22 aa, Staphylococcus epidermidis
PEFDHYFAIGKQTARTILKFNT

SEQ ID NO: 1823673 - protein, 24 aa, Staphylococcus epidermidis
PESLLEPLFNHFTDQYPKVMSLLD

SEQ ID NO: 1823674 - protein, 18 aa, Staphylococcus epidermidis
PFLLIDKIVEYEEGKRCV

SEQ ID NO: 1823675 - protein, 19 aa, Staphylococcus epidermidis
PFNKKFLGNIIAEVFNRFS

SEQ ID NO: 1823676 - protein, 20 aa, Staphylococcus epidermidis
PFNKKFLGNIIAEVFNRFSI

SEQ ID NO: 1823677 - protein, 36 aa, Staphylococcus epidermidis
PGEETGITFAGIPLGHEFNSLVLAILQVSGRAPKEK

SEQ ID NO: 1823678 - protein, 17 aa, Staphylococcus epidermidis
PGLIEKLDYLENLGIDV

SEQ ID NO: 1823679 - protein, 19 aa, Staphylococcus epidermidis
PGVDILSIIYQHGIEIEFP

SEQ ID NO: 1823680 - protein, 30 aa, Staphylococcus epidermidis; identical to SEQ ID NO: 1698796

SEQ ID NO: 1823681 - protein, 26 aa, Staphylococcus epidermidis
PHSLEDFLKYIIPELQRRALFKNSYN

SEQ ID NO: 1823682 - protein, 19 aa, Staphylococcus epidermidis
PILYQIWKKKHKKAYDKWR

SEQ ID NO: 1823683 - protein, 18 aa, Staphylococcus epidermidis
PITLIKIKDIYQSMEEIA

SEQ ID NO: 1823684 - protein, 20 aa, Staphylococcus epidermidis
PLSLMRLINQLNKATAIFVV

SEQ ID NO: 1823685 - protein, 21 aa, Staphylococcus epidermidis
PLSLMRLINQLNKTTAIFVVP

SEQ ID NO: 1823686 - protein, 17 aa, Staphylococcus epidermidis
PNWTTCVSICALFRDSD

SEQ ID NO: 1823687 - protein, 20 aa, Staphylococcus epidermidis
PQDFDFYPNMKVSEVLYYLG

SEQ ID NO: 1823688 - protein, 23 aa, Staphylococcus epidermidis
PQGRGKIKWQAFATLPQQFEILE

SEQ ID NO: 1823689 - protein, 21 aa, Staphylococcus epidermidis
PQMLRQRSGAIINLTSIVGAM

SEQ ID NO: 1823690 - protein, 17 aa, Staphylococcus epidermidis
PSKILIYSEDYPKIPRA

SEQ ID NO: 1823691 - protein, 18 aa, Staphylococcus epidermidis
PSSEILSSVLMLEHLGWQ

SEQ ID NO: 1823692 - protein, 20 aa, Staphylococcus epidermidis
PTEKFMKYKTFFDNINMPTT

SEQ ID NO: 1823693 - protein, 19 aa, Staphylococcus epidermidis
PVIGFIGGQTAPPGKRMGH

SEQ ID NO: 1823694 - protein, 17 aa, Staphylococcus epidermidis
PVLLPKFVELMAQGNPS

SEQ ID NO: 1823695 - protein, 17 aa, Staphylococcus epidermidis
PVLWKKVKKGLSAGRVQ

SEQ ID NO: 1823696 - protein, 24 aa, Staphylococcus epidermidis
PVVDMVKVKRYLQGRKTRLVGPNC

SEQ ID NO: 1823697 - protein, 29 aa, Staphylococcus epidermidis
PVVKGRHYIIITLWNSRQAFYDWQNSQAY

SEQ ID NO: 1823698 - protein, 21 aa, Staphylococcus epidermidis
PWDISAQFLFVRELGLIMTQI

SEQ ID NO: 1823699 - protein, 19 aa, Staphylococcus epidermidis
PYEGHLWIMDPIDGTSNLV

SEQ ID NO: 1823700 - protein, 26 aa, Staphylococcus epidermidis
PYFELHSAIKVKVLVDYRLKLKNTRA

SEQ ID NO: 1823701 - protein, 24 aa, Staphylococcus epidermidis
QDEQLIQHIVKFNEDLRTMTKQGQ

SEQ ID NO: 1823702 - protein, 24 aa, Staphylococcus epidermidis
QDHFTTVFKQLFGGGQAELRLTED

SEQ ID NO: 1823703 - protein, 18 aa, Staphylococcus epidermidis
QDLVILIKLLYASETSNK

SEQ ID NO: 1823704 - protein, 19 aa, Staphylococcus epidermidis
QDLVILIKLLYASETSNKQ

SEQ ID NO: 1823705 - protein, 18 aa, Staphylococcus epidermidis
QEEDYTYFFNGVKHILKA

SEQ ID NO: 1823706 - protein, 23 aa, Staphylococcus epidermidis
QEEDYTYFFNGVKHILKAKDKEL

SEQ ID NO: 1823707 - protein, 34 aa, Staphylococcus epidermidis
QEEEQDLFIDLIFSPIYFNILIKPETLDENYIKK

SEQ ID NO: 1823708 - protein, 18 aa, Staphylococcus epidermidis
QFLFVRELGLIMTQINGE

SEQ ID NO: 1823709 - protein, 22 aa, Staphylococcus epidermidis
QGDANVFVFPSLEAGNIGYKIA

SEQ ID NO: 1823710 - protein, 25 aa, Staphylococcus epidermidis
QHFSQLMRHYFPNKTLKTLNSDDIL

SEQ ID NO: 1823711 - protein, 17 aa, Staphylococcus epidermidis
QHHGCIDAAIFNLGYLP

SEQ ID NO: 1823712 - protein, 24 aa, Staphylococcus epidermidis
QHLNQYLPKYMIPKTLTAISEIPL

SEQ ID NO: 1823713 - protein, 18 aa, Staphylococcus epidermidis
QIDQYELQLLLDGPHDAN

SEQ ID NO: 1823714 - protein, 18 aa, Staphylococcus epidermidis
QIFDIALYRKVASKVGVE

SEQ ID NO: 1823715 - protein, 17 aa, Staphylococcus epidermidis
QLLSQIRRTTNDDIVIV

SEQ ID NO: 1823716 - protein, 18 aa, Staphylococcus epidermidis
QLSYLLADSSKRDAHASY

SEQ ID NO: 1823717 - protein, 28 aa, Staphylococcus epidermidis
QNKRQPLHVYYFGEKFLALLNVNFNTFE

SEQ ID NO: 1823718 - protein, 21 aa, Staphylococcus epidermidis
QPEFIGKPEPIIMSKSLDILG

SEQ ID NO: 1823719 - protein, 22 aa, Staphylococcus epidermidis
QPLREDMSFLTRFINKHAVNEK

SEQ ID NO: 1823720 - protein, 20 aa, Staphylococcus epidermidis
QQIRNLYPQANLIEFFGTSE

SEQ ID NO: 1823721 - protein, 26 aa, Staphylococcus epidermidis
QQLNDKFSILSYYKALIQLKKSDLIY

SEQ ID NO: 1823722 - protein, 33 aa, Staphylococcus epidermidis
QQLNDKFSILSYYKALIQLKKSDLIYIYGKFNM

SEQ ID NO: 1823723 - protein, 17 aa, Staphylococcus epidermidis
QQRFYNCSIYGFGGDPM

SEQ ID NO: 1823724 - protein, 22 aa, Staphylococcus epidermidis
QSEVPAHVQAGWMLTTIASIGE

SEQ ID NO: 1823725 - protein, 18 aa, Staphylococcus epidermidis
QSFYQTFISFHQFKEITQ

SEQ ID NO: 1823726 - protein, 21 aa, Staphylococcus epidermidis
QSKCLVLFTSYKMMHMVQDLL

SEQ ID NO: 1823727 - protein, 22 aa, Staphylococcus epidermidis
QSKCLVLFTSYKMMHMVQDLLN

SEQ ID NO: 1823728 - protein, 25 aa, Staphylococcus epidermidis
QSNKKLIPKYPKKIAVLTASTGAAI

SEQ ID NO: 1823729 - protein, 23 aa, Staphylococcus epidermidis
QTDLGIVLLNKDNIVYLGIYDGN

SEQ ID NO: 1823730 - protein, 21 aa, Staphylococcus epidermidis
QTYIQRVLMNVLLNITKDDVN

SEQ ID NO: 1823731 - protein, 31 aa, Staphylococcus epidermidis
QVDIAGPGFINFYLDNQYLTAIIPEAITKGD

SEQ ID NO: 1823732 - protein, 30 aa, Staphylococcus epidermidis
QVTFLKRPPSAWVVLAKPNIGISSPDVFKA

SEQ ID NO: 1823733 - protein, 30 aa, Staphylococcus epidermidis
QWIKDYSKALLGLVIPLYSKYGISLEAHLQ

SEQ ID NO: 1823734 - protein, 21 aa, Staphylococcus epidermidis
QYAISSALALGLKGDTCIAGG

SEQ ID NO: 1823735 - protein, 22 aa, Staphylococcus epidermidis
QYAISSALALGLKGDTCIAGGG

SEQ ID NO: 1823736 - protein, 19 aa, Staphylococcus epidermidis
RASQMYYHELNMSTPVVNF

SEQ ID NO: 1823737 - protein, 26 aa, Staphylococcus epidermidis
RATLKRLPLYYRLVSILKGKGIDRVN

SEQ ID NO: 1823738 - protein, 17 aa, Staphylococcus epidermidis
RAYHKFLQSGYQTELHL

SEQ ID NO: 1823739 - protein, 18 aa, Staphylococcus epidermidis
RCHIEAYIEFLFEYAANK

SEQ ID NO: 1823740 - protein, 20 aa, Staphylococcus epidermidis
RDDKAIEGIPQELALKNAKE

SEQ ID NO: 1823741 - protein, 21 aa, Staphylococcus epidermidis
RDDKAIEGIPQELALKNAKET

SEQ ID NO: 1823742 - protein, 26 aa, Staphylococcus epidermidis
RDVATKAWYNTYLNIYAASTVNELLA

SEQ ID NO: 1823743 - protein, 19 aa, Staphylococcus epidermidis
REFTLILYVNDIVGMLAQV

SEQ ID NO: 1823744 - protein, 20 aa, Staphylococcus epidermidis
REFTLILYVNDIVGMLAQVL

SEQ ID NO: 1823745 - protein, 21 aa, Staphylococcus epidermidis
REGFLLAQEISSYSLTLVAHE

SEQ ID NO: 1823746 - protein, 20 aa, Staphylococcus epidermidis
RFNIAILEKGNFLGTGNYIL

SEQ ID NO: 1823747 - protein, 18 aa, Staphylococcus epidermidis
RGEQVTFLKRPPSAWVVL

SEQ ID NO: 1823748 - protein, 33 aa, Staphylococcus epidermidis
RGEQVTFLKRPPSAWVVLAKPNIGISSPDVFKA

SEQ ID NO: 1823749 - protein, 27 aa, Staphylococcus epidermidis
RGESALNYRLTAATFFIKMNQKTVPEF

SEQ ID NO: 1823750 - protein, 18 aa, Staphylococcus epidermidis
RGLICAPIDKSIAERLKL

SEQ ID NO: 1823751 - protein, 19 aa, Staphylococcus epidermidis
RGLICAPIDKSIAERLKLQ

SEQ ID NO: 1823752 - protein, 24 aa, Staphylococcus epidermidis
RIGKLPLLMDFINNDSIDPSVIFS

SEQ ID NO: 1823753 - protein, 25 aa, Staphylococcus epidermidis
RIKSYPQDIAALFYEQLRHCSTLFV

SEQ ID NO: 1823754 - protein, 20 aa, Staphylococcus epidermidis
RILDFALALVGKPELLILDE

SEQ ID NO: 1823755 - protein, 21 aa, Staphylococcus epidermidis
RKIAMVFQNYALYPHMTVYKN

SEQ ID NO: 1823756 - protein, 20 aa, Staphylococcus epidermidis
RKMITTYLPKIKQTYHPTVS

SEQ ID NO: 1823757 - protein, 17 aa, Staphylococcus epidermidis
RLFSISDLLLYEDIRKI

SEQ ID NO: 1823758 - protein, 29 aa, Staphylococcus epidermidis
RLGKSRPYIANMLRLLQLPKNVAQMVQHG

SEQ ID NO: 1823759 - protein, 29 aa, Staphylococcus epidermidis
RLGKSRPYIANMLRLLQLPKNVAQMVQQG

SEQ ID NO: 1823760 - protein, 20 aa, Staphylococcus epidermidis
RLKGIIKKEFSISFEEFAVL

SEQ ID NO: 1823761 - protein, 17 aa, Staphylococcus epidermidis
RLLTSRAEYRLLLRHDN

SEQ ID NO: 1823762 - protein, 18 aa, Staphylococcus epidermidis
RLMKQAEKFNRPIFTFID

SEQ ID NO: 1823763 - protein, 26 aa, Staphylococcus epidermidis
RLQDDIQLIDMMRALFPCGSITGAPK

SEQ ID NO: 1823764 - protein, 22 aa, Staphylococcus epidermidis
RLSDLEKLIRLPGKFKYFEHNV

SEQ ID NO: 1823765 - protein, 21 aa, Staphylococcus epidermidis
RQPLHVYYFGKKFLALLNVNF

SEQ ID NO: 1823766 - protein, 23 aa, Staphylococcus epidermidis
RQPLREDMSFLTRFINKHAVNEK

SEQ ID NO: 1823767 - protein, 21 aa, Staphylococcus epidermidis
RRGELVSCFLLEVDDSLNSIN

SEQ ID NO: 1823768 - protein, 28 aa, Staphylococcus epidermidis
RSMQTVLYQILIDMTKLLAPILVHTAEE

SEQ ID NO: 1823769 - protein, 18 aa, Staphylococcus epidermidis
RSYLKYLKANYPNRHYIT

SEQ ID NO: 1823770 - protein, 19 aa, Staphylococcus epidermidis
RTISMINKYFHGELPAYQG

SEQ ID NO: 1823771 - protein, 29 aa, Staphylococcus epidermidis
RTMELIDKYDFIYGIIGWHPVDAIDCTDE

SEQ ID NO: 1823772 - protein, 32 aa, Staphylococcus epidermidis; identical to SEQ ID NO: 1684117

SEQ ID NO: 1823773 - protein, 30 aa, Staphylococcus epidermidis
RVKQLLHTLQLWLMRINYLNQPKSYPSIET

SEQ ID NO: 1823774 - protein, 22 aa, Staphylococcus epidermidis
RVSIEEKRLRELKPGEALVKTE

SEQ ID NO: 1823775 - protein, 18 aa, Staphylococcus epidermidis
RYVFKDGKLIIISYKLFK

SEQ ID NO: 1823776 - protein, 42 aa, Staphylococcus epidermidis
SAGFTLEQLAVQDFFFQPDYDRPWHYLNVLAQQALGDTFGSD

SEQ ID NO: 1823777 - protein, 19 aa, Staphylococcus epidermidis
SFIERYVYELYNKHTTHIT

SEQ ID NO: 1823778 - protein, 24 aa, Staphylococcus epidermidis
SFIERYVYELYNKHTTHITVVTSD

SEQ ID NO: 1823779 - protein, 25 aa, Staphylococcus epidermidis
SGAALVTRLFYMKHQFRTIATMGIG

SEQ ID NO: 1823780 - protein, 26 aa, Staphylococcus epidermidis
SGIEPGQWLGVFGVGGLGNLALQYAK

SEQ ID NO: 1823781 - protein, 27 aa, Staphylococcus epidermidis
SGIEPGQWLGVFGVGGLGNLALQYAKN

SEQ ID NO: 1823782 - protein, 18 aa, Staphylococcus epidermidis
SGLSYNISYASKAFTCIQ

SEQ ID NO: 1823783 - protein, 25 aa, Staphylococcus epidermidis
SGMSLTRDTSRFYQYWLDHVDEDLN

SEQ ID NO: 1823784 - protein, 26 aa, Staphylococcus epidermidis
SGMSLTRDTSRFYQYWLDHVDEDLNE

SEQ ID NO: 1823785 - protein, 19 aa, Staphylococcus epidermidis
SGVQFFTLPFATVSEVQNY

SEQ ID NO: 1823786 - protein, 21 aa, Staphylococcus epidermidis
SHSFLIMPLDAMGLKKVKNYL

SEQ ID NO: 1823787 - protein, 17 aa, Staphylococcus epidermidis
SHVLPTNQTARFTNGLS

SEQ ID NO: 1823788 - protein, 21 aa, Staphylococcus epidermidis
SHYQFGHIPSRIPLRASFNQK

SEQ ID NO: 1823789 - protein, 19 aa, Staphylococcus epidermidis
SILKNIEKLVWMGGTFLDK

SEQ ID NO: 1823790 - protein, 17 aa, Staphylococcus epidermidis
SIRVLLESVLRQEDDFV

SEQ ID NO: 1823791 - protein, 23 aa, Staphylococcus epidermidis
SKELRQILKDHFAMTTLTTVVKQ

SEQ ID NO: 1823792 - protein, 23 aa, Staphylococcus epidermidis
SKGNLYYHFKTKENLFLEILNIE

SEQ ID NO: 1823793 - protein, 19 aa, Staphylococcus epidermidis
SKLKQLSYILHKALRKISF

SEQ ID NO: 1823794 - protein, 23 aa, Staphylococcus epidermidis
SKQIFDLILKFADYGFPRAHAVS

SEQ ID NO: 1823795 - protein, 20 aa, Staphylococcus epidermidis
SKQLLVMLHGFISDATTYHS

SEQ ID NO: 1823796 - protein, 17 aa, Staphylococcus epidermidis
SLDLVIPNGMFGILGRN

SEQ ID NO: 1823797 - protein, 30 aa, Staphylococcus epidermidis
SLNDLIFHIQKLFLLIFQLPEHLARQEYSL

SEQ ID NO: 1823798 - protein, 17 aa, Staphylococcus epidermidis
SLQPFLNKYLSQPEFVE

SEQ ID NO: 1823799 - protein, 22 aa, Staphylococcus epidermidis
SMAEWDVMNIIWDKKSVSANEI

SEQ ID NO: 1823800 - protein, 23 aa, Staphylococcus epidermidis
SMAEWDVMNIIWGKKSVSANEIV

SEQ ID NO: 1823801 - protein, 22 aa, Staphylococcus epidermidis
SMAEWDVMNIIWNKKSVSANEI

SEQ ID NO: 1823802 - protein, 34 aa, Staphylococcus epidermidis
SNGKYLFEAVYGAGLARIYKLNPITGAIEKLIEE

SEQ ID NO: 1823803 - protein, 24 aa, Staphylococcus epidermidis
SNKKLIPKYPKKIAVLTASTGAAI

SEQ ID NO: 1823804 - protein, 22 aa, Staphylococcus epidermidis
SQHKGYGTRLLEAGLKRFKDQY

SEQ ID NO: 1823805 - protein, 27 aa, Staphylococcus epidermidis
SQQKLDILILNIQKLSVDCHFPRTSRK

SEQ ID NO: 1823806 - protein, 21 aa, Staphylococcus epidermidis
SRLTTFLEHELAKTTSLHGVL

SEQ ID NO: 1823807 - protein, 21 aa, Staphylococcus epidermidis
SSIVGVYLFGSAVNGGLRINS

SEQ ID NO: 1823808 - protein, 23 aa, Staphylococcus epidermidis
SSSIEEPFFMSLNEMFAMKEYKQ

SEQ ID NO: 1823809 - protein, 17 aa, Staphylococcus epidermidis
STGYFIEPTIFSGLQSA

SEQ ID NO: 1823810 - protein, 21 aa, Staphylococcus epidermidis
STIIQLMQYLKKRHIPMAITT

SEQ ID NO: 1823811 - protein, 23 aa, Staphylococcus epidermidis
SVEIDLFFAMCNKLKEQDTNKLY

SEQ ID NO: 1823812 - protein, 24 aa, Staphylococcus epidermidis
SVHRGDYLAVLSTGAYHYSMASNY

SEQ ID NO: 1823813 - protein, 17 aa, Staphylococcus epidermidis
SVTFTHEFMFSRPLHHT

SEQ ID NO: 1823814 - protein, 19 aa, Staphylococcus epidermidis
SYGINLRYPEGFKFEDAID

SEQ ID NO: 1823815 - protein, 31 aa, Staphylococcus epidermidis
SYKQLPLTLFQIQSKYRDEKRPRFGLLRGRE

SEQ ID NO: 1823816 - protein, 20 aa, Staphylococcus epidermidis
SYPFIKITKEKHPRLLVTRT

SEQ ID NO: 1823817 - protein, 22 aa, Staphylococcus epidermidis
SYRIDGFSEIDYMISDYAKPQN

SEQ ID NO: 1823818 - protein, 23 aa, Staphylococcus epidermidis
SYSKTMFRLLKQYKHTGYLKLSM

SEQ ID NO: 1823819 - protein, 18 aa, Staphylococcus epidermidis
TADVKIFKLLKPANESRS

SEQ ID NO: 1823820 - protein, 18 aa, Staphylococcus epidermidis
TDAIKWVLGEQSAKSLRG

SEQ ID NO: 1823821 - protein, 23 aa, Staphylococcus epidermidis
TEHMFFGPERLIEMRRFILASNH

SEQ ID NO: 1823822 - protein, 24 aa, Staphylococcus epidermidis
TEHMFFGPERLIEMRRFILASNHD

SEQ ID NO: 1823823 - protein, 23 aa, Staphylococcus epidermidis
TFKKMHVRMMPGQEPPYTRLIDS

SEQ ID NO: 1823824 - protein, 21 aa, Staphylococcus epidermidis
TGIFVTILRSFSHFSQQIQPE

SEQ ID NO: 1823825 - protein, 19 aa, Staphylococcus epidermidis
TGNLLVLKTLPGNAQSIGA

SEQ ID NO: 1823826 - protein, 23 aa, Staphylococcus epidermidis
TGQKRQTIYPKSQPKRGFSKRTT

SEQ ID NO: 1823827 - protein, 17 aa, Staphylococcus epidermidis
TIGVMPQGPLTIPYVED

SEQ ID NO: 1823828 - protein, 23 aa, Staphylococcus epidermidis
TIVSNKPVWFKQGKAETLKSLKL

SEQ ID NO: 1823829 - protein, 23 aa, Staphylococcus epidermidis
TKDDFIIKTLPKDSYQLSEDNDC

SEQ ID NO: 1823830 - protein, 17 aa, Staphylococcus epidermidis
TLHYYHEKGLLVPQQMS

SEQ ID NO: 1823831 - protein, 22 aa, Staphylococcus epidermidis
TLLLEEGATLLRKGKDALLKNG

SEQ ID NO: 1823832 - protein, 19 aa, Staphylococcus epidermidis
TLRMNYLFDFYQSLLTNKQ

SEQ ID NO: 1823833 - protein, 27 aa, Staphylococcus epidermidis
TLSVMKGRKILILADVLELGPNSQLMH

SEQ ID NO: 1823834 - protein, 18 aa, Staphylococcus epidermidis
TMAPLTDDLSYIRNLFKE

SEQ ID NO: 1823835 - protein, 28 aa, Staphylococcus epidermidis
TMELIDKYDFIYGIIGWHPVDAIDCTDE

SEQ ID NO: 1823836 - protein, 25 aa, Staphylococcus epidermidis
TMIDETLFTVWQGFDYCIDMSQSPF

SEQ ID NO: 1823837 - protein, 26 aa, Staphylococcus epidermidis
TNDNEGLVVFPLNKAISESALNIIKD

SEQ ID NO: 1823838 - protein, 24 aa, Staphylococcus epidermidis
TNKQKNYLEFFYLQDYSLSEIADT

SEQ ID NO: 1823839 - protein, 24 aa, Staphylococcus epidermidis
TNKQKNYLELFYLQDYSLSEIADT

SEQ ID NO: 1823840 - protein, 24 aa, Staphylococcus epidermidis
TNTIIAHHPLIFKGVKRIVEDGYG

SEQ ID NO: 1823841 - protein, 36 aa, Staphylococcus epidermidis; identical to SEQ ID NO: 1684027

SEQ ID NO: 1823842 - protein, 29 aa, Staphylococcus epidermidis
TQPTEAQWEAMLLGWKVVSAVKSNAVILS

SEQ ID NO: 1823843 - protein, 19 aa, Staphylococcus epidermidis
TRVILMCPQGRPFTQEIAQ

SEQ ID NO: 1823844 - protein, 18 aa, Staphylococcus epidermidis
TSIQFYKDILHGDLLVSG

SEQ ID NO: 1823845 - protein, 20 aa, Staphylococcus epidermidis
TSSMQVPLQHIIKFSCKPVQ

SEQ ID NO: 1823846 - protein, 21 aa, Staphylococcus epidermidis
TSSMQVPLQHIIKFSCKPVQQ

SEQ ID NO: 1823847 - protein, 25 aa, Staphylococcus epidermidis
TTFPTFLEMLMATYKLIQKAKATHR

SEQ ID NO: 1823848 - protein, 33 aa, Staphylococcus epidermidis
TTIFKAMIAIKTGNPIIFAFHPSAQQSSKYAAK

SEQ ID NO: 1823849 - protein, 27 aa, Staphylococcus epidermidis
TTSILTQVFQLDLFAEYLPHEDAQQPI

SEQ ID NO: 1823850 - protein, 24 aa, Staphylococcus epidermidis
TVVSNFYDYLYRSKKLDVNFYDFM

SEQ ID NO: 1823851 - protein, 20 aa, Staphylococcus epidermidis
TVWSTRYLNLSVNNKFIISS

SEQ ID NO: 1823852 - protein, 17 aa, Staphylococcus epidermidis
TYDPFTLTENQGYLYGR

SEQ ID NO: 1823853 - protein, 29 aa, Staphylococcus epidermidis
VCDIYPLLNRSLLYSAIILHDLGKVRELS

SEQ ID NO: 1823854 - protein, 23 aa, Staphylococcus epidermidis
VDNKIRDILIRIPNLINEDVPQG

SEQ ID NO: 1823855 - protein, 24 aa, Staphylococcus epidermidis
VDNKIRDILIRIPNLINEDVPQGA

SEQ ID NO: 1823856 - protein, 30 aa, Staphylococcus epidermidis
VDQILTYSTIYDLPILADPLSQLRKEKHPN

SEQ ID NO: 1823857 - protein, 28 aa, Staphylococcus epidermidis
VDSADADRLYFLKQHTLVTELIFDETQA

SEQ ID NO: 1823858 - protein, 22 aa, Staphylococcus epidermidis
VDSSLLLKKAIDILGVNYVKPV

SEQ ID NO: 1823859 - protein, 25 aa, Staphylococcus epidermidis
VEDVSTIIMNIKKLALKIYSEEDKT

SEQ ID NO: 1823860 - protein, 18 aa, Staphylococcus epidermidis
VEYVFGIPGAKIDYLFNA

SEQ ID NO: 1823861 - protein, 26 aa, Staphylococcus epidermidis
VFERYEKMMDWLAGVYINSLNIIHYM

SEQ ID NO: 1823862 - protein, 32 aa, Staphylococcus epidermidis
VFLNSRTTIFPILGGGERLGTLVLGRVQDDFN

SEQ ID NO: 1823863 - protein, 18 aa, Staphylococcus epidermidis
VHASLLPKYRGGAPIHQA

SEQ ID NO: 1823864 - protein, 28 aa, Staphylococcus epidermidis
VHFESLIHFDLDMLYRMIDIINDTLVSI

SEQ ID NO: 1823865 - protein, 17 aa, Staphylococcus epidermidis
VIQQLKLNHSLYIVTNG

SEQ ID NO: 1823866 - protein, 25 aa, Staphylococcus epidermidis
VIRYAQYLNELSTETQFIVITHRKG

SEQ ID NO: 1823867 - protein, 26 aa, Staphylococcus epidermidis
VIRYAQYLNELSTETQFIVITHRKGT

SEQ ID NO: 1823868 - protein, 34 aa, Staphylococcus epidermidis
VISKLRVVVDLSLEPKLFLQICCIGAGIPQINKK

SEQ ID NO: 1823869 - protein, 24 aa, Staphylococcus epidermidis
VLEKTKLIYLTYPNNPTGSTATQD

SEQ ID NO: 1823870 - protein, 18 aa, Staphylococcus epidermidis
VLQALKNLDYYLFEGIKT

SEQ ID NO: 1823871 - protein, 23 aa, Staphylococcus epidermidis
VLSKAKVIILDTYYLMMGGYQKK

SEQ ID NO: 1823872 - protein, 18 aa, Staphylococcus epidermidis
VNHVLEFYEISFNTLDDF

SEQ ID NO: 1823873 - protein, 19 aa, Staphylococcus epidermidis
VNHVLEFYEISFNTLDNFI

SEQ ID NO: 1823874 - protein, 17 aa, Staphylococcus epidermidis
VNILIGHLTIEGGKTSD

SEQ ID NO: 1823875 - protein, 18 aa, Staphylococcus epidermidis
VNLLVFIINQKLTAQDLN

SEQ ID NO: 1823876 - protein, 27 aa, Staphylococcus epidermidis
VNMGDAIYLSPASWLRKQAQMVKDAGV

SEQ ID NO: 1823877 - protein, 28 aa, Staphylococcus epidermidis
VNMGDAIYLSPASWLRKQAQMVKDAGVK

SEQ ID NO: 1823878 - protein, 23 aa, Staphylococcus epidermidis
VNMIALVNGRPKLINLKEALIHY

SEQ ID NO: 1823879 - protein, 28 aa, Staphylococcus epidermidis
VNQWSYEALVRIFFRYGEEKFSKQIARR

SEQ ID NO: 1823880 - protein, 19 aa, Staphylococcus epidermidis
VNRAGSMIGYFLNEGPVTN

SEQ ID NO: 1823881 - protein, 20 aa, Staphylococcus epidermidis
VNSKYLIATTAAKRARELDE

SEQ ID NO: 1823882 - protein, 18 aa, Staphylococcus epidermidis
VNSLFQYIQHKDGYKLKI

SEQ ID NO: 1823883 - protein, 30 aa, Staphylococcus epidermidis
VPQPTRAEHVKLLIPLLEKNRDEIAQLYVK

SEQ ID NO: 1823884 - protein, 25 aa, Staphylococcus epidermidis
VQDHFTTVFKQLFGGGQAELRLTED

SEQ ID NO: 1823885 - protein, 19 aa, Staphylococcus epidermidis
VQEYAPILYQIWKKKHKKA

SEQ ID NO: 1823886 - protein, 18 aa, Staphylococcus epidermidis
VSNVIYFKVAKTESLEQL

SEQ ID NO: 1823887 - protein, 20 aa, Staphylococcus epidermidis
VTTSKPFFLEFMAKNVSKGN

SEQ ID NO: 1823888 - protein, 18 aa, Staphylococcus epidermidis
VVGFIGGQTAPPGKRMGH

SEQ ID NO: 1823889 - protein, 25 aa, Staphylococcus epidermidis
VVRLANFGAFVEIAPSVQGLVHISE

SEQ ID NO: 1823890 - protein, 26 aa, Staphylococcus epidermidis
VVRLANFGAFVEIAPSVQGLVHISEI

SEQ ID NO: 1823891 - protein, 17 aa, Staphylococcus epidermidis
VYELYNKHTTHITVVTS

SEQ ID NO: 1823892 - protein, 28 aa, Staphylococcus epidermidis
VYHAIKPDIFFFLPSYMAPLKHHNTQLY

SEQ ID NO: 1823893 - protein, 18 aa, Staphylococcus epidermidis
WDISAQFLFARELGLIMT

SEQ ID NO: 1823894 - protein, 18 aa, Staphylococcus epidermidis
WELDEPVPPLPPAKNFKG

SEQ ID NO: 1823895 - protein, 17 aa, Staphylococcus epidermidis
WLTHMTHQFPNKLYLSV

SEQ ID NO: 1823896 - protein, 18 aa, Staphylococcus epidermidis
WLTILKKKESYEQAFYNF

SEQ ID NO: 1823897 - protein, 17 aa, Staphylococcus epidermidis
YDIFQIYSPQIWEEIIG

SEQ ID NO: 1823898 - protein, 18 aa, Staphylococcus epidermidis
YDKTLAKQVLLIDRIQDP

SEQ ID NO: 1823899 - protein, 19 aa, Staphylococcus epidermidis
YDVSGLGLDLFAGSGALGI

SEQ ID NO: 1823900 - protein, 29 aa, Staphylococcus epidermidis
YEETGAIAKFIYYFAQYSIKMGHDEPFIK

SEQ ID NO: 1823901 - protein, 18 aa, Staphylococcus epidermidis
YEGYRLGSDDLSIGEIVF

SEQ ID NO: 1823902 - protein, 17 aa, Staphylococcus epidermidis
YEKGYDLLLESIRLIQE

SEQ ID NO: 1823903 - protein, 23 aa, Staphylococcus epidermidis
YEKGYDLLLESIRLIQEDLRQLN

SEQ ID NO: 1823904 - protein, 18 aa, Staphylococcus epidermidis
YFELHSAIKVKVVVDYRL

SEQ ID NO: 1823905 - protein, 17 aa, Staphylococcus epidermidis
YFHPKPSVDSVLIVLER

SEQ ID NO: 1823906 - protein, 17 aa, Staphylococcus epidermidis
YFLKKQQGGLNHASIYN

SEQ ID NO: 1823907 - protein, 18 aa, Staphylococcus epidermidis
YFNNLTSLFIPKINEDTL

SEQ ID NO: 1823908 - protein, 24 aa, Staphylococcus epidermidis
YGKLGVKVWIYRGEVLPTKNTSEG

SEQ ID NO: 1823909 - protein, 21 aa, Staphylococcus epidermidis
YGPLLDGFRKVEFGDFNQLKA

SEQ ID NO: 1823910 - protein, 24 aa, Staphylococcus epidermidis
YGTAEHPFVPHFTIAQGLTSQEFE

SEQ ID NO: 1823911 - protein, 27 aa, Staphylococcus epidermidis
YHAIKPDIFFFLPSYMAPLKHHNTQLY

SEQ ID NO: 1823912 - protein, 23 aa, Staphylococcus epidermidis
YIKIKGKWSYLYRAIDTEGHTLD

SEQ ID NO: 1823913 - protein, 20 aa, Staphylococcus epidermidis
YIQEGKWKSWGPYLLSGKDV

SEQ ID NO: 1823914 - protein, 25 aa, Staphylococcus epidermidis
YKKDIDKTIFPGIQGGPLEHVIAAK

SEQ ID NO: 1823915 - protein, 17 aa, Staphylococcus epidermidis
YKPLYHKYCELHDLLGR

SEQ ID NO: 1823916 - protein, 17 aa, Staphylococcus epidermidis
YLFPRKDGSPLKQETFR

SEQ ID NO: 1823917 - protein, 26 aa, Staphylococcus epidermidis
YLYNELSLTTEYYYPLQNAIIEFCTE

SEQ ID NO: 1823918 - protein, 18 aa, Staphylococcus epidermidis
YMYVPKSHPLAMTVHPPL

SEQ ID NO: 1823919 - protein, 29 aa, Staphylococcus epidermidis
YNVQDISKLQYILFLKELDLTLKQIQIYF

SEQ ID NO: 1823920 - protein, 29 aa, Staphylococcus epidermidis
YNVQDISKLQYILFLKELDLTLKQIQTYF

SEQ ID NO: 1823921 - protein, 18 aa, Staphylococcus epidermidis
YPDYLFTSQIIKEPYIVD

SEQ ID NO: 1823922 - protein, 17 aa, Staphylococcus epidermidis
YRDRTMLELLYATGMRV

SEQ ID NO: 1823923 - protein, 20 aa, Staphylococcus epidermidis
YRMKHRTLPLFITYDKHENI

SEQ ID NO: 1823924 - protein, 19 aa, Staphylococcus epidermidis
YTNLKPWDRVQIARLPERP

SEQ ID NO: 1823925 - protein, 18 aa, Staphylococcus epidermidis
AAHPNTIIFLTADAFGVI

SEQ ID NO: 1823926 - protein, 18 aa, Staphylococcus epidermidis
AAKLLLKLGANVKVNDGK

SEQ ID NO: 1823927 - protein, 22 aa, Staphylococcus epidermidis
ACDLLIHFNFSQPTLSHHMKLL

SEQ ID NO: 1823928 - protein, 17 aa, Staphylococcus epidermidis
ADQLQQYFLSHGVSSAI

SEQ ID NO: 1823929 - protein, 27 aa, Staphylococcus epidermidis
AENVIFIGLICKNAVWHAVVFEIGRGY

SEQ ID NO: 1823930 - protein, 23 aa, Staphylococcus epidermidis
AFIGAIIYCILESRYSECKDLFK

SEQ ID NO: 1823931 - protein, 19 aa, Staphylococcus epidermidis
AFNGFLHKNNFKGKEIFSA

SEQ ID NO: 1823932 - protein, 18 aa, Staphylococcus epidermidis
AFTCIQMVKLIDEENLQL

SEQ ID NO: 1823933 - protein, 21 aa, Staphylococcus epidermidis
AFVGALYLDQGLDTVWTFAEK

SEQ ID NO: 1823934 - protein, 17 aa, Staphylococcus epidermidis
AGGCFWCMTKPFDTFDG

SEQ ID NO: 1823935 - protein, 19 aa, Staphylococcus epidermidis
AGKKLAIVPILRAGLGMTD

SEQ ID NO: 1823936 - protein, 22 aa, Staphylococcus epidermidis
AGRYGINLRYPEGFKFEDAIDR

SEQ ID NO: 1823937 - protein, 37 aa, Staphylococcus epidermidis
AHLRLNDIGFIFQASHLVPYLKVLDQLTLIGKEAGMS

SEQ ID NO: 1823938 - protein, 21 aa, Staphylococcus epidermidis
AHSITAIWNFEKQNYYLKDLK

SEQ ID NO: 1823939 - protein, 17 aa, Staphylococcus epidermidis
AIAIGKKAQDAHDSVRL

SEQ ID NO: 1823940 - protein, 38 aa, Staphylococcus epidermidis
AIKGKIDWRDTLPDAHFSKIYLFSPNLDKITDFRNQLV

SEQ ID NO: 1823941 - protein, 18 aa, Staphylococcus epidermidis
AINEIFDILSIEGIIILV

SEQ ID NO: 1823942 - protein, 17 aa, Staphylococcus epidermidis
AINIVRHFNHIQRKMRL

SEQ ID NO: 1823943 - protein, 26 aa, Staphylococcus epidermidis
AISKAFRGYGLGQLLLKYAMNYARFS

SEQ ID NO: 1823944 - protein, 34 aa, Staphylococcus epidermidis
AITVPQDRLKLRKQIRQLAAIYLASGIDPDKSTL

SEQ ID NO: 1823945 - protein, 25 aa, Staphylococcus epidermidis
AKDEKFKFITIKDYLNLLDYFKKRD

SEQ ID NO: 1823946 - protein, 24 aa, Staphylococcus epidermidis
AKKGRHTVYIPKGTYYIRKALVIY

SEQ ID NO: 1823947 - protein, 17 aa, Staphylococcus epidermidis
AKKNKFLTLHHGYHGDT

SEQ ID NO: 1823948 - protein, 18 aa, Staphylococcus epidermidis
AKKNKFLTLHHGYHGDTI

SEQ ID NO: 1823949 - protein, 23 aa, Staphylococcus epidermidis
AKNKLFNIVYAYNAVKNFKQAKD

SEQ ID NO: 1823950 - protein, 34 aa, Staphylococcus epidermidis; identical to SEQ ID NO: 1688806

SEQ ID NO: 1823951 - protein, 22 aa, Staphylococcus epidermidis
ALEGVLYNLYTVYLALIEVMNE

SEQ ID NO: 1823952 - protein, 20 aa, Staphylococcus epidermidis
ALEILNLVGLPRAEKRFKAY

SEQ ID NO: 1823953 - protein, 25 aa, Staphylococcus epidermidis
ALHRDKIIGHILVSKIFIVKGEKSI

SEQ ID NO: 1823954 - protein, 19 aa, Staphylococcus epidermidis
ALHSIFLEVVIAPQFTEEA

SEQ ID NO: 1823955 - protein, 18 aa, Staphylococcus epidermidis
ALNIFDEKFGNTAIKNFS

SEQ ID NO: 1823956 - protein, 20 aa, Staphylococcus epidermidis
ALPVGLLPQIIVDGKEYVVP

SEQ ID NO: 1823957 - protein, 21 aa, Staphylococcus epidermidis
ALTKILETAVPLLEDFDIELT

SEQ ID NO: 1823958 - protein, 19 aa, Staphylococcus epidermidis
AMLAGYFSKAGSSAQIPVD

SEQ ID NO: 1823959 - protein, 17 aa, Staphylococcus epidermidis
AMVRMAQDFSYRYPLVD

SEQ ID NO: 1823960 - protein, 18 aa, Staphylococcus epidermidis
ANSFAMRLNQLGKNAYVV

SEQ ID NO: 1823961 - protein, 23 aa, Staphylococcus epidermidis
ANVLGVVAIFTYGLAKADETFNK

SEQ ID NO: 1823962 - protein, 19 aa, Staphylococcus epidermidis
APISLEFYKQFIGGEATEL

SEQ ID NO: 1823963 - protein, 38 aa, Staphylococcus epidermidis
APTFEEALKESLRLIKGGFTFAILTKDALYGVVDPNAI

SEQ ID NO: 1823964 - protein, 22 aa, Staphylococcus epidermidis
AQDLDIIYAMSNSLGFGGHNAV

SEQ ID NO: 1823965 - protein, 44 aa, Staphylococcus epidermidis
AQFKQNEGYNLTFFAFFVKAVAEALKVNPLLNSTWQGDEIVIHK

SEQ ID NO: 1823966 - protein, 33 aa, Staphylococcus epidermidis
AQVYRAKLLRQLPYPTKFIFLDFIQSENIQTLT

SEQ ID NO: 1823967 - protein, 26 aa, Staphylococcus epidermidis
ARAIREYVNKYPIIEGQVIHINSCLD

SEQ ID NO: 1823968 - protein, 26 aa, Staphylococcus epidermidis
ARFHRSPLPIPKFKYFKLKSTRKQNL

SEQ ID NO: 1823969 - protein, 22 aa, Staphylococcus epidermidis
ARGYIVFGHPLKINKVAQSYST

SEQ ID NO: 1823970 - protein, 26 aa, Staphylococcus epidermidis
ASAKENINCRCKLLYYIDEDELPTTM

SEQ ID NO: 1823971 - protein, 20 aa, Staphylococcus epidermidis
ASGLSYNISYASKAFTCIQM

SEQ ID NO: 1823972 - protein, 24 aa, Staphylococcus epidermidis
ASNFAPISNVIYFKVAKTESLDQL

SEQ ID NO: 1823973 - protein, 18 aa, Staphylococcus epidermidis
ASNYFHLLRAQAASLDTL

SEQ ID NO: 1823974 - protein, 23 aa, Staphylococcus epidermidis
ATATELALYPIISNHLIRVDSII

SEQ ID NO: 1823975 - protein, 27 aa, Staphylococcus epidermidis
ATDLQQPITPLLFMTEGPSFVTDTIYP

SEQ ID NO: 1823976 - protein, 23 aa, Staphylococcus epidermidis
ATEINLFFAMCNKLKEQDTNTLH

SEQ ID NO: 1823977 - protein, 17 aa, Staphylococcus epidermidis
ATLLRKGKDALLKNGRR

SEQ ID NO: 1823978 - protein, 21 aa, Staphylococcus epidermidis
ATRYYLMRELPFGSDGVFTPE

SEQ ID NO: 1823979 - protein, 25 aa, Staphylococcus epidermidis
ATTNSAFLIYLIAKESPNHDERMSL

SEQ ID NO: 1823980 - protein, 24 aa, Staphylococcus epidermidis
ATVKGAYKTYAYVVSYKPTNGNEK

SEQ ID NO: 1823981 - protein, 25 aa, Staphylococcus epidermidis
AVNEMRALIWQLKPVGLEQGLIHAL

SEQ ID NO: 1823982 - protein, 17 aa, Staphylococcus epidermidis
AYFLQQGTPFIYQGQEI

SEQ ID NO: 1823983 - protein, 18 aa, Staphylococcus epidermidis
AYRLLRVGSFLLSNEGYK

SEQ ID NO: 1823984 - protein, 20 aa, Staphylococcus epidermidis
CASPYATHSYVFISWTGKMA

SEQ ID NO: 1823985 - protein, 18 aa, Staphylococcus epidermidis
CGSPMVIKMGRYGKFMAC

SEQ ID NO: 1823986 - protein, 18 aa, Staphylococcus epidermidis
CHNDFSCNHLLLDGNNRL

SEQ ID NO: 1823987 - protein, 17 aa, Staphylococcus epidermidis
CLPLVKKGGQFLALKSS

SEQ ID NO: 1823988 - protein, 23 aa, Staphylococcus epidermidis
DADKNCPILPPSVKKEHWGFDDP

SEQ ID NO: 1823989 - protein, 22 aa, Staphylococcus epidermidis
DAEILDWFDAIGRRRGLLQKGN

SEQ ID NO: 1823990 - protein, 23 aa, Staphylococcus epidermidis
DAKALFQLNKNILLKGPTGSGKT

SEQ ID NO: 1823991 - protein, 24 aa, Staphylococcus epidermidis
DAKNKLFNIVYAYNAVKNFKQAED

SEQ ID NO: 1823992 - protein, 29 aa, Staphylococcus epidermidis
DALISVGLDLPFPLKMNRLLGFDSTYVTY

SEQ ID NO: 1823993 - protein, 22 aa, Staphylococcus epidermidis
DALTEFVNIYGAKGLAWVKVVD

SEQ ID NO: 1823994 - protein, 17 aa, Staphylococcus epidermidis
DAVFPLLHGPNGEDGTI

SEQ ID NO: 1823995 - protein, 22 aa, Staphylococcus epidermidis
DAVMLITPYYNKTNQRGLIQHF

SEQ ID NO: 1823996 - protein, 25 aa, Staphylococcus epidermidis
DAYGSQLGLKYYLQKKFPNKQIYAV

SEQ ID NO: 1823997 - protein, 22 aa, Staphylococcus epidermidis
DCRRTMDIFKLLGVTIEEQDNS

SEQ ID NO: 1823998 - protein, 22 aa, Staphylococcus epidermidis
DDGSQYVFLSNNRTKGNFGGLE

SEQ ID NO: 1823999 - protein, 26 aa, Staphylococcus epidermidis
DDKIDILIVVNMFLTGFDSKKLNTLY

SEQ ID NO: 1824000 - protein, 21 aa, Staphylococcus epidermidis
DDKKYILYCPTWRGNQRKEVT

SEQ ID NO: 1824001 - protein, 22 aa, Staphylococcus epidermidis
DDLQPFSPESYVYGLFADMIEQ

SEQ ID NO: 1824002 - protein, 25 aa, Staphylococcus epidermidis
DDNTIDYLKTILNKKTTKESTKFDE

SEQ ID NO: 1824003 - protein, 23 aa, Staphylococcus epidermidis
DDTWGQVPILYYVTNQDINQTEL

SEQ ID NO: 1824004 - protein, 17 aa, Staphylococcus epidermidis
DDTYMIKDIPFGRQMVF

SEQ ID NO: 1824005 - protein, 23 aa, Staphylococcus epidermidis
DDVENILLRLIQAADFDIDKAEK

SEQ ID NO: 1824006 - protein, 18 aa, Staphylococcus epidermidis
DEFDLFLDLYRETEARTG

SEQ ID NO: 1824007 - protein, 17 aa, Staphylococcus epidermidis
DEKLRVFIEYALEQGKV

SEQ ID NO: 1824008 - protein, 24 aa, Staphylococcus epidermidis
DEKRLNYAGFYRLHHSYKKKVVMA

SEQ ID NO: 1824009 - protein, 22 aa, Staphylococcus epidermidis
DEKVTLLFTGPLTDLAKAIKYD

SEQ ID NO: 1824010 - protein, 17 aa, Staphylococcus epidermidis
DELIIRFGQKLVTVKVT

SEQ ID NO: 1824011 - protein, 20 aa, Staphylococcus epidermidis
DELVATEYPVLLGTSRKRYI

SEQ ID NO: 1824012 - protein, 22 aa, Staphylococcus epidermidis
DENIFPMNFIFNETPAPYEICT

SEQ ID NO: 1824013 - protein, 25 aa, Staphylococcus epidermidis
DEPAFINVLEILALEYAKNKGYELY

SEQ ID NO: 1824014 - protein, 19 aa, Staphylococcus epidermidis
DEPKLNGLAGNLDKKMNPE

SEQ ID NO: 1824015 - protein, 24 aa, Staphylococcus epidermidis
DEVKDISYIIKLFNYIIKNQIVDD

SEQ ID NO: 1824016 - protein, 17 aa, Staphylococcus epidermidis
DEYCDFIYLLEDSEEEI

SEQ ID NO: 1824017 - protein, 17 aa, Staphylococcus epidermidis
DFKAIFKNQNVIGISEL

SEQ ID NO: 1824018 - protein, 18 aa, Staphylococcus epidermidis
DFKKVSLELGGKSPYIVL

SEQ ID NO: 1824019 - protein, 30 aa, Staphylococcus epidermidis
DFQERQYIELLSRLGIQLNLPDLTFDTDRL

SEQ ID NO: 1824020 - protein, 20 aa, Staphylococcus epidermidis
DFYSYVRTFSEYYAPFDNKA

SEQ ID NO: 1824021 - protein, 24 aa, Staphylococcus epidermidis
DGATKEFFSWGFRVGFMTFGIDHE

SEQ ID NO: 1824022 - protein, 22 aa, Staphylococcus epidermidis
DGMAFLSGVVSRKKQVVPQITE

SEQ ID NO: 1824023 - protein, 21 aa, Staphylococcus epidermidis
DGVLLVIKNYAGDVMNFEMAQ

SEQ ID NO: 1824024 - protein, 20 aa, Staphylococcus epidermidis
DGYGSIIRKLIKNNINLIAL

SEQ ID NO: 1824025 - protein, 24 aa, Staphylococcus epidermidis
DIEKKYNMLFPKLAMNEEEFVKLY

SEQ ID NO: 1824026 - protein, 25 aa, Staphylococcus epidermidis
DIFDKCLHHYLIKDAIRDHNVLGFS

SEQ ID NO: 1824027 - protein, 26 aa, Staphylococcus epidermidis
DIGKTYVTKYLYKALRTRGYRVCIFK

SEQ ID NO: 1824028 - protein, 17 aa, Staphylococcus epidermidis
DIINYFIECDVNDNYYE

SEQ ID NO: 1824029 - protein, 18 aa, Staphylococcus epidermidis
DIKDLDCQVIILSSYDDF

SEQ ID NO: 1824030 - protein, 26 aa, Staphylococcus epidermidis
DIKTTDLLIRLYEKVLNKLNYESKKQ

SEQ ID NO: 1824031 - protein, 18 aa, Staphylococcus epidermidis
DILHFCSVDLIESDMKYA

SEQ ID NO: 1824032 - protein, 19 aa, Staphylococcus epidermidis
DILHFCSVDLIESDMKYAH

SEQ ID NO: 1824033 - protein, 17 aa, Staphylococcus epidermidis
DIPLYLGRTLSNMKGTW

SEQ ID NO: 1824034 - protein, 17 aa, Staphylococcus epidermidis
DIPLYLGRTLSNVKGTW

SEQ ID NO: 1824035 - protein, 33 aa, Staphylococcus epidermidis
DIPRLNVLDLQRLIRVIPKPIIAMVRGYAIGGG

SEQ ID NO: 1824036 - protein, 22 aa, Staphylococcus epidermidis
DISIIITQLIMRYPMNAVVVRK

SEQ ID NO: 1824037 - protein, 20 aa, Staphylococcus epidermidis
DKCGFLVNFRDLKKLVHEQF

SEQ ID NO: 1824038 - protein, 19 aa, Staphylococcus epidermidis
DKKYILYCPTWRENQRKEV

SEQ ID NO: 1824039 - protein, 19 aa, Staphylococcus epidermidis
DKKYILYCPTWRGNQRKEV

SEQ ID NO: 1824040 - protein, 19 aa, Staphylococcus epidermidis
DKLAQLRPAFKKDGSVTAG

SEQ ID NO: 1824041 - protein, 22 aa, Staphylococcus epidermidis
DKNTSRIYAKFGKEIYVAAKSG

SEQ ID NO: 1824042 - protein, 25 aa, Staphylococcus epidermidis
DLAQDLSNRLIRMRKRRGEIDFDIN

SEQ ID NO: 1824043 - protein, 17 aa, Staphylococcus epidermidis
DLDCQVIILSSYDDFEY

SEQ ID NO: 1824044 - protein, 23 aa, Staphylococcus epidermidis
DLEMTFFYELVFGEETEFYQQLL

SEQ ID NO: 1824045 - protein, 21 aa, Staphylococcus epidermidis
DLGIVLLNKDNIVYLGIYDGN

SEQ ID NO: 1824046 - protein, 25 aa, Staphylococcus epidermidis
DLHNRIFTQKLIFKNTLNNAPELKA

SEQ ID NO: 1824047 - protein, 23 aa, Staphylococcus epidermidis
DLKKEFVISFRDLSNTLIKLKTF

SEQ ID NO: 1824048 - protein, 24 aa, Staphylococcus epidermidis
DMRKGAYLIKYIRRIDLSGVHPQL

SEQ ID NO: 1824049 - protein, 24 aa, Staphylococcus epidermidis
DNDFTINLYGIRLSFGRIGGYNTY

SEQ ID NO: 1824050 - protein, 17 aa, Staphylococcus epidermidis
DNIIVKGAFGEALGAVI

SEQ ID NO: 1824051 - protein, 24 aa, Staphylococcus epidermidis
DNQKNLWLHVKLDTGMGRIGMKDI

SEQ ID NO: 1824052 - protein, 25 aa, Staphylococcus epidermidis
DPEDIEMLQDLVLAATNEAMNKADE

SEQ ID NO: 1824053 - protein, 20 aa, Staphylococcus epidermidis
DPELYIIDEPFLGLDPLGIQ

SEQ ID NO: 1824054 - protein, 25 aa, Staphylococcus epidermidis
DQHVREYIVLKLQSKPHRLHQVSKS

SEQ ID NO: 1824055 - protein, 30 aa, Staphylococcus epidermidis
DQNATKFLINYLEWLKLSSTIILTSHELNQ

SEQ ID NO: 1824056 - protein, 26 aa, Staphylococcus epidermidis
DQYTKHGIIRLIFKYRHNTLQRSVTN

SEQ ID NO: 1824057 - protein, 18 aa, Staphylococcus epidermidis
DRHPVDVCFVPIGDNFTM

SEQ ID NO: 1824058 - protein, 20 aa, Staphylococcus epidermidis
DRIRRLLKLYLERESFEIHE

SEQ ID NO: 1824059 - protein, 17 aa, Staphylococcus epidermidis
DRKGDGYPAFKKEYGYS

SEQ ID NO: 1824060 - protein, 27 aa, Staphylococcus epidermidis
DRKYNQIRYVYTFLKYVDGVQVIGNKV

SEQ ID NO: 1824061 - protein, 27 aa, Staphylococcus epidermidis
DSADADRLYFLKQHTLVTELIFDETQA

SEQ ID NO: 1824062 - protein, 21 aa, Staphylococcus epidermidis
DSDGFNFYMTHSDIMKISGLE

SEQ ID NO: 1824063 - protein, 17 aa, Staphylococcus epidermidis
DSFYHFNPNWHIVGITY

SEQ ID NO: 1824064 - protein, 23 aa, Staphylococcus epidermidis
DSIGLILGFLVQRFLEHKKEMHI

SEQ ID NO: 1824065 - protein, 27 aa, Staphylococcus epidermidis
DSKIDFMDALLVFYAKENHPEILEAFK

SEQ ID NO: 1824066 - protein, 23 aa, Staphylococcus epidermidis
DSLHAYFKPEILNRMDDIVLFKP

SEQ ID NO: 1824067 - protein, 25 aa, Staphylococcus epidermidis
DSNYPYISFIPLNDKAILTLQGFKY

SEQ ID NO: 1824068 - protein, 25 aa, Staphylococcus epidermidis
DSPTNQQFFILSNDKIEELKQKVKF

SEQ ID NO: 1824069 - protein, 18 aa, Staphylococcus epidermidis
DSTGYFIEPTIFSGLQSA

SEQ ID NO: 1824070 - protein, 23 aa, Staphylococcus epidermidis
DSVHVANFYFTITDSGMTGPIGK

SEQ ID NO: 1824071 - protein, 25 aa, Staphylococcus epidermidis
DTTKKIELFKKLEFKQLLADIDTSS

SEQ ID NO: 1824072 - protein, 26 aa, Staphylococcus epidermidis
DVEPVFGFMKAILGFTRMSVRGLNKV

SEQ ID NO: 1824073 - protein, 25 aa, Staphylococcus epidermidis
DVFKDTKAWLREYFKGNYPEIKVPL

SEQ ID NO: 1824074 - protein, 24 aa, Staphylococcus epidermidis
DVNPIPIKVLTTYLGYGHYEVRLP

SEQ ID NO: 1824075 - protein, 18 aa, Staphylococcus epidermidis
DVSGLGLDLFAGSGALGI

SEQ ID NO: 1824076 - protein, 25 aa, Staphylococcus epidermidis
DVSKQTIHYHLKSLPSNLKVNKVGN

SEQ ID NO: 1824077 - protein, 17 aa, Staphylococcus epidermidis
DVVFKLRKILKMKKIGH

SEQ ID NO: 1824078 - protein, 25 aa, Staphylococcus epidermidis
DVYDFPRVWLEKDSYDFSFSGLKSA

SEQ ID NO: 1824079 - protein, 17 aa, Staphylococcus epidermidis
DWVFHNDIPLNYKTSDL

SEQ ID NO: 1824080 - protein, 19 aa, Staphylococcus epidermidis
DYCIPGPFDKRVAPSVAKN

SEQ ID NO: 1824081 - protein, 20 aa, Staphylococcus epidermidis
DYEGWWLFDDWPQKIVEQSE

SEQ ID NO: 1824082 - protein, 23 aa, Staphylococcus epidermidis
DYEKLYLTYLVQGLTLNKLDFIH

SEQ ID NO: 1824083 - protein, 21 aa, Staphylococcus epidermidis
DYQPQELVIIGGGYIALEFAS

SEQ ID NO: 1824084 - protein, 20 aa, Staphylococcus epidermidis
DYSSTIFDYIHLNKPVFILQ

SEQ ID NO: 1824085 - protein, 25 aa, Staphylococcus epidermidis
EADFINCVVFRRQAENVNNYLSKGS

SEQ ID NO: 1824086 - protein, 19 aa, Staphylococcus epidermidis
EALNKPLFNTFIHDLIDLA

SEQ ID NO: 1824087 - protein, 23 aa, Staphylococcus epidermidis
EANVKYLAYDLGPDNIRVNAISA

SEQ ID NO: 1824088 - protein, 17 aa, Staphylococcus epidermidis
EARFNIAILEKGNFLST

SEQ ID NO: 1824089 - protein, 23 aa, Staphylococcus epidermidis
EAVDRACYLLETYASATVLKDRI

SEQ ID NO: 1824090 - protein, 24 aa, Staphylococcus epidermidis
EAYHAPIRLLIVIQAPDAYIQRLL

SEQ ID NO: 1824091 - protein, 23 aa, Staphylococcus epidermidis
EDAEILDWFDAIGRRRGLLQKGN

SEQ ID NO: 1824092 - protein, 17 aa, Staphylococcus epidermidis
EDLPIIPKKMKTVVISK

SEQ ID NO: 1824093 - protein, 17 aa, Staphylococcus epidermidis
EDLSLNMIIFYKNYQKN

SEQ ID NO: 1824094 - protein, 20 aa, Staphylococcus epidermidis
EDLWKKLINLWKDQTVLIVE

SEQ ID NO: 1824095 - protein, 25 aa, Staphylococcus epidermidis
EDMKDFMHNLKYYKAISVAGESGSG

SEQ ID NO: 1824096 - protein, 23 aa, Staphylococcus epidermidis
EDVIEFFVLFNHFKIHKTEKYLE

SEQ ID NO: 1824097 - protein, 34 aa, Staphylococcus epidermidis
EEEQDLFIDLIFSPIYFNILIKPETLDKNYIKKM

SEQ ID NO: 1824098 - protein, 24 aa, Staphylococcus epidermidis
EEEYSLWLYDVIGCGTSLTESVPT

SEQ ID NO: 1824099 - protein, 24 aa, Staphylococcus epidermidis
EEFYTFIGQFYSLNQHLLPKEVHV

SEQ ID NO: 1824100 - protein, 29 aa, Staphylococcus epidermidis
EEKNYLDAVIGLPANLFFGTSIPTCVLVF

SEQ ID NO: 1824101 - protein, 30 aa, Staphylococcus epidermidis
EELIGDFYKPINKVKYWLFNTLDRIRNKLK

SEQ ID NO: 1824102 - protein, 28 aa, Staphylococcus epidermidis
EEMTIAILPIGYADGYLRSMQGAFVNVN

SEQ ID NO: 1824103 - protein, 18 aa, Staphylococcus epidermidis
EEYYPIETIVYGIKNIKQ

SEQ ID NO: 1824104 - protein, 23 aa, Staphylococcus epidermidis
EFLEQEYGKDNLLYATVHMDEKT

SEQ ID NO: 1824105 - protein, 19 aa, Staphylococcus epidermidis
EFLYRRDDYRIPSYSQSDH

SEQ ID NO: 1824106 - protein, 17 aa, Staphylococcus epidermidis
EFNTLHQLLRTLQDKMN

SEQ ID NO: 1824107 - protein, 23 aa, Staphylococcus epidermidis
EFYTFIGQFYSLNQHLIPKEVHV

SEQ ID NO: 1824108 - protein, 23 aa, Staphylococcus epidermidis
EGFGKLILGDKWNVYSAGIETHG

SEQ ID NO: 1824109 - protein, 19 aa, Staphylococcus epidermidis
EGFLLAQDISSYSLTIVAH

SEQ ID NO: 1824110 - protein, 24 aa, Staphylococcus epidermidis
EGVDALLFETYYDLDELTRIVTAT

SEQ ID NO: 1824111 - protein, 17 aa, Staphylococcus epidermidis
EHFFARNDDLDIIRDRS

SEQ ID NO: 1824112 - protein, 17 aa, Staphylococcus epidermidis
EHHVKVAELLLERAKRL

SEQ ID NO: 1824113 - protein, 23 aa, Staphylococcus epidermidis
EHQIPYVDYMSELISIIKQHTHA

SEQ ID NO: 1824114 - protein, 21 aa, Staphylococcus epidermidis
EHTRVILMCPQGRPFTQEIAQ

SEQ ID NO: 1824115 - protein, 18 aa, Staphylococcus epidermidis
EIDKLSNFLVFMDQHRES

SEQ ID NO: 1824116 - protein, 19 aa, Staphylococcus epidermidis
EIDLNKYDYIYVSGYSFEP

SEQ ID NO: 1824117 - protein, 17 aa, Staphylococcus epidermidis
EIDMLKSQKFDPDLKNK

SEQ ID NO: 1824118 - protein, 18 aa, Staphylococcus epidermidis
EIDTFPDQQLLSLKVFVD

SEQ ID NO: 1824119 - protein, 23 aa, Staphylococcus epidermidis
EIHGDNLFRHSLTLERVQKIVEL

SEQ ID NO: 1824120 - protein, 25 aa, Staphylococcus epidermidis
EIIEFITLNNYVLIKTSPGFAQSIS

SEQ ID NO: 1824121 - protein, 20 aa, Staphylococcus epidermidis
EIPFDVYPQDAIMPLPLEEA

SEQ ID NO: 1824122 - protein, 27 aa, Staphylococcus epidermidis
EKARLQLVLLMLQRDNVLILDEPTNHL

SEQ ID NO: 1824123 - protein, 24 aa, Staphylococcus epidermidis
EKDFDLLINWINSPELLVKWAGTD

SEQ ID NO: 1824124 - protein, 22 aa, Staphylococcus epidermidis
EKHAVSRLVGAPPGYVGHDDGG

SEQ ID NO: 1824125 - protein, 23 aa, Staphylococcus epidermidis
EKIDQCVILFGDVKLMIADDTEG

SEQ ID NO: 1824126 - protein, 36 aa, Staphylococcus epidermidis
EKIQSSILTSIPLWKNQMAIALTLMRQRNAVSAQRS

SEQ ID NO: 1824127 - protein, 17 aa, Staphylococcus epidermidis
EKKLNLMPLDQLKQVTG

SEQ ID NO: 1824128 - protein, 21 aa, Staphylococcus epidermidis
EKKLNLMPLDQLKQVTGYVRG

SEQ ID NO: 1824129 - protein, 26 aa, Staphylococcus epidermidis
EKPHPKVLDPLFNAFDVEPGQVAIVG

SEQ ID NO: 1824130 - protein, 21 aa, Staphylococcus epidermidis
EKTSIKIHRTFKPLFDELVAE

SEQ ID NO: 1824131 - protein, 21 aa, Staphylococcus epidermidis
EKVTLLFTGPLTDLAKAIKYD

SEQ ID NO: 1824132 - protein, 18 aa, Staphylococcus epidermidis
EKYLEIATSPDLKYILNS

SEQ ID NO: 1824133 - protein, 25 aa, Staphylococcus epidermidis
EKYRKIDVLLIDDIQFIQNKEQTQE

SEQ ID NO: 1824134 - protein, 22 aa, Staphylococcus epidermidis
ELARIQTFPDDFIFKGTSINVQ

SEQ ID NO: 1824135 - protein, 41 aa, Staphylococcus epidermidis
ELARLVRYSYRLEGYKRFMFLALLRRAMIRKLPYSRMNVNW

SEQ ID NO: 1824136 - protein, 22 aa, Staphylococcus epidermidis
ELDEAVVLYYLKKWIHENDPIL

SEQ ID NO: 1824137 - protein, 25 aa, Staphylococcus epidermidis
ELEKWETYFKDEGFYPVAVDAKHGK

SEQ ID NO: 1824138 - protein, 27 aa, Staphylococcus epidermidis
ELEVAHYFKRLFSQYGIRSHIDTVTDG

SEQ ID NO: 1824139 - protein, 17 aa, Staphylococcus epidermidis
ELFFIVSVDTPMITSKA

SEQ ID NO: 1824140 - protein, 20 aa, Staphylococcus epidermidis
ELKNRRATLVNLQRIDQVSA

SEQ ID NO: 1824141 - protein, 32 aa, Staphylococcus epidermidis
ELKSRLPEYMIPRKFEWMERLPLTLNGKLDRK

SEQ ID NO: 1824142 - protein, 18 aa, Staphylococcus epidermidis
ELTKDPKYLIGRIIARPY

SEQ ID NO: 1824143 - protein, 57 aa, Staphylococcus epidermidis
ELVYGTLKRKYTLDYLLKPFIKTKIKSWVRQLLWMSLYQYLYLDKIPNHAIIHEAVD

SEQ ID NO: 1824144 - protein, 17 aa, Staphylococcus epidermidis
EMAHRGFRLQPISLEKS

SEQ ID NO: 1824145 - protein, 20 aa, Staphylococcus epidermidis
EMEFLLNLSEDLKRAKYAGI

SEQ ID NO: 1824146 - protein, 25 aa, Staphylococcus epidermidis
EMLTEREMEILLLIAKGYSNQEIAS

SEQ ID NO: 1824147 - protein, 24 aa, Staphylococcus epidermidis
ENDEILEYYGLKVLVDQNDAPVLN

SEQ ID NO: 1824148 - protein, 22 aa, Staphylococcus epidermidis
ENPYFVSFMGDAPKKDPKVIVY

SEQ ID NO: 1824149 - protein, 24 aa, Staphylococcus epidermidis
EPDEVWEKRIKLLEPYRVTKELMK

SEQ ID NO: 1824150 - protein, 25 aa, Staphylococcus epidermidis
EPESLLEPLFNHFTDQYPKVMSLLD

SEQ ID NO: 1824151 - protein, 19 aa, Staphylococcus epidermidis
EPGSTFKTYGLAAAIQEGK

SEQ ID NO: 1824152 - protein, 24 aa, Staphylococcus epidermidis
EPIQPDHPILKLPNAVVLPHIGSS

SEQ ID NO: 1824153 - protein, 19 aa, Staphylococcus epidermidis
EQLLKEVWHYEFYGDLRTV

SEQ ID NO: 1824154 - protein, 18 aa, Staphylococcus epidermidis
EQLLSQIRRTTNDDIVIV

SEQ ID NO: 1824155 - protein, 17 aa, Staphylococcus epidermidis
EQLSDMPVINYPGNIQG

SEQ ID NO: 1824156 - protein, 20 aa, Staphylococcus epidermidis
EQRELIFSNIFYSNASFNTS

SEQ ID NO: 1824157 - protein, 24 aa, Staphylococcus epidermidis
EQRVEDIFFEVFDVLQELGLTKVN

SEQ ID NO: 1824158 - protein, 22 aa, Staphylococcus epidermidis
ERIESKPFWNKGYFLKTLGSVS

SEQ ID NO: 1824159 - protein, 29 aa, Staphylococcus epidermidis
ERQYDMYLNYPLIKIITLPEKFDFTELDE

SEQ ID NO: 1824160 - protein, 17 aa, Staphylococcus epidermidis
ERSRKALSEADLILFVL

SEQ ID NO: 1824161 - protein, 24 aa, Staphylococcus epidermidis
ERYAPKDLFAVVMDAKTGEILAYS

SEQ ID NO: 1824162 - protein, 23 aa, Staphylococcus epidermidis
ESEDDFIHLFDDMDLNSSRLGNT

SEQ ID NO: 1824163 - protein, 23 aa, Staphylococcus epidermidis
ESGSIFGVIGFSGAGKSTLIRMF

SEQ ID NO: 1824164 - protein, 26 aa, Staphylococcus epidermidis
ESRSERPEWNVVGLLGQIYTNIEKDV

SEQ ID NO: 1824165 - protein, 20 aa, Staphylococcus epidermidis
ETAINSKIMLLTGGPGTGKT

SEQ ID NO: 1824166 - protein, 17 aa, Staphylococcus epidermidis
ETDIYNIAYTLYNDLKD

SEQ ID NO: 1824167 - protein, 24 aa, Staphylococcus epidermidis
ETFNKAHIPFYTLSDYNELIEVAK

SEQ ID NO: 1824168 - protein, 28 aa, Staphylococcus epidermidis
ETHLRVMPLFEENYYMYVPKSHPLAMTV

SEQ ID NO: 1824169 - protein, 18 aa, Staphylococcus epidermidis
ETIIMSKSLDILGLEKSE

SEQ ID NO: 1824170 - protein, 18 aa, Staphylococcus epidermidis
ETKMLYVETPSNPLLRVT

SEQ ID NO: 1824171 - protein, 17 aa, Staphylococcus epidermidis
ETLAEVLEVEKVDFIPT

SEQ ID NO: 1824172 - protein, 20 aa, Staphylococcus epidermidis
ETLHPYLYEKTARKPMILPV

SEQ ID NO: 1824173 - protein, 17 aa, Staphylococcus epidermidis
ETRIHLLKDYQVNRKML

SEQ ID NO: 1824174 - protein, 18 aa, Staphylococcus epidermidis
ETRIHLLKDYQVNRKMLN

SEQ ID NO: 1824175 - protein, 25 aa, Staphylococcus epidermidis
ETTTLYDVPTGKIPLTVKTLSLMHF

SEQ ID NO: 1824176 - protein, 21 aa, Staphylococcus epidermidis
ETYPQLGRLIGFIPKEKVVDV

SEQ ID NO: 1824177 - protein, 22 aa, Staphylococcus epidermidis
ETYVLYRKFYEDTNIIEFEDVM

SEQ ID NO: 1824178 - protein, 24 aa, Staphylococcus epidermidis
EVIERLRPFLLRDGGDCTLVDVED

SEQ ID NO: 1824179 - protein, 24 aa, Staphylococcus epidermidis
EVLKPMMQAELDKKLRFAQFADID

SEQ ID NO: 1824180 - protein, 25 aa, Staphylococcus epidermidis
EVPEGLVPLLKIQGLGSKKIAKLYH

SEQ ID NO: 1824181 - protein, 19 aa, Staphylococcus epidermidis
EVRNRFVLAPLTHTSSNDD

SEQ ID NO: 1824182 - protein, 24 aa, Staphylococcus epidermidis
EVVEKKLPFLFGEDFSFYGQQLAP

SEQ ID NO: 1824183 - protein, 21 aa, Staphylococcus epidermidis
EVVKMREKINWFVEQATVQNE

SEQ ID NO: 1824184 - protein, 17 aa, Staphylococcus epidermidis
EWKAILAGDALLTKAFE

SEQ ID NO: 1824185 - protein, 17 aa, Staphylococcus epidermidis
EYILLRETIYNDLTDIE

SEQ ID NO: 1824186 - protein, 18 aa, Staphylococcus epidermidis
EYIMTFILDDYKKMKTSY

SEQ ID NO: 1824187 - protein, 18 aa, Staphylococcus epidermidis
EYLIPYIEDVVKDIDIEN

SEQ ID NO: 1824188 - protein, 24 aa, Staphylococcus epidermidis
FAELCEACQLKFIGPSYQSIQKMG

SEQ ID NO: 1824189 - protein, 27 aa, Staphylococcus epidermidis
FALGGNRLFYLAMAPQFFGVISDYLKS

SEQ ID NO: 1824190 - protein, 25 aa, Staphylococcus epidermidis
FANFDNFYHAMGQFTFNMEKQAKYN

SEQ ID NO: 1824191 - protein, 25 aa, Staphylococcus epidermidis
FAVQSIPMAIKYYDTFQRLKNEGVH

SEQ ID NO: 1824192 - protein, 25 aa, Staphylococcus epidermidis
FDSARPMQIGLVYDALKNNKLDVAV

SEQ ID NO: 1824193 - protein, 17 aa, Staphylococcus epidermidis
FGFNSRQLTTSSAMLII

SEQ ID NO: 1824194 - protein, 17 aa, Staphylococcus epidermidis
FGGIIALNRTVDVKLAE

SEQ ID NO: 1824195 - protein, 24 aa, Staphylococcus epidermidis
FGLSIKHGLALNAVNKVKATKHLQ

SEQ ID NO: 1824196 - protein, 19 aa, Staphylococcus epidermidis
FGMNLYQPYTVYPATNTNR

SEQ ID NO: 1824197 - protein, 17 aa, Staphylococcus epidermidis
FHMLKQQMKPHEKLYTV

SEQ ID NO: 1824198 - protein, 19 aa, Staphylococcus epidermidis
FKAIVRFDSLVELDYYRHG

SEQ ID NO: 1824199 - protein, 18 aa, Staphylococcus epidermidis
FKPNIPSYRKSSMPDGVH

SEQ ID NO: 1824200 - protein, 18 aa, Staphylococcus epidermidis
FKQKSRLFWTQMNSAPSM

SEQ ID NO: 1824201 - protein, 27 aa, Staphylococcus epidermidis
FKSAYHILDLVFWFGHLSILTKNHYSI

SEQ ID NO: 1824202 - protein, 22 aa, Staphylococcus epidermidis
FKTISSERLMIGQIVFDDVDDT

SEQ ID NO: 1824203 - protein, 20 aa, Staphylococcus epidermidis
FLGINYYMSDWMRGYEGESE

SEQ ID NO: 1824204 - protein, 28 aa, Staphylococcus epidermidis
FLQSKHLNELILYIAPKLIGGSGKHQFY

SEQ ID NO: 1824205 - protein, 18 aa, Staphylococcus epidermidis
FLTLLDFTQKEMEFLLNL

SEQ ID NO: 1824206 - protein, 17 aa, Staphylococcus epidermidis
FMTNGCYIVPKQPNRFL

SEQ ID NO: 1824207 - protein, 20 aa, Staphylococcus epidermidis
FNNAINQFKLFLENENLSDV

SEQ ID NO: 1824208 - protein, 18 aa, Staphylococcus epidermidis
FNQWEIDYVSCSPFRVPG

SEQ ID NO: 1824209 - protein, 19 aa, Staphylococcus epidermidis
FNQWEIDYVSCSPFRVPGA

SEQ ID NO: 1824210 - protein, 21 aa, Staphylococcus epidermidis
FNTELTPQPYLGALGHVIIFD

SEQ ID NO: 1824211 - protein, 19 aa, Staphylococcus epidermidis
FPEYLTLRDIVRAIELGIQ

SEQ ID NO: 1824212 - protein, 24 aa, Staphylococcus epidermidis
FPKYIKVCELLHLYQSFYQTFISF

SEQ ID NO: 1824213 - protein, 17 aa, Staphylococcus epidermidis
FQFLVKIKDIYKTKLGS

SEQ ID NO: 1824214 - protein, 33 aa, Staphylococcus epidermidis
FQNYALYPHMTVYKNLAFGLKMRGIKKKIYDEK

SEQ ID NO: 1824215 - protein, 34 aa, Staphylococcus epidermidis
FQNYALYPHMTVYKNLAFGLKMRGIKKKIYDEKI

SEQ ID NO: 1824216 - protein, 25 aa, Staphylococcus epidermidis
FRENETLYNFYFYSSGDTHLDKTIL

SEQ ID NO: 1824217 - protein, 17 aa, Staphylococcus epidermidis
FTCIQMVKLIDEENLQL

SEQ ID NO: 1824218 - protein, 25 aa, Staphylococcus epidermidis
FTGKSYFDLVFKDTGYKYELHAKVS

SEQ ID NO: 1824219 - protein, 25 aa, Staphylococcus epidermidis
FTLDFETIELPYFESIGYSTDLEKE

SEQ ID NO: 1824220 - protein, 30 aa, Staphylococcus epidermidis
FTVINIKKYLMNRLVGFTRKILGVLEEFNI

SEQ ID NO: 1824221 - protein, 18 aa, Staphylococcus epidermidis
FVIGPGNRFPHAASLAVA

SEQ ID NO: 1824222 - protein, 19 aa, Staphylococcus epidermidis
FVIMGIANKRSIGFGVAKV

SEQ ID NO: 1824223 - protein, 18 aa, Staphylococcus epidermidis
FVKSWLLDARAPKVTPPS

SEQ ID NO: 1824224 - protein, 19 aa, Staphylococcus epidermidis
FVKYIIPELQRRSLFKNSY

SEQ ID NO: 1824225 - protein, 17 aa, Staphylococcus epidermidis
FVNESPYEKAWMVKIEI

SEQ ID NO: 1824226 - protein, 19 aa, Staphylococcus epidermidis
FVPKAIEPVIPNLTKVIES

SEQ ID NO: 1824227 - protein, 20 aa, Staphylococcus epidermidis
FYHFNPNWHIVGITYDSIEK

SEQ ID NO: 1824228 - protein, 23 aa, Staphylococcus epidermidis
GAEGLIFHPYLAGERAPLWNADA

SEQ ID NO: 1824229 - protein, 24 aa, Staphylococcus epidermidis
GAGNDFLGWLDLPVDYDNEEFSRI

SEQ ID NO: 1824230 - protein, 36 aa, Staphylococcus epidermidis
GAYDLALYKDNTFIGQPLWGSIGYTLPATLGTQIAN

SEQ ID NO: 1824231 - protein, 25 aa, Staphylococcus epidermidis
GDIGKAFARRLQGFDARIIYHNRKR

SEQ ID NO: 1824232 - protein, 24 aa, Staphylococcus epidermidis
GEGIPIILIHGLDGNLAGFKDLKN

SEQ ID NO: 1824233 - protein, 26 aa, Staphylococcus epidermidis
GEGQSLYIRPFVFATEGILGVRSSHQ

SEQ ID NO: 1824234 - protein, 25 aa, Staphylococcus epidermidis
GEVGKLGRVLGPKGLMPNPKTGTVT

SEQ ID NO: 1824235 - protein, 24 aa, Staphylococcus epidermidis
GFLDHMLTLFTFHSGLTLSIEATG

SEQ ID NO: 1824236 - protein, 40 aa, Staphylococcus epidermidis
GFTLEQLAVQDFFFQPDYDRPWHYLNVLAQQALGDTFGSD

SEQ ID NO: 1824237 - protein, 21 aa, Staphylococcus epidermidis
GGFKSYRLLKPTEGSTYKIYF

SEQ ID NO: 1824238 - protein, 26 aa, Staphylococcus epidermidis
GGGAKSRFWLQLQADIFNLQIKRLKH

SEQ ID NO: 1824239 - protein, 23 aa, Staphylococcus epidermidis
GGKTLTINLRKNAKWSNGDSVTA

SEQ ID NO: 1824240 - protein, 34 aa, Staphylococcus epidermidis
GIDSVFTPIKLRKRVWRRLAKDLKPQQLHDIKHV

SEQ ID NO: 1824241 - protein, 18 aa, Staphylococcus epidermidis
GIIALNRTVDVKLAEALH

SEQ ID NO: 1824242 - protein, 17 aa, Staphylococcus epidermidis
GIIRRMVDTKRLSSMIF

SEQ ID NO: 1824243 - protein, 23 aa, Staphylococcus epidermidis
GKESEELINLIKLAIDQHIPYTV

SEQ ID NO: 1824244 - protein, 24 aa, Staphylococcus epidermidis
GKGLLCVYEGFLKGLKGEKVEAQA

SEQ ID NO: 1824245 - protein, 23 aa, Staphylococcus epidermidis
GKNKHGIDLKKANALLLEEAGVP

SEQ ID NO: 1824246 - protein, 22 aa, Staphylococcus epidermidis
GKNVWFGVREFAMGAAINGMAA

SEQ ID NO: 1824247 - protein, 25 aa, Staphylococcus epidermidis
GKSRAIPIFVFMNDSFEQLTVWRPR

SEQ ID NO: 1824248 - protein, 19 aa, Staphylococcus epidermidis
GKTLYKLSRFSFVDEIIQI

SEQ ID NO: 1824249 - protein, 18 aa, Staphylococcus epidermidis
GLARIYKLNQITGAIEKL

SEQ ID NO: 1824250 - protein, 18 aa, Staphylococcus epidermidis
GLEDNIYLRKGVKATNEA

SEQ ID NO: 1824251 - protein, 25 aa, Staphylococcus epidermidis
GLEFPIVFIMGMEESLFPHIRAIKS

SEQ ID NO: 1824252 - protein, 23 aa, Staphylococcus epidermidis
GLGPKIIKKLLKKAFEDLGLHRI

SEQ ID NO: 1824253 - protein, 17 aa, Staphylococcus epidermidis
GLKPVHRRILYGLNEQG

SEQ ID NO: 1824254 - protein, 22 aa, Staphylococcus epidermidis
GLMRIIIEKPFGDDLKSAKKLN

SEQ ID NO: 1824255 - protein, 20 aa, Staphylococcus epidermidis
GMDWLLRHAYHRVPQLKDSH

SEQ ID NO: 1824256 - protein, 23 aa, Staphylococcus epidermidis
GMGTTLVCAIIYDKQVVVANVGD

SEQ ID NO: 1824257 - protein, 18 aa, Staphylococcus epidermidis
GMNLYQPYTVYPATSTNR

SEQ ID NO: 1824258 - protein, 17 aa, Staphylococcus epidermidis
GMVKWAPFATLPEQFET

SEQ ID NO: 1824259 - protein, 24 aa, Staphylococcus epidermidis
GNKIPTILNEVIIDYLRGNGSLQD

SEQ ID NO: 1824260 - protein, 23 aa, Staphylococcus epidermidis
GNSGVILSQLFRGFCKNIEGEKE

SEQ ID NO: 1824261 - protein, 17 aa, Staphylococcus epidermidis
GNVVFIFQYGEEIMPGG

SEQ ID NO: 1824262 - protein, 21 aa, Staphylococcus epidermidis
GPDFPTAGLVLGKSGIRRAYE

SEQ ID NO: 1824263 - protein, 18 aa, Staphylococcus epidermidis
GPTIIEVKTIIGFGSPNK

SEQ ID NO: 1824264 - protein, 34 aa, Staphylococcus epidermidis
GQIKGVGQLLFKKIPKLPYTLCYVSRGFVADYNN

SEQ ID NO: 1824265 - protein, 23 aa, Staphylococcus epidermidis
GQNPFYHDILENKGWSFKKYANA

SEQ ID NO: 1824266 - protein, 20 aa, Staphylococcus epidermidis
GQPSYFPIPEVIGVRLTHSL

SEQ ID NO: 1824267 - protein, 19 aa, Staphylococcus epidermidis
GQWLVLRDIANYQPTTLVK

SEQ ID NO: 1824268 - protein, 21 aa, Staphylococcus epidermidis
GRGLFIGIELHESARPYCEAL

SEQ ID NO: 1824269 - protein, 21 aa, Staphylococcus epidermidis
GRSYDAVFPLLHGPNGEDGTI

SEQ ID NO: 1824270 - protein, 24 aa, Staphylococcus epidermidis
GSAMRIAPIGTLFSKDQKVELVNY

SEQ ID NO: 1824271 - protein, 24 aa, Staphylococcus epidermidis
GTEPKIKLYVSLSCDHFDVIAQKI

SEQ ID NO: 1824272 - protein, 22 aa, Staphylococcus epidermidis
GTGIFVTILRSFSHFSQQIQPE

SEQ ID NO: 1824273 - protein, 53 aa, Staphylococcus epidermidis
GTIKRKYSLDYLLKPFIKTKIKSWVRQLLWMSLYQYLYLDKIPNHAIIHEAVD

SEQ ID NO: 1824274 - protein, 53 aa, Staphylococcus epidermidis
GTIKRKYTLDYLLKPFIKTKIKSWVRQLLWMSLYQYLYLDKIPNHAIIHEAVD

SEQ ID NO: 1824275 - protein, 17 aa, Staphylococcus epidermidis
GTKKRIRYYSCSNFRNK

SEQ ID NO: 1824276 - protein, 28 aa, Staphylococcus epidermidis
GTPIHPMSPLSKIFWMRHEEPKIFKQTA

SEQ ID NO: 1824277 - protein, 23 aa, Staphylococcus epidermidis
GTQMFFYYRSFVEKERRLTTLEY

SEQ ID NO: 1824278 - protein, 24 aa, Staphylococcus epidermidis
GTSGLQLFDYKFGQTGIHGTEIDN

SEQ ID NO: 1824279 - protein, 19 aa, Staphylococcus epidermidis
GTYLTTGIKMPNNSRLVGQ

SEQ ID NO: 1824280 - protein, 27 aa, Staphylococcus epidermidis
GVDVSGKWFFDRYSPVTHIKAVGHADV

SEQ ID NO: 1824281 - protein, 17 aa, Staphylococcus epidermidis
GVFQLINTSILNAFGLN

SEQ ID NO: 1824282 - protein, 31 aa, Staphylococcus epidermidis
GVMSQNLWYFRYFIYYLIKENVIPKDKINSY

SEQ ID NO: 1824283 - protein, 33 aa, Staphylococcus epidermidis
GVNVIAILEIYFPISNIYLYAPITGMHAFDRID

SEQ ID NO: 1824284 - protein, 18 aa, Staphylococcus epidermidis
GVNYIFCTFDTDMYYEMM

SEQ ID NO: 1824285 - protein, 19 aa, Staphylococcus epidermidis
GVVGKFVEFFGPGVQHLPL

SEQ ID NO: 1824286 - protein, 21 aa, Staphylococcus epidermidis
HAMALAISNLLGLVCDPVAGL

SEQ ID NO: 1824287 - protein, 25 aa, Staphylococcus epidermidis
HDNKESFINFYHERLLIADKKPNIV

SEQ ID NO: 1824288 - protein, 23 aa, Staphylococcus epidermidis
HDRPSEDWVWRDGFVKMDTLEVD

SEQ ID NO: 1824289 - protein, 25 aa, Staphylococcus epidermidis
HEINEKVIMLITRQQPIATDLRMMM

SEQ ID NO: 1824290 - protein, 19 aa, Staphylococcus epidermidis
HELIFFELRERVRFHLEIE

SEQ ID NO: 1824291 - protein, 24 aa, Staphylococcus epidermidis
HETTTLYDVPAGKIPLTVKTLSLK

SEQ ID NO: 1824292 - protein, 19 aa, Staphylococcus epidermidis
HFECEYVQTVRIPTGDPVS

SEQ ID NO: 1824293 - protein, 38 aa, Staphylococcus epidermidis
HGEKVAYGILVQLVLENAPTEKFMKYKTFFDNINMPTT

SEQ ID NO: 1824294 - protein, 18 aa, Staphylococcus epidermidis
HGPSHPYLLKLQDLYREF

SEQ ID NO: 1824295 - protein, 24 aa, Staphylococcus epidermidis
HHPDRKIKIFPGLVTYVGETHEKA

SEQ ID NO: 1824296 - protein, 17 aa, Staphylococcus epidermidis
HILNIETGIFYINDINK

SEQ ID NO: 1824297 - protein, 30 aa, Staphylococcus epidermidis
HINEQFQISKQFWAYLIREGHIESPDKFIQ

SEQ ID NO: 1824298 - protein, 21 aa, Staphylococcus epidermidis
HLAARKGLPYVFAGHFAPQQM

SEQ ID NO: 1824299 - protein, 23 aa, Staphylococcus epidermidis
HLAKIKQLVNIPIIASGGGGNAQ

SEQ ID NO: 1824300 - protein, 25 aa, Staphylococcus epidermidis
HLEERGYHLSKTEYRGREATDFKED

SEQ ID NO: 1824301 - protein, 18 aa, Staphylococcus epidermidis
HLNRPIHVAILTVSDTRD

SEQ ID NO: 1824302 - protein, 17 aa, Staphylococcus epidermidis
HMHYGVVPITDDGRLSA

SEQ ID NO: 1824303 - protein, 30 aa, Staphylococcus epidermidis
HMMHVTISYPLPDNQLLTQLFTALEEESVN

SEQ ID NO: 1824304 - protein, 17 aa, Staphylococcus epidermidis
HNLKALEAVWDYAYDKV

SEQ ID NO: 1824305 - protein, 20 aa, Staphylococcus epidermidis
HNLSIMCEADWIIDVGPGPG

SEQ ID NO: 1824306 - protein, 17 aa, Staphylococcus epidermidis
HNVVFIFQPAEETGGGA

SEQ ID NO: 1824307 - protein, 17 aa, Staphylococcus epidermidis
HPLIQHKLSYIRDAHTG

SEQ ID NO: 1824308 - protein, 25 aa, Staphylococcus epidermidis
HQLKRHGFFYAPTVLDSVRKDDNVF

SEQ ID NO: 1824309 - protein, 25 aa, Staphylococcus epidermidis
HRSNLVMMGVLPLQFQQGESAEALG

SEQ ID NO: 1824310 - protein, 23 aa, Staphylococcus epidermidis
HSYVFISWTGKMAETFVLAHELG

SEQ ID NO: 1824311 - protein, 23 aa, Staphylococcus epidermidis
HTAAFIAGLLDNQSIEKACIWGN

SEQ ID NO: 1824312 - protein, 19 aa, Staphylococcus epidermidis
HTLLMETSVLIPANDISRH

SEQ ID NO: 1824313 - protein, 20 aa, Staphylococcus epidermidis
HTRVILMCPQGRPFTQEIAQ

SEQ ID NO: 1824314 - protein, 18 aa, Staphylococcus epidermidis
HTTWELGVVWKKDKRLSH

SEQ ID NO: 1824315 - protein, 17 aa, Staphylococcus epidermidis
HVQYLFKQNNNIPNDVL

SEQ ID NO: 1824316 - protein, 17 aa, Staphylococcus epidermidis
HWGFDDPAGKDWSEFQR

SEQ ID NO: 1824317 - protein, 21 aa, Staphylococcus epidermidis
HYETEAIWQLFKDANYERVEF

SEQ ID NO: 1824318 - protein, 20 aa, Staphylococcus epidermidis
HYQFGHIPSRIPLRASFNQK

SEQ ID NO: 1824319 - protein, 26 aa, Staphylococcus epidermidis
HYSGTLVNGLMYQIKDLSGINGEIRP

SEQ ID NO: 1824320 - protein, 19 aa, Staphylococcus epidermidis
IALANMMTSAALLGINSCP

SEQ ID NO: 1824321 - protein, 21 aa, Staphylococcus epidermidis
IALGLDRLVMLLTNRTNLRDT

SEQ ID NO: 1824322 - protein, 25 aa, Staphylococcus epidermidis
IANEVKLPVILYNVPSRTNMTIEPE

SEQ ID NO: 1824323 - protein, 28 aa, Staphylococcus epidermidis
IAQTCYQFKVPFIVIRAVSDLANGKADI

SEQ ID NO: 1824324 - protein, 22 aa, Staphylococcus epidermidis
IARFRREMMGFVFQDFNVLNTM

SEQ ID NO: 1824325 - protein, 30 aa, Staphylococcus epidermidis
IDENEILESLRPLLLRYSKERLDGEHFGDF

SEQ ID NO: 1824326 - protein, 27 aa, Staphylococcus epidermidis
IDGDPMFQFCLGIPWGAENDPETIEYL

SEQ ID NO: 1824327 - protein, 21 aa, Staphylococcus epidermidis
IDIATVLLNRQRQLLLTVDNI

SEQ ID NO: 1824328 - protein, 18 aa, Staphylococcus epidermidis
IDILFSAIKGKPIHSMIN

SEQ ID NO: 1824329 - protein, 21 aa, Staphylococcus epidermidis
IDITRINPRLKDVNIKVACDV

SEQ ID NO: 1824330 - protein, 23 aa, Staphylococcus epidermidis
IDITRINPRLKDVNIKVACDVTN

SEQ ID NO: 1824331 - protein, 18 aa, Staphylococcus epidermidis
IDLCLDVLVLPNGEYELV

SEQ ID NO: 1824332 - protein, 26 aa, Staphylococcus epidermidis
IDLHNRIFTQKLIFKNTLNNAPELKA

SEQ ID NO: 1824333 - protein, 17 aa, Staphylococcus epidermidis
IDNLFNFNYINIKIDNV

SEQ ID NO: 1824334 - protein, 34 aa, Staphylococcus epidermidis
IDNYNGHLLIQWYSKGIYKFRFPILEAIKEVYEY

SEQ ID NO: 1824335 - protein, 23 aa, Staphylococcus epidermidis
IDPLKYNLLFERFLNPERVTMPD

SEQ ID NO: 1824336 - protein, 23 aa, Staphylococcus epidermidis
IDRGALILVKQGIQPIFSVGDFD

SEQ ID NO: 1824337 - protein, 17 aa, Staphylococcus epidermidis
IDSLPIKNGVVLDGFSG

SEQ ID NO: 1824338 - protein, 25 aa, Staphylococcus epidermidis
IDVKKRHILPGFIDIHIHGGYGEDA

SEQ ID NO: 1824339 - protein, 18 aa, Staphylococcus epidermidis
IEDDYLLTLKKDYLAYYE

SEQ ID NO: 1824340 - protein, 21 aa, Staphylococcus epidermidis
IEIDTFPNHRLLSLKVFVDTK

SEQ ID NO: 1824341 - protein, 24 aa, Staphylococcus epidermidis
IEKKLSRYPQLYSRIGFAHEFDNL

SEQ ID NO: 1824342 - protein, 22 aa, Staphylococcus epidermidis
IEKSRLKALYLSVIDRIDIKKD

SEQ ID NO: 1824343 - protein, 25 aa, Staphylococcus epidermidis
IEQDANMIFFLYRDDYYDQDQQDNI

SEQ ID NO: 1824344 - protein, 23 aa, Staphylococcus epidermidis
IEQPIEFIKLVPTLQKHRDDTLK

SEQ ID NO: 1824345 - protein, 28 aa, Staphylococcus epidermidis
IEQSLREPLLFYRQLKPQNIKNIILNYL

SEQ ID NO: 1824346 - protein, 21 aa, Staphylococcus epidermidis
IERISGVIPVYAIPVGYSSID

SEQ ID NO: 1824347 - protein, 28 aa, Staphylococcus epidermidis
IEYDVALFSYHKLLEIFFSVIDPLDDGG

SEQ ID NO: 1824348 - protein, 17 aa, Staphylococcus epidermidis
IFAPFKNLGIIIIDEEH

SEQ ID NO: 1824349 - protein, 18 aa, Staphylococcus epidermidis
IFASRTLIDQLRANRFEI

SEQ ID NO: 1824350 - protein, 20 aa, Staphylococcus epidermidis
IFVQTWHGFPLKKMVNDLNE

SEQ ID NO: 1824351 - protein, 23 aa, Staphylococcus epidermidis
IGEEYSFFVYPNRSGDLFATQNM

SEQ ID NO: 1824352 - protein, 24 aa, Staphylococcus epidermidis
IGINPNWLTKPILSDIFSSIVNEA

SEQ ID NO: 1824353 - protein, 18 aa, Staphylococcus epidermidis
IGMALDKYLHMSIRKIER

SEQ ID NO: 1824354 - protein, 24 aa, Staphylococcus epidermidis
IGNLYQKLELLKKKLKKEGYFDQS

SEQ ID NO: 1824355 - protein, 19 aa, Staphylococcus epidermidis
IGQGALPVGLLPQIIVDGK

SEQ ID NO: 1824356 - protein, 33 aa, Staphylococcus epidermidis
IGVERSRKALSEADLILFVLNNNEPLTEDDQTL

SEQ ID NO: 1824357 - protein, 18 aa, Staphylococcus epidermidis
IGVLGDFHQLYPNITYNL

SEQ ID NO: 1824358 - protein, 23 aa, Staphylococcus epidermidis
IHGSQFIDTLRIIIDFIDENHEE

SEQ ID NO: 1824359 - protein, 17 aa, Staphylococcus epidermidis
IHLIRANNHLIILVMVF

SEQ ID NO: 1824360 - protein, 17 aa, Staphylococcus epidermidis
IKDLDCQVIILSSYDDF

SEQ ID NO: 1824361 - protein, 27 aa, Staphylococcus epidermidis
IKEYENIQIIGLMTMAPLTDDLSYIKN

SEQ ID NO: 1824362 - protein, 20 aa, Staphylococcus epidermidis
IKHYYQQPKFIKYWTEKINE

SEQ ID NO: 1824363 - protein, 29 aa, Staphylococcus epidermidis
IKQGITKFRIVPLLIFSAMHYISDIPQIL

SEQ ID NO: 1824364 - protein, 18 aa, Staphylococcus epidermidis
IKSIRPIARLGYYDYTVV

SEQ ID NO: 1824365 - protein, 25 aa, Staphylococcus epidermidis
IKTKKTPRLLMRGAGDPKGSSVGYK

SEQ ID NO: 1824366 - protein, 19 aa, Staphylococcus epidermidis
IKWVLGEQSAKSLRGAKME

SEQ ID NO: 1824367 - protein, 18 aa, Staphylococcus epidermidis
ILAKRGAVKLITKRDFFL

SEQ ID NO: 1824368 - protein, 25 aa, Staphylococcus epidermidis
ILEDDRKFFPPYDGSPLANEQLIKN

SEQ ID NO: 1824369 - protein, 17 aa, Staphylococcus epidermidis
ILISNHSVPYYAGLSFR

SEQ ID NO: 1824370 - protein, 17 aa, Staphylococcus epidermidis
ILKNIEKLVWMGGTFLD

SEQ ID NO: 1824371 - protein, 17 aa, Staphylococcus epidermidis
ILLNYPLINEEVANSLI

SEQ ID NO: 1824372 - protein, 17 aa, Staphylococcus epidermidis
INCNGGIRFLGVKDGKN

SEQ ID NO: 1824373 - protein, 23 aa, Staphylococcus epidermidis
INDLKNIFTDYDKVIFSVGSGGS

SEQ ID NO: 1824374 - protein, 19 aa, Staphylococcus epidermidis
INEPTAAALAYGLDKTETD

SEQ ID NO: 1824375 - protein, 27 aa, Staphylococcus epidermidis
INHIAVKCVFFNQPYLKKKLELNSIVT

SEQ ID NO: 1824376 - protein, 25 aa, Staphylococcus epidermidis
INLETPIEIQVLPKAIQLLTATEQN

SEQ ID NO: 1824377 - protein, 18 aa, Staphylococcus epidermidis
IPCISKEAQLLFHSGYDL

SEQ ID NO: 1824378 - protein, 21 aa, Staphylococcus epidermidis
IPGHFAPIADFNLVAKAKKAA

SEQ ID NO: 1824379 - protein, 18 aa, Staphylococcus epidermidis
IPIKRAPKLILKGDGDLK

SEQ ID NO: 1824380 - protein, 26 aa, Staphylococcus epidermidis
IQKEKFYQLPKVFFTNPKYVNLSNDA

SEQ ID NO: 1824381 - protein, 20 aa, Staphylococcus epidermidis
IQKKWIRKFKKIESEFKARA

SEQ ID NO: 1824382 - protein, 23 aa, Staphylococcus epidermidis
IQSLFRGRVNVVIYTQGAQGATI

SEQ ID NO: 1824383 - protein, 19 aa, Staphylococcus epidermidis
IRDGRMQRLIAPEKEPITP

SEQ ID NO: 1824384 - protein, 18 aa, Staphylococcus epidermidis
IRISYAYNMETLKKGMHR

SEQ ID NO: 1824385 - protein, 18 aa, Staphylococcus epidermidis
IRKWFKRYLSESEHIYVD

SEQ ID NO: 1824386 - protein, 23 aa, Staphylococcus epidermidis
IRWGPRTLDIDILLFGDQIIEQD

SEQ ID NO: 1824387 - protein, 24 aa, Staphylococcus epidermidis
ISKLKHLSFILHKALRKISFNVRD

SEQ ID NO: 1824388 - protein, 24 aa, Staphylococcus epidermidis
ISKLPYSIRVLLESVLRQEDDFVI

SEQ ID NO: 1824389 - protein, 24 aa, Staphylococcus epidermidis
ISKQIFDLILKFADYGFPRAHAVS

SEQ ID NO: 1824390 - protein, 24 aa, Staphylococcus epidermidis
ISKTKGLIGNIMKIKPIGTLRDGK

SEQ ID NO: 1824391 - protein, 27 aa, Staphylococcus epidermidis
ISPTIIVGPDYYMGIGSPGGNKIPTIL

SEQ ID NO: 1824392 - protein, 26 aa, Staphylococcus epidermidis
ISSTIVYLPEFIRTLKGGFKDGSFEK

SEQ ID NO: 1824393 - protein, 21 aa, Staphylococcus epidermidis
ITAGHMPGMKGAEATVKGAYK

SEQ ID NO: 1824394 - protein, 25 aa, Staphylococcus epidermidis
ITENVAMAFGFFDGMHRGHDKVFQV

SEQ ID NO: 1824395 - protein, 25 aa, Staphylococcus epidermidis
ITQEEWVNLWQKALQVNYRPVANIK

SEQ ID NO: 1824396 - protein, 24 aa, Staphylococcus epidermidis
ITSFPRMDEVIGKPLLYIESHALC

SEQ ID NO: 1824397 - protein, 18 aa, Staphylococcus epidermidis
ITSLPVLCKDFIIDKIQI

SEQ ID NO: 1824398 - protein, 21 aa, Staphylococcus epidermidis
ITSLPVLCKDFIIDKIQIDVA

SEQ ID NO: 1824399 - protein, 24 aa, Staphylococcus epidermidis
IVADMSVRNPGYVSSIILVNPTSI

SEQ ID NO: 1824400 - protein, 25 aa, Staphylococcus epidermidis
IVNVRYRSFYEHIWVYEKDGVVAGC

SEQ ID NO: 1824401 - protein, 17 aa, Staphylococcus epidermidis
IVYSTQNLDLWYGENHA

SEQ ID NO: 1824402 - protein, 19 aa, Staphylococcus epidermidis
IWKVIDFQHVKPGKGSAFV

SEQ ID NO: 1824403 - protein, 18 aa, Staphylococcus epidermidis
KACVVLDMHIGHLKSIME

SEQ ID NO: 1824404 - protein, 17 aa, Staphylococcus epidermidis
KADISFEEFLDKAALSS

SEQ ID NO: 1824405 - protein, 19 aa, Staphylococcus epidermidis
KAHAIFNHGMTPIICVGES

SEQ ID NO: 1824406 - protein, 23 aa, Staphylococcus epidermidis
KAHAYDDFIIGYRLSPEEAESPG

SEQ ID NO: 1824407 - protein, 18 aa, Staphylococcus epidermidis
KAIMLPPGLAFVAYSDRA

SEQ ID NO: 1824408 - protein, 24 aa, Staphylococcus epidermidis
KAKALGLQPIAVLDSFGASGVAPS

SEQ ID NO: 1824409 - protein, 17 aa, Staphylococcus epidermidis
KAMALIGVIELLKQAKN

SEQ ID NO: 1824410 - protein, 18 aa, Staphylococcus epidermidis
KATKMGIPVVSHLGLTPQ

SEQ ID NO: 1824411 - protein, 17 aa, Staphylococcus epidermidis
KAVFIHKSISRIQSLNV

SEQ ID NO: 1824412 - protein, 24 aa, Staphylococcus epidermidis
KDAIQIVPLMIKYAAELKNEGRML

SEQ ID NO: 1824413 - protein, 20 aa, Staphylococcus epidermidis
KDDTYMIKDIPFGRQMVFEY

SEQ ID NO: 1824414 - protein, 18 aa, Staphylococcus epidermidis
KDGKAREVIKRQSLRQLI

SEQ ID NO: 1824415 - protein, 23 aa, Staphylococcus epidermidis
KDIIKIYQKIGYATQFIGKDSNY

SEQ ID NO: 1824416 - protein, 17 aa, Staphylococcus epidermidis
KDIMLPTAKAALAVGAD

SEQ ID NO: 1824417 - protein, 24 aa, Staphylococcus epidermidis
KDKHGVEWVLRLPRRPDVYKRTKP

SEQ ID NO: 1824418 - protein, 22 aa, Staphylococcus epidermidis
KDLPNYIQIWPGHGAGSPCGKS

SEQ ID NO: 1824419 - protein, 19 aa, Staphylococcus epidermidis
KDLRVGMDSSWMDRKGDGY

SEQ ID NO: 1824420 - protein, 21 aa, Staphylococcus epidermidis
KDPKYLIGRIIARPYVGEPGN

SEQ ID NO: 1824421 - protein, 23 aa, Staphylococcus epidermidis
KDRNFNIEFITKLEGAHLEYEKE

SEQ ID NO: 1824422 - protein, 24 aa, Staphylococcus epidermidis
KDSRFPFSIMWIEELAEFKTEDEV

SEQ ID NO: 1824423 - protein, 23 aa, Staphylococcus epidermidis
KDTIKIYQKIGYATQFIGKDSNY

SEQ ID NO: 1824424 - protein, 23 aa, Staphylococcus epidermidis
KDTIKLYQKIGYATQFIGKDSNY

SEQ ID NO: 1824425 - protein, 23 aa, Staphylococcus epidermidis
KDWSRSQLQDWIKEGLVKVNGKV

SEQ ID NO: 1824426 - protein, 23 aa, Staphylococcus epidermidis
KDYSMYIQFLYESRQYIKSLKIE

SEQ ID NO: 1824427 - protein, 23 aa, Staphylococcus epidermidis
KEEHLDFVIIDTAGRLHIDETLM

SEQ ID NO: 1824428 - protein, 18 aa, Staphylococcus epidermidis
KEERVAGTAGGGMVTVTV

SEQ ID NO: 1824429 - protein, 19 aa, Staphylococcus epidermidis
KEHWGFDDPAGKDWSEFQR

SEQ ID NO: 1824430 - protein, 22 aa, Staphylococcus epidermidis
KELFIEGAYIYYLGSFIDSDSS

SEQ ID NO: 1824431 - protein, 24 aa, Staphylococcus epidermidis
KELRGAHIFLDMVSVGATINIMLA

SEQ ID NO: 1824432 - protein, 33 aa, Staphylococcus epidermidis
KEMNYRKLGKYPPYYFLINFTISHTDIKKVMVA

SEQ ID NO: 1824433 - protein, 23 aa, Staphylococcus epidermidis
KEMSKDLDFIISTSEPKKVQQQL

SEQ ID NO: 1824434 - protein, 21 aa, Staphylococcus epidermidis
KEMYDLRLMLESFAFSKLSGT

SEQ ID NO: 1824435 - protein, 31 aa, Staphylococcus epidermidis
KESVKNFKQLRLWIWEVKKRDGKHHGTFAYV

SEQ ID NO: 1824436 - protein, 23 aa, Staphylococcus epidermidis
KESYKTFKLTLTKTYLNLVERQY

SEQ ID NO: 1824437 - protein, 37 aa, Staphylococcus epidermidis; identical to SEQ ID NO: 1688051

SEQ ID NO: 1824438 - protein, 26 aa, Staphylococcus epidermidis
KETKYHAKLLLQVHDELIFEIPKSEV

SEQ ID NO: 1824439 - protein, 18 aa, Staphylococcus epidermidis
KFEQIIKLCRKCSRYLVI

SEQ ID NO: 1824440 - protein, 20 aa, Staphylococcus epidermidis
KFGVYVIFDEKKPVFVGQTG

SEQ ID NO: 1824441 - protein, 25 aa, Staphylococcus epidermidis
KFHGEVAMHLFLNDDFILPSKVDIC

SEQ ID NO: 1824442 - protein, 19 aa, Staphylococcus epidermidis
KFQFVVQKDNKPLLISDKN

SEQ ID NO: 1824443 - protein, 25 aa, Staphylococcus epidermidis
KFRAKQIFEWLYQKRVNTIDEMTNL

SEQ ID NO: 1824444 - protein, 29 aa, Staphylococcus epidermidis
KFRYDLNERFIITRGLDKCLFGYTLEEWQ

SEQ ID NO: 1824445 - protein, 20 aa, Staphylococcus epidermidis
KFYIADFEFPKALAKEEIAE

SEQ ID NO: 1824446 - protein, 34 aa, Staphylococcus epidermidis
KGFDYVVTGSGFLYNMVRVLVAFLIEVGKGKREP

SEQ ID NO: 1824447 - protein, 17 aa, Staphylococcus epidermidis
KGFTVINIKKYLMNRLV

SEQ ID NO: 1824448 - protein, 18 aa, Staphylococcus epidermidis
KGIGTRYIKLIFEFLKKE

SEQ ID NO: 1824449 - protein, 23 aa, Staphylococcus epidermidis
KGKNIALLFEKDSTRTRCAFETA

SEQ ID NO: 1824450 - protein, 23 aa, Staphylococcus epidermidis
KGLIGVTVPQWFLKNVVDSEVLG

SEQ ID NO: 1824451 - protein, 20 aa, Staphylococcus epidermidis
KGMINEKIKWNFTKFLIDRE

SEQ ID NO: 1824452 - protein, 17 aa, Staphylococcus epidermidis
KHPYTWGLLSSMPDLTT

SEQ ID NO: 1824453 - protein, 19 aa, Staphylococcus epidermidis
KHTVRLLHAIEIERLNLGR

SEQ ID NO: 1824454 - protein, 28 aa, Staphylococcus epidermidis
KIEKMKLPGIALYPETERFYPNGNFASH

SEQ ID NO: 1824455 - protein, 29 aa, Staphylococcus epidermidis
KIEKMKLPGIALYPETERFYPNGNFASHL

SEQ ID NO: 1824456 - protein, 30 aa, Staphylococcus epidermidis
KIEKMKLPGIALYPETERFYPNGNFASHLI

SEQ ID NO: 1824457 - protein, 31 aa, Staphylococcus epidermidis; identical to SEQ ID NO: 1690242

SEQ ID NO: 1824458 - protein, 31 aa, Staphylococcus epidermidis
KIGKDYLNNILKYYYGTLIIVSHDRALIDQI

SEQ ID NO: 1824459 - protein, 21 aa, Staphylococcus epidermidis
KIHGRIFISLAVKFSKARLID

SEQ ID NO: 1824460 - protein, 21 aa, Staphylococcus epidermidis
KISHRGNAILLLKEYLEGEQH

SEQ ID NO: 1824461 - protein, 18 aa, Staphylococcus epidermidis
KITWNWGGTFYPNAPKSG

SEQ ID NO: 1824462 - protein, 24 aa, Staphylococcus epidermidis
KKDDMLPFCLHISGLPVVNSNAFK

SEQ ID NO: 1824463 - protein, 24 aa, Staphylococcus epidermidis
KKGIFSVMNYLLPIQDIMSMHCSA

SEQ ID NO: 1824464 - protein, 27 aa, Staphylococcus epidermidis
KKRDEESYVLLYLLGITGARYSDVINM

SEQ ID NO: 1824465 - protein, 32 aa, Staphylococcus epidermidis
KKRQKVSMIFQHFNLLWSRNVLKNVTFPLEIA

SEQ ID NO: 1824466 - protein, 25 aa, Staphylococcus epidermidis
KKTELQKEYLELSDKMFEEDVSDEE

SEQ ID NO: 1824467 - protein, 22 aa, Staphylococcus epidermidis
KKVILFAPTFRGSGHRTAHYPF

SEQ ID NO: 1824468 - protein, 17 aa, Staphylococcus epidermidis
KLGYDQVLWLDGVEQKY

SEQ ID NO: 1824469 - protein, 18 aa, Staphylococcus epidermidis
KLGYRRIFNIKEKGTRHG

SEQ ID NO: 1824470 - protein, 17 aa, Staphylococcus epidermidis
KLHYKIEHLSPLTKKEF

SEQ ID NO: 1824471 - protein, 19 aa, Staphylococcus epidermidis
KLNLMPLDQLKQVTGYVRG

SEQ ID NO: 1824472 - protein, 17 aa, Staphylococcus epidermidis
KLRKHLINNYSIGIIAL

SEQ ID NO: 1824473 - protein, 25 aa, Staphylococcus epidermidis
KLSYIYDYPHQRLYRAIAGIGAYEN

SEQ ID NO: 1824474 - protein, 20 aa, Staphylococcus epidermidis
KLTTQFYPTQFIKFEEATIE

SEQ ID NO: 1824475 - protein, 26 aa, Staphylococcus epidermidis
KNECWKQYTHYLWEQKHGPVPKGYCL

SEQ ID NO: 1824476 - protein, 25 aa, Staphylococcus epidermidis
KNEIENFKFFVQYGSFKNSDDYKEG

SEQ ID NO: 1824477 - protein, 17 aa, Staphylococcus epidermidis
KNHIHMLVSIPPKLGVS

SEQ ID NO: 1824478 - protein, 20 aa, Staphylococcus epidermidis
KNMYVDRDFIFTNHKGNPIS

SEQ ID NO: 1824479 - protein, 17 aa, Staphylococcus epidermidis
KNNDELLYITGSPYDTL

SEQ ID NO: 1824480 - protein, 25 aa, Staphylococcus epidermidis
KNPNDSILLIAVERLYPFPEEEIKE

SEQ ID NO: 1824481 - protein, 22 aa, Staphylococcus epidermidis
KNSFRPEFLNRVDDIIVFHKLT

SEQ ID NO: 1824482 - protein, 35 aa, Staphylococcus epidermidis
KNTQIENIYDWLSDFKLLSIPKSRFKKKTLYSEKD

SEQ ID NO: 1824483 - protein, 19 aa, Staphylococcus epidermidis
KNVNVDFPLSVLTVVTGVS

SEQ ID NO: 1824484 - protein, 24 aa, Staphylococcus epidermidis
KNVTKEHWGFDDPAGKDWSEFQRV

SEQ ID NO: 1824485 - protein, 23 aa, Staphylococcus epidermidis
KPENYDALLIPGGFSPDHLRGDE

SEQ ID NO: 1824486 - protein, 17 aa, Staphylococcus epidermidis
KPIGIKVTRLAQGLSVG

SEQ ID NO: 1824487 - protein, 17 aa, Staphylococcus epidermidis
KPRLVPLLQMSNKKFKS

SEQ ID NO: 1824488 - protein, 26 aa, Staphylococcus epidermidis
KQKYSFQELPQFTPEIFMKVSAKNVM

SEQ ID NO: 1824489 - protein, 18 aa, Staphylococcus epidermidis
KQLINATSIYLEAIYALC

SEQ ID NO: 1824490 - protein, 19 aa, Staphylococcus epidermidis
KQLLVMLHGFISDATTYHS

SEQ ID NO: 1824491 - protein, 34 aa, Staphylococcus epidermidis
KQQAYIELGTRFSPFYFKKLWLDAWEETHERRLV

SEQ ID NO: 1824492 - protein, 17 aa, Staphylococcus epidermidis
KQTAAYGHFGRTDVLLP

SEQ ID NO: 1824493 - protein, 18 aa, Staphylococcus epidermidis
KRAELYEMLTEREMEILL

SEQ ID NO: 1824494 - protein, 28 aa, Staphylococcus epidermidis
KRARRDIEMLLGSKVYLELWVKVQRDWR

SEQ ID NO: 1824495 - protein, 22 aa, Staphylococcus epidermidis
KRFYDVGVSGIHRLLSNIHDIR

SEQ ID NO: 1824496 - protein, 18 aa, Staphylococcus epidermidis
KRPIFLKIKRNRYKDING

SEQ ID NO: 1824497 - protein, 20 aa, Staphylococcus epidermidis
KSLLTRIRFLDKEMGIHNKI

SEQ ID NO: 1824498 - protein, 22 aa, Staphylococcus epidermidis
KSVLIDLGLIIGKDARYRRNIL

SEQ ID NO: 1824499 - protein, 21 aa, Staphylococcus epidermidis
KSYPFIKITKEKHPRLLVTRT

SEQ ID NO: 1824500 - protein, 22 aa, Staphylococcus epidermidis
KTTLLRMINALEIPTEGTVYVN

SEQ ID NO: 1824501 - protein, 28 aa, Staphylococcus epidermidis
KTTTATALQWLLFDIGLDGSTKSFTPVP

SEQ ID NO: 1824502 - protein, 26 aa, Staphylococcus epidermidis
KVAKRLNKTIGLLLDTKGPEIRTHNM

SEQ ID NO: 1824503 - protein, 18 aa, Staphylococcus epidermidis
KVFKELEFIYDEKGLIKI

SEQ ID NO: 1824504 - protein, 21 aa, Staphylococcus epidermidis
KVHYPHYFYANILSNVIGSEK

SEQ ID NO: 1824505 - protein, 25 aa, Staphylococcus epidermidis
KVIFCEADEWKQFYQKNHSLITELE

SEQ ID NO: 1824506 - protein, 26 aa, Staphylococcus epidermidis
KWKVHAKDLIAYPKLTGKPAATIDPE

SEQ ID NO: 1824507 - protein, 17 aa, Staphylococcus epidermidis
KYDYIYVSGYSFEPPSD

SEQ ID NO: 1824508 - protein, 17 aa, Staphylococcus epidermidis
KYFLKKYFNLNVSIIPF

SEQ ID NO: 1824509 - protein, 30 aa, Staphylococcus epidermidis
KYKSRYDVTILINGLPLVQIELKRSGVAIT

SEQ ID NO: 1824510 - protein, 17 aa, Staphylococcus epidermidis
KYKYVKLSPFQSAFIHP

SEQ ID NO: 1824511 - protein, 18 aa, Staphylococcus epidermidis
KYKYVKLSPFQSAFIHPI

SEQ ID NO: 1824512 - protein, 20 aa, Staphylococcus epidermidis
KYLFDLINTHLKIHQVAPIS

SEQ ID NO: 1824513 - protein, 19 aa, Staphylococcus epidermidis
KYNQTFFNSYGFENTYALI

SEQ ID NO: 1824514 - protein, 23 aa, Staphylococcus epidermidis
LAIESRAMFPQLSKSLLDETGID

SEQ ID NO: 1824515 - protein, 21 aa, Staphylococcus epidermidis
LAKVSPLVHRASIGGVLNVAE

SEQ ID NO: 1824516 - protein, 19 aa, Staphylococcus epidermidis
LALIIRQKPTIYDYGCTVV

SEQ ID NO: 1824517 - protein, 21 aa, Staphylococcus epidermidis
LALTMMWNIAQRGYPTTFFSL

SEQ ID NO: 1824518 - protein, 25 aa, Staphylococcus epidermidis
LASDGMLVKRPLAISGNHLTLGFKE

SEQ ID NO: 1824519 - protein, 23 aa, Staphylococcus epidermidis
LAYEINDFKEGFYNIVRIKTDNN

SEQ ID NO: 1824520 - protein, 25 aa, Staphylococcus epidermidis
LDHEDIDYRWLDAYLAIRDDDQLNQ

SEQ ID NO: 1824521 - protein, 17 aa, Staphylococcus epidermidis
LDSARFRYLISKELGVT

SEQ ID NO: 1824522 - protein, 22 aa, Staphylococcus epidermidis
LEEQILPVMKKLNQIHVIINAK

SEQ ID NO: 1824523 - protein, 20 aa, Staphylococcus epidermidis
LEGVLYNLYTVYLALIEVMN

SEQ ID NO: 1824524 - protein, 22 aa, Staphylococcus epidermidis
LEGYKQDILNDKMLVVANSDRS

SEQ ID NO: 1824525 - protein, 25 aa, Staphylococcus epidermidis
LEKEKDFLQVIVKDEDSQLPTDQNV

SEQ ID NO: 1824526 - protein, 22 aa, Staphylococcus epidermidis
LENDALCFYDIGSAGMNLDTAL

SEQ ID NO: 1824527 - protein, 25 aa, Staphylococcus epidermidis
LEYQPQNFLDFIKTYSIHLSSSRLV

SEQ ID NO: 1824528 - protein, 17 aa, Staphylococcus epidermidis
LFMKQLNEYCKQKDILI

SEQ ID NO: 1824529 - protein, 20 aa, Staphylococcus epidermidis
LFMTNGCYIVPKQPNRFLIG

SEQ ID NO: 1824530 - protein, 24 aa, Staphylococcus epidermidis
LFNENMFQMFKKGAVFVNCARGSL

SEQ ID NO: 1824531 - protein, 17 aa, Staphylococcus epidermidis
LFNTFIHDLIDLANYNN

SEQ ID NO: 1824532 - protein, 19 aa, Staphylococcus epidermidis
LFSTEFMKKYTNKTDIYEF

SEQ ID NO: 1824533 - protein, 23 aa, Staphylococcus epidermidis
LGAPYEVLKQIKDNGRLPVVNFA

SEQ ID NO: 1824534 - protein, 20 aa, Staphylococcus epidermidis
LGGGERLGTLVLGRVQDDFN

SEQ ID NO: 1824535 - protein, 22 aa, Staphylococcus epidermidis
LGNVTFPNFLKRDKLTISVSTD

SEQ ID NO: 1824536 - protein, 17 aa, Staphylococcus epidermidis
LHDKIYFEQLILQETSS

SEQ ID NO: 1824537 - protein, 19 aa, Staphylococcus epidermidis
LHDKMNHLPILTDLFKEIN

SEQ ID NO: 1824538 - protein, 18 aa, Staphylococcus epidermidis
LHFRDVIYYFEPGDTLVL

SEQ ID NO: 1824539 - protein, 18 aa, Staphylococcus epidermidis
LHLPQGFNIRVDSLLYTG

SEQ ID NO: 1824540 - protein, 30 aa, Staphylococcus epidermidis
LIAESVMGQIDFLIAKARYARTIKGTKPTF

SEQ ID NO: 1824541 - protein, 23 aa, Staphylococcus epidermidis
LIEHNLSIMCEADWIIDVGPGPG

SEQ ID NO: 1824542 - protein, 23 aa, Staphylococcus epidermidis
LIKKYQLSYIIDDKFNYASNLDT

SEQ ID NO: 1824543 - protein, 23 aa, Staphylococcus epidermidis
LINVKYIMDLIGQINLSDAKARD

SEQ ID NO: 1824544 - protein, 27 aa, Staphylococcus epidermidis
LIQLKHSISEIPHIKALLNELGAQTTT

SEQ ID NO: 1824545 - protein, 21 aa, Staphylococcus epidermidis
LKAARRWAYDVKGIEPNKAEI

SEQ ID NO: 1824546 - protein, 24 aa, Staphylococcus epidermidis
LKDKLHIDYVDYYETILANVKANK

SEQ ID NO: 1824547 - protein, 22 aa, Staphylococcus epidermidis
LKESRWMNLIRKNKYLFNKCKT

SEQ ID NO: 1824548 - protein, 33 aa, Staphylococcus epidermidis
LKQTLDIIKRHRLLELFLIEILQYNWEEVHQEA

SEQ ID NO: 1824549 - protein, 19 aa, Staphylococcus epidermidis
LKWRDLFNDFEMHFYRYVF

SEQ ID NO: 1824550 - protein, 17 aa, Staphylococcus epidermidis
LKYIDFNAGKIAKQLLN

SEQ ID NO: 1824551 - protein, 17 aa, Staphylococcus epidermidis
LLEEVNHVLEFYEISFN

SEQ ID NO: 1824552 - protein, 20 aa, Staphylococcus epidermidis
LLEQNDEIIKLLKQILNKGE

SEQ ID NO: 1824553 - protein, 18 aa, Staphylococcus epidermidis
LLHNDVSIYYISKRLGHK

SEQ ID NO: 1824554 - protein, 17 aa, Staphylococcus epidermidis
LLKNDKAFLYWSTVNRN

SEQ ID NO: 1824555 - protein, 20 aa, Staphylococcus epidermidis
LLKQLNHLISPTSGDLYLND

SEQ ID NO: 1824556 - protein, 20 aa, Staphylococcus epidermidis
LLLEEGATLLRKGKDALLKN

SEQ ID NO: 1824557 - protein, 18 aa, Staphylococcus epidermidis
LLLKKHGKNLYQAGLRRI

SEQ ID NO: 1824558 - protein, 19 aa, Staphylococcus epidermidis
LLLTVDNIEMILVKGSDVP

SEQ ID NO: 1824559 - protein, 22 aa, Staphylococcus epidermidis
LLPTHNWGNYKLVFSTRHGAHI

SEQ ID NO: 1824560 - protein, 17 aa, Staphylococcus epidermidis
LLVDCKLVFANKVGNKQ

SEQ ID NO: 1824561 - protein, 19 aa, Staphylococcus epidermidis
LMRNPELLSKFRLKPEMFT

SEQ ID NO: 1824562 - protein, 30 aa, Staphylococcus epidermidis
LMTEDIKAQLLDWILPYYKNLSREGMKDIV

SEQ ID NO: 1824563 - protein, 26 aa, Staphylococcus epidermidis
LMTHPRYHIKKKYVAKLKGYLMREEI

SEQ ID NO: 1824564 - protein, 31 aa, Staphylococcus epidermidis
LNAGGKRIRPVILLLTLKMLNKDYQQGLNSA

SEQ ID NO: 1824565 - protein, 17 aa, Staphylococcus epidermidis
LNEQFERLRKEQIFVYI

SEQ ID NO: 1824566 - protein, 24 aa, Staphylococcus epidermidis
LNKHKMGILFQKTEFPKYIKVCEL

SEQ ID NO: 1824567 - protein, 19 aa, Staphylococcus epidermidis
LNPSPKWSIARYKGLGEMN

SEQ ID NO: 1824568 - protein, 25 aa, Staphylococcus epidermidis
LNPVELRRSIGYVIQQIGLMPHMTV

SEQ ID NO: 1824569 - protein, 23 aa, Staphylococcus epidermidis
LNQSLMLVTALNPHIGYEKAAQI

SEQ ID NO: 1824570 - protein, 17 aa, Staphylococcus epidermidis
LNYYYKYKQDLKGIHVH

SEQ ID NO: 1824571 - protein, 18 aa, Staphylococcus epidermidis
LNYYYKYKQDLKGIHVHL

SEQ ID NO: 1824572 - protein, 18 aa, Staphylococcus epidermidis
LNYYYKYKQNLKGIHVHL

SEQ ID NO: 1824573 - protein, 29 aa, Staphylococcus epidermidis
LPANEGRGYVLRRLLRRAVRFSQSLGINE

SEQ ID NO: 1824574 - protein, 17 aa, Staphylococcus epidermidis
LQALKNLDYYLFEGIKT

SEQ ID NO: 1824575 - protein, 25 aa, Staphylococcus epidermidis
LQEDFDNAFLLRTFSKAYGLAGLRV

SEQ ID NO: 1824576 - protein, 26 aa, Staphylococcus epidermidis
LQEDFDNAFLLRTFSKAYGLAGLRVG

SEQ ID NO: 1824577 - protein, 24 aa, Staphylococcus epidermidis
LQNYHLMMVHPWQIKHILQSDYRD

SEQ ID NO: 1824578 - protein, 19 aa, Staphylococcus epidermidis
LRKPDWLKIKLNTNDNYTG

SEQ ID NO: 1824579 - protein, 32 aa, Staphylococcus epidermidis
LRPGFEGGQLPLFRRLPKRGFTNINRKEYAIV

SEQ ID NO: 1824580 - protein, 30 aa, Staphylococcus epidermidis
LRQELDLFTCLRPVRWFKGVPSPVKRPEDV

SEQ ID NO: 1824581 - protein, 36 aa, Staphylococcus epidermidis
LRVEAPLIQAQLIETILLNIINFQTLIATKASRIRQ

SEQ ID NO: 1824582 - protein, 26 aa, Staphylococcus epidermidis
LSGMKGRKILILADVLELGPNSQLMH

SEQ ID NO: 1824583 - protein, 24 aa, Staphylococcus epidermidis
LSKFRLKPEMFTDEKLRVFIEYAL

SEQ ID NO: 1824584 - protein, 18 aa, Staphylococcus epidermidis
LSLILSQNKISDANPEVE

SEQ ID NO: 1824585 - protein, 17 aa, Staphylococcus epidermidis
LSQIRRTTNDDIVIVAG

SEQ ID NO: 1824586 - protein, 19 aa, Staphylococcus epidermidis
LSTLYRWNKLYKEEGLTGL

SEQ ID NO: 1824587 - protein, 30 aa, Staphylococcus epidermidis
LTDLRSLNIDHLYAYQFEKIALIGGNGTGK

SEQ ID NO: 1824588 - protein, 30 aa, Staphylococcus epidermidis; identical to SEQ ID NO: 1690324

SEQ ID NO: 1824589 - protein, 19 aa, Staphylococcus epidermidis
LTDVRVYDWVQEVELLGAG

SEQ ID NO: 1824590 - protein, 21 aa, Staphylococcus epidermidis
LTDVRVYDWVQEVELLGAGEL

SEQ ID NO: 1824591 - protein, 22 aa, Staphylococcus epidermidis
LTERDILLVPDVLASAGGVTVS

SEQ ID NO: 1824592 - protein, 17 aa, Staphylococcus epidermidis
LTIAVLLSAQCTDNLVN

SEQ ID NO: 1824593 - protein, 17 aa, Staphylococcus epidermidis
LTILKKKESYEQAFYNF

SEQ ID NO: 1824594 - protein, 24 aa, Staphylococcus epidermidis
LTPELAFKLGRYGGYVLAHNKGEK

SEQ ID NO: 1824595 - protein, 17 aa, Staphylococcus epidermidis
LTPLKSKYTFITKNKFI

SEQ ID NO: 1824596 - protein, 19 aa, Staphylococcus epidermidis
LTQVAFFERGELVDAESIE

SEQ ID NO: 1824597 - protein, 19 aa, Staphylococcus epidermidis
LTTQFYPTQFIKFEEATIE

SEQ ID NO: 1824598 - protein, 20 aa, Staphylococcus epidermidis
LVEDVFVFDHYKDELYIIAS

SEQ ID NO: 1824599 - protein, 18 aa, Staphylococcus epidermidis
LVEYDGELLFWDKSSPDA

SEQ ID NO: 1824600 - protein, 32 aa, Staphylococcus epidermidis; identical to SEQ ID NO: 1691280

SEQ ID NO: 1824601 - protein, 24 aa, Staphylococcus epidermidis
LVHEQFDHYLLNDLPAFKDKSPST

SEQ ID NO: 1824602 - protein, 17 aa, Staphylococcus epidermidis
LYALRDVTGTVNSIPLI

SEQ ID NO: 1824603 - protein, 20 aa, Staphylococcus epidermidis
LYDDLFQFLVKIKDIYKTKL

SEQ ID NO: 1824604 - protein, 17 aa, Staphylococcus epidermidis
LYEQHMWTPSMLDSFAK

SEQ ID NO: 1824605 - protein, 19 aa, Staphylococcus epidermidis
LYTPTYKGDMLPGCMRQSL

SEQ ID NO: 1824606 - protein, 19 aa, Staphylococcus epidermidis
MARHFGVYYSLTTISRDLQ

SEQ ID NO: 1824607 - protein, 23 aa, Staphylococcus epidermidis
MCDRYFELRKDFRKAIESCKTQS

SEQ ID NO: 1824608 - protein, 29 aa, Staphylococcus epidermidis
MDASEFRNYILGLIFYRFLSEKTEEEVAE

SEQ ID NO: 1824609 - protein, 27 aa, Staphylococcus epidermidis
MGNVPLPKQFLLLQGKPIIIHTVEKFL

SEQ ID NO: 1824610 - protein, 17 aa, Staphylococcus epidermidis
MHTDPMKFLPEDGSLEL

SEQ ID NO: 1824611 - protein, 25 aa, Staphylococcus epidermidis
MIEIDVETYYILSKKHQLLTIIDNT

SEQ ID NO: 1824612 - protein, 17 aa, Staphylococcus epidermidis
MIIYLPQEGRGIGLINK

SEQ ID NO: 1824613 - protein, 17 aa, Staphylococcus epidermidis
MIYYIKSLNGLGQFNEA

SEQ ID NO: 1824614 - protein, 29 aa, Staphylococcus epidermidis
MKETATYFLNLGISAVLITLGEQGTYCAY

SEQ ID NO: 1824615 - protein, 18 aa, Staphylococcus epidermidis
MKEVVRDDKIDILIVVNM

SEQ ID NO: 1824616 - protein, 26 aa, Staphylococcus epidermidis
MKEYKQKYLILRIFNVSGKEPQFYFI

SEQ ID NO: 1824617 - protein, 17 aa, Staphylococcus epidermidis
MKIIYDKDTHRILGGQV

SEQ ID NO: 1824618 - protein, 18 aa, Staphylococcus epidermidis
MKVILGYSIYQEGNFEVI

SEQ ID NO: 1824619 - protein, 19 aa, Staphylococcus epidermidis
MKYKTFFDNINMPTTLEGL

SEQ ID NO: 1824620 - protein, 32 aa, Staphylococcus epidermidis
MLRGELDDGLFYKFFFSYNPPKRKQSWVNKKY

SEQ ID NO: 1824621 - protein, 17 aa, Staphylococcus epidermidis
MLRPTKSSIIFIQQLGR

SEQ ID NO: 1824622 - protein, 17 aa, Staphylococcus epidermidis
MMNEVIGNPLLDKFMKD

SEQ ID NO: 1824623 - protein, 24 aa, Staphylococcus epidermidis
MNPVELRRSIGYVIQQIGLMPHMT

SEQ ID NO: 1824624 - protein, 18 aa, Staphylococcus epidermidis
MQPFKVYPNGFPAELVKE

SEQ ID NO: 1824625 - protein, 24 aa, Staphylococcus epidermidis
MQTVLYQILVDMTKLLAPILVHTA

SEQ ID NO: 1824626 - protein, 22 aa, Staphylococcus epidermidis
MRDIINNYPFPNTFKVIELSGK

SEQ ID NO: 1824627 - protein, 22 aa, Staphylococcus epidermidis
MSRLTTFLEHELAKTTSLHGVL

SEQ ID NO: 1824628 - protein, 17 aa, Staphylococcus epidermidis
MTGHLLGATGGIEAIFS

SEQ ID NO: 1824629 - protein, 28 aa, Staphylococcus epidermidis
MTQQKLDILILNIQKLSIDCHFPRTSRK

SEQ ID NO: 1824630 - protein, 28 aa, Staphylococcus epidermidis
MTSICKKWYINSFKYFRNTYKRFYYSRP

SEQ ID NO: 1824631 - protein, 18 aa, Staphylococcus epidermidis
MTVELIAPIAIEDGTRFS

SEQ ID NO: 1824632 - protein, 19 aa, Staphylococcus epidermidis
MVPMTYNMDAWYFDGQKVA

SEQ ID NO: 1824633 - protein, 21 aa, Staphylococcus epidermidis
NASVILNNLYKQTPLQTSFGV

SEQ ID NO: 1824634 - protein, 18 aa, Staphylococcus epidermidis
NATAPYSIFIRGAKYRFE

SEQ ID NO: 1824635 - protein, 19 aa, Staphylococcus epidermidis
NAVLPVLTASLLASEGHSK

SEQ ID NO: 1824636 - protein, 26 aa, Staphylococcus epidermidis
NAVNEMRALIWQLKPVGLEQGLIHAL

SEQ ID NO: 1824637 - protein, 27 aa, Staphylococcus epidermidis
NAVNEMRALIWQLKPVGLEQGLIHALH

SEQ ID NO: 1824638 - protein, 18 aa, Staphylococcus epidermidis
NDEKYIENLTKQLDQQNS

SEQ ID NO: 1824639 - protein, 22 aa, Staphylococcus epidermidis
NDFTINLYGIRLSFGRVGGYNT

SEQ ID NO: 1824640 - protein, 21 aa, Staphylococcus epidermidis
NDLHGLWLGDLILIKRNLSET

SEQ ID NO: 1824641 - protein, 28 aa, Staphylococcus epidermidis
NDNAQGEYYLPDVLSLILKDGGKAEVYC

SEQ ID NO: 1824642 - protein, 23 aa, Staphylococcus epidermidis
NDNYVFTRLKTMGKLAMLMLEDL

SEQ ID NO: 1824643 - protein, 29 aa, Staphylococcus epidermidis
NDRARLKDIIDLFLDSGLGKEAFSIISQG

SEQ ID NO: 1824644 - protein, 19 aa, Staphylococcus epidermidis
NDVMGIPSILIFQNGEKLA

SEQ ID NO: 1824645 - protein, 17 aa, Staphylococcus epidermidis
NDVSIYYISKRLGHKNI

SEQ ID NO: 1824646 - protein, 23 aa, Staphylococcus epidermidis
NEFKNLTFLSRQLTPGLKKVDID

SEQ ID NO: 1824647 - protein, 42 aa, Staphylococcus epidermidis
NEKDGRQAIQYLKQRGLGRATFLPLNVIQPRHVAAEIKDVAR

SEQ ID NO: 1824648 - protein, 24 aa, Staphylococcus epidermidis
NEKNADRIGVWIGSGIGGMETFEV

SEQ ID NO: 1824649 - protein, 17 aa, Staphylococcus epidermidis
NELLAFAINALYHLGDV

SEQ ID NO: 1824650 - protein, 17 aa, Staphylococcus epidermidis
NEQAMVYMLIHEEDKWG

SEQ ID NO: 1824651 - protein, 25 aa, Staphylococcus epidermidis
NEQRRLEFLAGRFTVKEAFSKALGT

SEQ ID NO: 1824652 - protein, 26 aa, Staphylococcus epidermidis
NESKYDVQIIELLEKQIDTLNKQLEK

SEQ ID NO: 1824653 - protein, 42 aa, Staphylococcus epidermidis
NETIQIINKPIGVTAGIVPWNAPILVLMRKVIPAIVTGCSVV

SEQ ID NO: 1824654 - protein, 19 aa, Staphylococcus epidermidis
NEYISARAYRLLRVGSFLL

SEQ ID NO: 1824655 - protein, 24 aa, Staphylococcus epidermidis
NFKIRYLINEVCHKYQIPWVYGAA

SEQ ID NO: 1824656 - protein, 19 aa, Staphylococcus epidermidis
NFTEVGIFSVMWSEHCSYK

SEQ ID NO: 1824657 - protein, 22 aa, Staphylococcus epidermidis
NFYNIDEQLIFVDVPGYGYAKV

SEQ ID NO: 1824658 - protein, 17 aa, Staphylococcus epidermidis
NGGIFVYVPKNTVVEHP

SEQ ID NO: 1824659 - protein, 31 aa, Staphylococcus epidermidis
NGKKPEAYPYPIYNNVLPHIDVFLENGYTKE

SEQ ID NO: 1824660 - protein, 18 aa, Staphylococcus epidermidis
NHKKQFYVTLKLNNEIIK

SEQ ID NO: 1824661 - protein, 28 aa, Staphylococcus epidermidis
NIDFLREGGLGLFLIESLMDEVTVYKES

SEQ ID NO: 1824662 - protein, 26 aa, Staphylococcus epidermidis
NIDKTYGLIFSQRVLLALINKGMVRE

SEQ ID NO: 1824663 - protein, 24 aa, Staphylococcus epidermidis
NIKKAWWQKFISQSPYNVGIDAAI

SEQ ID NO: 1824664 - protein, 17 aa, Staphylococcus epidermidis
NILGLLETPTEGQIIYK

SEQ ID NO: 1824665 - protein, 17 aa, Staphylococcus epidermidis
NILLEYVSANPTGDLHI

SEQ ID NO: 1824666 - protein, 17 aa, Staphylococcus epidermidis
NIPAIYNKYFLDISNYR

SEQ ID NO: 1824667 - protein, 25 aa, Staphylococcus epidermidis
NIVTTYLDRDILLPAIGQGALGIEC

SEQ ID NO: 1824668 - protein, 26 aa, Staphylococcus epidermidis
NKAKAIQALLLWLNQHHFDYSSIAKL

SEQ ID NO: 1824669 - protein, 27 aa, Staphylococcus epidermidis
NKIIGFAYCYTLLRPDGKTMFYLHSIG

SEQ ID NO: 1824670 - protein, 18 aa, Staphylococcus epidermidis
NKNDVIYVHCQSGIRSSI

SEQ ID NO: 1824671 - protein, 25 aa, Staphylococcus epidermidis
NKQQQLMQLINDLAMIFMKAGYEEL

SEQ ID NO: 1824672 - protein, 27 aa, Staphylococcus epidermidis
NKTITPLRYVLPFNEQNRYLVMPALSD

SEQ ID NO: 1824673 - protein, 21 aa, Staphylococcus epidermidis
NLINGGTLAIYMGVKRLGQII

SEQ ID NO: 1824674 - protein, 29 aa, Staphylococcus epidermidis
NLITEYCFVRPIYLFLNKMNSCDTWLARF

SEQ ID NO: 1824675 - protein, 17 aa, Staphylococcus epidermidis
NLITSNMEGFSLALLEC

SEQ ID NO: 1824676 - protein, 18 aa, Staphylococcus epidermidis
NLLDYFKKRDEESYVLLY

SEQ ID NO: 1824677 - protein, 22 aa, Staphylococcus epidermidis
NLLIEGALNILSPGGTLLLCTN

SEQ ID NO: 1824678 - protein, 27 aa, Staphylococcus epidermidis
NLMTHPRYHIKKKYVAKLKGYLMREEI

SEQ ID NO: 1824679 - protein, 24 aa, Staphylococcus epidermidis
NLNKTYFNTFYRYKNDDLKNLENG

SEQ ID NO: 1824680 - protein, 24 aa, Staphylococcus epidermidis
NLRKLGFDIVRFKTGTPPRVNART

SEQ ID NO: 1824681 - protein, 22 aa, Staphylococcus epidermidis
NNGRFSPVVFKLASEHDIDLTQ

SEQ ID NO: 1824682 - protein, 17 aa, Staphylococcus epidermidis
NNHLFAQLERLSDEDLK

SEQ ID NO: 1824683 - protein, 17 aa, Staphylococcus epidermidis
NNIELIHPHNKYHHLRL

SEQ ID NO: 1824684 - protein, 27 aa, Staphylococcus epidermidis
NPEDFHRPGHLFPLIAKENGVLTRNGH

SEQ ID NO: 1824685 - protein, 22 aa, Staphylococcus epidermidis
NPHTIFEHCLPSFHDTETIIGK

SEQ ID NO: 1824686 - protein, 22 aa, Staphylococcus epidermidis
NPIKAILLNIDKKNFDMIAHQL

SEQ ID NO: 1824687 - protein, 22 aa, Staphylococcus epidermidis
NPIKAILLNIDNKDFDMIAHLL

SEQ ID NO: 1824688 - protein, 22 aa, Staphylococcus epidermidis
NPIKAILLNIDNKDFDMIAHQL

SEQ ID NO: 1824689 - protein, 23 aa, Staphylococcus epidermidis
NPNDSILLIAVERLYPFPEEEIK

SEQ ID NO: 1824690 - protein, 24 aa, Staphylococcus epidermidis
NPNDSILLIAVERLYPFPEEEIKE

SEQ ID NO: 1824691 - protein, 17 aa, Staphylococcus epidermidis
NPRLKDVNIKVACDVTN

SEQ ID NO: 1824692 - protein, 20 aa, Staphylococcus epidermidis
NQIKFLVKTLQYHPQKSLTE

SEQ ID NO: 1824693 - protein, 20 aa, Staphylococcus epidermidis
NQSYSLIRIPCKYQELINQL

SEQ ID NO: 1824694 - protein, 22 aa, Staphylococcus epidermidis
NRFKEVYSIFSDVLGIPLKSKE

SEQ ID NO: 1824695 - protein, 18 aa, Staphylococcus epidermidis
NRNDVIYVHCQSGIRSSI

SEQ ID NO: 1824696 - protein, 17 aa, Staphylococcus epidermidis
NSCDTWLARFDWHQPHT

SEQ ID NO: 1824697 - protein, 27 aa, Staphylococcus epidermidis
NSTLFQNAMFDSNLIRSVKWTDIIFKN

SEQ ID NO: 1824698 - protein, 23 aa, Staphylococcus epidermidis
NTPKQLMIYEAFGWEAPRFGHMS

SEQ ID NO: 1824699 - protein, 19 aa, Staphylococcus epidermidis
NVHASLLPKYRGGAPIHQA

SEQ ID NO: 1824700 - protein, 26 aa, Staphylococcus epidermidis
NVNFLRKRYETLRTLPMFDTIEYTED

SEQ ID NO: 1824701 - protein, 23 aa, Staphylococcus epidermidis
NVNTLNKLLENQQILALESNKKI

SEQ ID NO: 1824702 - protein, 26 aa, Staphylococcus epidermidis
NVSYADILEILKIKKAFNVKQCGNVL

SEQ ID NO: 1824703 - protein, 27 aa, Staphylococcus epidermidis
NWVDKNGDIFFIYTNEKLKSILNISSP

SEQ ID NO: 1824704 - protein, 24 aa, Staphylococcus epidermidis
NYIDDNDYLKIIEKITKKESTIQN

SEQ ID NO: 1824705 - protein, 27 aa, Staphylococcus epidermidis
PAEAEALSHRLLLKAGLIKQSTSGIYS

SEQ ID NO: 1824706 - protein, 22 aa, Staphylococcus epidermidis
PAFDDILVHMYQYLPNIFQNHT

SEQ ID NO: 1824707 - protein, 27 aa, Staphylococcus epidermidis
PALNGSILPGITRKSIIQLAEDLGYEV

SEQ ID NO: 1824708 - protein, 18 aa, Staphylococcus epidermidis
PCQGFSLAGKFGRTFIDD

SEQ ID NO: 1824709 - protein, 19 aa, Staphylococcus epidermidis
PEFIGKPETIIMSKSLDIL

SEQ ID NO: 1824710 - protein, 29 aa, Staphylococcus epidermidis
PESNDLRYQFLQKYWNTLPQKGNINIYFR

SEQ ID NO: 1824711 - protein, 19 aa, Staphylococcus epidermidis
PFDIDFSGFIFKIQANMDP

SEQ ID NO: 1824712 - protein, 17 aa, Staphylococcus epidermidis
PHFQALTPLYPEERILL

SEQ ID NO: 1824713 - protein, 23 aa, Staphylococcus epidermidis
PIRDLLPVIPEFADDTLIGGNGS

SEQ ID NO: 1824714 - protein, 27 aa, Staphylococcus epidermidis
PIRRYPDLTVHRLIRKYLIENSMDKKE

SEQ ID NO: 1824715 - protein, 18 aa, Staphylococcus epidermidis
PISLEFYKQFIGGEATEL

SEQ ID NO: 1824716 - protein, 22 aa, Staphylococcus epidermidis
PKLDWHLSNLRNYAYLTPQKST

SEQ ID NO: 1824717 - protein, 20 aa, Staphylococcus epidermidis
PKVTSLYKKGGTIYAHVMHT

SEQ ID NO: 1824718 - protein, 23 aa, Staphylococcus epidermidis
PLANVDIFIMSGGKLCGVGIPGE

SEQ ID NO: 1824719 - protein, 20 aa, Staphylococcus epidermidis
PLFMKQLNEYCKQKDILIIV

SEQ ID NO: 1824720 - protein, 18 aa, Staphylococcus epidermidis
PLKYRKMYGQFGGNITHT

SEQ ID NO: 1824721 - protein, 21 aa, Staphylococcus epidermidis
PLNHEGLLKYGANLQQKMSHF

SEQ ID NO: 1824722 - protein, 24 aa, Staphylococcus epidermidis
PNIYSYLNLMFFIQKNKEEFKRIF

SEQ ID NO: 1824723 - protein, 25 aa, Staphylococcus epidermidis
PNMKVSEVLYYLGFLSKINQTDFDK

SEQ ID NO: 1824724 - protein, 26 aa, Staphylococcus epidermidis
PPELSEQFPYIRQLLDAYHIKRYELD

SEQ ID NO: 1824725 - protein, 24 aa, Staphylococcus epidermidis
PQKKHEGLFIINQQLEPGTYQAFV

SEQ ID NO: 1824726 - protein, 20 aa, Staphylococcus epidermidis
PQMLRQRSGAIINLTSIVGA

SEQ ID NO: 1824727 - protein, 17 aa, Staphylococcus epidermidis
PQNIKNIILNYLIEFNL

SEQ ID NO: 1824728 - protein, 21 aa, Staphylococcus epidermidis
PRDEWVFPIQTHDSRIVEVTS

SEQ ID NO: 1824729 - protein, 26 aa, Staphylococcus epidermidis
PRMKEHIIELNAVFPMFIAEFAMESG

SEQ ID NO: 1824730 - protein, 30 aa, Staphylococcus epidermidis
PRNQLFKEYLRFVSILKPKIFIIENVARLV

SEQ ID NO: 1824731 - protein, 19 aa, Staphylococcus epidermidis
PRYSDNGVFQLINTSILNA

SEQ ID NO: 1824732 - protein, 17 aa, Staphylococcus epidermidis
PSMNMVPMTYNMDAWYF

SEQ ID NO: 1824733 - protein, 22 aa, Staphylococcus epidermidis
PTALAIAYFCKDPNKCAIFCAN

SEQ ID NO: 1824734 - protein, 29 aa, Staphylococcus epidermidis
PTFKEERTIYLPNAFHPLLDKDTVVANTI

SEQ ID NO: 1824735 - protein, 25 aa, Staphylococcus epidermidis
PTLMCAKLWPQFELFQSFSKKPIIL

SEQ ID NO: 1824736 - protein, 23 aa, Staphylococcus epidermidis
PTNQAPKLLLKGTGDLKGSSVGY

SEQ ID NO: 1824737 - protein, 19 aa, Staphylococcus epidermidis
PVDFYLTKGIVERVAEKLN

SEQ ID NO: 1824738 - protein, 21 aa, Staphylococcus epidermidis
PVELRRSIGYVIQQIGLMPHM

SEQ ID NO: 1824739 - protein, 25 aa, Staphylococcus epidermidis
PYDKNFINQIGWYLNYDQEINLIGD

SEQ ID NO: 1824740 - protein, 27 aa, Staphylococcus epidermidis
PYDKNFINQIGWYLNYDQEINLIGEYH

SEQ ID NO: 1824741 - protein, 19 aa, Staphylococcus epidermidis
PYSLRHTHTSYLLSKGIPI

SEQ ID NO: 1824742 - protein, 27 aa, Staphylococcus epidermidis
PYVLDNGYLFVFVLDYYRHHLVDEVAA

SEQ ID NO: 1824743 - protein, 21 aa, Staphylococcus epidermidis
PYYAGLSFRTLVPKQPDLSPH

SEQ ID NO: 1824744 - protein, 17 aa, Staphylococcus epidermidis
QAQINQLLQRYKGKRQQ

SEQ ID NO: 1824745 - protein, 17 aa, Staphylococcus epidermidis
QAYSRIFKRVGINARPV

SEQ ID NO: 1824746 - protein, 25 aa, Staphylococcus epidermidis
QDDTKIHMKIIYDKDTHLILGGQVM

SEQ ID NO: 1824747 - protein, 24 aa, Staphylococcus epidermidis
QDEQLIQHIIKFNEDLRTMTKQGQ

SEQ ID NO: 1824748 - protein, 31 aa, Staphylococcus epidermidis
QDILANLIGYPRDEWVFPIQTHDNRIVEVTS

SEQ ID NO: 1824749 - protein, 20 aa, Staphylococcus epidermidis
QDILPLLEQVVQSSRPILIV

SEQ ID NO: 1824750 - protein, 17 aa, Staphylococcus epidermidis
QDNELITIIDDTYIPIF

SEQ ID NO: 1824751 - protein, 26 aa, Staphylococcus epidermidis
QDPLGDPIVLIAPTQSTFQLEQAFVN

SEQ ID NO: 1824752 - protein, 26 aa, Staphylococcus epidermidis
QDYIGQQVIFYLFTEKRIIATIKEER

SEQ ID NO: 1824753 - protein, 24 aa, Staphylococcus epidermidis
QEDFDNAFLLRTFSKAYGLAGLRV

SEQ ID NO: 1824754 - protein, 26 aa, Staphylococcus epidermidis
QEENIKKVIFLVDRKDLDNQTLAEFN

SEQ ID NO: 1824755 - protein, 17 aa, Staphylococcus epidermidis
QELIHYMTYMKLKDPQS

SEQ ID NO: 1824756 - protein, 21 aa, Staphylococcus epidermidis
QESAFLLKDLKITLTDLRSGK

SEQ ID NO: 1824757 - protein, 23 aa, Staphylococcus epidermidis
QEYQKSLNTLKKPINVPYEQETE

SEQ ID NO: 1824758 - protein, 24 aa, Staphylococcus epidermidis
QGEYDFLMVMSHVGIFFDEKLCQE

SEQ ID NO: 1824759 - protein, 25 aa, Staphylococcus epidermidis
QHFSQLMRHYFPNKTLKTLTSDDIL

SEQ ID NO: 1824760 - protein, 18 aa, Staphylococcus epidermidis
QHHGCIDAAIFNLGYLPK

SEQ ID NO: 1824761 - protein, 21 aa, Staphylococcus epidermidis
QHRGYGTRLLEAGLKRFKDQY

SEQ ID NO: 1824762 - protein, 18 aa, Staphylococcus epidermidis
QHTLLMETSVLISTNDIS

SEQ ID NO: 1824763 - protein, 19 aa, Staphylococcus epidermidis
QHTLLMETSVLISTNDISR

SEQ ID NO: 1824764 - protein, 19 aa, Staphylococcus epidermidis
QIDQYELQLLLDGPHDANN

SEQ ID NO: 1824765 - protein, 23 aa, Staphylococcus epidermidis
QIKRLKFDYLYIDNARLKSSYLL

SEQ ID NO: 1824766 - protein, 17 aa, Staphylococcus epidermidis
QITHIDFLAINMSEERT

SEQ ID NO: 1824767 - protein, 24 aa, Staphylococcus epidermidis
QKIRKFDFSLLTNKIKKYKIQNNF

SEQ ID NO: 1824768 - protein, 23 aa, Staphylococcus epidermidis
QKKLKKLFKYAHKKALAFTPEDR

SEQ ID NO: 1824769 - protein, 33 aa, Staphylococcus epidermidis
QLGYMADHFYPDLLFGFIHVPLIPEQTINHSQQ

SEQ ID NO: 1824770 - protein, 18 aa, Staphylococcus epidermidis
QLNYRQIKSFLMKQLSRQ

SEQ ID NO: 1824771 - protein, 24 aa, Staphylococcus epidermidis
QLRKKYDIPTKKAPKLILKGDGDL

SEQ ID NO: 1824772 - protein, 34 aa, Staphylococcus epidermidis
QMIQAQSAFFNKGNMLKPWFVSSIDNPITKKNYY

SEQ ID NO: 1824773 - protein, 24 aa, Staphylococcus epidermidis
QMQKPSVFFLKDGKAREVIKRQSL

SEQ ID NO: 1824774 - protein, 17 aa, Staphylococcus epidermidis
QNEFVLFDLGVVYHHYC

SEQ ID NO: 1824775 - protein, 19 aa, Staphylococcus epidermidis
QPFLLIDKIVEYEEGKRCV

SEQ ID NO: 1824776 - protein, 17 aa, Staphylococcus epidermidis
QPISNRGIGFYNLDKNT

SEQ ID NO: 1824777 - protein, 28 aa, Staphylococcus epidermidis
QPTRAEHVKLLIPLLEKNRDEIAQLYVK

SEQ ID NO: 1824778 - protein, 29 aa, Staphylococcus epidermidis
QQNVYIEKYMMSLFLYEVASQTSMNFDIP

SEQ ID NO: 1824779 - protein, 20 aa, Staphylococcus epidermidis
QRIAIARALIARPKLLLADE

SEQ ID NO: 1824780 - protein, 17 aa, Staphylococcus epidermidis
QRLASGWKFEDAIEAPI

SEQ ID NO: 1824781 - protein, 28 aa, Staphylococcus epidermidis
QSFDSLHQRLYHDFLRESNAREELRADL

SEQ ID NO: 1824782 - protein, 18 aa, Staphylococcus epidermidis
QSIFGGIIALNRTVDVKL

SEQ ID NO: 1824783 - protein, 17 aa, Staphylococcus epidermidis
QTDLGIVLLNKDNIVYL

SEQ ID NO: 1824784 - protein, 17 aa, Staphylococcus epidermidis
QTLVTPLIAYIQNYGIA

SEQ ID NO: 1824785 - protein, 18 aa, Staphylococcus epidermidis
QTLVTPLIAYIQNYGIAL

SEQ ID NO: 1824786 - protein, 31 aa, Staphylococcus epidermidis
QVDIAGPGFINFYLDNQYLTDIIPEAITKGD

SEQ ID NO: 1824787 - protein, 21 aa, Staphylococcus epidermidis
QVLPMEDINLHFNGDFHAITT

SEQ ID NO: 1824788 - protein, 19 aa, Staphylococcus epidermidis
RAKPLLKVFRLENELKVFP

SEQ ID NO: 1824789 - protein, 31 aa, Staphylococcus epidermidis; identical to SEQ ID NO: 1682136

SEQ ID NO: 1824790 - protein, 27 aa, Staphylococcus epidermidis
RATLKRLPLYYRFVSILKGKGIDRVNS

SEQ ID NO: 1824791 - protein, 26 aa, Staphylococcus epidermidis
RAYSPDKFLFIVHNEGILNRAIEEFK

SEQ ID NO: 1824792 - protein, 19 aa, Staphylococcus epidermidis
REGQLFLLDVFEGNIFKVN

SEQ ID NO: 1824793 - protein, 24 aa, Staphylococcus epidermidis
RENETLYNFYFYSSGDTHLDKTIL

SEQ ID NO: 1824794 - protein, 29 aa, Staphylococcus epidermidis
RFAGVTNGYIYNVKSYDALLHCIDVTYAN

SEQ ID NO: 1824795 - protein, 20 aa, Staphylococcus epidermidis
RFNIAILEKGNFLSTGNYIL

SEQ ID NO: 1824796 - protein, 20 aa, Staphylococcus epidermidis
RGELVSCFLLEVDDSLNSIN

SEQ ID NO: 1824797 - protein, 18 aa, Staphylococcus epidermidis
RGIGFYNLDKNTAKFQFV

SEQ ID NO: 1824798 - protein, 17 aa, Staphylococcus epidermidis
RGLKIWMFGVDEGDQIR

SEQ ID NO: 1824799 - protein, 20 aa, Staphylococcus epidermidis
RGMVLYMNRNTRKTTGHFYT

SEQ ID NO: 1824800 - protein, 17 aa, Staphylococcus epidermidis
RGQLMAQAFPNGVGGMA

SEQ ID NO: 1824801 - protein, 22 aa, Staphylococcus epidermidis
RGRKTLLFGPMKPVGLEDPKTG

SEQ ID NO: 1824802 - protein, 21 aa, Staphylococcus epidermidis
RHIIKLARSNAIPIIYHVYAP

SEQ ID NO: 1824803 - protein, 30 aa, Staphylococcus epidermidis
RIASELIELIIAFMFHHQIPMRVETSKLLS

SEQ ID NO: 1824804 - protein, 22 aa, Staphylococcus epidermidis
RIEIDTFPNHRLLSLKVFVDTK

SEQ ID NO: 1824805 - protein, 21 aa, Staphylococcus epidermidis
RINNEYRFQILVKYKSEPQLH

SEQ ID NO: 1824806 - protein, 22 aa, Staphylococcus epidermidis
RKDIGWSQMQFAQKLKVPQTTI

SEQ ID NO: 1824807 - protein, 24 aa, Staphylococcus epidermidis
RKIERANWEFLYYSSELEGLPKDE

SEQ ID NO: 1824808 - protein, 20 aa, Staphylococcus epidermidis
RKMMTTYLPKIKQTYHPTVS

SEQ ID NO: 1824809 - protein, 17 aa, Staphylococcus epidermidis
RKSDLVITIGYDPIEYE

SEQ ID NO: 1824810 - protein, 17 aa, Staphylococcus epidermidis
RKWFKRYLSESEHIYVD

SEQ ID NO: 1824811 - protein, 17 aa, Staphylococcus epidermidis
RLDKRIYDLQLSRQIAI

SEQ ID NO: 1824812 - protein, 17 aa, Staphylococcus epidermidis
RLDLNAEIVRKYPKVKL

SEQ ID NO: 1824813 - protein, 20 aa, Staphylococcus epidermidis
RLFEGFSMGNPKIQTGNLLE

SEQ ID NO: 1824814 - protein, 17 aa, Staphylococcus epidermidis
RLKDGILAIDLLRRPEM

SEQ ID NO: 1824815 - protein, 22 aa, Staphylococcus epidermidis
RLKGIIKKEFSISFEEFAVLTY

SEQ ID NO: 1824816 - protein, 17 aa, Staphylococcus epidermidis
RLLKPTEGSTYKIYFGF

SEQ ID NO: 1824817 - protein, 17 aa, Staphylococcus epidermidis
RLMKQAEKFNRPIFTFI

SEQ ID NO: 1824818 - protein, 27 aa, Staphylococcus epidermidis
RLQDDIQLIDMMRALFPCGSITGAPKI

SEQ ID NO: 1824819 - protein, 17 aa, Staphylococcus epidermidis
RLRELRPGEALVKTEYC

SEQ ID NO: 1824820 - protein, 23 aa, Staphylococcus epidermidis
RLSDLEKLIRLPGKFKYFEHNVA

SEQ ID NO: 1824821 - protein, 17 aa, Staphylococcus epidermidis
RNAGLIRSVRGAKGGYQ

SEQ ID NO: 1824822 - protein, 18 aa, Staphylococcus epidermidis
RNDFTPSILTAIKIARIF

SEQ ID NO: 1824823 - protein, 27 aa, Staphylococcus epidermidis
RNHSFPTPPVKPVIMAFTKSYDRPYEE

SEQ ID NO: 1824824 - protein, 22 aa, Staphylococcus epidermidis
RNQSYSLIRIPCKYQELINQLK

SEQ ID NO: 1824825 - protein, 18 aa, Staphylococcus epidermidis
RPMDRVMKPLLKMNANIS

SEQ ID NO: 1824826 - protein, 18 aa, Staphylococcus epidermidis
RQIAELCYFIWRDMELDI

SEQ ID NO: 1824827 - protein, 18 aa, Staphylococcus epidermidis
RQLTTSSAMLIIFGDLQN

SEQ ID NO: 1824828 - protein, 25 aa, Staphylococcus epidermidis
RRERGITFGLFRLSVGLENSEELIA

SEQ ID NO: 1824829 - protein, 21 aa, Staphylococcus epidermidis
RSDIPLARGLGSSASALVGAL

SEQ ID NO: 1824830 - protein, 17 aa, Staphylococcus epidermidis
RSFYEHIWVYEKDGVVA

SEQ ID NO: 1824831 - protein, 24 aa, Staphylococcus epidermidis
RSNKKARKLLFWVIMNIIRGQHHY

SEQ ID NO: 1824832 - protein, 23 aa, Staphylococcus epidermidis
RSRTKYPHFIKQLQDRKPYQLSA

SEQ ID NO: 1824833 - protein, 27 aa, Staphylococcus epidermidis
RTETKIKKFVLFYKYEIDISEKYLEIA

SEQ ID NO: 1824834 - protein, 29 aa, Staphylococcus epidermidis
RVKQLLHTLQLWLMRINYLNQPKSYPSIE

SEQ ID NO: 1824835 - protein, 19 aa, Staphylococcus epidermidis
RVLLALINKGMVREEAYDK

SEQ ID NO: 1824836 - protein, 26 aa, Staphylococcus epidermidis
RVNCVAPGPFWSPLQIVGGQPQSAIP

SEQ ID NO: 1824837 - protein, 22 aa, Staphylococcus epidermidis
RVSIEEKRLRELRPGEALVKTE

SEQ ID NO: 1824838 - protein, 23 aa, Staphylococcus epidermidis
RYGPLLNGFYHIPFPDKYRGMFE

SEQ ID NO: 1824839 - protein, 24 aa, Staphylococcus epidermidis
RYGPLLNGFYHIPFPDKYRGMFEQ

SEQ ID NO: 1824840 - protein, 20 aa, Staphylococcus epidermidis
RYQLSYIIDDKFNYASNLDS

SEQ ID NO: 1824841 - protein, 30 aa, Staphylococcus epidermidis
RYRRQNYTGLFRYIQLFVVSNKMETRYYAN

SEQ ID NO: 1824842 - protein, 17 aa, Staphylococcus epidermidis
SAGFTLEQLAVQDFFFQ

SEQ ID NO: 1824843 - protein, 30 aa, Staphylococcus epidermidis
SDFPNQINNVLAFPGLFRGALDVEATHINE

SEQ ID NO: 1824844 - protein, 22 aa, Staphylococcus epidermidis
SDIKLHFIGSLQSRKVKDIINE

SEQ ID NO: 1824845 - protein, 20 aa, Staphylococcus epidermidis
SDLAYFARKGKLPWKCYEPQ

SEQ ID NO: 1824846 - protein, 21 aa, Staphylococcus epidermidis
SDLLIKTFLKEHPPGPSKTIA

SEQ ID NO: 1824847 - protein, 27 aa, Staphylococcus epidermidis
SDWYNASYIMMWGSNVPLTRTPDAHFM

SEQ ID NO: 1824848 - protein, 19 aa, Staphylococcus epidermidis
SFGFLVIHIPHISEEHFKQ

SEQ ID NO: 1824849 - protein, 18 aa, Staphylococcus epidermidis
SFTLDDFLEQLDQVKNLG

SEQ ID NO: 1824850 - protein, 26 aa, Staphylococcus epidermidis
SGAALVTRLFYMKHQFRTVATMGIGG

SEQ ID NO: 1824851 - protein, 23 aa, Staphylococcus epidermidis
SGIHPEWLYCAKANLVLEPAYTG

SEQ ID NO: 1824852 - protein, 18 aa, Staphylococcus epidermidis
SGIRYYVNRLLEQTSHQS

SEQ ID NO: 1824853 - protein, 17 aa, Staphylococcus epidermidis
SGLSYHVLTMLRIAKSI

SEQ ID NO: 1824854 - protein, 23 aa, Staphylococcus epidermidis
SHISLLSQLGISLRAIMDRVGHT

SEQ ID NO: 1824855 - protein, 18 aa, Staphylococcus epidermidis
SHPFSLLDDNPIIVKNPG

SEQ ID NO: 1824856 - protein, 17 aa, Staphylococcus epidermidis
SHQHDLPVWNKPALCSL

SEQ ID NO: 1824857 - protein, 23 aa, Staphylococcus epidermidis
SHQTKIQLFEYLRGWLDHEDIDI

SEQ ID NO: 1824858 - protein, 18 aa, Staphylococcus epidermidis
SHSFLIMPLDAMGLKKVK

SEQ ID NO: 1824859 - protein, 18 aa, Staphylococcus epidermidis
SHVLPTNQTARFTNGLSV

SEQ ID NO: 1824860 - protein, 17 aa, Staphylococcus epidermidis
SIFSDVLGIPLKSKETD

SEQ ID NO: 1824861 - protein, 22 aa, Staphylococcus epidermidis
SIHYIATVVSVYRKVIDAYAED

SEQ ID NO: 1824862 - protein, 20 aa, Staphylococcus epidermidis
SIKPQLTLKTLGRLKPLLNE

SEQ ID NO: 1824863 - protein, 18 aa, Staphylococcus epidermidis
SILRRRDAMINRLAEFIG

SEQ ID NO: 1824864 - protein, 17 aa, Staphylococcus epidermidis
SISVPLQYLIAAALEVT

SEQ ID NO: 1824865 - protein, 17 aa, Staphylococcus epidermidis
SIYLQSPYFIPDQSYIN

SEQ ID NO: 1824866 - protein, 20 aa, Staphylococcus epidermidis
SKAYSSRSFVLGSGAKSKAY

SEQ ID NO: 1824867 - protein, 21 aa, Staphylococcus epidermidis
SKKLNQWLKKIDAYQIIVQNN

SEQ ID NO: 1824868 - protein, 17 aa, Staphylococcus epidermidis
SKLQEQYQFHLAISGHE

SEQ ID NO: 1824869 - protein, 17 aa, Staphylococcus epidermidis
SLELGGKSPYIVLDDVD

SEQ ID NO: 1824870 - protein, 23 aa, Staphylococcus epidermidis
SLEPKLFLQICCIGAGIPQINKK

SEQ ID NO: 1824871 - protein, 19 aa, Staphylococcus epidermidis
SLPCFIDVLETVLTEMEIQ

SEQ ID NO: 1824872 - protein, 26 aa, Staphylococcus epidermidis
SLQKAEYILLHEAPVAPVYQKGEAHL

SEQ ID NO: 1824873 - protein, 23 aa, Staphylococcus epidermidis
SLSPNDLFTWSSGIKSPIYCDNR

SEQ ID NO: 1824874 - protein, 26 aa, Staphylococcus epidermidis
SNGKYLFEAVYGAGLARIYKLNQITG

SEQ ID NO: 1824875 - protein, 22 aa, Staphylococcus epidermidis
SNSAPLLFKTISKLKKHFKGYG

SEQ ID NO: 1824876 - protein, 23 aa, Staphylococcus epidermidis
SNYREHVVFILWGRPAQQKERFI

SEQ ID NO: 1824877 - protein, 26 aa, Staphylococcus epidermidis
SPDSTTFYAHFPKKGMYKIWAEFKFN

SEQ ID NO: 1824878 - protein, 18 aa, Staphylococcus epidermidis
SPIMSRPAKNMTVAIIGT

SEQ ID NO: 1824879 - protein, 29 aa, Staphylococcus epidermidis
SPIRRYPDLTVHRLIRKYLIENSMDKKEI

SEQ ID NO: 1824880 - protein, 29 aa, Staphylococcus epidermidis
SPSQMLKFGLPRLTQYFRSNLKLEQQRLK

SEQ ID NO: 1824881 - protein, 27 aa, Staphylococcus epidermidis
SQEDISLYVINLNRYIYKDIKGEFIEI

SEQ ID NO: 1824882 - protein, 27 aa, Staphylococcus epidermidis
SQFPARIKCATLAWKALEKGTVEKEGK

SEQ ID NO: 1824883 - protein, 25 aa, Staphylococcus epidermidis
SQHLNQYLPKYMIPKTLTAISEIPL

SEQ ID NO: 1824884 - protein, 28 aa, Staphylococcus epidermidis
SRKALSEADLILFVLNNNEPLTEDDQTL

SEQ ID NO: 1824885 - protein, 20 aa, Staphylococcus epidermidis
SRLTTFLEHELAKTTSLHGV

SEQ ID NO: 1824886 - protein, 30 aa, Staphylococcus epidermidis
SSFMSIEPQIRLWDILQTKFKAKALQEKVY

SEQ ID NO: 1824887 - protein, 18 aa, Staphylococcus epidermidis
SSLLLKKAIDVLGVNYVK

SEQ ID NO: 1824888 - protein, 25 aa, Staphylococcus epidermidis
SSNDPRFKRWVIGSILSRTYYHNMV

SEQ ID NO: 1824889 - protein, 17 aa, Staphylococcus epidermidis
SSSNPLGGGLMLQGLKL

SEQ ID NO: 1824890 - protein, 24 aa, Staphylococcus epidermidis
STDQIKFVYFLVNGCILHESSNIT

SEQ ID NO: 1824891 - protein, 18 aa, Staphylococcus epidermidis
STNFLINYGYFDITPKNN

SEQ ID NO: 1824892 - protein, 23 aa, Staphylococcus epidermidis
STYAKNMFRLLKQYKHTGYFKIQ

SEQ ID NO: 1824893 - protein, 22 aa, Staphylococcus epidermidis
SVAFMHIPMLMERIKATYNKNA

SEQ ID NO: 1824894 - protein, 24 aa, Staphylococcus epidermidis
SVDSLPPEWLNPSAAAPTVEWEDM

SEQ ID NO: 1824895 - protein, 21 aa, Staphylococcus epidermidis
SVFHIHFHLIPRYENDIDGFG

SEQ ID NO: 1824896 - protein, 25 aa, Staphylococcus epidermidis
SVHRGDYLAILSTGAYHYSMASNYN

SEQ ID NO: 1824897 - protein, 18 aa, Staphylococcus epidermidis
SVLKRFKAMLLQKNETVE

SEQ ID NO: 1824898 - protein, 25 aa, Staphylococcus epidermidis
SVTAYDFVYAWRKVVNPKTASEFAY

SEQ ID NO: 1824899 - protein, 22 aa, Staphylococcus epidermidis
SVTFTHEFMFSRPLHHTDDVIK

SEQ ID NO: 1824900 - protein, 19 aa, Staphylococcus epidermidis
SYAPWYIVPADHKKTSRIE

SEQ ID NO: 1824901 - protein, 35 aa, Staphylococcus epidermidis
SYKQLPLTLFQIQSKYRDEKRPRFGLLRGREFLMK

SEQ ID NO: 1824902 - protein, 17 aa, Staphylococcus epidermidis
TAKFQFVVQKDNKPLLI

SEQ ID NO: 1824903 - protein, 17 aa, Staphylococcus epidermidis
TCYQFKVPFIVTRAVSD

SEQ ID NO: 1824904 - protein, 17 aa, Staphylococcus epidermidis
TDYILLDEPLNNLDMKH

SEQ ID NO: 1824905 - protein, 17 aa, Staphylococcus epidermidis
TEEKLNVPLIGFTGAPF

SEQ ID NO: 1824906 - protein, 17 aa, Staphylococcus epidermidis
TEGLLKEQFYTKGKYKD

SEQ ID NO: 1824907 - protein, 22 aa, Staphylococcus epidermidis
TEKAYWDNLPISEKRQFVELYK

SEQ ID NO: 1824908 - protein, 22 aa, Staphylococcus epidermidis
TEYPVLLGTSRKRYIKEMMNQD

SEQ ID NO: 1824909 - protein, 24 aa, Staphylococcus epidermidis
TFKKMHVRMMPGQEPPYTRLIDSA

SEQ ID NO: 1824910 - protein, 30 aa, Staphylococcus epidermidis
TFLTIPGVEMTWKKNWFKEIDLNKYDYIYV

SEQ ID NO: 1824911 - protein, 17 aa, Staphylococcus epidermidis
TGANDVWIVKGEKEYLI

SEQ ID NO: 1824912 - protein, 29 aa, Staphylococcus epidermidis
TGIPIHPMSPLSKIFWMRHEEPKIFKQTA

SEQ ID NO: 1824913 - protein, 22 aa, Staphylococcus epidermidis
TGKIEADLYFDKAGSIPREDVA

SEQ ID NO: 1824914 - protein, 33 aa, Staphylococcus epidermidis
TGRKLKEYLLTKDGFTLYMFNIQGHNDFKMAYI

SEQ ID NO: 1824915 - protein, 22 aa, Staphylococcus epidermidis
TGYTLNVPLFVNEGDTLVINTS

SEQ ID NO: 1824916 - protein, 18 aa, Staphylococcus epidermidis
TIADIRGLKIWMFGVDEG

SEQ ID NO: 1824917 - protein, 20 aa, Staphylococcus epidermidis
TIADIRGLKIWMFGVDEGDQ

SEQ ID NO: 1824918 - protein, 18 aa, Staphylococcus epidermidis
TIEIWNHQISHNDFLKIS

SEQ ID NO: 1824919 - protein, 26 aa, Staphylococcus epidermidis
TIEKRVQAHNFTWASPIMSRPAKNMT

SEQ ID NO: 1824920 - protein, 18 aa, Staphylococcus epidermidis
TIELLIEKYLNVAEEYCN

SEQ ID NO: 1824921 - protein, 32 aa, Staphylococcus epidermidis
TIFKAMIAIKTGNPIIFAFHPSAQQSSKYAAK

SEQ ID NO: 1824922 - protein, 17 aa, Staphylococcus epidermidis
TIIFDPSPRINKMNCES

SEQ ID NO: 1824923 - protein, 20 aa, Staphylococcus epidermidis
TIIQLMQYLKKRHIPMAITT

SEQ ID NO: 1824924 - protein, 21 aa, Staphylococcus epidermidis
TIKSPLKFNPDLAKKNWREAQ

SEQ ID NO: 1824925 - protein, 20 aa, Staphylococcus epidermidis
TILQDLYQRGIGKLLVEAGP

SEQ ID NO: 1824926 - protein, 23 aa, Staphylococcus epidermidis
TIRTLITRLYKKEIIKRYKYNNI

SEQ ID NO: 1824927 - protein, 23 aa, Staphylococcus epidermidis
TISMGYIGLYEAATLFYGPNWEH

SEQ ID NO: 1824928 - protein, 20 aa, Staphylococcus epidermidis
TIYLLKRKDFIQMDNNVLFI

SEQ ID NO: 1824929 - protein, 24 aa, Staphylococcus epidermidis
TKGNFRLIHRLFAQIDRIMDINGL

SEQ ID NO: 1824930 - protein, 22 aa, Staphylococcus epidermidis
TKKRIAIQYSLPKWIVDHWVTH

SEQ ID NO: 1824931 - protein, 24 aa, Staphylococcus epidermidis
TKKRIAIQYSLPKWIVDHWVTHFG

SEQ ID NO: 1824932 - protein, 25 aa, Staphylococcus epidermidis
TKKRIAIQYSLPKWIVDHWVTHFGI

SEQ ID NO: 1824933 - protein, 22 aa, Staphylococcus epidermidis
TKRMYPDILNYDKLVELLGDFK

SEQ ID NO: 1824934 - protein, 17 aa, Staphylococcus epidermidis
TKSLPCFIDVLETVLTE

SEQ ID NO: 1824935 - protein, 27 aa, Staphylococcus epidermidis
TLIDDDFPLMLKWLTDERVLEFYGGRD

SEQ ID NO: 1824936 - protein, 24 aa, Staphylococcus epidermidis
TLKGIECIYALYKKNRRSLQIYGF

SEQ ID NO: 1824937 - protein, 27 aa, Staphylococcus epidermidis
TLSDLNTTFYRKFIKWYGDDHATETVR

SEQ ID NO: 1824938 - protein, 18 aa, Staphylococcus epidermidis
TMHEKEMHFVLVSNDMEK

SEQ ID NO: 1824939 - protein, 18 aa, Staphylococcus epidermidis
TMIELYEAYADYHDIMDL

SEQ ID NO: 1824940 - protein, 24 aa, Staphylococcus epidermidis
TMNEMLMANYLFNSSNDPRFKRWV

SEQ ID NO: 1824941 - protein, 23 aa, Staphylococcus epidermidis
TMNRPRIITLEEALQFINDDELV

SEQ ID NO: 1824942 - protein, 25 aa, Staphylococcus epidermidis
TNKGDMTFKLFPDIAPKTVENFVTH

SEQ ID NO: 1824943 - protein, 22 aa, Staphylococcus epidermidis
TNLVPFLTIEQQFKLLSKYKKD

SEQ ID NO: 1824944 - protein, 23 aa, Staphylococcus epidermidis
TNNLDIFLLKTFLKKNNKQIKEE

SEQ ID NO: 1824945 - protein, 23 aa, Staphylococcus epidermidis
TNQAEKWYQHASKEELETLKNKH

SEQ ID NO: 1824946 - protein, 23 aa, Staphylococcus epidermidis
TNTIIAHHPLIFKGVKRIVEDGY

SEQ ID NO: 1824947 - protein, 21 aa, Staphylococcus epidermidis
TNVIDLAYPGVLPVVNRRAVD

SEQ ID NO: 1824948 - protein, 20 aa, Staphylococcus epidermidis
TPYEGHLWIMDPIDGTSNLV

SEQ ID NO: 1824949 - protein, 26 aa, Staphylococcus epidermidis
TQDLMRLRYWECPIGCSEWEDIADYF

SEQ ID NO: 1824950 - protein, 26 aa, Staphylococcus epidermidis
TQFQHNFQHNLLFTHIPLQEYREVEN

SEQ ID NO: 1824951 - protein, 29 aa, Staphylococcus epidermidis
TQIICYDLRFPEILRYPARKGAKIAFYVA

SEQ ID NO: 1824952 - protein, 20 aa, Staphylococcus epidermidis
TQLTLICKLHDKIYFEQLIL

SEQ ID NO: 1824953 - protein, 18 aa, Staphylococcus epidermidis
TRILAERVGPIKLHLVPF

SEQ ID NO: 1824954 - protein, 37 aa, Staphylococcus epidermidis
TRLIMVHLYDYIPRLFWPIYYFIQAPIQGLLMRGFEI

SEQ ID NO: 1824955 - protein, 24 aa, Staphylococcus epidermidis
TRYIKLIFEFLKKERNANAVILDP

SEQ ID NO: 1824956 - protein, 20 aa, Staphylococcus epidermidis
TSEFNTVLFNAAQYVRDLYQ

SEQ ID NO: 1824957 - protein, 24 aa, Staphylococcus epidermidis
TSKNLMCLFRKINQKHQTILMVTH

SEQ ID NO: 1824958 - protein, 26 aa, Staphylococcus epidermidis
TSMFYNFKLMKNNVLPSLLLPELSGP

SEQ ID NO: 1824959 - protein, 17 aa, Staphylococcus epidermidis
TSNIKFDLSTYSGNLTL

SEQ ID NO: 1824960 - protein, 19 aa, Staphylococcus epidermidis
TTAYLTIGHTWIALNQEKN

SEQ ID NO: 1824961 - protein, 19 aa, Staphylococcus epidermidis
TTELSFYNLLPDEEKKGRM

SEQ ID NO: 1824962 - protein, 34 aa, Staphylococcus epidermidis
TTKKYDNPFTPPMFARVFRKHLEGGFIKAIRQVG

SEQ ID NO: 1824963 - protein, 23 aa, Staphylococcus epidermidis
TTKQLIELAQWLENNNIELQIID

SEQ ID NO: 1824964 - protein, 26 aa, Staphylococcus epidermidis
TTSILTQVFQLDLFAEYLTHEDAQQP

SEQ ID NO: 1824965 - protein, 18 aa, Staphylococcus epidermidis
TTSKPFFLEFMAKNVSKG

SEQ ID NO: 1824966 - protein, 18 aa, Staphylococcus epidermidis
TVIILDGLEDPHNLGSIL

SEQ ID NO: 1824967 - protein, 17 aa, Staphylococcus epidermidis
TVRNMFGYTGTYKGKEV

SEQ ID NO: 1824968 - protein, 18 aa, Staphylococcus epidermidis
TWFALMNHLVDISIDYVV

SEQ ID NO: 1824969 - protein, 19 aa, Staphylococcus epidermidis
TYDFTRTHYPIYGKKVGEK

SEQ ID NO: 1824970 - protein, 18 aa, Staphylococcus epidermidis
TYDPFTLTENQGYLYGRG

SEQ ID NO: 1824971 - protein, 17 aa, Staphylococcus epidermidis
TYMIKDIPFGRQMVFEY

SEQ ID NO: 1824972 - protein, 25 aa, Staphylococcus epidermidis
TYSVHLLYWEYHDFYIEISFSVDKG

SEQ ID NO: 1824973 - protein, 24 aa, Staphylococcus epidermidis
VAMHLVKFKKGINVKLFIGGTDLE

SEQ ID NO: 1824974 - protein, 18 aa, Staphylococcus epidermidis
VANSIVSQLLFLQAQDSE

SEQ ID NO: 1824975 - protein, 24 aa, Staphylococcus epidermidis
VASKAFMTLINSDIPFYQTTTSEI

SEQ ID NO: 1824976 - protein, 19 aa, Staphylococcus epidermidis
VCNYLDDIYVIEKMLLRQE

SEQ ID NO: 1824977 - protein, 18 aa, Staphylococcus epidermidis
VDTFKRMLTHIDSTGYIN

SEQ ID NO: 1824978 - protein, 17 aa, Staphylococcus epidermidis
VEDGYGSIIRKLIKNNI

SEQ ID NO: 1824979 - protein, 26 aa, Staphylococcus epidermidis
VEDVITYFINYLFTGYEVLNTFTFRI

SEQ ID NO: 1824980 - protein, 17 aa, Staphylococcus epidermidis
VEKIIPSLQAGKIVLCD

SEQ ID NO: 1824981 - protein, 23 aa, Staphylococcus epidermidis
VEPERLRFDFSHFGPMTQEEINL

SEQ ID NO: 1824982 - protein, 25 aa, Staphylococcus epidermidis
VETLSPTYKLLMGVPGRSNAFDISK

SEQ ID NO: 1824983 - protein, 17 aa, Staphylococcus epidermidis
VEVAKIISLALNNYDND

SEQ ID NO: 1824984 - protein, 18 aa, Staphylococcus epidermidis
VEVGDVIIIMTYAQLNED

SEQ ID NO: 1824985 - protein, 19 aa, Staphylococcus epidermidis
VFGIMKPILSFTRKSVRGI

SEQ ID NO: 1824986 - protein, 27 aa, Staphylococcus epidermidis
VFLNSRTTIFPILGGGERLGTLVLGRV

SEQ ID NO: 1824987 - protein, 17 aa, Staphylococcus epidermidis
VFNGIGYIKRGGTKSIA

SEQ ID NO: 1824988 - protein, 19 aa, Staphylococcus epidermidis
VFNNIKRLNIETVKQDNTS

SEQ ID NO: 1824989 - protein, 19 aa, Staphylococcus epidermidis
VGPKGIIRRMVDTKRLSSM

SEQ ID NO: 1824990 - protein, 29 aa, Staphylococcus epidermidis
VGQHQIWTAQFYPFKNYGQWVTSGGLGTM

SEQ ID NO: 1824991 - protein, 25 aa, Staphylococcus epidermidis
VGQNNNPCIFFNTNNYYSLIEQFYD

SEQ ID NO: 1824992 - protein, 26 aa, Staphylococcus epidermidis
VGQPGDTLTFPAFVYSGDATVVPEGQ

SEQ ID NO: 1824993 - protein, 29 aa, Staphylococcus epidermidis
VHFESLIHFDLDMLYRMIDIINDTLVSIR

SEQ ID NO: 1824994 - protein, 23 aa, Staphylococcus epidermidis
VHVYYEDQLWKVKSKEARRASDT

SEQ ID NO: 1824995 - protein, 19 aa, Staphylococcus epidermidis
VIAGFDFTFGKFGKGNMTV

SEQ ID NO: 1824996 - protein, 19 aa, Staphylococcus epidermidis
VIELCKANHYTYGYRKITA

SEQ ID NO: 1824997 - protein, 17 aa, Staphylococcus epidermidis
VIFDEKKPVFVGQTGGY

SEQ ID NO: 1824998 - protein, 34 aa, Staphylococcus epidermidis
VIFNTLSTPFLAIYHLPTLKKGILFWQEQSQGYV

SEQ ID NO: 1824999 - protein, 27 aa, Staphylococcus epidermidis
VIGNPLLDKFMKDLIIQILAMVSEQER

SEQ ID NO: 1825000 - protein, 30 aa, Staphylococcus epidermidis
VIKRNMVKQLYLPVQFIQSTEWLINQGVDH

SEQ ID NO: 1825001 - protein, 17 aa, Staphylococcus epidermidis
VIMAFTKSYDRPYEELE

SEQ ID NO: 1825002 - protein, 23 aa, Staphylococcus epidermidis
VINKLNFYVSLGGPVTFKNAKQP

SEQ ID NO: 1825003 - protein, 17 aa, Staphylococcus epidermidis
VIQLKTKYNAAFLKSEF

SEQ ID NO: 1825004 - protein, 26 aa, Staphylococcus epidermidis
VISKLRVVVDLSLEPKLFLQICCIGA

SEQ ID NO: 1825005 - protein, 17 aa, Staphylococcus epidermidis
VIYLKAVFIHKSISRIQ

SEQ ID NO: 1825006 - protein, 30 aa, Staphylococcus epidermidis
VKNLGPLDDIMKMIPGMNKMKGLDKLNMSD

SEQ ID NO: 1825007 - protein, 26 aa, Staphylococcus epidermidis
VKSNYILKYVFANGISREIIYPLLKE

SEQ ID NO: 1825008 - protein, 23 aa, Staphylococcus epidermidis
VKSYYLHYFGLEESAYMDDYSLF

SEQ ID NO: 1825009 - protein, 28 aa, Staphylococcus epidermidis
VKYKDEIDLIYLDPPYPGTMNKYQEFYG

SEQ ID NO: 1825010 - protein, 18 aa, Staphylococcus epidermidis
VLDVEFIDPMKGLIGVTV

SEQ ID NO: 1825011 - protein, 25 aa, Staphylococcus epidermidis
VLEDDRRFFPPYDASPLASDQLLKE

SEQ ID NO: 1825012 - protein, 18 aa, Staphylococcus epidermidis
VLFKMHPFVRNKLNIPAI

SEQ ID NO: 1825013 - protein, 24 aa, Staphylococcus epidermidis
VLLPTHNWGNYKLVFSTRHGAHIN

SEQ ID NO: 1825014 - protein, 17 aa, Staphylococcus epidermidis
VLSLDLTTVLILNQLAN

SEQ ID NO: 1825015 - protein, 19 aa, Staphylococcus epidermidis
VLTMGFIDDLLYPDDQVRA

SEQ ID NO: 1825016 - protein, 24 aa, Staphylococcus epidermidis
VNHQCFDYILTNPPIRAGKDIVHR

SEQ ID NO: 1825017 - protein, 25 aa, Staphylococcus epidermidis
VNLDGIFVQIGLVPNTSWLQNAVEL

SEQ ID NO: 1825018 - protein, 19 aa, Staphylococcus epidermidis
VNLLVFIINQKLTAQDLNK

SEQ ID NO: 1825019 - protein, 20 aa, Staphylococcus epidermidis
VNRAGSMIGYFLNEGPVTNF

SEQ ID NO: 1825020 - protein, 19 aa, Staphylococcus epidermidis
VNSKYLIATTAAKRARELD

SEQ ID NO: 1825021 - protein, 19 aa, Staphylococcus epidermidis
VNSLFQYIQHKDGYKLKIL

SEQ ID NO: 1825022 - protein, 18 aa, Staphylococcus epidermidis
VNWMNYKIKYLKPINIDE

SEQ ID NO: 1825023 - protein, 23 aa, Staphylococcus epidermidis
VPEFDHYFAIGKQTARTILKFNT

SEQ ID NO: 1825024 - protein, 23 aa, Staphylococcus epidermidis
VPEGLVTLLKIQGLGSKKIAKLY

SEQ ID NO: 1825025 - protein, 19 aa, Staphylococcus epidermidis
VPFSFFNVVNHTPPMIAIA

SEQ ID NO: 1825026 - protein, 17 aa, Staphylococcus epidermidis
VPWISIYDENITKETKD

SEQ ID NO: 1825027 - protein, 38 aa, Staphylococcus epidermidis
VQEEPKNQGAWLFVYPYLKALVANKYDLSYHGRIQRAA

SEQ ID NO: 1825028 - protein, 20 aa, Staphylococcus epidermidis
VQVRHRDKYYFPGGKIDEGE

SEQ ID NO: 1825029 - protein, 25 aa, Staphylococcus epidermidis
VTIAPFGATILYYFTGHEGPDSCCI

SEQ ID NO: 1825030 - protein, 24 aa, Staphylococcus epidermidis
VTNQFIEHTLFFKNQNITVIDDTI

SEQ ID NO: 1825031 - protein, 23 aa, Staphylococcus epidermidis
VTPQGFFAIIKKPTYDKTQAKQV

SEQ ID NO: 1825032 - protein, 17 aa, Staphylococcus epidermidis
VVFIFQYGEEIMPGGSQ

SEQ ID NO: 1825033 - protein, 18 aa, Staphylococcus epidermidis
VVKSELFRNEEFELALKL

SEQ ID NO: 1825034 - protein, 29 aa, Staphylococcus epidermidis
VVNQWSYEALVKIFYRYGEEKFSKQIARR

SEQ ID NO: 1825035 - protein, 20 aa, Staphylococcus epidermidis
VVQEYWFIHDGKIEKIIGSF

SEQ ID NO: 1825036 - protein, 23 aa, Staphylococcus epidermidis
VYADGEKRYIIAPKGLQVGQTVE

SEQ ID NO: 1825037 - protein, 17 aa, Staphylococcus epidermidis
VYYEDQLWKVKSTEARR

SEQ ID NO: 1825038 - protein, 17 aa, Staphylococcus epidermidis
WAYDVKGIEPNKAEIIA

SEQ ID NO: 1825039 - protein, 19 aa, Staphylococcus epidermidis
WELGVVWKKDKRLSHATNK

SEQ ID NO: 1825040 - protein, 17 aa, Staphylococcus epidermidis
WFALMNHLVNISIDYVV

SEQ ID NO: 1825041 - protein, 18 aa, Staphylococcus epidermidis
WFIQGRIDFQIKLNGYRM

SEQ ID NO: 1825042 - protein, 18 aa, Staphylococcus epidermidis
WGGTFYPNAPKSGIRVRR

SEQ ID NO: 1825043 - protein, 26 aa, Staphylococcus epidermidis
WLDHEDIDYRWLDAYLAIRDDDQLNQ

SEQ ID NO: 1825044 - protein, 17 aa, Staphylococcus epidermidis
WNIAQRGYPTTFFSLET

SEQ ID NO: 1825045 - protein, 18 aa, Staphylococcus epidermidis
WNIIRPPFNVTRISEYAA

SEQ ID NO: 1825046 - protein, 30 aa, Staphylococcus epidermidis
WRKSAKYVGLIPRFSRIFLGDKEFNKKRYA

SEQ ID NO: 1825047 - protein, 18 aa, Staphylococcus epidermidis
YAPWYIVPADHKKTSRIE

SEQ ID NO: 1825048 - protein, 18 aa, Staphylococcus epidermidis
YCIPGPFDKRVAPSVAKN

SEQ ID NO: 1825049 - protein, 24 aa, Staphylococcus epidermidis
YDSDRYVPVLAIAIGKKAQDAHDS

SEQ ID NO: 1825050 - protein, 17 aa, Staphylococcus epidermidis
YEAAKLLLKLGANVKVN

SEQ ID NO: 1825051 - protein, 25 aa, Staphylococcus epidermidis
YEETGAIAKFIYYFAQYSIKMEHDE

SEQ ID NO: 1825052 - protein, 27 aa, Staphylococcus epidermidis
YFDINQVDIFIGRIPVLIRSSPVKYDK

SEQ ID NO: 1825053 - protein, 25 aa, Staphylococcus epidermidis
YFDNVSLYILAAQKKKKEILTETIP

SEQ ID NO: 1825054 - protein, 20 aa, Staphylococcus epidermidis
YFEGAQKYLSYLKSTIDVNF

SEQ ID NO: 1825055 - protein, 20 aa, Staphylococcus epidermidis
YFEGAQKYLSYLKSTVDVNF

SEQ ID NO: 1825056 - protein, 28 aa, Staphylococcus epidermidis
YFEYKHILLATGFYNQLLTQPLIKNLIQ

SEQ ID NO: 1825057 - protein, 17 aa, Staphylococcus epidermidis
YFGSGKYMDEGFYMNNS

SEQ ID NO: 1825058 - protein, 23 aa, Staphylococcus epidermidis
YFNHQFMELFPDQPLSNTPIKNI

SEQ ID NO: 1825059 - protein, 27 aa, Staphylococcus epidermidis
YGHFGRTDVLLPWEKLDKVNLLKDAVE

SEQ ID NO: 1825060 - protein, 17 aa, Staphylococcus epidermidis
YGSIIRKLIQNNINLIA

SEQ ID NO: 1825061 - protein, 28 aa, Staphylococcus epidermidis
YGYSFGTVRPMQIGLVYDALSSGKLDVA

SEQ ID NO: 1825062 - protein, 19 aa, Staphylococcus epidermidis
YHELVINKIIPEIKKDHDN

SEQ ID NO: 1825063 - protein, 17 aa, Staphylococcus epidermidis
YHENILEWIKIANEYKI

SEQ ID NO: 1825064 - protein, 17 aa, Staphylococcus epidermidis
YIIAPKGLQVGQTVESG

SEQ ID NO: 1825065 - protein, 22 aa, Staphylococcus epidermidis
YIKNIERYRRELKVREYELLEN

SEQ ID NO: 1825066 - protein, 19 aa, Staphylococcus epidermidis
YIQEGKWKSWGPYLLSGKD

SEQ ID NO: 1825067 - protein, 20 aa, Staphylococcus epidermidis
YKDRKIPCISKEAQLLFHSG

SEQ ID NO: 1825068 - protein, 25 aa, Staphylococcus epidermidis
YKMPKKMRRLALRSALSFKVQENSF

SEQ ID NO: 1825069 - protein, 23 aa, Staphylococcus epidermidis
YKSKDNGKIIKNHKWMTGNELKA

SEQ ID NO: 1825070 - protein, 22 aa, Staphylococcus epidermidis
YKYKNLIKEISPVDLTELMKST

SEQ ID NO: 1825071 - protein, 17 aa, Staphylococcus epidermidis
YLGEMLVSIPFEPDDPL

SEQ ID NO: 1825072 - protein, 17 aa, Staphylococcus epidermidis
YLKAVFIHKSISRIQSL

SEQ ID NO: 1825073 - protein, 19 aa, Staphylococcus epidermidis
YLLTLKKDYLAYYESLKND

SEQ ID NO: 1825074 - protein, 21 aa, Staphylococcus epidermidis
YNLARMNMLLHDVNFKAFQIE

SEQ ID NO: 1825075 - protein, 18 aa, Staphylococcus epidermidis
YNNYLFNENMFQMFKKGA

SEQ ID NO: 1825076 - protein, 18 aa, Staphylococcus epidermidis
YNNYLFNENMFQMFKKGC

SEQ ID NO: 1825077 - protein, 17 aa, Staphylococcus epidermidis
YNQFLMVSYINNHVNAL

SEQ ID NO: 1825078 - protein, 18 aa, Staphylococcus epidermidis
YNTLIEDGYFITSGIIEE

SEQ ID NO: 1825079 - protein, 17 aa, Staphylococcus epidermidis
YPYYASGGFIHYCEYPK

SEQ ID NO: 1825080 - protein, 26 aa, Staphylococcus epidermidis
YQGNKLMSWGRVPFIPFKNNPQEVSD

SEQ ID NO: 1825081 - protein, 25 aa, Staphylococcus epidermidis
YRIHKGFHMLRFEGINNINDIEHLK

SEQ ID NO: 1825082 - protein, 17 aa, Staphylococcus epidermidis
YRIVDNCVVSLLDRGWC

SEQ ID NO: 1825083 - protein, 17 aa, Staphylococcus epidermidis
YTIAHCGDYNYFSFKGM

SEQ ID NO: 1825084 - protein, 22 aa, Staphylococcus epidermidis
YTIQTLHHPIDKQNLLRARRTY

SEQ ID NO: 1825085 - protein, 18 aa, Staphylococcus epidermidis
YTNLKPWDRVQIARLPER

SEQ ID NO: 1825086 - protein, 17 aa, Staphylococcus epidermidis
YVFAGHFAPQQMKEALQ

SEQ ID NO: 1825087 - protein, 17 aa, Staphylococcus epidermidis
YVIPLAEDGFEVNSELE

SEQ ID NO: 1825088 - protein, 26 aa, Staphylococcus epidermidis
YVSNFEIREIRIIKSVLLKGKKSFNN

SEQ ID NO: 1825089 - protein, 25 aa, Staphylococcus epidermidis
YYDRPSEDWLWRDGFVKMDTLEVDV

SEQ ID NO: 1825090 - protein, 17 aa, Staphylococcus epidermidis
YYIVVGERRFRASKLAG

SEQ ID NO: 1825091 - protein, 23 aa, Staphylococcus epidermidis
YYYKVQTFIPKNYIEDFKDSLNE

SEQ ID NO: 1825092 - protein, 22 aa, Staphylococcus epidermidis
AAAKKYYRQFKGTNGSSGFLSG

SEQ ID NO: 1825093 - protein, 24 aa, Staphylococcus epidermidis
AAALFAASFLNKNISRLGSLATIS

SEQ ID NO: 1825094 - protein, 24 aa, Staphylococcus epidermidis
AADLKLTLMERYPDDWEVKIVTGA

SEQ ID NO: 1825095 - protein, 19 aa, Staphylococcus epidermidis
AADMKSGLAALAIALIEIK

SEQ ID NO: 1825096 - protein, 29 aa, Staphylococcus epidermidis
AAGRDVTIFFTFWGLNALKKAQTVNVKKK

SEQ ID NO: 1825097 - protein, 25 aa, Staphylococcus epidermidis
AAHKNVILLIGDLSFYHDMNGLLMA

SEQ ID NO: 1825098 - protein, 17 aa, Staphylococcus epidermidis
AAILAAYGLGWFKTIES

SEQ ID NO: 1825099 - protein, 21 aa, Staphylococcus epidermidis
AAILGMHSIITRPIAVDKDTI

SEQ ID NO: 1825100 - protein, 22 aa, Staphylococcus epidermidis
AAILGMHSIITRPIAVDKDTIE

SEQ ID NO: 1825101 - protein, 23 aa, Staphylococcus epidermidis
AAISAVIMLLDKGDHLILNSDVY

SEQ ID NO: 1825102 - protein, 24 aa, Staphylococcus epidermidis
AALVARLFHMKSYYRSIATMGIGG

SEQ ID NO: 1825103 - protein, 21 aa, Staphylococcus epidermidis
AAPFSFFNVVNHTPPMIAIAV

SEQ ID NO: 1825104 - protein, 23 aa, Staphylococcus epidermidis
AAPNAKILFVSPDNDHYLSSIKS

SEQ ID NO: 1825105 - protein, 23 aa, Staphylococcus epidermidis
AARRYQLKFFTPSSIGAFGISTP

SEQ ID NO: 1825106 - protein, 41 aa, Staphylococcus epidermidis
AAVDLKVILEYGESAPKIFRKVTDLVKEQVKYITGLEVVEV

SEQ ID NO: 1825107 - protein, 33 aa, Staphylococcus epidermidis
AAVPPLTHFVTNSTYFLWDVLTTAYVGKPKLVK

SEQ ID NO: 1825108 - protein, 19 aa, Staphylococcus epidermidis
ACDAVTLNFYNLNTQEYEA

SEQ ID NO: 1825109 - protein, 23 aa, Staphylococcus epidermidis
ACEYRRHFLSYHPDYAIMTNIDF

SEQ ID NO: 1825110 - protein, 18 aa, Staphylococcus epidermidis
ACFSFYPNKNITTGEGGV

SEQ ID NO: 1825111 - protein, 29 aa, Staphylococcus epidermidis
ACLLTAVPVMKFFKYFYSNRGPVIDYDNK

SEQ ID NO: 1825112 - protein, 27 aa, Staphylococcus epidermidis
ADAAWITTPLNVYYFTGYRSEPHERLF

SEQ ID NO: 1825113 - protein, 17 aa, Staphylococcus epidermidis
ADAFYQPKPGTDLVWLG

SEQ ID NO: 1825114 - protein, 23 aa, Staphylococcus epidermidis
ADAGLLYISYITNPTTGGVSASF

SEQ ID NO: 1825115 - protein, 24 aa, Staphylococcus epidermidis
ADAKPLPLKLSPPNYLPNWNTINA

SEQ ID NO: 1825116 - protein, 33 aa, Staphylococcus epidermidis
ADAMIREGMLKDVLPIAFPFTPNVDVAGKIEKV

SEQ ID NO: 1825117 - protein, 20 aa, Staphylococcus epidermidis
ADDELGERLGFISNSTGGVL

SEQ ID NO: 1825118 - protein, 25 aa, Staphylococcus epidermidis
ADDNYKWLQILPDKKRYSITVMFDN

SEQ ID NO: 1825119 - protein, 25 aa, Staphylococcus epidermidis
ADDNYKWLQILPEKKRYSITVMFDD

SEQ ID NO: 1825120 - protein, 24 aa, Staphylococcus epidermidis
ADDPLAFVRWHYDKKKRVIYAIDE

SEQ ID NO: 1825121 - protein, 24 aa, Staphylococcus epidermidis
ADELKNRRATLVNLQRIDKVSAKR

SEQ ID NO: 1825122 - protein, 25 aa, Staphylococcus epidermidis
ADGFNLMPPSLPYSLEDFVELIVPE

SEQ ID NO: 1825123 - protein, 31 aa, Staphylococcus epidermidis
ADGLHAGFKRKKLDFGWIVSEVPANVAGVFT

SEQ ID NO: 1825124 - protein, 23 aa, Staphylococcus epidermidis
ADGVKFDYLFAAIGGGGLISGIS

SEQ ID NO: 1825125 - protein, 18 aa, Staphylococcus epidermidis
ADHKPVVYCLDKIAKQYL

SEQ ID NO: 1825126 - protein, 31 aa, Staphylococcus epidermidis
ADIFDSLINENYLIWKGQKYVIKSTELKYEE

SEQ ID NO: 1825127 - protein, 25 aa, Staphylococcus epidermidis
ADIFGKCLHTYLIKDAIRDGNVLGF

SEQ ID NO: 1825128 - protein, 24 aa, Staphylococcus epidermidis
ADIHPIFGMTLILTDGLYKVETVV

SEQ ID NO: 1825129 - protein, 18 aa, Staphylococcus epidermidis
ADKRQYLGVDFLGTSYAA

SEQ ID NO: 1825130 - protein, 25 aa, Staphylococcus epidermidis
ADLGNITFPNFLKRDKLTISVSTDG

SEQ ID NO: 1825131 - protein, 21 aa, Staphylococcus epidermidis
ADLIVLGPGSLYTSVISNLCV

SEQ ID NO: 1825132 - protein, 27 aa, Staphylococcus epidermidis
ADLKVEGALAMILKDAIKPNLVQSIEG

SEQ ID NO: 1825133 - protein, 22 aa, Staphylococcus epidermidis
ADLNWFIPDFTKSVVFKINEDD

SEQ ID NO: 1825134 - protein, 18 aa, Staphylococcus epidermidis
ADMKSGLAALAIALIEIK

SEQ ID NO: 1825135 - protein, 23 aa, Staphylococcus epidermidis
ADNKRRVFVTQPIPPYDQGDMWT

SEQ ID NO: 1825136 - protein, 26 aa, Staphylococcus epidermidis
ADNRHLSYIEDVFRAFQSLYNAHYNQ

SEQ ID NO: 1825137 - protein, 26 aa, Staphylococcus epidermidis
ADRDLLQAQLYLLQHDELPFQQEDIV

SEQ ID NO: 1825138 - protein, 23 aa, Staphylococcus epidermidis
ADRFKEWFDHLPSNIVRSKGIVW

SEQ ID NO: 1825139 - protein, 20 aa, Staphylococcus epidermidis
ADRILHLIKVQMDNLTLPSC

SEQ ID NO: 1825140 - protein, 17 aa, Staphylococcus epidermidis
ADTVLFAVGVEPATEWL

SEQ ID NO: 1825141 - protein, 23 aa, Staphylococcus epidermidis
ADVDIRLFGGSNRPSRVSLNNIN

SEQ ID NO: 1825142 - protein, 25 aa, Staphylococcus epidermidis
ADVNRGTFYLHYEDKYMLLTDMEDE

SEQ ID NO: 1825143 - protein, 24 aa, Staphylococcus epidermidis
ADYNLKRQFNKAVKDAREALSKTK

SEQ ID NO: 1825144 - protein, 17 aa, Staphylococcus epidermidis
ADYQRVGFFYPEIAMYF

SEQ ID NO: 1825145 - protein, 25 aa, Staphylococcus epidermidis
AEADLLFQTALDNQNRWLGYYGFNV

SEQ ID NO: 1825146 - protein, 27 aa, Staphylococcus epidermidis
AEAGETIYFILRETPFYAVSGGQVADK

SEQ ID NO: 1825147 - protein, 22 aa, Staphylococcus epidermidis
AEDIPFFLEVLTYDDNIPDNKS

SEQ ID NO: 1825148 - protein, 23 aa, Staphylococcus epidermidis
AEDIPFFLEVLTYDDNIPDNSSV

SEQ ID NO: 1825149 - protein, 30 aa, Staphylococcus epidermidis; identical to SEQ ID NO: 1679733

SEQ ID NO: 1825150 - protein, 24 aa, Staphylococcus epidermidis
AEEYQCPVIILSDLQLSLGKQTVK

SEQ ID NO: 1825151 - protein, 29 aa, Staphylococcus epidermidis
AEFSKLLNVIETYLFQWNLYIHEVDEDEE

SEQ ID NO: 1825152 - protein, 25 aa, Staphylococcus epidermidis
AEFSLEYIAFFPSDKPKKVKDEIKK

SEQ ID NO: 1825153 - protein, 27 aa, Staphylococcus epidermidis
AEGFEGYFMMKRMNAPFILIADPRIEG

SEQ ID NO: 1825154 - protein, 20 aa, Staphylococcus epidermidis
AEGKIKHKVSHKFNIGYMYI

SEQ ID NO: 1825155 - protein, 19 aa, Staphylococcus epidermidis
AEGQRRYVESLSAYARQFL

SEQ ID NO: 1825156 - protein, 20 aa, Staphylococcus epidermidis
AEGQRRYVESLSAYARQFLG

SEQ ID NO: 1825157 - protein, 24 aa, Staphylococcus epidermidis
AEHGIDYCIVINFSSRFASVTSDD

SEQ ID NO: 1825158 - protein, 17 aa, Staphylococcus epidermidis
AEHGSNIWFEREAKDLL

SEQ ID NO: 1825159 - protein, 26 aa, Staphylococcus epidermidis
AEKAKSLACQFAFYGHTHIAKYENIG

SEQ ID NO: 1825160 - protein, 26 aa, Staphylococcus epidermidis
AEKNPLFAWDLNMGGLMNALEAARTY

SEQ ID NO: 1825161 - protein, 25 aa, Staphylococcus epidermidis
AEKPLKLFHPVHTYKMKFIKSFEAK

SEQ ID NO: 1825162 - protein, 24 aa, Staphylococcus epidermidis
AEKTEVTVFFLNGFQMKGVIEDFD

SEQ ID NO: 1825163 - protein, 17 aa, Staphylococcus epidermidis
AELGDNLFVLLCIANSL

SEQ ID NO: 1825164 - protein, 25 aa, Staphylococcus epidermidis
AELLGKRYMMWTDKQQIETTATVQF

SEQ ID NO: 1825165 - protein, 25 aa, Staphylococcus epidermidis
AELNIKLHLPIIIISGNHDGKERLN

SEQ ID NO: 1825166 - protein, 29 aa, Staphylococcus epidermidis
AENAQFEEIIFLLWNYRLPNEKELSELKE

SEQ ID NO: 1825167 - protein, 28 aa, Staphylococcus epidermidis
AENAQFEEIIFLLWNYRLPNKDELKELK

SEQ ID NO: 1825168 - protein, 21 aa, Staphylococcus epidermidis
AENCFLVSTPELDLAAKANGH

SEQ ID NO: 1825169 - protein, 36 aa, Staphylococcus epidermidis
AEQGTKLTFLPYVVKALVSALKKYPALNTSFNEEAG

SEQ ID NO: 1825170 - protein, 25 aa, Staphylococcus epidermidis
AEQQNIYYEVFPFGAQRIVLNRDEQ

SEQ ID NO: 1825171 - protein, 19 aa, Staphylococcus epidermidis
AERALSSHYDLLIAAGGDG

SEQ ID NO: 1825172 - protein, 26 aa, Staphylococcus epidermidis
AESFTRWLKLFLNEQLTYADGLAMRI

SEQ ID NO: 1825173 - protein, 19 aa, Staphylococcus epidermidis
AESGIGGLALGLAVTGYRP

SEQ ID NO: 1825174 - protein, 23 aa, Staphylococcus epidermidis
AESYLLHHSIEYDKIIRADIDRF

SEQ ID NO: 1825175 - protein, 35 aa, Staphylococcus epidermidis
AETFETNVYPVFWTVQKALEYLKPGASITTTSSVQ

SEQ ID NO: 1825176 - protein, 30 aa, Staphylococcus epidermidis
AETVINAHWFDGVFYIPNCDKITPGMILAA

SEQ ID NO: 1825177 - protein, 18 aa, Staphylococcus epidermidis
AEVKDYVFINSYDPRLFE

SEQ ID NO: 1825178 - protein, 23 aa, Staphylococcus epidermidis
AEVKDYVFINSYDPRLFEGFSMG

SEQ ID NO: 1825179 - protein, 24 aa, Staphylococcus epidermidis
AEVPALLGAYILEGSKAGATAVAV

SEQ ID NO: 1825180 - protein, 20 aa, Staphylococcus epidermidis
AEWNAFWDPEAVKTVFDSKI

SEQ ID NO: 1825181 - protein, 20 aa, Staphylococcus epidermidis
AEYEYIEMIPLLMNENDELD

SEQ ID NO: 1825182 - protein, 21 aa, Staphylococcus epidermidis
AEYFSAELFKRDIPNNLLIAQ

SEQ ID NO: 1825183 - protein, 25 aa, Staphylococcus epidermidis
AEYQRVGFFYPEIAMYFKNPKRILG

SEQ ID NO: 1825184 - protein, 24 aa, Staphylococcus epidermidis
AFAYKVLPDLFYPELISVGNNSVI

SEQ ID NO: 1825185 - protein, 27 aa, Staphylococcus epidermidis
AFDLYGGTFRLFDFYEKQYGLKFKYVD

SEQ ID NO: 1825186 - protein, 18 aa, Staphylococcus epidermidis
AFDRFKLNIFISLAELES

SEQ ID NO: 1825187 - protein, 19 aa, Staphylococcus epidermidis
AFEKAINYAFDILNMHKIY

SEQ ID NO: 1825188 - protein, 23 aa, Staphylococcus epidermidis
AFENGIFVFPTEVTPGTDALEAL

SEQ ID NO: 1825189 - protein, 20 aa, Staphylococcus epidermidis
AFEQFALAVGETFAKSGMLD

SEQ ID NO: 1825190 - protein, 27 aa, Staphylococcus epidermidis
AFGDQNKFFIEDIKLFPVATISTGNGN

SEQ ID NO: 1825191 - protein, 19 aa, Staphylococcus epidermidis
AFGMGPDRIAMLKYGIEDI

SEQ ID NO: 1825192 - protein, 21 aa, Staphylococcus epidermidis
AFGQLLPESLLNAPKLGAINV

SEQ ID NO: 1825193 - protein, 20 aa, Staphylococcus epidermidis
AFKDIPAYDLGATVIKHIVK

SEQ ID NO: 1825194 - protein, 23 aa, Staphylococcus epidermidis
AFKDIPAYELGATVIRQILEHSQ

SEQ ID NO: 1825195 - protein, 18 aa, Staphylococcus epidermidis
AFKHRKRPATSKPVLLGI

SEQ ID NO: 1825196 - protein, 42 aa, Staphylococcus epidermidis
AFKQNEGYNLTFFAFFVKAVADALKAHPLLNSTWQGEEIVIH

SEQ ID NO: 1825197 - protein, 32 aa, Staphylococcus epidermidis
AFKVMTDPYVGKLTFFRVYSGTLTSGSYVKNS

SEQ ID NO: 1825198 - protein, 22 aa, Staphylococcus epidermidis
AFKYPTSNILTYGYPRNDILSN

SEQ ID NO: 1825199 - protein, 18 aa, Staphylococcus epidermidis
AFLLLSMDMSGIQDFIYN

SEQ ID NO: 1825200 - protein, 18 aa, Staphylococcus epidermidis
AFNGFLHKNNIKGKDIFN

SEQ ID NO: 1825201 - protein, 17 aa, Staphylococcus epidermidis
AFNRFEEQFQQLSPKVE

SEQ ID NO: 1825202 - protein, 31 aa, Staphylococcus epidermidis
AFSKKRFDILKLTAFGAIPKDMLDLGPKYIA

SEQ ID NO: 1825203 - protein, 21 aa, Staphylococcus epidermidis
AFVGALYLDQGLETVWAFAEK

SEQ ID NO: 1825204 - protein, 19 aa, Staphylococcus epidermidis
AFVLPIEGSDLPSVIGWRT

SEQ ID NO: 1825205 - protein, 22 aa, Staphylococcus epidermidis
AFVPLSEMFGYATSLRSNTQGR

SEQ ID NO: 1825206 - protein, 19 aa, Staphylococcus epidermidis
AFYQDFDFAVQTIDLLVDD

SEQ ID NO: 1825207 - protein, 29 aa, Staphylococcus epidermidis
AFYQPKPGTDLVWLGAVTKYIIDNDLHDK

SEQ ID NO: 1825208 - protein, 18 aa, Staphylococcus epidermidis
AGAAYLNIFHSDVIELLN

SEQ ID NO: 1825209 - protein, 33 aa, Staphylococcus epidermidis
AGANAIYEFLTLRIPMLLIPLGLDQSRGDQIDN

SEQ ID NO: 1825210 - protein, 24 aa, Staphylococcus epidermidis
AGASIILLIVNILSDTELKELYDY

SEQ ID NO: 1825211 - protein, 25 aa, Staphylococcus epidermidis
AGDETAIPLLLGLGLDEFSMSATSI

SEQ ID NO: 1825212 - protein, 20 aa, Staphylococcus epidermidis
AGDTFIGAFVSRLERDLSNL

SEQ ID NO: 1825213 - protein, 23 aa, Staphylococcus epidermidis
AGELLCQYYFVKFGVDTRSVRFP

SEQ ID NO: 1825214 - protein, 33 aa, Staphylococcus epidermidis
AGFDYVVTGSGFLYNMVRVLVAFLIEVGKGKRN

SEQ ID NO: 1825215 - protein, 18 aa, Staphylococcus epidermidis
AGFHIHFASDERDYGGHV

SEQ ID NO: 1825216 - protein, 25 aa, Staphylococcus epidermidis
AGGILRIIYAWLKEGQKRSVEDLTR

SEQ ID NO: 1825217 - protein, 24 aa, Staphylococcus epidermidis
AGGMGTALIAFLNAELRPGIDVVL

SEQ ID NO: 1825218 - protein, 27 aa, Staphylococcus epidermidis
AGGMGTALIAFLNAKLRPGIDVVLEET

SEQ ID NO: 1825219 - protein, 23 aa, Staphylococcus epidermidis
AGGQWFTPVINHPEVAILGIGRI

SEQ ID NO: 1825220 - protein, 21 aa, Staphylococcus epidermidis
AGGYYTTLYVPDNVSETTYNT

SEQ ID NO: 1825221 - protein, 22 aa, Staphylococcus epidermidis
AGHALYLLNQLNDEGRLIAIDQ

SEQ ID NO: 1825222 - protein, 23 aa, Staphylococcus epidermidis
AGHDLCSYLYHKGHRHIIFINES

SEQ ID NO: 1825223 - protein, 23 aa, Staphylococcus epidermidis
AGHNQYLTLLDLTSQRQYSVKVS

SEQ ID NO: 1825224 - protein, 22 aa, Staphylococcus epidermidis
AGINHWFNSDTIYRAILNLVML

SEQ ID NO: 1825225 - protein, 21 aa, Staphylococcus epidermidis
AGKKLAIVPILRAGLGMTDGV

SEQ ID NO: 1825226 - protein, 24 aa, Staphylococcus epidermidis
AGKSTLIRMFNNLEAPTSGDVIID

SEQ ID NO: 1825227 - protein, 22 aa, Staphylococcus epidermidis
AGNIYACEALFRAGVRPDKIAH

SEQ ID NO: 1825228 - protein, 19 aa, Staphylococcus epidermidis
AGPVVACAVILNKDHHYLG

SEQ ID NO: 1825229 - protein, 23 aa, Staphylococcus epidermidis
AGQGLTFYQWWTNTYNDFEDYEG

SEQ ID NO: 1825230 - protein, 26 aa, Staphylococcus epidermidis
AGRDVTIFCTFWGLNALKKNQSQRIK

SEQ ID NO: 1825231 - protein, 26 aa, Staphylococcus epidermidis
AGRDVTIFCTFWGLNALKKTQSQRIK

SEQ ID NO: 1825232 - protein, 25 aa, Staphylococcus epidermidis
AGRTNKPILLKRGLSATIEEFIYAA

SEQ ID NO: 1825233 - protein, 22 aa, Staphylococcus epidermidis
AGRYGVNLRYPEGFKFEDAIER

SEQ ID NO: 1825234 - protein, 23 aa, Staphylococcus epidermidis
AGSCWYYLRYIDPDNEKMIADPE

SEQ ID NO: 1825235 - protein, 30 aa, Staphylococcus epidermidis
AGTLKITTIPTLFHKIVPKALSHFKNDYPQ

SEQ ID NO: 1825236 - protein, 26 aa, Staphylococcus epidermidis
AGVHDLPFICVIINNKYAISVPDSLQ

SEQ ID NO: 1825237 - protein, 26 aa, Staphylococcus epidermidis
AHAEDLFHLDLAYAPPFSTTKDPVIY

SEQ ID NO: 1825238 - protein, 19 aa, Staphylococcus epidermidis
AHALFLSTQARDKALHYQH

SEQ ID NO: 1825239 - protein, 17 aa, Staphylococcus epidermidis
AHANAMIMLPGGTRGFK

SEQ ID NO: 1825240 - protein, 25 aa, Staphylococcus epidermidis
AHATRIYFKDLFGKQFKRGRYNDVI

SEQ ID NO: 1825241 - protein, 24 aa, Staphylococcus epidermidis
AHAYLRKLKGYWWDFDGVYGAQCF

SEQ ID NO: 1825242 - protein, 22 aa, Staphylococcus epidermidis
AHFNPLVMLPERKESIYECGQS

SEQ ID NO: 1825243 - protein, 20 aa, Staphylococcus epidermidis
AHIAGLVAAGLHPNPLEYAD

SEQ ID NO: 1825244 - protein, 26 aa, Staphylococcus epidermidis
AHIHPIFGMTIYLTDGLYIIETVVLA

SEQ ID NO: 1825245 - protein, 35 aa, Staphylococcus epidermidis
AHKTMLSRVLLLRDKYYLYISGGSLHLFTRDFKSA

SEQ ID NO: 1825246 - protein, 18 aa, Staphylococcus epidermidis
AHLKDFYQKQFSIEAVVI

SEQ ID NO: 1825247 - protein, 17 aa, Staphylococcus epidermidis
AHLNYKVLVKVHPFIYE

SEQ ID NO: 1825248 - protein, 34 aa, Staphylococcus epidermidis
AHLRLNDIGFIFQASHLVPYLKVLDQLTLVGKEA

SEQ ID NO: 1825249 - protein, 32 aa, Staphylococcus epidermidis
AHLVENIRFATILLQPFLTHAPREIFKQLNIN

SEQ ID NO: 1825250 - protein, 23 aa, Staphylococcus epidermidis
AHLVSFIQKATRMGIPIVSHLGL

SEQ ID NO: 1825251 - protein, 30 aa, Staphylococcus epidermidis
AHNTSIANVVLAFYLTRPSLDVVIPGAKRA

SEQ ID NO: 1825252 - protein, 20 aa, Staphylococcus epidermidis
AHPTGRIIGRRKGYKANIEK

SEQ ID NO: 1825253 - protein, 24 aa, Staphylococcus epidermidis
AHPTGRIIGRRPGYEPNIEKLMQL

SEQ ID NO: 1825254 - protein, 24 aa, Staphylococcus epidermidis
AHQSNFILDKNFKTSLKADNFKIN

SEQ ID NO: 1825255 - protein, 24 aa, Staphylococcus epidermidis
AHQVVIRCFFVYFKMITKEEALAT

SEQ ID NO: 1825256 - protein, 25 aa, Staphylococcus epidermidis
AHQVVIRCFFVYFKMITKEEALATE

SEQ ID NO: 1825257 - protein, 25 aa, Staphylococcus epidermidis
AHQVVIRCFFVYFKMITKEEALSTE

SEQ ID NO: 1825258 - protein, 25 aa, Staphylococcus epidermidis
AHREPGVFGAAWLNKGLNTEMIVDG

SEQ ID NO: 1825259 - protein, 23 aa, Staphylococcus epidermidis
AHSFPFGVVTLKRQFFGDKDHND

SEQ ID NO: 1825260 - protein, 23 aa, Staphylococcus epidermidis
AHTNIALIKYWGKADEAYIIPMN

SEQ ID NO: 1825261 - protein, 23 aa, Staphylococcus epidermidis
AHTTWELGVVWKKDKRLSHATNK

SEQ ID NO: 1825262 - protein, 26 aa, Staphylococcus epidermidis
AHVAMIEAVRITLHNALTLVGVTAPE

SEQ ID NO: 1825263 - protein, 24 aa, Staphylococcus epidermidis
AHYLFEHDAIARKILIASQPGNPL

SEQ ID NO: 1825264 - protein, 29 aa, Staphylococcus epidermidis
AIDAYGAGSFIVATKIKGMIAAEVSDERS

SEQ ID NO: 1825265 - protein, 23 aa, Staphylococcus epidermidis
AIDWVIIGPEQPLIDGLSDLLRN

SEQ ID NO: 1825266 - protein, 26 aa, Staphylococcus epidermidis
AIEDARLYIIKQYANGLPLDNKAALV

SEQ ID NO: 1825267 - protein, 18 aa, Staphylococcus epidermidis
AIEILGLDKSDVAMVGDL

SEQ ID NO: 1825268 - protein, 26 aa, Staphylococcus epidermidis
AIEKQLVARGFTVKVPPEYLGGQNNK

SEQ ID NO: 1825269 - protein, 22 aa, Staphylococcus epidermidis
AIEKWNIIRPPFNVTRLSEYAA

SEQ ID NO: 1825270 - protein, 25 aa, Staphylococcus epidermidis
AIERIKEIVPIWKKEIWDDGAEWQG

SEQ ID NO: 1825271 - protein, 17 aa, Staphylococcus epidermidis
AIERLIKPELNHLVHEL

SEQ ID NO: 1825272 - protein, 21 aa, Staphylococcus epidermidis
AIEYTLVGPNIEFLTDNTFAI

SEQ ID NO: 1825273 - protein, 34 aa, Staphylococcus epidermidis
AIFNIDFEISFYRLLEFIELNFEFIKVLIMNMNN

SEQ ID NO: 1825274 - protein, 18 aa, Staphylococcus epidermidis
AIFSALSIRDSKVAPTIH

SEQ ID NO: 1825275 - protein, 25 aa, Staphylococcus epidermidis
AIGEHLTLTCYAYIPSSSKGKLTGN

SEQ ID NO: 1825276 - protein, 17 aa, Staphylococcus epidermidis
AIHQPPIILLDEPSSNL

SEQ ID NO: 1825277 - protein, 24 aa, Staphylococcus epidermidis
AIHTAKQFIGNEPFAVLLGDDIVE

SEQ ID NO: 1825278 - protein, 28 aa, Staphylococcus epidermidis
AIIPNNDKWVYDFLGMDATSPNDVIDAL

SEQ ID NO: 1825279 - protein, 27 aa, Staphylococcus epidermidis
AIIVIEWSKFIKDFLPPNHLTININVK

SEQ ID NO: 1825280 - protein, 27 aa, Staphylococcus epidermidis
AIKQGMILTPPPFYYDRVDNTYIPNDY

SEQ ID NO: 1825281 - protein, 18 aa, Staphylococcus epidermidis
AILAYYLFSPTELDSDDN

SEQ ID NO: 1825282 - protein, 19 aa, Staphylococcus epidermidis
AILDITGPLSDNIHFANSA

SEQ ID NO: 1825283 - protein, 18 aa, Staphylococcus epidermidis
AILKYKVFDLFSQKATPF

SEQ ID NO: 1825284 - protein, 25 aa, Staphylococcus epidermidis
AIMASFHFDVPCLFAKKAKPSTLKD

SEQ ID NO: 1825285 - protein, 18 aa, Staphylococcus epidermidis
AIMGRYVLTPEIFDYLET

SEQ ID NO: 1825286 - protein, 19 aa, Staphylococcus epidermidis
AINEKLYNFFGADQEITYF

SEQ ID NO: 1825287 - protein, 17 aa, Staphylococcus epidermidis
AINYMYSLKGKFVDFDN

SEQ ID NO: 1825288 - protein, 19 aa, Staphylococcus epidermidis
AIPENLVFYIYGSTLDGFM

SEQ ID NO: 1825289 - protein, 25 aa, Staphylococcus epidermidis
AIPQSEHFLPSQTNFIFVKTTNSKA

SEQ ID NO: 1825290 - protein, 26 aa, Staphylococcus epidermidis
AIQERRPVHLHLPIDVALAEIEVSET

SEQ ID NO: 1825291 - protein, 22 aa, Staphylococcus epidermidis
AISNLLLITGNYRKPGAGAYPL

SEQ ID NO: 1825292 - protein, 21 aa, Staphylococcus epidermidis
AISNLLLVTGNYRKPGAGAYP

SEQ ID NO: 1825293 - protein, 25 aa, Staphylococcus epidermidis
AITETLKGVAWFWHTTYSHTTEQGR

SEQ ID NO: 1825294 - protein, 33 aa, Staphylococcus epidermidis
AITVPQDRLKLRKQIRQLAAIYLATGIDSDKST

SEQ ID NO: 1825295 - protein, 18 aa, Staphylococcus epidermidis
AIYIYEKVIAGAGGLPVG

SEQ ID NO: 1825296 - protein, 20 aa, Staphylococcus epidermidis
AIYLMQYKYFYNKETNVYEI

SEQ ID NO: 1825297 - protein, 19 aa, Staphylococcus epidermidis
AIYLSRYEYSIYKNSLKNM

SEQ ID NO: 1825298 - protein, 32 aa, Staphylococcus epidermidis
AIYTHPINNFILNGITRRVIKWIAEDYNIPFK

SEQ ID NO: 1825299 - protein, 26 aa, Staphylococcus epidermidis
AKADKFIESLAHINQAQLAHALKEIA

SEQ ID NO: 1825300 - protein, 23 aa, Staphylococcus epidermidis
AKALGIQPIAVLDSFGASGVAPS

SEQ ID NO: 1825301 - protein, 18 aa, Staphylococcus epidermidis
AKALGVKPIAVLESFGTS

SEQ ID NO: 1825302 - protein, 29 aa, Staphylococcus epidermidis
AKAQSKKFFQLYTPLLKKGGIVVTDNVLY

SEQ ID NO: 1825303 - protein, 18 aa, Staphylococcus epidermidis
AKAYLKHVNPKVIAVTGS

SEQ ID NO: 1825304 - protein, 22 aa, Staphylococcus epidermidis
AKDALNGVKLLNADKQAAQQSL

SEQ ID NO: 1825305 - protein, 27 aa, Staphylococcus epidermidis
AKDPQKHTLFPKYDFFRADTDYADIAK

SEQ ID NO: 1825306 - protein, 25 aa, Staphylococcus epidermidis
AKESLTLYINAYRLAERYSNIATNC

SEQ ID NO: 1825307 - protein, 26 aa, Staphylococcus epidermidis
AKFDTYITPTQIPFRKIYDASDLMDG

SEQ ID NO: 1825308 - protein, 29 aa, Staphylococcus epidermidis
AKGKPEHIVKLKLTYKWINADNPQEVLEV

SEQ ID NO: 1825309 - protein, 22 aa, Staphylococcus epidermidis
AKGMLNEKIKWNFTKFLVDREG

SEQ ID NO: 1825310 - protein, 34 aa, Staphylococcus epidermidis
AKIAFYVAQWPSARLNHWLSLLKARAIENDMYVV

SEQ ID NO: 1825311 - protein, 17 aa, Staphylococcus epidermidis
AKKNILTRILSEEFNKL

SEQ ID NO: 1825312 - protein, 24 aa, Staphylococcus epidermidis
AKKQHIYYEVFPFESDRISLKEDE

SEQ ID NO: 1825313 - protein, 24 aa, Staphylococcus epidermidis
AKLNLFDYVAKIEHLPLGGVIYTD

SEQ ID NO: 1825314 - protein, 23 aa, Staphylococcus epidermidis
AKLNLGYRFPTYYGKQNYYAFVV

SEQ ID NO: 1825315 - protein, 29 aa, Staphylococcus epidermidis
AKLRYHKIGKGPVLILIPGANGTGDIYMP

SEQ ID NO: 1825316 - protein, 28 aa, Staphylococcus epidermidis
AKMRVAVRRLLKKYGYPPDLQKMAVEQV

SEQ ID NO: 1825317 - protein, 17 aa, Staphylococcus epidermidis
AKMSGQVILLLDEIHRL

SEQ ID NO: 1825318 - protein, 32 aa, Staphylococcus epidermidis
AKNTSTIIPMCHPLPLTGIDVSFKWGSNNDDS

SEQ ID NO: 1825319 - protein, 21 aa, Staphylococcus epidermidis
AKPILKKIQNNGFKAYFVGGS

SEQ ID NO: 1825320 - protein, 25 aa, Staphylococcus epidermidis
AKQTRWFPVIGQAVSASISYYFMSK

SEQ ID NO: 1825321 - protein, 28 aa, Staphylococcus epidermidis
AKREVQFDVIFLDPPYNKGLINEAISRI

SEQ ID NO: 1825322 - protein, 21 aa, Staphylococcus epidermidis
AKRRGLIILTAGTNVIRLLPP

SEQ ID NO: 1825323 - protein, 25 aa, Staphylococcus epidermidis
AKSKPELILASFRQAHTKTIDEMKK

SEQ ID NO: 1825324 - protein, 24 aa, Staphylococcus epidermidis
AKSLEMSRPLQRYYRDIRAGLHNP

SEQ ID NO: 1825325 - protein, 18 aa, Staphylococcus epidermidis
AKSLLPNDSIASRGLFAV

SEQ ID NO: 1825326 - protein, 23 aa, Staphylococcus epidermidis
AKSWMLKALEPMGEEYLNVVKEG

SEQ ID NO: 1825327 - protein, 23 aa, Staphylococcus epidermidis
AKTIHRTLRFDPVNFGFLHNEEN

SEQ ID NO: 1825328 - protein, 21 aa, Staphylococcus epidermidis
AKTIRIKLNSPGGNAFDGLEI

SEQ ID NO: 1825329 - protein, 18 aa, Staphylococcus epidermidis
AKTLLAYTKHIHVVSPTI

SEQ ID NO: 1825330 - protein, 24 aa, Staphylococcus epidermidis
AKVFFSSIGFENLAFEKNASKIDD

SEQ ID NO: 1825331 - protein, 20 aa, Staphylococcus epidermidis
AKWFLQDFQVLINGQRETRR

SEQ ID NO: 1825332 - protein, 27 aa, Staphylococcus epidermidis
AKWGERSGLTLFLPHSYEGQGAEHSSA

SEQ ID NO: 1825333 - protein, 19 aa, Staphylococcus epidermidis
AKYTKIRRPVELVYQEMYE

SEQ ID NO: 1825334 - protein, 20 aa, Staphylococcus epidermidis
AKYWQAYDFNSGYFMSLKLN

SEQ ID NO: 1825335 - protein, 21 aa, Staphylococcus epidermidis
ALAGSILKMNEGLKNLIQFTG

SEQ ID NO: 1825336 - protein, 30 aa, Staphylococcus epidermidis
ALAQGVKGLFIVPLNGFKKWLTPVEMWQSH

SEQ ID NO: 1825337 - protein, 21 aa, Staphylococcus epidermidis
ALDLIQFVAPIKTIITDIIYT

SEQ ID NO: 1825338 - protein, 23 aa, Staphylococcus epidermidis
ALDNFARVYAVLCPSWNIDHYNK

SEQ ID NO: 1825339 - protein, 24 aa, Staphylococcus epidermidis
ALDSLMGALKESIKDHSTVTGNGN

SEQ ID NO: 1825340 - protein, 19 aa, Staphylococcus epidermidis
ALDYMYNLGKRDGFSTHDV

SEQ ID NO: 1825341 - protein, 26 aa, Staphylococcus epidermidis
ALEAARTYHLQFFTPSSIGAFGASTP

SEQ ID NO: 1825342 - protein, 26 aa, Staphylococcus epidermidis
ALEHEDSKGYFFWETNQFVKLEPNTD

SEQ ID NO: 1825343 - protein, 44 aa, Staphylococcus epidermidis
ALEKEDFILPGYRDVPQIIWHGLPLTEAFLFSRGHFKGNQFPEG

SEQ ID NO: 1825344 - protein, 18 aa, Staphylococcus epidermidis
ALELFKPFVMKELVQREI

SEQ ID NO: 1825345 - protein, 20 aa, Staphylococcus epidermidis
ALGFGYRTGFLGMLHMEIIQ

SEQ ID NO: 1825346 - protein, 17 aa, Staphylococcus epidermidis
ALGKIPMNFNGIDSLSL

SEQ ID NO: 1825347 - protein, 27 aa, Staphylococcus epidermidis
ALHKDKIIGHILLSKIFIVKGEKSIES

SEQ ID NO: 1825348 - protein, 17 aa, Staphylococcus epidermidis
ALHYPRMFIDPYTMQLS

SEQ ID NO: 1825349 - protein, 26 aa, Staphylococcus epidermidis
ALISHPPQQFLALAAIGTIADLVSLT

SEQ ID NO: 1825350 - protein, 28 aa, Staphylococcus epidermidis
ALKDYNVPDFCQLIFITTPDKLETDNQK

SEQ ID NO: 1825351 - protein, 18 aa, Staphylococcus epidermidis
ALKYFLPTIGVLEFGHCY

SEQ ID NO: 1825352 - protein, 18 aa, Staphylococcus epidermidis
ALLIFDEVMTGFRVGYNC

SEQ ID NO: 1825353 - protein, 17 aa, Staphylococcus epidermidis
ALMKLTKQELDVFLMHK

SEQ ID NO: 1825354 - protein, 21 aa, Staphylococcus epidermidis
ALNFKFMKRINEAGIPIIFVI

SEQ ID NO: 1825355 - protein, 36 aa, Staphylococcus epidermidis
ALNPKYNGVYPGSTPRALLISAYKNVSVNNFTAIGD

SEQ ID NO: 1825356 - protein, 27 aa, Staphylococcus epidermidis
ALNSFKQPIIWLCGGLDRGNDFDELIP

SEQ ID NO: 1825357 - protein, 19 aa, Staphylococcus epidermidis
ALNTSTFEGLRKTVKEIKN

SEQ ID NO: 1825358 - protein, 25 aa, Staphylococcus epidermidis
ALPDDAIFHFIGSLQSRKVKDVINE

SEQ ID NO: 1825359 - protein, 24 aa, Staphylococcus epidermidis
ALQELPEHLAIIGGGVIGLEFASL

SEQ ID NO: 1825360 - protein, 24 aa, Staphylococcus epidermidis
ALQTLQLWEGWLKSWGLKDIHLDI

SEQ ID NO: 1825361 - protein, 28 aa, Staphylococcus epidermidis
ALQYDVDYVFFDYIHLNFQIMMDIASKT

SEQ ID NO: 1825362 - protein, 17 aa, Staphylococcus epidermidis
ALRCSQFVYKEQKNQKK

SEQ ID NO: 1825363 - protein, 19 aa, Staphylococcus epidermidis
ALREGLPLRSEYHEQYLKD

SEQ ID NO: 1825364 - protein, 26 aa, Staphylococcus epidermidis
ALRHKDIVFSPELISWIEQRSLDIHR

SEQ ID NO: 1825365 - protein, 20 aa, Staphylococcus epidermidis
ALRLMKQAEKFNRPIFTFID

SEQ ID NO: 1825366 - protein, 23 aa, Staphylococcus epidermidis
ALSTAKVIVIDTYYLMMGGYHKK

SEQ ID NO: 1825367 - protein, 25 aa, Staphylococcus epidermidis
ALVKALQAWDIDHLYGIPGDSIDAV

SEQ ID NO: 1825368 - protein, 19 aa, Staphylococcus epidermidis
ALVYDLNIATPKTTGRKNT

SEQ ID NO: 1825369 - protein, 17 aa, Staphylococcus epidermidis
ALYPQYNGAYEGATPRA

SEQ ID NO: 1825370 - protein, 27 aa, Staphylococcus epidermidis
AMAQEGHDFFGLLYIGAILTKDGPKVI

SEQ ID NO: 1825371 - protein, 18 aa, Staphylococcus epidermidis
AMEQLKQSIADKNKTLNS

SEQ ID NO: 1825372 - protein, 22 aa, Staphylococcus epidermidis
AMGRLFVTLVGAMAEWERETIR

SEQ ID NO: 1825373 - protein, 19 aa, Staphylococcus epidermidis
AMIAGYFSKAGNSGQIPVD

SEQ ID NO: 1825374 - protein, 25 aa, Staphylococcus epidermidis
AMITFRLLKHYDDLPSMLNIYGKNL

SEQ ID NO: 1825375 - protein, 28 aa, Staphylococcus epidermidis
AMNRILENLGVQLLPNTKIKQLIGDDNE

SEQ ID NO: 1825376 - protein, 20 aa, Staphylococcus epidermidis
AMRYGNGIKSLFNYPSQKTD

SEQ ID NO: 1825377 - protein, 30 aa, Staphylococcus epidermidis
ANALETLRRYCFDRAFIGMNGIDLKYGFTT

SEQ ID NO: 1825378 - protein, 24 aa, Staphylococcus epidermidis
ANDEHLLRLLYYNPIDENGNYIEF

SEQ ID NO: 1825379 - protein, 22 aa, Staphylococcus epidermidis
ANDIAWWSIIDQYPILMREESS

SEQ ID NO: 1825380 - protein, 22 aa, Staphylococcus epidermidis
ANDLNNAKALNEAMRQLESEVN

SEQ ID NO: 1825381 - protein, 18 aa, Staphylococcus epidermidis
ANEFFTVEKWTINHKMQW

SEQ ID NO: 1825382 - protein, 24 aa, Staphylococcus epidermidis
ANEKYDLFVLVVTDIINSDSKILV

SEQ ID NO: 1825383 - protein, 21 aa, Staphylococcus epidermidis
ANEYKGELIFLHKVKDGAVDD

SEQ ID NO: 1825384 - protein, 25 aa, Staphylococcus epidermidis
ANFEMTLPFPPHKLINYILELNHTS

SEQ ID NO: 1825385 - protein, 17 aa, Staphylococcus epidermidis
ANGFVCYMIGRLILENC

SEQ ID NO: 1825386 - protein, 22 aa, Staphylococcus epidermidis
ANHEHFVFVIPVNASLDMKQAA

SEQ ID NO: 1825387 - protein, 25 aa, Staphylococcus epidermidis
ANHIIEAFGMKPYIKKKVNKYSMGM

SEQ ID NO: 1825388 - protein, 24 aa, Staphylococcus epidermidis
ANHYDLPVFITNYPTRIKPFYMQP

SEQ ID NO: 1825389 - protein, 23 aa, Staphylococcus epidermidis
ANKVLQFYVRYGGEFQLKQGFSP

SEQ ID NO: 1825390 - protein, 18 aa, Staphylococcus epidermidis
ANLDLNITKARAQVVKAL

SEQ ID NO: 1825391 - protein, 23 aa, Staphylococcus epidermidis
ANMTFALSFQHHTMRNDRAPLYH

SEQ ID NO: 1825392 - protein, 33 aa, Staphylococcus epidermidis; identical to SEQ ID NO: 1687647

SEQ ID NO: 1825393 - protein, 29 aa, Staphylococcus epidermidis
ANNESDEEIILFKGFFARFEFKQINKRMR

SEQ ID NO: 1825394 - protein, 20 aa, Staphylococcus epidermidis
ANNHLLPYFKSMDVFNMTTQ

SEQ ID NO: 1825395 - protein, 21 aa, Staphylococcus epidermidis
ANTVAFLASDKAKYITGQTIH

SEQ ID NO: 1825396 - protein, 22 aa, Staphylococcus epidermidis
ANYYRPDMPNTDPLFIGAIVDE

SEQ ID NO: 1825397 - protein, 24 aa, Staphylococcus epidermidis
APDFPIIIEENFTFYNVDLEDGLM

SEQ ID NO: 1825398 - protein, 18 aa, Staphylococcus epidermidis
APDTFIVVDMPIGTVGLS

SEQ ID NO: 1825399 - protein, 20 aa, Staphylococcus epidermidis
APENMEVLIGWTGSPASSPH

SEQ ID NO: 1825400 - protein, 18 aa, Staphylococcus epidermidis
APGMKYKHYSPDTPLTII

SEQ ID NO: 1825401 - protein, 22 aa, Staphylococcus epidermidis
APHEALLCLDATTGQNALSQAR

SEQ ID NO: 1825402 - protein, 18 aa, Staphylococcus epidermidis
APIIKELGFIFNNLNINK

SEQ ID NO: 1825403 - protein, 32 aa, Staphylococcus epidermidis
APKIFQKLNIEWVFRLLIDWKRIGRMVSIPKF

SEQ ID NO: 1825404 - protein, 19 aa, Staphylococcus epidermidis
APPAELIPQFDYVKEISQQ

SEQ ID NO: 1825405 - protein, 26 aa, Staphylococcus epidermidis
APSFEYVYPYMLQFIDQLPVVAHNAA

SEQ ID NO: 1825406 - protein, 25 aa, Staphylococcus epidermidis
APYSHFKVGAYLRTKDGRTFHGANV

SEQ ID NO: 1825407 - protein, 26 aa, Staphylococcus epidermidis
AQCMDLVIDYCLWISDNQFRIRGNAK

SEQ ID NO: 1825408 - protein, 21 aa, Staphylococcus epidermidis
AQDVANVALFLASDLASYIHG

SEQ ID NO: 1825409 - protein, 25 aa, Staphylococcus epidermidis
AQEHYQMTIVFITHDINLVKDYATH

SEQ ID NO: 1825410 - protein, 19 aa, Staphylococcus epidermidis
AQELFPNKFTDGQKPRHLY

SEQ ID NO: 1825411 - protein, 18 aa, Staphylococcus epidermidis
AQGGTLIYPSWKDGMDPI

SEQ ID NO: 1825412 - protein, 24 aa, Staphylococcus epidermidis
AQGYEAIFVLCDTDYFENLDYKDA

SEQ ID NO: 1825413 - protein, 20 aa, Staphylococcus epidermidis
AQHALDLLGLATLSLLDTFS

SEQ ID NO: 1825414 - protein, 24 aa, Staphylococcus epidermidis
AQHDIDYCIVINFSSRFANVTSEA

SEQ ID NO: 1825415 - protein, 22 aa, Staphylococcus epidermidis
AQILEIENLLDRKPKALSGGQR

SEQ ID NO: 1825416 - protein, 17 aa, Staphylococcus epidermidis
AQILSKYPHLEIKWIRG

SEQ ID NO: 1825417 - protein, 25 aa, Staphylococcus epidermidis
AQLNLFEFVSQIEGLPLGGIIYTDI

SEQ ID NO: 1825418 - protein, 24 aa, Staphylococcus epidermidis
AQNAIPWAKILKVKKATKAVGGIQ

SEQ ID NO: 1825419 - protein, 24 aa, Staphylococcus epidermidis
AQQQFTNQIATMKKLGTTGQQVMT

SEQ ID NO: 1825420 - protein, 21 aa, Staphylococcus epidermidis
AQRVAFIMSLIRQPECLVVDE

SEQ ID NO: 1825421 - protein, 24 aa, Staphylococcus epidermidis
AQTYNFKHAIIATGSRPIEIPNFE

SEQ ID NO: 1825422 - protein, 27 aa, Staphylococcus epidermidis
AQWPNSRLDHWLSLLKARAIENDIFIV

SEQ ID NO: 1825423 - protein, 28 aa, Staphylococcus epidermidis
AQYSFLKLMNYMFKDEPYKYIATGQLEQ

SEQ ID NO: 1825424 - protein, 19 aa, Staphylococcus epidermidis
AREALPKVIAAQRALTHIR

SEQ ID NO: 1825425 - protein, 25 aa, Staphylococcus epidermidis
AREHHIPVVFMRVALEKNFADVSPN

SEQ ID NO: 1825426 - protein, 26 aa, Staphylococcus epidermidis
AREYYYEYKKFGILPEKEYAINKVKK

SEQ ID NO: 1825427 - protein, 27 aa, Staphylococcus epidermidis
ARFHRHPLPIPKFKYFKLKSTRKQNLL

SEQ ID NO: 1825428 - protein, 25 aa, Staphylococcus epidermidis
ARFKVPDEIYFVDKLPYSNIGKIDK

SEQ ID NO: 1825429 - protein, 22 aa, Staphylococcus epidermidis
ARGFIIGCPVAYSMGIGFAPVR

SEQ ID NO: 1825430 - protein, 20 aa, Staphylococcus epidermidis
ARGLGSSASALVGALFIANY

SEQ ID NO: 1825431 - protein, 18 aa, Staphylococcus epidermidis
ARGLGSSASALVGALYIA

SEQ ID NO: 1825432 - protein, 17 aa, Staphylococcus epidermidis
ARKYFRKLIDKVNDDSD

SEQ ID NO: 1825433 - protein, 20 aa, Staphylococcus epidermidis
ARLFVVRYPEFANGLILTGT

SEQ ID NO: 1825434 - protein, 24 aa, Staphylococcus epidermidis
ARLTNFGAFINIGGVDGLVHVSEL

SEQ ID NO: 1825435 - protein, 17 aa, Staphylococcus epidermidis
ARNFYLKLGYSPFGKVF

SEQ ID NO: 1825436 - protein, 23 aa, Staphylococcus epidermidis
ARNIARGLGLYKTGKGVSGIDIE

SEQ ID NO: 1825437 - protein, 41 aa, Staphylococcus epidermidis
ARNIYFEKALKVLRPIYLEQSPVPTFYIVNVGGGYLDGDRY

SEQ ID NO: 1825438 - protein, 24 aa, Staphylococcus epidermidis
ARRGELVSCFLLEIDDSLNSINFI

SEQ ID NO: 1825439 - protein, 30 aa, Staphylococcus epidermidis
ARRGKSWKDLNTQLDFIWKELNTTEVNALR

SEQ ID NO: 1825440 - protein, 27 aa, Staphylococcus epidermidis
ARRRESIFMTYILKHHPRFKDKDVPVW

SEQ ID NO: 1825441 - protein, 24 aa, Staphylococcus epidermidis
ARRRKARGLKLNHPEALALISDEL

SEQ ID NO: 1825442 - protein, 23 aa, Staphylococcus epidermidis
ARTLDLCLDVLVLPSGEYELVDE

SEQ ID NO: 1825443 - protein, 20 aa, Staphylococcus epidermidis
ARTVMHFHPALAPYKAAVLP

SEQ ID NO: 1825444 - protein, 17 aa, Staphylococcus epidermidis
ARVFANLDLNITKARAQ

SEQ ID NO: 1825445 - protein, 24 aa, Staphylococcus epidermidis
ARYELQEFPEHLATYLMNYSLSEI

SEQ ID NO: 1825446 - protein, 22 aa, Staphylococcus epidermidis
ARYVLNKIPCTKNLKLKRLWAN

SEQ ID NO: 1825447 - protein, 24 aa, Staphylococcus epidermidis
ASAPKNMLLSLILNSDLVSPKDLE

SEQ ID NO: 1825448 - protein, 25 aa, Staphylococcus epidermidis
ASAPKNMLLSLILNSDLVSPKDLEE

SEQ ID NO: 1825449 - protein, 31 aa, Staphylococcus epidermidis
ASAWRPEVIKALKMNGLPASSAYVNAWIRQI

SEQ ID NO: 1825450 - protein, 26 aa, Staphylococcus epidermidis
ASAYGKLNIMFPMVATIKEFRDAKAI

SEQ ID NO: 1825451 - protein, 18 aa, Staphylococcus epidermidis
ASAYYIWNKDEVYYLSSG

SEQ ID NO: 1825452 - protein, 29 aa, Staphylococcus epidermidis
ASDDTTLPAFWFDPIINLTAIAQVTSHVG

SEQ ID NO: 1825453 - protein, 22 aa, Staphylococcus epidermidis
ASEFEIPKTWKLIAQMPFGDVR

SEQ ID NO: 1825454 - protein, 25 aa, Staphylococcus epidermidis
ASEIAERTVYLRKANKYNKLANNLE

SEQ ID NO: 1825455 - protein, 35 aa, Staphylococcus epidermidis
ASFSWYEYSPLRVKYPYIRGKLLDLWTEALEENNG

SEQ ID NO: 1825456 - protein, 34 aa, Staphylococcus epidermidis
ASFSWYEYSPLRVKYPYIRGKLLDLWTEALEEQN

SEQ ID NO: 1825457 - protein, 18 aa, Staphylococcus epidermidis
ASHSIVYYGMKKFAHEFE

SEQ ID NO: 1825458 - protein, 28 aa, Staphylococcus epidermidis
ASILKAKRIILLAFGPKKKEAISKLLNE

SEQ ID NO: 1825459 - protein, 23 aa, Staphylococcus epidermidis
ASKTYDLEVWLPSYNDYKEISSC

SEQ ID NO: 1825460 - protein, 27 aa, Staphylococcus epidermidis
ASLIFLDSVVLPLMDAFHISEKTMQEN

SEQ ID NO: 1825461 - protein, 19 aa, Staphylococcus epidermidis
ASLIRFPESALRPLGRTAA

SEQ ID NO: 1825462 - protein, 25 aa, Staphylococcus epidermidis
ASNFAPISNVIYFKVAKTESLEQLF

SEQ ID NO: 1825463 - protein, 17 aa, Staphylococcus epidermidis
ASPINAHFSPEPSYMPG

SEQ ID NO: 1825464 - protein, 25 aa, Staphylococcus epidermidis
ASQAQPIIYHIYSPHTKTMQSVLEG

SEQ ID NO: 1825465 - protein, 24 aa, Staphylococcus epidermidis
ASQIIQYLGFVLNSEIEINNYSFI

SEQ ID NO: 1825466 - protein, 31 aa, Staphylococcus epidermidis
ASQKPMFENIRYIGIYNPRFNQIYKYDMTQS

SEQ ID NO: 1825467 - protein, 17 aa, Staphylococcus epidermidis
ASQMYYHELNMSTPVVN

SEQ ID NO: 1825468 - protein, 32 aa, Staphylococcus epidermidis
ASRLTMIYVDTGAMYRAITYKYLQNGKPENFD

SEQ ID NO: 1825469 - protein, 29 aa, Staphylococcus epidermidis
ASRTLMFNIYDLKWDDELLELLDIPKQML

SEQ ID NO: 1825470 - protein, 22 aa, Staphylococcus epidermidis
ASSAYVNAWIRQIQSESGGNAG

SEQ ID NO: 1825471 - protein, 18 aa, Staphylococcus epidermidis
ASTHLILLMIETGGRFSD

SEQ ID NO: 1825472 - protein, 18 aa, Staphylococcus epidermidis
ASTIANYIRRDIYEVTRL

SEQ ID NO: 1825473 - protein, 18 aa, Staphylococcus epidermidis
ASVGIIIELLKKLKEENT

SEQ ID NO: 1825474 - protein, 17 aa, Staphylococcus epidermidis
ASVILNNLYKQTPLQTS

SEQ ID NO: 1825475 - protein, 33 aa, Staphylococcus epidermidis
ASVLHTYLFVRLKYYLIDIFRKESYRMEMMGST

SEQ ID NO: 1825476 - protein, 20 aa, Staphylococcus epidermidis
ASYAERVIFIKDGRLYHEIY

SEQ ID NO: 1825477 - protein, 24 aa, Staphylococcus epidermidis
ASYLFSYLAFMNIIKKRIMNYSKV

SEQ ID NO: 1825478 - protein, 24 aa, Staphylococcus epidermidis
ASYRIDGFSEIDYMISDYAKPQNM

SEQ ID NO: 1825479 - protein, 27 aa, Staphylococcus epidermidis
ASYRIHKGFHMLKFEGINNINDIEHLK

SEQ ID NO: 1825480 - protein, 21 aa, Staphylococcus epidermidis
ASYTLHRRVYVSKLNKAKLYR

SEQ ID NO: 1825481 - protein, 24 aa, Staphylococcus epidermidis
ATADLTIGLILSVARRIVEGDELS

SEQ ID NO: 1825482 - protein, 23 aa, Staphylococcus epidermidis
ATADLTIGLILSVARRIVEGDHL

SEQ ID NO: 1825483 - protein, 26 aa, Staphylococcus epidermidis
ATDFNRPGHLFPLIAKDNGVLERNGH

SEQ ID NO: 1825484 - protein, 26 aa, Staphylococcus epidermidis
ATDLMKIANDIRWLASGPRAGLAEIS

SEQ ID NO: 1825485 - protein, 26 aa, Staphylococcus epidermidis
ATDLQQPITPLLFMTEGPSFVTDTIY

SEQ ID NO: 1825486 - protein, 27 aa, Staphylococcus epidermidis
ATDLQQPITPLLFMTNGPSFVTDTIYP

SEQ ID NO: 1825487 - protein, 25 aa, Staphylococcus epidermidis
ATEHSIAMILAMARNIPQAHQSLRN

SEQ ID NO: 1825488 - protein, 17 aa, Staphylococcus epidermidis
ATFFIKMNQKTVPEFKN

SEQ ID NO: 1825489 - protein, 26 aa, Staphylococcus epidermidis
ATGIRIGFLIGPEYLIEKLTFMHAYN

SEQ ID NO: 1825490 - protein, 31 aa, Staphylococcus epidermidis
ATGVVNLVNFYYPKLTFKSSILQLIKDNNVT

SEQ ID NO: 1825491 - protein, 22 aa, Staphylococcus epidermidis
ATGYINHLLQLIGPSISQQQAY

SEQ ID NO: 1825492 - protein, 27 aa, Staphylococcus epidermidis
ATITFQNLFKLFDKFAGMTGTGKQGEK

SEQ ID NO: 1825493 - protein, 18 aa, Staphylococcus epidermidis
ATLLRKGKDALLKNGRRL

SEQ ID NO: 1825494 - protein, 26 aa, Staphylococcus epidermidis
ATLSPLDSYLLQRGLKTLHLRIDRSQ

SEQ ID NO: 1825495 - protein, 27 aa, Staphylococcus epidermidis
ATLSPLDSYLLQRGLKTLHLRIERSQE

SEQ ID NO: 1825496 - protein, 24 aa, Staphylococcus epidermidis
ATLSRQLSLFFKYELNHLLENYQI

SEQ ID NO: 1825497 - protein, 22 aa, Staphylococcus epidermidis
ATLTPDAYSQKGAISLNTRLDS

SEQ ID NO: 1825498 - protein, 32 aa, Staphylococcus epidermidis
ATPDMMGEVGKLGRVLGPKGLMPNPKTGTVTM

SEQ ID NO: 1825499 - protein, 18 aa, Staphylococcus epidermidis
ATQFALNSFKQPIIWLCG

SEQ ID NO: 1825500 - protein, 27 aa, Staphylococcus epidermidis
ATQFWQKAVYKLIYDNELLIIQNDTED

SEQ ID NO: 1825501 - protein, 20 aa, Staphylococcus epidermidis
ATQKYNIIKPFILGNQSLSS

SEQ ID NO: 1825502 - protein, 21 aa, Staphylococcus epidermidis
ATQKYNIIKPFILGNQSLSSI

SEQ ID NO: 1825503 - protein, 27 aa, Staphylococcus epidermidis
ATQQQKLFFKLLFYSGARKGEIRALTW

SEQ ID NO: 1825504 - protein, 35 aa, Staphylococcus epidermidis
ATQSLKWAVEEMEKRYKLFAQYHVRNITAFNKKAP

SEQ ID NO: 1825505 - protein, 27 aa, Staphylococcus epidermidis
ATRILTERGILLVPDVLASAGGVTVSY

SEQ ID NO: 1825506 - protein, 25 aa, Staphylococcus epidermidis
ATSNRSWLLGVGANSTASGSRSGIM

SEQ ID NO: 1825507 - protein, 17 aa, Staphylococcus epidermidis
ATTEKIVFVNHLGKIIA

SEQ ID NO: 1825508 - protein, 24 aa, Staphylococcus epidermidis
ATTELAYTIAHRGNYNYFSFKGMR

SEQ ID NO: 1825509 - protein, 17 aa, Staphylococcus epidermidis
AVDLVVELPLIGSLSSS

SEQ ID NO: 1825510 - protein, 33 aa, Staphylococcus epidermidis
AVDMRGTFLVTKFLLPLMMKQGGSIINTASFSG

SEQ ID NO: 1825511 - protein, 22 aa, Staphylococcus epidermidis
AVDRACYLLETYASGTVLSDRV

SEQ ID NO: 1825512 - protein, 24 aa, Staphylococcus epidermidis
AVDRELPYHLAIKKLKQLDEDFGV

SEQ ID NO: 1825513 - protein, 26 aa, Staphylococcus epidermidis
AVDYIKKPFDPMELYYRVALHLNNDK

SEQ ID NO: 1825514 - protein, 29 aa, Staphylococcus epidermidis
AVFYHVGNALKYLLRAPRKNGLEDLKKAK

SEQ ID NO: 1825515 - protein, 34 aa, Staphylococcus epidermidis
AVGTVLTYGAEWAYKNNWLGIKTGTDWVGRNVLD

SEQ ID NO: 1825516 - protein, 18 aa, Staphylococcus epidermidis
AVHLETDVLFKYVENIMN

SEQ ID NO: 1825517 - protein, 19 aa, Staphylococcus epidermidis
AVIEMWAENYDWFPGDLTS

SEQ ID NO: 1825518 - protein, 21 aa, Staphylococcus epidermidis
AVINPFGTFIAKSVIYPHPPK

SEQ ID NO: 1825519 - protein, 28 aa, Staphylococcus epidermidis
AVISGKEYFYVPSVHKGGFTGGATGSAA

SEQ ID NO: 1825520 - protein, 17 aa, Staphylococcus epidermidis
AVLPVLTASLLASEGQS

SEQ ID NO: 1825521 - protein, 18 aa, Staphylococcus epidermidis
AVMIGILYQFIVANEILG

SEQ ID NO: 1825522 - protein, 21 aa, Staphylococcus epidermidis
AVMIGILYQFIVANHLFESNY

SEQ ID NO: 1825523 - protein, 24 aa, Staphylococcus epidermidis
AVNRYNMTIIFVTHDLNLVRTYAT

SEQ ID NO: 1825524 - protein, 18 aa, Staphylococcus epidermidis
AVQRADYLVEELVEFLWS

SEQ ID NO: 1825525 - protein, 29 aa, Staphylococcus epidermidis
AVRAGHHCAQPLMKWLNVSSTARASFYVY

SEQ ID NO: 1825526 - protein, 19 aa, Staphylococcus epidermidis
AVRRNPYSVILLDEVEKAH

SEQ ID NO: 1825527 - protein, 21 aa, Staphylococcus epidermidis
AVSVYSGWLAYSTFDHEWVKQ

SEQ ID NO: 1825528 - protein, 24 aa, Staphylococcus epidermidis
AVTQIGIPGILKPVGASGSKGIFK

SEQ ID NO: 1825529 - protein, 27 aa, Staphylococcus epidermidis
AWCALDTLMFPALIGRTVHIASPCHGT

SEQ ID NO: 1825530 - protein, 17 aa, Staphylococcus epidermidis
AWDRYYLENVSEDCLKT

SEQ ID NO: 1825531 - protein, 18 aa, Staphylococcus epidermidis
AWGCDLSYDYVKINALYT

SEQ ID NO: 1825532 - protein, 31 aa, Staphylococcus epidermidis
AWSNAKSVYKGFKTWLSNTLSWIRSVGKDMG

SEQ ID NO: 1825533 - protein, 29 aa, Staphylococcus epidermidis
AYAAENNITFVPYFPLASGILAGKYDEDQ

SEQ ID NO: 1825534 - protein, 19 aa, Staphylococcus epidermidis
AYAFIKRLIKQFGKPQKVI

SEQ ID NO: 1825535 - protein, 18 aa, Staphylococcus epidermidis
AYAHDRGLKSLYYTRNKL

SEQ ID NO: 1825536 - protein, 21 aa, Staphylococcus epidermidis
AYATEIGVLLKSIKIARKELK

SEQ ID NO: 1825537 - protein, 30 aa, Staphylococcus epidermidis
AYDNLTIKTLMRLIKDIYMQLTRNPSMLIK

SEQ ID NO: 1825538 - protein, 23 aa, Staphylococcus epidermidis
AYEHYDIIPDIITLAKGLGNGIP

SEQ ID NO: 1825539 - protein, 25 aa, Staphylococcus epidermidis
AYENGIYRQLNLKRMVRPVKNIRNL

SEQ ID NO: 1825540 - protein, 17 aa, Staphylococcus epidermidis
AYGFKFLGPVTVFSFLE

SEQ ID NO: 1825541 - protein, 21 aa, Staphylococcus epidermidis
AYGINLRPLLTLAEKYYDGEN

SEQ ID NO: 1825542 - protein, 24 aa, Staphylococcus epidermidis
AYIESHLLSLPGWAGMMYYRAEKN

SEQ ID NO: 1825543 - protein, 18 aa, Staphylococcus epidermidis
AYKTYAYVVSYKPTNGMK

SEQ ID NO: 1825544 - protein, 19 aa, Staphylococcus epidermidis
AYNNNIPVTYLGNGSNIII

SEQ ID NO: 1825545 - protein, 19 aa, Staphylococcus epidermidis
AYQFFNDPMLSVFLYSEVD

SEQ ID NO: 1825546 - protein, 21 aa, Staphylococcus epidermidis
AYRAKLLRQLDRNVKFIFLDF

SEQ ID NO: 1825547 - protein, 19 aa, Staphylococcus epidermidis
AYRDDVAQFFKYFNCNNES

SEQ ID NO: 1825548 - protein, 24 aa, Staphylococcus epidermidis
AYSPDKFLFIVHNEGILNRAIEEF

SEQ ID NO: 1825549 - protein, 25 aa, Staphylococcus epidermidis
AYSPDKFLFIVHNEGILNRAIEEFK

SEQ ID NO: 1825550 - protein, 19 aa, Staphylococcus epidermidis
AYTAQIAVLSILSQIVAKN

SEQ ID NO: 1825551 - protein, 34 aa, Staphylococcus epidermidis
AYTEDVYDFWRPTGHKYPLVAGALSKDAYIKSFQ

SEQ ID NO: 1825552 - protein, 17 aa, Staphylococcus epidermidis
AYVKLWKHHGAQAEADL

SEQ ID NO: 1825553 - protein, 25 aa, Staphylococcus epidermidis
AYVTPRLQPWDFAGGLLILNEVGGI

SEQ ID NO: 1825554 - protein, 19 aa, Staphylococcus epidermidis
CAGRRIIFEAYIQSYAQIF

SEQ ID NO: 1825555 - protein, 20 aa, Staphylococcus epidermidis
CAYQEQYKMIPACNVKAVDT

SEQ ID NO: 1825556 - protein, 24 aa, Staphylococcus epidermidis
CCVIDIPIHLYMRITGHHILSSGS

SEQ ID NO: 1825557 - protein, 27 aa, Staphylococcus epidermidis
CDLEAYMMQTFKNVFFDYIRSRQQRAY

SEQ ID NO: 1825558 - protein, 23 aa, Staphylococcus epidermidis
CDSATLPIFDQIFTRIGAADDLV

SEQ ID NO: 1825559 - protein, 19 aa, Staphylococcus epidermidis
CEKYFELRKDFRKAIESCE

SEQ ID NO: 1825560 - protein, 20 aa, Staphylococcus epidermidis
CELPVVIKKDGLAAGKGVII

SEQ ID NO: 1825561 - protein, 17 aa, Staphylococcus epidermidis
CERIFGPTKDWECSCGK

SEQ ID NO: 1825562 - protein, 22 aa, Staphylococcus epidermidis
CGKTTLLRLIAGLETPDSGSIV

SEQ ID NO: 1825563 - protein, 17 aa, Staphylococcus epidermidis
CGNATMSYIHYLKERLL

SEQ ID NO: 1825564 - protein, 24 aa, Staphylococcus epidermidis
CGNATMSYIHYLKERLLIQHQQFQ

SEQ ID NO: 1825565 - protein, 25 aa, Staphylococcus epidermidis
CGNATMSYIHYLKERLLIQHQQFQL

SEQ ID NO: 1825566 - protein, 22 aa, Staphylococcus epidermidis
CGNATMSYIHYLQEHQLLQHSQ

SEQ ID NO: 1825567 - protein, 24 aa, Staphylococcus epidermidis
CHKHQIPWVYGAAVGSKGSVYGID

SEQ ID NO: 1825568 - protein, 22 aa, Staphylococcus epidermidis
CHKIDRLILPTVFHDSANVIAK

SEQ ID NO: 1825569 - protein, 20 aa, Staphylococcus epidermidis
CHTMFQFYVQDGKLSCQLYQ

SEQ ID NO: 1825570 - protein, 17 aa, Staphylococcus epidermidis
CIALPGGPGTLEEITEV

SEQ ID NO: 1825571 - protein, 18 aa, Staphylococcus epidermidis
CIDVDRSFHAQCMDLVID

SEQ ID NO: 1825572 - protein, 18 aa, Staphylococcus epidermidis
CIVNFANYLIDELEFINF

SEQ ID NO: 1825573 - protein, 27 aa, Staphylococcus epidermidis
CKVLLDKGYIVCPYISNDLVLAKRLEA

SEQ ID NO: 1825574 - protein, 23 aa, Staphylococcus epidermidis
CLASQNYISILKGLVHHFTAIDD

SEQ ID NO: 1825575 - protein, 22 aa, Staphylococcus epidermidis
CLELANLIYDAGFLTGIYHGDL

SEQ ID NO: 1825576 - protein, 25 aa, Staphylococcus epidermidis
CLESKNYISIVKGLVHHFTAIEDEE

SEQ ID NO: 1825577 - protein, 17 aa, Staphylococcus epidermidis
CLPIVKKGGQFIALKSS

SEQ ID NO: 1825578 - protein, 20 aa, Staphylococcus epidermidis
CNHNLDFALAIRTMLIDENQ

SEQ ID NO: 1825579 - protein, 26 aa, Staphylococcus epidermidis
CNRNIILMTHIVTHPQFVVPTPHRIF

SEQ ID NO: 1825580 - protein, 18 aa, Staphylococcus epidermidis
CRKYDVLLICDEVAVGFG

SEQ ID NO: 1825581 - protein, 25 aa, Staphylococcus epidermidis
CTEHHLPFILFSASGGARMQEGIIS

SEQ ID NO: 1825582 - protein, 23 aa, Staphylococcus epidermidis
CTHYHSFLDVIAIKFKCCNKYYP

SEQ ID NO: 1825583 - protein, 17 aa, Staphylococcus epidermidis
CTKNLKLKRLWANTQEP

SEQ ID NO: 1825584 - protein, 17 aa, Staphylococcus epidermidis
CVAEDIPFFLEVLTYDD

SEQ ID NO: 1825585 - protein, 18 aa, Staphylococcus epidermidis
CVDNLPPVLLPKFVELME

SEQ ID NO: 1825586 - protein, 24 aa, Staphylococcus epidermidis
CVEAGLGIAFLPMSVLNKGNSDGI

SEQ ID NO: 1825587 - protein, 17 aa, Staphylococcus epidermidis
CVFFNQPYLKKKIELHG

SEQ ID NO: 1825588 - protein, 26 aa, Staphylococcus epidermidis
CVMCAGAIVMSRIPRVVYGAIDPKGG

SEQ ID NO: 1825589 - protein, 25 aa, Staphylococcus epidermidis
CVMCAGTIIMSRIPKVVYGATDSKG

SEQ ID NO: 1825590 - protein, 18 aa, Staphylococcus epidermidis
CVPVYFYSESHGYVGLAH

SEQ ID NO: 1825591 - protein, 25 aa, Staphylococcus epidermidis
CWDLPNYIFNRYWRFRTTGNAIAMA

SEQ ID NO: 1825592 - protein, 26 aa, Staphylococcus epidermidis
CYAILGLVHTLWKPMPGRFKDYIAMP

SEQ ID NO: 1825593 - protein, 27 aa, Staphylococcus epidermidis
CYATTTELALIPLIKNRLIDIDSIIVD

SEQ ID NO: 1825594 - protein, 18 aa, Staphylococcus epidermidis
CYFIIPQEKFDKEAEMKA

SEQ ID NO: 1825595 - protein, 18 aa, Staphylococcus epidermidis
CYMWIRFEHDEQFKRFSP

SEQ ID NO: 1825596 - protein, 21 aa, Staphylococcus epidermidis
CYPIIAVDIFDSRLDLAMELG

SEQ ID NO: 1825597 - protein, 17 aa, Staphylococcus epidermidis
DAAILPSVAEKKAPGAK

SEQ ID NO: 1825598 - protein, 21 aa, Staphylococcus epidermidis
DACSTLLFNPENCEWTRDVGD

SEQ ID NO: 1825599 - protein, 32 aa, Staphylococcus epidermidis
DADLLIMAGTNYPYVDYLPKKNIKAIQIDTNE

SEQ ID NO: 1825600 - protein, 31 aa, Staphylococcus epidermidis
DAEKDLVETVLPYQPLFIKPNKDELEVMFNT

SEQ ID NO: 1825601 - protein, 20 aa, Staphylococcus epidermidis
DAELFLVKLEPKPVLDMVNQ

SEQ ID NO: 1825602 - protein, 22 aa, Staphylococcus epidermidis
DAEQFIQYILSNDTNLLTNDKA

SEQ ID NO: 1825603 - protein, 24 aa, Staphylococcus epidermidis
DAFGAYLHMGGRIGVLTVVEGSTD

SEQ ID NO: 1825604 - protein, 20 aa, Staphylococcus epidermidis
DAGRGYRRVVPSPQPKSIVE

SEQ ID NO: 1825605 - protein, 25 aa, Staphylococcus epidermidis
DAHKLKAYQTVYSKGFKPYMEASQK

SEQ ID NO: 1825606 - protein, 18 aa, Staphylococcus epidermidis
DAHTLVVGPYYRGNNGSE

SEQ ID NO: 1825607 - protein, 18 aa, Staphylococcus epidermidis
DAIANYNALIADEIVCVF

SEQ ID NO: 1825608 - protein, 17 aa, Staphylococcus epidermidis
DAIVVGNTYGRIRAMVN

SEQ ID NO: 1825609 - protein, 24 aa, Staphylococcus epidermidis
DAKAEHLLQYAQLGNIYAQKIRGI

SEQ ID NO: 1825610 - protein, 23 aa, Staphylococcus epidermidis
DAKLAMHFTYMEERFKQLNKMKF

SEQ ID NO: 1825611 - protein, 23 aa, Staphylococcus epidermidis
DAKNKLYNIVYAYNSVKKNFKQA

SEQ ID NO: 1825612 - protein, 30 aa, Staphylococcus epidermidis
DALDQVNWVGFYLIEGNGLILGPFQGHPAC

SEQ ID NO: 1825613 - protein, 23 aa, Staphylococcus epidermidis
DALFILGETLYNFGLTPQGLEVF

SEQ ID NO: 1825614 - protein, 26 aa, Staphylococcus epidermidis
DALIDFELDMLYRMIDIINDTLVSIR

SEQ ID NO: 1825615 - protein, 17 aa, Staphylococcus epidermidis
DALNLFIELTGINFNIV

SEQ ID NO: 1825616 - protein, 26 aa, Staphylococcus epidermidis
DALSHLCIYILIITGSRFKPVQHLRY

SEQ ID NO: 1825617 - protein, 22 aa, Staphylococcus epidermidis
DALTEFVNIYGAKGLAWVKVVE

SEQ ID NO: 1825618 - protein, 23 aa, Staphylococcus epidermidis
DAMGKMFFTMMSAFAELEANLLS

SEQ ID NO: 1825619 - protein, 19 aa, Staphylococcus epidermidis
DAMRDLRDKLKSTVNPVKA

SEQ ID NO: 1825620 - protein, 31 aa, Staphylococcus epidermidis
DAMSIIRNIMKYIQRKYKLTDISYLDDIVIP

SEQ ID NO: 1825621 - protein, 26 aa, Staphylococcus epidermidis
DANDLVNLLVFIINKQMTAQELNQNI

SEQ ID NO: 1825622 - protein, 29 aa, Staphylococcus epidermidis
DANEFKNYILGLIFYRFLSEKVEESSAKL

SEQ ID NO: 1825623 - protein, 28 aa, Staphylococcus epidermidis
DANEFKNYILGLIFYRFLSEKVEETSGR

SEQ ID NO: 1825624 - protein, 20 aa, Staphylococcus epidermidis
DAPFLLIGDPRIEGGSFYLG

SEQ ID NO: 1825625 - protein, 21 aa, Staphylococcus epidermidis
DARGSMLDFVADANIGLRTVT

SEQ ID NO: 1825626 - protein, 23 aa, Staphylococcus epidermidis
DARHRRNILGRKLHIGHSNGKQL

SEQ ID NO: 1825627 - protein, 23 aa, Staphylococcus epidermidis
DARRRREILGRKLHIGHSNGKQL

SEQ ID NO: 1825628 - protein, 17 aa, Staphylococcus epidermidis
DARVLMDAYYQLNDRKS

SEQ ID NO: 1825629 - protein, 25 aa, Staphylococcus epidermidis
DASAMEIYCTLLNGYKLVIANDNER

SEQ ID NO: 1825630 - protein, 19 aa, Staphylococcus epidermidis
DASIKWALGLMNEGSQIID

SEQ ID NO: 1825631 - protein, 26 aa, Staphylococcus epidermidis
DASNTIDHLKYLNPSQQQTAKDNVEQ

SEQ ID NO: 1825632 - protein, 29 aa, Staphylococcus epidermidis
DAVIGLPANLFFGTSIPTSILVFKKCRED

SEQ ID NO: 1825633 - protein, 21 aa, Staphylococcus epidermidis
DAVLIQYQPYNSTVIYQKRFY

SEQ ID NO: 1825634 - protein, 20 aa, Staphylococcus epidermidis
DAVYIYEEIIPGSGGLPVGT

SEQ ID NO: 1825635 - protein, 24 aa, Staphylococcus epidermidis
DAYGSQLGLKYYLQKKFPDKQIYA

SEQ ID NO: 1825636 - protein, 20 aa, Staphylococcus epidermidis
DAYLTQFPGIGKKTARQIVL

SEQ ID NO: 1825637 - protein, 25 aa, Staphylococcus epidermidis
DAYNFPRVWLEKDSYDFSFSGLKSA

SEQ ID NO: 1825638 - protein, 22 aa, Staphylococcus epidermidis
DAYYGLFYEDVYTQSIFTALTQ

SEQ ID NO: 1825639 - protein, 37 aa, Staphylococcus epidermidis
DCDKIMVVANLPYYITTPILLNLMQQDIPIDGYVVMM

SEQ ID NO: 1825640 - protein, 19 aa, Staphylococcus epidermidis
DCFNDLHILKPSWSTLENI

SEQ ID NO: 1825641 - protein, 27 aa, Staphylococcus epidermidis
DCMEMKPLYEWLGLTASLGFIDIPDYE

SEQ ID NO: 1825642 - protein, 24 aa, Staphylococcus epidermidis
DCNLDNDTFIYLITGPNMSGKSTY

SEQ ID NO: 1825643 - protein, 18 aa, Staphylococcus epidermidis
DCTQFPFRIARPGSVTKE

SEQ ID NO: 1825644 - protein, 18 aa, Staphylococcus epidermidis
DCYSIKIDLPKQFKVNAT

SEQ ID NO: 1825645 - protein, 26 aa, Staphylococcus epidermidis
DDAKKGFLLDGFPRTIEQAEALNNIM

SEQ ID NO: 1825646 - protein, 24 aa, Staphylococcus epidermidis
DDAKRKVAIALRNRYRRSLLDEEA

SEQ ID NO: 1825647 - protein, 19 aa, Staphylococcus epidermidis
DDALAERLGFISNSTGGVL

SEQ ID NO: 1825648 - protein, 29 aa, Staphylococcus epidermidis
DDDEKIEWLIPFLNYSGPTIIYISSKKKC

SEQ ID NO: 1825649 - protein, 22 aa, Staphylococcus epidermidis
DDDFRILPYLSSGGAGLAIPMI

SEQ ID NO: 1825650 - protein, 25 aa, Staphylococcus epidermidis
DDDYYYYIDPLWSRLSKFVIFPSII

SEQ ID NO: 1825651 - protein, 25 aa, Staphylococcus epidermidis
DDDYYYYIDPLWSRLTKFVIFPSII

SEQ ID NO: 1825652 - protein, 17 aa, Staphylococcus epidermidis
DDEDRIRRLLKLYLERE

SEQ ID NO: 1825653 - protein, 19 aa, Staphylococcus epidermidis
DDEDVVEFLGIKKQMDAIL

SEQ ID NO: 1825654 - protein, 24 aa, Staphylococcus epidermidis
DDEILRKVWELSGKTAERLNKLQK

SEQ ID NO: 1825655 - protein, 19 aa, Staphylococcus epidermidis
DDERLNRGLDYLITSLTYD

SEQ ID NO: 1825656 - protein, 23 aa, Staphylococcus epidermidis
DDESLGFPSFLFVEGDTIGFART

SEQ ID NO: 1825657 - protein, 23 aa, Staphylococcus epidermidis
DDEVIERFILFNHYRIHKKDKYL

SEQ ID NO: 1825658 - protein, 25 aa, Staphylococcus epidermidis
DDFFYKVIQFWNIEAELLMLLISDN

SEQ ID NO: 1825659 - protein, 24 aa, Staphylococcus epidermidis
DDFTNKYFKSIFNILHDYFSEQDY

SEQ ID NO: 1825660 - protein, 27 aa, Staphylococcus epidermidis
DDGMYDLIKEPLRFLQVRIPVRMDDGT

SEQ ID NO: 1825661 - protein, 19 aa, Staphylococcus epidermidis
DDHKYIIYTQNDQKVYNEL

SEQ ID NO: 1825662 - protein, 19 aa, Staphylococcus epidermidis
DDIIVFHKLSKEELKEIVT

SEQ ID NO: 1825663 - protein, 27 aa, Staphylococcus epidermidis
DDINNYVYFDLYYKAAFMVDLYEYNNI

SEQ ID NO: 1825664 - protein, 25 aa, Staphylococcus epidermidis
DDKADILYIGFISTKGAIGEGAERL

SEQ ID NO: 1825665 - protein, 21 aa, Staphylococcus epidermidis
DDKIIGYLGLWIVIDQVQITT

SEQ ID NO: 1825666 - protein, 22 aa, Staphylococcus epidermidis
DDKIKIVEKWRKGLIVLSGQSG

SEQ ID NO: 1825667 - protein, 26 aa, Staphylococcus epidermidis
DDKLENLWRVTSLNQAITLGIDDVKG

SEQ ID NO: 1825668 - protein, 25 aa, Staphylococcus epidermidis
DDKVDLRYLGPLGCGFMTGSGAVFN

SEQ ID NO: 1825669 - protein, 29 aa, Staphylococcus epidermidis
DDKVFQGEALLFLLGLTNSMAGFEKLVPD

SEQ ID NO: 1825670 - protein, 21 aa, Staphylococcus epidermidis
DDLAALGIQIGTDIPFCIYNQ

SEQ ID NO: 1825671 - protein, 21 aa, Staphylococcus epidermidis
DDLFHIRTLGFRGEALASISS

SEQ ID NO: 1825672 - protein, 23 aa, Staphylococcus epidermidis
DDLKQQFDTALQQARNTLAKATG

SEQ ID NO: 1825673 - protein, 21 aa, Staphylococcus epidermidis
DDLQPFNPESYVYGLFADMIE

SEQ ID NO: 1825674 - protein, 20 aa, Staphylococcus epidermidis
DDLQYTMTVTFEEAVFGTKK

SEQ ID NO: 1825675 - protein, 21 aa, Staphylococcus epidermidis
DDLSALGIQIGTDIPFCIYNK

SEQ ID NO: 1825676 - protein, 27 aa, Staphylococcus epidermidis
DDLSIELIYYFINCVMAFTFEENENEA

SEQ ID NO: 1825677 - protein, 26 aa, Staphylococcus epidermidis
DDMFKKPMILITILEKPIQFQHNQND

SEQ ID NO: 1825678 - protein, 21 aa, Staphylococcus epidermidis
DDMLGKYHKLFTERKEFTGDT

SEQ ID NO: 1825679 - protein, 24 aa, Staphylococcus epidermidis
DDNGDIYFIFTNESLQNILDKSKN

SEQ ID NO: 1825680 - protein, 25 aa, Staphylococcus epidermidis
DDNPDYAPFINYVNDVFLQEGELTD

SEQ ID NO: 1825681 - protein, 24 aa, Staphylococcus epidermidis
DDPHDGLDTFYLEGGKYLVVEAKG

SEQ ID NO: 1825682 - protein, 23 aa, Staphylococcus epidermidis
DDPMIDFQLLPQGSNFQQEVWNE

SEQ ID NO: 1825683 - protein, 25 aa, Staphylococcus epidermidis
DDQLETIFYRLLSGRSTRSALGMSL

SEQ ID NO: 1825684 - protein, 19 aa, Staphylococcus epidermidis
DDQVIRQIIKFNEDLRTMT

SEQ ID NO: 1825685 - protein, 22 aa, Staphylococcus epidermidis
DDRLFPFICKLDDPLEVDNPEM

SEQ ID NO: 1825686 - protein, 17 aa, Staphylococcus epidermidis
DDRNLVGIITNRDLRFI

SEQ ID NO: 1825687 - protein, 17 aa, Staphylococcus epidermidis
DDTADRIGVWIGSGIGG

SEQ ID NO: 1825688 - protein, 26 aa, Staphylococcus epidermidis
DDTDLYLNFMNLKQWCQNKFQVTNQI

SEQ ID NO: 1825689 - protein, 30 aa, Staphylococcus epidermidis; identical to SEQ ID NO: 1691917

SEQ ID NO: 1825690 - protein, 27 aa, Staphylococcus epidermidis
DDTTLEPMVLPSRFPNLLVNGSTGISS

SEQ ID NO: 1825691 - protein, 19 aa, Staphylococcus epidermidis
DDTYMIKDIPFGRQMVFEY

SEQ ID NO: 1825692 - protein, 26 aa, Staphylococcus epidermidis
DDVARMILHMIDHLNGILFTEKANRL

SEQ ID NO: 1825693 - protein, 25 aa, Staphylococcus epidermidis
DDVKALLDYIYIDQAAYIGHEMGAI

SEQ ID NO: 1825694 - protein, 25 aa, Staphylococcus epidermidis
DDVRTFFNILVLGKMGMGKSTLLKM

SEQ ID NO: 1825695 - protein, 21 aa, Staphylococcus epidermidis
DDVTSPYRFFAAYQIYEDDTP

SEQ ID NO: 1825696 - protein, 17 aa, Staphylococcus epidermidis
DDVWDFPFITRQLDEVL

SEQ ID NO: 1825697 - protein, 23 aa, Staphylococcus epidermidis
DDYNLMIMHPWQYDHVLHQDYME

SEQ ID NO: 1825698 - protein, 25 aa, Staphylococcus epidermidis
DEALKYMKLWVEKRGYEDEYIFTVG

SEQ ID NO: 1825699 - protein, 23 aa, Staphylococcus epidermidis
DEASLFYQAFLKVKDKYDDVMRF

SEQ ID NO: 1825700 - protein, 23 aa, Staphylococcus epidermidis
DEASLLYQAFLKVKDKYDEVMRF

SEQ ID NO: 1825701 - protein, 20 aa, Staphylococcus epidermidis
DEDFLLVKREIFSSGKSICR

SEQ ID NO: 1825702 - protein, 23 aa, Staphylococcus epidermidis
DEDIDIFFASNQVLFRVGNVNFI

SEQ ID NO: 1825703 - protein, 26 aa, Staphylococcus epidermidis
DEDLEPMVLFINPKDAGKLRSSASAN

SEQ ID NO: 1825704 - protein, 26 aa, Staphylococcus epidermidis
DEDLEPMVLFINPKDAGKLRSSASDN

SEQ ID NO: 1825705 - protein, 19 aa, Staphylococcus epidermidis
DEELFFIVSVDTPMITSKA

SEQ ID NO: 1825706 - protein, 21 aa, Staphylococcus epidermidis
DEFQILLHEYAKDIKQWENES

SEQ ID NO: 1825707 - protein, 21 aa, Staphylococcus epidermidis
DEFYRLPHALFENPKYKSLNT

SEQ ID NO: 1825708 - protein, 26 aa, Staphylococcus epidermidis
DEGDIVVGMLPWKKINTVKSEYVNKV

SEQ ID NO: 1825709 - protein, 27 aa, Staphylococcus epidermidis
DEGRIQYFNQYLSRRRIRHIVGYVPQD

SEQ ID NO: 1825710 - protein, 22 aa, Staphylococcus epidermidis
DEGTIILKFFLSLDKDEQLKRF

SEQ ID NO: 1825711 - protein, 24 aa, Staphylococcus epidermidis
DEGYLKLYKTWFCKSKLCPVCNWR

SEQ ID NO: 1825712 - protein, 19 aa, Staphylococcus epidermidis
DEHDIFGVIGYSGAGKSTL

SEQ ID NO: 1825713 - protein, 24 aa, Staphylococcus epidermidis
DEIDVQALWDHRKKFKEIAAEQGT

SEQ ID NO: 1825714 - protein, 26 aa, Staphylococcus epidermidis
DEIERLHYLVDNNFYFNVFEKYSEAE

SEQ ID NO: 1825715 - protein, 26 aa, Staphylococcus epidermidis
DEIERLHYLVDNNFYFNVFEKYTEES

SEQ ID NO: 1825716 - protein, 24 aa, Staphylococcus epidermidis
DEIKLLAKEIGFPVVLKAASGGGG

SEQ ID NO: 1825717 - protein, 18 aa, Staphylococcus epidermidis
DEILILPHVFGEDARMES

SEQ ID NO: 1825718 - protein, 32 aa, Staphylococcus epidermidis
DEILVAFDLYGGTFRLFDFYEKQYGLKFKYVD

SEQ ID NO: 1825719 - protein, 25 aa, Staphylococcus epidermidis
DEITKILMSLLMYAPTKAHKTMLSR

SEQ ID NO: 1825720 - protein, 17 aa, Staphylococcus epidermidis
DEIYKQEKILNKTVLCY

SEQ ID NO: 1825721 - protein, 24 aa, Staphylococcus epidermidis
DEKRLNYAGFYRLHHSYKKKVMMA

SEQ ID NO: 1825722 - protein, 24 aa, Staphylococcus epidermidis
DELIDVLKRFRIIIKKKNESVQSM

SEQ ID NO: 1825723 - protein, 25 aa, Staphylococcus epidermidis
DELIDVLKRFRIIIKKKNESVQSMQ

SEQ ID NO: 1825724 - protein, 18 aa, Staphylococcus epidermidis
DELIKDLRRLGLRVYFNI

SEQ ID NO: 1825725 - protein, 17 aa, Staphylococcus epidermidis
DELIPYMNNVRIMVVFG

SEQ ID NO: 1825726 - protein, 17 aa, Staphylococcus epidermidis
DELLYITGSPYDTLLEV

SEQ ID NO: 1825727 - protein, 29 aa, Staphylococcus epidermidis
DELTSIGLDLPFSMKMNQLLGFDSSFVTY

SEQ ID NO: 1825728 - protein, 20 aa, Staphylococcus epidermidis
DELVKLLSNIDLLVLDDVGV

SEQ ID NO: 1825729 - protein, 20 aa, Staphylococcus epidermidis
DEMLKVYEYLAKIDTSIIDV

SEQ ID NO: 1825730 - protein, 20 aa, Staphylococcus epidermidis
DEMREMIKHSRLLEASMLQD

SEQ ID NO: 1825731 - protein, 17 aa, Staphylococcus epidermidis
DENAKLKILNRFLNKND

SEQ ID NO: 1825732 - protein, 24 aa, Staphylococcus epidermidis
DENEKLAHFILDKNIELSEEIMSD

SEQ ID NO: 1825733 - protein, 24 aa, Staphylococcus epidermidis
DENGGMIIYLPQEGRGIGLMNKLR

SEQ ID NO: 1825734 - protein, 17 aa, Staphylococcus epidermidis
DENGTWIYTNKDGIKVA

SEQ ID NO: 1825735 - protein, 17 aa, Staphylococcus epidermidis
DENIQVFKIGEGGLGGE

SEQ ID NO: 1825736 - protein, 32 aa, Staphylococcus epidermidis; identical to SEQ ID NO: 1686995

SEQ ID NO: 1825737 - protein, 17 aa, Staphylococcus epidermidis
DEQIYRNLLQDVGYHSV

SEQ ID NO: 1825738 - protein, 24 aa, Staphylococcus epidermidis
DEQKAHFKPLIDNAQTRGEVDKQI

SEQ ID NO: 1825739 - protein, 23 aa, Staphylococcus epidermidis
DEQLIQDIVKFNEDLRTMTKQGQ

SEQ ID NO: 1825740 - protein, 21 aa, Staphylococcus epidermidis
DERAYHYMGLKPGQKAEDIEL

SEQ ID NO: 1825741 - protein, 18 aa, Staphylococcus epidermidis
DERMLSILSLYTQQDIRN

SEQ ID NO: 1825742 - protein, 34 aa, Staphylococcus epidermidis
DERVSKLMEAFWPGPISFILPLKSGYLCETVTGG

SEQ ID NO: 1825743 - protein, 27 aa, Staphylococcus epidermidis
DESAPHMHLHFIPVNHQGRLSARTAMN

SEQ ID NO: 1825744 - protein, 20 aa, Staphylococcus epidermidis
DESFKLVLGNEIYLVDSLEE

SEQ ID NO: 1825745 - protein, 23 aa, Staphylococcus epidermidis
DESKKIVLARRRLIKFDKEIDIP

SEQ ID NO: 1825746 - protein, 24 aa, Staphylococcus epidermidis
DESPFKVDLFIKANIELTKDIYGT

SEQ ID NO: 1825747 - protein, 25 aa, Staphylococcus epidermidis
DESYLIVEYGFAKRLLNTKRSLALL

SEQ ID NO: 1825748 - protein, 23 aa, Staphylococcus epidermidis
DETTFVVINSTCGCAAGLARPAA

SEQ ID NO: 1825749 - protein, 26 aa, Staphylococcus epidermidis
DETVCYLWLRFEHDKYFNDFKLTDYL

SEQ ID NO: 1825750 - protein, 19 aa, Staphylococcus epidermidis
DETVCYMWIRFEHDEQFKR

SEQ ID NO: 1825751 - protein, 21 aa, Staphylococcus epidermidis
DETYYIICAAGSRSARVVQYL

SEQ ID NO: 1825752 - protein, 29 aa, Staphylococcus epidermidis
DEVELGQSLILQGLIINKFIVEQVERSSS

SEQ ID NO: 1825753 - protein, 21 aa, Staphylococcus epidermidis
DEVGKLVAFLASDDSSFITGE

SEQ ID NO: 1825754 - protein, 17 aa, Staphylococcus epidermidis
DEWVFPIQTHDNRIVEV

SEQ ID NO: 1825755 - protein, 25 aa, Staphylococcus epidermidis
DEYEDLLYMIDNKYYYSIHFDDSVS

SEQ ID NO: 1825756 - protein, 23 aa, Staphylococcus epidermidis
DEYICQWIRGLDNIIPRLVEKME

SEQ ID NO: 1825757 - protein, 19 aa, Staphylococcus epidermidis
DFANFINQFEWHNANYPVV

SEQ ID NO: 1825758 - protein, 21 aa, Staphylococcus epidermidis
DFASYINQFNWNDAQFPVVQN

SEQ ID NO: 1825759 - protein, 24 aa, Staphylococcus epidermidis
DFDDDLIMEVYLPGAINEIKTAVS

SEQ ID NO: 1825760 - protein, 31 aa, Staphylococcus epidermidis
DFDHLFKHVPVHPGEFYYVPAGTVHAIGSGI

SEQ ID NO: 1825761 - protein, 22 aa, Staphylococcus epidermidis
DFDSELVFVGLSNTLLITEAEA

SEQ ID NO: 1825762 - protein, 25 aa, Staphylococcus epidermidis
DFEEILRFINFAKYNINYIDDPIKL

SEQ ID NO: 1825763 - protein, 17 aa, Staphylococcus epidermidis
DFENDYLYFNSLKTFQK

SEQ ID NO: 1825764 - protein, 29 aa, Staphylococcus epidermidis
DFESRIQAWSYPFVIKPGDDLPTAGGYGV

SEQ ID NO: 1825765 - protein, 24 aa, Staphylococcus epidermidis
DFGKIKVYVGNYDFWYQSSQLAQK

SEQ ID NO: 1825766 - protein, 24 aa, Staphylococcus epidermidis
DFHKAMPIIIHGDAAYPGQGINFE

SEQ ID NO: 1825767 - protein, 22 aa, Staphylococcus epidermidis
DFIEKPFNLSLTIAKIQALLRR

SEQ ID NO: 1825768 - protein, 19 aa, Staphylococcus epidermidis
DFIFKDDPSELKMRIIDCL

SEQ ID NO: 1825769 - protein, 19 aa, Staphylococcus epidermidis
DFKAIFKDDHVIGISELIQ

SEQ ID NO: 1825770 - protein, 29 aa, Staphylococcus epidermidis
DFKEEPPWFKISPTHFVKSWLLDARAPKV

SEQ ID NO: 1825771 - protein, 26 aa, Staphylococcus epidermidis
DFKGSWSVVCFYPADFSFVCPTELED

SEQ ID NO: 1825772 - protein, 22 aa, Staphylococcus epidermidis
DFKKVSLELGGKSPYIVLDDVD

SEQ ID NO: 1825773 - protein, 31 aa, Staphylococcus epidermidis
DFLVIEKIERYIALVKKYRQLITAINKEGLT

SEQ ID NO: 1825774 - protein, 20 aa, Staphylococcus epidermidis
DFMPSPGKITQYLAPGGFGV

SEQ ID NO: 1825775 - protein, 18 aa, Staphylococcus epidermidis
DFMVVQDEFLTFTATFAD

SEQ ID NO: 1825776 - protein, 18 aa, Staphylococcus epidermidis
DFQYFIQNVLHDDIQFII

SEQ ID NO: 1825777 - protein, 17 aa, Staphylococcus epidermidis
DFRGLQCPGPIVNISKE

SEQ ID NO: 1825778 - protein, 24 aa, Staphylococcus epidermidis
DFSFKTIKINVLTNSPLKFKFNSA

SEQ ID NO: 1825779 - protein, 25 aa, Staphylococcus epidermidis
DFSLNVPKLHLISPAIYGVIGPNGA

SEQ ID NO: 1825780 - protein, 29 aa, Staphylococcus epidermidis
DFSRSIPFKRYLYFLIRSVKYDYLRKLKA

SEQ ID NO: 1825781 - protein, 17 aa, Staphylococcus epidermidis
DFSSENLIFLNLYNHQL

SEQ ID NO: 1825782 - protein, 22 aa, Staphylococcus epidermidis
DFTYKYMHLINEIYIENQLVVF

SEQ ID NO: 1825783 - protein, 27 aa, Staphylococcus epidermidis
DFVGNPKWLFIYVNKYRKDIDAYWMCD

SEQ ID NO: 1825784 - protein, 18 aa, Staphylococcus epidermidis
DFVLPFQWNDEFYCYEPK

SEQ ID NO: 1825785 - protein, 22 aa, Staphylococcus epidermidis
DGAINVPLKILRSYAKTVDKNQ

SEQ ID NO: 1825786 - protein, 31 aa, Staphylococcus epidermidis
DGANTTTHSFIRYYLTRPLETGKTYTLKASV

SEQ ID NO: 1825787 - protein, 24 aa, Staphylococcus epidermidis
DGATKEFFAWGFRVGFMTFGTENE

SEQ ID NO: 1825788 - protein, 20 aa, Staphylococcus epidermidis
DGDPWFVVGKNLNDNILYVE

SEQ ID NO: 1825789 - protein, 23 aa, Staphylococcus epidermidis
DGDPYLYIRKAYPNPFIKGLDII

SEQ ID NO: 1825790 - protein, 25 aa, Staphylococcus epidermidis
DGEALYLNIFRPNKEGRFPVVMSAD

SEQ ID NO: 1825791 - protein, 21 aa, Staphylococcus epidermidis
DGEFQFDAAILPSVAEKKAPG

SEQ ID NO: 1825792 - protein, 21 aa, Staphylococcus epidermidis
DGFITKFNRLIERRLLNHFRK

SEQ ID NO: 1825793 - protein, 25 aa, Staphylococcus epidermidis
DGFLLNFNDWAPNLYHFLNLKQFKR

SEQ ID NO: 1825794 - protein, 19 aa, Staphylococcus epidermidis
DGFYWCRKMRQQSNVPILF

SEQ ID NO: 1825795 - protein, 25 aa, Staphylococcus epidermidis
DGHLDYIIAPLPEKTLFTARLVQRT

SEQ ID NO: 1825796 - protein, 19 aa, Staphylococcus epidermidis
DGIGDTVVTLIILAQQHDM

SEQ ID NO: 1825797 - protein, 25 aa, Staphylococcus epidermidis
DGIGDTVVTLIILAQQHGWTLEECL

SEQ ID NO: 1825798 - protein, 28 aa, Staphylococcus epidermidis
DGIHERIAIFDLYFRSMPFNSGYAVFNG

SEQ ID NO: 1825799 - protein, 19 aa, Staphylococcus epidermidis
DGIKVAYRNGYPDFKGAGL

SEQ ID NO: 1825800 - protein, 28 aa, Staphylococcus epidermidis
DGIPNTFVPARNLLFLSFAGALAYQINA

SEQ ID NO: 1825801 - protein, 19 aa, Staphylococcus epidermidis
DGIYIDVYCALKHGVNISK

SEQ ID NO: 1825802 - protein, 20 aa, Staphylococcus epidermidis
DGKKILQMPLEQLQQTIRSS

SEQ ID NO: 1825803 - protein, 30 aa, Staphylococcus epidermidis
DGKPKDFLVHRLVAFAFIPAVKGKECINHI

SEQ ID NO: 1825804 - protein, 17 aa, Staphylococcus epidermidis
DGKRRVFVNTPVPPYDT

SEQ ID NO: 1825805 - protein, 31 aa, Staphylococcus epidermidis
DGLFVITGHYRNGILLSPIIGRDIANWLISG

SEQ ID NO: 1825806 - protein, 24 aa, Staphylococcus epidermidis
DGMALLFRHFYATSLHNQFMYNSK

SEQ ID NO: 1825807 - protein, 22 aa, Staphylococcus epidermidis
DGNGRYLLQDSIINTAGNTVLG

SEQ ID NO: 1825808 - protein, 26 aa, Staphylococcus epidermidis
DGNRFKFYDFALFLYEEFHGCYIDNR

SEQ ID NO: 1825809 - protein, 24 aa, Staphylococcus epidermidis
DGNYLFEAVYGAGIARLYKLNKNT

SEQ ID NO: 1825810 - protein, 27 aa, Staphylococcus epidermidis
DGPVGYLAATALHYIYGIDKENLIVFG

SEQ ID NO: 1825811 - protein, 26 aa, Staphylococcus epidermidis
DGQFLKYYFDFFKIDYTKYSLEKNND

SEQ ID NO: 1825812 - protein, 27 aa, Staphylococcus epidermidis
DGQFVPNISIGIPLLDAVKSYSNLPID

SEQ ID NO: 1825813 - protein, 26 aa, Staphylococcus epidermidis
DGQKQKLKFLSFLLEDNSLIILDEIT

SEQ ID NO: 1825814 - protein, 21 aa, Staphylococcus epidermidis
DGQSFLSFLKENEQPDIVLLD

SEQ ID NO: 1825815 - protein, 19 aa, Staphylococcus epidermidis
DGRMIFNIPIRTIEYRNQE

SEQ ID NO: 1825816 - protein, 19 aa, Staphylococcus epidermidis
DGRYLLFQPNDSGLAQIGP

SEQ ID NO: 1825817 - protein, 27 aa, Staphylococcus epidermidis
DGSIKNFRVTKIFGYFGLKREEIEEAQ

SEQ ID NO: 1825818 - protein, 18 aa, Staphylococcus epidermidis
DGSLPLLTPMSEVAGRMS

SEQ ID NO: 1825819 - protein, 18 aa, Staphylococcus epidermidis
DGSQLSFMGLPTPNIFTG

SEQ ID NO: 1825820 - protein, 24 aa, Staphylococcus epidermidis
DGSTYFLEKYKGKVLIIVNTATNC

SEQ ID NO: 1825821 - protein, 22 aa, Staphylococcus epidermidis
DGSYYEGYRLGSDDLTIGEIVF

SEQ ID NO: 1825822 - protein, 22 aa, Staphylococcus epidermidis
DGTMILKPQFRDYLLQLAESND

SEQ ID NO: 1825823 - protein, 20 aa, Staphylococcus epidermidis
DGVNKFKTIVGKDAFIGCNT

SEQ ID NO: 1825824 - protein, 26 aa, Staphylococcus epidermidis
DGWYSLHLFYAMDWTTFRLVPEEERE

SEQ ID NO: 1825825 - protein, 23 aa, Staphylococcus epidermidis
DHDLAILMIVGEGMNQVVGTASK

SEQ ID NO: 1825826 - protein, 25 aa, Staphylococcus epidermidis
DHEDIDIRWLDAYLAIRDDDQLNQG

SEQ ID NO: 1825827 - protein, 25 aa, Staphylococcus epidermidis
DHFSKKLLLEIKKPSQYPGIEEMIV

SEQ ID NO: 1825828 - protein, 26 aa, Staphylococcus epidermidis
DHHKPHIMPVWSIKNRARKVRDEDFE

SEQ ID NO: 1825829 - protein, 23 aa, Staphylococcus epidermidis
DHHSRRGLLKMVGRRRHLLNYLR

SEQ ID NO: 1825830 - protein, 17 aa, Staphylococcus epidermidis
DHILDTSLLFNIIPERF

SEQ ID NO: 1825831 - protein, 19 aa, Staphylococcus epidermidis
DHISIEYLRFSYYLTIEQF

SEQ ID NO: 1825832 - protein, 23 aa, Staphylococcus epidermidis
DHLNMDYFKMKPVGLIGNSGGIV

SEQ ID NO: 1825833 - protein, 24 aa, Staphylococcus epidermidis
DHPINNLINYFAIHNLGGLPCFLN

SEQ ID NO: 1825834 - protein, 19 aa, Staphylococcus epidermidis
DHQAILHFAQHNAIDWVII

SEQ ID NO: 1825835 - protein, 21 aa, Staphylococcus epidermidis
DHREFTLILYVNDIVGMLAQV

SEQ ID NO: 1825836 - protein, 24 aa, Staphylococcus epidermidis
DHRNDTFFIIDLEKYGLLETINND

SEQ ID NO: 1825837 - protein, 20 aa, Staphylococcus epidermidis
DHTREYIPVLMFSPKINEYH

SEQ ID NO: 1825838 - protein, 17 aa, Staphylococcus epidermidis
DIAIVDPQFVLSVPKDV

SEQ ID NO: 1825839 - protein, 21 aa, Staphylococcus epidermidis
DIANQFVYVSLIAGPKENSIV

SEQ ID NO: 1825840 - protein, 29 aa, Staphylococcus epidermidis
DIAPKEIYNLVIYQLGALNGFCKVHGVKI

SEQ ID NO: 1825841 - protein, 22 aa, Staphylococcus epidermidis
DIASELPYLQWLEECKIDNHFE

SEQ ID NO: 1825842 - protein, 25 aa, Staphylococcus epidermidis
DIDIDDLFDMFIFKNERLKAKMKEN

SEQ ID NO: 1825843 - protein, 26 aa, Staphylococcus epidermidis
DIDIDELFDMFIFKNDRLKAKMKEAF

SEQ ID NO: 1825844 - protein, 27 aa, Staphylococcus epidermidis
DIDLDKFKLLKIKYKNYKIIDPSGILS

SEQ ID NO: 1825845 - protein, 26 aa, Staphylococcus epidermidis
DIDNKRYFLFKKLKEYDIFSKLIKFE

SEQ ID NO: 1825846 - protein, 24 aa, Staphylococcus epidermidis
DIEAKYYQMLMREKAIKRKFQELL

SEQ ID NO: 1825847 - protein, 23 aa, Staphylococcus epidermidis
DIEDFFSIFMKYNNLEHGNFNRE

SEQ ID NO: 1825848 - protein, 17 aa, Staphylococcus epidermidis
DIEIITGHSLGGRDAII

SEQ ID NO: 1825849 - protein, 20 aa, Staphylococcus epidermidis
DIEINFYPHYRSQMFFKSFL

SEQ ID NO: 1825850 - protein, 20 aa, Staphylococcus epidermidis
DIELICDRAVFLRDGKFVKD

SEQ ID NO: 1825851 - protein, 21 aa, Staphylococcus epidermidis
DIERLMIKHIPGLKKIQRQET

SEQ ID NO: 1825852 - protein, 17 aa, Staphylococcus epidermidis
DIFRNAGIDFCCGGQES

SEQ ID NO: 1825853 - protein, 22 aa, Staphylococcus epidermidis
DIGKAFAHRLKGFNTRILYHNR

SEQ ID NO: 1825854 - protein, 24 aa, Staphylococcus epidermidis
DIGKAFARRLQGFDARIIYHNRKR

SEQ ID NO: 1825855 - protein, 28 aa, Staphylococcus epidermidis
DIGKTYVTKYLYKALKTRGYRVCIFKPF

SEQ ID NO: 1825856 - protein, 22 aa, Staphylococcus epidermidis
DIGMIFQHFNLLNSKSVYKNVA

SEQ ID NO: 1825857 - protein, 21 aa, Staphylococcus epidermidis
DIGMIFQHFNLLNSKTVYKNV

SEQ ID NO: 1825858 - protein, 24 aa, Staphylococcus epidermidis
DIGMLLYNYVPQSKWSKWFKTYGV

SEQ ID NO: 1825859 - protein, 19 aa, Staphylococcus epidermidis
DIGNIIALRQRAKKRNIKL

SEQ ID NO: 1825860 - protein, 23 aa, Staphylococcus epidermidis
DIHHHIIPKIYKDALKKIGVTTA

SEQ ID NO: 1825861 - protein, 25 aa, Staphylococcus epidermidis
DIHQNKKALLQFAEKLEYAADKFEE

SEQ ID NO: 1825862 - protein, 27 aa, Staphylococcus epidermidis
DIIASMSYFFNLLNGIGYTDDIDHLGN

SEQ ID NO: 1825863 - protein, 19 aa, Staphylococcus epidermidis
DIIHNKFILDATYLGKYSR

SEQ ID NO: 1825864 - protein, 20 aa, Staphylococcus epidermidis
DIIPLITSANIACGFHAGDE

SEQ ID NO: 1825865 - protein, 24 aa, Staphylococcus epidermidis
DIISFDNDFLIKNHLYDAKTDELN

SEQ ID NO: 1825866 - protein, 19 aa, Staphylococcus epidermidis
DIIVQPPGKKLQHLSLLSG

SEQ ID NO: 1825867 - protein, 22 aa, Staphylococcus epidermidis
DIKDLDCQIIILSSYDDFEYMK

SEQ ID NO: 1825868 - protein, 22 aa, Staphylococcus epidermidis
DIKKLKFYLPSNNSEQQKIGDF

SEQ ID NO: 1825869 - protein, 26 aa, Staphylococcus epidermidis
DIKTTDLLIRLYEKVLNGINYQDKKK

SEQ ID NO: 1825870 - protein, 17 aa, Staphylococcus epidermidis
DILPYLDASFRTEPSLN

SEQ ID NO: 1825871 - protein, 17 aa, Staphylococcus epidermidis
DIMAVPAVFLDGQEFGN

SEQ ID NO: 1825872 - protein, 20 aa, Staphylococcus epidermidis
DIMKWNALQLQHSFQRISLF

SEQ ID NO: 1825873 - protein, 28 aa, Staphylococcus epidermidis
DINNPHAHVLLTQRPFNADGTWGKKTKT

SEQ ID NO: 1825874 - protein, 19 aa, Staphylococcus epidermidis
DIPIERFPVFIHPSSIISP

SEQ ID NO: 1825875 - protein, 31 aa, Staphylococcus epidermidis
DIPRLNVLDLQRLIRVIPKPVIAMVRGYAIG

SEQ ID NO: 1825876 - protein, 18 aa, Staphylococcus epidermidis
DIPRVRFTTSHPWDFTDR

SEQ ID NO: 1825877 - protein, 24 aa, Staphylococcus epidermidis
DIQETIEKWPKFMKPDYLEVTTQL

SEQ ID NO: 1825878 - protein, 17 aa, Staphylococcus epidermidis
DIQQLNEDISNQKSKIA

SEQ ID NO: 1825879 - protein, 22 aa, Staphylococcus epidermidis
DIQRIEHMIRNALIIEDNGDNN

SEQ ID NO: 1825880 - protein, 19 aa, Staphylococcus epidermidis
DIQRLRPFGTDFNSPTFEL

SEQ ID NO: 1825881 - protein, 27 aa, Staphylococcus epidermidis
DIRDEETWMLFGTLPIYPCINDENDQK

SEQ ID NO: 1825882 - protein, 17 aa, Staphylococcus epidermidis
DIRHFYTNDVRFLDQFK

SEQ ID NO: 1825883 - protein, 17 aa, Staphylococcus epidermidis
DISIFELLNEKVEHQLP

SEQ ID NO: 1825884 - protein, 24 aa, Staphylococcus epidermidis
DISLKFEQNILLIKANKKLKNENQ

SEQ ID NO: 1825885 - protein, 24 aa, Staphylococcus epidermidis
DISNYVLLEYGQPLHMFDQDQIGS

SEQ ID NO: 1825886 - protein, 20 aa, Staphylococcus epidermidis
DISVIYTKYLGSASAINTTK

SEQ ID NO: 1825887 - protein, 20 aa, Staphylococcus epidermidis
DITCEFNTVLFNAAQYVRDL

SEQ ID NO: 1825888 - protein, 33 aa, Staphylococcus epidermidis
DITHVSLVPQTLKWLMDAGLTQPYSIEKILLGG

SEQ ID NO: 1825889 - protein, 17 aa, Staphylococcus epidermidis
DITIDLQAKLGYPPNNL

SEQ ID NO: 1825890 - protein, 26 aa, Staphylococcus epidermidis
DITVSQLMKYIKGPDFPTGGIIQGVD

SEQ ID NO: 1825891 - protein, 24 aa, Staphylococcus epidermidis
DIVEIYNRLPKNKPVKLLGVKNAN

SEQ ID NO: 1825892 - protein, 18 aa, Staphylococcus epidermidis
DIVKFRTRMGLENYTREG

SEQ ID NO: 1825893 - protein, 24 aa, Staphylococcus epidermidis
DIVSIGARPINLLNSLRFGELSVK

SEQ ID NO: 1825894 - protein, 19 aa, Staphylococcus epidermidis
DIVYIPYKTPILEEAENKG

SEQ ID NO: 1825895 - protein, 26 aa, Staphylococcus epidermidis
DIWEQVHVFMLPKDYLRYCLTDQIHM

SEQ ID NO: 1825896 - protein, 24 aa, Staphylococcus epidermidis
DIYDFPRVWLEKDSYDFSFSGLKS

SEQ ID NO: 1825897 - protein, 19 aa, Staphylococcus epidermidis
DIYELSLLQQKYDNQLNES

SEQ ID NO: 1825898 - protein, 18 aa, Staphylococcus epidermidis
DIYKYPLHDYTKSLLSAI

SEQ ID NO: 1825899 - protein, 29 aa, Staphylococcus epidermidis
DIYQAPFPSRWLYVVKHLQTLIQERKINQ

SEQ ID NO: 1825900 - protein, 18 aa, Staphylococcus epidermidis
DIYVSYRRAKIQLDADDE

SEQ ID NO: 1825901 - protein, 28 aa, Staphylococcus epidermidis
DIYYNLNVSFPQAALGDEIKIPTLKSNV

SEQ ID NO: 1825902 - protein, 23 aa, Staphylococcus epidermidis
DKADISLKRSFPFISQLAKEFNV

SEQ ID NO: 1825903 - protein, 19 aa, Staphylococcus epidermidis
DKAFLYWSTVNRNCVICGK

SEQ ID NO: 1825904 - protein, 23 aa, Staphylococcus epidermidis
DKAKIEDGLWFIQGRIDFQIKLN

SEQ ID NO: 1825905 - protein, 21 aa, Staphylococcus epidermidis
DKAMLYWATINRNCVLCGESN

SEQ ID NO: 1825906 - protein, 26 aa, Staphylococcus epidermidis
DKDAIQIVPLIIKYKNLLYENNITLT

SEQ ID NO: 1825907 - protein, 25 aa, Staphylococcus epidermidis
DKDPKLIGHLLDELIIINSYEIQKT

SEQ ID NO: 1825908 - protein, 23 aa, Staphylococcus epidermidis
DKDQKVLVFDLGGGTFDVSILEL

SEQ ID NO: 1825909 - protein, 25 aa, Staphylococcus epidermidis
DKDSEHYGLWSFKRVWGTYLSEKIG

SEQ ID NO: 1825910 - protein, 24 aa, Staphylococcus epidermidis
DKEITSKLIFELISSRISSEQIIT

SEQ ID NO: 1825911 - protein, 37 aa, Staphylococcus epidermidis
DKELPYLNLPEEMNPFLGYRAIRLCLAQQDIFRPQLR

SEQ ID NO: 1825912 - protein, 19 aa, Staphylococcus epidermidis
DKFLSKLTDFSLARLDKDV

SEQ ID NO: 1825913 - protein, 24 aa, Staphylococcus epidermidis
DKFYNDHFVIQYFSGLLGGKGRRA

SEQ ID NO: 1825914 - protein, 33 aa, Staphylococcus epidermidis
DKGFTVINIKKYLMNRLVGFTRKILGVLEDYNI

SEQ ID NO: 1825915 - protein, 23 aa, Staphylococcus epidermidis
DKGFTVINIKKYLMNRQVGFTRK

SEQ ID NO: 1825916 - protein, 25 aa, Staphylococcus epidermidis
DKGWHDMKIVPYAPLEVSPAAQGLH

SEQ ID NO: 1825917 - protein, 21 aa, Staphylococcus epidermidis
DKGYQLYFDSPTNQQFFVISN

SEQ ID NO: 1825918 - protein, 36 aa, Staphylococcus epidermidis
DKIDWRDELPNLDYSKIYLFNPNLDKITIFRDELIQ

SEQ ID NO: 1825919 - protein, 18 aa, Staphylococcus epidermidis
DKIIGYVGLWLVVDQAQI

SEQ ID NO: 1825920 - protein, 25 aa, Staphylococcus epidermidis
DKIIKKLNQINKPLKAVLLTHAHYD

SEQ ID NO: 1825921 - protein, 22 aa, Staphylococcus epidermidis
DKKLFIQDLEKFYDKVFSLTYR

SEQ ID NO: 1825922 - protein, 22 aa, Staphylococcus epidermidis
DKKVIMYAPTWRDDEFVSKGKY

SEQ ID NO: 1825923 - protein, 20 aa, Staphylococcus epidermidis
DKKVPKLYFTSHMDTVVPGI

SEQ ID NO: 1825924 - protein, 22 aa, Staphylococcus epidermidis
DKKVRGRKLGEDYNKGGIEDGF

SEQ ID NO: 1825925 - protein, 26 aa, Staphylococcus epidermidis
DKKVRSFYEFYSYLMEPWDGPTMISF

SEQ ID NO: 1825926 - protein, 28 aa, Staphylococcus epidermidis
DKLGGKMQIYPEKIIWDIGGVAPKPCYQ

SEQ ID NO: 1825927 - protein, 23 aa, Staphylococcus epidermidis
DKLYGYCIQRHISVRDKILIFSG

SEQ ID NO: 1825928 - protein, 18 aa, Staphylococcus epidermidis
DKLYGYCIQRHISVRNKV

SEQ ID NO: 1825929 - protein, 18 aa, Staphylococcus epidermidis
DKMYRRFSILTTISQNQP

SEQ ID NO: 1825930 - protein, 24 aa, Staphylococcus epidermidis
DKNNPLLEMLNFISIFSSNLDEFF

SEQ ID NO: 1825931 - protein, 21 aa, Staphylococcus epidermidis
DKNPYQLVYDIKGIGFNKADQ

SEQ ID NO: 1825932 - protein, 24 aa, Staphylococcus epidermidis
DKQGKPLRRAILWNDTRNSEQCRQ

SEQ ID NO: 1825933 - protein, 22 aa, Staphylococcus epidermidis
DKQNYLDFVDYYVDFLTSFVEE

SEQ ID NO: 1825934 - protein, 24 aa, Staphylococcus epidermidis
DKQSQIILWQSSLLLNFFKVEPME

SEQ ID NO: 1825935 - protein, 21 aa, Staphylococcus epidermidis
DKRFKLLNQIVNRNGALIDYQ

SEQ ID NO: 1825936 - protein, 24 aa, Staphylococcus epidermidis
DKRIKLGVIPSFSLYKLHEKNYIN

SEQ ID NO: 1825937 - protein, 24 aa, Staphylococcus epidermidis
DKSKPYLTTTFFSTKKNFSKDNST

SEQ ID NO: 1825938 - protein, 22 aa, Staphylococcus epidermidis
DKSVLIDLGLIIGKDARHRRNI

SEQ ID NO: 1825939 - protein, 17 aa, Staphylococcus epidermidis
DKTLAKQVLLIDRIQDP

SEQ ID NO: 1825940 - protein, 17 aa, Staphylococcus epidermidis
DKTLERKAVWDKWMEQD

SEQ ID NO: 1825941 - protein, 31 aa, Staphylococcus epidermidis
DKTTIQYQRFIRHIQFLIYRLTKGENVAAQD

SEQ ID NO: 1825942 - protein, 24 aa, Staphylococcus epidermidis
DKTYYIKPYFSNQLFKVQLTEEVL

SEQ ID NO: 1825943 - protein, 23 aa, Staphylococcus epidermidis
DKVILNLPIESPFGELKPLSIHD

SEQ ID NO: 1825944 - protein, 33 aa, Staphylococcus epidermidis
DKVKVLMDEFWPGPISFILPLKQGYLCSKVTGG

SEQ ID NO: 1825945 - protein, 25 aa, Staphylococcus epidermidis
DKYGEFFKGFTAVPVDKVANAFIKS

SEQ ID NO: 1825946 - protein, 19 aa, Staphylococcus epidermidis
DKYYLYTIDGWKMCSVIPL

SEQ ID NO: 1825947 - protein, 19 aa, Staphylococcus epidermidis
DLAIYDIFSMFQVGGSVVV

SEQ ID NO: 1825948 - protein, 20 aa, Staphylococcus epidermidis
DLALKKCWMLNQMSSFLELR

SEQ ID NO: 1825949 - protein, 18 aa, Staphylococcus epidermidis
DLALQKEVDFIIIAGDLF

SEQ ID NO: 1825950 - protein, 17 aa, Staphylococcus epidermidis
DLALYYNDAGADELVFL

SEQ ID NO: 1825951 - protein, 24 aa, Staphylococcus epidermidis
DLANFLYHAIQLNIAVGGGDHLVS

SEQ ID NO: 1825952 - protein, 18 aa, Staphylococcus epidermidis
DLAVLMIVGEGMSQVVGT

SEQ ID NO: 1825953 - protein, 17 aa, Staphylococcus epidermidis
DLCDRFLLLENHQIREI

SEQ ID NO: 1825954 - protein, 25 aa, Staphylococcus epidermidis
DLDIRAQYGINIIAIKRAKEFIVSP

SEQ ID NO: 1825955 - protein, 20 aa, Staphylococcus epidermidis
DLDLDFYLNGISLGRIGRDT

SEQ ID NO: 1825956 - protein, 19 aa, Staphylococcus epidermidis
DLDLILLNFANPDMVGHSG

SEQ ID NO: 1825957 - protein, 20 aa, Staphylococcus epidermidis
DLDPALIPFIMEKTGKTADE

SEQ ID NO: 1825958 - protein, 20 aa, Staphylococcus epidermidis
DLDVVVNAFGAPLGEEDAHV

SEQ ID NO: 1825959 - protein, 24 aa, Staphylococcus epidermidis
DLEQQWLDLPLEDDIRELGTPLPQ

SEQ ID NO: 1825960 - protein, 25 aa, Staphylococcus epidermidis
DLERDIWQYFTVLPGIQSVGVMGDY

SEQ ID NO: 1825961 - protein, 17 aa, Staphylococcus epidermidis
DLESRIYPVGRLDYDTS

SEQ ID NO: 1825962 - protein, 20 aa, Staphylococcus epidermidis
DLETRGMVLKINRNTQTSKG

SEQ ID NO: 1825963 - protein, 19 aa, Staphylococcus epidermidis
DLETRGMVLKVNRNTRTSK

SEQ ID NO: 1825964 - protein, 21 aa, Staphylococcus epidermidis
DLEVDFIFKARKPMGKAFKKA

SEQ ID NO: 1825965 - protein, 20 aa, Staphylococcus epidermidis
DLEYIYHYMVEGQKLIGKVK

SEQ ID NO: 1825966 - protein, 19 aa, Staphylococcus epidermidis
DLFKQLIMDELRKYKGNLK

SEQ ID NO: 1825967 - protein, 17 aa, Staphylococcus epidermidis
DLFKRCPYHFKLRYIDR

SEQ ID NO: 1825968 - protein, 19 aa, Staphylococcus epidermidis
DLGIELQSLLFFMKNYSNG

SEQ ID NO: 1825969 - protein, 22 aa, Staphylococcus epidermidis
DLGIKYLTLYAFSTENWSRPES

SEQ ID NO: 1825970 - protein, 18 aa, Staphylococcus epidermidis
DLGQARAFYIDELGLEHI

SEQ ID NO: 1825971 - protein, 24 aa, Staphylococcus epidermidis
DLHDHTFDIHLIPETRRSTILSSK

SEQ ID NO: 1825972 - protein, 21 aa, Staphylococcus epidermidis
DLHYTTGYYASPKLGYRRIFN

SEQ ID NO: 1825973 - protein, 18 aa, Staphylococcus epidermidis
DLIGKRLQYPGAPGSGGI

SEQ ID NO: 1825974 - protein, 20 aa, Staphylococcus epidermidis
DLIKSASYPNILPSSTNPTL

SEQ ID NO: 1825975 - protein, 22 aa, Staphylococcus epidermidis
DLINVQYILDLLNQIDLTDKEQ

SEQ ID NO: 1825976 - protein, 19 aa, Staphylococcus epidermidis
DLINYLHKFRNYHSHLYEL

SEQ ID NO: 1825977 - protein, 24 aa, Staphylococcus epidermidis
DLIPNQFVLIATGSTPKSLPFIDF

SEQ ID NO: 1825978 - protein, 19 aa, Staphylococcus epidermidis
DLIVVPGVAFDKLGYRIGY

SEQ ID NO: 1825979 - protein, 27 aa, Staphylococcus epidermidis
DLKEKVDPYLRPLYDGLNTVLGREQTE

SEQ ID NO: 1825980 - protein, 20 aa, Staphylococcus epidermidis
DLKPRYALNVLVEMANQSDL

SEQ ID NO: 1825981 - protein, 23 aa, Staphylococcus epidermidis
DLKPYTIAKHYADDYLRTSDLNY

SEQ ID NO: 1825982 - protein, 23 aa, Staphylococcus epidermidis
DLKPYTIAKHYADDYLRTSNLNY

SEQ ID NO: 1825983 - protein, 26 aa, Staphylococcus epidermidis
DLLDEETKFFINPTGRFVIGGPQGDA

SEQ ID NO: 1825984 - protein, 29 aa, Staphylococcus epidermidis
DLLKEKDALLKLDFITHSYPHDWRTKKPV

SEQ ID NO: 1825985 - protein, 24 aa, Staphylococcus epidermidis
DLLNAKFHFSRREANYYILSLYPQ

SEQ ID NO: 1825986 - protein, 19 aa, Staphylococcus epidermidis
DLLNVYCMMMDYYSLDESM

SEQ ID NO: 1825987 - protein, 30 aa, Staphylococcus epidermidis
DLLTEKGALLKLNFITHSYPHDWRTKKPVI

SEQ ID NO: 1825988 - protein, 20 aa, Staphylococcus epidermidis
DLLVEYDGELPFWDKSSPEA

SEQ ID NO: 1825989 - protein, 17 aa, Staphylococcus epidermidis
DLLVVPGVAFEKSGYRI

SEQ ID NO: 1825990 - protein, 18 aa, Staphylococcus epidermidis
DLLYIKSALLHHPRRRDN

SEQ ID NO: 1825991 - protein, 21 aa, Staphylococcus epidermidis
DLMKIANDVRWLASGPRAGLA

SEQ ID NO: 1825992 - protein, 18 aa, Staphylococcus epidermidis
DLMLVQTDRHYGKTLVLN

SEQ ID NO: 1825993 - protein, 19 aa, Staphylococcus epidermidis
DLMQIPYNKLPKALSDMIW

SEQ ID NO: 1825994 - protein, 25 aa, Staphylococcus epidermidis
DLNDIFNIGYFSLQTKVSLIAQETD

SEQ ID NO: 1825995 - protein, 25 aa, Staphylococcus epidermidis
DLNEKYSLFYFLREMFQDLLHHYII

SEQ ID NO: 1825996 - protein, 23 aa, Staphylococcus epidermidis
DLNIHVDFLPQDFSQEGFLAEFQ

SEQ ID NO: 1825997 - protein, 18 aa, Staphylococcus epidermidis
DLNIKYKKSIFYPEKVTI

SEQ ID NO: 1825998 - protein, 18 aa, Staphylococcus epidermidis
DLNKIEIHKLSLLEIVFS

SEQ ID NO: 1825999 - protein, 19 aa, Staphylococcus epidermidis
DLNQRLYHYWALGHIHQRE

SEQ ID NO: 1826000 - protein, 19 aa, Staphylococcus epidermidis
DLNRSMTYMLNLLRGMSSN

SEQ ID NO: 1826001 - protein, 22 aa, Staphylococcus epidermidis
DLNVYLQQLFTLCQLWKEISQL

SEQ ID NO: 1826002 - protein, 21 aa, Staphylococcus epidermidis
DLNVYSFFEKVLIKLTDNIEE

SEQ ID NO: 1826003 - protein, 20 aa, Staphylococcus epidermidis
DLPDYIQIWPGHGAGSPCGK

SEQ ID NO: 1826004 - protein, 21 aa, Staphylococcus epidermidis
DLPDYIQIWPGHGAGSPCGKA

SEQ ID NO: 1826005 - protein, 21 aa, Staphylococcus epidermidis
DLPDYIQIWPGHGAGSPCGKS

SEQ ID NO: 1826006 - protein, 30 aa, Staphylococcus epidermidis
DLPIIDTIKALMNYLKQRHIPMAIATSSYR

SEQ ID NO: 1826007 - protein, 19 aa, Staphylococcus epidermidis
DLPIIYDALINIVGHQLLV

SEQ ID NO: 1826008 - protein, 20 aa, Staphylococcus epidermidis
DLPNYIQIWPGHGAGSPCGK

SEQ ID NO: 1826009 - protein, 28 aa, Staphylococcus epidermidis
DLQPENMYQLLRKLPPREYSISSSYKAT

SEQ ID NO: 1826010 - protein, 22 aa, Staphylococcus epidermidis
DLRELHIYRLPVKANQYEYKLL

SEQ ID NO: 1826011 - protein, 26 aa, Staphylococcus epidermidis
DLSFDRKFEVFLVPTVIGEIKRYLRD

SEQ ID NO: 1826012 - protein, 21 aa, Staphylococcus epidermidis
DLSHRKLFPSIFHLYQQDNLD

SEQ ID NO: 1826013 - protein, 29 aa, Staphylococcus epidermidis
DLTEDQMVDFLFTSALFGRVVANNASVAG

SEQ ID NO: 1826014 - protein, 25 aa, Staphylococcus epidermidis
DLTETLAPYLTMAEGLKLAALTFDK

SEQ ID NO: 1826015 - protein, 24 aa, Staphylococcus epidermidis
DLTHYSDFFLTPNDYLRTLYEESF

SEQ ID NO: 1826016 - protein, 18 aa, Staphylococcus epidermidis
DLTIAVLLSAQCTDNLVN

SEQ ID NO: 1826017 - protein, 17 aa, Staphylococcus epidermidis
DLTLLPLEELDNYLKGD

SEQ ID NO: 1826018 - protein, 23 aa, Staphylococcus epidermidis
DLTPDEIFPYAPPQGIEALRDLW

SEQ ID NO: 1826019 - protein, 19 aa, Staphylococcus epidermidis
DLVFETFRNFMTGLPPVVK

SEQ ID NO: 1826020 - protein, 20 aa, Staphylococcus epidermidis
DLVLTNALIIDYDKIVKADI

SEQ ID NO: 1826021 - protein, 22 aa, Staphylococcus epidermidis
DLVNLLVFIINQKLTAHDLNQN

SEQ ID NO: 1826022 - protein, 24 aa, Staphylococcus epidermidis
DLYGGTFRLFDFYEQQYGVKFKYV

SEQ ID NO: 1826023 - protein, 25 aa, Staphylococcus epidermidis
DLYNKHHFKNFIYTPVGFVCEHLEV

SEQ ID NO: 1826024 - protein, 23 aa, Staphylococcus epidermidis
DMAEIRVFYRDEFLCTAISPDLA

SEQ ID NO: 1826025 - protein, 17 aa, Staphylococcus epidermidis
DMALFKFTKAVVNDESI

SEQ ID NO: 1826026 - protein, 24 aa, Staphylococcus epidermidis
DMDFRGEPFEPMPKLLAVSEQVTK

SEQ ID NO: 1826027 - protein, 17 aa, Staphylococcus epidermidis
DMFYIKHGTDNFSIIDC

SEQ ID NO: 1826028 - protein, 25 aa, Staphylococcus epidermidis
DMGELRGKIFYRKNFKTRVVSFVEW

SEQ ID NO: 1826029 - protein, 21 aa, Staphylococcus epidermidis
DMHNVEGMAFAIPINDVRKIA

SEQ ID NO: 1826030 - protein, 20 aa, Staphylococcus epidermidis
DMHSFRLFDYVMLGHLHHPF

SEQ ID NO: 1826031 - protein, 23 aa, Staphylococcus epidermidis
DMIDTWMNMTPMKRPGVPEELQG

SEQ ID NO: 1826032 - protein, 18 aa, Staphylococcus epidermidis
DMIEATVGELLPLGFSGK

SEQ ID NO: 1826033 - protein, 24 aa, Staphylococcus epidermidis
DMKEIIRRLSKVYGIKSISPVIKT

SEQ ID NO: 1826034 - protein, 33 aa, Staphylococcus epidermidis
DMKPYLTRDQHRLYKLIWERFVASQMAPAILDT

SEQ ID NO: 1826035 - protein, 25 aa, Staphylococcus epidermidis
DMLNEYYYLPQKLYEDIYADSFEDL

SEQ ID NO: 1826036 - protein, 25 aa, Staphylococcus epidermidis
DMLNIDVELRLLKYKHKDKVLAETS

SEQ ID NO: 1826037 - protein, 20 aa, Staphylococcus epidermidis
DMLRKKLALTSQIERIENRM

SEQ ID NO: 1826038 - protein, 28 aa, Staphylococcus epidermidis
DMNNPHAHVLLTQRPFNADGTWGKKTKT

SEQ ID NO: 1826039 - protein, 28 aa, Staphylococcus epidermidis
DMPWRETTNPYYIWLSEVMLQQTQVNTV

SEQ ID NO: 1826040 - protein, 17 aa, Staphylococcus epidermidis
DMQILIQKLIKTYHMTA

SEQ ID NO: 1826041 - protein, 24 aa, Staphylococcus epidermidis
DMTQKFFIAILIDLSDENQKIIQN

SEQ ID NO: 1826042 - protein, 19 aa, Staphylococcus epidermidis
DMWIDPIVEKYNNYSWYVV

SEQ ID NO: 1826043 - protein, 20 aa, Staphylococcus epidermidis
DMYLRQGYVYQGFKYHILKE

SEQ ID NO: 1826044 - protein, 25 aa, Staphylococcus epidermidis
DMYVNTWWETEADFKNWVNSDAFKE

SEQ ID NO: 1826045 - protein, 23 aa, Staphylococcus epidermidis
DNAKELLLKGLEKLEYRGYDSAG

SEQ ID NO: 1826046 - protein, 21 aa, Staphylococcus epidermidis
DNANIFYLKSAINKNLINFLD

SEQ ID NO: 1826047 - protein, 22 aa, Staphylococcus epidermidis
DNAYHEPLLILSDLYRSEEDYE

SEQ ID NO: 1826048 - protein, 25 aa, Staphylococcus epidermidis
DNDILGIPSFLVFKEGELLGSYIGK

SEQ ID NO: 1826049 - protein, 19 aa, Staphylococcus epidermidis
DNDISITNIILPFNENYNQ

SEQ ID NO: 1826050 - protein, 28 aa, Staphylococcus epidermidis
DNDISITNVILPFKENYNREIKHIDIFD

SEQ ID NO: 1826051 - protein, 27 aa, Staphylococcus epidermidis
DNDKFDYVIPKEGSNLWFDNMVIPKTA

SEQ ID NO: 1826052 - protein, 22 aa, Staphylococcus epidermidis
DNDRILYSMKVSETLIVVESPY

SEQ ID NO: 1826053 - protein, 36 aa, Staphylococcus epidermidis
DNESKNYILFFIDKYKIKTPFLDQLLINCLNQEIDQ

SEQ ID NO: 1826054 - protein, 24 aa, Staphylococcus epidermidis
DNEVRIQWRVADIKIPNNEIKNIS

SEQ ID NO: 1826055 - protein, 23 aa, Staphylococcus epidermidis
DNFRDILQDVFQLAPTPLDVDKL

SEQ ID NO: 1826056 - protein, 25 aa, Staphylococcus epidermidis
DNHEKIELFKKLEFKQLLSDIDEDA

SEQ ID NO: 1826057 - protein, 24 aa, Staphylococcus epidermidis
DNKDFYYFGFQDRAAIKDNLLHTV

SEQ ID NO: 1826058 - protein, 19 aa, Staphylococcus epidermidis
DNKKFVLGSVSHKVAKRAT

SEQ ID NO: 1826059 - protein, 24 aa, Staphylococcus epidermidis
DNKKFVLGSVSHKVAKRATIPVLI

SEQ ID NO: 1826060 - protein, 23 aa, Staphylococcus epidermidis
DNKKKLKKLFKYDKKEALSFTKE

SEQ ID NO: 1826061 - protein, 23 aa, Staphylococcus epidermidis
DNKNLAYKAADLMFERFNINEGV

SEQ ID NO: 1826062 - protein, 23 aa, Staphylococcus epidermidis
DNKVKVIAWYDNEWGYSNRVVEV

SEQ ID NO: 1826063 - protein, 25 aa, Staphylococcus epidermidis
DNLNLTINEYFKFLLKTYPSDQTQV

SEQ ID NO: 1826064 - protein, 22 aa, Staphylococcus epidermidis
DNLRNRIIITLRLFASTTKKEL

SEQ ID NO: 1826065 - protein, 28 aa, Staphylococcus epidermidis
DNNSELQNLLLDPYFKNIVTEYQDALRD

SEQ ID NO: 1826066 - protein, 28 aa, Staphylococcus epidermidis
DNPFDPPMFARVFRKHLEGGFIQNIRQV

SEQ ID NO: 1826067 - protein, 24 aa, Staphylococcus epidermidis
DNQHPLFHFLTNAAKGMINEKIKW

SEQ ID NO: 1826068 - protein, 29 aa, Staphylococcus epidermidis
DNRIVQALPTIKYIIEQGGKLVLFSHLGK

SEQ ID NO: 1826069 - protein, 33 aa, Staphylococcus epidermidis
DNSEFELIIKTDMPHFVMFTFNDPQVWNNDFNI

SEQ ID NO: 1826070 - protein, 28 aa, Staphylococcus epidermidis
DNSSKLRQYLVSKGILVFPGFEISTSEK

SEQ ID NO: 1826071 - protein, 19 aa, Staphylococcus epidermidis
DNTFPLGTIKITTDGYKFI

SEQ ID NO: 1826072 - protein, 32 aa, Staphylococcus epidermidis
DNTRKLLKQLADPTLPLIVTTIQKMANAVKSN

SEQ ID NO: 1826073 - protein, 24 aa, Staphylococcus epidermidis
DNTRKLLRQLADPTSPLIVTTIQK

SEQ ID NO: 1826074 - protein, 28 aa, Staphylococcus epidermidis
DNYDIEWPELMKLLPRRSRTSIKKKLFQ

SEQ ID NO: 1826075 - protein, 24 aa, Staphylococcus epidermidis
DPAFDRVKHIYSIEKGKLEIGNIL

SEQ ID NO: 1826076 - protein, 32 aa, Staphylococcus epidermidis
DPAKTSIHMLLDYLFEMINPYSLNQQGQDKGQ

SEQ ID NO: 1826077 - protein, 17 aa, Staphylococcus epidermidis
DPDERILEKVPTYFVKL

SEQ ID NO: 1826078 - protein, 21 aa, Staphylococcus epidermidis
DPDPLPMDIIYRRLDEIPNLR

SEQ ID NO: 1826079 - protein, 22 aa, Staphylococcus epidermidis
DPEIYNLGIPVLGICYGMQLTT

SEQ ID NO: 1826080 - protein, 17 aa, Staphylococcus epidermidis
DPFKILSKRELEILPLI

SEQ ID NO: 1826081 - protein, 24 aa, Staphylococcus epidermidis
DPFTKIQLWLPIKQEIYDLDEDYQ

SEQ ID NO: 1826082 - protein, 22 aa, Staphylococcus epidermidis
DPGFWVPNDYVVVKVALRGSSG

SEQ ID NO: 1826083 - protein, 20 aa, Staphylococcus epidermidis
DPIAIADFWECATAYLGKNA

SEQ ID NO: 1826084 - protein, 21 aa, Staphylococcus epidermidis
DPIAIADFWECATAYLGKNAP

SEQ ID NO: 1826085 - protein, 21 aa, Staphylococcus epidermidis
DPLFSEALKLYDNKLDIGLDE

SEQ ID NO: 1826086 - protein, 20 aa, Staphylococcus epidermidis
DPLHIVLWFDRMRETYGLEK

SEQ ID NO: 1826087 - protein, 33 aa, Staphylococcus epidermidis
DPNGLIYYKGYYYISHQWFPLGAVHGLKYWFNY

SEQ ID NO: 1826088 - protein, 22 aa, Staphylococcus epidermidis
DPNKVIELLNFMARSPQYSFKN

SEQ ID NO: 1826089 - protein, 20 aa, Staphylococcus epidermidis
DPQKIVRWRAAMFVFDEGNE

SEQ ID NO: 1826090 - protein, 24 aa, Staphylococcus epidermidis
DPTEYIYQIFYHWNQKEYLASEIF

SEQ ID NO: 1826091 - protein, 25 aa, Staphylococcus epidermidis
DPTRIRILHLLFYKEYSVNGIAETL

SEQ ID NO: 1826092 - protein, 20 aa, Staphylococcus epidermidis
DPTYLEYHDYYWGQPIYDGK

SEQ ID NO: 1826093 - protein, 25 aa, Staphylococcus epidermidis
DQDEATHLPYIYLSAGVSAELFQDT

SEQ ID NO: 1826094 - protein, 26 aa, Staphylococcus epidermidis
DQDGNIYFIYTVKQLEDILNCGNQKV

SEQ ID NO: 1826095 - protein, 26 aa, Staphylococcus epidermidis
DQDVKLTVTALLAKAVVLALKEYGAM

SEQ ID NO: 1826096 - protein, 22 aa, Staphylococcus epidermidis
DQETLTLDYVPSLKLSNYEANQ

SEQ ID NO: 1826097 - protein, 30 aa, Staphylococcus epidermidis
DQFRDIIKRMYFFSIANPNPFEWLNQLSHP

SEQ ID NO: 1826098 - protein, 24 aa, Staphylococcus epidermidis
DQHIREYIVLKLQSKPNRLHQVSK

SEQ ID NO: 1826099 - protein, 22 aa, Staphylococcus epidermidis
DQIFIQTWHGFPLKKMVNDLNE

SEQ ID NO: 1826100 - protein, 17 aa, Staphylococcus epidermidis
DQIIPMIDYFKDKDIEI

SEQ ID NO: 1826101 - protein, 22 aa, Staphylococcus epidermidis
DQKVIDWLWETQDKTFFDSKQD

SEQ ID NO: 1826102 - protein, 23 aa, Staphylococcus epidermidis
DQLFIYRRNYQSKSWLVIANFSK

SEQ ID NO: 1826103 - protein, 25 aa, Staphylococcus epidermidis
DQLKEVVIAYEPIWAIGTGKSSTSE

SEQ ID NO: 1826104 - protein, 18 aa, Staphylococcus epidermidis
DQLLFTQHKIRGIEFPGG

SEQ ID NO: 1826105 - protein, 18 aa, Staphylococcus epidermidis
DQLNLTDNIFNFSGKNRT

SEQ ID NO: 1826106 - protein, 18 aa, Staphylococcus epidermidis
DQLTCIFVDHGLLRKGEG

SEQ ID NO: 1826107 - protein, 21 aa, Staphylococcus epidermidis
DQLYEKFGFKSTEPYSKGMYI

SEQ ID NO: 1826108 - protein, 23 aa, Staphylococcus epidermidis
DQMEGKLFGIPMGIKDNIITKDV

SEQ ID NO: 1826109 - protein, 26 aa, Staphylococcus epidermidis
DQMNEFERMILLRSIDSHWTDHIDTM

SEQ ID NO: 1826110 - protein, 28 aa, Staphylococcus epidermidis
DQQEIKSPMVGTFFLQDSKELTEPKIKV

SEQ ID NO: 1826111 - protein, 23 aa, Staphylococcus epidermidis
DQRQTMLFSATMPKAIQELVQQF

SEQ ID NO: 1826112 - protein, 26 aa, Staphylococcus epidermidis
DQTTAILTGNFLLALGLQHLSEIKDS

SEQ ID NO: 1826113 - protein, 30 aa, Staphylococcus epidermidis
DQVMIDYGYTPLDKNNWRLNKTRKAEARSK

SEQ ID NO: 1826114 - protein, 17 aa, Staphylococcus epidermidis
DQYLTNGKSRSIPIFVF

SEQ ID NO: 1826115 - protein, 27 aa, Staphylococcus epidermidis
DRDDSFYYNRFKYFKDRVLVPLAYIDF

SEQ ID NO: 1826116 - protein, 25 aa, Staphylococcus epidermidis
DRDGRLIGIVSLKIDMHNVEGMAFA

SEQ ID NO: 1826117 - protein, 29 aa, Staphylococcus epidermidis
DREEGIHYKNLLGSYLHGPILPKNHEMTD

SEQ ID NO: 1826118 - protein, 22 aa, Staphylococcus epidermidis
DREQLLKEVWHYEFYGDLRTVD

SEQ ID NO: 1826119 - protein, 23 aa, Staphylococcus epidermidis
DRETLDILIGYDGSIDKAFIEEC

SEQ ID NO: 1826120 - protein, 18 aa, Staphylococcus epidermidis
DRFLLETLLFTDMITDED

SEQ ID NO: 1826121 - protein, 23 aa, Staphylococcus epidermidis
DRFPGFQLDYFKKTNYLDTDWKD

SEQ ID NO: 1826122 - protein, 31 aa, Staphylococcus epidermidis
DRFYEIYNELLRRYDFVLIDTPPVNTVTDAQ

SEQ ID NO: 1826123 - protein, 18 aa, Staphylococcus epidermidis
DRGALILVKQGIQPIFSV

SEQ ID NO: 1826124 - protein, 30 aa, Staphylococcus epidermidis
DRHFIEHCINLKWIGWFATGVNNLPLNYIK

SEQ ID NO: 1826125 - protein, 20 aa, Staphylococcus epidermidis
DRHSFLVEKLRLLIQQLKQS

SEQ ID NO: 1826126 - protein, 25 aa, Staphylococcus epidermidis
DRIGKLPLLMDFINNDSIDPSVIFS

SEQ ID NO: 1826127 - protein, 24 aa, Staphylococcus epidermidis
DRKEFEALLRQIYVPQPQGKTSTS

SEQ ID NO: 1826128 - protein, 22 aa, Staphylococcus epidermidis
DRKNIPFDELVLFSSARSAGKK

SEQ ID NO: 1826129 - protein, 25 aa, Staphylococcus epidermidis
DRLKCYLEPLRLNLNDYRVMLIHPW

SEQ ID NO: 1826130 - protein, 25 aa, Staphylococcus epidermidis
DRLKCYLEPLRLNLNNYRVMLIHPW

SEQ ID NO: 1826131 - protein, 19 aa, Staphylococcus epidermidis
DRLLVPIFDARREAVYTGV

SEQ ID NO: 1826132 - protein, 20 aa, Staphylococcus epidermidis
DRLTRQYENIIRNSNLVGAE

SEQ ID NO: 1826133 - protein, 29 aa, Staphylococcus epidermidis
DRMKARDLLGRYHSLFTEKVDLNVATPVF

SEQ ID NO: 1826134 - protein, 19 aa, Staphylococcus epidermidis
DRNLYTPYSLPITNTNLFK

SEQ ID NO: 1826135 - protein, 24 aa, Staphylococcus epidermidis
DRNSILSTLFRRVGYSEKAGSGGP

SEQ ID NO: 1826136 - protein, 22 aa, Staphylococcus epidermidis
DRPSEDWVWRDGFVKMDTLEVD

SEQ ID NO: 1826137 - protein, 22 aa, Staphylococcus epidermidis
DRPTDEWQWRDGFVKMDTLEVD

SEQ ID NO: 1826138 - protein, 21 aa, Staphylococcus epidermidis
DRRAQFVCVISMSAPDEETKT

SEQ ID NO: 1826139 - protein, 24 aa, Staphylococcus epidermidis
DRTGKLDYILNLAPISSEGLEQLL

SEQ ID NO: 1826140 - protein, 22 aa, Staphylococcus epidermidis
DRVTPPCIYYAKCGGCQLQHMT

SEQ ID NO: 1826141 - protein, 27 aa, Staphylococcus epidermidis
DSARMYYNLAYYLQIKITLEDMRRPVS

SEQ ID NO: 1826142 - protein, 23 aa, Staphylococcus epidermidis
DSDTFIYCLEGEVSLLLGNQTYQ

SEQ ID NO: 1826143 - protein, 23 aa, Staphylococcus epidermidis
DSELRSHFDSMPNSASISQSNVA

SEQ ID NO: 1826144 - protein, 24 aa, Staphylococcus epidermidis
DSFEYNVELQFIKEKEKEIEIYKE

SEQ ID NO: 1826145 - protein, 24 aa, Staphylococcus epidermidis
DSFYHFNPNWHIVGITYDSIEKIK

SEQ ID NO: 1826146 - protein, 24 aa, Staphylococcus epidermidis
DSGQVFLQPLNPQYPMIPCNESCS

SEQ ID NO: 1826147 - protein, 28 aa, Staphylococcus epidermidis
DSHNEWVNMLGVVPVIRALREKAMNIQS

SEQ ID NO: 1826148 - protein, 27 aa, Staphylococcus epidermidis
DSHTGQYYFHLFSKKQPDLNWNNPDVR

SEQ ID NO: 1826149 - protein, 23 aa, Staphylococcus epidermidis
DSHYRLYGIFLLNQLNGKEILMT

SEQ ID NO: 1826150 - protein, 25 aa, Staphylococcus epidermidis
DSILKAIRLIGILDEAKILDALNGG

SEQ ID NO: 1826151 - protein, 24 aa, Staphylococcus epidermidis
DSLHNELFPIEYGLKGLKSFQVKD

SEQ ID NO: 1826152 - protein, 25 aa, Staphylococcus epidermidis
DSLHNELFPIEYGLKGLKSFQVKDS

SEQ ID NO: 1826153 - protein, 18 aa, Staphylococcus epidermidis
DSLNYNTYYKVLNAHELG

SEQ ID NO: 1826154 - protein, 20 aa, Staphylococcus epidermidis
DSLPLVVFTGQVATPGIGKD

SEQ ID NO: 1826155 - protein, 28 aa, Staphylococcus epidermidis
DSNHVTLPHLFSDILIYCTERNVMLVDL

SEQ ID NO: 1826156 - protein, 25 aa, Staphylococcus epidermidis
DSNNKMLQRIYGTAFFDKKDLKAHL

SEQ ID NO: 1826157 - protein, 20 aa, Staphylococcus epidermidis
DSNVVGFLNILEGCRHHKVG

SEQ ID NO: 1826158 - protein, 23 aa, Staphylococcus epidermidis
DSPEFVNESPYEKAWMVKVEMND

SEQ ID NO: 1826159 - protein, 17 aa, Staphylococcus epidermidis
DSQYVVYGVRTYGYNLR

SEQ ID NO: 1826160 - protein, 29 aa, Staphylococcus epidermidis
DSRDFLSMESLPQSITFIGAGIISIEFAS

SEQ ID NO: 1826161 - protein, 21 aa, Staphylococcus epidermidis
DSSLMAMQFMLTAKAYGYDTN

SEQ ID NO: 1826162 - protein, 24 aa, Staphylococcus epidermidis
DSSSPHTYYLIANSMINGFPHKDR

SEQ ID NO: 1826163 - protein, 24 aa, Staphylococcus epidermidis
DSSSPHTYYLIANSMINGFSHKDR

SEQ ID NO: 1826164 - protein, 31 aa, Staphylococcus epidermidis
DSTGHILNLYFPFIDVETMLTLLDLANVYVS

SEQ ID NO: 1826165 - protein, 23 aa, Staphylococcus epidermidis
DSTTTYAAPNPYGAFSGDIKKQI

SEQ ID NO: 1826166 - protein, 18 aa, Staphylococcus epidermidis
DSVDFLRPIKTGDILSYE

SEQ ID NO: 1826167 - protein, 19 aa, Staphylococcus epidermidis
DSWNMSPVALRKAFEKFER

SEQ ID NO: 1826168 - protein, 22 aa, Staphylococcus epidermidis
DSYSQLLEFAYPTDKTEVYLND

SEQ ID NO: 1826169 - protein, 24 aa, Staphylococcus epidermidis
DTALFRLKSNLWQLAKDTYQEWYL

SEQ ID NO: 1826170 - protein, 21 aa, Staphylococcus epidermidis
DTAPAFFQGTPGYEEQMFGEA

SEQ ID NO: 1826171 - protein, 22 aa, Staphylococcus epidermidis
DTDEFLLNDLPYKNIENWEKAE

SEQ ID NO: 1826172 - protein, 25 aa, Staphylococcus epidermidis
DTDLYIDFMNLKQWCQNKFQVTNQI

SEQ ID NO: 1826173 - protein, 22 aa, Staphylococcus epidermidis
DTDWLLNDLIISDTFPYENELY

SEQ ID NO: 1826174 - protein, 20 aa, Staphylococcus epidermidis
DTDYILLDEPLNNLDMKHSV

SEQ ID NO: 1826175 - protein, 27 aa, Staphylococcus epidermidis
DTEFEKHMYAIHMLTSLVSSHQSRSTI

SEQ ID NO: 1826176 - protein, 23 aa, Staphylococcus epidermidis
DTETFIEWLTLFINEQLTYSDGL

SEQ ID NO: 1826177 - protein, 26 aa, Staphylococcus epidermidis
DTEVNIVWNPPWNKDMMSRYAKIALG

SEQ ID NO: 1826178 - protein, 21 aa, Staphylococcus epidermidis
DTFIIAFSKAKHHFSIMPEAA

SEQ ID NO: 1826179 - protein, 20 aa, Staphylococcus epidermidis
DTGFYPLGSCTMKYNPKVNE

SEQ ID NO: 1826180 - protein, 29 aa, Staphylococcus epidermidis
DTHMMHVTISYPLPDNRLLTQLFTELEEG

SEQ ID NO: 1826181 - protein, 28 aa, Staphylococcus epidermidis
DTIENRPMMYLALSYDHRIIDGKEAVGF

SEQ ID NO: 1826182 - protein, 20 aa, Staphylococcus epidermidis
DTIFLHCLPAFHDTQTQYGQ

SEQ ID NO: 1826183 - protein, 19 aa, Staphylococcus epidermidis
DTIYIYEKVIAGAGGLPVG

SEQ ID NO: 1826184 - protein, 26 aa, Staphylococcus epidermidis
DTKKMQNMGMIPRFAGGSKKKNWLEN

SEQ ID NO: 1826185 - protein, 23 aa, Staphylococcus epidermidis
DTKVMTVTYAGQTFTRNLTDWIK

SEQ ID NO: 1826186 - protein, 24 aa, Staphylococcus epidermidis
DTKYLMHFITSWDHISYKQAFYIA

SEQ ID NO: 1826187 - protein, 20 aa, Staphylococcus epidermidis
DTLDIVIDFGFNTYGKRRVR

SEQ ID NO: 1826188 - protein, 19 aa, Staphylococcus epidermidis
DTLDPVYKEIIRLIYREEI

SEQ ID NO: 1826189 - protein, 27 aa, Staphylococcus epidermidis
DTLKLQNYFRNLFVLRTFSKAYGLAGM

SEQ ID NO: 1826190 - protein, 29 aa, Staphylococcus epidermidis
DTLPDAHFSKIYLFSPNLDKITDFRNHLV

SEQ ID NO: 1826191 - protein, 23 aa, Staphylococcus epidermidis
DTNEVFLHLTQDKAHLIIQIVDS

SEQ ID NO: 1826192 - protein, 30 aa, Staphylococcus epidermidis
DTNEVIGTAPYWHPVLLKNHLKRMSDEQMR

SEQ ID NO: 1826193 - protein, 17 aa, Staphylococcus epidermidis
DTNGFVKLITLKEDDTI

SEQ ID NO: 1826194 - protein, 20 aa, Staphylococcus epidermidis
DTNWPVCGIPEKFYTDHGSD

SEQ ID NO: 1826195 - protein, 22 aa, Staphylococcus epidermidis
DTPLLYLDGFNFENKKAKLYPL

SEQ ID NO: 1826196 - protein, 18 aa, Staphylococcus epidermidis
DTRREVERKLLVEGIIPI

SEQ ID NO: 1826197 - protein, 23 aa, Staphylococcus epidermidis
DTSVAVQWLIDKGYDVVACCLDV

SEQ ID NO: 1826198 - protein, 20 aa, Staphylococcus epidermidis
DTTCFQYNISKHIATDFKFK

SEQ ID NO: 1826199 - protein, 25 aa, Staphylococcus epidermidis
DTVAVLLPATTFYLDKNDYADARGM

SEQ ID NO: 1826200 - protein, 23 aa, Staphylococcus epidermidis
DTVYRNLHLFKDLGIIESTELEG

SEQ ID NO: 1826201 - protein, 18 aa, Staphylococcus epidermidis
DTYSKIYELYFKNQSPFE

SEQ ID NO: 1826202 - protein, 34 aa, Staphylococcus epidermidis
DVAIDFSNPELLFPLLEEQFNLPLVIATTGEKET

SEQ ID NO: 1826203 - protein, 17 aa, Staphylococcus epidermidis
DVAYRMLHQLDLTAQDI

SEQ ID NO: 1826204 - protein, 20 aa, Staphylococcus epidermidis
DVDELLKKYDGNILRIVSDK

SEQ ID NO: 1826205 - protein, 20 aa, Staphylococcus epidermidis
DVDRLLVVTFTNLSAREMKH

SEQ ID NO: 1826206 - protein, 23 aa, Staphylococcus epidermidis
DVEEAPFLRIDLNEMVGALPKQL

SEQ ID NO: 1826207 - protein, 22 aa, Staphylococcus epidermidis
DVEMLQDLVLAATNEAMNKADE

SEQ ID NO: 1826208 - protein, 18 aa, Staphylococcus epidermidis
DVFHHLLQHFDSTAFLNF

SEQ ID NO: 1826209 - protein, 24 aa, Staphylococcus epidermidis
DVFHHLLQHFDSTAFLNFNTYRDD

SEQ ID NO: 1826210 - protein, 26 aa, Staphylococcus epidermidis
DVFHHLLQHFDSTAFLNFNTYRDDRQ

SEQ ID NO: 1826211 - protein, 17 aa, Staphylococcus epidermidis
DVFIGVSVADLLDKEMV

SEQ ID NO: 1826212 - protein, 17 aa, Staphylococcus epidermidis
DVFLGFDCASSEFYENG

SEQ ID NO: 1826213 - protein, 29 aa, Staphylococcus epidermidis
DVFSENLRNLLLQPPMKGKQILGVDPAFR

SEQ ID NO: 1826214 - protein, 18 aa, Staphylococcus epidermidis
DVFSPSTYPPLSYSFDHL

SEQ ID NO: 1826215 - protein, 24 aa, Staphylococcus epidermidis
DVIDEDGLTIIYAEPDQFAQVQDT

SEQ ID NO: 1826216 - protein, 19 aa, Staphylococcus epidermidis
DVIYVHCQSGIRSSIAIGI

SEQ ID NO: 1826217 - protein, 27 aa, Staphylococcus epidermidis
DVKGGLQFTYISLDDYRIIKSHLFGDG

SEQ ID NO: 1826218 - protein, 19 aa, Staphylococcus epidermidis
DVKLIIIKYDEQLSKDLIL

SEQ ID NO: 1826219 - protein, 24 aa, Staphylococcus epidermidis
DVKNKLFNIVYAYNAVKKNFKQAE

SEQ ID NO: 1826220 - protein, 18 aa, Staphylococcus epidermidis
DVKQFRHFQTVKFGDLSK

SEQ ID NO: 1826221 - protein, 35 aa, Staphylococcus epidermidis
DVLIHGMLNPNTLLDLIRYFVVFQDDGKGHISKIL

SEQ ID NO: 1826222 - protein, 23 aa, Staphylococcus epidermidis
DVLKEMFISMIYKNVSSIYLDFS

SEQ ID NO: 1826223 - protein, 26 aa, Staphylococcus epidermidis
DVLVDGLFMYQLYKPNLPYKGSLNQR

SEQ ID NO: 1826224 - protein, 26 aa, Staphylococcus epidermidis
DVMAHLTMEFFTKGLVPITSLSFGYD

SEQ ID NO: 1826225 - protein, 24 aa, Staphylococcus epidermidis
DVMNMITNWFPSQSTMYVIKQLEM

SEQ ID NO: 1826226 - protein, 23 aa, Staphylococcus epidermidis
DVNFKLYIGLKHISPYIEEAVEQ

SEQ ID NO: 1826227 - protein, 30 aa, Staphylococcus epidermidis
DVNKIFNSMNKRQLRRVMTLFNVSKSDIKL

SEQ ID NO: 1826228 - protein, 24 aa, Staphylococcus epidermidis
DVNKLKAYQAQYSKGFKPYMEASQ

SEQ ID NO: 1826229 - protein, 19 aa, Staphylococcus epidermidis
DVNNLLQGAKTLDTAMHGL

SEQ ID NO: 1826230 - protein, 20 aa, Staphylococcus epidermidis
DVNRAPYSSIYFLLTHEKIS

SEQ ID NO: 1826231 - protein, 24 aa, Staphylococcus epidermidis
DVPKSLEIHYYESFAKTHQGHGTD

SEQ ID NO: 1826232 - protein, 17 aa, Staphylococcus epidermidis
DVPLVEKAQQKELLEKY

SEQ ID NO: 1826233 - protein, 22 aa, Staphylococcus epidermidis
DVPTFAICHGPLLLVDTDDLNG

SEQ ID NO: 1826234 - protein, 24 aa, Staphylococcus epidermidis
DVSHRIRDVIPVYAIPVGFSEEAT

SEQ ID NO: 1826235 - protein, 26 aa, Staphylococcus epidermidis
DVSQQLHELYLKYQPDIIFIECSGVA

SEQ ID NO: 1826236 - protein, 23 aa, Staphylococcus epidermidis
DVTKLPFIEFQADPIYINQIKQW

SEQ ID NO: 1826237 - protein, 26 aa, Staphylococcus epidermidis
DVTLSMIMLTLYARTIAKWSQNKSFI

SEQ ID NO: 1826238 - protein, 20 aa, Staphylococcus epidermidis
DVTTSKPFFLEFMAKDVSKG

SEQ ID NO: 1826239 - protein, 19 aa, Staphylococcus epidermidis
DVVGITYGSLFDATQTRVM

SEQ ID NO: 1826240 - protein, 22 aa, Staphylococcus epidermidis
DVVIGDFPIGYYPVDERSKEMK

SEQ ID NO: 1826241 - protein, 23 aa, Staphylococcus epidermidis
DVVYIIFTRNNIVKYRSYLLEEK

SEQ ID NO: 1826242 - protein, 18 aa, Staphylococcus epidermidis
DVYDDCEFIVAIRSMLIK

SEQ ID NO: 1826243 - protein, 20 aa, Staphylococcus epidermidis
DWECFIISKTDMLLDGVPRE

SEQ ID NO: 1826244 - protein, 19 aa, Staphylococcus epidermidis
DWECLIISKTDMLLDGVPK

SEQ ID NO: 1826245 - protein, 19 aa, Staphylococcus epidermidis
DWELDEPVPPLPPAKNFKG

SEQ ID NO: 1826246 - protein, 20 aa, Staphylococcus epidermidis
DWEVLLKPAKRIKVGNRLSF

SEQ ID NO: 1826247 - protein, 25 aa, Staphylococcus epidermidis
DWKRIGRMISIPKFMLKVAIQKYKM

SEQ ID NO: 1826248 - protein, 18 aa, Staphylococcus epidermidis
DWNQLRMKAYLRDNRECQ

SEQ ID NO: 1826249 - protein, 25 aa, Staphylococcus epidermidis
DWRTKKPVIFRATPQWFASINKVRQ

SEQ ID NO: 1826250 - protein, 20 aa, Staphylococcus epidermidis
DWSIERLLKSDRIILRMATF

SEQ ID NO: 1826251 - protein, 17 aa, Staphylococcus epidermidis
DWVVIGPEQPLIDGLAD

SEQ ID NO: 1826252 - protein, 21 aa, Staphylococcus epidermidis
DYAFLVLNMNKVYLYVDIKNE

SEQ ID NO: 1826253 - protein, 17 aa, Staphylococcus epidermidis
DYDLDIKVYPNGKYHLL

SEQ ID NO: 1826254 - protein, 21 aa, Staphylococcus epidermidis
DYEGWWLFSDWPEKVVERLDF

SEQ ID NO: 1826255 - protein, 29 aa, Staphylococcus epidermidis
DYEHALTNYYLYFLVDSNIEIGIKSIIIK

SEQ ID NO: 1826256 - protein, 20 aa, Staphylococcus epidermidis
DYEISLLQIDYPEKFVNIQH

SEQ ID NO: 1826257 - protein, 23 aa, Staphylococcus epidermidis
DYENIKIVGLMTMAPLTDDASYI

SEQ ID NO: 1826258 - protein, 22 aa, Staphylococcus epidermidis
DYFDCNLFYRTSKGIFLTQKGN

SEQ ID NO: 1826259 - protein, 17 aa, Staphylococcus epidermidis
DYGPFYRYDPNQCILCG

SEQ ID NO: 1826260 - protein, 30 aa, Staphylococcus epidermidis; identical to SEQ ID NO: 1690795

SEQ ID NO: 1826261 - protein, 28 aa, Staphylococcus epidermidis
DYHVAAEILKYFGLSKINLLSNNPKKFE

SEQ ID NO: 1826262 - protein, 24 aa, Staphylococcus epidermidis
DYISQFKTGYFSPLANLARMTEEV

SEQ ID NO: 1826263 - protein, 20 aa, Staphylococcus epidermidis
DYKILFNEVAYQRRITKNDL

SEQ ID NO: 1826264 - protein, 19 aa, Staphylococcus epidermidis
DYLAVLSTGAYHYSMASNY

SEQ ID NO: 1826265 - protein, 18 aa, Staphylococcus epidermidis
DYLEDFIFPRNDLYFNDE

SEQ ID NO: 1826266 - protein, 28 aa, Staphylococcus epidermidis
DYLKDLGIDVIWLSPMYKSPNDDNGYDI

SEQ ID NO: 1826267 - protein, 25 aa, Staphylococcus epidermidis
DYLTSTTLLELKKIPKRLTVIGSGY

SEQ ID NO: 1826268 - protein, 25 aa, Staphylococcus epidermidis
DYLVEELVEFLWSSVAGNEHETEKL

SEQ ID NO: 1826269 - protein, 20 aa, Staphylococcus epidermidis
DYMRQFYYDTALSTGESAFA

SEQ ID NO: 1826270 - protein, 23 aa, Staphylococcus epidermidis
DYNNFIMISYIKNRVNAMYTNQN

SEQ ID NO: 1826271 - protein, 18 aa, Staphylococcus epidermidis
DYPILSSVLEIFHRHVPI

SEQ ID NO: 1826272 - protein, 29 aa, Staphylococcus epidermidis
DYPNQINNVLAFPGIFRGALDVEATHINE

SEQ ID NO: 1826273 - protein, 28 aa, Staphylococcus epidermidis
DYRAKSKRLMVMKQSFKKVVIKNCENMQ

SEQ ID NO: 1826274 - protein, 32 aa, Staphylococcus epidermidis
DYSINVPMDLLPYLFFQFSRNGKRLYSDNAVD

SEQ ID NO: 1826275 - protein, 25 aa, Staphylococcus epidermidis
DYSSFISYHIFFETLLRKYNERKEK

SEQ ID NO: 1826276 - protein, 26 aa, Staphylococcus epidermidis
DYTKRPDIVLFINGLPIVVIELKNST

SEQ ID NO: 1826277 - protein, 30 aa, Staphylococcus epidermidis
DYVESFIQHMKKIMTMLDAPNIECLRQADI

SEQ ID NO: 1826278 - protein, 25 aa, Staphylococcus epidermidis
DYVGRIGIGRVFRGKMRVGDNVSLI

SEQ ID NO: 1826279 - protein, 23 aa, Staphylococcus epidermidis
EAAKDVAMHIAAINPKYVSSDQV

SEQ ID NO: 1826280 - protein, 22 aa, Staphylococcus epidermidis
EAASGFLALIDAGPNKINKYSK

SEQ ID NO: 1826281 - protein, 20 aa, Staphylococcus epidermidis
EACQLLMGKVKFRCFACYRY

SEQ ID NO: 1826282 - protein, 35 aa, Staphylococcus epidermidis
EADKYVFVSPMWNLSFPLVLKAYIDAIAVAGKTFK

SEQ ID NO: 1826283 - protein, 20 aa, Staphylococcus epidermidis
EADRLRFDFSHFGPMSQEEI

SEQ ID NO: 1826284 - protein, 24 aa, Staphylococcus epidermidis
EADVILYDRLVNKEILNYASLSTK

SEQ ID NO: 1826285 - protein, 22 aa, Staphylococcus epidermidis
EAEILEWFDAIGRRRGLLQKGN

SEQ ID NO: 1826286 - protein, 24 aa, Staphylococcus epidermidis
EAEKISDFLSLIGGYQALLKFEDV

SEQ ID NO: 1826287 - protein, 17 aa, Staphylococcus epidermidis
EAFIHFLNRITAGNYDI

SEQ ID NO: 1826288 - protein, 17 aa, Staphylococcus epidermidis
EAFKDKILIPQNDLNRT

SEQ ID NO: 1826289 - protein, 17 aa, Staphylococcus epidermidis
EAFLKSKGGQLADFVRY

SEQ ID NO: 1826290 - protein, 19 aa, Staphylococcus epidermidis
EAFNKTLSLYPTKNLEDFY

SEQ ID NO: 1826291 - protein, 20 aa, Staphylococcus epidermidis
EAGAQIVPFLQIKNSQDLTQ

SEQ ID NO: 1826292 - protein, 23 aa, Staphylococcus epidermidis
EAGHALINLLKDVDTRAIIVGGA

SEQ ID NO: 1826293 - protein, 20 aa, Staphylococcus epidermidis
EAGMVITIEPGIYVPGIAGV

SEQ ID NO: 1826294 - protein, 26 aa, Staphylococcus epidermidis
EAHASHIMIQQSQLSYLLADSSKRDA

SEQ ID NO: 1826295 - protein, 21 aa, Staphylococcus epidermidis
EAHLLYQAFLKSKDQYDDVMR

SEQ ID NO: 1826296 - protein, 43 aa, Staphylococcus epidermidis
EAHNLRYQFLQKYWNTLPQKGNINIYFRSWYSHYLDYKENQIK

SEQ ID NO: 1826297 - protein, 17 aa, Staphylococcus epidermidis
EAIAWHLSKILELEDSK

SEQ ID NO: 1826298 - protein, 19 aa, Staphylococcus epidermidis
EAIDWFKTTLNTETPIGEL

SEQ ID NO: 1826299 - protein, 20 aa, Staphylococcus epidermidis
EAIDYLLLLIDTSHENVLLD

SEQ ID NO: 1826300 - protein, 18 aa, Staphylococcus epidermidis
EAIEAPAGMRRKEWDKLK

SEQ ID NO: 1826301 - protein, 18 aa, Staphylococcus epidermidis
EAIGVAGLVTPWNFPTNQ

SEQ ID NO: 1826302 - protein, 25 aa, Staphylococcus epidermidis
EAKDALNSIERLKAAKAKADKFIES

SEQ ID NO: 1826303 - protein, 29 aa, Staphylococcus epidermidis
EAKEDKVHFNYFKDYFLTDGGVKNWEQIS

SEQ ID NO: 1826304 - protein, 24 aa, Staphylococcus epidermidis
EAKFSILMLLLYEENLTLSPSELS

SEQ ID NO: 1826305 - protein, 25 aa, Staphylococcus epidermidis
EAKPTYTLQQYLDFGFKGNKLGFTF

SEQ ID NO: 1826306 - protein, 25 aa, Staphylococcus epidermidis
EAKRTKSLLKFKTFHTVDLRCLRVE

SEQ ID NO: 1826307 - protein, 17 aa, Staphylococcus epidermidis
EAKTGAGFIVALTGAIM

SEQ ID NO: 1826308 - protein, 27 aa, Staphylococcus epidermidis
EALENNFFTLSFNVKVLSGSATLKFKV

SEQ ID NO: 1826309 - protein, 23 aa, Staphylococcus epidermidis
EALHSIFLEVIIAPQFTEEALKI

SEQ ID NO: 1826310 - protein, 18 aa, Staphylococcus epidermidis
EALNYYVRRFMITVPFEN

SEQ ID NO: 1826311 - protein, 23 aa, Staphylococcus epidermidis
EAMASFLNSFPMFKDDTRNTNPK

SEQ ID NO: 1826312 - protein, 24 aa, Staphylococcus epidermidis
EAMESIFQLMKKHIKVYQMSDPSE

SEQ ID NO: 1826313 - protein, 35 aa, Staphylococcus epidermidis
EAPLIQAQLIETILLNIINFHTLIATKASRIRQIA

SEQ ID NO: 1826314 - protein, 27 aa, Staphylococcus epidermidis
EAQLFSTQLLFQFLFSQGRLEEARAFI

SEQ ID NO: 1826315 - protein, 28 aa, Staphylococcus epidermidis
EAQLFTTQLLFQFLFSQGRLTDARAYIL

SEQ ID NO: 1826316 - protein, 21 aa, Staphylococcus epidermidis
EAQPEQMLKFGLPRLVKYLNM

SEQ ID NO: 1826317 - protein, 31 aa, Staphylococcus epidermidis
EAQQKQVVIFTHDLPFLLLMQNKSSEKQLDC

SEQ ID NO: 1826318 - protein, 24 aa, Staphylococcus epidermidis
EARSIRLDLPPFTLVGATTRAGSL

SEQ ID NO: 1826319 - protein, 28 aa, Staphylococcus epidermidis
EARVKPHPFINLLNYILLESSGADIACT

SEQ ID NO: 1826320 - protein, 17 aa, Staphylococcus epidermidis
EARYVFNQPYEGGKMVV

SEQ ID NO: 1826321 - protein, 25 aa, Staphylococcus epidermidis
EAVEQQLQLIWHSPNIYKSQLQEKV

SEQ ID NO: 1826322 - protein, 22 aa, Staphylococcus epidermidis
EAYHAPIRLLIVIQAPDAYIQR

SEQ ID NO: 1826323 - protein, 17 aa, Staphylococcus epidermidis
EAYKIISQGLLEGFKNL

SEQ ID NO: 1826324 - protein, 23 aa, Staphylococcus epidermidis
EAYKQNMFALLGKPGYEDKKKEL

SEQ ID NO: 1826325 - protein, 35 aa, Staphylococcus epidermidis
ECGAREVFLDYVWNVQFAMQFSYSFSLLHTTAYSV

SEQ ID NO: 1826326 - protein, 20 aa, Staphylococcus epidermidis
ECYEIYHPIERVGIYVPGGK

SEQ ID NO: 1826327 - protein, 24 aa, Staphylococcus epidermidis
EDAEILDWFDAIGRRRGLLQKGNE

SEQ ID NO: 1826328 - protein, 17 aa, Staphylococcus epidermidis
EDALIFNSGYDANLAVF

SEQ ID NO: 1826329 - protein, 23 aa, Staphylococcus epidermidis
EDALRIIRGLRFQSQLNFQIVNE

SEQ ID NO: 1826330 - protein, 24 aa, Staphylococcus epidermidis
EDAQQHIQVFRIGEGGLGGEIHLF

SEQ ID NO: 1826331 - protein, 24 aa, Staphylococcus epidermidis
EDCKAQLIDLPFTSTAKELGTALM

SEQ ID NO: 1826332 - protein, 23 aa, Staphylococcus epidermidis
EDDALCFYDLGSSEMNLDMAIEM

SEQ ID NO: 1826333 - protein, 22 aa, Staphylococcus epidermidis
EDDIEIAHILSLTLAKIKVRAD

SEQ ID NO: 1826334 - protein, 24 aa, Staphylococcus epidermidis
EDDKSYFRRYALTGSGISPRPIPG

SEQ ID NO: 1826335 - protein, 24 aa, Staphylococcus epidermidis
EDEEMEDIFIPPTKINRALDGDTV

SEQ ID NO: 1826336 - protein, 37 aa, Staphylococcus epidermidis
EDEIKWDHIFVYKYKLKTPFIDKIIIDNLKNIKSQYI

SEQ ID NO: 1826337 - protein, 27 aa, Staphylococcus epidermidis
EDELSKLFNINVFGTLFGIQAAANQFI

SEQ ID NO: 1826338 - protein, 23 aa, Staphylococcus epidermidis
EDFKDLEIILFGDKEQYNLNHDR

SEQ ID NO: 1826339 - protein, 22 aa, Staphylococcus epidermidis
EDFQQWIQWLKENQVNILKGRP

SEQ ID NO: 1826340 - protein, 22 aa, Staphylococcus epidermidis
EDFVKYIIPELQRRALFKNSYN

SEQ ID NO: 1826341 - protein, 19 aa, Staphylococcus epidermidis
EDFYKNHTYIKHLITINVK

SEQ ID NO: 1826342 - protein, 24 aa, Staphylococcus epidermidis
EDGIQIGVRVIVPFGPRTIQGYVM

SEQ ID NO: 1826343 - protein, 25 aa, Staphylococcus epidermidis
EDGSREYVGLPKGLFTFPELEGNTK

SEQ ID NO: 1826344 - protein, 29 aa, Staphylococcus epidermidis
EDIALKKCRMLLKLNAYLELREEAIILLK

SEQ ID NO: 1826345 - protein, 18 aa, Staphylococcus epidermidis
EDIDQCYFIIPQEKFDKE

SEQ ID NO: 1826346 - protein, 20 aa, Staphylococcus epidermidis
EDIFFEVFDVLQELGLTKVN

SEQ ID NO: 1826347 - protein, 18 aa, Staphylococcus epidermidis
EDIIDIVQRVQGGQFEHV

SEQ ID NO: 1826348 - protein, 18 aa, Staphylococcus epidermidis
EDIKGAIVGFFTPELFHG

SEQ ID NO: 1826349 - protein, 24 aa, Staphylococcus epidermidis
EDINRLIYMIKEAKKPLILAGAGI

SEQ ID NO: 1826350 - protein, 18 aa, Staphylococcus epidermidis
EDISLIYRHLEARMSGEF

SEQ ID NO: 1826351 - protein, 22 aa, Staphylococcus epidermidis
EDKAFFFNQFSKVETIIKEAGF

SEQ ID NO: 1826352 - protein, 17 aa, Staphylococcus epidermidis
EDKDLYMFEPYSIQEEF

SEQ ID NO: 1826353 - protein, 40 aa, Staphylococcus epidermidis
EDKEADLILFGHNHRLHMFDGKSTIYFNPGAVGLNNGAHT

SEQ ID NO: 1826354 - protein, 23 aa, Staphylococcus epidermidis
EDKGILYAPDYIVNSGGVINTAD

SEQ ID NO: 1826355 - protein, 23 aa, Staphylococcus epidermidis
EDKKFNIVIANILAHIIEEMIED

SEQ ID NO: 1826356 - protein, 23 aa, Staphylococcus epidermidis
EDKKLLLETKITEVLSRLSIEPS

SEQ ID NO: 1826357 - protein, 24 aa, Staphylococcus epidermidis
EDKKVRGRRLGEDYNKGGIEDGFE

SEQ ID NO: 1826358 - protein, 22 aa, Staphylococcus epidermidis
EDKLLLIGSGAYPMTLIQVAKE

SEQ ID NO: 1826359 - protein, 47 aa, Staphylococcus epidermidis
EDLDIYIDWSFLLEYMKYVNKFIRILNFPFYFRGEVYDPFETLTLSE

SEQ ID NO: 1826360 - protein, 18 aa, Staphylococcus epidermidis
EDLDKARWYLNRAFEKWE

SEQ ID NO: 1826361 - protein, 26 aa, Staphylococcus epidermidis
EDLEMPNMIIFLDADLDILKSRIAKR

SEQ ID NO: 1826362 - protein, 19 aa, Staphylococcus epidermidis
EDLETISHSSFDFIKQLKA

SEQ ID NO: 1826363 - protein, 24 aa, Staphylococcus epidermidis
EDLKDQFDHALSNARKAIVKATGK

SEQ ID NO: 1826364 - protein, 18 aa, Staphylococcus epidermidis
EDLKLQFDHAIQVAHDVL

SEQ ID NO: 1826365 - protein, 28 aa, Staphylococcus epidermidis
EDLKTKINIFLFSCSTLIYPQPLNKKQK

SEQ ID NO: 1826366 - protein, 20 aa, Staphylococcus epidermidis
EDLTYFQIKLVIVGIERGDL

SEQ ID NO: 1826367 - protein, 18 aa, Staphylococcus epidermidis
EDMLKIYEDIGYSTQFIG

SEQ ID NO: 1826368 - protein, 23 aa, Staphylococcus epidermidis
EDPEKMIEDFWNALYGRSKVSQN

SEQ ID NO: 1826369 - protein, 21 aa, Staphylococcus epidermidis
EDPTFKQLISYCLLENEKGEI

SEQ ID NO: 1826370 - protein, 25 aa, Staphylococcus epidermidis
EDRLRSRFEWGLIVDITPPDYETRM

SEQ ID NO: 1826371 - protein, 23 aa, Staphylococcus epidermidis
EDSIYGKVFAMTHKCLYKAIEDY

SEQ ID NO: 1826372 - protein, 25 aa, Staphylococcus epidermidis
EDTNYLKDNILKFGLYTDDTHIVIN

SEQ ID NO: 1826373 - protein, 23 aa, Staphylococcus epidermidis
EDVALLAELCSVSLFPINQLKEV

SEQ ID NO: 1826374 - protein, 23 aa, Staphylococcus epidermidis
EDVEMLQDLVLAATNEAMNKADE

SEQ ID NO: 1826375 - protein, 22 aa, Staphylococcus epidermidis
EDVIEFFVLFNHFKIHKTEKYL

SEQ ID NO: 1826376 - protein, 18 aa, Staphylococcus epidermidis
EDVKLNDYLTFYQKEMNY

SEQ ID NO: 1826377 - protein, 22 aa, Staphylococcus epidermidis
EDVMPTLYLIKGDKELALRKAE

SEQ ID NO: 1826378 - protein, 24 aa, Staphylococcus epidermidis
EDVNFQAPPFAYFGSDFVGTIVAK

SEQ ID NO: 1826379 - protein, 26 aa, Staphylococcus epidermidis
EDVQPINVIVERLLDQLYKEIEKKPL

SEQ ID NO: 1826380 - protein, 25 aa, Staphylococcus epidermidis
EDWGGDTIFVPLSALSGDGIEDLLE

SEQ ID NO: 1826381 - protein, 29 aa, Staphylococcus epidermidis
EDWKARLRMLKSFPTPTFDDIPLLETALN

SEQ ID NO: 1826382 - protein, 17 aa, Staphylococcus epidermidis
EDYEAIIELLTFVDEED

SEQ ID NO: 1826383 - protein, 23 aa, Staphylococcus epidermidis
EDYFDCQLFYRTSKGIFLTQKGN

SEQ ID NO: 1826384 - protein, 28 aa, Staphylococcus epidermidis
EDYIQFLHDIGVDRIIFGDPAVVMFVKK

SEQ ID NO: 1826385 - protein, 26 aa, Staphylococcus epidermidis
EDYTVLRGFKPYYIEHGAFSGALGAI

SEQ ID NO: 1826386 - protein, 44 aa, Staphylococcus epidermidis
EDYVQFTAYQIIFDLAKKYVNPFFVNDLLPVDALKMWSQKFNEP

SEQ ID NO: 1826387 - protein, 26 aa, Staphylococcus epidermidis
EEAETLIIDIIVAVQIIITMLKEPTI

SEQ ID NO: 1826388 - protein, 18 aa, Staphylococcus epidermidis
EEAGKFVHHSLGEGTFDD

SEQ ID NO: 1826389 - protein, 24 aa, Staphylococcus epidermidis
EEAPGVGMRFIQINEIKLAIINLQ

SEQ ID NO: 1826390 - protein, 27 aa, Staphylococcus epidermidis
EEARYELQEFPEHLAKYLMNYSLSEIQ

SEQ ID NO: 1826391 - protein, 25 aa, Staphylococcus epidermidis
EEDFQKWIQWLKENQVNILKGRPRD

SEQ ID NO: 1826392 - protein, 24 aa, Staphylococcus epidermidis
EEDKDTIYVAKNKSPLLIGVGEGF

SEQ ID NO: 1826393 - protein, 25 aa, Staphylococcus epidermidis
EEDLDPVFMWHLAYAYGQEERDKEA

SEQ ID NO: 1826394 - protein, 24 aa, Staphylococcus epidermidis
EEDVVKAIFNCQTPIISAVGHETD

SEQ ID NO: 1826395 - protein, 25 aa, Staphylococcus epidermidis
EEEFYTFIGQFYSLNQHILPKEVHV

SEQ ID NO: 1826396 - protein, 25 aa, Staphylococcus epidermidis
EEEFYTFIGQFYSLNQHLLPKEVHV

SEQ ID NO: 1826397 - protein, 18 aa, Staphylococcus epidermidis
EEEKAHITIFPKIENQEG

SEQ ID NO: 1826398 - protein, 27 aa, Staphylococcus epidermidis
EEELSKLFNINVFGTLFGIQAAANQFI

SEQ ID NO: 1826399 - protein, 24 aa, Staphylococcus epidermidis
EEEQRTKLYKGWKKAVEATQVFKL

SEQ ID NO: 1826400 - protein, 21 aa, Staphylococcus epidermidis
EEFFRALVINARLTVHIDLLR

SEQ ID NO: 1826401 - protein, 22 aa, Staphylococcus epidermidis
EEFIAYFIRKLHLSHNDIVIID

SEQ ID NO: 1826402 - protein, 23 aa, Staphylococcus epidermidis
EEFLYKYMNLQYLRTDAGRINFI

SEQ ID NO: 1826403 - protein, 17 aa, Staphylococcus epidermidis
EEGKRAVLLLHGFTGNS

SEQ ID NO: 1826404 - protein, 23 aa, Staphylococcus epidermidis
EEGLYRKRLISYGGLLKEIHKEL

SEQ ID NO: 1826405 - protein, 25 aa, Staphylococcus epidermidis
EEGYINFIELIIHRIDSMNYEIEGT

SEQ ID NO: 1826406 - protein, 28 aa, Staphylococcus epidermidis
EEHGIHVILTDTFALNKPAQNLFEKFGF

SEQ ID NO: 1826407 - protein, 25 aa, Staphylococcus epidermidis
EEIEWQNFWKTFASQWLKDLNINEE

SEQ ID NO: 1826408 - protein, 28 aa, Staphylococcus epidermidis
EEIFKYVINYLIAYIKKEDDQEALSKVI

SEQ ID NO: 1826409 - protein, 23 aa, Staphylococcus epidermidis
EEIKFKLIKVKKNFAIGKLIEVI

SEQ ID NO: 1826410 - protein, 28 aa, Staphylococcus epidermidis
EEIQDYPFILYDRGFYHHQLKEFEKTHG

SEQ ID NO: 1826411 - protein, 23 aa, Staphylococcus epidermidis
EEIYQHFNVNWIAPAMREDGSEF

SEQ ID NO: 1826412 - protein, 24 aa, Staphylococcus epidermidis
EEKGFSYLMLFDDYNKIDLTLLPL

SEQ ID NO: 1826413 - protein, 23 aa, Staphylococcus epidermidis
EEKGKFNMIFQFEHLGLWSTGDT

SEQ ID NO: 1826414 - protein, 27 aa, Staphylococcus epidermidis
EEKKYYLILGCLPKYKGYLNLSTRPTN

SEQ ID NO: 1826415 - protein, 23 aa, Staphylococcus epidermidis
EEKMEEEMFLGLRMNQGVNTERF

SEQ ID NO: 1826416 - protein, 34 aa, Staphylococcus epidermidis
EEKNYLDAVIGLPANLFFGTSIPTSILVFKKCRE

SEQ ID NO: 1826417 - protein, 22 aa, Staphylococcus epidermidis
EEKYFYLYIMTNSKTSQCGIYE

SEQ ID NO: 1826418 - protein, 20 aa, Staphylococcus epidermidis
EELGFKGNTWLFFGEQHFTT

SEQ ID NO: 1826419 - protein, 24 aa, Staphylococcus epidermidis
EELGITILINLHFVDLAKEYGSRI

SEQ ID NO: 1826420 - protein, 19 aa, Staphylococcus epidermidis
EELIKWQKYMESISDSIEG

SEQ ID NO: 1826421 - protein, 23 aa, Staphylococcus epidermidis
EELLARIRAILRRQPQKDVIDIN

SEQ ID NO: 1826422 - protein, 18 aa, Staphylococcus epidermidis
EELRRKKPHLFTVPQKHG

SEQ ID NO: 1826423 - protein, 17 aa, Staphylococcus epidermidis
EELSLNMIIFYKNYQKN

SEQ ID NO: 1826424 - protein, 20 aa, Staphylococcus epidermidis
EELYRFPIMYVEYSGTYGDV

SEQ ID NO: 1826425 - protein, 26 aa, Staphylococcus epidermidis
EEMGYTQKSPRWAIAYKFPAEEVVTK

SEQ ID NO: 1826426 - protein, 26 aa, Staphylococcus epidermidis
EEMRKLFPENEKLLRWLDLAEEKISY

SEQ ID NO: 1826427 - protein, 50 aa, Staphylococcus epidermidis
EENAPVIWRGPMLGKMLTNFFTEVQWGDLDYLLLDLPPGTGDVALDVHSM

SEQ ID NO: 1826428 - protein, 31 aa, Staphylococcus epidermidis
EENDVYFLNGPLDLTFLFGLVSHLSNKLKYL

SEQ ID NO: 1826429 - protein, 24 aa, Staphylococcus epidermidis
EEPLDINEFKQIILKTIFGENEVE

SEQ ID NO: 1826430 - protein, 21 aa, Staphylococcus epidermidis
EEPLKFKVRLLFDEHKFTLNN

SEQ ID NO: 1826431 - protein, 19 aa, Staphylococcus epidermidis
EEPPKNTIAILLSTKPEQI

SEQ ID NO: 1826432 - protein, 23 aa, Staphylococcus epidermidis
EEQIYHLNGRLKLQLLDEVKSVY

SEQ ID NO: 1826433 - protein, 22 aa, Staphylococcus epidermidis
EEQLFALIVEKIREAFKDRILI

SEQ ID NO: 1826434 - protein, 25 aa, Staphylococcus epidermidis
EEQLKEVVIAYEPIWAIGTGKSSTS

SEQ ID NO: 1826435 - protein, 27 aa, Staphylococcus epidermidis
EEQVQQGHLFLLLAKENWHEGVLGIVA

SEQ ID NO: 1826436 - protein, 27 aa, Staphylococcus epidermidis
EEQYVELFFDLLGIKPDWEKIKYYILL

SEQ ID NO: 1826437 - protein, 20 aa, Staphylococcus epidermidis
EERFKGFYAPSPGSVYPILQ

SEQ ID NO: 1826438 - protein, 27 aa, Staphylococcus epidermidis
EETARQCAIVWGVNPVVKEGRKNTDAL

SEQ ID NO: 1826439 - protein, 26 aa, Staphylococcus epidermidis
EETEIYSMMLGALRLLINGSDFSTGW

SEQ ID NO: 1826440 - protein, 22 aa, Staphylococcus epidermidis
EETGWFVWNMATYDLREAVNLS

SEQ ID NO: 1826441 - protein, 23 aa, Staphylococcus epidermidis
EETKDVFYHLLNSQYRSERLLKE

SEQ ID NO: 1826442 - protein, 19 aa, Staphylococcus epidermidis
EETLTMPFFSDKKAIVVKN

SEQ ID NO: 1826443 - protein, 17 aa, Staphylococcus epidermidis
EETNLILNLMKSAGISP

SEQ ID NO: 1826444 - protein, 25 aa, Staphylococcus epidermidis
EETNPSLIISFYPKFAVHPDHEATA

SEQ ID NO: 1826445 - protein, 23 aa, Staphylococcus epidermidis
EETPFAAIILAEIFDKAGVPKGV

SEQ ID NO: 1826446 - protein, 38 aa, Staphylococcus epidermidis
EETTTLYDTPAGRIPLTVKTLSILHFVTPDGGKLKIHY

SEQ ID NO: 1826447 - protein, 26 aa, Staphylococcus epidermidis
EEVENTLIPYFKKIEKRALFNQEKVL

SEQ ID NO: 1826448 - protein, 26 aa, Staphylococcus epidermidis
EEVENTLIPYFRKIEKRALFNQEKVL

SEQ ID NO: 1826449 - protein, 23 aa, Staphylococcus epidermidis
EEVMHALPRHALFNHAGQAELGN

SEQ ID NO: 1826450 - protein, 26 aa, Staphylococcus epidermidis
EEVPPPLMEFIFDTTRTIIYMSQKNV

SEQ ID NO: 1826451 - protein, 19 aa, Staphylococcus epidermidis
EEYASFIRQQWAKLGLGLD

SEQ ID NO: 1826452 - protein, 24 aa, Staphylococcus epidermidis
EEYEKQLFNFDKYTPLYSVFNIVN

SEQ ID NO: 1826453 - protein, 17 aa, Staphylococcus epidermidis
EEYLAPLKEMFAKYVPA

SEQ ID NO: 1826454 - protein, 23 aa, Staphylococcus epidermidis
EEYQLIEEYLVAKAPKNLKSEQA

SEQ ID NO: 1826455 - protein, 27 aa, Staphylococcus epidermidis
EFDNGLKLFVIPKPGFQKTYVTYTTQF

SEQ ID NO: 1826456 - protein, 18 aa, Staphylococcus epidermidis
EFDVTFTCQPFSYSDGSL

SEQ ID NO: 1826457 - protein, 18 aa, Staphylococcus epidermidis
EFENLLHRSGFKNLDELH

SEQ ID NO: 1826458 - protein, 31 aa, Staphylococcus epidermidis
EFENPMTRIFNYFSFLILVSESLSSGANEFL

SEQ ID NO: 1826459 - protein, 33 aa, Staphylococcus epidermidis
EFEQERFYKLYKFLFEDDYFRKLSDSAKIAYCM

SEQ ID NO: 1826460 - protein, 28 aa, Staphylococcus epidermidis
EFGLQGNRLFYLAMAPQFFGVISDFLKS

SEQ ID NO: 1826461 - protein, 24 aa, Staphylococcus epidermidis
EFGPDLPELLKYLKLKLSDFIQLH

SEQ ID NO: 1826462 - protein, 24 aa, Staphylococcus epidermidis
EFGSPKAIIPKKLAHEVGADLIMS

SEQ ID NO: 1826463 - protein, 27 aa, Staphylococcus epidermidis
EFHEVMIFASNHQYLKTFWNHLKPVME

SEQ ID NO: 1826464 - protein, 17 aa, Staphylococcus epidermidis
EFIDPMKGLIGVTVPQW

SEQ ID NO: 1826465 - protein, 18 aa, Staphylococcus epidermidis
EFIDPMKGLIGVTVPQWF

SEQ ID NO: 1826466 - protein, 19 aa, Staphylococcus epidermidis
EFIGFVDLIVKRKGTNDIA

SEQ ID NO: 1826467 - protein, 24 aa, Staphylococcus epidermidis
EFKIREQHLLLPSSEKARPKLVQQ

SEQ ID NO: 1826468 - protein, 21 aa, Staphylococcus epidermidis
EFKLKPSGWYKTIPPKKDGGT

SEQ ID NO: 1826469 - protein, 17 aa, Staphylococcus epidermidis
EFKNLTPYVTKLAKVHS

SEQ ID NO: 1826470 - protein, 22 aa, Staphylococcus epidermidis
EFKSHLLKLFKETDVAVMSGSL

SEQ ID NO: 1826471 - protein, 23 aa, Staphylococcus epidermidis
EFLELLVRVFCDCFKFKEIVDYN

SEQ ID NO: 1826472 - protein, 19 aa, Staphylococcus epidermidis
EFNAVLFNAAQYVRDLYQT

SEQ ID NO: 1826473 - protein, 28 aa, Staphylococcus epidermidis
EFNRLQYQIIYILSKILDKHPLPKSDNN

SEQ ID NO: 1826474 - protein, 21 aa, Staphylococcus epidermidis
EFNYYLSEYVGRETPLTFAES

SEQ ID NO: 1826475 - protein, 25 aa, Staphylococcus epidermidis
EFNYYLSEYVGRETPLTFAESYTKL

SEQ ID NO: 1826476 - protein, 18 aa, Staphylococcus epidermidis
EFQRLRRIKQLGTLYLSF

SEQ ID NO: 1826477 - protein, 25 aa, Staphylococcus epidermidis
EFQYAYGLPDYGVIDKVLPLTIVII

SEQ ID NO: 1826478 - protein, 19 aa, Staphylococcus epidermidis
EFRMCNGGIRFLGVKDGKN

SEQ ID NO: 1826479 - protein, 23 aa, Staphylococcus epidermidis
EFSNKLLSYFVSSKSLILDLNSV

SEQ ID NO: 1826480 - protein, 17 aa, Staphylococcus epidermidis
EFSNLYALLVPKVPTME

SEQ ID NO: 1826481 - protein, 30 aa, Staphylococcus epidermidis
EFSTQLLDRYLVIAHSYHLKPRILITKHDI

SEQ ID NO: 1826482 - protein, 18 aa, Staphylococcus epidermidis
EFTNIYAMLIPKMSSMDD

SEQ ID NO: 1826483 - protein, 22 aa, Staphylococcus epidermidis
EFVSLSVLDYKYFEEITNVEKQ

SEQ ID NO: 1826484 - protein, 25 aa, Staphylococcus epidermidis
EGAARYMSGFYTVVKMVEGLIHDLN

SEQ ID NO: 1826485 - protein, 20 aa, Staphylococcus epidermidis
EGAEHFGYIFFADNKTFHIY

SEQ ID NO: 1826486 - protein, 24 aa, Staphylococcus epidermidis
EGDAIDVYTMTSILWDVVKKQQKE

SEQ ID NO: 1826487 - protein, 22 aa, Staphylococcus epidermidis
EGDSFTFDKVLFVGGDSVKVGA

SEQ ID NO: 1826488 - protein, 27 aa, Staphylococcus epidermidis
EGELLFGDTVAVFGAGPIGLLTVIAAK

SEQ ID NO: 1826489 - protein, 25 aa, Staphylococcus epidermidis
EGELNYELFPIPDKPFFTARLVQQK

SEQ ID NO: 1826490 - protein, 25 aa, Staphylococcus epidermidis
EGELPEERLFRKYAHTIRNWDDEEQ

SEQ ID NO: 1826491 - protein, 27 aa, Staphylococcus epidermidis
EGFEGYFMMNSLDAPFLLIGDPRIEGG

SEQ ID NO: 1826492 - protein, 18 aa, Staphylococcus epidermidis
EGFIWAHYEPQMSVVQIE

SEQ ID NO: 1826493 - protein, 19 aa, Staphylococcus epidermidis
EGFKNLGFETYFAIPRSKE

SEQ ID NO: 1826494 - protein, 19 aa, Staphylococcus epidermidis
EGFKNLGFETYFAVPRSKE

SEQ ID NO: 1826495 - protein, 17 aa, Staphylococcus epidermidis
EGFVFEYGLIQHSLSKK

SEQ ID NO: 1826496 - protein, 24 aa, Staphylococcus epidermidis
EGGHSWKSWKPMLGDILKYFLSDV

SEQ ID NO: 1826497 - protein, 24 aa, Staphylococcus epidermidis
EGHSYSHYLLIEQAINALKGAGYA

SEQ ID NO: 1826498 - protein, 25 aa, Staphylococcus epidermidis
EGIEFVEFLISPNKGEPLKSLNKIA

SEQ ID NO: 1826499 - protein, 19 aa, Staphylococcus epidermidis
EGIELLNYIKRIFTILHEA

SEQ ID NO: 1826500 - protein, 28 aa, Staphylococcus epidermidis
EGIVKQFSHCELIPQLKLIESTKSGGEV

SEQ ID NO: 1826501 - protein, 22 aa, Staphylococcus epidermidis
EGKGITFLRIADDAPAETIGIT

SEQ ID NO: 1826502 - protein, 22 aa, Staphylococcus epidermidis
EGKNIWFGVREFAMGAAVNGMA

SEQ ID NO: 1826503 - protein, 24 aa, Staphylococcus epidermidis
EGKYTGDYLADKGIVPFLKVDKGL

SEQ ID NO: 1826504 - protein, 19 aa, Staphylococcus epidermidis
EGLIKLDGLPLNQLKHKDI

SEQ ID NO: 1826505 - protein, 20 aa, Staphylococcus epidermidis
EGLPLGGIIYTDISKDGKLS

SEQ ID NO: 1826506 - protein, 19 aa, Staphylococcus epidermidis
EGLSIKASKFPYAANGRAL

SEQ ID NO: 1826507 - protein, 22 aa, Staphylococcus epidermidis
EGMDWLLHHAYHRVPQLKDSHI

SEQ ID NO: 1826508 - protein, 37 aa, Staphylococcus epidermidis
EGMMLCEYLKVKPELLKFMLKVFKDLEFIYDDQGIIK

SEQ ID NO: 1826509 - protein, 25 aa, Staphylococcus epidermidis
EGQGIPIILIHGLDGNLSGFQDLKN

SEQ ID NO: 1826510 - protein, 26 aa, Staphylococcus epidermidis
EGQICIPTIGFYTLSTFPFIEKALNS

SEQ ID NO: 1826511 - protein, 27 aa, Staphylococcus epidermidis
EGQKKTRVLYEPHLLLSIAASVGKPVI

SEQ ID NO: 1826512 - protein, 25 aa, Staphylococcus epidermidis
EGQTHFVTELYVETIKFMSPKTKSN

SEQ ID NO: 1826513 - protein, 24 aa, Staphylococcus epidermidis
EGQTLFFGGLARIDYVSGGKRPLI

SEQ ID NO: 1826514 - protein, 23 aa, Staphylococcus epidermidis
EGRFKETFHAVQSHFTTVLKQLF

SEQ ID NO: 1826515 - protein, 23 aa, Staphylococcus epidermidis
EGRNCKFIAVKLPYGVQQDANEV

SEQ ID NO: 1826516 - protein, 19 aa, Staphylococcus epidermidis
EGRVIGRKTMFVRTAGCDY

SEQ ID NO: 1826517 - protein, 18 aa, Staphylococcus epidermidis
EGSDLPSVIGWRTIEDTE

SEQ ID NO: 1826518 - protein, 22 aa, Staphylococcus epidermidis
EGTIYPLLRKLVREEYLESYYT

SEQ ID NO: 1826519 - protein, 24 aa, Staphylococcus epidermidis
EGVDALLFETYYDLDELKNIVVAT

SEQ ID NO: 1826520 - protein, 17 aa, Staphylococcus epidermidis
EGVGQTAILIPGDLRDE

SEQ ID NO: 1826521 - protein, 20 aa, Staphylococcus epidermidis
EGVMHACGHDIHMASILAVA

SEQ ID NO: 1826522 - protein, 25 aa, Staphylococcus epidermidis
EGVYMVPAFVGLGTPYWDSEARGAI

SEQ ID NO: 1826523 - protein, 23 aa, Staphylococcus epidermidis
EGYKRHFSILKNKDFYISTSIEE

SEQ ID NO: 1826524 - protein, 24 aa, Staphylococcus epidermidis
EHADILYIGFISSKGAIMEGSERL

SEQ ID NO: 1826525 - protein, 26 aa, Staphylococcus epidermidis
EHDKTKIWLGVWEHNPKAIRFYEKRG

SEQ ID NO: 1826526 - protein, 18 aa, Staphylococcus epidermidis
EHELSLSDKPFYHVMLDY

SEQ ID NO: 1826527 - protein, 17 aa, Staphylococcus epidermidis
EHFFARNDDLDVIRDRS

SEQ ID NO: 1826528 - protein, 26 aa, Staphylococcus epidermidis
EHHPHSIFVRHLLITQPQSFGRATMT

SEQ ID NO: 1826529 - protein, 28 aa, Staphylococcus epidermidis
EHIPVVDMVKVKRYLQGRKTRLVGPNCP

SEQ ID NO: 1826530 - protein, 29 aa, Staphylococcus epidermidis
EHKFNINNLLDLPFGKCHFALASKPQTTA

SEQ ID NO: 1826531 - protein, 28 aa, Staphylococcus epidermidis
EHLLNHSYDWLIFSSKNAVKYFYAYLKS

SEQ ID NO: 1826532 - protein, 26 aa, Staphylococcus epidermidis
EHLRDLPFIAGFIGTCSFDLVRHEFE

SEQ ID NO: 1826533 - protein, 39 aa, Staphylococcus epidermidis
EHNKYFYKPIGTGVTIPPWNFPFAIMAGTTLAPVVAGNT

SEQ ID NO: 1826534 - protein, 18 aa, Staphylococcus epidermidis
EHNYAYWDKAIKTAIEWF

SEQ ID NO: 1826535 - protein, 18 aa, Staphylococcus epidermidis
EHPKLYQDLSGIKNLKTI

SEQ ID NO: 1826536 - protein, 17 aa, Staphylococcus epidermidis
EHQGDFLTIVLSALLHD

SEQ ID NO: 1826537 - protein, 25 aa, Staphylococcus epidermidis
EHQNFNPYQWPSFDIKYLDLPKKQG

SEQ ID NO: 1826538 - protein, 25 aa, Staphylococcus epidermidis
EHRLTALHTALLNGGVFVYVPKNVV

SEQ ID NO: 1826539 - protein, 18 aa, Staphylococcus epidermidis
EHSIIPDRIEAGTLLIAG

SEQ ID NO: 1826540 - protein, 24 aa, Staphylococcus epidermidis
EHTFIQHHFLFIESFENYVDNVDV

SEQ ID NO: 1826541 - protein, 24 aa, Staphylococcus epidermidis
EHVMKLLMHVDQVSYVRFASVYKE

SEQ ID NO: 1826542 - protein, 17 aa, Staphylococcus epidermidis
EIAFHGGIPDTGFYRFW

SEQ ID NO: 1826543 - protein, 25 aa, Staphylococcus epidermidis
EIARLITLEWLDHKQTFKPKQVFDN

SEQ ID NO: 1826544 - protein, 17 aa, Staphylococcus epidermidis
EIDKLSNFLVFMDQHRE

SEQ ID NO: 1826545 - protein, 25 aa, Staphylococcus epidermidis
EIDNDLKIYFTNGKSLFLPKTKVVE

SEQ ID NO: 1826546 - protein, 27 aa, Staphylococcus epidermidis
EIDNLVWYFSELFKSELKLAIGPIERG

SEQ ID NO: 1826547 - protein, 29 aa, Staphylococcus epidermidis
EIDPDVLRFFMISVHYRSPINYNLELVGA

SEQ ID NO: 1826548 - protein, 25 aa, Staphylococcus epidermidis
EIDVKDLPNIKSYLFDDIGSLDVSS

SEQ ID NO: 1826549 - protein, 23 aa, Staphylococcus epidermidis
EIEDFIINLLIEETEFIRINYTG

SEQ ID NO: 1826550 - protein, 22 aa, Staphylococcus epidermidis
EIEGQKYLFDYSACKYPVGVVE

SEQ ID NO: 1826551 - protein, 25 aa, Staphylococcus epidermidis
EIEILHVLKRFKAILIQKNETVEAM

SEQ ID NO: 1826552 - protein, 17 aa, Staphylococcus epidermidis
EIENFKFFVQYGNFKDI

SEQ ID NO: 1826553 - protein, 24 aa, Staphylococcus epidermidis
EIENHYLIYRFINGLNLHKEERYI

SEQ ID NO: 1826554 - protein, 24 aa, Staphylococcus epidermidis
EIFDILSIEGIIILVIYHGHEEGK

SEQ ID NO: 1826555 - protein, 18 aa, Staphylococcus epidermidis
EIFFLMDLHYENDQFHPE

SEQ ID NO: 1826556 - protein, 20 aa, Staphylococcus epidermidis
EIFLVVTGSNKRDVIEKLYR

SEQ ID NO: 1826557 - protein, 17 aa, Staphylococcus epidermidis
EIFRDELAKAPLKFFDH

SEQ ID NO: 1826558 - protein, 33 aa, Staphylococcus epidermidis
EIGCQSYCGPGRRKTFAFVNNRPLAALTEDELM

SEQ ID NO: 1826559 - protein, 28 aa, Staphylococcus epidermidis
EIHEMTKIDYFFLNKFQNIINIEHELKE

SEQ ID NO: 1826560 - protein, 21 aa, Staphylococcus epidermidis
EIHGANTYLLQQFFSPHSNRR

SEQ ID NO: 1826561 - protein, 24 aa, Staphylococcus epidermidis
EIHGDNLFRHSLTLEQVQKIVELA

SEQ ID NO: 1826562 - protein, 26 aa, Staphylococcus epidermidis
EIHQKQYDYLLKRYLLNVERENDISM

SEQ ID NO: 1826563 - protein, 26 aa, Staphylococcus epidermidis
EIHSNGAVDFIWNPPYIPGNRLGENG

SEQ ID NO: 1826564 - protein, 20 aa, Staphylococcus epidermidis
EIIEWKFDYLSELKKQKNAL

SEQ ID NO: 1826565 - protein, 22 aa, Staphylococcus epidermidis
EIIHRLSKVYGIKSISPVIKID

SEQ ID NO: 1826566 - protein, 35 aa, Staphylococcus epidermidis
EIIQLTKKPIGVTAGIVPWNAPIMVLMRKVIPAIV

SEQ ID NO: 1826567 - protein, 34 aa, Staphylococcus epidermidis; identical to SEQ ID NO: 1695027

SEQ ID NO: 1826568 - protein, 25 aa, Staphylococcus epidermidis
EIKVLFLEGLYKRIGFKDSNIIFYF

SEQ ID NO: 1826569 - protein, 29 aa, Staphylococcus epidermidis
EIKVQDVMFLLLYALKDLGANLNMDPITE

SEQ ID NO: 1826570 - protein, 29 aa, Staphylococcus epidermidis
EIKVQDVMFLLLYALKDLGARLNMDPVTD

SEQ ID NO: 1826571 - protein, 17 aa, Staphylococcus epidermidis
EIKYFYCALGKITDKEA

SEQ ID NO: 1826572 - protein, 18 aa, Staphylococcus epidermidis
EILDLLSCGELCACDLLI

SEQ ID NO: 1826573 - protein, 22 aa, Staphylococcus epidermidis
EILHVLKRFKAMLIQKNETIEA

SEQ ID NO: 1826574 - protein, 23 aa, Staphylococcus epidermidis
EILKDLYRRGIGKLLVEAGPNIT

SEQ ID NO: 1826575 - protein, 19 aa, Staphylococcus epidermidis
EILLSFLERNHIQHRTNLY

SEQ ID NO: 1826576 - protein, 24 aa, Staphylococcus epidermidis
EILNRMDDIVLFKPLSVDDMSMIV

SEQ ID NO: 1826577 - protein, 25 aa, Staphylococcus epidermidis
EILPNQQRLLLYVKVDMSNVVMEER

SEQ ID NO: 1826578 - protein, 17 aa, Staphylococcus epidermidis
EILQYYEKKYDFIKCVQ
